United States Patent 7,655,785 (BIOINFORMATICALLY DETECTABLE GROUP OF NOVEL REGULATORY OLIGONUCLEOTIDES AND USES THEREOF) - sequence listing, part 34

SEQ ID NO: 1394531 - RNA, 12 nt, Homo sapiens
guuaacaauauu

SEQ ID NO: 1394532 - RNA, 13 nt, Homo sapiens
guuaacuguguau

SEQ ID NO: 1394533 - RNA, 18 nt, Homo sapiens
guuaaggguuaguuuaca

SEQ ID NO: 1394534 - RNA, 17 nt, Homo sapiens
guuaaucauguauuaaa

SEQ ID NO: 1394535 - RNA, 11 nt, Homo sapiens
guuaaugccau

SEQ ID NO: 1394536 - RNA, 21 nt, Homo sapiens
guuacauugcuggucuuguaa

SEQ ID NO: 1394537 - RNA, 14 nt, Homo sapiens
guuacugucuucag

SEQ ID NO: 1394538 - RNA, 20 nt, Homo sapiens
guuacuguggccaguauuuu

SEQ ID NO: 1394539 - RNA, 12 nt, Homo sapiens
guuacuguguca

SEQ ID NO: 1394540 - RNA, 15 nt, Homo sapiens
guuagcagagcugga

SEQ ID NO: 1394541 - RNA, 18 nt, Homo sapiens
guuaggaaauaaaaccuu

SEQ ID NO: 1394542 - RNA, 20 nt, Homo sapiens
guuauaaaucaaugucacuu

SEQ ID NO: 1394543 - RNA, 22 nt, Homo sapiens
guuauaaaucaaugucacuuaa

SEQ ID NO: 1394544 - RNA, 22 nt, Homo sapiens
guuauaauaauguuaacaugga

SEQ ID NO: 1394545 - RNA, 18 nt, Homo sapiens
guuaucuaauauguaaca

SEQ ID NO: 1394546 - RNA, 19 nt, Homo sapiens
guuaucuguguagcaagcu

SEQ ID NO: 1394547 - RNA, 17 nt, Homo sapiens
guuaugcaucauuucag

SEQ ID NO: 1394548 - RNA, 19 nt, Homo sapiens
guuauuaacagcugauaca

SEQ ID NO: 1394549 - RNA, 21 nt, Homo sapiens
guuauuuagggaacugcuuga

SEQ ID NO: 1394550 - RNA, 14 nt, Homo sapiens
guuauuuuccauuu

SEQ ID NO: 1394551 - RNA, 23 nt, Homo sapiens
guucaauucucauuugucacaca

SEQ ID NO: 1394552 - RNA, 12 nt, Homo sapiens
guucaggccagu

SEQ ID NO: 1394553 - RNA, 14 nt, Homo sapiens
guucagggucauag

SEQ ID NO: 1394554 - RNA, 23 nt, Homo sapiens
uuaugugaguguguguuugugcu

SEQ ID NO: 1394555 - RNA, 14 nt, Homo sapiens
uuauuaaugacaaa

SEQ ID NO: 1394556 - RNA, 12 nt, Homo sapiens
uuauuaccucug

SEQ ID NO: 1394557 - RNA, 18 nt, Homo sapiens
uuauucaacaacuacuac

SEQ ID NO: 1394558 - RNA, 12 nt, Homo sapiens
uuauuguuccaa

SEQ ID NO: 1394559 - RNA, 16 nt, Homo sapiens
uuauuuuuacaguucu

SEQ ID NO: 1394560 - RNA, 21 nt, Homo sapiens
uucaaaaauacucacauggcu

SEQ ID NO: 1394561 - RNA, 21 nt, Homo sapiens
uucaaaccaguauacaagaua

SEQ ID NO: 1394562 - RNA, 12 nt, Homo sapiens
uucaaacuuaaa

SEQ ID NO: 1394563 - RNA, 22 nt, Homo sapiens
uucaaagcacuguuucucucac

SEQ ID NO: 1394564 - RNA, 20 nt, Homo sapiens
ugcauggaacccccagaaua

SEQ ID NO: 1394565 - RNA, 19 nt, Homo sapiens
ugcauguacccuaagguca

SEQ ID NO: 1394566 - RNA, 21 nt, Homo sapiens
ugcauguauuuauccaauaaa

SEQ ID NO: 1394567 - RNA, 22 nt, Homo sapiens
ugcaugugugcgagugugugca

SEQ ID NO: 1394568 - RNA, 20 nt, Homo sapiens
ugcaugugugugcucagggg

SEQ ID NO: 1394569 - RNA, 19 nt, Homo sapiens
ugcauguuggcccagaccu

SEQ ID NO: 1394570 - RNA, 14 nt, Homo sapiens
ugcauuaucuauga

SEQ ID NO: 1394571 - RNA, 18 nt, Homo sapiens
ugcauugagaacugcaua

SEQ ID NO: 1394572 - RNA, 20 nt, Homo sapiens
ugcauuuauggucaacacuu

SEQ ID NO: 1394573 - RNA, 22 nt, Homo sapiens
ugcauuuauggucaacacuuaa

SEQ ID NO: 1394574 - RNA, 20 nt, Homo sapiens
ugcauuuucugaaacuaaug

SEQ ID NO: 1394575 - RNA, 15 nt, Homo sapiens
ugccaaccggucacc

SEQ ID NO: 1394576 - RNA, 15 nt, Homo sapiens
ugccaauuagcaauu

SEQ ID NO: 1394577 - RNA, 14 nt, Homo sapiens
ugccaccugcugcu

SEQ ID NO: 1394578 - RNA, 17 nt, Homo sapiens
ugccacgcccccagaaa

SEQ ID NO: 1394579 - RNA, 14 nt, Homo sapiens
ugccagacaugugg

SEQ ID NO: 1394580 - RNA, 19 nt, Homo sapiens
ugccagcuuaucucagggg

SEQ ID NO: 1394581 - RNA, 20 nt, Homo sapiens
ugccagcuuaucucaggggu

SEQ ID NO: 1394582 - RNA, 22 nt, Homo sapiens
ugccagugccuuaccuccugcc

SEQ ID NO: 1394583 - RNA, 17 nt, Homo sapiens
ugccagugggaacuccu

SEQ ID NO: 1394584 - RNA, 18 nt, Homo sapiens
ugccauauucuguuggcc

SEQ ID NO: 1394585 - RNA, 23 nt, Homo sapiens
ugccauccucccaaggggcccaa

SEQ ID NO: 1394586 - RNA, 16 nt, Homo sapiens
ugccauguuuugccac

SEQ ID NO: 1394587 - RNA, 14 nt, Homo sapiens
ugcccaaccucagc

SEQ ID NO: 1394588 - RNA, 23 nt, Homo sapiens
ugcccaauaagcagaagccauaa

SEQ ID NO: 1394589 - RNA, 21 nt, Homo sapiens
ugcccacauguguccauccca

SEQ ID NO: 1394590 - RNA, 19 nt, Homo sapiens
ugcccaggaaccucagggc

SEQ ID NO: 1394591 - RNA, 20 nt, Homo sapiens
ugccccaaacaaauaugcaa

SEQ ID NO: 1394592 - RNA, 15 nt, Homo sapiens
ugccccagagcuguu

SEQ ID NO: 1394593 - RNA, 16 nt, Homo sapiens
ugccccccuugccaga

SEQ ID NO: 1394594 - RNA, 16 nt, Homo sapiens
ugccccucaugccaac

SEQ ID NO: 1394595 - RNA, 16 nt, Homo sapiens
ugcccgagcuggugca

SEQ ID NO: 1394596 - RNA, 23 nt, Homo sapiens
ugcccggggcagcugccagagaa

SEQ ID NO: 1394597 - RNA, 14 nt, Homo sapiens
ugcccucagauucc

SEQ ID NO: 1394598 - RNA, 16 nt, Homo sapiens
ugcccucgugguggaa

SEQ ID NO: 1394599 - RNA, 16 nt, Homo sapiens
ugcccugggaugucca

SEQ ID NO: 1394600 - RNA, 18 nt, Homo sapiens
ugcccugggauguccaca

SEQ ID NO: 1394601 - RNA, 20 nt, Homo sapiens
ugcccugggauguccacaga

SEQ ID NO: 1394602 - RNA, 19 nt, Homo sapiens
ugcccuuucuguaccauuu

SEQ ID NO: 1394603 - RNA, 14 nt, Homo sapiens
ugccgaaacuggaa

SEQ ID NO: 1394604 - RNA, 16 nt, Homo sapiens
ugccgcuacaaaaagg

SEQ ID NO: 1394605 - RNA, 17 nt, Homo sapiens
ugccuagaggugcucau

SEQ ID NO: 1394606 - RNA, 22 nt, Homo sapiens
ugccucagccucccaaagugcu

SEQ ID NO: 1394607 - RNA, 18 nt, Homo sapiens
ugccucugacacacagcu

SEQ ID NO: 1394608 - RNA, 20 nt, Homo sapiens
ugccucugacacacagcucu

SEQ ID NO: 1394609 - RNA, 16 nt, Homo sapiens
ugccuguaacuugaga

SEQ ID NO: 1394610 - RNA, 18 nt, Homo sapiens
ugccugucccucucaggc

SEQ ID NO: 1394611 - RNA, 21 nt, Homo sapiens
ugccugugugggacugagaug

SEQ ID NO: 1394612 - RNA, 16 nt, Homo sapiens
ugccuucacuuuacaa

SEQ ID NO: 1394613 - RNA, 23 nt, Homo sapiens
ugccuuccacgcugucuccagac

SEQ ID NO: 1394614 - RNA, 19 nt, Homo sapiens
ugccuucccaggaguacac

SEQ ID NO: 1394615 - RNA, 16 nt, Homo sapiens
ugccuuggcuuugcca

SEQ ID NO: 1394616 - RNA, 17 nt, Homo sapiens
ugccuuuguaaguuauu

SEQ ID NO: 1394617 - RNA, 21 nt, Homo sapiens
ugcgaucuggguucacugcaa

SEQ ID NO: 1394618 - RNA, 14 nt, Homo sapiens
ugcgcaaaacugaa

SEQ ID NO: 1394619 - RNA, 16 nt, Homo sapiens
ugcgcaaaacugaaag

SEQ ID NO: 1394620 - RNA, 16 nt, Homo sapiens
ugcggaguugugcacg

SEQ ID NO: 1394621 - RNA, 13 nt, Homo sapiens
ugcgucacuguga

SEQ ID NO: 1394622 - RNA, 15 nt, Homo sapiens
ugcgugcaugugcac

SEQ ID NO: 1394623 - RNA, 13 nt, Homo sapiens
ugcgugugugcaa

SEQ ID NO: 1394624 - RNA, 16 nt, Homo sapiens
ugcguuagaaugagga

SEQ ID NO: 1394625 - RNA, 22 nt, Homo sapiens
ugcuaagaagcgagcacugacc

SEQ ID NO: 1394626 - RNA, 16 nt, Homo sapiens
ugcuaaggaguucuca

SEQ ID NO: 1394627 - RNA, 19 nt, Homo sapiens
ugcuaagggcaggcccaaa

SEQ ID NO: 1394628 - RNA, 21 nt, Homo sapiens
ugcuaaucagggaggucauuu

SEQ ID NO: 1394629 - RNA, 23 nt, Homo sapiens
ugcuaaucaugugggugagccag

SEQ ID NO: 1394630 - RNA, 17 nt, Homo sapiens
ugcuaccucacuggggu

SEQ ID NO: 1394631 - RNA, 20 nt, Homo sapiens
ugcuacuuuguauccucuga

SEQ ID NO: 1394632 - RNA, 16 nt, Homo sapiens
ugcuagcugcaaguga

SEQ ID NO: 1394633 - RNA, 15 nt, Homo sapiens
ugcuauuucccaagc

SEQ ID NO: 1394634 - RNA, 19 nt, Homo sapiens
ugcuauuuuacugucuuaa

SEQ ID NO: 1394635 - RNA, 17 nt, Homo sapiens
ugcucaguuggugcugc

SEQ ID NO: 1394636 - RNA, 20 nt, Homo sapiens
ugcucaguuggugcugcuuu

SEQ ID NO: 1394637 - RNA, 13 nt, Homo sapiens
ugcucccacagaa

SEQ ID NO: 1394638 - RNA, 16 nt, Homo sapiens
ugcucccuccacagcu

SEQ ID NO: 1394639 - RNA, 16 nt, Homo sapiens
ugcucgucacagugug

SEQ ID NO: 1394640 - RNA, 12 nt, Homo sapiens
ugcucuaucuca

SEQ ID NO: 1394641 - RNA, 21 nt, Homo sapiens
ugcucugucuucuuugcccac

SEQ ID NO: 1394642 - RNA, 17 nt, Homo sapiens
ugcucuuaaguugugga

SEQ ID NO: 1394643 - RNA, 16 nt, Homo sapiens
ugcucuuaugccauuu

SEQ ID NO: 1394644 - RNA, 23 nt, Homo sapiens
ugcucuuugauucaaagcacugu

SEQ ID NO: 1394645 - RNA, 20 nt, Homo sapiens
ugcugaaucggaaucucugg

SEQ ID NO: 1394646 - RNA, 18 nt, Homo sapiens
ugcugaccagacagccuc

SEQ ID NO: 1394647 - RNA, 18 nt, Homo sapiens
ugcugaccuccacagcuu

SEQ ID NO: 1394648 - RNA, 13 nt, Homo sapiens
ugcugagaacaaa

SEQ ID NO: 1394649 - RNA, 15 nt, Homo sapiens
ugcugagcauguacu

SEQ ID NO: 1394650 - RNA, 15 nt, Homo sapiens
ugcugaucgugcuaa

SEQ ID NO: 1394651 - RNA, 16 nt, Homo sapiens
ugcugcuccagugcag

SEQ ID NO: 1394652 - RNA, 21 nt, Homo sapiens
ugcugcuccuuagcugccaag

SEQ ID NO: 1394653 - RNA, 17 nt, Homo sapiens
ugcugcuggaaguagaa

SEQ ID NO: 1394654 - RNA, 18 nt, Homo sapiens
ugcugcuuucuuguugcu

SEQ ID NO: 1394655 - RNA, 13 nt, Homo sapiens
ugcuggacuguca

SEQ ID NO: 1394656 - RNA, 16 nt, Homo sapiens
ugcuggcaaagacaga

SEQ ID NO: 1394657 - RNA, 22 nt, Homo sapiens
ugcuggcauuugcaccuaccuc

SEQ ID NO: 1394658 - RNA, 18 nt, Homo sapiens
ugcugggcucuccaccuc

SEQ ID NO: 1394659 - RNA, 17 nt, Homo sapiens
ugcugguuucugccuuc

SEQ ID NO: 1394660 - RNA, 17 nt, Homo sapiens
ugcuguaaaaacugugg

SEQ ID NO: 1394661 - RNA, 18 nt, Homo sapiens
ugcugucagucugcuuau

SEQ ID NO: 1394662 - RNA, 14 nt, Homo sapiens
ugcuuaaaauagca

SEQ ID NO: 1394663 - RNA, 14 nt, Homo sapiens
ugcuuaaacuacaa

SEQ ID NO: 1394664 - RNA, 23 nt, Homo sapiens
ugcuuaaacuacaaacacaagca

SEQ ID NO: 1394665 - RNA, 16 nt, Homo sapiens
ugcuuaugacaucacu

SEQ ID NO: 1394666 - RNA, 12 nt, Homo sapiens
ugcuucagccug

SEQ ID NO: 1394667 - RNA, 21 nt, Homo sapiens
ugcuucaugaaaauccuacca

SEQ ID NO: 1394668 - RNA, 14 nt, Homo sapiens
ugcuugaaccuggg

SEQ ID NO: 1394669 - RNA, 21 nt, Homo sapiens
ugcuuguuugcucaccugggg

SEQ ID NO: 1394670 - RNA, 17 nt, Homo sapiens
ugcuuuacuuugcccag

SEQ ID NO: 1394671 - RNA, 16 nt, Homo sapiens
ugcuuuagaaguaaca

SEQ ID NO: 1394672 - RNA, 13 nt, Homo sapiens
ugcuuugcaggaa

SEQ ID NO: 1394673 - RNA, 20 nt, Homo sapiens
ugcuuuucaaacugauacag

SEQ ID NO: 1394674 - RNA, 13 nt, Homo sapiens
uggaaaaagccug

SEQ ID NO: 1394675 - RNA, 17 nt, Homo sapiens
uggaaaaagccugugaa

SEQ ID NO: 1394676 - RNA, 16 nt, Homo sapiens
uggaaaaagucacauu

SEQ ID NO: 1394677 - RNA, 21 nt, Homo sapiens
uaaaagaugcauuaucuauga

SEQ ID NO: 1394678 - RNA, 21 nt, Homo sapiens
uaaaagauguuuaugauguaa

SEQ ID NO: 1394679 - RNA, 19 nt, Homo sapiens
uaaaagugggaauuaggag

SEQ ID NO: 1394680 - RNA, 16 nt, Homo sapiens
uaaaaguucauaacag

SEQ ID NO: 1394681 - RNA, 13 nt, Homo sapiens
uaaaaguugcaaa

SEQ ID NO: 1394682 - RNA, 22 nt, Homo sapiens
uaaaauaaauaaaugcaauaug

SEQ ID NO: 1394683 - RNA, 14 nt, Homo sapiens
uaaaauaaaugcaa

SEQ ID NO: 1394684 - RNA, 14 nt, Homo sapiens
uaaaauagccauaa

SEQ ID NO: 1394685 - RNA, 19 nt, Homo sapiens
uaaaauauuuaugagaaag

SEQ ID NO: 1394686 - RNA, 21 nt, Homo sapiens
uaaaaucauaaauauaaucua

SEQ ID NO: 1394687 - RNA, 22 nt, Homo sapiens
uaaaaugagaucguuguuuaca

SEQ ID NO: 1394688 - RNA, 18 nt, Homo sapiens
uaaaauuagaugaacuca

SEQ ID NO: 1394689 - RNA, 14 nt, Homo sapiens
uaaacaaacaaaca

SEQ ID NO: 1394690 - RNA, 14 nt, Homo sapiens
uaaacaaauaacaa

SEQ ID NO: 1394691 - RNA, 14 nt, Homo sapiens
uaaacaaauguaug

SEQ ID NO: 1394692 - RNA, 14 nt, Homo sapiens
uaaacaacuaccuc

SEQ ID NO: 1394693 - RNA, 18 nt, Homo sapiens
uaaacacggggcuugcaa

SEQ ID NO: 1394694 - RNA, 21 nt, Homo sapiens
uaaacacggggcuugcaacuu

SEQ ID NO: 1394695 - RNA, 14 nt, Homo sapiens
uaaacacugauggu

SEQ ID NO: 1394696 - RNA, 17 nt, Homo sapiens
uaaacauauuggaaugu

SEQ ID NO: 1394697 - RNA, 14 nt, Homo sapiens
uaaacauccuucaa

SEQ ID NO: 1394698 - RNA, 17 nt, Homo sapiens
uaaacauugaaguaaug

SEQ ID NO: 1394699 - RNA, 17 nt, Homo sapiens
uaaacugcccugucuag

SEQ ID NO: 1394700 - RNA, 21 nt, Homo sapiens
uaaagaaaaguagguuuacau

SEQ ID NO: 1394701 - RNA, 19 nt, Homo sapiens
uaaagcaacaaaaauuacu

SEQ ID NO: 1394702 - RNA, 21 nt, Homo sapiens
uaaaggauucuguaugccaag

SEQ ID NO: 1394703 - RNA, 21 nt, Homo sapiens
uaaaguauuauuuauuugaau

SEQ ID NO: 1394704 - RNA, 12 nt, Homo sapiens
uaaaguauucca

SEQ ID NO: 1394705 - RNA, 15 nt, Homo sapiens
uaaagucacagaauu

SEQ ID NO: 1394706 - RNA, 16 nt, Homo sapiens
uaaagucacagaauua

SEQ ID NO: 1394707 - RNA, 21 nt, Homo sapiens
uaaagugaauaaccacuuaaa

SEQ ID NO: 1394708 - RNA, 20 nt, Homo sapiens
uaaagugagcaugcuuucug

SEQ ID NO: 1394709 - RNA, 23 nt, Homo sapiens
uaaauaaacacauagauucaccu

SEQ ID NO: 1394710 - RNA, 19 nt, Homo sapiens
uaaauaauguuaucugugu

SEQ ID NO: 1394711 - RNA, 15 nt, Homo sapiens
uaaauagaccucuca

SEQ ID NO: 1394712 - RNA, 17 nt, Homo sapiens
uaaauauagcucaggua

SEQ ID NO: 1394713 - RNA, 18 nt, Homo sapiens
uaaaucaaauauauguca

SEQ ID NO: 1394714 - RNA, 15 nt, Homo sapiens
uaaaucaaugcuaua

SEQ ID NO: 1394715 - RNA, 16 nt, Homo sapiens
uaaaucauuaagacaa

SEQ ID NO: 1394716 - RNA, 13 nt, Homo sapiens
uaaauccuuccau

SEQ ID NO: 1394717 - RNA, 14 nt, Homo sapiens
uaaaucgcuaccuu

SEQ ID NO: 1394718 - RNA, 15 nt, Homo sapiens
uaaaugaagugcaaa

SEQ ID NO: 1394719 - RNA, 19 nt, Homo sapiens
uaaaugaggggccucaggu

SEQ ID NO: 1394720 - RNA, 14 nt, Homo sapiens
uaaaugccccaaag

SEQ ID NO: 1394721 - RNA, 15 nt, Homo sapiens
uaaaugccccaaagc

SEQ ID NO: 1394722 - RNA, 14 nt, Homo sapiens
uaaauguacauuaa

SEQ ID NO: 1394723 - RNA, 16 nt, Homo sapiens
uaaauguaucauagaa

SEQ ID NO: 1394724 - RNA, 20 nt, Homo sapiens
uaaauguaucuuauucacau

SEQ ID NO: 1394725 - RNA, 17 nt, Homo sapiens
uaaauuacaaaugcaau

SEQ ID NO: 1394726 - RNA, 19 nt, Homo sapiens
uaaauuacuuuuucauucu

SEQ ID NO: 1394727 - RNA, 20 nt, Homo sapiens
uaaauuacuuuuucauucuu

SEQ ID NO: 1394728 - RNA, 14 nt, Homo sapiens
uaaauuaguauuua

SEQ ID NO: 1394729 - RNA, 22 nt, Homo sapiens
uaaauuauuuauuuauggagga

SEQ ID NO: 1394730 - RNA, 17 nt, Homo sapiens
uaaauuuguguucucaa

SEQ ID NO: 1394731 - RNA, 20 nt, Homo sapiens
uaaauuuguguucucaaaua

SEQ ID NO: 1394732 - RNA, 23 nt, Homo sapiens
uaacacauuaucgggagcagugu

SEQ ID NO: 1394733 - RNA, 15 nt, Homo sapiens
uaacagaccacugua

SEQ ID NO: 1394734 - RNA, 15 nt, Homo sapiens
uaacagaugcaaugu

SEQ ID NO: 1394735 - RNA, 22 nt, Homo sapiens
uaacagauguagcaacaugaga

SEQ ID NO: 1394736 - RNA, 16 nt, Homo sapiens
uaacaggaaaauuuua

SEQ ID NO: 1394737 - RNA, 16 nt, Homo sapiens
uaacaggauuagacag

SEQ ID NO: 1394738 - RNA, 18 nt, Homo sapiens
uaacaggucuccucuuaa

SEQ ID NO: 1394739 - RNA, 19 nt, Homo sapiens
uaacauaugcaaacauaac

SEQ ID NO: 1394740 - RNA, 20 nt, Homo sapiens
uaacauugggaaaucuuaua

SEQ ID NO: 1394741 - RNA, 13 nt, Homo sapiens
uaaccaaauuauu

SEQ ID NO: 1394742 - RNA, 17 nt, Homo sapiens
uaacccaggaaugaaga

SEQ ID NO: 1394743 - RNA, 16 nt, Homo sapiens
uaacgagaaauagaaa

SEQ ID NO: 1394744 - RNA, 12 nt, Homo sapiens
uaacggcacugu

SEQ ID NO: 1394745 - RNA, 22 nt, Homo sapiens
uaacuaacaaccaaagacuaca

SEQ ID NO: 1394746 - RNA, 12 nt, Homo sapiens
uaacuacugugu

SEQ ID NO: 1394747 - RNA, 14 nt, Homo sapiens
uaacuauguugaua

SEQ ID NO: 1394748 - RNA, 16 nt, Homo sapiens
uaacuccagugaagua

SEQ ID NO: 1394749 - RNA, 20 nt, Homo sapiens
uaacucuaacugauguucca

SEQ ID NO: 1394750 - RNA, 15 nt, Homo sapiens
uaacucuggugcucu

SEQ ID NO: 1394751 - RNA, 21 nt, Homo sapiens
uaacugaaggagaaggugccc

SEQ ID NO: 1394752 - RNA, 20 nt, Homo sapiens
uaacuucaaggcccauaucu

SEQ ID NO: 1394753 - RNA, 21 nt, Homo sapiens
uaacuuggagccccagugcca

SEQ ID NO: 1394754 - RNA, 18 nt, Homo sapiens
uaacuuuugguaucuacu

SEQ ID NO: 1394755 - RNA, 17 nt, Homo sapiens
uaacuuuuguaagacaa

SEQ ID NO: 1394756 - RNA, 17 nt, Homo sapiens
uaagaaaacaucacuga

SEQ ID NO: 1394757 - RNA, 18 nt, Homo sapiens
uaagaaaacaucacugaa

SEQ ID NO: 1394758 - RNA, 15 nt, Homo sapiens
uaagaagaugacuuc

SEQ ID NO: 1394759 - RNA, 14 nt, Homo sapiens
uaagaaugcugguu

SEQ ID NO: 1394760 - RNA, 13 nt, Homo sapiens
uaagacuacugaa

SEQ ID NO: 1394761 - RNA, 19 nt, Homo sapiens
uaagaggaugaagugauau

SEQ ID NO: 1394762 - RNA, 14 nt, Homo sapiens
uaagcaaaaccacu

SEQ ID NO: 1394763 - RNA, 15 nt, Homo sapiens
uaagccuuuccauaa

SEQ ID NO: 1394764 - RNA, 16 nt, Homo sapiens
uaagcuaucuucaaau

SEQ ID NO: 1394765 - RNA, 23 nt, Homo sapiens
uaagcuguaagauaauguugcuu

SEQ ID NO: 1394766 - RNA, 14 nt, Homo sapiens
uaagggacaacauc

SEQ ID NO: 1394767 - RNA, 21 nt, Homo sapiens
uaagggcuggucucugcugaa

SEQ ID NO: 1394768 - RNA, 18 nt, Homo sapiens
uaaguaaguuugauuuca

SEQ ID NO: 1394769 - RNA, 22 nt, Homo sapiens
uaaguacuauguaucaaugagu

SEQ ID NO: 1394770 - RNA, 20 nt, Homo sapiens
uaaguauuucagaugcuuua

SEQ ID NO: 1394771 - RNA, 15 nt, Homo sapiens
uaagucucugugaau

SEQ ID NO: 1394772 - RNA, 20 nt, Homo sapiens
uaaguuaccuuucuagguca

SEQ ID NO: 1394773 - RNA, 18 nt, Homo sapiens
uaauaaaacaucuuucca

SEQ ID NO: 1394774 - RNA, 15 nt, Homo sapiens
uaauaaaguauauaa

SEQ ID NO: 1394775 - RNA, 13 nt, Homo sapiens
uaauaacauaaca

SEQ ID NO: 1394776 - RNA, 17 nt, Homo sapiens
uaauaauacagccaaag

SEQ ID NO: 1394777 - RNA, 15 nt, Homo sapiens
uaauaauguuuaaua

SEQ ID NO: 1394778 - RNA, 16 nt, Homo sapiens
uaauacagccaaagau

SEQ ID NO: 1394779 - RNA, 15 nt, Homo sapiens
uaauacagggcauuu

SEQ ID NO: 1394780 - RNA, 14 nt, Homo sapiens
uaauaugcugccaa

SEQ ID NO: 1394781 - RNA, 19 nt, Homo sapiens
uaauauggggaugcagcau

SEQ ID NO: 1394782 - RNA, 19 nt, Homo sapiens
uaaucaugaaagcaucuga

SEQ ID NO: 1394783 - RNA, 15 nt, Homo sapiens
uaaucccagcacuuu

SEQ ID NO: 1394784 - RNA, 19 nt, Homo sapiens
uaaucgaaguaauuuuggg

SEQ ID NO: 1394785 - RNA, 17 nt, Homo sapiens
uaaucguacauuuucau

SEQ ID NO: 1394786 - RNA, 16 nt, Homo sapiens
uaaucuggacuccucu

SEQ ID NO: 1394787 - RNA, 22 nt, Homo sapiens
uaaucuggacuccucuguccag

SEQ ID NO: 1394788 - RNA, 15 nt, Homo sapiens
uaaugaaaaugucag

SEQ ID NO: 1394789 - RNA, 19 nt, Homo sapiens
uaaugaaguuaagaaccug

SEQ ID NO: 1394790 - RNA, 19 nt, Homo sapiens
uggaaaacaguauuuucca

SEQ ID NO: 1394791 - RNA, 19 nt, Homo sapiens
uggaaaagcaaaacuguag

SEQ ID NO: 1394792 - RNA, 14 nt, Homo sapiens
uggaaaauaaauca

SEQ ID NO: 1394793 - RNA, 15 nt, Homo sapiens
uggaaaccguguaaa

SEQ ID NO: 1394794 - RNA, 21 nt, Homo sapiens
uggaaagacagcuucucaucc

SEQ ID NO: 1394795 - RNA, 18 nt, Homo sapiens
uggaaagcaucaccucag

SEQ ID NO: 1394796 - RNA, 22 nt, Homo sapiens
uggaaagcaucaccucaggcca

SEQ ID NO: 1394797 - RNA, 14 nt, Homo sapiens
uggaaagcugcuuc

SEQ ID NO: 1394798 - RNA, 18 nt, Homo sapiens
uggaaauagugauuucca

SEQ ID NO: 1394799 - RNA, 16 nt, Homo sapiens
uggaacccccagaaua

SEQ ID NO: 1394800 - RNA, 14 nt, Homo sapiens
uggaagauuugccc

SEQ ID NO: 1394801 - RNA, 15 nt, Homo sapiens
uggaagcacagcuuc

SEQ ID NO: 1394802 - RNA, 17 nt, Homo sapiens
uggaagcauauuguuau

SEQ ID NO: 1394803 - RNA, 15 nt, Homo sapiens
uggaagugugugauc

SEQ ID NO: 1394804 - RNA, 20 nt, Homo sapiens
uggaauaaagucacagaauu

SEQ ID NO: 1394805 - RNA, 14 nt, Homo sapiens
uggaauaacaugua

SEQ ID NO: 1394806 - RNA, 20 nt, Homo sapiens
uggaauaacucuguggcauu

SEQ ID NO: 1394807 - RNA, 21 nt, Homo sapiens
uggaauauaaggaaagcaaua

SEQ ID NO: 1394808 - RNA, 14 nt, Homo sapiens
uggaauugcucaag

SEQ ID NO: 1394809 - RNA, 16 nt, Homo sapiens
uggacacacacagcuu

SEQ ID NO: 1394810 - RNA, 12 nt, Homo sapiens
uggacacagcuc

SEQ ID NO: 1394811 - RNA, 15 nt, Homo sapiens
uggacauaagacaga

SEQ ID NO: 1394812 - RNA, 17 nt, Homo sapiens
uggaccaguggugccuu

SEQ ID NO: 1394813 - RNA, 16 nt, Homo sapiens
uggacgcacacagcuu

SEQ ID NO: 1394814 - RNA, 19 nt, Homo sapiens
uggacucaaaguauccucc

SEQ ID NO: 1394815 - RNA, 20 nt, Homo sapiens
uggacucaagcaagauuuca

SEQ ID NO: 1394816 - RNA, 18 nt, Homo sapiens
uggacuuuccacccccuc

SEQ ID NO: 1394817 - RNA, 21 nt, Homo sapiens
uggagaagucuuagacuugaa

SEQ ID NO: 1394818 - RNA, 19 nt, Homo sapiens
uggagcagaaauucaccuc

SEQ ID NO: 1394819 - RNA, 22 nt, Homo sapiens
uggagccaccaugcccagcuca

SEQ ID NO: 1394820 - RNA, 17 nt, Homo sapiens
uggaggagaaggacauu

SEQ ID NO: 1394821 - RNA, 16 nt, Homo sapiens
uggaggcacacagcug

SEQ ID NO: 1394822 - RNA, 18 nt, Homo sapiens
uggaggccgggugcucag

SEQ ID NO: 1394823 - RNA, 17 nt, Homo sapiens
uggauaaaauaaaugca

SEQ ID NO: 1394824 - RNA, 19 nt, Homo sapiens
uggauaaaauaaaugcaau

SEQ ID NO: 1394825 - RNA, 15 nt, Homo sapiens
uggauaaaaugaggu

SEQ ID NO: 1394826 - RNA, 16 nt, Homo sapiens
uggauacugcugccaa

SEQ ID NO: 1394827 - RNA, 13 nt, Homo sapiens
uggaucagaaaga

SEQ ID NO: 1394828 - RNA, 14 nt, Homo sapiens
uggaucuaccagca

SEQ ID NO: 1394829 - RNA, 15 nt, Homo sapiens
uggaucuaccagcau

SEQ ID NO: 1394830 - RNA, 17 nt, Homo sapiens
uggaucuaccagcauaa

SEQ ID NO: 1394831 - RNA, 23 nt, Homo sapiens
uggaugucuccaucucugucuca

SEQ ID NO: 1394832 - RNA, 22 nt, Homo sapiens
uggauugugggaauuaaggaag

SEQ ID NO: 1394833 - RNA, 19 nt, Homo sapiens
uggcaaacuucagacugaa

SEQ ID NO: 1394834 - RNA, 23 nt, Homo sapiens
uggcaaagccuucauugccuuaa

SEQ ID NO: 1394835 - RNA, 21 nt, Homo sapiens
uggcaaggcuuaggaaaguga

SEQ ID NO: 1394836 - RNA, 20 nt, Homo sapiens
uggcaaugaaaaauucucag

SEQ ID NO: 1394837 - RNA, 15 nt, Homo sapiens
uggcaccacugcacu

SEQ ID NO: 1394838 - RNA, 12 nt, Homo sapiens
uggcaccagcag

SEQ ID NO: 1394839 - RNA, 15 nt, Homo sapiens
uggcacccaugcacc

SEQ ID NO: 1394840 - RNA, 16 nt, Homo sapiens
uggcacccaugcaccu

SEQ ID NO: 1394841 - RNA, 21 nt, Homo sapiens
uggcagcgccucaucuucaac

SEQ ID NO: 1394842 - RNA, 21 nt, Homo sapiens
uggcaguggaacuaagaaagc

SEQ ID NO: 1394843 - RNA, 11 nt, Homo sapiens
uggcauauaau

SEQ ID NO: 1394844 - RNA, 13 nt, Homo sapiens
uggccaaagccaa

SEQ ID NO: 1394845 - RNA, 16 nt, Homo sapiens
uggccaacaugaugaa

SEQ ID NO: 1394846 - RNA, 22 nt, Homo sapiens
uggccagaagggggccaugagg

SEQ ID NO: 1394847 - RNA, 18 nt, Homo sapiens
uggccaggcuggucucaa

SEQ ID NO: 1394848 - RNA, 17 nt, Homo sapiens
uggccaugguccccaag

SEQ ID NO: 1394849 - RNA, 21 nt, Homo sapiens
uggcccaagugguuugugcua

SEQ ID NO: 1394850 - RNA, 23 nt, Homo sapiens
uggcccaagugguuugugcuaac

SEQ ID NO: 1394851 - RNA, 13 nt, Homo sapiens
uggcccagccaaa

SEQ ID NO: 1394852 - RNA, 19 nt, Homo sapiens
uggcccagggaagccaaaa

SEQ ID NO: 1394853 - RNA, 13 nt, Homo sapiens
uggcccccagugg

SEQ ID NO: 1394854 - RNA, 17 nt, Homo sapiens
uggccccugcccggcug

SEQ ID NO: 1394855 - RNA, 19 nt, Homo sapiens
uggccuaaaaaugcaacuu

SEQ ID NO: 1394856 - RNA, 23 nt, Homo sapiens
uggccugcugggcucuccaccuc

SEQ ID NO: 1394857 - RNA, 13 nt, Homo sapiens
uggccugugaagc

SEQ ID NO: 1394858 - RNA, 18 nt, Homo sapiens
uggccuugaaaccaccuu

SEQ ID NO: 1394859 - RNA, 16 nt, Homo sapiens
uggcgucugucuucaa

SEQ ID NO: 1394860 - RNA, 17 nt, Homo sapiens
uggcuaguugaaucuau

SEQ ID NO: 1394861 - RNA, 14 nt, Homo sapiens
uggcucagccucaa

SEQ ID NO: 1394862 - RNA, 19 nt, Homo sapiens
uggcuccaacacugcugcu

SEQ ID NO: 1394863 - RNA, 21 nt, Homo sapiens
uggcuccaggacagaccuuca

SEQ ID NO: 1394864 - RNA, 14 nt, Homo sapiens
uggcugauggagua

SEQ ID NO: 1394865 - RNA, 15 nt, Homo sapiens
uggcugggcccagaa

SEQ ID NO: 1394866 - RNA, 18 nt, Homo sapiens
uggcuguuauucuuccac

SEQ ID NO: 1394867 - RNA, 21 nt, Homo sapiens
uggcuucacagaugugugauu

SEQ ID NO: 1394868 - RNA, 23 nt, Homo sapiens
uggcuucacagaugugugauuca

SEQ ID NO: 1394869 - RNA, 21 nt, Homo sapiens
uggcuuugaaugcggcccaac

SEQ ID NO: 1394870 - RNA, 22 nt, Homo sapiens
uggcuuugccuuggcuuugcca

SEQ ID NO: 1394871 - RNA, 20 nt, Homo sapiens
uggcuuuggaagccauguga

SEQ ID NO: 1394872 - RNA, 15 nt, Homo sapiens
uggcuuuuucuccuu

SEQ ID NO: 1394873 - RNA, 14 nt, Homo sapiens
ugggaaaaccagac

SEQ ID NO: 1394874 - RNA, 18 nt, Homo sapiens
ugggaacuagacucccaa

SEQ ID NO: 1394875 - RNA, 13 nt, Homo sapiens
ugggaacuccuaa

SEQ ID NO: 1394876 - RNA, 20 nt, Homo sapiens
ugggaacugugccuuugagu

SEQ ID NO: 1394877 - RNA, 18 nt, Homo sapiens
ugggaauaacauggugag

SEQ ID NO: 1394878 - RNA, 20 nt, Homo sapiens
ugggaauguauuauucugca

SEQ ID NO: 1394879 - RNA, 12 nt, Homo sapiens
ugggacacaguu

SEQ ID NO: 1394880 - RNA, 14 nt, Homo sapiens
ugggacuacaggca

SEQ ID NO: 1394881 - RNA, 22 nt, Homo sapiens
ugggacuacaggugugagucac

SEQ ID NO: 1394882 - RNA, 19 nt, Homo sapiens
ugggacugcugcuucuuaa

SEQ ID NO: 1394883 - RNA, 14 nt, Homo sapiens
ugggacuuauguau

SEQ ID NO: 1394884 - RNA, 20 nt, Homo sapiens
ugggagccaaauguggcauu

SEQ ID NO: 1394885 - RNA, 17 nt, Homo sapiens
ugggagccucauaaaga

SEQ ID NO: 1394886 - RNA, 22 nt, Homo sapiens
ugggagcucuguuuucaugcua

SEQ ID NO: 1394887 - RNA, 18 nt, Homo sapiens
ugggagguugugggcauu

SEQ ID NO: 1394888 - RNA, 14 nt, Homo sapiens
ugggauaaucacau

SEQ ID NO: 1394889 - RNA, 23 nt, Homo sapiens
ugggaucacgaggaaaagagaag

SEQ ID NO: 1394890 - RNA, 16 nt, Homo sapiens
ugggaucugugcccag

SEQ ID NO: 1394891 - RNA, 16 nt, Homo sapiens
ugggauuaggcccuca

SEQ ID NO: 1394892 - RNA, 23 nt, Homo sapiens
ugggauuauaggagugagccacc

SEQ ID NO: 1394893 - RNA, 19 nt, Homo sapiens
ugggauuuaaagccuuuag

SEQ ID NO: 1394894 - RNA, 21 nt, Homo sapiens
ugggcaaaacccacagaagac

SEQ ID NO: 1394895 - RNA, 18 nt, Homo sapiens
ugggcaacagagcaagau

SEQ ID NO: 1394896 - RNA, 14 nt, Homo sapiens
ugggcagaaagugg

SEQ ID NO: 1394897 - RNA, 18 nt, Homo sapiens
ugggcagcauagcaagac

SEQ ID NO: 1394898 - RNA, 16 nt, Homo sapiens
ugggcaggaagugaag

SEQ ID NO: 1394899 - RNA, 18 nt, Homo sapiens
ugggcauucuuguuucaa

SEQ ID NO: 1394900 - RNA, 14 nt, Homo sapiens
ugggcccagaucug

SEQ ID NO: 1394901 - RNA, 16 nt, Homo sapiens
ugggcugagacuggau

SEQ ID NO: 1394902 - RNA, 19 nt, Homo sapiens
uggggaagaguggucuuga

SEQ ID NO: 1394903 - RNA, 14 nt, Homo sapiens
uggggacaucucau

SEQ ID NO: 1394904 - RNA, 21 nt, Homo sapiens
uggggacauuccaauuugcac

SEQ ID NO: 1394905 - RNA, 16 nt, Homo sapiens
uggggagaaaagacau

SEQ ID NO: 1394906 - RNA, 22 nt, Homo sapiens
uggggagaaaagacaugaauau

SEQ ID NO: 1394907 - RNA, 19 nt, Homo sapiens
uggggagggagguguuuaa

SEQ ID NO: 1394908 - RNA, 15 nt, Homo sapiens
uggggauacuggcaa

SEQ ID NO: 1394909 - RNA, 23 nt, Homo sapiens
ugggggaaaguguugaccacaga

SEQ ID NO: 1394910 - RNA, 22 nt, Homo sapiens
ugggggaucacagccucugaaa

SEQ ID NO: 1394911 - RNA, 22 nt, Homo sapiens
ugggggcagggcaugacuuugu

SEQ ID NO: 1394912 - RNA, 18 nt, Homo sapiens
ugggguacccacugcucu

SEQ ID NO: 1394913 - RNA, 23 nt, Homo sapiens
ugggucagaguuccgacugccau

SEQ ID NO: 1394914 - RNA, 14 nt, Homo sapiens
uggguccaggggau

SEQ ID NO: 1394915 - RNA, 16 nt, Homo sapiens
ugggugacaaagugag

SEQ ID NO: 1394916 - RNA, 16 nt, Homo sapiens
ugggugcccacagccc

SEQ ID NO: 1394917 - RNA, 15 nt, Homo sapiens
uggguugcaaucugg

SEQ ID NO: 1394918 - RNA, 23 nt, Homo sapiens
uggguugcaggaccucaggugag

SEQ ID NO: 1394919 - RNA, 23 nt, Homo sapiens
uggguuuugaacauaaagccuug

SEQ ID NO: 1394920 - RNA, 15 nt, Homo sapiens
ugguaaauuaguauu

SEQ ID NO: 1394921 - RNA, 23 nt, Homo sapiens
ugguaacuuuuuuuuaaagcuca

SEQ ID NO: 1394922 - RNA, 23 nt, Homo sapiens
ugguauguguguguaugcuacua

SEQ ID NO: 1394923 - RNA, 15 nt, Homo sapiens
uggucaacacuuaag

SEQ ID NO: 1394924 - RNA, 21 nt, Homo sapiens
uggucaagauuuugaaugcuu

SEQ ID NO: 1394925 - RNA, 14 nt, Homo sapiens
uggucacauacaau

SEQ ID NO: 1394926 - RNA, 22 nt, Homo sapiens
uggucaccaaaucagcugcuac

SEQ ID NO: 1394927 - RNA, 20 nt, Homo sapiens
ugguccuuagccccaucugc

SEQ ID NO: 1394928 - RNA, 13 nt, Homo sapiens
uggucugacccac

SEQ ID NO: 1394929 - RNA, 22 nt, Homo sapiens
uggucugcaggcagggcugacu

SEQ ID NO: 1394930 - RNA, 18 nt, Homo sapiens
uggucuugagaugucuuc

SEQ ID NO: 1394931 - RNA, 17 nt, Homo sapiens
uggugaaauggcuggag

SEQ ID NO: 1394932 - RNA, 22 nt, Homo sapiens
uggugccgaauugucuuuggug

SEQ ID NO: 1394933 - RNA, 18 nt, Homo sapiens
ugguggcagauuuuacaa

SEQ ID NO: 1394934 - RNA, 19 nt, Homo sapiens
ugguggcagauuuuacaaa

SEQ ID NO: 1394935 - RNA, 12 nt, Homo sapiens
ugguggccucug

SEQ ID NO: 1394936 - RNA, 21 nt, Homo sapiens
ugguguggccagcacucugaa

SEQ ID NO: 1394937 - RNA, 14 nt, Homo sapiens
ugguucaggguugg

SEQ ID NO: 1394938 - RNA, 18 nt, Homo sapiens
ugguuguauuaaagcagg

SEQ ID NO: 1394939 - RNA, 17 nt, Homo sapiens
ugguuuucuuuugccau

SEQ ID NO: 1394940 - RNA, 21 nt, Homo sapiens
uguaaaauauuuaugagaaag

SEQ ID NO: 1394941 - RNA, 23 nt, Homo sapiens
uguaaaauuuaaaucauauccua

SEQ ID NO: 1394942 - RNA, 19 nt, Homo sapiens
uguaaacguuucaguaaua

SEQ ID NO: 1394943 - RNA, 14 nt, Homo sapiens
uguaaauuaccagu

SEQ ID NO: 1394944 - RNA, 16 nt, Homo sapiens
uguaaccgauaugcac

SEQ ID NO: 1394945 - RNA, 19 nt, Homo sapiens
uguaacucaaaggguggaa

SEQ ID NO: 1394946 - RNA, 19 nt, Homo sapiens
uguaagaaacacacugagg

SEQ ID NO: 1394947 - RNA, 20 nt, Homo sapiens
uguaagauuuugaaaacuac

SEQ ID NO: 1394948 - RNA, 19 nt, Homo sapiens
uguaaggaauuaucaauua

SEQ ID NO: 1394949 - RNA, 16 nt, Homo sapiens
uguaaguaaugauaca

SEQ ID NO: 1394950 - RNA, 22 nt, Homo sapiens
uguaagugaaguaaaacuuaag

SEQ ID NO: 1394951 - RNA, 21 nt, Homo sapiens
uguaagugagagagacaagaa

SEQ ID NO: 1394952 - RNA, 22 nt, Homo sapiens
uguaauaaacucauuucuagca

SEQ ID NO: 1394953 - RNA, 15 nt, Homo sapiens
uguaauaaguaucac

SEQ ID NO: 1394954 - RNA, 22 nt, Homo sapiens
uguaauccuguacaauugcauc

SEQ ID NO: 1394955 - RNA, 17 nt, Homo sapiens
uguaauguuauuuccac

SEQ ID NO: 1394956 - RNA, 20 nt, Homo sapiens
uguacacacuuuauuuacuu

SEQ ID NO: 1394957 - RNA, 15 nt, Homo sapiens
uguacagacguaugc

SEQ ID NO: 1394958 - RNA, 18 nt, Homo sapiens
uguacaguauguucaaag

SEQ ID NO: 1394959 - RNA, 23 nt, Homo sapiens
uguaccgggcuggccugugccua

SEQ ID NO: 1394960 - RNA, 15 nt, Homo sapiens
uguagaaugauuuca

SEQ ID NO: 1394961 - RNA, 20 nt, Homo sapiens
uguagaaugauuucaugcua

SEQ ID NO: 1394962 - RNA, 19 nt, Homo sapiens
uguagauaaacucagaaau

SEQ ID NO: 1394963 - RNA, 15 nt, Homo sapiens
uguagauacuagcua

SEQ ID NO: 1394964 - RNA, 12 nt, Homo sapiens
uguagauauugu

SEQ ID NO: 1394965 - RNA, 13 nt, Homo sapiens
uguagaugugcau

SEQ ID NO: 1394966 - RNA, 20 nt, Homo sapiens
uguagccucgccgucuguga

SEQ ID NO: 1394967 - RNA, 22 nt, Homo sapiens
uguagucccagcuacucaggag

SEQ ID NO: 1394968 - RNA, 14 nt, Homo sapiens
uguagucucaggac

SEQ ID NO: 1394969 - RNA, 21 nt, Homo sapiens
uguagucuuaacuucucccca

SEQ ID NO: 1394970 - RNA, 14 nt, Homo sapiens
uguauaagaauuac

SEQ ID NO: 1394971 - RNA, 19 nt, Homo sapiens
uguauauaaacauaucaau

SEQ ID NO: 1394972 - RNA, 17 nt, Homo sapiens
uguaucuaaaccauaug

SEQ ID NO: 1394973 - RNA, 23 nt, Homo sapiens
uguaugacucccaaauuuucaca

SEQ ID NO: 1394974 - RNA, 21 nt, Homo sapiens
uguaugauccuaaugaaugca

SEQ ID NO: 1394975 - RNA, 15 nt, Homo sapiens
uguaugcacgugugc

SEQ ID NO: 1394976 - RNA, 18 nt, Homo sapiens
uguaugcacgugugcaca

SEQ ID NO: 1394977 - RNA, 16 nt, Homo sapiens
uguaugccaagugaga

SEQ ID NO: 1394978 - RNA, 16 nt, Homo sapiens
uguaugugcgugugug

SEQ ID NO: 1394979 - RNA, 17 nt, Homo sapiens
uguauuagucacagaga

SEQ ID NO: 1394980 - RNA, 19 nt, Homo sapiens
uguauuguucccagugaca

SEQ ID NO: 1394981 - RNA, 16 nt, Homo sapiens
uguauuucaagaccuc

SEQ ID NO: 1394982 - RNA, 23 nt, Homo sapiens
uguauuuuauuacaucuuucaca

SEQ ID NO: 1394983 - RNA, 17 nt, Homo sapiens
ugucaaacaaagccaga

SEQ ID NO: 1394984 - RNA, 16 nt, Homo sapiens
ugucaauaaaaccacu

SEQ ID NO: 1394985 - RNA, 12 nt, Homo sapiens
ugucaaugucuu

SEQ ID NO: 1394986 - RNA, 19 nt, Homo sapiens
ugucacuacgugacugugg

SEQ ID NO: 1394987 - RNA, 13 nt, Homo sapiens
ugucagaguagaa

SEQ ID NO: 1394988 - RNA, 17 nt, Homo sapiens
ugucagaguagaagauu

SEQ ID NO: 1394989 - RNA, 14 nt, Homo sapiens
ugucagcaguuccc

SEQ ID NO: 1394990 - RNA, 17 nt, Homo sapiens
ugucauauaagauucau

SEQ ID NO: 1394991 - RNA, 21 nt, Homo sapiens
ugucauauggaagaguuaaaa

SEQ ID NO: 1394992 - RNA, 23 nt, Homo sapiens
ugucauuaaauggggcucacaaa

SEQ ID NO: 1394993 - RNA, 11 nt, Homo sapiens
uguccaaagac

SEQ ID NO: 1394994 - RNA, 17 nt, Homo sapiens
uguccaugugugugcaa

SEQ ID NO: 1394995 - RNA, 21 nt, Homo sapiens
uguccaugugugugcaagugu

SEQ ID NO: 1394996 - RNA, 22 nt, Homo sapiens
ugucccacucaagccaagcagc

SEQ ID NO: 1394997 - RNA, 20 nt, Homo sapiens
uguccccaacaccccacaga

SEQ ID NO: 1394998 - RNA, 16 nt, Homo sapiens
ugucccugcacuugca

SEQ ID NO: 1394999 - RNA, 19 nt, Homo sapiens
uguccggucccugucccag

SEQ ID NO: 1395000 - RNA, 17 nt, Homo sapiens
uguccuacccacccucc

SEQ ID NO: 1395001 - RNA, 15 nt, Homo sapiens
uguccuggaauuauu

SEQ ID NO: 1395002 - RNA, 13 nt, Homo sapiens
uguccuugcacac

SEQ ID NO: 1395003 - RNA, 15 nt, Homo sapiens
uguccuugcacacuc

SEQ ID NO: 1395004 - RNA, 19 nt, Homo sapiens
ugucgcaugagaacauuaa

SEQ ID NO: 1395005 - RNA, 16 nt, Homo sapiens
ugucuaauaguuauuc

SEQ ID NO: 1395006 - RNA, 18 nt, Homo sapiens
ugucucagaccacuauuc

SEQ ID NO: 1395007 - RNA, 14 nt, Homo sapiens
ugucucccaaaaau

SEQ ID NO: 1395008 - RNA, 17 nt, Homo sapiens
ugucucugcuauggaau

SEQ ID NO: 1395009 - RNA, 17 nt, Homo sapiens
ugucugcucaguaauuu

SEQ ID NO: 1395010 - RNA, 15 nt, Homo sapiens
ugucuggugguggca

SEQ ID NO: 1395011 - RNA, 15 nt, Homo sapiens
ugucugugugcaagu

SEQ ID NO: 1395012 - RNA, 14 nt, Homo sapiens
ugucuuuggugcuu

SEQ ID NO: 1395013 - RNA, 16 nt, Homo sapiens
ugugaaagaaccaaaa

SEQ ID NO: 1395014 - RNA, 19 nt, Homo sapiens
ugugaaauaccaaccugaa

SEQ ID NO: 1395015 - RNA, 16 nt, Homo sapiens
ugugaaguggaaaugu

SEQ ID NO: 1395016 - RNA, 18 nt, Homo sapiens
ugugaaugugacuacuua

SEQ ID NO: 1395017 - RNA, 15 nt, Homo sapiens
ugugaccauuuauaa

SEQ ID NO: 1395018 - RNA, 16 nt, Homo sapiens
ugugaccugugucacu

SEQ ID NO: 1395019 - RNA, 12 nt, Homo sapiens
ugugaccuugac

SEQ ID NO: 1395020 - RNA, 17 nt, Homo sapiens
ugugagaauaaacuaga

SEQ ID NO: 1395021 - RNA, 15 nt, Homo sapiens
ugugagagaaagugu

SEQ ID NO: 1395022 - RNA, 19 nt, Homo sapiens
ugugauauuuuuacuugca

SEQ ID NO: 1395023 - RNA, 16 nt, Homo sapiens
ugugaucaagcaauaa

SEQ ID NO: 1395024 - RNA, 14 nt, Homo sapiens
ugugaucugggaac

SEQ ID NO: 1395025 - RNA, 21 nt, Homo sapiens
ugugauuaucaauuaccacac

SEQ ID NO: 1395026 - RNA, 21 nt, Homo sapiens
ugugcaagugucugugugcaa

SEQ ID NO: 1395027 - RNA, 20 nt, Homo sapiens
ugugcaaguguguaugugcg

SEQ ID NO: 1395028 - RNA, 21 nt, Homo sapiens
uuaaagcagggauaugcugua

SEQ ID NO: 1395029 - RNA, 20 nt, Homo sapiens
uuaaagccuuuagagccagc

SEQ ID NO: 1395030 - RNA, 19 nt, Homo sapiens
uuaaagcugaaaacugcaa

SEQ ID NO: 1395031 - RNA, 17 nt, Homo sapiens
uuaaaggaauaaggugu

SEQ ID NO: 1395032 - RNA, 16 nt, Homo sapiens
uuaaagguaaaacaug

SEQ ID NO: 1395033 - RNA, 22 nt, Homo sapiens
uuaaauaaaccuuuuuggacac

SEQ ID NO: 1395034 - RNA, 16 nt, Homo sapiens
uuaaauagggccucac

SEQ ID NO: 1395035 - RNA, 21 nt, Homo sapiens
uuaaauauuuuggcauuguac

SEQ ID NO: 1395036 - RNA, 24 nt, Homo sapiens
uuaaaucagccguguaaccaugga

SEQ ID NO: 1395037 - RNA, 21 nt, Homo sapiens
uuaaauccuguugaaaagcca

SEQ ID NO: 1395038 - RNA, 16 nt, Homo sapiens
uuaaauuguaaaugaa

SEQ ID NO: 1395039 - RNA, 22 nt, Homo sapiens
aacaauuccaaaggaaucucca

SEQ ID NO: 1395040 - RNA, 13 nt, Homo sapiens
aacacacaauauu

SEQ ID NO: 1395041 - RNA, 11 nt, Homo sapiens
aacacacauaa

SEQ ID NO: 1395042 - RNA, 11 nt, Homo sapiens
aacacauuaag

SEQ ID NO: 1395043 - RNA, 17 nt, Homo sapiens
aacaccaaaaagggauc

SEQ ID NO: 1395044 - RNA, 14 nt, Homo sapiens
aacaccaagacuug

SEQ ID NO: 1395045 - RNA, 19 nt, Homo sapiens
aacacccgacuccucaaaa

SEQ ID NO: 1395046 - RNA, 18 nt, Homo sapiens
aacagaaagcauccuaaa

SEQ ID NO: 1395047 - RNA, 20 nt, Homo sapiens
aacagaaauuaaucuuacaa

SEQ ID NO: 1395048 - RNA, 18 nt, Homo sapiens
aacagaaguccauggagu

SEQ ID NO: 1395049 - RNA, 22 nt, Homo sapiens
aacagauaaucccuguauuuca

SEQ ID NO: 1395050 - RNA, 13 nt, Homo sapiens
aacagcacccucu

SEQ ID NO: 1395051 - RNA, 14 nt, Homo sapiens
aacagcucucaccu

SEQ ID NO: 1395052 - RNA, 18 nt, Homo sapiens
aacaggaauccacauugc

SEQ ID NO: 1395053 - RNA, 12 nt, Homo sapiens
aacaggcaguug

SEQ ID NO: 1395054 - RNA, 18 nt, Homo sapiens
aacaggcucaauauuccu

SEQ ID NO: 1395055 - RNA, 14 nt, Homo sapiens
aacaguccuucaaa

SEQ ID NO: 1395056 - RNA, 16 nt, Homo sapiens
aacagugagaaaccau

SEQ ID NO: 1395057 - RNA, 18 nt, Homo sapiens
aacaguugugaugacuau

SEQ ID NO: 1395058 - RNA, 16 nt, Homo sapiens
aacaguuuuccaugaa

SEQ ID NO: 1395059 - RNA, 12 nt, Homo sapiens
aacauaaagccu

SEQ ID NO: 1395060 - RNA, 20 nt, Homo sapiens
aacauaaauuguacuguuga

SEQ ID NO: 1395061 - RNA, 17 nt, Homo sapiens
aacauaagguacuagca

SEQ ID NO: 1395062 - RNA, 22 nt, Homo sapiens
aacauauaauauauguuuuaaa

SEQ ID NO: 1395063 - RNA, 16 nt, Homo sapiens
aacauauuuaagaaau

SEQ ID NO: 1395064 - RNA, 17 nt, Homo sapiens
aacaucuggaguccuau

SEQ ID NO: 1395065 - RNA, 21 nt, Homo sapiens
aacaucuuggucagauuugaa

SEQ ID NO: 1395066 - RNA, 18 nt, Homo sapiens
aacaucuuuuacauucug

SEQ ID NO: 1395067 - RNA, 12 nt, Homo sapiens
aacaugaugaaa

SEQ ID NO: 1395068 - RNA, 14 nt, Homo sapiens
aacaugcaaagauc

SEQ ID NO: 1395069 - RNA, 16 nt, Homo sapiens
aacaugguaaaacccc

SEQ ID NO: 1395070 - RNA, 22 nt, Homo sapiens
aacaugguaaacgcugucccua

SEQ ID NO: 1395071 - RNA, 20 nt, Homo sapiens
aacauguaagcauaacuuau

SEQ ID NO: 1395072 - RNA, 15 nt, Homo sapiens
aacauguacacuggu

SEQ ID NO: 1395073 - RNA, 13 nt, Homo sapiens
aacaugugcucag

SEQ ID NO: 1395074 - RNA, 16 nt, Homo sapiens
aacaugugcucaggga

SEQ ID NO: 1395075 - RNA, 14 nt, Homo sapiens
aacauuaugccuua

SEQ ID NO: 1395076 - RNA, 17 nt, Homo sapiens
aacauuccaaugcauug

SEQ ID NO: 1395077 - RNA, 21 nt, Homo sapiens
aacauuccguuuacauuuuag

SEQ ID NO: 1395078 - RNA, 18 nt, Homo sapiens
aacauugauuauaagcau

SEQ ID NO: 1395079 - RNA, 20 nt, Homo sapiens
aacauuucuaacucugaugu

SEQ ID NO: 1395080 - RNA, 21 nt, Homo sapiens
aacauuucuaacucugaugua

SEQ ID NO: 1395081 - RNA, 20 nt, Homo sapiens
aacauuucucaaaugcacau

SEQ ID NO: 1395082 - RNA, 14 nt, Homo sapiens
aacauuuucuugaa

SEQ ID NO: 1395083 - RNA, 20 nt, Homo sapiens
aaccaaauacuuuaauguau

SEQ ID NO: 1395084 - RNA, 23 nt, Homo sapiens
aaccaaauuuguauuuaagguau

SEQ ID NO: 1395085 - RNA, 19 nt, Homo sapiens
aaccaaguggcucccacac

SEQ ID NO: 1395086 - RNA, 15 nt, Homo sapiens
aaccaauagcuuuaa

SEQ ID NO: 1395087 - RNA, 14 nt, Homo sapiens
aaccacagcacuau

SEQ ID NO: 1395088 - RNA, 22 nt, Homo sapiens
aaccacuaugaagcuaccucaa

SEQ ID NO: 1395089 - RNA, 14 nt, Homo sapiens
aaccagauugucag

SEQ ID NO: 1395090 - RNA, 18 nt, Homo sapiens
aaccagauugucagcucc

SEQ ID NO: 1395091 - RNA, 16 nt, Homo sapiens
aaccaguuaugugaau

SEQ ID NO: 1395092 - RNA, 17 nt, Homo sapiens
aaccauaugaacauaua

SEQ ID NO: 1395093 - RNA, 18 nt, Homo sapiens
aaccauaugaacauauau

SEQ ID NO: 1395094 - RNA, 19 nt, Homo sapiens
aaccauaugaacauauauu

SEQ ID NO: 1395095 - RNA, 18 nt, Homo sapiens
aaccaucaaaguggcaaa

SEQ ID NO: 1395096 - RNA, 20 nt, Homo sapiens
aaccauucacagugcaagaa

SEQ ID NO: 1395097 - RNA, 20 nt, Homo sapiens
aaccauuucagcuguuucac

SEQ ID NO: 1395098 - RNA, 12 nt, Homo sapiens
aacccaccugcu

SEQ ID NO: 1395099 - RNA, 22 nt, Homo sapiens
aaccccaaagaagaagugacca

SEQ ID NO: 1395100 - RNA, 12 nt, Homo sapiens
aaccccaucucu

SEQ ID NO: 1395101 - RNA, 14 nt, Homo sapiens
aaccgagcaauuuu

SEQ ID NO: 1395102 - RNA, 20 nt, Homo sapiens
aaccuacagaauacuagcca

SEQ ID NO: 1395103 - RNA, 13 nt, Homo sapiens
aaccuauacucac

SEQ ID NO: 1395104 - RNA, 13 nt, Homo sapiens
aaccucaaaguga

SEQ ID NO: 1395105 - RNA, 17 nt, Homo sapiens
aaccucacgcaccuccc

SEQ ID NO: 1395106 - RNA, 11 nt, Homo sapiens
aaccucagggc

SEQ ID NO: 1395107 - RNA, 13 nt, Homo sapiens
aaccucuaugcaa

SEQ ID NO: 1395108 - RNA, 14 nt, Homo sapiens
aaccucuaugcaau

SEQ ID NO: 1395109 - RNA, 18 nt, Homo sapiens
aaccucuaugcaaucuga

SEQ ID NO: 1395110 - RNA, 22 nt, Homo sapiens
aaccucucugaucuugugcuca

SEQ ID NO: 1395111 - RNA, 23 nt, Homo sapiens
aaccugaauauaaauuuguguuc

SEQ ID NO: 1395112 - RNA, 16 nt, Homo sapiens
aaccuguccuugcaca

SEQ ID NO: 1395113 - RNA, 17 nt, Homo sapiens
aaccugugaugagggga

SEQ ID NO: 1395114 - RNA, 13 nt, Homo sapiens
aaccuuccaucuc

SEQ ID NO: 1395115 - RNA, 16 nt, Homo sapiens
aaccuuucaaauuuca

SEQ ID NO: 1395116 - RNA, 11 nt, Homo sapiens
aacgccagucu

SEQ ID NO: 1395117 - RNA, 19 nt, Homo sapiens
aacggagagcgccugcccc

SEQ ID NO: 1395118 - RNA, 13 nt, Homo sapiens
aacggcacugugg

SEQ ID NO: 1395119 - RNA, 23 nt, Homo sapiens
aacguccagcucguucucugggc

SEQ ID NO: 1395120 - RNA, 12 nt, Homo sapiens
aacguggcccag

SEQ ID NO: 1395121 - RNA, 22 nt, Homo sapiens
aacgugggaguucagcugcuuc

SEQ ID NO: 1395122 - RNA, 17 nt, Homo sapiens
aacguuuugaacuaaua

SEQ ID NO: 1395123 - RNA, 14 nt, Homo sapiens
aacuaaauaaagcu

SEQ ID NO: 1395124 - RNA, 13 nt, Homo sapiens
aacuaacucuccu

SEQ ID NO: 1395125 - RNA, 17 nt, Homo sapiens
aacuaagaaauaugcac

SEQ ID NO: 1395126 - RNA, 18 nt, Homo sapiens
aacuaaugaaagcacucc

SEQ ID NO: 1395127 - RNA, 23 nt, Homo sapiens
aacuaauuuccucugacauguaa

SEQ ID NO: 1395128 - RNA, 19 nt, Homo sapiens
aacuacaauguagucucau

SEQ ID NO: 1395129 - RNA, 17 nt, Homo sapiens
aacuagaaaucugccaa

SEQ ID NO: 1395130 - RNA, 19 nt, Homo sapiens
aacuagggaagauaauauu

SEQ ID NO: 1395131 - RNA, 19 nt, Homo sapiens
aacuagguaacaguuugau

SEQ ID NO: 1395132 - RNA, 16 nt, Homo sapiens
aacuaguguugcuugg

SEQ ID NO: 1395133 - RNA, 16 nt, Homo sapiens
aacuauguacuuuaaa

SEQ ID NO: 1395134 - RNA, 17 nt, Homo sapiens
aacuauuacaccaaaua

SEQ ID NO: 1395135 - RNA, 11 nt, Homo sapiens
aacucaauauu

SEQ ID NO: 1395136 - RNA, 15 nt, Homo sapiens
aacucauuccugccu

SEQ ID NO: 1395137 - RNA, 16 nt, Homo sapiens
aacucauuucuagcag

SEQ ID NO: 1395138 - RNA, 13 nt, Homo sapiens
aacuccaucucaa

SEQ ID NO: 1395139 - RNA, 13 nt, Homo sapiens
aacuccuguuuca

SEQ ID NO: 1395140 - RNA, 18 nt, Homo sapiens
aacuccuguuucacuugg

SEQ ID NO: 1395141 - RNA, 22 nt, Homo sapiens
aacucuaacugauguuccacaa

SEQ ID NO: 1395142 - RNA, 18 nt, Homo sapiens
aacucugggcugccaugu

SEQ ID NO: 1395143 - RNA, 14 nt, Homo sapiens
aacucuuaaaaccc

SEQ ID NO: 1395144 - RNA, 16 nt, Homo sapiens
aacucuugaccucagg

SEQ ID NO: 1395145 - RNA, 19 nt, Homo sapiens
aacugaaaggcaugugaag

SEQ ID NO: 1395146 - RNA, 14 nt, Homo sapiens
aacugaagccagaa

SEQ ID NO: 1395147 - RNA, 22 nt, Homo sapiens
aacugacaaaucaaguuuccaa

SEQ ID NO: 1395148 - RNA, 15 nt, Homo sapiens
aacugaccaguuguu

SEQ ID NO: 1395149 - RNA, 21 nt, Homo sapiens
aacugcccaaagcagcacuua

SEQ ID NO: 1395150 - RNA, 20 nt, Homo sapiens
aacugcugaugcucaugguc

SEQ ID NO: 1395151 - RNA, 14 nt, Homo sapiens
aacuggacucagga

SEQ ID NO: 1395152 - RNA, 21 nt, Homo sapiens
aacuggaggaguuccuugauc

SEQ ID NO: 1395153 - RNA, 19 nt, Homo sapiens
aagcugauuacugucaaua

SEQ ID NO: 1395154 - RNA, 18 nt, Homo sapiens
aagcuggcaauauuacaa

SEQ ID NO: 1395155 - RNA, 18 nt, Homo sapiens
aagcugggcaacaugccu

SEQ ID NO: 1395156 - RNA, 21 nt, Homo sapiens
aagcugucccucacuguugaa

SEQ ID NO: 1395157 - RNA, 16 nt, Homo sapiens
aagcuuaagugggcag

SEQ ID NO: 1395158 - RNA, 12 nt, Homo sapiens
aagcuuauguca

SEQ ID NO: 1395159 - RNA, 15 nt, Homo sapiens
aagcuuauuaaugcu

SEQ ID NO: 1395160 - RNA, 17 nt, Homo sapiens
aagcuuccgccgucuca

SEQ ID NO: 1395161 - RNA, 15 nt, Homo sapiens
aaggaaaaaaccauc

SEQ ID NO: 1395162 - RNA, 18 nt, Homo sapiens
aaggaaaaaaccauccag

SEQ ID NO: 1395163 - RNA, 20 nt, Homo sapiens
aaggaaaugaauuucucuac

SEQ ID NO: 1395164 - RNA, 18 nt, Homo sapiens
aaggaacauguacuguua

SEQ ID NO: 1395165 - RNA, 17 nt, Homo sapiens
aaggaagacaaugugaa

SEQ ID NO: 1395166 - RNA, 19 nt, Homo sapiens
aaggaauuaucaauuacaa

SEQ ID NO: 1395167 - RNA, 18 nt, Homo sapiens
aaggacacuagaagauuu

SEQ ID NO: 1395168 - RNA, 21 nt, Homo sapiens
aaggacggccuucaacugaaa

SEQ ID NO: 1395169 - RNA, 22 nt, Homo sapiens
aaggacugccgaccgaggcugg

SEQ ID NO: 1395170 - RNA, 21 nt, Homo sapiens
aaggacuuuauagaucagcca

SEQ ID NO: 1395171 - RNA, 16 nt, Homo sapiens
aaggagaacuauccaa

SEQ ID NO: 1395172 - RNA, 21 nt, Homo sapiens
aaggaggcuuaggacuuucca

SEQ ID NO: 1395173 - RNA, 14 nt, Homo sapiens
aaggauacuuuaca

SEQ ID NO: 1395174 - RNA, 12 nt, Homo sapiens
aaggaucuuuca

SEQ ID NO: 1395175 - RNA, 22 nt, Homo sapiens
aaggcaaggggugccugggaac

SEQ ID NO: 1395176 - RNA, 16 nt, Homo sapiens
aaggcaggacagagaa

SEQ ID NO: 1395177 - RNA, 22 nt, Homo sapiens
aaggccaagaggcuguucccac

SEQ ID NO: 1395178 - RNA, 22 nt, Homo sapiens
aaggccagcgccagaacccaga

SEQ ID NO: 1395179 - RNA, 17 nt, Homo sapiens
aaggcucagucucagga

SEQ ID NO: 1395180 - RNA, 23 nt, Homo sapiens
aaggcuuacacccacaguggaaa

SEQ ID NO: 1395181 - RNA, 19 nt, Homo sapiens
aagggacuaggagcacugu

SEQ ID NO: 1395182 - RNA, 21 nt, Homo sapiens
aagggauggaagaaguaaaua

SEQ ID NO: 1395183 - RNA, 21 nt, Homo sapiens
aagggauuuucagcccucaga

SEQ ID NO: 1395184 - RNA, 15 nt, Homo sapiens
aagggcaggcccaaa

SEQ ID NO: 1395185 - RNA, 20 nt, Homo sapiens
aagggccagcuggaggugaa

SEQ ID NO: 1395186 - RNA, 22 nt, Homo sapiens
aagggccagcuggaggugaaga

SEQ ID NO: 1395187 - RNA, 22 nt, Homo sapiens
aagggcccagauucuaccacac

SEQ ID NO: 1395188 - RNA, 19 nt, Homo sapiens
aagggcuuggacucaagca

SEQ ID NO: 1395189 - RNA, 17 nt, Homo sapiens
aagggggguugcagugg

SEQ ID NO: 1395190 - RNA, 22 nt, Homo sapiens
aaggguaccuugaacacugggg

SEQ ID NO: 1395191 - RNA, 21 nt, Homo sapiens
aaggguuauagacugccaugc

SEQ ID NO: 1395192 - RNA, 23 nt, Homo sapiens
aaggguuauagacugccaugcua

SEQ ID NO: 1395193 - RNA, 12 nt, Homo sapiens
aagguaugcaau

SEQ ID NO: 1395194 - RNA, 16 nt, Homo sapiens
aagguaugcaaucaaa

SEQ ID NO: 1395195 - RNA, 18 nt, Homo sapiens
aaggucacauugugccuu

SEQ ID NO: 1395196 - RNA, 12 nt, Homo sapiens
aaggucucucuu

SEQ ID NO: 1395197 - RNA, 14 nt, Homo sapiens
aagguggaguggau

SEQ ID NO: 1395198 - RNA, 15 nt, Homo sapiens
aaggugggcacugga

SEQ ID NO: 1395199 - RNA, 20 nt, Homo sapiens
aagguggguggaucacuuga

SEQ ID NO: 1395200 - RNA, 24 nt, Homo sapiens
aaggugugcucugaucauccacug

SEQ ID NO: 1395201 - RNA, 12 nt, Homo sapiens
aagguuuccuca

SEQ ID NO: 1395202 - RNA, 17 nt, Homo sapiens
aagguuuuuacugugag

SEQ ID NO: 1395203 - RNA, 17 nt, Homo sapiens
aaguaauguuaauucuu

SEQ ID NO: 1395204 - RNA, 23 nt, Homo sapiens
aaguaauuaucgggaacaguguu

SEQ ID NO: 1395205 - RNA, 24 nt, Homo sapiens
aaguaauuccuguauucuacagca

SEQ ID NO: 1395206 - RNA, 14 nt, Homo sapiens
aaguaauugugaaa

SEQ ID NO: 1395207 - RNA, 23 nt, Homo sapiens
aaguauaacugaguuaaauuaua

SEQ ID NO: 1395208 - RNA, 16 nt, Homo sapiens
aaguaugagggaaaau

SEQ ID NO: 1395209 - RNA, 17 nt, Homo sapiens
aaguaugagggaaaaug

SEQ ID NO: 1395210 - RNA, 19 nt, Homo sapiens
aaguauuauuuauuugaau

SEQ ID NO: 1395211 - RNA, 16 nt, Homo sapiens
aaguauuggcaaagau

SEQ ID NO: 1395212 - RNA, 15 nt, Homo sapiens
aagucaccuccuuaa

SEQ ID NO: 1395213 - RNA, 17 nt, Homo sapiens
aagucagcaugccucua

SEQ ID NO: 1395214 - RNA, 20 nt, Homo sapiens
aagucccugacucucuguga

SEQ ID NO: 1395215 - RNA, 17 nt, Homo sapiens
aaguccuuucuaaguau

SEQ ID NO: 1395216 - RNA, 13 nt, Homo sapiens
aagucucugugaa

SEQ ID NO: 1395217 - RNA, 18 nt, Homo sapiens
aagucuuugaagugacuu

SEQ ID NO: 1395218 - RNA, 21 nt, Homo sapiens
aagugaagagggagaagggau

SEQ ID NO: 1395219 - RNA, 14 nt, Homo sapiens
aagugaaggagcug

SEQ ID NO: 1395220 - RNA, 13 nt, Homo sapiens
aagugacuauuca

SEQ ID NO: 1395221 - RNA, 22 nt, Homo sapiens
aagugagacccugucucaaaaa

SEQ ID NO: 1395222 - RNA, 20 nt, Homo sapiens
aagugagcuccuaagccaug

SEQ ID NO: 1395223 - RNA, 19 nt, Homo sapiens
aagugauccucccaccuca

SEQ ID NO: 1395224 - RNA, 15 nt, Homo sapiens
aaguggcaagaccaa

SEQ ID NO: 1395225 - RNA, 20 nt, Homo sapiens
aaguggucgcuuacuuugag

SEQ ID NO: 1395226 - RNA, 21 nt, Homo sapiens
aaguguaugcacgugugcaca

SEQ ID NO: 1395227 - RNA, 22 nt, Homo sapiens
aaguuauacuguggcuaugcaa

SEQ ID NO: 1395228 - RNA, 14 nt, Homo sapiens
aaguucauaggguc

SEQ ID NO: 1395229 - RNA, 20 nt, Homo sapiens
aaguugaagcuaagauuuag

SEQ ID NO: 1395230 - RNA, 21 nt, Homo sapiens
aaguugauuuuaagaauccaa

SEQ ID NO: 1395231 - RNA, 20 nt, Homo sapiens
aaguugcugaugaacucuua

SEQ ID NO: 1395232 - RNA, 16 nt, Homo sapiens
aaguuucacugacuua

SEQ ID NO: 1395233 - RNA, 13 nt, Homo sapiens
aauaaaaacugac

SEQ ID NO: 1395234 - RNA, 14 nt, Homo sapiens
aauaaaaacugacu

SEQ ID NO: 1395235 - RNA, 14 nt, Homo sapiens
aauaaaauuguaca

SEQ ID NO: 1395236 - RNA, 19 nt, Homo sapiens
aauaaacagcuucaugccu

SEQ ID NO: 1395237 - RNA, 15 nt, Homo sapiens
aauaaaguauuccac

SEQ ID NO: 1395238 - RNA, 15 nt, Homo sapiens
aauaaauacuugccu

SEQ ID NO: 1395239 - RNA, 15 nt, Homo sapiens
aauaaauaugcucag

SEQ ID NO: 1395240 - RNA, 22 nt, Homo sapiens
aauaaaugacaagugagacaaa

SEQ ID NO: 1395241 - RNA, 14 nt, Homo sapiens
aauaaaugugcuua

SEQ ID NO: 1395242 - RNA, 23 nt, Homo sapiens
aauaacuaaaagguaugcaauca

SEQ ID NO: 1395243 - RNA, 19 nt, Homo sapiens
aauaaguacuguguacaga

SEQ ID NO: 1395244 - RNA, 15 nt, Homo sapiens
aauaauaaaucuggu

SEQ ID NO: 1395245 - RNA, 19 nt, Homo sapiens
aauaauacaccagagauaa

SEQ ID NO: 1395246 - RNA, 20 nt, Homo sapiens
aauaauccagaaaaacugug

SEQ ID NO: 1395247 - RNA, 18 nt, Homo sapiens
aauaaugcacuuccuuac

SEQ ID NO: 1395248 - RNA, 14 nt, Homo sapiens
aauaauguacaucu

SEQ ID NO: 1395249 - RNA, 15 nt, Homo sapiens
aauaauugauuucaa

SEQ ID NO: 1395250 - RNA, 18 nt, Homo sapiens
aauaauuuuucacuucaa

SEQ ID NO: 1395251 - RNA, 20 nt, Homo sapiens
aauacagauagauauaugcu

SEQ ID NO: 1395252 - RNA, 14 nt, Homo sapiens
aauacaguaucuca

SEQ ID NO: 1395253 - RNA, 15 nt, Homo sapiens
aauacaugcaucuca

SEQ ID NO: 1395254 - RNA, 18 nt, Homo sapiens
aauacauuaaagcaguca

SEQ ID NO: 1395255 - RNA, 20 nt, Homo sapiens
aauauauaguggacaguaac

SEQ ID NO: 1395256 - RNA, 22 nt, Homo sapiens
aauaucacaucacuuaacugau

SEQ ID NO: 1395257 - RNA, 15 nt, Homo sapiens
aauauccauccugaa

SEQ ID NO: 1395258 - RNA, 17 nt, Homo sapiens
aauauccgaacuuuaau

SEQ ID NO: 1395259 - RNA, 19 nt, Homo sapiens
aauaugaguuuuauugucc

SEQ ID NO: 1395260 - RNA, 14 nt, Homo sapiens
aauaugggcacuuu

SEQ ID NO: 1395261 - RNA, 14 nt, Homo sapiens
aauaugucaguuug

SEQ ID NO: 1395262 - RNA, 16 nt, Homo sapiens
aauauuaacauaagaa

SEQ ID NO: 1395263 - RNA, 13 nt, Homo sapiens
aauauuaucuuug

SEQ ID NO: 1395264 - RNA, 20 nt, Homo sapiens
aauauuucccucaccuuucc

SEQ ID NO: 1395265 - RNA, 15 nt, Homo sapiens
aauauuugcuaugaa

SEQ ID NO: 1395266 - RNA, 18 nt, Homo sapiens
aauauuugcugacagcug

SEQ ID NO: 1395267 - RNA, 21 nt, Homo sapiens
aaucaagauaaaggacaguga

SEQ ID NO: 1395268 - RNA, 17 nt, Homo sapiens
aaucaaguauuggcaaa

SEQ ID NO: 1395269 - RNA, 12 nt, Homo sapiens
aaucacaagcag

SEQ ID NO: 1395270 - RNA, 20 nt, Homo sapiens
aaucacacgucuggcuucac

SEQ ID NO: 1395271 - RNA, 12 nt, Homo sapiens
aaucacaguaua

SEQ ID NO: 1395272 - RNA, 14 nt, Homo sapiens
aaucacuugcacuc

SEQ ID NO: 1395273 - RNA, 16 nt, Homo sapiens
aaucauaaaacuugau

SEQ ID NO: 1395274 - RNA, 19 nt, Homo sapiens
aaucauauaauaaauguac

SEQ ID NO: 1395275 - RNA, 22 nt, Homo sapiens
aaucauaugguugacaguaugc

SEQ ID NO: 1395276 - RNA, 21 nt, Homo sapiens
aaucaugaaauaugcaucuca

SEQ ID NO: 1395277 - RNA, 21 nt, Homo sapiens
aaucaugugggugagccagug

SEQ ID NO: 1395278 - RNA, 20 nt, Homo sapiens
aauccaacccaugaugagcu

SEQ ID NO: 1395279 - RNA, 20 nt, Homo sapiens
aauccacucuccauuucuau

SEQ ID NO: 1395280 - RNA, 17 nt, Homo sapiens
aauccagagagcagugu

SEQ ID NO: 1395281 - RNA, 18 nt, Homo sapiens
aauccagcgguucucaaa

SEQ ID NO: 1395282 - RNA, 20 nt, Homo sapiens
aauccaggcgugguggcaca

SEQ ID NO: 1395283 - RNA, 14 nt, Homo sapiens
aaucccagcacuuu

SEQ ID NO: 1395284 - RNA, 17 nt, Homo sapiens
aaucccagcuacucaag

SEQ ID NO: 1395285 - RNA, 14 nt, Homo sapiens
aauccgaaguauga

SEQ ID NO: 1395286 - RNA, 23 nt, Homo sapiens
aauccugagcaaacaaaaccacc

SEQ ID NO: 1395287 - RNA, 14 nt, Homo sapiens
aauccuuccaugaa

SEQ ID NO: 1395288 - RNA, 21 nt, Homo sapiens
aaucgcuccaccuugcagcuc

SEQ ID NO: 1395289 - RNA, 15 nt, Homo sapiens
aaucuaauacacuuu

SEQ ID NO: 1395290 - RNA, 18 nt, Homo sapiens
aaucucaaauaacuaaaa

SEQ ID NO: 1395291 - RNA, 14 nt, Homo sapiens
aaucuccaguuuuc

SEQ ID NO: 1395292 - RNA, 14 nt, Homo sapiens
aaucucggcucacu

SEQ ID NO: 1395293 - RNA, 13 nt, Homo sapiens
aaucugaccaaaa

SEQ ID NO: 1395294 - RNA, 22 nt, Homo sapiens
aaucugaggccuccucucucag

SEQ ID NO: 1395295 - RNA, 15 nt, Homo sapiens
aaucugccuauugca

SEQ ID NO: 1395296 - RNA, 18 nt, Homo sapiens
aaucugccuauugcagcu

SEQ ID NO: 1395297 - RNA, 16 nt, Homo sapiens
aaucuggggauacugg

SEQ ID NO: 1395298 - RNA, 17 nt, Homo sapiens
aaucuguaagcucuuug

SEQ ID NO: 1395299 - RNA, 22 nt, Homo sapiens
aaucuguuuauuuacaagggaa

SEQ ID NO: 1395300 - RNA, 21 nt, Homo sapiens
aaucuuccuuuguugcacaaa

SEQ ID NO: 1395301 - RNA, 23 nt, Homo sapiens
aaucuucucuuugacaauuccua

SEQ ID NO: 1395302 - RNA, 14 nt, Homo sapiens
aaucuuguuuccaa

SEQ ID NO: 1395303 - RNA, 24 nt, Homo sapiens
aaugaaagcauguggcauguucau

SEQ ID NO: 1395304 - RNA, 16 nt, Homo sapiens
aaugaaccccacuggg

SEQ ID NO: 1395305 - RNA, 18 nt, Homo sapiens
aaugaaccccacugggug

SEQ ID NO: 1395306 - RNA, 14 nt, Homo sapiens
aaugaagugcaaua

SEQ ID NO: 1395307 - RNA, 15 nt, Homo sapiens
aaugaagugcaauac

SEQ ID NO: 1395308 - RNA, 13 nt, Homo sapiens
aaugaauugcuaa

SEQ ID NO: 1395309 - RNA, 12 nt, Homo sapiens
aaugacaaugau

SEQ ID NO: 1395310 - RNA, 23 nt, Homo sapiens
aaugacaucuucaaagcuugaag

SEQ ID NO: 1395311 - RNA, 20 nt, Homo sapiens
aaugacuuugaaaaccuggc

SEQ ID NO: 1395312 - RNA, 15 nt, Homo sapiens
aaugagccuggcaag

SEQ ID NO: 1395313 - RNA, 16 nt, Homo sapiens
aaugagggccaagaaa

SEQ ID NO: 1395314 - RNA, 19 nt, Homo sapiens
aaugaguuagaacuauuaa

SEQ ID NO: 1395315 - RNA, 16 nt, Homo sapiens
aaugaucgggauauaa

SEQ ID NO: 1395316 - RNA, 13 nt, Homo sapiens
aaugaugaggcuc

SEQ ID NO: 1395317 - RNA, 19 nt, Homo sapiens
aaugaugucguuugaauca

SEQ ID NO: 1395318 - RNA, 19 nt, Homo sapiens
aaugauuuagguacgucaa

SEQ ID NO: 1395319 - RNA, 18 nt, Homo sapiens
aaugcagaauucuugagu

SEQ ID NO: 1395320 - RNA, 19 nt, Homo sapiens
aaugcauauccaacaugug

SEQ ID NO: 1395321 - RNA, 14 nt, Homo sapiens
aaugcauugcuaaa

SEQ ID NO: 1395322 - RNA, 19 nt, Homo sapiens
aaugcauuuuauucuuuaa

SEQ ID NO: 1395323 - RNA, 23 nt, Homo sapiens
aaugccccauggggcaucucuug

SEQ ID NO: 1395324 - RNA, 20 nt, Homo sapiens
aaugcucuuuacuucaugga

SEQ ID NO: 1395325 - RNA, 10 nt, Homo sapiens
aauggcaaca

SEQ ID NO: 1395326 - RNA, 13 nt, Homo sapiens
aauggcagggaua

SEQ ID NO: 1395327 - RNA, 14 nt, Homo sapiens
aauggggccuguua

SEQ ID NO: 1395328 - RNA, 17 nt, Homo sapiens
aauggggugcaugaagg

SEQ ID NO: 1395329 - RNA, 17 nt, Homo sapiens
aauggucgcccaggaga

SEQ ID NO: 1395330 - RNA, 16 nt, Homo sapiens
aauggugcucauuuca

SEQ ID NO: 1395331 - RNA, 13 nt, Homo sapiens
aauguaaagacaa

SEQ ID NO: 1395332 - RNA, 14 nt, Homo sapiens
aauguaagaaucau

SEQ ID NO: 1395333 - RNA, 23 nt, Homo sapiens
aauguaauacuccuaagacuuau

SEQ ID NO: 1395334 - RNA, 17 nt, Homo sapiens
aauguacaugucaauaa

SEQ ID NO: 1395335 - RNA, 16 nt, Homo sapiens
aauguaccugauguac

SEQ ID NO: 1395336 - RNA, 16 nt, Homo sapiens
aauguaucauagaaau

SEQ ID NO: 1395337 - RNA, 18 nt, Homo sapiens
aauguauuauaacuuuaa

SEQ ID NO: 1395338 - RNA, 21 nt, Homo sapiens
aauguauuuaaccagucuucu

SEQ ID NO: 1395339 - RNA, 14 nt, Homo sapiens
aaugucacuuaaag

SEQ ID NO: 1395340 - RNA, 16 nt, Homo sapiens
aaugucagaaaccagu

SEQ ID NO: 1395341 - RNA, 19 nt, Homo sapiens
aaugucauuaaacaugaca

SEQ ID NO: 1395342 - RNA, 17 nt, Homo sapiens
aaugucuggucugucca

SEQ ID NO: 1395343 - RNA, 18 nt, Homo sapiens
aaugucuggucuguccac

SEQ ID NO: 1395344 - RNA, 22 nt, Homo sapiens
aaugucuuuccuuuugcucuua

SEQ ID NO: 1395345 - RNA, 18 nt, Homo sapiens
aaugucuuuuuaagcuua

SEQ ID NO: 1395346 - RNA, 18 nt, Homo sapiens
aaugugcagcucccauuu

SEQ ID NO: 1395347 - RNA, 21 nt, Homo sapiens
aaugugcagcucccauuuggc

SEQ ID NO: 1395348 - RNA, 16 nt, Homo sapiens
aauguuacauuauuau

SEQ ID NO: 1395349 - RNA, 21 nt, Homo sapiens
aauguuagauaguuacuauau

SEQ ID NO: 1395350 - RNA, 19 nt, Homo sapiens
aauguuauucaauggaauc

SEQ ID NO: 1395351 - RNA, 22 nt, Homo sapiens
aauguuauuuuuuaauuauuau

SEQ ID NO: 1395352 - RNA, 13 nt, Homo sapiens
aauguucugacau

SEQ ID NO: 1395353 - RNA, 16 nt, Homo sapiens
aauuaagaauguucuc

SEQ ID NO: 1395354 - RNA, 17 nt, Homo sapiens
aauuaagaauguucuca

SEQ ID NO: 1395355 - RNA, 15 nt, Homo sapiens
aauuacaaaugcaau

SEQ ID NO: 1395356 - RNA, 15 nt, Homo sapiens
aauuacaacagugag

SEQ ID NO: 1395357 - RNA, 17 nt, Homo sapiens
aauuacuuuuucauucu

SEQ ID NO: 1395358 - RNA, 18 nt, Homo sapiens
aauuacuuuuucauucuu

SEQ ID NO: 1395359 - RNA, 13 nt, Homo sapiens
aauuagaugaacu

SEQ ID NO: 1395360 - RNA, 16 nt, Homo sapiens
aauuagucaaaccacu

SEQ ID NO: 1395361 - RNA, 20 nt, Homo sapiens
aauuagucaaaccacuguua

SEQ ID NO: 1395362 - RNA, 21 nt, Homo sapiens
aauuaguuccucauuagcauu

SEQ ID NO: 1395363 - RNA, 21 nt, Homo sapiens
aauuauuauuuauauauguau

SEQ ID NO: 1395364 - RNA, 19 nt, Homo sapiens
aauuauuuuuacaguucuc

SEQ ID NO: 1395365 - RNA, 18 nt, Homo sapiens
aauucaaaaauguacaaa

SEQ ID NO: 1395366 - RNA, 18 nt, Homo sapiens
aauucagggagugggcua

SEQ ID NO: 1395367 - RNA, 16 nt, Homo sapiens
aauucauccucacuca

SEQ ID NO: 1395368 - RNA, 23 nt, Homo sapiens
aauucauccucacucaguccagc

SEQ ID NO: 1395369 - RNA, 20 nt, Homo sapiens
aauucauucuggucucucua

SEQ ID NO: 1395370 - RNA, 15 nt, Homo sapiens
aauuccauaugcugu

SEQ ID NO: 1395371 - RNA, 20 nt, Homo sapiens
aauucuagcuuugagcuuaa

SEQ ID NO: 1395372 - RNA, 17 nt, Homo sapiens
aauucuaggcaucccag

SEQ ID NO: 1395373 - RNA, 20 nt, Homo sapiens
aauucucauuugucacacac

SEQ ID NO: 1395374 - RNA, 23 nt, Homo sapiens
aauucucuuuccuguagucccau

SEQ ID NO: 1395375 - RNA, 19 nt, Homo sapiens
aauucuuacaaacaugugg

SEQ ID NO: 1395376 - RNA, 15 nt, Homo sapiens
aauucuuucaguggc

SEQ ID NO: 1395377 - RNA, 14 nt, Homo sapiens
aauugauguugcug

SEQ ID NO: 1395378 - RNA, 12 nt, Homo sapiens
aauugauuucaa

SEQ ID NO: 1395379 - RNA, 20 nt, Homo sapiens
aauugcagaguacuggcuga

SEQ ID NO: 1395380 - RNA, 18 nt, Homo sapiens
aauugcaugcugcuuuaa

SEQ ID NO: 1395381 - RNA, 12 nt, Homo sapiens
aauugcauuucc

SEQ ID NO: 1395382 - RNA, 18 nt, Homo sapiens
aauugcuaagaagggaaa

SEQ ID NO: 1395383 - RNA, 16 nt, Homo sapiens
aauugcuucaagcauu

SEQ ID NO: 1395384 - RNA, 18 nt, Homo sapiens
aauugggaauaugcacaa

SEQ ID NO: 1395385 - RNA, 14 nt, Homo sapiens
aauuguacaaccug

SEQ ID NO: 1395386 - RNA, 16 nt, Homo sapiens
aauuguauuacuuccu

SEQ ID NO: 1395387 - RNA, 17 nt, Homo sapiens
aauuuaaaacacagaga

SEQ ID NO: 1395388 - RNA, 17 nt, Homo sapiens
aauuuaaucacuuucau

SEQ ID NO: 1395389 - RNA, 19 nt, Homo sapiens
aauuuagaaauauaauuga

SEQ ID NO: 1395390 - RNA, 18 nt, Homo sapiens
aauuuaggaccaauaccu

SEQ ID NO: 1395391 - RNA, 20 nt, Homo sapiens
aauuuaucuugucucugggc

SEQ ID NO: 1395392 - RNA, 20 nt, Homo sapiens
aauuuauuucaaaaagggaa

SEQ ID NO: 1395393 - RNA, 13 nt, Homo sapiens
aauuugagacaaa

SEQ ID NO: 1395394 - RNA, 20 nt, Homo sapiens
aauuuuaaugaagugcaaua

SEQ ID NO: 1395395 - RNA, 13 nt, Homo sapiens
aauuuuaauugaa

SEQ ID NO: 1395396 - RNA, 18 nt, Homo sapiens
aauuuuaggcacccaucc

SEQ ID NO: 1395397 - RNA, 21 nt, Homo sapiens
aauuuugccauaaagucaaau

SEQ ID NO: 1395398 - RNA, 23 nt, Homo sapiens
aauuuuguguguaccugugacua

SEQ ID NO: 1395399 - RNA, 19 nt, Homo sapiens
aauuuuguuuguugaugug

SEQ ID NO: 1395400 - RNA, 21 nt, Homo sapiens
aauuuuuacacaaaccugaaa

SEQ ID NO: 1395401 - RNA, 23 nt, Homo sapiens
aauuuuuuagagagcuguuccca

SEQ ID NO: 1395402 - RNA, 16 nt, Homo sapiens
acaaaaaaaccucuau

SEQ ID NO: 1395403 - RNA, 15 nt, Homo sapiens
acaaaaaacaacuga

SEQ ID NO: 1395404 - RNA, 20 nt, Homo sapiens
acaaaauaaugcacuuccuu

SEQ ID NO: 1395405 - RNA, 17 nt, Homo sapiens
acaaacacaagcaaaac

SEQ ID NO: 1395406 - RNA, 14 nt, Homo sapiens
acaaacauauuugu

SEQ ID NO: 1395407 - RNA, 17 nt, Homo sapiens
acaaaccucaagccagc

SEQ ID NO: 1395408 - RNA, 19 nt, Homo sapiens
acaaacucucccuucacuc

SEQ ID NO: 1395409 - RNA, 11 nt, Homo sapiens
acaaacugcaa

SEQ ID NO: 1395410 - RNA, 12 nt, Homo sapiens
acaaacugcaau

SEQ ID NO: 1395411 - RNA, 17 nt, Homo sapiens
acaaagagaguuaauca

SEQ ID NO: 1395412 - RNA, 21 nt, Homo sapiens
acaaagcuggcaauauuacaa

SEQ ID NO: 1395413 - RNA, 14 nt, Homo sapiens
acaaaguauuugcu

SEQ ID NO: 1395414 - RNA, 16 nt, Homo sapiens
acaaauaaaaaauuca

SEQ ID NO: 1395415 - RNA, 22 nt, Homo sapiens
acaaauaauuuuuaaauauaag

SEQ ID NO: 1395416 - RNA, 14 nt, Homo sapiens
acaaaugacaucaa

SEQ ID NO: 1395417 - RNA, 16 nt, Homo sapiens
acaaauucaagccuua

SEQ ID NO: 1395418 - RNA, 17 nt, Homo sapiens
acaacaaccuggucaca

SEQ ID NO: 1395419 - RNA, 23 nt, Homo sapiens
acaacagcaaaacuccaucucaa

SEQ ID NO: 1395420 - RNA, 19 nt, Homo sapiens
acaacaucaagccugugau

SEQ ID NO: 1395421 - RNA, 19 nt, Homo sapiens
acaacaugcgaccgugacc

SEQ ID NO: 1395422 - RNA, 19 nt, Homo sapiens
acaacauuucucaaaugca

SEQ ID NO: 1395423 - RNA, 20 nt, Homo sapiens
acaaccaaaaaauucuacaa

SEQ ID NO: 1395424 - RNA, 18 nt, Homo sapiens
acaacgaggaagcccuaa

SEQ ID NO: 1395425 - RNA, 14 nt, Homo sapiens
acaacgaugaugcu

SEQ ID NO: 1395426 - RNA, 13 nt, Homo sapiens
acaacuaccuccu

SEQ ID NO: 1395427 - RNA, 18 nt, Homo sapiens
acaagaucuguaauguua

SEQ ID NO: 1395428 - RNA, 20 nt, Homo sapiens
acaagcgugagccacugcac

SEQ ID NO: 1395429 - RNA, 18 nt, Homo sapiens
acaaggcugaccaagaga

SEQ ID NO: 1395430 - RNA, 15 nt, Homo sapiens
acaauagaaaccugu

SEQ ID NO: 1395431 - RNA, 24 nt, Homo sapiens
acaauccaucucucaaguagugua

SEQ ID NO: 1395432 - RNA, 15 nt, Homo sapiens
acaaucuguauauaa

SEQ ID NO: 1395433 - RNA, 15 nt, Homo sapiens
acaaugaaaugcucu

SEQ ID NO: 1395434 - RNA, 16 nt, Homo sapiens
acaaugaaaugcucuc

SEQ ID NO: 1395435 - RNA, 18 nt, Homo sapiens
acaaugaagaugaugcua

SEQ ID NO: 1395436 - RNA, 19 nt, Homo sapiens
acaaugaccacauccugaa

SEQ ID NO: 1395437 - RNA, 16 nt, Homo sapiens
acaaugacuaaagaca

SEQ ID NO: 1395438 - RNA, 15 nt, Homo sapiens
acaaugcuuugcccc

SEQ ID NO: 1395439 - RNA, 19 nt, Homo sapiens
acaauggugcucauuucau

SEQ ID NO: 1395440 - RNA, 23 nt, Homo sapiens
acaauuauguaauugaaaaccaa

SEQ ID NO: 1395441 - RNA, 16 nt, Homo sapiens
acaauugaacuuaaau

SEQ ID NO: 1395442 - RNA, 22 nt, Homo sapiens
acaauuguaaaauuuaaaucau

SEQ ID NO: 1395443 - RNA, 21 nt, Homo sapiens
acacaaagcuguugaaauauu

SEQ ID NO: 1395444 - RNA, 15 nt, Homo sapiens
acacaaauuugccug

SEQ ID NO: 1395445 - RNA, 18 nt, Homo sapiens
acacaagacuuuccccau

SEQ ID NO: 1395446 - RNA, 12 nt, Homo sapiens
acacacagcucu

SEQ ID NO: 1395447 - RNA, 14 nt, Homo sapiens
acacacagcuucua

SEQ ID NO: 1395448 - RNA, 17 nt, Homo sapiens
acacacagcuucuagug

SEQ ID NO: 1395449 - RNA, 10 nt, Homo sapiens
acacacucca

SEQ ID NO: 1395450 - RNA, 13 nt, Homo sapiens
acacacuccauca

SEQ ID NO: 1395451 - RNA, 22 nt, Homo sapiens
acacagcgagacuccgucucaa

SEQ ID NO: 1395452 - RNA, 21 nt, Homo sapiens
acacagcucuucuccaggcug

SEQ ID NO: 1395453 - RNA, 21 nt, Homo sapiens
acacaggcccggcuccaggcu

SEQ ID NO: 1395454 - RNA, 21 nt, Homo sapiens
acacagggcauccaacugaga

SEQ ID NO: 1395455 - RNA, 16 nt, Homo sapiens
acacaguucaauucuc

SEQ ID NO: 1395456 - RNA, 14 nt, Homo sapiens
acacauagauucac

SEQ ID NO: 1395457 - RNA, 18 nt, Homo sapiens
acacaucuuccacagguc

SEQ ID NO: 1395458 - RNA, 19 nt, Homo sapiens
acacauuaagccuuccaca

SEQ ID NO: 1395459 - RNA, 23 nt, Homo sapiens
acacauuaagccuuccacacuca

SEQ ID NO: 1395460 - RNA, 20 nt, Homo sapiens
acaccaggcugugggccuca

SEQ ID NO: 1395461 - RNA, 17 nt, Homo sapiens
acaccauuuuccugccu

SEQ ID NO: 1395462 - RNA, 21 nt, Homo sapiens
acacccccaccuccugcaaua

SEQ ID NO: 1395463 - RNA, 22 nt, Homo sapiens
acacccccaccuccugcaauaa

SEQ ID NO: 1395464 - RNA, 14 nt, Homo sapiens
acaccguucauuca

SEQ ID NO: 1395465 - RNA, 20 nt, Homo sapiens
acaccucuccuuugugacuu

SEQ ID NO: 1395466 - RNA, 14 nt, Homo sapiens
acacggaggcaucu

SEQ ID NO: 1395467 - RNA, 12 nt, Homo sapiens
acacgugacaga

SEQ ID NO: 1395468 - RNA, 15 nt, Homo sapiens
acacguuacuagcag

SEQ ID NO: 1395469 - RNA, 14 nt, Homo sapiens
acacuaaacuucau

SEQ ID NO: 1395470 - RNA, 15 nt, Homo sapiens
acacuaauacaccag

SEQ ID NO: 1395471 - RNA, 13 nt, Homo sapiens
acacuagucugug

SEQ ID NO: 1395472 - RNA, 20 nt, Homo sapiens
acacuauuuaucugugcaaa

SEQ ID NO: 1395473 - RNA, 19 nt, Homo sapiens
acacucaucuuagugccug

SEQ ID NO: 1395474 - RNA, 15 nt, Homo sapiens
acacucugaauucca

SEQ ID NO: 1395475 - RNA, 15 nt, Homo sapiens
acacugaaaaggaaa

SEQ ID NO: 1395476 - RNA, 22 nt, Homo sapiens
acacugaaauauacacacagca

SEQ ID NO: 1395477 - RNA, 15 nt, Homo sapiens
acacugaaguuaaca

SEQ ID NO: 1395478 - RNA, 17 nt, Homo sapiens
acacugaaguuaacaga

SEQ ID NO: 1395479 - RNA, 19 nt, Homo sapiens
acauguaauuaaguacuau

SEQ ID NO: 1395480 - RNA, 13 nt, Homo sapiens
acaugugcacaug

SEQ ID NO: 1395481 - RNA, 22 nt, Homo sapiens
acauguuuuucuucucccucag

SEQ ID NO: 1395482 - RNA, 23 nt, Homo sapiens
acauuaaacacaaagcuguugaa

SEQ ID NO: 1395483 - RNA, 15 nt, Homo sapiens
acauuagccuaugug

SEQ ID NO: 1395484 - RNA, 19 nt, Homo sapiens
acauugaaagagaaccagu

SEQ ID NO: 1395485 - RNA, 17 nt, Homo sapiens
auagccuaggugacaga

SEQ ID NO: 1395486 - RNA, 17 nt, Homo sapiens
auagcuauauccaugua

SEQ ID NO: 1395487 - RNA, 14 nt, Homo sapiens
auagcuuccaugag

SEQ ID NO: 1395488 - RNA, 19 nt, Homo sapiens
auaggaaugcuaacaguuc

SEQ ID NO: 1395489 - RNA, 16 nt, Homo sapiens
auaggacccauauucc

SEQ ID NO: 1395490 - RNA, 20 nt, Homo sapiens
auaggacucuagacggcauc

SEQ ID NO: 1395491 - RNA, 18 nt, Homo sapiens
auaggaggccaacccaaa

SEQ ID NO: 1395492 - RNA, 14 nt, Homo sapiens
auaggucacuccug

SEQ ID NO: 1395493 - RNA, 11 nt, Homo sapiens
auaguacuggc

SEQ ID NO: 1395494 - RNA, 20 nt, Homo sapiens
auaguccgucucugcuuauc

SEQ ID NO: 1395495 - RNA, 22 nt, Homo sapiens
auaguggacaguaaccuuucaa

SEQ ID NO: 1395496 - RNA, 14 nt, Homo sapiens
auauaaacauauca

SEQ ID NO: 1395497 - RNA, 17 nt, Homo sapiens
auauaaauuuucccaaa

SEQ ID NO: 1395498 - RNA, 13 nt, Homo sapiens
auauaacuuuuuc

SEQ ID NO: 1395499 - RNA, 16 nt, Homo sapiens
auauaaggaaagcaau

SEQ ID NO: 1395500 - RNA, 20 nt, Homo sapiens
auauaauaugcacacagugc

SEQ ID NO: 1395501 - RNA, 15 nt, Homo sapiens
auauacaauaacaua

SEQ ID NO: 1395502 - RNA, 17 nt, Homo sapiens
auauacaauaacauaau

SEQ ID NO: 1395503 - RNA, 20 nt, Homo sapiens
auauaguaccuuugcucuug

SEQ ID NO: 1395504 - RNA, 17 nt, Homo sapiens
auauaguggacaguaac

SEQ ID NO: 1395505 - RNA, 16 nt, Homo sapiens
auauaugcaggaaaga

SEQ ID NO: 1395506 - RNA, 14 nt, Homo sapiens
auaucaaaagcaaa

SEQ ID NO: 1395507 - RNA, 22 nt, Homo sapiens
auaucauuuauuuuuuacauua

SEQ ID NO: 1395508 - RNA, 17 nt, Homo sapiens
auauccaacaugugcuc

SEQ ID NO: 1395509 - RNA, 22 nt, Homo sapiens
auauccaacaugugcucaggga

SEQ ID NO: 1395510 - RNA, 14 nt, Homo sapiens
auaucccuaccuug

SEQ ID NO: 1395511 - RNA, 13 nt, Homo sapiens
auaucgaucucuu

SEQ ID NO: 1395512 - RNA, 15 nt, Homo sapiens
auaucuugaaacaua

SEQ ID NO: 1395513 - RNA, 14 nt, Homo sapiens
auaugaaggaaaug

SEQ ID NO: 1395514 - RNA, 15 nt, Homo sapiens
auaugagacuuucaa

SEQ ID NO: 1395515 - RNA, 13 nt, Homo sapiens
auaugagcuuuau

SEQ ID NO: 1395516 - RNA, 15 nt, Homo sapiens
auaugauugugcaca

SEQ ID NO: 1395517 - RNA, 14 nt, Homo sapiens
auaugcugccaaau

SEQ ID NO: 1395518 - RNA, 14 nt, Homo sapiens
auauggucccaaau

SEQ ID NO: 1395519 - RNA, 16 nt, Homo sapiens
auauggugggcacaga

SEQ ID NO: 1395520 - RNA, 20 nt, Homo sapiens
auauguaacuggaaucucaa

SEQ ID NO: 1395521 - RNA, 21 nt, Homo sapiens
auauguacauaggcagcacua

SEQ ID NO: 1395522 - RNA, 22 nt, Homo sapiens
auauguacauaggcagcacuag

SEQ ID NO: 1395523 - RNA, 22 nt, Homo sapiens
auauguaucuaaaccauaugaa

SEQ ID NO: 1395524 - RNA, 16 nt, Homo sapiens
auauguucaacuggag

SEQ ID NO: 1395525 - RNA, 21 nt, Homo sapiens
auauuaaggaagacaauguga

SEQ ID NO: 1395526 - RNA, 12 nt, Homo sapiens
auauuagcuuua

SEQ ID NO: 1395527 - RNA, 17 nt, Homo sapiens
auauuaugcaggggcaa

SEQ ID NO: 1395528 - RNA, 18 nt, Homo sapiens
auauucaagguuauaugu

SEQ ID NO: 1395529 - RNA, 22 nt, Homo sapiens
auauucuuuaaauuucaucuca

SEQ ID NO: 1395530 - RNA, 22 nt, Homo sapiens
auauugaaugaugugauacaaa

SEQ ID NO: 1395531 - RNA, 18 nt, Homo sapiens
auauuguugaacacuuga

SEQ ID NO: 1395532 - RNA, 21 nt, Homo sapiens
auauuuaaauguaaagacaaa

SEQ ID NO: 1395533 - RNA, 14 nt, Homo sapiens
auauuuaaucuuaa

SEQ ID NO: 1395534 - RNA, 15 nt, Homo sapiens
auauuuauagcaauc

SEQ ID NO: 1395535 - RNA, 14 nt, Homo sapiens
auauuuauguagau

SEQ ID NO: 1395536 - RNA, 22 nt, Homo sapiens
auauuucagauaucagaaucau

SEQ ID NO: 1395537 - RNA, 20 nt, Homo sapiens
auauuucaggcauacugaca

SEQ ID NO: 1395538 - RNA, 21 nt, Homo sapiens
auauuuguuaaauauuuacau

SEQ ID NO: 1395539 - RNA, 15 nt, Homo sapiens
auauuuuguguauaa

SEQ ID NO: 1395540 - RNA, 18 nt, Homo sapiens
auauuuuguuuugugcag

SEQ ID NO: 1395541 - RNA, 14 nt, Homo sapiens
aucaaaacucuccu

SEQ ID NO: 1395542 - RNA, 18 nt, Homo sapiens
aucaaaauuucagcauua

SEQ ID NO: 1395543 - RNA, 15 nt, Homo sapiens
aucaaagacagcauc

SEQ ID NO: 1395544 - RNA, 20 nt, Homo sapiens
aucaauccagcgguucucaa

SEQ ID NO: 1395545 - RNA, 13 nt, Homo sapiens
aucaaucucuagu

SEQ ID NO: 1395546 - RNA, 11 nt, Homo sapiens
aucaaugucac

SEQ ID NO: 1395547 - RNA, 13 nt, Homo sapiens
aucaaugucacuu

SEQ ID NO: 1395548 - RNA, 16 nt, Homo sapiens
aucaaugucacuuaaa

SEQ ID NO: 1395549 - RNA, 19 nt, Homo sapiens
aucaauuauagaaagccaa

SEQ ID NO: 1395550 - RNA, 11 nt, Homo sapiens
aucacaacauu

SEQ ID NO: 1395551 - RNA, 23 nt, Homo sapiens
aucacacuguauauaaacauauc

SEQ ID NO: 1395552 - RNA, 19 nt, Homo sapiens
aucacagcuucagccagga

SEQ ID NO: 1395553 - RNA, 23 nt, Homo sapiens
aucacagggccccagaaggcagg

SEQ ID NO: 1395554 - RNA, 15 nt, Homo sapiens
aucacauuaucaucu

SEQ ID NO: 1395555 - RNA, 21 nt, Homo sapiens
aucacauuauuugcauguuac

SEQ ID NO: 1395556 - RNA, 17 nt, Homo sapiens
aucacggcucacugcag

SEQ ID NO: 1395557 - RNA, 17 nt, Homo sapiens
aucacuugcacuccgga

SEQ ID NO: 1395558 - RNA, 18 nt, Homo sapiens
aucacuuuaaagcccuuu

SEQ ID NO: 1395559 - RNA, 16 nt, Homo sapiens
aucacuuuucucugag

SEQ ID NO: 1395560 - RNA, 16 nt, Homo sapiens
aucagaaacuugugaa

SEQ ID NO: 1395561 - RNA, 17 nt, Homo sapiens
aucagaaggacauggug

SEQ ID NO: 1395562 - RNA, 16 nt, Homo sapiens
aucagaccauaauguu

SEQ ID NO: 1395563 - RNA, 22 nt, Homo sapiens
aucagaccauaauguuacauua

SEQ ID NO: 1395564 - RNA, 24 nt, Homo sapiens
aucagaccugucuuccaaggagac

SEQ ID NO: 1395565 - RNA, 16 nt, Homo sapiens
aucagacuagugacaa

SEQ ID NO: 1395566 - RNA, 17 nt, Homo sapiens
aucagacuccugugcaa

SEQ ID NO: 1395567 - RNA, 18 nt, Homo sapiens
aucagacuccugugcaac

SEQ ID NO: 1395568 - RNA, 15 nt, Homo sapiens
aucagagagcucacu

SEQ ID NO: 1395569 - RNA, 19 nt, Homo sapiens
aucagcaaaaaaguacuua

SEQ ID NO: 1395570 - RNA, 17 nt, Homo sapiens
aucagcauuuuacuacu

SEQ ID NO: 1395571 - RNA, 22 nt, Homo sapiens
aucagcccaaaagucaaucuua

SEQ ID NO: 1395572 - RNA, 21 nt, Homo sapiens
aucagcuccagcugcucuguc

SEQ ID NO: 1395573 - RNA, 13 nt, Homo sapiens
aucaggacgagaa

SEQ ID NO: 1395574 - RNA, 14 nt, Homo sapiens
aucaggccaacccc

SEQ ID NO: 1395575 - RNA, 14 nt, Homo sapiens
aucaguagccagca

SEQ ID NO: 1395576 - RNA, 12 nt, Homo sapiens
aucaguuugacu

SEQ ID NO: 1395577 - RNA, 23 nt, Homo sapiens
aucauauaauaaauguacauuaa

SEQ ID NO: 1395578 - RNA, 17 nt, Homo sapiens
aucauauaaucuuacaa

SEQ ID NO: 1395579 - RNA, 13 nt, Homo sapiens
aucauauuucaaa

SEQ ID NO: 1395580 - RNA, 17 nt, Homo sapiens
aucaucuguagauacua

SEQ ID NO: 1395581 - RNA, 15 nt, Homo sapiens
aucaucuuuccuguu

SEQ ID NO: 1395582 - RNA, 21 nt, Homo sapiens
aucauggaaauauuaugcaaa

SEQ ID NO: 1395583 - RNA, 21 nt, Homo sapiens
aucaugguuuuucuuaguaga

SEQ ID NO: 1395584 - RNA, 20 nt, Homo sapiens
aucaugugggugagccagug

SEQ ID NO: 1395585 - RNA, 14 nt, Homo sapiens
aucauuccuugaga

SEQ ID NO: 1395586 - RNA, 21 nt, Homo sapiens
aucauuucaaaacucauuucc

SEQ ID NO: 1395587 - RNA, 18 nt, Homo sapiens
aucauuuucugcauuuaa

SEQ ID NO: 1395588 - RNA, 23 nt, Homo sapiens
auccaagcgaggucaacagagaa

SEQ ID NO: 1395589 - RNA, 18 nt, Homo sapiens
auccaaucuuguuuccaa

SEQ ID NO: 1395590 - RNA, 15 nt, Homo sapiens
auccaaugcucaaga

SEQ ID NO: 1395591 - RNA, 15 nt, Homo sapiens
auccagacccggcug

SEQ ID NO: 1395592 - RNA, 16 nt, Homo sapiens
auccagcgguucucaa

SEQ ID NO: 1395593 - RNA, 22 nt, Homo sapiens
auccaugccugggaaaugccac

SEQ ID NO: 1395594 - RNA, 11 nt, Homo sapiens
aucccacucac

SEQ ID NO: 1395595 - RNA, 17 nt, Homo sapiens
aucccagacuugcugaa

SEQ ID NO: 1395596 - RNA, 21 nt, Homo sapiens
augauuguuuuugcucaaggc

SEQ ID NO: 1395597 - RNA, 18 nt, Homo sapiens
augcaaaguagcaauuuc

SEQ ID NO: 1395598 - RNA, 23 nt, Homo sapiens
accgccggccagcugggaucuga

SEQ ID NO: 1395599 - RNA, 16 nt, Homo sapiens
accggccggucacugc

SEQ ID NO: 1395600 - RNA, 21 nt, Homo sapiens
accgggcacucagaagacacu

SEQ ID NO: 1395601 - RNA, 23 nt, Homo sapiens
accguucauucaggcaacgcaca

SEQ ID NO: 1395602 - RNA, 17 nt, Homo sapiens
accuaagcaaaaccacu

SEQ ID NO: 1395603 - RNA, 20 nt, Homo sapiens
agcacccucuccagaugcag

SEQ ID NO: 1395604 - RNA, 18 nt, Homo sapiens
agcacuccucccugaugu

SEQ ID NO: 1395605 - RNA, 12 nt, Homo sapiens
agcacucugaaa

SEQ ID NO: 1395606 - RNA, 17 nt, Homo sapiens
agcacugagcaaagcau

SEQ ID NO: 1395607 - RNA, 19 nt, Homo sapiens
agcacugagcaaagcauug

SEQ ID NO: 1395608 - RNA, 17 nt, Homo sapiens
agcacugucucaguuuc

SEQ ID NO: 1395609 - RNA, 14 nt, Homo sapiens
agcagaacuuucac

SEQ ID NO: 1395610 - RNA, 21 nt, Homo sapiens
agcagaugaccccuccccuaa

SEQ ID NO: 1395611 - RNA, 19 nt, Homo sapiens
agcagaugcaaagaggcaa

SEQ ID NO: 1395612 - RNA, 13 nt, Homo sapiens
agcagauuuaaca

SEQ ID NO: 1395613 - RNA, 22 nt, Homo sapiens
agcagcuaaaaccuacucacuu

SEQ ID NO: 1395614 - RNA, 15 nt, Homo sapiens
agcagcuaucucuca

SEQ ID NO: 1395615 - RNA, 15 nt, Homo sapiens
agcaggaaaccugug

SEQ ID NO: 1395616 - RNA, 15 nt, Homo sapiens
agcaggaagcucaga

SEQ ID NO: 1395617 - RNA, 22 nt, Homo sapiens
agcaggaagcugugagagcagu

SEQ ID NO: 1395618 - RNA, 19 nt, Homo sapiens
agcagggauuagguguuca

SEQ ID NO: 1395619 - RNA, 13 nt, Homo sapiens
agcaggguggccu

SEQ ID NO: 1395620 - RNA, 14 nt, Homo sapiens
agcagguggcagaa

SEQ ID NO: 1395621 - RNA, 14 nt, Homo sapiens
agcagucacuugau

SEQ ID NO: 1395622 - RNA, 22 nt, Homo sapiens
agcagugucuuccauaauguau

SEQ ID NO: 1395623 - RNA, 22 nt, Homo sapiens
agcagugugucuccugcaugca

SEQ ID NO: 1395624 - RNA, 14 nt, Homo sapiens
agcaguucugcaaa

SEQ ID NO: 1395625 - RNA, 23 nt, Homo sapiens
agcaguuugguuucuagcaugaa

SEQ ID NO: 1395626 - RNA, 14 nt, Homo sapiens
agcaucaccucagg

SEQ ID NO: 1395627 - RNA, 21 nt, Homo sapiens
agcaucacuugggauuaauau

SEQ ID NO: 1395628 - RNA, 14 nt, Homo sapiens
agcaugagugccgu

SEQ ID NO: 1395629 - RNA, 16 nt, Homo sapiens
agcaugcacaaagugu

SEQ ID NO: 1395630 - RNA, 20 nt, Homo sapiens
agcaugucucaauaguaaaa

SEQ ID NO: 1395631 - RNA, 16 nt, Homo sapiens
agcauguuacugacag

SEQ ID NO: 1395632 - RNA, 17 nt, Homo sapiens
agcauugagcaaagggg

SEQ ID NO: 1395633 - RNA, 16 nt, Homo sapiens
agcauuuagcacauac

SEQ ID NO: 1395634 - RNA, 14 nt, Homo sapiens
agccaaacccauga

SEQ ID NO: 1395635 - RNA, 16 nt, Homo sapiens
agccaaacucugccag

SEQ ID NO: 1395636 - RNA, 20 nt, Homo sapiens
agccaaagagaaugccauuc

SEQ ID NO: 1395637 - RNA, 18 nt, Homo sapiens
agccaaagauaaucucuc

SEQ ID NO: 1395638 - RNA, 19 nt, Homo sapiens
agccaaagauaaucucuca

SEQ ID NO: 1395639 - RNA, 23 nt, Homo sapiens
agccaagucagcuuugccuucca

SEQ ID NO: 1395640 - RNA, 15 nt, Homo sapiens
agccacaaccaaaaa

SEQ ID NO: 1395641 - RNA, 15 nt, Homo sapiens
agccacaacugcagu

SEQ ID NO: 1395642 - RNA, 13 nt, Homo sapiens
agccacacugugg

SEQ ID NO: 1395643 - RNA, 15 nt, Homo sapiens
agccacacuguggga

SEQ ID NO: 1395644 - RNA, 21 nt, Homo sapiens
agccacaugggaaacuuccaa

SEQ ID NO: 1395645 - RNA, 16 nt, Homo sapiens
agccacccucccagcu

SEQ ID NO: 1395646 - RNA, 14 nt, Homo sapiens
agccaccgcugcca

SEQ ID NO: 1395647 - RNA, 18 nt, Homo sapiens
agccacgugcucucugga

SEQ ID NO: 1395648 - RNA, 18 nt, Homo sapiens
agccacuggacugacgac

SEQ ID NO: 1395649 - RNA, 13 nt, Homo sapiens
agccagauucaaa

SEQ ID NO: 1395650 - RNA, 18 nt, Homo sapiens
agccagcagccagcucuc

SEQ ID NO: 1395651 - RNA, 16 nt, Homo sapiens
agccagccuugcuccu

SEQ ID NO: 1395652 - RNA, 14 nt, Homo sapiens
agccagggucucac

SEQ ID NO: 1395653 - RNA, 15 nt, Homo sapiens
agccagguaauguga

SEQ ID NO: 1395654 - RNA, 16 nt, Homo sapiens
agccagguaaugugaa

SEQ ID NO: 1395655 - RNA, 22 nt, Homo sapiens
agccagucuaguuccugaugac

SEQ ID NO: 1395656 - RNA, 16 nt, Homo sapiens
agccaucaaacacaau

SEQ ID NO: 1395657 - RNA, 20 nt, Homo sapiens
agccauggacucuacacugu

SEQ ID NO: 1395658 - RNA, 15 nt, Homo sapiens
agccauguaucucag

SEQ ID NO: 1395659 - RNA, 19 nt, Homo sapiens
agcccaagauaucagccca

SEQ ID NO: 1395660 - RNA, 19 nt, Homo sapiens
agcccaccccucaacaccu

SEQ ID NO: 1395661 - RNA, 18 nt, Homo sapiens
agcccagaauagcuuuga

SEQ ID NO: 1395662 - RNA, 14 nt, Homo sapiens
agccccacugcccu

SEQ ID NO: 1395663 - RNA, 15 nt, Homo sapiens
agccccaucagcucc

SEQ ID NO: 1395664 - RNA, 13 nt, Homo sapiens
agcccccucggug

SEQ ID NO: 1395665 - RNA, 23 nt, Homo sapiens
agccccggugugcggugcauaca

SEQ ID NO: 1395666 - RNA, 20 nt, Homo sapiens
agccccuccuaguucuucau

SEQ ID NO: 1395667 - RNA, 19 nt, Homo sapiens
agcccggaugcuucuccau

SEQ ID NO: 1395668 - RNA, 16 nt, Homo sapiens
agcccuaagacguccc

SEQ ID NO: 1395669 - RNA, 15 nt, Homo sapiens
agcccugagcuuucu

SEQ ID NO: 1395670 - RNA, 18 nt, Homo sapiens
agcccugcagucacagcu

SEQ ID NO: 1395671 - RNA, 16 nt, Homo sapiens
agcccuuagcagggaa

SEQ ID NO: 1395672 - RNA, 21 nt, Homo sapiens
agccgagaucacgccacugca

SEQ ID NO: 1395673 - RNA, 21 nt, Homo sapiens
agccgagaucgcgccacugca

SEQ ID NO: 1395674 - RNA, 23 nt, Homo sapiens
agccgagaucgcgccacugcacu

SEQ ID NO: 1395675 - RNA, 20 nt, Homo sapiens
agccgagauugcaccacugc

SEQ ID NO: 1395676 - RNA, 16 nt, Homo sapiens
agccgcuucugacugc

SEQ ID NO: 1395677 - RNA, 15 nt, Homo sapiens
agccuacagaugaac

SEQ ID NO: 1395678 - RNA, 16 nt, Homo sapiens
agccuagccgaccuca

SEQ ID NO: 1395679 - RNA, 18 nt, Homo sapiens
agccuagccgaccucagc

SEQ ID NO: 1395680 - RNA, 11 nt, Homo sapiens
agccuauggca

SEQ ID NO: 1395681 - RNA, 18 nt, Homo sapiens
agccucacugcaagcacu

SEQ ID NO: 1395682 - RNA, 19 nt, Homo sapiens
agccuccccaccuucuuca

SEQ ID NO: 1395683 - RNA, 14 nt, Homo sapiens
agccucgaacuccu

SEQ ID NO: 1395684 - RNA, 14 nt, Homo sapiens
agccucuccaggaa

SEQ ID NO: 1395685 - RNA, 20 nt, Homo sapiens
agccucugguaaccucuuac

SEQ ID NO: 1395686 - RNA, 19 nt, Homo sapiens
agccugaauuuuguugcug

SEQ ID NO: 1395687 - RNA, 21 nt, Homo sapiens
agccugagcagagacaugacu

SEQ ID NO: 1395688 - RNA, 19 nt, Homo sapiens
agccugcacuacucccuca

SEQ ID NO: 1395689 - RNA, 17 nt, Homo sapiens
agccuggccaacaugau

SEQ ID NO: 1395690 - RNA, 15 nt, Homo sapiens
agccuggugcugcug

SEQ ID NO: 1395691 - RNA, 14 nt, Homo sapiens
agccuuagaaguca

SEQ ID NO: 1395692 - RNA, 20 nt, Homo sapiens
agccuugacaauagaacauu

SEQ ID NO: 1395693 - RNA, 17 nt, Homo sapiens
agcgagagucugucuca

SEQ ID NO: 1395694 - RNA, 18 nt, Homo sapiens
agcgaugaauuuggagac

SEQ ID NO: 1395695 - RNA, 21 nt, Homo sapiens
agcggccacacuguacucugc

SEQ ID NO: 1395696 - RNA, 23 nt, Homo sapiens
agcuaaaaccuacucacuuagca

SEQ ID NO: 1395697 - RNA, 18 nt, Homo sapiens
agcuaagccacauggcug

SEQ ID NO: 1395698 - RNA, 20 nt, Homo sapiens
agcuaauaaaauaucauuca

SEQ ID NO: 1395699 - RNA, 16 nt, Homo sapiens
agcuaccucaaacuuc

SEQ ID NO: 1395700 - RNA, 21 nt, Homo sapiens
agcuaccucaaacuuccaguc

SEQ ID NO: 1395701 - RNA, 13 nt, Homo sapiens
agcuacuaaugau

SEQ ID NO: 1395702 - RNA, 21 nt, Homo sapiens
agcuagaagugggccaggaca

SEQ ID NO: 1395703 - RNA, 23 nt, Homo sapiens
agcuaucucucagugaacuguga

SEQ ID NO: 1395704 - RNA, 23 nt, Homo sapiens
agcuaugaaaacagcuaucucac

SEQ ID NO: 1395705 - RNA, 17 nt, Homo sapiens
agcuaugggagccccag

SEQ ID NO: 1395706 - RNA, 12 nt, Homo sapiens
agcucagguguc

SEQ ID NO: 1395707 - RNA, 19 nt, Homo sapiens
agcuccacacccucuccca

SEQ ID NO: 1395708 - RNA, 18 nt, Homo sapiens
agcuccacuuucagugaa

SEQ ID NO: 1395709 - RNA, 17 nt, Homo sapiens
agcuccagaagaacaaa

SEQ ID NO: 1395710 - RNA, 19 nt, Homo sapiens
agcucccagauuucagucu

SEQ ID NO: 1395711 - RNA, 23 nt, Homo sapiens
agcuccuucuguccuacucugug

SEQ ID NO: 1395712 - RNA, 16 nt, Homo sapiens
agcucgcauuugucaa

SEQ ID NO: 1395713 - RNA, 23 nt, Homo sapiens
agcucguucucugggccuucuca

SEQ ID NO: 1395714 - RNA, 18 nt, Homo sapiens
caccucugccucaaugug

SEQ ID NO: 1395715 - RNA, 20 nt, Homo sapiens
caccucugccucaaugugaa

SEQ ID NO: 1395716 - RNA, 17 nt, Homo sapiens
caccugaaugugucugc

SEQ ID NO: 1395717 - RNA, 15 nt, Homo sapiens
caccugaccaaucag

SEQ ID NO: 1395718 - RNA, 16 nt, Homo sapiens
caccugaccaaucaga

SEQ ID NO: 1395719 - RNA, 17 nt, Homo sapiens
caccugccaaaugaaua

SEQ ID NO: 1395720 - RNA, 18 nt, Homo sapiens
caccugccaaaugaauaa

SEQ ID NO: 1395721 - RNA, 16 nt, Homo sapiens
caccugccauuugcac

SEQ ID NO: 1395722 - RNA, 12 nt, Homo sapiens
caccugcugcug

SEQ ID NO: 1395723 - RNA, 13 nt, Homo sapiens
caccuugggauga

SEQ ID NO: 1395724 - RNA, 14 nt, Homo sapiens
caccuuuuaacuca

SEQ ID NO: 1395725 - RNA, 16 nt, Homo sapiens
cacgcuggagugcagu

SEQ ID NO: 1395726 - RNA, 18 nt, Homo sapiens
cacggaugacuuaacugc

SEQ ID NO: 1395727 - RNA, 18 nt, Homo sapiens
cacguggcuucugaugaa

SEQ ID NO: 1395728 - RNA, 17 nt, Homo sapiens
cacuaaacuucaugaau

SEQ ID NO: 1395729 - RNA, 20 nt, Homo sapiens
cacuacgugacuguggcaca

SEQ ID NO: 1395730 - RNA, 17 nt, Homo sapiens
cacuagucacauucuug

SEQ ID NO: 1395731 - RNA, 19 nt, Homo sapiens
cacuauaauguaagcucua

SEQ ID NO: 1395732 - RNA, 23 nt, Homo sapiens
cacuauagccuaggugacagagu

SEQ ID NO: 1395733 - RNA, 20 nt, Homo sapiens
cacucaacaaaagugcuuug

SEQ ID NO: 1395734 - RNA, 17 nt, Homo sapiens
cacucaagccaagcagc

SEQ ID NO: 1395735 - RNA, 22 nt, Homo sapiens
cacucagauggaaccgcaggaa

SEQ ID NO: 1395736 - RNA, 22 nt, Homo sapiens
cacuccaccacccaaaagucaa

SEQ ID NO: 1395737 - RNA, 17 nt, Homo sapiens
cacuccucccugaugua

SEQ ID NO: 1395738 - RNA, 13 nt, Homo sapiens
cacucuacccuau

SEQ ID NO: 1395739 - RNA, 20 nt, Homo sapiens
cacucucaaagcaaauaauu

SEQ ID NO: 1395740 - RNA, 14 nt, Homo sapiens
cacucugaauucca

SEQ ID NO: 1395741 - RNA, 13 nt, Homo sapiens
cacucuguuccug

SEQ ID NO: 1395742 - RNA, 21 nt, Homo sapiens
cacucuucugaauugacugua

SEQ ID NO: 1395743 - RNA, 19 nt, Homo sapiens
cacugaaacuucaagcacc

SEQ ID NO: 1395744 - RNA, 22 nt, Homo sapiens
cacugaaaugcuagcugcaagu

SEQ ID NO: 1395745 - RNA, 13 nt, Homo sapiens
cacugacuauuac

SEQ ID NO: 1395746 - RNA, 15 nt, Homo sapiens
cacugagcaaagcau

SEQ ID NO: 1395747 - RNA, 19 nt, Homo sapiens
cacugagcaaagcauugag

SEQ ID NO: 1395748 - RNA, 20 nt, Homo sapiens
cacugcacagugcaucucag

SEQ ID NO: 1395749 - RNA, 18 nt, Homo sapiens
cacugccauggaggcaca

SEQ ID NO: 1395750 - RNA, 19 nt, Homo sapiens
cacugcccucuguucagua

SEQ ID NO: 1395751 - RNA, 19 nt, Homo sapiens
cacuggagaucaccagugu

SEQ ID NO: 1395752 - RNA, 16 nt, Homo sapiens
cacuggaguccagucu

SEQ ID NO: 1395753 - RNA, 18 nt, Homo sapiens
cacuggcagcaucuucac

SEQ ID NO: 1395754 - RNA, 18 nt, Homo sapiens
cacugggccuccaaccau

SEQ ID NO: 1395755 - RNA, 20 nt, Homo sapiens
cacuguacucugcacuggug

SEQ ID NO: 1395756 - RNA, 20 nt, Homo sapiens
cacuguauauaaacauauca

SEQ ID NO: 1395757 - RNA, 15 nt, Homo sapiens
cacugugaaaccccc

SEQ ID NO: 1395758 - RNA, 21 nt, Homo sapiens
cacuguggcauugucuguaau

SEQ ID NO: 1395759 - RNA, 21 nt, Homo sapiens
cacugugucccucucucugga

SEQ ID NO: 1395760 - RNA, 15 nt, Homo sapiens
cacuguuucucucac

SEQ ID NO: 1395761 - RNA, 16 nt, Homo sapiens
cacuguuugcccagug

SEQ ID NO: 1395762 - RNA, 18 nt, Homo sapiens
cacuuaaaaaauguccau

SEQ ID NO: 1395763 - RNA, 17 nt, Homo sapiens
cacuuaucccaagagaa

SEQ ID NO: 1395764 - RNA, 17 nt, Homo sapiens
cacuucaaaacaguauu

SEQ ID NO: 1395765 - RNA, 17 nt, Homo sapiens
cacuucaggguucuccu

SEQ ID NO: 1395766 - RNA, 21 nt, Homo sapiens
cacuuccaccagccugcacua

SEQ ID NO: 1395767 - RNA, 16 nt, Homo sapiens
cacuucccuacaugga

SEQ ID NO: 1395768 - RNA, 12 nt, Homo sapiens
cacuucuuccau

SEQ ID NO: 1395769 - RNA, 18 nt, Homo sapiens
cacuugaaugugucacua

SEQ ID NO: 1395770 - RNA, 14 nt, Homo sapiens
cacuugcaguggaa

SEQ ID NO: 1395771 - RNA, 19 nt, Homo sapiens
cacuugggauugucuuacu

SEQ ID NO: 1395772 - RNA, 20 nt, Homo sapiens
cacuuucaggaacacucuga

SEQ ID NO: 1395773 - RNA, 17 nt, Homo sapiens
cacuuucauugccagug

SEQ ID NO: 1395774 - RNA, 21 nt, Homo sapiens
cacuuuccccgugggccaugg

SEQ ID NO: 1395775 - RNA, 19 nt, Homo sapiens
cacuuugggaggcugaggu

SEQ ID NO: 1395776 - RNA, 14 nt, Homo sapiens
cagaaaacaaaaaa

SEQ ID NO: 1395777 - RNA, 13 nt, Homo sapiens
cagaaaacuagaa

SEQ ID NO: 1395778 - RNA, 16 nt, Homo sapiens
cagaaaagcaccugcc

SEQ ID NO: 1395779 - RNA, 19 nt, Homo sapiens
cagaaaauuguacaaccug

SEQ ID NO: 1395780 - RNA, 20 nt, Homo sapiens
cagaaacuugugaaguggaa

SEQ ID NO: 1395781 - RNA, 19 nt, Homo sapiens
cagaaagaccgugugugaa

SEQ ID NO: 1395782 - RNA, 16 nt, Homo sapiens
cagaaagcauccuaaa

SEQ ID NO: 1395783 - RNA, 21 nt, Homo sapiens
cagaaagcuuugaauacuaaa

SEQ ID NO: 1395784 - RNA, 15 nt, Homo sapiens
cagaaaguuaugaaa

SEQ ID NO: 1395785 - RNA, 22 nt, Homo sapiens
cagaaauguuaguaacaagaaa

SEQ ID NO: 1395786 - RNA, 12 nt, Homo sapiens
cagaacacacuc

SEQ ID NO: 1395787 - RNA, 14 nt, Homo sapiens
cagaacacacucca

SEQ ID NO: 1395788 - RNA, 19 nt, Homo sapiens
cagaacacacuccaucagc

SEQ ID NO: 1395789 - RNA, 13 nt, Homo sapiens
cagaacacugucu

SEQ ID NO: 1395790 - RNA, 17 nt, Homo sapiens
cagaacccagauuuccu

SEQ ID NO: 1395791 - RNA, 22 nt, Homo sapiens
cagaaccuguccuugcacacuc

SEQ ID NO: 1395792 - RNA, 14 nt, Homo sapiens
cagaagcauuucac

SEQ ID NO: 1395793 - RNA, 12 nt, Homo sapiens
cagaagccucac

SEQ ID NO: 1395794 - RNA, 12 nt, Homo sapiens
cagaagcucucg

SEQ ID NO: 1395795 - RNA, 19 nt, Homo sapiens
cagaaggcaaaaagacauu

SEQ ID NO: 1395796 - RNA, 18 nt, Homo sapiens
cagaagggggccaugagg

SEQ ID NO: 1395797 - RNA, 15 nt, Homo sapiens
cagaagguugcucua

SEQ ID NO: 1395798 - RNA, 16 nt, Homo sapiens
cagaaguuugagauca

SEQ ID NO: 1395799 - RNA, 21 nt, Homo sapiens
cagaaguuugagaucagccug

SEQ ID NO: 1395800 - RNA, 22 nt, Homo sapiens
cagaaucagaucugagcuucau

SEQ ID NO: 1395801 - RNA, 18 nt, Homo sapiens
cagaaucccggcugucaa

SEQ ID NO: 1395802 - RNA, 15 nt, Homo sapiens
cagaauguacggaaa

SEQ ID NO: 1395803 - RNA, 19 nt, Homo sapiens
cagaauguguuauuuguca

SEQ ID NO: 1395804 - RNA, 17 nt, Homo sapiens
cagaauucuaagcuggu

SEQ ID NO: 1395805 - RNA, 13 nt, Homo sapiens
cagaauucuucag

SEQ ID NO: 1395806 - RNA, 16 nt, Homo sapiens
cagacaacagaaguca

SEQ ID NO: 1395807 - RNA, 19 nt, Homo sapiens
cagacacacacacacacaa

SEQ ID NO: 1395808 - RNA, 18 nt, Homo sapiens
cagacacaggcccggcuc

SEQ ID NO: 1395809 - RNA, 22 nt, Homo sapiens
cagaccacuauucuuaacuauu

SEQ ID NO: 1395810 - RNA, 17 nt, Homo sapiens
cagacgguucaccagcc

SEQ ID NO: 1395811 - RNA, 16 nt, Homo sapiens
cagacucagacuccau

SEQ ID NO: 1395812 - RNA, 16 nt, Homo sapiens
cagacucaguuuguca

SEQ ID NO: 1395813 - RNA, 14 nt, Homo sapiens
cagacuggagacaa

SEQ ID NO: 1395814 - RNA, 20 nt, Homo sapiens
cagacuggugggcuagccaa

SEQ ID NO: 1395815 - RNA, 20 nt, Homo sapiens
cagacuucccugaauguauu

SEQ ID NO: 1395816 - RNA, 14 nt, Homo sapiens
cagacuucuccaga

SEQ ID NO: 1395817 - RNA, 22 nt, Homo sapiens
cagagacacuaacgacuucagg

SEQ ID NO: 1395818 - RNA, 14 nt, Homo sapiens
cagagacuaucuga

SEQ ID NO: 1395819 - RNA, 16 nt, Homo sapiens
cagagacuaucugauu

SEQ ID NO: 1395820 - RNA, 17 nt, Homo sapiens
cagagagacagacuuga

SEQ ID NO: 1395821 - RNA, 21 nt, Homo sapiens
cagagagacagacuugagaac

SEQ ID NO: 1395822 - RNA, 23 nt, Homo sapiens
cagagaggacuguugacauccaa

SEQ ID NO: 1395823 - RNA, 16 nt, Homo sapiens
cagagauaaagaccuu

SEQ ID NO: 1395824 - RNA, 17 nt, Homo sapiens
cagagcucuggagccac

SEQ ID NO: 1395825 - RNA, 15 nt, Homo sapiens
cagagcuggaccagu

SEQ ID NO: 1395826 - RNA, 13 nt, Homo sapiens
cagagcuuccuua

SEQ ID NO: 1395827 - RNA, 20 nt, Homo sapiens
cagaggagggcgugacucac

SEQ ID NO: 1395828 - RNA, 15 nt, Homo sapiens
cagaggccauggcag

SEQ ID NO: 1395829 - RNA, 18 nt, Homo sapiens
cagagggaucuuguguac

SEQ ID NO: 1395830 - RNA, 15 nt, Homo sapiens
cagagggcccaggca

SEQ ID NO: 1395831 - RNA, 14 nt, Homo sapiens
cagaggggaaacca

SEQ ID NO: 1395832 - RNA, 11 nt, Homo sapiens
cagaggugcug

SEQ ID NO: 1395833 - RNA, 20 nt, Homo sapiens
cagagguugcagugagccga

SEQ ID NO: 1395834 - RNA, 20 nt, Homo sapiens
cagagguugcagugagcuga

SEQ ID NO: 1395835 - RNA, 16 nt, Homo sapiens
cagagucaaugaacuu

SEQ ID NO: 1395836 - RNA, 12 nt, Homo sapiens
cagaguccuaca

SEQ ID NO: 1395837 - RNA, 12 nt, Homo sapiens
cagagucucacu

SEQ ID NO: 1395838 - RNA, 13 nt, Homo sapiens
cagagugccccac

SEQ ID NO: 1395839 - RNA, 14 nt, Homo sapiens
cagaguuguugcuu

SEQ ID NO: 1395840 - RNA, 18 nt, Homo sapiens
cagauaaacaacaaauaa

SEQ ID NO: 1395841 - RNA, 18 nt, Homo sapiens
cagauagauauaugcucu

SEQ ID NO: 1395842 - RNA, 23 nt, Homo sapiens
cagauaucagaaucauugaagua

SEQ ID NO: 1395843 - RNA, 14 nt, Homo sapiens
cagaucaaauuuca

SEQ ID NO: 1395844 - RNA, 16 nt, Homo sapiens
cagaucacagcuucag

SEQ ID NO: 1395845 - RNA, 14 nt, Homo sapiens
cagaucccagcuca

SEQ ID NO: 1395846 - RNA, 14 nt, Homo sapiens
cagaugaaugggag

SEQ ID NO: 1395847 - RNA, 14 nt, Homo sapiens
cagaugagaguaca

SEQ ID NO: 1395848 - RNA, 20 nt, Homo sapiens
cagaugagaguacaccccaa

SEQ ID NO: 1395849 - RNA, 14 nt, Homo sapiens
cagaugcaccagcc

SEQ ID NO: 1395850 - RNA, 19 nt, Homo sapiens
cagaugccccagagcuguu

SEQ ID NO: 1395851 - RNA, 17 nt, Homo sapiens
cagauggaaaagggaga

SEQ ID NO: 1395852 - RNA, 17 nt, Homo sapiens
cagaugguuaaauauca

SEQ ID NO: 1395853 - RNA, 23 nt, Homo sapiens
cagauuccaggcgaugugcaagu

SEQ ID NO: 1395854 - RNA, 18 nt, Homo sapiens
cagauuccgcaccaauaa

SEQ ID NO: 1395855 - RNA, 19 nt, Homo sapiens
cagauuuuuccuuuaacau

SEQ ID NO: 1395856 - RNA, 16 nt, Homo sapiens
cagcaaaagaagacaa

SEQ ID NO: 1395857 - RNA, 21 nt, Homo sapiens
cagcaaaagaagacaacauuu

SEQ ID NO: 1395858 - RNA, 23 nt, Homo sapiens
cagcaaaagaagacaacauuucu

SEQ ID NO: 1395859 - RNA, 20 nt, Homo sapiens
cagcaacggggaggccaagu

SEQ ID NO: 1395860 - RNA, 15 nt, Homo sapiens
cagcacaguuuuuaa

SEQ ID NO: 1395861 - RNA, 17 nt, Homo sapiens
cagcacccucuccagau

SEQ ID NO: 1395862 - RNA, 20 nt, Homo sapiens
cagcagagccuggaagacac

SEQ ID NO: 1395863 - RNA, 21 nt, Homo sapiens
cagcagagccuggaagacacc

SEQ ID NO: 1395864 - RNA, 17 nt, Homo sapiens
cagcagaucccagcuca

SEQ ID NO: 1395865 - RNA, 18 nt, Homo sapiens
cagcagaucccagcucac

SEQ ID NO: 1395866 - RNA, 22 nt, Homo sapiens
cagcagaucccagcucacguca

SEQ ID NO: 1395867 - RNA, 15 nt, Homo sapiens
cagcaucugcuaaua

SEQ ID NO: 1395868 - RNA, 17 nt, Homo sapiens
cagcauucucacuccua

SEQ ID NO: 1395869 - RNA, 15 nt, Homo sapiens
cagccaacuuuugca

SEQ ID NO: 1395870 - RNA, 15 nt, Homo sapiens
cagccaauacaauua

SEQ ID NO: 1395871 - RNA, 13 nt, Homo sapiens
cagccacauucua

SEQ ID NO: 1395872 - RNA, 12 nt, Homo sapiens
cagccaccucuc

SEQ ID NO: 1395873 - RNA, 16 nt, Homo sapiens
cagccagguucugacu

SEQ ID NO: 1395874 - RNA, 16 nt, Homo sapiens
cagccccagugcccac

SEQ ID NO: 1395875 - RNA, 19 nt, Homo sapiens
cagcccugaggugaaaggg

SEQ ID NO: 1395876 - RNA, 14 nt, Homo sapiens
cagccgcagcugua

SEQ ID NO: 1395877 - RNA, 16 nt, Homo sapiens
cagccucauugauguc

SEQ ID NO: 1395878 - RNA, 19 nt, Homo sapiens
cagccucauugaugucaaa

SEQ ID NO: 1395879 - RNA, 22 nt, Homo sapiens
cagccuccagagaguaucugag

SEQ ID NO: 1395880 - RNA, 18 nt, Homo sapiens
cagccucccaaguagcug

SEQ ID NO: 1395881 - RNA, 19 nt, Homo sapiens
cagccucccgaguagcugg

SEQ ID NO: 1395882 - RNA, 20 nt, Homo sapiens
cagccucccgaguagcuggg

SEQ ID NO: 1395883 - RNA, 15 nt, Homo sapiens
cagccucugaaguug

SEQ ID NO: 1395884 - RNA, 16 nt, Homo sapiens
cagccugccuggagua

SEQ ID NO: 1395885 - RNA, 14 nt, Homo sapiens
cagccuggcaaggg

SEQ ID NO: 1395886 - RNA, 17 nt, Homo sapiens
cagccuggccaacaugg

SEQ ID NO: 1395887 - RNA, 21 nt, Homo sapiens
cagccuggccaacauggugaa

SEQ ID NO: 1395888 - RNA, 22 nt, Homo sapiens
cagccuggcgaaaccccaucuc

SEQ ID NO: 1395889 - RNA, 20 nt, Homo sapiens
cagccugggcaacacagcga

SEQ ID NO: 1395890 - RNA, 22 nt, Homo sapiens
cagccuggggggucguggcaga

SEQ ID NO: 1395891 - RNA, 19 nt, Homo sapiens
cagccugggugacagagca

SEQ ID NO: 1395892 - RNA, 20 nt, Homo sapiens
cagccugggugacagagcaa

SEQ ID NO: 1395893 - RNA, 17 nt, Homo sapiens
cagcgaaaggauguaaa

SEQ ID NO: 1395894 - RNA, 17 nt, Homo sapiens
cagcgaaugaaugcugu

SEQ ID NO: 1395895 - RNA, 18 nt, Homo sapiens
cagcgaccucggugggcc

SEQ ID NO: 1395896 - RNA, 21 nt, Homo sapiens
cagcgagcuaugaucgcgcca

SEQ ID NO: 1395897 - RNA, 17 nt, Homo sapiens
cagcgggacucuucuca

SEQ ID NO: 1395898 - RNA, 18 nt, Homo sapiens
cagcgggacucuucucau

SEQ ID NO: 1395899 - RNA, 14 nt, Homo sapiens
cagcuaaugggaca

SEQ ID NO: 1395900 - RNA, 22 nt, Homo sapiens
cagcuacccaggaggcugaggu

SEQ ID NO: 1395901 - RNA, 20 nt, Homo sapiens
cagcucaaaggcacagugaa

SEQ ID NO: 1395902 - RNA, 17 nt, Homo sapiens
cagcucccucugccuga

SEQ ID NO: 1395903 - RNA, 15 nt, Homo sapiens
cagcuccuucugucc

SEQ ID NO: 1395904 - RNA, 12 nt, Homo sapiens
cagcucuucucc

SEQ ID NO: 1395905 - RNA, 20 nt, Homo sapiens
cagcugaccuuugucaucuu

SEQ ID NO: 1395906 - RNA, 24 nt, Homo sapiens
cagcugacuuuucuguccgagcuu

SEQ ID NO: 1395907 - RNA, 19 nt, Homo sapiens
cagcugccuuggacugugu

SEQ ID NO: 1395908 - RNA, 15 nt, Homo sapiens
cagcuggaucuccau

SEQ ID NO: 1395909 - RNA, 13 nt, Homo sapiens
cagcuguggugag

SEQ ID NO: 1395910 - RNA, 14 nt, Homo sapiens
cagcuuccaaacau

SEQ ID NO: 1395911 - RNA, 17 nt, Homo sapiens
cagcuucucuccacuga

SEQ ID NO: 1395912 - RNA, 23 nt, Homo sapiens
caggaaaauuguuugaacccagg

SEQ ID NO: 1395913 - RNA, 16 nt, Homo sapiens
caggaagccgugcccu

SEQ ID NO: 1395914 - RNA, 20 nt, Homo sapiens
caggaagcugugagagcagu

SEQ ID NO: 1395915 - RNA, 21 nt, Homo sapiens
caggacacggggcaguggcaa

SEQ ID NO: 1395916 - RNA, 17 nt, Homo sapiens
caggacagcauggugca

SEQ ID NO: 1395917 - RNA, 20 nt, Homo sapiens
caggacuuccauuugcuuug

SEQ ID NO: 1395918 - RNA, 17 nt, Homo sapiens
caggacuuggucugauu

SEQ ID NO: 1395919 - RNA, 13 nt, Homo sapiens
caggagaaucacu

SEQ ID NO: 1395920 - RNA, 10 nt, Homo sapiens
caggagcuca

SEQ ID NO: 1395921 - RNA, 11 nt, Homo sapiens
caggagcucag

SEQ ID NO: 1395922 - RNA, 12 nt, Homo sapiens
caggagcucaga

SEQ ID NO: 1395923 - RNA, 19 nt, Homo sapiens
caggagcugggauccuaag

SEQ ID NO: 1395924 - RNA, 20 nt, Homo sapiens
caggaggcagagguugcagu

SEQ ID NO: 1395925 - RNA, 18 nt, Homo sapiens
caggaggcuuggaaagca

SEQ ID NO: 1395926 - RNA, 19 nt, Homo sapiens
caggagguaaagaaauagc

SEQ ID NO: 1395927 - RNA, 13 nt, Homo sapiens
caggaguacaccc

SEQ ID NO: 1395928 - RNA, 14 nt, Homo sapiens
caggagucugucuc

SEQ ID NO: 1395929 - RNA, 18 nt, Homo sapiens
caggaguuacuggauuug

SEQ ID NO: 1395930 - RNA, 17 nt, Homo sapiens
caggaguuagaggccag

SEQ ID NO: 1395931 - RNA, 19 nt, Homo sapiens
caggaguucaagaccagcc

SEQ ID NO: 1395932 - RNA, 18 nt, Homo sapiens
caggaguuggaagugugu

SEQ ID NO: 1395933 - RNA, 23 nt, Homo sapiens
caggaguuggaagugugugaucu

SEQ ID NO: 1395934 - RNA, 23 nt, Homo sapiens
ccacugauggaaacaaaguggaa

SEQ ID NO: 1395935 - RNA, 15 nt, Homo sapiens
ccacugccaaagaac

SEQ ID NO: 1395936 - RNA, 16 nt, Homo sapiens
ccacuucuaaauagca

SEQ ID NO: 1395937 - RNA, 13 nt, Homo sapiens
ccacuucuuucag

SEQ ID NO: 1395938 - RNA, 15 nt, Homo sapiens
ccacuuugauaccau

SEQ ID NO: 1395939 - RNA, 14 nt, Homo sapiens
cccagaauagcuuu

SEQ ID NO: 1395940 - RNA, 22 nt, Homo sapiens
cccagaccuuuuauccacuuac

SEQ ID NO: 1395941 - RNA, 12 nt, Homo sapiens
cccagauuuccu

SEQ ID NO: 1395942 - RNA, 19 nt, Homo sapiens
cccagauuugaagacaaaa

SEQ ID NO: 1395943 - RNA, 13 nt, Homo sapiens
cccagcacuuugg

SEQ ID NO: 1395944 - RNA, 16 nt, Homo sapiens
ccggggcuccacugaa

SEQ ID NO: 1395945 - RNA, 17 nt, Homo sapiens
ccgguucuuaaauccau

SEQ ID NO: 1395946 - RNA, 17 nt, Homo sapiens
ccguaacaacugugguc

SEQ ID NO: 1395947 - RNA, 18 nt, Homo sapiens
ccguaacaacugugguca

SEQ ID NO: 1395948 - RNA, 23 nt, Homo sapiens
ccgucagccaaauguaauugaau

SEQ ID NO: 1395949 - RNA, 13 nt, Homo sapiens
ccgugaccaucuu

SEQ ID NO: 1395950 - RNA, 15 nt, Homo sapiens
gcaaaaauauaccuu

SEQ ID NO: 1395951 - RNA, 23 nt, Homo sapiens
gcaaaaccaaauauuccagagac

SEQ ID NO: 1395952 - RNA, 15 nt, Homo sapiens
gcaaaacuacaaugu

SEQ ID NO: 1395953 - RNA, 14 nt, Homo sapiens
gcaaagacaggagg

SEQ ID NO: 1395954 - RNA, 16 nt, Homo sapiens
gcaaagacuuuccucu

SEQ ID NO: 1395955 - RNA, 18 nt, Homo sapiens
gcaaagggagcacugggu

SEQ ID NO: 1395956 - RNA, 17 nt, Homo sapiens
gcaaagguaauaauaca

SEQ ID NO: 1395957 - RNA, 23 nt, Homo sapiens
gcaaaugcuguauucuucuuugg

SEQ ID NO: 1395958 - RNA, 16 nt, Homo sapiens
gcaaauguaauauaau

SEQ ID NO: 1395959 - RNA, 20 nt, Homo sapiens
gcaaauucccagauuugaag

SEQ ID NO: 1395960 - RNA, 14 nt, Homo sapiens
gcaaauuugauaca

SEQ ID NO: 1395961 - RNA, 23 nt, Homo sapiens
gcaacacaggauggucucugcca

SEQ ID NO: 1395962 - RNA, 20 nt, Homo sapiens
gcaaccagaccauugucuca

SEQ ID NO: 1395963 - RNA, 16 nt, Homo sapiens
gcaacggggaggccaa

SEQ ID NO: 1395964 - RNA, 23 nt, Homo sapiens
ccuguaccacaaacacauuacau

SEQ ID NO: 1395965 - RNA, 18 nt, Homo sapiens
ccuguagacuagugccgu

SEQ ID NO: 1395966 - RNA, 21 nt, Homo sapiens
ccuguagaugacauggugaaa

SEQ ID NO: 1395967 - RNA, 17 nt, Homo sapiens
ccuguagguucuugaua

SEQ ID NO: 1395968 - RNA, 22 nt, Homo sapiens
ccuguagucccagcuacuugag

SEQ ID NO: 1395969 - RNA, 17 nt, Homo sapiens
ggugaggggcuggcacu

SEQ ID NO: 1395970 - RNA, 14 nt, Homo sapiens
ggugaucugggauu

SEQ ID NO: 1395971 - RNA, 14 nt, Homo sapiens
ggugcaaaucaaug

SEQ ID NO: 1395972 - RNA, 21 nt, Homo sapiens
ggugcguguuuccugugcaag

SEQ ID NO: 1395973 - RNA, 15 nt, Homo sapiens
ggugcugccccauga

SEQ ID NO: 1395974 - RNA, 12 nt, Homo sapiens
gguggaaggccu

SEQ ID NO: 1395975 - RNA, 17 nt, Homo sapiens
gguggcccuugcaguuc

SEQ ID NO: 1395976 - RNA, 17 nt, Homo sapiens
gguggcucacgccugua

SEQ ID NO: 1395977 - RNA, 23 nt, Homo sapiens
gguggguaagacuaaaucuguaa

SEQ ID NO: 1395978 - RNA, 22 nt, Homo sapiens
ggugguuuuugagccaugcgug

SEQ ID NO: 1395979 - RNA, 15 nt, Homo sapiens
ggugugaaagucaga

SEQ ID NO: 1395980 - RNA, 13 nt, Homo sapiens
gguguugacaugu

SEQ ID NO: 1395981 - RNA, 16 nt, Homo sapiens
gguuaacuauguacaa

SEQ ID NO: 1395982 - RNA, 19 nt, Homo sapiens
gguuaauaaguuucacuga

SEQ ID NO: 1395983 - RNA, 15 nt, Homo sapiens
gguuauagacugcca

SEQ ID NO: 1395984 - RNA, 16 nt, Homo sapiens
gguugacuuaugggcc

SEQ ID NO: 1395985 - RNA, 22 nt, Homo sapiens
gguuggaaaacaguauuuucca

SEQ ID NO: 1395986 - RNA, 12 nt, Homo sapiens
gguuucauucug

SEQ ID NO: 1395987 - RNA, 15 nt, Homo sapiens
gguuuccuuccuugg

SEQ ID NO: 1395988 - RNA, 17 nt, Homo sapiens
gguuucuccagagggaa

SEQ ID NO: 1395989 - RNA, 17 nt, Homo sapiens
gguuuguugcagccaaa

SEQ ID NO: 1395990 - RNA, 18 nt, Homo sapiens
gguuuuuguuaccuuuau

SEQ ID NO: 1395991 - RNA, 12 nt, Homo sapiens
guaaaacaugcu

SEQ ID NO: 1395992 - RNA, 18 nt, Homo sapiens
guaaaacaugcuggugaa

SEQ ID NO: 1395993 - RNA, 15 nt, Homo sapiens
guaaaacuauauucu

SEQ ID NO: 1395994 - RNA, 17 nt, Homo sapiens
guaaaacuauauucuca

SEQ ID NO: 1395995 - RNA, 19 nt, Homo sapiens
guaaaacuuagcaacuugg

SEQ ID NO: 1395996 - RNA, 12 nt, Homo sapiens
guaaaagccauc

SEQ ID NO: 1395997 - RNA, 13 nt, Homo sapiens
guaaaauauuuau

SEQ ID NO: 1395998 - RNA, 13 nt, Homo sapiens
guaaacauaauuc

SEQ ID NO: 1395999 - RNA, 20 nt, Homo sapiens
guaaacauauuggaauguac

SEQ ID NO: 1396000 - RNA, 17 nt, Homo sapiens
guaaacauuaguucuau

SEQ ID NO: 1396001 - RNA, 19 nt, Homo sapiens
guaaagaauuuagcuguau

SEQ ID NO: 1396002 - RNA, 19 nt, Homo sapiens
guaaauauagcucagguag

SEQ ID NO: 1396003 - RNA, 18 nt, Homo sapiens
guaacaacuguggucaau

SEQ ID NO: 1396004 - RNA, 21 nt, Homo sapiens
guaacaagagugauucuugcu

SEQ ID NO: 1396005 - RNA, 20 nt, Homo sapiens
guaaccucuacuaugaagug

SEQ ID NO: 1396006 - RNA, 19 nt, Homo sapiens
guaacuauuacaccaaaua

SEQ ID NO: 1396007 - RNA, 16 nt, Homo sapiens
guaacuccaccaaccc

SEQ ID NO: 1396008 - RNA, 19 nt, Homo sapiens
guaacuccagcucugcucc

SEQ ID NO: 1396009 - RNA, 17 nt, Homo sapiens
guaacuugguuauacau

SEQ ID NO: 1396010 - RNA, 18 nt, Homo sapiens
guaagacuaaaucuguaa

SEQ ID NO: 1396011 - RNA, 18 nt, Homo sapiens
guaagagcuggugucuga

SEQ ID NO: 1396012 - RNA, 22 nt, Homo sapiens
guaagcucuacugaggugcuau

SEQ ID NO: 1396013 - RNA, 21 nt, Homo sapiens
guaagcucuuugaaacaacuu

SEQ ID NO: 1396014 - RNA, 21 nt, Homo sapiens
guaauaaguaucacacuguau

SEQ ID NO: 1396015 - RNA, 21 nt, Homo sapiens
guaauaauacagccaaagaua

SEQ ID NO: 1396016 - RNA, 15 nt, Homo sapiens
guaaugucaccaccu

SEQ ID NO: 1396017 - RNA, 20 nt, Homo sapiens
guaauguuuuauacuguuua

SEQ ID NO: 1396018 - RNA, 18 nt, Homo sapiens
guaauuuuguaucuugau

SEQ ID NO: 1396019 - RNA, 16 nt, Homo sapiens
guacaaccugugauca

SEQ ID NO: 1396020 - RNA, 18 nt, Homo sapiens
guacaaggcaacauauag

SEQ ID NO: 1396021 - RNA, 15 nt, Homo sapiens
guacagaagagacag

SEQ ID NO: 1396022 - RNA, 17 nt, Homo sapiens
guacagaauucugcuac

SEQ ID NO: 1396023 - RNA, 16 nt, Homo sapiens
guacagagaaggaaug

SEQ ID NO: 1396024 - RNA, 20 nt, Homo sapiens
guaccccagcucugcuugcc

SEQ ID NO: 1396025 - RNA, 14 nt, Homo sapiens
guacccuucaccca

SEQ ID NO: 1396026 - RNA, 18 nt, Homo sapiens
guacguggagagggauga

SEQ ID NO: 1396027 - RNA, 20 nt, Homo sapiens
guacuccagccugggugaca

SEQ ID NO: 1396028 - RNA, 22 nt, Homo sapiens
guacuuugaagaugucauccca

SEQ ID NO: 1396029 - RNA, 17 nt, Homo sapiens
guagacuagugccguag

SEQ ID NO: 1396030 - RNA, 22 nt, Homo sapiens
guagagggaguugucaagucuc

SEQ ID NO: 1396031 - RNA, 14 nt, Homo sapiens
guagauaacagauu

SEQ ID NO: 1396032 - RNA, 15 nt, Homo sapiens
guagauacuagcuau

SEQ ID NO: 1396033 - RNA, 20 nt, Homo sapiens
guagcuaagugaaaagguca

SEQ ID NO: 1396034 - RNA, 14 nt, Homo sapiens
guaggguugccaga

SEQ ID NO: 1396035 - RNA, 14 nt, Homo sapiens
guagguucuugaua

SEQ ID NO: 1396036 - RNA, 22 nt, Homo sapiens
guagugggugccuguaauccca

SEQ ID NO: 1396037 - RNA, 21 nt, Homo sapiens
guauaaaggcuaaaagggaaa

SEQ ID NO: 1396038 - RNA, 18 nt, Homo sapiens
guauaaugguugacuggg

SEQ ID NO: 1396039 - RNA, 16 nt, Homo sapiens
guauaauuuaacuuca

SEQ ID NO: 1396040 - RNA, 20 nt, Homo sapiens
guauacccuguccuuucuca

SEQ ID NO: 1396041 - RNA, 13 nt, Homo sapiens
guauaugcaauau

SEQ ID NO: 1396042 - RNA, 10 nt, Homo sapiens
guauaugcac

SEQ ID NO: 1396043 - RNA, 20 nt, Homo sapiens
guauauucaaccaaauacuu

SEQ ID NO: 1396044 - RNA, 17 nt, Homo sapiens
guauauuucccuguuuc

SEQ ID NO: 1396045 - RNA, 23 nt, Homo sapiens
guaucaaguggcaugugcuguga

SEQ ID NO: 1396046 - RNA, 16 nt, Homo sapiens
guaucaggugcugcca

SEQ ID NO: 1396047 - RNA, 22 nt, Homo sapiens
guauccuuguugacacggccau

SEQ ID NO: 1396048 - RNA, 20 nt, Homo sapiens
guaucucuuuugaauccaug

SEQ ID NO: 1396049 - RNA, 21 nt, Homo sapiens
guaucucuuuugaauccaugc

SEQ ID NO: 1396050 - RNA, 23 nt, Homo sapiens
guaugacucccaaauuuucacau

SEQ ID NO: 1396051 - RNA, 19 nt, Homo sapiens
guaugauccuaaugaaugc

SEQ ID NO: 1396052 - RNA, 18 nt, Homo sapiens
guauggaauacaguguua

SEQ ID NO: 1396053 - RNA, 17 nt, Homo sapiens
guauguacuaagcagua

SEQ ID NO: 1396054 - RNA, 18 nt, Homo sapiens
guaugugcgugugugcaa

SEQ ID NO: 1396055 - RNA, 20 nt, Homo sapiens
guauuaggugucauuuccau

SEQ ID NO: 1396056 - RNA, 20 nt, Homo sapiens
guauucacgugcagcagcaa

SEQ ID NO: 1396057 - RNA, 19 nt, Homo sapiens
guauucccaccccuggacu

SEQ ID NO: 1396058 - RNA, 23 nt, Homo sapiens
guauuccuagaaacugacacaug

SEQ ID NO: 1396059 - RNA, 16 nt, Homo sapiens
guauucuacagcagau

SEQ ID NO: 1396060 - RNA, 20 nt, Homo sapiens
guauucuacagcagauacuu

SEQ ID NO: 1396061 - RNA, 18 nt, Homo sapiens
guauucugcugaugcuac

SEQ ID NO: 1396062 - RNA, 14 nt, Homo sapiens
guauuggcaaagau

SEQ ID NO: 1396063 - RNA, 13 nt, Homo sapiens
guauugugcauag

SEQ ID NO: 1396064 - RNA, 19 nt, Homo sapiens
guauuuccagugcaauugu

SEQ ID NO: 1396065 - RNA, 13 nt, Homo sapiens
guggcccagagaa

SEQ ID NO: 1396066 - RNA, 21 nt, Homo sapiens
gugggagcuugauucucagca

SEQ ID NO: 1396067 - RNA, 17 nt, Homo sapiens
gugggcaaacaggcagu

SEQ ID NO: 1396068 - RNA, 22 nt, Homo sapiens
gugggcuaagcacgggccauau

SEQ ID NO: 1396069 - RNA, 15 nt, Homo sapiens
guggggauuggggga

SEQ ID NO: 1396070 - RNA, 15 nt, Homo sapiens
guggguuuugaacau

SEQ ID NO: 1396071 - RNA, 17 nt, Homo sapiens
guggucugagccaaaga

SEQ ID NO: 1396072 - RNA, 23 nt, Homo sapiens
guggugagccgagauugcaccau

SEQ ID NO: 1396073 - RNA, 23 nt, Homo sapiens
gugguggcauacgccuguagucc

SEQ ID NO: 1396074 - RNA, 14 nt, Homo sapiens
guguaaguaauuau

SEQ ID NO: 1396075 - RNA, 13 nt, Homo sapiens
guguaccagagaa

SEQ ID NO: 1396076 - RNA, 20 nt, Homo sapiens
guguacguggagagggauga

SEQ ID NO: 1396077 - RNA, 20 nt, Homo sapiens
guguagaaaagaacuggaaa

SEQ ID NO: 1396078 - RNA, 18 nt, Homo sapiens
guguauaaauaguaacuu

SEQ ID NO: 1396079 - RNA, 23 nt, Homo sapiens
guguaucggaugcuuuuguucag

SEQ ID NO: 1396080 - RNA, 23 nt, Homo sapiens
guguauuuaaccuugaaggguuc

SEQ ID NO: 1396081 - RNA, 23 nt, Homo sapiens
gugucauuuggcuuuccagucau

SEQ ID NO: 1396082 - RNA, 15 nt, Homo sapiens
gugugagugugugca

SEQ ID NO: 1396083 - RNA, 17 nt, Homo sapiens
gugugcaagugugugca

SEQ ID NO: 1396084 - RNA, 21 nt, Homo sapiens
gugugcaugugugugcucagg

SEQ ID NO: 1396085 - RNA, 14 nt, Homo sapiens
gugugcgugcaugu

SEQ ID NO: 1396086 - RNA, 22 nt, Homo sapiens
gugugguugcucacagcuguaa

SEQ ID NO: 1396087 - RNA, 20 nt, Homo sapiens
gugugugcaaguaugugagu

SEQ ID NO: 1396088 - RNA, 22 nt, Homo sapiens
gugugugcacguacacacacau

SEQ ID NO: 1396089 - RNA, 17 nt, Homo sapiens
guguucugauuagaaau

SEQ ID NO: 1396090 - RNA, 21 nt, Homo sapiens
guguugccccuauuagcucuu

SEQ ID NO: 1396091 - RNA, 14 nt, Homo sapiens
guguuuccaaugau

SEQ ID NO: 1396092 - RNA, 18 nt, Homo sapiens
guguuuuaaaacauucac

SEQ ID NO: 1396093 - RNA, 20 nt, Homo sapiens
guuaaaaguuguguuuugaa

SEQ ID NO: 1396094 - RNA, 14 nt, Homo sapiens
guuaaagugaauaa

SEQ ID NO: 1396095 - RNA, 19 nt, Homo sapiens
guuaaauaucacaucacuu

SEQ ID NO: 1396096 - RNA, 19 nt, Homo sapiens
guuaaggggagcaacagag

SEQ ID NO: 1396097 - RNA, 13 nt, Homo sapiens
guuaauaaagaag

SEQ ID NO: 1396098 - RNA, 15 nt, Homo sapiens
guuaccaacuaccua

SEQ ID NO: 1396099 - RNA, 19 nt, Homo sapiens
guuacuggauuuguuguuc

SEQ ID NO: 1396100 - RNA, 22 nt, Homo sapiens
guuagaagcaaugaauguauau

SEQ ID NO: 1396101 - RNA, 23 nt, Homo sapiens
guuaggaaaauuucacauuaaua

SEQ ID NO: 1396102 - RNA, 17 nt, Homo sapiens
guuauaaaucaauguca

SEQ ID NO: 1396103 - RNA, 23 nt, Homo sapiens
guuauaaaucaaugucacuuaaa

SEQ ID NO: 1396104 - RNA, 13 nt, Homo sapiens
guuauacaaccau

SEQ ID NO: 1396105 - RNA, 14 nt, Homo sapiens
guuauagacugcca

SEQ ID NO: 1396106 - RNA, 19 nt, Homo sapiens
guuauagauauguagauaa

SEQ ID NO: 1396107 - RNA, 19 nt, Homo sapiens
guuauuaauuaauauucau

SEQ ID NO: 1396108 - RNA, 19 nt, Homo sapiens
guuauuacagggcauucaa

SEQ ID NO: 1396109 - RNA, 17 nt, Homo sapiens
guuauuauauaauuaca

SEQ ID NO: 1396110 - RNA, 12 nt, Homo sapiens
guucaccagccu

SEQ ID NO: 1396111 - RNA, 23 nt, Homo sapiens
guucaccuugggaugaugccuca

SEQ ID NO: 1396112 - RNA, 17 nt, Homo sapiens
guucagcauucuuagcc

SEQ ID NO: 1396113 - RNA, 20 nt, Homo sapiens
guucagcuccuuccaccaca

SEQ ID NO: 1396114 - RNA, 20 nt, Homo sapiens
guucaggagucccaaggaaa

SEQ ID NO: 1396115 - RNA, 16 nt, Homo sapiens
guucagguaacaggca

SEQ ID NO: 1396116 - RNA, 18 nt, Homo sapiens
guucauuugugugcucau

SEQ ID NO: 1396117 - RNA, 20 nt, Homo sapiens
guuccccacugacagccucc

SEQ ID NO: 1396118 - RNA, 16 nt, Homo sapiens
guucccuuggccucag

SEQ ID NO: 1396119 - RNA, 22 nt, Homo sapiens
guucccuuggccucagaauuca

SEQ ID NO: 1396120 - RNA, 12 nt, Homo sapiens
guuccucaaaag

SEQ ID NO: 1396121 - RNA, 17 nt, Homo sapiens
guuccugaugacccagg

SEQ ID NO: 1396122 - RNA, 22 nt, Homo sapiens
guucucaaauauuugcuaugaa

SEQ ID NO: 1396123 - RNA, 21 nt, Homo sapiens
guucucauuuuuaucccauug

SEQ ID NO: 1396124 - RNA, 22 nt, Homo sapiens
guucucauuuuuaucccauuga

SEQ ID NO: 1396125 - RNA, 17 nt, Homo sapiens
guucucuauugcugcuc

SEQ ID NO: 1396126 - RNA, 16 nt, Homo sapiens
guucugggugcagcug

SEQ ID NO: 1396127 - RNA, 11 nt, Homo sapiens
guucuuaccug

SEQ ID NO: 1396128 - RNA, 13 nt, Homo sapiens
guugaaaagccau

SEQ ID NO: 1396129 - RNA, 14 nt, Homo sapiens
guugaaaagccaug

SEQ ID NO: 1396130 - RNA, 18 nt, Homo sapiens
guugaaccguuucuuuaa

SEQ ID NO: 1396131 - RNA, 16 nt, Homo sapiens
guugaagcucugguga

SEQ ID NO: 1396132 - RNA, 16 nt, Homo sapiens
guugaauuucccacau

SEQ ID NO: 1396133 - RNA, 23 nt, Homo sapiens
guugaauuucccacauacccucc

SEQ ID NO: 1396134 - RNA, 18 nt, Homo sapiens
guugaggggcuccuggaa

SEQ ID NO: 1396135 - RNA, 14 nt, Homo sapiens
guugaugccagaca

SEQ ID NO: 1396136 - RNA, 20 nt, Homo sapiens
guugcaaauacauggauaac

SEQ ID NO: 1396137 - RNA, 16 nt, Homo sapiens
guugcaucauguugaa

SEQ ID NO: 1396138 - RNA, 17 nt, Homo sapiens
guugccaugugugcuga

SEQ ID NO: 1396139 - RNA, 15 nt, Homo sapiens
guugcuggacuguca

SEQ ID NO: 1396140 - RNA, 16 nt, Homo sapiens
guugcuggacugucau

SEQ ID NO: 1396141 - RNA, 15 nt, Homo sapiens
guugcuuuuuuucca

SEQ ID NO: 1396142 - RNA, 16 nt, Homo sapiens
guuggaaccacggaga

SEQ ID NO: 1396143 - RNA, 20 nt, Homo sapiens
guuggaagugagggucagag

SEQ ID NO: 1396144 - RNA, 14 nt, Homo sapiens
guuggcacaugccu

SEQ ID NO: 1396145 - RNA, 22 nt, Homo sapiens
guuggccagugugacaaggauu

SEQ ID NO: 1396146 - RNA, 23 nt, Homo sapiens
guuggcccagaccucaggugcua

SEQ ID NO: 1396147 - RNA, 18 nt, Homo sapiens
guuggccuaacacugggc

SEQ ID NO: 1396148 - RNA, 20 nt, Homo sapiens
guuuaaaagccaucaaacac

SEQ ID NO: 1396149 - RNA, 21 nt, Homo sapiens
guuuacuucucaccauuugag

SEQ ID NO: 1396150 - RNA, 17 nt, Homo sapiens
guuuaguugcagacuca

SEQ ID NO: 1396151 - RNA, 14 nt, Homo sapiens
guuuaugagccaga

SEQ ID NO: 1396152 - RNA, 19 nt, Homo sapiens
guuuauucaacaacuacua

SEQ ID NO: 1396153 - RNA, 18 nt, Homo sapiens
guuuauuuacaagggaag

SEQ ID NO: 1396154 - RNA, 19 nt, Homo sapiens
guuuauuuaucagugacag

SEQ ID NO: 1396155 - RNA, 14 nt, Homo sapiens
guuuauuugcacua

SEQ ID NO: 1396156 - RNA, 15 nt, Homo sapiens
guuuauuugcacuau

SEQ ID NO: 1396157 - RNA, 17 nt, Homo sapiens
guuucaaaaaaucugac

SEQ ID NO: 1396158 - RNA, 19 nt, Homo sapiens
guuucaccauguuagccag

SEQ ID NO: 1396159 - RNA, 17 nt, Homo sapiens
guuucccauaauuuucu

SEQ ID NO: 1396160 - RNA, 17 nt, Homo sapiens
guuuccccaccagugaa

SEQ ID NO: 1396161 - RNA, 19 nt, Homo sapiens
guuuccucaaacugugauu

SEQ ID NO: 1396162 - RNA, 17 nt, Homo sapiens
guuucuccagagggaau

SEQ ID NO: 1396163 - RNA, 21 nt, Homo sapiens
guuucuccagagggaauugca

SEQ ID NO: 1396164 - RNA, 18 nt, Homo sapiens
guuucugauuaaugcuaa

SEQ ID NO: 1396165 - RNA, 23 nt, Homo sapiens
guuucugccuucuccaugcugag

SEQ ID NO: 1396166 - RNA, 22 nt, Homo sapiens
guuucuucaaucugaagauaca

SEQ ID NO: 1396167 - RNA, 11 nt, Homo sapiens
guuucuuccaa

SEQ ID NO: 1396168 - RNA, 22 nt, Homo sapiens
guuugaagaugccgcauuugga

SEQ ID NO: 1396169 - RNA, 18 nt, Homo sapiens
guuugaccucauuuguaa

SEQ ID NO: 1396170 - RNA, 18 nt, Homo sapiens
guuugcagaaaagcaccu

SEQ ID NO: 1396171 - RNA, 13 nt, Homo sapiens
guuuggggagcag

SEQ ID NO: 1396172 - RNA, 16 nt, Homo sapiens
guuuggugaacuauau

SEQ ID NO: 1396173 - RNA, 14 nt, Homo sapiens
guuuguaaauaaga

SEQ ID NO: 1396174 - RNA, 17 nt, Homo sapiens
guuuguaagguggucac

SEQ ID NO: 1396175 - RNA, 15 nt, Homo sapiens
guuuguauugugauu

SEQ ID NO: 1396176 - RNA, 16 nt, Homo sapiens
guuugucagacuuuaa

SEQ ID NO: 1396177 - RNA, 18 nt, Homo sapiens
guuuuacuguccaaagac

SEQ ID NO: 1396178 - RNA, 19 nt, Homo sapiens
guuuuccugaaauccucaa

SEQ ID NO: 1396179 - RNA, 16 nt, Homo sapiens
guuuugaaaugcagaa

SEQ ID NO: 1396180 - RNA, 13 nt, Homo sapiens
guuuugacaucaa

SEQ ID NO: 1396181 - RNA, 23 nt, Homo sapiens
guuuuggaagcucugaagucaca

SEQ ID NO: 1396182 - RNA, 19 nt, Homo sapiens
guuuuggggacucauuuca

SEQ ID NO: 1396183 - RNA, 23 nt, Homo sapiens
guuuuguagagauggggucucac

SEQ ID NO: 1396184 - RNA, 13 nt, Homo sapiens
guuuuguuucauc

SEQ ID NO: 1396185 - RNA, 16 nt, Homo sapiens
guuuuguuugaaaaag

SEQ ID NO: 1396186 - RNA, 19 nt, Homo sapiens
guuuuuaaaaaacugcuga

SEQ ID NO: 1396187 - RNA, 20 nt, Homo sapiens
guuuuuaugaggugggauau

SEQ ID NO: 1396188 - RNA, 22 nt, Homo sapiens
guuuuucuucaacaucaauguu

SEQ ID NO: 1396189 - RNA, 19 nt, Homo sapiens
guuuuucuuguuguuauuc

SEQ ID NO: 1396190 - RNA, 13 nt, Homo sapiens
guuuuugagccau

SEQ ID NO: 1396191 - RNA, 23 nt, Homo sapiens
guuuuuggaauuaugucugcuga

SEQ ID NO: 1396192 - RNA, 13 nt, Homo sapiens
guuuuuucacuau

SEQ ID NO: 1396193 - RNA, 20 nt, Homo sapiens
guuuuuucaucauaacauaa

SEQ ID NO: 1396194 - RNA, 16 nt, Homo sapiens
guuuuuugccauguua

SEQ ID NO: 1396195 - RNA, 23 nt, Homo sapiens
uaaaaaaaaaaaaaacauugugu

SEQ ID NO: 1396196 - RNA, 19 nt, Homo sapiens
uaaaaaaauaaaaaagauc

SEQ ID NO: 1396197 - RNA, 19 nt, Homo sapiens
uaaaaaaauacaugcaucu

SEQ ID NO: 1396198 - RNA, 19 nt, Homo sapiens
uaaaaacaaacagaacaaa

SEQ ID NO: 1396199 - RNA, 20 nt, Homo sapiens
uaaaaacaccaaaaagggau

SEQ ID NO: 1396200 - RNA, 14 nt, Homo sapiens
uaaaaagcagagcu

SEQ ID NO: 1396201 - RNA, 15 nt, Homo sapiens
uaaaaagggaauuau

SEQ ID NO: 1396202 - RNA, 23 nt, Homo sapiens
uaaaaagugccuguagaugacau

SEQ ID NO: 1396203 - RNA, 13 nt, Homo sapiens
uaaaaaguuauaa

SEQ ID NO: 1396204 - RNA, 16 nt, Homo sapiens
uaaaaauacaaaaaau

SEQ ID NO: 1396205 - RNA, 20 nt, Homo sapiens
uaaaaauagaagaauacaaa

SEQ ID NO: 1396206 - RNA, 18 nt, Homo sapiens
uaaaaauggauacuggug

SEQ ID NO: 1396207 - RNA, 13 nt, Homo sapiens
uaaaacauuauga

SEQ ID NO: 1396208 - RNA, 18 nt, Homo sapiens
uaaaacauuuucacacaa

SEQ ID NO: 1396209 - RNA, 17 nt, Homo sapiens
uaaaaccugugugccau

SEQ ID NO: 1396210 - RNA, 21 nt, Homo sapiens
uaaaacugauuuuuagcuuua

SEQ ID NO: 1396211 - RNA, 16 nt, Homo sapiens
uaaaagguaugcaauc

SEQ ID NO: 1396212 - RNA, 22 nt, Homo sapiens
uaaaaggucuaugcucauaacu

SEQ ID NO: 1396213 - RNA, 23 nt, Homo sapiens
uaaaauaaaguauauauagaauc

SEQ ID NO: 1396214 - RNA, 15 nt, Homo sapiens
uaaaauaaauuauua

SEQ ID NO: 1396215 - RNA, 18 nt, Homo sapiens
uaaaauagccacuuaccu

SEQ ID NO: 1396216 - RNA, 22 nt, Homo sapiens
uaaaauagccacuuaccuucaa

SEQ ID NO: 1396217 - RNA, 18 nt, Homo sapiens
uaaaauauauuucagaua

SEQ ID NO: 1396218 - RNA, 12 nt, Homo sapiens
uaaaauaucauu

SEQ ID NO: 1396219 - RNA, 19 nt, Homo sapiens
uaaaauauuguugaacacu

SEQ ID NO: 1396220 - RNA, 18 nt, Homo sapiens
uaaaaucauguacauuuc

SEQ ID NO: 1396221 - RNA, 11 nt, Homo sapiens
uaaaaugacau

SEQ ID NO: 1396222 - RNA, 21 nt, Homo sapiens
uaaaaugguguuuucauguaa

SEQ ID NO: 1396223 - RNA, 16 nt, Homo sapiens
uaaaauuacugaugca

SEQ ID NO: 1396224 - RNA, 19 nt, Homo sapiens
uaaaauuuugccuaauaca

SEQ ID NO: 1396225 - RNA, 22 nt, Homo sapiens
uaaacaaacuguguaacugccc

SEQ ID NO: 1396226 - RNA, 17 nt, Homo sapiens
uaaacaaauaacaaugu

SEQ ID NO: 1396227 - RNA, 22 nt, Homo sapiens
uaaacacauagauucaccugua

SEQ ID NO: 1396228 - RNA, 17 nt, Homo sapiens
uaaacagcuucaugccu

SEQ ID NO: 1396229 - RNA, 17 nt, Homo sapiens
uaaacuaucuuggugaa

SEQ ID NO: 1396230 - RNA, 20 nt, Homo sapiens
uaaacugauggauaucccua

SEQ ID NO: 1396231 - RNA, 21 nt, Homo sapiens
uaaacuguuuauuugcacuau

SEQ ID NO: 1396232 - RNA, 16 nt, Homo sapiens
uaaacuugucagggua

SEQ ID NO: 1396233 - RNA, 19 nt, Homo sapiens
uaaagagagaugaaccaca

SEQ ID NO: 1396234 - RNA, 20 nt, Homo sapiens
uaaagcccaaccuccugacc

SEQ ID NO: 1396235 - RNA, 23 nt, Homo sapiens
uaaagcccuuuauuuauaauaca

SEQ ID NO: 1396236 - RNA, 12 nt, Homo sapiens
uaaagccuucaa

SEQ ID NO: 1396237 - RNA, 18 nt, Homo sapiens
uaaagcucaucagcuauc

SEQ ID NO: 1396238 - RNA, 16 nt, Homo sapiens
uaaaggcauuucaaag

SEQ ID NO: 1396239 - RNA, 22 nt, Homo sapiens
uaaagggagauaacaaucugua

SEQ ID NO: 1396240 - RNA, 15 nt, Homo sapiens
uaaaguauuccaccu

SEQ ID NO: 1396241 - RNA, 20 nt, Homo sapiens
uaaagugaauaaccacuuaa

SEQ ID NO: 1396242 - RNA, 14 nt, Homo sapiens
uaaaguuacauugc

SEQ ID NO: 1396243 - RNA, 17 nt, Homo sapiens
uaaauaaacacauagau

SEQ ID NO: 1396244 - RNA, 18 nt, Homo sapiens
uaaauaagagauuuggag

SEQ ID NO: 1396245 - RNA, 16 nt, Homo sapiens
uaaauagcaacaugcu

SEQ ID NO: 1396246 - RNA, 17 nt, Homo sapiens
uaaauagcuauauccau

SEQ ID NO: 1396247 - RNA, 23 nt, Homo sapiens
uaaauagcuauauccauguacug

SEQ ID NO: 1396248 - RNA, 18 nt, Homo sapiens
uaaauauuuauguagaug

SEQ ID NO: 1396249 - RNA, 16 nt, Homo sapiens
uaaauauuucaggcau

SEQ ID NO: 1396250 - RNA, 22 nt, Homo sapiens
uaaaugaaguaacuugucuuaa

SEQ ID NO: 1396251 - RNA, 16 nt, Homo sapiens
uaaaugaagugcaaau

SEQ ID NO: 1396252 - RNA, 16 nt, Homo sapiens
uaaaugcaauauguau

SEQ ID NO: 1396253 - RNA, 17 nt, Homo sapiens
uaaaugggacuggaguc

SEQ ID NO: 1396254 - RNA, 11 nt, Homo sapiens
uaaauguaaua

SEQ ID NO: 1396255 - RNA, 16 nt, Homo sapiens
uaaauguauaccugua

SEQ ID NO: 1396256 - RNA, 14 nt, Homo sapiens
uaaauguaucuuau

SEQ ID NO: 1396257 - RNA, 22 nt, Homo sapiens
uaaaugucucuuuaaugucaca

SEQ ID NO: 1396258 - RNA, 18 nt, Homo sapiens
uaaaugucuuaaucauga

SEQ ID NO: 1396259 - RNA, 21 nt, Homo sapiens
uaaaugugaaugaugauccua

SEQ ID NO: 1396260 - RNA, 22 nt, Homo sapiens
uaaauuauacuggagaagucuu

SEQ ID NO: 1396261 - RNA, 23 nt, Homo sapiens
uaaauucuauaggaacauaugaa

SEQ ID NO: 1396262 - RNA, 13 nt, Homo sapiens
uaaauugcagaug

SEQ ID NO: 1396263 - RNA, 16 nt, Homo sapiens
uaaauuuguguucuca

SEQ ID NO: 1396264 - RNA, 22 nt, Homo sapiens
uaacaaccaaagacuacauauu

SEQ ID NO: 1396265 - RNA, 17 nt, Homo sapiens
uaacaaucacaaaggaa

SEQ ID NO: 1396266 - RNA, 19 nt, Homo sapiens
uaacacagagagacagacu

SEQ ID NO: 1396267 - RNA, 14 nt, Homo sapiens
uaacaccaugauua

SEQ ID NO: 1396268 - RNA, 15 nt, Homo sapiens
uaacagaacagucac

SEQ ID NO: 1396269 - RNA, 21 nt, Homo sapiens
uaacagccucauugaugucaa

SEQ ID NO: 1396270 - RNA, 22 nt, Homo sapiens
uaacaggcucaauauuccugaa

SEQ ID NO: 1396271 - RNA, 19 nt, Homo sapiens
uaacaguucacuuuuuaca

SEQ ID NO: 1396272 - RNA, 20 nt, Homo sapiens
uaacaguugugaugacuaug

SEQ ID NO: 1396273 - RNA, 15 nt, Homo sapiens
uaacaugcaaagauc

SEQ ID NO: 1396274 - RNA, 20 nt, Homo sapiens
uaacauguaauuaaguacua

SEQ ID NO: 1396275 - RNA, 21 nt, Homo sapiens
uaaccccuggcaaccaggaau

SEQ ID NO: 1396276 - RNA, 14 nt, Homo sapiens
uaacgacuucaggg

SEQ ID NO: 1396277 - RNA, 14 nt, Homo sapiens
uaacggcacugugg

SEQ ID NO: 1396278 - RNA, 21 nt, Homo sapiens
uaacuaaaagguaugcaauca

SEQ ID NO: 1396279 - RNA, 20 nt, Homo sapiens
uaacuaccuaaacauguuau

SEQ ID NO: 1396280 - RNA, 19 nt, Homo sapiens
uaacuagaaaucugccaau

SEQ ID NO: 1396281 - RNA, 12 nt, Homo sapiens
uaacuagaauuu

SEQ ID NO: 1396282 - RNA, 17 nt, Homo sapiens
uaacuagaauuuauuca

SEQ ID NO: 1396283 - RNA, 22 nt, Homo sapiens
uaacuaguccuuuacuaaucca

SEQ ID NO: 1396284 - RNA, 19 nt, Homo sapiens
uaacucaaaggguggaaua

SEQ ID NO: 1396285 - RNA, 17 nt, Homo sapiens
uaacucaggacuccagc

SEQ ID NO: 1396286 - RNA, 19 nt, Homo sapiens
uaacucuccuccauguugc

SEQ ID NO: 1396287 - RNA, 16 nt, Homo sapiens
uaacugacaacuugaa

SEQ ID NO: 1396288 - RNA, 15 nt, Homo sapiens
uaacuggcaguuuuc

SEQ ID NO: 1396289 - RNA, 19 nt, Homo sapiens
uaacuuuuuaaaacacaac

SEQ ID NO: 1396290 - RNA, 14 nt, Homo sapiens
uaagaaaacuaaga

SEQ ID NO: 1396291 - RNA, 18 nt, Homo sapiens
uaagaagagacugggaag

SEQ ID NO: 1396292 - RNA, 21 nt, Homo sapiens
uaagaagcagauaaugguguu

SEQ ID NO: 1396293 - RNA, 13 nt, Homo sapiens
uaagaaucauugu

SEQ ID NO: 1396294 - RNA, 17 nt, Homo sapiens
uaagacucugucucaaa

SEQ ID NO: 1396295 - RNA, 16 nt, Homo sapiens
uaagacugcugcugaa

SEQ ID NO: 1396296 - RNA, 14 nt, Homo sapiens
uaagagucucuauu

SEQ ID NO: 1396297 - RNA, 13 nt, Homo sapiens
uaagcauaacuua

SEQ ID NO: 1396298 - RNA, 22 nt, Homo sapiens
uaagcaucaaauauuugugcaa

SEQ ID NO: 1396299 - RNA, 17 nt, Homo sapiens
uaagccaagggccucuu

SEQ ID NO: 1396300 - RNA, 22 nt, Homo sapiens
uaagccacauggcugggauuua

SEQ ID NO: 1396301 - RNA, 15 nt, Homo sapiens
uaagccacugccaca

SEQ ID NO: 1396302 - RNA, 17 nt, Homo sapiens
uaagccuuccacacuca

SEQ ID NO: 1396303 - RNA, 15 nt, Homo sapiens
uaagcuaugugaaau

SEQ ID NO: 1396304 - RNA, 22 nt, Homo sapiens
uaagcucuuugaaacaacuuuc

SEQ ID NO: 1396305 - RNA, 21 nt, Homo sapiens
uaaggaacauguacuguuacu

SEQ ID NO: 1396306 - RNA, 20 nt, Homo sapiens
uaaggaauaugagcuuuaug

SEQ ID NO: 1396307 - RNA, 15 nt, Homo sapiens
uaaggacauuuccca

SEQ ID NO: 1396308 - RNA, 13 nt, Homo sapiens
uaagguacuagca

SEQ ID NO: 1396309 - RNA, 20 nt, Homo sapiens
uaaggucacauugugccuuu

SEQ ID NO: 1396310 - RNA, 20 nt, Homo sapiens
uaagguggguggaucaccug

SEQ ID NO: 1396311 - RNA, 17 nt, Homo sapiens
uaaguaccacucaggcc

SEQ ID NO: 1396312 - RNA, 13 nt, Homo sapiens
uaaguacuaugua

SEQ ID NO: 1396313 - RNA, 19 nt, Homo sapiens
uaaguauucaagaaagcca

SEQ ID NO: 1396314 - RNA, 14 nt, Homo sapiens
uaagugcaugacau

SEQ ID NO: 1396315 - RNA, 19 nt, Homo sapiens
uaaguuagggaauggcaca

SEQ ID NO: 1396316 - RNA, 19 nt, Homo sapiens
uaaguuugugaaugugacu

SEQ ID NO: 1396317 - RNA, 19 nt, Homo sapiens
uaauaaaacaucuuuccag

SEQ ID NO: 1396318 - RNA, 17 nt, Homo sapiens
uaauaaaaggaguucag

SEQ ID NO: 1396319 - RNA, 13 nt, Homo sapiens
uaauaaacauccu

SEQ ID NO: 1396320 - RNA, 18 nt, Homo sapiens
uaauacuccuaagacuua

SEQ ID NO: 1396321 - RNA, 14 nt, Homo sapiens
uaauauaacugccu

SEQ ID NO: 1396322 - RNA, 15 nt, Homo sapiens
uaauauaacugccuu

SEQ ID NO: 1396323 - RNA, 16 nt, Homo sapiens
uaauaugguaaugcac

SEQ ID NO: 1396324 - RNA, 21 nt, Homo sapiens
uaaucaaaacccaacaugacu

SEQ ID NO: 1396325 - RNA, 21 nt, Homo sapiens
uaaucagcaagaauuugaucg

SEQ ID NO: 1396326 - RNA, 22 nt, Homo sapiens
uaaucagguccucagagaauuu

SEQ ID NO: 1396327 - RNA, 18 nt, Homo sapiens
uaauccagaaaaacugug

SEQ ID NO: 1396328 - RNA, 13 nt, Homo sapiens
uaaucccagcacu

SEQ ID NO: 1396329 - RNA, 14 nt, Homo sapiens
uaaucccagcacuu

SEQ ID NO: 1396330 - RNA, 16 nt, Homo sapiens
uaaucguacauuuuca

SEQ ID NO: 1396331 - RNA, 15 nt, Homo sapiens
uaaucuaauacacuu

SEQ ID NO: 1396332 - RNA, 23 nt, Homo sapiens
uaaucuguuuauuuacaagggaa

SEQ ID NO: 1396333 - RNA, 21 nt, Homo sapiens
uaaucuuaaauuuauuagaua

SEQ ID NO: 1396334 - RNA, 23 nt, Homo sapiens
uaaucuucagggcacugcugcug

SEQ ID NO: 1396335 - RNA, 19 nt, Homo sapiens
uaaucuuccauacuucuuc

SEQ ID NO: 1396336 - RNA, 12 nt, Homo sapiens
uaaugaaagcac

SEQ ID NO: 1396337 - RNA, 22 nt, Homo sapiens
uaaugaaauaauguacaucugg

SEQ ID NO: 1396338 - RNA, 23 nt, Homo sapiens
uaaugaugucguuugaaucacag

SEQ ID NO: 1396339 - RNA, 19 nt, Homo sapiens
uaauggcucaugaccugga

SEQ ID NO: 1396340 - RNA, 14 nt, Homo sapiens
uaauguacaucugg

SEQ ID NO: 1396341 - RNA, 19 nt, Homo sapiens
uaauguauuuguuugcaau

SEQ ID NO: 1396342 - RNA, 14 nt, Homo sapiens
uaaugucaccaccu

SEQ ID NO: 1396343 - RNA, 17 nt, Homo sapiens
uaaugucuuguuaauau

SEQ ID NO: 1396344 - RNA, 23 nt, Homo sapiens
uaaugugaaguagaauccuaaau

SEQ ID NO: 1396345 - RNA, 15 nt, Homo sapiens
uaauguuauuuccac

SEQ ID NO: 1396346 - RNA, 16 nt, Homo sapiens
uaauguuauuuccacu

SEQ ID NO: 1396347 - RNA, 12 nt, Homo sapiens
uaauguugcuuu

SEQ ID NO: 1396348 - RNA, 22 nt, Homo sapiens
uaauguugcuuucuuaucccag

SEQ ID NO: 1396349 - RNA, 22 nt, Homo sapiens
uaauguuguaauucaugccagg

SEQ ID NO: 1396350 - RNA, 14 nt, Homo sapiens
uaauuaguuccuca

SEQ ID NO: 1396351 - RNA, 21 nt, Homo sapiens
uaauuaucggaagcagugccu

SEQ ID NO: 1396352 - RNA, 20 nt, Homo sapiens
uaauucuuauuuaaguuauu

SEQ ID NO: 1396353 - RNA, 15 nt, Homo sapiens
uaauugccacugaga

SEQ ID NO: 1396354 - RNA, 19 nt, Homo sapiens
uaauuuaaucuuccaugga

SEQ ID NO: 1396355 - RNA, 17 nt, Homo sapiens
uaauuucaggaauugaa

SEQ ID NO: 1396356 - RNA, 20 nt, Homo sapiens
uaauuuuaggcacccauccu

SEQ ID NO: 1396357 - RNA, 19 nt, Homo sapiens
uaauuuuggguggggagaa

SEQ ID NO: 1396358 - RNA, 20 nt, Homo sapiens
uaauuuuuuugagacagagu

SEQ ID NO: 1396359 - RNA, 15 nt, Homo sapiens
uacaaaaaacaacaa

SEQ ID NO: 1396360 - RNA, 21 nt, Homo sapiens
uacaaacaauuaacugagcau

SEQ ID NO: 1396361 - RNA, 14 nt, Homo sapiens
uacaaacugcaaua

SEQ ID NO: 1396362 - RNA, 15 nt, Homo sapiens
uacaaaggaaaaagu

SEQ ID NO: 1396363 - RNA, 21 nt, Homo sapiens
uacaaaggcuuauuaauuuga

SEQ ID NO: 1396364 - RNA, 15 nt, Homo sapiens
uacaacagugagaaa

SEQ ID NO: 1396365 - RNA, 12 nt, Homo sapiens
uacaaccuguga

SEQ ID NO: 1396366 - RNA, 13 nt, Homo sapiens
uacaaguuucaga

SEQ ID NO: 1396367 - RNA, 17 nt, Homo sapiens
uacaaguuucagacagg

SEQ ID NO: 1396368 - RNA, 15 nt, Homo sapiens
uacaaguuuucauaa

SEQ ID NO: 1396369 - RNA, 23 nt, Homo sapiens
uacaauaacauaauuuguacaua

SEQ ID NO: 1396370 - RNA, 23 nt, Homo sapiens
uacaauaggugcuuauucucaaa

SEQ ID NO: 1396371 - RNA, 16 nt, Homo sapiens
uacaauauacuuguau

SEQ ID NO: 1396372 - RNA, 20 nt, Homo sapiens
uacaaugacaaguaugauga

SEQ ID NO: 1396373 - RNA, 22 nt, Homo sapiens
uacaauuauuuuuacaguucuc

SEQ ID NO: 1396374 - RNA, 17 nt, Homo sapiens
uacaauugaaaugacua

SEQ ID NO: 1396375 - RNA, 19 nt, Homo sapiens
uacaauuguaaaacugagg

SEQ ID NO: 1396376 - RNA, 14 nt, Homo sapiens
uacacaucuuccac

SEQ ID NO: 1396377 - RNA, 15 nt, Homo sapiens
uacaccccaacagca

SEQ ID NO: 1396378 - RNA, 19 nt, Homo sapiens
uacaccccaacagcacccu

SEQ ID NO: 1396379 - RNA, 23 nt, Homo sapiens
uacacguaaaucuguucaaggaa

SEQ ID NO: 1396380 - RNA, 16 nt, Homo sapiens
uacacguggaggaaug

SEQ ID NO: 1396381 - RNA, 12 nt, Homo sapiens
uacacuaugaag

SEQ ID NO: 1396382 - RNA, 17 nt, Homo sapiens
uacacugugaacuuggg

SEQ ID NO: 1396383 - RNA, 21 nt, Homo sapiens
uacacuuuugagacuuuuugg

SEQ ID NO: 1396384 - RNA, 23 nt, Homo sapiens
uacagaaucauugcuuaugacau

SEQ ID NO: 1396385 - RNA, 16 nt, Homo sapiens
uacagacauuaaauaa

SEQ ID NO: 1396386 - RNA, 18 nt, Homo sapiens
uacagacuucuccagacc

SEQ ID NO: 1396387 - RNA, 13 nt, Homo sapiens
uacagaugaacuc

SEQ ID NO: 1396388 - RNA, 19 nt, Homo sapiens
uacagauugcugcuucugc

SEQ ID NO: 1396389 - RNA, 12 nt, Homo sapiens
uacagcaaauuu

SEQ ID NO: 1396390 - RNA, 24 nt, Homo sapiens
uacagcagcaugcauucauaacag

SEQ ID NO: 1396391 - RNA, 19 nt, Homo sapiens
uacaggcaacaaugagcag

SEQ ID NO: 1396392 - RNA, 13 nt, Homo sapiens
uacaggugugaac

SEQ ID NO: 1396393 - RNA, 21 nt, Homo sapiens
uacagguuacaugagagcaau

SEQ ID NO: 1396394 - RNA, 17 nt, Homo sapiens
uacaguauucuguacca

SEQ ID NO: 1396395 - RNA, 22 nt, Homo sapiens
uacaguauuguggcugcacuug

SEQ ID NO: 1396396 - RNA, 14 nt, Homo sapiens
uacaguggcuguca

SEQ ID NO: 1396397 - RNA, 14 nt, Homo sapiens
uacaguuuaucuau

SEQ ID NO: 1396398 - RNA, 12 nt, Homo sapiens
uacauacugcug

SEQ ID NO: 1396399 - RNA, 13 nt, Homo sapiens
uacauacugcugu

SEQ ID NO: 1396400 - RNA, 15 nt, Homo sapiens
uacauaguacauaca

SEQ ID NO: 1396401 - RNA, 15 nt, Homo sapiens
uacauauauauguca

SEQ ID NO: 1396402 - RNA, 22 nt, Homo sapiens
gucacuacgugacuguggcaca

SEQ ID NO: 1396403 - RNA, 14 nt, Homo sapiens
gucacuugaucucc

SEQ ID NO: 1396404 - RNA, 20 nt, Homo sapiens
gucacuuuuccugugcuguu

SEQ ID NO: 1396405 - RNA, 14 nt, Homo sapiens
gucaggaacagaag

SEQ ID NO: 1396406 - RNA, 20 nt, Homo sapiens
gucagggaccccugcccuug

SEQ ID NO: 1396407 - RNA, 20 nt, Homo sapiens
gucaggguauaaaaugacau

SEQ ID NO: 1396408 - RNA, 16 nt, Homo sapiens
gucauaagugacaguu

SEQ ID NO: 1396409 - RNA, 16 nt, Homo sapiens
gucauaucuucacaau

SEQ ID NO: 1396410 - RNA, 19 nt, Homo sapiens
gucaucucagugcuguaaa

SEQ ID NO: 1396411 - RNA, 23 nt, Homo sapiens
gucaugauggcaccacugcacuc

SEQ ID NO: 1396412 - RNA, 18 nt, Homo sapiens
gucaugcguuuaaucaca

SEQ ID NO: 1396413 - RNA, 21 nt, Homo sapiens
gucauuuuuauaaaacuuuga

SEQ ID NO: 1396414 - RNA, 22 nt, Homo sapiens
guccaagugugugugcgugugu

SEQ ID NO: 1396415 - RNA, 12 nt, Homo sapiens
guccacugugac

SEQ ID NO: 1396416 - RNA, 19 nt, Homo sapiens
guccaugugugugcaagug

SEQ ID NO: 1396417 - RNA, 15 nt, Homo sapiens
gucccagcuacucag

SEQ ID NO: 1396418 - RNA, 17 nt, Homo sapiens
gucccagcuacucagga

SEQ ID NO: 1396419 - RNA, 17 nt, Homo sapiens
guccccaguuugcagaa

SEQ ID NO: 1396420 - RNA, 16 nt, Homo sapiens
gucccggguguguaca

SEQ ID NO: 1396421 - RNA, 17 nt, Homo sapiens
gucccuauggaagcaua

SEQ ID NO: 1396422 - RNA, 17 nt, Homo sapiens
gucccuugcugugagca

SEQ ID NO: 1396423 - RNA, 13 nt, Homo sapiens
guccgagcuuuga

SEQ ID NO: 1396424 - RNA, 17 nt, Homo sapiens
guccucacaucuuucac

SEQ ID NO: 1396425 - RNA, 19 nt, Homo sapiens
guccucuacuuaaugagau

SEQ ID NO: 1396426 - RNA, 20 nt, Homo sapiens
guccuuagccccaucugcca

SEQ ID NO: 1396427 - RNA, 18 nt, Homo sapiens
gucguuuuuuucauucca

SEQ ID NO: 1396428 - RNA, 13 nt, Homo sapiens
gucuaaaaccuua

SEQ ID NO: 1396429 - RNA, 14 nt, Homo sapiens
gucuaaaauccugc

SEQ ID NO: 1396430 - RNA, 19 nt, Homo sapiens
gucuaaacuuuagaauuaa

SEQ ID NO: 1396431 - RNA, 19 nt, Homo sapiens
gucuaugcucauaacugug

SEQ ID NO: 1396432 - RNA, 17 nt, Homo sapiens
gucucacuauguugccc

SEQ ID NO: 1396433 - RNA, 18 nt, Homo sapiens
gucucacuuuuauugaua

SEQ ID NO: 1396434 - RNA, 15 nt, Homo sapiens
gucucaguuucacuu

SEQ ID NO: 1396435 - RNA, 14 nt, Homo sapiens
gucucauacucacc

SEQ ID NO: 1396436 - RNA, 17 nt, Homo sapiens
gucucauacucaccuca

SEQ ID NO: 1396437 - RNA, 20 nt, Homo sapiens
gucucauaugauugugcaca

SEQ ID NO: 1396438 - RNA, 14 nt, Homo sapiens
gucuccagcccacg

SEQ ID NO: 1396439 - RNA, 18 nt, Homo sapiens
gucucccgggaagccacc

SEQ ID NO: 1396440 - RNA, 14 nt, Homo sapiens
gucucuggcgugug

SEQ ID NO: 1396441 - RNA, 18 nt, Homo sapiens
gucugccagccagcagcc

SEQ ID NO: 1396442 - RNA, 15 nt, Homo sapiens
gucugucucugcuau

SEQ ID NO: 1396443 - RNA, 12 nt, Homo sapiens
gucugucuucaa

SEQ ID NO: 1396444 - RNA, 16 nt, Homo sapiens
gucugugugcaagugu

SEQ ID NO: 1396445 - RNA, 14 nt, Homo sapiens
gucuucaagcagau

SEQ ID NO: 1396446 - RNA, 23 nt, Homo sapiens
gucuucagccuagccgaccucag

SEQ ID NO: 1396447 - RNA, 17 nt, Homo sapiens
gucuucauccuuagcaa

SEQ ID NO: 1396448 - RNA, 12 nt, Homo sapiens
gucuuccauaau

SEQ ID NO: 1396449 - RNA, 15 nt, Homo sapiens
gucuugaaacaagca

SEQ ID NO: 1396450 - RNA, 12 nt, Homo sapiens
gucuuucacuga

SEQ ID NO: 1396451 - RNA, 19 nt, Homo sapiens
gucuuugcauggagacuug

SEQ ID NO: 1396452 - RNA, 21 nt, Homo sapiens
gucuuuguaaugucaccaccu

SEQ ID NO: 1396453 - RNA, 19 nt, Homo sapiens
gucuuuguuaagacugcug

SEQ ID NO: 1396454 - RNA, 20 nt, Homo sapiens
gugaaaccccgucuguacua

SEQ ID NO: 1396455 - RNA, 21 nt, Homo sapiens
gugaaaccucaucucuacuaa

SEQ ID NO: 1396456 - RNA, 13 nt, Homo sapiens
gugaaacuaacag

SEQ ID NO: 1396457 - RNA, 17 nt, Homo sapiens
gugaaaucugugcaaua

SEQ ID NO: 1396458 - RNA, 15 nt, Homo sapiens
gugaaaugcagaguc

SEQ ID NO: 1396459 - RNA, 14 nt, Homo sapiens
gugaaaugcuggca

SEQ ID NO: 1396460 - RNA, 21 nt, Homo sapiens
gugaagaucacguuccuuccc

SEQ ID NO: 1396461 - RNA, 18 nt, Homo sapiens
gugaagggagagccagcu

SEQ ID NO: 1396462 - RNA, 16 nt, Homo sapiens
gugaaguauacuguau

SEQ ID NO: 1396463 - RNA, 17 nt, Homo sapiens
gugaauaaaaauuaagg

SEQ ID NO: 1396464 - RNA, 14 nt, Homo sapiens
gugaaucagacccu

SEQ ID NO: 1396465 - RNA, 23 nt, Homo sapiens
gugaaucuuugucagcaguuccc

SEQ ID NO: 1396466 - RNA, 19 nt, Homo sapiens
gugacaacacuuguguuau

SEQ ID NO: 1396467 - RNA, 13 nt, Homo sapiens
gugacaacaugcg

SEQ ID NO: 1396468 - RNA, 15 nt, Homo sapiens
gugacagugaggucc

SEQ ID NO: 1396469 - RNA, 14 nt, Homo sapiens
gugacagugccugg

SEQ ID NO: 1396470 - RNA, 22 nt, Homo sapiens
gugaccugccaggcacacugag

SEQ ID NO: 1396471 - RNA, 19 nt, Homo sapiens
gugacucagaugucucugg

SEQ ID NO: 1396472 - RNA, 16 nt, Homo sapiens
gugagaaacaucucaa

SEQ ID NO: 1396473 - RNA, 20 nt, Homo sapiens
gugagaacuacucagggaau

SEQ ID NO: 1396474 - RNA, 23 nt, Homo sapiens
gugagaauaaacuagacucugaa

SEQ ID NO: 1396475 - RNA, 14 nt, Homo sapiens
gugagaccuggcag

SEQ ID NO: 1396476 - RNA, 15 nt, Homo sapiens
gugagccaagauugc

SEQ ID NO: 1396477 - RNA, 17 nt, Homo sapiens
gugagcccccagagcug

SEQ ID NO: 1396478 - RNA, 23 nt, Homo sapiens
gugagggauaguggggucagggc

SEQ ID NO: 1396479 - RNA, 23 nt, Homo sapiens
gugaguauaacucuaacugaugu

SEQ ID NO: 1396480 - RNA, 14 nt, Homo sapiens
gugagugugugcaa

SEQ ID NO: 1396481 - RNA, 15 nt, Homo sapiens
gugauaaugcagacu

SEQ ID NO: 1396482 - RNA, 16 nt, Homo sapiens
gugauacaaauugaua

SEQ ID NO: 1396483 - RNA, 13 nt, Homo sapiens
gugauacccaagu

SEQ ID NO: 1396484 - RNA, 13 nt, Homo sapiens
gugauauguuggu

SEQ ID NO: 1396485 - RNA, 14 nt, Homo sapiens
gugaucaagcaaua

SEQ ID NO: 1396486 - RNA, 13 nt, Homo sapiens
gugauccacccac

SEQ ID NO: 1396487 - RNA, 21 nt, Homo sapiens
gugauucacccugauuuuaca

SEQ ID NO: 1396488 - RNA, 17 nt, Homo sapiens
gugauuuucauugcugg

SEQ ID NO: 1396489 - RNA, 16 nt, Homo sapiens
gugcaagugugugcac

SEQ ID NO: 1396490 - RNA, 17 nt, Homo sapiens
gugcaagugugugcaca

SEQ ID NO: 1396491 - RNA, 18 nt, Homo sapiens
gugcacguacacacacau

SEQ ID NO: 1396492 - RNA, 16 nt, Homo sapiens
gugcagcugauuuuaa

SEQ ID NO: 1396493 - RNA, 15 nt, Homo sapiens
gugcaugugcacuug

SEQ ID NO: 1396494 - RNA, 19 nt, Homo sapiens
gugccaugggggcaacagc

SEQ ID NO: 1396495 - RNA, 13 nt, Homo sapiens
gugccccaugccu

SEQ ID NO: 1396496 - RNA, 17 nt, Homo sapiens
gugcccccugaaacagc

SEQ ID NO: 1396497 - RNA, 20 nt, Homo sapiens
gugcccuuggaggccagcca

SEQ ID NO: 1396498 - RNA, 21 nt, Homo sapiens
aacccaggaguucagggucau

SEQ ID NO: 1396499 - RNA, 22 nt, Homo sapiens
aacccagugaguucagccuuua

SEQ ID NO: 1396500 - RNA, 14 nt, Homo sapiens
aacccaucuacccc

SEQ ID NO: 1396501 - RNA, 16 nt, Homo sapiens
aacccccugacauuau

SEQ ID NO: 1396502 - RNA, 23 nt, Homo sapiens
aacccccugacauuaucuuggau

SEQ ID NO: 1396503 - RNA, 17 nt, Homo sapiens
aacccugccccugcccc

SEQ ID NO: 1396504 - RNA, 12 nt, Homo sapiens
aacccugucuga

SEQ ID NO: 1396505 - RNA, 14 nt, Homo sapiens
aacccuugcuugca

SEQ ID NO: 1396506 - RNA, 22 nt, Homo sapiens
aaccuagccuuagaagucacac

SEQ ID NO: 1396507 - RNA, 15 nt, Homo sapiens
aaccucauuccccaa

SEQ ID NO: 1396508 - RNA, 21 nt, Homo sapiens
aaccucauuccccaaccacuu

SEQ ID NO: 1396509 - RNA, 18 nt, Homo sapiens
aaccuccccaacagcacu

SEQ ID NO: 1396510 - RNA, 15 nt, Homo sapiens
aaccuccuuccaggg

SEQ ID NO: 1396511 - RNA, 20 nt, Homo sapiens
aaccucggcuccuggacuca

SEQ ID NO: 1396512 - RNA, 17 nt, Homo sapiens
aaccucuguauuugaau

SEQ ID NO: 1396513 - RNA, 21 nt, Homo sapiens
aaccuggagccacuucuaucu

SEQ ID NO: 1396514 - RNA, 14 nt, Homo sapiens
aaccuguccuugca

SEQ ID NO: 1396515 - RNA, 20 nt, Homo sapiens
aaccugugaucaagcaauaa

SEQ ID NO: 1396516 - RNA, 18 nt, Homo sapiens
aaccuuauuguaccucuc

SEQ ID NO: 1396517 - RNA, 17 nt, Homo sapiens
aaccuuccaucucgcca

SEQ ID NO: 1396518 - RNA, 18 nt, Homo sapiens
aaccuugucucuaugcca

SEQ ID NO: 1396519 - RNA, 23 nt, Homo sapiens
aaccuuugagacuauugagauau

SEQ ID NO: 1396520 - RNA, 21 nt, Homo sapiens
aacgcacacaguaucuaguca

SEQ ID NO: 1396521 - RNA, 18 nt, Homo sapiens
aacggugagcauuguggc

SEQ ID NO: 1396522 - RNA, 14 nt, Homo sapiens
aacguggggcagca

SEQ ID NO: 1396523 - RNA, 17 nt, Homo sapiens
aacuaacguacauucaa

SEQ ID NO: 1396524 - RNA, 17 nt, Homo sapiens
aacuaagaugcugccug

SEQ ID NO: 1396525 - RNA, 17 nt, Homo sapiens
aacuaauaaaagcauaa

SEQ ID NO: 1396526 - RNA, 18 nt, Homo sapiens
aacuacaaacacaagcaa

SEQ ID NO: 1396527 - RNA, 11 nt, Homo sapiens
aacuaccuccu

SEQ ID NO: 1396528 - RNA, 14 nt, Homo sapiens
aacuacucagggaa

SEQ ID NO: 1396529 - RNA, 16 nt, Homo sapiens
aacuagaaaucugcca

SEQ ID NO: 1396530 - RNA, 13 nt, Homo sapiens
aacuauccaaaac

SEQ ID NO: 1396531 - RNA, 16 nt, Homo sapiens
aacucaacuuugacaa

SEQ ID NO: 1396532 - RNA, 22 nt, Homo sapiens
aacucagagucggaacggagaa

SEQ ID NO: 1396533 - RNA, 16 nt, Homo sapiens
aacuccuauaauuccc

SEQ ID NO: 1396534 - RNA, 13 nt, Homo sapiens
aacuccuuucuca

SEQ ID NO: 1396535 - RNA, 15 nt, Homo sapiens
aacucuaacugaugu

SEQ ID NO: 1396536 - RNA, 21 nt, Homo sapiens
aacucuccaucuuauuuucau

SEQ ID NO: 1396537 - RNA, 22 nt, Homo sapiens
aacugacuagugagauggccug

SEQ ID NO: 1396538 - RNA, 18 nt, Homo sapiens
aacugauuuuuagcuuua

SEQ ID NO: 1396539 - RNA, 22 nt, Homo sapiens
aacugcccugucuaggucagua

SEQ ID NO: 1396540 - RNA, 21 nt, Homo sapiens
aacugccuuggcuucagggga

SEQ ID NO: 1396541 - RNA, 20 nt, Homo sapiens
aacugcuuuaucccacggaa

SEQ ID NO: 1396542 - RNA, 20 nt, Homo sapiens
aacuggaggaguuccuugau

SEQ ID NO: 1396543 - RNA, 16 nt, Homo sapiens
aacuggaggccaggaa

SEQ ID NO: 1396544 - RNA, 14 nt, Homo sapiens
aacuggcaguuuuc

SEQ ID NO: 1396545 - RNA, 15 nt, Homo sapiens
aacugggguggauuu

SEQ ID NO: 1396546 - RNA, 19 nt, Homo sapiens
aacugguauauacauauau

SEQ ID NO: 1396547 - RNA, 21 nt, Homo sapiens
aacugucaaagaaucaaucca

SEQ ID NO: 1396548 - RNA, 16 nt, Homo sapiens
aacuguccucuuucag

SEQ ID NO: 1396549 - RNA, 14 nt, Homo sapiens
aacuguguuuacuc

SEQ ID NO: 1396550 - RNA, 18 nt, Homo sapiens
aacuuaaaaagucugcau

SEQ ID NO: 1396551 - RNA, 13 nt, Homo sapiens
aacuuaacauuca

SEQ ID NO: 1396552 - RNA, 22 nt, Homo sapiens
aacuuaagcugggauaaucaca

SEQ ID NO: 1396553 - RNA, 16 nt, Homo sapiens
aacuuagcucacaccu

SEQ ID NO: 1396554 - RNA, 21 nt, Homo sapiens
aacuucaauauccacuucuuu

SEQ ID NO: 1396555 - RNA, 22 nt, Homo sapiens
aacuucacggggucauacuaca

SEQ ID NO: 1396556 - RNA, 15 nt, Homo sapiens
aacuuccaauuuaca

SEQ ID NO: 1396557 - RNA, 14 nt, Homo sapiens
aacuucccugaaaa

SEQ ID NO: 1396558 - RNA, 23 nt, Homo sapiens
aacuuggaaauagugauuuccac

SEQ ID NO: 1396559 - RNA, 19 nt, Homo sapiens
aacuuugauaggaugugga

SEQ ID NO: 1396560 - RNA, 13 nt, Homo sapiens
aacuuuggcuuau

SEQ ID NO: 1396561 - RNA, 20 nt, Homo sapiens
aacuuuugguaucuacuucu

SEQ ID NO: 1396562 - RNA, 13 nt, Homo sapiens
aacuuuugugcuc

SEQ ID NO: 1396563 - RNA, 15 nt, Homo sapiens
aacuuuugugcuccc

SEQ ID NO: 1396564 - RNA, 16 nt, Homo sapiens
aacuuuugugcucccc

SEQ ID NO: 1396565 - RNA, 22 nt, Homo sapiens
aagaaagcaaugccaaucuuca

SEQ ID NO: 1396566 - RNA, 20 nt, Homo sapiens
aagaacaguaacugccauca

SEQ ID NO: 1396567 - RNA, 17 nt, Homo sapiens
aagaaccaaaagagauc

SEQ ID NO: 1396568 - RNA, 18 nt, Homo sapiens
aagaagagaaccaugaaa

SEQ ID NO: 1396569 - RNA, 15 nt, Homo sapiens
aagaagagacuggga

SEQ ID NO: 1396570 - RNA, 14 nt, Homo sapiens
aagaagauggauug

SEQ ID NO: 1396571 - RNA, 20 nt, Homo sapiens
aagaagcccaagauaucagc

SEQ ID NO: 1396572 - RNA, 19 nt, Homo sapiens
aagaaguguccgagaacua

SEQ ID NO: 1396573 - RNA, 15 nt, Homo sapiens
aagaaguucauuuug

SEQ ID NO: 1396574 - RNA, 19 nt, Homo sapiens
aagaaguuuuguucugucc

SEQ ID NO: 1396575 - RNA, 22 nt, Homo sapiens
aagaaucuucugccccagcuuu

SEQ ID NO: 1396576 - RNA, 17 nt, Homo sapiens
aagaaugagacugaacu

SEQ ID NO: 1396577 - RNA, 18 nt, Homo sapiens
aagaauguguuuaaacuu

SEQ ID NO: 1396578 - RNA, 22 nt, Homo sapiens
aagaauuaugcaucugcuacug

SEQ ID NO: 1396579 - RNA, 14 nt, Homo sapiens
aagacaaauucugu

SEQ ID NO: 1396580 - RNA, 22 nt, Homo sapiens
aagacauggggaggaaggacaa

SEQ ID NO: 1396581 - RNA, 21 nt, Homo sapiens
aagacauuaccaugaguaaua

SEQ ID NO: 1396582 - RNA, 18 nt, Homo sapiens
aagaccaagacacagauc

SEQ ID NO: 1396583 - RNA, 21 nt, Homo sapiens
aagacuacauauugucacuga

SEQ ID NO: 1396584 - RNA, 18 nt, Homo sapiens
aagacuauucccuucuaa

SEQ ID NO: 1396585 - RNA, 15 nt, Homo sapiens
aagacucugucucaa

SEQ ID NO: 1396586 - RNA, 23 nt, Homo sapiens
aagacugagcucaaggugggaac

SEQ ID NO: 1396587 - RNA, 15 nt, Homo sapiens
aagacugcugcugaa

SEQ ID NO: 1396588 - RNA, 18 nt, Homo sapiens
aagacugggugaggauaa

SEQ ID NO: 1396589 - RNA, 18 nt, Homo sapiens
aagacugucagcuuccaa

SEQ ID NO: 1396590 - RNA, 16 nt, Homo sapiens
aagagaaccauaucaa

SEQ ID NO: 1396591 - RNA, 14 nt, Homo sapiens
aagagaacugauga

SEQ ID NO: 1396592 - RNA, 22 nt, Homo sapiens
aagagaauauuagcuuuacugu

SEQ ID NO: 1396593 - RNA, 18 nt, Homo sapiens
aagagacauauacuaaga

SEQ ID NO: 1396594 - RNA, 21 nt, Homo sapiens
aagagagaacaacuacuguga

SEQ ID NO: 1396595 - RNA, 22 nt, Homo sapiens
aagagauccuucuguaaagguu

SEQ ID NO: 1396596 - RNA, 23 nt, Homo sapiens
aagagauuccugagccaguguca

SEQ ID NO: 1396597 - RNA, 21 nt, Homo sapiens
aagaggaauauucugguuuau

SEQ ID NO: 1396598 - RNA, 14 nt, Homo sapiens
aagaguuacuuaau

SEQ ID NO: 1396599 - RNA, 22 nt, Homo sapiens
aagauaaucucucagcuuuuaa

SEQ ID NO: 1396600 - RNA, 15 nt, Homo sapiens
aagauacaaguuuca

SEQ ID NO: 1396601 - RNA, 24 nt, Homo sapiens
aagauacaugucuuucuccaggga

SEQ ID NO: 1396602 - RNA, 13 nt, Homo sapiens
aagauaguugaaa

SEQ ID NO: 1396603 - RNA, 18 nt, Homo sapiens
aagauauuauucaccaug

SEQ ID NO: 1396604 - RNA, 15 nt, Homo sapiens
aagaugacuucccaa

SEQ ID NO: 1396605 - RNA, 22 nt, Homo sapiens
aagaugcuucucacugccaugc

SEQ ID NO: 1396606 - RNA, 19 nt, Homo sapiens
aagaugcuuuucaaacuga

SEQ ID NO: 1396607 - RNA, 20 nt, Homo sapiens
aagauggccuuugcuuauga

SEQ ID NO: 1396608 - RNA, 18 nt, Homo sapiens
aagauggcugacuuugcu

SEQ ID NO: 1396609 - RNA, 21 nt, Homo sapiens
aagauggcugugccucugccu

SEQ ID NO: 1396610 - RNA, 14 nt, Homo sapiens
aggauggcaaagag

SEQ ID NO: 1396611 - RNA, 16 nt, Homo sapiens
aggaugggaaggaggg

SEQ ID NO: 1396612 - RNA, 17 nt, Homo sapiens
aggaugggaaggaggga

SEQ ID NO: 1396613 - RNA, 17 nt, Homo sapiens
aggauucauguggaaua

SEQ ID NO: 1396614 - RNA, 15 nt, Homo sapiens
aggauuucaugauuu

SEQ ID NO: 1396615 - RNA, 19 nt, Homo sapiens
aggauuugggcucuuggaa

SEQ ID NO: 1396616 - RNA, 14 nt, Homo sapiens
aggcaaaaggcagu

SEQ ID NO: 1396617 - RNA, 16 nt, Homo sapiens
aggcaacugaacaaaa

SEQ ID NO: 1396618 - RNA, 14 nt, Homo sapiens
aggcaaucacauag

SEQ ID NO: 1396619 - RNA, 18 nt, Homo sapiens
aggcacacgccugccagg

SEQ ID NO: 1396620 - RNA, 21 nt, Homo sapiens
aggcacagccggggccugccu

SEQ ID NO: 1396621 - RNA, 22 nt, Homo sapiens
aggcaccaguuacccugcaugu

SEQ ID NO: 1396622 - RNA, 13 nt, Homo sapiens
aggcacucauggg

SEQ ID NO: 1396623 - RNA, 22 nt, Homo sapiens
aggcacugcugcccagccucca

SEQ ID NO: 1396624 - RNA, 16 nt, Homo sapiens
aggcagacuugcagag

SEQ ID NO: 1396625 - RNA, 21 nt, Homo sapiens
aggcagagguugcagugagcu

SEQ ID NO: 1396626 - RNA, 20 nt, Homo sapiens
aggcaggaggaucacuugag

SEQ ID NO: 1396627 - RNA, 21 nt, Homo sapiens
aggcagggccuugcccagaga

SEQ ID NO: 1396628 - RNA, 14 nt, Homo sapiens
aggcagggucucac

SEQ ID NO: 1396629 - RNA, 20 nt, Homo sapiens
aggcagggucucacucuguc

SEQ ID NO: 1396630 - RNA, 22 nt, Homo sapiens
aggcaggugccccucucuccau

SEQ ID NO: 1396631 - RNA, 19 nt, Homo sapiens
aggcauaggccugggugcu

SEQ ID NO: 1396632 - RNA, 13 nt, Homo sapiens
aggcaugaaauga

SEQ ID NO: 1396633 - RNA, 22 nt, Homo sapiens
aggcaugagggaucacagggcc

SEQ ID NO: 1396634 - RNA, 16 nt, Homo sapiens
aggcaugauguuaacc

SEQ ID NO: 1396635 - RNA, 21 nt, Homo sapiens
aggccaaacuggcaaacuuca

SEQ ID NO: 1396636 - RNA, 21 nt, Homo sapiens
aggccagagggagugacagag

SEQ ID NO: 1396637 - RNA, 18 nt, Homo sapiens
aggccaggauggcacugu

SEQ ID NO: 1396638 - RNA, 15 nt, Homo sapiens
aggcccaaauuauca

SEQ ID NO: 1396639 - RNA, 21 nt, Homo sapiens
aggccgccccagccucugagc

SEQ ID NO: 1396640 - RNA, 14 nt, Homo sapiens
aggccuccagcuca

SEQ ID NO: 1396641 - RNA, 15 nt, Homo sapiens
aggcgauccaccugu

SEQ ID NO: 1396642 - RNA, 14 nt, Homo sapiens
aggcgaugugcaag

SEQ ID NO: 1396643 - RNA, 21 nt, Homo sapiens
aggcgccccuucccccuccaa

SEQ ID NO: 1396644 - RNA, 18 nt, Homo sapiens
aggcggauggcugugacc

SEQ ID NO: 1396645 - RNA, 20 nt, Homo sapiens
aggcgggagcaucucuugag

SEQ ID NO: 1396646 - RNA, 20 nt, Homo sapiens
aggcuauauuucugggauga

SEQ ID NO: 1396647 - RNA, 15 nt, Homo sapiens
aggcuauguauggaa

SEQ ID NO: 1396648 - RNA, 14 nt, Homo sapiens
aggcugaggacuua

SEQ ID NO: 1396649 - RNA, 19 nt, Homo sapiens
aggcugaggggaggaucac

SEQ ID NO: 1396650 - RNA, 13 nt, Homo sapiens
aggcugcauagaa

SEQ ID NO: 1396651 - RNA, 14 nt, Homo sapiens
aggcuggagcuggc

SEQ ID NO: 1396652 - RNA, 12 nt, Homo sapiens
aggcuggcuugu

SEQ ID NO: 1396653 - RNA, 22 nt, Homo sapiens
aggcuucaauuuauugcacaaa

SEQ ID NO: 1396654 - RNA, 16 nt, Homo sapiens
agggaaacacagcagc

SEQ ID NO: 1396655 - RNA, 15 nt, Homo sapiens
agggaagaaagcaga

SEQ ID NO: 1396656 - RNA, 18 nt, Homo sapiens
agggaagcugucccucac

SEQ ID NO: 1396657 - RNA, 22 nt, Homo sapiens
agggaagcugucccucacuguu

SEQ ID NO: 1396658 - RNA, 15 nt, Homo sapiens
agggaauaauccaga

SEQ ID NO: 1396659 - RNA, 14 nt, Homo sapiens
agggaaugacuugg

SEQ ID NO: 1396660 - RNA, 20 nt, Homo sapiens
agggaauggcacagcccaaa

SEQ ID NO: 1396661 - RNA, 17 nt, Homo sapiens
agggaccccugcccuug

SEQ ID NO: 1396662 - RNA, 21 nt, Homo sapiens
agggaccccugcccuuguccc

SEQ ID NO: 1396663 - RNA, 20 nt, Homo sapiens
agggacugacaaaagacuug

SEQ ID NO: 1396664 - RNA, 17 nt, Homo sapiens
agggacuuuagagaaua

SEQ ID NO: 1396665 - RNA, 15 nt, Homo sapiens
agggagaagcaugaa

SEQ ID NO: 1396666 - RNA, 14 nt, Homo sapiens
agggagagccagcu

SEQ ID NO: 1396667 - RNA, 14 nt, Homo sapiens
agggagcacugggu

SEQ ID NO: 1396668 - RNA, 16 nt, Homo sapiens
agggagccgagaucac

SEQ ID NO: 1396669 - RNA, 16 nt, Homo sapiens
agggagguuugugaga

SEQ ID NO: 1396670 - RNA, 17 nt, Homo sapiens
agggagugggcuaagca

SEQ ID NO: 1396671 - RNA, 17 nt, Homo sapiens
agggauguggagcacaa

SEQ ID NO: 1396672 - RNA, 18 nt, Homo sapiens
agggaugugugagaauaa

SEQ ID NO: 1396673 - RNA, 19 nt, Homo sapiens
agggcacugcugcugccuu

SEQ ID NO: 1396674 - RNA, 12 nt, Homo sapiens
agggcacugggu

SEQ ID NO: 1396675 - RNA, 18 nt, Homo sapiens
agggcaucuccugugcau

SEQ ID NO: 1396676 - RNA, 18 nt, Homo sapiens
agggccaagcaccuagcc

SEQ ID NO: 1396677 - RNA, 15 nt, Homo sapiens
agggcccacuuguau

SEQ ID NO: 1396678 - RNA, 19 nt, Homo sapiens
agggccucacucuguugcu

SEQ ID NO: 1396679 - RNA, 19 nt, Homo sapiens
agggcucccuauguugccc

SEQ ID NO: 1396680 - RNA, 15 nt, Homo sapiens
agggcugagugcccu

SEQ ID NO: 1396681 - RNA, 14 nt, Homo sapiens
agggcugcaaaagu

SEQ ID NO: 1396682 - RNA, 14 nt, Homo sapiens
agggcuggguguau

SEQ ID NO: 1396683 - RNA, 17 nt, Homo sapiens
agggcuuauccaugccu

SEQ ID NO: 1396684 - RNA, 21 nt, Homo sapiens
aggggaccacaccucccugaa

SEQ ID NO: 1396685 - RNA, 20 nt, Homo sapiens
aggggacucagcccugaggu

SEQ ID NO: 1396686 - RNA, 20 nt, Homo sapiens
aggggagcaacagaggacau

SEQ ID NO: 1396687 - RNA, 13 nt, Homo sapiens
aggggcacagggu

SEQ ID NO: 1396688 - RNA, 19 nt, Homo sapiens
aggggccucagguuugccu

SEQ ID NO: 1396689 - RNA, 23 nt, Homo sapiens
aggggcuguugaauuucccacau

SEQ ID NO: 1396690 - RNA, 19 nt, Homo sapiens
agggggccaggugcacaga

SEQ ID NO: 1396691 - RNA, 17 nt, Homo sapiens
aggggguuugggggcuu

SEQ ID NO: 1396692 - RNA, 16 nt, Homo sapiens
aggggucagggaccaa

SEQ ID NO: 1396693 - RNA, 20 nt, Homo sapiens
aggggucccauagaggugag

SEQ ID NO: 1396694 - RNA, 21 nt, Homo sapiens
aggggucugguggucucugcu

SEQ ID NO: 1396695 - RNA, 19 nt, Homo sapiens
agggguggaguuuuguaua

SEQ ID NO: 1396696 - RNA, 20 nt, Homo sapiens
aggguacuuuaagacauacu

SEQ ID NO: 1396697 - RNA, 23 nt, Homo sapiens
aggguagaaaaaggagcuuaccu

SEQ ID NO: 1396698 - RNA, 15 nt, Homo sapiens
aggguauggggcuag

SEQ ID NO: 1396699 - RNA, 18 nt, Homo sapiens
agggugcugccccaugaa

SEQ ID NO: 1396700 - RNA, 16 nt, Homo sapiens
agggugcugcuucccu

SEQ ID NO: 1396701 - RNA, 18 nt, Homo sapiens
aggguggcccuugcaguu

SEQ ID NO: 1396702 - RNA, 20 nt, Homo sapiens
aggguugggcccagaucugg

SEQ ID NO: 1396703 - RNA, 20 nt, Homo sapiens
aggguuuuaucucugucuac

SEQ ID NO: 1396704 - RNA, 16 nt, Homo sapiens
agguaaggugagggaa

SEQ ID NO: 1396705 - RNA, 14 nt, Homo sapiens
agguagacaguaua

SEQ ID NO: 1396706 - RNA, 16 nt, Homo sapiens
agguaguuaagggaug

SEQ ID NO: 1396707 - RNA, 20 nt, Homo sapiens
agguauauaaauuuucccaa

SEQ ID NO: 1396708 - RNA, 18 nt, Homo sapiens
agguaugcaaucaaaucu

SEQ ID NO: 1396709 - RNA, 21 nt, Homo sapiens
agguaugguuaauaaguuuca

SEQ ID NO: 1396710 - RNA, 16 nt, Homo sapiens
agguaugugucagcca

SEQ ID NO: 1396711 - RNA, 12 nt, Homo sapiens
aggucacuccug

SEQ ID NO: 1396712 - RNA, 17 nt, Homo sapiens
aggucauagcagugcuu

SEQ ID NO: 1396713 - RNA, 20 nt, Homo sapiens
agguccucuacuuaaugaga

SEQ ID NO: 1396714 - RNA, 21 nt, Homo sapiens
aggucguuuuuuucauuccau

SEQ ID NO: 1396715 - RNA, 18 nt, Homo sapiens
aggucuaggaacauacuu

SEQ ID NO: 1396716 - RNA, 14 nt, Homo sapiens
aggugaacacuucc

SEQ ID NO: 1396717 - RNA, 22 nt, Homo sapiens
aggugaacuguuuccacauuca

SEQ ID NO: 1396718 - RNA, 21 nt, Homo sapiens
aggugaggauugauuaccuag

SEQ ID NO: 1396719 - RNA, 16 nt, Homo sapiens
aggugauccacccacc

SEQ ID NO: 1396720 - RNA, 22 nt, Homo sapiens
aggugcccaggaaccucagggc

SEQ ID NO: 1396721 - RNA, 21 nt, Homo sapiens
aggugcguguuuccugugcaa

SEQ ID NO: 1396722 - RNA, 17 nt, Homo sapiens
aggugcuggcucuuucc

SEQ ID NO: 1396723 - RNA, 17 nt, Homo sapiens
auccaaagcugaauaca

SEQ ID NO: 1396724 - RNA, 17 nt, Homo sapiens
auccaacaugugcucag

SEQ ID NO: 1396725 - RNA, 20 nt, Homo sapiens
auccaacaugugcucaggga

SEQ ID NO: 1396726 - RNA, 14 nt, Homo sapiens
auccaauguaugaa

SEQ ID NO: 1396727 - RNA, 19 nt, Homo sapiens
auccacacagccaauacaa

SEQ ID NO: 1396728 - RNA, 15 nt, Homo sapiens
auccacccaccucag

SEQ ID NO: 1396729 - RNA, 16 nt, Homo sapiens
auccacuaaaaucaaa

SEQ ID NO: 1396730 - RNA, 16 nt, Homo sapiens
auccagucucccaacu

SEQ ID NO: 1396731 - RNA, 16 nt, Homo sapiens
auccaucaaguugcac

SEQ ID NO: 1396732 - RNA, 12 nt, Homo sapiens
auccaucucuca

SEQ ID NO: 1396733 - RNA, 18 nt, Homo sapiens
auccauguguggacucaa

SEQ ID NO: 1396734 - RNA, 12 nt, Homo sapiens
aucccaagagaa

SEQ ID NO: 1396735 - RNA, 23 nt, Homo sapiens
aucccacggaaaaugccaaucuc

SEQ ID NO: 1396736 - RNA, 14 nt, Homo sapiens
aucccagcuacuca

SEQ ID NO: 1396737 - RNA, 15 nt, Homo sapiens
aucccagcuacucaa

SEQ ID NO: 1396738 - RNA, 21 nt, Homo sapiens
aucccaggggaccacaccucc

SEQ ID NO: 1396739 - RNA, 15 nt, Homo sapiens
aucccaugagccuca

SEQ ID NO: 1396740 - RNA, 21 nt, Homo sapiens
aucccggcugucaaggggugu

SEQ ID NO: 1396741 - RNA, 22 nt, Homo sapiens
aucccugaggcuggacuccaga

SEQ ID NO: 1396742 - RNA, 15 nt, Homo sapiens
aucccugauuccugu

SEQ ID NO: 1396743 - RNA, 15 nt, Homo sapiens
aucccuggaaggaca

SEQ ID NO: 1396744 - RNA, 20 nt, Homo sapiens
auccggcagccuggauguuu

SEQ ID NO: 1396745 - RNA, 15 nt, Homo sapiens
auccgggaucaaagu

SEQ ID NO: 1396746 - RNA, 16 nt, Homo sapiens
auccgggucaagugaa

SEQ ID NO: 1396747 - RNA, 20 nt, Homo sapiens
auccguacauucaauguuua

SEQ ID NO: 1396748 - RNA, 16 nt, Homo sapiens
auccuaaauaauguua

SEQ ID NO: 1396749 - RNA, 15 nt, Homo sapiens
auccuacaacuucca

SEQ ID NO: 1396750 - RNA, 14 nt, Homo sapiens
auccuaccaaccuc

SEQ ID NO: 1396751 - RNA, 15 nt, Homo sapiens
auccuagcacuuugg

SEQ ID NO: 1396752 - RNA, 18 nt, Homo sapiens
auccuagcugugugcagu

SEQ ID NO: 1396753 - RNA, 16 nt, Homo sapiens
auccuaucucuccaac

SEQ ID NO: 1396754 - RNA, 14 nt, Homo sapiens
auccucccaccuca

SEQ ID NO: 1396755 - RNA, 16 nt, Homo sapiens
auccucgcucccggga

SEQ ID NO: 1396756 - RNA, 22 nt, Homo sapiens
auccucugagugugaccaggca

SEQ ID NO: 1396757 - RNA, 22 nt, Homo sapiens
auccuggguggucugcaggcag

SEQ ID NO: 1396758 - RNA, 16 nt, Homo sapiens
auccuuagcaacagcc

SEQ ID NO: 1396759 - RNA, 16 nt, Homo sapiens
auccuuguggcacauu

SEQ ID NO: 1396760 - RNA, 22 nt, Homo sapiens
aucgagauguccauagucaaau

SEQ ID NO: 1396761 - RNA, 22 nt, Homo sapiens
aucgaggaaccagagccaugga

SEQ ID NO: 1396762 - RNA, 17 nt, Homo sapiens
aucgaugcagugcuucc

SEQ ID NO: 1396763 - RNA, 16 nt, Homo sapiens
aucgcugucaucucag

SEQ ID NO: 1396764 - RNA, 22 nt, Homo sapiens
aucgcugucaucucagcuggau

SEQ ID NO: 1396765 - RNA, 19 nt, Homo sapiens
aucgcuuucuacacuguau

SEQ ID NO: 1396766 - RNA, 16 nt, Homo sapiens
aucgggagcagugucu

SEQ ID NO: 1396767 - RNA, 16 nt, Homo sapiens
aucgucuaaacuuuag

SEQ ID NO: 1396768 - RNA, 20 nt, Homo sapiens
aucguuccaguucccacuug

SEQ ID NO: 1396769 - RNA, 16 nt, Homo sapiens
aucguucuuucuagcu

SEQ ID NO: 1396770 - RNA, 18 nt, Homo sapiens
aucuaagccuuuccauaa

SEQ ID NO: 1396771 - RNA, 22 nt, Homo sapiens
aucuacaaaaaacaacaaauaa

SEQ ID NO: 1396772 - RNA, 14 nt, Homo sapiens
aucuaccagcauaa

SEQ ID NO: 1396773 - RNA, 22 nt, Homo sapiens
aucuacuccuuguaaagacugu

SEQ ID NO: 1396774 - RNA, 18 nt, Homo sapiens
aucuacuucaacacuuca

SEQ ID NO: 1396775 - RNA, 15 nt, Homo sapiens
aucuacuucuacauc

SEQ ID NO: 1396776 - RNA, 15 nt, Homo sapiens
aucucacagcacacu

SEQ ID NO: 1396777 - RNA, 23 nt, Homo sapiens
aucucagcuccugaaaaaugccu

SEQ ID NO: 1396778 - RNA, 23 nt, Homo sapiens
aucucauccaucaaguugcacac

SEQ ID NO: 1396779 - RNA, 15 nt, Homo sapiens
aucuccucagcaccc

SEQ ID NO: 1396780 - RNA, 20 nt, Homo sapiens
aucucuacuaccacaaggaa

SEQ ID NO: 1396781 - RNA, 13 nt, Homo sapiens
aucucucaucacu

SEQ ID NO: 1396782 - RNA, 22 nt, Homo sapiens
aucucugcuuuggaaaucacac

SEQ ID NO: 1396783 - RNA, 13 nt, Homo sapiens
aucucugucucaa

SEQ ID NO: 1396784 - RNA, 16 nt, Homo sapiens
aucucuuauuuuacaa

SEQ ID NO: 1396785 - RNA, 17 nt, Homo sapiens
aucucuuauuuuacaau

SEQ ID NO: 1396786 - RNA, 21 nt, Homo sapiens
aucugaggcacaugucagcaa

SEQ ID NO: 1396787 - RNA, 14 nt, Homo sapiens
aucugcagcuaacu

SEQ ID NO: 1396788 - RNA, 18 nt, Homo sapiens
aucugcauuuagcacaaa

SEQ ID NO: 1396789 - RNA, 15 nt, Homo sapiens
aucugccacguguau

SEQ ID NO: 1396790 - RNA, 14 nt, Homo sapiens
aucugcuacugugu

SEQ ID NO: 1396791 - RNA, 20 nt, Homo sapiens
aucuggaagaagaugggcug

SEQ ID NO: 1396792 - RNA, 16 nt, Homo sapiens
aucugggaacucccaa

SEQ ID NO: 1396793 - RNA, 17 nt, Homo sapiens
aucugggugacugagca

SEQ ID NO: 1396794 - RNA, 18 nt, Homo sapiens
aucugugcccagagaugg

SEQ ID NO: 1396795 - RNA, 15 nt, Homo sapiens
aucuguuuuacugcu

SEQ ID NO: 1396796 - RNA, 12 nt, Homo sapiens
aucuuaacucuu

SEQ ID NO: 1396797 - RNA, 14 nt, Homo sapiens
aucuuacaaagugu

SEQ ID NO: 1396798 - RNA, 18 nt, Homo sapiens
aucuuaguauuugcauau

SEQ ID NO: 1396799 - RNA, 15 nt, Homo sapiens
aucuuauauaguuua

SEQ ID NO: 1396800 - RNA, 20 nt, Homo sapiens
aucuuauucuuuuguaauau

SEQ ID NO: 1396801 - RNA, 19 nt, Homo sapiens
aucuucaaagcuugaagau

SEQ ID NO: 1396802 - RNA, 13 nt, Homo sapiens
aucuucaacagac

SEQ ID NO: 1396803 - RNA, 16 nt, Homo sapiens
aucuucauaucuauca

SEQ ID NO: 1396804 - RNA, 13 nt, Homo sapiens
aucuuccaagggu

SEQ ID NO: 1396805 - RNA, 15 nt, Homo sapiens
aucuucuuaugcaau

SEQ ID NO: 1396806 - RNA, 19 nt, Homo sapiens
aucuugaaaugaaaguaua

SEQ ID NO: 1396807 - RNA, 15 nt, Homo sapiens
aucuugcucuaucuc

SEQ ID NO: 1396808 - RNA, 14 nt, Homo sapiens
aucuuguccccaac

SEQ ID NO: 1396809 - RNA, 13 nt, Homo sapiens
aucuugugcucag

SEQ ID NO: 1396810 - RNA, 12 nt, Homo sapiens
aucuuucaggaa

SEQ ID NO: 1396811 - RNA, 21 nt, Homo sapiens
aucuuucaggacucuaccuca

SEQ ID NO: 1396812 - RNA, 13 nt, Homo sapiens
aucuuugauacuu

SEQ ID NO: 1396813 - RNA, 15 nt, Homo sapiens
aucuuuuaagcccau

SEQ ID NO: 1396814 - RNA, 16 nt, Homo sapiens
augaaaauuaggauuu

SEQ ID NO: 1396815 - RNA, 16 nt, Homo sapiens
augaaauaucaugcuc

SEQ ID NO: 1396816 - RNA, 17 nt, Homo sapiens
augaaauaucaugcucc

SEQ ID NO: 1396817 - RNA, 22 nt, Homo sapiens
augaaauccugcuucaguguau

SEQ ID NO: 1396818 - RNA, 22 nt, Homo sapiens
augaaaugaggucagagccugc

SEQ ID NO: 1396819 - RNA, 16 nt, Homo sapiens
augaaauugcugaaag

SEQ ID NO: 1396820 - RNA, 20 nt, Homo sapiens
augaaccugcccugcuccca

SEQ ID NO: 1396821 - RNA, 16 nt, Homo sapiens
augaacucuuaaucaa

SEQ ID NO: 1396822 - RNA, 15 nt, Homo sapiens
augaagauaccauca

SEQ ID NO: 1396823 - RNA, 12 nt, Homo sapiens
augaaggaaaug

SEQ ID NO: 1396824 - RNA, 16 nt, Homo sapiens
augaaggcagagccau

SEQ ID NO: 1396825 - RNA, 21 nt, Homo sapiens
augaagguggaacaagcacag

SEQ ID NO: 1396826 - RNA, 21 nt, Homo sapiens
augaagguuucugaaaauuaa

SEQ ID NO: 1396827 - RNA, 20 nt, Homo sapiens
augaagucuuguucagggua

SEQ ID NO: 1396828 - RNA, 13 nt, Homo sapiens
augaagugcaaua

SEQ ID NO: 1396829 - RNA, 20 nt, Homo sapiens
augaaguguguuuccuucag

SEQ ID NO: 1396830 - RNA, 23 nt, Homo sapiens
augaauguuuacacucuuuguaa

SEQ ID NO: 1396831 - RNA, 19 nt, Homo sapiens
augacaaugaugaugauaa

SEQ ID NO: 1396832 - RNA, 16 nt, Homo sapiens
augacacucuucugaa

SEQ ID NO: 1396833 - RNA, 18 nt, Homo sapiens
augacagcugucccuguc

SEQ ID NO: 1396834 - RNA, 14 nt, Homo sapiens
augacaucagcaau

SEQ ID NO: 1396835 - RNA, 19 nt, Homo sapiens
augacaucagcaauacaga

SEQ ID NO: 1396836 - RNA, 21 nt, Homo sapiens
auuuuguguguaccugugacu

SEQ ID NO: 1396837 - RNA, 12 nt, Homo sapiens
auuuuguugcau

SEQ ID NO: 1396838 - RNA, 15 nt, Homo sapiens
auuuuguugcaucau

SEQ ID NO: 1396839 - RNA, 16 nt, Homo sapiens
auuuuuagacagaguc

SEQ ID NO: 1396840 - RNA, 13 nt, Homo sapiens
auuuuuauacagu

SEQ ID NO: 1396841 - RNA, 18 nt, Homo sapiens
auuuuuauacagugauaa

SEQ ID NO: 1396842 - RNA, 19 nt, Homo sapiens
auuuuuucgugcacucugc

SEQ ID NO: 1396843 - RNA, 23 nt, Homo sapiens
auuuuuuucccuugguguugccc

SEQ ID NO: 1396844 - RNA, 15 nt, Homo sapiens
auuuuuuugagacag

SEQ ID NO: 1396845 - RNA, 18 nt, Homo sapiens
auuuuuuugagacagagu

SEQ ID NO: 1396846 - RNA, 20 nt, Homo sapiens
auuuuuuuuaacauuccaau

SEQ ID NO: 1396847 - RNA, 21 nt, Homo sapiens
caaaaaaaguucagcaugaag

SEQ ID NO: 1396848 - RNA, 12 nt, Homo sapiens
caaaaaacaacu

SEQ ID NO: 1396849 - RNA, 18 nt, Homo sapiens
caaaaaaguuguuaacua

SEQ ID NO: 1396850 - RNA, 14 nt, Homo sapiens
caaaaaaucugacc

SEQ ID NO: 1396851 - RNA, 17 nt, Homo sapiens
caaaaaaucugaccaaa

SEQ ID NO: 1396852 - RNA, 10 nt, Homo sapiens
caaaaacacc

SEQ ID NO: 1396853 - RNA, 21 nt, Homo sapiens
caaaaacagcagaacuucuga

SEQ ID NO: 1396854 - RNA, 14 nt, Homo sapiens
caaaaacuacacau

SEQ ID NO: 1396855 - RNA, 15 nt, Homo sapiens
caaaaagcuucccca

SEQ ID NO: 1396856 - RNA, 18 nt, Homo sapiens
caaaacagagaugugaua

SEQ ID NO: 1396857 - RNA, 11 nt, Homo sapiens
caaaaccaaau

SEQ ID NO: 1396858 - RNA, 19 nt, Homo sapiens
caaaaccaaauauuccaga

SEQ ID NO: 1396859 - RNA, 22 nt, Homo sapiens
caaaaccaaauauuccagagac

SEQ ID NO: 1396860 - RNA, 15 nt, Homo sapiens
caaaacuaauuuccu

SEQ ID NO: 1396861 - RNA, 16 nt, Homo sapiens
caaaacucaguaucau

SEQ ID NO: 1396862 - RNA, 16 nt, Homo sapiens
caaaacuccaucucaa

SEQ ID NO: 1396863 - RNA, 12 nt, Homo sapiens
caaaacucuccu

SEQ ID NO: 1396864 - RNA, 14 nt, Homo sapiens
caaaacuuaggcau

SEQ ID NO: 1396865 - RNA, 13 nt, Homo sapiens
caaaagaagacaa

SEQ ID NO: 1396866 - RNA, 22 nt, Homo sapiens
caaaagaagacaacauuucuca

SEQ ID NO: 1396867 - RNA, 23 nt, Homo sapiens
caaaagaagacaacauuucucaa

SEQ ID NO: 1396868 - RNA, 13 nt, Homo sapiens
caaaagcccaaug

SEQ ID NO: 1396869 - RNA, 17 nt, Homo sapiens
caaaaggaaaccaagug

SEQ ID NO: 1396870 - RNA, 23 nt, Homo sapiens
caaaaguucuuugggacaaaaca

SEQ ID NO: 1396871 - RNA, 21 nt, Homo sapiens
caaaaguuucuuacucaagga

SEQ ID NO: 1396872 - RNA, 20 nt, Homo sapiens
caaaauaaaaaccaagaaga

SEQ ID NO: 1396873 - RNA, 18 nt, Homo sapiens
caaaaugacaaugaugau

SEQ ID NO: 1396874 - RNA, 20 nt, Homo sapiens
caaaauguccaccaauagaa

SEQ ID NO: 1396875 - RNA, 12 nt, Homo sapiens
caaaauugcuaa

SEQ ID NO: 1396876 - RNA, 17 nt, Homo sapiens
caaacacccaugcccag

SEQ ID NO: 1396877 - RNA, 17 nt, Homo sapiens
caaacagccacacugug

SEQ ID NO: 1396878 - RNA, 13 nt, Homo sapiens
caaacaggcaguu

SEQ ID NO: 1396879 - RNA, 14 nt, Homo sapiens
caaacauaaagaga

SEQ ID NO: 1396880 - RNA, 21 nt, Homo sapiens
caaacauguaagcauaacuua

SEQ ID NO: 1396881 - RNA, 16 nt, Homo sapiens
caaaccccgaccaccu

SEQ ID NO: 1396882 - RNA, 17 nt, Homo sapiens
caaaccuccaaaagccc

SEQ ID NO: 1396883 - RNA, 20 nt, Homo sapiens
caaacguuaagaauuguuaa

SEQ ID NO: 1396884 - RNA, 12 nt, Homo sapiens
caaacugcaaua

SEQ ID NO: 1396885 - RNA, 21 nt, Homo sapiens
caaacuuaagaaacacugacu

SEQ ID NO: 1396886 - RNA, 14 nt, Homo sapiens
caaacuucaagggu

SEQ ID NO: 1396887 - RNA, 16 nt, Homo sapiens
caaacuucagacugaa

SEQ ID NO: 1396888 - RNA, 22 nt, Homo sapiens
caaagaacuuggaaauagugau

SEQ ID NO: 1396889 - RNA, 13 nt, Homo sapiens
caaagaagccagc

SEQ ID NO: 1396890 - RNA, 22 nt, Homo sapiens
caaagaauuaugcaucugcuac

SEQ ID NO: 1396891 - RNA, 23 nt, Homo sapiens
caaagaauuucaauuuguucagu

SEQ ID NO: 1396892 - RNA, 16 nt, Homo sapiens
caaagacaaaggugag

SEQ ID NO: 1396893 - RNA, 13 nt, Homo sapiens
caaagacuuuccu

SEQ ID NO: 1396894 - RNA, 16 nt, Homo sapiens
caaagagcccaauuac

SEQ ID NO: 1396895 - RNA, 14 nt, Homo sapiens
caaagagguauuua

SEQ ID NO: 1396896 - RNA, 17 nt, Homo sapiens
caaagauguggggaaaa

SEQ ID NO: 1396897 - RNA, 19 nt, Homo sapiens
caaagcacuguuucucuca

SEQ ID NO: 1396898 - RNA, 18 nt, Homo sapiens
caaagccuucauugccuu

SEQ ID NO: 1396899 - RNA, 20 nt, Homo sapiens
caaagccuucauugccuuaa

SEQ ID NO: 1396900 - RNA, 17 nt, Homo sapiens
caaagcugaauacauuc

SEQ ID NO: 1396901 - RNA, 15 nt, Homo sapiens
caaaggcacugaggc

SEQ ID NO: 1396902 - RNA, 19 nt, Homo sapiens
caaaggguacuuccacuga

SEQ ID NO: 1396903 - RNA, 14 nt, Homo sapiens
caaaggugcuaaau

SEQ ID NO: 1396904 - RNA, 14 nt, Homo sapiens
caaaguaagccaug

SEQ ID NO: 1396905 - RNA, 17 nt, Homo sapiens
caaagucuccagcccac

SEQ ID NO: 1396906 - RNA, 16 nt, Homo sapiens
caaagugacuauucag

SEQ ID NO: 1396907 - RNA, 21 nt, Homo sapiens
caaagugcugcuggaaguaga

SEQ ID NO: 1396908 - RNA, 11 nt, Homo sapiens
caaaguuggcg

SEQ ID NO: 1396909 - RNA, 15 nt, Homo sapiens
caaauaaagaccuga

SEQ ID NO: 1396910 - RNA, 21 nt, Homo sapiens
caaauaaagaccugagaaccu

SEQ ID NO: 1396911 - RNA, 12 nt, Homo sapiens
caaauacugaug

SEQ ID NO: 1396912 - RNA, 13 nt, Homo sapiens
caaauacugaugg

SEQ ID NO: 1396913 - RNA, 22 nt, Homo sapiens
caaauacugauggugcauuuua

SEQ ID NO: 1396914 - RNA, 22 nt, Homo sapiens
caaauagaaccacuaugaagcu

SEQ ID NO: 1396915 - RNA, 16 nt, Homo sapiens
caaauauuccagagac

SEQ ID NO: 1396916 - RNA, 19 nt, Homo sapiens
caaaucaauaaauucccaa

SEQ ID NO: 1396917 - RNA, 20 nt, Homo sapiens
caaaucuaagggaaaaagcc

SEQ ID NO: 1396918 - RNA, 19 nt, Homo sapiens
caaaugaacacacccauca

SEQ ID NO: 1396919 - RNA, 21 nt, Homo sapiens
caaaugauuuucaaauuugau

SEQ ID NO: 1396920 - RNA, 14 nt, Homo sapiens
caaaugcccagcuu

SEQ ID NO: 1396921 - RNA, 23 nt, Homo sapiens
caaauggugguuguuucuuccaa

SEQ ID NO: 1396922 - RNA, 22 nt, Homo sapiens
caaauucgcugcaaccuguuga

SEQ ID NO: 1396923 - RNA, 16 nt, Homo sapiens
caaauugauagucaau

SEQ ID NO: 1396924 - RNA, 16 nt, Homo sapiens
caaauuggauacugcu

SEQ ID NO: 1396925 - RNA, 11 nt, Homo sapiens
caaauuucaca

SEQ ID NO: 1396926 - RNA, 17 nt, Homo sapiens
caacaacaacaaaaagc

SEQ ID NO: 1396927 - RNA, 12 nt, Homo sapiens
caacaacaugua

SEQ ID NO: 1396928 - RNA, 14 nt, Homo sapiens
caacaagccauagu

SEQ ID NO: 1396929 - RNA, 14 nt, Homo sapiens
caacaagggcagug

SEQ ID NO: 1396930 - RNA, 13 nt, Homo sapiens
caacacacacugu

SEQ ID NO: 1396931 - RNA, 13 nt, Homo sapiens
caacagagcaaga

SEQ ID NO: 1396932 - RNA, 22 nt, Homo sapiens
caacagcccucaggucagggug

SEQ ID NO: 1396933 - RNA, 12 nt, Homo sapiens
caacaguuccuu

SEQ ID NO: 1396934 - RNA, 18 nt, Homo sapiens
caacaguuuuuuaugcua

SEQ ID NO: 1396935 - RNA, 15 nt, Homo sapiens
caacauaacugaagg

SEQ ID NO: 1396936 - RNA, 20 nt, Homo sapiens
caacauaacugaaggcauau

SEQ ID NO: 1396937 - RNA, 17 nt, Homo sapiens
caacaugcgaccgugac

SEQ ID NO: 1396938 - RNA, 17 nt, Homo sapiens
caacaugugcucaggga

SEQ ID NO: 1396939 - RNA, 20 nt, Homo sapiens
caacauguuacugaccagca

SEQ ID NO: 1396940 - RNA, 14 nt, Homo sapiens
caaccccaccacuu

SEQ ID NO: 1396941 - RNA, 20 nt, Homo sapiens
caaccccuucgcuccugugu

SEQ ID NO: 1396942 - RNA, 13 nt, Homo sapiens
caaccuaugguau

SEQ ID NO: 1396943 - RNA, 21 nt, Homo sapiens
caaccugcucuccucuugcca

SEQ ID NO: 1396944 - RNA, 15 nt, Homo sapiens
caaccugugaucaag

SEQ ID NO: 1396945 - RNA, 19 nt, Homo sapiens
caaccugugaucaagcaau

SEQ ID NO: 1396946 - RNA, 14 nt, Homo sapiens
caaccugugaugag

SEQ ID NO: 1396947 - RNA, 19 nt, Homo sapiens
caaccuuuucccaaccaua

SEQ ID NO: 1396948 - RNA, 13 nt, Homo sapiens
caacgaaaagcac

SEQ ID NO: 1396949 - RNA, 17 nt, Homo sapiens
caacuaacguacauuca

SEQ ID NO: 1396950 - RNA, 18 nt, Homo sapiens
cagaaauuaaucuuacaa

SEQ ID NO: 1396951 - RNA, 15 nt, Homo sapiens
cagaaauuuaauuca

SEQ ID NO: 1396952 - RNA, 18 nt, Homo sapiens
cagaaauuuaauucaugu

SEQ ID NO: 1396953 - RNA, 21 nt, Homo sapiens
cagaacacagcaauuccucag

SEQ ID NO: 1396954 - RNA, 22 nt, Homo sapiens
cagaacacugucuugaagacaa

SEQ ID NO: 1396955 - RNA, 14 nt, Homo sapiens
cagaaccacauuaa

SEQ ID NO: 1396956 - RNA, 19 nt, Homo sapiens
cagaacugcuuuaucccac

SEQ ID NO: 1396957 - RNA, 16 nt, Homo sapiens
cagaagaacaaagagc

SEQ ID NO: 1396958 - RNA, 14 nt, Homo sapiens
cagaagacacugca

SEQ ID NO: 1396959 - RNA, 18 nt, Homo sapiens
cagaagauuauuuacuga

SEQ ID NO: 1396960 - RNA, 15 nt, Homo sapiens
cagaagcauuucacc

SEQ ID NO: 1396961 - RNA, 13 nt, Homo sapiens
cagaaggacucag

SEQ ID NO: 1396962 - RNA, 16 nt, Homo sapiens
cagaaggcaaaaagac

SEQ ID NO: 1396963 - RNA, 16 nt, Homo sapiens
cagaagggggucucuu

SEQ ID NO: 1396964 - RNA, 22 nt, Homo sapiens
cagaagugcuuucuucucccaa

SEQ ID NO: 1396965 - RNA, 17 nt, Homo sapiens
cagaauaaauaugcuca

SEQ ID NO: 1396966 - RNA, 19 nt, Homo sapiens
cagaauccuacaacuucca

SEQ ID NO: 1396967 - RNA, 20 nt, Homo sapiens
cagaauucucagaaucucaa

SEQ ID NO: 1396968 - RNA, 21 nt, Homo sapiens
cagaauuuaaaccuauacuca

SEQ ID NO: 1396969 - RNA, 22 nt, Homo sapiens
cagacaauauggucccaaauga

SEQ ID NO: 1396970 - RNA, 21 nt, Homo sapiens
cagacacuguuugcccagugu

SEQ ID NO: 1396971 - RNA, 17 nt, Homo sapiens
cagacauguggugggac

SEQ ID NO: 1396972 - RNA, 14 nt, Homo sapiens
cagacauucugcca

SEQ ID NO: 1396973 - RNA, 14 nt, Homo sapiens
cagaccagagcucu

SEQ ID NO: 1396974 - RNA, 16 nt, Homo sapiens
cagaccucaggugcua

SEQ ID NO: 1396975 - RNA, 18 nt, Homo sapiens
cagaccuuaaccaccagg

SEQ ID NO: 1396976 - RNA, 18 nt, Homo sapiens
cagaccuucaacuuccaa

SEQ ID NO: 1396977 - RNA, 20 nt, Homo sapiens
cagacgcacgugggucuuca

SEQ ID NO: 1396978 - RNA, 21 nt, Homo sapiens
cagacuacuucuuccccagau

SEQ ID NO: 1396979 - RNA, 18 nt, Homo sapiens
cagacucaauaaaaucau

SEQ ID NO: 1396980 - RNA, 19 nt, Homo sapiens
cagacucagacuccauuug

SEQ ID NO: 1396981 - RNA, 16 nt, Homo sapiens
cagacugacaaaugug

SEQ ID NO: 1396982 - RNA, 14 nt, Homo sapiens
cagacuggugggau

SEQ ID NO: 1396983 - RNA, 14 nt, Homo sapiens
cagacuucccugaa

SEQ ID NO: 1396984 - RNA, 21 nt, Homo sapiens
cagagaaguucuggcugaaca

SEQ ID NO: 1396985 - RNA, 19 nt, Homo sapiens
cagagacaggcccaagaga

SEQ ID NO: 1396986 - RNA, 20 nt, Homo sapiens
cagagacaggcccaagagau

SEQ ID NO: 1396987 - RNA, 22 nt, Homo sapiens
cagagagagaagugccccugcu

SEQ ID NO: 1396988 - RNA, 15 nt, Homo sapiens
cagagaggagucaga

SEQ ID NO: 1396989 - RNA, 19 nt, Homo sapiens
cagagaugccuccaccgcu

SEQ ID NO: 1396990 - RNA, 20 nt, Homo sapiens
cagagcaagacucugucuca

SEQ ID NO: 1396991 - RNA, 17 nt, Homo sapiens
cagagcagaacuuucac

SEQ ID NO: 1396992 - RNA, 20 nt, Homo sapiens
cagagcgagacuccgucuca

SEQ ID NO: 1396993 - RNA, 22 nt, Homo sapiens
cagagcugccucucgguggcca

SEQ ID NO: 1396994 - RNA, 21 nt, Homo sapiens
cagagcuggaccaguggugcc

SEQ ID NO: 1396995 - RNA, 20 nt, Homo sapiens
cagagcuugaacacagucuc

SEQ ID NO: 1396996 - RNA, 13 nt, Homo sapiens
cagaggagccaug

SEQ ID NO: 1396997 - RNA, 15 nt, Homo sapiens
cagaggcuucuucag

SEQ ID NO: 1396998 - RNA, 17 nt, Homo sapiens
cagagguggcucuggaa

SEQ ID NO: 1396999 - RNA, 18 nt, Homo sapiens
cagagucaucuaccugag

SEQ ID NO: 1397000 - RNA, 19 nt, Homo sapiens
cagagucucacuguugccc

SEQ ID NO: 1397001 - RNA, 20 nt, Homo sapiens
cagagugagacucugucuca

SEQ ID NO: 1397002 - RNA, 15 nt, Homo sapiens
cagaguuauggugcc

SEQ ID NO: 1397003 - RNA, 18 nt, Homo sapiens
cagaguuccgacugccau

SEQ ID NO: 1397004 - RNA, 14 nt, Homo sapiens
cagaguuuguauug

SEQ ID NO: 1397005 - RNA, 15 nt, Homo sapiens
cagauaaacaacaaa

SEQ ID NO: 1397006 - RNA, 21 nt, Homo sapiens
cagauacuucccauuuuggaa

SEQ ID NO: 1397007 - RNA, 22 nt, Homo sapiens
cagaucacuucaggucaggagu

SEQ ID NO: 1397008 - RNA, 17 nt, Homo sapiens
cagauccuuugucuaca

SEQ ID NO: 1397009 - RNA, 16 nt, Homo sapiens
cagaucugugccccau

SEQ ID NO: 1397010 - RNA, 20 nt, Homo sapiens
cagaugacuagaaagugaau

SEQ ID NO: 1397011 - RNA, 21 nt, Homo sapiens
cagaugcagaaaauugccuaa

SEQ ID NO: 1397012 - RNA, 22 nt, Homo sapiens
cagauggcaggaugggcacugc

SEQ ID NO: 1397013 - RNA, 22 nt, Homo sapiens
cagaugggagugcccccaacag

SEQ ID NO: 1397014 - RNA, 21 nt, Homo sapiens
cagauguucacccaaccacau

SEQ ID NO: 1397015 - RNA, 21 nt, Homo sapiens
cagauuccaggcgaugugcaa

SEQ ID NO: 1397016 - RNA, 15 nt, Homo sapiens
cagauucccagagca

SEQ ID NO: 1397017 - RNA, 19 nt, Homo sapiens
cagauuuccuaacucuggu

SEQ ID NO: 1397018 - RNA, 16 nt, Homo sapiens
cagauuuuacaaaaga

SEQ ID NO: 1397019 - RNA, 18 nt, Homo sapiens
cagcaaccagagcacugu

SEQ ID NO: 1397020 - RNA, 15 nt, Homo sapiens
cagcacccugcaaaa

SEQ ID NO: 1397021 - RNA, 10 nt, Homo sapiens
cagcacuaac

SEQ ID NO: 1397022 - RNA, 15 nt, Homo sapiens
cagcacuaauucaac

SEQ ID NO: 1397023 - RNA, 17 nt, Homo sapiens
cagcacuaauucaacau

SEQ ID NO: 1397024 - RNA, 16 nt, Homo sapiens
cagcacuuguguuguc

SEQ ID NO: 1397025 - RNA, 11 nt, Homo sapiens
cagcacuuugg

SEQ ID NO: 1397026 - RNA, 20 nt, Homo sapiens
cagcaucuagugguggaccg

SEQ ID NO: 1397027 - RNA, 13 nt, Homo sapiens
cagcaucuucuca

SEQ ID NO: 1397028 - RNA, 14 nt, Homo sapiens
cagcauuauugaaa

SEQ ID NO: 1397029 - RNA, 17 nt, Homo sapiens
cagccaaagauaaucuc

SEQ ID NO: 1397030 - RNA, 20 nt, Homo sapiens
cagccaagagggcugcaaaa

SEQ ID NO: 1397031 - RNA, 16 nt, Homo sapiens
cagccaaucacaagca

SEQ ID NO: 1397032 - RNA, 17 nt, Homo sapiens
cagccaaucacaagcag

SEQ ID NO: 1397033 - RNA, 12 nt, Homo sapiens
cagccacaacca

SEQ ID NO: 1397034 - RNA, 22 nt, Homo sapiens
cagccacacugugggacucuuc

SEQ ID NO: 1397035 - RNA, 21 nt, Homo sapiens
cagcccuugaagucacccggc

SEQ ID NO: 1397036 - RNA, 22 nt, Homo sapiens
cagccguucuugacaucaagaa

SEQ ID NO: 1397037 - RNA, 20 nt, Homo sapiens
cagccucccgaauagcuggg

SEQ ID NO: 1397038 - RNA, 22 nt, Homo sapiens
cagccucuucuagagccgugau

SEQ ID NO: 1397039 - RNA, 22 nt, Homo sapiens
cagccugagcaacagagugaga

SEQ ID NO: 1397040 - RNA, 13 nt, Homo sapiens
cagccugccugga

SEQ ID NO: 1397041 - RNA, 23 nt, Homo sapiens
cagccuggaggccgggugcucag

SEQ ID NO: 1397042 - RNA, 18 nt, Homo sapiens
cagccugggcaacagagc

SEQ ID NO: 1397043 - RNA, 20 nt, Homo sapiens
cagccugggcaacagagcaa

SEQ ID NO: 1397044 - RNA, 19 nt, Homo sapiens
cagcgaaccaauauuugua

SEQ ID NO: 1397045 - RNA, 18 nt, Homo sapiens
cagcgaaugaaugcugua

SEQ ID NO: 1397046 - RNA, 14 nt, Homo sapiens
cagcguacucauca

SEQ ID NO: 1397047 - RNA, 14 nt, Homo sapiens
cagcuacucaggag

SEQ ID NO: 1397048 - RNA, 14 nt, Homo sapiens
cagcucaaaggcac

SEQ ID NO: 1397049 - RNA, 14 nt, Homo sapiens
cagcucacacauga

SEQ ID NO: 1397050 - RNA, 14 nt, Homo sapiens
cagcuccacucuga

SEQ ID NO: 1397051 - RNA, 14 nt, Homo sapiens
cagcuccagggcca

SEQ ID NO: 1397052 - RNA, 14 nt, Homo sapiens
cagcuccuugaggg

SEQ ID NO: 1397053 - RNA, 15 nt, Homo sapiens
cagcucugcaagaau

SEQ ID NO: 1397054 - RNA, 17 nt, Homo sapiens
cagcucuguccugggag

SEQ ID NO: 1397055 - RNA, 17 nt, Homo sapiens
cagcugcaucuacucag

SEQ ID NO: 1397056 - RNA, 18 nt, Homo sapiens
cagcugccagagaagcau

SEQ ID NO: 1397057 - RNA, 19 nt, Homo sapiens
cagcuggaagggucaacau

SEQ ID NO: 1397058 - RNA, 16 nt, Homo sapiens
cagcuguaaacauauu

SEQ ID NO: 1397059 - RNA, 22 nt, Homo sapiens
cagcuguaagaagagacuggga

SEQ ID NO: 1397060 - RNA, 21 nt, Homo sapiens
cagcuuauaaaaucaaacaga

SEQ ID NO: 1397061 - RNA, 16 nt, Homo sapiens
cagcuugcucuucagu

SEQ ID NO: 1397062 - RNA, 14 nt, Homo sapiens
caggaaaaaaacuu

SEQ ID NO: 1397063 - RNA, 21 nt, Homo sapiens
cuuuagagaauaccaguguua

SEQ ID NO: 1397064 - RNA, 23 nt, Homo sapiens
cuuuagaguagcaugagagaauu

SEQ ID NO: 1397065 - RNA, 21 nt, Homo sapiens
cuuuagcuaccucacuaugcu

SEQ ID NO: 1397066 - RNA, 22 nt, Homo sapiens
cuuuauagaucagccagugacc

SEQ ID NO: 1397067 - RNA, 17 nt, Homo sapiens
cuuuaugguuucuccag

SEQ ID NO: 1397068 - RNA, 17 nt, Homo sapiens
cuuuauuccuucauuuc

SEQ ID NO: 1397069 - RNA, 19 nt, Homo sapiens
cuuuauuuauaauacauuu

SEQ ID NO: 1397070 - RNA, 21 nt, Homo sapiens
cuuucaauaucuuuauugcau

SEQ ID NO: 1397071 - RNA, 18 nt, Homo sapiens
cuuucacaguuucuucca

SEQ ID NO: 1397072 - RNA, 19 nt, Homo sapiens
cuuucaccacaugugcaca

SEQ ID NO: 1397073 - RNA, 21 nt, Homo sapiens
cuuucaggccacauggcuaaa

SEQ ID NO: 1397074 - RNA, 13 nt, Homo sapiens
cuuuccaucccag

SEQ ID NO: 1397075 - RNA, 21 nt, Homo sapiens
cuuucccuuuagcacguuuaa

SEQ ID NO: 1397076 - RNA, 19 nt, Homo sapiens
cuuuccuguagucccauug

SEQ ID NO: 1397077 - RNA, 18 nt, Homo sapiens
cuuucuagcuaauggaaa

SEQ ID NO: 1397078 - RNA, 21 nt, Homo sapiens
cuuucucccaggccaggcucc

SEQ ID NO: 1397079 - RNA, 12 nt, Homo sapiens
cuuucucuaaaa

SEQ ID NO: 1397080 - RNA, 15 nt, Homo sapiens
cuuucugggccaagu

SEQ ID NO: 1397081 - RNA, 13 nt, Homo sapiens
cuuucuucucucc

SEQ ID NO: 1397082 - RNA, 19 nt, Homo sapiens
cuuugccagaaagcauaaa

SEQ ID NO: 1397083 - RNA, 18 nt, Homo sapiens
cuuugccuuggcuuugcc

SEQ ID NO: 1397084 - RNA, 21 nt, Homo sapiens
cuuugcuauggggacauucca

SEQ ID NO: 1397085 - RNA, 13 nt, Homo sapiens
cuuuggacacuca

SEQ ID NO: 1397086 - RNA, 20 nt, Homo sapiens
cuuuggugcuuuucacuugu

SEQ ID NO: 1397087 - RNA, 17 nt, Homo sapiens
cuuuguaaguaaacugc

SEQ ID NO: 1397088 - RNA, 16 nt, Homo sapiens
cuuugucaaaaggaag

SEQ ID NO: 1397089 - RNA, 11 nt, Homo sapiens
cuuugucacaa

SEQ ID NO: 1397090 - RNA, 17 nt, Homo sapiens
cuuugucccacagcuug

SEQ ID NO: 1397091 - RNA, 20 nt, Homo sapiens
cuuuuaagaugugucuucaa

SEQ ID NO: 1397092 - RNA, 23 nt, Homo sapiens
cuuuuaaguugcugaugaacucu

SEQ ID NO: 1397093 - RNA, 16 nt, Homo sapiens
cuuuuacauacugcug

SEQ ID NO: 1397094 - RNA, 13 nt, Homo sapiens
cuuuuacauucug

SEQ ID NO: 1397095 - RNA, 14 nt, Homo sapiens
cuuuuaguacccac

SEQ ID NO: 1397096 - RNA, 17 nt, Homo sapiens
cuuuucccccaaagugg

SEQ ID NO: 1397097 - RNA, 19 nt, Homo sapiens
cuuuucuggaauguaauca

SEQ ID NO: 1397098 - RNA, 21 nt, Homo sapiens
cuuuucuguccgagcuuugaa

SEQ ID NO: 1397099 - RNA, 23 nt, Homo sapiens
cuuuucuuugaaggaugacuaca

SEQ ID NO: 1397100 - RNA, 13 nt, Homo sapiens
cuuuugaaaaaca

SEQ ID NO: 1397101 - RNA, 15 nt, Homo sapiens
cuuuugaacccagga

SEQ ID NO: 1397102 - RNA, 20 nt, Homo sapiens
cuuuugcuggucacugccau

SEQ ID NO: 1397103 - RNA, 19 nt, Homo sapiens
cuuuugcuguuuauuaaaa

SEQ ID NO: 1397104 - RNA, 13 nt, Homo sapiens
cuuuuucuuugag

SEQ ID NO: 1397105 - RNA, 14 nt, Homo sapiens
cuuuuuuauacuca

SEQ ID NO: 1397106 - RNA, 16 nt, Homo sapiens
gaaaaaauucucuuaa

SEQ ID NO: 1397107 - RNA, 19 nt, Homo sapiens
gaaaaaccaccaccaucac

SEQ ID NO: 1397108 - RNA, 22 nt, Homo sapiens
gaaaaagagguagcacuacaaa

SEQ ID NO: 1397109 - RNA, 22 nt, Homo sapiens
gaaaaaggagcuuaccucccac

SEQ ID NO: 1397110 - RNA, 21 nt, Homo sapiens
gaaaaaucggcuuaccauuaa

SEQ ID NO: 1397111 - RNA, 20 nt, Homo sapiens
gaaaaauuaauuuacuagaa

SEQ ID NO: 1397112 - RNA, 19 nt, Homo sapiens
gaaaacuacauuuuaacau

SEQ ID NO: 1397113 - RNA, 15 nt, Homo sapiens
gaaaacugagacuca

SEQ ID NO: 1397114 - RNA, 20 nt, Homo sapiens
gaaaagagaaggaaagugau

SEQ ID NO: 1397115 - RNA, 12 nt, Homo sapiens
gaaaagcauccu

SEQ ID NO: 1397116 - RNA, 15 nt, Homo sapiens
gaaaagggcuuucuc

SEQ ID NO: 1397117 - RNA, 22 nt, Homo sapiens
gaaaaucgugacaacacuugug

SEQ ID NO: 1397118 - RNA, 17 nt, Homo sapiens
gaaaaucucagcaauga

SEQ ID NO: 1397119 - RNA, 18 nt, Homo sapiens
gaaaaugaaccauucaca

SEQ ID NO: 1397120 - RNA, 21 nt, Homo sapiens
gaaaaugauuuuacuuagcaa

SEQ ID NO: 1397121 - RNA, 22 nt, Homo sapiens
gaaaaugccagagcuugugaac

SEQ ID NO: 1397122 - RNA, 20 nt, Homo sapiens
gaaaaugucagaaaccaguu

SEQ ID NO: 1397123 - RNA, 14 nt, Homo sapiens
gaaaauuaacacug

SEQ ID NO: 1397124 - RNA, 14 nt, Homo sapiens
gaaaauuacaguau

SEQ ID NO: 1397125 - RNA, 22 nt, Homo sapiens
gaaaauugaauuuaacaaugcg

SEQ ID NO: 1397126 - RNA, 20 nt, Homo sapiens
gaaaauuggacauuaagcau

SEQ ID NO: 1397127 - RNA, 22 nt, Homo sapiens
gaaaauugggaauaugcacaaa

SEQ ID NO: 1397128 - RNA, 23 nt, Homo sapiens
gaaacacaucuucccuagagggu

SEQ ID NO: 1397129 - RNA, 19 nt, Homo sapiens
gaaacacuaaagcauucaa

SEQ ID NO: 1397130 - RNA, 18 nt, Homo sapiens
gaaacacugggcuucuag

SEQ ID NO: 1397131 - RNA, 20 nt, Homo sapiens
gaaacauugaacucauaucu

SEQ ID NO: 1397132 - RNA, 21 nt, Homo sapiens
gaaacauuuuguggucauuaa

SEQ ID NO: 1397133 - RNA, 19 nt, Homo sapiens
gaaacccguguaucuggga

SEQ ID NO: 1397134 - RNA, 19 nt, Homo sapiens
gaaaccucugggucaucuc

SEQ ID NO: 1397135 - RNA, 20 nt, Homo sapiens
gaaacuaauauuuuauguga

SEQ ID NO: 1397136 - RNA, 23 nt, Homo sapiens
gaaacucuauggguaucaaacag

SEQ ID NO: 1397137 - RNA, 11 nt, Homo sapiens
gaaacuggaag

SEQ ID NO: 1397138 - RNA, 18 nt, Homo sapiens
gaaacuggaugaggucau

SEQ ID NO: 1397139 - RNA, 19 nt, Homo sapiens
gaaacuggaugaggucaua

SEQ ID NO: 1397140 - RNA, 13 nt, Homo sapiens
gaaacuguaugaa

SEQ ID NO: 1397141 - RNA, 18 nt, Homo sapiens
gaaacuugugaaguggaa

SEQ ID NO: 1397142 - RNA, 20 nt, Homo sapiens
gaaacuuguuagaaaugcaa

SEQ ID NO: 1397143 - RNA, 18 nt, Homo sapiens
gaaagaccgugugugaaa

SEQ ID NO: 1397144 - RNA, 18 nt, Homo sapiens
gaaagacugagcucaagg

SEQ ID NO: 1397145 - RNA, 18 nt, Homo sapiens
gaaagcaucaccucaggc

SEQ ID NO: 1397146 - RNA, 16 nt, Homo sapiens
gaaagccacagacaau

SEQ ID NO: 1397147 - RNA, 19 nt, Homo sapiens
gaaaggaggaaggagccua

SEQ ID NO: 1397148 - RNA, 13 nt, Homo sapiens
gaaagggagcuau

SEQ ID NO: 1397149 - RNA, 18 nt, Homo sapiens
gaaagggauaguccaaag

SEQ ID NO: 1397150 - RNA, 16 nt, Homo sapiens
gaaagguuauguuagc

SEQ ID NO: 1397151 - RNA, 17 nt, Homo sapiens
gaaaguaagugguagcu

SEQ ID NO: 1397152 - RNA, 18 nt, Homo sapiens
gaaaguaauuucuucuca

SEQ ID NO: 1397153 - RNA, 23 nt, Homo sapiens
gaaaguggccaugccacccuguu

SEQ ID NO: 1397154 - RNA, 14 nt, Homo sapiens
gaaaguucaaaaag

SEQ ID NO: 1397155 - RNA, 16 nt, Homo sapiens
gaaauaaaaaagucuc

SEQ ID NO: 1397156 - RNA, 20 nt, Homo sapiens
gaaauaaaaaaugaaaaaca

SEQ ID NO: 1397157 - RNA, 15 nt, Homo sapiens
gaaauaaauguaccu

SEQ ID NO: 1397158 - RNA, 17 nt, Homo sapiens
gaaauaucaugcuccau

SEQ ID NO: 1397159 - RNA, 23 nt, Homo sapiens
gaaaucauuuuacccuuggcuca

SEQ ID NO: 1397160 - RNA, 19 nt, Homo sapiens
gaaauccgggucaagugaa

SEQ ID NO: 1397161 - RNA, 15 nt, Homo sapiens
gaaaucgaugagaaa

SEQ ID NO: 1397162 - RNA, 17 nt, Homo sapiens
gaaaucuagaagacugu

SEQ ID NO: 1397163 - RNA, 14 nt, Homo sapiens
gaaaugacuuugaa

SEQ ID NO: 1397164 - RNA, 21 nt, Homo sapiens
gaaaugacuuugaaaaccugg

SEQ ID NO: 1397165 - RNA, 15 nt, Homo sapiens
gaaaugcacaauguc

SEQ ID NO: 1397166 - RNA, 15 nt, Homo sapiens
gaaaugucaguugcu

SEQ ID NO: 1397167 - RNA, 15 nt, Homo sapiens
gaaauuuuaccaagu

SEQ ID NO: 1397168 - RNA, 23 nt, Homo sapiens
gaacaaaaacaaaacaccaggga

SEQ ID NO: 1397169 - RNA, 21 nt, Homo sapiens
gaacaaaaucaccuauucacu

SEQ ID NO: 1397170 - RNA, 19 nt, Homo sapiens
gaacaaguuguuucauuga

SEQ ID NO: 1397171 - RNA, 14 nt, Homo sapiens
gaacacaaggucau

SEQ ID NO: 1397172 - RNA, 15 nt, Homo sapiens
gaacacaaggucauu

SEQ ID NO: 1397173 - RNA, 23 nt, Homo sapiens
gaacagccgcuccugucugccag

SEQ ID NO: 1397174 - RNA, 23 nt, Homo sapiens
gaacagcgggagaccugugcuag

SEQ ID NO: 1397175 - RNA, 17 nt, Homo sapiens
gauaccuacccccaaaa

SEQ ID NO: 1397176 - RNA, 20 nt, Homo sapiens
gauacuaauaggugugugag

SEQ ID NO: 1397177 - RNA, 19 nt, Homo sapiens
gauacugaguaaauccaug

SEQ ID NO: 1397178 - RNA, 16 nt, Homo sapiens
gauagaagauguuugc

SEQ ID NO: 1397179 - RNA, 12 nt, Homo sapiens
gauagcaaguga

SEQ ID NO: 1397180 - RNA, 12 nt, Homo sapiens
gauagcuuuauu

SEQ ID NO: 1397181 - RNA, 20 nt, Homo sapiens
gauauacuauuuucauucuc

SEQ ID NO: 1397182 - RNA, 22 nt, Homo sapiens
gauauaugcucugcauguuaca

SEQ ID NO: 1397183 - RNA, 22 nt, Homo sapiens
gauaucacagaggccuauaacu

SEQ ID NO: 1397184 - RNA, 19 nt, Homo sapiens
gauaugcacuugaaaugau

SEQ ID NO: 1397185 - RNA, 23 nt, Homo sapiens
gauaugcacuugaaaugauggua

SEQ ID NO: 1397186 - RNA, 16 nt, Homo sapiens
gauauuagucauagaa

SEQ ID NO: 1397187 - RNA, 14 nt, Homo sapiens
gauauuccauagua

SEQ ID NO: 1397188 - RNA, 19 nt, Homo sapiens
gauauuugaagcaucacau

SEQ ID NO: 1397189 - RNA, 21 nt, Homo sapiens
gaucaagucaccggagcuuuc

SEQ ID NO: 1397190 - RNA, 23 nt, Homo sapiens
gaucacagccucugaaaaccaau

SEQ ID NO: 1397191 - RNA, 16 nt, Homo sapiens
gaucacuggcaaugaa

SEQ ID NO: 1397192 - RNA, 19 nt, Homo sapiens
gaucagccugggcaaugug

SEQ ID NO: 1397193 - RNA, 21 nt, Homo sapiens
gaucaggccaaccccaaagaa

SEQ ID NO: 1397194 - RNA, 17 nt, Homo sapiens
gaucaguugaggccagg

SEQ ID NO: 1397195 - RNA, 21 nt, Homo sapiens
gaucauuuguuggaaugaauu

SEQ ID NO: 1397196 - RNA, 21 nt, Homo sapiens
gauccaccugucucagccucc

SEQ ID NO: 1397197 - RNA, 18 nt, Homo sapiens
gaucgccaaccuuucccc

SEQ ID NO: 1397198 - RNA, 20 nt, Homo sapiens
gaucgcgccacugcacucca

SEQ ID NO: 1397199 - RNA, 23 nt, Homo sapiens
gaucgcgccacugcacucuagcc

SEQ ID NO: 1397200 - RNA, 17 nt, Homo sapiens
gaucuauguacuguaau

SEQ ID NO: 1397201 - RNA, 17 nt, Homo sapiens
gaucuugcucuaucuca

SEQ ID NO: 1397202 - RNA, 18 nt, Homo sapiens
gaugacgacgacaacgau

SEQ ID NO: 1397203 - RNA, 16 nt, Homo sapiens
gaugaggcagaugccu

SEQ ID NO: 1397204 - RNA, 15 nt, Homo sapiens
gaugaguuacuugaa

SEQ ID NO: 1397205 - RNA, 16 nt, Homo sapiens
gaugauacacuaugaa

SEQ ID NO: 1397206 - RNA, 21 nt, Homo sapiens
gaugaucuggauccaccaaga

SEQ ID NO: 1397207 - RNA, 15 nt, Homo sapiens
gaugaugccucauga

SEQ ID NO: 1397208 - RNA, 17 nt, Homo sapiens
gaugauucuaugucuca

SEQ ID NO: 1397209 - RNA, 15 nt, Homo sapiens
gaugcaauacaagau

SEQ ID NO: 1397210 - RNA, 15 nt, Homo sapiens
gaugcagugcuucca

SEQ ID NO: 1397211 - RNA, 17 nt, Homo sapiens
gaugccucccugacccu

SEQ ID NO: 1397212 - RNA, 16 nt, Homo sapiens
gaugcugccugaguca

SEQ ID NO: 1397213 - RNA, 21 nt, Homo sapiens
gaugcugccugcccagugcac

SEQ ID NO: 1397214 - RNA, 22 nt, Homo sapiens
gauggaauauuccccuaucucu

SEQ ID NO: 1397215 - RNA, 19 nt, Homo sapiens
gauggaggucacacuggua

SEQ ID NO: 1397216 - RNA, 16 nt, Homo sapiens
gauggauagucugucc

SEQ ID NO: 1397217 - RNA, 19 nt, Homo sapiens
gauggcuuuuucuccuugg

SEQ ID NO: 1397218 - RNA, 20 nt, Homo sapiens
gaugggagugcccccaacag

SEQ ID NO: 1397219 - RNA, 18 nt, Homo sapiens
gauguaggguaaggugcc

SEQ ID NO: 1397220 - RNA, 19 nt, Homo sapiens
gauguaggguaaggugccu

SEQ ID NO: 1397221 - RNA, 15 nt, Homo sapiens
gauguauuguugcuu

SEQ ID NO: 1397222 - RNA, 17 nt, Homo sapiens
gaugucacaucuuggca

SEQ ID NO: 1397223 - RNA, 18 nt, Homo sapiens
gaugucguuugaaucaca

SEQ ID NO: 1397224 - RNA, 13 nt, Homo sapiens
gaugugucuucaa

SEQ ID NO: 1397225 - RNA, 12 nt, Homo sapiens
gauguugcucag

SEQ ID NO: 1397226 - RNA, 22 nt, Homo sapiens
gauguuuuaaguuuaucuuuca

SEQ ID NO: 1397227 - RNA, 14 nt, Homo sapiens
gauuaaugcuaaau

SEQ ID NO: 1397228 - RNA, 18 nt, Homo sapiens
gauuacaggugugaacca

SEQ ID NO: 1397229 - RNA, 17 nt, Homo sapiens
gauuacucuuugagaua

SEQ ID NO: 1397230 - RNA, 14 nt, Homo sapiens
gauuacugucaaua

SEQ ID NO: 1397231 - RNA, 14 nt, Homo sapiens
gauuagacagucaa

SEQ ID NO: 1397232 - RNA, 22 nt, Homo sapiens
gauuauuagccagguaauguga

SEQ ID NO: 1397233 - RNA, 14 nt, Homo sapiens
gauuauuuaucaca

SEQ ID NO: 1397234 - RNA, 14 nt, Homo sapiens
gauucaaaucuaug

SEQ ID NO: 1397235 - RNA, 12 nt, Homo sapiens
gauuccagagag

SEQ ID NO: 1397236 - RNA, 19 nt, Homo sapiens
gauuccaggcgaugugcaa

SEQ ID NO: 1397237 - RNA, 23 nt, Homo sapiens
gauuccgcaccaauaaagccuuc

SEQ ID NO: 1397238 - RNA, 15 nt, Homo sapiens
gauucuaccacacag

SEQ ID NO: 1397239 - RNA, 21 nt, Homo sapiens
gauucuaugaggcaaccacag

SEQ ID NO: 1397240 - RNA, 15 nt, Homo sapiens
gauucuaugucucau

SEQ ID NO: 1397241 - RNA, 16 nt, Homo sapiens
gauucucgcuuaaaaa

SEQ ID NO: 1397242 - RNA, 17 nt, Homo sapiens
gauucucuccugauuau

SEQ ID NO: 1397243 - RNA, 20 nt, Homo sapiens
gauucuucucuuaauuucau

SEQ ID NO: 1397244 - RNA, 20 nt, Homo sapiens
gauugcgccauugcacucca

SEQ ID NO: 1397245 - RNA, 22 nt, Homo sapiens
gauuggccccacugacguuggc

SEQ ID NO: 1397246 - RNA, 19 nt, Homo sapiens
gauuguuuuugcucaaggc

SEQ ID NO: 1397247 - RNA, 21 nt, Homo sapiens
gauuuaucacacaaagcagaa

SEQ ID NO: 1397248 - RNA, 15 nt, Homo sapiens
gauuucacagugugu

SEQ ID NO: 1397249 - RNA, 19 nt, Homo sapiens
gauuuccacacgccaagcu

SEQ ID NO: 1397250 - RNA, 14 nt, Homo sapiens
gauuuccacaguga

SEQ ID NO: 1397251 - RNA, 19 nt, Homo sapiens
gauuucugacuuggggaaa

SEQ ID NO: 1397252 - RNA, 21 nt, Homo sapiens
gauuucuuccagaaggcaaaa

SEQ ID NO: 1397253 - RNA, 20 nt, Homo sapiens
gauuuuacauguggcccaac

SEQ ID NO: 1397254 - RNA, 12 nt, Homo sapiens
gauuuuggcaaa

SEQ ID NO: 1397255 - RNA, 14 nt, Homo sapiens
gauuuuggcaaagc

SEQ ID NO: 1397256 - RNA, 20 nt, Homo sapiens
gcaaaaaagaaaaauaauca

SEQ ID NO: 1397257 - RNA, 15 nt, Homo sapiens
gcaaaaaaguacuua

SEQ ID NO: 1397258 - RNA, 19 nt, Homo sapiens
gcaaaaccacuagaacucu

SEQ ID NO: 1397259 - RNA, 17 nt, Homo sapiens
gcaaaacuccaucucaa

SEQ ID NO: 1397260 - RNA, 19 nt, Homo sapiens
gcaaaacuuaggcaugcac

SEQ ID NO: 1397261 - RNA, 17 nt, Homo sapiens
gcaaacuucagacugaa

SEQ ID NO: 1397262 - RNA, 18 nt, Homo sapiens
gcaaagauccccaaaaca

SEQ ID NO: 1397263 - RNA, 21 nt, Homo sapiens
gcaaagcauugagcaaagggg

SEQ ID NO: 1397264 - RNA, 17 nt, Homo sapiens
gcaaagggagcacuggg

SEQ ID NO: 1397265 - RNA, 23 nt, Homo sapiens
gcaaagugcugcuggaaguagaa

SEQ ID NO: 1397266 - RNA, 18 nt, Homo sapiens
gcaaauaaagaccugaga

SEQ ID NO: 1397267 - RNA, 18 nt, Homo sapiens
gcaaauauuuauaagcua

SEQ ID NO: 1397268 - RNA, 21 nt, Homo sapiens
gcaaauccuugauacugcuca

SEQ ID NO: 1397269 - RNA, 14 nt, Homo sapiens
gcaaaugcuguauu

SEQ ID NO: 1397270 - RNA, 13 nt, Homo sapiens
gcaaauguuacau

SEQ ID NO: 1397271 - RNA, 16 nt, Homo sapiens
gcaaauguuaugcaua

SEQ ID NO: 1397272 - RNA, 15 nt, Homo sapiens
gcaacaaaaauuacu

SEQ ID NO: 1397273 - RNA, 24 nt, Homo sapiens
gcaacagauggauagucuguccaa

SEQ ID NO: 1397274 - RNA, 16 nt, Homo sapiens
gcaacaggaacuguga

SEQ ID NO: 1397275 - RNA, 15 nt, Homo sapiens
gcaacuuagcucaca

SEQ ID NO: 1397276 - RNA, 15 nt, Homo sapiens
gcaagagaauuacuu

SEQ ID NO: 1397277 - RNA, 15 nt, Homo sapiens
gcaagcacaucugca

SEQ ID NO: 1397278 - RNA, 15 nt, Homo sapiens
gcaagcuauucaaug

SEQ ID NO: 1397279 - RNA, 17 nt, Homo sapiens
gcaaggacggccuucaa

SEQ ID NO: 1397280 - RNA, 22 nt, Homo sapiens
gcaaggacugcagggacugcca

SEQ ID NO: 1397281 - RNA, 14 nt, Homo sapiens
gcaagggcacuuaa

SEQ ID NO: 1397282 - RNA, 17 nt, Homo sapiens
gcaagugagacccuguc

SEQ ID NO: 1397283 - RNA, 15 nt, Homo sapiens
gcaagugugugcaca

SEQ ID NO: 1397284 - RNA, 17 nt, Homo sapiens
gcaagugugugcacaug

SEQ ID NO: 1397285 - RNA, 13 nt, Homo sapiens
gcaauaaguacca

SEQ ID NO: 1397286 - RNA, 17 nt, Homo sapiens
gcaauacagacuacuuc

SEQ ID NO: 1397287 - RNA, 22 nt, Homo sapiens
gcaauacagacuacuucuuccc

SEQ ID NO: 1397288 - RNA, 16 nt, Homo sapiens
ggcccccagugggcau

SEQ ID NO: 1397289 - RNA, 22 nt, Homo sapiens
ggcccccaugcaaggugcccac

SEQ ID NO: 1397290 - RNA, 16 nt, Homo sapiens
ggccccugcccggcug

SEQ ID NO: 1397291 - RNA, 23 nt, Homo sapiens
ggcccgugacauccccacccuug

SEQ ID NO: 1397292 - RNA, 13 nt, Homo sapiens
ggccgucuucacu

SEQ ID NO: 1397293 - RNA, 15 nt, Homo sapiens
ggccuaacacugggc

SEQ ID NO: 1397294 - RNA, 23 nt, Homo sapiens
ggccuaacacugggcugcagaga

SEQ ID NO: 1397295 - RNA, 16 nt, Homo sapiens
ggccucacuccaggaa

SEQ ID NO: 1397296 - RNA, 19 nt, Homo sapiens
ggccuccagcccucucacu

SEQ ID NO: 1397297 - RNA, 19 nt, Homo sapiens
ggccuccugugcaucugua

SEQ ID NO: 1397298 - RNA, 23 nt, Homo sapiens
ggccugccuugaagccacugaag

SEQ ID NO: 1397299 - RNA, 15 nt, Homo sapiens
ggccugguccaugau

SEQ ID NO: 1397300 - RNA, 16 nt, Homo sapiens
ggccugucgugccagu

SEQ ID NO: 1397301 - RNA, 11 nt, Homo sapiens
ggccuucucac

SEQ ID NO: 1397302 - RNA, 12 nt, Homo sapiens
ggccuucucacc

SEQ ID NO: 1397303 - RNA, 20 nt, Homo sapiens
ggcgacaguuuuccuucuca

SEQ ID NO: 1397304 - RNA, 17 nt, Homo sapiens
ggcgauggacuacugaa

SEQ ID NO: 1397305 - RNA, 15 nt, Homo sapiens
ggcgucugucuucaa

SEQ ID NO: 1397306 - RNA, 22 nt, Homo sapiens
ggcgugguagcgggcgccugua

SEQ ID NO: 1397307 - RNA, 22 nt, Homo sapiens
ggcuaagcacgggccauaugaa

SEQ ID NO: 1397308 - RNA, 13 nt, Homo sapiens
ggcuagaucauga

SEQ ID NO: 1397309 - RNA, 14 nt, Homo sapiens
ggcucagccucaaa

SEQ ID NO: 1397310 - RNA, 20 nt, Homo sapiens
ggcucagccucaaaugcagu

SEQ ID NO: 1397311 - RNA, 21 nt, Homo sapiens
ggcucagccucaaaugcagua

SEQ ID NO: 1397312 - RNA, 15 nt, Homo sapiens
ggcucccagggccau

SEQ ID NO: 1397313 - RNA, 20 nt, Homo sapiens
ggcucccagggccaugaacu

SEQ ID NO: 1397314 - RNA, 16 nt, Homo sapiens
ggcuccuggggcaaug

SEQ ID NO: 1397315 - RNA, 23 nt, Homo sapiens
ggcugacacguccaccccagugc

SEQ ID NO: 1397316 - RNA, 19 nt, Homo sapiens
ggcugacucuaggugcccu

SEQ ID NO: 1397317 - RNA, 15 nt, Homo sapiens
ggcugaggauuucaa

SEQ ID NO: 1397318 - RNA, 17 nt, Homo sapiens
ggcugcacccacccagg

SEQ ID NO: 1397319 - RNA, 19 nt, Homo sapiens
ggcugcagugagcugagau

SEQ ID NO: 1397320 - RNA, 18 nt, Homo sapiens
ggcugcccacacacccca

SEQ ID NO: 1397321 - RNA, 17 nt, Homo sapiens
ggcugccugagcaccuc

SEQ ID NO: 1397322 - RNA, 20 nt, Homo sapiens
ggcuggacuccagaucugca

SEQ ID NO: 1397323 - RNA, 19 nt, Homo sapiens
ggcuggaguggaguggcgu

SEQ ID NO: 1397324 - RNA, 19 nt, Homo sapiens
ggcuggaugugguggcaua

SEQ ID NO: 1397325 - RNA, 11 nt, Homo sapiens
ggcuggcacug

SEQ ID NO: 1397326 - RNA, 12 nt, Homo sapiens
ggcuggcuuccu

SEQ ID NO: 1397327 - RNA, 22 nt, Homo sapiens
ggcugggggccucagugccacu

SEQ ID NO: 1397328 - RNA, 14 nt, Homo sapiens
ggcuggguggcacc

SEQ ID NO: 1397329 - RNA, 18 nt, Homo sapiens
ggcugucaucagccugug

SEQ ID NO: 1397330 - RNA, 20 nt, Homo sapiens
ggcugugggcucccuuccuc

SEQ ID NO: 1397331 - RNA, 20 nt, Homo sapiens
ggcuuacacccacaguggaa

SEQ ID NO: 1397332 - RNA, 21 nt, Homo sapiens
ggcuuuacaaagcuggcaaua

SEQ ID NO: 1397333 - RNA, 22 nt, Homo sapiens
ggcuuucuggagaggagggaug

SEQ ID NO: 1397334 - RNA, 21 nt, Homo sapiens
ggcuuuggaagccaugugauu

SEQ ID NO: 1397335 - RNA, 20 nt, Homo sapiens
gggaacauauuuaaggaaca

SEQ ID NO: 1397336 - RNA, 12 nt, Homo sapiens
gggaagccaaaa

SEQ ID NO: 1397337 - RNA, 18 nt, Homo sapiens
gggaauauuuuauucaag

SEQ ID NO: 1397338 - RNA, 17 nt, Homo sapiens
gggaauugaggucugcu

SEQ ID NO: 1397339 - RNA, 15 nt, Homo sapiens
gggaauugcagagua

SEQ ID NO: 1397340 - RNA, 17 nt, Homo sapiens
gggacaauaaauuuugc

SEQ ID NO: 1397341 - RNA, 20 nt, Homo sapiens
gggacagagcagaacuuuca

SEQ ID NO: 1397342 - RNA, 11 nt, Homo sapiens
gggacauucca

SEQ ID NO: 1397343 - RNA, 17 nt, Homo sapiens
gggacauuccaauuugc

SEQ ID NO: 1397344 - RNA, 19 nt, Homo sapiens
gggaccuggggaagcaaaa

SEQ ID NO: 1397345 - RNA, 14 nt, Homo sapiens
gggagcgaaaguug

SEQ ID NO: 1397346 - RNA, 20 nt, Homo sapiens
gggagcggaaagcagcucaa

SEQ ID NO: 1397347 - RNA, 20 nt, Homo sapiens
gggaggcggagcuugcagug

SEQ ID NO: 1397348 - RNA, 13 nt, Homo sapiens
gggaggcuucccc

SEQ ID NO: 1397349 - RNA, 21 nt, Homo sapiens
gggagucugaagcagaugcaa

SEQ ID NO: 1397350 - RNA, 17 nt, Homo sapiens
gggauccguacauucaa

SEQ ID NO: 1397351 - RNA, 13 nt, Homo sapiens
gggaugcuugccu

SEQ ID NO: 1397352 - RNA, 12 nt, Homo sapiens
gggcaacagagc

SEQ ID NO: 1397353 - RNA, 22 nt, Homo sapiens
gggcaccacccgcuuucuugcu

SEQ ID NO: 1397354 - RNA, 18 nt, Homo sapiens
gggcacugaggaccagcc

SEQ ID NO: 1397355 - RNA, 15 nt, Homo sapiens
gggcagaucaccaga

SEQ ID NO: 1397356 - RNA, 13 nt, Homo sapiens
gggcagucaccug

SEQ ID NO: 1397357 - RNA, 16 nt, Homo sapiens
gggcauccaacugaga

SEQ ID NO: 1397358 - RNA, 11 nt, Homo sapiens
gggcaucuccu

SEQ ID NO: 1397359 - RNA, 11 nt, Homo sapiens
gggccaaauau

SEQ ID NO: 1397360 - RNA, 18 nt, Homo sapiens
gggccaggugcacagacg

SEQ ID NO: 1397361 - RNA, 23 nt, Homo sapiens
gggccuguacaaaagggacauga

SEQ ID NO: 1397362 - RNA, 16 nt, Homo sapiens
gggccugucgugccag

SEQ ID NO: 1397363 - RNA, 17 nt, Homo sapiens
gggcgagucacugccuc

SEQ ID NO: 1397364 - RNA, 14 nt, Homo sapiens
gggcucagccuggu

SEQ ID NO: 1397365 - RNA, 14 nt, Homo sapiens
gggcugagacugga

SEQ ID NO: 1397366 - RNA, 14 nt, Homo sapiens
gggcugcccugcca

SEQ ID NO: 1397367 - RNA, 11 nt, Homo sapiens
gggcugugauc

SEQ ID NO: 1397368 - RNA, 19 nt, Homo sapiens
gggcugugucguagccaag

SEQ ID NO: 1397369 - RNA, 16 nt, Homo sapiens
gggcuuauccaugccu

SEQ ID NO: 1397370 - RNA, 22 nt, Homo sapiens
ggggaggccaagugcaggcugg

SEQ ID NO: 1397371 - RNA, 22 nt, Homo sapiens
ggggcccaaauucuuucagugg

SEQ ID NO: 1397372 - RNA, 16 nt, Homo sapiens
ggggcucugugcaggg

SEQ ID NO: 1397373 - RNA, 15 nt, Homo sapiens
ggggcugaggggcaa

SEQ ID NO: 1397374 - RNA, 10 nt, Homo sapiens
ggggcuuccu

SEQ ID NO: 1397375 - RNA, 10 nt, Homo sapiens
ggggggcccg

SEQ ID NO: 1397376 - RNA, 13 nt, Homo sapiens
ggggguuccguga

SEQ ID NO: 1397377 - RNA, 20 nt, Homo sapiens
ggggucccauagaggugagg

SEQ ID NO: 1397378 - RNA, 14 nt, Homo sapiens
ggggugcagcagug

SEQ ID NO: 1397379 - RNA, 22 nt, Homo sapiens
ggguaggcgggaaggaggguua

SEQ ID NO: 1397380 - RNA, 19 nt, Homo sapiens
gggucagagaggagucaga

SEQ ID NO: 1397381 - RNA, 11 nt, Homo sapiens
gggugggagag

SEQ ID NO: 1397382 - RNA, 18 nt, Homo sapiens
gggugguuuuugagccau

SEQ ID NO: 1397383 - RNA, 19 nt, Homo sapiens
gggugugaaagguuuccaa

SEQ ID NO: 1397384 - RNA, 14 nt, Homo sapiens
gggugugucugcuc

SEQ ID NO: 1397385 - RNA, 17 nt, Homo sapiens
gguaaaaccccaucucu

SEQ ID NO: 1397386 - RNA, 23 nt, Homo sapiens
gguaacuuuuuuuuaaagcucau

SEQ ID NO: 1397387 - RNA, 20 nt, Homo sapiens
gguacacguaaaucuguuca

SEQ ID NO: 1397388 - RNA, 21 nt, Homo sapiens
gguauauucauuucaaaggga

SEQ ID NO: 1397389 - RNA, 13 nt, Homo sapiens
gguaucaggugcu

SEQ ID NO: 1397390 - RNA, 21 nt, Homo sapiens
gguaucauuuucugcauuuaa

SEQ ID NO: 1397391 - RNA, 14 nt, Homo sapiens
gguaucccaaaaau

SEQ ID NO: 1397392 - RNA, 15 nt, Homo sapiens
gguaucuacuucuac

SEQ ID NO: 1397393 - RNA, 18 nt, Homo sapiens
gguaugaucacggcucac

SEQ ID NO: 1397394 - RNA, 18 nt, Homo sapiens
gguauuugagacauucca

SEQ ID NO: 1397395 - RNA, 15 nt, Homo sapiens
ggucaaaggcucaaa

SEQ ID NO: 1397396 - RNA, 14 nt, Homo sapiens
ggucaagcccagga

SEQ ID NO: 1397397 - RNA, 15 nt, Homo sapiens
gguccuggcuccuga

SEQ ID NO: 1397398 - RNA, 14 nt, Homo sapiens
ggucgugaggccag

SEQ ID NO: 1397399 - RNA, 20 nt, Homo sapiens
ggucucgcuuuguugcccag

SEQ ID NO: 1397400 - RNA, 16 nt, Homo sapiens
ggucugauuucaggau

SEQ ID NO: 1397401 - RNA, 23 nt, Homo sapiens
ggucuguuguaggguugccagau

SEQ ID NO: 1397402 - RNA, 19 nt, Homo sapiens
ugaaaaggguguugcuaag

SEQ ID NO: 1397403 - RNA, 14 nt, Homo sapiens
ugaaaaugaaccau

SEQ ID NO: 1397404 - RNA, 19 nt, Homo sapiens
ugaaaaugaaccauucaca

SEQ ID NO: 1397405 - RNA, 13 nt, Homo sapiens
ugaaacagcugcc

SEQ ID NO: 1397406 - RNA, 15 nt, Homo sapiens
ugaaaccucaucucu

SEQ ID NO: 1397407 - RNA, 23 nt, Homo sapiens
ugaaacuaacagauaagcaagag

SEQ ID NO: 1397408 - RNA, 20 nt, Homo sapiens
ugaaagcugauuacugucaa

SEQ ID NO: 1397409 - RNA, 14 nt, Homo sapiens
ugaaaggcauguga

SEQ ID NO: 1397410 - RNA, 18 nt, Homo sapiens
ugaaaggcaugugaaggg

SEQ ID NO: 1397411 - RNA, 17 nt, Homo sapiens
ugaaaggcauucucuga

SEQ ID NO: 1397412 - RNA, 13 nt, Homo sapiens
ugaaagggcaaua

SEQ ID NO: 1397413 - RNA, 23 nt, Homo sapiens
ugaaauaccaaccugaagacacc

SEQ ID NO: 1397414 - RNA, 12 nt, Homo sapiens
ugaaauaugcau

SEQ ID NO: 1397415 - RNA, 14 nt, Homo sapiens
ugaaauaugcaucu

SEQ ID NO: 1397416 - RNA, 16 nt, Homo sapiens
ugaaaucugugcaaua

SEQ ID NO: 1397417 - RNA, 21 nt, Homo sapiens
ugaaaugcagagucaaugaac

SEQ ID NO: 1397418 - RNA, 16 nt, Homo sapiens
ugaaaugcuggcauuu

SEQ ID NO: 1397419 - RNA, 20 nt, Homo sapiens
ugaaaugucuggucugucca

SEQ ID NO: 1397420 - RNA, 22 nt, Homo sapiens
ugaaauuguaagugaaguaaaa

SEQ ID NO: 1397421 - RNA, 13 nt, Homo sapiens
ugaacaaaugaca

SEQ ID NO: 1397422 - RNA, 23 nt, Homo sapiens
ugaacaccacgcuugacaggaca

SEQ ID NO: 1397423 - RNA, 12 nt, Homo sapiens
ugaacacugggg

SEQ ID NO: 1397424 - RNA, 11 nt, Homo sapiens
ugaacagaauu

SEQ ID NO: 1397425 - RNA, 19 nt, Homo sapiens
ugaacucgcuucucuguga

SEQ ID NO: 1397426 - RNA, 17 nt, Homo sapiens
ugaacucuuucuggccu

SEQ ID NO: 1397427 - RNA, 12 nt, Homo sapiens
ugaagacugggu

SEQ ID NO: 1397428 - RNA, 18 nt, Homo sapiens
ugaagagaccaagacucu

SEQ ID NO: 1397429 - RNA, 15 nt, Homo sapiens
ugaagagcuauuaua

SEQ ID NO: 1397430 - RNA, 22 nt, Homo sapiens
ugaagaggaagggcaaaaccac

SEQ ID NO: 1397431 - RNA, 19 nt, Homo sapiens
ugaagagugagagggcaug

SEQ ID NO: 1397432 - RNA, 15 nt, Homo sapiens
ugaagauacaggaca

SEQ ID NO: 1397433 - RNA, 15 nt, Homo sapiens
ugaagaugaugcuau

SEQ ID NO: 1397434 - RNA, 21 nt, Homo sapiens
ugaagaugccagugaaacuuc

SEQ ID NO: 1397435 - RNA, 17 nt, Homo sapiens
ugaaguacuaagcgcua

SEQ ID NO: 1397436 - RNA, 16 nt, Homo sapiens
ugaaguagaauccuaa

SEQ ID NO: 1397437 - RNA, 14 nt, Homo sapiens
ugaagucacacagu

SEQ ID NO: 1397438 - RNA, 11 nt, Homo sapiens
ugaagugcaau

SEQ ID NO: 1397439 - RNA, 21 nt, Homo sapiens
ugaaguuuaaacucugcucag

SEQ ID NO: 1397440 - RNA, 19 nt, Homo sapiens
ugaauaaaguugaagcuaa

SEQ ID NO: 1397441 - RNA, 16 nt, Homo sapiens
ugaauaaccacuuaaa

SEQ ID NO: 1397442 - RNA, 13 nt, Homo sapiens
ugaauaauacagu

SEQ ID NO: 1397443 - RNA, 16 nt, Homo sapiens
ugaauaauacaguauc

SEQ ID NO: 1397444 - RNA, 22 nt, Homo sapiens
ugaauauaaauuuguguucuca

SEQ ID NO: 1397445 - RNA, 17 nt, Homo sapiens
ugaauaugauuaguaaa

SEQ ID NO: 1397446 - RNA, 12 nt, Homo sapiens
ugaaucacagua

SEQ ID NO: 1397447 - RNA, 14 nt, Homo sapiens
ugaaucacaguaua

SEQ ID NO: 1397448 - RNA, 22 nt, Homo sapiens
ugaaucacaguauacgcuccau

SEQ ID NO: 1397449 - RNA, 14 nt, Homo sapiens
ugaaucaccugugg

SEQ ID NO: 1397450 - RNA, 13 nt, Homo sapiens
ugaauccuacaua

SEQ ID NO: 1397451 - RNA, 16 nt, Homo sapiens
ugaaugaaagucuugu

SEQ ID NO: 1397452 - RNA, 18 nt, Homo sapiens
ugaaugugucacuacuca

SEQ ID NO: 1397453 - RNA, 15 nt, Homo sapiens
ugaauugaaauguuc

SEQ ID NO: 1397454 - RNA, 15 nt, Homo sapiens
ugaauuucuaaaaaa

SEQ ID NO: 1397455 - RNA, 14 nt, Homo sapiens
ugaauuucucuaca

SEQ ID NO: 1397456 - RNA, 21 nt, Homo sapiens
ugaauuuggccugcacuaauu

SEQ ID NO: 1397457 - RNA, 20 nt, Homo sapiens
ugaauuuuguguguaccugu

SEQ ID NO: 1397458 - RNA, 14 nt, Homo sapiens
ugaauuuuguugcu

SEQ ID NO: 1397459 - RNA, 17 nt, Homo sapiens
ugacaaggccccagaga

SEQ ID NO: 1397460 - RNA, 15 nt, Homo sapiens
ugacaagugagacaa

SEQ ID NO: 1397461 - RNA, 16 nt, Homo sapiens
ugacaaucaacucuaa

SEQ ID NO: 1397462 - RNA, 18 nt, Homo sapiens
ugacaaugggagccucau

SEQ ID NO: 1397463 - RNA, 12 nt, Homo sapiens
ugacacacagcu

SEQ ID NO: 1397464 - RNA, 19 nt, Homo sapiens
ugacacuagcuaauaucaa

SEQ ID NO: 1397465 - RNA, 13 nt, Homo sapiens
ugacacugagaac

SEQ ID NO: 1397466 - RNA, 17 nt, Homo sapiens
ugacacuuugccagaaa

SEQ ID NO: 1397467 - RNA, 14 nt, Homo sapiens
ugacaggcaaugcu

SEQ ID NO: 1397468 - RNA, 15 nt, Homo sapiens
ugacaguaugcauua

SEQ ID NO: 1397469 - RNA, 17 nt, Homo sapiens
ugacagugccugggaau

SEQ ID NO: 1397470 - RNA, 15 nt, Homo sapiens
ugacaucaguggcau

SEQ ID NO: 1397471 - RNA, 14 nt, Homo sapiens
ugacauccaagcuu

SEQ ID NO: 1397472 - RNA, 14 nt, Homo sapiens
ugacauuguuggcc

SEQ ID NO: 1397473 - RNA, 22 nt, Homo sapiens
ugaccaauauuauacuaagaaa

SEQ ID NO: 1397474 - RNA, 18 nt, Homo sapiens
ugaccacauccaccuuua

SEQ ID NO: 1397475 - RNA, 16 nt, Homo sapiens
ugaccagcaacuuguc

SEQ ID NO: 1397476 - RNA, 16 nt, Homo sapiens
ugaccaguuguugaua

SEQ ID NO: 1397477 - RNA, 19 nt, Homo sapiens
ugaccaucccaacuuuggu

SEQ ID NO: 1397478 - RNA, 16 nt, Homo sapiens
ugaccauuucaggggu

SEQ ID NO: 1397479 - RNA, 23 nt, Homo sapiens
ugacccacuuaccuugcaucuca

SEQ ID NO: 1397480 - RNA, 23 nt, Homo sapiens
ugaccccuguccccacacugacc

SEQ ID NO: 1397481 - RNA, 20 nt, Homo sapiens
ugacccucugacccuagcuc

SEQ ID NO: 1397482 - RNA, 18 nt, Homo sapiens
ugaccucauuuguaaaau

SEQ ID NO: 1397483 - RNA, 14 nt, Homo sapiens
ugaccucccaguga

SEQ ID NO: 1397484 - RNA, 20 nt, Homo sapiens
ugaccucgcccuccacaaau

SEQ ID NO: 1397485 - RNA, 16 nt, Homo sapiens
ugaccugccaggcaca

SEQ ID NO: 1397486 - RNA, 16 nt, Homo sapiens
ugaccugugucacuac

SEQ ID NO: 1397487 - RNA, 15 nt, Homo sapiens
ugaccuguguucccu

SEQ ID NO: 1397488 - RNA, 14 nt, Homo sapiens
ugaccuugagcaaa

SEQ ID NO: 1397489 - RNA, 14 nt, Homo sapiens
ugaccuugaucaag

SEQ ID NO: 1397490 - RNA, 18 nt, Homo sapiens
ugacgcggcucaaaagga

SEQ ID NO: 1397491 - RNA, 18 nt, Homo sapiens
ugacggcgcccccagugu

SEQ ID NO: 1397492 - RNA, 12 nt, Homo sapiens
ugacuaaacaac

SEQ ID NO: 1397493 - RNA, 20 nt, Homo sapiens
ugacuaaacaacuaccuccu

SEQ ID NO: 1397494 - RNA, 19 nt, Homo sapiens
ugacucaacauguuacuga

SEQ ID NO: 1397495 - RNA, 23 nt, Homo sapiens
ugacucuccagaaagcucaucuc

SEQ ID NO: 1397496 - RNA, 17 nt, Homo sapiens
ugacugacugcaccuuc

SEQ ID NO: 1397497 - RNA, 21 nt, Homo sapiens
ugacugccucugccugucgca

SEQ ID NO: 1397498 - RNA, 12 nt, Homo sapiens
ugacuguaucug

SEQ ID NO: 1397499 - RNA, 17 nt, Homo sapiens
ugacuguaucuguguag

SEQ ID NO: 1397500 - RNA, 20 nt, Homo sapiens
ugacuugagaaacaaauaau

SEQ ID NO: 1397501 - RNA, 23 nt, Homo sapiens
ugagaaaccuuauuguaccucuc

SEQ ID NO: 1397502 - RNA, 14 nt, Homo sapiens
ugagaaaguucuca

SEQ ID NO: 1397503 - RNA, 14 nt, Homo sapiens
ugagaacugcauau

SEQ ID NO: 1397504 - RNA, 14 nt, Homo sapiens
ugagaacuugacaa

SEQ ID NO: 1397505 - RNA, 20 nt, Homo sapiens
ugagaagugucuaaaaacac

SEQ ID NO: 1397506 - RNA, 16 nt, Homo sapiens
ugagacccugucucaa

SEQ ID NO: 1397507 - RNA, 23 nt, Homo sapiens
ugagauccuuuaaauccuuccau

SEQ ID NO: 1397508 - RNA, 22 nt, Homo sapiens
ugagaugcaggauuucuucaca

SEQ ID NO: 1397509 - RNA, 14 nt, Homo sapiens
ugagcaaaaccaaa

SEQ ID NO: 1397510 - RNA, 14 nt, Homo sapiens
ugagcaaacaaaac

SEQ ID NO: 1397511 - RNA, 17 nt, Homo sapiens
ugagcaaacaaaaccac

SEQ ID NO: 1397512 - RNA, 14 nt, Homo sapiens
ugagcaaaggugau

SEQ ID NO: 1397513 - RNA, 21 nt, Homo sapiens
ugagccaaagagaaugccauu

SEQ ID NO: 1397514 - RNA, 13 nt, Homo sapiens
ugagccaguguca

SEQ ID NO: 1397515 - RNA, 16 nt, Homo sapiens
ugagcuccaguggaag

SEQ ID NO: 1397516 - RNA, 16 nt, Homo sapiens
uggguaucaaacagcu

SEQ ID NO: 1397517 - RNA, 18 nt, Homo sapiens
ugggucuucagggggcca

SEQ ID NO: 1397518 - RNA, 19 nt, Homo sapiens
ugggucuucagggggccag

SEQ ID NO: 1397519 - RNA, 20 nt, Homo sapiens
ugggugaauaauacaguauc

SEQ ID NO: 1397520 - RNA, 21 nt, Homo sapiens
uggguggggcugcuccuccag

SEQ ID NO: 1397521 - RNA, 20 nt, Homo sapiens
ugggugucaagagggucuga

SEQ ID NO: 1397522 - RNA, 15 nt, Homo sapiens
ugggugucucugcau

SEQ ID NO: 1397523 - RNA, 13 nt, Homo sapiens
ugguaagcuucca

SEQ ID NO: 1397524 - RNA, 19 nt, Homo sapiens
ugguaauaaguacugugua

SEQ ID NO: 1397525 - RNA, 12 nt, Homo sapiens
ugguaugaucac

SEQ ID NO: 1397526 - RNA, 12 nt, Homo sapiens
ugguaugugaca

SEQ ID NO: 1397527 - RNA, 19 nt, Homo sapiens
uggucagguuauacuccuc

SEQ ID NO: 1397528 - RNA, 20 nt, Homo sapiens
uggucguuuucaacagaauu

SEQ ID NO: 1397529 - RNA, 16 nt, Homo sapiens
uggucucuauacuaca

SEQ ID NO: 1397530 - RNA, 15 nt, Homo sapiens
uggucugagccaaag

SEQ ID NO: 1397531 - RNA, 20 nt, Homo sapiens
uggucuuguggaauugggag

SEQ ID NO: 1397532 - RNA, 19 nt, Homo sapiens
uggugaaacauacgacaga

SEQ ID NO: 1397533 - RNA, 23 nt, Homo sapiens
uggugaaagaaaauucuuggaau

SEQ ID NO: 1397534 - RNA, 19 nt, Homo sapiens
uggugaauuugaaucucaa

SEQ ID NO: 1397535 - RNA, 19 nt, Homo sapiens
uggugagccgagauugcac

SEQ ID NO: 1397536 - RNA, 13 nt, Homo sapiens
uggugauuuagca

SEQ ID NO: 1397537 - RNA, 13 nt, Homo sapiens
uggugcuggauau

SEQ ID NO: 1397538 - RNA, 16 nt, Homo sapiens
ugguggcagugcagca

SEQ ID NO: 1397539 - RNA, 19 nt, Homo sapiens
ugguggcccacgccuguaa

SEQ ID NO: 1397540 - RNA, 14 nt, Homo sapiens
ugguggucagggag

SEQ ID NO: 1397541 - RNA, 22 nt, Homo sapiens
ugguguacaaaauggaauucau

SEQ ID NO: 1397542 - RNA, 22 nt, Homo sapiens
ugguguuaccuuagcuaacuaa

SEQ ID NO: 1397543 - RNA, 18 nt, Homo sapiens
ugguguuuacccaguauu

SEQ ID NO: 1397544 - RNA, 20 nt, Homo sapiens
ugguuaauaaguuucacuga

SEQ ID NO: 1397545 - RNA, 15 nt, Homo sapiens
ugguuacacuguuag

SEQ ID NO: 1397546 - RNA, 16 nt, Homo sapiens
ugguucaguaccacau

SEQ ID NO: 1397547 - RNA, 15 nt, Homo sapiens
ugguugagguuucaa

SEQ ID NO: 1397548 - RNA, 19 nt, Homo sapiens
ugguugccuuaaaagaaau

SEQ ID NO: 1397549 - RNA, 18 nt, Homo sapiens
ugguuucuagcaugaaga

SEQ ID NO: 1397550 - RNA, 14 nt, Homo sapiens
ugguuuuugagcca

SEQ ID NO: 1397551 - RNA, 18 nt, Homo sapiens
uguaaaagagucaucugg

SEQ ID NO: 1397552 - RNA, 23 nt, Homo sapiens
uguaaaaugucuguuaacuuaau

SEQ ID NO: 1397553 - RNA, 15 nt, Homo sapiens
uguaaacacugaugg

SEQ ID NO: 1397554 - RNA, 16 nt, Homo sapiens
uguaaacccucaaggg

SEQ ID NO: 1397555 - RNA, 19 nt, Homo sapiens
uguaaacuguacuagucug

SEQ ID NO: 1397556 - RNA, 18 nt, Homo sapiens
uguaaagaauuuagcugu

SEQ ID NO: 1397557 - RNA, 20 nt, Homo sapiens
uguaaagacaaaaaacuaua

SEQ ID NO: 1397558 - RNA, 15 nt, Homo sapiens
uguaaagcaggugcc

SEQ ID NO: 1397559 - RNA, 12 nt, Homo sapiens
uguaaauaaaua

SEQ ID NO: 1397560 - RNA, 20 nt, Homo sapiens
uguaaauacuguuuuuaaca

SEQ ID NO: 1397561 - RNA, 14 nt, Homo sapiens
uguaagaaacacac

SEQ ID NO: 1397562 - RNA, 16 nt, Homo sapiens
uguaagaaagcauaga

SEQ ID NO: 1397563 - RNA, 14 nt, Homo sapiens
uguaaggugcuaca

SEQ ID NO: 1397564 - RNA, 14 nt, Homo sapiens
uguaaucauauaau

SEQ ID NO: 1397565 - RNA, 17 nt, Homo sapiens
uguaaugucaccaccuu

SEQ ID NO: 1397566 - RNA, 23 nt, Homo sapiens
uguaauuuuaaauaaaagugauc

SEQ ID NO: 1397567 - RNA, 12 nt, Homo sapiens
uguacaaaaggg

SEQ ID NO: 1397568 - RNA, 20 nt, Homo sapiens
uguacaacuuuuuaccuagu

SEQ ID NO: 1397569 - RNA, 18 nt, Homo sapiens
uguacauaauucuugcua

SEQ ID NO: 1397570 - RNA, 15 nt, Homo sapiens
uguaccacaaacaca

SEQ ID NO: 1397571 - RNA, 12 nt, Homo sapiens
uguaccagagaa

SEQ ID NO: 1397572 - RNA, 13 nt, Homo sapiens
uguaccauguaca

SEQ ID NO: 1397573 - RNA, 18 nt, Homo sapiens
uguacgucugacaggcaa

SEQ ID NO: 1397574 - RNA, 21 nt, Homo sapiens
uguacuguaauagugugauua

SEQ ID NO: 1397575 - RNA, 18 nt, Homo sapiens
uguacuguuacuguguca

SEQ ID NO: 1397576 - RNA, 19 nt, Homo sapiens
uguacuguuacugugucag

SEQ ID NO: 1397577 - RNA, 11 nt, Homo sapiens
uguacuguuga

SEQ ID NO: 1397578 - RNA, 18 nt, Homo sapiens
uguagaaaagaacuggaa

SEQ ID NO: 1397579 - RNA, 20 nt, Homo sapiens
uguagaagaaagagcaacaa

SEQ ID NO: 1397580 - RNA, 15 nt, Homo sapiens
uguagacucuggaag

SEQ ID NO: 1397581 - RNA, 20 nt, Homo sapiens
uguagagauggggucucaca

SEQ ID NO: 1397582 - RNA, 16 nt, Homo sapiens
uguagagcuucuggca

SEQ ID NO: 1397583 - RNA, 10 nt, Homo sapiens
uguagagugg

SEQ ID NO: 1397584 - RNA, 15 nt, Homo sapiens
uguagcuuugcucuu

SEQ ID NO: 1397585 - RNA, 23 nt, Homo sapiens
uguagcuuugcucuuugguagaa

SEQ ID NO: 1397586 - RNA, 21 nt, Homo sapiens
uguagucccagcuacucagga

SEQ ID NO: 1397587 - RNA, 18 nt, Homo sapiens
uguauauaaacauaucaa

SEQ ID NO: 1397588 - RNA, 17 nt, Homo sapiens
uguaucaaacuagugca

SEQ ID NO: 1397589 - RNA, 13 nt, Homo sapiens
uguaugugccauu

SEQ ID NO: 1397590 - RNA, 18 nt, Homo sapiens
uguauguuccucuaugaa

SEQ ID NO: 1397591 - RNA, 23 nt, Homo sapiens
uguauucacgugcagcagcaaca

SEQ ID NO: 1397592 - RNA, 22 nt, Homo sapiens
uguauuuauccaauaaauguga

SEQ ID NO: 1397593 - RNA, 19 nt, Homo sapiens
ugucaauaaaaccacugua

SEQ ID NO: 1397594 - RNA, 20 nt, Homo sapiens
ugucaauaaaaccacuguac

SEQ ID NO: 1397595 - RNA, 21 nt, Homo sapiens
ugucacaaccucucugaucuu

SEQ ID NO: 1397596 - RNA, 22 nt, Homo sapiens
ugucacuacgugacuguggcac

SEQ ID NO: 1397597 - RNA, 22 nt, Homo sapiens
ugucacuacucacagucucuuu

SEQ ID NO: 1397598 - RNA, 21 nt, Homo sapiens
ugucagaaaccaguuauguga

SEQ ID NO: 1397599 - RNA, 16 nt, Homo sapiens
ugucagcuuccaaaca

SEQ ID NO: 1397600 - RNA, 12 nt, Homo sapiens
ugucagugcagc

SEQ ID NO: 1397601 - RNA, 11 nt, Homo sapiens
ugucaucucag

SEQ ID NO: 1397602 - RNA, 23 nt, Homo sapiens
ugucauuuuuauaaaacuuugaa

SEQ ID NO: 1397603 - RNA, 23 nt, Homo sapiens
uguccaaauggacauaagacaga

SEQ ID NO: 1397604 - RNA, 16 nt, Homo sapiens
uguccacagaugccuc

SEQ ID NO: 1397605 - RNA, 18 nt, Homo sapiens
uguccaugugugugcaag

SEQ ID NO: 1397606 - RNA, 23 nt, Homo sapiens
ugucccuuucuuggccaguuauc

SEQ ID NO: 1397607 - RNA, 23 nt, Homo sapiens
uguccgguggagaucccacccga

SEQ ID NO: 1397608 - RNA, 17 nt, Homo sapiens
uguccuccccucaagga

SEQ ID NO: 1397609 - RNA, 15 nt, Homo sapiens
uguccuuggggacau

SEQ ID NO: 1397610 - RNA, 19 nt, Homo sapiens
uguccuuggggacaucuca

SEQ ID NO: 1397611 - RNA, 12 nt, Homo sapiens
ugucgcccagug

SEQ ID NO: 1397612 - RNA, 16 nt, Homo sapiens
ugucgccucugcauuc

SEQ ID NO: 1397613 - RNA, 16 nt, Homo sapiens
ugucucaaaccuccaa

SEQ ID NO: 1397614 - RNA, 14 nt, Homo sapiens
ugucucagccuccc

SEQ ID NO: 1397615 - RNA, 21 nt, Homo sapiens
ugucuccacccguguccagca

SEQ ID NO: 1397616 - RNA, 19 nt, Homo sapiens
ugucuccaucucugucuca

SEQ ID NO: 1397617 - RNA, 11 nt, Homo sapiens
ugucucugcau

SEQ ID NO: 1397618 - RNA, 16 nt, Homo sapiens
ugucugacaaccucuu

SEQ ID NO: 1397619 - RNA, 16 nt, Homo sapiens
ugucuggacauucaga

SEQ ID NO: 1397620 - RNA, 19 nt, Homo sapiens
ugucuguaaugacaaauaa

SEQ ID NO: 1397621 - RNA, 14 nt, Homo sapiens
ugucugugugcaag

SEQ ID NO: 1397622 - RNA, 12 nt, Homo sapiens
ugucuuaccaga

SEQ ID NO: 1397623 - RNA, 13 nt, Homo sapiens
ugucuucucaggc

SEQ ID NO: 1397624 - RNA, 22 nt, Homo sapiens
ugucuuuaaaaguauccagaga

SEQ ID NO: 1397625 - RNA, 13 nt, Homo sapiens
ugucuuucacuga

SEQ ID NO: 1397626 - RNA, 18 nt, Homo sapiens
ugucuuuuuaagcuuauu

SEQ ID NO: 1397627 - RNA, 18 nt, Homo sapiens
ugucuuuuuucacuacau

SEQ ID NO: 1397628 - RNA, 23 nt, Homo sapiens
ugugaaagaaccaaaagagauca

SEQ ID NO: 1397629 - RNA, 13 nt, Homo sapiens
uugaaaagacauc

SEQ ID NO: 1397630 - RNA, 21 nt, Homo sapiens
uugaaaaggaagaucaggcca

SEQ ID NO: 1397631 - RNA, 16 nt, Homo sapiens
uugaaagcauccaugu

SEQ ID NO: 1397632 - RNA, 23 nt, Homo sapiens
uugaaauaauaaaucugguagaa

SEQ ID NO: 1397633 - RNA, 14 nt, Homo sapiens
uugaaauaguugau

SEQ ID NO: 1397634 - RNA, 18 nt, Homo sapiens
uugaaauuugccuugagu

SEQ ID NO: 1397635 - RNA, 15 nt, Homo sapiens
uugaacccaggagau

SEQ ID NO: 1397636 - RNA, 23 nt, Homo sapiens
uugaagcucuggugacaccagcc

SEQ ID NO: 1397637 - RNA, 21 nt, Homo sapiens
uugaaguuuuagcggucaauu

SEQ ID NO: 1397638 - RNA, 21 nt, Homo sapiens
uugaauaaagccugcuuuuua

SEQ ID NO: 1397639 - RNA, 22 nt, Homo sapiens
uugaaucacugcucacacugcu

SEQ ID NO: 1397640 - RNA, 20 nt, Homo sapiens
uugaauuaauccacacauca

SEQ ID NO: 1397641 - RNA, 23 nt, Homo sapiens
uugacaaacucucccuucacucc

SEQ ID NO: 1397642 - RNA, 17 nt, Homo sapiens
uugacaaccaugagacc

SEQ ID NO: 1397643 - RNA, 15 nt, Homo sapiens
uugacaauaauuuca

SEQ ID NO: 1397644 - RNA, 17 nt, Homo sapiens
uugacacggccaugacc

SEQ ID NO: 1397645 - RNA, 20 nt, Homo sapiens
uugacacuauucacuaaaau

SEQ ID NO: 1397646 - RNA, 15 nt, Homo sapiens
uugacagaacacugu

SEQ ID NO: 1397647 - RNA, 17 nt, Homo sapiens
uugacaggaauacuuaa

SEQ ID NO: 1397648 - RNA, 18 nt, Homo sapiens
uugacaggcuuauggaag

SEQ ID NO: 1397649 - RNA, 20 nt, Homo sapiens
uugacaucaaugaugaggcu

SEQ ID NO: 1397650 - RNA, 20 nt, Homo sapiens
uugacaucagcaucaccuag

SEQ ID NO: 1397651 - RNA, 11 nt, Homo sapiens
uugaccagcag

SEQ ID NO: 1397652 - RNA, 18 nt, Homo sapiens
uugaccucaaccugugau

SEQ ID NO: 1397653 - RNA, 22 nt, Homo sapiens
uugacuagggauucaggcugcu

SEQ ID NO: 1397654 - RNA, 20 nt, Homo sapiens
uugagaauuacccuuuugcc

SEQ ID NO: 1397655 - RNA, 14 nt, Homo sapiens
uugagacaggagac

SEQ ID NO: 1397656 - RNA, 17 nt, Homo sapiens
uugagacaggaugguua

SEQ ID NO: 1397657 - RNA, 22 nt, Homo sapiens
uugagcgugaaucuguaucuug

SEQ ID NO: 1397658 - RNA, 17 nt, Homo sapiens
uugaggauuuugaucca

SEQ ID NO: 1397659 - RNA, 18 nt, Homo sapiens
uugagguaggagaauugc

SEQ ID NO: 1397660 - RNA, 16 nt, Homo sapiens
uugauaguauugugca

SEQ ID NO: 1397661 - RNA, 12 nt, Homo sapiens
uugauagucaau

SEQ ID NO: 1397662 - RNA, 15 nt, Homo sapiens
uugaugaguguaaca

SEQ ID NO: 1397663 - RNA, 19 nt, Homo sapiens
uugaugauuaauucaccuu

SEQ ID NO: 1397664 - RNA, 14 nt, Homo sapiens
uugauguacuuuac

SEQ ID NO: 1397665 - RNA, 21 nt, Homo sapiens
uugauuuaauaacauaacaaa

SEQ ID NO: 1397666 - RNA, 10 nt, Homo sapiens
uugauuucaa

SEQ ID NO: 1397667 - RNA, 21 nt, Homo sapiens
uugcaaggcaaagacuauucc

SEQ ID NO: 1397668 - RNA, 14 nt, Homo sapiens
uugcaauggcagcc

SEQ ID NO: 1397669 - RNA, 19 nt, Homo sapiens
uugcagcuguaaacauauu

SEQ ID NO: 1397670 - RNA, 17 nt, Homo sapiens
uugcauguggccauuac

SEQ ID NO: 1397671 - RNA, 10 nt, Homo sapiens
uugcauuugg

SEQ ID NO: 1397672 - RNA, 17 nt, Homo sapiens
uugccagugacaugaga

SEQ ID NO: 1397673 - RNA, 17 nt, Homo sapiens
uugcccagagaugccuc

SEQ ID NO: 1397674 - RNA, 13 nt, Homo sapiens
uugcccagugugu

SEQ ID NO: 1397675 - RNA, 15 nt, Homo sapiens
uugccccugagacaa

SEQ ID NO: 1397676 - RNA, 20 nt, Homo sapiens
uugccccugagacaaaugga

SEQ ID NO: 1397677 - RNA, 17 nt, Homo sapiens
uugcccuucacaguguu

SEQ ID NO: 1397678 - RNA, 13 nt, Homo sapiens
uugccuucauccc

SEQ ID NO: 1397679 - RNA, 20 nt, Homo sapiens
uugcuaaaggaaaaaaccau

SEQ ID NO: 1397680 - RNA, 17 nt, Homo sapiens
uugcuacugguucagca

SEQ ID NO: 1397681 - RNA, 13 nt, Homo sapiens
uugcugcaucucc

SEQ ID NO: 1397682 - RNA, 15 nt, Homo sapiens
uugcuggcaaagaca

SEQ ID NO: 1397683 - RNA, 13 nt, Homo sapiens
uugcugugagcaa

SEQ ID NO: 1397684 - RNA, 15 nt, Homo sapiens
uugcuuauucacuga

SEQ ID NO: 1397685 - RNA, 19 nt, Homo sapiens
uuggaaaaagccugugaaa

SEQ ID NO: 1397686 - RNA, 19 nt, Homo sapiens
uuggaaaggaccaguaugc

SEQ ID NO: 1397687 - RNA, 20 nt, Homo sapiens
uuggaauuaugucugcugaa

SEQ ID NO: 1397688 - RNA, 16 nt, Homo sapiens
uuggacacacacagcu

SEQ ID NO: 1397689 - RNA, 20 nt, Homo sapiens
uuggacauuaagcaucacaa

SEQ ID NO: 1397690 - RNA, 21 nt, Homo sapiens
uuggacucaagcaagauuuca

SEQ ID NO: 1397691 - RNA, 16 nt, Homo sapiens
uuggauggagacucca

SEQ ID NO: 1397692 - RNA, 19 nt, Homo sapiens
uuggauggagacuccauga

SEQ ID NO: 1397693 - RNA, 12 nt, Homo sapiens
uuggcaugccuu

SEQ ID NO: 1397694 - RNA, 23 nt, Homo sapiens
uuggcccccgagcugggggccau

SEQ ID NO: 1397695 - RNA, 19 nt, Homo sapiens
uuggcuaguaaaagccauc

SEQ ID NO: 1397696 - RNA, 22 nt, Homo sapiens
uuggcuguagaaggagacagag

SEQ ID NO: 1397697 - RNA, 16 nt, Homo sapiens
uuggcuucuaaucaaa

SEQ ID NO: 1397698 - RNA, 15 nt, Homo sapiens
uugggaacugcaaua

SEQ ID NO: 1397699 - RNA, 13 nt, Homo sapiens
uugggaagacaug

SEQ ID NO: 1397700 - RNA, 21 nt, Homo sapiens
uugggagcaccgccugugaaa

SEQ ID NO: 1397701 - RNA, 22 nt, Homo sapiens
uugggaggcugaggcaagagaa

SEQ ID NO: 1397702 - RNA, 23 nt, Homo sapiens
uugguaucuacuucuacauccaa

SEQ ID NO: 1397703 - RNA, 16 nt, Homo sapiens
uuggugcugcuuucuu

SEQ ID NO: 1397704 - RNA, 14 nt, Homo sapiens
uugguggguuuuga

SEQ ID NO: 1397705 - RNA, 17 nt, Homo sapiens
uugguucaguaccacau

SEQ ID NO: 1397706 - RNA, 18 nt, Homo sapiens
uuguaagguggucacugu

SEQ ID NO: 1397707 - RNA, 24 nt, Homo sapiens
uuguaagugaaguaaaacuuaaga

SEQ ID NO: 1397708 - RNA, 19 nt, Homo sapiens
uuguagagauggggucuca

SEQ ID NO: 1397709 - RNA, 20 nt, Homo sapiens
uuguaguuuuggcuaguccu

SEQ ID NO: 1397710 - RNA, 19 nt, Homo sapiens
uuguauauugucagauauu

SEQ ID NO: 1397711 - RNA, 15 nt, Homo sapiens
uuguauugcauauau

SEQ ID NO: 1397712 - RNA, 21 nt, Homo sapiens
uugucaaaaggaagucucuag

SEQ ID NO: 1397713 - RNA, 13 nt, Homo sapiens
uugucaaacugua

SEQ ID NO: 1397714 - RNA, 22 nt, Homo sapiens
uugucaacaaagucacccacuu

SEQ ID NO: 1397715 - RNA, 18 nt, Homo sapiens
uugucacuuuccucuucc

SEQ ID NO: 1397716 - RNA, 16 nt, Homo sapiens
uugucuuacuguugca

SEQ ID NO: 1397717 - RNA, 17 nt, Homo sapiens
uugucuuuacuccauga

SEQ ID NO: 1397718 - RNA, 23 nt, Homo sapiens
uugugaaguggaaauguucuaaa

SEQ ID NO: 1397719 - RNA, 15 nt, Homo sapiens
uugugacuagugcug

SEQ ID NO: 1397720 - RNA, 18 nt, Homo sapiens
uugugcauaaaaacaaga

SEQ ID NO: 1397721 - RNA, 15 nt, Homo sapiens
uuguguccacuguga

SEQ ID NO: 1397722 - RNA, 16 nt, Homo sapiens
uuguguccacugugac

SEQ ID NO: 1397723 - RNA, 17 nt, Homo sapiens
uugugugcucauguaug

SEQ ID NO: 1397724 - RNA, 21 nt, Homo sapiens
uugugugcucauguaugugcg

SEQ ID NO: 1397725 - RNA, 13 nt, Homo sapiens
uuguguucucaaa

SEQ ID NO: 1397726 - RNA, 20 nt, Homo sapiens
uuguguuuuguuuuguauca

SEQ ID NO: 1397727 - RNA, 15 nt, Homo sapiens
uuguucagaugcuuc

SEQ ID NO: 1397728 - RNA, 21 nt, Homo sapiens
uuguucagucuuucauuuaga

SEQ ID NO: 1397729 - RNA, 23 nt, Homo sapiens
uuguucaucagacuccugugcaa

SEQ ID NO: 1397730 - RNA, 21 nt, Homo sapiens
uuguucuuuaaagucaggucc

SEQ ID NO: 1397731 - RNA, 15 nt, Homo sapiens
uuguugaacacuuga

SEQ ID NO: 1397732 - RNA, 11 nt, Homo sapiens
uuguugcucag

SEQ ID NO: 1397733 - RNA, 13 nt, Homo sapiens
uuguuguuauuaa

SEQ ID NO: 1397734 - RNA, 21 nt, Homo sapiens
uuguuuuaaaauuaaagcuaa

SEQ ID NO: 1397735 - RNA, 14 nt, Homo sapiens
uuuaaaacauucac

SEQ ID NO: 1397736 - RNA, 16 nt, Homo sapiens
uuuaaaacauucacac

SEQ ID NO: 1397737 - RNA, 21 nt, Homo sapiens
uuuaaaagccaucaaacacaa

SEQ ID NO: 1397738 - RNA, 17 nt, Homo sapiens
uuuaaaccuauacucac

SEQ ID NO: 1397739 - RNA, 15 nt, Homo sapiens
uuuaaauccuuccau

SEQ ID NO: 1397740 - RNA, 15 nt, Homo sapiens
uuuaaaugauguuga

SEQ ID NO: 1397741 - RNA, 17 nt, Homo sapiens
uuuaagaguuacuuaau

SEQ ID NO: 1397742 - RNA, 22 nt, Homo sapiens
acuuuccccgugggccauggca

SEQ ID NO: 1397743 - RNA, 18 nt, Homo sapiens
acuuugaguuagugccau

SEQ ID NO: 1397744 - RNA, 18 nt, Homo sapiens
acuuugauaggaugugga

SEQ ID NO: 1397745 - RNA, 22 nt, Homo sapiens
acuuuggaauguacucuguuca

SEQ ID NO: 1397746 - RNA, 17 nt, Homo sapiens
acuuugguacauggcca

SEQ ID NO: 1397747 - RNA, 22 nt, Homo sapiens
acuuuguuuagcccaaaaccaa

SEQ ID NO: 1397748 - RNA, 15 nt, Homo sapiens
acuuuuauaaauuaa

SEQ ID NO: 1397749 - RNA, 18 nt, Homo sapiens
acuuuuuaccuaguacaa

SEQ ID NO: 1397750 - RNA, 13 nt, Homo sapiens
acuuuuuggugga

SEQ ID NO: 1397751 - RNA, 22 nt, Homo sapiens
acuuuuuucuuauuuaacuuaa

SEQ ID NO: 1397752 - RNA, 15 nt, Homo sapiens
agaaaacuguuaaua

SEQ ID NO: 1397753 - RNA, 21 nt, Homo sapiens
agaaaacuugaauucauagaa

SEQ ID NO: 1397754 - RNA, 21 nt, Homo sapiens
agaaaauaguuuggauuacuu

SEQ ID NO: 1397755 - RNA, 21 nt, Homo sapiens
agaaaauguuacuucucucau

SEQ ID NO: 1397756 - RNA, 13 nt, Homo sapiens
agaaacacugggc

SEQ ID NO: 1397757 - RNA, 14 nt, Homo sapiens
agaaacuuugugcu

SEQ ID NO: 1397758 - RNA, 15 nt, Homo sapiens
agaaagacuaucuaa

SEQ ID NO: 1397759 - RNA, 23 nt, Homo sapiens
agaaagcagaggcuggccucaga

SEQ ID NO: 1397760 - RNA, 14 nt, Homo sapiens
agaaagcucaucuc

SEQ ID NO: 1397761 - RNA, 22 nt, Homo sapiens
agaaaguacuucuccacccugc

SEQ ID NO: 1397762 - RNA, 17 nt, Homo sapiens
agaaaguggcuugaaau

SEQ ID NO: 1397763 - RNA, 13 nt, Homo sapiens
agaaaguuaugaa

SEQ ID NO: 1397764 - RNA, 23 nt, Homo sapiens
agaaaguuuccccaccagugaau

SEQ ID NO: 1397765 - RNA, 20 nt, Homo sapiens
agaaauaauaugcauuguca

SEQ ID NO: 1397766 - RNA, 12 nt, Homo sapiens
agaaaucugcca

SEQ ID NO: 1397767 - RNA, 17 nt, Homo sapiens
agaaaugcaaauucuca

SEQ ID NO: 1397768 - RNA, 13 nt, Homo sapiens
agaaaugcacaau

SEQ ID NO: 1397769 - RNA, 12 nt, Homo sapiens
agaaauguacaa

SEQ ID NO: 1397770 - RNA, 22 nt, Homo sapiens
agaaauugcauuuccugacaga

SEQ ID NO: 1397771 - RNA, 16 nt, Homo sapiens
agaacaacuacuguga

SEQ ID NO: 1397772 - RNA, 14 nt, Homo sapiens
agaacagacuggcc

SEQ ID NO: 1397773 - RNA, 17 nt, Homo sapiens
agaacaguaacugccau

SEQ ID NO: 1397774 - RNA, 19 nt, Homo sapiens
agaacaguaacugccauca

SEQ ID NO: 1397775 - RNA, 15 nt, Homo sapiens
agaacccagauuucc

SEQ ID NO: 1397776 - RNA, 17 nt, Homo sapiens
agaacccagauuuccua

SEQ ID NO: 1397777 - RNA, 21 nt, Homo sapiens
agaacuagugguggcucugag

SEQ ID NO: 1397778 - RNA, 12 nt, Homo sapiens
agaacucuccau

SEQ ID NO: 1397779 - RNA, 16 nt, Homo sapiens
agaacucugagcagug

SEQ ID NO: 1397780 - RNA, 18 nt, Homo sapiens
agaacucugggcugcuac

SEQ ID NO: 1397781 - RNA, 18 nt, Homo sapiens
agaacugaauaaacagga

SEQ ID NO: 1397782 - RNA, 20 nt, Homo sapiens
ccucuuucccucccuuccuc

SEQ ID NO: 1397783 - RNA, 16 nt, Homo sapiens
ccugaacuuacacaaa

SEQ ID NO: 1397784 - RNA, 18 nt, Homo sapiens
ccugaagucccagcauug

SEQ ID NO: 1397785 - RNA, 17 nt, Homo sapiens
ccugaauuuuguugcug

SEQ ID NO: 1397786 - RNA, 18 nt, Homo sapiens
ccugacagaaggacucag

SEQ ID NO: 1397787 - RNA, 16 nt, Homo sapiens
ccugaccucacuguga

SEQ ID NO: 1397788 - RNA, 18 nt, Homo sapiens
ccugaggaucagaaagua

SEQ ID NO: 1397789 - RNA, 21 nt, Homo sapiens
ccugauauagaucacauaaca

SEQ ID NO: 1397790 - RNA, 17 nt, Homo sapiens
ccugaucacuaugcauu

SEQ ID NO: 1397791 - RNA, 18 nt, Homo sapiens
ccugaucgccaaccuuuc

SEQ ID NO: 1397792 - RNA, 18 nt, Homo sapiens
ccugcaccccugcaguuu

SEQ ID NO: 1397793 - RNA, 19 nt, Homo sapiens
ccugcaggccaagagcaga

SEQ ID NO: 1397794 - RNA, 23 nt, Homo sapiens
ccugcauguuggcccagaccuca

SEQ ID NO: 1397795 - RNA, 20 nt, Homo sapiens
ccugccaccuggggcaguca

SEQ ID NO: 1397796 - RNA, 16 nt, Homo sapiens
ccugccucacuucuuc

SEQ ID NO: 1397797 - RNA, 15 nt, Homo sapiens
cggggcuccacugaa

SEQ ID NO: 1397798 - RNA, 20 nt, Homo sapiens
cggggcuugcaacuuagcuc

SEQ ID NO: 1397799 - RNA, 18 nt, Homo sapiens
cgggggaccccuuugccc

SEQ ID NO: 1397800 - RNA, 23 nt, Homo sapiens
cgggggcuuggcugugcccucag

SEQ ID NO: 1397801 - RNA, 13 nt, Homo sapiens
cggguguguacac

SEQ ID NO: 1397802 - RNA, 19 nt, Homo sapiens
cggguguguacaccaaggu

SEQ ID NO: 1397803 - RNA, 22 nt, Homo sapiens
cgguacuaguucagacacuuug

SEQ ID NO: 1397804 - RNA, 16 nt, Homo sapiens
cgguggacccagggau

SEQ ID NO: 1397805 - RNA, 16 nt, Homo sapiens
cgguggugugaucucg

SEQ ID NO: 1397806 - RNA, 14 nt, Homo sapiens
cguaacaacugugg

SEQ ID NO: 1397807 - RNA, 15 nt, Homo sapiens
cguaacaacuguggu

SEQ ID NO: 1397808 - RNA, 16 nt, Homo sapiens
cguaagggaucuuccu

SEQ ID NO: 1397809 - RNA, 14 nt, Homo sapiens
cguaguucccugaa

SEQ ID NO: 1397810 - RNA, 21 nt, Homo sapiens
cguaucugcucuuaggugcuu

SEQ ID NO: 1397811 - RNA, 17 nt, Homo sapiens
cgucaaagcaguaguca

SEQ ID NO: 1397812 - RNA, 20 nt, Homo sapiens
cgucucuacuaaaaauacaa

SEQ ID NO: 1397813 - RNA, 19 nt, Homo sapiens
cgucuucuguauacugugg

SEQ ID NO: 1397814 - RNA, 16 nt, Homo sapiens
cgugaaaaugcuguau

SEQ ID NO: 1397815 - RNA, 23 nt, Homo sapiens
cgugaccugccaggcacacugag

SEQ ID NO: 1397816 - RNA, 15 nt, Homo sapiens
cgugacuguggcaca

SEQ ID NO: 1397817 - RNA, 15 nt, Homo sapiens
cgugaggaugggaag

SEQ ID NO: 1397818 - RNA, 16 nt, Homo sapiens
cgugcacacaccagag

SEQ ID NO: 1397819 - RNA, 16 nt, Homo sapiens
cguggaaagggugcug

SEQ ID NO: 1397820 - RNA, 20 nt, Homo sapiens
cguggaauugugcugaguug

SEQ ID NO: 1397821 - RNA, 17 nt, Homo sapiens
cguggacuuaccgccug

SEQ ID NO: 1397822 - RNA, 15 nt, Homo sapiens
cgugguggcacacac

SEQ ID NO: 1397823 - RNA, 15 nt, Homo sapiens
cgugugacuacuccc

SEQ ID NO: 1397824 - RNA, 16 nt, Homo sapiens
cgugugcgugcaugug

SEQ ID NO: 1397825 - RNA, 21 nt, Homo sapiens
cguguguguugucugaacaug

SEQ ID NO: 1397826 - RNA, 23 nt, Homo sapiens
cguuaguguauuuuauguguggc

SEQ ID NO: 1397827 - RNA, 20 nt, Homo sapiens
cguugaagaggaagggcaaa

SEQ ID NO: 1397828 - RNA, 18 nt, Homo sapiens
cuaaaaaacagaggccau

SEQ ID NO: 1397829 - RNA, 17 nt, Homo sapiens
cuaaaaaucaugagauc

SEQ ID NO: 1397830 - RNA, 17 nt, Homo sapiens
cuaaaaggaaaucucac

SEQ ID NO: 1397831 - RNA, 16 nt, Homo sapiens
cuaaaaguguaagaaa

SEQ ID NO: 1397832 - RNA, 13 nt, Homo sapiens
cuaaaauauuauu

SEQ ID NO: 1397833 - RNA, 22 nt, Homo sapiens
cuaaagaagguuucagaaagaa

SEQ ID NO: 1397834 - RNA, 20 nt, Homo sapiens
cuaaagagagaugaaccaca

SEQ ID NO: 1397835 - RNA, 21 nt, Homo sapiens
cuaaagaggaaggaccaagga

SEQ ID NO: 1397836 - RNA, 15 nt, Homo sapiens
cuaaaggucccaagg

SEQ ID NO: 1397837 - RNA, 19 nt, Homo sapiens
cuaaagguuguauugcaua

SEQ ID NO: 1397838 - RNA, 12 nt, Homo sapiens
cuaaaguagacu

SEQ ID NO: 1397839 - RNA, 21 nt, Homo sapiens
cuaaauaauguuaucugugua

SEQ ID NO: 1397840 - RNA, 22 nt, Homo sapiens
cuaaauagaaauaaaugauccc

SEQ ID NO: 1397841 - RNA, 18 nt, Homo sapiens
cuaaauccuuuacuguua

SEQ ID NO: 1397842 - RNA, 14 nt, Homo sapiens
cuaaaucugaggaa

SEQ ID NO: 1397843 - RNA, 16 nt, Homo sapiens
cuaaaugaagugcaaa

SEQ ID NO: 1397844 - RNA, 16 nt, Homo sapiens
cuaaaugcagugaauu

SEQ ID NO: 1397845 - RNA, 14 nt, Homo sapiens
cuaaauguaagaau

SEQ ID NO: 1397846 - RNA, 22 nt, Homo sapiens
cuaaaugugaaugaugauccua

SEQ ID NO: 1397847 - RNA, 13 nt, Homo sapiens
cuaaauucaggug

SEQ ID NO: 1397848 - RNA, 15 nt, Homo sapiens
cuaaauuugguucua

SEQ ID NO: 1397849 - RNA, 23 nt, Homo sapiens
cuaacaauggaagauuugcccau

SEQ ID NO: 1397850 - RNA, 21 nt, Homo sapiens
cuaacacagccaucaagggaa

SEQ ID NO: 1397851 - RNA, 15 nt, Homo sapiens
cuaacaccaacauaa

SEQ ID NO: 1397852 - RNA, 11 nt, Homo sapiens
cuaacacuagu

SEQ ID NO: 1397853 - RNA, 21 nt, Homo sapiens
cuaacauuauauugcaaugaa

SEQ ID NO: 1397854 - RNA, 13 nt, Homo sapiens
cuaaccaaaugca

SEQ ID NO: 1397855 - RNA, 17 nt, Homo sapiens
cuaaccagccuggucaa

SEQ ID NO: 1397856 - RNA, 15 nt, Homo sapiens
cuaacuccagugaag

SEQ ID NO: 1397857 - RNA, 20 nt, Homo sapiens
cuaagaagcgagcacugacc

SEQ ID NO: 1397858 - RNA, 14 nt, Homo sapiens
cuaagaagggaaaa

SEQ ID NO: 1397859 - RNA, 22 nt, Homo sapiens
cuaagcaaaauugcuaaagaga

SEQ ID NO: 1397860 - RNA, 20 nt, Homo sapiens
cuaagcacgggccauaugaa

SEQ ID NO: 1397861 - RNA, 22 nt, Homo sapiens
cuaagcaguaagcuaucuucaa

SEQ ID NO: 1397862 - RNA, 18 nt, Homo sapiens
cuaagcuauucaguaaua

SEQ ID NO: 1397863 - RNA, 20 nt, Homo sapiens
cuaaggaauaugagcuuuau

SEQ ID NO: 1397864 - RNA, 21 nt, Homo sapiens
cuaaggaauaugagcuuuaug

SEQ ID NO: 1397865 - RNA, 14 nt, Homo sapiens
cuaaggacauuucc

SEQ ID NO: 1397866 - RNA, 15 nt, Homo sapiens
cuaagggaaaaagcc

SEQ ID NO: 1397867 - RNA, 16 nt, Homo sapiens
cuaagucucugugaau

SEQ ID NO: 1397868 - RNA, 16 nt, Homo sapiens
cuaaguguaccagaga

SEQ ID NO: 1397869 - RNA, 17 nt, Homo sapiens
cuaaguguaccagagaa

SEQ ID NO: 1397870 - RNA, 22 nt, Homo sapiens
cuaaguguuucauaaauuugag

SEQ ID NO: 1397871 - RNA, 15 nt, Homo sapiens
cuaaguucuuagaua

SEQ ID NO: 1397872 - RNA, 20 nt, Homo sapiens
cuaauaaaaaacaccuucua

SEQ ID NO: 1397873 - RNA, 19 nt, Homo sapiens
cuaauacagacuaugucac

SEQ ID NO: 1397874 - RNA, 16 nt, Homo sapiens
cuaaucagcauucuca

SEQ ID NO: 1397875 - RNA, 22 nt, Homo sapiens
cuaaucagcauucucacuccua

SEQ ID NO: 1397876 - RNA, 23 nt, Homo sapiens
cuaaugccugcggaguugugcac

SEQ ID NO: 1397877 - RNA, 18 nt, Homo sapiens
cuaauguggcagcugucu

SEQ ID NO: 1397878 - RNA, 14 nt, Homo sapiens
cuaauucaacauau

SEQ ID NO: 1397879 - RNA, 15 nt, Homo sapiens
cuaauucaacauaua

SEQ ID NO: 1397880 - RNA, 21 nt, Homo sapiens
cuaauucccauuuugcaaaau

SEQ ID NO: 1397881 - RNA, 18 nt, Homo sapiens
cuaauuggccucuuuaag

SEQ ID NO: 1397882 - RNA, 18 nt, Homo sapiens
cuaauuugauguuuacag

SEQ ID NO: 1397883 - RNA, 15 nt, Homo sapiens
cuacaaaaaacaaca

SEQ ID NO: 1397884 - RNA, 20 nt, Homo sapiens
cuacaacuuuuccuaaggca

SEQ ID NO: 1397885 - RNA, 17 nt, Homo sapiens
cuacacagaucacagcu

SEQ ID NO: 1397886 - RNA, 13 nt, Homo sapiens
cuacacuguauua

SEQ ID NO: 1397887 - RNA, 14 nt, Homo sapiens
cuacagaggccaug

SEQ ID NO: 1397888 - RNA, 22 nt, Homo sapiens
cuacaguggcugucacgcagcc

SEQ ID NO: 1397889 - RNA, 19 nt, Homo sapiens
cuacaguucuuuuguugua

SEQ ID NO: 1397890 - RNA, 21 nt, Homo sapiens
cuacaugacgacaaagcugcu

SEQ ID NO: 1397891 - RNA, 13 nt, Homo sapiens
cuaccacaguguc

SEQ ID NO: 1397892 - RNA, 13 nt, Homo sapiens
cuaccagcauaaa

SEQ ID NO: 1397893 - RNA, 19 nt, Homo sapiens
cuaccucacuaugcugcuu

SEQ ID NO: 1397894 - RNA, 16 nt, Homo sapiens
cuaccuuuucucuuca

SEQ ID NO: 1397895 - RNA, 18 nt, Homo sapiens
cuacgugacuguggcaca

SEQ ID NO: 1397896 - RNA, 15 nt, Homo sapiens
aaaugcucacacucc

SEQ ID NO: 1397897 - RNA, 20 nt, Homo sapiens
aaaugcuguauuagucacag

SEQ ID NO: 1397898 - RNA, 20 nt, Homo sapiens
aaaugggcuacuuuguccuu

SEQ ID NO: 1397899 - RNA, 19 nt, Homo sapiens
aaauggggauauguuaacu

SEQ ID NO: 1397900 - RNA, 22 nt, Homo sapiens
aaauggugguuguuucuuccaa

SEQ ID NO: 1397901 - RNA, 16 nt, Homo sapiens
aaauguaaagacaaaa

SEQ ID NO: 1397902 - RNA, 15 nt, Homo sapiens
aaauguaauugaaua

SEQ ID NO: 1397903 - RNA, 11 nt, Homo sapiens
aaauguacaau

SEQ ID NO: 1397904 - RNA, 16 nt, Homo sapiens
aaauguacauuaauua

SEQ ID NO: 1397905 - RNA, 19 nt, Homo sapiens
aaauguauucaaauaccaa

SEQ ID NO: 1397906 - RNA, 21 nt, Homo sapiens
aaaugucucuuuaaugucaca

SEQ ID NO: 1397907 - RNA, 16 nt, Homo sapiens
aaaugucuggucuguc

SEQ ID NO: 1397908 - RNA, 18 nt, Homo sapiens
aaaugucuggucugucca

SEQ ID NO: 1397909 - RNA, 19 nt, Homo sapiens
aaaugucuuaaucaugaga

SEQ ID NO: 1397910 - RNA, 23 nt, Homo sapiens
aaaugucuuuccuuuugcucuua

SEQ ID NO: 1397911 - RNA, 14 nt, Homo sapiens
aaaugugcuuaugu

SEQ ID NO: 1397912 - RNA, 14 nt, Homo sapiens
aaauuacaguaugg

SEQ ID NO: 1397913 - RNA, 22 nt, Homo sapiens
aaauuaguauagcuacuuugga

SEQ ID NO: 1397914 - RNA, 17 nt, Homo sapiens
aaauucacaagcugccu

SEQ ID NO: 1397915 - RNA, 17 nt, Homo sapiens
aaauucccaugagucag

SEQ ID NO: 1397916 - RNA, 21 nt, Homo sapiens
aaauucuacugaacacuucaa

SEQ ID NO: 1397917 - RNA, 21 nt, Homo sapiens
aaauucucuuuccuguagucc

SEQ ID NO: 1397918 - RNA, 15 nt, Homo sapiens
aaauugcuccuugac

SEQ ID NO: 1397919 - RNA, 15 nt, Homo sapiens
aaauuggagcaggga

SEQ ID NO: 1397920 - RNA, 20 nt, Homo sapiens
aaauugggaaaggaguagaa

SEQ ID NO: 1397921 - RNA, 17 nt, Homo sapiens
aaauuuaauauagcuau

SEQ ID NO: 1397922 - RNA, 22 nt, Homo sapiens
aaauuuaggaccaauaccuccu

SEQ ID NO: 1397923 - RNA, 14 nt, Homo sapiens
aaauuugagacaaa

SEQ ID NO: 1397924 - RNA, 17 nt, Homo sapiens
aaauuugaugaaaucag

SEQ ID NO: 1397925 - RNA, 20 nt, Homo sapiens
aaauuuuaaugaagugcaau

SEQ ID NO: 1397926 - RNA, 22 nt, Homo sapiens
aaauuuuguaauuuucuugaug

SEQ ID NO: 1397927 - RNA, 14 nt, Homo sapiens
aacaaauaugcaaa

SEQ ID NO: 1397928 - RNA, 15 nt, Homo sapiens
aacaaauuauguuac

SEQ ID NO: 1397929 - RNA, 14 nt, Homo sapiens
aacaacuacuguga

SEQ ID NO: 1397930 - RNA, 22 nt, Homo sapiens
aacaacuaggcuucagcauauu

SEQ ID NO: 1397931 - RNA, 15 nt, Homo sapiens
aacaacugaccaguu

SEQ ID NO: 1397932 - RNA, 22 nt, Homo sapiens
aacaagccaacgacaaagccaa

SEQ ID NO: 1397933 - RNA, 14 nt, Homo sapiens
aacaauccaucucu

SEQ ID NO: 1397934 - RNA, 21 nt, Homo sapiens
aacaauggaagauuugcccau

SEQ ID NO: 1397935 - RNA, 13 nt, Homo sapiens
aacacaagcaaaa

SEQ ID NO: 1397936 - RNA, 19 nt, Homo sapiens
aacacaauucuucuuccaa

SEQ ID NO: 1397937 - RNA, 14 nt, Homo sapiens
aacacacaauauua

SEQ ID NO: 1397938 - RNA, 19 nt, Homo sapiens
aacacacacuguucugaaa

SEQ ID NO: 1397939 - RNA, 19 nt, Homo sapiens
aacacagacauucugccag

SEQ ID NO: 1397940 - RNA, 22 nt, Homo sapiens
aacacagcgagacuccgucuca

SEQ ID NO: 1397941 - RNA, 13 nt, Homo sapiens
aacacaguauuuu

SEQ ID NO: 1397942 - RNA, 15 nt, Homo sapiens
aacacauuaagccuu

SEQ ID NO: 1397943 - RNA, 14 nt, Homo sapiens
aacacauuguguca

SEQ ID NO: 1397944 - RNA, 13 nt, Homo sapiens
aacacccaugccc

SEQ ID NO: 1397945 - RNA, 22 nt, Homo sapiens
aacacccuguagguucuugaua

SEQ ID NO: 1397946 - RNA, 13 nt, Homo sapiens
aacaccucugcac

SEQ ID NO: 1397947 - RNA, 19 nt, Homo sapiens
aacacggggcuugcaacuu

SEQ ID NO: 1397948 - RNA, 15 nt, Homo sapiens
aacacuaaacuucau

SEQ ID NO: 1397949 - RNA, 10 nt, Homo sapiens
aacacugcac

SEQ ID NO: 1397950 - RNA, 17 nt, Homo sapiens
aacagaaagcauccuaa

SEQ ID NO: 1397951 - RNA, 16 nt, Homo sapiens
aacagaagcuuccauu

SEQ ID NO: 1397952 - RNA, 13 nt, Homo sapiens
aacagacaacaga

SEQ ID NO: 1397953 - RNA, 20 nt, Homo sapiens
aacagacaagugacuguauc

SEQ ID NO: 1397954 - RNA, 13 nt, Homo sapiens
aacagaggccaug

SEQ ID NO: 1397955 - RNA, 22 nt, Homo sapiens
aacagauggauagucuguccaa

SEQ ID NO: 1397956 - RNA, 17 nt, Homo sapiens
cagugcuucagccugag

SEQ ID NO: 1397957 - RNA, 14 nt, Homo sapiens
caguggaggugcug

SEQ ID NO: 1397958 - RNA, 21 nt, Homo sapiens
cagugggcauggagccagugc

SEQ ID NO: 1397959 - RNA, 13 nt, Homo sapiens
cagugucuuccau

SEQ ID NO: 1397960 - RNA, 15 nt, Homo sapiens
cagugucuuccauaa

SEQ ID NO: 1397961 - RNA, 12 nt, Homo sapiens
cagugugacaag

SEQ ID NO: 1397962 - RNA, 23 nt, Homo sapiens
cagugugaucccaagugccaguc

SEQ ID NO: 1397963 - RNA, 22 nt, Homo sapiens
caguguggcccagggaagccaa

SEQ ID NO: 1397964 - RNA, 13 nt, Homo sapiens
caguuaaggggag

SEQ ID NO: 1397965 - RNA, 19 nt, Homo sapiens
caguuaugcagaauccaaa

SEQ ID NO: 1397966 - RNA, 15 nt, Homo sapiens
caguuggugcugcuu

SEQ ID NO: 1397967 - RNA, 20 nt, Homo sapiens
caguuucagguguuuaguug

SEQ ID NO: 1397968 - RNA, 20 nt, Homo sapiens
caguuugcuuuguaugcacu

SEQ ID NO: 1397969 - RNA, 17 nt, Homo sapiens
caguuugguuucuagca

SEQ ID NO: 1397970 - RNA, 21 nt, Homo sapiens
caguuuuaucuuuaaucuccu

SEQ ID NO: 1397971 - RNA, 21 nt, Homo sapiens
cauaaagccuuggauguauau

SEQ ID NO: 1397972 - RNA, 13 nt, Homo sapiens
cauaaauuacuuu

SEQ ID NO: 1397973 - RNA, 22 nt, Homo sapiens
cauaaauuacuuuuucauucuu

SEQ ID NO: 1397974 - RNA, 22 nt, Homo sapiens
cauaaauuagaggucuccaaaa

SEQ ID NO: 1397975 - RNA, 18 nt, Homo sapiens
cauaaauuguacuguuga

SEQ ID NO: 1397976 - RNA, 16 nt, Homo sapiens
cauaacaggagugcca

SEQ ID NO: 1397977 - RNA, 17 nt, Homo sapiens
cauaagauaaaugugcu

SEQ ID NO: 1397978 - RNA, 20 nt, Homo sapiens
cauaagccuccauuuaguuc

SEQ ID NO: 1397979 - RNA, 22 nt, Homo sapiens
cauaauuaaacaugauccugag

SEQ ID NO: 1397980 - RNA, 15 nt, Homo sapiens
caaccagagcacugu

SEQ ID NO: 1397981 - RNA, 17 nt, Homo sapiens
caaccccgcccuaggcc

SEQ ID NO: 1397982 - RNA, 14 nt, Homo sapiens
caacccugccccug

SEQ ID NO: 1397983 - RNA, 17 nt, Homo sapiens
caaccuaaccccuuucc

SEQ ID NO: 1397984 - RNA, 20 nt, Homo sapiens
caaccuccccggcucaagug

SEQ ID NO: 1397985 - RNA, 17 nt, Homo sapiens
caaccucggcuccugga

SEQ ID NO: 1397986 - RNA, 23 nt, Homo sapiens
caaccuggucacaggacucugcc

SEQ ID NO: 1397987 - RNA, 23 nt, Homo sapiens
caaccuuuucccaaccauacaaa

SEQ ID NO: 1397988 - RNA, 19 nt, Homo sapiens
caacguggggcagcacaga

SEQ ID NO: 1397989 - RNA, 17 nt, Homo sapiens
caacuaccuagacugga

SEQ ID NO: 1397990 - RNA, 15 nt, Homo sapiens
caacuacugugauca

SEQ ID NO: 1397991 - RNA, 17 nt, Homo sapiens
caacuauauuaucaugc

SEQ ID NO: 1397992 - RNA, 13 nt, Homo sapiens
caacugaccagcc

SEQ ID NO: 1397993 - RNA, 20 nt, Homo sapiens
caacugcagaaaauguccuc

SEQ ID NO: 1397994 - RNA, 16 nt, Homo sapiens
caacuggaagcacaga

SEQ ID NO: 1397995 - RNA, 17 nt, Homo sapiens
caacugucuccuaccuc

SEQ ID NO: 1397996 - RNA, 16 nt, Homo sapiens
caacuuaagcugggau

SEQ ID NO: 1397997 - RNA, 21 nt, Homo sapiens
caacuucauuugaugcuaaau

SEQ ID NO: 1397998 - RNA, 14 nt, Homo sapiens
caacuuuugugcuc

SEQ ID NO: 1397999 - RNA, 20 nt, Homo sapiens
caagaaacuucggggcugca

SEQ ID NO: 1398000 - RNA, 13 nt, Homo sapiens
caagaacagcagg

SEQ ID NO: 1398001 - RNA, 17 nt, Homo sapiens
caagaaggaauugacuu

SEQ ID NO: 1398002 - RNA, 22 nt, Homo sapiens
caagacagugccuauacugccu

SEQ ID NO: 1398003 - RNA, 16 nt, Homo sapiens
caagaccuucucccca

SEQ ID NO: 1398004 - RNA, 20 nt, Homo sapiens
caagacucuuuggacacuca

SEQ ID NO: 1398005 - RNA, 15 nt, Homo sapiens
caagagccacaguau

SEQ ID NO: 1398006 - RNA, 23 nt, Homo sapiens
caagagccacaguauauuucccu

SEQ ID NO: 1398007 - RNA, 22 nt, Homo sapiens
cagaaucccggcugucaagggg

SEQ ID NO: 1398008 - RNA, 17 nt, Homo sapiens
cagaaucgcuccaccuu

SEQ ID NO: 1398009 - RNA, 16 nt, Homo sapiens
cagaaucugaauguaa

SEQ ID NO: 1398010 - RNA, 15 nt, Homo sapiens
cagaauugagaguga

SEQ ID NO: 1398011 - RNA, 16 nt, Homo sapiens
cagaauugagagugau

SEQ ID NO: 1398012 - RNA, 12 nt, Homo sapiens
cagacaaaugga

SEQ ID NO: 1398013 - RNA, 15 nt, Homo sapiens
cagacaaaugugguu

SEQ ID NO: 1398014 - RNA, 12 nt, Homo sapiens
cagacaacagaa

SEQ ID NO: 1398015 - RNA, 15 nt, Homo sapiens
cagacaagugacugu

SEQ ID NO: 1398016 - RNA, 23 nt, Homo sapiens
cagacacugaccauccacucuac

SEQ ID NO: 1398017 - RNA, 16 nt, Homo sapiens
cagacagaaggugcua

SEQ ID NO: 1398018 - RNA, 20 nt, Homo sapiens
cagacccccacucucauucc

SEQ ID NO: 1398019 - RNA, 20 nt, Homo sapiens
cagaccgugaccaucuuugu

SEQ ID NO: 1398020 - RNA, 18 nt, Homo sapiens
cagaccuuuuauccacuu

SEQ ID NO: 1398021 - RNA, 21 nt, Homo sapiens
cagacuaugaauauuauagua

SEQ ID NO: 1398022 - RNA, 23 nt, Homo sapiens
cagacuaugucacccaaugcaua

SEQ ID NO: 1398023 - RNA, 16 nt, Homo sapiens
cagacuccugugcaac

SEQ ID NO: 1398024 - RNA, 18 nt, Homo sapiens
cagacuccugugcaacuu

SEQ ID NO: 1398025 - RNA, 21 nt, Homo sapiens
cagacucuacagaggccaugg

SEQ ID NO: 1398026 - RNA, 22 nt, Homo sapiens
cagacuugucccuccuuuucca

SEQ ID NO: 1398027 - RNA, 14 nt, Homo sapiens
cagagaaaguacuu

SEQ ID NO: 1398028 - RNA, 20 nt, Homo sapiens
cagagaacuggaaagacaua

SEQ ID NO: 1398029 - RNA, 13 nt, Homo sapiens
cagagaagccaaa

SEQ ID NO: 1398030 - RNA, 20 nt, Homo sapiens
cagagaaucauacuuagcaa

SEQ ID NO: 1398031 - RNA, 20 nt, Homo sapiens
cagagaauucucuuauccaa

SEQ ID NO: 1398032 - RNA, 14 nt, Homo sapiens
cagagacaccugca

SEQ ID NO: 1398033 - RNA, 18 nt, Homo sapiens
cagagacaggcccaagag

SEQ ID NO: 1398034 - RNA, 22 nt, Homo sapiens
cagagacgcagacaugugcacu

SEQ ID NO: 1398035 - RNA, 20 nt, Homo sapiens
cagagacuaucugauuuccu

SEQ ID NO: 1398036 - RNA, 13 nt, Homo sapiens
cagagacugggac

SEQ ID NO: 1398037 - RNA, 19 nt, Homo sapiens
cagagagccuggugcugcu

SEQ ID NO: 1398038 - RNA, 16 nt, Homo sapiens
cagagaggacuguuga

SEQ ID NO: 1398039 - RNA, 15 nt, Homo sapiens
cagagagggggccac

SEQ ID NO: 1398040 - RNA, 21 nt, Homo sapiens
cagagauaauucuagcuuuga

SEQ ID NO: 1398041 - RNA, 13 nt, Homo sapiens
cagagcaagugag

SEQ ID NO: 1398042 - RNA, 14 nt, Homo sapiens
cagagcacuguaua

SEQ ID NO: 1398043 - RNA, 16 nt, Homo sapiens
cagagcagagucugaa

SEQ ID NO: 1398044 - RNA, 15 nt, Homo sapiens
cagagcuggaccuga

SEQ ID NO: 1398045 - RNA, 23 nt, Homo sapiens
cagagggaaaguaaauauuucag

SEQ ID NO: 1398046 - RNA, 15 nt, Homo sapiens
cagaggguacuuuaa

SEQ ID NO: 1398047 - RNA, 15 nt, Homo sapiens
cagagguucauuuca

SEQ ID NO: 1398048 - RNA, 19 nt, Homo sapiens
cagagguugcagugagcug

SEQ ID NO: 1398049 - RNA, 19 nt, Homo sapiens
cagagucaaugaacuuucc

SEQ ID NO: 1398050 - RNA, 13 nt, Homo sapiens
cagaguugugcac

SEQ ID NO: 1398051 - RNA, 18 nt, Homo sapiens
cagaguuuguauugugau

SEQ ID NO: 1398052 - RNA, 17 nt, Homo sapiens
cagauagauauaugcuc

SEQ ID NO: 1398053 - RNA, 17 nt, Homo sapiens
cagaugagaguacaccc

SEQ ID NO: 1398054 - RNA, 23 nt, Homo sapiens
cagaugagaguacaccccaacag

SEQ ID NO: 1398055 - RNA, 19 nt, Homo sapiens
cagaugauucuaugucuca

SEQ ID NO: 1398056 - RNA, 22 nt, Homo sapiens
cagaugauucuaugucucauga

SEQ ID NO: 1398057 - RNA, 12 nt, Homo sapiens
cagaugcaauac

SEQ ID NO: 1398058 - RNA, 12 nt, Homo sapiens
cagaugcacaug

SEQ ID NO: 1398059 - RNA, 20 nt, Homo sapiens
cagaugccucuagaagagac

SEQ ID NO: 1398060 - RNA, 20 nt, Homo sapiens
cagauguccuugaugcucau

SEQ ID NO: 1398061 - RNA, 14 nt, Homo sapiens
cagauuucagucuu

SEQ ID NO: 1398062 - RNA, 21 nt, Homo sapiens
cagcaacuggugauuguuuca

SEQ ID NO: 1398063 - RNA, 21 nt, Homo sapiens
cagcaaugauuacucuuugag

SEQ ID NO: 1398064 - RNA, 19 nt, Homo sapiens
cagcacccucuccagauga

SEQ ID NO: 1398065 - RNA, 17 nt, Homo sapiens
cagcacucugaaacuga

SEQ ID NO: 1398066 - RNA, 20 nt, Homo sapiens
cagcacucugaaacugagaa

SEQ ID NO: 1398067 - RNA, 22 nt, Homo sapiens
cagcagaaaggagaacuaucca

SEQ ID NO: 1398068 - RNA, 14 nt, Homo sapiens
cagcagacuaugaa

SEQ ID NO: 1398069 - RNA, 17 nt, Homo sapiens
cagcagccagcucucag

SEQ ID NO: 1398070 - RNA, 23 nt, Homo sapiens
cagcaggcauaaggcaccaguua

SEQ ID NO: 1398071 - RNA, 14 nt, Homo sapiens
cagcaggguggccu

SEQ ID NO: 1398072 - RNA, 18 nt, Homo sapiens
cagcauccucaguuccug

SEQ ID NO: 1398073 - RNA, 19 nt, Homo sapiens
cagcaugaaggaugccaua

SEQ ID NO: 1398074 - RNA, 21 nt, Homo sapiens
cagcaugaccugugaccagca

SEQ ID NO: 1398075 - RNA, 15 nt, Homo sapiens
cagcauggagucaca

SEQ ID NO: 1398076 - RNA, 18 nt, Homo sapiens
cagcauucuuagccugug

SEQ ID NO: 1398077 - RNA, 13 nt, Homo sapiens
cagccaacaagca

SEQ ID NO: 1398078 - RNA, 16 nt, Homo sapiens
cagccacaaccaaaaa

SEQ ID NO: 1398079 - RNA, 14 nt, Homo sapiens
cagccacaacugca

SEQ ID NO: 1398080 - RNA, 17 nt, Homo sapiens
cagccacgugcucucug

SEQ ID NO: 1398081 - RNA, 14 nt, Homo sapiens
cagccaggcugcca

SEQ ID NO: 1398082 - RNA, 19 nt, Homo sapiens
cagccagugaccugaggaa

SEQ ID NO: 1398083 - RNA, 13 nt, Homo sapiens
cagccaucaaggg

SEQ ID NO: 1398084 - RNA, 15 nt, Homo sapiens
cagcccagcuggugg

SEQ ID NO: 1398085 - RNA, 15 nt, Homo sapiens
cagcccauggcuuua

SEQ ID NO: 1398086 - RNA, 23 nt, Homo sapiens
cagccucacuugaaugugucacu

SEQ ID NO: 1398087 - RNA, 14 nt, Homo sapiens
cagccucccaagua

SEQ ID NO: 1398088 - RNA, 20 nt, Homo sapiens
cagccuccccaccuucuuca

SEQ ID NO: 1398089 - RNA, 21 nt, Homo sapiens
cagccugaccaacauggugaa

SEQ ID NO: 1398090 - RNA, 18 nt, Homo sapiens
cagccugggcaaugugau

SEQ ID NO: 1398091 - RNA, 19 nt, Homo sapiens
cagccugggcagcauagca

SEQ ID NO: 1398092 - RNA, 21 nt, Homo sapiens
cagccuggucaacauggugaa

SEQ ID NO: 1398093 - RNA, 14 nt, Homo sapiens
auuaugcuaccuac

SEQ ID NO: 1398094 - RNA, 18 nt, Homo sapiens
auuauucccuguacaaua

SEQ ID NO: 1398095 - RNA, 19 nt, Homo sapiens
auuauuuaaacaucagcaa

SEQ ID NO: 1398096 - RNA, 15 nt, Homo sapiens
auuauuucaauguga

SEQ ID NO: 1398097 - RNA, 23 nt, Homo sapiens
auucaaaagcacuuugugcugug

SEQ ID NO: 1398098 - RNA, 22 nt, Homo sapiens
auucaagaaagccagucuuaac

SEQ ID NO: 1398099 - RNA, 19 nt, Homo sapiens
auucaagucaccuccuuaa

SEQ ID NO: 1398100 - RNA, 21 nt, Homo sapiens
auucacaauagaaacucacca

SEQ ID NO: 1398101 - RNA, 14 nt, Homo sapiens
auucacagugcaag

SEQ ID NO: 1398102 - RNA, 15 nt, Homo sapiens
auucacccuguccaa

SEQ ID NO: 1398103 - RNA, 20 nt, Homo sapiens
auucaccuguaaaacuuuau

SEQ ID NO: 1398104 - RNA, 22 nt, Homo sapiens
auucaccuuccagugucucgga

SEQ ID NO: 1398105 - RNA, 21 nt, Homo sapiens
auucacuagguucgaauccag

SEQ ID NO: 1398106 - RNA, 17 nt, Homo sapiens
auucagcucugcaagaa

SEQ ID NO: 1398107 - RNA, 12 nt, Homo sapiens
auucagcugccc

SEQ ID NO: 1398108 - RNA, 16 nt, Homo sapiens
auucaggauuacaugc

SEQ ID NO: 1398109 - RNA, 17 nt, Homo sapiens
auucauaacagaacaag

SEQ ID NO: 1398110 - RNA, 18 nt, Homo sapiens
auucauauuuaugaaucu

SEQ ID NO: 1398111 - RNA, 19 nt, Homo sapiens
auucaucucucuuuaauau

SEQ ID NO: 1398112 - RNA, 23 nt, Homo sapiens
auucauuuuucuuucugauguca

SEQ ID NO: 1398113 - RNA, 21 nt, Homo sapiens
auuccaaacacauacaggaag

SEQ ID NO: 1398114 - RNA, 22 nt, Homo sapiens
auuccaacagcucaagucuucc

SEQ ID NO: 1398115 - RNA, 14 nt, Homo sapiens
auuccaauuugcac

SEQ ID NO: 1398116 - RNA, 18 nt, Homo sapiens
auuccaauuugcacuuuc

SEQ ID NO: 1398117 - RNA, 17 nt, Homo sapiens
auuccaccuagagcuag

SEQ ID NO: 1398118 - RNA, 17 nt, Homo sapiens
auuccaccugcaaucaa

SEQ ID NO: 1398119 - RNA, 13 nt, Homo sapiens
auuccaggcuccu

SEQ ID NO: 1398120 - RNA, 11 nt, Homo sapiens
auuccaucucc

SEQ ID NO: 1398121 - RNA, 15 nt, Homo sapiens
agcaccacccuaguc

SEQ ID NO: 1398122 - RNA, 17 nt, Homo sapiens
agcacuaaagcagugga

SEQ ID NO: 1398123 - RNA, 23 nt, Homo sapiens
agcacuaaggugugcucugauca

SEQ ID NO: 1398124 - RNA, 18 nt, Homo sapiens
agcacuaauucaacauau

SEQ ID NO: 1398125 - RNA, 15 nt, Homo sapiens
agcacuagcgacauu

SEQ ID NO: 1398126 - RNA, 12 nt, Homo sapiens
agcacuggguug

SEQ ID NO: 1398127 - RNA, 16 nt, Homo sapiens
agcacuguuucucuca

SEQ ID NO: 1398128 - RNA, 17 nt, Homo sapiens
agcacuuucauugccag

SEQ ID NO: 1398129 - RNA, 22 nt, Homo sapiens
agcagaaaucuagaagacuguc

SEQ ID NO: 1398130 - RNA, 23 nt, Homo sapiens
agcagaaaucuagaagacuguca

SEQ ID NO: 1398131 - RNA, 15 nt, Homo sapiens
agcagaacuucugaa

SEQ ID NO: 1398132 - RNA, 17 nt, Homo sapiens
agcagaacuucugaaac

SEQ ID NO: 1398133 - RNA, 17 nt, Homo sapiens
agcagagacaugacuca

SEQ ID NO: 1398134 - RNA, 14 nt, Homo sapiens
agcagauacuuugu

SEQ ID NO: 1398135 - RNA, 22 nt, Homo sapiens
agcagaugguggagcugaauau

SEQ ID NO: 1398136 - RNA, 12 nt, Homo sapiens
agcagcacuuau

SEQ ID NO: 1398137 - RNA, 14 nt, Homo sapiens
agcagcacuuauaa

SEQ ID NO: 1398138 - RNA, 15 nt, Homo sapiens
agcagccaacaagca

SEQ ID NO: 1398139 - RNA, 16 nt, Homo sapiens
agcagccacaaccaaa

SEQ ID NO: 1398140 - RNA, 16 nt, Homo sapiens
agcagcuaucucucag

SEQ ID NO: 1398141 - RNA, 22 nt, Homo sapiens
agcagcucaaaggcacagugaa

SEQ ID NO: 1398142 - RNA, 18 nt, Homo sapiens
agcaggaaccccaggaga

SEQ ID NO: 1398143 - RNA, 16 nt, Homo sapiens
agcagggacagaucau

SEQ ID NO: 1398144 - RNA, 15 nt, Homo sapiens
agcaggggcucuuag

SEQ ID NO: 1398145 - RNA, 12 nt, Homo sapiens
agcagucacuuu

SEQ ID NO: 1398146 - RNA, 14 nt, Homo sapiens
agcaguucagcucc

SEQ ID NO: 1398147 - RNA, 21 nt, Homo sapiens
agcaguugaaacaagaagcca

SEQ ID NO: 1398148 - RNA, 13 nt, Homo sapiens
agcauaagcaaaa

SEQ ID NO: 1398149 - RNA, 18 nt, Homo sapiens
agcauaaguuucugggac

SEQ ID NO: 1398150 - RNA, 11 nt, Homo sapiens
agcauccaugu

SEQ ID NO: 1398151 - RNA, 22 nt, Homo sapiens
agcaucuucacuucuaaaugca

SEQ ID NO: 1398152 - RNA, 12 nt, Homo sapiens
agcaucuucuca

SEQ ID NO: 1398153 - RNA, 13 nt, Homo sapiens
agcaucuucucac

SEQ ID NO: 1398154 - RNA, 20 nt, Homo sapiens
agcaugaccugugaccagca

SEQ ID NO: 1398155 - RNA, 15 nt, Homo sapiens
agcaugaugagaguu

SEQ ID NO: 1398156 - RNA, 22 nt, Homo sapiens
agcaugcucaguuggugcugcu

SEQ ID NO: 1398157 - RNA, 15 nt, Homo sapiens
agcauguguauuucc

SEQ ID NO: 1398158 - RNA, 18 nt, Homo sapiens
aucugcauuuucacccca

SEQ ID NO: 1398159 - RNA, 18 nt, Homo sapiens
aucugcuacugugucagg

SEQ ID NO: 1398160 - RNA, 12 nt, Homo sapiens
aucuggaaaaua

SEQ ID NO: 1398161 - RNA, 13 nt, Homo sapiens
aucuguaagcucu

SEQ ID NO: 1398162 - RNA, 23 nt, Homo sapiens
aucuguauauacaauaacauaau

SEQ ID NO: 1398163 - RNA, 14 nt, Homo sapiens
aucuguaucuugcc

SEQ ID NO: 1398164 - RNA, 22 nt, Homo sapiens
aucugugcaaauccuugauacu

SEQ ID NO: 1398165 - RNA, 13 nt, Homo sapiens
aucuguuacccag

SEQ ID NO: 1398166 - RNA, 22 nt, Homo sapiens
aucuguuuauuuacaagggaag

SEQ ID NO: 1398167 - RNA, 14 nt, Homo sapiens
aucuuacugaaggu

SEQ ID NO: 1398168 - RNA, 19 nt, Homo sapiens
aucuucagggcacugcugc

SEQ ID NO: 1398169 - RNA, 20 nt, Homo sapiens
aucuucauacaaugacaagu

SEQ ID NO: 1398170 - RNA, 21 nt, Homo sapiens
aucuuccaaggguacuaagga

SEQ ID NO: 1398171 - RNA, 22 nt, Homo sapiens
aucuuccaaggguacuaaggaa

SEQ ID NO: 1398172 - RNA, 16 nt, Homo sapiens
aucuuccacaggucuc

SEQ ID NO: 1398173 - RNA, 15 nt, Homo sapiens
aucuuccauggauuu

SEQ ID NO: 1398174 - RNA, 18 nt, Homo sapiens
aucuucucuuugacaauu

SEQ ID NO: 1398175 - RNA, 15 nt, Homo sapiens
aucuuggcaggggug

SEQ ID NO: 1398176 - RNA, 22 nt, Homo sapiens
aucuuucacacuuccaccagcc

SEQ ID NO: 1398177 - RNA, 22 nt, Homo sapiens
aucuuuuucucuaaaauagcca

SEQ ID NO: 1398178 - RNA, 17 nt, Homo sapiens
augaaaaccauuaccug

SEQ ID NO: 1398179 - RNA, 17 nt, Homo sapiens
augaaaaggacuuuaua

SEQ ID NO: 1398180 - RNA, 20 nt, Homo sapiens
augaaaugucuggucugucc

SEQ ID NO: 1398181 - RNA, 18 nt, Homo sapiens
augaacaugugaaguuau

SEQ ID NO: 1398182 - RNA, 21 nt, Homo sapiens
augaaccacauagacuuuaug

SEQ ID NO: 1398183 - RNA, 21 nt, Homo sapiens
augaaccauucacagugcaag

SEQ ID NO: 1398184 - RNA, 23 nt, Homo sapiens
augaaccugcccugcucccacag

SEQ ID NO: 1398185 - RNA, 14 nt, Homo sapiens
augaacggugagca

SEQ ID NO: 1398186 - RNA, 14 nt, Homo sapiens
augaacuuuccaca

SEQ ID NO: 1398187 - RNA, 16 nt, Homo sapiens
augaagcaaacacauu

SEQ ID NO: 1398188 - RNA, 16 nt, Homo sapiens
augaaguaacuugucu

SEQ ID NO: 1398189 - RNA, 12 nt, Homo sapiens
augaagugcaaa

SEQ ID NO: 1398190 - RNA, 21 nt, Homo sapiens
augaauauuuuugucauuaaa

SEQ ID NO: 1398191 - RNA, 20 nt, Homo sapiens
augaauggacucaaacugcc

SEQ ID NO: 1398192 - RNA, 18 nt, Homo sapiens
augacaaugaugaugaua

SEQ ID NO: 1398193 - RNA, 20 nt, Homo sapiens
augacaucacuuguacaaaa

SEQ ID NO: 1398194 - RNA, 23 nt, Homo sapiens
augacccccaaccaaguggcucc

SEQ ID NO: 1398195 - RNA, 18 nt, Homo sapiens
augaccuuauaguguuaa

SEQ ID NO: 1398196 - RNA, 23 nt, Homo sapiens
augacgguguccaugccuuccau

SEQ ID NO: 1398197 - RNA, 23 nt, Homo sapiens
augacuaaagagagaauguagau

SEQ ID NO: 1398198 - RNA, 15 nt, Homo sapiens
augacuccuuucucu

SEQ ID NO: 1398199 - RNA, 16 nt, Homo sapiens
augacugaugacauau

SEQ ID NO: 1398200 - RNA, 20 nt, Homo sapiens
augacugcauuuuacuguac

SEQ ID NO: 1398201 - RNA, 20 nt, Homo sapiens
augagaaaguucucauuuaa

SEQ ID NO: 1398202 - RNA, 18 nt, Homo sapiens
augagaagucaacaguga

SEQ ID NO: 1398203 - RNA, 15 nt, Homo sapiens
augagcaaaaccaaa

SEQ ID NO: 1398204 - RNA, 11 nt, Homo sapiens
augagcauuua

SEQ ID NO: 1398205 - RNA, 21 nt, Homo sapiens
augagccucagcauccuggca

SEQ ID NO: 1398206 - RNA, 23 nt, Homo sapiens
augagcuuuauguaauaauguga

SEQ ID NO: 1398207 - RNA, 13 nt, Homo sapiens
augaggaaacuuu

SEQ ID NO: 1398208 - RNA, 15 nt, Homo sapiens
augaggcaaugucag

SEQ ID NO: 1398209 - RNA, 14 nt, Homo sapiens
augaggggccucag

SEQ ID NO: 1398210 - RNA, 16 nt, Homo sapiens
augaguaacaggaaaa

SEQ ID NO: 1398211 - RNA, 20 nt, Homo sapiens
augaguggagguuaaggcug

SEQ ID NO: 1398212 - RNA, 14 nt, Homo sapiens
augaguuacuugaa

SEQ ID NO: 1398213 - RNA, 20 nt, Homo sapiens
augaguuuuugauagcuuua

SEQ ID NO: 1398214 - RNA, 14 nt, Homo sapiens
augauagcuacugu

SEQ ID NO: 1398215 - RNA, 13 nt, Homo sapiens
augaucuuuucaa

SEQ ID NO: 1398216 - RNA, 22 nt, Homo sapiens
augaugggauaucugaggccau

SEQ ID NO: 1398217 - RNA, 16 nt, Homo sapiens
augauugugcacauac

SEQ ID NO: 1398218 - RNA, 18 nt, Homo sapiens
augauuuagguacgucaa

SEQ ID NO: 1398219 - RNA, 20 nt, Homo sapiens
augauuuuagcaauacccau

SEQ ID NO: 1398220 - RNA, 15 nt, Homo sapiens
augcaaaguagcaau

SEQ ID NO: 1398221 - RNA, 18 nt, Homo sapiens
augcaacaacauguauaa

SEQ ID NO: 1398222 - RNA, 13 nt, Homo sapiens
augcacacagugc

SEQ ID NO: 1398223 - RNA, 21 nt, Homo sapiens
augcacauuucauguauucca

SEQ ID NO: 1398224 - RNA, 18 nt, Homo sapiens
augcacuugaaaugaugg

SEQ ID NO: 1398225 - RNA, 13 nt, Homo sapiens
augcagacuuccu

SEQ ID NO: 1398226 - RNA, 15 nt, Homo sapiens
augcagcagcuugcu

SEQ ID NO: 1398227 - RNA, 14 nt, Homo sapiens
augcagcaucuaag

SEQ ID NO: 1398228 - RNA, 18 nt, Homo sapiens
augcagccccaucuccuc

SEQ ID NO: 1398229 - RNA, 16 nt, Homo sapiens
augcauacacucucaa

SEQ ID NO: 1398230 - RNA, 23 nt, Homo sapiens
augcauauccaacaugugcucag

SEQ ID NO: 1398231 - RNA, 18 nt, Homo sapiens
augcauauccugagccau

SEQ ID NO: 1398232 - RNA, 20 nt, Homo sapiens
augcaucaaguuauugacaa

SEQ ID NO: 1398233 - RNA, 21 nt, Homo sapiens
augcaucugcuacugugucag

SEQ ID NO: 1398234 - RNA, 17 nt, Homo sapiens
augccacagaguaugaa

SEQ ID NO: 1398235 - RNA, 17 nt, Homo sapiens
augccagugaaacuuca

SEQ ID NO: 1398236 - RNA, 19 nt, Homo sapiens
augccucauuaccuugugc

SEQ ID NO: 1398237 - RNA, 18 nt, Homo sapiens
augcgggcugggcagcug

SEQ ID NO: 1398238 - RNA, 16 nt, Homo sapiens
augcggugaaguuuaa

SEQ ID NO: 1398239 - RNA, 16 nt, Homo sapiens
augcguuuaaucacau

SEQ ID NO: 1398240 - RNA, 22 nt, Homo sapiens
acuccucaaaagcaaaugagau

SEQ ID NO: 1398241 - RNA, 14 nt, Homo sapiens
acuccucugucaua

SEQ ID NO: 1398242 - RNA, 23 nt, Homo sapiens
acuccuuucucuaaaacugccuu

SEQ ID NO: 1398243 - RNA, 17 nt, Homo sapiens
acucgagucacacucaa

SEQ ID NO: 1398244 - RNA, 16 nt, Homo sapiens
acucuaauagugcuua

SEQ ID NO: 1398245 - RNA, 17 nt, Homo sapiens
acucuaccucauaucag

SEQ ID NO: 1398246 - RNA, 23 nt, Homo sapiens
acucucauuccccagguggcuga

SEQ ID NO: 1398247 - RNA, 14 nt, Homo sapiens
acucugaauuccaa

SEQ ID NO: 1398248 - RNA, 23 nt, Homo sapiens
acucugaggcucuuucugggcca

SEQ ID NO: 1398249 - RNA, 19 nt, Homo sapiens
acucugccagccacaucca

SEQ ID NO: 1398250 - RNA, 22 nt, Homo sapiens
acucugcuuugacugagcagac

SEQ ID NO: 1398251 - RNA, 15 nt, Homo sapiens
acucugucucaaaaa

SEQ ID NO: 1398252 - RNA, 23 nt, Homo sapiens
acugaaaaaugguaauuguugcu

SEQ ID NO: 1398253 - RNA, 19 nt, Homo sapiens
acugaaggcauaugcuggc

SEQ ID NO: 1398254 - RNA, 14 nt, Homo sapiens
acugaaggcuuuca

SEQ ID NO: 1398255 - RNA, 16 nt, Homo sapiens
acugaccagccuccau

SEQ ID NO: 1398256 - RNA, 19 nt, Homo sapiens
acugaccagccuccaugcu

SEQ ID NO: 1398257 - RNA, 11 nt, Homo sapiens
acugaccaguu

SEQ ID NO: 1398258 - RNA, 12 nt, Homo sapiens
acugacuccuua

SEQ ID NO: 1398259 - RNA, 13 nt, Homo sapiens
acugacuccuuag

SEQ ID NO: 1398260 - RNA, 12 nt, Homo sapiens
acugagccagca

SEQ ID NO: 1398261 - RNA, 14 nt, Homo sapiens
acugaggaccagcc

SEQ ID NO: 1398262 - RNA, 22 nt, Homo sapiens
acugaggcuccagcaucuagug

SEQ ID NO: 1398263 - RNA, 18 nt, Homo sapiens
acugaguccucguagcca

SEQ ID NO: 1398264 - RNA, 16 nt, Homo sapiens
acugauguuccacaaa

SEQ ID NO: 1398265 - RNA, 20 nt, Homo sapiens
acugauuuuuagcuuuacaa

SEQ ID NO: 1398266 - RNA, 10 nt, Homo sapiens
acugcaauaa

SEQ ID NO: 1398267 - RNA, 16 nt, Homo sapiens
acugcaccaagucuca

SEQ ID NO: 1398268 - RNA, 20 nt, Homo sapiens
acugcaccauugcugcuccu

SEQ ID NO: 1398269 - RNA, 18 nt, Homo sapiens
acugcacguggcuucuga

SEQ ID NO: 1398270 - RNA, 20 nt, Homo sapiens
acugcacuauagccuaggug

SEQ ID NO: 1398271 - RNA, 20 nt, Homo sapiens
acugcacuccagccugggca

SEQ ID NO: 1398272 - RNA, 20 nt, Homo sapiens
acugcacucuagccugggug

SEQ ID NO: 1398273 - RNA, 17 nt, Homo sapiens
acugcaggggucuggug

SEQ ID NO: 1398274 - RNA, 14 nt, Homo sapiens
acugcagugagaau

SEQ ID NO: 1398275 - RNA, 21 nt, Homo sapiens
acugcauaaaaagugccugua

SEQ ID NO: 1398276 - RNA, 20 nt, Homo sapiens
acugcauaccaaccugggca

SEQ ID NO: 1398277 - RNA, 22 nt, Homo sapiens
acugcaucguuucaucuuccaa

SEQ ID NO: 1398278 - RNA, 17 nt, Homo sapiens
acugcauuuuacuguac

SEQ ID NO: 1398279 - RNA, 18 nt, Homo sapiens
acugccaaagaacuugga

SEQ ID NO: 1398280 - RNA, 21 nt, Homo sapiens
acugccaucaagaugagagaa

SEQ ID NO: 1398281 - RNA, 21 nt, Homo sapiens
acugccaucuuggacuuguca

SEQ ID NO: 1398282 - RNA, 19 nt, Homo sapiens
aacuugacaguaaaucaca

SEQ ID NO: 1398283 - RNA, 20 nt, Homo sapiens
aacuugauguguuaucucuu

SEQ ID NO: 1398284 - RNA, 20 nt, Homo sapiens
aacuuggagccccagugcca

SEQ ID NO: 1398285 - RNA, 18 nt, Homo sapiens
aacuuguauuaaagacag

SEQ ID NO: 1398286 - RNA, 19 nt, Homo sapiens
aacuuuagcagaaucaaaa

SEQ ID NO: 1398287 - RNA, 23 nt, Homo sapiens
aagaaaaagaccuaugagcacau

SEQ ID NO: 1398288 - RNA, 13 nt, Homo sapiens
aagaaacccaagu

SEQ ID NO: 1398289 - RNA, 23 nt, Homo sapiens
aagaaagagcaacaauccaucuc

SEQ ID NO: 1398290 - RNA, 17 nt, Homo sapiens
aagaaagccagucuuaa

SEQ ID NO: 1398291 - RNA, 23 nt, Homo sapiens
aagaaaguuuccccaccagugaa

SEQ ID NO: 1398292 - RNA, 15 nt, Homo sapiens
aagaaauaacaaauu

SEQ ID NO: 1398293 - RNA, 21 nt, Homo sapiens
aagaaauccugugugucgcuu

SEQ ID NO: 1398294 - RNA, 16 nt, Homo sapiens
aagaaauuaugucagc

SEQ ID NO: 1398295 - RNA, 13 nt, Homo sapiens
aagaaccucucac

SEQ ID NO: 1398296 - RNA, 14 nt, Homo sapiens
aagaagaugacuuc

SEQ ID NO: 1398297 - RNA, 15 nt, Homo sapiens
aagaagcucucuccu

SEQ ID NO: 1398298 - RNA, 14 nt, Homo sapiens
aagaaggauaccaa

SEQ ID NO: 1398299 - RNA, 20 nt, Homo sapiens
aagaaggauaccaaauacca

SEQ ID NO: 1398300 - RNA, 21 nt, Homo sapiens
aagaaucagaaacaggugcau

SEQ ID NO: 1398301 - RNA, 23 nt, Homo sapiens
aagaaugagacugaacuguguga

SEQ ID NO: 1398302 - RNA, 21 nt, Homo sapiens
aagaauuuuuauauccacuaa

SEQ ID NO: 1398303 - RNA, 14 nt, Homo sapiens
aagacaacauuucu

SEQ ID NO: 1398304 - RNA, 18 nt, Homo sapiens
aagacaaccccagccaau

SEQ ID NO: 1398305 - RNA, 20 nt, Homo sapiens
aagacacugaaauauacaca

SEQ ID NO: 1398306 - RNA, 16 nt, Homo sapiens
aagacagaugccccag

SEQ ID NO: 1398307 - RNA, 20 nt, Homo sapiens
aagacauacuccuuccauca

SEQ ID NO: 1398308 - RNA, 19 nt, Homo sapiens
aagacauaguugugcaugc

SEQ ID NO: 1398309 - RNA, 13 nt, Homo sapiens
aagacaugaacca

SEQ ID NO: 1398310 - RNA, 15 nt, Homo sapiens
aagaccaaaaugaca

SEQ ID NO: 1398311 - RNA, 17 nt, Homo sapiens
aagaccagccuggccaa

SEQ ID NO: 1398312 - RNA, 18 nt, Homo sapiens
aagaccuauaaaucauua

SEQ ID NO: 1398313 - RNA, 23 nt, Homo sapiens
aagacuauucccuucuaaccuga

SEQ ID NO: 1398314 - RNA, 22 nt, Homo sapiens
aagacucuacccauauuacaga

SEQ ID NO: 1398315 - RNA, 22 nt, Homo sapiens
aagacuguggcugcuagcacuu

SEQ ID NO: 1398316 - RNA, 21 nt, Homo sapiens
aagagaaacaggguguuguca

SEQ ID NO: 1398317 - RNA, 21 nt, Homo sapiens
aagagaaugaaauugcugaaa

SEQ ID NO: 1398318 - RNA, 18 nt, Homo sapiens
aagagaccaagacucuga

SEQ ID NO: 1398319 - RNA, 14 nt, Homo sapiens
aagagacugggaag

SEQ ID NO: 1398320 - RNA, 21 nt, Homo sapiens
aagagagaaagaaguaggcau

SEQ ID NO: 1398321 - RNA, 23 nt, Homo sapiens
aagagagucgcaucucagugcag

SEQ ID NO: 1398322 - RNA, 17 nt, Homo sapiens
aagagaucacaauacuc

SEQ ID NO: 1398323 - RNA, 19 nt, Homo sapiens
aagagcccaauuaccagaa

SEQ ID NO: 1398324 - RNA, 19 nt, Homo sapiens
aagaggcaccacuaaaaga

SEQ ID NO: 1398325 - RNA, 14 nt, Homo sapiens
aagaggcagggucu

SEQ ID NO: 1398326 - RNA, 14 nt, Homo sapiens
aagaggccugugau

SEQ ID NO: 1398327 - RNA, 19 nt, Homo sapiens
aagauaacaagaucuuuca

SEQ ID NO: 1398328 - RNA, 14 nt, Homo sapiens
aagauaaucucuca

SEQ ID NO: 1398329 - RNA, 20 nt, Homo sapiens
aagauacaggacauucucau

SEQ ID NO: 1398330 - RNA, 16 nt, Homo sapiens
aagauaucagcccaaa

SEQ ID NO: 1398331 - RNA, 18 nt, Homo sapiens
aagauaucuugaaaugaa

SEQ ID NO: 1398332 - RNA, 22 nt, Homo sapiens
aagaugaaugagcaaaaccaaa

SEQ ID NO: 1398333 - RNA, 18 nt, Homo sapiens
aagaugagagaacuggag

SEQ ID NO: 1398334 - RNA, 17 nt, Homo sapiens
accacagguucaugcca

SEQ ID NO: 1398335 - RNA, 15 nt, Homo sapiens
accacauagacuuua

SEQ ID NO: 1398336 - RNA, 16 nt, Homo sapiens
accacauccugaaaag

SEQ ID NO: 1398337 - RNA, 11 nt, Homo sapiens
accaccccagc

SEQ ID NO: 1398338 - RNA, 16 nt, Homo sapiens
accacccuagucccuu

SEQ ID NO: 1398339 - RNA, 20 nt, Homo sapiens
accaccuucccagcucuccc

SEQ ID NO: 1398340 - RNA, 17 nt, Homo sapiens
accacuagaacucucca

SEQ ID NO: 1398341 - RNA, 20 nt, Homo sapiens
accacuauucuuaacuauuc

SEQ ID NO: 1398342 - RNA, 21 nt, Homo sapiens
accacucaggccaacaagcca

SEQ ID NO: 1398343 - RNA, 20 nt, Homo sapiens
accacuggagaucaccagug

SEQ ID NO: 1398344 - RNA, 13 nt, Homo sapiens
accagagcacugu

SEQ ID NO: 1398345 - RNA, 14 nt, Homo sapiens
accagagcacugua

SEQ ID NO: 1398346 - RNA, 12 nt, Homo sapiens
accagaggucag

SEQ ID NO: 1398347 - RNA, 21 nt, Homo sapiens
accagcagaucccagcucacg

SEQ ID NO: 1398348 - RNA, 22 nt, Homo sapiens
accagccuggucaacaugguga

SEQ ID NO: 1398349 - RNA, 20 nt, Homo sapiens
accaggacucccuccucacc

SEQ ID NO: 1398350 - RNA, 16 nt, Homo sapiens
accaggagacagacag

SEQ ID NO: 1398351 - RNA, 19 nt, Homo sapiens
accaggcugcucagggcug

SEQ ID NO: 1398352 - RNA, 22 nt, Homo sapiens
accaggcuggccagcaugguga

SEQ ID NO: 1398353 - RNA, 13 nt, Homo sapiens
accaggucaggga

SEQ ID NO: 1398354 - RNA, 13 nt, Homo sapiens
accaguccaugag

SEQ ID NO: 1398355 - RNA, 18 nt, Homo sapiens
accagugaaucuuuguca

SEQ ID NO: 1398356 - RNA, 15 nt, Homo sapiens
accaguggugccuug

SEQ ID NO: 1398357 - RNA, 15 nt, Homo sapiens
accaguuaugugaau

SEQ ID NO: 1398358 - RNA, 16 nt, Homo sapiens
accaguuguugauaac

SEQ ID NO: 1398359 - RNA, 14 nt, Homo sapiens
accauacugaggga

SEQ ID NO: 1398360 - RNA, 15 nt, Homo sapiens
accaucauaguacag

SEQ ID NO: 1398361 - RNA, 22 nt, Homo sapiens
accaucauuauaaacgugauga

SEQ ID NO: 1398362 - RNA, 20 nt, Homo sapiens
accaucucaggccaccugcc

SEQ ID NO: 1398363 - RNA, 22 nt, Homo sapiens
accaugagaccacuguuaucaa

SEQ ID NO: 1398364 - RNA, 15 nt, Homo sapiens
accaugcaaugccuc

SEQ ID NO: 1398365 - RNA, 15 nt, Homo sapiens
accaugccucuccaa

SEQ ID NO: 1398366 - RNA, 17 nt, Homo sapiens
accauucacagugcaag

SEQ ID NO: 1398367 - RNA, 20 nt, Homo sapiens
accauugcuucacuacccau

SEQ ID NO: 1398368 - RNA, 14 nt, Homo sapiens
accauuucagagag

SEQ ID NO: 1398369 - RNA, 21 nt, Homo sapiens
accauuuugggguacccacug

SEQ ID NO: 1398370 - RNA, 15 nt, Homo sapiens
acccaccaguugaau

SEQ ID NO: 1398371 - RNA, 20 nt, Homo sapiens
acccacuuccugaucccuca

SEQ ID NO: 1398372 - RNA, 19 nt, Homo sapiens
acccagauuuccuaacucu

SEQ ID NO: 1398373 - RNA, 15 nt, Homo sapiens
acccagcaacuccaa

SEQ ID NO: 1398374 - RNA, 16 nt, Homo sapiens
acccaggcugccugag

SEQ ID NO: 1398375 - RNA, 14 nt, Homo sapiens
acccaguauuccau

SEQ ID NO: 1398376 - RNA, 16 nt, Homo sapiens
acccaguuagcucuca

SEQ ID NO: 1398377 - RNA, 15 nt, Homo sapiens
acccaugaggcaaug

SEQ ID NO: 1398378 - RNA, 22 nt, Homo sapiens
acccauugggcccuuccggcau

SEQ ID NO: 1398379 - RNA, 23 nt, Homo sapiens
acccauugucuuuacuccaugaa

SEQ ID NO: 1398380 - RNA, 12 nt, Homo sapiens
accccaacagca

SEQ ID NO: 1398381 - RNA, 17 nt, Homo sapiens
accccagcucccuagga

SEQ ID NO: 1398382 - RNA, 16 nt, Homo sapiens
accccaguaagccacu

SEQ ID NO: 1398383 - RNA, 17 nt, Homo sapiens
acccccaaaaaacaauu

SEQ ID NO: 1398384 - RNA, 16 nt, Homo sapiens
accccucaacaccucu

SEQ ID NO: 1398385 - RNA, 18 nt, Homo sapiens
accccuccccuaaugccu

SEQ ID NO: 1398386 - RNA, 19 nt, Homo sapiens
accccuccccuaaugccug

SEQ ID NO: 1398387 - RNA, 16 nt, Homo sapiens
accccuccuuccuuga

SEQ ID NO: 1398388 - RNA, 13 nt, Homo sapiens
accccugaccuca

SEQ ID NO: 1398389 - RNA, 19 nt, Homo sapiens
accccugucucccaaaaau

SEQ ID NO: 1398390 - RNA, 23 nt, Homo sapiens
accccuuacuuagcaugcacaaa

SEQ ID NO: 1398391 - RNA, 21 nt, Homo sapiens
acccguggagaugggaugcuu

SEQ ID NO: 1398392 - RNA, 17 nt, Homo sapiens
acccuagucuuuuaaac

SEQ ID NO: 1398393 - RNA, 16 nt, Homo sapiens
acccucagaugcacau

SEQ ID NO: 1398394 - RNA, 11 nt, Homo sapiens
acccucccacu

SEQ ID NO: 1398395 - RNA, 22 nt, Homo sapiens
acccucuggagaaggugggcac

SEQ ID NO: 1398396 - RNA, 18 nt, Homo sapiens
acccugccccugccuuga

SEQ ID NO: 1398397 - RNA, 17 nt, Homo sapiens
acccugcucuccgacca

SEQ ID NO: 1398398 - RNA, 15 nt, Homo sapiens
acccugcugaccucc

SEQ ID NO: 1398399 - RNA, 16 nt, Homo sapiens
acccugugguuuccaa

SEQ ID NO: 1398400 - RNA, 18 nt, Homo sapiens
acccuguuuucagcuaaa

SEQ ID NO: 1398401 - RNA, 18 nt, Homo sapiens
acccuucccuugagcccu

SEQ ID NO: 1398402 - RNA, 21 nt, Homo sapiens
ggauggggcagucucugccca

SEQ ID NO: 1398403 - RNA, 16 nt, Homo sapiens
ggauguucugggacac

SEQ ID NO: 1398404 - RNA, 13 nt, Homo sapiens
ggauguugcucag

SEQ ID NO: 1398405 - RNA, 21 nt, Homo sapiens
ggauugcuacuguccuaccca

SEQ ID NO: 1398406 - RNA, 20 nt, Homo sapiens
ggcaacacagcgagacuccg

SEQ ID NO: 1398407 - RNA, 16 nt, Homo sapiens
ggcaacgcacaaaaca

SEQ ID NO: 1398408 - RNA, 22 nt, Homo sapiens
ggcaauauaaggggaugaggaa

SEQ ID NO: 1398409 - RNA, 16 nt, Homo sapiens
ggcaaugucagaugaa

SEQ ID NO: 1398410 - RNA, 17 nt, Homo sapiens
ggcacacugagccagca

SEQ ID NO: 1398411 - RNA, 22 nt, Homo sapiens
ggcacccacaaauaaaugacaa

SEQ ID NO: 1398412 - RNA, 20 nt, Homo sapiens
ggcaccuauaauaccagcua

SEQ ID NO: 1398413 - RNA, 23 nt, Homo sapiens
ggcagacacuguuugcccagugu

SEQ ID NO: 1398414 - RNA, 20 nt, Homo sapiens
ggcagagguugcaguguggu

SEQ ID NO: 1398415 - RNA, 17 nt, Homo sapiens
ggcagcauuuagcacau

SEQ ID NO: 1398416 - RNA, 13 nt, Homo sapiens
ggcagccacgugc

SEQ ID NO: 1398417 - RNA, 20 nt, Homo sapiens
ggcaggagaauggcgugaac

SEQ ID NO: 1398418 - RNA, 15 nt, Homo sapiens
ggcaggaugggcacu

SEQ ID NO: 1398419 - RNA, 19 nt, Homo sapiens
ggcagggguggaggagagc

SEQ ID NO: 1398420 - RNA, 21 nt, Homo sapiens
ggcaggugccccucucuccau

SEQ ID NO: 1398421 - RNA, 19 nt, Homo sapiens
ggcagucucugcccaaaca

SEQ ID NO: 1398422 - RNA, 18 nt, Homo sapiens
ggcaugcccccaguuacu

SEQ ID NO: 1398423 - RNA, 18 nt, Homo sapiens
ggcauggagccagugccu

SEQ ID NO: 1398424 - RNA, 23 nt, Homo sapiens
ggcauggcaccugucgcccagug

SEQ ID NO: 1398425 - RNA, 14 nt, Homo sapiens
ggcaugguggccca

SEQ ID NO: 1398426 - RNA, 19 nt, Homo sapiens
ggccaaaaagaaucugcau

SEQ ID NO: 1398427 - RNA, 15 nt, Homo sapiens
ggccaaccuccccaa

SEQ ID NO: 1398428 - RNA, 15 nt, Homo sapiens
ggccaaguuccucua

SEQ ID NO: 1398429 - RNA, 21 nt, Homo sapiens
ggccaccugcaggucacugaa

SEQ ID NO: 1398430 - RNA, 19 nt, Homo sapiens
ggccagaagggggccauga

SEQ ID NO: 1398431 - RNA, 13 nt, Homo sapiens
ggccagccaguga

SEQ ID NO: 1398432 - RNA, 22 nt, Homo sapiens
ggccagccccucccaccacagc

SEQ ID NO: 1398433 - RNA, 17 nt, Homo sapiens
ggccagcugggaucuga

SEQ ID NO: 1398434 - RNA, 20 nt, Homo sapiens
ggccaggaguuugagaccag

SEQ ID NO: 1398435 - RNA, 13 nt, Homo sapiens
ggccagguggcca

SEQ ID NO: 1398436 - RNA, 16 nt, Homo sapiens
ggccaucaaccucugu

SEQ ID NO: 1398437 - RNA, 15 nt, Homo sapiens
ggcccagaccucagg

SEQ ID NO: 1398438 - RNA, 16 nt, Homo sapiens
ggcccauaucugugaa

SEQ ID NO: 1398439 - RNA, 12 nt, Homo sapiens
ggcccccagugg

SEQ ID NO: 1398440 - RNA, 14 nt, Homo sapiens
ggcccccaugcaag

SEQ ID NO: 1398441 - RNA, 23 nt, Homo sapiens
ggcccguccggcaguucugggug

SEQ ID NO: 1398442 - RNA, 22 nt, Homo sapiens
ggcccgugggagucaucucaac

SEQ ID NO: 1398443 - RNA, 15 nt, Homo sapiens
ggcccugagcucggu

SEQ ID NO: 1398444 - RNA, 23 nt, Homo sapiens
ggcccuuccucuccacugccuuc

SEQ ID NO: 1398445 - RNA, 18 nt, Homo sapiens
ggccgggcaauccagaca

SEQ ID NO: 1398446 - RNA, 13 nt, Homo sapiens
ggccucagguuug

SEQ ID NO: 1398447 - RNA, 12 nt, Homo sapiens
ggccucccucaa

SEQ ID NO: 1398448 - RNA, 16 nt, Homo sapiens
ggccuccugugugugc

SEQ ID NO: 1398449 - RNA, 15 nt, Homo sapiens
ggccugcacuggugu

SEQ ID NO: 1398450 - RNA, 17 nt, Homo sapiens
ggccuggucguuuucaa

SEQ ID NO: 1398451 - RNA, 21 nt, Homo sapiens
ggccugucccuggccaucucu

SEQ ID NO: 1398452 - RNA, 16 nt, Homo sapiens
ggccuuaaaagccauc

SEQ ID NO: 1398453 - RNA, 16 nt, Homo sapiens
ggccuugcuaccucaa

SEQ ID NO: 1398454 - RNA, 13 nt, Homo sapiens
ggcgacaguuuuc

SEQ ID NO: 1398455 - RNA, 13 nt, Homo sapiens
ggcgcagugcuuc

SEQ ID NO: 1398456 - RNA, 18 nt, Homo sapiens
ggcgcugcuuugucaaaa

SEQ ID NO: 1398457 - RNA, 14 nt, Homo sapiens
ggcgucccuaccuc

SEQ ID NO: 1398458 - RNA, 16 nt, Homo sapiens
ggcgucccuaccuccu

SEQ ID NO: 1398459 - RNA, 23 nt, Homo sapiens
ggcuacucacucaaguucaagga

SEQ ID NO: 1398460 - RNA, 18 nt, Homo sapiens
ggcuauauuucugggaug

SEQ ID NO: 1398461 - RNA, 16 nt, Homo sapiens
ggcuaucguuagugcu

SEQ ID NO: 1398462 - RNA, 16 nt, Homo sapiens
ggcucaugaccuggaa

SEQ ID NO: 1398463 - RNA, 16 nt, Homo sapiens
ggcuccaacacugcug

SEQ ID NO: 1398464 - RNA, 22 nt, Homo sapiens
ggcuccaccccauccaguucau

SEQ ID NO: 1398465 - RNA, 17 nt, Homo sapiens
ggcucccagggccauga

SEQ ID NO: 1398466 - RNA, 17 nt, Homo sapiens
ggcuccgucaguaucag

SEQ ID NO: 1398467 - RNA, 22 nt, Homo sapiens
ggcucgucggggggacagcucc

SEQ ID NO: 1398468 - RNA, 19 nt, Homo sapiens
ggcuggagugcaguggcgu

SEQ ID NO: 1398469 - RNA, 16 nt, Homo sapiens
ggcuguuauucuucca

SEQ ID NO: 1398470 - RNA, 18 nt, Homo sapiens
ggcuuaggaaagugauau

SEQ ID NO: 1398471 - RNA, 16 nt, Homo sapiens
ggcuucccugucuauu

SEQ ID NO: 1398472 - RNA, 21 nt, Homo sapiens
ggcuucccugucuauugccuu

SEQ ID NO: 1398473 - RNA, 13 nt, Homo sapiens
ggcuucugaugau

SEQ ID NO: 1398474 - RNA, 20 nt, Homo sapiens
ggcuuuaugcuaguuugacc

SEQ ID NO: 1398475 - RNA, 19 nt, Homo sapiens
ggcuuugucccacagcuug

SEQ ID NO: 1398476 - RNA, 15 nt, Homo sapiens
gggaaaucuuauauu

SEQ ID NO: 1398477 - RNA, 21 nt, Homo sapiens
gggaagaguggucuugagggg

SEQ ID NO: 1398478 - RNA, 23 nt, Homo sapiens
gggaagcuggcuuucuggcugcu

SEQ ID NO: 1398479 - RNA, 20 nt, Homo sapiens
gggacauuccaauuugcacu

SEQ ID NO: 1398480 - RNA, 20 nt, Homo sapiens
gggacuaaguguaccagaga

SEQ ID NO: 1398481 - RNA, 16 nt, Homo sapiens
gggacucaaugcacug

SEQ ID NO: 1398482 - RNA, 13 nt, Homo sapiens
gggaggagggugg

SEQ ID NO: 1398483 - RNA, 20 nt, Homo sapiens
gggagguggagguugcagug

SEQ ID NO: 1398484 - RNA, 20 nt, Homo sapiens
gggaguaggacauaccagcu

SEQ ID NO: 1398485 - RNA, 13 nt, Homo sapiens
gggauauguuaac

SEQ ID NO: 1398486 - RNA, 15 nt, Homo sapiens
gggaucacuaaggga

SEQ ID NO: 1398487 - RNA, 22 nt, Homo sapiens
gggaugcugccugagucaccca

SEQ ID NO: 1398488 - RNA, 15 nt, Homo sapiens
gggauucaggcugcu

SEQ ID NO: 1398489 - RNA, 17 nt, Homo sapiens
gggauugucuuacuguu

SEQ ID NO: 1398490 - RNA, 22 nt, Homo sapiens
gggauugucuuacuguugcaua

SEQ ID NO: 1398491 - RNA, 15 nt, Homo sapiens
gggcaauccagacag

SEQ ID NO: 1398492 - RNA, 20 nt, Homo sapiens
gggcaccuauaauaccagcu

SEQ ID NO: 1398493 - RNA, 13 nt, Homo sapiens
gggcacugguggc

SEQ ID NO: 1398494 - RNA, 22 nt, Homo sapiens
gggcaggauggcaaccagacca

SEQ ID NO: 1398495 - RNA, 18 nt, Homo sapiens
gggcaucugccccucccc

SEQ ID NO: 1398496 - RNA, 13 nt, Homo sapiens
gggccacagccag

SEQ ID NO: 1398497 - RNA, 16 nt, Homo sapiens
gggccagggcccugca

SEQ ID NO: 1398498 - RNA, 19 nt, Homo sapiens
gggcccagaggcacagccg

SEQ ID NO: 1398499 - RNA, 19 nt, Homo sapiens
gggccuguuacacaugaca

SEQ ID NO: 1398500 - RNA, 12 nt, Homo sapiens
gggcgcgguggc

SEQ ID NO: 1398501 - RNA, 12 nt, Homo sapiens
gggcucagcaaa

SEQ ID NO: 1398502 - RNA, 22 nt, Homo sapiens
gggcuccccuucgcguauuuca

SEQ ID NO: 1398503 - RNA, 18 nt, Homo sapiens
gggcucugugaccaggaa

SEQ ID NO: 1398504 - RNA, 16 nt, Homo sapiens
gggcugagcccuggca

SEQ ID NO: 1398505 - RNA, 15 nt, Homo sapiens
gggcugcccuggugc

SEQ ID NO: 1398506 - RNA, 19 nt, Homo sapiens
gggcuucuagaaccaggca

SEQ ID NO: 1398507 - RNA, 22 nt, Homo sapiens
gggcuuggcugugcccucagau

SEQ ID NO: 1398508 - RNA, 19 nt, Homo sapiens
gggcuuugauuccaucucc

SEQ ID NO: 1398509 - RNA, 20 nt, Homo sapiens
ggggacagcuccacucugac

SEQ ID NO: 1398510 - RNA, 12 nt, Homo sapiens
ggggacauucca

SEQ ID NO: 1398511 - RNA, 22 nt, Homo sapiens
ggggaccucauuccugggacua

SEQ ID NO: 1398512 - RNA, 17 nt, Homo sapiens
ggggagucugaagcaga

SEQ ID NO: 1398513 - RNA, 20 nt, Homo sapiens
ggggauacuggcaaagcaga

SEQ ID NO: 1398514 - RNA, 14 nt, Homo sapiens
ggggcaggcaguga

SEQ ID NO: 1398515 - RNA, 22 nt, Homo sapiens
ggaacuagagggauacacugaa

SEQ ID NO: 1398516 - RNA, 21 nt, Homo sapiens
ggaacucccaagaacagcagg

SEQ ID NO: 1398517 - RNA, 19 nt, Homo sapiens
ggaagaaacaaaguugaac

SEQ ID NO: 1398518 - RNA, 15 nt, Homo sapiens
ggaagacaaugugaa

SEQ ID NO: 1398519 - RNA, 19 nt, Homo sapiens
ggaagacuagaggcuugca

SEQ ID NO: 1398520 - RNA, 24 nt, Homo sapiens
ggaagagugguuaagacuacugaa

SEQ ID NO: 1398521 - RNA, 17 nt, Homo sapiens
ggaagauuugcccauuu

SEQ ID NO: 1398522 - RNA, 21 nt, Homo sapiens
ggaagccacccucccagcucu

SEQ ID NO: 1398523 - RNA, 22 nt, Homo sapiens
ggaagcuccaguccugcucucu

SEQ ID NO: 1398524 - RNA, 21 nt, Homo sapiens
ggaagcuccgcuuucuaccca

SEQ ID NO: 1398525 - RNA, 17 nt, Homo sapiens
ggaagguucuacgccag

SEQ ID NO: 1398526 - RNA, 14 nt, Homo sapiens
ggaagucagacuuu

SEQ ID NO: 1398527 - RNA, 21 nt, Homo sapiens
ggaauauaaggaaagcaauaa

SEQ ID NO: 1398528 - RNA, 15 nt, Homo sapiens
ggaaucaacagggca

SEQ ID NO: 1398529 - RNA, 19 nt, Homo sapiens
ggaauuucuguucuuccau

SEQ ID NO: 1398530 - RNA, 22 nt, Homo sapiens
ggacagagcacguuugcagaag

SEQ ID NO: 1398531 - RNA, 15 nt, Homo sapiens
ggacagggaggugac

SEQ ID NO: 1398532 - RNA, 22 nt, Homo sapiens
ggacagggcuggagucaaaaca

SEQ ID NO: 1398533 - RNA, 13 nt, Homo sapiens
ggacauaagacag

SEQ ID NO: 1398534 - RNA, 16 nt, Homo sapiens
ggaccagaagcauuuc

SEQ ID NO: 1398535 - RNA, 15 nt, Homo sapiens
ggaccaguggugccu

SEQ ID NO: 1398536 - RNA, 17 nt, Homo sapiens
ggaccaguggugccuug

SEQ ID NO: 1398537 - RNA, 14 nt, Homo sapiens
ggaccucaguuuua

SEQ ID NO: 1398538 - RNA, 13 nt, Homo sapiens
ggacuagcuggau

SEQ ID NO: 1398539 - RNA, 18 nt, Homo sapiens
ggacucaagcaagauuuc

SEQ ID NO: 1398540 - RNA, 13 nt, Homo sapiens
ggacucauugcuu

SEQ ID NO: 1398541 - RNA, 16 nt, Homo sapiens
ggacucuacacuguga

SEQ ID NO: 1398542 - RNA, 19 nt, Homo sapiens
ggacugaagggguucucac

SEQ ID NO: 1398543 - RNA, 14 nt, Homo sapiens
ggacugauaaucuc

SEQ ID NO: 1398544 - RNA, 19 nt, Homo sapiens
ggacuucaaaaacugucaa

SEQ ID NO: 1398545 - RNA, 16 nt, Homo sapiens
ggacuuuucgaccaau

SEQ ID NO: 1398546 - RNA, 23 nt, Homo sapiens
ggagaaccucaggcuuccuuggc

SEQ ID NO: 1398547 - RNA, 14 nt, Homo sapiens
ggagaacuauccaa

SEQ ID NO: 1398548 - RNA, 17 nt, Homo sapiens
ggagaagcaugaaaaag

SEQ ID NO: 1398549 - RNA, 23 nt, Homo sapiens
ggagacacuauuuaucugugcaa

SEQ ID NO: 1398550 - RNA, 14 nt, Homo sapiens
ggagaccuggcacu

SEQ ID NO: 1398551 - RNA, 17 nt, Homo sapiens
ggagaccuggcacugga

SEQ ID NO: 1398552 - RNA, 15 nt, Homo sapiens
ggagaccugugcuag

SEQ ID NO: 1398553 - RNA, 15 nt, Homo sapiens
ggagacuagauuuau

SEQ ID NO: 1398554 - RNA, 12 nt, Homo sapiens
ggagacuuguau

SEQ ID NO: 1398555 - RNA, 14 nt, Homo sapiens
ggagagagacucca

SEQ ID NO: 1398556 - RNA, 13 nt, Homo sapiens
ggagagcccuuca

SEQ ID NO: 1398557 - RNA, 17 nt, Homo sapiens
ggagauaaucuagaaca

SEQ ID NO: 1398558 - RNA, 20 nt, Homo sapiens
ggagcaaaaucgaugcagug

SEQ ID NO: 1398559 - RNA, 13 nt, Homo sapiens
ggagcaacagagg

SEQ ID NO: 1398560 - RNA, 17 nt, Homo sapiens
ggagccccagugccaag

SEQ ID NO: 1398561 - RNA, 22 nt, Homo sapiens
ggagcuugcagugagccgagau

SEQ ID NO: 1398562 - RNA, 21 nt, Homo sapiens
ggaggaguuuaaacugaauga

SEQ ID NO: 1398563 - RNA, 20 nt, Homo sapiens
ggaggauguucugggacaca

SEQ ID NO: 1398564 - RNA, 20 nt, Homo sapiens
ggaggcagagguugcaguga

SEQ ID NO: 1398565 - RNA, 19 nt, Homo sapiens
ggaggccagccagugaccu

SEQ ID NO: 1398566 - RNA, 14 nt, Homo sapiens
ggaggccuuucauc

SEQ ID NO: 1398567 - RNA, 19 nt, Homo sapiens
ggaggcggagcuugcagug

SEQ ID NO: 1398568 - RNA, 22 nt, Homo sapiens
ggagggcgugacucacccaagc

SEQ ID NO: 1398569 - RNA, 17 nt, Homo sapiens
ggagguaguuaagggau

SEQ ID NO: 1398570 - RNA, 19 nt, Homo sapiens
ggagguggcuggguuuaca

SEQ ID NO: 1398571 - RNA, 14 nt, Homo sapiens
ggagguugcaguga

SEQ ID NO: 1398572 - RNA, 14 nt, Homo sapiens
ggaguacaccccaa

SEQ ID NO: 1398573 - RNA, 18 nt, Homo sapiens
ggaguacaccccaacagc

SEQ ID NO: 1398574 - RNA, 21 nt, Homo sapiens
ggaguccuugaccgcucucug

SEQ ID NO: 1398575 - RNA, 18 nt, Homo sapiens
ggagucugucucugcuau

SEQ ID NO: 1398576 - RNA, 22 nt, Homo sapiens
ggagugcucaccgccucacuca

SEQ ID NO: 1398577 - RNA, 18 nt, Homo sapiens
ggaguguggccacguggg

SEQ ID NO: 1398578 - RNA, 23 nt, Homo sapiens
ggauacgcaucagacagauggaa

SEQ ID NO: 1398579 - RNA, 11 nt, Homo sapiens
ggauagcacug

SEQ ID NO: 1398580 - RNA, 16 nt, Homo sapiens
ggauauaggucaguga

SEQ ID NO: 1398581 - RNA, 22 nt, Homo sapiens
ggauauaggucagugaggccca

SEQ ID NO: 1398582 - RNA, 17 nt, Homo sapiens
ggauccggggcuuguac

SEQ ID NO: 1398583 - RNA, 13 nt, Homo sapiens
ggaugaggucaua

SEQ ID NO: 1398584 - RNA, 19 nt, Homo sapiens
ggaugaucuugauuguggg

SEQ ID NO: 1398585 - RNA, 21 nt, Homo sapiens
ggaugccaaccggucacccag

SEQ ID NO: 1398586 - RNA, 23 nt, Homo sapiens
ggaugccaaccggucacccagga

SEQ ID NO: 1398587 - RNA, 14 nt, Homo sapiens
ggaugcccaaagau

SEQ ID NO: 1398588 - RNA, 13 nt, Homo sapiens
ggauggcacuguu

SEQ ID NO: 1398589 - RNA, 21 nt, Homo sapiens
cugacuauugaaguugcagau

SEQ ID NO: 1398590 - RNA, 22 nt, Homo sapiens
cugacuccuuagagacaucaaa

SEQ ID NO: 1398591 - RNA, 21 nt, Homo sapiens
cugacucucugugaccugccc

SEQ ID NO: 1398592 - RNA, 21 nt, Homo sapiens
cugacugcacguggcuucuga

SEQ ID NO: 1398593 - RNA, 16 nt, Homo sapiens
cugacuggcacagucu

SEQ ID NO: 1398594 - RNA, 16 nt, Homo sapiens
cugacuguacuccucc

SEQ ID NO: 1398595 - RNA, 15 nt, Homo sapiens
cugacuuggggaaaa

SEQ ID NO: 1398596 - RNA, 19 nt, Homo sapiens
cugagacuauuuuaacugg

SEQ ID NO: 1398597 - RNA, 16 nt, Homo sapiens
cugagagacaggacua

SEQ ID NO: 1398598 - RNA, 22 nt, Homo sapiens
cugagagacccaaggaggaaaa

SEQ ID NO: 1398599 - RNA, 23 nt, Homo sapiens
cugagcagugcuugaaugaaguu

SEQ ID NO: 1398600 - RNA, 23 nt, Homo sapiens
cugagccccugggacugcugcuu

SEQ ID NO: 1398601 - RNA, 13 nt, Homo sapiens
cugagcccuggca

SEQ ID NO: 1398602 - RNA, 22 nt, Homo sapiens
cugagcuuuggacacacacagc

SEQ ID NO: 1398603 - RNA, 14 nt, Homo sapiens
cugaggaucagaaa

SEQ ID NO: 1398604 - RNA, 13 nt, Homo sapiens
cugaggauuucaa

SEQ ID NO: 1398605 - RNA, 17 nt, Homo sapiens
cugaggcagacagcagc

SEQ ID NO: 1398606 - RNA, 22 nt, Homo sapiens
cugaggcaggaggauugcuuga

SEQ ID NO: 1398607 - RNA, 22 nt, Homo sapiens
cugaggcgcugcuuugucaaaa

SEQ ID NO: 1398608 - RNA, 16 nt, Homo sapiens
cugaggggcaucugcc

SEQ ID NO: 1398609 - RNA, 16 nt, Homo sapiens
cugaggugaaagggag

SEQ ID NO: 1398610 - RNA, 22 nt, Homo sapiens
cugagucaacuccuuucucauc

SEQ ID NO: 1398611 - RNA, 22 nt, Homo sapiens
cugagucccuuagccaagcagu

SEQ ID NO: 1398612 - RNA, 22 nt, Homo sapiens
cugaguggaugacaaaaagagg

SEQ ID NO: 1398613 - RNA, 20 nt, Homo sapiens
cugauaaccacuccuaauau

SEQ ID NO: 1398614 - RNA, 16 nt, Homo sapiens
cugauacccuuugaaa

SEQ ID NO: 1398615 - RNA, 16 nt, Homo sapiens
cugauaggacccauau

SEQ ID NO: 1398616 - RNA, 15 nt, Homo sapiens
cugaugacacugaga

SEQ ID NO: 1398617 - RNA, 19 nt, Homo sapiens
cugauggaaacaaagugga

SEQ ID NO: 1398618 - RNA, 17 nt, Homo sapiens
cugauguuaaaauucca

SEQ ID NO: 1398619 - RNA, 17 nt, Homo sapiens
cugauuaaagguggugc

SEQ ID NO: 1398620 - RNA, 13 nt, Homo sapiens
cugauuucuugcu

SEQ ID NO: 1398621 - RNA, 16 nt, Homo sapiens
cugauuuuuagcuuua

SEQ ID NO: 1398622 - RNA, 17 nt, Homo sapiens
cugauuuuuagcuuuac

SEQ ID NO: 1398623 - RNA, 16 nt, Homo sapiens
cugcaaauaaauucau

SEQ ID NO: 1398624 - RNA, 13 nt, Homo sapiens
cugcaacggaauu

SEQ ID NO: 1398625 - RNA, 16 nt, Homo sapiens
cugcaagucacaaagg

SEQ ID NO: 1398626 - RNA, 17 nt, Homo sapiens
cugcaagucacaaagga

SEQ ID NO: 1398627 - RNA, 21 nt, Homo sapiens
cugcacaaagcccuuccaugu

SEQ ID NO: 1398628 - RNA, 19 nt, Homo sapiens
cugcaccccugcaguuuga

SEQ ID NO: 1398629 - RNA, 15 nt, Homo sapiens
cugcacccucgauga

SEQ ID NO: 1398630 - RNA, 14 nt, Homo sapiens
cugcacuccagccu

SEQ ID NO: 1398631 - RNA, 22 nt, Homo sapiens
cugcacuggugugagggccccu

SEQ ID NO: 1398632 - RNA, 22 nt, Homo sapiens
cugcagggggugugucugcuca

SEQ ID NO: 1398633 - RNA, 15 nt, Homo sapiens
cugcaggucacugaa

SEQ ID NO: 1398634 - RNA, 23 nt, Homo sapiens
cugcagucccauccucuugucag

SEQ ID NO: 1398635 - RNA, 21 nt, Homo sapiens
cugcagugacgugcaccugua

SEQ ID NO: 1398636 - RNA, 21 nt, Homo sapiens
cugcauaguauuccauugugu

SEQ ID NO: 1398637 - RNA, 12 nt, Homo sapiens
cugcauguuaca

SEQ ID NO: 1398638 - RNA, 15 nt, Homo sapiens
cugcauuacauuccu

SEQ ID NO: 1398639 - RNA, 15 nt, Homo sapiens
cugcauucacccaga

SEQ ID NO: 1398640 - RNA, 15 nt, Homo sapiens
cugcauuuagcacaa

SEQ ID NO: 1398641 - RNA, 16 nt, Homo sapiens
cugcauuuagcacaaa

SEQ ID NO: 1398642 - RNA, 22 nt, Homo sapiens
cugccaacacgcccggcuaauu

SEQ ID NO: 1398643 - RNA, 16 nt, Homo sapiens
cugccagccacaucca

SEQ ID NO: 1398644 - RNA, 20 nt, Homo sapiens
cugccagugccuuaccuccu

SEQ ID NO: 1398645 - RNA, 17 nt, Homo sapiens
cugccaugaacuggagg

SEQ ID NO: 1398646 - RNA, 19 nt, Homo sapiens
cugcccaaagcagcacuua

SEQ ID NO: 1398647 - RNA, 21 nt, Homo sapiens
cugcccaaagcagcacuuaua

SEQ ID NO: 1398648 - RNA, 14 nt, Homo sapiens
cugcccaccuguca

SEQ ID NO: 1398649 - RNA, 20 nt, Homo sapiens
cugcccaccugucaaacaaa

SEQ ID NO: 1398650 - RNA, 21 nt, Homo sapiens
cugcccagaccccucuggcca

SEQ ID NO: 1398651 - RNA, 19 nt, Homo sapiens
cugcccagagcugggugag

SEQ ID NO: 1398652 - RNA, 21 nt, Homo sapiens
cugccccaaacaaauaugcaa

SEQ ID NO: 1398653 - RNA, 16 nt, Homo sapiens
cugcccuucagcaucc

SEQ ID NO: 1398654 - RNA, 16 nt, Homo sapiens
cugcccuugucccacu

SEQ ID NO: 1398655 - RNA, 16 nt, Homo sapiens
cugccuagcacucaca

SEQ ID NO: 1398656 - RNA, 14 nt, Homo sapiens
cugccucagccucc

SEQ ID NO: 1398657 - RNA, 23 nt, Homo sapiens
cugccuccauucugaccauuuca

SEQ ID NO: 1398658 - RNA, 15 nt, Homo sapiens
cugccuccucuucaa

SEQ ID NO: 1398659 - RNA, 14 nt, Homo sapiens
cugccucuuaaaua

SEQ ID NO: 1398660 - RNA, 15 nt, Homo sapiens
cugccugaagucaca

SEQ ID NO: 1398661 - RNA, 17 nt, Homo sapiens
cugccugaagucacaca

SEQ ID NO: 1398662 - RNA, 12 nt, Homo sapiens
cugccugagcac

SEQ ID NO: 1398663 - RNA, 16 nt, Homo sapiens
cugccuuggacugugu

SEQ ID NO: 1398664 - RNA, 23 nt, Homo sapiens
cugccuuuuaucugcccagaauu

SEQ ID NO: 1398665 - RNA, 13 nt, Homo sapiens
cugcucaaguuga

SEQ ID NO: 1398666 - RNA, 18 nt, Homo sapiens
cugcucagcagaggauau

SEQ ID NO: 1398667 - RNA, 14 nt, Homo sapiens
cugcuccagugcag

SEQ ID NO: 1398668 - RNA, 15 nt, Homo sapiens
cugcuccagugcagg

SEQ ID NO: 1398669 - RNA, 18 nt, Homo sapiens
cugcucuccgaccagaca

SEQ ID NO: 1398670 - RNA, 21 nt, Homo sapiens
cugcucugucuucuuugccca

SEQ ID NO: 1398671 - RNA, 13 nt, Homo sapiens
cugcugacagugu

SEQ ID NO: 1398672 - RNA, 23 nt, Homo sapiens
cugcuggcagaaagcaaauguga

SEQ ID NO: 1398673 - RNA, 19 nt, Homo sapiens
cugcuucaaacucaaacac

SEQ ID NO: 1398674 - RNA, 23 nt, Homo sapiens
cugcuucaaacucaaacacagag

SEQ ID NO: 1398675 - RNA, 19 nt, Homo sapiens
cugcuucacaaaccuugcu

SEQ ID NO: 1398676 - RNA, 18 nt, Homo sapiens
cugcuuguuaugcaucau

SEQ ID NO: 1398677 - RNA, 17 nt, Homo sapiens
cugcuuuacuuugccca

SEQ ID NO: 1398678 - RNA, 17 nt, Homo sapiens
cugcuuucuuguugcug

SEQ ID NO: 1398679 - RNA, 21 nt, Homo sapiens
cugcuuucuuguugcugcauc

SEQ ID NO: 1398680 - RNA, 17 nt, Homo sapiens
cugcuuuuuaaguguua

SEQ ID NO: 1398681 - RNA, 15 nt, Homo sapiens
cuggaaaacugccuu

SEQ ID NO: 1398682 - RNA, 17 nt, Homo sapiens
guacuuugaagauguca

SEQ ID NO: 1398683 - RNA, 18 nt, Homo sapiens
guagaaauaauaugcauu

SEQ ID NO: 1398684 - RNA, 17 nt, Homo sapiens
guagagagcaagggaag

SEQ ID NO: 1398685 - RNA, 17 nt, Homo sapiens
guagaugacauggugaa

SEQ ID NO: 1398686 - RNA, 11 nt, Homo sapiens
guagccucaac

SEQ ID NO: 1398687 - RNA, 14 nt, Homo sapiens
guagcuucugaccu

SEQ ID NO: 1398688 - RNA, 22 nt, Homo sapiens
guagcuuuccacauuugucaca

SEQ ID NO: 1398689 - RNA, 18 nt, Homo sapiens
guaggaaaaugaagaaga

SEQ ID NO: 1398690 - RNA, 15 nt, Homo sapiens
guagucagacuggau

SEQ ID NO: 1398691 - RNA, 22 nt, Homo sapiens
guaguuaggaaauaaaaccuuu

SEQ ID NO: 1398692 - RNA, 13 nt, Homo sapiens
guauaaaugaagu

SEQ ID NO: 1398693 - RNA, 12 nt, Homo sapiens
guauaauggggc

SEQ ID NO: 1398694 - RNA, 19 nt, Homo sapiens
guauaaugguugacugggu

SEQ ID NO: 1398695 - RNA, 15 nt, Homo sapiens
guauaguacuggcau

SEQ ID NO: 1398696 - RNA, 15 nt, Homo sapiens
guauauacaauaaca

SEQ ID NO: 1398697 - RNA, 17 nt, Homo sapiens
guauaugagacuuucaa

SEQ ID NO: 1398698 - RNA, 14 nt, Homo sapiens
guauauugucagau

SEQ ID NO: 1398699 - RNA, 14 nt, Homo sapiens
guaucaaugaguaa

SEQ ID NO: 1398700 - RNA, 23 nt, Homo sapiens
guauccagagauacuacaauauu

SEQ ID NO: 1398701 - RNA, 16 nt, Homo sapiens
guaucuauuuuccucu

SEQ ID NO: 1398702 - RNA, 23 nt, Homo sapiens
guaugauccuaaugaaugcauaa

SEQ ID NO: 1398703 - RNA, 20 nt, Homo sapiens
guaugcugaaauccggguca

SEQ ID NO: 1398704 - RNA, 18 nt, Homo sapiens
guauguguaccuaaggga

SEQ ID NO: 1398705 - RNA, 13 nt, Homo sapiens
guauuacuuccuc

SEQ ID NO: 1398706 - RNA, 12 nt, Homo sapiens
guauuagucaca

SEQ ID NO: 1398707 - RNA, 17 nt, Homo sapiens
guauugugauuaucaau

SEQ ID NO: 1398708 - RNA, 17 nt, Homo sapiens
guauuuaggcagauuga

SEQ ID NO: 1398709 - RNA, 23 nt, Homo sapiens
guauuuuauuacaucuuucacau

SEQ ID NO: 1398710 - RNA, 11 nt, Homo sapiens
gucaaacugua

SEQ ID NO: 1398711 - RNA, 13 nt, Homo sapiens
gucaaacuguaga

SEQ ID NO: 1398712 - RNA, 20 nt, Homo sapiens
gucaacaaagucacccacuu

SEQ ID NO: 1398713 - RNA, 18 nt, Homo sapiens
gucaauccccucauucag

SEQ ID NO: 1398714 - RNA, 18 nt, Homo sapiens
gucacacacuuuggcuau

SEQ ID NO: 1398715 - RNA, 11 nt, Homo sapiens
gucacuccugg

SEQ ID NO: 1398716 - RNA, 14 nt, Homo sapiens
gucacuuuccucuu

SEQ ID NO: 1398717 - RNA, 12 nt, Homo sapiens
gucagacuggau

SEQ ID NO: 1398718 - RNA, 13 nt, Homo sapiens
gucagaguagaag

SEQ ID NO: 1398719 - RNA, 21 nt, Homo sapiens
gucagcuacuaaugauguuuu

SEQ ID NO: 1398720 - RNA, 19 nt, Homo sapiens
gucagugcccaacuguuau

SEQ ID NO: 1398721 - RNA, 20 nt, Homo sapiens
gucaucacuccucugucaua

SEQ ID NO: 1398722 - RNA, 20 nt, Homo sapiens
gucaucuccaucagcuguaa

SEQ ID NO: 1398723 - RNA, 16 nt, Homo sapiens
guccaaacugccuaag

SEQ ID NO: 1398724 - RNA, 21 nt, Homo sapiens
guccaagugugugugcgugug

SEQ ID NO: 1398725 - RNA, 18 nt, Homo sapiens
guccagcuugcucuucag

SEQ ID NO: 1398726 - RNA, 23 nt, Homo sapiens
guccaggccugugaggugcagag

SEQ ID NO: 1398727 - RNA, 19 nt, Homo sapiens
guccauuuugcccuuccau

SEQ ID NO: 1398728 - RNA, 15 nt, Homo sapiens
gucccauugauguac

SEQ ID NO: 1398729 - RNA, 20 nt, Homo sapiens
gucccauuuucagacugcuu

SEQ ID NO: 1398730 - RNA, 14 nt, Homo sapiens
guccccuuccuucc

SEQ ID NO: 1398731 - RNA, 11 nt, Homo sapiens
gucccuaccuc

SEQ ID NO: 1398732 - RNA, 13 nt, Homo sapiens
gucccucucaggc

SEQ ID NO: 1398733 - RNA, 18 nt, Homo sapiens
gucccuguuguaacugcc

SEQ ID NO: 1398734 - RNA, 18 nt, Homo sapiens
guccuacucugugucagg

SEQ ID NO: 1398735 - RNA, 23 nt, Homo sapiens
guccuccuuguucuacucauaua

SEQ ID NO: 1398736 - RNA, 15 nt, Homo sapiens
guccugaaagccaca

SEQ ID NO: 1398737 - RNA, 16 nt, Homo sapiens
guccugaccugucuca

SEQ ID NO: 1398738 - RNA, 22 nt, Homo sapiens
guccuucaaguuagcucaggag

SEQ ID NO: 1398739 - RNA, 22 nt, Homo sapiens
guccuugauuuaucacacaaag

SEQ ID NO: 1398740 - RNA, 18 nt, Homo sapiens
guccuuucuaaguauuuu

SEQ ID NO: 1398741 - RNA, 16 nt, Homo sapiens
guccuuuuguaccaug

SEQ ID NO: 1398742 - RNA, 23 nt, Homo sapiens
gucgagaggcaccacggccucac

SEQ ID NO: 1398743 - RNA, 18 nt, Homo sapiens
gucgcaucucagugcagg

SEQ ID NO: 1398744 - RNA, 18 nt, Homo sapiens
gucuaaaaacaccaaaaa

SEQ ID NO: 1398745 - RNA, 18 nt, Homo sapiens
gucuaggaacauacuuca

SEQ ID NO: 1398746 - RNA, 22 nt, Homo sapiens
gucuauaacuccuuguuucaga

SEQ ID NO: 1398747 - RNA, 18 nt, Homo sapiens
gucuaugggacucaaugc

SEQ ID NO: 1398748 - RNA, 22 nt, Homo sapiens
gucucaaaccuccaaaagcccu

SEQ ID NO: 1398749 - RNA, 17 nt, Homo sapiens
gucucacaguguugccc

SEQ ID NO: 1398750 - RNA, 15 nt, Homo sapiens
gucucaguccaccug

SEQ ID NO: 1398751 - RNA, 17 nt, Homo sapiens
gucuccccaugugccug

SEQ ID NO: 1398752 - RNA, 16 nt, Homo sapiens
gucuccucucucugua

SEQ ID NO: 1398753 - RNA, 13 nt, Homo sapiens
gucucgcuuuguu

SEQ ID NO: 1398754 - RNA, 15 nt, Homo sapiens
gucucuauacuacau

SEQ ID NO: 1398755 - RNA, 17 nt, Homo sapiens
gucucuucuaagcaaaa

SEQ ID NO: 1398756 - RNA, 21 nt, Homo sapiens
gucucuuuaaugucacaggca

SEQ ID NO: 1398757 - RNA, 14 nt, Homo sapiens
gucugagccaaaga

SEQ ID NO: 1398758 - RNA, 20 nt, Homo sapiens
gucugcucggccgucuucac

SEQ ID NO: 1398759 - RNA, 20 nt, Homo sapiens
gucuguagcuccucaacuca

SEQ ID NO: 1398760 - RNA, 15 nt, Homo sapiens
gucuguccaccccau

SEQ ID NO: 1398761 - RNA, 18 nt, Homo sapiens
gucugugugggacuguac

SEQ ID NO: 1398762 - RNA, 17 nt, Homo sapiens
gucuuaaucaugagaua

SEQ ID NO: 1398763 - RNA, 23 nt, Homo sapiens
gucuuaauuaaguaaacuaauga

SEQ ID NO: 1398764 - RNA, 15 nt, Homo sapiens
gucuuacuguugcau

SEQ ID NO: 1398765 - RNA, 16 nt, Homo sapiens
gucuuacuguugcaua

SEQ ID NO: 1398766 - RNA, 15 nt, Homo sapiens
gucuuagauguauau

SEQ ID NO: 1398767 - RNA, 20 nt, Homo sapiens
gucuucagggggccaggugc

SEQ ID NO: 1398768 - RNA, 22 nt, Homo sapiens
gucuucauaauuucuucacuca

SEQ ID NO: 1398769 - RNA, 19 nt, Homo sapiens
gucuucccugaucaaguca

SEQ ID NO: 1398770 - RNA, 15 nt, Homo sapiens
gucuuccugcauuca

SEQ ID NO: 1398771 - RNA, 16 nt, Homo sapiens
gucuucguacugggaa

SEQ ID NO: 1398772 - RNA, 16 nt, Homo sapiens
gucuucguauucccau

SEQ ID NO: 1398773 - RNA, 16 nt, Homo sapiens
gucuugugacuagugc

SEQ ID NO: 1398774 - RNA, 23 nt, Homo sapiens
gucuuucugacaucagcagagaa

SEQ ID NO: 1398775 - RNA, 18 nt, Homo sapiens
gugaaauauaugcuauau

SEQ ID NO: 1398776 - RNA, 19 nt, Homo sapiens
gugaaaugcuggcauuugc

SEQ ID NO: 1398777 - RNA, 12 nt, Homo sapiens
gugaacagggaa

SEQ ID NO: 1398778 - RNA, 15 nt, Homo sapiens
gugaaccaucauuau

SEQ ID NO: 1398779 - RNA, 17 nt, Homo sapiens
gugaaccuuaguaccua

SEQ ID NO: 1398780 - RNA, 15 nt, Homo sapiens
gugaacugugagggu

SEQ ID NO: 1398781 - RNA, 16 nt, Homo sapiens
gugaaguuuaaacucu

SEQ ID NO: 1398782 - RNA, 16 nt, Homo sapiens
gugaauaaccacuuaa

SEQ ID NO: 1398783 - RNA, 13 nt, Homo sapiens
gugaccaaccuuu

SEQ ID NO: 1398784 - RNA, 11 nt, Homo sapiens
gugaccagcac

SEQ ID NO: 1398785 - RNA, 14 nt, Homo sapiens
gugaccuccacagc

SEQ ID NO: 1398786 - RNA, 21 nt, Homo sapiens
gugaccucugccugaagucac

SEQ ID NO: 1398787 - RNA, 14 nt, Homo sapiens
gugacuguggcaca

SEQ ID NO: 1398788 - RNA, 17 nt, Homo sapiens
gugacuguggcacacgc

SEQ ID NO: 1398789 - RNA, 14 nt, Homo sapiens
gugaggagcacagc

SEQ ID NO: 1398790 - RNA, 19 nt, Homo sapiens
gugaggcuccggauguuuc

SEQ ID NO: 1398791 - RNA, 15 nt, Homo sapiens
gugaguguguccaag

SEQ ID NO: 1398792 - RNA, 16 nt, Homo sapiens
gugagugugugcaagu

SEQ ID NO: 1398793 - RNA, 22 nt, Homo sapiens
gugaucagaccauaauguuaca

SEQ ID NO: 1398794 - RNA, 13 nt, Homo sapiens
gugauccucccac

SEQ ID NO: 1398795 - RNA, 18 nt, Homo sapiens
gugauccucccaccucag

SEQ ID NO: 1398796 - RNA, 16 nt, Homo sapiens
ggggccaggugcacag

SEQ ID NO: 1398797 - RNA, 24 nt, Homo sapiens
ggggcugggcagcguacucaucau

SEQ ID NO: 1398798 - RNA, 20 nt, Homo sapiens
gggggcuuggcugugcccuc

SEQ ID NO: 1398799 - RNA, 20 nt, Homo sapiens
ggggucgucaccaccucucc

SEQ ID NO: 1398800 - RNA, 15 nt, Homo sapiens
gggguggggagcaug

SEQ ID NO: 1398801 - RNA, 13 nt, Homo sapiens
ggguaaauucucu

SEQ ID NO: 1398802 - RNA, 13 nt, Homo sapiens
gggucaacaucuu

SEQ ID NO: 1398803 - RNA, 14 nt, Homo sapiens
gggucaguaaggaa

SEQ ID NO: 1398804 - RNA, 20 nt, Homo sapiens
gggucauacuacauacaagc

SEQ ID NO: 1398805 - RNA, 22 nt, Homo sapiens
gggucccauagaggugagggaa

SEQ ID NO: 1398806 - RNA, 20 nt, Homo sapiens
gggucucacuauguugccca

SEQ ID NO: 1398807 - RNA, 20 nt, Homo sapiens
gggucuuugugagagugagc

SEQ ID NO: 1398808 - RNA, 22 nt, Homo sapiens
gggugcucccuaccaccucccc

SEQ ID NO: 1398809 - RNA, 15 nt, Homo sapiens
ggguggaucaccuga

SEQ ID NO: 1398810 - RNA, 18 nt, Homo sapiens
ggguggcaggugaccuuc

SEQ ID NO: 1398811 - RNA, 17 nt, Homo sapiens
ggguguguguagccaag

SEQ ID NO: 1398812 - RNA, 11 nt, Homo sapiens
ggguguugcua

SEQ ID NO: 1398813 - RNA, 23 nt, Homo sapiens
ggguguugucagcaucuucucac

SEQ ID NO: 1398814 - RNA, 20 nt, Homo sapiens
ggguucaccaggucagggag

SEQ ID NO: 1398815 - RNA, 13 nt, Homo sapiens
ggguucacugcaa

SEQ ID NO: 1398816 - RNA, 15 nt, Homo sapiens
gguaaaaguuacuua

SEQ ID NO: 1398817 - RNA, 14 nt, Homo sapiens
gguaauuguugcua

SEQ ID NO: 1398818 - RNA, 15 nt, Homo sapiens
gguagacacaggaua

SEQ ID NO: 1398819 - RNA, 20 nt, Homo sapiens
gguaguacuccugcaaaauu

SEQ ID NO: 1398820 - RNA, 20 nt, Homo sapiens
gguauaaugguugacugggu

SEQ ID NO: 1398821 - RNA, 23 nt, Homo sapiens
gguaugaucacggcucacugcag

SEQ ID NO: 1398822 - RNA, 21 nt, Homo sapiens
gguauuaaauugauguugcug

SEQ ID NO: 1398823 - RNA, 17 nt, Homo sapiens
ggucacauugugccuuu

SEQ ID NO: 1398824 - RNA, 12 nt, Homo sapiens
ggucacccagga

SEQ ID NO: 1398825 - RNA, 21 nt, Homo sapiens
ggucauacuacauacaagcau

SEQ ID NO: 1398826 - RNA, 11 nt, Homo sapiens
ggucauuugcu

SEQ ID NO: 1398827 - RNA, 19 nt, Homo sapiens
ggucauuuuuauguuauua

SEQ ID NO: 1398828 - RNA, 16 nt, Homo sapiens
gguccaccccauguca

SEQ ID NO: 1398829 - RNA, 22 nt, Homo sapiens
gguccagcuugcucuucagugg

SEQ ID NO: 1398830 - RNA, 19 nt, Homo sapiens
ggucccaggcagagaauca

SEQ ID NO: 1398831 - RNA, 14 nt, Homo sapiens
gguccugggggccu

SEQ ID NO: 1398832 - RNA, 15 nt, Homo sapiens
gguccuucccucucc

SEQ ID NO: 1398833 - RNA, 20 nt, Homo sapiens
ggucuccugcccccacaccu

SEQ ID NO: 1398834 - RNA, 21 nt, Homo sapiens
ggucucuggcccuucuugccu

SEQ ID NO: 1398835 - RNA, 14 nt, Homo sapiens
ggucugugugauga

SEQ ID NO: 1398836 - RNA, 13 nt, Homo sapiens
ggucuucuuacau

SEQ ID NO: 1398837 - RNA, 20 nt, Homo sapiens
ggucuuugcaagaaucauua

SEQ ID NO: 1398838 - RNA, 18 nt, Homo sapiens
ggugaaaccucaucucua

SEQ ID NO: 1398839 - RNA, 19 nt, Homo sapiens
ggugaaaccucaucucuac

SEQ ID NO: 1398840 - RNA, 14 nt, Homo sapiens
ggugacagagcaag

SEQ ID NO: 1398841 - RNA, 19 nt, Homo sapiens
ggugaucaauuaaauguag

SEQ ID NO: 1398842 - RNA, 19 nt, Homo sapiens
ggugcaugaagguuucuga

SEQ ID NO: 1398843 - RNA, 23 nt, Homo sapiens
ggugcucauucauuuaacagagc

SEQ ID NO: 1398844 - RNA, 17 nt, Homo sapiens
ggugcucuuucccuuua

SEQ ID NO: 1398845 - RNA, 20 nt, Homo sapiens
ggugcugcuuucuuguugcu

SEQ ID NO: 1398846 - RNA, 17 nt, Homo sapiens
gguggagguugcaguga

SEQ ID NO: 1398847 - RNA, 13 nt, Homo sapiens
gguggaugccugg

SEQ ID NO: 1398848 - RNA, 17 nt, Homo sapiens
gguggcccacgccugua

SEQ ID NO: 1398849 - RNA, 19 nt, Homo sapiens
ggugggccuccucugucca

SEQ ID NO: 1398850 - RNA, 17 nt, Homo sapiens
gguguacaaaauggaau

SEQ ID NO: 1398851 - RNA, 20 nt, Homo sapiens
ggugugaaccaccacaccca

SEQ ID NO: 1398852 - RNA, 19 nt, Homo sapiens
ggugugagggccccugccu

SEQ ID NO: 1398853 - RNA, 21 nt, Homo sapiens
gguguugccccuauuagcucu

SEQ ID NO: 1398854 - RNA, 22 nt, Homo sapiens
gguguuuauccuaucucuccaa

SEQ ID NO: 1398855 - RNA, 14 nt, Homo sapiens
gguuaaauuugaau

SEQ ID NO: 1398856 - RNA, 12 nt, Homo sapiens
gguuaacagcug

SEQ ID NO: 1398857 - RNA, 18 nt, Homo sapiens
gguuggcugggcccagaa

SEQ ID NO: 1398858 - RNA, 21 nt, Homo sapiens
gguuggcugggcccagaaggu

SEQ ID NO: 1398859 - RNA, 14 nt, Homo sapiens
gguuguuucuucca

SEQ ID NO: 1398860 - RNA, 14 nt, Homo sapiens
gguuucucuguaua

SEQ ID NO: 1398861 - RNA, 19 nt, Homo sapiens
gguuuguguuugaguuuua

SEQ ID NO: 1398862 - RNA, 17 nt, Homo sapiens
gguuuuccuguugagau

SEQ ID NO: 1398863 - RNA, 13 nt, Homo sapiens
guaaaaagggaau

SEQ ID NO: 1398864 - RNA, 16 nt, Homo sapiens
guaaaacuauauucuc

SEQ ID NO: 1398865 - RNA, 23 nt, Homo sapiens
guaaaacuauauucucaguguag

SEQ ID NO: 1398866 - RNA, 14 nt, Homo sapiens
guaaaaucuuggca

SEQ ID NO: 1398867 - RNA, 11 nt, Homo sapiens
guaaacuaaug

SEQ ID NO: 1398868 - RNA, 12 nt, Homo sapiens
guaaagacugua

SEQ ID NO: 1398869 - RNA, 22 nt, Homo sapiens
guaaagguuuuuggaauuaugu

SEQ ID NO: 1398870 - RNA, 22 nt, Homo sapiens
guaaaguauuauuuauuugaau

SEQ ID NO: 1398871 - RNA, 19 nt, Homo sapiens
guaaaguguaacauaugca

SEQ ID NO: 1398872 - RNA, 21 nt, Homo sapiens
guaaauaaccccauucuuugc

SEQ ID NO: 1398873 - RNA, 16 nt, Homo sapiens
guaaauaccugucaau

SEQ ID NO: 1398874 - RNA, 20 nt, Homo sapiens
guaaauagcaacaugcuuca

SEQ ID NO: 1398875 - RNA, 17 nt, Homo sapiens
guaaaugaaguaacuug

SEQ ID NO: 1398876 - RNA, 15 nt, Homo sapiens
guaaauguuuagguu

SEQ ID NO: 1398877 - RNA, 19 nt, Homo sapiens
guaacaacuguggucaauc

SEQ ID NO: 1398878 - RNA, 13 nt, Homo sapiens
guaacauauuuau

SEQ ID NO: 1398879 - RNA, 18 nt, Homo sapiens
guaacaugcaauuuugca

SEQ ID NO: 1398880 - RNA, 13 nt, Homo sapiens
guaacuccagcuc

SEQ ID NO: 1398881 - RNA, 12 nt, Homo sapiens
guaagaaaguga

SEQ ID NO: 1398882 - RNA, 21 nt, Homo sapiens
guaagagaauguugaauacuu

SEQ ID NO: 1398883 - RNA, 15 nt, Homo sapiens
guaagcauaacuuau

SEQ ID NO: 1398884 - RNA, 14 nt, Homo sapiens
guaaguaaugauac

SEQ ID NO: 1398885 - RNA, 19 nt, Homo sapiens
guaauaauacagccaaaga

SEQ ID NO: 1398886 - RNA, 22 nt, Homo sapiens
guaauccuguacaauugcauca

SEQ ID NO: 1398887 - RNA, 21 nt, Homo sapiens
guaaugacaaauaaguggaaa

SEQ ID NO: 1398888 - RNA, 17 nt, Homo sapiens
guaauuauuuucuuccu

SEQ ID NO: 1398889 - RNA, 14 nt, Homo sapiens
guacaaaagggaca

SEQ ID NO: 1398890 - RNA, 17 nt, Homo sapiens
guacaaaguaagccaug

SEQ ID NO: 1398891 - RNA, 21 nt, Homo sapiens
guacaaccugugaucaagcaa

SEQ ID NO: 1398892 - RNA, 21 nt, Homo sapiens
guacacagacuauugacauca

SEQ ID NO: 1398893 - RNA, 22 nt, Homo sapiens
guacagaauucugcuaccucac

SEQ ID NO: 1398894 - RNA, 16 nt, Homo sapiens
guacagauugcugcuu

SEQ ID NO: 1398895 - RNA, 17 nt, Homo sapiens
guacagguaaggugagg

SEQ ID NO: 1398896 - RNA, 17 nt, Homo sapiens
guacauaggcagcacua

SEQ ID NO: 1398897 - RNA, 22 nt, Homo sapiens
guacauucaauguuuaugcaag

SEQ ID NO: 1398898 - RNA, 20 nt, Homo sapiens
guacauuuuuauacagugau

SEQ ID NO: 1398899 - RNA, 21 nt, Homo sapiens
guaccacucaggccaacaagc

SEQ ID NO: 1398900 - RNA, 22 nt, Homo sapiens
guacccaccugagcuuuggacg

SEQ ID NO: 1398901 - RNA, 18 nt, Homo sapiens
guaccuugaacacugggg

SEQ ID NO: 1398902 - RNA, 16 nt, Homo sapiens
guacuagcaguguuuc

SEQ ID NO: 1398903 - RNA, 13 nt, Homo sapiens
guacucuccugga

SEQ ID NO: 1398904 - RNA, 21 nt, Homo sapiens
guacuggagagcaacacagga

SEQ ID NO: 1398905 - RNA, 16 nt, Homo sapiens
guacuguuacuguguc

SEQ ID NO: 1398906 - RNA, 15 nt, Homo sapiens
guacuuagcagcuau

SEQ ID NO: 1398907 - RNA, 19 nt, Homo sapiens
guacuuagcagcuaucucu

SEQ ID NO: 1398908 - RNA, 21 nt, Homo sapiens
guacuuagcagcuaucucuca

SEQ ID NO: 1398909 - RNA, 19 nt, Homo sapiens
uauguaccauguacaugaa

SEQ ID NO: 1398910 - RNA, 18 nt, Homo sapiens
uauguauccaguacauuu

SEQ ID NO: 1398911 - RNA, 21 nt, Homo sapiens
uaugucaggcaaagugcugcu

SEQ ID NO: 1398912 - RNA, 18 nt, Homo sapiens
uaugucucagaccacuau

SEQ ID NO: 1398913 - RNA, 15 nt, Homo sapiens
uaugucuucaugcaa

SEQ ID NO: 1398914 - RNA, 23 nt, Homo sapiens
uaugugaguguguccaagugugu

SEQ ID NO: 1398915 - RNA, 12 nt, Homo sapiens
uauguugcccag

SEQ ID NO: 1398916 - RNA, 16 nt, Homo sapiens
uauuaauauucauugu

SEQ ID NO: 1398917 - RNA, 16 nt, Homo sapiens
uauuacaucuuucaca

SEQ ID NO: 1398918 - RNA, 17 nt, Homo sapiens
uauuagauaaauuucaa

SEQ ID NO: 1398919 - RNA, 16 nt, Homo sapiens
uauuauaacagugugg

SEQ ID NO: 1398920 - RNA, 15 nt, Homo sapiens
uauuauacuaagaaa

SEQ ID NO: 1398921 - RNA, 15 nt, Homo sapiens
uauuauccauucagu

SEQ ID NO: 1398922 - RNA, 18 nt, Homo sapiens
uauuauucuucauaacaa

SEQ ID NO: 1398923 - RNA, 23 nt, Homo sapiens
uauucaauggugagcagacugca

SEQ ID NO: 1398924 - RNA, 21 nt, Homo sapiens
uauucacaaccacucauucaa

SEQ ID NO: 1398925 - RNA, 12 nt, Homo sapiens
uauuccagagac

SEQ ID NO: 1398926 - RNA, 16 nt, Homo sapiens
uauuccauugugugag

SEQ ID NO: 1398927 - RNA, 13 nt, Homo sapiens
uauucccauuaga

SEQ ID NO: 1398928 - RNA, 23 nt, Homo sapiens
uauuccccccacuuaagacugug

SEQ ID NO: 1398929 - RNA, 16 nt, Homo sapiens
uauucucaguguaggg

SEQ ID NO: 1398930 - RNA, 23 nt, Homo sapiens
uauucucaguguagggcagagag

SEQ ID NO: 1398931 - RNA, 17 nt, Homo sapiens
uauucugguuacugugg

SEQ ID NO: 1398932 - RNA, 12 nt, Homo sapiens
uauucuugugaa

SEQ ID NO: 1398933 - RNA, 20 nt, Homo sapiens
uauugaaguuuugacaucaa

SEQ ID NO: 1398934 - RNA, 12 nt, Homo sapiens
uauugacugccu

SEQ ID NO: 1398935 - RNA, 14 nt, Homo sapiens
uauugaugugcaaa

SEQ ID NO: 1398936 - RNA, 17 nt, Homo sapiens
uauugaugugcaaaaau

SEQ ID NO: 1398937 - RNA, 15 nt, Homo sapiens
uauugcauaugcaua

SEQ ID NO: 1398938 - RNA, 18 nt, Homo sapiens
uauugccuggagugugaa

SEQ ID NO: 1398939 - RNA, 19 nt, Homo sapiens
uauuggacugauaaucucu

SEQ ID NO: 1398940 - RNA, 17 nt, Homo sapiens
uauuggaggaccaaaaa

SEQ ID NO: 1398941 - RNA, 14 nt, Homo sapiens
uauugguguuuacc

SEQ ID NO: 1398942 - RNA, 17 nt, Homo sapiens
uauugguguuuacccag

SEQ ID NO: 1398943 - RNA, 17 nt, Homo sapiens
uauugugaaguacauau

SEQ ID NO: 1398944 - RNA, 23 nt, Homo sapiens
uauuguuccaagacauugucaau

SEQ ID NO: 1398945 - RNA, 14 nt, Homo sapiens
uauuuacaagggaa

SEQ ID NO: 1398946 - RNA, 18 nt, Homo sapiens
uauuuacauacaggccau

SEQ ID NO: 1398947 - RNA, 13 nt, Homo sapiens
uauuuauaacuca

SEQ ID NO: 1398948 - RNA, 15 nt, Homo sapiens
uauuuauagucacaa

SEQ ID NO: 1398949 - RNA, 17 nt, Homo sapiens
uauuuaucaaguguauu

SEQ ID NO: 1398950 - RNA, 19 nt, Homo sapiens
uauuuaucagugacagagu

SEQ ID NO: 1398951 - RNA, 21 nt, Homo sapiens
uauuuaugaccuuauaguguu

SEQ ID NO: 1398952 - RNA, 15 nt, Homo sapiens
uauuuaugugugagg

SEQ ID NO: 1398953 - RNA, 13 nt, Homo sapiens
uauuuauuuacug

SEQ ID NO: 1398954 - RNA, 18 nt, Homo sapiens
uauuucccucaccuuucc

SEQ ID NO: 1398955 - RNA, 22 nt, Homo sapiens
uauuucccuguuucuuccacag

SEQ ID NO: 1398956 - RNA, 11 nt, Homo sapiens
ucacacacagg

SEQ ID NO: 1398957 - RNA, 19 nt, Homo sapiens
ucacaccgcgucuggugac

SEQ ID NO: 1398958 - RNA, 16 nt, Homo sapiens
ucacacuuccaccagc

SEQ ID NO: 1398959 - RNA, 21 nt, Homo sapiens
ucacagagauaauucuagcuu

SEQ ID NO: 1398960 - RNA, 18 nt, Homo sapiens
ucacagagugcauuguga

SEQ ID NO: 1398961 - RNA, 16 nt, Homo sapiens
ucacagaugugugauu

SEQ ID NO: 1398962 - RNA, 18 nt, Homo sapiens
ucacagccacuugggaua

SEQ ID NO: 1398963 - RNA, 20 nt, Homo sapiens
ucacagggccccagaaggca

SEQ ID NO: 1398964 - RNA, 15 nt, Homo sapiens
ucacaguuucuucca

SEQ ID NO: 1398965 - RNA, 14 nt, Homo sapiens
ucacauccuguguu

SEQ ID NO: 1398966 - RNA, 14 nt, Homo sapiens
ucacaugcauacau

SEQ ID NO: 1398967 - RNA, 18 nt, Homo sapiens
ucacaugcauacauacac

SEQ ID NO: 1398968 - RNA, 18 nt, Homo sapiens
ucacaugcuggacagguc

SEQ ID NO: 1398969 - RNA, 19 nt, Homo sapiens
ucacaugcuugaugguuua

SEQ ID NO: 1398970 - RNA, 18 nt, Homo sapiens
ucacauuaauauuugcug

SEQ ID NO: 1398971 - RNA, 16 nt, Homo sapiens
ucacauuaucaucuga

SEQ ID NO: 1398972 - RNA, 19 nt, Homo sapiens
ucacauucgaguguuucag

SEQ ID NO: 1398973 - RNA, 14 nt, Homo sapiens
ucacauugugccuu

SEQ ID NO: 1398974 - RNA, 12 nt, Homo sapiens
ucaccaagccca

SEQ ID NO: 1398975 - RNA, 15 nt, Homo sapiens
ucaccagauuugcua

SEQ ID NO: 1398976 - RNA, 18 nt, Homo sapiens
ucaccaucagucaaugaa

SEQ ID NO: 1398977 - RNA, 23 nt, Homo sapiens
ucaccaugcaaugccucuggaau

SEQ ID NO: 1398978 - RNA, 14 nt, Homo sapiens
ucaccauguacaua

SEQ ID NO: 1398979 - RNA, 20 nt, Homo sapiens
ucaccauguacauagcuuga

SEQ ID NO: 1398980 - RNA, 18 nt, Homo sapiens
ucacccaaccacauccca

SEQ ID NO: 1398981 - RNA, 22 nt, Homo sapiens
ucacccaggcaucugcuuuacu

SEQ ID NO: 1398982 - RNA, 18 nt, Homo sapiens
ucaccccugcccugggau

SEQ ID NO: 1398983 - RNA, 14 nt, Homo sapiens
ucaccgacaacaug

SEQ ID NO: 1398984 - RNA, 22 nt, Homo sapiens
ucaccggagcuuucaaagaagg

SEQ ID NO: 1398985 - RNA, 14 nt, Homo sapiens
ucaccgugagcagc

SEQ ID NO: 1398986 - RNA, 21 nt, Homo sapiens
ucaccucuuaugcacaccucc

SEQ ID NO: 1398987 - RNA, 18 nt, Homo sapiens
ucaccugggcugaggcau

SEQ ID NO: 1398988 - RNA, 17 nt, Homo sapiens
ucaccuuaggcagggaa

SEQ ID NO: 1398989 - RNA, 19 nt, Homo sapiens
ucaccuugggaugaugccu

SEQ ID NO: 1398990 - RNA, 21 nt, Homo sapiens
ucaccuugggaugaugccuca

SEQ ID NO: 1398991 - RNA, 19 nt, Homo sapiens
ucacgaaguuuguucauca

SEQ ID NO: 1398992 - RNA, 14 nt, Homo sapiens
ucacgauauuauua

SEQ ID NO: 1398993 - RNA, 17 nt, Homo sapiens
ucacuaaaauuaaucug

SEQ ID NO: 1398994 - RNA, 14 nt, Homo sapiens
ucacucaccaucug

SEQ ID NO: 1398995 - RNA, 15 nt, Homo sapiens
ucacucaguccagcu

SEQ ID NO: 1398996 - RNA, 16 nt, Homo sapiens
ucacuccucugucaua

SEQ ID NO: 1398997 - RNA, 17 nt, Homo sapiens
ucacuccucugucauau

SEQ ID NO: 1398998 - RNA, 17 nt, Homo sapiens
ucacucuuauugcccac

SEQ ID NO: 1398999 - RNA, 16 nt, Homo sapiens
ucacugaaaagacuau

SEQ ID NO: 1399000 - RNA, 15 nt, Homo sapiens
ucacugcagccucaa

SEQ ID NO: 1399001 - RNA, 21 nt, Homo sapiens
ucacugggccuccaaccaugu

SEQ ID NO: 1399002 - RNA, 22 nt, Homo sapiens
ucacuuaacugauguuacugaa

SEQ ID NO: 1399003 - RNA, 12 nt, Homo sapiens
ucacuucuucca

SEQ ID NO: 1399004 - RNA, 17 nt, Homo sapiens
ucacuugaggucaggag

SEQ ID NO: 1399005 - RNA, 12 nt, Homo sapiens
uccagauggcaa

SEQ ID NO: 1399006 - RNA, 19 nt, Homo sapiens
uccagccuggcuacagggc

SEQ ID NO: 1399007 - RNA, 21 nt, Homo sapiens
uccagccugggcaacacagcg

SEQ ID NO: 1399008 - RNA, 20 nt, Homo sapiens
uccaggaugaguuacuugaa

SEQ ID NO: 1399009 - RNA, 15 nt, Homo sapiens
uccaggcgaugugca

SEQ ID NO: 1399010 - RNA, 20 nt, Homo sapiens
uccaggcgaugugcaagugu

SEQ ID NO: 1399011 - RNA, 17 nt, Homo sapiens
uccaguauccacuuugc

SEQ ID NO: 1399012 - RNA, 13 nt, Homo sapiens
uccagucauacca

SEQ ID NO: 1399013 - RNA, 14 nt, Homo sapiens
uccagugagcuuau

SEQ ID NO: 1399014 - RNA, 16 nt, Homo sapiens
uccaguugucuauuca

SEQ ID NO: 1399015 - RNA, 18 nt, Homo sapiens
uccauauauuagcauuua

SEQ ID NO: 1399016 - RNA, 22 nt, Homo sapiens
uccaugacugcauuuuacugua

SEQ ID NO: 1399017 - RNA, 14 nt, Homo sapiens
uccaugccuuccau

SEQ ID NO: 1399018 - RNA, 23 nt, Homo sapiens
uccaugggggcagggcaugacuu

SEQ ID NO: 1399019 - RNA, 20 nt, Homo sapiens
uccauguuugauguaucuga

SEQ ID NO: 1399020 - RNA, 14 nt, Homo sapiens
uccauuauuuauau

SEQ ID NO: 1399021 - RNA, 13 nt, Homo sapiens
ucccaaaaauaaa

SEQ ID NO: 1399022 - RNA, 16 nt, Homo sapiens
ucccaaauugaaucac

SEQ ID NO: 1399023 - RNA, 12 nt, Homo sapiens
ucccaaggcagc

SEQ ID NO: 1399024 - RNA, 17 nt, Homo sapiens
ucccacccccaucucuc

SEQ ID NO: 1399025 - RNA, 18 nt, Homo sapiens
ucccacccccaucucucc

SEQ ID NO: 1399026 - RNA, 21 nt, Homo sapiens
ucccaccgguugcuucuggga

SEQ ID NO: 1399027 - RNA, 14 nt, Homo sapiens
ucccaccucagccu

SEQ ID NO: 1399028 - RNA, 14 nt, Homo sapiens
ucccaggcugaggc

SEQ ID NO: 1399029 - RNA, 21 nt, Homo sapiens
ucccagggccuuaaaagccau

SEQ ID NO: 1399030 - RNA, 22 nt, Homo sapiens
ucccagggccuuaaaagccauc

SEQ ID NO: 1399031 - RNA, 23 nt, Homo sapiens
ucccagguuuaagcgauucucau

SEQ ID NO: 1399032 - RNA, 16 nt, Homo sapiens
ucccauagccaggaaa

SEQ ID NO: 1399033 - RNA, 15 nt, Homo sapiens
ucccaucacuucccu

SEQ ID NO: 1399034 - RNA, 16 nt, Homo sapiens
ucccaucccaucccau

SEQ ID NO: 1399035 - RNA, 17 nt, Homo sapiens
ucccaucccaucccauc

SEQ ID NO: 1399036 - RNA, 13 nt, Homo sapiens
ucccauguuaaau

SEQ ID NO: 1399037 - RNA, 13 nt, Homo sapiens
uccccaacgaaaa

SEQ ID NO: 1399038 - RNA, 14 nt, Homo sapiens
uccccacacugacc

SEQ ID NO: 1399039 - RNA, 13 nt, Homo sapiens
uccccagccucuu

SEQ ID NO: 1399040 - RNA, 19 nt, Homo sapiens
uccccgugggccauggcaa

SEQ ID NO: 1399041 - RNA, 15 nt, Homo sapiens
uccccucaaggacaa

SEQ ID NO: 1399042 - RNA, 14 nt, Homo sapiens
uccccucagauucc

SEQ ID NO: 1399043 - RNA, 22 nt, Homo sapiens
uccccucccuggcucccaugac

SEQ ID NO: 1399044 - RNA, 20 nt, Homo sapiens
uccccuccguggcaucaccu

SEQ ID NO: 1399045 - RNA, 20 nt, Homo sapiens
uccccucuuauguaccucuu

SEQ ID NO: 1399046 - RNA, 14 nt, Homo sapiens
ucccuaaaaacaca

SEQ ID NO: 1399047 - RNA, 15 nt, Homo sapiens
ucccucaaagcacac

SEQ ID NO: 1399048 - RNA, 13 nt, Homo sapiens
ucccucaacccca

SEQ ID NO: 1399049 - RNA, 16 nt, Homo sapiens
ucccuccccugccauu

SEQ ID NO: 1399050 - RNA, 14 nt, Homo sapiens
ucccucuggcccug

SEQ ID NO: 1399051 - RNA, 23 nt, Homo sapiens
ucccugaaguaagcaaagacuuu

SEQ ID NO: 1399052 - RNA, 14 nt, Homo sapiens
ucccuggaccucag

SEQ ID NO: 1399053 - RNA, 19 nt, Homo sapiens
ucccugggggaagcccugg

SEQ ID NO: 1399054 - RNA, 18 nt, Homo sapiens
ucccuuuccuacucucag

SEQ ID NO: 1399055 - RNA, 20 nt, Homo sapiens
ucccuuuuaaaugcaaauca

SEQ ID NO: 1399056 - RNA, 17 nt, Homo sapiens
ucccuuuuuauauccca

SEQ ID NO: 1399057 - RNA, 15 nt, Homo sapiens
uccggaauccugucc

SEQ ID NO: 1399058 - RNA, 15 nt, Homo sapiens
uccggcagccuggau

SEQ ID NO: 1399059 - RNA, 14 nt, Homo sapiens
uccggggcuuguac

SEQ ID NO: 1399060 - RNA, 12 nt, Homo sapiens
uccguacauuca

SEQ ID NO: 1399061 - RNA, 13 nt, Homo sapiens
uccguacauucaa

SEQ ID NO: 1399062 - RNA, 18 nt, Homo sapiens
uccguccaggagccugug

SEQ ID NO: 1399063 - RNA, 19 nt, Homo sapiens
uccuaagccaugggagaca

SEQ ID NO: 1399064 - RNA, 16 nt, Homo sapiens
uccuaagcuauucagu

SEQ ID NO: 1399065 - RNA, 15 nt, Homo sapiens
uccuaccacaaugca

SEQ ID NO: 1399066 - RNA, 17 nt, Homo sapiens
uccuacuuuuccuuccc

SEQ ID NO: 1399067 - RNA, 20 nt, Homo sapiens
uccuacuuuuccuucccuca

SEQ ID NO: 1399068 - RNA, 15 nt, Homo sapiens
uaaaucuugcaacug

SEQ ID NO: 1399069 - RNA, 15 nt, Homo sapiens
uaaaugggacuggag

SEQ ID NO: 1399070 - RNA, 17 nt, Homo sapiens
uaaauguaucauagaaa

SEQ ID NO: 1399071 - RNA, 19 nt, Homo sapiens
uaaauguaucuuauucaca

SEQ ID NO: 1399072 - RNA, 14 nt, Homo sapiens
uaaaugugaacuua

SEQ ID NO: 1399073 - RNA, 12 nt, Homo sapiens
uaaaugugaaug

SEQ ID NO: 1399074 - RNA, 14 nt, Homo sapiens
uaaaugugcuuaug

SEQ ID NO: 1399075 - RNA, 20 nt, Homo sapiens
uaaauguggagaaacuguag

SEQ ID NO: 1399076 - RNA, 15 nt, Homo sapiens
uaaauuauaguguag

SEQ ID NO: 1399077 - RNA, 20 nt, Homo sapiens
uaaauugaaauauaaugcaa

SEQ ID NO: 1399078 - RNA, 15 nt, Homo sapiens
uaaauugauguugcu

SEQ ID NO: 1399079 - RNA, 19 nt, Homo sapiens
uaaauugcuccuugacauu

SEQ ID NO: 1399080 - RNA, 13 nt, Homo sapiens
uaaauuuauuuca

SEQ ID NO: 1399081 - RNA, 15 nt, Homo sapiens
uaaauuucaucucag

SEQ ID NO: 1399082 - RNA, 13 nt, Homo sapiens
uaaauuucuuccu

SEQ ID NO: 1399083 - RNA, 18 nt, Homo sapiens
uaaauuuuauaaucauga

SEQ ID NO: 1399084 - RNA, 14 nt, Homo sapiens
uaacaacuaugauu

SEQ ID NO: 1399085 - RNA, 13 nt, Homo sapiens
uaacaacuguggu

SEQ ID NO: 1399086 - RNA, 21 nt, Homo sapiens
uaacaauaacuacuguguucc

SEQ ID NO: 1399087 - RNA, 17 nt, Homo sapiens
uaacacuguuaagagag

SEQ ID NO: 1399088 - RNA, 23 nt, Homo sapiens
uaacagaccacuguauguuuacu

SEQ ID NO: 1399089 - RNA, 20 nt, Homo sapiens
uaacagaugcaaugugcuac

SEQ ID NO: 1399090 - RNA, 21 nt, Homo sapiens
uaacagauguagcaacaugag

SEQ ID NO: 1399091 - RNA, 18 nt, Homo sapiens
uaacagcuguggcucacg

SEQ ID NO: 1399092 - RNA, 16 nt, Homo sapiens
uaacaggcagauacag

SEQ ID NO: 1399093 - RNA, 14 nt, Homo sapiens
uaacaguucacuuu

SEQ ID NO: 1399094 - RNA, 18 nt, Homo sapiens
uaacaguugugaugacua

SEQ ID NO: 1399095 - RNA, 17 nt, Homo sapiens
uaacaguuuuccaugaa

SEQ ID NO: 1399096 - RNA, 22 nt, Homo sapiens
uaacauaauuuguacauaugua

SEQ ID NO: 1399097 - RNA, 17 nt, Homo sapiens
uaacaugcaauuuugca

SEQ ID NO: 1399098 - RNA, 15 nt, Homo sapiens
uaacauggugugcuu

SEQ ID NO: 1399099 - RNA, 21 nt, Homo sapiens
uaacauguaauuaaguacuau

SEQ ID NO: 1399100 - RNA, 19 nt, Homo sapiens
uaaccaacuuuucuauuaa

SEQ ID NO: 1399101 - RNA, 15 nt, Homo sapiens
uaaccccauucuuug

SEQ ID NO: 1399102 - RNA, 18 nt, Homo sapiens
uaaccgauaugcacuuga

SEQ ID NO: 1399103 - RNA, 17 nt, Homo sapiens
uaaccucaaagugacua

SEQ ID NO: 1399104 - RNA, 14 nt, Homo sapiens
uaaccucaguguca

SEQ ID NO: 1399105 - RNA, 19 nt, Homo sapiens
uaaccucagugucauuuau

SEQ ID NO: 1399106 - RNA, 12 nt, Homo sapiens
uaaccuggugcu

SEQ ID NO: 1399107 - RNA, 18 nt, Homo sapiens
uaacuagaaaucugccaa

SEQ ID NO: 1399108 - RNA, 11 nt, Homo sapiens
uaacuauucaa

SEQ ID NO: 1399109 - RNA, 16 nt, Homo sapiens
uaacucuaacugaugu

SEQ ID NO: 1399110 - RNA, 20 nt, Homo sapiens
uaacugauguuccacaaaac

SEQ ID NO: 1399111 - RNA, 20 nt, Homo sapiens
uaacuggagccccaucagcu

SEQ ID NO: 1399112 - RNA, 13 nt, Homo sapiens
uaacuuauuuucc

SEQ ID NO: 1399113 - RNA, 19 nt, Homo sapiens
uaacuugguuauacaugac

SEQ ID NO: 1399114 - RNA, 20 nt, Homo sapiens
uaagaaaauacaauaaacua

SEQ ID NO: 1399115 - RNA, 15 nt, Homo sapiens
uaagaaacacacuga

SEQ ID NO: 1399116 - RNA, 16 nt, Homo sapiens
uaagaaacacugacuc

SEQ ID NO: 1399117 - RNA, 13 nt, Homo sapiens
uaagaaagacuau

SEQ ID NO: 1399118 - RNA, 17 nt, Homo sapiens
uaagaagaugacuuccc

SEQ ID NO: 1399119 - RNA, 13 nt, Homo sapiens
uaagaagggaaaa

SEQ ID NO: 1399120 - RNA, 20 nt, Homo sapiens
uaagacaaccccagccaauc

SEQ ID NO: 1399121 - RNA, 21 nt, Homo sapiens
uaagacauacuccuuccauca

SEQ ID NO: 1399122 - RNA, 17 nt, Homo sapiens
uaagagccauuuagggg

SEQ ID NO: 1399123 - RNA, 15 nt, Homo sapiens
uaagaggccugugau

SEQ ID NO: 1399124 - RNA, 13 nt, Homo sapiens
uaagaguuacuua

SEQ ID NO: 1399125 - RNA, 22 nt, Homo sapiens
uaagauguguuaggaaugucaa

SEQ ID NO: 1399126 - RNA, 18 nt, Homo sapiens
uaagauguucacuguggc

SEQ ID NO: 1399127 - RNA, 13 nt, Homo sapiens
uaagauucaucca

SEQ ID NO: 1399128 - RNA, 13 nt, Homo sapiens
uaagauuuaccca

SEQ ID NO: 1399129 - RNA, 22 nt, Homo sapiens
uaagauuuugaaaacuacauuu

SEQ ID NO: 1399130 - RNA, 15 nt, Homo sapiens
uaagcaaagacuuuc

SEQ ID NO: 1399131 - RNA, 21 nt, Homo sapiens
uaagcacgggccauaugaaua

SEQ ID NO: 1399132 - RNA, 14 nt, Homo sapiens
uaagcuacugauga

SEQ ID NO: 1399133 - RNA, 12 nt, Homo sapiens
uaagcugggaua

SEQ ID NO: 1399134 - RNA, 18 nt, Homo sapiens
uaagcugggauaaucaca

SEQ ID NO: 1399135 - RNA, 16 nt, Homo sapiens
uaaggaagaaucuucu

SEQ ID NO: 1399136 - RNA, 15 nt, Homo sapiens
uaaggauugugauau

SEQ ID NO: 1399137 - RNA, 15 nt, Homo sapiens
uaagggggugcagca

SEQ ID NO: 1399138 - RNA, 16 nt, Homo sapiens
uaagguggguggauca

SEQ ID NO: 1399139 - RNA, 13 nt, Homo sapiens
uaaguaaacugcc

SEQ ID NO: 1399140 - RNA, 20 nt, Homo sapiens
uaaguacuauguaucaauga

SEQ ID NO: 1399141 - RNA, 17 nt, Homo sapiens
uaaguaucacacuguau

SEQ ID NO: 1399142 - RNA, 18 nt, Homo sapiens
uaaguaucacacuguaua

SEQ ID NO: 1399143 - RNA, 19 nt, Homo sapiens
uaaguaucacacuguauau

SEQ ID NO: 1399144 - RNA, 14 nt, Homo sapiens
uaagucucugugaa

SEQ ID NO: 1399145 - RNA, 19 nt, Homo sapiens
uaagugcuuuguaauggga

SEQ ID NO: 1399146 - RNA, 19 nt, Homo sapiens
uaaguugauggugaugaaa

SEQ ID NO: 1399147 - RNA, 14 nt, Homo sapiens
uaaguuucugggac

SEQ ID NO: 1399148 - RNA, 15 nt, Homo sapiens
uaaguuugauuucau

SEQ ID NO: 1399149 - RNA, 17 nt, Homo sapiens
uaauaaacauccuucaa

SEQ ID NO: 1399150 - RNA, 14 nt, Homo sapiens
uaauaacauaacaa

SEQ ID NO: 1399151 - RNA, 20 nt, Homo sapiens
uaauaaguaucacacuguau

SEQ ID NO: 1399152 - RNA, 18 nt, Homo sapiens
uaauaauacaaguuuuca

SEQ ID NO: 1399153 - RNA, 23 nt, Homo sapiens
uaauacagccaaagauaaucucu

SEQ ID NO: 1399154 - RNA, 18 nt, Homo sapiens
uaauaguuuugauccuaa

SEQ ID NO: 1399155 - RNA, 22 nt, Homo sapiens
uaauauauguauaugcaauaua

SEQ ID NO: 1399156 - RNA, 12 nt, Homo sapiens
uaauauugcaag

SEQ ID NO: 1399157 - RNA, 20 nt, Homo sapiens
uaaucccagcuacuugggag

SEQ ID NO: 1399158 - RNA, 23 nt, Homo sapiens
uaaucccgauucacccuguccaa

SEQ ID NO: 1399159 - RNA, 22 nt, Homo sapiens
uaaugaaagacuguacaaagua

SEQ ID NO: 1399160 - RNA, 13 nt, Homo sapiens
uaaugaacaugug

SEQ ID NO: 1399161 - RNA, 20 nt, Homo sapiens
uaaugauugacguacuuagc

SEQ ID NO: 1399162 - RNA, 18 nt, Homo sapiens
uaauuaaguaaacuaaug

SEQ ID NO: 1399163 - RNA, 16 nt, Homo sapiens
uaauuacauauuugca

SEQ ID NO: 1399164 - RNA, 20 nt, Homo sapiens
uaauuaucgggaacaguguu

SEQ ID NO: 1399165 - RNA, 14 nt, Homo sapiens
uaauucaaaagcac

SEQ ID NO: 1399166 - RNA, 18 nt, Homo sapiens
uaauucaacauauaccuu

SEQ ID NO: 1399167 - RNA, 14 nt, Homo sapiens
uaauuuaaugcaug

SEQ ID NO: 1399168 - RNA, 21 nt, Homo sapiens
uaauuuaucuugucucugggc

SEQ ID NO: 1399169 - RNA, 17 nt, Homo sapiens
uaauuuccauaguguga

SEQ ID NO: 1399170 - RNA, 13 nt, Homo sapiens
uaauuucuucaca

SEQ ID NO: 1399171 - RNA, 23 nt, Homo sapiens
uacaaaaauuccuuuucccgaag

SEQ ID NO: 1399172 - RNA, 17 nt, Homo sapiens
uacaaacacaagcaaaa

SEQ ID NO: 1399173 - RNA, 18 nt, Homo sapiens
uacaaacacaauauucaa

SEQ ID NO: 1399174 - RNA, 17 nt, Homo sapiens
uacaaacucccacuugu

SEQ ID NO: 1399175 - RNA, 14 nt, Homo sapiens
uacaaaguauuugc

SEQ ID NO: 1399176 - RNA, 17 nt, Homo sapiens
uacaaaugcaauuucau

SEQ ID NO: 1399177 - RNA, 18 nt, Homo sapiens
uacaagauaagcuuccag

SEQ ID NO: 1399178 - RNA, 14 nt, Homo sapiens
uacaagcgugagcc

SEQ ID NO: 1399179 - RNA, 18 nt, Homo sapiens
uacaagggaagauuuaug

SEQ ID NO: 1399180 - RNA, 15 nt, Homo sapiens
uacaauaaguuaacu

SEQ ID NO: 1399181 - RNA, 19 nt, Homo sapiens
uacaaucagccacauucua

SEQ ID NO: 1399182 - RNA, 20 nt, Homo sapiens
gugaucuugcucuaucucac

SEQ ID NO: 1399183 - RNA, 23 nt, Homo sapiens
gugaugccucccuguugaagcuc

SEQ ID NO: 1399184 - RNA, 19 nt, Homo sapiens
gugauguugguugaggcag

SEQ ID NO: 1399185 - RNA, 12 nt, Homo sapiens
gugauucuugcu

SEQ ID NO: 1399186 - RNA, 20 nt, Homo sapiens
gugcaaagauuugcuuuaau

SEQ ID NO: 1399187 - RNA, 20 nt, Homo sapiens
gugcaagaaggauaccaaau

SEQ ID NO: 1399188 - RNA, 13 nt, Homo sapiens
gugcaaguguaug

SEQ ID NO: 1399189 - RNA, 19 nt, Homo sapiens
gugcaagugugugcacaug

SEQ ID NO: 1399190 - RNA, 17 nt, Homo sapiens
gugcaagugugugcaug

SEQ ID NO: 1399191 - RNA, 18 nt, Homo sapiens
gugcagauaucacagagg

SEQ ID NO: 1399192 - RNA, 20 nt, Homo sapiens
gugcagugagccgagaucac

SEQ ID NO: 1399193 - RNA, 21 nt, Homo sapiens
gugcauauuaauucaugcaaa

SEQ ID NO: 1399194 - RNA, 20 nt, Homo sapiens
gugcaugaauagauucucuc

SEQ ID NO: 1399195 - RNA, 12 nt, Homo sapiens
gugcaugcucuc

SEQ ID NO: 1399196 - RNA, 15 nt, Homo sapiens
gugcaugugugcgag

SEQ ID NO: 1399197 - RNA, 21 nt, Homo sapiens
gugccauuuuaagaguuacuu

SEQ ID NO: 1399198 - RNA, 13 nt, Homo sapiens
gugcccccaugua

SEQ ID NO: 1399199 - RNA, 15 nt, Homo sapiens
gugcgagugugugca

SEQ ID NO: 1399200 - RNA, 17 nt, Homo sapiens
gugcgagugugugcaug

SEQ ID NO: 1399201 - RNA, 15 nt, Homo sapiens
gugcgugugugcaag

SEQ ID NO: 1399202 - RNA, 16 nt, Homo sapiens
gugcgugugugcaagu

SEQ ID NO: 1399203 - RNA, 24 nt, Homo sapiens
gugcuaaccacgucugucuucaca

SEQ ID NO: 1399204 - RNA, 17 nt, Homo sapiens
gugcucugaucauccac

SEQ ID NO: 1399205 - RNA, 15 nt, Homo sapiens
gugcuggagacacuc

SEQ ID NO: 1399206 - RNA, 15 nt, Homo sapiens
guggaauugugcuga

SEQ ID NO: 1399207 - RNA, 21 nt, Homo sapiens
guggagcacaaaagccucuca

SEQ ID NO: 1399208 - RNA, 19 nt, Homo sapiens
guggagcagccaacaagca

SEQ ID NO: 1399209 - RNA, 15 nt, Homo sapiens
guggaugauguuucg

SEQ ID NO: 1399210 - RNA, 23 nt, Homo sapiens
guggauuauguguguuuugcuaa

SEQ ID NO: 1399211 - RNA, 14 nt, Homo sapiens
guggcaacugcuga

SEQ ID NO: 1399212 - RNA, 16 nt, Homo sapiens
guggcagauuuaguga

SEQ ID NO: 1399213 - RNA, 13 nt, Homo sapiens
guggccaguauuu

SEQ ID NO: 1399214 - RNA, 16 nt, Homo sapiens
guggccaucaaccucu

SEQ ID NO: 1399215 - RNA, 14 nt, Homo sapiens
guggcccaacacaa

SEQ ID NO: 1399216 - RNA, 19 nt, Homo sapiens
guggcccagggaagccaaa

SEQ ID NO: 1399217 - RNA, 21 nt, Homo sapiens
guggccucaacccucccucag

SEQ ID NO: 1399218 - RNA, 12 nt, Homo sapiens
guggccucagaa

SEQ ID NO: 1399219 - RNA, 14 nt, Homo sapiens
guggcugacccccc

SEQ ID NO: 1399220 - RNA, 22 nt, Homo sapiens
gugggagcuuuugguaugugac

SEQ ID NO: 1399221 - RNA, 15 nt, Homo sapiens
uaccuaccacagugu

SEQ ID NO: 1399222 - RNA, 21 nt, Homo sapiens
uaccuagcaaagcuccugccu

SEQ ID NO: 1399223 - RNA, 15 nt, Homo sapiens
uaccuaguagucauu

SEQ ID NO: 1399224 - RNA, 11 nt, Homo sapiens
uaccucaaggg

SEQ ID NO: 1399225 - RNA, 17 nt, Homo sapiens
uaccucaagggggacug

SEQ ID NO: 1399226 - RNA, 20 nt, Homo sapiens
uaccuccuccucuggacaaa

SEQ ID NO: 1399227 - RNA, 15 nt, Homo sapiens
uaccucgaguuuuaa

SEQ ID NO: 1399228 - RNA, 16 nt, Homo sapiens
uaccugagucccaaag

SEQ ID NO: 1399229 - RNA, 11 nt, Homo sapiens
uaccugucaau

SEQ ID NO: 1399230 - RNA, 19 nt, Homo sapiens
uaccuuguaauuugaaaua

SEQ ID NO: 1399231 - RNA, 18 nt, Homo sapiens
uaccuuuugcuguggcaa

SEQ ID NO: 1399232 - RNA, 15 nt, Homo sapiens
uacguaucugcuacu

SEQ ID NO: 1399233 - RNA, 13 nt, Homo sapiens
uacguccuuccac

SEQ ID NO: 1399234 - RNA, 17 nt, Homo sapiens
uacgucuuucacaguuu

SEQ ID NO: 1399235 - RNA, 15 nt, Homo sapiens
uacguuaccaggcag

SEQ ID NO: 1399236 - RNA, 20 nt, Homo sapiens
uacguuuccugagaaguguc

SEQ ID NO: 1399237 - RNA, 15 nt, Homo sapiens
uacuacacauucaau

SEQ ID NO: 1399238 - RNA, 17 nt, Homo sapiens
uacuacauacaagcaua

SEQ ID NO: 1399239 - RNA, 13 nt, Homo sapiens
uacuacauuauua

SEQ ID NO: 1399240 - RNA, 14 nt, Homo sapiens
uacuaccacaagga

SEQ ID NO: 1399241 - RNA, 12 nt, Homo sapiens
uacuauaugauu

SEQ ID NO: 1399242 - RNA, 15 nt, Homo sapiens
uacuaucaugucaaa

SEQ ID NO: 1399243 - RNA, 23 nt, Homo sapiens
uacucaaggaauuugcauuuagu

SEQ ID NO: 1399244 - RNA, 16 nt, Homo sapiens
uacucaccucacccca

SEQ ID NO: 1399245 - RNA, 16 nt, Homo sapiens
uacucacuuucccaaa

SEQ ID NO: 1399246 - RNA, 15 nt, Homo sapiens
uacuccuaccucagc

SEQ ID NO: 1399247 - RNA, 20 nt, Homo sapiens
uacucuaucagagaaaaaca

SEQ ID NO: 1399248 - RNA, 22 nt, Homo sapiens
uacucugaagggcaucaugcau

SEQ ID NO: 1399249 - RNA, 15 nt, Homo sapiens
uacucuuuguagcaa

SEQ ID NO: 1399250 - RNA, 21 nt, Homo sapiens
uacugaaagguuacccuguaa

SEQ ID NO: 1399251 - RNA, 15 nt, Homo sapiens
uacugaacacuucaa

SEQ ID NO: 1399252 - RNA, 16 nt, Homo sapiens
uacugaguauguggaa

SEQ ID NO: 1399253 - RNA, 23 nt, Homo sapiens
uacugcagcuuuguuuguuguca

SEQ ID NO: 1399254 - RNA, 14 nt, Homo sapiens
uacugcuguaaaua

SEQ ID NO: 1399255 - RNA, 16 nt, Homo sapiens
uacuuacacaucuucc

SEQ ID NO: 1399256 - RNA, 18 nt, Homo sapiens
uacuuagcagcuaucucu

SEQ ID NO: 1399257 - RNA, 14 nt, Homo sapiens
uacuuagcaugcac

SEQ ID NO: 1399258 - RNA, 14 nt, Homo sapiens
uacuuauucauugu

SEQ ID NO: 1399259 - RNA, 22 nt, Homo sapiens
uacuucuacauccaauguauga

SEQ ID NO: 1399260 - RNA, 15 nt, Homo sapiens
uacuucucgugacac

SEQ ID NO: 1399261 - RNA, 20 nt, Homo sapiens
uacuugagaggcugaggcaa

SEQ ID NO: 1399262 - RNA, 15 nt, Homo sapiens
uacuuuaauguauaa

SEQ ID NO: 1399263 - RNA, 20 nt, Homo sapiens
uacuuucucuagggagaaaa

SEQ ID NO: 1399264 - RNA, 17 nt, Homo sapiens
uacuuucuguugccaca

SEQ ID NO: 1399265 - RNA, 19 nt, Homo sapiens
uacuuugaguuagugccau

SEQ ID NO: 1399266 - RNA, 12 nt, Homo sapiens
uagaaaaaccac

SEQ ID NO: 1399267 - RNA, 13 nt, Homo sapiens
uagaaaaaccacc

SEQ ID NO: 1399268 - RNA, 19 nt, Homo sapiens
uagaaauauagccaaaaau

SEQ ID NO: 1399269 - RNA, 15 nt, Homo sapiens
uagaaaugggaaaug

SEQ ID NO: 1399270 - RNA, 20 nt, Homo sapiens
uagaagauuuuaugcugcug

SEQ ID NO: 1399271 - RNA, 21 nt, Homo sapiens
uagaaggcacaauaugggcac

SEQ ID NO: 1399272 - RNA, 22 nt, Homo sapiens
uagaagggccaguccugccugg

SEQ ID NO: 1399273 - RNA, 20 nt, Homo sapiens
uagaauauuuauuaccucug

SEQ ID NO: 1399274 - RNA, 20 nt, Homo sapiens
uagaaucagccuagggguca

SEQ ID NO: 1399275 - RNA, 19 nt, Homo sapiens
uagaaugagugaaucaccu

SEQ ID NO: 1399276 - RNA, 15 nt, Homo sapiens
uagacuauuugcuua

SEQ ID NO: 1399277 - RNA, 22 nt, Homo sapiens
uagagaccaguuuucucuggaa

SEQ ID NO: 1399278 - RNA, 22 nt, Homo sapiens
uagagacgggguuucaccaugu

SEQ ID NO: 1399279 - RNA, 20 nt, Homo sapiens
uagagagaagaucacugaag

SEQ ID NO: 1399280 - RNA, 16 nt, Homo sapiens
uagagagcuguuccca

SEQ ID NO: 1399281 - RNA, 20 nt, Homo sapiens
uagagaucuauguacuguaa

SEQ ID NO: 1399282 - RNA, 21 nt, Homo sapiens
uagagccagcccauggcuuua

SEQ ID NO: 1399283 - RNA, 18 nt, Homo sapiens
uagagccagggucucacu

SEQ ID NO: 1399284 - RNA, 19 nt, Homo sapiens
uagagcuagaugugucuua

SEQ ID NO: 1399285 - RNA, 15 nt, Homo sapiens
uagaggaaagaaaga

SEQ ID NO: 1399286 - RNA, 13 nt, Homo sapiens
uagaggcauuuag

SEQ ID NO: 1399287 - RNA, 14 nt, Homo sapiens
uagaggugagggaa

SEQ ID NO: 1399288 - RNA, 12 nt, Homo sapiens
uuaucugugcaa

SEQ ID NO: 1399289 - RNA, 21 nt, Homo sapiens
uuaugaaaaauaagucacuua

SEQ ID NO: 1399290 - RNA, 21 nt, Homo sapiens
uuaugagaaaugccagugugc

SEQ ID NO: 1399291 - RNA, 18 nt, Homo sapiens
uuaugaguuuuucaauua

SEQ ID NO: 1399292 - RNA, 21 nt, Homo sapiens
uuaugcagaauccaaaguaaa

SEQ ID NO: 1399293 - RNA, 21 nt, Homo sapiens
uuaugcaucauuucaggaguu

SEQ ID NO: 1399294 - RNA, 15 nt, Homo sapiens
uuaugccuucacuuu

SEQ ID NO: 1399295 - RNA, 17 nt, Homo sapiens
uuaugccuucacuuuac

SEQ ID NO: 1399296 - RNA, 19 nt, Homo sapiens
uuauguaaaauuuugccua

SEQ ID NO: 1399297 - RNA, 20 nt, Homo sapiens
uuauguauguauguauuuau

SEQ ID NO: 1399298 - RNA, 22 nt, Homo sapiens
uuauguaugugaaaguuacaaa

SEQ ID NO: 1399299 - RNA, 17 nt, Homo sapiens
uuauuacauggggucua

SEQ ID NO: 1399300 - RNA, 19 nt, Homo sapiens
uuauuacccuucuuuccau

SEQ ID NO: 1399301 - RNA, 15 nt, Homo sapiens
uuauuaccucugaua

SEQ ID NO: 1399302 - RNA, 18 nt, Homo sapiens
uuauuauuuaaacaucag

SEQ ID NO: 1399303 - RNA, 15 nt, Homo sapiens
uuauucccuuucaca

SEQ ID NO: 1399304 - RNA, 22 nt, Homo sapiens
uuauugcuugauacuuuugaca

SEQ ID NO: 1399305 - RNA, 14 nt, Homo sapiens
uuauuguaccucuc

SEQ ID NO: 1399306 - RNA, 21 nt, Homo sapiens
uuauuuggauaucaaaagcaa

SEQ ID NO: 1399307 - RNA, 16 nt, Homo sapiens
uuauuuugaaaauaau

SEQ ID NO: 1399308 - RNA, 18 nt, Homo sapiens
uucaaaauauacauucaa

SEQ ID NO: 1399309 - RNA, 18 nt, Homo sapiens
uucaaacuuccagugcaa

SEQ ID NO: 1399310 - RNA, 14 nt, Homo sapiens
uucaacauauaccu

SEQ ID NO: 1399311 - RNA, 20 nt, Homo sapiens
uucaagaccagccugaccaa

SEQ ID NO: 1399312 - RNA, 18 nt, Homo sapiens
uucaagauuaaacugagu

SEQ ID NO: 1399313 - RNA, 16 nt, Homo sapiens
uucaaggucauuuacu

SEQ ID NO: 1399314 - RNA, 16 nt, Homo sapiens
uucaaucaaaauuuca

SEQ ID NO: 1399315 - RNA, 22 nt, Homo sapiens
uucaauucucauuugucacaca

SEQ ID NO: 1399316 - RNA, 18 nt, Homo sapiens
uucaccacaugugcacau

SEQ ID NO: 1399317 - RNA, 19 nt, Homo sapiens
uucaccuaagucucuguga

SEQ ID NO: 1399318 - RNA, 20 nt, Homo sapiens
uucaccuguaaaacuuuauu

SEQ ID NO: 1399319 - RNA, 20 nt, Homo sapiens
uucaccuuccagugucucgg

SEQ ID NO: 1399320 - RNA, 12 nt, Homo sapiens
uucacuacauua

SEQ ID NO: 1399321 - RNA, 13 nt, Homo sapiens
uucacuucagagc

SEQ ID NO: 1399322 - RNA, 12 nt, Homo sapiens
uucacuugcagu

SEQ ID NO: 1399323 - RNA, 21 nt, Homo sapiens
uucacuugguucaguaccaca

SEQ ID NO: 1399324 - RNA, 22 nt, Homo sapiens
uucacuugguucaguaccacau

SEQ ID NO: 1399325 - RNA, 21 nt, Homo sapiens
uucacuuuuuacagugcuauu

SEQ ID NO: 1399326 - RNA, 19 nt, Homo sapiens
uucagaaaauucccaugag

SEQ ID NO: 1399327 - RNA, 17 nt, Homo sapiens
uucagaagagaugggcu

SEQ ID NO: 1399328 - RNA, 13 nt, Homo sapiens
uucagaaucucuc

SEQ ID NO: 1399329 - RNA, 23 nt, Homo sapiens
uucagaauguacggaaagaugau

SEQ ID NO: 1399330 - RNA, 19 nt, Homo sapiens
uucagaugauucuaugucu

SEQ ID NO: 1399331 - RNA, 14 nt, Homo sapiens
uucagccaggagau

SEQ ID NO: 1399332 - RNA, 15 nt, Homo sapiens
uucagccugaggcug

SEQ ID NO: 1399333 - RNA, 13 nt, Homo sapiens
uucagcucuacag

SEQ ID NO: 1399334 - RNA, 17 nt, Homo sapiens
uucaggaguuacuggau

SEQ ID NO: 1399335 - RNA, 18 nt, Homo sapiens
uucaggcaacgcacaaaa

SEQ ID NO: 1399336 - RNA, 16 nt, Homo sapiens
uucagggcacugcugc

SEQ ID NO: 1399337 - RNA, 13 nt, Homo sapiens
uucaguaauaacu

SEQ ID NO: 1399338 - RNA, 23 nt, Homo sapiens
uucaguaccacaugggugaacac

SEQ ID NO: 1399339 - RNA, 18 nt, Homo sapiens
uucagugcuguacuugau

SEQ ID NO: 1399340 - RNA, 13 nt, Homo sapiens
uucagugcuucuu

SEQ ID NO: 1399341 - RNA, 22 nt, Homo sapiens
uucaguggcuaccuacauacaa

SEQ ID NO: 1399342 - RNA, 21 nt, Homo sapiens
uucaguuggcugacuuccaca

SEQ ID NO: 1399343 - RNA, 16 nt, Homo sapiens
uucauacccuguuacc

SEQ ID NO: 1399344 - RNA, 16 nt, Homo sapiens
uucaucuuccccaagu

SEQ ID NO: 1399345 - RNA, 14 nt, Homo sapiens
uucaugaaaauccu

SEQ ID NO: 1399346 - RNA, 14 nt, Homo sapiens
uucauguuacucau

SEQ ID NO: 1399347 - RNA, 20 nt, Homo sapiens
uucauuauuggaauuaaccu

SEQ ID NO: 1399348 - RNA, 15 nt, Homo sapiens
uucauucacuuuaau

SEQ ID NO: 1399349 - RNA, 15 nt, Homo sapiens
uuccaaaaaccaugu

SEQ ID NO: 1399350 - RNA, 19 nt, Homo sapiens
uuccaaauuggauacugcu

SEQ ID NO: 1399351 - RNA, 14 nt, Homo sapiens
uuccaauuuacaua

SEQ ID NO: 1399352 - RNA, 17 nt, Homo sapiens
uuccacaaguuaaauaa

SEQ ID NO: 1399353 - RNA, 22 nt, Homo sapiens
uugauaaaauaaaaaucauucu

SEQ ID NO: 1399354 - RNA, 22 nt, Homo sapiens
uugauggauuaauuaaauaagu

SEQ ID NO: 1399355 - RNA, 21 nt, Homo sapiens
uugauggcuccgaacacccuc

SEQ ID NO: 1399356 - RNA, 12 nt, Homo sapiens
uugauggugaua

SEQ ID NO: 1399357 - RNA, 17 nt, Homo sapiens
uugaugugaaacauuau

SEQ ID NO: 1399358 - RNA, 17 nt, Homo sapiens
uugauucacaaugaaau

SEQ ID NO: 1399359 - RNA, 22 nt, Homo sapiens
uugauucacaaugaaaugcucu

SEQ ID NO: 1399360 - RNA, 17 nt, Homo sapiens
uugauuguuguuauuaa

SEQ ID NO: 1399361 - RNA, 16 nt, Homo sapiens
uugcaaauacauggau

SEQ ID NO: 1399362 - RNA, 13 nt, Homo sapiens
uugcaaauccacu

SEQ ID NO: 1399363 - RNA, 15 nt, Homo sapiens
uugcaacuuagcuca

SEQ ID NO: 1399364 - RNA, 15 nt, Homo sapiens
uugcaagaaucauua

SEQ ID NO: 1399365 - RNA, 18 nt, Homo sapiens
uugcaauguggcuugaau

SEQ ID NO: 1399366 - RNA, 18 nt, Homo sapiens
uugcacaaauugggccaa

SEQ ID NO: 1399367 - RNA, 21 nt, Homo sapiens
uugcacacuccccugcacugg

SEQ ID NO: 1399368 - RNA, 16 nt, Homo sapiens
uugcacgcccaugugu

SEQ ID NO: 1399369 - RNA, 20 nt, Homo sapiens
uugcauaguaccaaucauuu

SEQ ID NO: 1399370 - RNA, 13 nt, Homo sapiens
uugcauaugcaua

SEQ ID NO: 1399371 - RNA, 11 nt, Homo sapiens
uugcaucucac

SEQ ID NO: 1399372 - RNA, 14 nt, Homo sapiens
uugccaaacagcca

SEQ ID NO: 1399373 - RNA, 22 nt, Homo sapiens
uugccaaacagccacacugugg

SEQ ID NO: 1399374 - RNA, 16 nt, Homo sapiens
uugccacaacccuguu

SEQ ID NO: 1399375 - RNA, 15 nt, Homo sapiens
uugccauaaagucaa

SEQ ID NO: 1399376 - RNA, 18 nt, Homo sapiens
uugcccagggacuuccuc

SEQ ID NO: 1399377 - RNA, 14 nt, Homo sapiens
uugccuaaguauuc

SEQ ID NO: 1399378 - RNA, 15 nt, Homo sapiens
uugccuugggcugcu

SEQ ID NO: 1399379 - RNA, 20 nt, Homo sapiens
uugcgccauugcacuccagc

SEQ ID NO: 1399380 - RNA, 13 nt, Homo sapiens
uugcggacagcca

SEQ ID NO: 1399381 - RNA, 15 nt, Homo sapiens
uugcuaccucaaggg

SEQ ID NO: 1399382 - RNA, 14 nt, Homo sapiens
uugcuaugaagcgu

SEQ ID NO: 1399383 - RNA, 11 nt, Homo sapiens
uugcucaaggc

SEQ ID NO: 1399384 - RNA, 14 nt, Homo sapiens
uugcuccuugacau

SEQ ID NO: 1399385 - RNA, 22 nt, Homo sapiens
uugcugccaaacacccaugccc

SEQ ID NO: 1399386 - RNA, 15 nt, Homo sapiens
uugcugcccuaggcu

SEQ ID NO: 1399387 - RNA, 16 nt, Homo sapiens
uugcuucucucucuaa

SEQ ID NO: 1399388 - RNA, 14 nt, Homo sapiens
uuggaaaaucaaga

SEQ ID NO: 1399389 - RNA, 12 nt, Homo sapiens
uuggaaaucaca

SEQ ID NO: 1399390 - RNA, 15 nt, Homo sapiens
uuggaagaaauaucc

SEQ ID NO: 1399391 - RNA, 23 nt, Homo sapiens
uuggaauuaugucugcugaauaa

SEQ ID NO: 1399392 - RNA, 15 nt, Homo sapiens
uuggaauuuugugcc

SEQ ID NO: 1399393 - RNA, 16 nt, Homo sapiens
uuggaauuuugugccc

SEQ ID NO: 1399394 - RNA, 23 nt, Homo sapiens
uuggacauguccaugaccagaag

SEQ ID NO: 1399395 - RNA, 23 nt, Homo sapiens
uuggaccgaguagaggcauuuag

SEQ ID NO: 1399396 - RNA, 23 nt, Homo sapiens
uuggagaaacccuugaaaagaca

SEQ ID NO: 1399397 - RNA, 12 nt, Homo sapiens
uuggagcacucu

SEQ ID NO: 1399398 - RNA, 20 nt, Homo sapiens
uuggagggcccacuuguauc

SEQ ID NO: 1399399 - RNA, 20 nt, Homo sapiens
uguauccucugaccuacaua

SEQ ID NO: 1399400 - RNA, 21 nt, Homo sapiens
uguauccucugaccuacauac

SEQ ID NO: 1399401 - RNA, 18 nt, Homo sapiens
uguaucggagacagugau

SEQ ID NO: 1399402 - RNA, 13 nt, Homo sapiens
uguaucucaggaa

SEQ ID NO: 1399403 - RNA, 16 nt, Homo sapiens
uguaucuuauucacau

SEQ ID NO: 1399404 - RNA, 14 nt, Homo sapiens
uguaugacuaaaga

SEQ ID NO: 1399405 - RNA, 22 nt, Homo sapiens
uguaugcacgugugcacacaca

SEQ ID NO: 1399406 - RNA, 12 nt, Homo sapiens
uguaugcacuuu

SEQ ID NO: 1399407 - RNA, 20 nt, Homo sapiens
uguaugugcgugugugcaag

SEQ ID NO: 1399408 - RNA, 17 nt, Homo sapiens
uguauguuccucuauga

SEQ ID NO: 1399409 - RNA, 18 nt, Homo sapiens
uguauuaaagacagaggc

SEQ ID NO: 1399410 - RNA, 20 nt, Homo sapiens
uguauuuccagugcaauugu

SEQ ID NO: 1399411 - RNA, 18 nt, Homo sapiens
uguauuuuccaacuuguu

SEQ ID NO: 1399412 - RNA, 21 nt, Homo sapiens
ugucaauaaaaccacuguaca

SEQ ID NO: 1399413 - RNA, 21 nt, Homo sapiens
ugucacaaauaaacauaauaa

SEQ ID NO: 1399414 - RNA, 18 nt, Homo sapiens
ugucacaaccucucugau

SEQ ID NO: 1399415 - RNA, 20 nt, Homo sapiens
ugucacauagagugaucuuu

SEQ ID NO: 1399416 - RNA, 18 nt, Homo sapiens
ugucacuguuccuuguca

SEQ ID NO: 1399417 - RNA, 24 nt, Homo sapiens
ugucacuuuccucuuccacuuuga

SEQ ID NO: 1399418 - RNA, 16 nt, Homo sapiens
ugucagcuacuaauga

SEQ ID NO: 1399419 - RNA, 20 nt, Homo sapiens
ugucagcuacuaaugauguu

SEQ ID NO: 1399420 - RNA, 17 nt, Homo sapiens
ugucaucagccugugua

SEQ ID NO: 1399421 - RNA, 21 nt, Homo sapiens
ugucaucccauugucuucuga

SEQ ID NO: 1399422 - RNA, 22 nt, Homo sapiens
uguccacguaucuuugggucuu

SEQ ID NO: 1399423 - RNA, 16 nt, Homo sapiens
uguccaugccuuccau

SEQ ID NO: 1399424 - RNA, 20 nt, Homo sapiens
ugucccggggcuccacugaa

SEQ ID NO: 1399425 - RNA, 12 nt, Homo sapiens
ugucccuaguaa

SEQ ID NO: 1399426 - RNA, 16 nt, Homo sapiens
ugucccucacuguuga

SEQ ID NO: 1399427 - RNA, 17 nt, Homo sapiens
uguccuacucuguguca

SEQ ID NO: 1399428 - RNA, 21 nt, Homo sapiens
uguccuuuuggcacugagaua

SEQ ID NO: 1399429 - RNA, 18 nt, Homo sapiens
ugucuacguuaccaggca

SEQ ID NO: 1399430 - RNA, 17 nt, Homo sapiens
ugucucagaccacuauu

SEQ ID NO: 1399431 - RNA, 21 nt, Homo sapiens
ugucucggagggauuccccua

SEQ ID NO: 1399432 - RNA, 19 nt, Homo sapiens
ugucugccagccagcagcc

SEQ ID NO: 1399433 - RNA, 17 nt, Homo sapiens
ugucugugugcaagugu

SEQ ID NO: 1399434 - RNA, 16 nt, Homo sapiens
ugucuguucauggaga

SEQ ID NO: 1399435 - RNA, 18 nt, Homo sapiens
ugucuucauagcagauuu

SEQ ID NO: 1399436 - RNA, 12 nt, Homo sapiens
ugucuuccauaa

SEQ ID NO: 1399437 - RNA, 22 nt, Homo sapiens
ugucuuggcagccuacuaggga

SEQ ID NO: 1399438 - RNA, 15 nt, Homo sapiens
ugucuuguucaccuu

SEQ ID NO: 1399439 - RNA, 16 nt, Homo sapiens
ugucuuuacuccauga

SEQ ID NO: 1399440 - RNA, 17 nt, Homo sapiens
ugucuuucuuuggugcc

SEQ ID NO: 1399441 - RNA, 20 nt, Homo sapiens
ugugaaaguuacaaauugcu

SEQ ID NO: 1399442 - RNA, 17 nt, Homo sapiens
ugugaaauucucuuucc

SEQ ID NO: 1399443 - RNA, 20 nt, Homo sapiens
ugugaacagggaacucagaa

SEQ ID NO: 1399444 - RNA, 13 nt, Homo sapiens
ugugaacuagcug

SEQ ID NO: 1399445 - RNA, 18 nt, Homo sapiens
ugugacccacuuaccuug

SEQ ID NO: 1399446 - RNA, 13 nt, Homo sapiens
ugugaccuugacu

SEQ ID NO: 1399447 - RNA, 17 nt, Homo sapiens
ugugagaaacaucucaa

SEQ ID NO: 1399448 - RNA, 18 nt, Homo sapiens
ugugagaauaaacuagac

SEQ ID NO: 1399449 - RNA, 16 nt, Homo sapiens
ugugagccaccacguc

SEQ ID NO: 1399450 - RNA, 15 nt, Homo sapiens
ugugagugugugcaa

SEQ ID NO: 1399451 - RNA, 16 nt, Homo sapiens
ugugauguuuguccug

SEQ ID NO: 1399452 - RNA, 17 nt, Homo sapiens
ugugauucacaguguga

SEQ ID NO: 1399453 - RNA, 23 nt, Homo sapiens
ugugcacuugcacgcccaugugu

SEQ ID NO: 1399454 - RNA, 16 nt, Homo sapiens
ugugcaucuguacuca

SEQ ID NO: 1399455 - RNA, 22 nt, Homo sapiens
ugugcgcugacaaccaccgcuc

SEQ ID NO: 1399456 - RNA, 17 nt, Homo sapiens
ugugcgugcaugugcac

SEQ ID NO: 1399457 - RNA, 24 nt, Homo sapiens
ugugcucugaucauccacugugcc

SEQ ID NO: 1399458 - RNA, 22 nt, Homo sapiens
ugugcugaguugguguugacau

SEQ ID NO: 1399459 - RNA, 21 nt, Homo sapiens
ugugcuucuuaaaauagccau

SEQ ID NO: 1399460 - RNA, 13 nt, Homo sapiens
uguggacugugau

SEQ ID NO: 1399461 - RNA, 18 nt, Homo sapiens
uguggaugauaaaacaca

SEQ ID NO: 1399462 - RNA, 20 nt, Homo sapiens
uguggcaaagccuucauugc

SEQ ID NO: 1399463 - RNA, 16 nt, Homo sapiens
uguggcaacugcugau

SEQ ID NO: 1399464 - RNA, 15 nt, Homo sapiens
uguggcccaagacaa

SEQ ID NO: 1399465 - RNA, 17 nt, Homo sapiens
uguggcugcuagcacuu

SEQ ID NO: 1399466 - RNA, 21 nt, Homo sapiens
uguggcugcuagcacuuggag

SEQ ID NO: 1399467 - RNA, 19 nt, Homo sapiens
ugugggaaugcggcaagaa

SEQ ID NO: 1399468 - RNA, 17 nt, Homo sapiens
ugugggacugagaugca

SEQ ID NO: 1399469 - RNA, 14 nt, Homo sapiens
ugugggcugugagu

SEQ ID NO: 1399470 - RNA, 15 nt, Homo sapiens
uguggguaccuguau

SEQ ID NO: 1399471 - RNA, 13 nt, Homo sapiens
uguggucaauccg

SEQ ID NO: 1399472 - RNA, 19 nt, Homo sapiens
ugugguuaaugccauggac

SEQ ID NO: 1399473 - RNA, 22 nt, Homo sapiens
ugugguuaaugccauggacaga

SEQ ID NO: 1399474 - RNA, 21 nt, Homo sapiens
ugugguuuucuuuugccauga

SEQ ID NO: 1399475 - RNA, 15 nt, Homo sapiens
uguguaccuaaggga

SEQ ID NO: 1399476 - RNA, 9 nt, Homo sapiens
uguguauga

SEQ ID NO: 1399477 - RNA, 13 nt, Homo sapiens
uguguaugugcca

SEQ ID NO: 1399478 - RNA, 16 nt, Homo sapiens
uguguauguuugcaca

SEQ ID NO: 1399479 - RNA, 18 nt, Homo sapiens
ugugucagggaacauauu

SEQ ID NO: 1399480 - RNA, 19 nt, Homo sapiens
uguguccaagugugugugc

SEQ ID NO: 1399481 - RNA, 20 nt, Homo sapiens
uguguccaugugugugcaag

SEQ ID NO: 1399482 - RNA, 12 nt, Homo sapiens
ugugucuucaau

SEQ ID NO: 1399483 - RNA, 14 nt, Homo sapiens
ugugucuucaauuu

SEQ ID NO: 1399484 - RNA, 13 nt, Homo sapiens
ugugugaagauca

SEQ ID NO: 1399485 - RNA, 12 nt, Homo sapiens
ugugugaucugu

SEQ ID NO: 1399486 - RNA, 21 nt, Homo sapiens
ugugugaucugugggcacauu

SEQ ID NO: 1399487 - RNA, 15 nt, Homo sapiens
ugugugcaugugugc

SEQ ID NO: 1399488 - RNA, 17 nt, Homo sapiens
ugugugcgugugcgugc

SEQ ID NO: 1399489 - RNA, 21 nt, Homo sapiens
uguguuaggacagcauauaaa

SEQ ID NO: 1399490 - RNA, 18 nt, Homo sapiens
uguguucucuauugcugc

SEQ ID NO: 1399491 - RNA, 20 nt, Homo sapiens
uguuaaauauuuacauauga

SEQ ID NO: 1399492 - RNA, 21 nt, Homo sapiens
uguuaaauauuuacauaugaa

SEQ ID NO: 1399493 - RNA, 14 nt, Homo sapiens
uguuaauaucuuga

SEQ ID NO: 1399494 - RNA, 20 nt, Homo sapiens
uguuacacaugacacucuuc

SEQ ID NO: 1399495 - RNA, 20 nt, Homo sapiens
uguuacgcacacguacuuaa

SEQ ID NO: 1399496 - RNA, 15 nt, Homo sapiens
uguuacugugucagg

SEQ ID NO: 1399497 - RNA, 13 nt, Homo sapiens
uguuagaaaugca

SEQ ID NO: 1399498 - RNA, 17 nt, Homo sapiens
uguuagugguuacccag

SEQ ID NO: 1399499 - RNA, 15 nt, Homo sapiens
uguuauuuauugcua

SEQ ID NO: 1399500 - RNA, 15 nt, Homo sapiens
uguucacuguggcau

SEQ ID NO: 1399501 - RNA, 13 nt, Homo sapiens
uguucagaugcuu

SEQ ID NO: 1399502 - RNA, 22 nt, Homo sapiens
uguuccaugaaggcagagccau

SEQ ID NO: 1399503 - RNA, 20 nt, Homo sapiens
uguucccuccccgaucaucu

SEQ ID NO: 1399504 - RNA, 22 nt, Homo sapiens
uguucccuccccgaucaucuuu

SEQ ID NO: 1399505 - RNA, 20 nt, Homo sapiens
uguuccugaaccgaugagaa

SEQ ID NO: 1399506 - RNA, 13 nt, Homo sapiens
uguucuacacuca

SEQ ID NO: 1399507 - RNA, 20 nt, Homo sapiens
uguucugacccugcuucaaa

SEQ ID NO: 1399508 - RNA, 13 nt, Homo sapiens
uguucugauuaga

SEQ ID NO: 1399509 - RNA, 22 nt, Homo sapiens
uguucuucuaccacccaccagu

SEQ ID NO: 1399510 - RNA, 14 nt, Homo sapiens
uguugaaaagccau

SEQ ID NO: 1399511 - RNA, 14 nt, Homo sapiens
uguugacaugugcu

SEQ ID NO: 1399512 - RNA, 17 nt, Homo sapiens
agaaaacuugaauucau

SEQ ID NO: 1399513 - RNA, 16 nt, Homo sapiens
agaaaagaacuggaaa

SEQ ID NO: 1399514 - RNA, 12 nt, Homo sapiens
agaaaagacaug

SEQ ID NO: 1399515 - RNA, 22 nt, Homo sapiens
augugcugaaugguuuucaaaa

SEQ ID NO: 1399516 - RNA, 21 nt, Homo sapiens
auguggaagaacuuaggcauc

SEQ ID NO: 1399517 - RNA, 19 nt, Homo sapiens
auguggaaggcagcagagc

SEQ ID NO: 1399518 - RNA, 23 nt, Homo sapiens
auguggcaacugcugaugcucau

SEQ ID NO: 1399519 - RNA, 18 nt, Homo sapiens
auguggcagcugucucaa

SEQ ID NO: 1399520 - RNA, 14 nt, Homo sapiens
auguggcauguuca

SEQ ID NO: 1399521 - RNA, 22 nt, Homo sapiens
auguggccuaaaaaugcaacuu

SEQ ID NO: 1399522 - RNA, 15 nt, Homo sapiens
augugggugagccag

SEQ ID NO: 1399523 - RNA, 16 nt, Homo sapiens
auguguaccuaaggga

SEQ ID NO: 1399524 - RNA, 21 nt, Homo sapiens
augugucacuacucacagucu

SEQ ID NO: 1399525 - RNA, 22 nt, Homo sapiens
augugucuuaccagaucuaaua

SEQ ID NO: 1399526 - RNA, 12 nt, Homo sapiens
augugucuucaa

SEQ ID NO: 1399527 - RNA, 14 nt, Homo sapiens
augugugaggagcu

SEQ ID NO: 1399528 - RNA, 14 nt, Homo sapiens
augugugagugugu

SEQ ID NO: 1399529 - RNA, 19 nt, Homo sapiens
auguguguguauguuugca

SEQ ID NO: 1399530 - RNA, 20 nt, Homo sapiens
auguguuauuugucacaaau

SEQ ID NO: 1399531 - RNA, 15 nt, Homo sapiens
auguguuuuucacau

SEQ ID NO: 1399532 - RNA, 21 nt, Homo sapiens
auguuacagguuacaugagag

SEQ ID NO: 1399533 - RNA, 15 nt, Homo sapiens
auguuacauagugua

SEQ ID NO: 1399534 - RNA, 21 nt, Homo sapiens
auguuaguagaaauuuuacaa

SEQ ID NO: 1399535 - RNA, 13 nt, Homo sapiens
auguuaugcauaa

SEQ ID NO: 1399536 - RNA, 21 nt, Homo sapiens
auguucauuguaauguuacug

SEQ ID NO: 1399537 - RNA, 14 nt, Homo sapiens
auguucauuuguac

SEQ ID NO: 1399538 - RNA, 14 nt, Homo sapiens
auguucugggacac

SEQ ID NO: 1399539 - RNA, 16 nt, Homo sapiens
auguugauuucuugua

SEQ ID NO: 1399540 - RNA, 15 nt, Homo sapiens
auguuuaugagccag

SEQ ID NO: 1399541 - RNA, 13 nt, Homo sapiens
auguuucuauucu

SEQ ID NO: 1399542 - RNA, 16 nt, Homo sapiens
auguuuguccugaaca

SEQ ID NO: 1399543 - RNA, 14 nt, Homo sapiens
auguuuuucuucau

SEQ ID NO: 1399544 - RNA, 20 nt, Homo sapiens
auguuuuucuucucccucag

SEQ ID NO: 1399545 - RNA, 16 nt, Homo sapiens
auuaaaaauauauuau

SEQ ID NO: 1399546 - RNA, 18 nt, Homo sapiens
auuaaaaucacucucagu

SEQ ID NO: 1399547 - RNA, 13 nt, Homo sapiens
auuaaauuaggaa

SEQ ID NO: 1399548 - RNA, 16 nt, Homo sapiens
auuaacauaagaaaag

SEQ ID NO: 1399549 - RNA, 14 nt, Homo sapiens
auuaaccuggugcu

SEQ ID NO: 1399550 - RNA, 18 nt, Homo sapiens
auuaacuuugaccagagu

SEQ ID NO: 1399551 - RNA, 16 nt, Homo sapiens
auuaagccuuccacac

SEQ ID NO: 1399552 - RNA, 13 nt, Homo sapiens
auuaauauuugcu

SEQ ID NO: 1399553 - RNA, 22 nt, Homo sapiens
auuaaugacaaaggcacugagg

SEQ ID NO: 1399554 - RNA, 13 nt, Homo sapiens
auuaaugcuaaau

SEQ ID NO: 1399555 - RNA, 12 nt, Homo sapiens
auuaauucaccu

SEQ ID NO: 1399556 - RNA, 15 nt, Homo sapiens
auuacaaaugcaauu

SEQ ID NO: 1399557 - RNA, 14 nt, Homo sapiens
auuacaauugugag

SEQ ID NO: 1399558 - RNA, 15 nt, Homo sapiens
auuaccagaaccaca

SEQ ID NO: 1399559 - RNA, 16 nt, Homo sapiens
auuaccuaguagucau

SEQ ID NO: 1399560 - RNA, 14 nt, Homo sapiens
auuaccuugugcua

SEQ ID NO: 1399561 - RNA, 22 nt, Homo sapiens
auuaccuugugcuaauccucuu

SEQ ID NO: 1399562 - RNA, 20 nt, Homo sapiens
auuacuuuuucauucuuuua

SEQ ID NO: 1399563 - RNA, 20 nt, Homo sapiens
auuagaaauaaagcaucuca

SEQ ID NO: 1399564 - RNA, 19 nt, Homo sapiens
auuagcaauugacugucac

SEQ ID NO: 1399565 - RNA, 18 nt, Homo sapiens
auuagcauuuugcuaaau

SEQ ID NO: 1399566 - RNA, 18 nt, Homo sapiens
auuauaauuaguuccuca

SEQ ID NO: 1399567 - RNA, 19 nt, Homo sapiens
auuauaggagugagccacc

SEQ ID NO: 1399568 - RNA, 16 nt, Homo sapiens
auuauauuguuaauca

SEQ ID NO: 1399569 - RNA, 17 nt, Homo sapiens
auuaucaauuaccacac

SEQ ID NO: 1399570 - RNA, 21 nt, Homo sapiens
auuaucgggagcagugucuuc

SEQ ID NO: 1399571 - RNA, 16 nt, Homo sapiens
auuaugcaggggcaaa

SEQ ID NO: 1399572 - RNA, 11 nt, Homo sapiens
auuauggcauu

SEQ ID NO: 1399573 - RNA, 15 nt, Homo sapiens
auuauuaacacugaa

SEQ ID NO: 1399574 - RNA, 18 nt, Homo sapiens
auuauuauucuucauaac

SEQ ID NO: 1399575 - RNA, 17 nt, Homo sapiens
auuauuuaaacaucagc

SEQ ID NO: 1399576 - RNA, 15 nt, Homo sapiens
auuauuuacugacau

SEQ ID NO: 1399577 - RNA, 23 nt, Homo sapiens
auuauuuacugacauauaucuau

SEQ ID NO: 1399578 - RNA, 14 nt, Homo sapiens
auuauuuuaaucua

SEQ ID NO: 1399579 - RNA, 16 nt, Homo sapiens
auuauuuucacuguag

SEQ ID NO: 1399580 - RNA, 20 nt, Homo sapiens
auucaaaagguuauauacca

SEQ ID NO: 1399581 - RNA, 15 nt, Homo sapiens
auucaaagcacuguu

SEQ ID NO: 1399582 - RNA, 11 nt, Homo sapiens
auucaaaguga

SEQ ID NO: 1399583 - RNA, 14 nt, Homo sapiens
auucaaccacugua

SEQ ID NO: 1399584 - RNA, 12 nt, Homo sapiens
auucacaaugaa

SEQ ID NO: 1399585 - RNA, 13 nt, Homo sapiens
auucacaguguga

SEQ ID NO: 1399586 - RNA, 14 nt, Homo sapiens
auucaccuguaaaa

SEQ ID NO: 1399587 - RNA, 18 nt, Homo sapiens
auucacugcuuaugcagu

SEQ ID NO: 1399588 - RNA, 16 nt, Homo sapiens
auucacuugcauuucu

SEQ ID NO: 1399589 - RNA, 22 nt, Homo sapiens
auucagacuguuuuucagggag

SEQ ID NO: 1399590 - RNA, 17 nt, Homo sapiens
auucaggcaacgcacaa

SEQ ID NO: 1399591 - RNA, 17 nt, Homo sapiens
auucagggagugggcua

SEQ ID NO: 1399592 - RNA, 13 nt, Homo sapiens
auucaguauuaaa

SEQ ID NO: 1399593 - RNA, 16 nt, Homo sapiens
auucaguuuucaggau

SEQ ID NO: 1399594 - RNA, 15 nt, Homo sapiens
auucauguggaauau

SEQ ID NO: 1399595 - RNA, 19 nt, Homo sapiens
auuccaauauaaaggcagg

SEQ ID NO: 1399596 - RNA, 19 nt, Homo sapiens
auuccaccuagagcuagau

SEQ ID NO: 1399597 - RNA, 16 nt, Homo sapiens
auuccaccuucccaug

SEQ ID NO: 1399598 - RNA, 20 nt, Homo sapiens
auuccaggcgaugugcaagu

SEQ ID NO: 1399599 - RNA, 18 nt, Homo sapiens
auucccacagcacuaauu

SEQ ID NO: 1399600 - RNA, 20 nt, Homo sapiens
auucccagcugucuguguca

SEQ ID NO: 1399601 - RNA, 18 nt, Homo sapiens
auucccauuuccugucau

SEQ ID NO: 1399602 - RNA, 19 nt, Homo sapiens
auucccuaucuuuuaguuu

SEQ ID NO: 1399603 - RNA, 14 nt, Homo sapiens
auuccuacaaagau

SEQ ID NO: 1399604 - RNA, 19 nt, Homo sapiens
auuccuggagcccgaggca

SEQ ID NO: 1399605 - RNA, 13 nt, Homo sapiens
auuccuugauuca

SEQ ID NO: 1399606 - RNA, 12 nt, Homo sapiens
auucgugcagca

SEQ ID NO: 1399607 - RNA, 18 nt, Homo sapiens
auucuacguaucugcuac

SEQ ID NO: 1399608 - RNA, 13 nt, Homo sapiens
auucuaggcaucc

SEQ ID NO: 1399609 - RNA, 13 nt, Homo sapiens
auucuaguacuug

SEQ ID NO: 1399610 - RNA, 11 nt, Homo sapiens
auucuaugagg

SEQ ID NO: 1399611 - RNA, 16 nt, Homo sapiens
auucucaaagcaggaa

SEQ ID NO: 1399612 - RNA, 14 nt, Homo sapiens
auucucacuccuac

SEQ ID NO: 1399613 - RNA, 22 nt, Homo sapiens
auucucaguguagggcagagag

SEQ ID NO: 1399614 - RNA, 15 nt, Homo sapiens
auucucaugccucag

SEQ ID NO: 1399615 - RNA, 14 nt, Homo sapiens
auucucgcuuaaaa

SEQ ID NO: 1399616 - RNA, 22 nt, Homo sapiens
auucucuccucagacugcucaa

SEQ ID NO: 1399617 - RNA, 16 nt, Homo sapiens
auucucucuccuguac

SEQ ID NO: 1399618 - RNA, 19 nt, Homo sapiens
auucugauuuuacauguaa

SEQ ID NO: 1399619 - RNA, 20 nt, Homo sapiens
auucuggucucucuauuacc

SEQ ID NO: 1399620 - RNA, 19 nt, Homo sapiens
auucuguaugccaagugaa

SEQ ID NO: 1399621 - RNA, 19 nt, Homo sapiens
auucuuguauauuauggaa

SEQ ID NO: 1399622 - RNA, 19 nt, Homo sapiens
auucuuguuuuaagugccu

SEQ ID NO: 1399623 - RNA, 20 nt, Homo sapiens
auucuuuucuuuuccauuua

SEQ ID NO: 1399624 - RNA, 17 nt, Homo sapiens
auugaaagcuuuuguua

SEQ ID NO: 1399625 - RNA, 23 nt, Homo sapiens
auugaaauauaaugcaaaccaua

SEQ ID NO: 1399626 - RNA, 14 nt, Homo sapiens
caaacugauacaga

SEQ ID NO: 1399627 - RNA, 12 nt, Homo sapiens
caaacugccuaa

SEQ ID NO: 1399628 - RNA, 20 nt, Homo sapiens
caaagaaggaauucuaggca

SEQ ID NO: 1399629 - RNA, 19 nt, Homo sapiens
acucagggccccagcacua

SEQ ID NO: 1399630 - RNA, 22 nt, Homo sapiens
acucaguuugucagacuuuaaa

SEQ ID NO: 1399631 - RNA, 17 nt, Homo sapiens
acucaucuuagugccug

SEQ ID NO: 1399632 - RNA, 13 nt, Homo sapiens
acucauucaggga

SEQ ID NO: 1399633 - RNA, 12 nt, Homo sapiens
acuccaugagaa

SEQ ID NO: 1399634 - RNA, 20 nt, Homo sapiens
acucccuccucaccucugga

SEQ ID NO: 1399635 - RNA, 15 nt, Homo sapiens
acuccggagguagag

SEQ ID NO: 1399636 - RNA, 21 nt, Homo sapiens
acuccucugucauaugcagaa

SEQ ID NO: 1399637 - RNA, 14 nt, Homo sapiens
acuccucuuuacac

SEQ ID NO: 1399638 - RNA, 20 nt, Homo sapiens
acuccuuccugccaccugcu

SEQ ID NO: 1399639 - RNA, 19 nt, Homo sapiens
acuccuuguaaagacugua

SEQ ID NO: 1399640 - RNA, 22 nt, Homo sapiens
acuccuuguaaagacuguagaa

SEQ ID NO: 1399641 - RNA, 23 nt, Homo sapiens
acucgcuucucugugacugaugu

SEQ ID NO: 1399642 - RNA, 13 nt, Homo sapiens
acucgugugcaac

SEQ ID NO: 1399643 - RNA, 20 nt, Homo sapiens
acucuaacaucuagcuggcu

SEQ ID NO: 1399644 - RNA, 18 nt, Homo sapiens
acucuagggaaaaaccag

SEQ ID NO: 1399645 - RNA, 22 nt, Homo sapiens
acucuccagaaagcucaucuca

SEQ ID NO: 1399646 - RNA, 16 nt, Homo sapiens
acucugaaacugagaa

SEQ ID NO: 1399647 - RNA, 15 nt, Homo sapiens
acucugaauuccaag

SEQ ID NO: 1399648 - RNA, 19 nt, Homo sapiens
acucugacuggcacagucu

SEQ ID NO: 1399649 - RNA, 19 nt, Homo sapiens
acucugccucugccugcau

SEQ ID NO: 1399650 - RNA, 21 nt, Homo sapiens
acucuggaguucaucagaguu

SEQ ID NO: 1399651 - RNA, 15 nt, Homo sapiens
acucuguuccuggcu

SEQ ID NO: 1399652 - RNA, 21 nt, Homo sapiens
acucuucccccucucccaguu

SEQ ID NO: 1399653 - RNA, 15 nt, Homo sapiens
acucuucugaauuga

SEQ ID NO: 1399654 - RNA, 19 nt, Homo sapiens
acucuuguuuucaguuuca

SEQ ID NO: 1399655 - RNA, 19 nt, Homo sapiens
acucuuucuggccugccuu

SEQ ID NO: 1399656 - RNA, 18 nt, Homo sapiens
acugaaaacaagccauga

SEQ ID NO: 1399657 - RNA, 14 nt, Homo sapiens
acugaaaugcuagc

SEQ ID NO: 1399658 - RNA, 19 nt, Homo sapiens
acugaagaaacuucugcuu

SEQ ID NO: 1399659 - RNA, 23 nt, Homo sapiens
acugaaggcuuucagggccucca

SEQ ID NO: 1399660 - RNA, 15 nt, Homo sapiens
acugaccagccucca

SEQ ID NO: 1399661 - RNA, 16 nt, Homo sapiens
acugagagaucugcug

SEQ ID NO: 1399662 - RNA, 20 nt, Homo sapiens
acugagcagacuggugagca

SEQ ID NO: 1399663 - RNA, 14 nt, Homo sapiens
acugaggcagacag

SEQ ID NO: 1399664 - RNA, 22 nt, Homo sapiens
acugaguuaaauuauacuggag

SEQ ID NO: 1399665 - RNA, 13 nt, Homo sapiens
acugauaaucucu

SEQ ID NO: 1399666 - RNA, 19 nt, Homo sapiens
acugaugggcaacccccag

SEQ ID NO: 1399667 - RNA, 15 nt, Homo sapiens
acugcaagcacugca

SEQ ID NO: 1399668 - RNA, 18 nt, Homo sapiens
acugcacagugcaucuca

SEQ ID NO: 1399669 - RNA, 20 nt, Homo sapiens
acugcagggacugccagucc

SEQ ID NO: 1399670 - RNA, 20 nt, Homo sapiens
acugccucuuccucccucau

SEQ ID NO: 1399671 - RNA, 23 nt, Homo sapiens
acugccuuuuuguaauccuguac

SEQ ID NO: 1399672 - RNA, 19 nt, Homo sapiens
acugcucacacugcugaug

SEQ ID NO: 1399673 - RNA, 18 nt, Homo sapiens
acuggaggccaggaaucu

SEQ ID NO: 1399674 - RNA, 18 nt, Homo sapiens
acuggcaaccugcuuuca

SEQ ID NO: 1399675 - RNA, 20 nt, Homo sapiens
acuggcuuugucccacagcu

SEQ ID NO: 1399676 - RNA, 20 nt, Homo sapiens
acugggagaaaugacuuuga

SEQ ID NO: 1399677 - RNA, 19 nt, Homo sapiens
acugggcaaugauggcaau

SEQ ID NO: 1399678 - RNA, 22 nt, Homo sapiens
acugguagaacguaaccacgga

SEQ ID NO: 1399679 - RNA, 18 nt, Homo sapiens
acuguacucugcacuggu

SEQ ID NO: 1399680 - RNA, 15 nt, Homo sapiens
acuguagucucagga

SEQ ID NO: 1399681 - RNA, 16 nt, Homo sapiens
acuguauuacauaaau

SEQ ID NO: 1399682 - RNA, 12 nt, Homo sapiens
acugucacuguu

SEQ ID NO: 1399683 - RNA, 18 nt, Homo sapiens
acugucacuguuucucug

SEQ ID NO: 1399684 - RNA, 13 nt, Homo sapiens
acuguccaaagac

SEQ ID NO: 1399685 - RNA, 16 nt, Homo sapiens
acugucuugaagacaa

SEQ ID NO: 1399686 - RNA, 12 nt, Homo sapiens
acugucuuucag

SEQ ID NO: 1399687 - RNA, 20 nt, Homo sapiens
acugugaacuuggggaacaa

SEQ ID NO: 1399688 - RNA, 19 nt, Homo sapiens
acuguggagguacacucuu

SEQ ID NO: 1399689 - RNA, 22 nt, Homo sapiens
acuguggcugcuagcacuugga

SEQ ID NO: 1399690 - RNA, 12 nt, Homo sapiens
acugugggcucc

SEQ ID NO: 1399691 - RNA, 17 nt, Homo sapiens
acugugguacugaugga

SEQ ID NO: 1399692 - RNA, 18 nt, Homo sapiens
acuguguuuuuccuccau

SEQ ID NO: 1399693 - RNA, 10 nt, Homo sapiens
acuguugcau

SEQ ID NO: 1399694 - RNA, 17 nt, Homo sapiens
acuuaaaaaaaugacag

SEQ ID NO: 1399695 - RNA, 18 nt, Homo sapiens
acuuaaccgcaucagaag

SEQ ID NO: 1399696 - RNA, 17 nt, Homo sapiens
acuuaccuagauucuac

SEQ ID NO: 1399697 - RNA, 17 nt, Homo sapiens
acuuaccuugcaucuca

SEQ ID NO: 1399698 - RNA, 12 nt, Homo sapiens
acuuagcaacuu

SEQ ID NO: 1399699 - RNA, 23 nt, Homo sapiens
acuuagcagcuaucucucaguga

SEQ ID NO: 1399700 - RNA, 12 nt, Homo sapiens
acuuagcucaca

SEQ ID NO: 1399701 - RNA, 20 nt, Homo sapiens
acuucaaaaacugucaaaga

SEQ ID NO: 1399702 - RNA, 13 nt, Homo sapiens
acuucaagugcau

SEQ ID NO: 1399703 - RNA, 19 nt, Homo sapiens
acuucaaguuaaagugaau

SEQ ID NO: 1399704 - RNA, 18 nt, Homo sapiens
acuucauuugaugcuaaa

SEQ ID NO: 1399705 - RNA, 19 nt, Homo sapiens
acuuccaagaccugacuca

SEQ ID NO: 1399706 - RNA, 14 nt, Homo sapiens
acuuccauuugcuu

SEQ ID NO: 1399707 - RNA, 20 nt, Homo sapiens
acuuccccgcauuccaggcu

SEQ ID NO: 1399708 - RNA, 14 nt, Homo sapiens
acuucccuaaugaa

SEQ ID NO: 1399709 - RNA, 16 nt, Homo sapiens
acuucccuaaugaagu

SEQ ID NO: 1399710 - RNA, 16 nt, Homo sapiens
acuuccuguccagaga

SEQ ID NO: 1399711 - RNA, 19 nt, Homo sapiens
acuuccugugacuucagcu

SEQ ID NO: 1399712 - RNA, 15 nt, Homo sapiens
acuucuaaaugcaua

SEQ ID NO: 1399713 - RNA, 18 nt, Homo sapiens
acuucuacauccaaugua

SEQ ID NO: 1399714 - RNA, 19 nt, Homo sapiens
acuucugaaaccucugggu

SEQ ID NO: 1399715 - RNA, 17 nt, Homo sapiens
acuucugaccacacuuc

SEQ ID NO: 1399716 - RNA, 19 nt, Homo sapiens
acuucuuauacauuugaua

SEQ ID NO: 1399717 - RNA, 18 nt, Homo sapiens
acuugaaagcauccaugu

SEQ ID NO: 1399718 - RNA, 19 nt, Homo sapiens
acuugaaagcauccaugug

SEQ ID NO: 1399719 - RNA, 16 nt, Homo sapiens
acuugaagccaucuaa

SEQ ID NO: 1399720 - RNA, 17 nt, Homo sapiens
acuugacagaacacugu

SEQ ID NO: 1399721 - RNA, 21 nt, Homo sapiens
acuugaugacagacacuucua

SEQ ID NO: 1399722 - RNA, 15 nt, Homo sapiens
acuugcauacagaga

SEQ ID NO: 1399723 - RNA, 16 nt, Homo sapiens
acuugcauacagagac

SEQ ID NO: 1399724 - RNA, 14 nt, Homo sapiens
acuugcugccugaa

SEQ ID NO: 1399725 - RNA, 21 nt, Homo sapiens
acuuggagccccagugccaag

SEQ ID NO: 1399726 - RNA, 19 nt, Homo sapiens
acuugguucaguaccacau

SEQ ID NO: 1399727 - RNA, 15 nt, Homo sapiens
acuuguuuuaugcuc

SEQ ID NO: 1399728 - RNA, 15 nt, Homo sapiens
acuuuaaagcccuuu

SEQ ID NO: 1399729 - RNA, 16 nt, Homo sapiens
acuuuaccugaaacaa

SEQ ID NO: 1399730 - RNA, 19 nt, Homo sapiens
acuuucauugccagugucu

SEQ ID NO: 1399731 - RNA, 22 nt, Homo sapiens
acuuuccacuccuggcugagag

SEQ ID NO: 1399732 - RNA, 22 nt, Homo sapiens
acuuuccauagggccuccuuag

SEQ ID NO: 1399733 - RNA, 15 nt, Homo sapiens
acuuuccucuuccac

SEQ ID NO: 1399734 - RNA, 12 nt, Homo sapiens
acuuugauacca

SEQ ID NO: 1399735 - RNA, 11 nt, Homo sapiens
acuuugggacg

SEQ ID NO: 1399736 - RNA, 17 nt, Homo sapiens
acuuugggaggccaagg

SEQ ID NO: 1399737 - RNA, 18 nt, Homo sapiens
acuuugggaggccaagga

SEQ ID NO: 1399738 - RNA, 16 nt, Homo sapiens
acuuuguccgguggaa

SEQ ID NO: 1399739 - RNA, 18 nt, Homo sapiens
acuuuucguuaacauuga

SEQ ID NO: 1399740 - RNA, 13 nt, Homo sapiens
agaaaaacaauaa

SEQ ID NO: 1399741 - RNA, 11 nt, Homo sapiens
agaaaaaccac

SEQ ID NO: 1399742 - RNA, 11 nt, Homo sapiens
caaagacagaa

SEQ ID NO: 1399743 - RNA, 22 nt, Homo sapiens
caaagacuacauauugucacug

SEQ ID NO: 1399744 - RNA, 14 nt, Homo sapiens
caaagacuauuccc

SEQ ID NO: 1399745 - RNA, 16 nt, Homo sapiens
caaagacuauucccuu

SEQ ID NO: 1399746 - RNA, 15 nt, Homo sapiens
caaagacuuaacugg

SEQ ID NO: 1399747 - RNA, 15 nt, Homo sapiens
caaagagaaugccau

SEQ ID NO: 1399748 - RNA, 16 nt, Homo sapiens
caaagagaaugccauu

SEQ ID NO: 1399749 - RNA, 22 nt, Homo sapiens
caaagauuuuggaggagaagga

SEQ ID NO: 1399750 - RNA, 18 nt, Homo sapiens
caaagcaaggaucuuuca

SEQ ID NO: 1399751 - RNA, 18 nt, Homo sapiens
caaagcacgaaauguuau

SEQ ID NO: 1399752 - RNA, 22 nt, Homo sapiens
caaagcaggaauugguggcaga

SEQ ID NO: 1399753 - RNA, 19 nt, Homo sapiens
caaagcaguagucaaggag

SEQ ID NO: 1399754 - RNA, 23 nt, Homo sapiens
caaagccuccuccagccgccaug

SEQ ID NO: 1399755 - RNA, 16 nt, Homo sapiens
caaagcuuccauucca

SEQ ID NO: 1399756 - RNA, 17 nt, Homo sapiens
caaagcuuccauuccac

SEQ ID NO: 1399757 - RNA, 13 nt, Homo sapiens
caaaggaaaaagu

SEQ ID NO: 1399758 - RNA, 15 nt, Homo sapiens
caaaggguacuucca

SEQ ID NO: 1399759 - RNA, 13 nt, Homo sapiens
caaaguaagccau

SEQ ID NO: 1399760 - RNA, 15 nt, Homo sapiens
caaaguagcaauuuc

SEQ ID NO: 1399761 - RNA, 17 nt, Homo sapiens
caaagugagacuccguc

SEQ ID NO: 1399762 - RNA, 13 nt, Homo sapiens
caaagugcuggga

SEQ ID NO: 1399763 - RNA, 19 nt, Homo sapiens
caaaguuuggauuguauca

SEQ ID NO: 1399764 - RNA, 15 nt, Homo sapiens
caaauaaaaacccaa

SEQ ID NO: 1399765 - RNA, 16 nt, Homo sapiens
caaauaaauucauaca

SEQ ID NO: 1399766 - RNA, 22 nt, Homo sapiens
caaauaaccaacccuucccuga

SEQ ID NO: 1399767 - RNA, 13 nt, Homo sapiens
caaauaaguggaa

SEQ ID NO: 1399768 - RNA, 19 nt, Homo sapiens
caaauaauuuuucacuuca

SEQ ID NO: 1399769 - RNA, 17 nt, Homo sapiens
caaauauuauucuuaau

SEQ ID NO: 1399770 - RNA, 15 nt, Homo sapiens
caaauauuccagaga

SEQ ID NO: 1399771 - RNA, 21 nt, Homo sapiens
caaaucagcugcuacuacucc

SEQ ID NO: 1399772 - RNA, 12 nt, Homo sapiens
caaaucaucucu

SEQ ID NO: 1399773 - RNA, 11 nt, Homo sapiens
caaaugagauc

SEQ ID NO: 1399774 - RNA, 13 nt, Homo sapiens
caaauggacauaa

SEQ ID NO: 1399775 - RNA, 19 nt, Homo sapiens
caaauggacauaagacaga

SEQ ID NO: 1399776 - RNA, 18 nt, Homo sapiens
caaaugggaaaaccagac

SEQ ID NO: 1399777 - RNA, 14 nt, Homo sapiens
caaauguccuccag

SEQ ID NO: 1399778 - RNA, 15 nt, Homo sapiens
caaauuaaggcauaa

SEQ ID NO: 1399779 - RNA, 16 nt, Homo sapiens
caaauuaucaagcuaa

SEQ ID NO: 1399780 - RNA, 21 nt, Homo sapiens
caaauucauggugcacugagc

SEQ ID NO: 1399781 - RNA, 19 nt, Homo sapiens
caaauucuguuucuugaga

SEQ ID NO: 1399782 - RNA, 19 nt, Homo sapiens
caacaaacuucaaggguuu

SEQ ID NO: 1399783 - RNA, 19 nt, Homo sapiens
caacaaagccaacagucaa

SEQ ID NO: 1399784 - RNA, 15 nt, Homo sapiens
caacaaagucaccca

SEQ ID NO: 1399785 - RNA, 17 nt, Homo sapiens
caacaaagucacccacu

SEQ ID NO: 1399786 - RNA, 21 nt, Homo sapiens
caacaaauuagguuuuguaca

SEQ ID NO: 1399787 - RNA, 15 nt, Homo sapiens
caacaagucuugaaa

SEQ ID NO: 1399788 - RNA, 22 nt, Homo sapiens
caacaccucugcacaagcugca

SEQ ID NO: 1399789 - RNA, 23 nt, Homo sapiens
caacacugcugcuccagugcagg

SEQ ID NO: 1399790 - RNA, 18 nt, Homo sapiens
caacagaagcuuccauuc

SEQ ID NO: 1399791 - RNA, 18 nt, Homo sapiens
caacagaaucagaucuga

SEQ ID NO: 1399792 - RNA, 22 nt, Homo sapiens
caacagauggauagucugucca

SEQ ID NO: 1399793 - RNA, 14 nt, Homo sapiens
caacaguuccuuca

SEQ ID NO: 1399794 - RNA, 14 nt, Homo sapiens
caacaucccauugc

SEQ ID NO: 1399795 - RNA, 16 nt, Homo sapiens
caacauccuuaaguca

SEQ ID NO: 1399796 - RNA, 12 nt, Homo sapiens
caacaucuucaa

SEQ ID NO: 1399797 - RNA, 12 nt, Homo sapiens
caacaugacugu

SEQ ID NO: 1399798 - RNA, 21 nt, Homo sapiens
caacauggugaaaccccaucu

SEQ ID NO: 1399799 - RNA, 21 nt, Homo sapiens
caacauggugaaaccucaucu

SEQ ID NO: 1399800 - RNA, 23 nt, Homo sapiens
caacauggugaaaccucaucucu

SEQ ID NO: 1399801 - RNA, 15 nt, Homo sapiens
caaccacucauucaa

SEQ ID NO: 1399802 - RNA, 16 nt, Homo sapiens
caaccagagcacugua

SEQ ID NO: 1399803 - RNA, 17 nt, Homo sapiens
caaccagagcacuguau

SEQ ID NO: 1399804 - RNA, 16 nt, Homo sapiens
caacccacaccaaaua

SEQ ID NO: 1399805 - RNA, 18 nt, Homo sapiens
caaccccagccaaucaca

SEQ ID NO: 1399806 - RNA, 17 nt, Homo sapiens
caaccccccaccugcca

SEQ ID NO: 1399807 - RNA, 15 nt, Homo sapiens
caacccuaaaaagca

SEQ ID NO: 1399808 - RNA, 22 nt, Homo sapiens
caacccuuugccccaccuuuau

SEQ ID NO: 1399809 - RNA, 19 nt, Homo sapiens
caaccgaguggcugucauc

SEQ ID NO: 1399810 - RNA, 14 nt, Homo sapiens
caacgaugaugcuu

SEQ ID NO: 1399811 - RNA, 15 nt, Homo sapiens
caacugcugccccaa

SEQ ID NO: 1399812 - RNA, 16 nt, Homo sapiens
caacuguggucaaucc

SEQ ID NO: 1399813 - RNA, 17 nt, Homo sapiens
caacuugggaacuagac

SEQ ID NO: 1399814 - RNA, 20 nt, Homo sapiens
caacuuuuuaccuaguacaa

SEQ ID NO: 1399815 - RNA, 18 nt, Homo sapiens
caagaaaaguaagcccuu

SEQ ID NO: 1399816 - RNA, 19 nt, Homo sapiens
caagaaaaguugaagaaga

SEQ ID NO: 1399817 - RNA, 17 nt, Homo sapiens
caagaaaggagagucuu

SEQ ID NO: 1399818 - RNA, 20 nt, Homo sapiens
caagaaaggagagucuugca

SEQ ID NO: 1399819 - RNA, 18 nt, Homo sapiens
caagaaucuucuguucca

SEQ ID NO: 1399820 - RNA, 18 nt, Homo sapiens
caagaccucugugcacuu

SEQ ID NO: 1399821 - RNA, 16 nt, Homo sapiens
caagacuugguguccu

SEQ ID NO: 1399822 - RNA, 23 nt, Homo sapiens
caagagagaaagaaguaggcaug

SEQ ID NO: 1399823 - RNA, 21 nt, Homo sapiens
caagagugauucuugcugcua

SEQ ID NO: 1399824 - RNA, 15 nt, Homo sapiens
caagauaagcuucca

SEQ ID NO: 1399825 - RNA, 16 nt, Homo sapiens
caagauuaaacugagu

SEQ ID NO: 1399826 - RNA, 13 nt, Homo sapiens
caagauugaucau

SEQ ID NO: 1399827 - RNA, 20 nt, Homo sapiens
caagauugcgccauugcacu

SEQ ID NO: 1399828 - RNA, 20 nt, Homo sapiens
caagcacagugccugcaugu

SEQ ID NO: 1399829 - RNA, 18 nt, Homo sapiens
caagcacugcaugggcaa

SEQ ID NO: 1399830 - RNA, 20 nt, Homo sapiens
caagcagugaaauaugauaa

SEQ ID NO: 1399831 - RNA, 16 nt, Homo sapiens
caagcauaagcaaaac

SEQ ID NO: 1399832 - RNA, 17 nt, Homo sapiens
caagcugugacccucaa

SEQ ID NO: 1399833 - RNA, 20 nt, Homo sapiens
caagcuuggcuguagaagga

SEQ ID NO: 1399834 - RNA, 14 nt, Homo sapiens
caaggagcugagaa

SEQ ID NO: 1399835 - RNA, 13 nt, Homo sapiens
caaggaucuuuca

SEQ ID NO: 1399836 - RNA, 22 nt, Homo sapiens
caaggcaaggggugccugggaa

SEQ ID NO: 1399837 - RNA, 19 nt, Homo sapiens
caaggcccauaucugugaa

SEQ ID NO: 1399838 - RNA, 17 nt, Homo sapiens
caaggcugaccaagaga

SEQ ID NO: 1399839 - RNA, 20 nt, Homo sapiens
caaggcuuaggaaagugaua

SEQ ID NO: 1399840 - RNA, 21 nt, Homo sapiens
caagggccagcuggaggugaa

SEQ ID NO: 1399841 - RNA, 22 nt, Homo sapiens
caaggggcugaaaagaucugaa

SEQ ID NO: 1399842 - RNA, 14 nt, Homo sapiens
caaguaauugugaa

SEQ ID NO: 1399843 - RNA, 13 nt, Homo sapiens
caaguagcuuucc

SEQ ID NO: 1399844 - RNA, 19 nt, Homo sapiens
caaguauguugagaguugc

SEQ ID NO: 1399845 - RNA, 21 nt, Homo sapiens
caaguauguugagaguugcug

SEQ ID NO: 1399846 - RNA, 20 nt, Homo sapiens
caaguauuuuugacauuuac

SEQ ID NO: 1399847 - RNA, 18 nt, Homo sapiens
caagucaagugaaaaagg

SEQ ID NO: 1399848 - RNA, 17 nt, Homo sapiens
caagucagcucuucucc

SEQ ID NO: 1399849 - RNA, 19 nt, Homo sapiens
caagucuucccugaucaag

SEQ ID NO: 1399850 - RNA, 17 nt, Homo sapiens
caagugaaaaacaucca

SEQ ID NO: 1399851 - RNA, 14 nt, Homo sapiens
caaguguacaguga

SEQ ID NO: 1399852 - RNA, 17 nt, Homo sapiens
caaguguguaugugcgu

SEQ ID NO: 1399853 - RNA, 13 nt, Homo sapiens
caagugugugcac

SEQ ID NO: 1399854 - RNA, 15 nt, Homo sapiens
caagugugugugcgu

SEQ ID NO: 1399855 - RNA, 23 nt, Homo sapiens
caaguuaaagugaauaaccacuu

SEQ ID NO: 1399856 - RNA, 23 nt, Homo sapiens
caaguuauaaaucaaugucacuu

SEQ ID NO: 1399857 - RNA, 23 nt, Homo sapiens
caaguucauugaugacccucuga

SEQ ID NO: 1399858 - RNA, 22 nt, Homo sapiens
caaguuuucauaagcacacuuc

SEQ ID NO: 1399859 - RNA, 17 nt, Homo sapiens
caauaaaaccacuguac

SEQ ID NO: 1399860 - RNA, 20 nt, Homo sapiens
caauaaagaugcccacugag

SEQ ID NO: 1399861 - RNA, 16 nt, Homo sapiens
caauaaaguaucuaca

SEQ ID NO: 1399862 - RNA, 12 nt, Homo sapiens
caauaagcagaa

SEQ ID NO: 1399863 - RNA, 14 nt, Homo sapiens
caauaauuucaggu

SEQ ID NO: 1399864 - RNA, 15 nt, Homo sapiens
caauagagacuguag

SEQ ID NO: 1399865 - RNA, 15 nt, Homo sapiens
caauaguuguugauu

SEQ ID NO: 1399866 - RNA, 14 nt, Homo sapiens
caauaucuucauac

SEQ ID NO: 1399867 - RNA, 19 nt, Homo sapiens
caauauugccaugguuuua

SEQ ID NO: 1399868 - RNA, 17 nt, Homo sapiens
caauauuuuaagcauua

SEQ ID NO: 1399869 - RNA, 10 nt, Homo sapiens
caaucacaaa

SEQ ID NO: 1399870 - RNA, 16 nt, Homo sapiens
caaucagagagcucac

SEQ ID NO: 1399871 - RNA, 22 nt, Homo sapiens
caaucaugaaauaugcaucuca

SEQ ID NO: 1399872 - RNA, 16 nt, Homo sapiens
caauccuggcucugug

SEQ ID NO: 1399873 - RNA, 18 nt, Homo sapiens
caaucucugauucuguca

SEQ ID NO: 1399874 - RNA, 19 nt, Homo sapiens
caaugaccacauccugaaa

SEQ ID NO: 1399875 - RNA, 15 nt, Homo sapiens
caaugccaaucuuca

SEQ ID NO: 1399876 - RNA, 16 nt, Homo sapiens
caauggcuuacuccag

SEQ ID NO: 1399877 - RNA, 17 nt, Homo sapiens
caaugguuaacaucuuc

SEQ ID NO: 1399878 - RNA, 22 nt, Homo sapiens
caaugguuugcaaggaagccac

SEQ ID NO: 1399879 - RNA, 14 nt, Homo sapiens
caaugucagaugaa

SEQ ID NO: 1399880 - RNA, 19 nt, Homo sapiens
caaugucaggaacagaagg

SEQ ID NO: 1399881 - RNA, 17 nt, Homo sapiens
caauguuauuaccuaua

SEQ ID NO: 1399882 - RNA, 21 nt, Homo sapiens
caauuagcaauugacugucac

SEQ ID NO: 1399883 - RNA, 18 nt, Homo sapiens
caauuauagaaagccaaa

SEQ ID NO: 1399884 - RNA, 23 nt, Homo sapiens
caauuauaucaguccucuuucaa

SEQ ID NO: 1399885 - RNA, 14 nt, Homo sapiens
caauucaucaauau

SEQ ID NO: 1399886 - RNA, 13 nt, Homo sapiens
caauuccucuggg

SEQ ID NO: 1399887 - RNA, 20 nt, Homo sapiens
caauugacugucacuguucc

SEQ ID NO: 1399888 - RNA, 13 nt, Homo sapiens
caauuuauugcac

SEQ ID NO: 1399889 - RNA, 19 nt, Homo sapiens
caauuuguucagucuuuca

SEQ ID NO: 1399890 - RNA, 20 nt, Homo sapiens
cacaaaauguaggguuauaa

SEQ ID NO: 1399891 - RNA, 15 nt, Homo sapiens
cacaacacacacacu

SEQ ID NO: 1399892 - RNA, 16 nt, Homo sapiens
cacaaccacucauuca

SEQ ID NO: 1399893 - RNA, 20 nt, Homo sapiens
cacaagcuuuuuuacacaaa

SEQ ID NO: 1399894 - RNA, 13 nt, Homo sapiens
cacaauacaauaa

SEQ ID NO: 1399895 - RNA, 14 nt, Homo sapiens
cacaaugccucauc

SEQ ID NO: 1399896 - RNA, 12 nt, Homo sapiens
cacaauucacua

SEQ ID NO: 1399897 - RNA, 16 nt, Homo sapiens
cacacaaggugcaaau

SEQ ID NO: 1399898 - RNA, 16 nt, Homo sapiens
cacacagcaguagcag

SEQ ID NO: 1399899 - RNA, 15 nt, Homo sapiens
cacacagccaauaca

SEQ ID NO: 1399900 - RNA, 12 nt, Homo sapiens
cacaccaucucc

SEQ ID NO: 1399901 - RNA, 17 nt, Homo sapiens
cacaccauucgucauca

SEQ ID NO: 1399902 - RNA, 14 nt, Homo sapiens
cacacguacuuaaa

SEQ ID NO: 1399903 - RNA, 18 nt, Homo sapiens
cacacuccccugcacugg

SEQ ID NO: 1399904 - RNA, 18 nt, Homo sapiens
cacacugaggcagggaag

SEQ ID NO: 1399905 - RNA, 15 nt, Homo sapiens
cacacuugugugugg

SEQ ID NO: 1399906 - RNA, 20 nt, Homo sapiens
cacagaaagacugagcucaa

SEQ ID NO: 1399907 - RNA, 22 nt, Homo sapiens
cacagacuggagacaaugcaga

SEQ ID NO: 1399908 - RNA, 21 nt, Homo sapiens
cacagagacacagggcaucca

SEQ ID NO: 1399909 - RNA, 21 nt, Homo sapiens
cacagagauaauucuagcuuu

SEQ ID NO: 1399910 - RNA, 14 nt, Homo sapiens
cacagagugcauug

SEQ ID NO: 1399911 - RNA, 23 nt, Homo sapiens
cacagagugcauugugaggguua

SEQ ID NO: 1399912 - RNA, 15 nt, Homo sapiens
cacagaucacagcuu

SEQ ID NO: 1399913 - RNA, 15 nt, Homo sapiens
cacagcagcaguuac

SEQ ID NO: 1399914 - RNA, 18 nt, Homo sapiens
cacagcauguguauuucc

SEQ ID NO: 1399915 - RNA, 17 nt, Homo sapiens
cacagcccgcaugcagc

SEQ ID NO: 1399916 - RNA, 15 nt, Homo sapiens
cacagcuacacagau

SEQ ID NO: 1399917 - RNA, 22 nt, Homo sapiens
cacagcuacacagaucacagcu

SEQ ID NO: 1399918 - RNA, 22 nt, Homo sapiens
cacagcuguaguaccccaagaa

SEQ ID NO: 1399919 - RNA, 14 nt, Homo sapiens
cacaggauuuguaa

SEQ ID NO: 1399920 - RNA, 21 nt, Homo sapiens
cacaggauuuguaauuccuua

SEQ ID NO: 1399921 - RNA, 22 nt, Homo sapiens
cacaggcagcauuuagcacaua

SEQ ID NO: 1399922 - RNA, 18 nt, Homo sapiens
cacaggcagguccagggu

SEQ ID NO: 1399923 - RNA, 14 nt, Homo sapiens
cacaggcccggcuc

SEQ ID NO: 1399924 - RNA, 16 nt, Homo sapiens
cacagguucaugccac

SEQ ID NO: 1399925 - RNA, 22 nt, Homo sapiens
cacagugagucgaggacaggga

SEQ ID NO: 1399926 - RNA, 15 nt, Homo sapiens
cacagugcaucucag

SEQ ID NO: 1399927 - RNA, 11 nt, Homo sapiens
cacagugucug

SEQ ID NO: 1399928 - RNA, 12 nt, Homo sapiens
cacagugugaau

SEQ ID NO: 1399929 - RNA, 20 nt, Homo sapiens
cacauaaaagacacagaaca

SEQ ID NO: 1399930 - RNA, 17 nt, Homo sapiens
cacauacuugagacugu

SEQ ID NO: 1399931 - RNA, 15 nt, Homo sapiens
cacauagacuuuaug

SEQ ID NO: 1399932 - RNA, 21 nt, Homo sapiens
cacauagauucaccuguaaaa

SEQ ID NO: 1399933 - RNA, 20 nt, Homo sapiens
cacauccugaaaaggguguu

SEQ ID NO: 1399934 - RNA, 21 nt, Homo sapiens
cacaugauaccucugaucaag

SEQ ID NO: 1399935 - RNA, 19 nt, Homo sapiens
cacaugcacgugugugcac

SEQ ID NO: 1399936 - RNA, 17 nt, Homo sapiens
cacaugugcacaugcac

SEQ ID NO: 1399937 - RNA, 13 nt, Homo sapiens
cacauuaagccuu

SEQ ID NO: 1399938 - RNA, 20 nt, Homo sapiens
cacauuaucgggagcagugu

SEQ ID NO: 1399939 - RNA, 19 nt, Homo sapiens
cacauuuauucugcucaca

SEQ ID NO: 1399940 - RNA, 14 nt, Homo sapiens
cacauuugauucug

SEQ ID NO: 1399941 - RNA, 19 nt, Homo sapiens
cacauuuuuaaagcuuucc

SEQ ID NO: 1399942 - RNA, 15 nt, Homo sapiens
caccaaaaagggauc

SEQ ID NO: 1399943 - RNA, 18 nt, Homo sapiens
caccaaaucaucucucau

SEQ ID NO: 1399944 - RNA, 21 nt, Homo sapiens
caccaacccagagaaccugcu

SEQ ID NO: 1399945 - RNA, 14 nt, Homo sapiens
caccaagcccaguu

SEQ ID NO: 1399946 - RNA, 19 nt, Homo sapiens
caccaauauuucucagaca

SEQ ID NO: 1399947 - RNA, 13 nt, Homo sapiens
caccacacauaca

SEQ ID NO: 1399948 - RNA, 16 nt, Homo sapiens
caccaccuucccagcu

SEQ ID NO: 1399949 - RNA, 20 nt, Homo sapiens
caccagagauaauaugagaa

SEQ ID NO: 1399950 - RNA, 16 nt, Homo sapiens
caccaguuccuuucaa

SEQ ID NO: 1399951 - RNA, 19 nt, Homo sapiens
caccaguugaauuucauca

SEQ ID NO: 1399952 - RNA, 18 nt, Homo sapiens
caccaucagucaaugaau

SEQ ID NO: 1399953 - RNA, 20 nt, Homo sapiens
caccauguacauagcuugau

SEQ ID NO: 1399954 - RNA, 18 nt, Homo sapiens
caccauguuugagcucag

SEQ ID NO: 1399955 - RNA, 15 nt, Homo sapiens
cacccaacaagccau

SEQ ID NO: 1399956 - RNA, 14 nt, Homo sapiens
cacccacccaggag

SEQ ID NO: 1399957 - RNA, 17 nt, Homo sapiens
cacccaggcaucugcuu

SEQ ID NO: 1399958 - RNA, 23 nt, Homo sapiens
caccccccagaaccuguccuugc

SEQ ID NO: 1399959 - RNA, 22 nt, Homo sapiens
cacccuccuuucaccacaugug

SEQ ID NO: 1399960 - RNA, 15 nt, Homo sapiens
caccgacaacaugcu

SEQ ID NO: 1399961 - RNA, 21 nt, Homo sapiens
caccgugaccccuguccccac

SEQ ID NO: 1399962 - RNA, 18 nt, Homo sapiens
ccuguauucuacagcaga

SEQ ID NO: 1399963 - RNA, 17 nt, Homo sapiens
ccugucccccugagauc

SEQ ID NO: 1399964 - RNA, 14 nt, Homo sapiens
ccugucgugccagu

SEQ ID NO: 1399965 - RNA, 16 nt, Homo sapiens
ccugucgugccagucc

SEQ ID NO: 1399966 - RNA, 16 nt, Homo sapiens
ccugucuaaaaauuca

SEQ ID NO: 1399967 - RNA, 15 nt, Homo sapiens
ccugucuuuaaggaa

SEQ ID NO: 1399968 - RNA, 14 nt, Homo sapiens
ccugugaaauacca

SEQ ID NO: 1399969 - RNA, 16 nt, Homo sapiens
ccugugagcagggauu

SEQ ID NO: 1399970 - RNA, 15 nt, Homo sapiens
ccugugaucaagcaa

SEQ ID NO: 1399971 - RNA, 17 nt, Homo sapiens
ccugugugccauuuuaa

SEQ ID NO: 1399972 - RNA, 18 nt, Homo sapiens
ccugugugggacugagau

SEQ ID NO: 1399973 - RNA, 14 nt, Homo sapiens
ccuguucacucuac

SEQ ID NO: 1399974 - RNA, 15 nt, Homo sapiens
ccuguugaaaagcca

SEQ ID NO: 1399975 - RNA, 13 nt, Homo sapiens
ccuuaaaagccau

SEQ ID NO: 1399976 - RNA, 15 nt, Homo sapiens
ccuuaaaucacacau

SEQ ID NO: 1399977 - RNA, 22 nt, Homo sapiens
ccuuacauuugaaaucuaugaa

SEQ ID NO: 1399978 - RNA, 15 nt, Homo sapiens
ccuuagaagucacac

SEQ ID NO: 1399979 - RNA, 16 nt, Homo sapiens
ccuuagcaacagccga

SEQ ID NO: 1399980 - RNA, 15 nt, Homo sapiens
ccuuagcuggcauua

SEQ ID NO: 1399981 - RNA, 18 nt, Homo sapiens
ccuuagcuuagaccucag

SEQ ID NO: 1399982 - RNA, 12 nt, Homo sapiens
ccuuauaguguu

SEQ ID NO: 1399983 - RNA, 20 nt, Homo sapiens
ccuucaaguuagcucaggag

SEQ ID NO: 1399984 - RNA, 20 nt, Homo sapiens
ccuuccacacucaccucuaa

SEQ ID NO: 1399985 - RNA, 19 nt, Homo sapiens
ccuuccacggauccaugua

SEQ ID NO: 1399986 - RNA, 15 nt, Homo sapiens
ccuuccccagccucu

SEQ ID NO: 1399987 - RNA, 16 nt, Homo sapiens
ccuuccuugaccagca

SEQ ID NO: 1399988 - RNA, 22 nt, Homo sapiens
ccuucucagaccugcgcacucc

SEQ ID NO: 1399989 - RNA, 15 nt, Homo sapiens
ccuucuccagacaaa

SEQ ID NO: 1399990 - RNA, 16 nt, Homo sapiens
ccuucuccaugcugag

SEQ ID NO: 1399991 - RNA, 20 nt, Homo sapiens
ccuucucucaccuccuaaag

SEQ ID NO: 1399992 - RNA, 20 nt, Homo sapiens
ccuucugugcccagcucagu

SEQ ID NO: 1399993 - RNA, 20 nt, Homo sapiens
ccuucuucuuagcaccacaa

SEQ ID NO: 1399994 - RNA, 13 nt, Homo sapiens
ccuugaagccacu

SEQ ID NO: 1399995 - RNA, 13 nt, Homo sapiens
ccuugaaggguuc

SEQ ID NO: 1399996 - RNA, 23 nt, Homo sapiens
ccuugacucugccguuuccuaau

SEQ ID NO: 1399997 - RNA, 17 nt, Homo sapiens
ccuugagcaaauuaccc

SEQ ID NO: 1399998 - RNA, 14 nt, Homo sapiens
ccuugauucacaau

SEQ ID NO: 1399999 - RNA, 19 nt, Homo sapiens
ccuugauuuaucacacaaa

SEQ ID NO: 1400000 - RNA, 14 nt, Homo sapiens
ccuugcccagagau

SEQ ID NO: 1400001 - RNA, 18 nt, Homo sapiens
ccuuggcaugccuuccag

SEQ ID NO: 1400002 - RNA, 16 nt, Homo sapiens
ccuuguaaagacugua

SEQ ID NO: 1400003 - RNA, 19 nt, Homo sapiens
ccuuguaauucuaaaugaa

SEQ ID NO: 1400004 - RNA, 13 nt, Homo sapiens
ccuugucuuggca

SEQ ID NO: 1400005 - RNA, 17 nt, Homo sapiens
ccuuuauuuugcuucca

SEQ ID NO: 1400006 - RNA, 20 nt, Homo sapiens
ccuuucaccacaugugcaca

SEQ ID NO: 1400007 - RNA, 16 nt, Homo sapiens
ccuuuccauaaggaau

SEQ ID NO: 1400008 - RNA, 22 nt, Homo sapiens
ccuuuccugaucacuaugcauu

SEQ ID NO: 1400009 - RNA, 13 nt, Homo sapiens
ccuuucuucucuc

SEQ ID NO: 1400010 - RNA, 18 nt, Homo sapiens
ccuuugggaggcugaggc

SEQ ID NO: 1400011 - RNA, 22 nt, Homo sapiens
ccuuuucuccuaucuucauauc

SEQ ID NO: 1400012 - RNA, 19 nt, Homo sapiens
cgaaaaagagguagcacua

SEQ ID NO: 1400013 - RNA, 15 nt, Homo sapiens
cgaaaccccaucucu

SEQ ID NO: 1400014 - RNA, 12 nt, Homo sapiens
cgaaacuggaag

SEQ ID NO: 1400015 - RNA, 17 nt, Homo sapiens
cgaaacuggaaguuauu

SEQ ID NO: 1400016 - RNA, 21 nt, Homo sapiens
cgaaggaaaagggcuuucuca

SEQ ID NO: 1400017 - RNA, 16 nt, Homo sapiens
cgaauagccacugcau

SEQ ID NO: 1400018 - RNA, 22 nt, Homo sapiens
cgaauauaucaguaauuucaga

SEQ ID NO: 1400019 - RNA, 16 nt, Homo sapiens
cgaauugucuuuggug

SEQ ID NO: 1400020 - RNA, 12 nt, Homo sapiens
cgacaguuuucc

SEQ ID NO: 1400021 - RNA, 13 nt, Homo sapiens
cgagacagaaaaa

SEQ ID NO: 1400022 - RNA, 15 nt, Homo sapiens
cgagacuccgucuca

SEQ ID NO: 1400023 - RNA, 17 nt, Homo sapiens
cgagaucacgccacugc

SEQ ID NO: 1400024 - RNA, 20 nt, Homo sapiens
cgagaucacgccacugcacu

SEQ ID NO: 1400025 - RNA, 21 nt, Homo sapiens
cgagaucacgccacugcacuc

SEQ ID NO: 1400026 - RNA, 19 nt, Homo sapiens
cgagaucgcgccacugcac

SEQ ID NO: 1400027 - RNA, 20 nt, Homo sapiens
cgagaucgcgccacugcacu

SEQ ID NO: 1400028 - RNA, 21 nt, Homo sapiens
cgagaucgcgccacugcacuc

SEQ ID NO: 1400029 - RNA, 21 nt, Homo sapiens
cgagauugcaccauugcgcuc

SEQ ID NO: 1400030 - RNA, 19 nt, Homo sapiens
cgagcugggggccaugagc

SEQ ID NO: 1400031 - RNA, 23 nt, Homo sapiens
cgaggaaaagagaaggaaaguga

SEQ ID NO: 1400032 - RNA, 19 nt, Homo sapiens
cgaggacagggaggugacc

SEQ ID NO: 1400033 - RNA, 22 nt, Homo sapiens
cgaggcugcccacuauggucau

SEQ ID NO: 1400034 - RNA, 22 nt, Homo sapiens
cgagucaauccccucauucagg

SEQ ID NO: 1400035 - RNA, 14 nt, Homo sapiens
cgagucucuucucc

SEQ ID NO: 1400036 - RNA, 19 nt, Homo sapiens
cgagucucuucuccacugg

SEQ ID NO: 1400037 - RNA, 14 nt, Homo sapiens
cgagugugugcaug

SEQ ID NO: 1400038 - RNA, 12 nt, Homo sapiens
cgaucuggguuc

SEQ ID NO: 1400039 - RNA, 18 nt, Homo sapiens
cgauuaaaaucacucuca

SEQ ID NO: 1400040 - RNA, 20 nt, Homo sapiens
cgauucaucuacccugcuga

SEQ ID NO: 1400041 - RNA, 18 nt, Homo sapiens
cgauuguuccugaaccga

SEQ ID NO: 1400042 - RNA, 13 nt, Homo sapiens
cgcaacaguuuuu

SEQ ID NO: 1400043 - RNA, 15 nt, Homo sapiens
cgcaauugcucaugc

SEQ ID NO: 1400044 - RNA, 11 nt, Homo sapiens
cgcaccugccc

SEQ ID NO: 1400045 - RNA, 15 nt, Homo sapiens
cgcaucucagugcag

SEQ ID NO: 1400046 - RNA, 13 nt, Homo sapiens
cgccacucgcuuc

SEQ ID NO: 1400047 - RNA, 21 nt, Homo sapiens
cgccccucauuuaucccucaa

SEQ ID NO: 1400048 - RNA, 13 nt, Homo sapiens
cgcccuccacaaa

SEQ ID NO: 1400049 - RNA, 21 nt, Homo sapiens
cgccuaugaucccagcacuuu

SEQ ID NO: 1400050 - RNA, 20 nt, Homo sapiens
cgccuccccuuugugacuuc

SEQ ID NO: 1400051 - RNA, 16 nt, Homo sapiens
cgccuggcagaacuga

SEQ ID NO: 1400052 - RNA, 22 nt, Homo sapiens
cgcucuuggcagguacucagcg

SEQ ID NO: 1400053 - RNA, 22 nt, Homo sapiens
cgcugggauccgggaucaaagu

SEQ ID NO: 1400054 - RNA, 14 nt, Homo sapiens
cggacaaguuuuaa

SEQ ID NO: 1400055 - RNA, 14 nt, Homo sapiens
cggacagagcacgu

SEQ ID NO: 1400056 - RNA, 16 nt, Homo sapiens
cggagcuugcagugag

SEQ ID NO: 1400057 - RNA, 20 nt, Homo sapiens
cggagcuugcagugagccga

SEQ ID NO: 1400058 - RNA, 12 nt, Homo sapiens
cggagcuuucaa

SEQ ID NO: 1400059 - RNA, 21 nt, Homo sapiens
cggauguuucuggaauugaua

SEQ ID NO: 1400060 - RNA, 17 nt, Homo sapiens
cggcaacggcaaccccc

SEQ ID NO: 1400061 - RNA, 15 nt, Homo sapiens
cggccuuuguugcuc

SEQ ID NO: 1400062 - RNA, 17 nt, Homo sapiens
cggccuuuguugcucag

SEQ ID NO: 1400063 - RNA, 23 nt, Homo sapiens
cggugcauacacccccaccuccu

SEQ ID NO: 1400064 - RNA, 13 nt, Homo sapiens
cgguucaccagcc

SEQ ID NO: 1400065 - RNA, 14 nt, Homo sapiens
cgucauguuucuuc

SEQ ID NO: 1400066 - RNA, 20 nt, Homo sapiens
cguccagcuggaagggucaa

SEQ ID NO: 1400067 - RNA, 12 nt, Homo sapiens
cgucccuaccuc

SEQ ID NO: 1400068 - RNA, 15 nt, Homo sapiens
cgucuucuguauacu

SEQ ID NO: 1400069 - RNA, 22 nt, Homo sapiens
cucuacagaugucccauuuuca

SEQ ID NO: 1400070 - RNA, 22 nt, Homo sapiens
cucuacccuauacaacuggaca

SEQ ID NO: 1400071 - RNA, 18 nt, Homo sapiens
cucuacuccuaccucagc

SEQ ID NO: 1400072 - RNA, 14 nt, Homo sapiens
cucuacucuaggga

SEQ ID NO: 1400073 - RNA, 22 nt, Homo sapiens
cucuacugaggugcuauguucu

SEQ ID NO: 1400074 - RNA, 14 nt, Homo sapiens
cucuagauugagag

SEQ ID NO: 1400075 - RNA, 14 nt, Homo sapiens
cucuauaauugcca

SEQ ID NO: 1400076 - RNA, 21 nt, Homo sapiens
cucuaugguguggcaaagccu

SEQ ID NO: 1400077 - RNA, 14 nt, Homo sapiens
cucuauugcugcuc

SEQ ID NO: 1400078 - RNA, 23 nt, Homo sapiens
ggcagaguacaaaguaagccaug

SEQ ID NO: 1400079 - RNA, 14 nt, Homo sapiens
ggcagauugaaaag

SEQ ID NO: 1400080 - RNA, 16 nt, Homo sapiens
ggcagcaggguggccu

SEQ ID NO: 1400081 - RNA, 14 nt, Homo sapiens
ggcagcaucuucac

SEQ ID NO: 1400082 - RNA, 12 nt, Homo sapiens
ggcagcauuuag

SEQ ID NO: 1400083 - RNA, 18 nt, Homo sapiens
ggcagccacaacugcagu

SEQ ID NO: 1400084 - RNA, 18 nt, Homo sapiens
ggcagccaggcuggcaga

SEQ ID NO: 1400085 - RNA, 20 nt, Homo sapiens
ggcaggagaauugcuugaac

SEQ ID NO: 1400086 - RNA, 19 nt, Homo sapiens
ggcaguccuggaaucacau

SEQ ID NO: 1400087 - RNA, 16 nt, Homo sapiens
ggcaucuccugugcau

SEQ ID NO: 1400088 - RNA, 20 nt, Homo sapiens
ggcaugagggaucacagggc

SEQ ID NO: 1400089 - RNA, 15 nt, Homo sapiens
ggcauggagccagug

SEQ ID NO: 1400090 - RNA, 13 nt, Homo sapiens
ggcauggcaccug

SEQ ID NO: 1400091 - RNA, 18 nt, Homo sapiens
ggcauggccagguggcca

SEQ ID NO: 1400092 - RNA, 14 nt, Homo sapiens
ggcaugugcuguga

SEQ ID NO: 1400093 - RNA, 12 nt, Homo sapiens
uuccuaucccau

SEQ ID NO: 1400094 - RNA, 16 nt, Homo sapiens
uuccuauguaacugca

SEQ ID NO: 1400095 - RNA, 18 nt, Homo sapiens
uuccucauuagcauuuug

SEQ ID NO: 1400096 - RNA, 13 nt, Homo sapiens
uuccuccauaaau

SEQ ID NO: 1400097 - RNA, 12 nt, Homo sapiens
uuccucccaaaa

SEQ ID NO: 1400098 - RNA, 17 nt, Homo sapiens
uuccugaaccgaugaga

SEQ ID NO: 1400099 - RNA, 16 nt, Homo sapiens
uuccugaucacuaugc

SEQ ID NO: 1400100 - RNA, 18 nt, Homo sapiens
uuccugaucacuaugcau

SEQ ID NO: 1400101 - RNA, 19 nt, Homo sapiens
uuccuggaguacaaacaca

SEQ ID NO: 1400102 - RNA, 22 nt, Homo sapiens
uuccugggaauaacauggugag

SEQ ID NO: 1400103 - RNA, 15 nt, Homo sapiens
uuccuguccagagag

SEQ ID NO: 1400104 - RNA, 16 nt, Homo sapiens
uuccuuaucacugaca

SEQ ID NO: 1400105 - RNA, 18 nt, Homo sapiens
uuccuucagacagauucc

SEQ ID NO: 1400106 - RNA, 13 nt, Homo sapiens
uuccuugaccagc

SEQ ID NO: 1400107 - RNA, 17 nt, Homo sapiens
uuccuugaucuguauau

SEQ ID NO: 1400108 - RNA, 18 nt, Homo sapiens
uuccuuuccuaaaagugu

SEQ ID NO: 1400109 - RNA, 21 nt, Homo sapiens
uucgaauccagagagcagugu

SEQ ID NO: 1400110 - RNA, 23 nt, Homo sapiens
uucgaauccagagagcagugugg

SEQ ID NO: 1400111 - RNA, 20 nt, Homo sapiens
uucgcaggauucuuccuccc

SEQ ID NO: 1400112 - RNA, 15 nt, Homo sapiens
uucgugacaacaugc

SEQ ID NO: 1400113 - RNA, 21 nt, Homo sapiens
uucuaacuagaaaucugccaa

SEQ ID NO: 1400114 - RNA, 18 nt, Homo sapiens
uucuaaguauuuuauucc

SEQ ID NO: 1400115 - RNA, 17 nt, Homo sapiens
uucuaauuuuuaagcaa

SEQ ID NO: 1400116 - RNA, 16 nt, Homo sapiens
uucuaccaacuggaag

SEQ ID NO: 1400117 - RNA, 19 nt, Homo sapiens
uucuaucugggcuguugcu

SEQ ID NO: 1400118 - RNA, 15 nt, Homo sapiens
uucuauucuaaguaa

SEQ ID NO: 1400119 - RNA, 15 nt, Homo sapiens
uucuauuuauuuacu

SEQ ID NO: 1400120 - RNA, 20 nt, Homo sapiens
uucucacuccuaccugguaa

SEQ ID NO: 1400121 - RNA, 21 nt, Homo sapiens
uucucagaaucucaaauaacu

SEQ ID NO: 1400122 - RNA, 18 nt, Homo sapiens
uucucagagugguucuga

SEQ ID NO: 1400123 - RNA, 20 nt, Homo sapiens
uucucauccugcaggcagcu

SEQ ID NO: 1400124 - RNA, 15 nt, Homo sapiens
uucucauuugucaca

SEQ ID NO: 1400125 - RNA, 22 nt, Homo sapiens
uucuccaaaacaauuuucugca

SEQ ID NO: 1400126 - RNA, 16 nt, Homo sapiens
uucuccaacaauaaga

SEQ ID NO: 1400127 - RNA, 14 nt, Homo sapiens
uucuccagacaaac

SEQ ID NO: 1400128 - RNA, 23 nt, Homo sapiens
uucuccagacccaccacaccgca

SEQ ID NO: 1400129 - RNA, 23 nt, Homo sapiens
uucucccaggccaggcuccuucc

SEQ ID NO: 1400130 - RNA, 16 nt, Homo sapiens
uucucgugacaccacc

SEQ ID NO: 1400131 - RNA, 16 nt, Homo sapiens
uucucuaacucagaaa

SEQ ID NO: 1400132 - RNA, 20 nt, Homo sapiens
uucucuauuagacuuuagaa

SEQ ID NO: 1400133 - RNA, 19 nt, Homo sapiens
uucucucuccagucuucca

SEQ ID NO: 1400134 - RNA, 22 nt, Homo sapiens
uucucucugccugugagccagu

SEQ ID NO: 1400135 - RNA, 17 nt, Homo sapiens
uucucugcuccaccaca

SEQ ID NO: 1400136 - RNA, 16 nt, Homo sapiens
uucucuuugguguaca

SEQ ID NO: 1400137 - RNA, 17 nt, Homo sapiens
uucugaaucaaggugau

SEQ ID NO: 1400138 - RNA, 22 nt, Homo sapiens
uucugauuugucccuaugcaua

SEQ ID NO: 1400139 - RNA, 18 nt, Homo sapiens
uucugcaucaucuguaga

SEQ ID NO: 1400140 - RNA, 19 nt, Homo sapiens
uucugcauuuaaccgucaa

SEQ ID NO: 1400141 - RNA, 18 nt, Homo sapiens
uucugggaacuuccucag

SEQ ID NO: 1400142 - RNA, 14 nt, Homo sapiens
uucuggggcuucag

SEQ ID NO: 1400143 - RNA, 18 nt, Homo sapiens
uucugguuuguaaggugg

SEQ ID NO: 1400144 - RNA, 21 nt, Homo sapiens
uucuguccuuuuggcacugag

SEQ ID NO: 1400145 - RNA, 16 nt, Homo sapiens
uucugucucauaugau

SEQ ID NO: 1400146 - RNA, 12 nt, Homo sapiens
uucuguggcuca

SEQ ID NO: 1400147 - RNA, 14 nt, Homo sapiens
uucuguguauuuaa

SEQ ID NO: 1400148 - RNA, 21 nt, Homo sapiens
uucuguucugucucauaugau

SEQ ID NO: 1400149 - RNA, 14 nt, Homo sapiens
uucuuauaauauua

SEQ ID NO: 1400150 - RNA, 17 nt, Homo sapiens
uucuucacucaaucucu

SEQ ID NO: 1400151 - RNA, 16 nt, Homo sapiens
uucuuccaagacucca

SEQ ID NO: 1400152 - RNA, 13 nt, Homo sapiens
uucuucuauucca

SEQ ID NO: 1400153 - RNA, 16 nt, Homo sapiens
uucuucuguauguuag

SEQ ID NO: 1400154 - RNA, 14 nt, Homo sapiens
uucuucuucuccua

SEQ ID NO: 1400155 - RNA, 20 nt, Homo sapiens
uucuuguauauuauggaaga

SEQ ID NO: 1400156 - RNA, 14 nt, Homo sapiens
uucuuguugcugca

SEQ ID NO: 1400157 - RNA, 20 nt, Homo sapiens
uucuuugggauugcuaugaa

SEQ ID NO: 1400158 - RNA, 13 nt, Homo sapiens
uucuuuucugacu

SEQ ID NO: 1400159 - RNA, 13 nt, Homo sapiens
uucuuuugcucuu

SEQ ID NO: 1400160 - RNA, 13 nt, Homo sapiens
uugaaaaaguaua

SEQ ID NO: 1400161 - RNA, 13 nt, Homo sapiens
uugaaaagccaug

SEQ ID NO: 1400162 - RNA, 12 nt, Homo sapiens
uugaaaauguuc

SEQ ID NO: 1400163 - RNA, 14 nt, Homo sapiens
uugaaaauguucag

SEQ ID NO: 1400164 - RNA, 22 nt, Homo sapiens
uugaaacaacuuucucuuguaa

SEQ ID NO: 1400165 - RNA, 20 nt, Homo sapiens
uugaaagaucaaaagguuaa

SEQ ID NO: 1400166 - RNA, 16 nt, Homo sapiens
uugaaauagucugugu

SEQ ID NO: 1400167 - RNA, 15 nt, Homo sapiens
uugaaauauaaugca

SEQ ID NO: 1400168 - RNA, 23 nt, Homo sapiens
uugaacuuaaauaaaugucauua

SEQ ID NO: 1400169 - RNA, 17 nt, Homo sapiens
uugaagauaucuugaaa

SEQ ID NO: 1400170 - RNA, 21 nt, Homo sapiens
uugaagaugcuuguauuuuac

SEQ ID NO: 1400171 - RNA, 18 nt, Homo sapiens
uugaauaaagccugcuuu

SEQ ID NO: 1400172 - RNA, 22 nt, Homo sapiens
uugaaugaaaaauuuaagcauu

SEQ ID NO: 1400173 - RNA, 22 nt, Homo sapiens
uugaaugacauuuuagggacau

SEQ ID NO: 1400174 - RNA, 21 nt, Homo sapiens
uugaauggguccauuuugccc

SEQ ID NO: 1400175 - RNA, 19 nt, Homo sapiens
uugacacuauucacuaaaa

SEQ ID NO: 1400176 - RNA, 16 nt, Homo sapiens
uugacagaacacuguc

SEQ ID NO: 1400177 - RNA, 13 nt, Homo sapiens
uugacaggauuau

SEQ ID NO: 1400178 - RNA, 19 nt, Homo sapiens
uugacaguucauauguacc

SEQ ID NO: 1400179 - RNA, 14 nt, Homo sapiens
gcuagaugugucuu

SEQ ID NO: 1400180 - RNA, 21 nt, Homo sapiens
gcuagcugcaagugacaucuc

SEQ ID NO: 1400181 - RNA, 19 nt, Homo sapiens
gcuaggguggcccuugcag

SEQ ID NO: 1400182 - RNA, 15 nt, Homo sapiens
gcuaguuugaccuca

SEQ ID NO: 1400183 - RNA, 11 nt, Homo sapiens
gcuaugaauga

SEQ ID NO: 1400184 - RNA, 16 nt, Homo sapiens
gcucaaagagccucac

SEQ ID NO: 1400185 - RNA, 17 nt, Homo sapiens
gcucacaccugaccaau

SEQ ID NO: 1400186 - RNA, 20 nt, Homo sapiens
gcucacgccuguaaucccag

SEQ ID NO: 1400187 - RNA, 14 nt, Homo sapiens
gcucacugcagccu

SEQ ID NO: 1400188 - RNA, 20 nt, Homo sapiens
gcucaggugucccugcacuu

SEQ ID NO: 1400189 - RNA, 20 nt, Homo sapiens
gcucauucauuuaacagagc

SEQ ID NO: 1400190 - RNA, 18 nt, Homo sapiens
gcuccacucugacuggca

SEQ ID NO: 1400191 - RNA, 16 nt, Homo sapiens
gcuccagaagaacaaa

SEQ ID NO: 1400192 - RNA, 15 nt, Homo sapiens
gcuccaggacucccu

SEQ ID NO: 1400193 - RNA, 17 nt, Homo sapiens
gcuccagugcaggagac

SEQ ID NO: 1400194 - RNA, 19 nt, Homo sapiens
ucacagaacuauguacuuu

SEQ ID NO: 1400195 - RNA, 16 nt, Homo sapiens
ucacagagugcauugu

SEQ ID NO: 1400196 - RNA, 18 nt, Homo sapiens
ucacagaugugugauuca

SEQ ID NO: 1400197 - RNA, 14 nt, Homo sapiens
ucacagcuacacag

SEQ ID NO: 1400198 - RNA, 16 nt, Homo sapiens
ucacagcuacacagau

SEQ ID NO: 1400199 - RNA, 18 nt, Homo sapiens
ucacagcuguaauaacaa

SEQ ID NO: 1400200 - RNA, 18 nt, Homo sapiens
ucacagcuucagccagga

SEQ ID NO: 1400201 - RNA, 19 nt, Homo sapiens
ucacaggacucugccuccu

SEQ ID NO: 1400202 - RNA, 18 nt, Homo sapiens
ucacagguagacaguaua

SEQ ID NO: 1400203 - RNA, 19 nt, Homo sapiens
ucacaguguguuugugauu

SEQ ID NO: 1400204 - RNA, 16 nt, Homo sapiens
ucacaguguugcccag

SEQ ID NO: 1400205 - RNA, 19 nt, Homo sapiens
ucacaguuagguagcuuua

SEQ ID NO: 1400206 - RNA, 16 nt, Homo sapiens
ucacaguuucuuccau

SEQ ID NO: 1400207 - RNA, 15 nt, Homo sapiens
ucacaugaugcauac

SEQ ID NO: 1400208 - RNA, 18 nt, Homo sapiens
ucacauuuauucugcuca

SEQ ID NO: 1400209 - RNA, 11 nt, Homo sapiens
ucacauuugcg

SEQ ID NO: 1400210 - RNA, 19 nt, Homo sapiens
ucaccaaaucagcugcuac

SEQ ID NO: 1400211 - RNA, 20 nt, Homo sapiens
ucaccaacccagagaaccug

SEQ ID NO: 1400212 - RNA, 15 nt, Homo sapiens
ucaccaagcccaguu

SEQ ID NO: 1400213 - RNA, 19 nt, Homo sapiens
ucaccaagcucacaguucc

SEQ ID NO: 1400214 - RNA, 22 nt, Homo sapiens
ucaccacagggauccccaggau

SEQ ID NO: 1400215 - RNA, 17 nt, Homo sapiens
ucaccacaugugcacau

SEQ ID NO: 1400216 - RNA, 22 nt, Homo sapiens
ucaccaugcaaugccucuggaa

SEQ ID NO: 1400217 - RNA, 14 nt, Homo sapiens
ucacccaggaggau

SEQ ID NO: 1400218 - RNA, 14 nt, Homo sapiens
ucacccuaccugug

SEQ ID NO: 1400219 - RNA, 14 nt, Homo sapiens
ucaccggagcuuuc

SEQ ID NO: 1400220 - RNA, 18 nt, Homo sapiens
ucaccuaagucucuguga

SEQ ID NO: 1400221 - RNA, 21 nt, Homo sapiens
ucaccuaagucucugugaauu

SEQ ID NO: 1400222 - RNA, 12 nt, Homo sapiens
ucaccucaggcc

SEQ ID NO: 1400223 - RNA, 14 nt, Homo sapiens
ucaccucucaaggu

SEQ ID NO: 1400224 - RNA, 15 nt, Homo sapiens
ucaccucugccucaa

SEQ ID NO: 1400225 - RNA, 13 nt, Homo sapiens
ucaccuguaaaac

SEQ ID NO: 1400226 - RNA, 21 nt, Homo sapiens
ucacgaggaaaagagaaggaa

SEQ ID NO: 1400227 - RNA, 19 nt, Homo sapiens
ucacgccuguaaucccagc

SEQ ID NO: 1400228 - RNA, 23 nt, Homo sapiens
ucacucaacaaaagugcuuugga

SEQ ID NO: 1400229 - RNA, 22 nt, Homo sapiens
ucacucaaucucugauucuguc

SEQ ID NO: 1400230 - RNA, 19 nt, Homo sapiens
ucacuccacaacccaagaa

SEQ ID NO: 1400231 - RNA, 16 nt, Homo sapiens
ucacugaaacuucaag

SEQ ID NO: 1400232 - RNA, 14 nt, Homo sapiens
ucacugcaaccucc

SEQ ID NO: 1400233 - RNA, 18 nt, Homo sapiens
ucacugcuggcugccuua

SEQ ID NO: 1400234 - RNA, 23 nt, Homo sapiens
ucacuguagaaugauuucaugcu

SEQ ID NO: 1400235 - RNA, 19 nt, Homo sapiens
ucacuucaaaacaguauug

SEQ ID NO: 1400236 - RNA, 14 nt, Homo sapiens
ucacuuccauagug

SEQ ID NO: 1400237 - RNA, 18 nt, Homo sapiens
ucacuucccuacauggag

SEQ ID NO: 1400238 - RNA, 13 nt, Homo sapiens
ucacuucuuccau

SEQ ID NO: 1400239 - RNA, 21 nt, Homo sapiens
ucacuugguucaguaccacau

SEQ ID NO: 1400240 - RNA, 14 nt, Homo sapiens
ucacuuguucuuaa

SEQ ID NO: 1400241 - RNA, 17 nt, Homo sapiens
ucacuuuaaagcccuuu

SEQ ID NO: 1400242 - RNA, 18 nt, Homo sapiens
ucacuuuucuccaugagu

SEQ ID NO: 1400243 - RNA, 23 nt, Homo sapiens
ucagaaaagaugugcagauauca

SEQ ID NO: 1400244 - RNA, 20 nt, Homo sapiens
ucagaaacaggugcaucugg

SEQ ID NO: 1400245 - RNA, 14 nt, Homo sapiens
ucagaauacagaca

SEQ ID NO: 1400246 - RNA, 17 nt, Homo sapiens
ucagacacaaacaaaca

SEQ ID NO: 1400247 - RNA, 19 nt, Homo sapiens
ucagacagggucugaagga

SEQ ID NO: 1400248 - RNA, 20 nt, Homo sapiens
ucagacccuaccccaccacg

SEQ ID NO: 1400249 - RNA, 20 nt, Homo sapiens
ucagaccugucuuccaagga

SEQ ID NO: 1400250 - RNA, 17 nt, Homo sapiens
ucagacuccugugcaac

SEQ ID NO: 1400251 - RNA, 15 nt, Homo sapiens
ucagaggccuaguca

SEQ ID NO: 1400252 - RNA, 21 nt, Homo sapiens
ucagauacaugguugugaccu

SEQ ID NO: 1400253 - RNA, 19 nt, Homo sapiens
ucagauggaaccgcaggaa

SEQ ID NO: 1400254 - RNA, 18 nt, Homo sapiens
ucagauggacaagauuac

SEQ ID NO: 1400255 - RNA, 12 nt, Homo sapiens
ucagcaaugauu

SEQ ID NO: 1400256 - RNA, 13 nt, Homo sapiens
ucagcaaugauua

SEQ ID NO: 1400257 - RNA, 15 nt, Homo sapiens
ucagccccucuugcc

SEQ ID NO: 1400258 - RNA, 23 nt, Homo sapiens
ucagcccugcccuucagcauccu

SEQ ID NO: 1400259 - RNA, 19 nt, Homo sapiens
ucagccgcuucugacugcu

SEQ ID NO: 1400260 - RNA, 19 nt, Homo sapiens
ucagccucccgaauagcug

SEQ ID NO: 1400261 - RNA, 12 nt, Homo sapiens
ucagcuccuucc

SEQ ID NO: 1400262 - RNA, 12 nt, Homo sapiens
ucagcugccuca

SEQ ID NO: 1400263 - RNA, 13 nt, Homo sapiens
ucagcugcuucuc

SEQ ID NO: 1400264 - RNA, 21 nt, Homo sapiens
ucagcuggaucuccauucucu

SEQ ID NO: 1400265 - RNA, 17 nt, Homo sapiens
ucagcuuauaaaaucaa

SEQ ID NO: 1400266 - RNA, 17 nt, Homo sapiens
ucagcuucuuaauauaa

SEQ ID NO: 1400267 - RNA, 13 nt, Homo sapiens
ucagcuuugccuu

SEQ ID NO: 1400268 - RNA, 14 nt, Homo sapiens
ucaggaaaacugac

SEQ ID NO: 1400269 - RNA, 13 nt, Homo sapiens
ucaggaacagucu

SEQ ID NO: 1400270 - RNA, 14 nt, Homo sapiens
ucaggaacagucuu

SEQ ID NO: 1400271 - RNA, 21 nt, Homo sapiens
ucaggaaggaugagcauuuag

SEQ ID NO: 1400272 - RNA, 17 nt, Homo sapiens
ucaggacaucagucuga

SEQ ID NO: 1400273 - RNA, 19 nt, Homo sapiens
ucaggaggaaggcuuacac

SEQ ID NO: 1400274 - RNA, 16 nt, Homo sapiens
ucaggauacucuguca

SEQ ID NO: 1400275 - RNA, 17 nt, Homo sapiens
ucaggccaacaagccaa

SEQ ID NO: 1400276 - RNA, 18 nt, Homo sapiens
ucaggccaaccccaaaga

SEQ ID NO: 1400277 - RNA, 18 nt, Homo sapiens
ucaggccaggugcagugg

SEQ ID NO: 1400278 - RNA, 14 nt, Homo sapiens
ucagggaccaagga

SEQ ID NO: 1400279 - RNA, 19 nt, Homo sapiens
ucagggaccccugcccuug

SEQ ID NO: 1400280 - RNA, 20 nt, Homo sapiens
ucagggagaguuugggaacu

SEQ ID NO: 1400281 - RNA, 18 nt, Homo sapiens
ucagggcugagaggagaa

SEQ ID NO: 1400282 - RNA, 14 nt, Homo sapiens
ucaggggacucagc

SEQ ID NO: 1400283 - RNA, 21 nt, Homo sapiens
ucaggguuuuuagauuaaaca

SEQ ID NO: 1400284 - RNA, 14 nt, Homo sapiens
ucaguaaacaauga

SEQ ID NO: 1400285 - RNA, 12 nt, Homo sapiens
ucagucaaugaa

SEQ ID NO: 1400286 - RNA, 15 nt, Homo sapiens
ucaguccuuugauca

SEQ ID NO: 1400287 - RNA, 13 nt, Homo sapiens
ucccagugaucac

SEQ ID NO: 1400288 - RNA, 9 nt, Homo sapiens
ucccagugc

SEQ ID NO: 1400289 - RNA, 16 nt, Homo sapiens
ucccauucgcaauaag

SEQ ID NO: 1400290 - RNA, 16 nt, Homo sapiens
uccccaacgaaaagca

SEQ ID NO: 1400291 - RNA, 22 nt, Homo sapiens
uccccuagcuuuccccagacac

SEQ ID NO: 1400292 - RNA, 15 nt, Homo sapiens
uccccucagauucca

SEQ ID NO: 1400293 - RNA, 16 nt, Homo sapiens
uccccucagauuccac

SEQ ID NO: 1400294 - RNA, 23 nt, Homo sapiens
uccccuccuugccuccuguguaa

SEQ ID NO: 1400295 - RNA, 22 nt, Homo sapiens
uccccuugcccagggcucagcc

SEQ ID NO: 1400296 - RNA, 15 nt, Homo sapiens
ucccgggaagccacc

SEQ ID NO: 1400297 - RNA, 20 nt, Homo sapiens
ucccuaaugagaagucaaca

SEQ ID NO: 1400298 - RNA, 19 nt, Homo sapiens
ucccuaucucgaacaugga

SEQ ID NO: 1400299 - RNA, 17 nt, Homo sapiens
ucccucaaagcacacgu

SEQ ID NO: 1400300 - RNA, 17 nt, Homo sapiens
ucccucgggugugcuau

SEQ ID NO: 1400301 - RNA, 15 nt, Homo sapiens
ucccucuaaguggaa

SEQ ID NO: 1400302 - RNA, 19 nt, Homo sapiens
ucccucuaauuuaucuugu

SEQ ID NO: 1400303 - RNA, 17 nt, Homo sapiens
ucccucucucuggaaag

SEQ ID NO: 1400304 - RNA, 21 nt, Homo sapiens
ucccuggcucccaugaccaua

SEQ ID NO: 1400305 - RNA, 18 nt, Homo sapiens
ucccuguuuaaugauuga

SEQ ID NO: 1400306 - RNA, 18 nt, Homo sapiens
ucccuuccucccaaaagu

SEQ ID NO: 1400307 - RNA, 16 nt, Homo sapiens
ucccuucuaaccugaa

SEQ ID NO: 1400308 - RNA, 19 nt, Homo sapiens
ucccuucucuuaauuuaau

SEQ ID NO: 1400309 - RNA, 22 nt, Homo sapiens
ucccuucuuuuuguucuucauc

SEQ ID NO: 1400310 - RNA, 19 nt, Homo sapiens
ucccuugguguugccccua

SEQ ID NO: 1400311 - RNA, 22 nt, Homo sapiens
ucccuuucugugugaagaucac

SEQ ID NO: 1400312 - RNA, 13 nt, Homo sapiens
ucccuuucuuccc

SEQ ID NO: 1400313 - RNA, 16 nt, Homo sapiens
ucccuuucuuggccag

SEQ ID NO: 1400314 - RNA, 17 nt, Homo sapiens
ucccuuuguaugggagc

SEQ ID NO: 1400315 - RNA, 20 nt, Homo sapiens
ucccuuuuacauacugcugu

SEQ ID NO: 1400316 - RNA, 23 nt, Homo sapiens
ucccuuuuuauaucccauuuuua

SEQ ID NO: 1400317 - RNA, 22 nt, Homo sapiens
uccgacaaccgaugcuccagcc

SEQ ID NO: 1400318 - RNA, 15 nt, Homo sapiens
uccgccauucucaag

SEQ ID NO: 1400319 - RNA, 13 nt, Homo sapiens
uccgggaucaaag

SEQ ID NO: 1400320 - RNA, 16 nt, Homo sapiens
uccguaguucccugaa

SEQ ID NO: 1400321 - RNA, 23 nt, Homo sapiens
uccuaacaggaugaaaguucccc

SEQ ID NO: 1400322 - RNA, 21 nt, Homo sapiens
uccuaaguuaccuuucuaggu

SEQ ID NO: 1400323 - RNA, 19 nt, Homo sapiens
uccuaaugaaugcauaaaa

SEQ ID NO: 1400324 - RNA, 16 nt, Homo sapiens
uccuacaguggcuguc

SEQ ID NO: 1400325 - RNA, 21 nt, Homo sapiens
uccuacuuuacauaugcuuua

SEQ ID NO: 1400326 - RNA, 17 nt, Homo sapiens
uccuagaaacugacaca

SEQ ID NO: 1400327 - RNA, 17 nt, Homo sapiens
uccuaucccaucccauc

SEQ ID NO: 1400328 - RNA, 20 nt, Homo sapiens
uccuauuucuggaauggaaa

SEQ ID NO: 1400329 - RNA, 20 nt, Homo sapiens
uccuauuucuuauagucaau

SEQ ID NO: 1400330 - RNA, 22 nt, Homo sapiens
uccucagagaauuucuaccauu

SEQ ID NO: 1400331 - RNA, 24 nt, Homo sapiens
uccucagggacagagacaccugca

SEQ ID NO: 1400332 - RNA, 17 nt, Homo sapiens
uccucauuguaaacaaa

SEQ ID NO: 1400333 - RNA, 17 nt, Homo sapiens
uccuccacaauagcaga

SEQ ID NO: 1400334 - RNA, 12 nt, Homo sapiens
uccuccaggcaa

SEQ ID NO: 1400335 - RNA, 19 nt, Homo sapiens
uccuccugcccaccuguca

SEQ ID NO: 1400336 - RNA, 13 nt, Homo sapiens
uccucuccacugc

SEQ ID NO: 1400337 - RNA, 23 nt, Homo sapiens
uccugaagguguuuuucauucac

SEQ ID NO: 1400338 - RNA, 14 nt, Homo sapiens
uccugaugacccag

SEQ ID NO: 1400339 - RNA, 17 nt, Homo sapiens
uccugccgcaacaguuu

SEQ ID NO: 1400340 - RNA, 15 nt, Homo sapiens
uccugcggcaucaga

SEQ ID NO: 1400341 - RNA, 23 nt, Homo sapiens
uccugcuacucuguuccuucaca

SEQ ID NO: 1400342 - RNA, 17 nt, Homo sapiens
uccuggacucauugcuu

SEQ ID NO: 1400343 - RNA, 15 nt, Homo sapiens
uccuggcugagagag

SEQ ID NO: 1400344 - RNA, 21 nt, Homo sapiens
uccugggaauaacauggugag

SEQ ID NO: 1400345 - RNA, 18 nt, Homo sapiens
uccugggagaaccucagg

SEQ ID NO: 1400346 - RNA, 17 nt, Homo sapiens
uccugggcuaagugauc

SEQ ID NO: 1400347 - RNA, 23 nt, Homo sapiens
uccugguuaaauuugaauuucag

SEQ ID NO: 1400348 - RNA, 22 nt, Homo sapiens
uccugucauuuuuuuucucuag

SEQ ID NO: 1400349 - RNA, 22 nt, Homo sapiens
uccugugugugcgccuacagga

SEQ ID NO: 1400350 - RNA, 18 nt, Homo sapiens
uccuguugaaaagccaug

SEQ ID NO: 1400351 - RNA, 17 nt, Homo sapiens
uccuuaaacuccuguga

SEQ ID NO: 1400352 - RNA, 20 nt, Homo sapiens
uccuuaccgugggcacugaa

SEQ ID NO: 1400353 - RNA, 16 nt, Homo sapiens
uccuuagagacaucaa

SEQ ID NO: 1400354 - RNA, 20 nt, Homo sapiens
uccuuagcuuagaccucagc

SEQ ID NO: 1400355 - RNA, 16 nt, Homo sapiens
uccuuaucgaaacuca

SEQ ID NO: 1400356 - RNA, 16 nt, Homo sapiens
uccuuccaucccuacc

SEQ ID NO: 1400357 - RNA, 17 nt, Homo sapiens
uccuucuaaucugcuau

SEQ ID NO: 1400358 - RNA, 18 nt, Homo sapiens
uccuucuaaucugcuaug

SEQ ID NO: 1400359 - RNA, 11 nt, Homo sapiens
uccuucuugcu

SEQ ID NO: 1400360 - RNA, 14 nt, Homo sapiens
uccuugaccagcag

SEQ ID NO: 1400361 - RNA, 17 nt, Homo sapiens
uccuugaccgcucucug

SEQ ID NO: 1400362 - RNA, 17 nt, Homo sapiens
uccuugauacugcucau

SEQ ID NO: 1400363 - RNA, 16 nt, Homo sapiens
uccuuguaaauuacau

SEQ ID NO: 1400364 - RNA, 19 nt, Homo sapiens
uccuugugaagaugauaua

SEQ ID NO: 1400365 - RNA, 22 nt, Homo sapiens
uccuuuacuaauccaacccaug

SEQ ID NO: 1400366 - RNA, 23 nt, Homo sapiens
uccuuuccaagcuccucgugaua

SEQ ID NO: 1400367 - RNA, 21 nt, Homo sapiens
uccuuuccugaucacuaugca

SEQ ID NO: 1400368 - RNA, 22 nt, Homo sapiens
uccuuuggccauuccaacagcu

SEQ ID NO: 1400369 - RNA, 23 nt, Homo sapiens
ucgaacauggaacucauuccugc

SEQ ID NO: 1400370 - RNA, 19 nt, Homo sapiens
ucgaacuccugggcucaag

SEQ ID NO: 1400371 - RNA, 13 nt, Homo sapiens
ucgaagcucagcc

SEQ ID NO: 1400372 - RNA, 16 nt, Homo sapiens
ucgagaccaaccugac

SEQ ID NO: 1400373 - RNA, 14 nt, Homo sapiens
ucgcauuugucaau

SEQ ID NO: 1400374 - RNA, 17 nt, Homo sapiens
ucgcccaggagacaucc

SEQ ID NO: 1400375 - RNA, 20 nt, Homo sapiens
ucggauuagaaauaaagcau

SEQ ID NO: 1400376 - RNA, 18 nt, Homo sapiens
ucggcucauguagccuca

SEQ ID NO: 1400377 - RNA, 17 nt, Homo sapiens
ucuaccaagcugugacc

SEQ ID NO: 1400378 - RNA, 15 nt, Homo sapiens
ucuaccagcauaaau

SEQ ID NO: 1400379 - RNA, 16 nt, Homo sapiens
ucuacguaucugcuac

SEQ ID NO: 1400380 - RNA, 17 nt, Homo sapiens
ucuacuaccacaaggaa

SEQ ID NO: 1400381 - RNA, 17 nt, Homo sapiens
ucuacugaacaguccau

SEQ ID NO: 1400382 - RNA, 18 nt, Homo sapiens
ucuacuggucuuguggaa

SEQ ID NO: 1400383 - RNA, 16 nt, Homo sapiens
ucuacuuaaugagaua

SEQ ID NO: 1400384 - RNA, 15 nt, Homo sapiens
ucuagaacacaggca

SEQ ID NO: 1400385 - RNA, 20 nt, Homo sapiens
ucuagaaccaggcaacuugg

SEQ ID NO: 1400386 - RNA, 21 nt, Homo sapiens
ucuagcaaauguuaugcauaa

SEQ ID NO: 1400387 - RNA, 19 nt, Homo sapiens
ucuagccugggcaacaaca

SEQ ID NO: 1400388 - RNA, 18 nt, Homo sapiens
ucuaggcaucccagggga

SEQ ID NO: 1400389 - RNA, 22 nt, Homo sapiens
ucuaggucaguacccaccugag

SEQ ID NO: 1400390 - RNA, 15 nt, Homo sapiens
ucuagucugcuuugg

SEQ ID NO: 1400391 - RNA, 15 nt, Homo sapiens
ucuaguuuugucaaa

SEQ ID NO: 1400392 - RNA, 18 nt, Homo sapiens
ucuaugggacucaaugca

SEQ ID NO: 1400393 - RNA, 18 nt, Homo sapiens
ucuauggguaucaaacag

SEQ ID NO: 1400394 - RNA, 13 nt, Homo sapiens
ucuauguacugua

SEQ ID NO: 1400395 - RNA, 16 nt, Homo sapiens
ucuaugucucaugaug

SEQ ID NO: 1400396 - RNA, 20 nt, Homo sapiens
ucuauugagugaacagaauu

SEQ ID NO: 1400397 - RNA, 13 nt, Homo sapiens
ucuauugcugcuc

SEQ ID NO: 1400398 - RNA, 13 nt, Homo sapiens
ucuauuuguauug

SEQ ID NO: 1400399 - RNA, 20 nt, Homo sapiens
ucucaaacucuugaccucag

SEQ ID NO: 1400400 - RNA, 18 nt, Homo sapiens
ucucaaaugcacaucuca

SEQ ID NO: 1400401 - RNA, 22 nt, Homo sapiens
ucucaaauucauggugcacuga

SEQ ID NO: 1400402 - RNA, 20 nt, Homo sapiens
ucucacuauguugcccaggc

SEQ ID NO: 1400403 - RNA, 20 nt, Homo sapiens
ucucacucugucgcccaguc

SEQ ID NO: 1400404 - RNA, 14 nt, Homo sapiens
ucucacugacuauu

SEQ ID NO: 1400405 - RNA, 11 nt, Homo sapiens
ucucacugugu

SEQ ID NO: 1400406 - RNA, 14 nt, Homo sapiens
ucucagaauucuuc

SEQ ID NO: 1400407 - RNA, 14 nt, Homo sapiens
ucucagccucugaa

SEQ ID NO: 1400408 - RNA, 18 nt, Homo sapiens
ucucagcuaccuaagaaa

SEQ ID NO: 1400409 - RNA, 12 nt, Homo sapiens
ucucagugcagg

SEQ ID NO: 1400410 - RNA, 14 nt, Homo sapiens
ucucagugcuucuu

SEQ ID NO: 1400411 - RNA, 12 nt, Homo sapiens
ucucauaugauu

SEQ ID NO: 1400412 - RNA, 20 nt, Homo sapiens
ucucauccugcaggcagcuu

SEQ ID NO: 1400413 - RNA, 14 nt, Homo sapiens
ucucaucugugauu

SEQ ID NO: 1400414 - RNA, 19 nt, Homo sapiens
ucuccaaauacugauggug

SEQ ID NO: 1400415 - RNA, 14 nt, Homo sapiens
ucuccaaaugagau

SEQ ID NO: 1400416 - RNA, 19 nt, Homo sapiens
ucuccacuucuuguucccc

SEQ ID NO: 1400417 - RNA, 23 nt, Homo sapiens
ucuccagagggaauugcagagua

SEQ ID NO: 1400418 - RNA, 23 nt, Homo sapiens
ucuccagaugagaguacacccca

SEQ ID NO: 1400419 - RNA, 12 nt, Homo sapiens
ucuccagugcac

SEQ ID NO: 1400420 - RNA, 14 nt, Homo sapiens
ucuccagugcaccu

SEQ ID NO: 1400421 - RNA, 21 nt, Homo sapiens
ucuccauccuaccacaaugca

SEQ ID NO: 1400422 - RNA, 22 nt, Homo sapiens
ucucccagggccuuaaaagcca

SEQ ID NO: 1400423 - RNA, 17 nt, Homo sapiens
ucuccccuucucuguau

SEQ ID NO: 1400424 - RNA, 11 nt, Homo sapiens
ucuccuacuuu

SEQ ID NO: 1400425 - RNA, 15 nt, Homo sapiens
ucuccucacugaaaa

SEQ ID NO: 1400426 - RNA, 16 nt, Homo sapiens
ucuccugauuauuuau

SEQ ID NO: 1400427 - RNA, 18 nt, Homo sapiens
ucuccuuugcaggcucau

SEQ ID NO: 1400428 - RNA, 18 nt, Homo sapiens
ucucgcuuuguugcccag

SEQ ID NO: 1400429 - RNA, 11 nt, Homo sapiens
ucucuagcuca

SEQ ID NO: 1400430 - RNA, 17 nt, Homo sapiens
ucucucacugacuauua

SEQ ID NO: 1400431 - RNA, 13 nt, Homo sapiens
ucucuccagugca

SEQ ID NO: 1400432 - RNA, 16 nt, Homo sapiens
ucucuccagugcaccu

SEQ ID NO: 1400433 - RNA, 15 nt, Homo sapiens
ucucugcccauuccc

SEQ ID NO: 1400434 - RNA, 12 nt, Homo sapiens
ucucugcuugca

SEQ ID NO: 1400435 - RNA, 20 nt, Homo sapiens
ucucuggcuaaggacaggca

SEQ ID NO: 1400436 - RNA, 13 nt, Homo sapiens
ucucugucucaaa

SEQ ID NO: 1400437 - RNA, 16 nt, Homo sapiens
ucucugugugcacaaa

SEQ ID NO: 1400438 - RNA, 22 nt, Homo sapiens
ucucuuaaaccacagcacuauu

SEQ ID NO: 1400439 - RNA, 16 nt, Homo sapiens
ucucuucuaagcaaaa

SEQ ID NO: 1400440 - RNA, 18 nt, Homo sapiens
ucucuugcacucaaagcu

SEQ ID NO: 1400441 - RNA, 17 nt, Homo sapiens
ucucuugcuugugggac

SEQ ID NO: 1400442 - RNA, 16 nt, Homo sapiens
ucucuuguuauugcau

SEQ ID NO: 1400443 - RNA, 20 nt, Homo sapiens
ucugaagucacaucacagga

SEQ ID NO: 1400444 - RNA, 17 nt, Homo sapiens
ucugaagucaguuucua

SEQ ID NO: 1400445 - RNA, 16 nt, Homo sapiens
ucugaaucaaggugau

SEQ ID NO: 1400446 - RNA, 12 nt, Homo sapiens
ucugaauuccaa

SEQ ID NO: 1400447 - RNA, 12 nt, Homo sapiens
ucugaccucagc

SEQ ID NO: 1400448 - RNA, 13 nt, Homo sapiens
ucugaccucuaua

SEQ ID NO: 1400449 - RNA, 16 nt, Homo sapiens
ucugacucccaaagag

SEQ ID NO: 1400450 - RNA, 17 nt, Homo sapiens
ucugagaaggugagaua

SEQ ID NO: 1400451 - RNA, 22 nt, Homo sapiens
ucugagccaaagagaaugccau

SEQ ID NO: 1400452 - RNA, 16 nt, Homo sapiens
ucugagcuaacuuaua

SEQ ID NO: 1400453 - RNA, 13 nt, Homo sapiens
ucugauaccucaa

SEQ ID NO: 1400454 - RNA, 21 nt, Homo sapiens
ucugaugaccuaaccuaagca

SEQ ID NO: 1400455 - RNA, 22 nt, Homo sapiens
ucugaugaccuaaccuaagcaa

SEQ ID NO: 1400456 - RNA, 17 nt, Homo sapiens
ucugauguaaaugaagu

SEQ ID NO: 1400457 - RNA, 21 nt, Homo sapiens
ucugcaaaggcgucugaaugu

SEQ ID NO: 1400458 - RNA, 21 nt, Homo sapiens
ucugcaagcacaucugcauuu

SEQ ID NO: 1400459 - RNA, 18 nt, Homo sapiens
ucugcaaggucuuugguu

SEQ ID NO: 1400460 - RNA, 14 nt, Homo sapiens
ucugcccagaauuc

SEQ ID NO: 1400461 - RNA, 18 nt, Homo sapiens
ucugcccugcccuagcuc

SEQ ID NO: 1400462 - RNA, 21 nt, Homo sapiens
ucugccuccccuucacuccca

SEQ ID NO: 1400463 - RNA, 20 nt, Homo sapiens
ucugccugaaccuuccaucu

SEQ ID NO: 1400464 - RNA, 22 nt, Homo sapiens
ucugccugcaccccugcaguuu

SEQ ID NO: 1400465 - RNA, 12 nt, Homo sapiens
ucugccugugga

SEQ ID NO: 1400466 - RNA, 19 nt, Homo sapiens
ucugccuucuccaugcuga

SEQ ID NO: 1400467 - RNA, 13 nt, Homo sapiens
ucugcuacugugu

SEQ ID NO: 1400468 - RNA, 19 nt, Homo sapiens
agagacuuugacucuccag

SEQ ID NO: 1400469 - RNA, 23 nt, Homo sapiens
agagagaaacucuauggguauca

SEQ ID NO: 1400470 - RNA, 19 nt, Homo sapiens
guguccagcugaguuucuc

SEQ ID NO: 1400471 - RNA, 21 nt, Homo sapiens
guguccuccccucaaggacaa

SEQ ID NO: 1400472 - RNA, 16 nt, Homo sapiens
gugucuggacauucag

SEQ ID NO: 1400473 - RNA, 21 nt, Homo sapiens
gugugaacagggaacucagaa

SEQ ID NO: 1400474 - RNA, 15 nt, Homo sapiens
gugugaagaucacgu

SEQ ID NO: 1400475 - RNA, 16 nt, Homo sapiens
gugugcaaguguguau

SEQ ID NO: 1400476 - RNA, 15 nt, Homo sapiens
gugugcgucacugug

SEQ ID NO: 1400477 - RNA, 19 nt, Homo sapiens
gugugggcugugaguguaa

SEQ ID NO: 1400478 - RNA, 19 nt, Homo sapiens
gugugggggaagcaccaua

SEQ ID NO: 1400479 - RNA, 14 nt, Homo sapiens
gugugguugcucac

SEQ ID NO: 1400480 - RNA, 21 nt, Homo sapiens
guguguaugugcgugugugca

SEQ ID NO: 1400481 - RNA, 23 nt, Homo sapiens
guguguccaugugugugcaagug

SEQ ID NO: 1400482 - RNA, 13 nt, Homo sapiens
gugugugcaugug

SEQ ID NO: 1400483 - RNA, 17 nt, Homo sapiens
gugugugcgugugucca

SEQ ID NO: 1400484 - RNA, 14 nt, Homo sapiens
gugugugugcaagu

SEQ ID NO: 1400485 - RNA, 15 nt, Homo sapiens
guguguguugucuga

SEQ ID NO: 1400486 - RNA, 14 nt, Homo sapiens
guguguugauccca

SEQ ID NO: 1400487 - RNA, 22 nt, Homo sapiens
guguuugugauuguuugcucug

SEQ ID NO: 1400488 - RNA, 13 nt, Homo sapiens
guguuugugcuga

SEQ ID NO: 1400489 - RNA, 18 nt, Homo sapiens
guguuuugcuaaaggaaa

SEQ ID NO: 1400490 - RNA, 16 nt, Homo sapiens
guuaaccucaguguca

SEQ ID NO: 1400491 - RNA, 16 nt, Homo sapiens
guuacaccagaaccug

SEQ ID NO: 1400492 - RNA, 22 nt, Homo sapiens
guuacauaagauaaaugugcug

SEQ ID NO: 1400493 - RNA, 13 nt, Homo sapiens
guuacucaugacu

SEQ ID NO: 1400494 - RNA, 15 nt, Homo sapiens
guuacugaccagcaa

SEQ ID NO: 1400495 - RNA, 19 nt, Homo sapiens
guuacuguggccaguauuu

SEQ ID NO: 1400496 - RNA, 13 nt, Homo sapiens
guuagaaaugcaa

SEQ ID NO: 1400497 - RNA, 15 nt, Homo sapiens
guuagaaaugcaaau

SEQ ID NO: 1400498 - RNA, 16 nt, Homo sapiens
guuagaaaugcaaauu

SEQ ID NO: 1400499 - RNA, 21 nt, Homo sapiens
guuagaggccagccuggcgaa

SEQ ID NO: 1400500 - RNA, 14 nt, Homo sapiens
guuagcaucuggcu

SEQ ID NO: 1400501 - RNA, 17 nt, Homo sapiens
guuaggaaaauuucaca

SEQ ID NO: 1400502 - RNA, 22 nt, Homo sapiens
guuagugcuaguggauuuuaca

SEQ ID NO: 1400503 - RNA, 19 nt, Homo sapiens
guuauaaaucaaugucacu

SEQ ID NO: 1400504 - RNA, 15 nt, Homo sapiens
guuauagacugccau

SEQ ID NO: 1400505 - RNA, 13 nt, Homo sapiens
guuaugcaucauu

SEQ ID NO: 1400506 - RNA, 17 nt, Homo sapiens
guuauuggguaucacca

SEQ ID NO: 1400507 - RNA, 19 nt, Homo sapiens
guuauuuagggaacugcuu

SEQ ID NO: 1400508 - RNA, 21 nt, Homo sapiens
guucacuacuacacccagcua

SEQ ID NO: 1400509 - RNA, 11 nt, Homo sapiens
guucacuccca

SEQ ID NO: 1400510 - RNA, 17 nt, Homo sapiens
guucacucuacuuagca

SEQ ID NO: 1400511 - RNA, 16 nt, Homo sapiens
guucagggcugugauc

SEQ ID NO: 1400512 - RNA, 23 nt, Homo sapiens
guucaucauccuaagcuauucag

SEQ ID NO: 1400513 - RNA, 13 nt, Homo sapiens
guuccccacugac

SEQ ID NO: 1400514 - RNA, 15 nt, Homo sapiens
guuccgagaagaaca

SEQ ID NO: 1400515 - RNA, 21 nt, Homo sapiens
guuccugcagcagagccugga

SEQ ID NO: 1400516 - RNA, 19 nt, Homo sapiens
guuccuggcucagccucaa

SEQ ID NO: 1400517 - RNA, 16 nt, Homo sapiens
guuccuuacugcagaa

SEQ ID NO: 1400518 - RNA, 17 nt, Homo sapiens
guucuacacucaucuua

SEQ ID NO: 1400519 - RNA, 21 nt, Homo sapiens
guucuauauaaaaaacauaau

SEQ ID NO: 1400520 - RNA, 16 nt, Homo sapiens
guucucuauugcugcu

SEQ ID NO: 1400521 - RNA, 22 nt, Homo sapiens
guucugagauuauuuuaaucua

SEQ ID NO: 1400522 - RNA, 16 nt, Homo sapiens
guucuuagugucacuu

SEQ ID NO: 1400523 - RNA, 17 nt, Homo sapiens
guucuuaguuugcaguu

SEQ ID NO: 1400524 - RNA, 14 nt, Homo sapiens
guugaacacuugaa

SEQ ID NO: 1400525 - RNA, 19 nt, Homo sapiens
guugauucagcucugcaag

SEQ ID NO: 1400526 - RNA, 16 nt, Homo sapiens
guugcagaauguggag

SEQ ID NO: 1400527 - RNA, 19 nt, Homo sapiens
guugcaggaccucagguga

SEQ ID NO: 1400528 - RNA, 19 nt, Homo sapiens
guugcucacagcuguaaua

SEQ ID NO: 1400529 - RNA, 15 nt, Homo sapiens
guugcugcaucuccc

SEQ ID NO: 1400530 - RNA, 19 nt, Homo sapiens
guuggaugcggaacccaaa

SEQ ID NO: 1400531 - RNA, 12 nt, Homo sapiens
guuggcuucuaa

SEQ ID NO: 1400532 - RNA, 13 nt, Homo sapiens
guuggugcugcuu

SEQ ID NO: 1400533 - RNA, 19 nt, Homo sapiens
guuguggagagugcaacag

SEQ ID NO: 1400534 - RNA, 19 nt, Homo sapiens
guuguuaaugaaaauguca

SEQ ID NO: 1400535 - RNA, 20 nt, Homo sapiens
guuguuaaugaaaaugucag

SEQ ID NO: 1400536 - RNA, 18 nt, Homo sapiens
guuguuauuaacagcuga

SEQ ID NO: 1400537 - RNA, 15 nt, Homo sapiens
guuuacacugucaaa

SEQ ID NO: 1400538 - RNA, 21 nt, Homo sapiens
guuuacccaguauuccauuuu

SEQ ID NO: 1400539 - RNA, 21 nt, Homo sapiens
guuuaccgaaaaucauauaau

SEQ ID NO: 1400540 - RNA, 23 nt, Homo sapiens
guuuagccaaaggauaagugucc

SEQ ID NO: 1400541 - RNA, 18 nt, Homo sapiens
guuuauaaaagaugcauu

SEQ ID NO: 1400542 - RNA, 18 nt, Homo sapiens
guuuauccuaucucucca

SEQ ID NO: 1400543 - RNA, 17 nt, Homo sapiens
guuucacacuagucaca

SEQ ID NO: 1400544 - RNA, 18 nt, Homo sapiens
guuucacacuagucacau

SEQ ID NO: 1400545 - RNA, 21 nt, Homo sapiens
guuucaccaucagucaaugaa

SEQ ID NO: 1400546 - RNA, 23 nt, Homo sapiens
guuucagaugauucuaugucuca

SEQ ID NO: 1400547 - RNA, 16 nt, Homo sapiens
guuuccaaaaaccaug

SEQ ID NO: 1400548 - RNA, 14 nt, Homo sapiens
guuucccuaucucg

SEQ ID NO: 1400549 - RNA, 21 nt, Homo sapiens
guuucgugaaguauacuguau

SEQ ID NO: 1400550 - RNA, 14 nt, Homo sapiens
guuugaguuacuau

SEQ ID NO: 1400551 - RNA, 16 nt, Homo sapiens
guuugcaaugucacaa

SEQ ID NO: 1400552 - RNA, 14 nt, Homo sapiens
guuugcuagcagaa

SEQ ID NO: 1400553 - RNA, 21 nt, Homo sapiens
guuugcuauugacaagucauu

SEQ ID NO: 1400554 - RNA, 13 nt, Homo sapiens
guuuggccaaaaa

SEQ ID NO: 1400555 - RNA, 14 nt, Homo sapiens
guuuggccaaaaag

SEQ ID NO: 1400556 - RNA, 14 nt, Homo sapiens
guuuggcugggaua

SEQ ID NO: 1400557 - RNA, 12 nt, Homo sapiens
guuuuaacugua

SEQ ID NO: 1400558 - RNA, 22 nt, Homo sapiens
guuuuaagaggcagggucucac

SEQ ID NO: 1400559 - RNA, 14 nt, Homo sapiens
guuuucccaaagag

SEQ ID NO: 1400560 - RNA, 21 nt, Homo sapiens
guuuucccugaccucccucua

SEQ ID NO: 1400561 - RNA, 19 nt, Homo sapiens
guuuuccuaaaugcaguga

SEQ ID NO: 1400562 - RNA, 19 nt, Homo sapiens
guuuuccuucucaucugug

SEQ ID NO: 1400563 - RNA, 15 nt, Homo sapiens
guuuucuagaauuua

SEQ ID NO: 1400564 - RNA, 16 nt, Homo sapiens
guuuucuugccaauga

SEQ ID NO: 1400565 - RNA, 15 nt, Homo sapiens
guuuugcuuaggcac

SEQ ID NO: 1400566 - RNA, 17 nt, Homo sapiens
guuuuggaagcucugaa

SEQ ID NO: 1400567 - RNA, 13 nt, Homo sapiens
guuuuuacuguga

SEQ ID NO: 1400568 - RNA, 18 nt, Homo sapiens
guuuuuguuuuuugccau

SEQ ID NO: 1400569 - RNA, 16 nt, Homo sapiens
uaaaaaagaucuccaa

SEQ ID NO: 1400570 - RNA, 21 nt, Homo sapiens
uaaaaaaugaaaaacauuauu

SEQ ID NO: 1400571 - RNA, 23 nt, Homo sapiens
uaaaaagcgggcacgggcccgug

SEQ ID NO: 1400572 - RNA, 18 nt, Homo sapiens
uaaaaauggccauuugcu

SEQ ID NO: 1400573 - RNA, 15 nt, Homo sapiens
uaaaaauugugauca

SEQ ID NO: 1400574 - RNA, 23 nt, Homo sapiens
uaaaaauugugaucagaccauaa

SEQ ID NO: 1400575 - RNA, 22 nt, Homo sapiens
uaaaacagccaaaacuccacag

SEQ ID NO: 1400576 - RNA, 13 nt, Homo sapiens
uaaaacaguccuu

SEQ ID NO: 1400577 - RNA, 15 nt, Homo sapiens
uaaaacauuuucaca

SEQ ID NO: 1400578 - RNA, 20 nt, Homo sapiens
uaaaacauuuucacacaaua

SEQ ID NO: 1400579 - RNA, 14 nt, Homo sapiens
uaaaaccacuguac

SEQ ID NO: 1400580 - RNA, 18 nt, Homo sapiens
uaaaacccaagugccuua

SEQ ID NO: 1400581 - RNA, 18 nt, Homo sapiens
uaaaacuccuguuucacu

SEQ ID NO: 1400582 - RNA, 19 nt, Homo sapiens
uaaaacuggcaucugacac

SEQ ID NO: 1400583 - RNA, 19 nt, Homo sapiens
uauaucaguccucuuucaa

SEQ ID NO: 1400584 - RNA, 15 nt, Homo sapiens
uauaucccauugaaa

SEQ ID NO: 1400585 - RNA, 17 nt, Homo sapiens
uauaucgcuuaaucuua

SEQ ID NO: 1400586 - RNA, 12 nt, Homo sapiens
uauaugcaauau

SEQ ID NO: 1400587 - RNA, 20 nt, Homo sapiens
uauaugccgcuacaaaaagg

SEQ ID NO: 1400588 - RNA, 17 nt, Homo sapiens
uauauuauaaucuucca

SEQ ID NO: 1400589 - RNA, 13 nt, Homo sapiens
uauauucauuuca

SEQ ID NO: 1400590 - RNA, 15 nt, Homo sapiens
uauauucucagugua

SEQ ID NO: 1400591 - RNA, 21 nt, Homo sapiens
uaucaauguucuaguucugug

SEQ ID NO: 1400592 - RNA, 18 nt, Homo sapiens
uaucaauuacaacaguga

SEQ ID NO: 1400593 - RNA, 14 nt, Homo sapiens
uaucaauuaccaca

SEQ ID NO: 1400594 - RNA, 19 nt, Homo sapiens
uaucaccucuuaugcacac

SEQ ID NO: 1400595 - RNA, 14 nt, Homo sapiens
uaucagaauucuca

SEQ ID NO: 1400596 - RNA, 14 nt, Homo sapiens
uaucaguaucugag

SEQ ID NO: 1400597 - RNA, 21 nt, Homo sapiens
uauccaacaugugcucaggga

SEQ ID NO: 1400598 - RNA, 21 nt, Homo sapiens
uauccaaucuuguuuccaaaa

SEQ ID NO: 1400599 - RNA, 24 nt, Homo sapiens
uauccacuuaccuagauucuacau

SEQ ID NO: 1400600 - RNA, 15 nt, Homo sapiens
uaucccuaugcugcc

SEQ ID NO: 1400601 - RNA, 15 nt, Homo sapiens
uauccuaucucucca

SEQ ID NO: 1400602 - RNA, 15 nt, Homo sapiens
uaucgccuuuugaca

SEQ ID NO: 1400603 - RNA, 15 nt, Homo sapiens
uaucgggaacagugu

SEQ ID NO: 1400604 - RNA, 17 nt, Homo sapiens
uaucgggagcagugucu

SEQ ID NO: 1400605 - RNA, 16 nt, Homo sapiens
uaucucuccaaccaga

SEQ ID NO: 1400606 - RNA, 14 nt, Homo sapiens
uaucugaguugacu

SEQ ID NO: 1400607 - RNA, 16 nt, Homo sapiens
uaucuuaaagcacuua

SEQ ID NO: 1400608 - RNA, 17 nt, Homo sapiens
uaucuucaggacacuca

SEQ ID NO: 1400609 - RNA, 13 nt, Homo sapiens
uaucuucauacaa

SEQ ID NO: 1400610 - RNA, 17 nt, Homo sapiens
uaucuucuuuugaacaa

SEQ ID NO: 1400611 - RNA, 20 nt, Homo sapiens
uaucuucuuuugaacaaaug

SEQ ID NO: 1400612 - RNA, 17 nt, Homo sapiens
uaucuuguuuuuccacu

SEQ ID NO: 1400613 - RNA, 18 nt, Homo sapiens
uaugaaaagaggggacca

SEQ ID NO: 1400614 - RNA, 23 nt, Homo sapiens
uaugaccucgcccuccacaaaug

SEQ ID NO: 1400615 - RNA, 22 nt, Homo sapiens
uaugacuaaagagagaauguag

SEQ ID NO: 1400616 - RNA, 23 nt, Homo sapiens
uaugaguuuuugauagcuuuauu

SEQ ID NO: 1400617 - RNA, 16 nt, Homo sapiens
uaugaugucccuaugg

SEQ ID NO: 1400618 - RNA, 14 nt, Homo sapiens
uaugauugugcaca

SEQ ID NO: 1400619 - RNA, 12 nt, Homo sapiens
uaugcaaucuga

SEQ ID NO: 1400620 - RNA, 13 nt, Homo sapiens
uaugcacaaacuu

SEQ ID NO: 1400621 - RNA, 13 nt, Homo sapiens
uaugcacaccucc

SEQ ID NO: 1400622 - RNA, 19 nt, Homo sapiens
uaugcaccaaaucaucucu

SEQ ID NO: 1400623 - RNA, 23 nt, Homo sapiens
uaugcaggggcaaacaccugcug

SEQ ID NO: 1400624 - RNA, 16 nt, Homo sapiens
uaugcaucugcuacug

SEQ ID NO: 1400625 - RNA, 12 nt, Homo sapiens
uaugccauagca

SEQ ID NO: 1400626 - RNA, 23 nt, Homo sapiens
uaugccauguggucauacucuca

SEQ ID NO: 1400627 - RNA, 22 nt, Homo sapiens
uaugcucagggucaauuucuuu

SEQ ID NO: 1400628 - RNA, 19 nt, Homo sapiens
uaugcucauaacuguguca

SEQ ID NO: 1400629 - RNA, 16 nt, Homo sapiens
uaugcugcuguuuaca

SEQ ID NO: 1400630 - RNA, 16 nt, Homo sapiens
uauggaauacaguguu

SEQ ID NO: 1400631 - RNA, 16 nt, Homo sapiens
uauggacucaguuuuc

SEQ ID NO: 1400632 - RNA, 18 nt, Homo sapiens
uauggcacccaugcaccu

SEQ ID NO: 1400633 - RNA, 17 nt, Homo sapiens
uauggcucuacuuucag

SEQ ID NO: 1400634 - RNA, 15 nt, Homo sapiens
uauggggacauucca

SEQ ID NO: 1400635 - RNA, 16 nt, Homo sapiens
uauggggacauuccaa

SEQ ID NO: 1400636 - RNA, 17 nt, Homo sapiens
uaugguuucuccaucca

SEQ ID NO: 1400637 - RNA, 10 nt, Homo sapiens
uauguaaaaa

SEQ ID NO: 1400638 - RNA, 15 nt, Homo sapiens
uauguaaaauuuugc

SEQ ID NO: 1400639 - RNA, 16 nt, Homo sapiens
uauguacuaagcagua

SEQ ID NO: 1400640 - RNA, 20 nt, Homo sapiens
uaugucacccaaugcauauc

SEQ ID NO: 1400641 - RNA, 20 nt, Homo sapiens
uaugucaucucagugcugua

SEQ ID NO: 1400642 - RNA, 23 nt, Homo sapiens
uauguccauaucuaaccagugau

SEQ ID NO: 1400643 - RNA, 13 nt, Homo sapiens
uaugucugcugaa

SEQ ID NO: 1400644 - RNA, 14 nt, Homo sapiens
uauguggcuguauc

SEQ ID NO: 1400645 - RNA, 17 nt, Homo sapiens
uauguugcccagugugu

SEQ ID NO: 1400646 - RNA, 18 nt, Homo sapiens
uauguuuacacugucaaa

SEQ ID NO: 1400647 - RNA, 20 nt, Homo sapiens
uauuaacagcugauacaggu

SEQ ID NO: 1400648 - RNA, 21 nt, Homo sapiens
uauuaucuucaggacacucac

SEQ ID NO: 1400649 - RNA, 16 nt, Homo sapiens
uauuaugcaaauuccc

SEQ ID NO: 1400650 - RNA, 13 nt, Homo sapiens
uauuauuguggaa

SEQ ID NO: 1400651 - RNA, 21 nt, Homo sapiens
uauucaagaaagccagucuua

SEQ ID NO: 1400652 - RNA, 19 nt, Homo sapiens
uauucaagguaaaauucua

SEQ ID NO: 1400653 - RNA, 13 nt, Homo sapiens
uauucaauggaaa

SEQ ID NO: 1400654 - RNA, 19 nt, Homo sapiens
uauucaauggaaagcugcu

SEQ ID NO: 1400655 - RNA, 20 nt, Homo sapiens
uauucaauggaaagcugcuu

SEQ ID NO: 1400656 - RNA, 22 nt, Homo sapiens
uauucagaaaagaugugcagau

SEQ ID NO: 1400657 - RNA, 22 nt, Homo sapiens
uauucaguugguaagcuuccag

SEQ ID NO: 1400658 - RNA, 22 nt, Homo sapiens
uauuccauggcuaacuggcgag

SEQ ID NO: 1400659 - RNA, 18 nt, Homo sapiens
uauucccauuagaccaag

SEQ ID NO: 1400660 - RNA, 23 nt, Homo sapiens
uauuccugauagagguauggaaa

SEQ ID NO: 1400661 - RNA, 13 nt, Homo sapiens
uauucgugcagca

SEQ ID NO: 1400662 - RNA, 13 nt, Homo sapiens
uauucucuccuca

SEQ ID NO: 1400663 - RNA, 14 nt, Homo sapiens
uauucucuuuggug

SEQ ID NO: 1400664 - RNA, 20 nt, Homo sapiens
uauucuuggagaauaucaaa

SEQ ID NO: 1400665 - RNA, 16 nt, Homo sapiens
uauucuuuaaauuuca

SEQ ID NO: 1400666 - RNA, 11 nt, Homo sapiens
uauugcugcuc

SEQ ID NO: 1400667 - RNA, 22 nt, Homo sapiens
uauugguccagcuugcucuuca

SEQ ID NO: 1400668 - RNA, 13 nt, Homo sapiens
uauugugcauaga

SEQ ID NO: 1400669 - RNA, 17 nt, Homo sapiens
uauuguuccaagacauu

SEQ ID NO: 1400670 - RNA, 23 nt, Homo sapiens
uauuuaaaauuuauugcuugaua

SEQ ID NO: 1400671 - RNA, 18 nt, Homo sapiens
uauuuaaagacaaagaca

SEQ ID NO: 1400672 - RNA, 20 nt, Homo sapiens
uauuuaaauguaaagacaaa

SEQ ID NO: 1400673 - RNA, 15 nt, Homo sapiens
uauuuaaguauucaa

SEQ ID NO: 1400674 - RNA, 17 nt, Homo sapiens
uauuuaccagaccacaa

SEQ ID NO: 1400675 - RNA, 21 nt, Homo sapiens
uauuuacugagcuucucugug

SEQ ID NO: 1400676 - RNA, 18 nt, Homo sapiens
uauuuauaagagugccgu

SEQ ID NO: 1400677 - RNA, 21 nt, Homo sapiens
uauuuauauauuuauaacuca

SEQ ID NO: 1400678 - RNA, 16 nt, Homo sapiens
uauuuaucugugcaaa

SEQ ID NO: 1400679 - RNA, 21 nt, Homo sapiens
uauuuccacuuauaaaggaaa

SEQ ID NO: 1400680 - RNA, 18 nt, Homo sapiens
uauuucuggaauggaaaa

SEQ ID NO: 1400681 - RNA, 21 nt, Homo sapiens
uauuugaagcaucacauaaaa

SEQ ID NO: 1400682 - RNA, 13 nt, Homo sapiens
uauuugcacuaug

SEQ ID NO: 1400683 - RNA, 13 nt, Homo sapiens
uauuugguacugu

SEQ ID NO: 1400684 - RNA, 20 nt, Homo sapiens
uauuuuaauuuaaucuucca

SEQ ID NO: 1400685 - RNA, 17 nt, Homo sapiens
uauuuuauagagcagaa

SEQ ID NO: 1400686 - RNA, 19 nt, Homo sapiens
uauuuuccccuagcuuucc

SEQ ID NO: 1400687 - RNA, 15 nt, Homo sapiens
uauuuucuccugaua

SEQ ID NO: 1400688 - RNA, 13 nt, Homo sapiens
uauuuucuguuga

SEQ ID NO: 1400689 - RNA, 16 nt, Homo sapiens
uauuuugcuuccacau

SEQ ID NO: 1400690 - RNA, 17 nt, Homo sapiens
uauuuuuuaaguauuua

SEQ ID NO: 1400691 - RNA, 17 nt, Homo sapiens
ucaaaaaaucugaccaa

SEQ ID NO: 1400692 - RNA, 14 nt, Homo sapiens
ucaaaaacagcaga

SEQ ID NO: 1400693 - RNA, 13 nt, Homo sapiens
ucaaaacacuugu

SEQ ID NO: 1400694 - RNA, 17 nt, Homo sapiens
ucaaaacagagauguga

SEQ ID NO: 1400695 - RNA, 18 nt, Homo sapiens
ucaaaacccaacaugacu

SEQ ID NO: 1400696 - RNA, 18 nt, Homo sapiens
ucagccuagccgaccuca

SEQ ID NO: 1400697 - RNA, 20 nt, Homo sapiens
ucagccuagccgaccucagc

SEQ ID NO: 1400698 - RNA, 20 nt, Homo sapiens
ucagccucuuaaagcugccu

SEQ ID NO: 1400699 - RNA, 18 nt, Homo sapiens
ucagcucuggcucacaga

SEQ ID NO: 1400700 - RNA, 14 nt, Homo sapiens
ucagcuggaucucc

SEQ ID NO: 1400701 - RNA, 15 nt, Homo sapiens
ucagcuggaucucca

SEQ ID NO: 1400702 - RNA, 18 nt, Homo sapiens
ucagcuggaucuccauuc

SEQ ID NO: 1400703 - RNA, 21 nt, Homo sapiens
ucagcuggcacugucucugcu

SEQ ID NO: 1400704 - RNA, 22 nt, Homo sapiens
ucagcuggcacugucucugcug

SEQ ID NO: 1400705 - RNA, 21 nt, Homo sapiens
ucagcuuauaaaaucaaacag

SEQ ID NO: 1400706 - RNA, 21 nt, Homo sapiens
ucaggacacuaauacaccagg

SEQ ID NO: 1400707 - RNA, 23 nt, Homo sapiens
ucaggagaggggcagaacagccg

SEQ ID NO: 1400708 - RNA, 18 nt, Homo sapiens
ucaggaguucgagaccag

SEQ ID NO: 1400709 - RNA, 20 nt, Homo sapiens
ucaggaugauacacuaugaa

SEQ ID NO: 1400710 - RNA, 18 nt, Homo sapiens
ucaggcaaagugcugcug

SEQ ID NO: 1400711 - RNA, 16 nt, Homo sapiens
ucagggagugggcuaa

SEQ ID NO: 1400712 - RNA, 16 nt, Homo sapiens
ucagggauagcacuga

SEQ ID NO: 1400713 - RNA, 18 nt, Homo sapiens
ucagggcagccugccugg

SEQ ID NO: 1400714 - RNA, 22 nt, Homo sapiens
ucaggugucccugcacuugcag

SEQ ID NO: 1400715 - RNA, 20 nt, Homo sapiens
ucaguaauaaaacaucuuuc

SEQ ID NO: 1400716 - RNA, 20 nt, Homo sapiens
ucagucccuaaaaacacaga

SEQ ID NO: 1400717 - RNA, 14 nt, Homo sapiens
ucaguccucuuuca

SEQ ID NO: 1400718 - RNA, 22 nt, Homo sapiens
ucagucugaugagaacucugag

SEQ ID NO: 1400719 - RNA, 15 nt, Homo sapiens
ucagugaaagccaga

SEQ ID NO: 1400720 - RNA, 14 nt, Homo sapiens
ucagugaauugugu

SEQ ID NO: 1400721 - RNA, 19 nt, Homo sapiens
ucagugcaaagauuugcuu

SEQ ID NO: 1400722 - RNA, 21 nt, Homo sapiens
ucagugcuucgcagauguccu

SEQ ID NO: 1400723 - RNA, 14 nt, Homo sapiens
ucaguguacaugga

SEQ ID NO: 1400724 - RNA, 13 nt, Homo sapiens
ucaguuggugcug

SEQ ID NO: 1400725 - RNA, 17 nt, Homo sapiens
ucaguuucccuaucucg

SEQ ID NO: 1400726 - RNA, 23 nt, Homo sapiens
ucauaaagucuuugaagugacuu

SEQ ID NO: 1400727 - RNA, 20 nt, Homo sapiens
ucauaauucuaaucuaacaa

SEQ ID NO: 1400728 - RNA, 15 nt, Homo sapiens
ucauacuacauacaa

SEQ ID NO: 1400729 - RNA, 14 nt, Homo sapiens
ucauagcugagauu

SEQ ID NO: 1400730 - RNA, 15 nt, Homo sapiens
ucauagcugagauuc

SEQ ID NO: 1400731 - RNA, 22 nt, Homo sapiens
ucauagggaggccuuuagcuua

SEQ ID NO: 1400732 - RNA, 22 nt, Homo sapiens
ucauaguggcuuaaaacaacac

SEQ ID NO: 1400733 - RNA, 16 nt, Homo sapiens
ucauauaccagcaaua

SEQ ID NO: 1400734 - RNA, 21 nt, Homo sapiens
ucauaugauugugcacauacu

SEQ ID NO: 1400735 - RNA, 22 nt, Homo sapiens
ucauaugauugugcacauacuu

SEQ ID NO: 1400736 - RNA, 22 nt, Homo sapiens
ucauauuggacugauaaucucu

SEQ ID NO: 1400737 - RNA, 20 nt, Homo sapiens
ucaucaccuguuaucugugu

SEQ ID NO: 1400738 - RNA, 13 nt, Homo sapiens
ucaucauuuccau

SEQ ID NO: 1400739 - RNA, 15 nt, Homo sapiens
ucaucccauugucuu

SEQ ID NO: 1400740 - RNA, 19 nt, Homo sapiens
ucauccccaggggucccag

SEQ ID NO: 1400741 - RNA, 15 nt, Homo sapiens
ucaucccuaugggau

SEQ ID NO: 1400742 - RNA, 17 nt, Homo sapiens
ucaucuauaacaugcau

SEQ ID NO: 1400743 - RNA, 13 nt, Homo sapiens
ucaucucagugcu

SEQ ID NO: 1400744 - RNA, 13 nt, Homo sapiens
ucaucucuacuaa

SEQ ID NO: 1400745 - RNA, 13 nt, Homo sapiens
ucaucuguagaua

SEQ ID NO: 1400746 - RNA, 20 nt, Homo sapiens
ucaucuugaccaagcaggaa

SEQ ID NO: 1400747 - RNA, 18 nt, Homo sapiens
ucaucuuggucacauaca

SEQ ID NO: 1400748 - RNA, 19 nt, Homo sapiens
ucaucuuggucacauacaa

SEQ ID NO: 1400749 - RNA, 15 nt, Homo sapiens
ucaugaaauaugcau

SEQ ID NO: 1400750 - RNA, 17 nt, Homo sapiens
ucaugaagcccaaguga

SEQ ID NO: 1400751 - RNA, 15 nt, Homo sapiens
ucauggguuaugugu

SEQ ID NO: 1400752 - RNA, 18 nt, Homo sapiens
ucaugguggguucagggg

SEQ ID NO: 1400753 - RNA, 21 nt, Homo sapiens
ucauguaaauaaauacauucu

SEQ ID NO: 1400754 - RNA, 22 nt, Homo sapiens
ucauguaagucuauaugacuuc

SEQ ID NO: 1400755 - RNA, 15 nt, Homo sapiens
ucauguucuagucug

SEQ ID NO: 1400756 - RNA, 17 nt, Homo sapiens
ucauuagcauuuugcua

SEQ ID NO: 1400757 - RNA, 13 nt, Homo sapiens
ucauuauuggaau

SEQ ID NO: 1400758 - RNA, 17 nt, Homo sapiens
ucauuauuggaauuaac

SEQ ID NO: 1400759 - RNA, 23 nt, Homo sapiens
ucauucaagucagcucuucucca

SEQ ID NO: 1400760 - RNA, 12 nt, Homo sapiens
ucauucagggau

SEQ ID NO: 1400761 - RNA, 22 nt, Homo sapiens
ucauuccaccauggcuaaggca

SEQ ID NO: 1400762 - RNA, 16 nt, Homo sapiens
ucauuccaccuuccca

SEQ ID NO: 1400763 - RNA, 17 nt, Homo sapiens
ucauuccaccuucccau

SEQ ID NO: 1400764 - RNA, 21 nt, Homo sapiens
ucauuccugaaagaaacaguu

SEQ ID NO: 1400765 - RNA, 21 nt, Homo sapiens
ucauucuacugaacaguccau

SEQ ID NO: 1400766 - RNA, 14 nt, Homo sapiens
ucauugacugaugg

SEQ ID NO: 1400767 - RNA, 14 nt, Homo sapiens
ucauugauugaaua

SEQ ID NO: 1400768 - RNA, 18 nt, Homo sapiens
ucauuguaaacauuaguu

SEQ ID NO: 1400769 - RNA, 14 nt, Homo sapiens
ucauuguguucucu

SEQ ID NO: 1400770 - RNA, 20 nt, Homo sapiens
ucauuguuuauuaacaaauu

SEQ ID NO: 1400771 - RNA, 13 nt, Homo sapiens
ucauuuaaacuuc

SEQ ID NO: 1400772 - RNA, 21 nt, Homo sapiens
ucauuuauuauuucaauguga

SEQ ID NO: 1400773 - RNA, 15 nt, Homo sapiens
ucauuuauugagcac

SEQ ID NO: 1400774 - RNA, 14 nt, Homo sapiens
ucauuucaaaggga

SEQ ID NO: 1400775 - RNA, 13 nt, Homo sapiens
ucauuugaacaac

SEQ ID NO: 1400776 - RNA, 13 nt, Homo sapiens
uccaaaugccaac

SEQ ID NO: 1400777 - RNA, 13 nt, Homo sapiens
uccaaauucacaa

SEQ ID NO: 1400778 - RNA, 16 nt, Homo sapiens
uccaacaugugcucag

SEQ ID NO: 1400779 - RNA, 23 nt, Homo sapiens
uccaacguggcccagagaagcca

SEQ ID NO: 1400780 - RNA, 17 nt, Homo sapiens
uccaaggguacuaagga

SEQ ID NO: 1400781 - RNA, 14 nt, Homo sapiens
uccaauaaauguga

SEQ ID NO: 1400782 - RNA, 20 nt, Homo sapiens
uccaauauucgcugugucag

SEQ ID NO: 1400783 - RNA, 14 nt, Homo sapiens
uccacagaaauaca

SEQ ID NO: 1400784 - RNA, 18 nt, Homo sapiens
uccacagaacuagccuua

SEQ ID NO: 1400785 - RNA, 22 nt, Homo sapiens
uccacaggucucagaaucuuuc

SEQ ID NO: 1400786 - RNA, 17 nt, Homo sapiens
uccaccagccugcacua

SEQ ID NO: 1400787 - RNA, 13 nt, Homo sapiens
uccaccugucuca

SEQ ID NO: 1400788 - RNA, 24 nt, Homo sapiens
uccaccuuaaauuaaacaauuuau

SEQ ID NO: 1400789 - RNA, 22 nt, Homo sapiens
uccaccuuuaaacacggggcuu

SEQ ID NO: 1400790 - RNA, 17 nt, Homo sapiens
uccacgucaacagaauu

SEQ ID NO: 1400791 - RNA, 21 nt, Homo sapiens
uccacuccagauuuuuuacag

SEQ ID NO: 1400792 - RNA, 17 nt, Homo sapiens
uccacucuacccuccca

SEQ ID NO: 1400793 - RNA, 23 nt, Homo sapiens
uccacugauggaaacaaagugga

SEQ ID NO: 1400794 - RNA, 21 nt, Homo sapiens
uccacuuaccuagauucuaca

SEQ ID NO: 1400795 - RNA, 22 nt, Homo sapiens
uccacuuaccuagauucuacau

SEQ ID NO: 1400796 - RNA, 16 nt, Homo sapiens
uccagaaggcaaaaag

SEQ ID NO: 1400797 - RNA, 24 nt, Homo sapiens
uccagacaaaccagaagcaacaga

SEQ ID NO: 1400798 - RNA, 14 nt, Homo sapiens
uccagacccggcug

SEQ ID NO: 1400799 - RNA, 15 nt, Homo sapiens
uccagagaguggcuc

SEQ ID NO: 1400800 - RNA, 19 nt, Homo sapiens
uccagcaucuaguggugga

SEQ ID NO: 1400801 - RNA, 16 nt, Homo sapiens
uccagcgguucucaaa

SEQ ID NO: 1400802 - RNA, 15 nt, Homo sapiens
uccagcucaccagcc

SEQ ID NO: 1400803 - RNA, 18 nt, Homo sapiens
uccagcuuaguucaaguc

SEQ ID NO: 1400804 - RNA, 23 nt, Homo sapiens
uccaggcaaaauugauauacuuu

SEQ ID NO: 1400805 - RNA, 14 nt, Homo sapiens
uccaggccccaaaa

SEQ ID NO: 1400806 - RNA, 17 nt, Homo sapiens
uccaggcgaugugcaag

SEQ ID NO: 1400807 - RNA, 21 nt, Homo sapiens
uccagguuuccuuaagggaca

SEQ ID NO: 1400808 - RNA, 16 nt, Homo sapiens
agagagggcuuucuca

SEQ ID NO: 1400809 - RNA, 16 nt, Homo sapiens
agagagucgcaucuca

SEQ ID NO: 1400810 - RNA, 13 nt, Homo sapiens
agagaguggcucc

SEQ ID NO: 1400811 - RNA, 21 nt, Homo sapiens
agagaguuaaucaacugaaag

SEQ ID NO: 1400812 - RNA, 19 nt, Homo sapiens
agagaucacaauacucaaa

SEQ ID NO: 1400813 - RNA, 16 nt, Homo sapiens
agagaugggacuggga

SEQ ID NO: 1400814 - RNA, 22 nt, Homo sapiens
agagauuccugagccaguguca

SEQ ID NO: 1400815 - RNA, 20 nt, Homo sapiens
agagcacacuuaugggccaa

SEQ ID NO: 1400816 - RNA, 18 nt, Homo sapiens
agagcagaacccuagucu

SEQ ID NO: 1400817 - RNA, 14 nt, Homo sapiens
agagcaguguggaa

SEQ ID NO: 1400818 - RNA, 16 nt, Homo sapiens
agagcaguguggaaaa

SEQ ID NO: 1400819 - RNA, 22 nt, Homo sapiens
agagccauggacucuacacugu

SEQ ID NO: 1400820 - RNA, 18 nt, Homo sapiens
agagccccacccucagau

SEQ ID NO: 1400821 - RNA, 17 nt, Homo sapiens
agagccuggugcugcug

SEQ ID NO: 1400822 - RNA, 19 nt, Homo sapiens
agagcgagacuccgucuca

SEQ ID NO: 1400823 - RNA, 21 nt, Homo sapiens
agagcuagaugugucuuacca

SEQ ID NO: 1400824 - RNA, 17 nt, Homo sapiens
agagcuuuuuuacauaa

SEQ ID NO: 1400825 - RNA, 18 nt, Homo sapiens
agaggcaugugccaucau

SEQ ID NO: 1400826 - RNA, 15 nt, Homo sapiens
agaggcuguucccac

SEQ ID NO: 1400827 - RNA, 17 nt, Homo sapiens
agagggcuuucucagga

SEQ ID NO: 1400828 - RNA, 20 nt, Homo sapiens
agaggggaaaccaguguagc

SEQ ID NO: 1400829 - RNA, 16 nt, Homo sapiens
agaguaaaaacugaau

SEQ ID NO: 1400830 - RNA, 20 nt, Homo sapiens
agaguaagacucugucucaa

SEQ ID NO: 1400831 - RNA, 16 nt, Homo sapiens
agaguauaugcacuuu

SEQ ID NO: 1400832 - RNA, 22 nt, Homo sapiens
agaguaucugaggcacauguca

SEQ ID NO: 1400833 - RNA, 20 nt, Homo sapiens
agagucaaugaacuuuccac

SEQ ID NO: 1400834 - RNA, 17 nt, Homo sapiens
agagucaucuaccugag

SEQ ID NO: 1400835 - RNA, 21 nt, Homo sapiens
agagugcccagaacuggacuc

SEQ ID NO: 1400836 - RNA, 16 nt, Homo sapiens
agaguggguacuagaa

SEQ ID NO: 1400837 - RNA, 23 nt, Homo sapiens
agauaacaagaucuuucaggaaa

SEQ ID NO: 1400838 - RNA, 14 nt, Homo sapiens
agauaauguugcuu

SEQ ID NO: 1400839 - RNA, 17 nt, Homo sapiens
agauaauuauaauauac

SEQ ID NO: 1400840 - RNA, 17 nt, Homo sapiens
agauaauucuagcuuug

SEQ ID NO: 1400841 - RNA, 18 nt, Homo sapiens
agauacaggacauucuca

SEQ ID NO: 1400842 - RNA, 16 nt, Homo sapiens
agauagauauaugcuc

SEQ ID NO: 1400843 - RNA, 16 nt, Homo sapiens
agauagcauuggggac

SEQ ID NO: 1400844 - RNA, 22 nt, Homo sapiens
agauagcauuggggacauggga

SEQ ID NO: 1400845 - RNA, 20 nt, Homo sapiens
agauaguacauaaagguggu

SEQ ID NO: 1400846 - RNA, 17 nt, Homo sapiens
agauauacugggagaaa

SEQ ID NO: 1400847 - RNA, 15 nt, Homo sapiens
agauaugaugucccu

SEQ ID NO: 1400848 - RNA, 18 nt, Homo sapiens
agauauuaaaugauguuu

SEQ ID NO: 1400849 - RNA, 16 nt, Homo sapiens
agaucacgagaucaag

SEQ ID NO: 1400850 - RNA, 18 nt, Homo sapiens
agaucacgccacugcacu

SEQ ID NO: 1400851 - RNA, 14 nt, Homo sapiens
caacagacaaguga

SEQ ID NO: 1400852 - RNA, 14 nt, Homo sapiens
caacagcacccucu

SEQ ID NO: 1400853 - RNA, 11 nt, Homo sapiens
caacagcacuu

SEQ ID NO: 1400854 - RNA, 20 nt, Homo sapiens
caacaggagcugggauccua

SEQ ID NO: 1400855 - RNA, 15 nt, Homo sapiens
caacaucuugcaaaa

SEQ ID NO: 1400856 - RNA, 18 nt, Homo sapiens
caacaugugcucagggaa

SEQ ID NO: 1400857 - RNA, 17 nt, Homo sapiens
caacauuaaacacaaag

SEQ ID NO: 1400858 - RNA, 18 nt, Homo sapiens
caaccaagucaugugcau

SEQ ID NO: 1400859 - RNA, 20 nt, Homo sapiens
caacccaauaguuguugauu

SEQ ID NO: 1400860 - RNA, 13 nt, Homo sapiens
caacccacaccaa

SEQ ID NO: 1400861 - RNA, 15 nt, Homo sapiens
caacccuuugcccca

SEQ ID NO: 1400862 - RNA, 18 nt, Homo sapiens
caaccggucacccaggag

SEQ ID NO: 1400863 - RNA, 14 nt, Homo sapiens
caaccugaagacac

SEQ ID NO: 1400864 - RNA, 20 nt, Homo sapiens
caaccugcucuccucuugcc

SEQ ID NO: 1400865 - RNA, 14 nt, Homo sapiens
caacgaaaagcaca

SEQ ID NO: 1400866 - RNA, 15 nt, Homo sapiens
caacgaaaagcacau

SEQ ID NO: 1400867 - RNA, 16 nt, Homo sapiens
caacguggcccagaga

SEQ ID NO: 1400868 - RNA, 14 nt, Homo sapiens
caacuacuacuuga

SEQ ID NO: 1400869 - RNA, 20 nt, Homo sapiens
caacuauauuaucaugcaaa

SEQ ID NO: 1400870 - RNA, 20 nt, Homo sapiens
caacugaaaagacucagugu

SEQ ID NO: 1400871 - RNA, 10 nt, Homo sapiens
caacugacca

SEQ ID NO: 1400872 - RNA, 13 nt, Homo sapiens
caacugaccaguu

SEQ ID NO: 1400873 - RNA, 19 nt, Homo sapiens
caacugccauguuuugcca

SEQ ID NO: 1400874 - RNA, 22 nt, Homo sapiens
caacugcuguucauguuacuca

SEQ ID NO: 1400875 - RNA, 22 nt, Homo sapiens
caacuggugauuguuucagaga

SEQ ID NO: 1400876 - RNA, 21 nt, Homo sapiens
caacuuaagcugggauaauca

SEQ ID NO: 1400877 - RNA, 13 nt, Homo sapiens
caacuuagcucac

SEQ ID NO: 1400878 - RNA, 22 nt, Homo sapiens
caacuuccaaauuggauacugc

SEQ ID NO: 1400879 - RNA, 20 nt, Homo sapiens
caacuugaauaauacaccag

SEQ ID NO: 1400880 - RNA, 19 nt, Homo sapiens
caacuugagcauguuacug

SEQ ID NO: 1400881 - RNA, 20 nt, Homo sapiens
caacuugggaacuagacucc

SEQ ID NO: 1400882 - RNA, 12 nt, Homo sapiens
caacuuugacaa

SEQ ID NO: 1400883 - RNA, 18 nt, Homo sapiens
caagaacugcauggaccu

SEQ ID NO: 1400884 - RNA, 23 nt, Homo sapiens
caagaauagaugcugacuguacu

SEQ ID NO: 1400885 - RNA, 16 nt, Homo sapiens
caagaaucagugcaaa

SEQ ID NO: 1400886 - RNA, 16 nt, Homo sapiens
caagaccucugugcac

SEQ ID NO: 1400887 - RNA, 22 nt, Homo sapiens
caagaccuucuccccauucugc

SEQ ID NO: 1400888 - RNA, 23 nt, Homo sapiens
acuuuuaaguugcugaugaacuc

SEQ ID NO: 1400889 - RNA, 19 nt, Homo sapiens
acuuuucuuauaaugcaau

SEQ ID NO: 1400890 - RNA, 20 nt, Homo sapiens
acuuuugugcuccccuuugc

SEQ ID NO: 1400891 - RNA, 19 nt, Homo sapiens
acuuuuuaaaauaauaaca

SEQ ID NO: 1400892 - RNA, 18 nt, Homo sapiens
acuuuuuacagugcuauu

SEQ ID NO: 1400893 - RNA, 11 nt, Homo sapiens
acuuuuuccag

SEQ ID NO: 1400894 - RNA, 13 nt, Homo sapiens
agaaaaauuaauu

SEQ ID NO: 1400895 - RNA, 15 nt, Homo sapiens
agaaaagaacuggaa

SEQ ID NO: 1400896 - RNA, 19 nt, Homo sapiens
agaaaaguagguuuacauu

SEQ ID NO: 1400897 - RNA, 16 nt, Homo sapiens
agaaaagugggccagu

SEQ ID NO: 1400898 - RNA, 16 nt, Homo sapiens
agaaaaugauugcuua

SEQ ID NO: 1400899 - RNA, 23 nt, Homo sapiens
agaaacaaccguuggaaacauaa

SEQ ID NO: 1400900 - RNA, 21 nt, Homo sapiens
agaaacacuaaagcauucaau

SEQ ID NO: 1400901 - RNA, 21 nt, Homo sapiens
agaaacacugacuccugugga

SEQ ID NO: 1400902 - RNA, 21 nt, Homo sapiens
agaaacuuaucuuacaaagug

SEQ ID NO: 1400903 - RNA, 16 nt, Homo sapiens
agaaacuuugugcuac

SEQ ID NO: 1400904 - RNA, 15 nt, Homo sapiens
agaaagagucaggcc

SEQ ID NO: 1400905 - RNA, 14 nt, Homo sapiens
agaaagaguucagu

SEQ ID NO: 1400906 - RNA, 14 nt, Homo sapiens
agaaagcaaacuua

SEQ ID NO: 1400907 - RNA, 19 nt, Homo sapiens
agaaagcagaggcuggccu

SEQ ID NO: 1400908 - RNA, 16 nt, Homo sapiens
agaaagccagucuuaa

SEQ ID NO: 1400909 - RNA, 12 nt, Homo sapiens
agaaagccucag

SEQ ID NO: 1400910 - RNA, 15 nt, Homo sapiens
agaaagcucaucuca

SEQ ID NO: 1400911 - RNA, 17 nt, Homo sapiens
agaaagcuuugaauacu

SEQ ID NO: 1400912 - RNA, 15 nt, Homo sapiens
agaaauaaacuuugg

SEQ ID NO: 1400913 - RNA, 17 nt, Homo sapiens
agaaauaaagcaucuca

SEQ ID NO: 1400914 - RNA, 18 nt, Homo sapiens
agaaauacaagauacuuu

SEQ ID NO: 1400915 - RNA, 19 nt, Homo sapiens
agaaauaucugaaaaugua

SEQ ID NO: 1400916 - RNA, 19 nt, Homo sapiens
agaaaucauguuaugauaa

SEQ ID NO: 1400917 - RNA, 19 nt, Homo sapiens
agaaaucuagaagacuguc

SEQ ID NO: 1400918 - RNA, 16 nt, Homo sapiens
agaacacaaggucauu

SEQ ID NO: 1400919 - RNA, 12 nt, Homo sapiens
agaacagccgcu

SEQ ID NO: 1400920 - RNA, 19 nt, Homo sapiens
agaaccaugguaugaaggu

SEQ ID NO: 1400921 - RNA, 13 nt, Homo sapiens
agaaccucuuccc

SEQ ID NO: 1400922 - RNA, 20 nt, Homo sapiens
agaaccuggacauuggccag

SEQ ID NO: 1400923 - RNA, 22 nt, Homo sapiens
agaacuagagguuuuaugauau

SEQ ID NO: 1400924 - RNA, 12 nt, Homo sapiens
agaacuauccaa

SEQ ID NO: 1400925 - RNA, 16 nt, Homo sapiens
agaacuauguacuuua

SEQ ID NO: 1400926 - RNA, 12 nt, Homo sapiens
agaacugaugac

SEQ ID NO: 1400927 - RNA, 16 nt, Homo sapiens
agaacuggacucagga

SEQ ID NO: 1400928 - RNA, 22 nt, Homo sapiens
agaacuggaggaguuccuugau

SEQ ID NO: 1400929 - RNA, 21 nt, Homo sapiens
agaagaaguuugaccaucacc

SEQ ID NO: 1400930 - RNA, 13 nt, Homo sapiens
agaagaugaauga

SEQ ID NO: 1400931 - RNA, 12 nt, Homo sapiens
cugaccaagaga

SEQ ID NO: 1400932 - RNA, 15 nt, Homo sapiens
cugaccucacuguga

SEQ ID NO: 1400933 - RNA, 21 nt, Homo sapiens
cugaccuccuuacauaugcaa

SEQ ID NO: 1400934 - RNA, 17 nt, Homo sapiens
cugaccucgugauccac

SEQ ID NO: 1400935 - RNA, 23 nt, Homo sapiens
cugaccucgugauccaccugccu

SEQ ID NO: 1400936 - RNA, 22 nt, Homo sapiens
cugagaacagaucuccaaagcu

SEQ ID NO: 1400937 - RNA, 20 nt, Homo sapiens
cugagaagucaaacauuuca

SEQ ID NO: 1400938 - RNA, 15 nt, Homo sapiens
cugagagaaccucac

SEQ ID NO: 1400939 - RNA, 14 nt, Homo sapiens
cugagagacaggac

SEQ ID NO: 1400940 - RNA, 18 nt, Homo sapiens
cugagcaaacaaaaccac

SEQ ID NO: 1400941 - RNA, 22 nt, Homo sapiens
cugagcaaagcauugagcaaag

SEQ ID NO: 1400942 - RNA, 21 nt, Homo sapiens
cugagccaaagagaaugccau

SEQ ID NO: 1400943 - RNA, 23 nt, Homo sapiens
cugagccaaagagaaugccauuc

SEQ ID NO: 1400944 - RNA, 13 nt, Homo sapiens
cugagcucaaggu

SEQ ID NO: 1400945 - RNA, 17 nt, Homo sapiens
cugagcucgguggaccc

SEQ ID NO: 1400946 - RNA, 14 nt, Homo sapiens
cugaggcaagagaa

SEQ ID NO: 1400947 - RNA, 14 nt, Homo sapiens
cugaggcagggaag

SEQ ID NO: 1400948 - RNA, 16 nt, Homo sapiens
cugaggucucuugagg

SEQ ID NO: 1400949 - RNA, 12 nt, Homo sapiens
cugaggugggag

SEQ ID NO: 1400950 - RNA, 18 nt, Homo sapiens
cugaguaguugggauuac

SEQ ID NO: 1400951 - RNA, 15 nt, Homo sapiens
cugagucccaaagcu

SEQ ID NO: 1400952 - RNA, 13 nt, Homo sapiens
cugagugagcuga

SEQ ID NO: 1400953 - RNA, 12 nt, Homo sapiens
cugauaccucaa

SEQ ID NO: 1400954 - RNA, 21 nt, Homo sapiens
cugaucagucuaagaugggug

SEQ ID NO: 1400955 - RNA, 21 nt, Homo sapiens
cugaucauccacugugccaug

SEQ ID NO: 1400956 - RNA, 20 nt, Homo sapiens
cugaucgugcuaaauuuuca

SEQ ID NO: 1400957 - RNA, 13 nt, Homo sapiens
cugaucugaugca

SEQ ID NO: 1400958 - RNA, 19 nt, Homo sapiens
cugaucuuauucuguggug

SEQ ID NO: 1400959 - RNA, 14 nt, Homo sapiens
cugaugcagaaaga

SEQ ID NO: 1400960 - RNA, 19 nt, Homo sapiens
cugaugcagaaagaccgug

SEQ ID NO: 1400961 - RNA, 16 nt, Homo sapiens
cugaugcuuuggugug

SEQ ID NO: 1400962 - RNA, 16 nt, Homo sapiens
cugauggaaacaaagu

SEQ ID NO: 1400963 - RNA, 17 nt, Homo sapiens
cugauggaaacaaagug

SEQ ID NO: 1400964 - RNA, 19 nt, Homo sapiens
cugauggagcucagaauuc

SEQ ID NO: 1400965 - RNA, 21 nt, Homo sapiens
cugauggauaucccuaccuug

SEQ ID NO: 1400966 - RNA, 20 nt, Homo sapiens
cugauuagaaaugaccaaua

SEQ ID NO: 1400967 - RNA, 18 nt, Homo sapiens
cugauuauuuaucacaua

SEQ ID NO: 1400968 - RNA, 13 nt, Homo sapiens
cugauucauaaua

SEQ ID NO: 1400969 - RNA, 20 nt, Homo sapiens
cugauucauaauaaauaucu

SEQ ID NO: 1400970 - RNA, 19 nt, Homo sapiens
cugauucccaagcucugcu

SEQ ID NO: 1400971 - RNA, 19 nt, Homo sapiens
cugauugcgcaaaacugaa

SEQ ID NO: 1400972 - RNA, 20 nt, Homo sapiens
cugauugcgcaaaacugaaa

SEQ ID NO: 1400973 - RNA, 14 nt, Homo sapiens
cugauuuuacacac

SEQ ID NO: 1400974 - RNA, 22 nt, Homo sapiens
cugcaaaggcaccugaaugugu

SEQ ID NO: 1400975 - RNA, 19 nt, Homo sapiens
cugcaaaggcgcagugcuu

SEQ ID NO: 1400976 - RNA, 13 nt, Homo sapiens
cugcaagcacugc

SEQ ID NO: 1400977 - RNA, 21 nt, Homo sapiens
cugcacagauggauuugccug

SEQ ID NO: 1400978 - RNA, 18 nt, Homo sapiens
cugcacagugcaucucag

SEQ ID NO: 1400979 - RNA, 16 nt, Homo sapiens
cugcacccacccagga

SEQ ID NO: 1400980 - RNA, 23 nt, Homo sapiens
cugcacuauagccuaggugacag

SEQ ID NO: 1400981 - RNA, 20 nt, Homo sapiens
cugcacuccagccugggcaa

SEQ ID NO: 1400982 - RNA, 18 nt, Homo sapiens
cugcagcagagccuggaa

SEQ ID NO: 1400983 - RNA, 21 nt, Homo sapiens
cugcagcuuuguuuguuguca

SEQ ID NO: 1400984 - RNA, 20 nt, Homo sapiens
cugcagucaucuugaccaag

SEQ ID NO: 1400985 - RNA, 17 nt, Homo sapiens
cugcaguuccaaaagag

SEQ ID NO: 1400986 - RNA, 15 nt, Homo sapiens
cugcauaguauucca

SEQ ID NO: 1400987 - RNA, 14 nt, Homo sapiens
cugcauugccugcg

SEQ ID NO: 1400988 - RNA, 18 nt, Homo sapiens
cugcauuuuacuguacag

SEQ ID NO: 1400989 - RNA, 21 nt, Homo sapiens
cugcauuuucugaaacuaaug

SEQ ID NO: 1400990 - RNA, 22 nt, Homo sapiens
cugcauuuucugaaacuaauga

SEQ ID NO: 1400991 - RNA, 15 nt, Homo sapiens
cugcauuuucugggu

SEQ ID NO: 1400992 - RNA, 22 nt, Homo sapiens
cugccacuaggcugggugccca

SEQ ID NO: 1400993 - RNA, 16 nt, Homo sapiens
cugccagccuggcuuc

SEQ ID NO: 1400994 - RNA, 12 nt, Homo sapiens
cugcccaaagca

SEQ ID NO: 1400995 - RNA, 17 nt, Homo sapiens
cugcccugcucccacag

SEQ ID NO: 1400996 - RNA, 21 nt, Homo sapiens
cugcccugggauguccacaga

SEQ ID NO: 1400997 - RNA, 23 nt, Homo sapiens
cugccuccagaauggucuuucua

SEQ ID NO: 1400998 - RNA, 12 nt, Homo sapiens
cugccuguaacu

SEQ ID NO: 1400999 - RNA, 12 nt, Homo sapiens
cugccuguggag

SEQ ID NO: 1401000 - RNA, 20 nt, Homo sapiens
cugccugugugggacugaga

SEQ ID NO: 1401001 - RNA, 17 nt, Homo sapiens
cugccuuuucaucuaau

SEQ ID NO: 1401002 - RNA, 18 nt, Homo sapiens
cugcgucucauacucacc

SEQ ID NO: 1401003 - RNA, 17 nt, Homo sapiens
cugcgugguugaugauc

SEQ ID NO: 1401004 - RNA, 12 nt, Homo sapiens
cugcuaccucac

SEQ ID NO: 1401005 - RNA, 13 nt, Homo sapiens
cugcuccacccuu

SEQ ID NO: 1401006 - RNA, 23 nt, Homo sapiens
cugcuccgugcuuguuugcucac

SEQ ID NO: 1401007 - RNA, 15 nt, Homo sapiens
cugcucuaagcacac

SEQ ID NO: 1401008 - RNA, 17 nt, Homo sapiens
cugcucugccuguggag

SEQ ID NO: 1401009 - RNA, 22 nt, Homo sapiens
cugcucugucuucuuugcccac

SEQ ID NO: 1401010 - RNA, 23 nt, Homo sapiens
cugcucuuugauucaaagcacug

SEQ ID NO: 1401011 - RNA, 11 nt, Homo sapiens
cugcugaauaa

SEQ ID NO: 1401012 - RNA, 13 nt, Homo sapiens
cugcugaccucca

SEQ ID NO: 1401013 - RNA, 14 nt, Homo sapiens
cugcugaccuccac

SEQ ID NO: 1401014 - RNA, 18 nt, Homo sapiens
cugcugaccuccacagcu

SEQ ID NO: 1401015 - RNA, 22 nt, Homo sapiens
cugcugaccucccagugacccc

SEQ ID NO: 1401016 - RNA, 15 nt, Homo sapiens
cugcugcugcuaauc

SEQ ID NO: 1401017 - RNA, 14 nt, Homo sapiens
cugcuggucuucaa

SEQ ID NO: 1401018 - RNA, 21 nt, Homo sapiens
cugcuguggcgugagggugag

SEQ ID NO: 1401019 - RNA, 19 nt, Homo sapiens
cugcuugccgaaacuggaa

SEQ ID NO: 1401020 - RNA, 20 nt, Homo sapiens
cugcuugccgaaacuggaag

SEQ ID NO: 1401021 - RNA, 17 nt, Homo sapiens
cugcuuuggaaaucaca

SEQ ID NO: 1401022 - RNA, 17 nt, Homo sapiens
cuggaaucacauucuua

SEQ ID NO: 1401023 - RNA, 13 nt, Homo sapiens
cuggaccaaagcu

SEQ ID NO: 1401024 - RNA, 20 nt, Homo sapiens
cuggaccagaugcugaaaga

SEQ ID NO: 1401025 - RNA, 19 nt, Homo sapiens
cuggacucaggaugcccag

SEQ ID NO: 1401026 - RNA, 14 nt, Homo sapiens
cuggacugugggac

SEQ ID NO: 1401027 - RNA, 22 nt, Homo sapiens
cuggagaagucuuagacuugaa

SEQ ID NO: 1401028 - RNA, 20 nt, Homo sapiens
cuggagcccauccagucucc

SEQ ID NO: 1401029 - RNA, 15 nt, Homo sapiens
cuggagcccgaggca

SEQ ID NO: 1401030 - RNA, 23 nt, Homo sapiens
cuggagcccgaggcaccaguguc

SEQ ID NO: 1401031 - RNA, 23 nt, Homo sapiens
cuggagcuggcgucugucuucaa

SEQ ID NO: 1401032 - RNA, 22 nt, Homo sapiens
cuggaggaaccgaaaggccaaa

SEQ ID NO: 1401033 - RNA, 20 nt, Homo sapiens
cuggagugcgguggugugau

SEQ ID NO: 1401034 - RNA, 13 nt, Homo sapiens
cuggaugaaguua

SEQ ID NO: 1401035 - RNA, 16 nt, Homo sapiens
cuggcagaaagcaaau

SEQ ID NO: 1401036 - RNA, 16 nt, Homo sapiens
cuggccccuagaauca

SEQ ID NO: 1401037 - RNA, 20 nt, Homo sapiens
cuggcugucaguaugacauu

SEQ ID NO: 1401038 - RNA, 16 nt, Homo sapiens
cugggaacucccaaga

SEQ ID NO: 1401039 - RNA, 17 nt, Homo sapiens
cugggaacucccaagaa

SEQ ID NO: 1401040 - RNA, 21 nt, Homo sapiens
cugggaacugugccuuugagu

SEQ ID NO: 1401041 - RNA, 18 nt, Homo sapiens
cugggaaggugaccacau

SEQ ID NO: 1401042 - RNA, 19 nt, Homo sapiens
cugggacuaaguguaccag

SEQ ID NO: 1401043 - RNA, 17 nt, Homo sapiens
cugggacuacaggugug

SEQ ID NO: 1401044 - RNA, 20 nt, Homo sapiens
ggagguggaggcugcaguga

SEQ ID NO: 1401045 - RNA, 19 nt, Homo sapiens
ggagguggagguugcagug

SEQ ID NO: 1401046 - RNA, 20 nt, Homo sapiens
ggagguugcagugagccaag

SEQ ID NO: 1401047 - RNA, 13 nt, Homo sapiens
ggagucaucucaa

SEQ ID NO: 1401048 - RNA, 14 nt, Homo sapiens
ggagucugucucug

SEQ ID NO: 1401049 - RNA, 17 nt, Homo sapiens
ggagugcccccaacagc

SEQ ID NO: 1401050 - RNA, 20 nt, Homo sapiens
ggauacugcccggggcagcu

SEQ ID NO: 1401051 - RNA, 18 nt, Homo sapiens
ggauaguccgucucugcu

SEQ ID NO: 1401052 - RNA, 14 nt, Homo sapiens
ggauaucaaaagca

SEQ ID NO: 1401053 - RNA, 15 nt, Homo sapiens
ggauauuuucuucca

SEQ ID NO: 1401054 - RNA, 15 nt, Homo sapiens
ggaucaagucacuca

SEQ ID NO: 1401055 - RNA, 20 nt, Homo sapiens
ggaucaucuauugcuggcaa

SEQ ID NO: 1401056 - RNA, 14 nt, Homo sapiens
ggaugaagugauau

SEQ ID NO: 1401057 - RNA, 13 nt, Homo sapiens
ggaugauguuucg

SEQ ID NO: 1401058 - RNA, 22 nt, Homo sapiens
ggaugccaaccggucacccagg

SEQ ID NO: 1401059 - RNA, 14 nt, Homo sapiens
ggauguccacagau

SEQ ID NO: 1401060 - RNA, 19 nt, Homo sapiens
ggauguccacagaugccuc

SEQ ID NO: 1401061 - RNA, 23 nt, Homo sapiens
ggauuagaaauaaagcaucucau

SEQ ID NO: 1401062 - RNA, 22 nt, Homo sapiens
ggauuagguguucaggccagua

SEQ ID NO: 1401063 - RNA, 16 nt, Homo sapiens
ggauucuguaugccaa

SEQ ID NO: 1401064 - RNA, 22 nt, Homo sapiens
ggauugucuuacuguugcauaa

SEQ ID NO: 1401065 - RNA, 12 nt, Homo sapiens
ggcaaacaggca

SEQ ID NO: 1401066 - RNA, 21 nt, Homo sapiens
ggcaacaacagcaaaacucca

SEQ ID NO: 1401067 - RNA, 14 nt, Homo sapiens
ggcaacaaugagca

SEQ ID NO: 1401068 - RNA, 22 nt, Homo sapiens
ggcaaggacggccuucaacuga

SEQ ID NO: 1401069 - RNA, 23 nt, Homo sapiens
ggcaauaguggaacgaacuuucc

SEQ ID NO: 1401070 - RNA, 19 nt, Homo sapiens
ggcaaucacauagugaaag

SEQ ID NO: 1401071 - RNA, 18 nt, Homo sapiens
ggcaauccagacagcagg

SEQ ID NO: 1401072 - RNA, 15 nt, Homo sapiens
ggcacaccgggcacu

SEQ ID NO: 1401073 - RNA, 23 nt, Homo sapiens
ggcaccacucuccuuucacagag

SEQ ID NO: 1401074 - RNA, 22 nt, Homo sapiens
ggcaccuccuacgucaaacaug

SEQ ID NO: 1401075 - RNA, 20 nt, Homo sapiens
ggcacucagaagacacugau

SEQ ID NO: 1401076 - RNA, 13 nt, Homo sapiens
ggcacugucucug

SEQ ID NO: 1401077 - RNA, 14 nt, Homo sapiens
ggcacuguggccuu

SEQ ID NO: 1401078 - RNA, 22 nt, Homo sapiens
ggcagaagaauugaacccagga

SEQ ID NO: 1401079 - RNA, 13 nt, Homo sapiens
ggcagaagggaac

SEQ ID NO: 1401080 - RNA, 19 nt, Homo sapiens
ggcagaccgugaccaucuu

SEQ ID NO: 1401081 - RNA, 17 nt, Homo sapiens
ggcagagaggacuguug

SEQ ID NO: 1401082 - RNA, 12 nt, Homo sapiens
ggcagagccaug

SEQ ID NO: 1401083 - RNA, 14 nt, Homo sapiens
ggcagcagaucugu

SEQ ID NO: 1401084 - RNA, 16 nt, Homo sapiens
ggcagcauuuagcaca

SEQ ID NO: 1401085 - RNA, 19 nt, Homo sapiens
ggcagccacgugcucucug

SEQ ID NO: 1401086 - RNA, 21 nt, Homo sapiens
ggcagcugucucaaaccucca

SEQ ID NO: 1401087 - RNA, 20 nt, Homo sapiens
ggcaggaaaauuguuugaac

SEQ ID NO: 1401088 - RNA, 16 nt, Homo sapiens
ggcaggcuccaggccu

SEQ ID NO: 1401089 - RNA, 14 nt, Homo sapiens
ggcagggucucacu

SEQ ID NO: 1401090 - RNA, 16 nt, Homo sapiens
ggcauaggccugggug

SEQ ID NO: 1401091 - RNA, 23 nt, Homo sapiens
ggcaugcuggcucccagggccau

SEQ ID NO: 1401092 - RNA, 23 nt, Homo sapiens
ggcauguuuugcccaccagauca

SEQ ID NO: 1401093 - RNA, 17 nt, Homo sapiens
ggcauucuuuugcuguu

SEQ ID NO: 1401094 - RNA, 20 nt, Homo sapiens
ggcauugucuguaaugacaa

SEQ ID NO: 1401095 - RNA, 21 nt, Homo sapiens
ggccaagaaagagucaggccu

SEQ ID NO: 1401096 - RNA, 23 nt, Homo sapiens
ggccaagguggguggaucacuug

SEQ ID NO: 1401097 - RNA, 18 nt, Homo sapiens
ggccagagggagugacag

SEQ ID NO: 1401098 - RNA, 18 nt, Homo sapiens
ggccaucucugaacuuca

SEQ ID NO: 1401099 - RNA, 17 nt, Homo sapiens
ggccaugagcuccagac

SEQ ID NO: 1401100 - RNA, 23 nt, Homo sapiens
ggccauuccaacagcucaagucu

SEQ ID NO: 1401101 - RNA, 13 nt, Homo sapiens
ggccccacugggg

SEQ ID NO: 1401102 - RNA, 19 nt, Homo sapiens
ggcccuggggccuguacaa

SEQ ID NO: 1401103 - RNA, 21 nt, Homo sapiens
ggcccuucuugccuacuaugc

SEQ ID NO: 1401104 - RNA, 21 nt, Homo sapiens
ggccugaagucccagcauuga

SEQ ID NO: 1401105 - RNA, 11 nt, Homo sapiens
ggccugaccuc

SEQ ID NO: 1401106 - RNA, 16 nt, Homo sapiens
ggccuggccagaugca

SEQ ID NO: 1401107 - RNA, 22 nt, Homo sapiens
ggccuuaauuuucaguauaauu

SEQ ID NO: 1401108 - RNA, 17 nt, Homo sapiens
ggcgaaucacgagguca

SEQ ID NO: 1401109 - RNA, 20 nt, Homo sapiens
ggcgaugugcaaguguaugc

SEQ ID NO: 1401110 - RNA, 17 nt, Homo sapiens
ggcgccaucgccaagua

SEQ ID NO: 1401111 - RNA, 17 nt, Homo sapiens
ggcggagcuugcaguga

SEQ ID NO: 1401112 - RNA, 16 nt, Homo sapiens
ggcggauggcugugac

SEQ ID NO: 1401113 - RNA, 14 nt, Homo sapiens
ggcgugguggcaca

SEQ ID NO: 1401114 - RNA, 15 nt, Homo sapiens
ggcucacaccuguaa

SEQ ID NO: 1401115 - RNA, 13 nt, Homo sapiens
ggcucccaugacc

SEQ ID NO: 1401116 - RNA, 17 nt, Homo sapiens
ggcucucccagccaggu

SEQ ID NO: 1401117 - RNA, 21 nt, Homo sapiens
ggcugauuauuaaaguccuuu

SEQ ID NO: 1401118 - RNA, 11 nt, Homo sapiens
ggcugcaguga

SEQ ID NO: 1401119 - RNA, 16 nt, Homo sapiens
ggcuggagcccaggga

SEQ ID NO: 1401120 - RNA, 15 nt, Homo sapiens
ggcuguaucccauga

SEQ ID NO: 1401121 - RNA, 16 nt, Homo sapiens
ggcuuaggacuuucca

SEQ ID NO: 1401122 - RNA, 21 nt, Homo sapiens
ggcuucagucuuuuccaugaa

SEQ ID NO: 1401123 - RNA, 16 nt, Homo sapiens
ggcuucaguggcagcu

SEQ ID NO: 1401124 - RNA, 21 nt, Homo sapiens
ggcuuccauuugugugugugc

SEQ ID NO: 1401125 - RNA, 13 nt, Homo sapiens
ggcuucugaugaa

SEQ ID NO: 1401126 - RNA, 14 nt, Homo sapiens
ggcuucugaugaau

SEQ ID NO: 1401127 - RNA, 15 nt, Homo sapiens
ggcuugccacagcuc

SEQ ID NO: 1401128 - RNA, 13 nt, Homo sapiens
gggaaaaccagac

SEQ ID NO: 1401129 - RNA, 21 nt, Homo sapiens
gggaaaggauauuuucuucca

SEQ ID NO: 1401130 - RNA, 19 nt, Homo sapiens
gggaaaguaaauauuucag

SEQ ID NO: 1401131 - RNA, 23 nt, Homo sapiens
gggaaauggcuugaagccaaguc

SEQ ID NO: 1401132 - RNA, 15 nt, Homo sapiens
uucaaccacuguaaa

SEQ ID NO: 1401133 - RNA, 15 nt, Homo sapiens
uucaagaaagcuuca

SEQ ID NO: 1401134 - RNA, 17 nt, Homo sapiens
uucaagauugaucauuu

SEQ ID NO: 1401135 - RNA, 16 nt, Homo sapiens
uucaagccuuagauaa

SEQ ID NO: 1401136 - RNA, 18 nt, Homo sapiens
uucaaguuagcucaggag

SEQ ID NO: 1401137 - RNA, 21 nt, Homo sapiens
uucaauaaaguaucuacaugc

SEQ ID NO: 1401138 - RNA, 12 nt, Homo sapiens
uucaaucucuug

SEQ ID NO: 1401139 - RNA, 15 nt, Homo sapiens
uucaauuaguaacau

SEQ ID NO: 1401140 - RNA, 14 nt, Homo sapiens
uucacacaauacaa

SEQ ID NO: 1401141 - RNA, 17 nt, Homo sapiens
uucacacuuccaccagc

SEQ ID NO: 1401142 - RNA, 16 nt, Homo sapiens
uucacagaugugugau

SEQ ID NO: 1401143 - RNA, 12 nt, Homo sapiens
uucacaguguga

SEQ ID NO: 1401144 - RNA, 23 nt, Homo sapiens
uucaccaauauuucucagacauc

SEQ ID NO: 1401145 - RNA, 22 nt, Homo sapiens
uucaccuaagucucugugaauu

SEQ ID NO: 1401146 - RNA, 21 nt, Homo sapiens
uucaccugggcugaggcaucc

SEQ ID NO: 1401147 - RNA, 20 nt, Homo sapiens
uucacgccuguaaucccagc

SEQ ID NO: 1401148 - RNA, 15 nt, Homo sapiens
uucacggcaggacaa

SEQ ID NO: 1401149 - RNA, 22 nt, Homo sapiens
uucacgugcagcagcaacacaa

SEQ ID NO: 1401150 - RNA, 16 nt, Homo sapiens
uucacucccaaccuga

SEQ ID NO: 1401151 - RNA, 12 nt, Homo sapiens
uucacucccacc

SEQ ID NO: 1401152 - RNA, 20 nt, Homo sapiens
uucagaaaagaugugcagau

SEQ ID NO: 1401153 - RNA, 14 nt, Homo sapiens
uucagaagacacug

SEQ ID NO: 1401154 - RNA, 15 nt, Homo sapiens
uucagaagacacugc

SEQ ID NO: 1401155 - RNA, 19 nt, Homo sapiens
uucagauauauuuuucaca

SEQ ID NO: 1401156 - RNA, 15 nt, Homo sapiens
uucagcagacuauga

SEQ ID NO: 1401157 - RNA, 19 nt, Homo sapiens
uucagcagacuaugaauau

SEQ ID NO: 1401158 - RNA, 22 nt, Homo sapiens
uucagcauuauugaaauuguaa

SEQ ID NO: 1401159 - RNA, 13 nt, Homo sapiens
uucagccaccucu

SEQ ID NO: 1401160 - RNA, 14 nt, Homo sapiens
uucagccccuccuc

SEQ ID NO: 1401161 - RNA, 21 nt, Homo sapiens
uucagccuagccgaccucagc

SEQ ID NO: 1401162 - RNA, 16 nt, Homo sapiens
uucagcucuguuuuac

SEQ ID NO: 1401163 - RNA, 16 nt, Homo sapiens
uucaggacucuaccuc

SEQ ID NO: 1401164 - RNA, 18 nt, Homo sapiens
uucagggaauuucaggaa

SEQ ID NO: 1401165 - RNA, 16 nt, Homo sapiens
uucagugcuucgcaga

SEQ ID NO: 1401166 - RNA, 14 nt, Homo sapiens
uucaguggcagcug

SEQ ID NO: 1401167 - RNA, 16 nt, Homo sapiens
uucaguguacauggaa

SEQ ID NO: 1401168 - RNA, 22 nt, Homo sapiens
uucaguguacauggaauaacau

SEQ ID NO: 1401169 - RNA, 19 nt, Homo sapiens
uucaguugaucacuggcaa

SEQ ID NO: 1401170 - RNA, 17 nt, Homo sapiens
uucauaacagaacaaga

SEQ ID NO: 1401171 - RNA, 21 nt, Homo sapiens
uucauaacagugccauugucu

SEQ ID NO: 1401172 - RNA, 19 nt, Homo sapiens
uucauaauuucuucacuca

SEQ ID NO: 1401173 - RNA, 17 nt, Homo sapiens
uucauauaccagcaaua

SEQ ID NO: 1401174 - RNA, 13 nt, Homo sapiens
uucaucagaguua

SEQ ID NO: 1401175 - RNA, 21 nt, Homo sapiens
uucaucccucgggugugcuau

SEQ ID NO: 1401176 - RNA, 20 nt, Homo sapiens
uucaucucaggccucccuca

SEQ ID NO: 1401177 - RNA, 18 nt, Homo sapiens
uucauggugcacugagcu

SEQ ID NO: 1401178 - RNA, 15 nt, Homo sapiens
uucauguauuccagu

SEQ ID NO: 1401179 - RNA, 17 nt, Homo sapiens
uucauucuggucucucu

SEQ ID NO: 1401180 - RNA, 13 nt, Homo sapiens
uucauugacugau

SEQ ID NO: 1401181 - RNA, 19 nt, Homo sapiens
uucauugacugauggugaa

SEQ ID NO: 1401182 - RNA, 15 nt, Homo sapiens
uucauuguguucucu

SEQ ID NO: 1401183 - RNA, 20 nt, Homo sapiens
uucauuuaggaugcuuucau

SEQ ID NO: 1401184 - RNA, 19 nt, Homo sapiens
uuccaacguggcccagaga

SEQ ID NO: 1401185 - RNA, 20 nt, Homo sapiens
uuccaacuaacguacauuca

SEQ ID NO: 1401186 - RNA, 15 nt, Homo sapiens
uuccaaugaugggau

SEQ ID NO: 1401187 - RNA, 17 nt, Homo sapiens
uuccaauuuuguugcau

SEQ ID NO: 1401188 - RNA, 17 nt, Homo sapiens
uuccacaucauccagaa

SEQ ID NO: 1401189 - RNA, 23 nt, Homo sapiens
uuccacugauggaaacaaagugg

SEQ ID NO: 1401190 - RNA, 17 nt, Homo sapiens
uuccacuuugauaccau

SEQ ID NO: 1401191 - RNA, 14 nt, Homo sapiens
uuccagaaaggaua

SEQ ID NO: 1401192 - RNA, 13 nt, Homo sapiens
uuccagacugcuu

SEQ ID NO: 1401193 - RNA, 16 nt, Homo sapiens
uuccaggcgaugugca

SEQ ID NO: 1401194 - RNA, 17 nt, Homo sapiens
uuccaggcgaugugcaa

SEQ ID NO: 1401195 - RNA, 14 nt, Homo sapiens
uuccagguucuggu

SEQ ID NO: 1401196 - RNA, 19 nt, Homo sapiens
uuccauaaucuggacuccu

SEQ ID NO: 1401197 - RNA, 15 nt, Homo sapiens
uuccauuccaagccu

SEQ ID NO: 1401198 - RNA, 20 nt, Homo sapiens
uucccaacacuucagacugc

SEQ ID NO: 1401199 - RNA, 14 nt, Homo sapiens
uucccccaaagugg

SEQ ID NO: 1401200 - RNA, 15 nt, Homo sapiens
uucccccgcaaugug

SEQ ID NO: 1401201 - RNA, 16 nt, Homo sapiens
uucccggccauucucc

SEQ ID NO: 1401202 - RNA, 14 nt, Homo sapiens
uucccuaaugaagu

SEQ ID NO: 1401203 - RNA, 19 nt, Homo sapiens
uucccuacuuccugugacu

SEQ ID NO: 1401204 - RNA, 21 nt, Homo sapiens
uucccuaucucgaacauggaa

SEQ ID NO: 1401205 - RNA, 21 nt, Homo sapiens
uucccuauuuugccaguggga

SEQ ID NO: 1401206 - RNA, 19 nt, Homo sapiens
uucccuucaaggucauuua

SEQ ID NO: 1401207 - RNA, 16 nt, Homo sapiens
uuccguggcacugcau

SEQ ID NO: 1401208 - RNA, 17 nt, Homo sapiens
uuccguggcacugcaua

SEQ ID NO: 1401209 - RNA, 22 nt, Homo sapiens
uuccuaacaggauuagacaguc

SEQ ID NO: 1401210 - RNA, 20 nt, Homo sapiens
uuccucagggacagagacac

SEQ ID NO: 1401211 - RNA, 23 nt, Homo sapiens
uuccucauuagcauuuugcuaaa

SEQ ID NO: 1401212 - RNA, 20 nt, Homo sapiens
uuccugggacuaugcuguaa

SEQ ID NO: 1401213 - RNA, 15 nt, Homo sapiens
uuccuguagucccau

SEQ ID NO: 1401214 - RNA, 14 nt, Homo sapiens
uuccuguccagaga

SEQ ID NO: 1401215 - RNA, 22 nt, Homo sapiens
uuccuguggggggaaguccaug

SEQ ID NO: 1401216 - RNA, 15 nt, Homo sapiens
uuccuuaaacugugu

SEQ ID NO: 1401217 - RNA, 22 nt, Homo sapiens
uuccuuagcuuagaccucagcc

SEQ ID NO: 1401218 - RNA, 16 nt, Homo sapiens
uuccuuaggucugccc

SEQ ID NO: 1401219 - RNA, 17 nt, Homo sapiens
uuccuucauuucugaua

SEQ ID NO: 1401220 - RNA, 17 nt, Homo sapiens
uuccuugggaugaucuu

SEQ ID NO: 1401221 - RNA, 20 nt, Homo sapiens
uuccuuggggcaggcaguga

SEQ ID NO: 1401222 - RNA, 17 nt, Homo sapiens
uuccuuuccugaucacu

SEQ ID NO: 1401223 - RNA, 16 nt, Homo sapiens
uuccuuuguugcacaa

SEQ ID NO: 1401224 - RNA, 20 nt, Homo sapiens
uuccuuuuaaaacacuucca

SEQ ID NO: 1401225 - RNA, 20 nt, Homo sapiens
uucgagaccagccuggccaa

SEQ ID NO: 1401226 - RNA, 15 nt, Homo sapiens
uucgagguggaucac

SEQ ID NO: 1401227 - RNA, 23 nt, Homo sapiens
uucgauacaccgggccuggagaa

SEQ ID NO: 1401228 - RNA, 17 nt, Homo sapiens
uucgcguauuucaggau

SEQ ID NO: 1401229 - RNA, 15 nt, Homo sapiens
uucggguuggcaaaa

SEQ ID NO: 1401230 - RNA, 19 nt, Homo sapiens
uucgugaaguauacuguau

SEQ ID NO: 1401231 - RNA, 22 nt, Homo sapiens
uucuaacgaguggaccauuauc

SEQ ID NO: 1401232 - RNA, 15 nt, Homo sapiens
uucuaacucugaugu

SEQ ID NO: 1401233 - RNA, 17 nt, Homo sapiens
uucuaagcaaaauugcu

SEQ ID NO: 1401234 - RNA, 14 nt, Homo sapiens
uucuaaugugccua

SEQ ID NO: 1401235 - RNA, 12 nt, Homo sapiens
gggaaauugcuu

SEQ ID NO: 1401236 - RNA, 22 nt, Homo sapiens
gggaacaaggguggcaucccag

SEQ ID NO: 1401237 - RNA, 15 nt, Homo sapiens
gggaagagugcauuu

SEQ ID NO: 1401238 - RNA, 15 nt, Homo sapiens
gggaagcccauuccu

SEQ ID NO: 1401239 - RNA, 22 nt, Homo sapiens
gggaaggugaccacauccaccu

SEQ ID NO: 1401240 - RNA, 15 nt, Homo sapiens
gggaauggauccugg

SEQ ID NO: 1401241 - RNA, 21 nt, Homo sapiens
gggacaucaaaaacagcagaa

SEQ ID NO: 1401242 - RNA, 22 nt, Homo sapiens
gggaccaacugggcccaagaca

SEQ ID NO: 1401243 - RNA, 16 nt, Homo sapiens
gggaccacaccucccu

SEQ ID NO: 1401244 - RNA, 13 nt, Homo sapiens
gggagaaaugacu

SEQ ID NO: 1401245 - RNA, 13 nt, Homo sapiens
gggagcagugucu

SEQ ID NO: 1401246 - RNA, 14 nt, Homo sapiens
gggagcauguucau

SEQ ID NO: 1401247 - RNA, 17 nt, Homo sapiens
gggaggaagcagguuga

SEQ ID NO: 1401248 - RNA, 17 nt, Homo sapiens
gggaggccaagugcagg

SEQ ID NO: 1401249 - RNA, 18 nt, Homo sapiens
gggagguauucgugcagc

SEQ ID NO: 1401250 - RNA, 20 nt, Homo sapiens
gggagugcccccaacagcac

SEQ ID NO: 1401251 - RNA, 23 nt, Homo sapiens
gggaucuuccuugggaugaucuu

SEQ ID NO: 1401252 - RNA, 10 nt, Homo sapiens
gggauguuuu

SEQ ID NO: 1401253 - RNA, 14 nt, Homo sapiens
gggcaacaacagca

SEQ ID NO: 1401254 - RNA, 17 nt, Homo sapiens
gggcagcauagcaagac

SEQ ID NO: 1401255 - RNA, 20 nt, Homo sapiens
gggcaggagggcccuaccug

SEQ ID NO: 1401256 - RNA, 22 nt, Homo sapiens
gggcaugcuggggcaagucccu

SEQ ID NO: 1401257 - RNA, 21 nt, Homo sapiens
gggcccaaauucuuucagugg

SEQ ID NO: 1401258 - RNA, 14 nt, Homo sapiens
gggcccagccagcc

SEQ ID NO: 1401259 - RNA, 14 nt, Homo sapiens
gggcccagggccua

SEQ ID NO: 1401260 - RNA, 18 nt, Homo sapiens
ucaguuacucagcccugg

SEQ ID NO: 1401261 - RNA, 21 nt, Homo sapiens
ucaguucccccaguaccucca

SEQ ID NO: 1401262 - RNA, 15 nt, Homo sapiens
ucauaaauauaaucu

SEQ ID NO: 1401263 - RNA, 14 nt, Homo sapiens
ucauaauucuaauc

SEQ ID NO: 1401264 - RNA, 14 nt, Homo sapiens
ucauacucaccuca

SEQ ID NO: 1401265 - RNA, 15 nt, Homo sapiens
ucauacucaccucac

SEQ ID NO: 1401266 - RNA, 13 nt, Homo sapiens
ucauauaccagca

SEQ ID NO: 1401267 - RNA, 17 nt, Homo sapiens
ucauauauauacauaca

SEQ ID NO: 1401268 - RNA, 18 nt, Homo sapiens
ucaucacaucaugcuguu

SEQ ID NO: 1401269 - RNA, 16 nt, Homo sapiens
ucaucaccacagggau

SEQ ID NO: 1401270 - RNA, 16 nt, Homo sapiens
ucauccacugugccau

SEQ ID NO: 1401271 - RNA, 21 nt, Homo sapiens
ucauccucacucaguccagcu

SEQ ID NO: 1401272 - RNA, 13 nt, Homo sapiens
ucauccugcaggc

SEQ ID NO: 1401273 - RNA, 22 nt, Homo sapiens
ucauccuuuucuccuaucuuca

SEQ ID NO: 1401274 - RNA, 18 nt, Homo sapiens
ucaucucagugcuguaaa

SEQ ID NO: 1401275 - RNA, 20 nt, Homo sapiens
ucaucucauuccaacuuccc

SEQ ID NO: 1401276 - RNA, 16 nt, Homo sapiens
ucaucucucaucacuu

SEQ ID NO: 1401277 - RNA, 13 nt, Homo sapiens
ucaucugggcaaa

SEQ ID NO: 1401278 - RNA, 23 nt, Homo sapiens
ucaucuguagauacuagcuaucu

SEQ ID NO: 1401279 - RNA, 23 nt, Homo sapiens
ucaucugugauucccuccugcua

SEQ ID NO: 1401280 - RNA, 14 nt, Homo sapiens
ucaugaaauaugca

SEQ ID NO: 1401281 - RNA, 16 nt, Homo sapiens
ucaugauaugucaggg

SEQ ID NO: 1401282 - RNA, 20 nt, Homo sapiens
ucauggcagcuaagccacau

SEQ ID NO: 1401283 - RNA, 17 nt, Homo sapiens
ucauggcucacugcagc

SEQ ID NO: 1401284 - RNA, 18 nt, Homo sapiens
ucaugguccccauggcau

SEQ ID NO: 1401285 - RNA, 20 nt, Homo sapiens
ucaugguccccauggcaugg

SEQ ID NO: 1401286 - RNA, 13 nt, Homo sapiens
ucauguagccuca

SEQ ID NO: 1401287 - RNA, 20 nt, Homo sapiens
ucauuauaaacgugaugauc

SEQ ID NO: 1401288 - RNA, 15 nt, Homo sapiens
ucauucaagucagcu

SEQ ID NO: 1401289 - RNA, 13 nt, Homo sapiens
ucauuccaccuuc

SEQ ID NO: 1401290 - RNA, 13 nt, Homo sapiens
ucauucuacugaa

SEQ ID NO: 1401291 - RNA, 14 nt, Homo sapiens
ucauugacuaucaa

SEQ ID NO: 1401292 - RNA, 18 nt, Homo sapiens
ucauugacugauggugaa

SEQ ID NO: 1401293 - RNA, 17 nt, Homo sapiens
ucauugcuucacaaccc

SEQ ID NO: 1401294 - RNA, 16 nt, Homo sapiens
ucauuguaaaaagccc

SEQ ID NO: 1401295 - RNA, 21 nt, Homo sapiens
ucauuuacuuguacgagacag

SEQ ID NO: 1401296 - RNA, 14 nt, Homo sapiens
ucauuucaaauaca

SEQ ID NO: 1401297 - RNA, 17 nt, Homo sapiens
ucauuucaaauacaucu

SEQ ID NO: 1401298 - RNA, 16 nt, Homo sapiens
ucauuucaucuaccau

SEQ ID NO: 1401299 - RNA, 12 nt, Homo sapiens
ucauuugaacaa

SEQ ID NO: 1401300 - RNA, 21 nt, Homo sapiens
uccaaacguuaagaauuguua

SEQ ID NO: 1401301 - RNA, 14 nt, Homo sapiens
uccaaacugccuaa

SEQ ID NO: 1401302 - RNA, 14 nt, Homo sapiens
uccaaagacauguu

SEQ ID NO: 1401303 - RNA, 22 nt, Homo sapiens
uccaaaggaggauggcauauaa

SEQ ID NO: 1401304 - RNA, 16 nt, Homo sapiens
uccaaauacugauggu

SEQ ID NO: 1401305 - RNA, 16 nt, Homo sapiens
uccaaaugcccagcuu

SEQ ID NO: 1401306 - RNA, 15 nt, Homo sapiens
uccaaauggacauaa

SEQ ID NO: 1401307 - RNA, 15 nt, Homo sapiens
uccaaauguccucca

SEQ ID NO: 1401308 - RNA, 16 nt, Homo sapiens
uccaacacugcugcuc

SEQ ID NO: 1401309 - RNA, 20 nt, Homo sapiens
uccaacaugugcucagggaa

SEQ ID NO: 1401310 - RNA, 21 nt, Homo sapiens
uccaacuaacaagaaacucac

SEQ ID NO: 1401311 - RNA, 17 nt, Homo sapiens
uccaacuguacuuuuaa

SEQ ID NO: 1401312 - RNA, 16 nt, Homo sapiens
uccaacuucccaguuc

SEQ ID NO: 1401313 - RNA, 18 nt, Homo sapiens
uccaagcaaguagcuuuc

SEQ ID NO: 1401314 - RNA, 19 nt, Homo sapiens
uccaaggauggaccacaca

SEQ ID NO: 1401315 - RNA, 14 nt, Homo sapiens
uccaaggguacuaa

SEQ ID NO: 1401316 - RNA, 14 nt, Homo sapiens
uccaaugaugggau

SEQ ID NO: 1401317 - RNA, 13 nt, Homo sapiens
uccaaugcucaag

SEQ ID NO: 1401318 - RNA, 14 nt, Homo sapiens
uccaaugcucaaga

SEQ ID NO: 1401319 - RNA, 17 nt, Homo sapiens
uccacaaaaucugucca

SEQ ID NO: 1401320 - RNA, 20 nt, Homo sapiens
uccacaagauucccagagac

SEQ ID NO: 1401321 - RNA, 18 nt, Homo sapiens
uccacacagccaauacaa

SEQ ID NO: 1401322 - RNA, 20 nt, Homo sapiens
uccacaccuagcaucucaug

SEQ ID NO: 1401323 - RNA, 17 nt, Homo sapiens
uccacagugacuccacu

SEQ ID NO: 1401324 - RNA, 10 nt, Homo sapiens
uccaccagcc

SEQ ID NO: 1401325 - RNA, 11 nt, Homo sapiens
uccaccccagu

SEQ ID NO: 1401326 - RNA, 14 nt, Homo sapiens
uccaccccauguca

SEQ ID NO: 1401327 - RNA, 21 nt, Homo sapiens
uccaccuagagcuagaugugu

SEQ ID NO: 1401328 - RNA, 13 nt, Homo sapiens
uccacguaucuuu

SEQ ID NO: 1401329 - RNA, 20 nt, Homo sapiens
uccacuagcaccgaccccac

SEQ ID NO: 1401330 - RNA, 15 nt, Homo sapiens
uccacugugccaugu

SEQ ID NO: 1401331 - RNA, 11 nt, Homo sapiens
uccacuuagaa

SEQ ID NO: 1401332 - RNA, 20 nt, Homo sapiens
uccacuuagaaauugcauuu

SEQ ID NO: 1401333 - RNA, 16 nt, Homo sapiens
uccagacccccagcaa

SEQ ID NO: 1401334 - RNA, 20 nt, Homo sapiens
uccagaugagaguacacccc

SEQ ID NO: 1401335 - RNA, 17 nt, Homo sapiens
uccagccgccauugcca

SEQ ID NO: 1401336 - RNA, 19 nt, Homo sapiens
uccagccgcugcacaucac

SEQ ID NO: 1401337 - RNA, 13 nt, Homo sapiens
uccaggaaaaagg

SEQ ID NO: 1401338 - RNA, 21 nt, Homo sapiens
uccaggccccaaaaccacagc

SEQ ID NO: 1401339 - RNA, 18 nt, Homo sapiens
uccaggcgugguggcaca

SEQ ID NO: 1401340 - RNA, 23 nt, Homo sapiens
uccaggcgugguggcacacaccu

SEQ ID NO: 1401341 - RNA, 18 nt, Homo sapiens
uccagggacauguggaaa

SEQ ID NO: 1401342 - RNA, 16 nt, Homo sapiens
uccagggcaaggccau

SEQ ID NO: 1401343 - RNA, 18 nt, Homo sapiens
uccagucuuccaccugga

SEQ ID NO: 1401344 - RNA, 14 nt, Homo sapiens
uccagugcaauugu

SEQ ID NO: 1401345 - RNA, 15 nt, Homo sapiens
uccagugcaggagac

SEQ ID NO: 1401346 - RNA, 22 nt, Homo sapiens
uccauagccuaaucccugggca

SEQ ID NO: 1401347 - RNA, 15 nt, Homo sapiens
uccaucucaaaaaau

SEQ ID NO: 1401348 - RNA, 15 nt, Homo sapiens
uccaucuccacucca

SEQ ID NO: 1401349 - RNA, 17 nt, Homo sapiens
uccaucucugucucaaa

SEQ ID NO: 1401350 - RNA, 17 nt, Homo sapiens
uccaugacugcauuuua

SEQ ID NO: 1401351 - RNA, 15 nt, Homo sapiens
uccauuugcuuuguc

SEQ ID NO: 1401352 - RNA, 18 nt, Homo sapiens
ucccaaauuuucacauaa

SEQ ID NO: 1401353 - RNA, 14 nt, Homo sapiens
ucccaauagcacuu

SEQ ID NO: 1401354 - RNA, 20 nt, Homo sapiens
ucuggccuugaaaccaccuu

SEQ ID NO: 1401355 - RNA, 16 nt, Homo sapiens
ucugggaagauuucua

SEQ ID NO: 1401356 - RNA, 18 nt, Homo sapiens
ucugggccaagucaaaga

SEQ ID NO: 1401357 - RNA, 18 nt, Homo sapiens
ucugggcugccaugugaa

SEQ ID NO: 1401358 - RNA, 18 nt, Homo sapiens
ucuggggauacuggcaaa

SEQ ID NO: 1401359 - RNA, 14 nt, Homo sapiens
ucugggugcagcug

SEQ ID NO: 1401360 - RNA, 19 nt, Homo sapiens
ucugguaggaauagcaugu

SEQ ID NO: 1401361 - RNA, 12 nt, Homo sapiens
ucuggucugucc

SEQ ID NO: 1401362 - RNA, 14 nt, Homo sapiens
ucuggucuguccac

SEQ ID NO: 1401363 - RNA, 15 nt, Homo sapiens
ucuggugacaccagc

SEQ ID NO: 1401364 - RNA, 16 nt, Homo sapiens
ucugguuuauuuccua

SEQ ID NO: 1401365 - RNA, 16 nt, Homo sapiens
ucuguauuccuagaaa

SEQ ID NO: 1401366 - RNA, 15 nt, Homo sapiens
ucugucuucuuugcc

SEQ ID NO: 1401367 - RNA, 17 nt, Homo sapiens
ucuuaaaauagccauaa

SEQ ID NO: 1401368 - RNA, 18 nt, Homo sapiens
ucuuacaaaagauuguca

SEQ ID NO: 1401369 - RNA, 13 nt, Homo sapiens
ucuuacaaagugu

SEQ ID NO: 1401370 - RNA, 13 nt, Homo sapiens
ucuuacaaugaaa

SEQ ID NO: 1401371 - RNA, 15 nt, Homo sapiens
ucuuacauuagcagu

SEQ ID NO: 1401372 - RNA, 17 nt, Homo sapiens
ucuuacuguugcauaac

SEQ ID NO: 1401373 - RNA, 20 nt, Homo sapiens
ucuuacuucccuaaugaagu

SEQ ID NO: 1401374 - RNA, 22 nt, Homo sapiens
ucuuacuuugaguuagugccau

SEQ ID NO: 1401375 - RNA, 16 nt, Homo sapiens
ucuuagaaguggacca

SEQ ID NO: 1401376 - RNA, 20 nt, Homo sapiens
ucuuagagagaagaucacug

SEQ ID NO: 1401377 - RNA, 20 nt, Homo sapiens
ucuuaggcaaucacauagug

SEQ ID NO: 1401378 - RNA, 21 nt, Homo sapiens
ucuuauccaacaucaacaucu

SEQ ID NO: 1401379 - RNA, 18 nt, Homo sapiens
ucuuauucucacuccacc

SEQ ID NO: 1401380 - RNA, 19 nt, Homo sapiens
ucuucacaccuacccuccu

SEQ ID NO: 1401381 - RNA, 18 nt, Homo sapiens
ucuucacuucuaaaugca

SEQ ID NO: 1401382 - RNA, 11 nt, Homo sapiens
ucuucagccac

SEQ ID NO: 1401383 - RNA, 12 nt, Homo sapiens
ucuucagccuag

SEQ ID NO: 1401384 - RNA, 17 nt, Homo sapiens
ucuucagggcacugcug

SEQ ID NO: 1401385 - RNA, 23 nt, Homo sapiens
ucuucagggggccaggugcacag

SEQ ID NO: 1401386 - RNA, 16 nt, Homo sapiens
ucuucauaauuucuuc

SEQ ID NO: 1401387 - RNA, 12 nt, Homo sapiens
ucuucaugcaau

SEQ ID NO: 1401388 - RNA, 20 nt, Homo sapiens
ucuuccagaaggcaaaaaga

SEQ ID NO: 1401389 - RNA, 22 nt, Homo sapiens
ucuuccagagucaucuaccuga

SEQ ID NO: 1401390 - RNA, 13 nt, Homo sapiens
ucuuccccagaua

SEQ ID NO: 1401391 - RNA, 11 nt, Homo sapiens
ucuucccuacc

SEQ ID NO: 1401392 - RNA, 13 nt, Homo sapiens
ucuuccugcauuc

SEQ ID NO: 1401393 - RNA, 22 nt, Homo sapiens
ucuuccuggcuccaacacugcu

SEQ ID NO: 1401394 - RNA, 19 nt, Homo sapiens
ucuucguauucccauuaga

SEQ ID NO: 1401395 - RNA, 14 nt, Homo sapiens
ucuucuaagcaaaa

SEQ ID NO: 1401396 - RNA, 23 nt, Homo sapiens
ucuucuccaggcuguaucccaug

SEQ ID NO: 1401397 - RNA, 23 nt, Homo sapiens
ucuucugccccagcuuugcagga

SEQ ID NO: 1401398 - RNA, 23 nt, Homo sapiens
ucuucugcuggcagaaagcaaau

SEQ ID NO: 1401399 - RNA, 16 nt, Homo sapiens
ucuucugggaacuucc

SEQ ID NO: 1401400 - RNA, 14 nt, Homo sapiens
ucuucugucaucua

SEQ ID NO: 1401401 - RNA, 14 nt, Homo sapiens
ucuucuuacaugca

SEQ ID NO: 1401402 - RNA, 23 nt, Homo sapiens
ucuugaaaauagaacaacuugca

SEQ ID NO: 1401403 - RNA, 21 nt, Homo sapiens
ucuugaaacauagagaucuau

SEQ ID NO: 1401404 - RNA, 12 nt, Homo sapiens
ucuugaagugau

SEQ ID NO: 1401405 - RNA, 16 nt, Homo sapiens
ucuugaguuuagugau

SEQ ID NO: 1401406 - RNA, 15 nt, Homo sapiens
ucuugcagcuguaaa

SEQ ID NO: 1401407 - RNA, 13 nt, Homo sapiens
ucuugcuaugaaa

SEQ ID NO: 1401408 - RNA, 15 nt, Homo sapiens
ucuugcucuaucuca

SEQ ID NO: 1401409 - RNA, 16 nt, Homo sapiens
ucuugcuuauucacug

SEQ ID NO: 1401410 - RNA, 15 nt, Homo sapiens
ucuuggucacauaca

SEQ ID NO: 1401411 - RNA, 13 nt, Homo sapiens
ucuuguugcugca

SEQ ID NO: 1401412 - RNA, 20 nt, Homo sapiens
ucuuguuuccaaaaaccaug

SEQ ID NO: 1401413 - RNA, 18 nt, Homo sapiens
ucuuuaaauuucaucuca

SEQ ID NO: 1401414 - RNA, 17 nt, Homo sapiens
ucuuuaaugucacaggc

SEQ ID NO: 1401415 - RNA, 17 nt, Homo sapiens
ucuuuauaaucuacucc

SEQ ID NO: 1401416 - RNA, 18 nt, Homo sapiens
ucuuucacccacagaaag

SEQ ID NO: 1401417 - RNA, 21 nt, Homo sapiens
ucuuucaccuuucccuaaaga

SEQ ID NO: 1401418 - RNA, 21 nt, Homo sapiens
ucuuucaggacucuaccucau

SEQ ID NO: 1401419 - RNA, 21 nt, Homo sapiens
ucuuucaguggcuaccuacau

SEQ ID NO: 1401420 - RNA, 23 nt, Homo sapiens
ucuuuccuguagucccauugaug

SEQ ID NO: 1401421 - RNA, 18 nt, Homo sapiens
ucuuucuaacuccaguga

SEQ ID NO: 1401422 - RNA, 18 nt, Homo sapiens
ucuuucuaaugugugaau

SEQ ID NO: 1401423 - RNA, 17 nt, Homo sapiens
ucuuucuagcuaaugga

SEQ ID NO: 1401424 - RNA, 14 nt, Homo sapiens
ucuuucuccaggga

SEQ ID NO: 1401425 - RNA, 19 nt, Homo sapiens
ucuuugacaauuccuagau

SEQ ID NO: 1401426 - RNA, 20 nt, Homo sapiens
ucuuugcagacaggcaagca

SEQ ID NO: 1401427 - RNA, 16 nt, Homo sapiens
ucuuuggacaaccaug

SEQ ID NO: 1401428 - RNA, 23 nt, Homo sapiens
ucuuugguguacaaaauggaauu

SEQ ID NO: 1401429 - RNA, 22 nt, Homo sapiens
ucuuuguaaagaaaguggcuug

SEQ ID NO: 1401430 - RNA, 21 nt, Homo sapiens
ucuuuguaagaguggaaccaa

SEQ ID NO: 1401431 - RNA, 19 nt, Homo sapiens
ucuuugucagcaguucccu

SEQ ID NO: 1401432 - RNA, 23 nt, Homo sapiens
ucuuuugccaugacaacuucuaa

SEQ ID NO: 1401433 - RNA, 16 nt, Homo sapiens
ucuuuugguugccuua

SEQ ID NO: 1401434 - RNA, 18 nt, Homo sapiens
ugaaaaaucggcuuacca

SEQ ID NO: 1401435 - RNA, 12 nt, Homo sapiens
ugaaaaaugccu

SEQ ID NO: 1401436 - RNA, 14 nt, Homo sapiens
ugaaaaauguauau

SEQ ID NO: 1401437 - RNA, 17 nt, Homo sapiens
ugaaaaccucacaugca

SEQ ID NO: 1401438 - RNA, 12 nt, Homo sapiens
ugaaaagccaug

SEQ ID NO: 1401439 - RNA, 18 nt, Homo sapiens
ugaaaaggguguugcuaa

SEQ ID NO: 1401440 - RNA, 16 nt, Homo sapiens
ugaaaauaauguugua

SEQ ID NO: 1401441 - RNA, 22 nt, Homo sapiens
ugaaaaugcuguauuagucaca

SEQ ID NO: 1401442 - RNA, 16 nt, Homo sapiens
ugaaaauuaacacugc

SEQ ID NO: 1401443 - RNA, 15 nt, Homo sapiens
ugaaacaacccaaag

SEQ ID NO: 1401444 - RNA, 22 nt, Homo sapiens
ugaaacccccacccuucugccu

SEQ ID NO: 1401445 - RNA, 21 nt, Homo sapiens
ugaaacuaaugaaagcacucc

SEQ ID NO: 1401446 - RNA, 17 nt, Homo sapiens
ugaaagaaccaaaagag

SEQ ID NO: 1401447 - RNA, 21 nt, Homo sapiens
ugaaagaaccaaaagagauca

SEQ ID NO: 1401448 - RNA, 13 nt, Homo sapiens
uugcuguuuccuu

SEQ ID NO: 1401449 - RNA, 20 nt, Homo sapiens
uugcuuaugacaugaucgcu

SEQ ID NO: 1401450 - RNA, 23 nt, Homo sapiens
uugcuucccggcgucccuaccuc

SEQ ID NO: 1401451 - RNA, 18 nt, Homo sapiens
uuggaaaaagccugugaa

SEQ ID NO: 1401452 - RNA, 17 nt, Homo sapiens
uuggaaagcaucaccuc

SEQ ID NO: 1401453 - RNA, 19 nt, Homo sapiens
uuggaagugugugaucugu

SEQ ID NO: 1401454 - RNA, 14 nt, Homo sapiens
uuggaauacuaaaa

SEQ ID NO: 1401455 - RNA, 21 nt, Homo sapiens
uuggacugauaaucucuuuaa

SEQ ID NO: 1401456 - RNA, 15 nt, Homo sapiens
uuucuggccugccuu

SEQ ID NO: 1401457 - RNA, 16 nt, Homo sapiens
uuucugucacaucagc

SEQ ID NO: 1401458 - RNA, 18 nt, Homo sapiens
uuucuuaaaacauuauga

SEQ ID NO: 1401459 - RNA, 19 nt, Homo sapiens
uuucuuaucccagugauca

SEQ ID NO: 1401460 - RNA, 21 nt, Homo sapiens
uuucuuccaaagcacauugaa

SEQ ID NO: 1401461 - RNA, 16 nt, Homo sapiens
uuucuuccauucccau

SEQ ID NO: 1401462 - RNA, 23 nt, Homo sapiens
uuucuucccgaaccccaaggagg

SEQ ID NO: 1401463 - RNA, 13 nt, Homo sapiens
uuucuucucccaa

SEQ ID NO: 1401464 - RNA, 22 nt, Homo sapiens
uuucuuuaauaguuuugauccu

SEQ ID NO: 1401465 - RNA, 18 nt, Homo sapiens
uuugaagcaucacauaaa

SEQ ID NO: 1401466 - RNA, 19 nt, Homo sapiens
uuugaauacaggcauagag

SEQ ID NO: 1401467 - RNA, 16 nt, Homo sapiens
uuugaaugcggcccaa

SEQ ID NO: 1401468 - RNA, 19 nt, Homo sapiens
uuugaccucauuuguaaaa

SEQ ID NO: 1401469 - RNA, 13 nt, Homo sapiens
uuugagugauccu

SEQ ID NO: 1401470 - RNA, 17 nt, Homo sapiens
uuugauaggauguggau

SEQ ID NO: 1401471 - RNA, 16 nt, Homo sapiens
uuugauuucagguuug

SEQ ID NO: 1401472 - RNA, 21 nt, Homo sapiens
uuugcaaaauuuccaguaccu

SEQ ID NO: 1401473 - RNA, 18 nt, Homo sapiens
uuugcacacuugugugug

SEQ ID NO: 1401474 - RNA, 14 nt, Homo sapiens
uuugcagacaggca

SEQ ID NO: 1401475 - RNA, 19 nt, Homo sapiens
uuugcauaagugcaugaca

SEQ ID NO: 1401476 - RNA, 15 nt, Homo sapiens
uuugcauguuuugua

SEQ ID NO: 1401477 - RNA, 16 nt, Homo sapiens
uuugcccaccagauca

SEQ ID NO: 1401478 - RNA, 19 nt, Homo sapiens
uuugccuuggcuuugccag

SEQ ID NO: 1401479 - RNA, 18 nt, Homo sapiens
uuugcuagcagaaaucua

SEQ ID NO: 1401480 - RNA, 14 nt, Homo sapiens
uuugcuaucaaaau

SEQ ID NO: 1401481 - RNA, 16 nt, Homo sapiens
uuugcucagaacacau

SEQ ID NO: 1401482 - RNA, 18 nt, Homo sapiens
uuugcucuuuucaaugug

SEQ ID NO: 1401483 - RNA, 22 nt, Homo sapiens
uuuggaaaucacacgucuggcu

SEQ ID NO: 1401484 - RNA, 14 nt, Homo sapiens
uuuggaauuauguc

SEQ ID NO: 1401485 - RNA, 18 nt, Homo sapiens
uuuggaauuaugucugcu

SEQ ID NO: 1401486 - RNA, 21 nt, Homo sapiens
uuuggauaucaaaagcaaaua

SEQ ID NO: 1401487 - RNA, 15 nt, Homo sapiens
uuuggauuguaucaa

SEQ ID NO: 1401488 - RNA, 14 nt, Homo sapiens
uuuggccauuccaa

SEQ ID NO: 1401489 - RNA, 15 nt, Homo sapiens
uuuggggagcagaga

SEQ ID NO: 1401490 - RNA, 16 nt, Homo sapiens
uuugguaugugacaug

SEQ ID NO: 1401491 - RNA, 14 nt, Homo sapiens
uuuggugaauuuga

SEQ ID NO: 1401492 - RNA, 19 nt, Homo sapiens
uuuggugaauuugaaucuc

SEQ ID NO: 1401493 - RNA, 23 nt, Homo sapiens
uuugguuguguaagagaauguug

SEQ ID NO: 1401494 - RNA, 22 nt, Homo sapiens
uuugucccggggcuccacugaa

SEQ ID NO: 1401495 - RNA, 19 nt, Homo sapiens
uuugugagaaacaucucaa

SEQ ID NO: 1401496 - RNA, 22 nt, Homo sapiens
uuugugcagagauaaagaccuu

SEQ ID NO: 1401497 - RNA, 14 nt, Homo sapiens
uuugugugcgucac

SEQ ID NO: 1401498 - RNA, 19 nt, Homo sapiens
uuugugugugugcaagugu

SEQ ID NO: 1401499 - RNA, 20 nt, Homo sapiens
uuuguucuucuaccacccac

SEQ ID NO: 1401500 - RNA, 12 nt, Homo sapiens
uuuguugcucag

SEQ ID NO: 1401501 - RNA, 12 nt, Homo sapiens
uuuguuguaaaa

SEQ ID NO: 1401502 - RNA, 22 nt, Homo sapiens
uuuguuuugauguuuguggccu

SEQ ID NO: 1401503 - RNA, 20 nt, Homo sapiens
uuuguuuuguaucauuauga

SEQ ID NO: 1401504 - RNA, 17 nt, Homo sapiens
uuuuaaaacauucacac

SEQ ID NO: 1401505 - RNA, 16 nt, Homo sapiens
uuuuaaaaguuauuaa

SEQ ID NO: 1401506 - RNA, 23 nt, Homo sapiens
uuuuaaauaaaaauaaguguaca

SEQ ID NO: 1401507 - RNA, 17 nt, Homo sapiens
uuuuaacaacuaugauu

SEQ ID NO: 1401508 - RNA, 14 nt, Homo sapiens
uuuuaacacacaua

SEQ ID NO: 1401509 - RNA, 17 nt, Homo sapiens
uuuuaacucaccucuca

SEQ ID NO: 1401510 - RNA, 17 nt, Homo sapiens
uuuuacucaugaucuug

SEQ ID NO: 1401511 - RNA, 23 nt, Homo sapiens
uuuuagaaugaugcacauuucau

SEQ ID NO: 1401512 - RNA, 18 nt, Homo sapiens
uuuuagcaguucugcaaa

SEQ ID NO: 1401513 - RNA, 22 nt, Homo sapiens
uuuuaguauaaguacauuauug

SEQ ID NO: 1401514 - RNA, 21 nt, Homo sapiens
uuuuaucuuuaaucuccucuu

SEQ ID NO: 1401515 - RNA, 23 nt, Homo sapiens
uuuuauguguggcccaagacaau

SEQ ID NO: 1401516 - RNA, 13 nt, Homo sapiens
uuuuauuacccuu

SEQ ID NO: 1401517 - RNA, 23 nt, Homo sapiens
uuuuauuuuuagacagagucuca

SEQ ID NO: 1401518 - RNA, 13 nt, Homo sapiens
uuuucauguauuu

SEQ ID NO: 1401519 - RNA, 13 nt, Homo sapiens
uuuuccuucucau

SEQ ID NO: 1401520 - RNA, 16 nt, Homo sapiens
uuuucuaaacuuuaau

SEQ ID NO: 1401521 - RNA, 14 nt, Homo sapiens
uuuucuauuauuaa

SEQ ID NO: 1401522 - RNA, 19 nt, Homo sapiens
uuuucuuauuuaacuuaac

SEQ ID NO: 1401523 - RNA, 19 nt, Homo sapiens
uuuugaacauaaagccuug

SEQ ID NO: 1401524 - RNA, 21 nt, Homo sapiens
uuuugauuuaauaacauaaca

SEQ ID NO: 1401525 - RNA, 20 nt, Homo sapiens
uuuugcuggucacugccaug

SEQ ID NO: 1401526 - RNA, 16 nt, Homo sapiens
uuuuggaauuaugucu

SEQ ID NO: 1401527 - RNA, 21 nt, Homo sapiens
uuuuggaauuaugucugcuga

SEQ ID NO: 1401528 - RNA, 23 nt, Homo sapiens
uuuuuccuuccuuaucacugaca

SEQ ID NO: 1401529 - RNA, 22 nt, Homo sapiens
uuuuucuuugagacugggucuc

SEQ ID NO: 1401530 - RNA, 22 nt, Homo sapiens
uuuuugauuucagguuuguaug

SEQ ID NO: 1401531 - RNA, 23 nt, Homo sapiens
uuuuuggaauuaugucugcugaa

SEQ ID NO: 1401532 - RNA, 21 nt, Homo sapiens
uuuuuguuucuuccaaagcac

SEQ ID NO: 1401533 - RNA, 13 nt, Homo sapiens
uuuuuuaacauuc

SEQ ID NO: 1401534 - RNA, 12 nt, Homo sapiens
uuuuuuccacaa

SEQ ID NO: 1401535 - RNA, 12 nt, Homo sapiens
aaaaaaagccaa

SEQ ID NO: 1401536 - RNA, 20 nt, Homo sapiens
aaaaaaucaaguauuggcaa

SEQ ID NO: 1401537 - RNA, 20 nt, Homo sapiens
aaaaaauuaaauugcagaug

SEQ ID NO: 1401538 - RNA, 20 nt, Homo sapiens
aaaaacaacugaccaguugu

SEQ ID NO: 1401539 - RNA, 13 nt, Homo sapiens
aaaaacacagaca

SEQ ID NO: 1401540 - RNA, 18 nt, Homo sapiens
aaaaaccauaggcugcuc

SEQ ID NO: 1401541 - RNA, 14 nt, Homo sapiens
aaaaacuauaugua

SEQ ID NO: 1401542 - RNA, 12 nt, Homo sapiens
aaaaagccaaaa

SEQ ID NO: 1401543 - RNA, 14 nt, Homo sapiens
aaaaagccugugaa

SEQ ID NO: 1401544 - RNA, 11 nt, Homo sapiens
aaaaagggaau

SEQ ID NO: 1401545 - RNA, 21 nt, Homo sapiens
aaaaauagccugccucuucuc

SEQ ID NO: 1401546 - RNA, 12 nt, Homo sapiens
aaaaauauacag

SEQ ID NO: 1401547 - RNA, 17 nt, Homo sapiens
aaaaauauuaaauagaa

SEQ ID NO: 1401548 - RNA, 13 nt, Homo sapiens
aaaaauauuauaa

SEQ ID NO: 1401549 - RNA, 15 nt, Homo sapiens
aaaaaucccuuaccu

SEQ ID NO: 1401550 - RNA, 17 nt, Homo sapiens
aaaaaugagaacauguu

SEQ ID NO: 1401551 - RNA, 20 nt, Homo sapiens
aaaaauguauuuuuccuaaa

SEQ ID NO: 1401552 - RNA, 22 nt, Homo sapiens
aaaaauuggcuaguugaaucua

SEQ ID NO: 1401553 - RNA, 23 nt, Homo sapiens
aaaacacagagaugcugcaaaua

SEQ ID NO: 1401554 - RNA, 13 nt, Homo sapiens
aaaacaggccagg

SEQ ID NO: 1401555 - RNA, 11 nt, Homo sapiens
aaaacaguauu

SEQ ID NO: 1401556 - RNA, 20 nt, Homo sapiens
aaaacaguccuucaaacuuc

SEQ ID NO: 1401557 - RNA, 19 nt, Homo sapiens
aaaacauugauuauaagca

SEQ ID NO: 1401558 - RNA, 22 nt, Homo sapiens
aaaaccaaaagaacaagaauuu

SEQ ID NO: 1401559 - RNA, 13 nt, Homo sapiens
aaaacccagagag

SEQ ID NO: 1401560 - RNA, 14 nt, Homo sapiens
aaaaccccaucucu

SEQ ID NO: 1401561 - RNA, 15 nt, Homo sapiens
aaaacuauauucuca

SEQ ID NO: 1401562 - RNA, 17 nt, Homo sapiens
aaaacucaguaucauaa

SEQ ID NO: 1401563 - RNA, 20 nt, Homo sapiens
aaaacucauuuccuauguaa

SEQ ID NO: 1401564 - RNA, 16 nt, Homo sapiens
aaaacuccaucucaaa

SEQ ID NO: 1401565 - RNA, 14 nt, Homo sapiens
aaaacugacagagg

SEQ ID NO: 1401566 - RNA, 20 nt, Homo sapiens
aaaacugauuuuuagcuuua

SEQ ID NO: 1401567 - RNA, 17 nt, Homo sapiens
aaaacuggcaucugaca

SEQ ID NO: 1401568 - RNA, 16 nt, Homo sapiens
aaaacuucaguaagua

SEQ ID NO: 1401569 - RNA, 22 nt, Homo sapiens
aaaacuugauguguuaucucuu

SEQ ID NO: 1401570 - RNA, 23 nt, Homo sapiens
aaaagaaucccuguucauuguaa

SEQ ID NO: 1401571 - RNA, 15 nt, Homo sapiens
aaaagaccaguccau

SEQ ID NO: 1401572 - RNA, 15 nt, Homo sapiens
aaaagagagaucuug

SEQ ID NO: 1401573 - RNA, 21 nt, Homo sapiens
aaaagggauccguacauucaa

SEQ ID NO: 1401574 - RNA, 13 nt, Homo sapiens
aaaagggcuuucu

SEQ ID NO: 1401575 - RNA, 12 nt, Homo sapiens
aaaaggucuuua

SEQ ID NO: 1401576 - RNA, 18 nt, Homo sapiens
aaaaguaaguaccacuca

SEQ ID NO: 1401577 - RNA, 19 nt, Homo sapiens
aaaaguccuugauuuagca

SEQ ID NO: 1401578 - RNA, 20 nt, Homo sapiens
aaaagucugcauuacauucc

SEQ ID NO: 1401579 - RNA, 21 nt, Homo sapiens
aaaagucugcauuacauuccu

SEQ ID NO: 1401580 - RNA, 12 nt, Homo sapiens
aaaagugggcca

SEQ ID NO: 1401581 - RNA, 13 nt, Homo sapiens
aaaaguuacuuau

SEQ ID NO: 1401582 - RNA, 15 nt, Homo sapiens
aaaaguuaugguacu

SEQ ID NO: 1401583 - RNA, 21 nt, Homo sapiens
aaaauaaugucuuguuaauau

SEQ ID NO: 1401584 - RNA, 21 nt, Homo sapiens
aaaauacaguauucuguacca

SEQ ID NO: 1401585 - RNA, 17 nt, Homo sapiens
aaaauacaugcaucuca

SEQ ID NO: 1401586 - RNA, 18 nt, Homo sapiens
aaaauacucuaauucuaa

SEQ ID NO: 1401587 - RNA, 15 nt, Homo sapiens
aaaauagacuaaccu

SEQ ID NO: 1401588 - RNA, 17 nt, Homo sapiens
aaaauagccacuuaccu

SEQ ID NO: 1401589 - RNA, 19 nt, Homo sapiens
aaaauaggagagagaucau

SEQ ID NO: 1401590 - RNA, 22 nt, Homo sapiens
aaaauaguuuggauuacuuaaa

SEQ ID NO: 1401591 - RNA, 20 nt, Homo sapiens
aaaaucaaacaauucaggga

SEQ ID NO: 1401592 - RNA, 12 nt, Homo sapiens
aaaaucaaacag

SEQ ID NO: 1401593 - RNA, 19 nt, Homo sapiens
aaaaucagccugcuccagc

SEQ ID NO: 1401594 - RNA, 20 nt, Homo sapiens
aaaaucauucuacugaacag

SEQ ID NO: 1401595 - RNA, 22 nt, Homo sapiens
aaaaugaaaauuaggauuucau

SEQ ID NO: 1401596 - RNA, 23 nt, Homo sapiens
aaaaugagugacuagacguucau

SEQ ID NO: 1401597 - RNA, 18 nt, Homo sapiens
aaaaugaugggacaauaa

SEQ ID NO: 1401598 - RNA, 13 nt, Homo sapiens
aaaaugcauuuaa

SEQ ID NO: 1401599 - RNA, 19 nt, Homo sapiens
aaaauggacaaaauccaug

SEQ ID NO: 1401600 - RNA, 19 nt, Homo sapiens
aaaauggauccccagugaa

SEQ ID NO: 1401601 - RNA, 20 nt, Homo sapiens
aaaauggauccccagugaaa

SEQ ID NO: 1401602 - RNA, 20 nt, Homo sapiens
aaaauggggaagaguugaaa

SEQ ID NO: 1401603 - RNA, 22 nt, Homo sapiens
aaaauguccaccaauagaauga

SEQ ID NO: 1401604 - RNA, 20 nt, Homo sapiens
aaaaugucuguuaacuuaau

SEQ ID NO: 1401605 - RNA, 13 nt, Homo sapiens
aaaauuaaauugc

SEQ ID NO: 1401606 - RNA, 15 nt, Homo sapiens
aaaauuacugaugca

SEQ ID NO: 1401607 - RNA, 20 nt, Homo sapiens
aaaauucuauuacaguaugu

SEQ ID NO: 1401608 - RNA, 16 nt, Homo sapiens
acucgcuucucuguga

SEQ ID NO: 1401609 - RNA, 16 nt, Homo sapiens
acucuaacaucuagcu

SEQ ID NO: 1401610 - RNA, 15 nt, Homo sapiens
acucuaacugauguu

SEQ ID NO: 1401611 - RNA, 13 nt, Homo sapiens
acucuacccuaua

SEQ ID NO: 1401612 - RNA, 22 nt, Homo sapiens
acucuauggguaucaaacagcu

SEQ ID NO: 1401613 - RNA, 15 nt, Homo sapiens
acucucagcuugcug

SEQ ID NO: 1401614 - RNA, 18 nt, Homo sapiens
acucucugugaccugccc

SEQ ID NO: 1401615 - RNA, 13 nt, Homo sapiens
acucugcacuggu

SEQ ID NO: 1401616 - RNA, 12 nt, Homo sapiens
acucugugucag

SEQ ID NO: 1401617 - RNA, 17 nt, Homo sapiens
acugaaaacaagccaug

SEQ ID NO: 1401618 - RNA, 18 nt, Homo sapiens
acugaaaacuugccguua

SEQ ID NO: 1401619 - RNA, 16 nt, Homo sapiens
acugaaauauacacac

SEQ ID NO: 1401620 - RNA, 15 nt, Homo sapiens
acugaauuaaugaca

SEQ ID NO: 1401621 - RNA, 14 nt, Homo sapiens
acugacacaugcug

SEQ ID NO: 1401622 - RNA, 19 nt, Homo sapiens
acugacacuuugccagaaa

SEQ ID NO: 1401623 - RNA, 11 nt, Homo sapiens
acugaccagcc

SEQ ID NO: 1401624 - RNA, 15 nt, Homo sapiens
acugacuccugugga

SEQ ID NO: 1401625 - RNA, 15 nt, Homo sapiens
acugacuuucucagc

SEQ ID NO: 1401626 - RNA, 18 nt, Homo sapiens
acugacuuucucagccuc

SEQ ID NO: 1401627 - RNA, 17 nt, Homo sapiens
acugagcaaagcauuga

SEQ ID NO: 1401628 - RNA, 17 nt, Homo sapiens
acugagcagacugguga

SEQ ID NO: 1401629 - RNA, 15 nt, Homo sapiens
acugaggcagggaag

SEQ ID NO: 1401630 - RNA, 23 nt, Homo sapiens
acugaggcccagggaggugaccc

SEQ ID NO: 1401631 - RNA, 19 nt, Homo sapiens
acugagguugggguguacu

SEQ ID NO: 1401632 - RNA, 23 nt, Homo sapiens
acugaguccucguagccaucucu

SEQ ID NO: 1401633 - RNA, 20 nt, Homo sapiens
acugcaccgggccacagaga

SEQ ID NO: 1401634 - RNA, 21 nt, Homo sapiens
acugcaccuucugugccucag

SEQ ID NO: 1401635 - RNA, 21 nt, Homo sapiens
acugcacuauagccuagguga

SEQ ID NO: 1401636 - RNA, 20 nt, Homo sapiens
acugcacuccagccugggug

SEQ ID NO: 1401637 - RNA, 20 nt, Homo sapiens
acugcauaaaaagugccugu

SEQ ID NO: 1401638 - RNA, 21 nt, Homo sapiens
acugcauaugaaaggacacua

SEQ ID NO: 1401639 - RNA, 19 nt, Homo sapiens
acugcauuuuuaaauacaa

SEQ ID NO: 1401640 - RNA, 12 nt, Homo sapiens
acugccaaagaa

SEQ ID NO: 1401641 - RNA, 22 nt, Homo sapiens
acugccauggaggcacacagcu

SEQ ID NO: 1401642 - RNA, 17 nt, Homo sapiens
acugcccugucuagguc

SEQ ID NO: 1401643 - RNA, 22 nt, Homo sapiens
acugcugcccagccuccaagcu

SEQ ID NO: 1401644 - RNA, 21 nt, Homo sapiens
acugcuucuaccaacuggaag

SEQ ID NO: 1401645 - RNA, 15 nt, Homo sapiens
acuggaagcacagcu

SEQ ID NO: 1401646 - RNA, 15 nt, Homo sapiens
acuggagaagucuua

SEQ ID NO: 1401647 - RNA, 19 nt, Homo sapiens
acuggagccccaucagcuc

SEQ ID NO: 1401648 - RNA, 15 nt, Homo sapiens
acuggaugaggucau

SEQ ID NO: 1401649 - RNA, 16 nt, Homo sapiens
acuggcagcaucuuca

SEQ ID NO: 1401650 - RNA, 16 nt, Homo sapiens
acuggcaguuuuccau

SEQ ID NO: 1401651 - RNA, 14 nt, Homo sapiens
acuggcccaagugg

SEQ ID NO: 1401652 - RNA, 22 nt, Homo sapiens
acuggcccucuucuuacuugau

SEQ ID NO: 1401653 - RNA, 18 nt, Homo sapiens
acuggcuuugucccacag

SEQ ID NO: 1401654 - RNA, 23 nt, Homo sapiens
acugggacuaaguguaccagaga

SEQ ID NO: 1401655 - RNA, 19 nt, Homo sapiens
acugggccuccaaccaugu

SEQ ID NO: 1401656 - RNA, 16 nt, Homo sapiens
acugguauguguggau

SEQ ID NO: 1401657 - RNA, 23 nt, Homo sapiens
acugguauguguggaugaugcug

SEQ ID NO: 1401658 - RNA, 21 nt, Homo sapiens
acuggucuuguggaauuggga

SEQ ID NO: 1401659 - RNA, 23 nt, Homo sapiens
acuguaaauguggcccccagugg

SEQ ID NO: 1401660 - RNA, 15 nt, Homo sapiens
acuguacuagucugu

SEQ ID NO: 1401661 - RNA, 13 nt, Homo sapiens
acuguacuccucc

SEQ ID NO: 1401662 - RNA, 14 nt, Homo sapiens
acugucauagaaau

SEQ ID NO: 1401663 - RNA, 14 nt, Homo sapiens
acuguccuacccac

SEQ ID NO: 1401664 - RNA, 16 nt, Homo sapiens
acuguccuacccaccc

SEQ ID NO: 1401665 - RNA, 12 nt, Homo sapiens
acugucucaaga

SEQ ID NO: 1401666 - RNA, 15 nt, Homo sapiens
acugucuccuaccuc

SEQ ID NO: 1401667 - RNA, 23 nt, Homo sapiens
acugucuuaauuaaguaaacuaa

SEQ ID NO: 1401668 - RNA, 18 nt, Homo sapiens
acugugaggguaaaggcu

SEQ ID NO: 1401669 - RNA, 20 nt, Homo sapiens
acugugucagggaacauauu

SEQ ID NO: 1401670 - RNA, 17 nt, Homo sapiens
acuguuacugugucagg

SEQ ID NO: 1401671 - RNA, 23 nt, Homo sapiens
acuguucucuauuagacuuuaga

SEQ ID NO: 1401672 - RNA, 18 nt, Homo sapiens
acuguugacauccaagcu

SEQ ID NO: 1401673 - RNA, 14 nt, Homo sapiens
acuguuucucucac

SEQ ID NO: 1401674 - RNA, 16 nt, Homo sapiens
acuuaaauaucaauca

SEQ ID NO: 1401675 - RNA, 13 nt, Homo sapiens
acuuaacauucug

SEQ ID NO: 1401676 - RNA, 11 nt, Homo sapiens
acuuaaugucu

SEQ ID NO: 1401677 - RNA, 21 nt, Homo sapiens
acuuaauguuugguaacuuuu

SEQ ID NO: 1401678 - RNA, 16 nt, Homo sapiens
acuuacacaucuucca

SEQ ID NO: 1401679 - RNA, 17 nt, Homo sapiens
acuuacacaucuuccac

SEQ ID NO: 1401680 - RNA, 17 nt, Homo sapiens
acuuagcaugucccuac

SEQ ID NO: 1401681 - RNA, 22 nt, Homo sapiens
acuuaucccaagagaaugaaau

SEQ ID NO: 1401682 - RNA, 23 nt, Homo sapiens
acuuauuguuuaagguuuccuca

SEQ ID NO: 1401683 - RNA, 18 nt, Homo sapiens
acuucaaaaacugucaaa

SEQ ID NO: 1401684 - RNA, 22 nt, Homo sapiens
acuucaaggguuuguugaacaa

SEQ ID NO: 1401685 - RNA, 18 nt, Homo sapiens
acuucaguugcuuugcag

SEQ ID NO: 1401686 - RNA, 13 nt, Homo sapiens
acuuccacuccaa

SEQ ID NO: 1401687 - RNA, 13 nt, Homo sapiens
acuuccagugcaa

SEQ ID NO: 1401688 - RNA, 16 nt, Homo sapiens
acuuccauuaacuuag

SEQ ID NO: 1401689 - RNA, 13 nt, Homo sapiens
acuuccauuugcu

SEQ ID NO: 1401690 - RNA, 13 nt, Homo sapiens
acuucgacuguga

SEQ ID NO: 1401691 - RNA, 15 nt, Homo sapiens
acuucuaaaugaagu

SEQ ID NO: 1401692 - RNA, 21 nt, Homo sapiens
acuucuaaaugaagugcaaau

SEQ ID NO: 1401693 - RNA, 15 nt, Homo sapiens
acuucuggccucuag

SEQ ID NO: 1401694 - RNA, 17 nt, Homo sapiens
acuugaaauuugccuug

SEQ ID NO: 1401695 - RNA, 17 nt, Homo sapiens
acuugagcgugaaucug

SEQ ID NO: 1401696 - RNA, 20 nt, Homo sapiens
acuugaugacccccaaccaa

SEQ ID NO: 1401697 - RNA, 18 nt, Homo sapiens
acuugcacgcccaugugu

SEQ ID NO: 1401698 - RNA, 19 nt, Homo sapiens
acuugcacgcccaugugug

SEQ ID NO: 1401699 - RNA, 22 nt, Homo sapiens
acuugcugugugaccucaggcc

SEQ ID NO: 1401700 - RNA, 13 nt, Homo sapiens
acuugggaacuag

SEQ ID NO: 1401701 - RNA, 14 nt, Homo sapiens
acuugguucaguac

SEQ ID NO: 1401702 - RNA, 18 nt, Homo sapiens
acuugucuuguucaccuu

SEQ ID NO: 1401703 - RNA, 22 nt, Homo sapiens
acuugugcugaucgugcuaaau

SEQ ID NO: 1401704 - RNA, 22 nt, Homo sapiens
acuugugugugggcugugagug

SEQ ID NO: 1401705 - RNA, 14 nt, Homo sapiens
acuuuaagauguuu

SEQ ID NO: 1401706 - RNA, 19 nt, Homo sapiens
acuuuaaucccacuugccc

SEQ ID NO: 1401707 - RNA, 13 nt, Homo sapiens
acuuuagaaauaa

SEQ ID NO: 1401708 - RNA, 13 nt, Homo sapiens
acuuuagaauuaa

SEQ ID NO: 1401709 - RNA, 20 nt, Homo sapiens
acuuuagaguagcaugagag

SEQ ID NO: 1401710 - RNA, 21 nt, Homo sapiens
acuuuauagaucagccaguga

SEQ ID NO: 1401711 - RNA, 22 nt, Homo sapiens
acuuuauagaucagccagugac

SEQ ID NO: 1401712 - RNA, 18 nt, Homo sapiens
acuuucagguacuaaaua

SEQ ID NO: 1401713 - RNA, 20 nt, Homo sapiens
acuuucagguacuaaauacc

SEQ ID NO: 1401714 - RNA, 18 nt, Homo sapiens
acuuucuaagaagauacc

SEQ ID NO: 1401715 - RNA, 22 nt, Homo sapiens
acuuucuguugccacaacccug

SEQ ID NO: 1401716 - RNA, 15 nt, Homo sapiens
acuuuggaggacaau

SEQ ID NO: 1401717 - RNA, 15 nt, Homo sapiens
acuuugggaggccaa

SEQ ID NO: 1401718 - RNA, 17 nt, Homo sapiens
acuuugggauucuuucc

SEQ ID NO: 1401719 - RNA, 20 nt, Homo sapiens
acuuuguauccucugaccua

SEQ ID NO: 1401720 - RNA, 17 nt, Homo sapiens
acuuuuaaguugcugau

SEQ ID NO: 1401721 - RNA, 17 nt, Homo sapiens
auucucauuugucacac

SEQ ID NO: 1401722 - RNA, 19 nt, Homo sapiens
auucucauuugucacacac

SEQ ID NO: 1401723 - RNA, 18 nt, Homo sapiens
auucucuccucagacugc

SEQ ID NO: 1401724 - RNA, 15 nt, Homo sapiens
auucucuuacugcuu

SEQ ID NO: 1401725 - RNA, 17 nt, Homo sapiens
auucugaaucaagguga

SEQ ID NO: 1401726 - RNA, 18 nt, Homo sapiens
auucugcucuuugauuca

SEQ ID NO: 1401727 - RNA, 12 nt, Homo sapiens
auucugcugaug

SEQ ID NO: 1401728 - RNA, 15 nt, Homo sapiens
auucugcugaugcua

SEQ ID NO: 1401729 - RNA, 17 nt, Homo sapiens
auucuggaaaagcaaaa

SEQ ID NO: 1401730 - RNA, 20 nt, Homo sapiens
auucuuauuuaaguuauuga

SEQ ID NO: 1401731 - RNA, 12 nt, Homo sapiens
auucuucuguac

SEQ ID NO: 1401732 - RNA, 13 nt, Homo sapiens
auucuuggaauac

SEQ ID NO: 1401733 - RNA, 18 nt, Homo sapiens
auucuuuauucuuuuacu

SEQ ID NO: 1401734 - RNA, 22 nt, Homo sapiens
auucuuugaauuucccagucuc

SEQ ID NO: 1401735 - RNA, 15 nt, Homo sapiens
auucuuuuguaauau

SEQ ID NO: 1401736 - RNA, 17 nt, Homo sapiens
auugaaaggcauucucu

SEQ ID NO: 1401737 - RNA, 19 nt, Homo sapiens
auugaaguuuugacaucaa

SEQ ID NO: 1401738 - RNA, 19 nt, Homo sapiens
auugacaucagcaucaccu

SEQ ID NO: 1401739 - RNA, 17 nt, Homo sapiens
auugacuaucaaacuga

SEQ ID NO: 1401740 - RNA, 18 nt, Homo sapiens
auugacugauggugaaau

SEQ ID NO: 1401741 - RNA, 14 nt, Homo sapiens
auugagcaaagggg

SEQ ID NO: 1401742 - RNA, 23 nt, Homo sapiens
auugauauacacggaugacuuaa

SEQ ID NO: 1401743 - RNA, 14 nt, Homo sapiens
auugauguacuuua

SEQ ID NO: 1401744 - RNA, 20 nt, Homo sapiens
auugaugucaaaaacuucaa

SEQ ID NO: 1401745 - RNA, 12 nt, Homo sapiens
auugauguugcu

SEQ ID NO: 1401746 - RNA, 13 nt, Homo sapiens
auugauguugcug

SEQ ID NO: 1401747 - RNA, 19 nt, Homo sapiens
auugauuauaagcauguau

SEQ ID NO: 1401748 - RNA, 20 nt, Homo sapiens
auugcagcgauuaauaacag

SEQ ID NO: 1401749 - RNA, 17 nt, Homo sapiens
auugccuagaggugcuc

SEQ ID NO: 1401750 - RNA, 12 nt, Homo sapiens
auugcuccauac

SEQ ID NO: 1401751 - RNA, 13 nt, Homo sapiens
auugcugcucucu

SEQ ID NO: 1401752 - RNA, 21 nt, Homo sapiens
auugcuuaucaguaguaucaa

SEQ ID NO: 1401753 - RNA, 15 nt, Homo sapiens
auugcuuuacuggcu

SEQ ID NO: 1401754 - RNA, 18 nt, Homo sapiens
auuggaauuaaccuggug

SEQ ID NO: 1401755 - RNA, 22 nt, Homo sapiens
auugggauuuucuacaaguauu

SEQ ID NO: 1401756 - RNA, 23 nt, Homo sapiens
auugggcccuuccggcaugcccc

SEQ ID NO: 1401757 - RNA, 17 nt, Homo sapiens
auuggggacaugggaug

SEQ ID NO: 1401758 - RNA, 20 nt, Homo sapiens
auugguggcagauuuuacaa

SEQ ID NO: 1401759 - RNA, 16 nt, Homo sapiens
auuguacaaccuguga

SEQ ID NO: 1401760 - RNA, 14 nt, Homo sapiens
auuguacagaauca

SEQ ID NO: 1401761 - RNA, 13 nt, Homo sapiens
auuguacuguuga

SEQ ID NO: 1401762 - RNA, 21 nt, Homo sapiens
auuguaucaaguggcaugugc

SEQ ID NO: 1401763 - RNA, 14 nt, Homo sapiens
auugucagcuccuu

SEQ ID NO: 1401764 - RNA, 16 nt, Homo sapiens
auugucuguaaugaca

SEQ ID NO: 1401765 - RNA, 14 nt, Homo sapiens
auugucuuacuguu

SEQ ID NO: 1401766 - RNA, 18 nt, Homo sapiens
auugucuuacuguugcau

SEQ ID NO: 1401767 - RNA, 18 nt, Homo sapiens
auugucuucugaccucua

SEQ ID NO: 1401768 - RNA, 21 nt, Homo sapiens
auugucuuuggugcuuuucac

SEQ ID NO: 1401769 - RNA, 15 nt, Homo sapiens
auugugagccaccac

SEQ ID NO: 1401770 - RNA, 18 nt, Homo sapiens
auugugauauuuuuacuu

SEQ ID NO: 1401771 - RNA, 18 nt, Homo sapiens
auugugaucagaccauaa

SEQ ID NO: 1401772 - RNA, 23 nt, Homo sapiens
auugugauuauagugacaaugaa

SEQ ID NO: 1401773 - RNA, 21 nt, Homo sapiens
auugugccuacgaauagccac

SEQ ID NO: 1401774 - RNA, 22 nt, Homo sapiens
auuguguucucuauugcugcuc

SEQ ID NO: 1401775 - RNA, 20 nt, Homo sapiens
auuguguuuugagguuuccu

SEQ ID NO: 1401776 - RNA, 13 nt, Homo sapiens
auuuaaacaucag

SEQ ID NO: 1401777 - RNA, 14 nt, Homo sapiens
auuuaaacaucagc

SEQ ID NO: 1401778 - RNA, 15 nt, Homo sapiens
auuuaaagacaaaga

SEQ ID NO: 1401779 - RNA, 18 nt, Homo sapiens
auuuaaucuuaaucuguu

SEQ ID NO: 1401780 - RNA, 14 nt, Homo sapiens
auuuaaucuuccau

SEQ ID NO: 1401781 - RNA, 14 nt, Homo sapiens
auuuacucaauauc

SEQ ID NO: 1401782 - RNA, 19 nt, Homo sapiens
auuuacuuaacagaacagu

SEQ ID NO: 1401783 - RNA, 18 nt, Homo sapiens
auuuaggaccaauaccuc

SEQ ID NO: 1401784 - RNA, 18 nt, Homo sapiens
auuuaguaacaguuguga

SEQ ID NO: 1401785 - RNA, 19 nt, Homo sapiens
auuuauaauguuaguagaa

SEQ ID NO: 1401786 - RNA, 14 nt, Homo sapiens
auuuaucacacaaa

SEQ ID NO: 1401787 - RNA, 14 nt, Homo sapiens
auuuaucagugaca

SEQ ID NO: 1401788 - RNA, 15 nt, Homo sapiens
auuuaucugugcaaa

SEQ ID NO: 1401789 - RNA, 12 nt, Homo sapiens
auuuaucugugu

SEQ ID NO: 1401790 - RNA, 19 nt, Homo sapiens
auuuaugagaaaguucuca

SEQ ID NO: 1401791 - RNA, 23 nt, Homo sapiens
auuuaugaguuuuugauagcuuu

SEQ ID NO: 1401792 - RNA, 19 nt, Homo sapiens
auuuauggucaacacuuaa

SEQ ID NO: 1401793 - RNA, 13 nt, Homo sapiens
auuuauucugcuc

SEQ ID NO: 1401794 - RNA, 13 nt, Homo sapiens
auuuauugccugg

SEQ ID NO: 1401795 - RNA, 16 nt, Homo sapiens
aagaugaugcuauuaa

SEQ ID NO: 1401796 - RNA, 20 nt, Homo sapiens
aagaugcauuaucuaugaua

SEQ ID NO: 1401797 - RNA, 21 nt, Homo sapiens
aagaugccagugaaacuucaa

SEQ ID NO: 1401798 - RNA, 16 nt, Homo sapiens
aagaugcccacugagg

SEQ ID NO: 1401799 - RNA, 22 nt, Homo sapiens
aagauguggggaaaauucucau

SEQ ID NO: 1401800 - RNA, 17 nt, Homo sapiens
aagauguuauacaacca

SEQ ID NO: 1401801 - RNA, 20 nt, Homo sapiens
aagauugcgccauugcacuc

SEQ ID NO: 1401802 - RNA, 17 nt, Homo sapiens
aagauuuaauuugccaa

SEQ ID NO: 1401803 - RNA, 16 nt, Homo sapiens
aagauuuuaugcugcu

SEQ ID NO: 1401804 - RNA, 13 nt, Homo sapiens
aagcaacaucuag

SEQ ID NO: 1401805 - RNA, 20 nt, Homo sapiens
aagcaaguagcuuuccacau

SEQ ID NO: 1401806 - RNA, 16 nt, Homo sapiens
aagcaauaaccucaaa

SEQ ID NO: 1401807 - RNA, 19 nt, Homo sapiens
aagcacagauguucuucaa

SEQ ID NO: 1401808 - RNA, 15 nt, Homo sapiens
aagcaccccaugcca

SEQ ID NO: 1401809 - RNA, 17 nt, Homo sapiens
aagcacuguuucucuca

SEQ ID NO: 1401810 - RNA, 12 nt, Homo sapiens
aagcacuuugug

SEQ ID NO: 1401811 - RNA, 16 nt, Homo sapiens
aagcacuuugugcugu

SEQ ID NO: 1401812 - RNA, 17 nt, Homo sapiens
aagcagauuuaacaauu

SEQ ID NO: 1401813 - RNA, 16 nt, Homo sapiens
aagcagccaagcuccu

SEQ ID NO: 1401814 - RNA, 19 nt, Homo sapiens
aagcaggacuaaaugucua

SEQ ID NO: 1401815 - RNA, 17 nt, Homo sapiens
aagcagucaauuuucac

SEQ ID NO: 1401816 - RNA, 20 nt, Homo sapiens
aagcauaaaaauuagccaag

SEQ ID NO: 1401817 - RNA, 18 nt, Homo sapiens
aagcauccaggcacccaa

SEQ ID NO: 1401818 - RNA, 13 nt, Homo sapiens
aagcauucuucaa

SEQ ID NO: 1401819 - RNA, 16 nt, Homo sapiens
aagcauuggacauuua

SEQ ID NO: 1401820 - RNA, 15 nt, Homo sapiens
aagcauuuacuuuga

SEQ ID NO: 1401821 - RNA, 15 nt, Homo sapiens
aagcauuucaccuuu

SEQ ID NO: 1401822 - RNA, 15 nt, Homo sapiens
aagccagucuuaaca

SEQ ID NO: 1401823 - RNA, 22 nt, Homo sapiens
aagccauaguggagagaacuga

SEQ ID NO: 1401824 - RNA, 17 nt, Homo sapiens
aagcccaagugaaauca

SEQ ID NO: 1401825 - RNA, 21 nt, Homo sapiens
aagccucagagaauugcugau

SEQ ID NO: 1401826 - RNA, 18 nt, Homo sapiens
aagccucucaucccccau

SEQ ID NO: 1401827 - RNA, 16 nt, Homo sapiens
aagccuuggauguaua

SEQ ID NO: 1401828 - RNA, 22 nt, Homo sapiens
aagcuaaauccuuuacuguuag

SEQ ID NO: 1401829 - RNA, 21 nt, Homo sapiens
aagcuaggguggcccuugcag

SEQ ID NO: 1401830 - RNA, 13 nt, Homo sapiens
aagcucaucucag

SEQ ID NO: 1401831 - RNA, 20 nt, Homo sapiens
aagcucuugaagacacugaa

SEQ ID NO: 1401832 - RNA, 20 nt, Homo sapiens
aagcugagcaccaggggaug

SEQ ID NO: 1401833 - RNA, 17 nt, Homo sapiens
aagcugccgguucuuaa

SEQ ID NO: 1401834 - RNA, 13 nt, Homo sapiens
aagcugcuuuaaa

SEQ ID NO: 1401835 - RNA, 14 nt, Homo sapiens
aagcugcuuuagaa

SEQ ID NO: 1401836 - RNA, 19 nt, Homo sapiens
aagcugggauaaucacauu

SEQ ID NO: 1401837 - RNA, 21 nt, Homo sapiens
aagcugggauaaucacauuau

SEQ ID NO: 1401838 - RNA, 16 nt, Homo sapiens
aagcugugacccucaa

SEQ ID NO: 1401839 - RNA, 23 nt, Homo sapiens
aagcuguguccuugcaccugcau

SEQ ID NO: 1401840 - RNA, 18 nt, Homo sapiens
aagcuuuuuagugcauua

SEQ ID NO: 1401841 - RNA, 18 nt, Homo sapiens
aaggaaaccaagugguca

SEQ ID NO: 1401842 - RNA, 16 nt, Homo sapiens
aaggaagaucaggcca

SEQ ID NO: 1401843 - RNA, 15 nt, Homo sapiens
aaggaagccacagcu

SEQ ID NO: 1401844 - RNA, 18 nt, Homo sapiens
aaggaagucagacuuuuu

SEQ ID NO: 1401845 - RNA, 15 nt, Homo sapiens
aaggaaugcuuggaa

SEQ ID NO: 1401846 - RNA, 15 nt, Homo sapiens
aaggagaacuaucca

SEQ ID NO: 1401847 - RNA, 23 nt, Homo sapiens
aaggagacucaccucugccucaa

SEQ ID NO: 1401848 - RNA, 23 nt, Homo sapiens
aaggagagucuugcagugauuaa

SEQ ID NO: 1401849 - RNA, 17 nt, Homo sapiens
aaggauaccaaauacca

SEQ ID NO: 1401850 - RNA, 18 nt, Homo sapiens
aaggauaccaaauaccau

SEQ ID NO: 1401851 - RNA, 15 nt, Homo sapiens
aaggauagugcgaug

SEQ ID NO: 1401852 - RNA, 16 nt, Homo sapiens
aaggaugagcauuuag

SEQ ID NO: 1401853 - RNA, 17 nt, Homo sapiens
aaggaugggaaggaggg

SEQ ID NO: 1401854 - RNA, 15 nt, Homo sapiens
aaggauucuguaugc

SEQ ID NO: 1401855 - RNA, 19 nt, Homo sapiens
acaccuguagucccagcua

SEQ ID NO: 1401856 - RNA, 15 nt, Homo sapiens
acaccuugacagggc

SEQ ID NO: 1401857 - RNA, 19 nt, Homo sapiens
acaccuugacagggcacac

SEQ ID NO: 1401858 - RNA, 18 nt, Homo sapiens
acacggggcuugcaacuu

SEQ ID NO: 1401859 - RNA, 19 nt, Homo sapiens
acacguaaaucuguucaag

SEQ ID NO: 1401860 - RNA, 15 nt, Homo sapiens
acacuaaaaggugac

SEQ ID NO: 1401861 - RNA, 18 nt, Homo sapiens
acacuaacauauaauguu

SEQ ID NO: 1401862 - RNA, 17 nt, Homo sapiens
acacuaauacaccaggu

SEQ ID NO: 1401863 - RNA, 19 nt, Homo sapiens
acacuauaaagguugacaa

SEQ ID NO: 1401864 - RNA, 15 nt, Homo sapiens
acacucacauuuauu

SEQ ID NO: 1401865 - RNA, 16 nt, Homo sapiens
acacuccccugcacug

SEQ ID NO: 1401866 - RNA, 16 nt, Homo sapiens
acacugaccuguguuc

SEQ ID NO: 1401867 - RNA, 19 nt, Homo sapiens
acacugcugcuccagugca

SEQ ID NO: 1401868 - RNA, 21 nt, Homo sapiens
acacugcugcuccagugcagg

SEQ ID NO: 1401869 - RNA, 16 nt, Homo sapiens
acacugugggacucuu

SEQ ID NO: 1401870 - RNA, 15 nt, Homo sapiens
acacuguucugaaag

SEQ ID NO: 1401871 - RNA, 22 nt, Homo sapiens
acacuguucugaaagugacuca

SEQ ID NO: 1401872 - RNA, 14 nt, Homo sapiens
acacuguuugccca

SEQ ID NO: 1401873 - RNA, 16 nt, Homo sapiens
acacuuccauuaacuu

SEQ ID NO: 1401874 - RNA, 20 nt, Homo sapiens
acacuucuaaaugaagugca

SEQ ID NO: 1401875 - RNA, 21 nt, Homo sapiens
acagaacacugucuugaagac

SEQ ID NO: 1401876 - RNA, 18 nt, Homo sapiens
acagaacuauguacuuua

SEQ ID NO: 1401877 - RNA, 15 nt, Homo sapiens
acagaaggauguccc

SEQ ID NO: 1401878 - RNA, 20 nt, Homo sapiens
acagacaagugacuguaucu

SEQ ID NO: 1401879 - RNA, 17 nt, Homo sapiens
acagacuaugucaccca

SEQ ID NO: 1401880 - RNA, 13 nt, Homo sapiens
acagagagacaga

SEQ ID NO: 1401881 - RNA, 15 nt, Homo sapiens
acagagaugugauaa

SEQ ID NO: 1401882 - RNA, 18 nt, Homo sapiens
acagagcagaacuuucac

SEQ ID NO: 1401883 - RNA, 19 nt, Homo sapiens
acagagccccacccucaga

SEQ ID NO: 1401884 - RNA, 23 nt, Homo sapiens
acagagcugccucucgguggcca

SEQ ID NO: 1401885 - RNA, 18 nt, Homo sapiens
acagaggaagagcaggca

SEQ ID NO: 1401886 - RNA, 12 nt, Homo sapiens
acagaggugcug

SEQ ID NO: 1401887 - RNA, 13 nt, Homo sapiens
acagagugcauug

SEQ ID NO: 1401888 - RNA, 17 nt, Homo sapiens
acagagugcauugugag

SEQ ID NO: 1401889 - RNA, 14 nt, Homo sapiens
acagaguucacuau

SEQ ID NO: 1401890 - RNA, 18 nt, Homo sapiens
acagaugacaaugggagc

SEQ ID NO: 1401891 - RNA, 20 nt, Homo sapiens
acagauggauagucugucca

SEQ ID NO: 1401892 - RNA, 16 nt, Homo sapiens
acagauggauuugccu

SEQ ID NO: 1401893 - RNA, 22 nt, Homo sapiens
acagaugugugauucacagugu

SEQ ID NO: 1401894 - RNA, 22 nt, Homo sapiens
acagauuccaggcgaugugcaa

SEQ ID NO: 1401895 - RNA, 21 nt, Homo sapiens
acagcaaaaccauugcuucac

SEQ ID NO: 1401896 - RNA, 20 nt, Homo sapiens
acagcaaaacuccaucucaa

SEQ ID NO: 1401897 - RNA, 15 nt, Homo sapiens
acagcagaacuucug

SEQ ID NO: 1401898 - RNA, 17 nt, Homo sapiens
acagcauggugcaugcc

SEQ ID NO: 1401899 - RNA, 13 nt, Homo sapiens
acagcauguguau

SEQ ID NO: 1401900 - RNA, 15 nt, Homo sapiens
acagcauucuuguca

SEQ ID NO: 1401901 - RNA, 16 nt, Homo sapiens
acagccaauacaauua

SEQ ID NO: 1401902 - RNA, 21 nt, Homo sapiens
aggcuggcagauuuccaaaag

SEQ ID NO: 1401903 - RNA, 13 nt, Homo sapiens
aggcuggggcuau

SEQ ID NO: 1401904 - RNA, 16 nt, Homo sapiens
aggcugugggccucaa

SEQ ID NO: 1401905 - RNA, 12 nt, Homo sapiens
aggcuucuucag

SEQ ID NO: 1401906 - RNA, 21 nt, Homo sapiens
agggaagcugucccucacugu

SEQ ID NO: 1401907 - RNA, 19 nt, Homo sapiens
agggaaggucucaggagaa

SEQ ID NO: 1401908 - RNA, 17 nt, Homo sapiens
agggaauaauccagaaa

SEQ ID NO: 1401909 - RNA, 13 nt, Homo sapiens
agggaaugcauua

SEQ ID NO: 1401910 - RNA, 14 nt, Homo sapiens
agggagaagggaug

SEQ ID NO: 1401911 - RNA, 15 nt, Homo sapiens
agggagagccaucac

SEQ ID NO: 1401912 - RNA, 21 nt, Homo sapiens
agggagcuaucaggaacagcu

SEQ ID NO: 1401913 - RNA, 18 nt, Homo sapiens
agggaggcucugucucaa

SEQ ID NO: 1401914 - RNA, 14 nt, Homo sapiens
agggauaagcaaaa

SEQ ID NO: 1401915 - RNA, 21 nt, Homo sapiens
agggauagaggggggcugccu

SEQ ID NO: 1401916 - RNA, 17 nt, Homo sapiens
agggauagcacugagca

SEQ ID NO: 1401917 - RNA, 17 nt, Homo sapiens
agggauccguacauuca

SEQ ID NO: 1401918 - RNA, 17 nt, Homo sapiens
agggaugcugccugagu

SEQ ID NO: 1401919 - RNA, 19 nt, Homo sapiens
agggaugcugccugaguca

SEQ ID NO: 1401920 - RNA, 23 nt, Homo sapiens
agggauggggcagucucugccca

SEQ ID NO: 1401921 - RNA, 17 nt, Homo sapiens
agggauuagguguucag

SEQ ID NO: 1401922 - RNA, 16 nt, Homo sapiens
agggauuccccuaacc

SEQ ID NO: 1401923 - RNA, 17 nt, Homo sapiens
agggcauggccaggugg

SEQ ID NO: 1401924 - RNA, 17 nt, Homo sapiens
agggcauuuccaaguua

SEQ ID NO: 1401925 - RNA, 23 nt, Homo sapiens
agggcugacucuaggugcccuug

SEQ ID NO: 1401926 - RNA, 19 nt, Homo sapiens
agggcugccaccaagguga

SEQ ID NO: 1401927 - RNA, 15 nt, Homo sapiens
agggcuuucucagga

SEQ ID NO: 1401928 - RNA, 15 nt, Homo sapiens
aggggaaaaucucag

SEQ ID NO: 1401929 - RNA, 21 nt, Homo sapiens
aggggauagagagagaccacu

SEQ ID NO: 1401930 - RNA, 23 nt, Homo sapiens
aggggcccaaauucuuucagugg

SEQ ID NO: 1401931 - RNA, 20 nt, Homo sapiens
agggggccaugaggccucag

SEQ ID NO: 1401932 - RNA, 19 nt, Homo sapiens
aggggugguccugacucaa

SEQ ID NO: 1401933 - RNA, 13 nt, Homo sapiens
agggucauagcau

SEQ ID NO: 1401934 - RNA, 23 nt, Homo sapiens
agggucuucuuacaugcauuuga

SEQ ID NO: 1401935 - RNA, 22 nt, Homo sapiens
agggugaagcuauuuaucugua

SEQ ID NO: 1401936 - RNA, 14 nt, Homo sapiens
aggguggaauauca

SEQ ID NO: 1401937 - RNA, 23 nt, Homo sapiens
aggguggcuggguccaggggaug

SEQ ID NO: 1401938 - RNA, 23 nt, Homo sapiens
agggugggguaaccaaauguugg

SEQ ID NO: 1401939 - RNA, 20 nt, Homo sapiens
agggugguggugguggugaa

SEQ ID NO: 1401940 - RNA, 19 nt, Homo sapiens
aggguugggcuggugucac

SEQ ID NO: 1401941 - RNA, 14 nt, Homo sapiens
agguaaaacaaauc

SEQ ID NO: 1401942 - RNA, 18 nt, Homo sapiens
agguaagggggugcagca

SEQ ID NO: 1401943 - RNA, 15 nt, Homo sapiens
agguaaggugaggga

SEQ ID NO: 1401944 - RNA, 14 nt, Homo sapiens
agguaaugugaaua

SEQ ID NO: 1401945 - RNA, 22 nt, Homo sapiens
agguaccccagcucugcuugcc

SEQ ID NO: 1401946 - RNA, 12 nt, Homo sapiens
agguagcacuac

SEQ ID NO: 1401947 - RNA, 19 nt, Homo sapiens
agguaggggcccacuucac

SEQ ID NO: 1401948 - RNA, 15 nt, Homo sapiens
aggucaagcccagga

SEQ ID NO: 1401949 - RNA, 18 nt, Homo sapiens
aggucagcuugcugcccu

SEQ ID NO: 1401950 - RNA, 22 nt, Homo sapiens
aggucaguacccaccugagcuu

SEQ ID NO: 1401951 - RNA, 21 nt, Homo sapiens
agguccugggggccugaccuc

SEQ ID NO: 1401952 - RNA, 21 nt, Homo sapiens
aggucuaggaacauacuucag

SEQ ID NO: 1401953 - RNA, 20 nt, Homo sapiens
aggucucaggagaagggaua

SEQ ID NO: 1401954 - RNA, 13 nt, Homo sapiens
aggucucccggga

SEQ ID NO: 1401955 - RNA, 16 nt, Homo sapiens
aggucugaaauggagg

SEQ ID NO: 1401956 - RNA, 16 nt, Homo sapiens
aggucugacacgucug

SEQ ID NO: 1401957 - RNA, 13 nt, Homo sapiens
aggugacagagug

SEQ ID NO: 1401958 - RNA, 19 nt, Homo sapiens
aggugagaguauagugcau

SEQ ID NO: 1401959 - RNA, 19 nt, Homo sapiens
aggugcagagugcccagaa

SEQ ID NO: 1401960 - RNA, 15 nt, Homo sapiens
aggugcuacugacuu

SEQ ID NO: 1401961 - RNA, 16 nt, Homo sapiens
aggugcuuauucucaa

SEQ ID NO: 1401962 - RNA, 15 nt, Homo sapiens
agguggccacuccag

SEQ ID NO: 1401963 - RNA, 15 nt, Homo sapiens
aggugggaggaucac

SEQ ID NO: 1401964 - RNA, 19 nt, Homo sapiens
aggugggccuugcuaccuc

SEQ ID NO: 1401965 - RNA, 21 nt, Homo sapiens
aggugggccuugcuaccucaa

SEQ ID NO: 1401966 - RNA, 20 nt, Homo sapiens
aggugguauguuugggagac

SEQ ID NO: 1401967 - RNA, 20 nt, Homo sapiens
aggugucuucuuugacuuaa

SEQ ID NO: 1401968 - RNA, 22 nt, Homo sapiens
agguguucaagaccagccugac

SEQ ID NO: 1401969 - RNA, 20 nt, Homo sapiens
agguuacaugagagcaauca

SEQ ID NO: 1401970 - RNA, 18 nt, Homo sapiens
agguucuuagugucacuu

SEQ ID NO: 1401971 - RNA, 14 nt, Homo sapiens
agguuggcaaaaag

SEQ ID NO: 1401972 - RNA, 13 nt, Homo sapiens
agguuuacauuca

SEQ ID NO: 1401973 - RNA, 18 nt, Homo sapiens
agguuuccucaaacugug

SEQ ID NO: 1401974 - RNA, 16 nt, Homo sapiens
agguuuguaugaugua

SEQ ID NO: 1401975 - RNA, 13 nt, Homo sapiens
aguaaaaagggaa

SEQ ID NO: 1401976 - RNA, 13 nt, Homo sapiens
aguaaaagccauc

SEQ ID NO: 1401977 - RNA, 17 nt, Homo sapiens
aguaagcaaagacuuuc

SEQ ID NO: 1401978 - RNA, 11 nt, Homo sapiens
aguaagccaug

SEQ ID NO: 1401979 - RNA, 11 nt, Homo sapiens
aguaagcccuu

SEQ ID NO: 1401980 - RNA, 20 nt, Homo sapiens
aguaaguaccacucaggcca

SEQ ID NO: 1401981 - RNA, 22 nt, Homo sapiens
aauuccugguuugaagaaauaa

SEQ ID NO: 1401982 - RNA, 14 nt, Homo sapiens
aauucuacuuugag

SEQ ID NO: 1401983 - RNA, 20 nt, Homo sapiens
aauucucaagccgcauccca

SEQ ID NO: 1401984 - RNA, 16 nt, Homo sapiens
aauucucagaaucuca

SEQ ID NO: 1401985 - RNA, 17 nt, Homo sapiens
aauucucauuugucaca

SEQ ID NO: 1401986 - RNA, 21 nt, Homo sapiens
aauucucuuauccaacaucaa

SEQ ID NO: 1401987 - RNA, 16 nt, Homo sapiens
aauucuugcuaugaaa

SEQ ID NO: 1401988 - RNA, 13 nt, Homo sapiens
aauugaaaaccaa

SEQ ID NO: 1401989 - RNA, 17 nt, Homo sapiens
aauugaaaggcauucuc

SEQ ID NO: 1401990 - RNA, 19 nt, Homo sapiens
aauugaaauauaaugcaaa

SEQ ID NO: 1401991 - RNA, 14 nt, Homo sapiens
aauugaacuaacaa

SEQ ID NO: 1401992 - RNA, 21 nt, Homo sapiens
aauugaccuuuugacuuaaag

SEQ ID NO: 1401993 - RNA, 21 nt, Homo sapiens
aauugagcuggaccucaccaa

SEQ ID NO: 1401994 - RNA, 19 nt, Homo sapiens
aauugauauugaaugaugu

SEQ ID NO: 1401995 - RNA, 23 nt, Homo sapiens
aauugauguugcuggacugucau

SEQ ID NO: 1401996 - RNA, 22 nt, Homo sapiens
aauugcagaugguuaaauauca

SEQ ID NO: 1401997 - RNA, 15 nt, Homo sapiens
aauugccacugagag

SEQ ID NO: 1401998 - RNA, 14 nt, Homo sapiens
aauugccuaaagag

SEQ ID NO: 1401999 - RNA, 12 nt, Homo sapiens
aauugcugaaag

SEQ ID NO: 1402000 - RNA, 15 nt, Homo sapiens
aauugggccaaagaa

SEQ ID NO: 1402001 - RNA, 23 nt, Homo sapiens
aauugggccaaagaaacauugcc

SEQ ID NO: 1402002 - RNA, 20 nt, Homo sapiens
aauuguaaaauuuaaaucau

SEQ ID NO: 1402003 - RNA, 16 nt, Homo sapiens
aauuguuuuuuaucuu

SEQ ID NO: 1402004 - RNA, 16 nt, Homo sapiens
aauuuaaaaaaauaca

SEQ ID NO: 1402005 - RNA, 21 nt, Homo sapiens
aauuuaaaacacagagaugcu

SEQ ID NO: 1402006 - RNA, 14 nt, Homo sapiens
aauuuagaggacaa

SEQ ID NO: 1402007 - RNA, 14 nt, Homo sapiens
aauuuaggaccaau

SEQ ID NO: 1402008 - RNA, 21 nt, Homo sapiens
aauuuaggaccaauaccuccu

SEQ ID NO: 1402009 - RNA, 19 nt, Homo sapiens
aauuuauauguauccagua

SEQ ID NO: 1402010 - RNA, 18 nt, Homo sapiens
aauuuauucaauuccucu

SEQ ID NO: 1402011 - RNA, 15 nt, Homo sapiens
aauuuauugcacaaa

SEQ ID NO: 1402012 - RNA, 15 nt, Homo sapiens
aauuuauuucaaaaa

SEQ ID NO: 1402013 - RNA, 14 nt, Homo sapiens
aauuucagcauuau

SEQ ID NO: 1402014 - RNA, 19 nt, Homo sapiens
aauuucuaaaaaacagagg

SEQ ID NO: 1402015 - RNA, 21 nt, Homo sapiens
aauuugaaccaaaacauuccg

SEQ ID NO: 1402016 - RNA, 14 nt, Homo sapiens
aauuugaaucucaa

SEQ ID NO: 1402017 - RNA, 14 nt, Homo sapiens
aauuuguguucuca

SEQ ID NO: 1402018 - RNA, 19 nt, Homo sapiens
aauuuuaaugaagugcaau

SEQ ID NO: 1402019 - RNA, 14 nt, Homo sapiens
aauuuuauaaucau

SEQ ID NO: 1402020 - RNA, 23 nt, Homo sapiens
aauuuuauguuuaguugcacaaa

SEQ ID NO: 1402021 - RNA, 15 nt, Homo sapiens
aauuuucaguauaau

SEQ ID NO: 1402022 - RNA, 21 nt, Homo sapiens
aauuuuuuaguauaaguacau

SEQ ID NO: 1402023 - RNA, 22 nt, Homo sapiens
acaaaaaucacaaggcauucaa

SEQ ID NO: 1402024 - RNA, 22 nt, Homo sapiens
acaaaaauucacaagcugccuc

SEQ ID NO: 1402025 - RNA, 15 nt, Homo sapiens
acaaaagcccaaugu

SEQ ID NO: 1402026 - RNA, 14 nt, Homo sapiens
acaaaagccucuca

SEQ ID NO: 1402027 - RNA, 17 nt, Homo sapiens
acaaaauccaugaacaa

SEQ ID NO: 1402028 - RNA, 15 nt, Homo sapiens
acaaacaaacagaaa

SEQ ID NO: 1402029 - RNA, 21 nt, Homo sapiens
acaaacaauuaacugagcaua

SEQ ID NO: 1402030 - RNA, 13 nt, Homo sapiens
cccacaguggaaa

SEQ ID NO: 1402031 - RNA, 21 nt, Homo sapiens
cccacccccuucucugcucca

SEQ ID NO: 1402032 - RNA, 19 nt, Homo sapiens
cccaccugucaaacaaagc

SEQ ID NO: 1402033 - RNA, 13 nt, Homo sapiens
cccacgcccucau

SEQ ID NO: 1402034 - RNA, 19 nt, Homo sapiens
cccacgcuggagugcagug

SEQ ID NO: 1402035 - RNA, 13 nt, Homo sapiens
cccacugagauuu

SEQ ID NO: 1402036 - RNA, 15 nt, Homo sapiens
cccagaaggaccucc

SEQ ID NO: 1402037 - RNA, 12 nt, Homo sapiens
cccagaaggcag

SEQ ID NO: 1402038 - RNA, 12 nt, Homo sapiens
cccagacagcuc

SEQ ID NO: 1402039 - RNA, 16 nt, Homo sapiens
cccagaccugagcucc

SEQ ID NO: 1402040 - RNA, 20 nt, Homo sapiens
cccagagaggguggugaccu

SEQ ID NO: 1402041 - RNA, 18 nt, Homo sapiens
cccagagcaaaauaauuu

SEQ ID NO: 1402042 - RNA, 21 nt, Homo sapiens
cccagauagcuggcugggugg

SEQ ID NO: 1402043 - RNA, 15 nt, Homo sapiens
cccagaucugguccc

SEQ ID NO: 1402044 - RNA, 21 nt, Homo sapiens
cccagcacuuugggaggccaa

SEQ ID NO: 1402045 - RNA, 15 nt, Homo sapiens
cccagcagggccuca

SEQ ID NO: 1402046 - RNA, 13 nt, Homo sapiens
cccagccaaucac

SEQ ID NO: 1402047 - RNA, 14 nt, Homo sapiens
cccagccaaucaca

SEQ ID NO: 1402048 - RNA, 20 nt, Homo sapiens
cccagcccacuucugccaua

SEQ ID NO: 1402049 - RNA, 15 nt, Homo sapiens
cccagcuacucagga

SEQ ID NO: 1402050 - RNA, 16 nt, Homo sapiens
cccagcuacucaggag

SEQ ID NO: 1402051 - RNA, 20 nt, Homo sapiens
cccagcuacucaggagguug

SEQ ID NO: 1402052 - RNA, 13 nt, Homo sapiens
cccagcuacuuga

SEQ ID NO: 1402053 - RNA, 21 nt, Homo sapiens
cccagcuaucuauauggaauu

SEQ ID NO: 1402054 - RNA, 16 nt, Homo sapiens
cccaggaacugggcca

SEQ ID NO: 1402055 - RNA, 13 nt, Homo sapiens
cccaggaguacac

SEQ ID NO: 1402056 - RNA, 14 nt, Homo sapiens
cccaggaguuugag

SEQ ID NO: 1402057 - RNA, 19 nt, Homo sapiens
cccaggcaucugcuuuacu

SEQ ID NO: 1402058 - RNA, 22 nt, Homo sapiens
cccaggcuuuugaaaaacaaac

SEQ ID NO: 1402059 - RNA, 16 nt, Homo sapiens
cccagggagaggccau

SEQ ID NO: 1402060 - RNA, 18 nt, Homo sapiens
cccagggagaggccauga

SEQ ID NO: 1402061 - RNA, 21 nt, Homo sapiens
cccaguaauuauuuucuuccu

SEQ ID NO: 1402062 - RNA, 10 nt, Homo sapiens
cccagugugu

SEQ ID NO: 1402063 - RNA, 17 nt, Homo sapiens
cccauaauuuucuucau

SEQ ID NO: 1402064 - RNA, 20 nt, Homo sapiens
cccaucacgccugugcagug

SEQ ID NO: 1402065 - RNA, 17 nt, Homo sapiens
cccaucagcuccagcug

SEQ ID NO: 1402066 - RNA, 22 nt, Homo sapiens
cccaucccacacccuggaggau

SEQ ID NO: 1402067 - RNA, 10 nt, Homo sapiens
cccaucccau

SEQ ID NO: 1402068 - RNA, 22 nt, Homo sapiens
cccauccuagagaaaacuugaa

SEQ ID NO: 1402069 - RNA, 15 nt, Homo sapiens
cccaucucuacugaa

SEQ ID NO: 1402070 - RNA, 17 nt, Homo sapiens
cccaucuuuugguugcc

SEQ ID NO: 1402071 - RNA, 21 nt, Homo sapiens
cccaugagaguagagggcacu

SEQ ID NO: 1402072 - RNA, 18 nt, Homo sapiens
cccaugagguacagcaga

SEQ ID NO: 1402073 - RNA, 20 nt, Homo sapiens
cccaugcccuggauccauca

SEQ ID NO: 1402074 - RNA, 23 nt, Homo sapiens
cccauguaagcaccccuucauuu

SEQ ID NO: 1402075 - RNA, 12 nt, Homo sapiens
cccauucuugca

SEQ ID NO: 1402076 - RNA, 22 nt, Homo sapiens
cccauugaaacaaaacauugau

SEQ ID NO: 1402077 - RNA, 14 nt, Homo sapiens
cccauuuacacuuu

SEQ ID NO: 1402078 - RNA, 15 nt, Homo sapiens
cccauuucuauuuau

SEQ ID NO: 1402079 - RNA, 14 nt, Homo sapiens
cccauuuugcaaaa

SEQ ID NO: 1402080 - RNA, 22 nt, Homo sapiens
ccccaagugcggggaguacaag

SEQ ID NO: 1402081 - RNA, 14 nt, Homo sapiens
ccccaccaccccag

SEQ ID NO: 1402082 - RNA, 16 nt, Homo sapiens
ccccagccucuucuag

SEQ ID NO: 1402083 - RNA, 21 nt, Homo sapiens
ccccagcuguggguacagaga

SEQ ID NO: 1402084 - RNA, 14 nt, Homo sapiens
cccccuucagugcc

SEQ ID NO: 1402085 - RNA, 22 nt, Homo sapiens
ccccgagcugggggccaugagc

SEQ ID NO: 1402086 - RNA, 14 nt, Homo sapiens
ccccuaagagccau

SEQ ID NO: 1402087 - RNA, 15 nt, Homo sapiens
ccccucagauuccac

SEQ ID NO: 1402088 - RNA, 17 nt, Homo sapiens
ccccucccagaacacac

SEQ ID NO: 1402089 - RNA, 21 nt, Homo sapiens
ccccuggcugguaagggccaa

SEQ ID NO: 1402090 - RNA, 18 nt, Homo sapiens
ccccugggacugcugcuu

SEQ ID NO: 1402091 - RNA, 22 nt, Homo sapiens
cccgccucuucuucuucagaag

SEQ ID NO: 1402092 - RNA, 17 nt, Homo sapiens
cccggagcuaacacugg

SEQ ID NO: 1402093 - RNA, 17 nt, Homo sapiens
cccggcucaagugaucc

SEQ ID NO: 1402094 - RNA, 17 nt, Homo sapiens
cccggcugucaaggggu

SEQ ID NO: 1402095 - RNA, 17 nt, Homo sapiens
cccggggcuccacugaa

SEQ ID NO: 1402096 - RNA, 22 nt, Homo sapiens
cccggggcuggcggcuacucag

SEQ ID NO: 1402097 - RNA, 20 nt, Homo sapiens
cccgucauguuccucaaaag

SEQ ID NO: 1402098 - RNA, 15 nt, Homo sapiens
cccuaacucagccaa

SEQ ID NO: 1402099 - RNA, 18 nt, Homo sapiens
cccuaaugagaagucaac

SEQ ID NO: 1402100 - RNA, 14 nt, Homo sapiens
cccuaggagaccaa

SEQ ID NO: 1402101 - RNA, 22 nt, Homo sapiens
cccuauggaagcauauuguuau

SEQ ID NO: 1402102 - RNA, 21 nt, Homo sapiens
cccucaaucccagcuacucaa

SEQ ID NO: 1402103 - RNA, 20 nt, Homo sapiens
cccucaccugggcaccuggg

SEQ ID NO: 1402104 - RNA, 16 nt, Homo sapiens
cccucagauuccaccu

SEQ ID NO: 1402105 - RNA, 17 nt, Homo sapiens
cccucagauuccaccua

SEQ ID NO: 1402106 - RNA, 13 nt, Homo sapiens
cccucagauuccg

SEQ ID NO: 1402107 - RNA, 13 nt, Homo sapiens
cccuccaauccca

SEQ ID NO: 1402108 - RNA, 14 nt, Homo sapiens
cccuccacguucac

SEQ ID NO: 1402109 - RNA, 23 nt, Homo sapiens
cccucuuguuuucacuucacuuu

SEQ ID NO: 1402110 - RNA, 19 nt, Homo sapiens
cccugaccucacugugacc

SEQ ID NO: 1402111 - RNA, 22 nt, Homo sapiens
cccugacucucugugaccugcc

SEQ ID NO: 1402112 - RNA, 18 nt, Homo sapiens
cccugagcuuucugcuau

SEQ ID NO: 1402113 - RNA, 23 nt, Homo sapiens
cccugauugcgcaaaacugaaag

SEQ ID NO: 1402114 - RNA, 17 nt, Homo sapiens
cccugcaaaaugagacc

SEQ ID NO: 1402115 - RNA, 16 nt, Homo sapiens
cccugcagucacagcu

SEQ ID NO: 1402116 - RNA, 15 nt, Homo sapiens
cccugcccuggucca

SEQ ID NO: 1402117 - RNA, 13 nt, Homo sapiens
cccugcucccaca

SEQ ID NO: 1402118 - RNA, 13 nt, Homo sapiens
cccugcugaccuc

SEQ ID NO: 1402119 - RNA, 12 nt, Homo sapiens
cccugcuugcaa

SEQ ID NO: 1402120 - RNA, 18 nt, Homo sapiens
cccuggaaggacauccau

SEQ ID NO: 1402121 - RNA, 23 nt, Homo sapiens
cccuggaggaaccgaaaggccaa

SEQ ID NO: 1402122 - RNA, 19 nt, Homo sapiens
cccuguagacuagugccgu

SEQ ID NO: 1402123 - RNA, 16 nt, Homo sapiens
cccugucucccaaaaa

SEQ ID NO: 1402124 - RNA, 20 nt, Homo sapiens
ccacgucugcuaacuuggag

SEQ ID NO: 1402125 - RNA, 22 nt, Homo sapiens
ccacguucucucugccugugag

SEQ ID NO: 1402126 - RNA, 12 nt, Homo sapiens
ccacuacugcua

SEQ ID NO: 1402127 - RNA, 20 nt, Homo sapiens
ccacugaccggaggcaaaag

SEQ ID NO: 1402128 - RNA, 16 nt, Homo sapiens
ccacugagaagucaaa

SEQ ID NO: 1402129 - RNA, 14 nt, Homo sapiens
ccacuggacuugag

SEQ ID NO: 1402130 - RNA, 19 nt, Homo sapiens
ccacugugaagagaaccau

SEQ ID NO: 1402131 - RNA, 19 nt, Homo sapiens
ccacuuagaaauugcauuu

SEQ ID NO: 1402132 - RNA, 23 nt, Homo sapiens
ccacuuuccccgugggccauggc

SEQ ID NO: 1402133 - RNA, 15 nt, Homo sapiens
ccagaaaucaaaaag

SEQ ID NO: 1402134 - RNA, 12 nt, Homo sapiens
ccagaaccugga

SEQ ID NO: 1402135 - RNA, 17 nt, Homo sapiens
ccagaagcugagcacca

SEQ ID NO: 1402136 - RNA, 15 nt, Homo sapiens
ccagaaggcaaaaag

SEQ ID NO: 1402137 - RNA, 15 nt, Homo sapiens
ccagaccauugucuc

SEQ ID NO: 1402138 - RNA, 19 nt, Homo sapiens
ccagacccaccacaccgca

SEQ ID NO: 1402139 - RNA, 13 nt, Homo sapiens
ccagacccggcug

SEQ ID NO: 1402140 - RNA, 17 nt, Homo sapiens
ccagaccucaggugcua

SEQ ID NO: 1402141 - RNA, 19 nt, Homo sapiens
ccagagaaccugcuuuacu

SEQ ID NO: 1402142 - RNA, 12 nt, Homo sapiens
ccagagcacugu

SEQ ID NO: 1402143 - RNA, 15 nt, Homo sapiens
ccagagccauggacu

SEQ ID NO: 1402144 - RNA, 16 nt, Homo sapiens
ccagagcuacugacua

SEQ ID NO: 1402145 - RNA, 20 nt, Homo sapiens
ccagagcuggaccugagcua

SEQ ID NO: 1402146 - RNA, 17 nt, Homo sapiens
ccagaggaaacuugcau

SEQ ID NO: 1402147 - RNA, 16 nt, Homo sapiens
ccagagggaauugcag

SEQ ID NO: 1402148 - RNA, 20 nt, Homo sapiens
ccagaguggccuggccagga

SEQ ID NO: 1402149 - RNA, 19 nt, Homo sapiens
ccagauauucaagucaccu

SEQ ID NO: 1402150 - RNA, 16 nt, Homo sapiens
ccagauucuaccacac

SEQ ID NO: 1402151 - RNA, 20 nt, Homo sapiens
ccagauuugaagacaaaaau

SEQ ID NO: 1402152 - RNA, 16 nt, Homo sapiens
ccagcaagguggagug

SEQ ID NO: 1402153 - RNA, 15 nt, Homo sapiens
ccagcaccaccaggu

SEQ ID NO: 1402154 - RNA, 22 nt, Homo sapiens
ccagcacuaacguaaauacaca

SEQ ID NO: 1402155 - RNA, 13 nt, Homo sapiens
ccagcacucugaa

SEQ ID NO: 1402156 - RNA, 16 nt, Homo sapiens
ccagcacuuugggagg

SEQ ID NO: 1402157 - RNA, 20 nt, Homo sapiens
ccagcacuuugggaggccaa

SEQ ID NO: 1402158 - RNA, 15 nt, Homo sapiens
ccagcagaucccagc

SEQ ID NO: 1402159 - RNA, 18 nt, Homo sapiens
ccagcagggccucaaagu

SEQ ID NO: 1402160 - RNA, 20 nt, Homo sapiens
ccagcaucagccccaauguc

SEQ ID NO: 1402161 - RNA, 22 nt, Homo sapiens
ccagccaagagggcugcaaaag

SEQ ID NO: 1402162 - RNA, 13 nt, Homo sapiens
ccagcccacugga

SEQ ID NO: 1402163 - RNA, 20 nt, Homo sapiens
ccagccugggcaacagagca

SEQ ID NO: 1402164 - RNA, 15 nt, Homo sapiens
ccagcuacucgggag

SEQ ID NO: 1402165 - RNA, 15 nt, Homo sapiens
ccagcucagucccau

SEQ ID NO: 1402166 - RNA, 19 nt, Homo sapiens
ccagcucccuaggagacca

SEQ ID NO: 1402167 - RNA, 16 nt, Homo sapiens
ccagcugcaccugcca

SEQ ID NO: 1402168 - RNA, 23 nt, Homo sapiens
ccagcugcgccugcgcugcagga

SEQ ID NO: 1402169 - RNA, 14 nt, Homo sapiens
ccagcugcucugcc

SEQ ID NO: 1402170 - RNA, 16 nt, Homo sapiens
ccaggaaccucagggc

SEQ ID NO: 1402171 - RNA, 13 nt, Homo sapiens
ccaggagcucuuc

SEQ ID NO: 1402172 - RNA, 16 nt, Homo sapiens
ccaggaguacacccca

SEQ ID NO: 1402173 - RNA, 14 nt, Homo sapiens
ccaggcacugcugc

SEQ ID NO: 1402174 - RNA, 15 nt, Homo sapiens
ccaggccccaggaag

SEQ ID NO: 1402175 - RNA, 18 nt, Homo sapiens
ccaggcgaugugcaagug

SEQ ID NO: 1402176 - RNA, 18 nt, Homo sapiens
ccaggcuggcgugcagug

SEQ ID NO: 1402177 - RNA, 16 nt, Homo sapiens
ccaggcuggucucaaa

SEQ ID NO: 1402178 - RNA, 20 nt, Homo sapiens
ccagguaagggggugcagca

SEQ ID NO: 1402179 - RNA, 19 nt, Homo sapiens
ccagguguucuacacucau

SEQ ID NO: 1402180 - RNA, 21 nt, Homo sapiens
ccagguucugguuagcucagc

SEQ ID NO: 1402181 - RNA, 20 nt, Homo sapiens
ccagguuuuuggucugaccc

SEQ ID NO: 1402182 - RNA, 16 nt, Homo sapiens
ccagugagcuuaucau

SEQ ID NO: 1402183 - RNA, 18 nt, Homo sapiens
ccaguguuauuaaugaca

SEQ ID NO: 1402184 - RNA, 19 nt, Homo sapiens
ccauagcaagauugcuuaa

SEQ ID NO: 1402185 - RNA, 20 nt, Homo sapiens
ccauagucaaauuuguaaau

SEQ ID NO: 1402186 - RNA, 23 nt, Homo sapiens
ccauaguggagagaacugaauaa

SEQ ID NO: 1402187 - RNA, 16 nt, Homo sapiens
ccauaucugugaaaug

SEQ ID NO: 1402188 - RNA, 14 nt, Homo sapiens
ccaucaacaagucu

SEQ ID NO: 1402189 - RNA, 19 nt, Homo sapiens
ccaucaacaagucuugaaa

SEQ ID NO: 1402190 - RNA, 14 nt, Homo sapiens
ccaucaccagacag

SEQ ID NO: 1402191 - RNA, 23 nt, Homo sapiens
ccaucagcuuaggggcugcugac

SEQ ID NO: 1402192 - RNA, 17 nt, Homo sapiens
ccauccaauucuuugaa

SEQ ID NO: 1402193 - RNA, 22 nt, Homo sapiens
ccauccagccgcugcacaucac

SEQ ID NO: 1402194 - RNA, 23 nt, Homo sapiens
ccaucccagcugaaauacugagg

SEQ ID NO: 1402195 - RNA, 14 nt, Homo sapiens
ccauccuaccacaa

SEQ ID NO: 1402196 - RNA, 19 nt, Homo sapiens
ccaucggugaaacuaacag

SEQ ID NO: 1402197 - RNA, 17 nt, Homo sapiens
ccaucuccucagcaccc

SEQ ID NO: 1402198 - RNA, 14 nt, Homo sapiens
ccaucucuacugaa

SEQ ID NO: 1402199 - RNA, 22 nt, Homo sapiens
ccaucucuacugaaaguacaaa

SEQ ID NO: 1402200 - RNA, 15 nt, Homo sapiens
ccaucuucuuuauac

SEQ ID NO: 1402201 - RNA, 15 nt, Homo sapiens
ccaugaaaaugcaac

SEQ ID NO: 1402202 - RNA, 21 nt, Homo sapiens
ccaugacugcauuuuacugua

SEQ ID NO: 1402203 - RNA, 23 nt, Homo sapiens
ccaugagaguagagggcacuggg

SEQ ID NO: 1402204 - RNA, 11 nt, Homo sapiens
ccaugcaaugc

SEQ ID NO: 1402205 - RNA, 23 nt, Homo sapiens
ccaugcacccucauacacagaaa

SEQ ID NO: 1402206 - RNA, 23 nt, Homo sapiens
ccaugccucuccaacaucuucaa

SEQ ID NO: 1402207 - RNA, 13 nt, Homo sapiens
ccauggaggcaca

SEQ ID NO: 1402208 - RNA, 19 nt, Homo sapiens
ccauggcaugggggccuca

SEQ ID NO: 1402209 - RNA, 19 nt, Homo sapiens
ccaugguaugaaggugauu

SEQ ID NO: 1402210 - RNA, 16 nt, Homo sapiens
ccaugguccccaagac

SEQ ID NO: 1402211 - RNA, 19 nt, Homo sapiens
ccauguacaguauguucaa

SEQ ID NO: 1402212 - RNA, 21 nt, Homo sapiens
ccauguacauaauucuugcua

SEQ ID NO: 1402213 - RNA, 19 nt, Homo sapiens
ccaugugugagugugugca

SEQ ID NO: 1402214 - RNA, 20 nt, Homo sapiens
ccaugugugagugugugcaa

SEQ ID NO: 1402215 - RNA, 23 nt, Homo sapiens
agucccugacucucugugaccug

SEQ ID NO: 1402216 - RNA, 14 nt, Homo sapiens
aguccuauuugcac

SEQ ID NO: 1402217 - RNA, 16 nt, Homo sapiens
aguccuggaaucacau

SEQ ID NO: 1402218 - RNA, 17 nt, Homo sapiens
agucuaggagcugggag

SEQ ID NO: 1402219 - RNA, 21 nt, Homo sapiens
agucucacuuuuauugauaaa

SEQ ID NO: 1402220 - RNA, 18 nt, Homo sapiens
agucucugcccaaacaua

SEQ ID NO: 1402221 - RNA, 12 nt, Homo sapiens
agucucugugaa

SEQ ID NO: 1402222 - RNA, 22 nt, Homo sapiens
agucucuuuaaucuucaguuuu

SEQ ID NO: 1402223 - RNA, 19 nt, Homo sapiens
agucugaugagaacucuga

SEQ ID NO: 1402224 - RNA, 22 nt, Homo sapiens
agucugauugguuuuaauugaa

SEQ ID NO: 1402225 - RNA, 14 nt, Homo sapiens
agucugucucugcu

SEQ ID NO: 1402226 - RNA, 19 nt, Homo sapiens
agucugugugggacuguac

SEQ ID NO: 1402227 - RNA, 16 nt, Homo sapiens
agucuuccaccuggaa

SEQ ID NO: 1402228 - RNA, 13 nt, Homo sapiens
agucuucccugau

SEQ ID NO: 1402229 - RNA, 16 nt, Homo sapiens
agugaaacauugaacu

SEQ ID NO: 1402230 - RNA, 15 nt, Homo sapiens
agugaaucaccugug

SEQ ID NO: 1402231 - RNA, 24 nt, Homo sapiens
agugaaugaaagucuugugacuag

SEQ ID NO: 1402232 - RNA, 20 nt, Homo sapiens
agugacaucucuuugauguc

SEQ ID NO: 1402233 - RNA, 16 nt, Homo sapiens
agugaccccugaccuc

SEQ ID NO: 1402234 - RNA, 13 nt, Homo sapiens
agugagacccugu

SEQ ID NO: 1402235 - RNA, 22 nt, Homo sapiens
agugagccugaauuuuguugcu

SEQ ID NO: 1402236 - RNA, 15 nt, Homo sapiens
agugaggcaggugac

SEQ ID NO: 1402237 - RNA, 16 nt, Homo sapiens
agugaggcaggugaca

SEQ ID NO: 1402238 - RNA, 19 nt, Homo sapiens
agugagucgaggacaggga

SEQ ID NO: 1402239 - RNA, 19 nt, Homo sapiens
agugauccucccaccucag

SEQ ID NO: 1402240 - RNA, 21 nt, Homo sapiens
agugcagugagccgagaucac

SEQ ID NO: 1402241 - RNA, 21 nt, Homo sapiens
agugccaagcacagugccugc

SEQ ID NO: 1402242 - RNA, 16 nt, Homo sapiens
agugccaugggggcaa

SEQ ID NO: 1402243 - RNA, 14 nt, Homo sapiens
agugcccucaucca

SEQ ID NO: 1402244 - RNA, 23 nt, Homo sapiens
agugcccuggggcugaucucagg

SEQ ID NO: 1402245 - RNA, 20 nt, Homo sapiens
agugccguagggaguaccug

SEQ ID NO: 1402246 - RNA, 13 nt, Homo sapiens
agugccugcugaa

SEQ ID NO: 1402247 - RNA, 13 nt, Homo sapiens
agugccugggaau

SEQ ID NO: 1402248 - RNA, 17 nt, Homo sapiens
agugcuuguuccucuca

SEQ ID NO: 1402249 - RNA, 22 nt, Homo sapiens
aguggaaagacagcuucucauc

SEQ ID NO: 1402250 - RNA, 15 nt, Homo sapiens
aguggaugacaaaaa

SEQ ID NO: 1402251 - RNA, 23 nt, Homo sapiens
aguggcaaccuugucucuaugcc

SEQ ID NO: 1402252 - RNA, 15 nt, Homo sapiens
aguggcaagaccaaa

SEQ ID NO: 1402253 - RNA, 17 nt, Homo sapiens
aguggcucacaccugua

SEQ ID NO: 1402254 - RNA, 23 nt, Homo sapiens
aguggcucacaccuguaauccca

SEQ ID NO: 1402255 - RNA, 21 nt, Homo sapiens
aguggcucacgccuaugaucc

SEQ ID NO: 1402256 - RNA, 17 nt, Homo sapiens
agugggagccagggcug

SEQ ID NO: 1402257 - RNA, 20 nt, Homo sapiens
aguggugcuaucuuggcuca

SEQ ID NO: 1402258 - RNA, 10 nt, Homo sapiens
aguguaagaa

SEQ ID NO: 1402259 - RNA, 12 nt, Homo sapiens
aguguacaugga

SEQ ID NO: 1402260 - RNA, 13 nt, Homo sapiens
aguguacauggaa

SEQ ID NO: 1402261 - RNA, 15 nt, Homo sapiens
aguguaccagagaag

SEQ ID NO: 1402262 - RNA, 20 nt, Homo sapiens
aguguauuuuauaaaauuaa

SEQ ID NO: 1402263 - RNA, 23 nt, Homo sapiens
aguguauuuuauguguggcccaa

SEQ ID NO: 1402264 - RNA, 20 nt, Homo sapiens
agugucaggaggaaggcuua

SEQ ID NO: 1402265 - RNA, 23 nt, Homo sapiens
aguguggcccagggaagccaaaa

SEQ ID NO: 1402266 - RNA, 13 nt, Homo sapiens
agugugugcacau

SEQ ID NO: 1402267 - RNA, 13 nt, Homo sapiens
agugugugcaugu

SEQ ID NO: 1402268 - RNA, 12 nt, Homo sapiens
aguguugcccag

SEQ ID NO: 1402269 - RNA, 20 nt, Homo sapiens
aguguuuuuuagauacagag

SEQ ID NO: 1402270 - RNA, 19 nt, Homo sapiens
aguuaaacauugaaguaau

SEQ ID NO: 1402271 - RNA, 13 nt, Homo sapiens
aguuaagaaccug

SEQ ID NO: 1402272 - RNA, 20 nt, Homo sapiens
aguuaagaaugucgauuaaa

SEQ ID NO: 1402273 - RNA, 19 nt, Homo sapiens
aguuaaggauuguuuuaaa

SEQ ID NO: 1402274 - RNA, 23 nt, Homo sapiens
aguuacccugcauguuggcccag

SEQ ID NO: 1402275 - RNA, 18 nt, Homo sapiens
aguuacucauucagggau

SEQ ID NO: 1402276 - RNA, 16 nt, Homo sapiens
aguuagguagcuuuag

SEQ ID NO: 1402277 - RNA, 22 nt, Homo sapiens
aguuagguagcuuuagggcaau

SEQ ID NO: 1402278 - RNA, 22 nt, Homo sapiens
aguuauaaaucaaugucacuua

SEQ ID NO: 1402279 - RNA, 13 nt, Homo sapiens
aguuauaaccaac

SEQ ID NO: 1402280 - RNA, 14 nt, Homo sapiens
aguucaagaccagc

SEQ ID NO: 1402281 - RNA, 22 nt, Homo sapiens
aguucaaguccugccucuuaaa

SEQ ID NO: 1402282 - RNA, 17 nt, Homo sapiens
aguucagcuccuuccac

SEQ ID NO: 1402283 - RNA, 19 nt, Homo sapiens
aguucccccaguaccucca

SEQ ID NO: 1402284 - RNA, 15 nt, Homo sapiens
aguuccuucagcuuc

SEQ ID NO: 1402285 - RNA, 18 nt, Homo sapiens
aguuccuugaucuguaua

SEQ ID NO: 1402286 - RNA, 18 nt, Homo sapiens
aguucgaggcugcaguca

SEQ ID NO: 1402287 - RNA, 22 nt, Homo sapiens
aguucuggaagggacuuuagag

SEQ ID NO: 1402288 - RNA, 14 nt, Homo sapiens
aguugauucagcuc

SEQ ID NO: 1402289 - RNA, 14 nt, Homo sapiens
aguugauuuuacaa

SEQ ID NO: 1402290 - RNA, 22 nt, Homo sapiens
aguuggcucugagauacuaaua

SEQ ID NO: 1402291 - RNA, 15 nt, Homo sapiens
aguugggugauaugu

SEQ ID NO: 1402292 - RNA, 19 nt, Homo sapiens
aguuguagguaauauugca

SEQ ID NO: 1402293 - RNA, 23 nt, Homo sapiens
aguugucccgauuguaacucaaa

SEQ ID NO: 1402294 - RNA, 14 nt, Homo sapiens
aguugucuauucau

SEQ ID NO: 1402295 - RNA, 14 nt, Homo sapiens
aaaccuauguuugc

SEQ ID NO: 1402296 - RNA, 14 nt, Homo sapiens
aaaguaaaggcaaa

SEQ ID NO: 1402297 - RNA, 18 nt, Homo sapiens
aauuuccuuacucuugau

SEQ ID NO: 1402298 - RNA, 16 nt, Homo sapiens
acacuguuaucuucac

SEQ ID NO: 1402299 - RNA, 18 nt, Homo sapiens
acacuguuaucuucacuu

SEQ ID NO: 1402300 - RNA, 17 nt, Homo sapiens
acaggcaaauuccugac

SEQ ID NO: 1402301 - RNA, 13 nt, Homo sapiens
agagaauuuccuu

SEQ ID NO: 1402302 - RNA, 19 nt, Homo sapiens
agcuagaaaacaggcaaau

SEQ ID NO: 1402303 - RNA, 14 nt, Homo sapiens
aguaccucugcuau

SEQ ID NO: 1402304 - RNA, 20 nt, Homo sapiens
agucuucagcagagaaguuu

SEQ ID NO: 1402305 - RNA, 19 nt, Homo sapiens
aguuuuggaaacguauuca

SEQ ID NO: 1402306 - RNA, 23 nt, Homo sapiens
auaggaaauauuuuaauguuucu

SEQ ID NO: 1402307 - RNA, 13 nt, Homo sapiens
auauaaauuuauc

SEQ ID NO: 1402308 - RNA, 23 nt, Homo sapiens
aucauuuacuuuuaaacuuugau

SEQ ID NO: 1402309 - RNA, 22 nt, Homo sapiens
auguuugccgcuuaagcuuuca

SEQ ID NO: 1402310 - RNA, 14 nt, Homo sapiens
auuuuaucugcuau

SEQ ID NO: 1402311 - RNA, 16 nt, Homo sapiens
caauuugaauauaaau

SEQ ID NO: 1402312 - RNA, 15 nt, Homo sapiens
ccaucauuuacuuuu

SEQ ID NO: 1402313 - RNA, 18 nt, Homo sapiens
ccuggauuccucacuuug

SEQ ID NO: 1402314 - RNA, 22 nt, Homo sapiens
cuauuuaauuauuucacuuuag

SEQ ID NO: 1402315 - RNA, 20 nt, Homo sapiens
cugccaucauuuacuuuuaa

SEQ ID NO: 1402316 - RNA, 18 nt, Homo sapiens
cugcuauuugcuguuauu

SEQ ID NO: 1402317 - RNA, 19 nt, Homo sapiens
cuguuauuuuaucugcuau

SEQ ID NO: 1402318 - RNA, 18 nt, Homo sapiens
cuuacucuugauuguggg

SEQ ID NO: 1402319 - RNA, 21 nt, Homo sapiens
cuugauugugggauacuauuu

SEQ ID NO: 1402320 - RNA, 23 nt, Homo sapiens
gaaacguauucaaacaauuugaa

SEQ ID NO: 1402321 - RNA, 17 nt, Homo sapiens
gaaucacuggcuguuaa

SEQ ID NO: 1402322 - RNA, 15 nt, Homo sapiens
gagagagcuuggaau

SEQ ID NO: 1402323 - RNA, 15 nt, Homo sapiens
gauguuucauaagaa

SEQ ID NO: 1402324 - RNA, 18 nt, Homo sapiens
cucgaggcccuagcauuu

SEQ ID NO: 1402325 - RNA, 11 nt, Homo sapiens
cugacugcuag

SEQ ID NO: 1402326 - RNA, 19 nt, Homo sapiens
cugcuaguuuauauagaaa

SEQ ID NO: 1402327 - RNA, 16 nt, Homo sapiens
cuguuaucuucacuuu

SEQ ID NO: 1402328 - RNA, 18 nt, Homo sapiens
cuguuaucuucacuuuua

SEQ ID NO: 1402329 - RNA, 12 nt, Homo sapiens
cuuaagcuuuca

SEQ ID NO: 1402330 - RNA, 13 nt, Homo sapiens
cuugaauuguagg

SEQ ID NO: 1402331 - RNA, 23 nt, Homo sapiens
gaaauacacuguuaucuucacuu

SEQ ID NO: 1402332 - RNA, 20 nt, Homo sapiens
gagaauuuccuuacucuuga

SEQ ID NO: 1402333 - RNA, 19 nt, Homo sapiens
gauugugggauacuauuua

SEQ ID NO: 1402334 - RNA, 22 nt, Homo sapiens
gcugaguguuucacaccuuauc

SEQ ID NO: 1402335 - RNA, 17 nt, Homo sapiens
guuauuuuaucugcuau

SEQ ID NO: 1402336 - RNA, 19 nt, Homo sapiens
uaaugaaguguuuagcaua

SEQ ID NO: 1402337 - RNA, 22 nt, Homo sapiens
uaccucugcuauuugcuguuau

SEQ ID NO: 1402338 - RNA, 19 nt, Homo sapiens
uagaaagcugaguguuuca

SEQ ID NO: 1402339 - RNA, 21 nt, Homo sapiens
uagaauauauuuccuuauuca

SEQ ID NO: 1402340 - RNA, 15 nt, Homo sapiens
uagagaauuuccuua

SEQ ID NO: 1402341 - RNA, 11 nt, Homo sapiens
uaucugcuaug

SEQ ID NO: 1402342 - RNA, 18 nt, Homo sapiens
uaugcuauugaaguuuug

SEQ ID NO: 1402343 - RNA, 14 nt, Homo sapiens
ucacuggcuguuaa

SEQ ID NO: 1402344 - RNA, 15 nt, Homo sapiens
uccuggauuccucac

SEQ ID NO: 1402345 - RNA, 21 nt, Homo sapiens
uccuggauuccucacuuugaa

SEQ ID NO: 1402346 - RNA, 22 nt, Homo sapiens
ugacugcuaguuuauauagaaa

SEQ ID NO: 1402347 - RNA, 21 nt, Homo sapiens
ugauggaaauacacuguuauc

SEQ ID NO: 1402348 - RNA, 16 nt, Homo sapiens
uggauuccucacuuug

SEQ ID NO: 1402349 - RNA, 23 nt, Homo sapiens
ugggauacuauuuaauuauuuca

SEQ ID NO: 1402350 - RNA, 18 nt, Homo sapiens
uguacucugaaaguuuug

SEQ ID NO: 1402351 - RNA, 15 nt, Homo sapiens
uguuaucuucacuuu

SEQ ID NO: 1402352 - RNA, 18 nt, Homo sapiens
uguuaucuucacuuuuau

SEQ ID NO: 1402353 - RNA, 23 nt, Homo sapiens
uuagagaauuuccuuacucuuga

SEQ ID NO: 1402354 - RNA, 13 nt, Homo sapiens
uuauucagaauuu

SEQ ID NO: 1402355 - RNA, 15 nt, Homo sapiens
uuauuuuaucugcua

SEQ ID NO: 1402356 - RNA, 18 nt, Homo sapiens
uucagcagagaaguuuuc

SEQ ID NO: 1402357 - RNA, 18 nt, Homo sapiens
uuccaguaguuagcuuuc

SEQ ID NO: 1402358 - RNA, 14 nt, Homo sapiens
uuccugacugcuag

SEQ ID NO: 1402359 - RNA, 22 nt, Homo sapiens
uugaauuguaggugacuauuau

SEQ ID NO: 1402360 - RNA, 15 nt, Homo sapiens
uugugggauacuauu

SEQ ID NO: 1402361 - RNA, 21 nt, Homo sapiens
uuuagcauaguaccucugcua

SEQ ID NO: 1402362 - RNA, 22 nt, Homo sapiens
uuuagcauaguaccucugcuau

SEQ ID NO: 1402363 - RNA, 16 nt, Homo sapiens
uuugaagagugugagg

SEQ ID NO: 1402364 - RNA, 14 nt, Homo sapiens
uuuuaaacuuugau

SEQ ID NO: 1402365 - RNA, 14 nt, Homo sapiens
ggaaauacacuguu

SEQ ID NO: 1402366 - RNA, 15 nt, Homo sapiens
ggaaaugauguuuca

SEQ ID NO: 1402367 - RNA, 23 nt, Homo sapiens
ggaauauguuagagaauuuccuu

SEQ ID NO: 1402368 - RNA, 15 nt, Homo sapiens
ggauacuauuuaauu

SEQ ID NO: 1402369 - RNA, 19 nt, Homo sapiens
uaagauauuaacugagaag

SEQ ID NO: 1402370 - RNA, 17 nt, Homo sapiens
uacuuuuaaacuuugau

SEQ ID NO: 1402371 - RNA, 20 nt, Homo sapiens
uagaaaacaggcaaauuccu

SEQ ID NO: 1402372 - RNA, 21 nt, Homo sapiens
uagcauaguaccucugcuauu

SEQ ID NO: 1402373 - RNA, 14 nt, Homo sapiens
aagaaauauuccuu

SEQ ID NO: 1402374 - RNA, 15 nt, Homo sapiens
aauaucuuaucuucc

SEQ ID NO: 1402375 - RNA, 20 nt, Homo sapiens
aaucuuucaaagugucuuga

SEQ ID NO: 1402376 - RNA, 19 nt, Homo sapiens
acaaugacuuguacucuga

SEQ ID NO: 1402377 - RNA, 17 nt, Homo sapiens
acugccaucauuuacuu

SEQ ID NO: 1402378 - RNA, 15 nt, Homo sapiens
aggaaagauuuuguu

SEQ ID NO: 1402379 - RNA, 20 nt, Homo sapiens
auacuauuuaauuauuucac

SEQ ID NO: 1402380 - RNA, 17 nt, Homo sapiens
auaguaccucugcuauu

SEQ ID NO: 1402381 - RNA, 21 nt, Homo sapiens
aucuuucaaagugucuugaau

SEQ ID NO: 1402382 - RNA, 14 nt, Homo sapiens
augcuauuuauuaa

SEQ ID NO: 1402383 - RNA, 14 nt, Homo sapiens
auggcaaacugcca

SEQ ID NO: 1402384 - RNA, 21 nt, Homo sapiens
auguagaauauauuuccuuau

SEQ ID NO: 1402385 - RNA, 13 nt, Homo sapiens
auucuuuuaguuu

SEQ ID NO: 1402386 - RNA, 18 nt, Homo sapiens
auugaaguuuuggcaauu

SEQ ID NO: 1402387 - RNA, 16 nt, Homo sapiens
caguaguuagcuuucu

SEQ ID NO: 1402388 - RNA, 15 nt, Homo sapiens
cauaagaauucuguu

SEQ ID NO: 1402389 - RNA, 14 nt, Homo sapiens
cgcuuaagcuuuca

SEQ ID NO: 1402390 - RNA, 21 nt, Homo sapiens
cucagcuaaugaaguguuuag

SEQ ID NO: 1402391 - RNA, 19 nt, Homo sapiens
cucugcuauuugcuguuau

SEQ ID NO: 1402392 - RNA, 16 nt, Homo sapiens
cuuccuauaauuuuag

SEQ ID NO: 1402393 - RNA, 20 nt, Homo sapiens
cuuucagcucagcuaaugaa

SEQ ID NO: 1402394 - RNA, 18 nt, Homo sapiens
cuuugauuuuauaugcua

SEQ ID NO: 1402395 - RNA, 14 nt, Homo sapiens
gaaaguuuuggaaa

SEQ ID NO: 1402396 - RNA, 14 nt, Homo sapiens
gaaauauuccuuaa

SEQ ID NO: 1402397 - RNA, 19 nt, Homo sapiens
gaauuguaggugacuauua

SEQ ID NO: 1402398 - RNA, 15 nt, Homo sapiens
gaguaccauaauucu

SEQ ID NO: 1402399 - RNA, 15 nt, Homo sapiens
gauauuaacugagaa

SEQ ID NO: 1402400 - RNA, 16 nt, Homo sapiens
gauuccucacuuugaa

SEQ ID NO: 1402401 - RNA, 21 nt, Homo sapiens
gcaaacugccaucauuuacuu

SEQ ID NO: 1402402 - RNA, 18 nt, Homo sapiens
gcauaguaccucugcuau

SEQ ID NO: 1402403 - RNA, 22 nt, Homo sapiens
gccaggaaucacuggcuguuaa

SEQ ID NO: 1402404 - RNA, 13 nt, Homo sapiens
gcccuagcauuuc

SEQ ID NO: 1402405 - RNA, 20 nt, Homo sapiens
gcuguuauuuuaucugcuau

SEQ ID NO: 1402406 - RNA, 18 nt, Homo sapiens
ggaaucacuggcuguuaa

SEQ ID NO: 1402407 - RNA, 22 nt, Homo sapiens
ggaaucacuggcuguuaaucuu

SEQ ID NO: 1402408 - RNA, 17 nt, Homo sapiens
guauggcaaacugccau

SEQ ID NO: 1402409 - RNA, 16 nt, Homo sapiens
uaacaaugacuuguac

SEQ ID NO: 1402410 - RNA, 15 nt, Homo sapiens
uaauuauuucacuuu

SEQ ID NO: 1402411 - RNA, 17 nt, Homo sapiens
uaauuauuucacuuuag

SEQ ID NO: 1402412 - RNA, 20 nt, Homo sapiens
uacacuguuaucuucacuuu

SEQ ID NO: 1402413 - RNA, 13 nt, Homo sapiens
uauauuuccuuau

SEQ ID NO: 1402414 - RNA, 14 nt, Homo sapiens
uaucuucacuuuua

SEQ ID NO: 1402415 - RNA, 21 nt, Homo sapiens
uaugcuauuuauuaaguauuu

SEQ ID NO: 1402416 - RNA, 13 nt, Homo sapiens
uauuucacuuuag

SEQ ID NO: 1402417 - RNA, 23 nt, Homo sapiens
uauuuccaagaaauauuccuuaa

SEQ ID NO: 1402418 - RNA, 20 nt, Homo sapiens
ucacuggcuguuaaucuuuc

SEQ ID NO: 1402419 - RNA, 17 nt, Homo sapiens
ucagcagagaaguuuuc

SEQ ID NO: 1402420 - RNA, 15 nt, Homo sapiens
ucauaagaauucugu

SEQ ID NO: 1402421 - RNA, 22 nt, Homo sapiens
ucauuuacuuuuaaacuuugau

SEQ ID NO: 1402422 - RNA, 17 nt, Homo sapiens
uccaguaguuagcuuuc

SEQ ID NO: 1402423 - RNA, 16 nt, Homo sapiens
uccuuauucagaauuu

SEQ ID NO: 1402424 - RNA, 17 nt, Homo sapiens
ucuaugagggcuaauau

SEQ ID NO: 1402425 - RNA, 16 nt, Homo sapiens
ugacuuguacucugaa

SEQ ID NO: 1402426 - RNA, 19 nt, Homo sapiens
ugauuuuauaugcuauuua

SEQ ID NO: 1402427 - RNA, 18 nt, Homo sapiens
ugccaucauuuacuuuua

SEQ ID NO: 1402428 - RNA, 16 nt, Homo sapiens
ugcuaguuuauauaga

SEQ ID NO: 1402429 - RNA, 14 nt, Homo sapiens
uggaaacguauuca

SEQ ID NO: 1402430 - RNA, 18 nt, Homo sapiens
uggauuccucacuuugaa

SEQ ID NO: 1402431 - RNA, 19 nt, Homo sapiens
uguuagagaauuuccuuac

SEQ ID NO: 1402432 - RNA, 18 nt, Homo sapiens
uguuauuuuaucugcuau

SEQ ID NO: 1402433 - RNA, 16 nt, Homo sapiens
uuaagcuuucagcuca

SEQ ID NO: 1402434 - RNA, 12 nt, Homo sapiens
uuaucugcuaug

SEQ ID NO: 1402435 - RNA, 20 nt, Homo sapiens
uuaucugcuaugcuauugaa

SEQ ID NO: 1402436 - RNA, 12 nt, Homo sapiens
uuauuucacuuu

SEQ ID NO: 1402437 - RNA, 15 nt, Homo sapiens
uuccucacuuugaag

SEQ ID NO: 1402438 - RNA, 17 nt, Homo sapiens
uugauuuuauaugcuau

SEQ ID NO: 1402439 - RNA, 20 nt, Homo sapiens
uuucauaagaauucuguuga

SEQ ID NO: 1402440 - RNA, 15 nt, Homo sapiens
aaaacaggcaaauuc

SEQ ID NO: 1402441 - RNA, 17 nt, Homo sapiens
aaagcugaguguuucac

SEQ ID NO: 1402442 - RNA, 23 nt, Homo sapiens
aaauacacuguuaucuucacuuu

SEQ ID NO: 1402443 - RNA, 14 nt, Homo sapiens
aauacacuguuauc

SEQ ID NO: 1402444 - RNA, 20 nt, Homo sapiens
aauauaaauuuaucauuuag

SEQ ID NO: 1402445 - RNA, 18 nt, Homo sapiens
aaucacuggcuguuaauc

SEQ ID NO: 1402446 - RNA, 14 nt, Homo sapiens
acaggcaaauuccu

SEQ ID NO: 1402447 - RNA, 17 nt, Homo sapiens
acgcauggaaaaguuuc

SEQ ID NO: 1402448 - RNA, 16 nt, Homo sapiens
acuuuuaaacuuugau

SEQ ID NO: 1402449 - RNA, 13 nt, Homo sapiens
acuuuuauaagaa

SEQ ID NO: 1402450 - RNA, 13 nt, Homo sapiens
agaauauauuucc

SEQ ID NO: 1402451 - RNA, 14 nt, Homo sapiens
aguaguuagcuuuc

SEQ ID NO: 1402452 - RNA, 20 nt, Homo sapiens
aguucuaugagggcuaauau

SEQ ID NO: 1402453 - RNA, 16 nt, Homo sapiens
auaauuuuagacauuc

SEQ ID NO: 1402454 - RNA, 23 nt, Homo sapiens
auacuauuuaauuauuucacuuu

SEQ ID NO: 1402455 - RNA, 16 nt, Homo sapiens
auaguaccucugcuau

SEQ ID NO: 1402456 - RNA, 19 nt, Homo sapiens
auauauuuccuuauucaga

SEQ ID NO: 1402457 - RNA, 12 nt, Homo sapiens
auauauuuuaga

SEQ ID NO: 1402458 - RNA, 20 nt, Homo sapiens
aucauuuacuuuuaaacuuu

SEQ ID NO: 1402459 - RNA, 14 nt, Homo sapiens
aucuucacuuuuau

SEQ ID NO: 1402460 - RNA, 11 nt, Homo sapiens
augauguuuca

SEQ ID NO: 1402461 - RNA, 23 nt, Homo sapiens
auucagaauuucuaaaaguuuaa

SEQ ID NO: 1402462 - RNA, 16 nt, Homo sapiens
auuuaucauuuaguua

SEQ ID NO: 1402463 - RNA, 18 nt, Homo sapiens
cacuguuaucuucacuuu

SEQ ID NO: 1402464 - RNA, 15 nt, Homo sapiens
cacuuuagaaagcug

SEQ ID NO: 1402465 - RNA, 19 nt, Homo sapiens
cauaguaccucugcuauuu

SEQ ID NO: 1402466 - RNA, 16 nt, Homo sapiens
ccucugcuauuugcug

SEQ ID NO: 1402467 - RNA, 17 nt, Homo sapiens
cuagaaaacaggcaaau

SEQ ID NO: 1402468 - RNA, 19 nt, Homo sapiens
cuagaaaacaggcaaauuc

SEQ ID NO: 1402469 - RNA, 22 nt, Homo sapiens
cugcuaugcuauugaaguuuug

SEQ ID NO: 1402470 - RNA, 15 nt, Homo sapiens
cuuuuaaacuuugau

SEQ ID NO: 1402471 - RNA, 13 nt, Homo sapiens
gaaaacaggcaaa

SEQ ID NO: 1402472 - RNA, 20 nt, Homo sapiens
gaaaaguuucccagucuuca

SEQ ID NO: 1402473 - RNA, 17 nt, Homo sapiens
gaaagcugaguguuuca

SEQ ID NO: 1402474 - RNA, 13 nt, Homo sapiens
gaaauaggaaaua

SEQ ID NO: 1402475 - RNA, 16 nt, Homo sapiens
gaauauauuuccuuau

SEQ ID NO: 1402476 - RNA, 12 nt, Homo sapiens
gaauuuccuuac

SEQ ID NO: 1402477 - RNA, 14 nt, Homo sapiens
gagggcuaauaucu

SEQ ID NO: 1402478 - RNA, 19 nt, Homo sapiens
gauacuauuuaauuauuuc

SEQ ID NO: 1402479 - RNA, 13 nt, Homo sapiens
gcuaugcuauuga

SEQ ID NO: 1402480 - RNA, 19 nt, Homo sapiens
gcuauuuauuaaguauuuu

SEQ ID NO: 1402481 - RNA, 20 nt, Homo sapiens
ggaaauauuuuaauguuucu

SEQ ID NO: 1402482 - RNA, 23 nt, Homo sapiens
guaccucugcuauuugcuguuau

SEQ ID NO: 1402483 - RNA, 18 nt, Homo sapiens
guauucaaacaauuugaa

SEQ ID NO: 1402484 - RNA, 18 nt, Homo sapiens
guuagagaauuuccuuac

SEQ ID NO: 1402485 - RNA, 22 nt, Homo sapiens
guugauggaaauacacuguuau

SEQ ID NO: 1402486 - RNA, 23 nt, Homo sapiens
guuuagcauaguaccucugcuau

SEQ ID NO: 1402487 - RNA, 22 nt, Homo sapiens
uaaaaauauauagcgacauccu

SEQ ID NO: 1402488 - RNA, 15 nt, Homo sapiens
uagacauucuuuauc

SEQ ID NO: 1402489 - RNA, 16 nt, Homo sapiens
uagagaauuuccuuac

SEQ ID NO: 1402490 - RNA, 19 nt, Homo sapiens
uagaugaagaagcuagaaa

SEQ ID NO: 1402491 - RNA, 20 nt, Homo sapiens
uagcauaguaccucugcuau

SEQ ID NO: 1402492 - RNA, 16 nt, Homo sapiens
uaguaccucugcuauu

SEQ ID NO: 1402493 - RNA, 16 nt, Homo sapiens
uaucuauguagaauau

SEQ ID NO: 1402494 - RNA, 21 nt, Homo sapiens
uauguagaauauauuuccuua

SEQ ID NO: 1402495 - RNA, 14 nt, Homo sapiens
uccuuacucuugau

SEQ ID NO: 1402496 - RNA, 18 nt, Homo sapiens
ucugcuauuugcuguuau

SEQ ID NO: 1402497 - RNA, 21 nt, Homo sapiens
ucuugaauuguaggugacuau

SEQ ID NO: 1402498 - RNA, 22 nt, Homo sapiens
ugacuauuauauuuccaagaaa

SEQ ID NO: 1402499 - RNA, 20 nt, Homo sapiens
ugauugugggauacuauuua

SEQ ID NO: 1402500 - RNA, 13 nt, Homo sapiens
ugcuaugcuauug

SEQ ID NO: 1402501 - RNA, 16 nt, Homo sapiens
uggaaauacacuguua

SEQ ID NO: 1402502 - RNA, 19 nt, Homo sapiens
uguagaauauauuuccuua

SEQ ID NO: 1402503 - RNA, 18 nt, Homo sapiens
uuaggaguaccauaauuc

SEQ ID NO: 1402504 - RNA, 21 nt, Homo sapiens
uuaggaguaccauaauucugg

SEQ ID NO: 1402505 - RNA, 13 nt, Homo sapiens
uuauaugcuauuu

SEQ ID NO: 1402506 - RNA, 21 nt, Homo sapiens
uuccuauaauuuuagacauuc

SEQ ID NO: 1402507 - RNA, 14 nt, Homo sapiens
uuccucacuuugaa

SEQ ID NO: 1402508 - RNA, 12 nt, Homo sapiens
uuuaaacuuuga

SEQ ID NO: 1402509 - RNA, 23 nt, Homo sapiens
uuuagcauaguaccucugcuauu

SEQ ID NO: 1402510 - RNA, 18 nt, Homo sapiens
uuuaucugcuaugcuauu

SEQ ID NO: 1402511 - RNA, 11 nt, Homo sapiens
uaguuagcuuu

SEQ ID NO: 1402512 - RNA, 13 nt, Homo sapiens
uaguuagcuuucu

SEQ ID NO: 1402513 - RNA, 15 nt, Homo sapiens
uaucuucacuuuuau

SEQ ID NO: 1402514 - RNA, 20 nt, Homo sapiens
uauguuagagaauuuccuua

SEQ ID NO: 1402515 - RNA, 16 nt, Homo sapiens
uauuuuaucugcuaug

SEQ ID NO: 1402516 - RNA, 15 nt, Homo sapiens
ucacuggcuguuaau

SEQ ID NO: 1402517 - RNA, 13 nt, Homo sapiens
uccucacuuugaa

SEQ ID NO: 1402518 - RNA, 20 nt, Homo sapiens
uccucgaggcccuagcauuu

SEQ ID NO: 1402519 - RNA, 13 nt, Homo sapiens
ucugcuaugcuau

SEQ ID NO: 1402520 - RNA, 18 nt, Homo sapiens
ucugcuaugcuauugaag

SEQ ID NO: 1402521 - RNA, 16 nt, Homo sapiens
ucuggaggucucugaa

SEQ ID NO: 1402522 - RNA, 13 nt, Homo sapiens
ucuuggggaauau

SEQ ID NO: 1402523 - RNA, 16 nt, Homo sapiens
ugauuuuauaugcuau

SEQ ID NO: 1402524 - RNA, 16 nt, Homo sapiens
ugcuauuugcuguuau

SEQ ID NO: 1402525 - RNA, 21 nt, Homo sapiens
ugcuguuauuuuaucugcuau

SEQ ID NO: 1402526 - RNA, 23 nt, Homo sapiens
uuauauuuccaagaaauauuccu

SEQ ID NO: 1402527 - RNA, 13 nt, Homo sapiens
uuaucuucacuuu

SEQ ID NO: 1402528 - RNA, 20 nt, Homo sapiens
uucagcucagcuaaugaagu

SEQ ID NO: 1402529 - RNA, 18 nt, Homo sapiens
uuuaaaguaaaggcaaac

SEQ ID NO: 1402530 - RNA, 13 nt, Homo sapiens
uuuauaugcuauu

SEQ ID NO: 1402531 - RNA, 18 nt, Homo sapiens
uuucuggaggucucugaa

SEQ ID NO: 1402532 - RNA, 18 nt, Homo sapiens
aaagcugaguguuucaca

SEQ ID NO: 1402533 - RNA, 21 nt, Homo sapiens
aacaaugacuuguacucugaa

SEQ ID NO: 1402534 - RNA, 18 nt, Homo sapiens
aacugccaucauuuacuu

SEQ ID NO: 1402535 - RNA, 13 nt, Homo sapiens
aagaaauauuccu

SEQ ID NO: 1402536 - RNA, 14 nt, Homo sapiens
aauauauauuuuag

SEQ ID NO: 1402537 - RNA, 23 nt, Homo sapiens
aaucacuggcuguuaaucuuuca

SEQ ID NO: 1402538 - RNA, 16 nt, Homo sapiens
aauuauuucacuuuag

SEQ ID NO: 1402539 - RNA, 20 nt, Homo sapiens
acuggcuguuaaucuuucaa

SEQ ID NO: 1402540 - RNA, 20 nt, Homo sapiens
acuuugauuuuauaugcuau

SEQ ID NO: 1402541 - RNA, 19 nt, Homo sapiens
agaaaacaggcaaauuccu

SEQ ID NO: 1402542 - RNA, 15 nt, Homo sapiens
agaauauauuuccuu

SEQ ID NO: 1402543 - RNA, 20 nt, Homo sapiens
agcauaguaccucugcuauu

SEQ ID NO: 1402544 - RNA, 16 nt, Homo sapiens
aguaaaggcaaacuua

SEQ ID NO: 1402545 - RNA, 21 nt, Homo sapiens
auacuauuuaauuauuucacu

SEQ ID NO: 1402546 - RNA, 22 nt, Homo sapiens
auauuuccaagaaauauuccuu

SEQ ID NO: 1402547 - RNA, 14 nt, Homo sapiens
aucugcuaugcuau

SEQ ID NO: 1402548 - RNA, 20 nt, Homo sapiens
auguuagagaauuuccuuac

SEQ ID NO: 1402549 - RNA, 15 nt, Homo sapiens
auuccucacuuugaa

SEQ ID NO: 1402550 - RNA, 18 nt, Homo sapiens
auugacuauagugugagc

SEQ ID NO: 1402551 - RNA, 22 nt, Homo sapiens
auuuccaagaaauauuccuuaa

SEQ ID NO: 1402552 - RNA, 15 nt, Homo sapiens
auuuuaucugcuaug

SEQ ID NO: 1402553 - RNA, 19 nt, Homo sapiens
caccuuaucuauguagaau

SEQ ID NO: 1402554 - RNA, 21 nt, Homo sapiens
cacuggcuguuaaucuuucaa

SEQ ID NO: 1402555 - RNA, 19 nt, Homo sapiens
cacuguuaucuucacuuuu

SEQ ID NO: 1402556 - RNA, 17 nt, Homo sapiens
cauaguaccucugcuau

SEQ ID NO: 1402557 - RNA, 19 nt, Homo sapiens
ccuggauuccucacuuuga

SEQ ID NO: 1402558 - RNA, 18 nt, Homo sapiens
ccuuauucagaauuucua

SEQ ID NO: 1402559 - RNA, 21 nt, Homo sapiens
cuauuuaauuauuucacuuua

SEQ ID NO: 1402560 - RNA, 21 nt, Homo sapiens
cucacuuugaagagugugagg

SEQ ID NO: 1402561 - RNA, 21 nt, Homo sapiens
cuguaauccuagcacuuuggg

SEQ ID NO: 1402562 - RNA, 21 nt, Homo sapiens
cuguagacauuugcuaugagc

SEQ ID NO: 1402563 - RNA, 19 nt, Homo sapiens
cuguagcagcauuacagaa

SEQ ID NO: 1402564 - RNA, 17 nt, Homo sapiens
cuguauuucaagaccuc

SEQ ID NO: 1402565 - RNA, 16 nt, Homo sapiens
cugucuugugagcuga

SEQ ID NO: 1402566 - RNA, 21 nt, Homo sapiens
cugugccuuggugugcuguau

SEQ ID NO: 1402567 - RNA, 20 nt, Homo sapiens
cuguggcucugcaugacaaa

SEQ ID NO: 1402568 - RNA, 17 nt, Homo sapiens
cuguucagcugguugag

SEQ ID NO: 1402569 - RNA, 17 nt, Homo sapiens
cuuaaaauaaaaugcag

SEQ ID NO: 1402570 - RNA, 14 nt, Homo sapiens
cuuaaauccauccu

SEQ ID NO: 1402571 - RNA, 15 nt, Homo sapiens
cuuaccauugugauu

SEQ ID NO: 1402572 - RNA, 15 nt, Homo sapiens
cuuacuuaggugugg

SEQ ID NO: 1402573 - RNA, 17 nt, Homo sapiens
cuuagguuggcaaaaag

SEQ ID NO: 1402574 - RNA, 14 nt, Homo sapiens
cuuaguuguuauca

SEQ ID NO: 1402575 - RNA, 15 nt, Homo sapiens
cuuauagguuuccac

SEQ ID NO: 1402576 - RNA, 20 nt, Homo sapiens
cuucacuuauccuguucucu

SEQ ID NO: 1402577 - RNA, 16 nt, Homo sapiens
cuucagauuugccuua

SEQ ID NO: 1402578 - RNA, 23 nt, Homo sapiens
cuucauagaugagaaaacugaga

SEQ ID NO: 1402579 - RNA, 23 nt, Homo sapiens
cuucauccccuuuggcuaccuga

SEQ ID NO: 1402580 - RNA, 18 nt, Homo sapiens
cuucauuucucuugcuca

SEQ ID NO: 1402581 - RNA, 12 nt, Homo sapiens
cuucccacggcu

SEQ ID NO: 1402582 - RNA, 15 nt, Homo sapiens
cuucccacggcuccu

SEQ ID NO: 1402583 - RNA, 13 nt, Homo sapiens
cuucccugaucaa

SEQ ID NO: 1402584 - RNA, 15 nt, Homo sapiens
cuuccucuccugucu

SEQ ID NO: 1402585 - RNA, 19 nt, Homo sapiens
cuuccuuaaacuccuguga

SEQ ID NO: 1402586 - RNA, 13 nt, Homo sapiens
cuucgaugacugg

SEQ ID NO: 1402587 - RNA, 22 nt, Homo sapiens
cuucuccagggacagaagcagg

SEQ ID NO: 1402588 - RNA, 20 nt, Homo sapiens
cuugagacaaaucuaugcca

SEQ ID NO: 1402589 - RNA, 16 nt, Homo sapiens
cuugaggcaacucauc

SEQ ID NO: 1402590 - RNA, 17 nt, Homo sapiens
cuugaguuaaccuugcu

SEQ ID NO: 1402591 - RNA, 22 nt, Homo sapiens
cuugauauguaaguacuuccac

SEQ ID NO: 1402592 - RNA, 19 nt, Homo sapiens
cuugcaugaauuacuguau

SEQ ID NO: 1402593 - RNA, 23 nt, Homo sapiens
cuugcucaccaagaaguaacaaa

SEQ ID NO: 1402594 - RNA, 21 nt, Homo sapiens
cuuggaaauuggaagagcaca

SEQ ID NO: 1402595 - RNA, 21 nt, Homo sapiens
cuuggagggcaugaagacaga

SEQ ID NO: 1402596 - RNA, 16 nt, Homo sapiens
cuuggcuuuagccaua

SEQ ID NO: 1402597 - RNA, 13 nt, Homo sapiens
cuugguucuguca

SEQ ID NO: 1402598 - RNA, 22 nt, Homo sapiens
cuuguggcuucucucucuagca

SEQ ID NO: 1402599 - RNA, 22 nt, Homo sapiens
cuuguugacacggccaugacca

SEQ ID NO: 1402600 - RNA, 21 nt, Homo sapiens
cuuuccuggacuuaacucuaa

SEQ ID NO: 1402601 - RNA, 13 nt, Homo sapiens
cuuucuuccaaac

SEQ ID NO: 1402602 - RNA, 21 nt, Homo sapiens
cuuucuuuuuaagcucagugg

SEQ ID NO: 1402603 - RNA, 15 nt, Homo sapiens
cuuugcucuuuggua

SEQ ID NO: 1402604 - RNA, 22 nt, Homo sapiens
cuuuggacuugucccgggacac

SEQ ID NO: 1402605 - RNA, 15 nt, Homo sapiens
cuuuggccauuccaa

SEQ ID NO: 1402606 - RNA, 15 nt, Homo sapiens
cuuugucugcuccca

SEQ ID NO: 1402607 - RNA, 23 nt, Homo sapiens
cuuuuaaagaaaaauaugauacu

SEQ ID NO: 1402608 - RNA, 21 nt, Homo sapiens
cuuuucuguccgagcuuugaa

SEQ ID NO: 1402609 - RNA, 22 nt, Homo sapiens
cuuuuuuuugagaauacacuau

SEQ ID NO: 1402610 - RNA, 23 nt, Homo sapiens
gaaaaauauugcugaacuacuuu

SEQ ID NO: 1402611 - RNA, 18 nt, Homo sapiens
gaaaacacuaguaccuuc

SEQ ID NO: 1402612 - RNA, 15 nt, Homo sapiens
gaaaacauaugcauu

SEQ ID NO: 1402613 - RNA, 13 nt, Homo sapiens
gaaaacaugacuu

SEQ ID NO: 1402614 - RNA, 18 nt, Homo sapiens
gaaaagaaaaaaaauaau

SEQ ID NO: 1402615 - RNA, 12 nt, Homo sapiens
gaaaaugcauua

SEQ ID NO: 1402616 - RNA, 11 nt, Homo sapiens
gaaaauuacag

SEQ ID NO: 1402617 - RNA, 14 nt, Homo sapiens
gaaacgucaugugu

SEQ ID NO: 1402618 - RNA, 20 nt, Homo sapiens
gaaacuguuacuguccuguu

SEQ ID NO: 1402619 - RNA, 14 nt, Homo sapiens
gaaagaaguaggca

SEQ ID NO: 1402620 - RNA, 15 nt, Homo sapiens
gaaagugaccauguu

SEQ ID NO: 1402621 - RNA, 14 nt, Homo sapiens
gaacaaugaaugcu

SEQ ID NO: 1402622 - RNA, 22 nt, Homo sapiens
gaacacagccugggaccagggc

SEQ ID NO: 1402623 - RNA, 15 nt, Homo sapiens
gaacaguccauugaa

SEQ ID NO: 1402624 - RNA, 20 nt, Homo sapiens
gaacaugcagcaaggggaca

SEQ ID NO: 1402625 - RNA, 12 nt, Homo sapiens
gaaccauaucaa

SEQ ID NO: 1402626 - RNA, 16 nt, Homo sapiens
gaaccgaggcagggaa

SEQ ID NO: 1402627 - RNA, 12 nt, Homo sapiens
gaaccucuccau

SEQ ID NO: 1402628 - RNA, 21 nt, Homo sapiens
gaaccucuccaucaucuuccg

SEQ ID NO: 1402629 - RNA, 21 nt, Homo sapiens
gaaccugcccugcucccacag

SEQ ID NO: 1402630 - RNA, 17 nt, Homo sapiens
gaacugccccaucuccu

SEQ ID NO: 1402631 - RNA, 21 nt, Homo sapiens
gaacugcuuuaucccacggaa

SEQ ID NO: 1402632 - RNA, 14 nt, Homo sapiens
gaagaaaacaugac

SEQ ID NO: 1402633 - RNA, 15 nt, Homo sapiens
gaagaaaacaugacu

SEQ ID NO: 1402634 - RNA, 22 nt, Homo sapiens
gaagaacagauaaucccuguau

SEQ ID NO: 1402635 - RNA, 17 nt, Homo sapiens
gaagaacauccaaggag

SEQ ID NO: 1402636 - RNA, 16 nt, Homo sapiens
gaagaacuggcaucuu

SEQ ID NO: 1402637 - RNA, 17 nt, Homo sapiens
gaagaucugcuucccug

SEQ ID NO: 1402638 - RNA, 16 nt, Homo sapiens
gaagcaucaccaugca

SEQ ID NO: 1402639 - RNA, 17 nt, Homo sapiens
gaagccccaacugugau

SEQ ID NO: 1402640 - RNA, 18 nt, Homo sapiens
gaaggagcaagagaacau

SEQ ID NO: 1402641 - RNA, 13 nt, Homo sapiens
gaagguugcucua

SEQ ID NO: 1402642 - RNA, 17 nt, Homo sapiens
gaagugugggucugugu

SEQ ID NO: 1402643 - RNA, 22 nt, Homo sapiens
gaagugugucacccuuaggcca

SEQ ID NO: 1402644 - RNA, 13 nt, Homo sapiens
gaauacugugcau

SEQ ID NO: 1402645 - RNA, 12 nt, Homo sapiens
gaaucacuggaa

SEQ ID NO: 1402646 - RNA, 13 nt, Homo sapiens
gaauugaagccaa

SEQ ID NO: 1402647 - RNA, 22 nt, Homo sapiens
gaauugcuccugcaugcaacua

SEQ ID NO: 1402648 - RNA, 13 nt, Homo sapiens
gaauuuuguugcu

SEQ ID NO: 1402649 - RNA, 17 nt, Homo sapiens
gacaaagguuuuccucu

SEQ ID NO: 1402650 - RNA, 21 nt, Homo sapiens
gacaaagguuuuccucuucua

SEQ ID NO: 1402651 - RNA, 23 nt, Homo sapiens
gacacaggccagcuccacagugu

SEQ ID NO: 1402652 - RNA, 16 nt, Homo sapiens
gacaccuaggcuaggg

SEQ ID NO: 1402653 - RNA, 15 nt, Homo sapiens
gacacggccaugacc

SEQ ID NO: 1402654 - RNA, 15 nt, Homo sapiens
gacacuacauaucua

SEQ ID NO: 1402655 - RNA, 14 nt, Homo sapiens
gacaggcaccagau

SEQ ID NO: 1402656 - RNA, 19 nt, Homo sapiens
gacaucuuaggcuggccag

SEQ ID NO: 1402657 - RNA, 20 nt, Homo sapiens
gaccaaaugcuuuuccucaa

SEQ ID NO: 1402658 - RNA, 18 nt, Homo sapiens
gaccacagaagacccgcu

SEQ ID NO: 1402659 - RNA, 22 nt, Homo sapiens
gaccacuuuccccgugggccau

SEQ ID NO: 1402660 - RNA, 12 nt, Homo sapiens
gaccccaucuca

SEQ ID NO: 1402661 - RNA, 13 nt, Homo sapiens
gaccccaucucau

SEQ ID NO: 1402662 - RNA, 23 nt, Homo sapiens
gacccuaaauguggacaucauga

SEQ ID NO: 1402663 - RNA, 14 nt, Homo sapiens
gacccuauugcugc

SEQ ID NO: 1402664 - RNA, 16 nt, Homo sapiens
gaccgaaucucacucu

SEQ ID NO: 1402665 - RNA, 16 nt, Homo sapiens
gaccuggcuggugaca

SEQ ID NO: 1402666 - RNA, 20 nt, Homo sapiens
gacggaaaggaaaaacugau

SEQ ID NO: 1402667 - RNA, 22 nt, Homo sapiens
gacggcaccaucuggaaggaca

SEQ ID NO: 1402668 - RNA, 17 nt, Homo sapiens
gacguuugacuagccau

SEQ ID NO: 1402669 - RNA, 16 nt, Homo sapiens
gacuagccaucucaag

SEQ ID NO: 1402670 - RNA, 12 nt, Homo sapiens
gacuuaucaaca

SEQ ID NO: 1402671 - RNA, 20 nt, Homo sapiens
gacuugucccgggacaccua

SEQ ID NO: 1402672 - RNA, 23 nt, Homo sapiens
gagaaaaaauauuuuccugccag

SEQ ID NO: 1402673 - RNA, 13 nt, Homo sapiens
gagaaaacugaga

SEQ ID NO: 1402674 - RNA, 13 nt, Homo sapiens
gagaacuaaauaa

SEQ ID NO: 1402675 - RNA, 21 nt, Homo sapiens
gagaagaggcugcugcagaca

SEQ ID NO: 1402676 - RNA, 21 nt, Homo sapiens
gagaagccagcuuuccucauc

SEQ ID NO: 1402677 - RNA, 15 nt, Homo sapiens
gagacccuacagaca

SEQ ID NO: 1402678 - RNA, 18 nt, Homo sapiens
gagaggccuuuuggaaug

SEQ ID NO: 1402679 - RNA, 13 nt, Homo sapiens
gagauaagcaagu

SEQ ID NO: 1402680 - RNA, 16 nt, Homo sapiens
gagaucccaacacugc

SEQ ID NO: 1402681 - RNA, 17 nt, Homo sapiens
gagcaggguuagcucac

SEQ ID NO: 1402682 - RNA, 21 nt, Homo sapiens
gagcaugggacugugccuuug

SEQ ID NO: 1402683 - RNA, 16 nt, Homo sapiens
gagcccccacauucuc

SEQ ID NO: 1402684 - RNA, 20 nt, Homo sapiens
gagcccuuagccuugcugua

SEQ ID NO: 1402685 - RNA, 14 nt, Homo sapiens
gagcccuuaugaca

SEQ ID NO: 1402686 - RNA, 15 nt, Homo sapiens
gagccuggaagacac

SEQ ID NO: 1402687 - RNA, 16 nt, Homo sapiens
gagggaggagaaugag

SEQ ID NO: 1402688 - RNA, 23 nt, Homo sapiens
gaggugacuugccuggggccaca

SEQ ID NO: 1402689 - RNA, 12 nt, Homo sapiens
gaguauaccucc

SEQ ID NO: 1402690 - RNA, 12 nt, Homo sapiens
gagugaauuuga

SEQ ID NO: 1402691 - RNA, 17 nt, Homo sapiens
gagugaauuugaccuag

SEQ ID NO: 1402692 - RNA, 20 nt, Homo sapiens
gagugggguagguugggaga

SEQ ID NO: 1402693 - RNA, 15 nt, Homo sapiens
gaguuugcuuucaaa

SEQ ID NO: 1402694 - RNA, 16 nt, Homo sapiens
gauacagaaugaaucc

SEQ ID NO: 1402695 - RNA, 11 nt, Homo sapiens
gauaugcacac

SEQ ID NO: 1402696 - RNA, 19 nt, Homo sapiens
gauaugcacacacauggau

SEQ ID NO: 1402697 - RNA, 21 nt, Homo sapiens
gaucaagucaccggagcuuuc

SEQ ID NO: 1402698 - RNA, 15 nt, Homo sapiens
gauccaggugccaag

SEQ ID NO: 1402699 - RNA, 22 nt, Homo sapiens
gauccugcacucuaacacucga

SEQ ID NO: 1402700 - RNA, 20 nt, Homo sapiens
gaucgcaccauugcacucca

SEQ ID NO: 1402701 - RNA, 18 nt, Homo sapiens
gaucuuucugcaggaaau

SEQ ID NO: 1402702 - RNA, 18 nt, Homo sapiens
gaugagcacacacacacc

SEQ ID NO: 1402703 - RNA, 13 nt, Homo sapiens
gaugauaaaacac

SEQ ID NO: 1402704 - RNA, 21 nt, Homo sapiens
gaugcacacacagauauacac

SEQ ID NO: 1402705 - RNA, 22 nt, Homo sapiens
gauggaccuccuucgcuggaag

SEQ ID NO: 1402706 - RNA, 19 nt, Homo sapiens
gauggagucucgcucugcu

SEQ ID NO: 1402707 - RNA, 20 nt, Homo sapiens
gauguuaacaagaggggaaa

SEQ ID NO: 1402708 - RNA, 18 nt, Homo sapiens
gauguugcuggacuguca

SEQ ID NO: 1402709 - RNA, 23 nt, Homo sapiens
gauguuuugugaccagguuugug

SEQ ID NO: 1402710 - RNA, 23 nt, Homo sapiens
gauuaaaaucuggcaaaguuaua

SEQ ID NO: 1402711 - RNA, 17 nt, Homo sapiens
gauuaacaacaggaaau

SEQ ID NO: 1402712 - RNA, 19 nt, Homo sapiens
gauuacaggugugagccac

SEQ ID NO: 1402713 - RNA, 13 nt, Homo sapiens
gauuauauaucau

SEQ ID NO: 1402714 - RNA, 14 nt, Homo sapiens
gauucaugccaauu

SEQ ID NO: 1402715 - RNA, 17 nt, Homo sapiens
gauugauaaguaaugaa

SEQ ID NO: 1402716 - RNA, 18 nt, Homo sapiens
gauuuucgacguuugacu

SEQ ID NO: 1402717 - RNA, 20 nt, Homo sapiens
gauuuucgacguuugacuag

SEQ ID NO: 1402718 - RNA, 14 nt, Homo sapiens
gcaacaugcuucau

SEQ ID NO: 1402719 - RNA, 15 nt, Homo sapiens
gcaacuccauuuacc

SEQ ID NO: 1402720 - RNA, 19 nt, Homo sapiens
gcaagaccaaaucauugua

SEQ ID NO: 1402721 - RNA, 15 nt, Homo sapiens
gcaaguuuaaucaau

SEQ ID NO: 1402722 - RNA, 22 nt, Homo sapiens
gcaauacagacuacuucuuccc

SEQ ID NO: 1402723 - RNA, 20 nt, Homo sapiens
gcaauggcacgaucucagcu

SEQ ID NO: 1402724 - RNA, 14 nt, Homo sapiens
gcacaaaagggacu

SEQ ID NO: 1402725 - RNA, 16 nt, Homo sapiens
gcacacacacaccaau

SEQ ID NO: 1402726 - RNA, 12 nt, Homo sapiens
gcacacacagau

SEQ ID NO: 1402727 - RNA, 22 nt, Homo sapiens
gcacacacagauauacacaugg

SEQ ID NO: 1402728 - RNA, 17 nt, Homo sapiens
gcacacacagauaugca

SEQ ID NO: 1402729 - RNA, 20 nt, Homo sapiens
gcacacacagaugcacacac

SEQ ID NO: 1402730 - RNA, 19 nt, Homo sapiens
gcacacggaugcacagaga

SEQ ID NO: 1402731 - RNA, 15 nt, Homo sapiens
gcacagagauaugca

SEQ ID NO: 1402732 - RNA, 18 nt, Homo sapiens
gcacauagagauaugcac

SEQ ID NO: 1402733 - RNA, 20 nt, Homo sapiens
gcacauagagauaugcacac

SEQ ID NO: 1402734 - RNA, 12 nt, Homo sapiens
gcacaucaggag

SEQ ID NO: 1402735 - RNA, 16 nt, Homo sapiens
gcacauccaggcaaug

SEQ ID NO: 1402736 - RNA, 19 nt, Homo sapiens
gcaccauugcacuccagcu

SEQ ID NO: 1402737 - RNA, 18 nt, Homo sapiens
gcacccaugccauagaaa

SEQ ID NO: 1402738 - RNA, 22 nt, Homo sapiens
gcacugaaggcuuucagggccu

SEQ ID NO: 1402739 - RNA, 15 nt, Homo sapiens
gcagacaaguggaca

SEQ ID NO: 1402740 - RNA, 22 nt, Homo sapiens
gcagccuccagugggaggacag

SEQ ID NO: 1402741 - RNA, 18 nt, Homo sapiens
gcaggacuaaaugucuag

SEQ ID NO: 1402742 - RNA, 22 nt, Homo sapiens
gcaggcugcaacccuggugugc

SEQ ID NO: 1402743 - RNA, 14 nt, Homo sapiens
gcagggauucuucc

SEQ ID NO: 1402744 - RNA, 18 nt, Homo sapiens
gcagguacuuccucaguc

SEQ ID NO: 1402745 - RNA, 14 nt, Homo sapiens
gcagugaacugaga

SEQ ID NO: 1402746 - RNA, 23 nt, Homo sapiens
gcaguuucaucaaagaacaaaca

SEQ ID NO: 1402747 - RNA, 13 nt, Homo sapiens
gcauaaaugcauu

SEQ ID NO: 1402748 - RNA, 20 nt, Homo sapiens
gcauagcaaaugacauaagc

SEQ ID NO: 1402749 - RNA, 14 nt, Homo sapiens
gcauagccauggaa

SEQ ID NO: 1402750 - RNA, 11 nt, Homo sapiens
gcaucauucac

SEQ ID NO: 1402751 - RNA, 20 nt, Homo sapiens
gcaucuuccccaacgaaaag

SEQ ID NO: 1402752 - RNA, 20 nt, Homo sapiens
gcaugacaaacacacaucca

SEQ ID NO: 1402753 - RNA, 22 nt, Homo sapiens
gcaugcuggcucccagggccau

SEQ ID NO: 1402754 - RNA, 22 nt, Homo sapiens
gcauuuuguuuguuucuucacu

SEQ ID NO: 1402755 - RNA, 14 nt, Homo sapiens
gccaaagacuguaa

SEQ ID NO: 1402756 - RNA, 20 nt, Homo sapiens
gccaaugcacacacacagag

SEQ ID NO: 1402757 - RNA, 13 nt, Homo sapiens
gccacuaccuuug

SEQ ID NO: 1402758 - RNA, 19 nt, Homo sapiens
gccacucaggggucauuca

SEQ ID NO: 1402759 - RNA, 12 nt, Homo sapiens
gccagacuuccc

SEQ ID NO: 1402760 - RNA, 22 nt, Homo sapiens
gccagagaaaauguuggaagag

SEQ ID NO: 1402761 - RNA, 20 nt, Homo sapiens
gccaggcugggcucugggau

SEQ ID NO: 1402762 - RNA, 21 nt, Homo sapiens
gccaguggcuggaucugugag

SEQ ID NO: 1402763 - RNA, 20 nt, Homo sapiens
gccaucuccucccaccagug

SEQ ID NO: 1402764 - RNA, 23 nt, Homo sapiens
gccauuauuucaaccgcuugcca

SEQ ID NO: 1402765 - RNA, 14 nt, Homo sapiens
gccauucuuuccca

SEQ ID NO: 1402766 - RNA, 19 nt, Homo sapiens
gcccaggcuagagugcagu

SEQ ID NO: 1402767 - RNA, 20 nt, Homo sapiens
gcccaggcuagagugcagug

SEQ ID NO: 1402768 - RNA, 19 nt, Homo sapiens
gcccaggcuggagugcaau

SEQ ID NO: 1402769 - RNA, 20 nt, Homo sapiens
gcccaggcuggagugcaaug

SEQ ID NO: 1402770 - RNA, 19 nt, Homo sapiens
gcccaggcuggagugcagu

SEQ ID NO: 1402771 - RNA, 17 nt, Homo sapiens
gcccgaccccaucucau

SEQ ID NO: 1402772 - RNA, 15 nt, Homo sapiens
gcccugcccugccac

SEQ ID NO: 1402773 - RNA, 21 nt, Homo sapiens
gccgagauugcaccacugcac

SEQ ID NO: 1402774 - RNA, 16 nt, Homo sapiens
gccggugcucuggaag

SEQ ID NO: 1402775 - RNA, 13 nt, Homo sapiens
gccucagccucca

SEQ ID NO: 1402776 - RNA, 15 nt, Homo sapiens
gggaauggauccugg

SEQ ID NO: 1402777 - RNA, 18 nt, Homo sapiens
gggagccugacccucauc

SEQ ID NO: 1402778 - RNA, 15 nt, Homo sapiens
gggaguuuagggugg

SEQ ID NO: 1402779 - RNA, 16 nt, Homo sapiens
gggccacaugggucca

SEQ ID NO: 1402780 - RNA, 12 nt, Homo sapiens
gggccaucuccu

SEQ ID NO: 1402781 - RNA, 19 nt, Homo sapiens
gggccucagccuccaggca

SEQ ID NO: 1402782 - RNA, 16 nt, Homo sapiens
gggccuuauccaguca

SEQ ID NO: 1402783 - RNA, 19 nt, Homo sapiens
gggcugauuguauuuaccu

SEQ ID NO: 1402784 - RNA, 17 nt, Homo sapiens
ggggcacccuccaaaca

SEQ ID NO: 1402785 - RNA, 11 nt, Homo sapiens
gggugccauuc

SEQ ID NO: 1402786 - RNA, 18 nt, Homo sapiens
gggugguuuuugagccau

SEQ ID NO: 1402787 - RNA, 17 nt, Homo sapiens
ggguuggacaaccucau

SEQ ID NO: 1402788 - RNA, 18 nt, Homo sapiens
ggucugcuucugcauuca

SEQ ID NO: 1402789 - RNA, 16 nt, Homo sapiens
ggucuuauuuguaaag

SEQ ID NO: 1402790 - RNA, 22 nt, Homo sapiens
ggugcgaucuuggcucacugca

SEQ ID NO: 1402791 - RNA, 12 nt, Homo sapiens
gguggaaggccu

SEQ ID NO: 1402792 - RNA, 12 nt, Homo sapiens
gguuacaaagac

SEQ ID NO: 1402793 - RNA, 20 nt, Homo sapiens
gguuagaaaaaggacucugc

SEQ ID NO: 1402794 - RNA, 14 nt, Homo sapiens
gguugguguucuca

SEQ ID NO: 1402795 - RNA, 12 nt, Homo sapiens
gguuucauucug

SEQ ID NO: 1402796 - RNA, 20 nt, Homo sapiens
guaaauagcaacaugcuuca

SEQ ID NO: 1402797 - RNA, 16 nt, Homo sapiens
guaaaucuauuggcca

SEQ ID NO: 1402798 - RNA, 14 nt, Homo sapiens
guaacucuuggcca

SEQ ID NO: 1402799 - RNA, 13 nt, Homo sapiens
guaacuuacuuag

SEQ ID NO: 1402800 - RNA, 15 nt, Homo sapiens
guaaucccagcacuu

SEQ ID NO: 1402801 - RNA, 16 nt, Homo sapiens
guagacauuugcuaug

SEQ ID NO: 1402802 - RNA, 14 nt, Homo sapiens
guaguagugucuuc

SEQ ID NO: 1402803 - RNA, 14 nt, Homo sapiens
guauaaauaaccaa

SEQ ID NO: 1402804 - RNA, 21 nt, Homo sapiens
guauaaccuucaugaugaauu

SEQ ID NO: 1402805 - RNA, 19 nt, Homo sapiens
guauaaugguguuacuaaa

SEQ ID NO: 1402806 - RNA, 13 nt, Homo sapiens
aaauuuaugugau

SEQ ID NO: 1402807 - RNA, 16 nt, Homo sapiens
aacacaccgaugcaca

SEQ ID NO: 1402808 - RNA, 17 nt, Homo sapiens
aacacaccgaugcacac

SEQ ID NO: 1402809 - RNA, 16 nt, Homo sapiens
aacacuaaaaccauau

SEQ ID NO: 1402810 - RNA, 17 nt, Homo sapiens
aacaggaaacugaucau

SEQ ID NO: 1402811 - RNA, 20 nt, Homo sapiens
aacauaggccugcucagccu

SEQ ID NO: 1402812 - RNA, 21 nt, Homo sapiens
aacaucaacuggggaauugaa

SEQ ID NO: 1402813 - RNA, 16 nt, Homo sapiens
aacaugcuugcauuau

SEQ ID NO: 1402814 - RNA, 17 nt, Homo sapiens
aacaugcuugcauuaua

SEQ ID NO: 1402815 - RNA, 14 nt, Homo sapiens
aaccacuucagcug

SEQ ID NO: 1402816 - RNA, 14 nt, Homo sapiens
aaccgcuugccaua

SEQ ID NO: 1402817 - RNA, 19 nt, Homo sapiens
aaccuacuuucauacugaa

SEQ ID NO: 1402818 - RNA, 17 nt, Homo sapiens
aaccugaaccugggaac

SEQ ID NO: 1402819 - RNA, 16 nt, Homo sapiens
aaccugaauuauucca

SEQ ID NO: 1402820 - RNA, 23 nt, Homo sapiens
aacuuuguuuagcccaaaaccaa

SEQ ID NO: 1402821 - RNA, 15 nt, Homo sapiens
aagaaagacuuauca

SEQ ID NO: 1402822 - RNA, 17 nt, Homo sapiens
aagaacaguccauugaa

SEQ ID NO: 1402823 - RNA, 20 nt, Homo sapiens
aagaaccccagaccucugaa

SEQ ID NO: 1402824 - RNA, 14 nt, Homo sapiens
aagaaccucuccau

SEQ ID NO: 1402825 - RNA, 15 nt, Homo sapiens
aagaagcucucuccu

SEQ ID NO: 1402826 - RNA, 18 nt, Homo sapiens
aagaauguguuuaaacuu

SEQ ID NO: 1402827 - RNA, 17 nt, Homo sapiens
aagacagauacuccucc

SEQ ID NO: 1402828 - RNA, 23 nt, Homo sapiens
aagacuuugauccaggugccaag

SEQ ID NO: 1402829 - RNA, 22 nt, Homo sapiens
aagagacuaauagagacacaga

SEQ ID NO: 1402830 - RNA, 21 nt, Homo sapiens
aagagagaaagaaguaggcau

SEQ ID NO: 1402831 - RNA, 14 nt, Homo sapiens
aagagcuggaugca

SEQ ID NO: 1402832 - RNA, 17 nt, Homo sapiens
aagaggcugcugagaaa

SEQ ID NO: 1402833 - RNA, 15 nt, Homo sapiens
aagaggcugcugcag

SEQ ID NO: 1402834 - RNA, 12 nt, Homo sapiens
aagagugaauuu

SEQ ID NO: 1402835 - RNA, 15 nt, Homo sapiens
aagagugagagggca

SEQ ID NO: 1402836 - RNA, 15 nt, Homo sapiens
aagaugcagcaaaau

SEQ ID NO: 1402837 - RNA, 22 nt, Homo sapiens
aagaugcuucucacugccaugc

SEQ ID NO: 1402838 - RNA, 15 nt, Homo sapiens
aagcaccugcucaac

SEQ ID NO: 1402839 - RNA, 14 nt, Homo sapiens
aagccauuaugaua

SEQ ID NO: 1402840 - RNA, 22 nt, Homo sapiens
aagcccaccugcacgugaucug

SEQ ID NO: 1402841 - RNA, 20 nt, Homo sapiens
aagccucgggccacaugggu

SEQ ID NO: 1402842 - RNA, 14 nt, Homo sapiens
aaggagagcauagg

SEQ ID NO: 1402843 - RNA, 12 nt, Homo sapiens
aaggcugaccaa

SEQ ID NO: 1402844 - RNA, 17 nt, Homo sapiens
aaggcugagagcucucu

SEQ ID NO: 1402845 - RNA, 20 nt, Homo sapiens
cagagacaggcccaagagau

SEQ ID NO: 1402846 - RNA, 16 nt, Homo sapiens
cagagagagcucugca

SEQ ID NO: 1402847 - RNA, 16 nt, Homo sapiens
cagagauaaagaccuu

SEQ ID NO: 1402848 - RNA, 18 nt, Homo sapiens
cagagauacgcaaacaca

SEQ ID NO: 1402849 - RNA, 13 nt, Homo sapiens
cagagcugggcua

SEQ ID NO: 1402850 - RNA, 17 nt, Homo sapiens
cagaguuuacauucuaa

SEQ ID NO: 1402851 - RNA, 19 nt, Homo sapiens
cagauauacacauggaugc

SEQ ID NO: 1402852 - RNA, 20 nt, Homo sapiens
cagauaugcacacacaugga

SEQ ID NO: 1402853 - RNA, 16 nt, Homo sapiens
cagaugauacuuccaa

SEQ ID NO: 1402854 - RNA, 13 nt, Homo sapiens
cagaugcacacac

SEQ ID NO: 1402855 - RNA, 23 nt, Homo sapiens
cagaugcacacacagaugcacac

SEQ ID NO: 1402856 - RNA, 16 nt, Homo sapiens
cagauggucacacaga

SEQ ID NO: 1402857 - RNA, 14 nt, Homo sapiens
cagauuaguaguua

SEQ ID NO: 1402858 - RNA, 20 nt, Homo sapiens
cagauugauaaguaaugaaa

SEQ ID NO: 1402859 - RNA, 16 nt, Homo sapiens
cagcacuuguguuguc

SEQ ID NO: 1402860 - RNA, 18 nt, Homo sapiens
cagcacuuguguugucug

SEQ ID NO: 1402861 - RNA, 20 nt, Homo sapiens
cagcagagccuggaagacac

SEQ ID NO: 1402862 - RNA, 18 nt, Homo sapiens
cagcagucagucccccaa

SEQ ID NO: 1402863 - RNA, 16 nt, Homo sapiens
cagccaggacaucucu

SEQ ID NO: 1402864 - RNA, 19 nt, Homo sapiens
cagccaggacaucucugcc

SEQ ID NO: 1402865 - RNA, 14 nt, Homo sapiens
cagcccugcugcuu

SEQ ID NO: 1402866 - RNA, 19 nt, Homo sapiens
cagccuccugaguagcugg

SEQ ID NO: 1402867 - RNA, 18 nt, Homo sapiens
cagccuggccaucuggau

SEQ ID NO: 1402868 - RNA, 14 nt, Homo sapiens
cagccugggaccag

SEQ ID NO: 1402869 - RNA, 20 nt, Homo sapiens
cagccugggugacagagcaa

SEQ ID NO: 1402870 - RNA, 14 nt, Homo sapiens
cagcuaucagcucu

SEQ ID NO: 1402871 - RNA, 23 nt, Homo sapiens
cagcucaacggaagaggcugcug

SEQ ID NO: 1402872 - RNA, 24 nt, Homo sapiens
cagcugacuuuucuguccgagcuu

SEQ ID NO: 1402873 - RNA, 15 nt, Homo sapiens
cagcugaggacacac

SEQ ID NO: 1402874 - RNA, 22 nt, Homo sapiens
cagcugggagacacagcaagac

SEQ ID NO: 1402875 - RNA, 18 nt, Homo sapiens
cagcuguuaccugagaua

SEQ ID NO: 1402876 - RNA, 13 nt, Homo sapiens
cagcuuaucucag

SEQ ID NO: 1402877 - RNA, 20 nt, Homo sapiens
cagcuuuccucaucaggcca

SEQ ID NO: 1402878 - RNA, 18 nt, Homo sapiens
caggagaaucacuggaac

SEQ ID NO: 1402879 - RNA, 14 nt, Homo sapiens
caggagacaguuca

SEQ ID NO: 1402880 - RNA, 18 nt, Homo sapiens
caggagucccugccauca

SEQ ID NO: 1402881 - RNA, 17 nt, Homo sapiens
caggagugguggaaccu

SEQ ID NO: 1402882 - RNA, 13 nt, Homo sapiens
caggauucccaga

SEQ ID NO: 1402883 - RNA, 18 nt, Homo sapiens
caggccagaaaacauaug

SEQ ID NO: 1402884 - RNA, 14 nt, Homo sapiens
caggccagcuccac

SEQ ID NO: 1402885 - RNA, 17 nt, Homo sapiens
cagggagcuggcaaugc

SEQ ID NO: 1402886 - RNA, 15 nt, Homo sapiens
cagggccuccagccc

SEQ ID NO: 1402887 - RNA, 22 nt, Homo sapiens
caggggcaaagaacugccccau

SEQ ID NO: 1402888 - RNA, 20 nt, Homo sapiens
caggugccacugaccgggau

SEQ ID NO: 1402889 - RNA, 15 nt, Homo sapiens
cagguuggugggggc

SEQ ID NO: 1402890 - RNA, 17 nt, Homo sapiens
caguacuuccugcagua

SEQ ID NO: 1402891 - RNA, 15 nt, Homo sapiens
cagucacugacucaa

SEQ ID NO: 1402892 - RNA, 14 nt, Homo sapiens
caguccuccagacc

SEQ ID NO: 1402893 - RNA, 12 nt, Homo sapiens
cagucuuggaau

SEQ ID NO: 1402894 - RNA, 14 nt, Homo sapiens
cagugagccaagau

SEQ ID NO: 1402895 - RNA, 19 nt, Homo sapiens
cagugaugaaaauuugccu

SEQ ID NO: 1402896 - RNA, 19 nt, Homo sapiens
caguggcuggaucugugag

SEQ ID NO: 1402897 - RNA, 18 nt, Homo sapiens
caguggugcgaucuuggc

SEQ ID NO: 1402898 - RNA, 22 nt, Homo sapiens
caguucuuuucaaccuacuuuc

SEQ ID NO: 1402899 - RNA, 16 nt, Homo sapiens
cauaaagguauuuaga

SEQ ID NO: 1402900 - RNA, 16 nt, Homo sapiens
cauagagauaugcaca

SEQ ID NO: 1402901 - RNA, 20 nt, Homo sapiens
cauagagauaugcacacaca

SEQ ID NO: 1402902 - RNA, 16 nt, Homo sapiens
cauagccauggaaccc

SEQ ID NO: 1402903 - RNA, 21 nt, Homo sapiens
cauagccauggaacccugcca

SEQ ID NO: 1402904 - RNA, 20 nt, Homo sapiens
cauaucuaaagcuuuggaca

SEQ ID NO: 1402905 - RNA, 18 nt, Homo sapiens
caucaaagaacaaacauc

SEQ ID NO: 1402906 - RNA, 21 nt, Homo sapiens
caucagugcacacggaugcac

SEQ ID NO: 1402907 - RNA, 17 nt, Homo sapiens
caucauaauucagcucu

SEQ ID NO: 1402908 - RNA, 10 nt, Homo sapiens
cauccaaagu

SEQ ID NO: 1402909 - RNA, 19 nt, Homo sapiens
cauccaacauuaaaagcca

SEQ ID NO: 1402910 - RNA, 18 nt, Homo sapiens
cauccaaggagaaacaga

SEQ ID NO: 1402911 - RNA, 17 nt, Homo sapiens
cauccauagcaccucca

SEQ ID NO: 1402912 - RNA, 15 nt, Homo sapiens
caucccuggaaggac

SEQ ID NO: 1402913 - RNA, 24 nt, Homo sapiens
cauccuuggaaauuggaagagcac

SEQ ID NO: 1402914 - RNA, 16 nt, Homo sapiens
caucuacaaucaggag

SEQ ID NO: 1402915 - RNA, 18 nt, Homo sapiens
caucucacgcugaucauu

SEQ ID NO: 1402916 - RNA, 13 nt, Homo sapiens
caucucuacaaaa

SEQ ID NO: 1402917 - RNA, 16 nt, Homo sapiens
caucucuuuaccuccu

SEQ ID NO: 1402918 - RNA, 23 nt, Homo sapiens
caucucuuuaccuccuaauucca

SEQ ID NO: 1402919 - RNA, 17 nt, Homo sapiens
caucuggauuuucacac

SEQ ID NO: 1402920 - RNA, 14 nt, Homo sapiens
caucuguaccucug

SEQ ID NO: 1402921 - RNA, 14 nt, Homo sapiens
caucuuccaacuca

SEQ ID NO: 1402922 - RNA, 12 nt, Homo sapiens
caugaagcugga

SEQ ID NO: 1402923 - RNA, 19 nt, Homo sapiens
caugacaaacacacaucca

SEQ ID NO: 1402924 - RNA, 16 nt, Homo sapiens
ccuaccaaccucugaa

SEQ ID NO: 1402925 - RNA, 20 nt, Homo sapiens
ccuagcacuuugggaggcca

SEQ ID NO: 1402926 - RNA, 21 nt, Homo sapiens
ccuaggaauucccagcccaaa

SEQ ID NO: 1402927 - RNA, 17 nt, Homo sapiens
ccuaggcauuugcugaa

SEQ ID NO: 1402928 - RNA, 21 nt, Homo sapiens
ccucaaaccuaccacucagga

SEQ ID NO: 1402929 - RNA, 20 nt, Homo sapiens
ccucacccccagcuuugcua

SEQ ID NO: 1402930 - RNA, 22 nt, Homo sapiens
ccucacugcuguagacauuugc

SEQ ID NO: 1402931 - RNA, 17 nt, Homo sapiens
ccucaggcaggugggau

SEQ ID NO: 1402932 - RNA, 13 nt, Homo sapiens
ccucauuagcauu

SEQ ID NO: 1402933 - RNA, 22 nt, Homo sapiens
ccucauuuaaguaaaagguuag

SEQ ID NO: 1402934 - RNA, 15 nt, Homo sapiens
ccuccauucugacca

SEQ ID NO: 1402935 - RNA, 17 nt, Homo sapiens
ccuccccacaguccuca

SEQ ID NO: 1402936 - RNA, 10 nt, Homo sapiens
ccucccugaa

SEQ ID NO: 1402937 - RNA, 23 nt, Homo sapiens
ccuccuccagccgccaugcuccu

SEQ ID NO: 1402938 - RNA, 20 nt, Homo sapiens
ccucgagaucccaacacugc

SEQ ID NO: 1402939 - RNA, 13 nt, Homo sapiens
ccucuccacucau

SEQ ID NO: 1402940 - RNA, 23 nt, Homo sapiens
ccucugaaugucccagaggcuag

SEQ ID NO: 1402941 - RNA, 20 nt, Homo sapiens
ccucugccuuguccugaugc

SEQ ID NO: 1402942 - RNA, 21 nt, Homo sapiens
ccucuuccgugacgucacugg

SEQ ID NO: 1402943 - RNA, 21 nt, Homo sapiens
ccucuucucuacucuagggaa

SEQ ID NO: 1402944 - RNA, 17 nt, Homo sapiens
ccugaaccugggaacca

SEQ ID NO: 1402945 - RNA, 17 nt, Homo sapiens
ccugaauuuuguugcug

SEQ ID NO: 1402946 - RNA, 21 nt, Homo sapiens
ccugagaggaaccagagcaga

SEQ ID NO: 1402947 - RNA, 21 nt, Homo sapiens
ccugagauacugaagugcagc

SEQ ID NO: 1402948 - RNA, 19 nt, Homo sapiens
ccugaguuucaaguauccu

SEQ ID NO: 1402949 - RNA, 15 nt, Homo sapiens
ccugccaggcugcua

SEQ ID NO: 1402950 - RNA, 23 nt, Homo sapiens
ccugcucaacauaggccugcuca

SEQ ID NO: 1402951 - RNA, 14 nt, Homo sapiens
ccugcucccacaga

SEQ ID NO: 1402952 - RNA, 20 nt, Homo sapiens
ccuggcccacugcaucguuu

SEQ ID NO: 1402953 - RNA, 18 nt, Homo sapiens
ccuggccuguggagagaa

SEQ ID NO: 1402954 - RNA, 14 nt, Homo sapiens
ccugggcaauguga

SEQ ID NO: 1402955 - RNA, 19 nt, Homo sapiens
ccuggggccccauuugcca

SEQ ID NO: 1402956 - RNA, 22 nt, Homo sapiens
ccugggugacagagcaagugag

SEQ ID NO: 1402957 - RNA, 15 nt, Homo sapiens
ccuguccauaaagua

SEQ ID NO: 1402958 - RNA, 22 nt, Homo sapiens
ccuuagcuggcauuacagcugg

SEQ ID NO: 1402959 - RNA, 19 nt, Homo sapiens
ccuucauugcuggagacag

SEQ ID NO: 1402960 - RNA, 19 nt, Homo sapiens
ccuucccuccccacagucc

SEQ ID NO: 1402961 - RNA, 17 nt, Homo sapiens
ccuucgauauaugacuu

SEQ ID NO: 1402962 - RNA, 14 nt, Homo sapiens
ccuugccaugucuu

SEQ ID NO: 1402963 - RNA, 15 nt, Homo sapiens
ccuuggugugcugua

SEQ ID NO: 1402964 - RNA, 22 nt, Homo sapiens
ccuugucguaggaaaaccauga

SEQ ID NO: 1402965 - RNA, 14 nt, Homo sapiens
ccuuuaccccucau

SEQ ID NO: 1402966 - RNA, 13 nt, Homo sapiens
ccuuugagggcag

SEQ ID NO: 1402967 - RNA, 14 nt, Homo sapiens
ccuuugagguugau

SEQ ID NO: 1402968 - RNA, 22 nt, Homo sapiens
ccuuugcaggcccagcagacuu

SEQ ID NO: 1402969 - RNA, 20 nt, Homo sapiens
ccuuuggacuugucccggga

SEQ ID NO: 1402970 - RNA, 21 nt, Homo sapiens
ccuuuggcuaucuacugagac

SEQ ID NO: 1402971 - RNA, 14 nt, Homo sapiens
ccuuugucccagaa

SEQ ID NO: 1402972 - RNA, 13 nt, Homo sapiens
ccuuuugccaucc

SEQ ID NO: 1402973 - RNA, 21 nt, Homo sapiens
cgacguuugacuagccaucuc

SEQ ID NO: 1402974 - RNA, 22 nt, Homo sapiens
cgacguuugacuagccaucuca

SEQ ID NO: 1402975 - RNA, 19 nt, Homo sapiens
cgaugcacacgcacauaga

SEQ ID NO: 1402976 - RNA, 19 nt, Homo sapiens
cgauugcaggagucccugc

SEQ ID NO: 1402977 - RNA, 17 nt, Homo sapiens
cgcacaaggcugaccaa

SEQ ID NO: 1402978 - RNA, 21 nt, Homo sapiens
cgcacaaggcugaccaagaga

SEQ ID NO: 1402979 - RNA, 13 nt, Homo sapiens
cgcacacacagau

SEQ ID NO: 1402980 - RNA, 19 nt, Homo sapiens
cgcacauagagauaugcac

SEQ ID NO: 1402981 - RNA, 14 nt, Homo sapiens
cgccagacuuccca

SEQ ID NO: 1402982 - RNA, 13 nt, Homo sapiens
cgccagaucugca

SEQ ID NO: 1402983 - RNA, 22 nt, Homo sapiens
cgcuauuccucacucagaggaa

SEQ ID NO: 1402984 - RNA, 18 nt, Homo sapiens
cgcugugucagcauagaa

SEQ ID NO: 1402985 - RNA, 18 nt, Homo sapiens
cggaagugaccacagaag

SEQ ID NO: 1402986 - RNA, 12 nt, Homo sapiens
cggagcuuucaa

SEQ ID NO: 1402987 - RNA, 19 nt, Homo sapiens
cggcaaugcccugugcaug

SEQ ID NO: 1402988 - RNA, 16 nt, Homo sapiens
cggccacucuaccuga

SEQ ID NO: 1402989 - RNA, 18 nt, Homo sapiens
cggccacucuaccugaac

SEQ ID NO: 1402990 - RNA, 15 nt, Homo sapiens
cgggacaccuaggcu

SEQ ID NO: 1402991 - RNA, 18 nt, Homo sapiens
cgggagccugacccucau

SEQ ID NO: 1402992 - RNA, 13 nt, Homo sapiens
cgggcugcacaga

SEQ ID NO: 1402993 - RNA, 22 nt, Homo sapiens
cggugcucuggaagaccugaaa

SEQ ID NO: 1402994 - RNA, 13 nt, Homo sapiens
cguaggaaaacca

SEQ ID NO: 1402995 - RNA, 22 nt, Homo sapiens
cguuugacuagccaucucaagc

SEQ ID NO: 1402996 - RNA, 22 nt, Homo sapiens
cuaaccugccgagaguccauca

SEQ ID NO: 1402997 - RNA, 20 nt, Homo sapiens
cuaagcugccgguucuuaaa

SEQ ID NO: 1402998 - RNA, 12 nt, Homo sapiens
cuaagcuuucuc

SEQ ID NO: 1402999 - RNA, 21 nt, Homo sapiens
cuaaucuucuuaugcaauuuc

SEQ ID NO: 1403000 - RNA, 18 nt, Homo sapiens
cuaauguggcagcugucu

SEQ ID NO: 1403001 - RNA, 22 nt, Homo sapiens
cuacaagucaucauaauucagc

SEQ ID NO: 1403002 - RNA, 21 nt, Homo sapiens
cuaccaaagcaccuuagcugg

SEQ ID NO: 1403003 - RNA, 15 nt, Homo sapiens
cuacugagacaugac

SEQ ID NO: 1403004 - RNA, 17 nt, Homo sapiens
cuacuucuuuugcucuu

SEQ ID NO: 1403005 - RNA, 17 nt, Homo sapiens
cuacuuguaaaggugcu

SEQ ID NO: 1403006 - RNA, 20 nt, Homo sapiens
cuacuuguaaaggugcugca

SEQ ID NO: 1403007 - RNA, 18 nt, Homo sapiens
cuacuuuuggugcuuaaa

SEQ ID NO: 1403008 - RNA, 15 nt, Homo sapiens
cuacuuuuugcaccu

SEQ ID NO: 1403009 - RNA, 13 nt, Homo sapiens
cuagaaacaaaca

SEQ ID NO: 1403010 - RNA, 19 nt, Homo sapiens
cuagaaacaaacaucuaau

SEQ ID NO: 1403011 - RNA, 13 nt, Homo sapiens
cuagagugcagug

SEQ ID NO: 1403012 - RNA, 22 nt, Homo sapiens
cuaggcuaggguggggagagac

SEQ ID NO: 1403013 - RNA, 21 nt, Homo sapiens
cuaguuaggaaguuaccugga

SEQ ID NO: 1403014 - RNA, 13 nt, Homo sapiens
cuaguucugccag

SEQ ID NO: 1403015 - RNA, 18 nt, Homo sapiens
cuaugggacugcagugcc

SEQ ID NO: 1403016 - RNA, 19 nt, Homo sapiens
cuauuccuugguucuguca

SEQ ID NO: 1403017 - RNA, 14 nt, Homo sapiens
cucaaaugcaguau

SEQ ID NO: 1403018 - RNA, 14 nt, Homo sapiens
cucacacuacuuga

SEQ ID NO: 1403019 - RNA, 10 nt, Homo sapiens
cucacugugu

SEQ ID NO: 1403020 - RNA, 19 nt, Homo sapiens
cucagccucaaaugcagua

SEQ ID NO: 1403021 - RNA, 17 nt, Homo sapiens
cucagccuccugaguag

SEQ ID NO: 1403022 - RNA, 23 nt, Homo sapiens
cucaguccugggucaacaucuua

SEQ ID NO: 1403023 - RNA, 16 nt, Homo sapiens
cucagugucagcacuc

SEQ ID NO: 1403024 - RNA, 15 nt, Homo sapiens
cucaucuuucuucca

SEQ ID NO: 1403025 - RNA, 13 nt, Homo sapiens
cuccacaguguug

SEQ ID NO: 1403026 - RNA, 12 nt, Homo sapiens
cuccacauaccu

SEQ ID NO: 1403027 - RNA, 23 nt, Homo sapiens
cuccacucaugugacucuuucca

SEQ ID NO: 1403028 - RNA, 22 nt, Homo sapiens
cuccagcugggagacacagcaa

SEQ ID NO: 1403029 - RNA, 16 nt, Homo sapiens
cuccagggacaaagag

SEQ ID NO: 1403030 - RNA, 22 nt, Homo sapiens
cuccauugguguugacauacau

SEQ ID NO: 1403031 - RNA, 19 nt, Homo sapiens
cucccaaagugcugggauu

SEQ ID NO: 1403032 - RNA, 20 nt, Homo sapiens
cucccaaagugcugggauua

SEQ ID NO: 1403033 - RNA, 22 nt, Homo sapiens
cuccgcugggaggaaccugaac

SEQ ID NO: 1403034 - RNA, 15 nt, Homo sapiens
cuccuaagacaccug

SEQ ID NO: 1403035 - RNA, 19 nt, Homo sapiens
cuccucccaggaacugggc

SEQ ID NO: 1403036 - RNA, 21 nt, Homo sapiens
cuccucccaggaacugggcca

SEQ ID NO: 1403037 - RNA, 17 nt, Homo sapiens
cuccucgagaucccaac

SEQ ID NO: 1403038 - RNA, 19 nt, Homo sapiens
cuccugucccuugaccuua

SEQ ID NO: 1403039 - RNA, 13 nt, Homo sapiens
cucgaacuccuga

SEQ ID NO: 1403040 - RNA, 16 nt, Homo sapiens
cucgaugaagcccaau

SEQ ID NO: 1403041 - RNA, 21 nt, Homo sapiens
cucgcaagggaaguccuugca

SEQ ID NO: 1403042 - RNA, 17 nt, Homo sapiens
cucggccucccaaagug

SEQ ID NO: 1403043 - RNA, 23 nt, Homo sapiens
cucggccuccucccacaagcacc

SEQ ID NO: 1403044 - RNA, 20 nt, Homo sapiens
cucuaacacggccaggcugg

SEQ ID NO: 1403045 - RNA, 23 nt, Homo sapiens
cucuaauucuagagucucuguua

SEQ ID NO: 1403046 - RNA, 13 nt, Homo sapiens
cucuacaaaaagc

SEQ ID NO: 1403047 - RNA, 21 nt, Homo sapiens
cucuagaacacccacuggcca

SEQ ID NO: 1403048 - RNA, 24 nt, Homo sapiens
cucuaugaccucgcccuccacaaa

SEQ ID NO: 1403049 - RNA, 18 nt, Homo sapiens
cucucggcuucaccaggg

SEQ ID NO: 1403050 - RNA, 13 nt, Homo sapiens
cucucucaugaua

SEQ ID NO: 1403051 - RNA, 16 nt, Homo sapiens
cucugcuucaguccac

SEQ ID NO: 1403052 - RNA, 16 nt, Homo sapiens
cucuuagaaaaaccac

SEQ ID NO: 1403053 - RNA, 13 nt, Homo sapiens
cucuuuaccuccu

SEQ ID NO: 1403054 - RNA, 11 nt, Homo sapiens
cugaaaaccaa

SEQ ID NO: 1403055 - RNA, 18 nt, Homo sapiens
cugaaauaacauggccuu

SEQ ID NO: 1403056 - RNA, 16 nt, Homo sapiens
cugaaccgacuuuucu

SEQ ID NO: 1403057 - RNA, 19 nt, Homo sapiens
ucccuucgauauaugacuu

SEQ ID NO: 1403058 - RNA, 21 nt, Homo sapiens
uccggcaaugcccugugcaug

SEQ ID NO: 1403059 - RNA, 19 nt, Homo sapiens
uccggccuccugucccuca

SEQ ID NO: 1403060 - RNA, 22 nt, Homo sapiens
uccuacccccugugccuuguca

SEQ ID NO: 1403061 - RNA, 18 nt, Homo sapiens
uccuaggcauuugcugaa

SEQ ID NO: 1403062 - RNA, 13 nt, Homo sapiens
uccucaaaccuac

SEQ ID NO: 1403063 - RNA, 23 nt, Homo sapiens
uccucaaaccuaccacucaggaa

SEQ ID NO: 1403064 - RNA, 22 nt, Homo sapiens
uccucaaagggagagagugcua

SEQ ID NO: 1403065 - RNA, 21 nt, Homo sapiens
uccucauuagcauuuugcuaa

SEQ ID NO: 1403066 - RNA, 18 nt, Homo sapiens
uccuggaccugaaggcau

SEQ ID NO: 1403067 - RNA, 12 nt, Homo sapiens
uccuguauauuc

SEQ ID NO: 1403068 - RNA, 19 nt, Homo sapiens
uccugucccucauccauag

SEQ ID NO: 1403069 - RNA, 16 nt, Homo sapiens
uccugugccagaggaa

SEQ ID NO: 1403070 - RNA, 11 nt, Homo sapiens
uccuguucucu

SEQ ID NO: 1403071 - RNA, 24 nt, Homo sapiens
uccuguugcaaugacacauaggaa

SEQ ID NO: 1403072 - RNA, 17 nt, Homo sapiens
uccuuaccauugugauu

SEQ ID NO: 1403073 - RNA, 16 nt, Homo sapiens
uccuuaccgugggcac

SEQ ID NO: 1403074 - RNA, 19 nt, Homo sapiens
uccuuccccagcuuugcug

SEQ ID NO: 1403075 - RNA, 21 nt, Homo sapiens
uccuuggcgcugccaccugcc

SEQ ID NO: 1403076 - RNA, 19 nt, Homo sapiens
uccuuuaccccucauccaa

SEQ ID NO: 1403077 - RNA, 17 nt, Homo sapiens
uccuuuccccucccuca

SEQ ID NO: 1403078 - RNA, 16 nt, Homo sapiens
uccuuuggccauucca

SEQ ID NO: 1403079 - RNA, 17 nt, Homo sapiens
uccuuugguccuucaaa

SEQ ID NO: 1403080 - RNA, 21 nt, Homo sapiens
ucgagccacaaccgaccagau

SEQ ID NO: 1403081 - RNA, 22 nt, Homo sapiens
ucgauauaugacuuuuucucag

SEQ ID NO: 1403082 - RNA, 16 nt, Homo sapiens
ucggggacacaggcca

SEQ ID NO: 1403083 - RNA, 24 nt, Homo sapiens
ucgugauauccacaaaugcuauuc

SEQ ID NO: 1403084 - RNA, 23 nt, Homo sapiens
ucuaaagcuuuggacaaguccuu

SEQ ID NO: 1403085 - RNA, 14 nt, Homo sapiens
ucuacgccagggga

SEQ ID NO: 1403086 - RNA, 17 nt, Homo sapiens
ucuacugagacaugacu

SEQ ID NO: 1403087 - RNA, 22 nt, Homo sapiens
ucuagaacacaggcaaaauccu

SEQ ID NO: 1403088 - RNA, 15 nt, Homo sapiens
ucuagcaccaggacu

SEQ ID NO: 1403089 - RNA, 16 nt, Homo sapiens
ucuagggaaaaaccag

SEQ ID NO: 1403090 - RNA, 18 nt, Homo sapiens
ucucaccuggacuccagu

SEQ ID NO: 1403091 - RNA, 17 nt, Homo sapiens
ucucaugauagaaggcu

SEQ ID NO: 1403092 - RNA, 13 nt, Homo sapiens
ucucauuccagag

SEQ ID NO: 1403093 - RNA, 13 nt, Homo sapiens
ucuccaucuucca

SEQ ID NO: 1403094 - RNA, 15 nt, Homo sapiens
ucuccugccucagcc

SEQ ID NO: 1403095 - RNA, 23 nt, Homo sapiens
ucuccuuuaaacagacucgcuuu

SEQ ID NO: 1403096 - RNA, 18 nt, Homo sapiens
ucucuaaacugcuguuaa

SEQ ID NO: 1403097 - RNA, 14 nt, Homo sapiens
ucucucuucuccac

SEQ ID NO: 1403098 - RNA, 18 nt, Homo sapiens
ucucuugcucaccaagaa

SEQ ID NO: 1403099 - RNA, 15 nt, Homo sapiens
ucucuuuaccuccua

SEQ ID NO: 1403100 - RNA, 18 nt, Homo sapiens
ucugcaaggucuuugguu

SEQ ID NO: 1403101 - RNA, 21 nt, Homo sapiens
ucugcagggggugugucugcu

SEQ ID NO: 1403102 - RNA, 17 nt, Homo sapiens
ucugcccgggagcucag

SEQ ID NO: 1403103 - RNA, 11 nt, Homo sapiens
ucugcuucugc

SEQ ID NO: 1403104 - RNA, 19 nt, Homo sapiens
ucuggccacacugggcuca

SEQ ID NO: 1403105 - RNA, 19 nt, Homo sapiens
ucuguaugugacaacauuu

SEQ ID NO: 1403106 - RNA, 14 nt, Homo sapiens
ucuuagcugccaag

SEQ ID NO: 1403107 - RNA, 20 nt, Homo sapiens
ucuuagcugccaaguaaaua

SEQ ID NO: 1403108 - RNA, 16 nt, Homo sapiens
ucuuagcugucugcuc

SEQ ID NO: 1403109 - RNA, 20 nt, Homo sapiens
ucuucacuucagacaauuca

SEQ ID NO: 1403110 - RNA, 21 nt, Homo sapiens
ucuucaggguguuaaggcagu

SEQ ID NO: 1403111 - RNA, 14 nt, Homo sapiens
ucuucauuaccuca

SEQ ID NO: 1403112 - RNA, 12 nt, Homo sapiens
ucuuccaaacag

SEQ ID NO: 1403113 - RNA, 13 nt, Homo sapiens
ucuucucuacucu

SEQ ID NO: 1403114 - RNA, 22 nt, Homo sapiens
ucuucuuauucaugcuuucucc

SEQ ID NO: 1403115 - RNA, 12 nt, Homo sapiens
ucuuuaccuccu

SEQ ID NO: 1403116 - RNA, 16 nt, Homo sapiens
ucuuucauacauuaua

SEQ ID NO: 1403117 - RNA, 23 nt, Homo sapiens
ucuuuccuggacuuaacucuaau

SEQ ID NO: 1403118 - RNA, 18 nt, Homo sapiens
ucuuuccuuuugcaacaa

SEQ ID NO: 1403119 - RNA, 21 nt, Homo sapiens
ucuuucuuuucuauuagugaa

SEQ ID NO: 1403120 - RNA, 14 nt, Homo sapiens
ucuuuugucccaga

SEQ ID NO: 1403121 - RNA, 16 nt, Homo sapiens
ugaaauaacauggccu

SEQ ID NO: 1403122 - RNA, 20 nt, Homo sapiens
ugaaauacgccagaacugcu

SEQ ID NO: 1403123 - RNA, 14 nt, Homo sapiens
ugaacacacaugga

SEQ ID NO: 1403124 - RNA, 19 nt, Homo sapiens
ugaacacagccugggacca

SEQ ID NO: 1403125 - RNA, 19 nt, Homo sapiens
ugaaccugggaaccaugaa

SEQ ID NO: 1403126 - RNA, 19 nt, Homo sapiens
ugaagagugagagggcaug

SEQ ID NO: 1403127 - RNA, 12 nt, Homo sapiens
ugaagcuggaag

SEQ ID NO: 1403128 - RNA, 18 nt, Homo sapiens
ugaagugcagcucaggag

SEQ ID NO: 1403129 - RNA, 22 nt, Homo sapiens
ugaauaauacaguaucucaggg

SEQ ID NO: 1403130 - RNA, 14 nt, Homo sapiens
ugaauuuuguugcu

SEQ ID NO: 1403131 - RNA, 16 nt, Homo sapiens
ugaccaguaauuguga

SEQ ID NO: 1403132 - RNA, 16 nt, Homo sapiens
ugaccauuucaggggu

SEQ ID NO: 1403133 - RNA, 20 nt, Homo sapiens
ugaccucgcccuccacaaau

SEQ ID NO: 1403134 - RNA, 12 nt, Homo sapiens
ugacuagccauc

SEQ ID NO: 1403135 - RNA, 19 nt, Homo sapiens
ugacuagccaucucaagca

SEQ ID NO: 1403136 - RNA, 19 nt, Homo sapiens
ugacuccccccuuccaaau

SEQ ID NO: 1403137 - RNA, 15 nt, Homo sapiens
ugagaaaacugagag

SEQ ID NO: 1403138 - RNA, 18 nt, Homo sapiens
ugagaagccagcuuuccu

SEQ ID NO: 1403139 - RNA, 15 nt, Homo sapiens
ugagaccaaccuggg

SEQ ID NO: 1403140 - RNA, 16 nt, Homo sapiens
ugagacccugucucaa

SEQ ID NO: 1403141 - RNA, 19 nt, Homo sapiens
ugagaggccacagugcaau

SEQ ID NO: 1403142 - RNA, 19 nt, Homo sapiens
ugagauacugaagugcagc

SEQ ID NO: 1403143 - RNA, 17 nt, Homo sapiens
ugagcaaggacaaccug

SEQ ID NO: 1403144 - RNA, 16 nt, Homo sapiens
ugagcauuagcuacuu

SEQ ID NO: 1403145 - RNA, 18 nt, Homo sapiens
ugagcuggggaugucucu

SEQ ID NO: 1403146 - RNA, 20 nt, Homo sapiens
ugagcuggggaugucucuca

SEQ ID NO: 1403147 - RNA, 13 nt, Homo sapiens
ugaggacauggag

SEQ ID NO: 1403148 - RNA, 13 nt, Homo sapiens
ugaggaguggagu

SEQ ID NO: 1403149 - RNA, 14 nt, Homo sapiens
ugaggccucucauu

SEQ ID NO: 1403150 - RNA, 15 nt, Homo sapiens
ugaggggcucucuca

SEQ ID NO: 1403151 - RNA, 19 nt, Homo sapiens
ugagggugacuauggagcu

SEQ ID NO: 1403152 - RNA, 22 nt, Homo sapiens
ugagucucuaugaucuuggcac

SEQ ID NO: 1403153 - RNA, 15 nt, Homo sapiens
ugagugggugaauaa

SEQ ID NO: 1403154 - RNA, 20 nt, Homo sapiens
uuaagugacuauagaaugca

SEQ ID NO: 1403155 - RNA, 14 nt, Homo sapiens
uuaauaaacagcuc

SEQ ID NO: 1403156 - RNA, 16 nt, Homo sapiens
uuacaaaaacauggcc

SEQ ID NO: 1403157 - RNA, 21 nt, Homo sapiens
uuaccugauuugaugauacau

SEQ ID NO: 1403158 - RNA, 18 nt, Homo sapiens
uuacuaaagucacauaua

SEQ ID NO: 1403159 - RNA, 13 nt, Homo sapiens
uuagacagaugac

SEQ ID NO: 1403160 - RNA, 17 nt, Homo sapiens
uuagagaaugauuucaa

SEQ ID NO: 1403161 - RNA, 17 nt, Homo sapiens
uuagaguugcucuacaa

SEQ ID NO: 1403162 - RNA, 20 nt, Homo sapiens
uuagauauuaggggggaaag

SEQ ID NO: 1403163 - RNA, 15 nt, Homo sapiens
uuagcauuuugcuaa

SEQ ID NO: 1403164 - RNA, 14 nt, Homo sapiens
uuagccuugcugua

SEQ ID NO: 1403165 - RNA, 15 nt, Homo sapiens
uuagcugucugcuca

SEQ ID NO: 1403166 - RNA, 19 nt, Homo sapiens
uuagucuuaauguacacau

SEQ ID NO: 1403167 - RNA, 19 nt, Homo sapiens
uuagugguuacccaguuag

SEQ ID NO: 1403168 - RNA, 17 nt, Homo sapiens
uuauaagaggauagcua

SEQ ID NO: 1403169 - RNA, 15 nt, Homo sapiens
uuauagguuuccacu

SEQ ID NO: 1403170 - RNA, 17 nt, Homo sapiens
uuauagguuuccacugc

SEQ ID NO: 1403171 - RNA, 15 nt, Homo sapiens
uuauauuuacuuuaa

SEQ ID NO: 1403172 - RNA, 14 nt, Homo sapiens
uuaucaccacacca

SEQ ID NO: 1403173 - RNA, 14 nt, Homo sapiens
uuaucagccugugc

SEQ ID NO: 1403174 - RNA, 14 nt, Homo sapiens
uuauccaagaccug

SEQ ID NO: 1403175 - RNA, 22 nt, Homo sapiens
uuauccaagaccugaaagaugg

SEQ ID NO: 1403176 - RNA, 22 nt, Homo sapiens
uuaucccacggaaaaugccaau

SEQ ID NO: 1403177 - RNA, 13 nt, Homo sapiens
uuauuccaacucc

SEQ ID NO: 1403178 - RNA, 11 nt, Homo sapiens
uuauuuccaca

SEQ ID NO: 1403179 - RNA, 17 nt, Homo sapiens
uuauuugucaagcaaau

SEQ ID NO: 1403180 - RNA, 20 nt, Homo sapiens
uucaauauuuguuacuguua

SEQ ID NO: 1403181 - RNA, 20 nt, Homo sapiens
uucaccguauuagccaggau

SEQ ID NO: 1403182 - RNA, 14 nt, Homo sapiens
uucacugcucugcc

SEQ ID NO: 1403183 - RNA, 17 nt, Homo sapiens
uucagaagguugcucua

SEQ ID NO: 1403184 - RNA, 13 nt, Homo sapiens
uucagaguccuca

SEQ ID NO: 1403185 - RNA, 13 nt, Homo sapiens
uucagcagucagu

SEQ ID NO: 1403186 - RNA, 18 nt, Homo sapiens
uucaggcaacgcacaaaa

SEQ ID NO: 1403187 - RNA, 23 nt, Homo sapiens
uucauacugaagaugcagcaaaa

SEQ ID NO: 1403188 - RNA, 21 nt, Homo sapiens
uucauucaggcaacgcacaaa

SEQ ID NO: 1403189 - RNA, 11 nt, Homo sapiens
uuccaaaaaga

SEQ ID NO: 1403190 - RNA, 21 nt, Homo sapiens
uuccacacccucacugcugua

SEQ ID NO: 1403191 - RNA, 13 nt, Homo sapiens
uuccagacugcuu

SEQ ID NO: 1403192 - RNA, 16 nt, Homo sapiens
uuccaguuccacgaaa

SEQ ID NO: 1403193 - RNA, 12 nt, Homo sapiens
uucccaugcauu

SEQ ID NO: 1403194 - RNA, 19 nt, Homo sapiens
uuccccgugggccauggca

SEQ ID NO: 1403195 - RNA, 22 nt, Homo sapiens
uucccuacaguugaaaaacagc

SEQ ID NO: 1403196 - RNA, 21 nt, Homo sapiens
uuccggccuccugucccucau

SEQ ID NO: 1403197 - RNA, 16 nt, Homo sapiens
uucgacguuugacuag

SEQ ID NO: 1403198 - RNA, 22 nt, Homo sapiens
uucuaauuugcauugugucaga

SEQ ID NO: 1403199 - RNA, 14 nt, Homo sapiens
uucuacacauauau

SEQ ID NO: 1403200 - RNA, 22 nt, Homo sapiens
uucucaguaaauauuaaccuga

SEQ ID NO: 1403201 - RNA, 11 nt, Homo sapiens
uucugagauca

SEQ ID NO: 1403202 - RNA, 12 nt, Homo sapiens
uucuucuauggg

SEQ ID NO: 1403203 - RNA, 13 nt, Homo sapiens
uucuucuauucca

SEQ ID NO: 1403204 - RNA, 12 nt, Homo sapiens
uugaaaauguuc

SEQ ID NO: 1403205 - RNA, 21 nt, Homo sapiens
uugaagaaaaagacacagaca

SEQ ID NO: 1403206 - RNA, 21 nt, Homo sapiens
uugaaggagaaaaugcauuau

SEQ ID NO: 1403207 - RNA, 17 nt, Homo sapiens
uugacacggccaugacc

SEQ ID NO: 1403208 - RNA, 18 nt, Homo sapiens
uugagaauacacuaucaa

SEQ ID NO: 1403209 - RNA, 21 nt, Homo sapiens
uugagacccuuuaaaugccug

SEQ ID NO: 1403210 - RNA, 21 nt, Homo sapiens
uugaggacaaccauuccagac

SEQ ID NO: 1403211 - RNA, 20 nt, Homo sapiens
uugaguccagaaguuugaga

SEQ ID NO: 1403212 - RNA, 22 nt, Homo sapiens
uugaugucauucagcagucagu

SEQ ID NO: 1403213 - RNA, 14 nt, Homo sapiens
uugcaccacugcac

SEQ ID NO: 1403214 - RNA, 20 nt, Homo sapiens
uugcaggaccucaggugaga

SEQ ID NO: 1403215 - RNA, 15 nt, Homo sapiens
uugccagagccuuaa

SEQ ID NO: 1403216 - RNA, 18 nt, Homo sapiens
uugccaugucuuguucag

SEQ ID NO: 1403217 - RNA, 21 nt, Homo sapiens
uugcccaggcuggagugcagu

SEQ ID NO: 1403218 - RNA, 16 nt, Homo sapiens
uugccuggaagcacau

SEQ ID NO: 1403219 - RNA, 16 nt, Homo sapiens
uugcgagaauuuucaa

SEQ ID NO: 1403220 - RNA, 19 nt, Homo sapiens
uuggaagaggcugagacau

SEQ ID NO: 1403221 - RNA, 14 nt, Homo sapiens
uuggacaaccucau

SEQ ID NO: 1403222 - RNA, 23 nt, Homo sapiens
uuggcagcucuacucuggagguu

SEQ ID NO: 1403223 - RNA, 21 nt, Homo sapiens
uugggagcaccgccugugaaa

SEQ ID NO: 1403224 - RNA, 14 nt, Homo sapiens
uugggcaugccauu

SEQ ID NO: 1403225 - RNA, 18 nt, Homo sapiens
uuggguacugggugcugu

SEQ ID NO: 1403226 - RNA, 20 nt, Homo sapiens
uuguaacgaagacacagacu

SEQ ID NO: 1403227 - RNA, 14 nt, Homo sapiens
uuguuuaccagaga

SEQ ID NO: 1403228 - RNA, 15 nt, Homo sapiens
uuuaauaucugagaa

SEQ ID NO: 1403229 - RNA, 20 nt, Homo sapiens
uuuaccccucauccaaaguu

SEQ ID NO: 1403230 - RNA, 14 nt, Homo sapiens
uuuagccauaccag

SEQ ID NO: 1403231 - RNA, 12 nt, Homo sapiens
uuuaugguucuc

SEQ ID NO: 1403232 - RNA, 12 nt, Homo sapiens
uuuauuuccaca

SEQ ID NO: 1403233 - RNA, 16 nt, Homo sapiens
uuuauuuuucucauga

SEQ ID NO: 1403234 - RNA, 19 nt, Homo sapiens
uuuccaaagggcaguaaag

SEQ ID NO: 1403235 - RNA, 15 nt, Homo sapiens
uuuccacugccaaaa

SEQ ID NO: 1403236 - RNA, 22 nt, Homo sapiens
uuuccaugcacccucauacaca

SEQ ID NO: 1403237 - RNA, 20 nt, Homo sapiens
uuuccuggacuuaacucuaa

SEQ ID NO: 1403238 - RNA, 12 nt, Homo sapiens
uuuccuuaccau

SEQ ID NO: 1403239 - RNA, 22 nt, Homo sapiens
uuucucuugcucaccaagaagu

SEQ ID NO: 1403240 - RNA, 13 nt, Homo sapiens
uuucuuuccaaaa

SEQ ID NO: 1403241 - RNA, 14 nt, Homo sapiens
uuugacuagccauc

SEQ ID NO: 1403242 - RNA, 19 nt, Homo sapiens
uuugagugucuuugacuug

SEQ ID NO: 1403243 - RNA, 13 nt, Homo sapiens
uuugauauagaua

SEQ ID NO: 1403244 - RNA, 17 nt, Homo sapiens
uuugauccaggugccaa

SEQ ID NO: 1403245 - RNA, 18 nt, Homo sapiens
uuugcaacaagacaaagc

SEQ ID NO: 1403246 - RNA, 19 nt, Homo sapiens
uuugcuaaaugugaaugau

SEQ ID NO: 1403247 - RNA, 14 nt, Homo sapiens
uuuggccauuccaa

SEQ ID NO: 1403248 - RNA, 18 nt, Homo sapiens
uuugggagaguucauuca

SEQ ID NO: 1403249 - RNA, 11 nt, Homo sapiens
uuuggggcuca

SEQ ID NO: 1403250 - RNA, 20 nt, Homo sapiens
uuuggggcucagaguggggu

SEQ ID NO: 1403251 - RNA, 12 nt, Homo sapiens
uuuguacauuau

SEQ ID NO: 1403252 - RNA, 14 nt, Homo sapiens
uuuucuaaucucuu

SEQ ID NO: 1403253 - RNA, 14 nt, Homo sapiens
uuuucucaugauga

SEQ ID NO: 1403254 - RNA, 23 nt, Homo sapiens
uuuucucuccuaagacaccugca

SEQ ID NO: 1403255 - RNA, 12 nt, Homo sapiens
uuuucugauuug

SEQ ID NO: 1403256 - RNA, 14 nt, Homo sapiens
uaauucuagagucu

SEQ ID NO: 1403257 - RNA, 23 nt, Homo sapiens
uaauucuagagucucuguuacug

SEQ ID NO: 1403258 - RNA, 19 nt, Homo sapiens
uaauuuugugaaagaagga

SEQ ID NO: 1403259 - RNA, 14 nt, Homo sapiens
uacaaaacgagaua

SEQ ID NO: 1403260 - RNA, 17 nt, Homo sapiens
uacaaacucccacuugu

SEQ ID NO: 1403261 - RNA, 21 nt, Homo sapiens
uacaagucaucauaauucagc

SEQ ID NO: 1403262 - RNA, 14 nt, Homo sapiens
uacacacacagaug

SEQ ID NO: 1403263 - RNA, 14 nt, Homo sapiens
uacauagagaauaa

SEQ ID NO: 1403264 - RNA, 17 nt, Homo sapiens
uaccaaccugaagacac

SEQ ID NO: 1403265 - RNA, 16 nt, Homo sapiens
uaccaaggaacaggaa

SEQ ID NO: 1403266 - RNA, 17 nt, Homo sapiens
uacccccugugccuugu

SEQ ID NO: 1403267 - RNA, 20 nt, Homo sapiens
uaccuggcccugugccuugg

SEQ ID NO: 1403268 - RNA, 16 nt, Homo sapiens
uaccugggcauacuaa

SEQ ID NO: 1403269 - RNA, 15 nt, Homo sapiens
uacgccagaacugcu

SEQ ID NO: 1403270 - RNA, 18 nt, Homo sapiens
uacuaaagucacauauaa

SEQ ID NO: 1403271 - RNA, 19 nt, Homo sapiens
ggcuggccugcaggcugca

SEQ ID NO: 1403272 - RNA, 16 nt, Homo sapiens
accacaaaacuuuucu

SEQ ID NO: 1403273 - RNA, 16 nt, Homo sapiens
accacaccucccugaa

SEQ ID NO: 1403274 - RNA, 14 nt, Homo sapiens
accacuucagcuga

SEQ ID NO: 1403275 - RNA, 13 nt, Homo sapiens
accagaauugcuu

SEQ ID NO: 1403276 - RNA, 23 nt, Homo sapiens
accagaugggaugggcuuucuca

SEQ ID NO: 1403277 - RNA, 18 nt, Homo sapiens
accagcgugugacuacuc

SEQ ID NO: 1403278 - RNA, 15 nt, Homo sapiens
accaggcagcuccag

SEQ ID NO: 1403279 - RNA, 20 nt, Homo sapiens
accauaaaaauccuucucac

SEQ ID NO: 1403280 - RNA, 17 nt, Homo sapiens
accauauuuuuuguaaa

SEQ ID NO: 1403281 - RNA, 19 nt, Homo sapiens
accaucuggaaggacaucu

SEQ ID NO: 1403282 - RNA, 9 nt, Homo sapiens
accaugcug

SEQ ID NO: 1403283 - RNA, 14 nt, Homo sapiens
acccaccccagugc

SEQ ID NO: 1403284 - RNA, 16 nt, Homo sapiens
acccaguuagcucuca

SEQ ID NO: 1403285 - RNA, 13 nt, Homo sapiens
accccuacaugaa

SEQ ID NO: 1403286 - RNA, 15 nt, Homo sapiens
accccucauccaaag

SEQ ID NO: 1403287 - RNA, 23 nt, Homo sapiens
acccuaauguggcagcugucuca

SEQ ID NO: 1403288 - RNA, 14 nt, Homo sapiens
acccucauacacag

SEQ ID NO: 1403289 - RNA, 17 nt, Homo sapiens
acccuccaaacacuggg

SEQ ID NO: 1403290 - RNA, 14 nt, Homo sapiens
acccucgaugaagc

SEQ ID NO: 1403291 - RNA, 21 nt, Homo sapiens
accguggccccaaauuugcua

SEQ ID NO: 1403292 - RNA, 14 nt, Homo sapiens
accgugggcacuga

SEQ ID NO: 1403293 - RNA, 20 nt, Homo sapiens
accucaggugagaagcagag

SEQ ID NO: 1403294 - RNA, 17 nt, Homo sapiens
accuccuggugguacca

SEQ ID NO: 1403295 - RNA, 23 nt, Homo sapiens
accugagggggcccaucccugcc

SEQ ID NO: 1403296 - RNA, 15 nt, Homo sapiens
accugauuugaugau

SEQ ID NO: 1403297 - RNA, 15 nt, Homo sapiens
accugcacaccuacg

SEQ ID NO: 1403298 - RNA, 16 nt, Homo sapiens
accugccgagagucca

SEQ ID NO: 1403299 - RNA, 15 nt, Homo sapiens
accuuuccugaggaa

SEQ ID NO: 1403300 - RNA, 16 nt, Homo sapiens
acgacgauuucagcua

SEQ ID NO: 1403301 - RNA, 14 nt, Homo sapiens
acgaucucagcuca

SEQ ID NO: 1403302 - RNA, 17 nt, Homo sapiens
acgaucucagcucacca

SEQ ID NO: 1403303 - RNA, 16 nt, Homo sapiens
acgccaaugcacacac

SEQ ID NO: 1403304 - RNA, 18 nt, Homo sapiens
acgccagaacugcuuuau

SEQ ID NO: 1403305 - RNA, 16 nt, Homo sapiens
acgccuguaauccuag

SEQ ID NO: 1403306 - RNA, 20 nt, Homo sapiens
acgcgguuccagauguggau

SEQ ID NO: 1403307 - RNA, 22 nt, Homo sapiens
acggaagaggcugcugagaaag

SEQ ID NO: 1403308 - RNA, 22 nt, Homo sapiens
acguguuuuguuuggacuucac

SEQ ID NO: 1403309 - RNA, 21 nt, Homo sapiens
acguuugacuagccaucucaa

SEQ ID NO: 1403310 - RNA, 17 nt, Homo sapiens
acuaauagagacacaga

SEQ ID NO: 1403311 - RNA, 20 nt, Homo sapiens
acuaccaaaugagcauuagc

SEQ ID NO: 1403312 - RNA, 14 nt, Homo sapiens
acuacuugagaaaa

SEQ ID NO: 1403313 - RNA, 14 nt, Homo sapiens
acuaggcacugugg

SEQ ID NO: 1403314 - RNA, 14 nt, Homo sapiens
acucaaucauuucu

SEQ ID NO: 1403315 - RNA, 21 nt, Homo sapiens
acucacacggacacucaaaag

SEQ ID NO: 1403316 - RNA, 13 nt, Homo sapiens
acucacugccaaa

SEQ ID NO: 1403317 - RNA, 20 nt, Homo sapiens
acucagagaugaacaucuaa

SEQ ID NO: 1403318 - RNA, 16 nt, Homo sapiens
acucagcuaucagcuc

SEQ ID NO: 1403319 - RNA, 14 nt, Homo sapiens
acucaggggucauu

SEQ ID NO: 1403320 - RNA, 16 nt, Homo sapiens
acucaggggucauuca

SEQ ID NO: 1403321 - RNA, 12 nt, Homo sapiens
acuccuucagga

SEQ ID NO: 1403322 - RNA, 15 nt, Homo sapiens
acucgugucuggcac

SEQ ID NO: 1403323 - RNA, 18 nt, Homo sapiens
acucuagggaaaaaccag

SEQ ID NO: 1403324 - RNA, 14 nt, Homo sapiens
acucucaccucgug

SEQ ID NO: 1403325 - RNA, 13 nt, Homo sapiens
acucugcaggcag

SEQ ID NO: 1403326 - RNA, 22 nt, Homo sapiens
acucuuuaagaccucaaaccau

SEQ ID NO: 1403327 - RNA, 23 nt, Homo sapiens
acugaaggcuuucagggccucca

SEQ ID NO: 1403328 - RNA, 12 nt, Homo sapiens
acugaucauuaa

SEQ ID NO: 1403329 - RNA, 20 nt, Homo sapiens
acugcacuccagccugggug

SEQ ID NO: 1403330 - RNA, 15 nt, Homo sapiens
acugccaugccagcu

SEQ ID NO: 1403331 - RNA, 17 nt, Homo sapiens
acugcugggcuuggcag

SEQ ID NO: 1403332 - RNA, 18 nt, Homo sapiens
acuggcaguaaccuagug

SEQ ID NO: 1403333 - RNA, 21 nt, Homo sapiens
acuggcaguaaccuagugaau

SEQ ID NO: 1403334 - RNA, 13 nt, Homo sapiens
acuggcaucuuaa

SEQ ID NO: 1403335 - RNA, 19 nt, Homo sapiens
acugggcaaugauggcaau

SEQ ID NO: 1403336 - RNA, 21 nt, Homo sapiens
acuggucuuguggaauuggga

SEQ ID NO: 1403337 - RNA, 18 nt, Homo sapiens
acugucccaggagcaaau

SEQ ID NO: 1403338 - RNA, 14 nt, Homo sapiens
acuguggcucugca

SEQ ID NO: 1403339 - RNA, 21 nt, Homo sapiens
acugugucccucucucuggaa

SEQ ID NO: 1403340 - RNA, 17 nt, Homo sapiens
acuuaaaagaacaugua

SEQ ID NO: 1403341 - RNA, 20 nt, Homo sapiens
acuuacccuaaaacaugugu

SEQ ID NO: 1403342 - RNA, 16 nt, Homo sapiens
acuuagguguggggga

SEQ ID NO: 1403343 - RNA, 14 nt, Homo sapiens
acuuaucaacauuu

SEQ ID NO: 1403344 - RNA, 20 nt, Homo sapiens
acuuaucaccacaccacugc

SEQ ID NO: 1403345 - RNA, 16 nt, Homo sapiens
acuuauccuguucucu

SEQ ID NO: 1403346 - RNA, 19 nt, Homo sapiens
acuuccuguaagauugcuu

SEQ ID NO: 1403347 - RNA, 15 nt, Homo sapiens
acuugaaaaccucau

SEQ ID NO: 1403348 - RNA, 19 nt, Homo sapiens
acuugagaaaaugcaggag

SEQ ID NO: 1403349 - RNA, 21 nt, Homo sapiens
acuugcaccugguacugcaca

SEQ ID NO: 1403350 - RNA, 21 nt, Homo sapiens
acuuucugaaauaacauggcc

SEQ ID NO: 1403351 - RNA, 14 nt, Homo sapiens
auuccaacagcuca

SEQ ID NO: 1403352 - RNA, 23 nt, Homo sapiens
auuccacacccucacugcuguag

SEQ ID NO: 1403353 - RNA, 15 nt, Homo sapiens
auuccagcaagacca

SEQ ID NO: 1403354 - RNA, 15 nt, Homo sapiens
auuccuugguucugu

SEQ ID NO: 1403355 - RNA, 17 nt, Homo sapiens
auucgcugugucagcau

SEQ ID NO: 1403356 - RNA, 13 nt, Homo sapiens
auucuagagucuc

SEQ ID NO: 1403357 - RNA, 15 nt, Homo sapiens
auucugucacucacc

SEQ ID NO: 1403358 - RNA, 12 nt, Homo sapiens
auugaagccaau

SEQ ID NO: 1403359 - RNA, 22 nt, Homo sapiens
auugaaggagaaaaugcauuau

SEQ ID NO: 1403360 - RNA, 17 nt, Homo sapiens
auugacugucacuguuc

SEQ ID NO: 1403361 - RNA, 12 nt, Homo sapiens
auugauguugcu

SEQ ID NO: 1403362 - RNA, 18 nt, Homo sapiens
auuggaauuuucuuucau

SEQ ID NO: 1403363 - RNA, 19 nt, Homo sapiens
auuguauuucuucaucccu

SEQ ID NO: 1403364 - RNA, 16 nt, Homo sapiens
auuuacugucccagga

SEQ ID NO: 1403365 - RNA, 22 nt, Homo sapiens
auuuaucguauagguugaugaa

SEQ ID NO: 1403366 - RNA, 13 nt, Homo sapiens
auuuaugugaugg

SEQ ID NO: 1403367 - RNA, 19 nt, Homo sapiens
auuugcacccaugccauag

SEQ ID NO: 1403368 - RNA, 20 nt, Homo sapiens
auuuguauaaugguguuacu

SEQ ID NO: 1403369 - RNA, 23 nt, Homo sapiens
auuugucaagcaaauguuuaaaa

SEQ ID NO: 1403370 - RNA, 23 nt, Homo sapiens
auuuguucauuaaacgucauuca

SEQ ID NO: 1403371 - RNA, 20 nt, Homo sapiens
auuuuauaugaugggggaaa

SEQ ID NO: 1403372 - RNA, 18 nt, Homo sapiens
auuuucgacguuugacua

SEQ ID NO: 1403373 - RNA, 23 nt, Homo sapiens
auuuucgacguuugacuagccau

SEQ ID NO: 1403374 - RNA, 19 nt, Homo sapiens
auuuucuggaauacaugaa

SEQ ID NO: 1403375 - RNA, 19 nt, Homo sapiens
auuuucuuucauacauuau

SEQ ID NO: 1403376 - RNA, 19 nt, Homo sapiens
auuuuggcuuaaaaaucau

SEQ ID NO: 1403377 - RNA, 19 nt, Homo sapiens
auuuuuguacauuauguua

SEQ ID NO: 1403378 - RNA, 17 nt, Homo sapiens
caaaaauaaacgaacuc

SEQ ID NO: 1403379 - RNA, 21 nt, Homo sapiens
caaacucucccccaaauguau

SEQ ID NO: 1403380 - RNA, 20 nt, Homo sapiens
caaagaaaacuuccaaaaag

SEQ ID NO: 1403381 - RNA, 17 nt, Homo sapiens
caaagugcugggauuac

SEQ ID NO: 1403382 - RNA, 19 nt, Homo sapiens
caaagugcugggauuacag

SEQ ID NO: 1403383 - RNA, 18 nt, Homo sapiens
caaaguucacuguuuauu

SEQ ID NO: 1403384 - RNA, 17 nt, Homo sapiens
caaauauuauucuuaau

SEQ ID NO: 1403385 - RNA, 13 nt, Homo sapiens
caaaugcuauuca

SEQ ID NO: 1403386 - RNA, 16 nt, Homo sapiens
caaaugcuuuuccuca

SEQ ID NO: 1403387 - RNA, 18 nt, Homo sapiens
caaaugggaaaaccagac

SEQ ID NO: 1403388 - RNA, 23 nt, Homo sapiens
caaaugucuucaugaccuacuuc

SEQ ID NO: 1403389 - RNA, 18 nt, Homo sapiens
caaauuguuuuuacuguc

SEQ ID NO: 1403390 - RNA, 20 nt, Homo sapiens
caacagcuaggaaauaucau

SEQ ID NO: 1403391 - RNA, 19 nt, Homo sapiens
caacccagccugagugcac

SEQ ID NO: 1403392 - RNA, 15 nt, Homo sapiens
caacgaaaagcacau

SEQ ID NO: 1403393 - RNA, 12 nt, Homo sapiens
caacugugcuac

SEQ ID NO: 1403394 - RNA, 13 nt, Homo sapiens
caagaaccucucc

SEQ ID NO: 1403395 - RNA, 16 nt, Homo sapiens
caagaaguaacaaaag

SEQ ID NO: 1403396 - RNA, 15 nt, Homo sapiens
caagacacugagaua

SEQ ID NO: 1403397 - RNA, 23 nt, Homo sapiens
caagagagaaagaaguaggcaug

SEQ ID NO: 1403398 - RNA, 13 nt, Homo sapiens
caagaggggaaaa

SEQ ID NO: 1403399 - RNA, 14 nt, Homo sapiens
caagcaccugcuca

SEQ ID NO: 1403400 - RNA, 16 nt, Homo sapiens
caaggacaaccugccc

SEQ ID NO: 1403401 - RNA, 17 nt, Homo sapiens
caaggccagaugcacau

SEQ ID NO: 1403402 - RNA, 15 nt, Homo sapiens
caaggcugcagugag

SEQ ID NO: 1403403 - RNA, 15 nt, Homo sapiens
caaggggacaucuua

SEQ ID NO: 1403404 - RNA, 14 nt, Homo sapiens
caaggucuuugguu

SEQ ID NO: 1403405 - RNA, 19 nt, Homo sapiens
caaguagcugagauuacag

SEQ ID NO: 1403406 - RNA, 17 nt, Homo sapiens
caauaaauuggaacacc

SEQ ID NO: 1403407 - RNA, 19 nt, Homo sapiens
caauacagaugccuucccu

SEQ ID NO: 1403408 - RNA, 19 nt, Homo sapiens
caauaguggauaacaugua

SEQ ID NO: 1403409 - RNA, 15 nt, Homo sapiens
caaugcccuaccugc

SEQ ID NO: 1403410 - RNA, 14 nt, Homo sapiens
caaugcgcacacac

SEQ ID NO: 1403411 - RNA, 14 nt, Homo sapiens
caauugcugccaau

SEQ ID NO: 1403412 - RNA, 14 nt, Homo sapiens
caauuuaugcugcu

SEQ ID NO: 1403413 - RNA, 23 nt, Homo sapiens
caauuuucuuuuuuauacucaau

SEQ ID NO: 1403414 - RNA, 12 nt, Homo sapiens
cacaaauuguac

SEQ ID NO: 1403415 - RNA, 12 nt, Homo sapiens
cacaauccucca

SEQ ID NO: 1403416 - RNA, 13 nt, Homo sapiens
cacacacaccaau

SEQ ID NO: 1403417 - RNA, 13 nt, Homo sapiens
cacacacaccgau

SEQ ID NO: 1403418 - RNA, 12 nt, Homo sapiens
cacacacaugga

SEQ ID NO: 1403419 - RNA, 17 nt, Homo sapiens
cacacaccgaugugcgc

SEQ ID NO: 1403420 - RNA, 15 nt, Homo sapiens
cacacacggaugcac

SEQ ID NO: 1403421 - RNA, 23 nt, Homo sapiens
cacacacggaugcacacacagau

SEQ ID NO: 1403422 - RNA, 20 nt, Homo sapiens
cacacagauauacacaugga

SEQ ID NO: 1403423 - RNA, 21 nt, Homo sapiens
cacacagauauacacauggau

SEQ ID NO: 1403424 - RNA, 15 nt, Homo sapiens
cacacagaugcacac

SEQ ID NO: 1403425 - RNA, 21 nt, Homo sapiens
cacacagaugcacacacagau

SEQ ID NO: 1403426 - RNA, 17 nt, Homo sapiens
cacacauggaugcacac

SEQ ID NO: 1403427 - RNA, 18 nt, Homo sapiens
cacaccaaugcgcacaca

SEQ ID NO: 1403428 - RNA, 13 nt, Homo sapiens
cacaccauucucc

SEQ ID NO: 1403429 - RNA, 16 nt, Homo sapiens
cacacggaugcacaga

SEQ ID NO: 1403430 - RNA, 21 nt, Homo sapiens
cacacugggcucacauuccca

SEQ ID NO: 1403431 - RNA, 13 nt, Homo sapiens
cgaccccaucuca

SEQ ID NO: 1403432 - RNA, 20 nt, Homo sapiens
cgagauugcaccacugcacu

SEQ ID NO: 1403433 - RNA, 21 nt, Homo sapiens
cgagcccuuagccuugcugua

SEQ ID NO: 1403434 - RNA, 15 nt, Homo sapiens
cgcacacacaccgau

SEQ ID NO: 1403435 - RNA, 19 nt, Homo sapiens
cgcacacacagauaugcac

SEQ ID NO: 1403436 - RNA, 14 nt, Homo sapiens
cggaugcacagaga

SEQ ID NO: 1403437 - RNA, 18 nt, Homo sapiens
cggccuccugucccucau

SEQ ID NO: 1403438 - RNA, 19 nt, Homo sapiens
cggcugggugagcugagau

SEQ ID NO: 1403439 - RNA, 17 nt, Homo sapiens
cgggaacaaaaugaugu

SEQ ID NO: 1403440 - RNA, 13 nt, Homo sapiens
cguauagguugau

SEQ ID NO: 1403441 - RNA, 14 nt, Homo sapiens
cgucagcugggaca

SEQ ID NO: 1403442 - RNA, 17 nt, Homo sapiens
cgucauguguuuugcca

SEQ ID NO: 1403443 - RNA, 13 nt, Homo sapiens
cgugcuaccugca

SEQ ID NO: 1403444 - RNA, 18 nt, Homo sapiens
cguggccccaaauuugcu

SEQ ID NO: 1403445 - RNA, 19 nt, Homo sapiens
cguguucacaccauucucc

SEQ ID NO: 1403446 - RNA, 14 nt, Homo sapiens
cguuugacuagcca

SEQ ID NO: 1403447 - RNA, 15 nt, Homo sapiens
cguuugacuagccau

SEQ ID NO: 1403448 - RNA, 16 nt, Homo sapiens
cguuugacuagccauc

SEQ ID NO: 1403449 - RNA, 20 nt, Homo sapiens
cguuugacuagccaucucaa

SEQ ID NO: 1403450 - RNA, 20 nt, Homo sapiens
cuaaacugcuguuaauugau

SEQ ID NO: 1403451 - RNA, 16 nt, Homo sapiens
cuaaagucacauauaa

SEQ ID NO: 1403452 - RNA, 22 nt, Homo sapiens
cuaaaugugaaugaugauccua

SEQ ID NO: 1403453 - RNA, 19 nt, Homo sapiens
cuaauagagacacagagau

SEQ ID NO: 1403454 - RNA, 21 nt, Homo sapiens
cuaauuuauccugaaauuuca

SEQ ID NO: 1403455 - RNA, 11 nt, Homo sapiens
cuacacauaua

SEQ ID NO: 1403456 - RNA, 18 nt, Homo sapiens
cuacaugaucuggagcaa

SEQ ID NO: 1403457 - RNA, 16 nt, Homo sapiens
cuaccaaccucugaag

SEQ ID NO: 1403458 - RNA, 14 nt, Homo sapiens
cuaccacucaggaa

SEQ ID NO: 1403459 - RNA, 21 nt, Homo sapiens
cuacccccugugccuugucac

SEQ ID NO: 1403460 - RNA, 14 nt, Homo sapiens
cuacuugggagcac

SEQ ID NO: 1403461 - RNA, 19 nt, Homo sapiens
aaccgcuugccauauuccg

SEQ ID NO: 1403462 - RNA, 14 nt, Homo sapiens
aaccggcuuugugg

SEQ ID NO: 1403463 - RNA, 12 nt, Homo sapiens
aaccuagugaau

SEQ ID NO: 1403464 - RNA, 14 nt, Homo sapiens
aaccucauuuacca

SEQ ID NO: 1403465 - RNA, 20 nt, Homo sapiens
aaccuggguaacuagggaag

SEQ ID NO: 1403466 - RNA, 16 nt, Homo sapiens
aacgcguaucuaggcu

SEQ ID NO: 1403467 - RNA, 22 nt, Homo sapiens
aacgucauguguuuugccaaag

SEQ ID NO: 1403468 - RNA, 17 nt, Homo sapiens
aacuacagaaguggaag

SEQ ID NO: 1403469 - RNA, 16 nt, Homo sapiens
aacuaggagucuucac

SEQ ID NO: 1403470 - RNA, 19 nt, Homo sapiens
aacuagggaagauaauauu

SEQ ID NO: 1403471 - RNA, 13 nt, Homo sapiens
aacuccuguucuu

SEQ ID NO: 1403472 - RNA, 21 nt, Homo sapiens
aacucuuggccagagcugagu

SEQ ID NO: 1403473 - RNA, 23 nt, Homo sapiens
aacucuuggccagagcugagugg

SEQ ID NO: 1403474 - RNA, 18 nt, Homo sapiens
aacugucuugugagcuga

SEQ ID NO: 1403475 - RNA, 14 nt, Homo sapiens
aacuguuacugucc

SEQ ID NO: 1403476 - RNA, 12 nt, Homo sapiens
aacuguucucuu

SEQ ID NO: 1403477 - RNA, 17 nt, Homo sapiens
aagaaaaaaaaucucuu

SEQ ID NO: 1403478 - RNA, 16 nt, Homo sapiens
aagaaacuguuacugu

SEQ ID NO: 1403479 - RNA, 18 nt, Homo sapiens
aagaacugccccaucucc

SEQ ID NO: 1403480 - RNA, 19 nt, Homo sapiens
aagaacugccccaucuccu

SEQ ID NO: 1403481 - RNA, 17 nt, Homo sapiens
aagacaaagcaaagcca

SEQ ID NO: 1403482 - RNA, 17 nt, Homo sapiens
aagacaccguucauuca

SEQ ID NO: 1403483 - RNA, 23 nt, Homo sapiens
aagaccuggagcggcuauuccag

SEQ ID NO: 1403484 - RNA, 15 nt, Homo sapiens
aagacuuugauccag

SEQ ID NO: 1403485 - RNA, 16 nt, Homo sapiens
aagagaaccauaucaa

SEQ ID NO: 1403486 - RNA, 17 nt, Homo sapiens
aagagaggccccggcug

SEQ ID NO: 1403487 - RNA, 21 nt, Homo sapiens
aagagcuggaugcacaucagg

SEQ ID NO: 1403488 - RNA, 17 nt, Homo sapiens
aagauacugcugaugcu

SEQ ID NO: 1403489 - RNA, 19 nt, Homo sapiens
aagaugcagcaaaauguga

SEQ ID NO: 1403490 - RNA, 17 nt, Homo sapiens
uagccaucucaagcaag

SEQ ID NO: 1403491 - RNA, 15 nt, Homo sapiens
uagccuuugucccag

SEQ ID NO: 1403492 - RNA, 14 nt, Homo sapiens
uaggauuacaggca

SEQ ID NO: 1403493 - RNA, 20 nt, Homo sapiens
uaggccagcaccaucucuuu

SEQ ID NO: 1403494 - RNA, 20 nt, Homo sapiens
uaguaguuaauucugucacu

SEQ ID NO: 1403495 - RNA, 23 nt, Homo sapiens
uaguaguuaauucugucacucac

SEQ ID NO: 1403496 - RNA, 13 nt, Homo sapiens
uauaaacuccuua

SEQ ID NO: 1403497 - RNA, 13 nt, Homo sapiens
uauacacauggau

SEQ ID NO: 1403498 - RNA, 15 nt, Homo sapiens
uauacacauggaugc

SEQ ID NO: 1403499 - RNA, 19 nt, Homo sapiens
uauagagaauaaggcacaa

SEQ ID NO: 1403500 - RNA, 14 nt, Homo sapiens
uauagauaacagau

SEQ ID NO: 1403501 - RNA, 17 nt, Homo sapiens
uauauaguuugugguaa

SEQ ID NO: 1403502 - RNA, 19 nt, Homo sapiens
uauauauucuacacauaua

SEQ ID NO: 1403503 - RNA, 19 nt, Homo sapiens
uaucagccugugccacgau

SEQ ID NO: 1403504 - RNA, 22 nt, Homo sapiens
uaucagugaugaaaauuugccu

SEQ ID NO: 1403505 - RNA, 13 nt, Homo sapiens
uauccauccaugg

SEQ ID NO: 1403506 - RNA, 13 nt, Homo sapiens
uaucccacggaaa

SEQ ID NO: 1403507 - RNA, 14 nt, Homo sapiens
uaugaacuugagga

SEQ ID NO: 1403508 - RNA, 21 nt, Homo sapiens
uaugagucggauacccuggag

SEQ ID NO: 1403509 - RNA, 18 nt, Homo sapiens
uaugcacacacagaugca

SEQ ID NO: 1403510 - RNA, 19 nt, Homo sapiens
uaugcaggacaugugcucu

SEQ ID NO: 1403511 - RNA, 18 nt, Homo sapiens
uauggguuggacaaccuc

SEQ ID NO: 1403512 - RNA, 20 nt, Homo sapiens
uauggguuggacaaccucau

SEQ ID NO: 1403513 - RNA, 22 nt, Homo sapiens
uaugguaggaacugcugggcuu

SEQ ID NO: 1403514 - RNA, 16 nt, Homo sapiens
uauguaaguacuucca

SEQ ID NO: 1403515 - RNA, 22 nt, Homo sapiens
uauguggaagugugggucugug

SEQ ID NO: 1403516 - RNA, 17 nt, Homo sapiens
uauguuaggaauacucu

SEQ ID NO: 1403517 - RNA, 20 nt, Homo sapiens
uauuaaggaagacaauguga

SEQ ID NO: 1403518 - RNA, 22 nt, Homo sapiens
uauuacuuauuuuugacagugu

SEQ ID NO: 1403519 - RNA, 18 nt, Homo sapiens
uauuagcaacugugcuac

SEQ ID NO: 1403520 - RNA, 17 nt, Homo sapiens
uauucaauaaagcugcu

SEQ ID NO: 1403521 - RNA, 21 nt, Homo sapiens
uauucagauaaggcagaacua

SEQ ID NO: 1403522 - RNA, 23 nt, Homo sapiens
uauuccgggugccauucccacua

SEQ ID NO: 1403523 - RNA, 14 nt, Homo sapiens
uauuggcagcucua

SEQ ID NO: 1403524 - RNA, 16 nt, Homo sapiens
uauuuaccagaccaca

SEQ ID NO: 1403525 - RNA, 17 nt, Homo sapiens
uauuuaccagaccacaa

SEQ ID NO: 1403526 - RNA, 17 nt, Homo sapiens
uauuucaaccgcuugcc

SEQ ID NO: 1403527 - RNA, 19 nt, Homo sapiens
uauuuuaagagaaaacugc

SEQ ID NO: 1403528 - RNA, 14 nt, Homo sapiens
uauuuuucucauga

SEQ ID NO: 1403529 - RNA, 16 nt, Homo sapiens
ucaaaagguagauccu

SEQ ID NO: 1403530 - RNA, 16 nt, Homo sapiens
ucaaaauguccagcuu

SEQ ID NO: 1403531 - RNA, 20 nt, Homo sapiens
ucaaaauguccagcuucucu

SEQ ID NO: 1403532 - RNA, 22 nt, Homo sapiens
ucaaagggagagagugcuauug

SEQ ID NO: 1403533 - RNA, 15 nt, Homo sapiens
ucaacauaugugauu

SEQ ID NO: 1403534 - RNA, 17 nt, Homo sapiens
ucaaccgcuugccauau

SEQ ID NO: 1403535 - RNA, 21 nt, Homo sapiens
ucaacuggggaauugaagcca

SEQ ID NO: 1403536 - RNA, 16 nt, Homo sapiens
ucaagcaaauguuuaa

SEQ ID NO: 1403537 - RNA, 17 nt, Homo sapiens
ucaauaaauuucugcuu

SEQ ID NO: 1403538 - RNA, 15 nt, Homo sapiens
ucaauuuccugaugc

SEQ ID NO: 1403539 - RNA, 16 nt, Homo sapiens
ucacaaaccaugcaaa

SEQ ID NO: 1403540 - RNA, 14 nt, Homo sapiens
ucacagccucugaa

SEQ ID NO: 1403541 - RNA, 14 nt, Homo sapiens
ucacauauaaaagu

SEQ ID NO: 1403542 - RNA, 13 nt, Homo sapiens
ucacaucucugcc

SEQ ID NO: 1403543 - RNA, 17 nt, Homo sapiens
ucaccucguuacucuca

SEQ ID NO: 1403544 - RNA, 23 nt, Homo sapiens
ucacgugucuuuagaacuccagu

SEQ ID NO: 1403545 - RNA, 19 nt, Homo sapiens
ucacuaggaugcagaugga

SEQ ID NO: 1403546 - RNA, 22 nt, Homo sapiens
ucacugacucaagacacugaga

SEQ ID NO: 1403547 - RNA, 15 nt, Homo sapiens
ucagaaguacauuaa

SEQ ID NO: 1403548 - RNA, 14 nt, Homo sapiens
ucagagcagcacug

SEQ ID NO: 1403549 - RNA, 19 nt, Homo sapiens
ucagaguccucauuauaaa

SEQ ID NO: 1403550 - RNA, 12 nt, Homo sapiens
ucagauuugccu

SEQ ID NO: 1403551 - RNA, 19 nt, Homo sapiens
ucagcaauacagacuacuu

SEQ ID NO: 1403552 - RNA, 14 nt, Homo sapiens
ucagcagugaugcu

SEQ ID NO: 1403553 - RNA, 21 nt, Homo sapiens
ucagcauuuagucuugccagg

SEQ ID NO: 1403554 - RNA, 23 nt, Homo sapiens
ucagcccugcccuucagcauccu

SEQ ID NO: 1403555 - RNA, 19 nt, Homo sapiens
ucagcucuugagagcauuc

SEQ ID NO: 1403556 - RNA, 18 nt, Homo sapiens
ucaggccauugucccuga

SEQ ID NO: 1403557 - RNA, 23 nt, Homo sapiens
ucaggcuggguugucacugagac

SEQ ID NO: 1403558 - RNA, 20 nt, Homo sapiens
ucaguaaauauuaaccugaa

SEQ ID NO: 1403559 - RNA, 20 nt, Homo sapiens
ucagugaugaaaauuugccu

SEQ ID NO: 1403560 - RNA, 15 nt, Homo sapiens
ucagugucagcacuc

SEQ ID NO: 1403561 - RNA, 14 nt, Homo sapiens
ucaucccuugcuua

SEQ ID NO: 1403562 - RNA, 15 nt, Homo sapiens
ucauggccaccucca

SEQ ID NO: 1403563 - RNA, 16 nt, Homo sapiens
ucaugugacucuuucc

SEQ ID NO: 1403564 - RNA, 11 nt, Homo sapiens
ucauuaccuca

SEQ ID NO: 1403565 - RNA, 17 nt, Homo sapiens
ucauuagcauuuugcua

SEQ ID NO: 1403566 - RNA, 14 nt, Homo sapiens
ucauuauaaaaugg

SEQ ID NO: 1403567 - RNA, 16 nt, Homo sapiens
ucauucagcagucagu

SEQ ID NO: 1403568 - RNA, 14 nt, Homo sapiens
uccaaaaucaggcu

SEQ ID NO: 1403569 - RNA, 15 nt, Homo sapiens
acucuguuccuggcu

SEQ ID NO: 1403570 - RNA, 17 nt, Homo sapiens
acucuuaaguugaucua

SEQ ID NO: 1403571 - RNA, 17 nt, Homo sapiens
acucuuagaagugacau

SEQ ID NO: 1403572 - RNA, 13 nt, Homo sapiens
acucuuugcuaca

SEQ ID NO: 1403573 - RNA, 17 nt, Homo sapiens
acugaaccacucuccca

SEQ ID NO: 1403574 - RNA, 18 nt, Homo sapiens
acugaagaugcagcaaaa

SEQ ID NO: 1403575 - RNA, 13 nt, Homo sapiens
acugaucauuaaa

SEQ ID NO: 1403576 - RNA, 11 nt, Homo sapiens
acugcucugcc

SEQ ID NO: 1403577 - RNA, 22 nt, Homo sapiens
acugcucugcccccaacucccg

SEQ ID NO: 1403578 - RNA, 20 nt, Homo sapiens
acugcuguagacauuugcua

SEQ ID NO: 1403579 - RNA, 12 nt, Homo sapiens
acugucacuguu

SEQ ID NO: 1403580 - RNA, 14 nt, Homo sapiens
acugucauagaaau

SEQ ID NO: 1403581 - RNA, 19 nt, Homo sapiens
acuguccuguuuucuaauc

SEQ ID NO: 1403582 - RNA, 14 nt, Homo sapiens
acuuaaacuuccac

SEQ ID NO: 1403583 - RNA, 21 nt, Homo sapiens
acuuagaauuaguggcacuug

SEQ ID NO: 1403584 - RNA, 16 nt, Homo sapiens
acuucacuaccaaaug

SEQ ID NO: 1403585 - RNA, 13 nt, Homo sapiens
acuuccacaagag

SEQ ID NO: 1403586 - RNA, 19 nt, Homo sapiens
acuuccacaagagugaauu

SEQ ID NO: 1403587 - RNA, 16 nt, Homo sapiens
acuucccacggcuccu

SEQ ID NO: 1403588 - RNA, 14 nt, Homo sapiens
acuuccucagucug

SEQ ID NO: 1403589 - RNA, 14 nt, Homo sapiens
acuucuaccaggac

SEQ ID NO: 1403590 - RNA, 13 nt, Homo sapiens
acuucugcucugg

SEQ ID NO: 1403591 - RNA, 16 nt, Homo sapiens
acuucuggugugauac

SEQ ID NO: 1403592 - RNA, 12 nt, Homo sapiens
acuugagacaaa

SEQ ID NO: 1403593 - RNA, 23 nt, Homo sapiens
acuugaggacacauguccagugg

SEQ ID NO: 1403594 - RNA, 19 nt, Homo sapiens
acuugucccgggacaccua

SEQ ID NO: 1403595 - RNA, 13 nt, Homo sapiens
acuuugccauuaa

SEQ ID NO: 1403596 - RNA, 20 nt, Homo sapiens
agaaaaauaagcucgaguga

SEQ ID NO: 1403597 - RNA, 14 nt, Homo sapiens
agaaaacaugacuu

SEQ ID NO: 1403598 - RNA, 12 nt, Homo sapiens
agaaaaugcauu

SEQ ID NO: 1403599 - RNA, 16 nt, Homo sapiens
agaaacaaacaucuaa

SEQ ID NO: 1403600 - RNA, 17 nt, Homo sapiens
agaacaguccauugaaa

SEQ ID NO: 1403601 - RNA, 22 nt, Homo sapiens
agaacauuccucugcagcacuu

SEQ ID NO: 1403602 - RNA, 15 nt, Homo sapiens
agaagacacagggga

SEQ ID NO: 1403603 - RNA, 17 nt, Homo sapiens
agaagcaucaccaugca

SEQ ID NO: 1403604 - RNA, 19 nt, Homo sapiens
agaagcaucaccaugcaug

SEQ ID NO: 1403605 - RNA, 20 nt, Homo sapiens
agaagcccagguuacaaaga

SEQ ID NO: 1403606 - RNA, 13 nt, Homo sapiens
agaaguaggcaug

SEQ ID NO: 1403607 - RNA, 14 nt, Homo sapiens
agaauacacuauca

SEQ ID NO: 1403608 - RNA, 16 nt, Homo sapiens
agaaucacuggaaccu

SEQ ID NO: 1403609 - RNA, 19 nt, Homo sapiens
agaauuaguggcacuugcu

SEQ ID NO: 1403610 - RNA, 21 nt, Homo sapiens
agaauuauaauuaguuccuca

SEQ ID NO: 1403611 - RNA, 14 nt, Homo sapiens
agacaaagcaaagc

SEQ ID NO: 1403612 - RNA, 23 nt, Homo sapiens
agacacucccacuuggcaucauu

SEQ ID NO: 1403613 - RNA, 10 nt, Homo sapiens
agacagagac

SEQ ID NO: 1403614 - RNA, 16 nt, Homo sapiens
agacagauacuccucc

SEQ ID NO: 1403615 - RNA, 19 nt, Homo sapiens
agacauuugcuaugagcug

SEQ ID NO: 1403616 - RNA, 18 nt, Homo sapiens
agaccaccucucaauauu

SEQ ID NO: 1403617 - RNA, 21 nt, Homo sapiens
agaccuggagcggcuauucca

SEQ ID NO: 1403618 - RNA, 18 nt, Homo sapiens
agacuccgucucaaaaga

SEQ ID NO: 1403619 - RNA, 13 nt, Homo sapiens
agacucugucuca

SEQ ID NO: 1403620 - RNA, 17 nt, Homo sapiens
agacuucagcuguuccu

SEQ ID NO: 1403621 - RNA, 21 nt, Homo sapiens
agacuuccuguaagauugcuu

SEQ ID NO: 1403622 - RNA, 18 nt, Homo sapiens
agagaaagaaguaggcau

SEQ ID NO: 1403623 - RNA, 19 nt, Homo sapiens
agagauaugcacacacaga

SEQ ID NO: 1403624 - RNA, 16 nt, Homo sapiens
agagauucuugugccu

SEQ ID NO: 1403625 - RNA, 14 nt, Homo sapiens
agagccacuaccuu

SEQ ID NO: 1403626 - RNA, 20 nt, Homo sapiens
agagcuccugucccuaccca

SEQ ID NO: 1403627 - RNA, 13 nt, Homo sapiens
agagcuggaugca

SEQ ID NO: 1403628 - RNA, 16 nt, Homo sapiens
agaggauagcuauauu

SEQ ID NO: 1403629 - RNA, 18 nt, Homo sapiens
agagggggcgaagggauc

SEQ ID NO: 1403630 - RNA, 21 nt, Homo sapiens
agagguggagugucacaucuc

SEQ ID NO: 1403631 - RNA, 15 nt, Homo sapiens
agagugaauuugacc

SEQ ID NO: 1403632 - RNA, 15 nt, Homo sapiens
agauaugcacacacc

SEQ ID NO: 1403633 - RNA, 17 nt, Homo sapiens
agauauuaggggggaaa

SEQ ID NO: 1403634 - RNA, 14 nt, Homo sapiens
agaucaaauggaaa

SEQ ID NO: 1403635 - RNA, 18 nt, Homo sapiens
agaucaugaaaguccagc

SEQ ID NO: 1403636 - RNA, 12 nt, Homo sapiens
agaugcacacac

SEQ ID NO: 1403637 - RNA, 14 nt, Homo sapiens
agaugggauuucac

SEQ ID NO: 1403638 - RNA, 13 nt, Homo sapiens
agauuugccuuau

SEQ ID NO: 1403639 - RNA, 19 nt, Homo sapiens
agcaagaugugaaagaaga

SEQ ID NO: 1403640 - RNA, 18 nt, Homo sapiens
agcaaggacaaccugccc

SEQ ID NO: 1403641 - RNA, 20 nt, Homo sapiens
agcaauugacugucacuguu

SEQ ID NO: 1403642 - RNA, 15 nt, Homo sapiens
agcaccaggacucag

SEQ ID NO: 1403643 - RNA, 16 nt, Homo sapiens
agcaccauaacuuugu

SEQ ID NO: 1403644 - RNA, 17 nt, Homo sapiens
agcacguguggccuguu

SEQ ID NO: 1403645 - RNA, 19 nt, Homo sapiens
agcacuauguggagcucag

SEQ ID NO: 1403646 - RNA, 13 nt, Homo sapiens
agcacucagguag

SEQ ID NO: 1403647 - RNA, 22 nt, Homo sapiens
agcagaccuaccugcaguggga

SEQ ID NO: 1403648 - RNA, 20 nt, Homo sapiens
agcaugggacugugccuuug

SEQ ID NO: 1403649 - RNA, 11 nt, Homo sapiens
agccauaccag

SEQ ID NO: 1403650 - RNA, 15 nt, Homo sapiens
agccaucucaagcaa

SEQ ID NO: 1403651 - RNA, 18 nt, Homo sapiens
agccaucucaagcaaguu

SEQ ID NO: 1403652 - RNA, 15 nt, Homo sapiens
agcccucucacugug

SEQ ID NO: 1403653 - RNA, 13 nt, Homo sapiens
agcccugcugcuu

SEQ ID NO: 1403654 - RNA, 21 nt, Homo sapiens
agccugggcgacagagcaaga

SEQ ID NO: 1403655 - RNA, 17 nt, Homo sapiens
agccuuggcucuacccu

SEQ ID NO: 1403656 - RNA, 16 nt, Homo sapiens
agcgugugacuacucc

SEQ ID NO: 1403657 - RNA, 19 nt, Homo sapiens
agcucaagucuucccugau

SEQ ID NO: 1403658 - RNA, 20 nt, Homo sapiens
agcuccgccccuugaacaug

SEQ ID NO: 1403659 - RNA, 15 nt, Homo sapiens
agcucugaacaaaag

SEQ ID NO: 1403660 - RNA, 19 nt, Homo sapiens
agcuggcagccuccagugg

SEQ ID NO: 1403661 - RNA, 21 nt, Homo sapiens
agcuggcagccuccaguggga

SEQ ID NO: 1403662 - RNA, 19 nt, Homo sapiens
agcuggggaugucucucau

SEQ ID NO: 1403663 - RNA, 22 nt, Homo sapiens
agcugucucaaaccuccaaaag

SEQ ID NO: 1403664 - RNA, 12 nt, Homo sapiens
agcuuaucucag

SEQ ID NO: 1403665 - RNA, 16 nt, Homo sapiens
agcuuugcugccugag

SEQ ID NO: 1403666 - RNA, 14 nt, Homo sapiens
aggaaaaccaugac

SEQ ID NO: 1403667 - RNA, 20 nt, Homo sapiens
aggaaaaucuuaaaauucuu

SEQ ID NO: 1403668 - RNA, 16 nt, Homo sapiens
aggaauucuaggcauc

SEQ ID NO: 1403669 - RNA, 15 nt, Homo sapiens
aggacucugcuucag

SEQ ID NO: 1403670 - RNA, 19 nt, Homo sapiens
aggacuugugucucugugc

SEQ ID NO: 1403671 - RNA, 18 nt, Homo sapiens
aggagccagccaggacuc

SEQ ID NO: 1403672 - RNA, 17 nt, Homo sapiens
aggagccggugcucugg

SEQ ID NO: 1403673 - RNA, 18 nt, Homo sapiens
aggaguuugagaccaacc

SEQ ID NO: 1403674 - RNA, 18 nt, Homo sapiens
aggcacuguggcucugca

SEQ ID NO: 1403675 - RNA, 20 nt, Homo sapiens
aggcaggagaaucacuggaa

SEQ ID NO: 1403676 - RNA, 15 nt, Homo sapiens
aggccauugucccug

SEQ ID NO: 1403677 - RNA, 19 nt, Homo sapiens
aggcccuuauuuucaagaa

SEQ ID NO: 1403678 - RNA, 18 nt, Homo sapiens
ugcugagccuccuugucu

SEQ ID NO: 1403679 - RNA, 19 nt, Homo sapiens
ugcugcuugaggcaacuca

SEQ ID NO: 1403680 - RNA, 21 nt, Homo sapiens
ugcuggccacagaaaggccac

SEQ ID NO: 1403681 - RNA, 15 nt, Homo sapiens
ugcugggcuuggcag

SEQ ID NO: 1403682 - RNA, 23 nt, Homo sapiens
ugcuuagcuugagggugacuaug

SEQ ID NO: 1403683 - RNA, 21 nt, Homo sapiens
ugcuucaugaaaauccuacca

SEQ ID NO: 1403684 - RNA, 22 nt, Homo sapiens
ugcuucuaguucugccaggaga

SEQ ID NO: 1403685 - RNA, 16 nt, Homo sapiens
ugcuugagcucaggag

SEQ ID NO: 1403686 - RNA, 14 nt, Homo sapiens
ugcuuuuaaaugca

SEQ ID NO: 1403687 - RNA, 19 nt, Homo sapiens
uggaaaauguuaugugcuc

SEQ ID NO: 1403688 - RNA, 19 nt, Homo sapiens
uggaagaggcugagacauu

SEQ ID NO: 1403689 - RNA, 15 nt, Homo sapiens
uggacugucauagaa

SEQ ID NO: 1403690 - RNA, 17 nt, Homo sapiens
uggacuuaacucuaauu

SEQ ID NO: 1403691 - RNA, 12 nt, Homo sapiens
uggacuuguccc

SEQ ID NO: 1403692 - RNA, 24 nt, Homo sapiens
uggagcugagcagguguucuucau

SEQ ID NO: 1403693 - RNA, 21 nt, Homo sapiens
uggagguuuguuuagaagaag

SEQ ID NO: 1403694 - RNA, 19 nt, Homo sapiens
uggaguccucgacuuauca

SEQ ID NO: 1403695 - RNA, 16 nt, Homo sapiens
uggagugucacaucuc

SEQ ID NO: 1403696 - RNA, 17 nt, Homo sapiens
uggaguucucuguucua

SEQ ID NO: 1403697 - RNA, 11 nt, Homo sapiens
uggaugcacac

SEQ ID NO: 1403698 - RNA, 12 nt, Homo sapiens
uggcaccagcag

SEQ ID NO: 1403699 - RNA, 11 nt, Homo sapiens
uggcaucuccc

SEQ ID NO: 1403700 - RNA, 17 nt, Homo sapiens
uggccacacugggcuca

SEQ ID NO: 1403701 - RNA, 18 nt, Homo sapiens
uggccauuccaacagcuc

SEQ ID NO: 1403702 - RNA, 13 nt, Homo sapiens
uggcccacgcacu

SEQ ID NO: 1403703 - RNA, 21 nt, Homo sapiens
uggcccuuggcuuuagccaua

SEQ ID NO: 1403704 - RNA, 22 nt, Homo sapiens
uggccuguucuucuauggguug

SEQ ID NO: 1403705 - RNA, 14 nt, Homo sapiens
uggcuaacuggcga

SEQ ID NO: 1403706 - RNA, 16 nt, Homo sapiens
uggcugaggauuucaa

SEQ ID NO: 1403707 - RNA, 12 nt, Homo sapiens
uggcugccuugu

SEQ ID NO: 1403708 - RNA, 15 nt, Homo sapiens
ugggaaaaccagacu

SEQ ID NO: 1403709 - RNA, 14 nt, Homo sapiens
ugggcaaugugaua

SEQ ID NO: 1403710 - RNA, 18 nt, Homo sapiens
ugggcaggguacagacac

SEQ ID NO: 1403711 - RNA, 16 nt, Homo sapiens
ugggcgaagcuaaaag

SEQ ID NO: 1403712 - RNA, 14 nt, Homo sapiens
ugggcgugcuaccu

SEQ ID NO: 1403713 - RNA, 17 nt, Homo sapiens
ugggcucacauucccaa

SEQ ID NO: 1403714 - RNA, 19 nt, Homo sapiens
uggggagggagguguuuaa

SEQ ID NO: 1403715 - RNA, 16 nt, Homo sapiens
uggggauaugauuuaa

SEQ ID NO: 1403716 - RNA, 17 nt, Homo sapiens
uggggccgaaagaacag

SEQ ID NO: 1403717 - RNA, 15 nt, Homo sapiens
uggggcugauuguau

SEQ ID NO: 1403718 - RNA, 15 nt, Homo sapiens
uggggcuggccugca

SEQ ID NO: 1403719 - RNA, 22 nt, Homo sapiens
uggggucugugaucacccucuc

SEQ ID NO: 1403720 - RNA, 14 nt, Homo sapiens
ugggucaguuguau

SEQ ID NO: 1403721 - RNA, 23 nt, Homo sapiens
uggguugcaggaccucaggugag

SEQ ID NO: 1403722 - RNA, 16 nt, Homo sapiens
ugguaauuaugugaua

SEQ ID NO: 1403723 - RNA, 20 nt, Homo sapiens
ugguaugaacuugaggacac

SEQ ID NO: 1403724 - RNA, 21 nt, Homo sapiens
uggucccaaguaguagugucu

SEQ ID NO: 1403725 - RNA, 18 nt, Homo sapiens
uggugcagccuacacuau

SEQ ID NO: 1403726 - RNA, 15 nt, Homo sapiens
uggugcgaucuuggc

SEQ ID NO: 1403727 - RNA, 16 nt, Homo sapiens
ugguguugacauacau

SEQ ID NO: 1403728 - RNA, 15 nt, Homo sapiens
ugguugagguuucaa

SEQ ID NO: 1403729 - RNA, 14 nt, Homo sapiens
uguaaguacuucca

SEQ ID NO: 1403730 - RNA, 15 nt, Homo sapiens
uguaaguacuuccac

SEQ ID NO: 1403731 - RNA, 18 nt, Homo sapiens
uguaauuuaaaauuguga

SEQ ID NO: 1403732 - RNA, 15 nt, Homo sapiens
uguagaaugauuuca

SEQ ID NO: 1403733 - RNA, 10 nt, Homo sapiens
uguagagugg

SEQ ID NO: 1403734 - RNA, 17 nt, Homo sapiens
uguaucacucacugcca

SEQ ID NO: 1403735 - RNA, 20 nt, Homo sapiens
uguaucacucacugccaaaa

SEQ ID NO: 1403736 - RNA, 19 nt, Homo sapiens
uguauccauccauggggcu

SEQ ID NO: 1403737 - RNA, 20 nt, Homo sapiens
uguauuuaccuucuaccucu

SEQ ID NO: 1403738 - RNA, 16 nt, Homo sapiens
uguauuucaagaccuc

SEQ ID NO: 1403739 - RNA, 19 nt, Homo sapiens
ugucacgccagacuuccca

SEQ ID NO: 1403740 - RNA, 19 nt, Homo sapiens
ugucacucaccacuacauc

SEQ ID NO: 1403741 - RNA, 18 nt, Homo sapiens
ugucacuguuccuuguca

SEQ ID NO: 1403742 - RNA, 15 nt, Homo sapiens
ugucaugucagcucc

SEQ ID NO: 1403743 - RNA, 15 nt, Homo sapiens
ugucccagaaaagca

SEQ ID NO: 1403744 - RNA, 19 nt, Homo sapiens
uguccggucccugucccag

SEQ ID NO: 1403745 - RNA, 23 nt, Homo sapiens
ugucguuucccucccaacagagc

SEQ ID NO: 1403746 - RNA, 15 nt, Homo sapiens
ugucucucaugacca

SEQ ID NO: 1403747 - RNA, 17 nt, Homo sapiens
uguggaugauaaaacac

SEQ ID NO: 1403748 - RNA, 14 nt, Homo sapiens
uguggcagcugucu

SEQ ID NO: 1403749 - RNA, 19 nt, Homo sapiens
uguuccuugucacugguag

SEQ ID NO: 1403750 - RNA, 21 nt, Homo sapiens
uguucuuagcugaacaaugaa

SEQ ID NO: 1403751 - RNA, 10 nt, Homo sapiens
uguugccagc

SEQ ID NO: 1403752 - RNA, 18 nt, Homo sapiens
uguuugcuggggccgaaa

SEQ ID NO: 1403753 - RNA, 21 nt, Homo sapiens
uuaaaaucuggcaaaguuaua

SEQ ID NO: 1403754 - RNA, 20 nt, Homo sapiens
uuaaauauauaauguugcca

SEQ ID NO: 1403755 - RNA, 13 nt, Homo sapiens
uuaagggggaaaa

SEQ ID NO: 1403756 - RNA, 12 nt, Homo sapiens
uuaaucaaugau

SEQ ID NO: 1403757 - RNA, 20 nt, Homo sapiens
uuaaucaaugaucaucucac

SEQ ID NO: 1403758 - RNA, 18 nt, Homo sapiens
uuaaucugagaggccaca

SEQ ID NO: 1403759 - RNA, 16 nt, Homo sapiens
uuaccagagaaaaagg

SEQ ID NO: 1403760 - RNA, 13 nt, Homo sapiens
uuagaaaaaccac

SEQ ID NO: 1403761 - RNA, 15 nt, Homo sapiens
uuagcccaaaaccaa

SEQ ID NO: 1403762 - RNA, 14 nt, Homo sapiens
uuauagguuuccac

SEQ ID NO: 1403763 - RNA, 23 nt, Homo sapiens
uuauauuuguaaauuuaugugau

SEQ ID NO: 1403764 - RNA, 13 nt, Homo sapiens
uuaucucaggggu

SEQ ID NO: 1403765 - RNA, 23 nt, Homo sapiens
uuaugccaccugaauaaagaaug

SEQ ID NO: 1403766 - RNA, 18 nt, Homo sapiens
uucaaacugcaugauuca

SEQ ID NO: 1403767 - RNA, 16 nt, Homo sapiens
uucaagagauucuugu

SEQ ID NO: 1403768 - RNA, 15 nt, Homo sapiens
uucacgccuggguga

SEQ ID NO: 1403769 - RNA, 16 nt, Homo sapiens
uucagaggauaaauau

SEQ ID NO: 1403770 - RNA, 15 nt, Homo sapiens
uucagcugguugagg

SEQ ID NO: 1403771 - RNA, 19 nt, Homo sapiens
uuccaaacaggcucagagg

SEQ ID NO: 1403772 - RNA, 15 nt, Homo sapiens
uuccaaccggcuuug

SEQ ID NO: 1403773 - RNA, 23 nt, Homo sapiens
uuccaguacuuccugcaguacaa

SEQ ID NO: 1403774 - RNA, 16 nt, Homo sapiens
uuccaguuauaaauau

SEQ ID NO: 1403775 - RNA, 22 nt, Homo sapiens
uuccccucuacuccaugcacau

SEQ ID NO: 1403776 - RNA, 22 nt, Homo sapiens
uucccuggggccccauuugcca

SEQ ID NO: 1403777 - RNA, 19 nt, Homo sapiens
uucgacguuugacuagcca

SEQ ID NO: 1403778 - RNA, 23 nt, Homo sapiens
uucgacguuugacuagccaucuc

SEQ ID NO: 1403779 - RNA, 19 nt, Homo sapiens
uucuaaagcucugaacaaa

SEQ ID NO: 1403780 - RNA, 20 nt, Homo sapiens
uucuaccucuuggcugccuu

SEQ ID NO: 1403781 - RNA, 15 nt, Homo sapiens
uucuagaaacaaaca

SEQ ID NO: 1403782 - RNA, 17 nt, Homo sapiens
uucucccagcacacggc

SEQ ID NO: 1403783 - RNA, 21 nt, Homo sapiens
uucugccuccauucugaccau

SEQ ID NO: 1403784 - RNA, 22 nt, Homo sapiens
uucugcucugguuagaaaaagg

SEQ ID NO: 1403785 - RNA, 17 nt, Homo sapiens
uucugucacucaccacu

SEQ ID NO: 1403786 - RNA, 17 nt, Homo sapiens
aaaaagaaggugccgau

SEQ ID NO: 1403787 - RNA, 17 nt, Homo sapiens
aaaaaggacucugcuuc

SEQ ID NO: 1403788 - RNA, 12 nt, Homo sapiens
aaaacauaugca

SEQ ID NO: 1403789 - RNA, 22 nt, Homo sapiens
aaaacauaugcauuaugaaguu

SEQ ID NO: 1403790 - RNA, 23 nt, Homo sapiens
aaaaccccaucucuacaaaaagc

SEQ ID NO: 1403791 - RNA, 21 nt, Homo sapiens
aaaaggacucugcuucagucc

SEQ ID NO: 1403792 - RNA, 21 nt, Homo sapiens
aaaauaccaaggaacaggaaa

SEQ ID NO: 1403793 - RNA, 14 nt, Homo sapiens
aaaauccaaaugag

SEQ ID NO: 1403794 - RNA, 16 nt, Homo sapiens
aaaauggccauuugcu

SEQ ID NO: 1403795 - RNA, 16 nt, Homo sapiens
aaaauguaaaauggag

SEQ ID NO: 1403796 - RNA, 15 nt, Homo sapiens
aaaauguuaugugcu

SEQ ID NO: 1403797 - RNA, 17 nt, Homo sapiens
aaacacaccgaugcaca

SEQ ID NO: 1403798 - RNA, 14 nt, Homo sapiens
aaacacugggcucu

SEQ ID NO: 1403799 - RNA, 14 nt, Homo sapiens
aaacagcugagggu

SEQ ID NO: 1403800 - RNA, 16 nt, Homo sapiens
aaacaggaacaaucca

SEQ ID NO: 1403801 - RNA, 14 nt, Homo sapiens
aaacauaugcauua

SEQ ID NO: 1403802 - RNA, 16 nt, Homo sapiens
aaacauccuugcaaau

SEQ ID NO: 1403803 - RNA, 21 nt, Homo sapiens
aaacaucuaauaaguauauaa

SEQ ID NO: 1403804 - RNA, 11 nt, Homo sapiens
aaaccaugacg

SEQ ID NO: 1403805 - RNA, 20 nt, Homo sapiens
aaacuugguauaucuggcca

SEQ ID NO: 1403806 - RNA, 18 nt, Homo sapiens
aaagaacucagugcugcc

SEQ ID NO: 1403807 - RNA, 20 nt, Homo sapiens
aaagaaggugccgauuucau

SEQ ID NO: 1403808 - RNA, 12 nt, Homo sapiens
aaagcacuguuu

SEQ ID NO: 1403809 - RNA, 16 nt, Homo sapiens
aaaggaaaaacugaug

SEQ ID NO: 1403810 - RNA, 19 nt, Homo sapiens
aaaggacucugcuucaguc

SEQ ID NO: 1403811 - RNA, 16 nt, Homo sapiens
aaaguaagacaucuca

SEQ ID NO: 1403812 - RNA, 17 nt, Homo sapiens
aaaguaugguauugaaa

SEQ ID NO: 1403813 - RNA, 20 nt, Homo sapiens
aaaguuauauuuacuuuaaa

SEQ ID NO: 1403814 - RNA, 13 nt, Homo sapiens
aaaguugaugcua

SEQ ID NO: 1403815 - RNA, 13 nt, Homo sapiens
aaauaacauggcc

SEQ ID NO: 1403816 - RNA, 13 nt, Homo sapiens
aaauagucacuca

SEQ ID NO: 1403817 - RNA, 17 nt, Homo sapiens
aaauaugccuaguaaca

SEQ ID NO: 1403818 - RNA, 13 nt, Homo sapiens
aaaugagaacuaa

SEQ ID NO: 1403819 - RNA, 12 nt, Homo sapiens
aaaugauggaau

SEQ ID NO: 1403820 - RNA, 23 nt, Homo sapiens
aaaugcccagcuuaaaggggcua

SEQ ID NO: 1403821 - RNA, 16 nt, Homo sapiens
aaaugcuuuuccucaa

SEQ ID NO: 1403822 - RNA, 16 nt, Homo sapiens
aaauggaaauugaugg

SEQ ID NO: 1403823 - RNA, 18 nt, Homo sapiens
aaaugggaaaaccagacu

SEQ ID NO: 1403824 - RNA, 22 nt, Homo sapiens
aaauguacucagcuaucagcuc

SEQ ID NO: 1403825 - RNA, 13 nt, Homo sapiens
aaauuacauuaaa

SEQ ID NO: 1403826 - RNA, 17 nt, Homo sapiens
aaauuggaacaccuccu

SEQ ID NO: 1403827 - RNA, 22 nt, Homo sapiens
aaauuugcuauucccaugcauu

SEQ ID NO: 1403828 - RNA, 19 nt, Homo sapiens
aacaaaagcuuuucuuucc

SEQ ID NO: 1403829 - RNA, 14 nt, Homo sapiens
aacaagaauuggaa

SEQ ID NO: 1403830 - RNA, 17 nt, Homo sapiens
aacaagacaaagcaaag

SEQ ID NO: 1403831 - RNA, 20 nt, Homo sapiens
aacacaaacgggcucagcaa

SEQ ID NO: 1403832 - RNA, 19 nt, Homo sapiens
aacacacauggaugcacac

SEQ ID NO: 1403833 - RNA, 19 nt, Homo sapiens
aacacaguguuuccugagu

SEQ ID NO: 1403834 - RNA, 17 nt, Homo sapiens
aacacguuggcucaguc

SEQ ID NO: 1403835 - RNA, 18 nt, Homo sapiens
aacacugggcucugagga

SEQ ID NO: 1403836 - RNA, 14 nt, Homo sapiens
aacacugugcaaag

SEQ ID NO: 1403837 - RNA, 15 nt, Homo sapiens
aacagagcugggcua

SEQ ID NO: 1403838 - RNA, 13 nt, Homo sapiens
aacagauaauccc

SEQ ID NO: 1403839 - RNA, 20 nt, Homo sapiens
aacaggcucugagauuucac

SEQ ID NO: 1403840 - RNA, 17 nt, Homo sapiens
aacauaggccugcucag

SEQ ID NO: 1403841 - RNA, 19 nt, Homo sapiens
aacaucuaauaaguauaua

SEQ ID NO: 1403842 - RNA, 22 nt, Homo sapiens
aacaugcuugaauaacugagcu

SEQ ID NO: 1403843 - RNA, 12 nt, Homo sapiens
aacauggccuuu

SEQ ID NO: 1403844 - RNA, 14 nt, Homo sapiens
aacauggccuuugc

SEQ ID NO: 1403845 - RNA, 19 nt, Homo sapiens
aacauguaaaacaguuaca

SEQ ID NO: 1403846 - RNA, 13 nt, Homo sapiens
aaccaucccugau

SEQ ID NO: 1403847 - RNA, 17 nt, Homo sapiens
aacccaucuucacgccu

SEQ ID NO: 1403848 - RNA, 20 nt, Homo sapiens
aaccugggaaccaugaagcu

SEQ ID NO: 1403849 - RNA, 13 nt, Homo sapiens
aaccugugucuua

SEQ ID NO: 1403850 - RNA, 17 nt, Homo sapiens
aaccuuaaauauauaau

SEQ ID NO: 1403851 - RNA, 13 nt, Homo sapiens
aacggcacugugg

SEQ ID NO: 1403852 - RNA, 18 nt, Homo sapiens
aacguccacagaguauaa

SEQ ID NO: 1403853 - RNA, 18 nt, Homo sapiens
aacuccccuuguacucuu

SEQ ID NO: 1403854 - RNA, 15 nt, Homo sapiens
aacugccccaucucc

SEQ ID NO: 1403855 - RNA, 20 nt, Homo sapiens
aacugcuuuaucccacggaa

SEQ ID NO: 1403856 - RNA, 20 nt, Homo sapiens
aacuuccaaaaagauuuauu

SEQ ID NO: 1403857 - RNA, 19 nt, Homo sapiens
aacuuccacaagagugaau

SEQ ID NO: 1403858 - RNA, 21 nt, Homo sapiens
aacuuccacaagagugaauuu

SEQ ID NO: 1403859 - RNA, 23 nt, Homo sapiens
aacuugaggacacauguccagug

SEQ ID NO: 1403860 - RNA, 20 nt, Homo sapiens
aacuuuguuuagcccaaaac

SEQ ID NO: 1403861 - RNA, 15 nt, Homo sapiens
aagaaaauaccaagg

SEQ ID NO: 1403862 - RNA, 17 nt, Homo sapiens
aagaaaauaccaaggaa

SEQ ID NO: 1403863 - RNA, 18 nt, Homo sapiens
aagaaacuguuacugucc

SEQ ID NO: 1403864 - RNA, 18 nt, Homo sapiens
aagaacaacugccaagaa

SEQ ID NO: 1403865 - RNA, 21 nt, Homo sapiens
aagaaccccagaccucugaau

SEQ ID NO: 1403866 - RNA, 13 nt, Homo sapiens
aagacaaagcaaa

SEQ ID NO: 1403867 - RNA, 14 nt, Homo sapiens
aagacacagacugc

SEQ ID NO: 1403868 - RNA, 16 nt, Homo sapiens
aagacagauacuccuc

SEQ ID NO: 1403869 - RNA, 15 nt, Homo sapiens
aagacuacacuguug

SEQ ID NO: 1403870 - RNA, 17 nt, Homo sapiens
aagacuuaucaacauuu

SEQ ID NO: 1403871 - RNA, 16 nt, Homo sapiens
aagccagcuuuccuca

SEQ ID NO: 1403872 - RNA, 15 nt, Homo sapiens
aagccgugauuuuca

SEQ ID NO: 1403873 - RNA, 15 nt, Homo sapiens
aagcucgagugaauu

SEQ ID NO: 1403874 - RNA, 17 nt, Homo sapiens
aagcugccgguucuuaa

SEQ ID NO: 1403875 - RNA, 20 nt, Homo sapiens
aaggaaaaacugauguuuaa

SEQ ID NO: 1403876 - RNA, 19 nt, Homo sapiens
aaggacucugcuucagucc

SEQ ID NO: 1403877 - RNA, 15 nt, Homo sapiens
aaggagaaaaugcau

SEQ ID NO: 1403878 - RNA, 23 nt, Homo sapiens
aaggaggguugugcccacuucau

SEQ ID NO: 1403879 - RNA, 14 nt, Homo sapiens
aaggccacacuggc

SEQ ID NO: 1403880 - RNA, 14 nt, Homo sapiens
aaggcucuuuugua

SEQ ID NO: 1403881 - RNA, 16 nt, Homo sapiens
aaggugccgauuucau

SEQ ID NO: 1403882 - RNA, 18 nt, Homo sapiens
aaguacuuaaacuuccac

SEQ ID NO: 1403883 - RNA, 18 nt, Homo sapiens
aaguauaggauaaauuac

SEQ ID NO: 1403884 - RNA, 17 nt, Homo sapiens
aaguauauauucuacac

SEQ ID NO: 1403885 - RNA, 22 nt, Homo sapiens
aagucaucuguuuaauuuacac

SEQ ID NO: 1403886 - RNA, 22 nt, Homo sapiens
aagugagacccugucucaaaaa

SEQ ID NO: 1403887 - RNA, 12 nt, Homo sapiens
aagugcuacuuu

SEQ ID NO: 1403888 - RNA, 22 nt, Homo sapiens
aauaaauuggaacaccuccuca

SEQ ID NO: 1403889 - RNA, 13 nt, Homo sapiens
aauaaggcacaaa

SEQ ID NO: 1403890 - RNA, 21 nt, Homo sapiens
aauaaguauauaauccuguga

SEQ ID NO: 1403891 - RNA, 20 nt, Homo sapiens
aauaauacaguaucucaggg

SEQ ID NO: 1403892 - RNA, 17 nt, Homo sapiens
aauacaguaucucaggg

SEQ ID NO: 1403893 - RNA, 20 nt, Homo sapiens
aauacugugcauaagccauu

SEQ ID NO: 1403894 - RNA, 18 nt, Homo sapiens
aauaucugagaaguguau

SEQ ID NO: 1403895 - RNA, 22 nt, Homo sapiens
aauaucugagaaguguauauag

SEQ ID NO: 1403896 - RNA, 21 nt, Homo sapiens
aauaugggguugguguucuca

SEQ ID NO: 1403897 - RNA, 19 nt, Homo sapiens
aauauugcugaacuacuuu

SEQ ID NO: 1403898 - RNA, 18 nt, Homo sapiens
aauauuucuuucaugucu

SEQ ID NO: 1403899 - RNA, 16 nt, Homo sapiens
aaucagcauuuagucu

SEQ ID NO: 1403900 - RNA, 15 nt, Homo sapiens
aaucagccuggccau

SEQ ID NO: 1403901 - RNA, 17 nt, Homo sapiens
aauccuucucacuaaaa

SEQ ID NO: 1403902 - RNA, 23 nt, Homo sapiens
aaugaggucccucuagcuuuagc

SEQ ID NO: 1403903 - RNA, 19 nt, Homo sapiens
aaugaugauccuaggcauu

SEQ ID NO: 1403904 - RNA, 14 nt, Homo sapiens
aaugaugggucagu

SEQ ID NO: 1403905 - RNA, 16 nt, Homo sapiens
aaugcacacacacaga

SEQ ID NO: 1403906 - RNA, 19 nt, Homo sapiens
aaugcacgcacacaucagu

SEQ ID NO: 1403907 - RNA, 23 nt, Homo sapiens
aaugcccuaccugccuguucucc

SEQ ID NO: 1403908 - RNA, 19 nt, Homo sapiens
aauggcacgaucucagcuc

SEQ ID NO: 1403909 - RNA, 20 nt, Homo sapiens
aauggccuaaacuucagagg

SEQ ID NO: 1403910 - RNA, 16 nt, Homo sapiens
aauguccagcuucucu

SEQ ID NO: 1403911 - RNA, 13 nt, Homo sapiens
aauguuaugugcu

SEQ ID NO: 1403912 - RNA, 23 nt, Homo sapiens
aauuagcaauugacugucacugu

SEQ ID NO: 1403913 - RNA, 14 nt, Homo sapiens
aauuaguggcacuu

SEQ ID NO: 1403914 - RNA, 21 nt, Homo sapiens
aauuaguuccucauuagcauu

SEQ ID NO: 1403915 - RNA, 20 nt, Homo sapiens
aauucagcucuugagagcau

SEQ ID NO: 1403916 - RNA, 21 nt, Homo sapiens
aauucuagagucucuguuacu

SEQ ID NO: 1403917 - RNA, 17 nt, Homo sapiens
aauuuacacacuugcau

SEQ ID NO: 1403918 - RNA, 21 nt, Homo sapiens
aauuuggguacugggugcugu

SEQ ID NO: 1403919 - RNA, 20 nt, Homo sapiens
aauuuuguuuaaaacucaga

SEQ ID NO: 1403920 - RNA, 13 nt, Homo sapiens
acaaaacgagaua

SEQ ID NO: 1403921 - RNA, 17 nt, Homo sapiens
acaaagaggagcugcug

SEQ ID NO: 1403922 - RNA, 18 nt, Homo sapiens
acaaaugggaaaaccaga

SEQ ID NO: 1403923 - RNA, 19 nt, Homo sapiens
acaaauuuuuuucuuguuu

SEQ ID NO: 1403924 - RNA, 19 nt, Homo sapiens
acaaccucauuuuaacuca

SEQ ID NO: 1403925 - RNA, 20 nt, Homo sapiens
acaagauuugcugcauuucc

SEQ ID NO: 1403926 - RNA, 15 nt, Homo sapiens
acaaguccuugaccu

SEQ ID NO: 1403927 - RNA, 13 nt, Homo sapiens
acaauucuucucg

SEQ ID NO: 1403928 - RNA, 16 nt, Homo sapiens
acacaauccuccaaga

SEQ ID NO: 1403929 - RNA, 13 nt, Homo sapiens
acacacacaccaa

SEQ ID NO: 1403930 - RNA, 17 nt, Homo sapiens
acacacagagauaugca

SEQ ID NO: 1403931 - RNA, 18 nt, Homo sapiens
acacacagagauaugcac

SEQ ID NO: 1403932 - RNA, 15 nt, Homo sapiens
acacacagauaugca

SEQ ID NO: 1403933 - RNA, 23 nt, Homo sapiens
acacaccgauguacacacacaga

SEQ ID NO: 1403934 - RNA, 16 nt, Homo sapiens
acacagauaugcacac

SEQ ID NO: 1403935 - RNA, 14 nt, Homo sapiens
acacagaugcacac

SEQ ID NO: 1403936 - RNA, 19 nt, Homo sapiens
acacagauggucacacaga

SEQ ID NO: 1403937 - RNA, 21 nt, Homo sapiens
acacagauggucacacagaga

SEQ ID NO: 1403938 - RNA, 22 nt, Homo sapiens
acacaggggcaaagaacugccc

SEQ ID NO: 1403939 - RNA, 20 nt, Homo sapiens
acacaguguuuccugaguag

SEQ ID NO: 1403940 - RNA, 14 nt, Homo sapiens
acacauggaugcac

SEQ ID NO: 1403941 - RNA, 17 nt, Homo sapiens
acacauguccaguggga

SEQ ID NO: 1403942 - RNA, 17 nt, Homo sapiens
acaccagcccugcugcu

SEQ ID NO: 1403943 - RNA, 16 nt, Homo sapiens
acaccgauguacacac

SEQ ID NO: 1403944 - RNA, 17 nt, Homo sapiens
acaccgaugugcgcaca

SEQ ID NO: 1403945 - RNA, 13 nt, Homo sapiens
acaccucccugaa

SEQ ID NO: 1403946 - RNA, 16 nt, Homo sapiens
acacgccaaugcacac

SEQ ID NO: 1403947 - RNA, 14 nt, Homo sapiens
acacggaggcaucu

SEQ ID NO: 1403948 - RNA, 14 nt, Homo sapiens
acacuaaaaccaua

SEQ ID NO: 1403949 - RNA, 17 nt, Homo sapiens
acacucccacuuggcau

SEQ ID NO: 1403950 - RNA, 17 nt, Homo sapiens
acagaaugaaucccaua

SEQ ID NO: 1403951 - RNA, 23 nt, Homo sapiens
acagacacucccacuuggcauca

SEQ ID NO: 1403952 - RNA, 13 nt, Homo sapiens
acagagacagaga

SEQ ID NO: 1403953 - RNA, 17 nt, Homo sapiens
acagagacaggcccaag

SEQ ID NO: 1403954 - RNA, 14 nt, Homo sapiens
acagagauaugcac

SEQ ID NO: 1403955 - RNA, 13 nt, Homo sapiens
acagauaugcaca

SEQ ID NO: 1403956 - RNA, 17 nt, Homo sapiens
acagaugcacacacaga

SEQ ID NO: 1403957 - RNA, 16 nt, Homo sapiens
acagauggucacacag

SEQ ID NO: 1403958 - RNA, 17 nt, Homo sapiens
acagauggucacacaga

SEQ ID NO: 1403959 - RNA, 18 nt, Homo sapiens
acagcaagacuccgucuc

SEQ ID NO: 1403960 - RNA, 20 nt, Homo sapiens
acagcucuagacacugccac

SEQ ID NO: 1403961 - RNA, 14 nt, Homo sapiens
acaggcccaagaga

SEQ ID NO: 1403962 - RNA, 15 nt, Homo sapiens
acaggcucugagauu

SEQ ID NO: 1403963 - RNA, 19 nt, Homo sapiens
acaggcucugagauuucac

SEQ ID NO: 1403964 - RNA, 19 nt, Homo sapiens
acaguguugaaaauguuca

SEQ ID NO: 1403965 - RNA, 22 nt, Homo sapiens
acauaccuggcccugugccuug

SEQ ID NO: 1403966 - RNA, 16 nt, Homo sapiens
acauagagauaugcac

SEQ ID NO: 1403967 - RNA, 16 nt, Homo sapiens
acauaugcauuaugaa

SEQ ID NO: 1403968 - RNA, 13 nt, Homo sapiens
acaucacuugaga

SEQ ID NO: 1403969 - RNA, 20 nt, Homo sapiens
acaucacuuguacaaaauaa

SEQ ID NO: 1403970 - RNA, 21 nt, Homo sapiens
acauccaaggagaaacagaga

SEQ ID NO: 1403971 - RNA, 14 nt, Homo sapiens
acauccagcccagg

SEQ ID NO: 1403972 - RNA, 21 nt, Homo sapiens
acaugcagcaaggggacaucu

SEQ ID NO: 1403973 - RNA, 22 nt, Homo sapiens
aggcuuauauacaaugcuucuu

SEQ ID NO: 1403974 - RNA, 15 nt, Homo sapiens
agggaaguccuugca

SEQ ID NO: 1403975 - RNA, 16 nt, Homo sapiens
agggaauacugugcau

SEQ ID NO: 1403976 - RNA, 16 nt, Homo sapiens
agggacagaagcagga

SEQ ID NO: 1403977 - RNA, 18 nt, Homo sapiens
agggauuuggggcucaga

SEQ ID NO: 1403978 - RNA, 17 nt, Homo sapiens
aggggcaaagaacugcc

SEQ ID NO: 1403979 - RNA, 14 nt, Homo sapiens
aggggcucucucau

SEQ ID NO: 1403980 - RNA, 22 nt, Homo sapiens
aggguugggcgugcuaccugca

SEQ ID NO: 1403981 - RNA, 15 nt, Homo sapiens
aggugagaccaccuc

SEQ ID NO: 1403982 - RNA, 18 nt, Homo sapiens
agguggaacaagcacaga

SEQ ID NO: 1403983 - RNA, 16 nt, Homo sapiens
agguggagugucacau

SEQ ID NO: 1403984 - RNA, 22 nt, Homo sapiens
aggugucaccuuccuaguucuu

SEQ ID NO: 1403985 - RNA, 21 nt, Homo sapiens
agguguucuucauuaccucag

SEQ ID NO: 1403986 - RNA, 23 nt, Homo sapiens
agguguucuucauuaccucagug

SEQ ID NO: 1403987 - RNA, 14 nt, Homo sapiens
agguuggcaaaaag

SEQ ID NO: 1403988 - RNA, 13 nt, Homo sapiens
aguaaccuaguga

SEQ ID NO: 1403989 - RNA, 20 nt, Homo sapiens
aguaauuuugugaaagaagg

SEQ ID NO: 1403990 - RNA, 19 nt, Homo sapiens
aguacuuacccuaaaacau

SEQ ID NO: 1403991 - RNA, 21 nt, Homo sapiens
aguacuuccugcaguacaaga

SEQ ID NO: 1403992 - RNA, 18 nt, Homo sapiens
aguauaguuuugacagag

SEQ ID NO: 1403993 - RNA, 15 nt, Homo sapiens
agucaacagugaaau

SEQ ID NO: 1403994 - RNA, 22 nt, Homo sapiens
aguccacuuuuaaaacuauauu

SEQ ID NO: 1403995 - RNA, 12 nt, Homo sapiens
aguccagcacug

SEQ ID NO: 1403996 - RNA, 23 nt, Homo sapiens
agucggauacccuggagcaagac

SEQ ID NO: 1403997 - RNA, 12 nt, Homo sapiens
agucucuaugau

SEQ ID NO: 1403998 - RNA, 14 nt, Homo sapiens
agucucuaugaucu

SEQ ID NO: 1403999 - RNA, 13 nt, Homo sapiens
agugagaagccag

SEQ ID NO: 1404000 - RNA, 13 nt, Homo sapiens
agugagacccugu

SEQ ID NO: 1404001 - RNA, 19 nt, Homo sapiens
agugauuguuaugccuugc

SEQ ID NO: 1404002 - RNA, 13 nt, Homo sapiens
agugcaguggcgu

SEQ ID NO: 1404003 - RNA, 15 nt, Homo sapiens
agugcuauuguagag

SEQ ID NO: 1404004 - RNA, 13 nt, Homo sapiens
agugcuugauaug

SEQ ID NO: 1404005 - RNA, 20 nt, Homo sapiens
aguggaagaagaaaacacua

SEQ ID NO: 1404006 - RNA, 21 nt, Homo sapiens
aguggcccccacucacaggga

SEQ ID NO: 1404007 - RNA, 15 nt, Homo sapiens
agugggggaucacag

SEQ ID NO: 1404008 - RNA, 15 nt, Homo sapiens
agugggguagguugg

SEQ ID NO: 1404009 - RNA, 13 nt, Homo sapiens
agugggugaauaa

SEQ ID NO: 1404010 - RNA, 19 nt, Homo sapiens
agugggugaauaauacagu

SEQ ID NO: 1404011 - RNA, 19 nt, Homo sapiens
aguggguuagcuaccugcu

SEQ ID NO: 1404012 - RNA, 19 nt, Homo sapiens
agugugccccucuguaaca

SEQ ID NO: 1404013 - RNA, 21 nt, Homo sapiens
aguuccagauuguucugucca

SEQ ID NO: 1404014 - RNA, 14 nt, Homo sapiens
aguugauucagcuc

SEQ ID NO: 1404015 - RNA, 16 nt, Homo sapiens
aguugguguucauaau

SEQ ID NO: 1404016 - RNA, 20 nt, Homo sapiens
auaaacaaauaacaaugugc

SEQ ID NO: 1404017 - RNA, 16 nt, Homo sapiens
auaaagagacugagcc

SEQ ID NO: 1404018 - RNA, 20 nt, Homo sapiens
auaaccuucaugaugaauua

SEQ ID NO: 1404019 - RNA, 19 nt, Homo sapiens
auaagagcuggaugcacau

SEQ ID NO: 1404020 - RNA, 17 nt, Homo sapiens
auaauacaguaucucag

SEQ ID NO: 1404021 - RNA, 23 nt, Homo sapiens
auaauauuaaggaagacaaugug

SEQ ID NO: 1404022 - RNA, 23 nt, Homo sapiens
auaauucagcucuugagagcauu

SEQ ID NO: 1404023 - RNA, 20 nt, Homo sapiens
auaauuucuagaaacaaaca

SEQ ID NO: 1404024 - RNA, 14 nt, Homo sapiens
auacauuauauucc

SEQ ID NO: 1404025 - RNA, 22 nt, Homo sapiens
auacgcaaacacaccgaugcac

SEQ ID NO: 1404026 - RNA, 13 nt, Homo sapiens
auacuucauuaaa

SEQ ID NO: 1404027 - RNA, 12 nt, Homo sapiens
auagaaacugag

SEQ ID NO: 1404028 - RNA, 18 nt, Homo sapiens
auaggccugcucagccuc

SEQ ID NO: 1404029 - RNA, 18 nt, Homo sapiens
auauaaacaugcuugcau

SEQ ID NO: 1404030 - RNA, 16 nt, Homo sapiens
auauaauguugccagc

SEQ ID NO: 1404031 - RNA, 19 nt, Homo sapiens
auaucugagaaguguauau

SEQ ID NO: 1404032 - RNA, 17 nt, Homo sapiens
auaucuggccacacugg

SEQ ID NO: 1404033 - RNA, 17 nt, Homo sapiens
auaugcacacacaugga

SEQ ID NO: 1404034 - RNA, 19 nt, Homo sapiens
auaugcacacacauggaug

SEQ ID NO: 1404035 - RNA, 14 nt, Homo sapiens
auaugggguuggug

SEQ ID NO: 1404036 - RNA, 20 nt, Homo sapiens
auaugggguugguguucuca

SEQ ID NO: 1404037 - RNA, 20 nt, Homo sapiens
auauuccucuaaaacucuca

SEQ ID NO: 1404038 - RNA, 17 nt, Homo sapiens
auauuuaccagaccaca

SEQ ID NO: 1404039 - RNA, 16 nt, Homo sapiens
aucauaauucagcucu

SEQ ID NO: 1404040 - RNA, 17 nt, Homo sapiens
auccauaacuuuagucu

SEQ ID NO: 1404041 - RNA, 22 nt, Homo sapiens
auccauagcaccuccacauacc

SEQ ID NO: 1404042 - RNA, 19 nt, Homo sapiens
auccauggggcugauugua

SEQ ID NO: 1404043 - RNA, 15 nt, Homo sapiens
aucccaugagcuccu

SEQ ID NO: 1404044 - RNA, 22 nt, Homo sapiens
auccccuuuggcuaccugaugg

SEQ ID NO: 1404045 - RNA, 15 nt, Homo sapiens
aucccuggaaggaca

SEQ ID NO: 1404046 - RNA, 14 nt, Homo sapiens
auccuaccaaccuc

SEQ ID NO: 1404047 - RNA, 14 nt, Homo sapiens
auccuacucaacaa

SEQ ID NO: 1404048 - RNA, 21 nt, Homo sapiens
auccuuguugacacggccaug

SEQ ID NO: 1404049 - RNA, 20 nt, Homo sapiens
aucgcugccuugccaugucu

SEQ ID NO: 1404050 - RNA, 16 nt, Homo sapiens
aucuaugccacucaga

SEQ ID NO: 1404051 - RNA, 17 nt, Homo sapiens
aucucaagcaaguuuaa

SEQ ID NO: 1404052 - RNA, 19 nt, Homo sapiens
aucucacucuguugcccag

SEQ ID NO: 1404053 - RNA, 17 nt, Homo sapiens
aucuccugagcucguga

SEQ ID NO: 1404054 - RNA, 17 nt, Homo sapiens
aucucggcucacugcaa

SEQ ID NO: 1404055 - RNA, 15 nt, Homo sapiens
aucucuuuaccuccu

SEQ ID NO: 1404056 - RNA, 17 nt, Homo sapiens
aucugagaggccacagu

SEQ ID NO: 1404057 - RNA, 17 nt, Homo sapiens
aucuggaaggacaucua

SEQ ID NO: 1404058 - RNA, 20 nt, Homo sapiens
aucuuagacccgguccugcc

SEQ ID NO: 1404059 - RNA, 16 nt, Homo sapiens
aucuuagcugccaagu

SEQ ID NO: 1404060 - RNA, 15 nt, Homo sapiens
augaaaugcuuccaa

SEQ ID NO: 1404061 - RNA, 14 nt, Homo sapiens
augaagacagauac

SEQ ID NO: 1404062 - RNA, 19 nt, Homo sapiens
augaaucccauaauugaca

SEQ ID NO: 1404063 - RNA, 19 nt, Homo sapiens
augacaucagcaauacaga

SEQ ID NO: 1404064 - RNA, 20 nt, Homo sapiens
augagcacacacacaccaau

SEQ ID NO: 1404065 - RNA, 22 nt, Homo sapiens
augaggacuugugucucugugc

SEQ ID NO: 1404066 - RNA, 22 nt, Homo sapiens
augagucggauacccuggagca

SEQ ID NO: 1404067 - RNA, 22 nt, Homo sapiens
augauccuaggcauuugcugaa

SEQ ID NO: 1404068 - RNA, 15 nt, Homo sapiens
augauguguagggcu

SEQ ID NO: 1404069 - RNA, 16 nt, Homo sapiens
augcacacacagaugc

SEQ ID NO: 1404070 - RNA, 19 nt, Homo sapiens
augcacacacagaugcaca

SEQ ID NO: 1404071 - RNA, 20 nt, Homo sapiens
augcacacacagaugcacac

SEQ ID NO: 1404072 - RNA, 16 nt, Homo sapiens
augcacacacauggau

SEQ ID NO: 1404073 - RNA, 22 nt, Homo sapiens
augcacacacauggaugagcac

SEQ ID NO: 1404074 - RNA, 18 nt, Homo sapiens
augcacagagauaugcac

SEQ ID NO: 1404075 - RNA, 20 nt, Homo sapiens
augcacagagauaugcacac

SEQ ID NO: 1404076 - RNA, 16 nt, Homo sapiens
augcagcaaaauguga

SEQ ID NO: 1404077 - RNA, 17 nt, Homo sapiens
augcccugugcaugcca

SEQ ID NO: 1404078 - RNA, 22 nt, Homo sapiens
auggaaugaccagccuguccaa

SEQ ID NO: 1404079 - RNA, 15 nt, Homo sapiens
auggaugcacgcaca

SEQ ID NO: 1404080 - RNA, 19 nt, Homo sapiens
auggaugcacgcacaugcc

SEQ ID NO: 1404081 - RNA, 17 nt, Homo sapiens
auggccuuggagggcau

SEQ ID NO: 1404082 - RNA, 18 nt, Homo sapiens
auggcucuggcaccacua

SEQ ID NO: 1404083 - RNA, 16 nt, Homo sapiens
augggaagacugagcu

SEQ ID NO: 1404084 - RNA, 18 nt, Homo sapiens
auggguccacugcaccag

SEQ ID NO: 1404085 - RNA, 17 nt, Homo sapiens
augguaauuaugugaua

SEQ ID NO: 1404086 - RNA, 15 nt, Homo sapiens
auggucuugaucucc

SEQ ID NO: 1404087 - RNA, 13 nt, Homo sapiens
auguacacacaca

SEQ ID NO: 1404088 - RNA, 22 nt, Homo sapiens
auguauaucuauaucucuaaac

SEQ ID NO: 1404089 - RNA, 20 nt, Homo sapiens
auguccuuuguguccauuga

SEQ ID NO: 1404090 - RNA, 19 nt, Homo sapiens
augucuuuuuacccuuuaa

SEQ ID NO: 1404091 - RNA, 20 nt, Homo sapiens
augugcucugauuugauaua

SEQ ID NO: 1404092 - RNA, 19 nt, Homo sapiens
auguggagcucagcaacaa

SEQ ID NO: 1404093 - RNA, 12 nt, Homo sapiens
auguggcagcug

SEQ ID NO: 1404094 - RNA, 21 nt, Homo sapiens
augugggggucuguguguuua

SEQ ID NO: 1404095 - RNA, 16 nt, Homo sapiens
auguguguguguugug

SEQ ID NO: 1404096 - RNA, 16 nt, Homo sapiens
auuaaccacuucagcu

SEQ ID NO: 1404097 - RNA, 20 nt, Homo sapiens
auuaaccugaauuauuccaa

SEQ ID NO: 1404098 - RNA, 12 nt, Homo sapiens
auuaagcaugaa

SEQ ID NO: 1404099 - RNA, 17 nt, Homo sapiens
auuaauuaaaccagacu

SEQ ID NO: 1404100 - RNA, 16 nt, Homo sapiens
auuacaaaaacauggc

SEQ ID NO: 1404101 - RNA, 18 nt, Homo sapiens
auuacaggcgcacaccac

SEQ ID NO: 1404102 - RNA, 18 nt, Homo sapiens
auuaccacuucccugcuu

SEQ ID NO: 1404103 - RNA, 19 nt, Homo sapiens
auuagagaaugauuucaaa

SEQ ID NO: 1404104 - RNA, 19 nt, Homo sapiens
auuagugaauuacacucaa

SEQ ID NO: 1404105 - RNA, 18 nt, Homo sapiens
auuaugagucucuaugau

SEQ ID NO: 1404106 - RNA, 13 nt, Homo sapiens
auuauucccauga

SEQ ID NO: 1404107 - RNA, 16 nt, Homo sapiens
auuauuuucacuguag

SEQ ID NO: 1404108 - RNA, 21 nt, Homo sapiens
auucaauaaagcugcugagaa

SEQ ID NO: 1404109 - RNA, 18 nt, Homo sapiens
auucacagcaagucacug

SEQ ID NO: 1404110 - RNA, 22 nt, Homo sapiens
auuccaacagcucaagucuucc

SEQ ID NO: 1404111 - RNA, 15 nt, Homo sapiens
auuccaggagcugcg

SEQ ID NO: 1404112 - RNA, 14 nt, Homo sapiens
auucuaauuacaaa

SEQ ID NO: 1404113 - RNA, 21 nt, Homo sapiens
auucuacacauauauguauau

SEQ ID NO: 1404114 - RNA, 22 nt, Homo sapiens
auucugccuccauucugaccau

SEQ ID NO: 1404115 - RNA, 15 nt, Homo sapiens
auucuuugaccuguu

SEQ ID NO: 1404116 - RNA, 15 nt, Homo sapiens
auugaauuagaaaca

SEQ ID NO: 1404117 - RNA, 16 nt, Homo sapiens
auugauguuaacaaga

SEQ ID NO: 1404118 - RNA, 11 nt, Homo sapiens
auugauuucaa

SEQ ID NO: 1404119 - RNA, 13 nt, Homo sapiens
auugggcaugcca

SEQ ID NO: 1404120 - RNA, 12 nt, Homo sapiens
auugucccugaa

SEQ ID NO: 1404121 - RNA, 11 nt, Homo sapiens
auugucuucca

SEQ ID NO: 1404122 - RNA, 12 nt, Homo sapiens
auuuaugaaggc

SEQ ID NO: 1404123 - RNA, 15 nt, Homo sapiens
auuuaugguucucag

SEQ ID NO: 1404124 - RNA, 21 nt, Homo sapiens
auuuaugguucucaggccuga

SEQ ID NO: 1404125 - RNA, 13 nt, Homo sapiens
auuuauguguaua

SEQ ID NO: 1404126 - RNA, 13 nt, Homo sapiens
auuuauuuaugua

SEQ ID NO: 1404127 - RNA, 16 nt, Homo sapiens
auuuauuuauguagga

SEQ ID NO: 1404128 - RNA, 19 nt, Homo sapiens
auuucaaccgcuugccaua

SEQ ID NO: 1404129 - RNA, 13 nt, Homo sapiens
auuucaagaccuc

SEQ ID NO: 1404130 - RNA, 16 nt, Homo sapiens
auuugcugaauacaga

SEQ ID NO: 1404131 - RNA, 16 nt, Homo sapiens
auuuuauuucugaaga

SEQ ID NO: 1404132 - RNA, 18 nt, Homo sapiens
auuuuauuuuucucauga

SEQ ID NO: 1404133 - RNA, 19 nt, Homo sapiens
auuuucaagaaacugagga

SEQ ID NO: 1404134 - RNA, 22 nt, Homo sapiens
auuuucgacguuugacuagcca

SEQ ID NO: 1404135 - RNA, 12 nt, Homo sapiens
auuuugcauuag

SEQ ID NO: 1404136 - RNA, 19 nt, Homo sapiens
auuuuguuuuugucuuaaa

SEQ ID NO: 1404137 - RNA, 22 nt, Homo sapiens
auuuuucaaguaauaaaacaau

SEQ ID NO: 1404138 - RNA, 14 nt, Homo sapiens
caaaaacauggccu

SEQ ID NO: 1404139 - RNA, 21 nt, Homo sapiens
caaaaccucauuuaaguaaaa

SEQ ID NO: 1404140 - RNA, 15 nt, Homo sapiens
caaaauguccagcuu

SEQ ID NO: 1404141 - RNA, 13 nt, Homo sapiens
caaacgcugaaaa

SEQ ID NO: 1404142 - RNA, 21 nt, Homo sapiens
caaagaacugccccaucuccu

SEQ ID NO: 1404143 - RNA, 14 nt, Homo sapiens
caaagacuguaaau

SEQ ID NO: 1404144 - RNA, 14 nt, Homo sapiens
caaaugcccagcuu

SEQ ID NO: 1404145 - RNA, 14 nt, Homo sapiens
caacaaguugccuc

SEQ ID NO: 1404146 - RNA, 22 nt, Homo sapiens
caacaccucugcacaagcugca

SEQ ID NO: 1404147 - RNA, 11 nt, Homo sapiens
caacaggaaau

SEQ ID NO: 1404148 - RNA, 18 nt, Homo sapiens
caacauuuguuccaugag

SEQ ID NO: 1404149 - RNA, 18 nt, Homo sapiens
caaccggcuuuguggcac

SEQ ID NO: 1404150 - RNA, 18 nt, Homo sapiens
caaccucauuuuaacuca

SEQ ID NO: 1404151 - RNA, 13 nt, Homo sapiens
caacgaaaagcac

SEQ ID NO: 1404152 - RNA, 21 nt, Homo sapiens
caacuggggaauugaagccaa

SEQ ID NO: 1404153 - RNA, 16 nt, Homo sapiens
caagaccucugugcac

SEQ ID NO: 1404154 - RNA, 19 nt, Homo sapiens
caagaucgcaccauugcac

SEQ ID NO: 1404155 - RNA, 16 nt, Homo sapiens
caagccugccuaggaa

SEQ ID NO: 1404156 - RNA, 11 nt, Homo sapiens
caagcucugcc

SEQ ID NO: 1404157 - RNA, 20 nt, Homo sapiens
caagcuuuggguuggagcug

SEQ ID NO: 1404158 - RNA, 16 nt, Homo sapiens
caaggaauuucugcuc

SEQ ID NO: 1404159 - RNA, 17 nt, Homo sapiens
caagguuauuggacacc

SEQ ID NO: 1404160 - RNA, 15 nt, Homo sapiens
caaguagcugagauu

SEQ ID NO: 1404161 - RNA, 17 nt, Homo sapiens
caaguagcugagauuac

SEQ ID NO: 1404162 - RNA, 18 nt, Homo sapiens
caagucaagugaaaaagg

SEQ ID NO: 1404163 - RNA, 19 nt, Homo sapiens
caagucuucccugaucaag

SEQ ID NO: 1404164 - RNA, 18 nt, Homo sapiens
caaguggaaacaugcuga

SEQ ID NO: 1404165 - RNA, 18 nt, Homo sapiens
caaguugcuuuuaccuga

SEQ ID NO: 1404166 - RNA, 13 nt, Homo sapiens
caauaaauuggaa

SEQ ID NO: 1404167 - RNA, 14 nt, Homo sapiens
caaugaucaucuca

SEQ ID NO: 1404168 - RNA, 15 nt, Homo sapiens
caaugaucaucucac

SEQ ID NO: 1404169 - RNA, 15 nt, Homo sapiens
caaugcacacacaca

SEQ ID NO: 1404170 - RNA, 16 nt, Homo sapiens
caaugcacgcacacau

SEQ ID NO: 1404171 - RNA, 20 nt, Homo sapiens
caaugucagaaacucgauga

SEQ ID NO: 1404172 - RNA, 12 nt, Homo sapiens
caauucuucucg

SEQ ID NO: 1404173 - RNA, 20 nt, Homo sapiens
caauugacugucacuguucc

SEQ ID NO: 1404174 - RNA, 16 nt, Homo sapiens
caauugcacuaggcaa

SEQ ID NO: 1404175 - RNA, 15 nt, Homo sapiens
cacaagagugaauuu

SEQ ID NO: 1404176 - RNA, 15 nt, Homo sapiens
cacaaggcugaccaa

SEQ ID NO: 1404177 - RNA, 21 nt, Homo sapiens
cacaaggcugaccaagagaga

SEQ ID NO: 1404178 - RNA, 15 nt, Homo sapiens
cacacacacaccaau

SEQ ID NO: 1404179 - RNA, 15 nt, Homo sapiens
cacacacaccgaugu

SEQ ID NO: 1404180 - RNA, 17 nt, Homo sapiens
cacacaccgauguacac

SEQ ID NO: 1404181 - RNA, 13 nt, Homo sapiens
cacacagauaugc

SEQ ID NO: 1404182 - RNA, 20 nt, Homo sapiens
cacacagaugcacacacaga

SEQ ID NO: 1404183 - RNA, 22 nt, Homo sapiens
caugcuugcauuauauuuguaa

SEQ ID NO: 1404184 - RNA, 11 nt, Homo sapiens
caugcuuucuc

SEQ ID NO: 1404185 - RNA, 14 nt, Homo sapiens
cauggaugagcaca

SEQ ID NO: 1404186 - RNA, 22 nt, Homo sapiens
cauggaugcacgcacaugccaa

SEQ ID NO: 1404187 - RNA, 16 nt, Homo sapiens
cauggggcugauugua

SEQ ID NO: 1404188 - RNA, 16 nt, Homo sapiens
cauggguccacugcac

SEQ ID NO: 1404189 - RNA, 15 nt, Homo sapiens
cauguaaaacaguua

SEQ ID NO: 1404190 - RNA, 12 nt, Homo sapiens
caugucagcucc

SEQ ID NO: 1404191 - RNA, 20 nt, Homo sapiens
caugucucugguggugcugg

SEQ ID NO: 1404192 - RNA, 16 nt, Homo sapiens
caugucuuguucagaa

SEQ ID NO: 1404193 - RNA, 17 nt, Homo sapiens
cauguguugccuggaag

SEQ ID NO: 1404194 - RNA, 22 nt, Homo sapiens
cauucacagcaagucacuggcc

SEQ ID NO: 1404195 - RNA, 19 nt, Homo sapiens
cauucagcagucagucccc

SEQ ID NO: 1404196 - RNA, 19 nt, Homo sapiens
cauucaggcaacgcacaaa

SEQ ID NO: 1404197 - RNA, 18 nt, Homo sapiens
cauuccagacugcuucca

SEQ ID NO: 1404198 - RNA, 20 nt, Homo sapiens
cauucuuucccaacaccucu

SEQ ID NO: 1404199 - RNA, 21 nt, Homo sapiens
cauucuuucccaacaccucuu

SEQ ID NO: 1404200 - RNA, 16 nt, Homo sapiens
cauugcacuccagcug

SEQ ID NO: 1404201 - RNA, 18 nt, Homo sapiens
cauuggauccuacucaac

SEQ ID NO: 1404202 - RNA, 14 nt, Homo sapiens
cauugggauauucu

SEQ ID NO: 1404203 - RNA, 19 nt, Homo sapiens
cauugguguugacauacau

SEQ ID NO: 1404204 - RNA, 17 nt, Homo sapiens
cauuucaggggucguca

SEQ ID NO: 1404205 - RNA, 20 nt, Homo sapiens
cauuucauuaagguuccagu

SEQ ID NO: 1404206 - RNA, 21 nt, Homo sapiens
cauuucucuugcucaccaaga

SEQ ID NO: 1404207 - RNA, 20 nt, Homo sapiens
cauuucugagaucaaaacgg

SEQ ID NO: 1404208 - RNA, 14 nt, Homo sapiens
cauuugagugucuu

SEQ ID NO: 1404209 - RNA, 21 nt, Homo sapiens
cauuuguuggaaugaauuaaa

SEQ ID NO: 1404210 - RNA, 21 nt, Homo sapiens
cauuuugcauuagacagauga

SEQ ID NO: 1404211 - RNA, 22 nt, Homo sapiens
ccaaaaagauuuauuaauuaaa

SEQ ID NO: 1404212 - RNA, 15 nt, Homo sapiens
ccaaaaguacuuacc

SEQ ID NO: 1404213 - RNA, 18 nt, Homo sapiens
ccaaaauaaaaccagcuc

SEQ ID NO: 1404214 - RNA, 13 nt, Homo sapiens
ccaaagacuacac

SEQ ID NO: 1404215 - RNA, 15 nt, Homo sapiens
ccaaagugcugggau

SEQ ID NO: 1404216 - RNA, 16 nt, Homo sapiens
ccaaccugaagacacc

SEQ ID NO: 1404217 - RNA, 14 nt, Homo sapiens
ccaagaugagcugc

SEQ ID NO: 1404218 - RNA, 21 nt, Homo sapiens
ccaauaaaccuuccuucuuaa

SEQ ID NO: 1404219 - RNA, 21 nt, Homo sapiens
ccaauauuuaccagaccacaa

SEQ ID NO: 1404220 - RNA, 18 nt, Homo sapiens
ccaaugcacacacacaga

SEQ ID NO: 1404221 - RNA, 20 nt, Homo sapiens
ccaaugcgcacacacaccga

SEQ ID NO: 1404222 - RNA, 11 nt, Homo sapiens
ccaauuccuca

SEQ ID NO: 1404223 - RNA, 21 nt, Homo sapiens
ccacaaaugggaaaaccagac

SEQ ID NO: 1404224 - RNA, 16 nt, Homo sapiens
ccacaaccgaccagau

SEQ ID NO: 1404225 - RNA, 18 nt, Homo sapiens
ccacaaccgaccagaugc

SEQ ID NO: 1404226 - RNA, 16 nt, Homo sapiens
ccacacggaggcaucu

SEQ ID NO: 1404227 - RNA, 15 nt, Homo sapiens
ccaccaucaccagac

SEQ ID NO: 1404228 - RNA, 17 nt, Homo sapiens
ccacucucccaccuccu

SEQ ID NO: 1404229 - RNA, 15 nt, Homo sapiens
ccacucuuugcuaca

SEQ ID NO: 1404230 - RNA, 19 nt, Homo sapiens
ccacugugaagagaaccau

SEQ ID NO: 1404231 - RNA, 21 nt, Homo sapiens
ccacuuuccccgugggccaug

SEQ ID NO: 1404232 - RNA, 13 nt, Homo sapiens
ccagagagagcuc

SEQ ID NO: 1404233 - RNA, 17 nt, Homo sapiens
ccagagagagcucugca

SEQ ID NO: 1404234 - RNA, 18 nt, Homo sapiens
ccagaggucuggcccuau

SEQ ID NO: 1404235 - RNA, 17 nt, Homo sapiens
ccagaguuuacauucua

SEQ ID NO: 1404236 - RNA, 20 nt, Homo sapiens
ccagauugccccauugcuca

SEQ ID NO: 1404237 - RNA, 17 nt, Homo sapiens
ccagcuuuccucaucag

SEQ ID NO: 1404238 - RNA, 13 nt, Homo sapiens
ccaggacaucucu

SEQ ID NO: 1404239 - RNA, 14 nt, Homo sapiens
ccauaccaggguga

SEQ ID NO: 1404240 - RNA, 14 nt, Homo sapiens
ccauagcaccucca

SEQ ID NO: 1404241 - RNA, 14 nt, Homo sapiens
ccaucaccagacag

SEQ ID NO: 1404242 - RNA, 20 nt, Homo sapiens
ccaucagcaaauauuauucu

SEQ ID NO: 1404243 - RNA, 18 nt, Homo sapiens
ccaucuccucccaccagu

SEQ ID NO: 1404244 - RNA, 23 nt, Homo sapiens
ccaugagcuccuuaaggcucuuu

SEQ ID NO: 1404245 - RNA, 21 nt, Homo sapiens
ccauuggagucccugaaggac

SEQ ID NO: 1404246 - RNA, 14 nt, Homo sapiens
cccaacgaaaagca

SEQ ID NO: 1404247 - RNA, 17 nt, Homo sapiens
cccaaggcugaugcauu

SEQ ID NO: 1404248 - RNA, 18 nt, Homo sapiens
cccaaguagcugagauua

SEQ ID NO: 1404249 - RNA, 13 nt, Homo sapiens
cccacaguccuca

SEQ ID NO: 1404250 - RNA, 23 nt, Homo sapiens
cccacuaagcuuucuccuuugag

SEQ ID NO: 1404251 - RNA, 12 nt, Homo sapiens
cccagaaggcag

SEQ ID NO: 1404252 - RNA, 15 nt, Homo sapiens
cccagagagagcucu

SEQ ID NO: 1404253 - RNA, 21 nt, Homo sapiens
cccagauagcuggcugggugg

SEQ ID NO: 1404254 - RNA, 15 nt, Homo sapiens
cccagcagacuugag

SEQ ID NO: 1404255 - RNA, 24 nt, Homo sapiens
cccagccacaguggccaaagaggc

SEQ ID NO: 1404256 - RNA, 16 nt, Homo sapiens
cccagccugagugcac

SEQ ID NO: 1404257 - RNA, 19 nt, Homo sapiens
cccagccugccccagccuc

SEQ ID NO: 1404258 - RNA, 19 nt, Homo sapiens
cccagcuuugcugccugag

SEQ ID NO: 1404259 - RNA, 15 nt, Homo sapiens
ccccaaccaggcuaa

SEQ ID NO: 1404260 - RNA, 13 nt, Homo sapiens
ccccacaccccag

SEQ ID NO: 1404261 - RNA, 20 nt, Homo sapiens
ccccacccaguuucuggaaa

SEQ ID NO: 1404262 - RNA, 15 nt, Homo sapiens
ccccagcccuuugca

SEQ ID NO: 1404263 - RNA, 12 nt, Homo sapiens
ccccauugcuca

SEQ ID NO: 1404264 - RNA, 18 nt, Homo sapiens
cccccaauugcugccaau

SEQ ID NO: 1404265 - RNA, 18 nt, Homo sapiens
ccccucaacaccucugca

SEQ ID NO: 1404266 - RNA, 17 nt, Homo sapiens
ccccugugccuugucac

SEQ ID NO: 1404267 - RNA, 22 nt, Homo sapiens
cccuaaauguggacaucaugaa

SEQ ID NO: 1404268 - RNA, 21 nt, Homo sapiens
cccuauugcugcuugaggcaa

SEQ ID NO: 1404269 - RNA, 23 nt, Homo sapiens
cccucaacaccucugcacaagcu

SEQ ID NO: 1404270 - RNA, 13 nt, Homo sapiens
cccucccaacaga

SEQ ID NO: 1404271 - RNA, 24 nt, Homo sapiens
cccugcccgaccccaucucauuca

SEQ ID NO: 1404272 - RNA, 18 nt, Homo sapiens
cccuggaaggacauccau

SEQ ID NO: 1404273 - RNA, 16 nt, Homo sapiens
cccugggcuuugucau

SEQ ID NO: 1404274 - RNA, 11 nt, Homo sapiens
ccgaugcacac

SEQ ID NO: 1404275 - RNA, 19 nt, Homo sapiens
ccgaugugcgcacacacag

SEQ ID NO: 1404276 - RNA, 13 nt, Homo sapiens
ccgcuugccauau

SEQ ID NO: 1404277 - RNA, 19 nt, Homo sapiens
ccgcuuucaugaacacagc

SEQ ID NO: 1404278 - RNA, 17 nt, Homo sapiens
ccggcugggugagcuga

SEQ ID NO: 1404279 - RNA, 18 nt, Homo sapiens
ccgggaacaaaaugaugu

SEQ ID NO: 1404280 - RNA, 20 nt, Homo sapiens
ccgggucaucuguaccucug

SEQ ID NO: 1404281 - RNA, 19 nt, Homo sapiens
ccuacccccugugccuugu

SEQ ID NO: 1404282 - RNA, 14 nt, Homo sapiens
ccuaggauuccucc

SEQ ID NO: 1404283 - RNA, 14 nt, Homo sapiens
ccucaguuccugca

SEQ ID NO: 1404284 - RNA, 14 nt, Homo sapiens
ccucauccaaaguu

SEQ ID NO: 1404285 - RNA, 16 nt, Homo sapiens
ccucaucuuucuucca

SEQ ID NO: 1404286 - RNA, 13 nt, Homo sapiens
ccuccaaaagccc

SEQ ID NO: 1404287 - RNA, 14 nt, Homo sapiens
ccuccaaaagcccu

SEQ ID NO: 1404288 - RNA, 14 nt, Homo sapiens
uacugaagugcagc

SEQ ID NO: 1404289 - RNA, 20 nt, Homo sapiens
uacugagacaugacuaggaa

SEQ ID NO: 1404290 - RNA, 15 nt, Homo sapiens
uacuuaaacuuccac

SEQ ID NO: 1404291 - RNA, 15 nt, Homo sapiens
uacuugaaaaccuca

SEQ ID NO: 1404292 - RNA, 12 nt, Homo sapiens
uagaaaaaccac

SEQ ID NO: 1404293 - RNA, 19 nt, Homo sapiens
uagaaaaaggacucugcuu

SEQ ID NO: 1404294 - RNA, 14 nt, Homo sapiens
uagaaauuccccac

SEQ ID NO: 1404295 - RNA, 13 nt, Homo sapiens
uagaacacccacu

SEQ ID NO: 1404296 - RNA, 19 nt, Homo sapiens
uagaauugccuuaaggcca

SEQ ID NO: 1404297 - RNA, 15 nt, Homo sapiens
uagagauaugcacac

SEQ ID NO: 1404298 - RNA, 23 nt, Homo sapiens
uagaggcaugaacacacauggau

SEQ ID NO: 1404299 - RNA, 16 nt, Homo sapiens
uagagucucuguuacu

SEQ ID NO: 1404300 - RNA, 23 nt, Homo sapiens
uagauuuuagacccuauugcugc

SEQ ID NO: 1404301 - RNA, 14 nt, Homo sapiens
uagauuuuugcucu

SEQ ID NO: 1404302 - RNA, 13 nt, Homo sapiens
uagcaaaugacau

SEQ ID NO: 1404303 - RNA, 20 nt, Homo sapiens
uagcaacaugcuucaugaaa

SEQ ID NO: 1404304 - RNA, 11 nt, Homo sapiens
uagcuaccugc

SEQ ID NO: 1404305 - RNA, 21 nt, Homo sapiens
uaggaacugcugggcuuggca

SEQ ID NO: 1404306 - RNA, 20 nt, Homo sapiens
uaggagaaacuuagaggaaa

SEQ ID NO: 1404307 - RNA, 21 nt, Homo sapiens
uaggcauuugcugaauacaga

SEQ ID NO: 1404308 - RNA, 22 nt, Homo sapiens
uaggccuggggacggcuuuuac

SEQ ID NO: 1404309 - RNA, 14 nt, Homo sapiens
uagugguuacccag

SEQ ID NO: 1404310 - RNA, 19 nt, Homo sapiens
uaguucuuaugagcuagca

SEQ ID NO: 1404311 - RNA, 12 nt, Homo sapiens
uauacacaugga

SEQ ID NO: 1404312 - RNA, 22 nt, Homo sapiens
uauaggaucauuuguuggaaug

SEQ ID NO: 1404313 - RNA, 19 nt, Homo sapiens
uauccacaaaugcuauuca

SEQ ID NO: 1404314 - RNA, 13 nt, Homo sapiens
uauccuguucucu

SEQ ID NO: 1404315 - RNA, 15 nt, Homo sapiens
uaucgcugccuugcc

SEQ ID NO: 1404316 - RNA, 23 nt, Homo sapiens
uaugaccucgcccuccacaaaug

SEQ ID NO: 1404317 - RNA, 20 nt, Homo sapiens
uaugagucucuaugaucuug

SEQ ID NO: 1404318 - RNA, 23 nt, Homo sapiens
uaugcacacacacggaugcacac

SEQ ID NO: 1404319 - RNA, 16 nt, Homo sapiens
uaugcugcucauccaa

SEQ ID NO: 1404320 - RNA, 14 nt, Homo sapiens
uaugguucucaggc

SEQ ID NO: 1404321 - RNA, 19 nt, Homo sapiens
uauguauauguauaucuau

SEQ ID NO: 1404322 - RNA, 14 nt, Homo sapiens
uauuaaaacagugu

SEQ ID NO: 1404323 - RNA, 17 nt, Homo sapiens
uauuaaauuagacuucc

SEQ ID NO: 1404324 - RNA, 16 nt, Homo sapiens
uauuaauuaaaccaga

SEQ ID NO: 1404325 - RNA, 18 nt, Homo sapiens
uauuagagcugccugugc

SEQ ID NO: 1404326 - RNA, 21 nt, Homo sapiens
uauuagagcugccugugccuu

SEQ ID NO: 1404327 - RNA, 18 nt, Homo sapiens
uauuuaccuucuaccucu

SEQ ID NO: 1404328 - RNA, 12 nt, Homo sapiens
ucaaaccuacca

SEQ ID NO: 1404329 - RNA, 20 nt, Homo sapiens
ucaaaccuaccacucaggaa

SEQ ID NO: 1404330 - RNA, 17 nt, Homo sapiens
ucaaagaaaacuuccaa

SEQ ID NO: 1404331 - RNA, 14 nt, Homo sapiens
ucaaagaacaaaca

SEQ ID NO: 1404332 - RNA, 14 nt, Homo sapiens
ucaaagcacuguuu

SEQ ID NO: 1404333 - RNA, 21 nt, Homo sapiens
ucaacauaggccugcucagcc

SEQ ID NO: 1404334 - RNA, 19 nt, Homo sapiens
ucaacuguuuuugucuaca

SEQ ID NO: 1404335 - RNA, 15 nt, Homo sapiens
ucaagaaacugagga

SEQ ID NO: 1404336 - RNA, 13 nt, Homo sapiens
ucacaaagaucau

SEQ ID NO: 1404337 - RNA, 20 nt, Homo sapiens
ucacagcaagucacuggcca

SEQ ID NO: 1404338 - RNA, 16 nt, Homo sapiens
ucacauuucuaugcca

SEQ ID NO: 1404339 - RNA, 14 nt, Homo sapiens
ucaccacuacauca

SEQ ID NO: 1404340 - RNA, 15 nt, Homo sapiens
ucaccagauuugcua

SEQ ID NO: 1404341 - RNA, 17 nt, Homo sapiens
ucaccuuccuaguucuu

SEQ ID NO: 1404342 - RNA, 13 nt, Homo sapiens
ucacucagaggaa

SEQ ID NO: 1404343 - RNA, 18 nt, Homo sapiens
ucacugcaagcucugccu

SEQ ID NO: 1404344 - RNA, 17 nt, Homo sapiens
ucacuggaccacugggc

SEQ ID NO: 1404345 - RNA, 17 nt, Homo sapiens
ucacuucagacaauuca

SEQ ID NO: 1404346 - RNA, 14 nt, Homo sapiens
ucagagaugaacau

SEQ ID NO: 1404347 - RNA, 18 nt, Homo sapiens
ucagagcagcacuggggu

SEQ ID NO: 1404348 - RNA, 14 nt, Homo sapiens
ucagauccuacccc

SEQ ID NO: 1404349 - RNA, 20 nt, Homo sapiens
ucagcacaggccauggugca

SEQ ID NO: 1404350 - RNA, 19 nt, Homo sapiens
ucagcacguguggccuguu

SEQ ID NO: 1404351 - RNA, 13 nt, Homo sapiens
ucagcacucaggu

SEQ ID NO: 1404352 - RNA, 15 nt, Homo sapiens
ucaggugccacugac

SEQ ID NO: 1404353 - RNA, 14 nt, Homo sapiens
ucagucuggugcuc

SEQ ID NO: 1404354 - RNA, 21 nt, Homo sapiens
ucagugcacacggaugcacag

SEQ ID NO: 1404355 - RNA, 12 nt, Homo sapiens
ucaucaggccau

SEQ ID NO: 1404356 - RNA, 22 nt, Homo sapiens
ucaucccaugggcgaccagggc

SEQ ID NO: 1404357 - RNA, 15 nt, Homo sapiens
ucaucuguaccucug

SEQ ID NO: 1404358 - RNA, 18 nt, Homo sapiens
ucaugucuaauugcuuaa

SEQ ID NO: 1404359 - RNA, 13 nt, Homo sapiens
ucauucaguacuu

SEQ ID NO: 1404360 - RNA, 13 nt, Homo sapiens
ucauuuaccauaa

SEQ ID NO: 1404361 - RNA, 21 nt, Homo sapiens
uccaaaguucccacuccuuca

SEQ ID NO: 1404362 - RNA, 19 nt, Homo sapiens
uccaacagcucaagucuuc

SEQ ID NO: 1404363 - RNA, 13 nt, Homo sapiens
uccaagaauuuga

SEQ ID NO: 1404364 - RNA, 17 nt, Homo sapiens
uccacaagagugaauuu

SEQ ID NO: 1404365 - RNA, 19 nt, Homo sapiens
uccacaccccaucuugcuc

SEQ ID NO: 1404366 - RNA, 14 nt, Homo sapiens
uccacagaguauaa

SEQ ID NO: 1404367 - RNA, 15 nt, Homo sapiens
uccagggacaaagag

SEQ ID NO: 1404368 - RNA, 15 nt, Homo sapiens
uccaguuuccaaagg

SEQ ID NO: 1404369 - RNA, 22 nt, Homo sapiens
uccauaauaaacuucuggugug

SEQ ID NO: 1404370 - RNA, 17 nt, Homo sapiens
uccauugguguugacau

SEQ ID NO: 1404371 - RNA, 18 nt, Homo sapiens
ucccacuaagcuuucucc

SEQ ID NO: 1404372 - RNA, 13 nt, Homo sapiens
ucccacuuggcau

SEQ ID NO: 1404373 - RNA, 18 nt, Homo sapiens
ucccagaggaugucacaa

SEQ ID NO: 1404374 - RNA, 15 nt, Homo sapiens
ucccaggaacugggc

SEQ ID NO: 1404375 - RNA, 13 nt, Homo sapiens
ucccagggccaug

SEQ ID NO: 1404376 - RNA, 10 nt, Homo sapiens
ucccaugagc

SEQ ID NO: 1404377 - RNA, 16 nt, Homo sapiens
uccccaacgaaaagca

SEQ ID NO: 1404378 - RNA, 17 nt, Homo sapiens
ucccccagcagccuggg

SEQ ID NO: 1404379 - RNA, 14 nt, Homo sapiens
ucccucauccauag

SEQ ID NO: 1404380 - RNA, 20 nt, Homo sapiens
ucccugaagagaagggcagg

SEQ ID NO: 1404381 - RNA, 16 nt, Homo sapiens
uccgcuuucaugaaca

SEQ ID NO: 1404382 - RNA, 20 nt, Homo sapiens
uccggccuccugucccucau

SEQ ID NO: 1404383 - RNA, 22 nt, Homo sapiens
uccucagagaauuucuaccauu

SEQ ID NO: 1404384 - RNA, 15 nt, Homo sapiens
uccucaguuccugca

SEQ ID NO: 1404385 - RNA, 16 nt, Homo sapiens
uccugaguagcaguga

SEQ ID NO: 1404386 - RNA, 12 nt, Homo sapiens
uccugcacucua

SEQ ID NO: 1404387 - RNA, 16 nt, Homo sapiens
uccugugaaaauauga

SEQ ID NO: 1404388 - RNA, 15 nt, Homo sapiens
uccuuaacuucaggg

SEQ ID NO: 1404389 - RNA, 18 nt, Homo sapiens
uccuuaccauugugauua

SEQ ID NO: 1404390 - RNA, 22 nt, Homo sapiens
uccuuagccuuugucccagaau

SEQ ID NO: 1404391 - RNA, 11 nt, Homo sapiens
uccuugcaaau

SEQ ID NO: 1404392 - RNA, 21 nt, Homo sapiens
uccuugucguaggaaaaccau

SEQ ID NO: 1404393 - RNA, 20 nt, Homo sapiens
uccuuugaagaaaaagacac

SEQ ID NO: 1404394 - RNA, 22 nt, Homo sapiens
uccuuuggccauuccaacagcu

SEQ ID NO: 1404395 - RNA, 18 nt, Homo sapiens
ucgacguuugacuagcca

SEQ ID NO: 1404396 - RNA, 13 nt, Homo sapiens
ucgauauaugacu

SEQ ID NO: 1404397 - RNA, 15 nt, Homo sapiens
ugcuguauccaucca

SEQ ID NO: 1404398 - RNA, 20 nt, Homo sapiens
uucucuuuuccuuugguccu

SEQ ID NO: 1404399 - RNA, 13 nt, Homo sapiens
acagagacagaaa

SEQ ID NO: 1404400 - RNA, 19 nt, Homo sapiens
acagagauaugcacacacc

SEQ ID NO: 1404401 - RNA, 18 nt, Homo sapiens
acagaggaagagcaggca

SEQ ID NO: 1404402 - RNA, 19 nt, Homo sapiens
acagaguugguguucauaa

SEQ ID NO: 1404403 - RNA, 14 nt, Homo sapiens
acagauacuccucc

SEQ ID NO: 1404404 - RNA, 12 nt, Homo sapiens
acagauaugcac

SEQ ID NO: 1404405 - RNA, 16 nt, Homo sapiens
acagaugauacuucca

SEQ ID NO: 1404406 - RNA, 12 nt, Homo sapiens
acagaugcacac

SEQ ID NO: 1404407 - RNA, 22 nt, Homo sapiens
acagaugccuucccuuguagca

SEQ ID NO: 1404408 - RNA, 19 nt, Homo sapiens
acagcaagacuccgucuca

SEQ ID NO: 1404409 - RNA, 21 nt, Homo sapiens
acagcucaagucuucccugau

SEQ ID NO: 1404410 - RNA, 19 nt, Homo sapiens
acaggucuugcccaaaguc

SEQ ID NO: 1404411 - RNA, 19 nt, Homo sapiens
acaguaugucuacuccuca

SEQ ID NO: 1404412 - RNA, 18 nt, Homo sapiens
acaguccucacagccucu

SEQ ID NO: 1404413 - RNA, 16 nt, Homo sapiens
acaguggccaaagagg

SEQ ID NO: 1404414 - RNA, 16 nt, Homo sapiens
acaguguuuccugagu

SEQ ID NO: 1404415 - RNA, 17 nt, Homo sapiens
acaguguuuccugagua

SEQ ID NO: 1404416 - RNA, 22 nt, Homo sapiens
acaguugaaaaacagcugaggg

SEQ ID NO: 1404417 - RNA, 15 nt, Homo sapiens
acauacauccaacau

SEQ ID NO: 1404418 - RNA, 22 nt, Homo sapiens
acaucacuugagacaaaucuau

SEQ ID NO: 1404419 - RNA, 14 nt, Homo sapiens
acaucagugcacac

SEQ ID NO: 1404420 - RNA, 17 nt, Homo sapiens
acaucuacaaucaggag

SEQ ID NO: 1404421 - RNA, 17 nt, Homo sapiens
acauugucaaguggaaa

SEQ ID NO: 1404422 - RNA, 18 nt, Homo sapiens
acauuuauccaagaccug

SEQ ID NO: 1404423 - RNA, 17 nt, Homo sapiens
acauuucuaugccaaac

SEQ ID NO: 1404424 - RNA, 19 nt, Homo sapiens
accaaaugcuuuuccucaa

SEQ ID NO: 1404425 - RNA, 17 nt, Homo sapiens
accaaggaacaggaaac

SEQ ID NO: 1404426 - RNA, 13 nt, Homo sapiens
accaauguucucu

SEQ ID NO: 1404427 - RNA, 13 nt, Homo sapiens
accaauuccucau

SEQ ID NO: 1404428 - RNA, 22 nt, Homo sapiens
acuuuguuuagcccaaaaccaa

SEQ ID NO: 1404429 - RNA, 15 nt, Homo sapiens
acuuuuaaaacuaua

SEQ ID NO: 1404430 - RNA, 20 nt, Homo sapiens
acuuuuugaaaaaaguauag

SEQ ID NO: 1404431 - RNA, 20 nt, Homo sapiens
agaaaaaggacucugcuuca

SEQ ID NO: 1404432 - RNA, 19 nt, Homo sapiens
agaaaagcaguggcuccau

SEQ ID NO: 1404433 - RNA, 18 nt, Homo sapiens
agaaacuguuacuguccu

SEQ ID NO: 1404434 - RNA, 15 nt, Homo sapiens
agaaagcauaguuau

SEQ ID NO: 1404435 - RNA, 22 nt, Homo sapiens
agaaagguaaacaaacaaauaa

SEQ ID NO: 1404436 - RNA, 13 nt, Homo sapiens
agaaccucuccau

SEQ ID NO: 1404437 - RNA, 15 nt, Homo sapiens
agaaggcuaugggga

SEQ ID NO: 1404438 - RNA, 16 nt, Homo sapiens
agaauaaaauacucuu

SEQ ID NO: 1404439 - RNA, 15 nt, Homo sapiens
agaaugaaauacucu

SEQ ID NO: 1404440 - RNA, 14 nt, Homo sapiens
agacacagcaagac

SEQ ID NO: 1404441 - RNA, 16 nt, Homo sapiens
agacagagacagagag

SEQ ID NO: 1404442 - RNA, 17 nt, Homo sapiens
agaccauugucuuccaa

SEQ ID NO: 1404443 - RNA, 22 nt, Homo sapiens
agaccauugucuuccaacccca

SEQ ID NO: 1404444 - RNA, 13 nt, Homo sapiens
agacccuguucua

SEQ ID NO: 1404445 - RNA, 19 nt, Homo sapiens
agacccuguucuaacucuu

SEQ ID NO: 1404446 - RNA, 21 nt, Homo sapiens
agacgggcccuggugguggcu

SEQ ID NO: 1404447 - RNA, 23 nt, Homo sapiens
agagacgggcccuggugguggcu

SEQ ID NO: 1404448 - RNA, 14 nt, Homo sapiens
agagagugcuauug

SEQ ID NO: 1404449 - RNA, 16 nt, Homo sapiens
agagauggccugagaa

SEQ ID NO: 1404450 - RNA, 19 nt, Homo sapiens
agagcaagacucugucuca

SEQ ID NO: 1404451 - RNA, 12 nt, Homo sapiens
agagcagcacug

SEQ ID NO: 1404452 - RNA, 13 nt, Homo sapiens
agaggaugucaca

SEQ ID NO: 1404453 - RNA, 17 nt, Homo sapiens
agaggaugucacaaaga

SEQ ID NO: 1404454 - RNA, 22 nt, Homo sapiens
agaggcuauuauuuucacugua

SEQ ID NO: 1404455 - RNA, 17 nt, Homo sapiens
agaggguguccugcacc

SEQ ID NO: 1404456 - RNA, 22 nt, Homo sapiens
agagguggagugucacaucucu

SEQ ID NO: 1404457 - RNA, 18 nt, Homo sapiens
cacuuauccuguucucug

SEQ ID NO: 1404458 - RNA, 16 nt, Homo sapiens
cagaaaacauaugcau

SEQ ID NO: 1404459 - RNA, 17 nt, Homo sapiens
cagaaccccuacaugaa

SEQ ID NO: 1404460 - RNA, 22 nt, Homo sapiens
cagaagacccgcucuccaucuu

SEQ ID NO: 1404461 - RNA, 15 nt, Homo sapiens
cagacaaagugacau

SEQ ID NO: 1404462 - RNA, 17 nt, Homo sapiens
cagaccauugucuucca

SEQ ID NO: 1404463 - RNA, 18 nt, Homo sapiens
cagaccauugucuuccaa

SEQ ID NO: 1404464 - RNA, 13 nt, Homo sapiens
cagacuucagcug

SEQ ID NO: 1404465 - RNA, 16 nt, Homo sapiens
cagacuucccacggcu

SEQ ID NO: 1404466 - RNA, 21 nt, Homo sapiens
cagagacugggaugggaacac

SEQ ID NO: 1404467 - RNA, 14 nt, Homo sapiens
cagagauaugcaca

SEQ ID NO: 1404468 - RNA, 18 nt, Homo sapiens
cagagaugaacaucuaac

SEQ ID NO: 1404469 - RNA, 13 nt, Homo sapiens
cagagauguuaaa

SEQ ID NO: 1404470 - RNA, 13 nt, Homo sapiens
cagagcaagugag

SEQ ID NO: 1404471 - RNA, 15 nt, Homo sapiens
cagagccacuaccuu

SEQ ID NO: 1404472 - RNA, 16 nt, Homo sapiens
cagagucccugccugg

SEQ ID NO: 1404473 - RNA, 12 nt, Homo sapiens
cagauaugcaca

SEQ ID NO: 1404474 - RNA, 13 nt, Homo sapiens
cagauaugcacac

SEQ ID NO: 1404475 - RNA, 19 nt, Homo sapiens
cagauauuaaauaacagug

SEQ ID NO: 1404476 - RNA, 11 nt, Homo sapiens
cagaugcacac

SEQ ID NO: 1404477 - RNA, 17 nt, Homo sapiens
cagauggucacacagag

SEQ ID NO: 1404478 - RNA, 19 nt, Homo sapiens
cagauuuacugucccagga

SEQ ID NO: 1404479 - RNA, 16 nt, Homo sapiens
cagcaaggggacaucu

SEQ ID NO: 1404480 - RNA, 23 nt, Homo sapiens
cagcacguguggccuguucuucu

SEQ ID NO: 1404481 - RNA, 20 nt, Homo sapiens
cagcacuggaagccagagaa

SEQ ID NO: 1404482 - RNA, 11 nt, Homo sapiens
cagcaucaggg

SEQ ID NO: 1404483 - RNA, 13 nt, Homo sapiens
cagcauuacagaa

SEQ ID NO: 1404484 - RNA, 21 nt, Homo sapiens
cagccacaguggccaaagagg

SEQ ID NO: 1404485 - RNA, 16 nt, Homo sapiens
cagcccaggacucuaa

SEQ ID NO: 1404486 - RNA, 16 nt, Homo sapiens
cagccucuccacucau

SEQ ID NO: 1404487 - RNA, 22 nt, Homo sapiens
cagccucugaaaaccaauguuc

SEQ ID NO: 1404488 - RNA, 18 nt, Homo sapiens
cagccugggcaaugugau

SEQ ID NO: 1404489 - RNA, 19 nt, Homo sapiens
cagccugggugacagagca

SEQ ID NO: 1404490 - RNA, 15 nt, Homo sapiens
cagcuccacaguguu

SEQ ID NO: 1404491 - RNA, 19 nt, Homo sapiens
cagcuuugcuaccaaagca

SEQ ID NO: 1404492 - RNA, 12 nt, Homo sapiens
caggacaugugc

SEQ ID NO: 1404493 - RNA, 15 nt, Homo sapiens
caggacaugugcucu

SEQ ID NO: 1404494 - RNA, 18 nt, Homo sapiens
caggagagcuucccccaa

SEQ ID NO: 1404495 - RNA, 21 nt, Homo sapiens
caggagcugcggccacucuac

SEQ ID NO: 1404496 - RNA, 20 nt, Homo sapiens
caggaggguugggcgugcua

SEQ ID NO: 1404497 - RNA, 17 nt, Homo sapiens
caggaguaaguuucuca

SEQ ID NO: 1404498 - RNA, 13 nt, Homo sapiens
caggagucccugc

SEQ ID NO: 1404499 - RNA, 14 nt, Homo sapiens
caggcaacgcacaa

SEQ ID NO: 1404500 - RNA, 20 nt, Homo sapiens
caggccauugucccugaaga

SEQ ID NO: 1404501 - RNA, 14 nt, Homo sapiens
caggcccaagagau

SEQ ID NO: 1404502 - RNA, 18 nt, Homo sapiens
caggcgcacaccaccacg

SEQ ID NO: 1404503 - RNA, 23 nt, Homo sapiens
caggcuggguugucacugagacu

SEQ ID NO: 1404504 - RNA, 20 nt, Homo sapiens
cagggauucuuccugcuuag

SEQ ID NO: 1404505 - RNA, 19 nt, Homo sapiens
cagggcugaggccucucau

SEQ ID NO: 1404506 - RNA, 15 nt, Homo sapiens
caggggaccacaccu

SEQ ID NO: 1404507 - RNA, 20 nt, Homo sapiens
cagggggugugucugcucag

SEQ ID NO: 1404508 - RNA, 17 nt, Homo sapiens
caggguguuaaggcagu

SEQ ID NO: 1404509 - RNA, 22 nt, Homo sapiens
caggguguuaaggcagugacuu

SEQ ID NO: 1404510 - RNA, 21 nt, Homo sapiens
caggguuagcucacgugucuu

SEQ ID NO: 1404511 - RNA, 22 nt, Homo sapiens
caggguuugcuguuugcgugaa

SEQ ID NO: 1404512 - RNA, 19 nt, Homo sapiens
cagguacuuccucagucug

SEQ ID NO: 1404513 - RNA, 21 nt, Homo sapiens
cagguguucuucauuaccuca

SEQ ID NO: 1404514 - RNA, 22 nt, Homo sapiens
caguaaagcaggaagccuccaa

SEQ ID NO: 1404515 - RNA, 20 nt, Homo sapiens
caguagaggcaugaacacac

SEQ ID NO: 1404516 - RNA, 19 nt, Homo sapiens
cagugcacacggaugcaca

SEQ ID NO: 1404517 - RNA, 16 nt, Homo sapiens
cagugcccucauuuua

SEQ ID NO: 1404518 - RNA, 13 nt, Homo sapiens
caguggaugcugc

SEQ ID NO: 1404519 - RNA, 23 nt, Homo sapiens
caguguauuuggaaaauguuaug

SEQ ID NO: 1404520 - RNA, 15 nt, Homo sapiens
cagugucagcacuca

SEQ ID NO: 1404521 - RNA, 14 nt, Homo sapiens
cagugugacaucua

SEQ ID NO: 1404522 - RNA, 13 nt, Homo sapiens
caguguugccaga

SEQ ID NO: 1404523 - RNA, 21 nt, Homo sapiens
caguguuuccugaguagcagu

SEQ ID NO: 1404524 - RNA, 19 nt, Homo sapiens
cauaaaguaugccuuccug

SEQ ID NO: 1404525 - RNA, 23 nt, Homo sapiens
cauaaauuuaugguucucaggcc

SEQ ID NO: 1404526 - RNA, 16 nt, Homo sapiens
cauacaguuugcacuu

SEQ ID NO: 1404527 - RNA, 21 nt, Homo sapiens
cauagaaauuacacccaaaga

SEQ ID NO: 1404528 - RNA, 22 nt, Homo sapiens
cauagagauaugcacacacaga

SEQ ID NO: 1404529 - RNA, 20 nt, Homo sapiens
cauagaugagaaaacugaga

SEQ ID NO: 1404530 - RNA, 14 nt, Homo sapiens
cauagcuggucuua

SEQ ID NO: 1404531 - RNA, 23 nt, Homo sapiens
caucagugcacacggaugcacag

SEQ ID NO: 1404532 - RNA, 21 nt, Homo sapiens
cauccagagucccugccugga

SEQ ID NO: 1404533 - RNA, 20 nt, Homo sapiens
cauccccuuuggcuaccuga

SEQ ID NO: 1404534 - RNA, 16 nt, Homo sapiens
caucucaagcaaguuu

SEQ ID NO: 1404535 - RNA, 23 nt, Homo sapiens
caucucccugaccuucuccaggg

SEQ ID NO: 1404536 - RNA, 20 nt, Homo sapiens
caugaagcuggaagcacugc

SEQ ID NO: 1404537 - RNA, 21 nt, Homo sapiens
caugcuggcucccagggccau

SEQ ID NO: 1404538 - RNA, 22 nt, Homo sapiens
caugcuggcucccagggccaug

SEQ ID NO: 1404539 - RNA, 14 nt, Homo sapiens
caugcuucaugaaa

SEQ ID NO: 1404540 - RNA, 21 nt, Homo sapiens
cauggagagagacucaaagag

SEQ ID NO: 1404541 - RNA, 18 nt, Homo sapiens
cauggaugagcacacaca

SEQ ID NO: 1404542 - RNA, 12 nt, Homo sapiens
cauggaugcaca

SEQ ID NO: 1404543 - RNA, 13 nt, Homo sapiens
cauggaugcacac

SEQ ID NO: 1404544 - RNA, 19 nt, Homo sapiens
caugguaauuaugugauau

SEQ ID NO: 1404545 - RNA, 20 nt, Homo sapiens
cauguaaaaaauguaaaaug

SEQ ID NO: 1404546 - RNA, 21 nt, Homo sapiens
cauguaucacucacugccaaa

SEQ ID NO: 1404547 - RNA, 22 nt, Homo sapiens
cauguguugccuggaagcacau

SEQ ID NO: 1404548 - RNA, 20 nt, Homo sapiens
cauuagugaauuacacucaa

SEQ ID NO: 1404549 - RNA, 20 nt, Homo sapiens
cauuaucagccugugccacg

SEQ ID NO: 1404550 - RNA, 15 nt, Homo sapiens
cauucagcagucagu

SEQ ID NO: 1404551 - RNA, 14 nt, Homo sapiens
cauucuagugcaga

SEQ ID NO: 1404552 - RNA, 15 nt, Homo sapiens
cauucuccugccuca

SEQ ID NO: 1404553 - RNA, 13 nt, Homo sapiens
cauugcacuccag

SEQ ID NO: 1404554 - RNA, 14 nt, Homo sapiens
cauugcucacacua

SEQ ID NO: 1404555 - RNA, 22 nt, Homo sapiens
cauuucauuaagguuccaguua

SEQ ID NO: 1404556 - RNA, 16 nt, Homo sapiens
cauuucugagaucaaa

SEQ ID NO: 1404557 - RNA, 14 nt, Homo sapiens
cauuuguuccauga

SEQ ID NO: 1404558 - RNA, 18 nt, Homo sapiens
ccaaagacuacacuguug

SEQ ID NO: 1404559 - RNA, 17 nt, Homo sapiens
ccaacagagcugggcua

SEQ ID NO: 1404560 - RNA, 16 nt, Homo sapiens
ccaacgaaaagcacau

SEQ ID NO: 1404561 - RNA, 12 nt, Homo sapiens
ccaaggugggag

SEQ ID NO: 1404562 - RNA, 17 nt, Homo sapiens
ccaauauuuaccagacc

SEQ ID NO: 1404563 - RNA, 16 nt, Homo sapiens
ccacacccucacugcu

SEQ ID NO: 1404564 - RNA, 21 nt, Homo sapiens
ccacagaaaggccacucagga

SEQ ID NO: 1404565 - RNA, 22 nt, Homo sapiens
cuagaacacccacuggccaguc

SEQ ID NO: 1404566 - RNA, 16 nt, Homo sapiens
cuagagugcaguggcg

SEQ ID NO: 1404567 - RNA, 20 nt, Homo sapiens
cuagcacuuugggaggccaa

SEQ ID NO: 1404568 - RNA, 18 nt, Homo sapiens
cuagccaucucaagcaag

SEQ ID NO: 1404569 - RNA, 18 nt, Homo sapiens
cuagcccucucacauuua

SEQ ID NO: 1404570 - RNA, 15 nt, Homo sapiens
cuaggguucaugucu

SEQ ID NO: 1404571 - RNA, 17 nt, Homo sapiens
cuaguucugccaggaga

SEQ ID NO: 1404572 - RNA, 21 nt, Homo sapiens
cuauauuuauuuauguaggau

SEQ ID NO: 1404573 - RNA, 19 nt, Homo sapiens
cuaugaucuggacuuccua

SEQ ID NO: 1404574 - RNA, 16 nt, Homo sapiens
cuaugggacugcagug

SEQ ID NO: 1404575 - RNA, 23 nt, Homo sapiens
cuauuagagcugccugugccuuu

SEQ ID NO: 1404576 - RNA, 22 nt, Homo sapiens
cuauuccauggcuaacuggcga

SEQ ID NO: 1404577 - RNA, 19 nt, Homo sapiens
cucaaaccuccaaaagccc

SEQ ID NO: 1404578 - RNA, 20 nt, Homo sapiens
cucaaaccuccaaaagcccu

SEQ ID NO: 1404579 - RNA, 18 nt, Homo sapiens
cucacaaaccaugcaaau

SEQ ID NO: 1404580 - RNA, 22 nt, Homo sapiens
cucacacggacacucaaaagcu

SEQ ID NO: 1404581 - RNA, 12 nt, Homo sapiens
cucacugccaaa

SEQ ID NO: 1404582 - RNA, 23 nt, Homo sapiens
cucagacagaaccccuacaugaa

SEQ ID NO: 1404583 - RNA, 23 nt, Homo sapiens
cucagagaauuucuaccauuuca

SEQ ID NO: 1404584 - RNA, 18 nt, Homo sapiens
cucagaggaugaggucaa

SEQ ID NO: 1404585 - RNA, 15 nt, Homo sapiens
cucagaucauuauca

SEQ ID NO: 1404586 - RNA, 23 nt, Homo sapiens
cucagaucauuaucagccugugc

SEQ ID NO: 1404587 - RNA, 13 nt, Homo sapiens
cucagcaacaagg

SEQ ID NO: 1404588 - RNA, 16 nt, Homo sapiens
cucaggaaccgaggca

SEQ ID NO: 1404589 - RNA, 16 nt, Homo sapiens
cucaguuccugcagca

SEQ ID NO: 1404590 - RNA, 17 nt, Homo sapiens
cucaguuccugcagcag

SEQ ID NO: 1404591 - RNA, 23 nt, Homo sapiens
cucauagggugcucugaggucaa

SEQ ID NO: 1404592 - RNA, 23 nt, Homo sapiens
cucaucaggccauugucccugaa

SEQ ID NO: 1404593 - RNA, 12 nt, Homo sapiens
cucaucccaugg

SEQ ID NO: 1404594 - RNA, 14 nt, Homo sapiens
cucauuuuaacuca

SEQ ID NO: 1404595 - RNA, 12 nt, Homo sapiens
cuccagaccacc

SEQ ID NO: 1404596 - RNA, 17 nt, Homo sapiens
cuccagcgguccaaagu

SEQ ID NO: 1404597 - RNA, 21 nt, Homo sapiens
cuccagcuguuaccugagaua

SEQ ID NO: 1404598 - RNA, 12 nt, Homo sapiens
cucccacagaac

SEQ ID NO: 1404599 - RNA, 18 nt, Homo sapiens
cucccaccagagacuggg

SEQ ID NO: 1404600 - RNA, 13 nt, Homo sapiens
cucccagggccau

SEQ ID NO: 1404601 - RNA, 15 nt, Homo sapiens
cucccagggccauga

SEQ ID NO: 1404602 - RNA, 18 nt, Homo sapiens
cuccccacaguccucaca

SEQ ID NO: 1404603 - RNA, 15 nt, Homo sapiens
cuccccucccagucc

SEQ ID NO: 1404604 - RNA, 18 nt, Homo sapiens
cuccccuuguacucuugc

SEQ ID NO: 1404605 - RNA, 15 nt, Homo sapiens
cuccucgagauccca

SEQ ID NO: 1404606 - RNA, 13 nt, Homo sapiens
cuccugcagggau

SEQ ID NO: 1404607 - RNA, 12 nt, Homo sapiens
cuccugccugag

SEQ ID NO: 1404608 - RNA, 18 nt, Homo sapiens
cuccugucccucauccau

SEQ ID NO: 1404609 - RNA, 21 nt, Homo sapiens
cuccuuagacugaucaagcca

SEQ ID NO: 1404610 - RNA, 23 nt, Homo sapiens
cuccuuuaccccucauccaaagu

SEQ ID NO: 1404611 - RNA, 17 nt, Homo sapiens
cuccuuuggccauucca

SEQ ID NO: 1404612 - RNA, 18 nt, Homo sapiens
cuccuuuuucuaccuuuu

SEQ ID NO: 1404613 - RNA, 23 nt, Homo sapiens
cucgaacuccugaccucgugauu

SEQ ID NO: 1404614 - RNA, 12 nt, Homo sapiens
cucgagugaauu

SEQ ID NO: 1404615 - RNA, 12 nt, Homo sapiens
cucuacaaaaag

SEQ ID NO: 1404616 - RNA, 14 nt, Homo sapiens
cucuacaaaaagca

SEQ ID NO: 1404617 - RNA, 22 nt, Homo sapiens
cucuacccucuuagaaaaacca

SEQ ID NO: 1404618 - RNA, 14 nt, Homo sapiens
cucuacucuaggga

SEQ ID NO: 1404619 - RNA, 20 nt, Homo sapiens
cucuacucuggagguuuguu

SEQ ID NO: 1404620 - RNA, 14 nt, Homo sapiens
cucuagauugagag

SEQ ID NO: 1404621 - RNA, 17 nt, Homo sapiens
cucuaugaucuuggcac

SEQ ID NO: 1404622 - RNA, 12 nt, Homo sapiens
cucuauggauua

SEQ ID NO: 1404623 - RNA, 19 nt, Homo sapiens
cucuccuuuggccauucca

SEQ ID NO: 1404624 - RNA, 13 nt, Homo sapiens
cucugaaaaccaa

SEQ ID NO: 1404625 - RNA, 14 nt, Homo sapiens
cucugaauguccca

SEQ ID NO: 1404626 - RNA, 22 nt, Homo sapiens
cucugcacaagcugcacccuca

SEQ ID NO: 1404627 - RNA, 20 nt, Homo sapiens
cucugcuucaguccacagua

SEQ ID NO: 1404628 - RNA, 16 nt, Homo sapiens
cucuuaaguugaucua

SEQ ID NO: 1404629 - RNA, 21 nt, Homo sapiens
cucuugagccugggaggucaa

SEQ ID NO: 1404630 - RNA, 12 nt, Homo sapiens
cucuuuaccucc

SEQ ID NO: 1404631 - RNA, 19 nt, Homo sapiens
cucuuuuaggaggcacaac

SEQ ID NO: 1404632 - RNA, 23 nt, Homo sapiens
cugaaaaaugguaauuguugcua

SEQ ID NO: 1404633 - RNA, 19 nt, Homo sapiens
cugaaaaccaauguucucu

SEQ ID NO: 1404634 - RNA, 20 nt, Homo sapiens
cugaaagaugggcaaaagac

SEQ ID NO: 1404635 - RNA, 16 nt, Homo sapiens
cugaaauaacauggcc

SEQ ID NO: 1404636 - RNA, 17 nt, Homo sapiens
cugaaauaacauggccu

SEQ ID NO: 1404637 - RNA, 21 nt, Homo sapiens
cugaagaagaucccagaggau

SEQ ID NO: 1404638 - RNA, 18 nt, Homo sapiens
cugaagugcagcucagga

SEQ ID NO: 1404639 - RNA, 17 nt, Homo sapiens
cugacagaaaugcaauc

SEQ ID NO: 1404640 - RNA, 20 nt, Homo sapiens
cugaccuucuccagggacag

SEQ ID NO: 1404641 - RNA, 22 nt, Homo sapiens
cugagagaggccauucuuuccc

SEQ ID NO: 1404642 - RNA, 20 nt, Homo sapiens
cugagauacugaagugcagc

SEQ ID NO: 1404643 - RNA, 17 nt, Homo sapiens
uccgcgcaggugccaac

SEQ ID NO: 1404644 - RNA, 15 nt, Homo sapiens
uccgguggaaggccu

SEQ ID NO: 1404645 - RNA, 18 nt, Homo sapiens
uccguccaggagccugug

SEQ ID NO: 1404646 - RNA, 12 nt, Homo sapiens
uccuaacuuauu

SEQ ID NO: 1404647 - RNA, 16 nt, Homo sapiens
uccuaccaaccucuga

SEQ ID NO: 1404648 - RNA, 18 nt, Homo sapiens
uccuacucaacaaaagga

SEQ ID NO: 1404649 - RNA, 14 nt, Homo sapiens
uccucaaagggaga

SEQ ID NO: 1404650 - RNA, 20 nt, Homo sapiens
uccucacagcaucucuauga

SEQ ID NO: 1404651 - RNA, 17 nt, Homo sapiens
uccucagaucauuauca

SEQ ID NO: 1404652 - RNA, 18 nt, Homo sapiens
uccucgagaucccaacac

SEQ ID NO: 1404653 - RNA, 22 nt, Homo sapiens
uccugaggaagagggacuguuc

SEQ ID NO: 1404654 - RNA, 17 nt, Homo sapiens
uccugaguagcagugau

SEQ ID NO: 1404655 - RNA, 13 nt, Homo sapiens
uccugcugccuaa

SEQ ID NO: 1404656 - RNA, 21 nt, Homo sapiens
uccuggcccucuucuuauuca

SEQ ID NO: 1404657 - RNA, 13 nt, Homo sapiens
uccugucccucau

SEQ ID NO: 1404658 - RNA, 16 nt, Homo sapiens
uccugucccucaucca

SEQ ID NO: 1404659 - RNA, 17 nt, Homo sapiens
uccuuaaacuccuguga

SEQ ID NO: 1404660 - RNA, 19 nt, Homo sapiens
uccuuaccgugggcacuga

SEQ ID NO: 1404661 - RNA, 13 nt, Homo sapiens
uccuucgcuggaa

SEQ ID NO: 1404662 - RNA, 17 nt, Homo sapiens
uccuucuuaacucugca

SEQ ID NO: 1404663 - RNA, 15 nt, Homo sapiens
uccuuggaaauugga

SEQ ID NO: 1404664 - RNA, 21 nt, Homo sapiens
uccuuuccccucccucaggcc

SEQ ID NO: 1404665 - RNA, 16 nt, Homo sapiens
uccuuuguguccauug

SEQ ID NO: 1404666 - RNA, 14 nt, Homo sapiens
ucgacguuugacua

SEQ ID NO: 1404667 - RNA, 21 nt, Homo sapiens
ucggauacccuggagcaagac

SEQ ID NO: 1404668 - RNA, 22 nt, Homo sapiens
ucgugauauccacaaaugcuau

SEQ ID NO: 1404669 - RNA, 13 nt, Homo sapiens
ucgugauuugccu

SEQ ID NO: 1404670 - RNA, 14 nt, Homo sapiens
ucuaaaacucucaa

SEQ ID NO: 1404671 - RNA, 20 nt, Homo sapiens
ucuaccucuuggcugccuug

SEQ ID NO: 1404672 - RNA, 17 nt, Homo sapiens
ucuacuccaugcacaua

SEQ ID NO: 1404673 - RNA, 18 nt, Homo sapiens
ucuacuggucuuguggaa

SEQ ID NO: 1404674 - RNA, 15 nt, Homo sapiens
ucuagaacacaggca

SEQ ID NO: 1404675 - RNA, 22 nt, Homo sapiens
ucuagacacugccacacagggu

SEQ ID NO: 1404676 - RNA, 22 nt, Homo sapiens
ucuagcaccaggacucagagga

SEQ ID NO: 1404677 - RNA, 23 nt, Homo sapiens
ucuaguugauugcgagaauuuuc

SEQ ID NO: 1404678 - RNA, 23 nt, Homo sapiens
ucuaugaccucgcccuccacaaa

SEQ ID NO: 1404679 - RNA, 14 nt, Homo sapiens
ucuaugaucuuggc

SEQ ID NO: 1404680 - RNA, 17 nt, Homo sapiens
ucucaaaccuccaaaag

SEQ ID NO: 1404681 - RNA, 18 nt, Homo sapiens
ucucaaguuaucagggua

SEQ ID NO: 1404682 - RNA, 16 nt, Homo sapiens
ucucaccuggacucca

SEQ ID NO: 1404683 - RNA, 15 nt, Homo sapiens
ucucacuaaaaugga

SEQ ID NO: 1404684 - RNA, 11 nt, Homo sapiens
ucucacugugu

SEQ ID NO: 1404685 - RNA, 17 nt, Homo sapiens
ucucagagcagcacugg

SEQ ID NO: 1404686 - RNA, 18 nt, Homo sapiens
ucucaggccugacucuca

SEQ ID NO: 1404687 - RNA, 18 nt, Homo sapiens
ucuccuuuggccauucca

SEQ ID NO: 1404688 - RNA, 23 nt, Homo sapiens
ucucuacaaacucccacuuguca

SEQ ID NO: 1404689 - RNA, 16 nt, Homo sapiens
ucucucgcaagggaag

SEQ ID NO: 1404690 - RNA, 16 nt, Homo sapiens
ucucucucucuacaaa

SEQ ID NO: 1404691 - RNA, 16 nt, Homo sapiens
ucucugugugcacaaa

SEQ ID NO: 1404692 - RNA, 19 nt, Homo sapiens
ucucuuuuaggaggcacaa

SEQ ID NO: 1404693 - RNA, 12 nt, Homo sapiens
ucugaaaaccaa

SEQ ID NO: 1404694 - RNA, 18 nt, Homo sapiens
ucugaccauuucaggggu

SEQ ID NO: 1404695 - RNA, 21 nt, Homo sapiens
ucugcucugguuagaaaaagg

SEQ ID NO: 1404696 - RNA, 15 nt, Homo sapiens
ucugcuucugcauuc

SEQ ID NO: 1404697 - RNA, 16 nt, Homo sapiens
ucuggaauacaugaaa

SEQ ID NO: 1404698 - RNA, 18 nt, Homo sapiens
ucuggcugaggauuucaa

SEQ ID NO: 1404699 - RNA, 13 nt, Homo sapiens
ucugucuggcuga

SEQ ID NO: 1404700 - RNA, 17 nt, Homo sapiens
ucuuagcugucugcuca

SEQ ID NO: 1404701 - RNA, 12 nt, Homo sapiens
ucuucauuaccu

SEQ ID NO: 1404702 - RNA, 22 nt, Homo sapiens
ucuucuauggguuggacaaccu

SEQ ID NO: 1404703 - RNA, 14 nt, Homo sapiens
ucuucucuacucua

SEQ ID NO: 1404704 - RNA, 22 nt, Homo sapiens
ucuucucuguuacaaaacgaga

SEQ ID NO: 1404705 - RNA, 21 nt, Homo sapiens
ucuucuuuuuuuaaacauuca

SEQ ID NO: 1404706 - RNA, 16 nt, Homo sapiens
ucuuggaauacuugaa

SEQ ID NO: 1404707 - RNA, 22 nt, Homo sapiens
ucuuguuguggaggcugaaaag

SEQ ID NO: 1404708 - RNA, 21 nt, Homo sapiens
ucuuuauuaaaacaguguauu

SEQ ID NO: 1404709 - RNA, 12 nt, Homo sapiens
ugaaaauguuca

SEQ ID NO: 1404710 - RNA, 18 nt, Homo sapiens
ugaaaauuaugagucucu

SEQ ID NO: 1404711 - RNA, 17 nt, Homo sapiens
ugaaacgucauguguuu

SEQ ID NO: 1404712 - RNA, 16 nt, Homo sapiens
ugaaagaaggagcaag

SEQ ID NO: 1404713 - RNA, 17 nt, Homo sapiens
ugaaagggaguauuaca

SEQ ID NO: 1404714 - RNA, 19 nt, Homo sapiens
ugaaaguccagcacuggaa

SEQ ID NO: 1404715 - RNA, 18 nt, Homo sapiens
ugaaauaacauggccuug

SEQ ID NO: 1404716 - RNA, 23 nt, Homo sapiens
ugaacacacauggaugcacacac

SEQ ID NO: 1404717 - RNA, 20 nt, Homo sapiens
ugaagacagauacuccucca

SEQ ID NO: 1404718 - RNA, 17 nt, Homo sapiens
ugaagcuggaagcacug

SEQ ID NO: 1404719 - RNA, 20 nt, Homo sapiens
ugaauaauacaguaucucag

SEQ ID NO: 1404720 - RNA, 15 nt, Homo sapiens
ugaauuucugaaaga

SEQ ID NO: 1404721 - RNA, 22 nt, Homo sapiens
aaaaacauggccuuugcuugaa

SEQ ID NO: 1404722 - RNA, 15 nt, Homo sapiens
aaaaaggacucugcu

SEQ ID NO: 1404723 - RNA, 14 nt, Homo sapiens
aaaaaguauaggau

SEQ ID NO: 1404724 - RNA, 15 nt, Homo sapiens
aaaaauauugcugaa

SEQ ID NO: 1404725 - RNA, 13 nt, Homo sapiens
aaaacacagguuu

SEQ ID NO: 1404726 - RNA, 11 nt, Homo sapiens
aaaacauaugc

SEQ ID NO: 1404727 - RNA, 17 nt, Homo sapiens
aaaacucucaagcagac

SEQ ID NO: 1404728 - RNA, 19 nt, Homo sapiens
aaaagagauggccugagaa

SEQ ID NO: 1404729 - RNA, 21 nt, Homo sapiens
aaaagauguugugucuugugu

SEQ ID NO: 1404730 - RNA, 21 nt, Homo sapiens
aaaagcuuuucuuuccuuuug

SEQ ID NO: 1404731 - RNA, 14 nt, Homo sapiens
aaaaguuaaacuac

SEQ ID NO: 1404732 - RNA, 13 nt, Homo sapiens
aaaauaaauuaca

SEQ ID NO: 1404733 - RNA, 22 nt, Homo sapiens
aaaauacucuuaaguugaucua

SEQ ID NO: 1404734 - RNA, 23 nt, Homo sapiens
aaaaugaagguggaacaagcaca

SEQ ID NO: 1404735 - RNA, 18 nt, Homo sapiens
aaaaugguaauuguugcu

SEQ ID NO: 1404736 - RNA, 15 nt, Homo sapiens
aaaauguuggaagag

SEQ ID NO: 1404737 - RNA, 17 nt, Homo sapiens
aaaauugggcaugccau

SEQ ID NO: 1404738 - RNA, 22 nt, Homo sapiens
aaacagagacaggcccaagaga

SEQ ID NO: 1404739 - RNA, 15 nt, Homo sapiens
aaacaggcucugaga

SEQ ID NO: 1404740 - RNA, 23 nt, Homo sapiens
aaacccaagugccuucagaggau

SEQ ID NO: 1404741 - RNA, 13 nt, Homo sapiens
aaacucaaaauau

SEQ ID NO: 1404742 - RNA, 23 nt, Homo sapiens
aaacucucaagcagacgugagug

SEQ ID NO: 1404743 - RNA, 17 nt, Homo sapiens
aaacuucuggugugaua

SEQ ID NO: 1404744 - RNA, 17 nt, Homo sapiens
aaagaaaauaccaagga

SEQ ID NO: 1404745 - RNA, 22 nt, Homo sapiens
aaagaaggaauucuaggcaucc

SEQ ID NO: 1404746 - RNA, 16 nt, Homo sapiens
aaagacuacacuguug

SEQ ID NO: 1404747 - RNA, 19 nt, Homo sapiens
aaagauaugcuaagcagua

SEQ ID NO: 1404748 - RNA, 18 nt, Homo sapiens
aaagaugugcucccacca

SEQ ID NO: 1404749 - RNA, 17 nt, Homo sapiens
aaagcucugaacaaaag

SEQ ID NO: 1404750 - RNA, 22 nt, Homo sapiens
aaaggacucugcuucaguccac

SEQ ID NO: 1404751 - RNA, 16 nt, Homo sapiens
aaagguugagauguaa

SEQ ID NO: 1404752 - RNA, 11 nt, Homo sapiens
aaaguauauau

SEQ ID NO: 1404753 - RNA, 22 nt, Homo sapiens
aaaguaugccuuccuguuuaaa

SEQ ID NO: 1404754 - RNA, 18 nt, Homo sapiens
aaaguucccacuccuuca

SEQ ID NO: 1404755 - RNA, 16 nt, Homo sapiens
aaauaauugauuucaa

SEQ ID NO: 1404756 - RNA, 20 nt, Homo sapiens
aaaugaugucaugucagcuc

SEQ ID NO: 1404757 - RNA, 16 nt, Homo sapiens
aaaugggccauuccag

SEQ ID NO: 1404758 - RNA, 18 nt, Homo sapiens
aaauguagcgacugucaa

SEQ ID NO: 1404759 - RNA, 15 nt, Homo sapiens
aaauguuaugugcuc

SEQ ID NO: 1404760 - RNA, 16 nt, Homo sapiens
aaauugggcaugccau

SEQ ID NO: 1404761 - RNA, 16 nt, Homo sapiens
aaauuugcuauuccca

SEQ ID NO: 1404762 - RNA, 18 nt, Homo sapiens
aacaaacauccuugcaaa

SEQ ID NO: 1404763 - RNA, 12 nt, Homo sapiens
aacaagaucugc

SEQ ID NO: 1404764 - RNA, 13 nt, Homo sapiens
aacacacauggau

SEQ ID NO: 1404765 - RNA, 18 nt, Homo sapiens
aacacacauggaugcaca

SEQ ID NO: 1404766 - RNA, 22 nt, Homo sapiens
guguguaucgcugccuugccau

SEQ ID NO: 1404767 - RNA, 19 nt, Homo sapiens
gugugugggaguguguaau

SEQ ID NO: 1404768 - RNA, 23 nt, Homo sapiens
guguucuucauuaccucagugag

SEQ ID NO: 1404769 - RNA, 14 nt, Homo sapiens
guuacaaagacaug

SEQ ID NO: 1404770 - RNA, 14 nt, Homo sapiens
guuacugucuucag

SEQ ID NO: 1404771 - RNA, 19 nt, Homo sapiens
guuauagaaacugauauau

SEQ ID NO: 1404772 - RNA, 16 nt, Homo sapiens
guuauccccuccuuua

SEQ ID NO: 1404773 - RNA, 15 nt, Homo sapiens
guucccacuccuuca

SEQ ID NO: 1404774 - RNA, 21 nt, Homo sapiens
guuccugcagcagagccugga

SEQ ID NO: 1404775 - RNA, 15 nt, Homo sapiens
guucuagagugacag

SEQ ID NO: 1404776 - RNA, 17 nt, Homo sapiens
guucuccagauggagaa

SEQ ID NO: 1404777 - RNA, 16 nt, Homo sapiens
guugaauuucccacau

SEQ ID NO: 1404778 - RNA, 13 nt, Homo sapiens
guugguguucuca

SEQ ID NO: 1404779 - RNA, 16 nt, Homo sapiens
guuuaaaaaaaguaua

SEQ ID NO: 1404780 - RNA, 19 nt, Homo sapiens
guuuaaaaguccacuuuua

SEQ ID NO: 1404781 - RNA, 21 nt, Homo sapiens
guuuaaucaaugaucaucuca

SEQ ID NO: 1404782 - RNA, 14 nt, Homo sapiens
guuugacuagccau

SEQ ID NO: 1404783 - RNA, 20 nt, Homo sapiens
guuuugauaaaagauuuucc

SEQ ID NO: 1404784 - RNA, 19 nt, Homo sapiens
uaaaaauggccauuugcuu

SEQ ID NO: 1404785 - RNA, 18 nt, Homo sapiens
uaaaacccaagugccuua

SEQ ID NO: 1404786 - RNA, 22 nt, Homo sapiens
uaaaacucucaagcagacguga

SEQ ID NO: 1404787 - RNA, 20 nt, Homo sapiens
uaaaacugucuugugagcug

SEQ ID NO: 1404788 - RNA, 15 nt, Homo sapiens
uaaaaucuggcaaag

SEQ ID NO: 1404789 - RNA, 11 nt, Homo sapiens
uaaaaugcaga

SEQ ID NO: 1404790 - RNA, 15 nt, Homo sapiens
uaaacuacuuguaaa

SEQ ID NO: 1404791 - RNA, 12 nt, Homo sapiens
uaaacuccuuaa

SEQ ID NO: 1404792 - RNA, 18 nt, Homo sapiens
uaaacuucuggugugaua

SEQ ID NO: 1404793 - RNA, 19 nt, Homo sapiens
uaaacuucuggugugauac

SEQ ID NO: 1404794 - RNA, 17 nt, Homo sapiens
uaaagaaaaauaugaua

SEQ ID NO: 1404795 - RNA, 22 nt, Homo sapiens
uaaaggcuuuuggcagcaaagu

SEQ ID NO: 1404796 - RNA, 17 nt, Homo sapiens
uaaaggugcugcacugg

SEQ ID NO: 1404797 - RNA, 20 nt, Homo sapiens
uaaauagggaaaaaacaugu

SEQ ID NO: 1404798 - RNA, 21 nt, Homo sapiens
uaaauguagcgacugucaaca

SEQ ID NO: 1404799 - RNA, 12 nt, Homo sapiens
uaaaugugaaug

SEQ ID NO: 1404800 - RNA, 13 nt, Homo sapiens
uaaauuaagcaug

SEQ ID NO: 1404801 - RNA, 13 nt, Homo sapiens
uaaauuucugcuu

SEQ ID NO: 1404802 - RNA, 13 nt, Homo sapiens
uaacaaaaguaua

SEQ ID NO: 1404803 - RNA, 14 nt, Homo sapiens
uaacaacucuaguc

SEQ ID NO: 1404804 - RNA, 17 nt, Homo sapiens
uaaccugaauuauucca

SEQ ID NO: 1404805 - RNA, 21 nt, Homo sapiens
uaacucuuagaagugacauug

SEQ ID NO: 1404806 - RNA, 19 nt, Homo sapiens
uaagaaacuguuacugucc

SEQ ID NO: 1404807 - RNA, 16 nt, Homo sapiens
uaagcuaggaaugaaa

SEQ ID NO: 1404808 - RNA, 14 nt, Homo sapiens
uaagcucgagugaa

SEQ ID NO: 1404809 - RNA, 17 nt, Homo sapiens
uaagcucgagugaauuu

SEQ ID NO: 1404810 - RNA, 22 nt, Homo sapiens
uaaggcccagcaaucugcauuu

SEQ ID NO: 1404811 - RNA, 14 nt, Homo sapiens
uaauaaaacaaugu

SEQ ID NO: 1404812 - RNA, 23 nt, Homo sapiens
uaauaaacagcucuaacacggcc

SEQ ID NO: 1404813 - RNA, 21 nt, Homo sapiens
uaauaucugagaaguguauau

SEQ ID NO: 1404814 - RNA, 21 nt, Homo sapiens
uaaucugagaggccacagugc

SEQ ID NO: 1404815 - RNA, 15 nt, Homo sapiens
uaaucuuuaaacugg

SEQ ID NO: 1404816 - RNA, 18 nt, Homo sapiens
uaauguacacauugcauu

SEQ ID NO: 1404817 - RNA, 20 nt, Homo sapiens
uaauuacuuauuguauuuau

SEQ ID NO: 1404818 - RNA, 15 nt, Homo sapiens
uaauucagcucuuga

SEQ ID NO: 1404819 - RNA, 14 nt, Homo sapiens
uaauucugucacuc

SEQ ID NO: 1404820 - RNA, 13 nt, Homo sapiens
uaauugauuucaa

SEQ ID NO: 1404821 - RNA, 20 nt, Homo sapiens
uaauugguccaacccagccu

SEQ ID NO: 1404822 - RNA, 20 nt, Homo sapiens
uaauugugaaaauuacaguu

SEQ ID NO: 1404823 - RNA, 16 nt, Homo sapiens
uacaaaaacauggccu

SEQ ID NO: 1404824 - RNA, 16 nt, Homo sapiens
uacacaaaccugaaaa

SEQ ID NO: 1404825 - RNA, 17 nt, Homo sapiens
uacagaaauacauaggc

SEQ ID NO: 1404826 - RNA, 21 nt, Homo sapiens
uacagacacucccacuuggca

SEQ ID NO: 1404827 - RNA, 14 nt, Homo sapiens
uacagaggacagua

SEQ ID NO: 1404828 - RNA, 22 nt, Homo sapiens
uacauaggcuuauauacaaugc

SEQ ID NO: 1404829 - RNA, 16 nt, Homo sapiens
uaccaaaugagcauua

SEQ ID NO: 1404830 - RNA, 12 nt, Homo sapiens
uaccaugcugaa

SEQ ID NO: 1404831 - RNA, 16 nt, Homo sapiens
uacccccccuccugcu

SEQ ID NO: 1404832 - RNA, 14 nt, Homo sapiens
uaccucuuggcugc

SEQ ID NO: 1404833 - RNA, 19 nt, Homo sapiens
uaccucuuggcugccuugu

SEQ ID NO: 1404834 - RNA, 15 nt, Homo sapiens
uaccugccuguucuc

SEQ ID NO: 1404835 - RNA, 16 nt, Homo sapiens
uaccuggaugccauug

SEQ ID NO: 1404836 - RNA, 15 nt, Homo sapiens
uaccuucuaccucuu

SEQ ID NO: 1404837 - RNA, 21 nt, Homo sapiens
uaccuucuaccucuuggcugc

SEQ ID NO: 1404838 - RNA, 17 nt, Homo sapiens
uacugaaccacucuccc

SEQ ID NO: 1404839 - RNA, 23 nt, Homo sapiens
uacugcagcuuuguuuguuguca

SEQ ID NO: 1404840 - RNA, 18 nt, Homo sapiens
uacuggucuuguggaauu

SEQ ID NO: 1404841 - RNA, 20 nt, Homo sapiens
uacuuauuguauuuaugugu

SEQ ID NO: 1404842 - RNA, 16 nt, Homo sapiens
uacuuguaaaggugcu

SEQ ID NO: 1404843 - RNA, 14 nt, Homo sapiens
uacuuucauacuga

SEQ ID NO: 1404844 - RNA, 21 nt, Homo sapiens
uagaagcuguaacagaauaca

SEQ ID NO: 1404845 - RNA, 13 nt, Homo sapiens
uagagauaugcac

SEQ ID NO: 1404846 - RNA, 14 nt, Homo sapiens
uagagugacaggca

SEQ ID NO: 1404847 - RNA, 17 nt, Homo sapiens
uagcaccaggacucaga

SEQ ID NO: 1404848 - RNA, 18 nt, Homo sapiens
uagcaccuccacauaccu

SEQ ID NO: 1404849 - RNA, 19 nt, Homo sapiens
uagcgacugucaacagcgu

SEQ ID NO: 1404850 - RNA, 16 nt, Homo sapiens
uaggaggcugaggcag

SEQ ID NO: 1404851 - RNA, 18 nt, Homo sapiens
uaggauaaauuacauuaa

SEQ ID NO: 1404852 - RNA, 21 nt, Homo sapiens
uaggaucugucaaagaaaacu

SEQ ID NO: 1404853 - RNA, 14 nt, Homo sapiens
uaggcauuugcuga

SEQ ID NO: 1404854 - RNA, 17 nt, Homo sapiens
uaggccagcaccaucuc

SEQ ID NO: 1404855 - RNA, 12 nt, Homo sapiens
uaggcuggccag

SEQ ID NO: 1404856 - RNA, 14 nt, Homo sapiens
uagggaaaaaccag

SEQ ID NO: 1404857 - RNA, 19 nt, Homo sapiens
uagguuuccacugccaaaa

SEQ ID NO: 1404858 - RNA, 13 nt, Homo sapiens
uaguagugucuuc

SEQ ID NO: 1404859 - RNA, 16 nt, Homo sapiens
uaguuauuuuacaaau

SEQ ID NO: 1404860 - RNA, 22 nt, Homo sapiens
uaguucaauauuuguuacuguu

SEQ ID NO: 1404861 - RNA, 16 nt, Homo sapiens
uaguucugccaggaga

SEQ ID NO: 1404862 - RNA, 23 nt, Homo sapiens
uauaccuccuauauguccauuua

SEQ ID NO: 1404863 - RNA, 18 nt, Homo sapiens
uauaccugggcauacuaa

SEQ ID NO: 1404864 - RNA, 19 nt, Homo sapiens
uauagguuuccacugccaa

SEQ ID NO: 1404865 - RNA, 11 nt, Homo sapiens
uauauaaacuc

SEQ ID NO: 1404866 - RNA, 17 nt, Homo sapiens
uauauaauguugccagc

SEQ ID NO: 1404867 - RNA, 21 nt, Homo sapiens
uauaucauaaaguaugccuuc

SEQ ID NO: 1404868 - RNA, 19 nt, Homo sapiens
uauauuuauuuauguagga

SEQ ID NO: 1404869 - RNA, 17 nt, Homo sapiens
uaucacucacugccaaa

SEQ ID NO: 1404870 - RNA, 19 nt, Homo sapiens
uaucccacggaaaaugcca

SEQ ID NO: 1404871 - RNA, 17 nt, Homo sapiens
uauccguaguuuugaua

SEQ ID NO: 1404872 - RNA, 12 nt, Homo sapiens
uauccuguucuc

SEQ ID NO: 1404873 - RNA, 22 nt, Homo sapiens
uaugagcuggggaugucucuca

SEQ ID NO: 1404874 - RNA, 23 nt, Homo sapiens
uaugagcuggggaugucucucau

SEQ ID NO: 1404875 - RNA, 17 nt, Homo sapiens
uucuguccaguuuccaa

SEQ ID NO: 1404876 - RNA, 17 nt, Homo sapiens
uucuuucccaacaccuc

SEQ ID NO: 1404877 - RNA, 16 nt, Homo sapiens
uugacuagccaucuca

SEQ ID NO: 1404878 - RNA, 11 nt, Homo sapiens
uugagccaugc

SEQ ID NO: 1404879 - RNA, 20 nt, Homo sapiens
uugauauguaaguacuucca

SEQ ID NO: 1404880 - RNA, 20 nt, Homo sapiens
uugcaacaagacaaagcaaa

SEQ ID NO: 1404881 - RNA, 16 nt, Homo sapiens
uugcacccaugccaua

SEQ ID NO: 1404882 - RNA, 18 nt, Homo sapiens
uugcaggaccucagguga

SEQ ID NO: 1404883 - RNA, 16 nt, Homo sapiens
uugcagugaacugaga

SEQ ID NO: 1404884 - RNA, 17 nt, Homo sapiens
uugcagugaacugagac

SEQ ID NO: 1404885 - RNA, 21 nt, Homo sapiens
uugcccaggcuggagugcaau

SEQ ID NO: 1404886 - RNA, 12 nt, Homo sapiens
uugcugcacuuu

SEQ ID NO: 1404887 - RNA, 16 nt, Homo sapiens
uuggcagcucuacucu

SEQ ID NO: 1404888 - RNA, 21 nt, Homo sapiens
uugggauauucugaaacuuga

SEQ ID NO: 1404889 - RNA, 13 nt, Homo sapiens
uugggcaugccau

SEQ ID NO: 1404890 - RNA, 19 nt, Homo sapiens
uugguauaucuggccacac

SEQ ID NO: 1404891 - RNA, 23 nt, Homo sapiens
uugugaaagaaggagcaagagaa

SEQ ID NO: 1404892 - RNA, 20 nt, Homo sapiens
uuuaauaucugagaagugua

SEQ ID NO: 1404893 - RNA, 22 nt, Homo sapiens
uuuaccauaaaaauccuucuca

SEQ ID NO: 1404894 - RNA, 11 nt, Homo sapiens
uuuaugguucu

SEQ ID NO: 1404895 - RNA, 18 nt, Homo sapiens
uuucaaccgcuugccaua

SEQ ID NO: 1404896 - RNA, 21 nt, Homo sapiens
uuuccacauaaagguauuuag

SEQ ID NO: 1404897 - RNA, 21 nt, Homo sapiens
uuucccgcccccagauugaua

SEQ ID NO: 1404898 - RNA, 12 nt, Homo sapiens
uuuccuguauau

SEQ ID NO: 1404899 - RNA, 17 nt, Homo sapiens
uuuccuuaccauuguga

SEQ ID NO: 1404900 - RNA, 20 nt, Homo sapiens
uuucgacguuugacuagcca

SEQ ID NO: 1404901 - RNA, 19 nt, Homo sapiens
uuucuaaagcucugaacaa

SEQ ID NO: 1404902 - RNA, 21 nt, Homo sapiens
uuucuaaagcucugaacaaaa

SEQ ID NO: 1404903 - RNA, 11 nt, Homo sapiens
uuucugaagag

SEQ ID NO: 1404904 - RNA, 15 nt, Homo sapiens
uuucuuugauuuucg

SEQ ID NO: 1404905 - RNA, 18 nt, Homo sapiens
uuugacuagccaucucaa

SEQ ID NO: 1404906 - RNA, 21 nt, Homo sapiens
uuugacuagccaucucaagca

SEQ ID NO: 1404907 - RNA, 11 nt, Homo sapiens
uuugagccaug

SEQ ID NO: 1404908 - RNA, 21 nt, Homo sapiens
uuugcuaaaugugaaugauga

SEQ ID NO: 1404909 - RNA, 15 nt, Homo sapiens
uuuggacuucacuua

SEQ ID NO: 1404910 - RNA, 22 nt, Homo sapiens
uuugugcagagauaaagaccuu

SEQ ID NO: 1404911 - RNA, 13 nt, Homo sapiens
uuuguuccaugag

SEQ ID NO: 1404912 - RNA, 19 nt, Homo sapiens
uuuuagacccuauugcugc

SEQ ID NO: 1404913 - RNA, 22 nt, Homo sapiens
uuuuccgggaacaaaaugaugu

SEQ ID NO: 1404914 - RNA, 18 nt, Homo sapiens
uuuuuaaaaaacugcuga

SEQ ID NO: 1404915 - RNA, 12 nt, Homo sapiens
aaaaaaaauccc

SEQ ID NO: 1404916 - RNA, 19 nt, Homo sapiens
aaaaaagaacaacugccaa

SEQ ID NO: 1404917 - RNA, 15 nt, Homo sapiens
aaaaaucccuuaccu

SEQ ID NO: 1404918 - RNA, 13 nt, Homo sapiens
aaaacaugacuuu

SEQ ID NO: 1404919 - RNA, 23 nt, Homo sapiens
aaaaccaccaccaucaccagaca

SEQ ID NO: 1404920 - RNA, 18 nt, Homo sapiens
aaaacuuuucuaauacuc

SEQ ID NO: 1404921 - RNA, 23 nt, Homo sapiens
aaaacuuuucuaauacucuaccc

SEQ ID NO: 1404922 - RNA, 17 nt, Homo sapiens
aaaagaacaacugccaa

SEQ ID NO: 1404923 - RNA, 20 nt, Homo sapiens
aaaaggacucugcuucaguc

SEQ ID NO: 1404924 - RNA, 14 nt, Homo sapiens
aaaaguauauauuc

SEQ ID NO: 1404925 - RNA, 22 nt, Homo sapiens
aaaauauucauauauuaucaaa

SEQ ID NO: 1404926 - RNA, 19 nt, Homo sapiens
aaaaucagccugcuccagc

SEQ ID NO: 1404927 - RNA, 21 nt, Homo sapiens
aaaaugaugucaugucagcuc

SEQ ID NO: 1404928 - RNA, 16 nt, Homo sapiens
aaaauguaauuacuua

SEQ ID NO: 1404929 - RNA, 13 nt, Homo sapiens
aaaauguacucag

SEQ ID NO: 1404930 - RNA, 23 nt, Homo sapiens
aaaauguacucagcuaucagcuc

SEQ ID NO: 1404931 - RNA, 20 nt, Homo sapiens
aaaauucuugggaguguugu

SEQ ID NO: 1404932 - RNA, 13 nt, Homo sapiens
aaacacacaucca

SEQ ID NO: 1404933 - RNA, 18 nt, Homo sapiens
aaacacugggcucugagg

SEQ ID NO: 1404934 - RNA, 15 nt, Homo sapiens
aaacguccacagagu

SEQ ID NO: 1404935 - RNA, 18 nt, Homo sapiens
aaacuccuuaacuucagg

SEQ ID NO: 1404936 - RNA, 14 nt, Homo sapiens
aaacuguuacuguc

SEQ ID NO: 1404937 - RNA, 21 nt, Homo sapiens
aaacuuccacaagagugaauu

SEQ ID NO: 1404938 - RNA, 12 nt, Homo sapiens
aaagacaugggg

SEQ ID NO: 1404939 - RNA, 22 nt, Homo sapiens
aaagaccuuuuccaugcacccu

SEQ ID NO: 1404940 - RNA, 15 nt, Homo sapiens
aaagacuacacuguu

SEQ ID NO: 1404941 - RNA, 12 nt, Homo sapiens
aaagagacugag

SEQ ID NO: 1404942 - RNA, 20 nt, Homo sapiens
aaagcacuguuuaacuggga

SEQ ID NO: 1404943 - RNA, 20 nt, Homo sapiens
aaagcaguggcuccauuggu

SEQ ID NO: 1404944 - RNA, 19 nt, Homo sapiens
aaagcauaguuauuuuaca

SEQ ID NO: 1404945 - RNA, 16 nt, Homo sapiens
aaagccugaguuugcu

SEQ ID NO: 1404946 - RNA, 22 nt, Homo sapiens
aaagcugcugagaaucuagccu

SEQ ID NO: 1404947 - RNA, 13 nt, Homo sapiens
aaaggacucugcu

SEQ ID NO: 1404948 - RNA, 21 nt, Homo sapiens
aaaggacucugcuucagucca

SEQ ID NO: 1404949 - RNA, 23 nt, Homo sapiens
aaagguauuaaauugauguugcu

SEQ ID NO: 1404950 - RNA, 20 nt, Homo sapiens
aaagucuaguuaccuacuuu

SEQ ID NO: 1404951 - RNA, 23 nt, Homo sapiens
aaauacacagugcugaccagaca

SEQ ID NO: 1404952 - RNA, 18 nt, Homo sapiens
aaaucccauauauucuuc

SEQ ID NO: 1404953 - RNA, 20 nt, Homo sapiens
aaaugcaggagagcuucccc

SEQ ID NO: 1404954 - RNA, 12 nt, Homo sapiens
aaaugcuuccaa

SEQ ID NO: 1404955 - RNA, 17 nt, Homo sapiens
aaaugggaaaaccagac

SEQ ID NO: 1404956 - RNA, 21 nt, Homo sapiens
aaauguaagaaagcauaguua

SEQ ID NO: 1404957 - RNA, 17 nt, Homo sapiens
aaauguggacaucauga

SEQ ID NO: 1404958 - RNA, 19 nt, Homo sapiens
aaauguucagaagguugcu

SEQ ID NO: 1404959 - RNA, 17 nt, Homo sapiens
aaauuagacuuccugua

SEQ ID NO: 1404960 - RNA, 18 nt, Homo sapiens
aaauuguuuuuacugucu

SEQ ID NO: 1404961 - RNA, 23 nt, Homo sapiens
ccaauuuucuggaauacaugaaa

SEQ ID NO: 1404962 - RNA, 16 nt, Homo sapiens
ccacaagagugaauuu

SEQ ID NO: 1404963 - RNA, 15 nt, Homo sapiens
ccacaagcaccugcu

SEQ ID NO: 1404964 - RNA, 14 nt, Homo sapiens
ccacacacagagga

SEQ ID NO: 1404965 - RNA, 14 nt, Homo sapiens
ccacauaccuggcc

SEQ ID NO: 1404966 - RNA, 18 nt, Homo sapiens
ccaccaccaucaccagac

SEQ ID NO: 1404967 - RNA, 10 nt, Homo sapiens
ccaccucuca

SEQ ID NO: 1404968 - RNA, 13 nt, Homo sapiens
ccacucuaccuga

SEQ ID NO: 1404969 - RNA, 17 nt, Homo sapiens
ccagaaaagcaguggcu

SEQ ID NO: 1404970 - RNA, 22 nt, Homo sapiens
ccagaaggcagggaaaggcucu

SEQ ID NO: 1404971 - RNA, 18 nt, Homo sapiens
ccagaaguuacagaugag

SEQ ID NO: 1404972 - RNA, 18 nt, Homo sapiens
ccagaccauugucuucca

SEQ ID NO: 1404973 - RNA, 20 nt, Homo sapiens
ccagacuucccacggcuccu

SEQ ID NO: 1404974 - RNA, 17 nt, Homo sapiens
ccagagccacuaccuuu

SEQ ID NO: 1404975 - RNA, 17 nt, Homo sapiens
ccagagcugaguggcag

SEQ ID NO: 1404976 - RNA, 20 nt, Homo sapiens
ccagaggaagggacaccaag

SEQ ID NO: 1404977 - RNA, 14 nt, Homo sapiens
ccagagucccugcc

SEQ ID NO: 1404978 - RNA, 13 nt, Homo sapiens
ccagauugcccca

SEQ ID NO: 1404979 - RNA, 12 nt, Homo sapiens
ccagcacuuugg

SEQ ID NO: 1404980 - RNA, 19 nt, Homo sapiens
ccagcaucucccaguucau

SEQ ID NO: 1404981 - RNA, 15 nt, Homo sapiens
ccagccugagugcac

SEQ ID NO: 1404982 - RNA, 20 nt, Homo sapiens
ccagccugggugacagagca

SEQ ID NO: 1404983 - RNA, 16 nt, Homo sapiens
ccagcgguccaaaguu

SEQ ID NO: 1404984 - RNA, 17 nt, Homo sapiens
ccagcuguuaccugaga

SEQ ID NO: 1404985 - RNA, 14 nt, Homo sapiens
ccagcuuuccucau

SEQ ID NO: 1404986 - RNA, 12 nt, Homo sapiens
ccaggcaauggc

SEQ ID NO: 1404987 - RNA, 17 nt, Homo sapiens
ccaggcuagagugcagu

SEQ ID NO: 1404988 - RNA, 18 nt, Homo sapiens
ccaggcuagagugcagug

SEQ ID NO: 1404989 - RNA, 15 nt, Homo sapiens
ccaggcuggagugca

SEQ ID NO: 1404990 - RNA, 17 nt, Homo sapiens
ccaggcuggagugcaau

SEQ ID NO: 1404991 - RNA, 21 nt, Homo sapiens
ccaguggcuggaucugugagg

SEQ ID NO: 1404992 - RNA, 13 nt, Homo sapiens
ccauagaaacuga

SEQ ID NO: 1404993 - RNA, 12 nt, Homo sapiens
ccaucaccagac

SEQ ID NO: 1404994 - RNA, 16 nt, Homo sapiens
ccaucucugauuuuca

SEQ ID NO: 1404995 - RNA, 13 nt, Homo sapiens
ccaucucuuuacc

SEQ ID NO: 1404996 - RNA, 17 nt, Homo sapiens
ccaucugggcuucacag

SEQ ID NO: 1404997 - RNA, 13 nt, Homo sapiens
ccaugaagcugga

SEQ ID NO: 1404998 - RNA, 23 nt, Homo sapiens
ccaugcacccucauacacagaaa

SEQ ID NO: 1404999 - RNA, 21 nt, Homo sapiens
ccauuaaauagggaaaaaaca

SEQ ID NO: 1405000 - RNA, 23 nt, Homo sapiens
ccauuauuucaaccgcuugccau

SEQ ID NO: 1405001 - RNA, 15 nt, Homo sapiens
ccauugguguugaca

SEQ ID NO: 1405002 - RNA, 17 nt, Homo sapiens
ccauuucugagaucaaa

SEQ ID NO: 1405003 - RNA, 16 nt, Homo sapiens
cccaagaugagcugca

SEQ ID NO: 1405004 - RNA, 21 nt, Homo sapiens
cccaagggccucccaccagag

SEQ ID NO: 1405005 - RNA, 17 nt, Homo sapiens
cccaauauuuaccagac

SEQ ID NO: 1405006 - RNA, 22 nt, Homo sapiens
cccaccaugcaccccugauguu

SEQ ID NO: 1405007 - RNA, 23 nt, Homo sapiens
cccaccaugcaccccugauguuc

SEQ ID NO: 1405008 - RNA, 14 nt, Homo sapiens
cccacuggccaguc

SEQ ID NO: 1405009 - RNA, 21 nt, Homo sapiens
cccagaggaugucacaaagau

SEQ ID NO: 1405010 - RNA, 16 nt, Homo sapiens
cccaggaacugggcca

SEQ ID NO: 1405011 - RNA, 17 nt, Homo sapiens
cccaggcuagagugcag

SEQ ID NO: 1405012 - RNA, 18 nt, Homo sapiens
cccaggcuagagugcagu

SEQ ID NO: 1405013 - RNA, 17 nt, Homo sapiens
cccaggcuggagugcaa

SEQ ID NO: 1405014 - RNA, 18 nt, Homo sapiens
cccaggcuggagugcaau

SEQ ID NO: 1405015 - RNA, 14 nt, Homo sapiens
ccccaacugugauc

SEQ ID NO: 1405016 - RNA, 18 nt, Homo sapiens
ccccacuaggcacugugg

SEQ ID NO: 1405017 - RNA, 13 nt, Homo sapiens
ccccuacaugaaa

SEQ ID NO: 1405018 - RNA, 22 nt, Homo sapiens
ccccuguagagugggagcugag

SEQ ID NO: 1405019 - RNA, 14 nt, Homo sapiens
cccuaaaacaugug

SEQ ID NO: 1405020 - RNA, 15 nt, Homo sapiens
cccucagcugccuca

SEQ ID NO: 1405021 - RNA, 16 nt, Homo sapiens
cccuccugcugccuaa

SEQ ID NO: 1405022 - RNA, 16 nt, Homo sapiens
cccucuacuccaugca

SEQ ID NO: 1405023 - RNA, 14 nt, Homo sapiens
cccucucacugugu

SEQ ID NO: 1405024 - RNA, 14 nt, Homo sapiens
cccugaucaaguca

SEQ ID NO: 1405025 - RNA, 18 nt, Homo sapiens
cccugauuuuaucauucu

SEQ ID NO: 1405026 - RNA, 11 nt, Homo sapiens
cccugccauca

SEQ ID NO: 1405027 - RNA, 17 nt, Homo sapiens
cccuggagcaagaccug

SEQ ID NO: 1405028 - RNA, 17 nt, Homo sapiens
cccugggccucagccuc

SEQ ID NO: 1405029 - RNA, 15 nt, Homo sapiens
cccuucagcauccuc

SEQ ID NO: 1405030 - RNA, 19 nt, Homo sapiens
cccuuccugaagaagaucc

SEQ ID NO: 1405031 - RNA, 18 nt, Homo sapiens
cccuuggcuuuagccaua

SEQ ID NO: 1405032 - RNA, 14 nt, Homo sapiens
ccgaccccaucuca

SEQ ID NO: 1405033 - RNA, 12 nt, Homo sapiens
ccgagaagaaca

SEQ ID NO: 1405034 - RNA, 18 nt, Homo sapiens
ccgauguacacacacaga

SEQ ID NO: 1405035 - RNA, 20 nt, Homo sapiens
ccgaugugcgcacacacaga

SEQ ID NO: 1405036 - RNA, 15 nt, Homo sapiens
ccgcuuucaugaaca

SEQ ID NO: 1405037 - RNA, 11 nt, Homo sapiens
ccgggacaccu

SEQ ID NO: 1405038 - RNA, 21 nt, Homo sapiens
ccgggucugcuucugcauuca

SEQ ID NO: 1405039 - RNA, 12 nt, Homo sapiens
ccggugcucugg

SEQ ID NO: 1405040 - RNA, 15 nt, Homo sapiens
ccgguggaaggccuu

SEQ ID NO: 1405041 - RNA, 17 nt, Homo sapiens
ccgguucuuaaauccau

SEQ ID NO: 1405042 - RNA, 12 nt, Homo sapiens
ccgugggccaug

SEQ ID NO: 1405043 - RNA, 22 nt, Homo sapiens
ccuaauguggcagcugucucaa

SEQ ID NO: 1405044 - RNA, 19 nt, Homo sapiens
uuuuggcagcaaaguguca

SEQ ID NO: 1405045 - RNA, 19 nt, Homo sapiens
uuuuugaaaaaaguauagg

SEQ ID NO: 1405046 - RNA, 19 nt, Homo sapiens
gccuccagugggaggacag

SEQ ID NO: 1405047 - RNA, 16 nt, Homo sapiens
gccuccugucccucau

SEQ ID NO: 1405048 - RNA, 22 nt, Homo sapiens
gccucuuccgugacgucacugg

SEQ ID NO: 1405049 - RNA, 20 nt, Homo sapiens
gccuguaaucccagcacuuu

SEQ ID NO: 1405050 - RNA, 19 nt, Homo sapiens
gcgaagcguuguccucagc

SEQ ID NO: 1405051 - RNA, 16 nt, Homo sapiens
gcggaugcuggccaca

SEQ ID NO: 1405052 - RNA, 17 nt, Homo sapiens
gcuaggaaugaaauccu

SEQ ID NO: 1405053 - RNA, 11 nt, Homo sapiens
gcuaucucugu

SEQ ID NO: 1405054 - RNA, 20 nt, Homo sapiens
gcuauggggauagaugugug

SEQ ID NO: 1405055 - RNA, 18 nt, Homo sapiens
gcucacacuacuugagaa

SEQ ID NO: 1405056 - RNA, 18 nt, Homo sapiens
gcuccuccugcccugucc

SEQ ID NO: 1405057 - RNA, 18 nt, Homo sapiens
gcuccugggggaugcucu

SEQ ID NO: 1405058 - RNA, 19 nt, Homo sapiens
gcucuacccugaguucaua

SEQ ID NO: 1405059 - RNA, 12 nt, Homo sapiens
gcucuggaagac

SEQ ID NO: 1405060 - RNA, 22 nt, Homo sapiens
gcugaggccucucauuccagag

SEQ ID NO: 1405061 - RNA, 23 nt, Homo sapiens
gcugagggugagugggugaauaa

SEQ ID NO: 1405062 - RNA, 21 nt, Homo sapiens
gcugcccaggcuagagugcag

SEQ ID NO: 1405063 - RNA, 22 nt, Homo sapiens
gcugcccaggcuagagugcagu

SEQ ID NO: 1405064 - RNA, 19 nt, Homo sapiens
gcugccccuggugcacugg

SEQ ID NO: 1405065 - RNA, 19 nt, Homo sapiens
gcugccuuuggacuugucc

SEQ ID NO: 1405066 - RNA, 20 nt, Homo sapiens
gcugcugagaaucuagccuc

SEQ ID NO: 1405067 - RNA, 14 nt, Homo sapiens
gcuggggaugucuc

SEQ ID NO: 1405068 - RNA, 17 nt, Homo sapiens
gcuguauccauccaugg

SEQ ID NO: 1405069 - RNA, 16 nt, Homo sapiens
gcuguggcauccagag

SEQ ID NO: 1405070 - RNA, 14 nt, Homo sapiens
gcuuagcuugaggg

SEQ ID NO: 1405071 - RNA, 13 nt, Homo sapiens
gcuucugccucag

SEQ ID NO: 1405072 - RNA, 18 nt, Homo sapiens
gcuuucaugaacacagcc

SEQ ID NO: 1405073 - RNA, 16 nt, Homo sapiens
gcuuucucagugucag

SEQ ID NO: 1405074 - RNA, 13 nt, Homo sapiens
gcuuuucucccag

SEQ ID NO: 1405075 - RNA, 22 nt, Homo sapiens
ggaaaucagagcuggcagccuc

SEQ ID NO: 1405076 - RNA, 22 nt, Homo sapiens
ggaacauguaaaacaguuacaa

SEQ ID NO: 1405077 - RNA, 22 nt, Homo sapiens
ggaaggagaggagaggggcaca

SEQ ID NO: 1405078 - RNA, 21 nt, Homo sapiens
ggaauacugugcauaagccau

SEQ ID NO: 1405079 - RNA, 15 nt, Homo sapiens
ggacaccaagccuug

SEQ ID NO: 1405080 - RNA, 16 nt, Homo sapiens
ggaccagccucuccac

SEQ ID NO: 1405081 - RNA, 20 nt, Homo sapiens
ggaccagccucuccacucau

SEQ ID NO: 1405082 - RNA, 15 nt, Homo sapiens
ggaccuuacaggccc

SEQ ID NO: 1405083 - RNA, 19 nt, Homo sapiens
ggacuauuuaugaaggcaa

SEQ ID NO: 1405084 - RNA, 20 nt, Homo sapiens
ggacucugcuucaguccacu

SEQ ID NO: 1405085 - RNA, 15 nt, Homo sapiens
ggagagagugcuauu

SEQ ID NO: 1405086 - RNA, 16 nt, Homo sapiens
ggagcuuuccaaagaa

SEQ ID NO: 1405087 - RNA, 17 nt, Homo sapiens
ggaggaaggagccuaug

SEQ ID NO: 1405088 - RNA, 20 nt, Homo sapiens
ggaggcugcagugagccaag

SEQ ID NO: 1405089 - RNA, 13 nt, Homo sapiens
ggagugugccccu

SEQ ID NO: 1405090 - RNA, 17 nt, Homo sapiens
ggauacagaaugaaucc

SEQ ID NO: 1405091 - RNA, 13 nt, Homo sapiens
ggauccugcacuc

SEQ ID NO: 1405092 - RNA, 14 nt, Homo sapiens
ggauccugcacucu

SEQ ID NO: 1405093 - RNA, 22 nt, Homo sapiens
ggcaaagaacugccccaucucc

SEQ ID NO: 1405094 - RNA, 21 nt, Homo sapiens
ggcaacccucagcugccucau

SEQ ID NO: 1405095 - RNA, 16 nt, Homo sapiens
ggcaacgcacaaaaca

SEQ ID NO: 1405096 - RNA, 19 nt, Homo sapiens
ggcacccuccaaacacugg

SEQ ID NO: 1405097 - RNA, 18 nt, Homo sapiens
ggcacgaucucagcucac

SEQ ID NO: 1405098 - RNA, 14 nt, Homo sapiens
ggcacuguggccuu

SEQ ID NO: 1405099 - RNA, 18 nt, Homo sapiens
ggcagcaucagggacaca

SEQ ID NO: 1405100 - RNA, 17 nt, Homo sapiens
ggcagccaggacaucuc

SEQ ID NO: 1405101 - RNA, 21 nt, Homo sapiens
ggcagcugucucaaaccucca

SEQ ID NO: 1405102 - RNA, 20 nt, Homo sapiens
ggcagucugagagaggccau

SEQ ID NO: 1405103 - RNA, 12 nt, Homo sapiens
ggcauacuaaua

SEQ ID NO: 1405104 - RNA, 23 nt, Homo sapiens
ggcaugcuggcucccagggccau

SEQ ID NO: 1405105 - RNA, 14 nt, Homo sapiens
ggccacacugggcu

SEQ ID NO: 1405106 - RNA, 11 nt, Homo sapiens
ggccagcacca

SEQ ID NO: 1405107 - RNA, 23 nt, Homo sapiens
ggccauuccaacagcucaagucu

SEQ ID NO: 1405108 - RNA, 19 nt, Homo sapiens
ggccuccagcccucucacu

SEQ ID NO: 1405109 - RNA, 14 nt, Homo sapiens
ggccugacucucag

SEQ ID NO: 1405110 - RNA, 22 nt, Homo sapiens
ggccugagaagagagaucaaau

SEQ ID NO: 1405111 - RNA, 14 nt, Homo sapiens
ggccuuguggcacu

SEQ ID NO: 1405112 - RNA, 14 nt, Homo sapiens
ggcucagccucaaa

SEQ ID NO: 1405113 - RNA, 20 nt, Homo sapiens
ggcucagccucaaaugcagu

SEQ ID NO: 1405114 - RNA, 15 nt, Homo sapiens
ggcugaggauuucaa

SEQ ID NO: 1405115 - RNA, 20 nt, Homo sapiens
ggcugaggccucucauucca

SEQ ID NO: 1405116 - RNA, 11 nt, Homo sapiens
ggcugcacaga

SEQ ID NO: 1405117 - RNA, 17 nt, Homo sapiens
ggcugccugacacugag

SEQ ID NO: 1405118 - RNA, 21 nt, Homo sapiens
ggcugcucgaagaacaauguc

SEQ ID NO: 1405119 - RNA, 14 nt, Homo sapiens
ggcuggguggcacc

SEQ ID NO: 1405120 - RNA, 13 nt, Homo sapiens
ggcuggugacaga

SEQ ID NO: 1405121 - RNA, 18 nt, Homo sapiens
ggcuuuuggcagcaaagu

SEQ ID NO: 1405122 - RNA, 13 nt, Homo sapiens
gggaaaaccagac

SEQ ID NO: 1405123 - RNA, 20 nt, Homo sapiens
gggaaccggcagcaucccag

SEQ ID NO: 1405124 - RNA, 21 nt, Homo sapiens
gucaaagaaaacuuccaaaaa

SEQ ID NO: 1405125 - RNA, 12 nt, Homo sapiens
gucaacauaugu

SEQ ID NO: 1405126 - RNA, 10 nt, Homo sapiens
gucauagaaa

SEQ ID NO: 1405127 - RNA, 19 nt, Homo sapiens
guccacuuuuaaaacuaua

SEQ ID NO: 1405128 - RNA, 14 nt, Homo sapiens
guccagcacuggaa

SEQ ID NO: 1405129 - RNA, 14 nt, Homo sapiens
guccaucagccucc

SEQ ID NO: 1405130 - RNA, 19 nt, Homo sapiens
guccauugaugucauucag

SEQ ID NO: 1405131 - RNA, 19 nt, Homo sapiens
guccuccagaccaccagcc

SEQ ID NO: 1405132 - RNA, 17 nt, Homo sapiens
guccuguuuauugagac

SEQ ID NO: 1405133 - RNA, 18 nt, Homo sapiens
gucucuaugaucuuggca

SEQ ID NO: 1405134 - RNA, 16 nt, Homo sapiens
gucugggccacucagg

SEQ ID NO: 1405135 - RNA, 14 nt, Homo sapiens
gucugucccaaaga

SEQ ID NO: 1405136 - RNA, 15 nt, Homo sapiens
gucuuaauguacaca

SEQ ID NO: 1405137 - RNA, 11 nt, Homo sapiens
gucuugccagg

SEQ ID NO: 1405138 - RNA, 19 nt, Homo sapiens
gugcaauggcacgaucuca

SEQ ID NO: 1405139 - RNA, 16 nt, Homo sapiens
gugccaaguuccacuu

SEQ ID NO: 1405140 - RNA, 22 nt, Homo sapiens
gugccuugucacgccagacuuc

SEQ ID NO: 1405141 - RNA, 17 nt, Homo sapiens
gugcuacacuugcaccu

SEQ ID NO: 1405142 - RNA, 15 nt, Homo sapiens
gugcuaggauuacag

SEQ ID NO: 1405143 - RNA, 15 nt, Homo sapiens
gugcucugaggucaa

SEQ ID NO: 1405144 - RNA, 15 nt, Homo sapiens
gugcugggauuacag

SEQ ID NO: 1405145 - RNA, 13 nt, Homo sapiens
guggagugucaca

SEQ ID NO: 1405146 - RNA, 22 nt, Homo sapiens
guggcuggaucugugaggggcu

SEQ ID NO: 1405147 - RNA, 17 nt, Homo sapiens
gugguuuuugagccaug

SEQ ID NO: 1405148 - RNA, 15 nt, Homo sapiens
guguagcuuugcucu

SEQ ID NO: 1405149 - RNA, 16 nt, Homo sapiens
gugugggaguguguaa

SEQ ID NO: 1405150 - RNA, 14 nt, Homo sapiens
guguucuucauuac

SEQ ID NO: 1405151 - RNA, 18 nt, Homo sapiens
guguugccagagccuuaa

SEQ ID NO: 1405152 - RNA, 11 nt, Homo sapiens
guuacaaagac

SEQ ID NO: 1405153 - RNA, 22 nt, Homo sapiens
guuacaugguaauuaugugaua

SEQ ID NO: 1405154 - RNA, 19 nt, Homo sapiens
guuacuaaagucacauaua

SEQ ID NO: 1405155 - RNA, 19 nt, Homo sapiens
guuagaaaaaggacucugc

SEQ ID NO: 1405156 - RNA, 12 nt, Homo sapiens
guucauucaaaa

SEQ ID NO: 1405157 - RNA, 19 nt, Homo sapiens
guuccuggcucagccucaa

SEQ ID NO: 1405158 - RNA, 11 nt, Homo sapiens
guucuuaccug

SEQ ID NO: 1405159 - RNA, 18 nt, Homo sapiens
guucuucaccuccugcca

SEQ ID NO: 1405160 - RNA, 16 nt, Homo sapiens
guugcuggacugucau

SEQ ID NO: 1405161 - RNA, 15 nt, Homo sapiens
guugucacaccugaa

SEQ ID NO: 1405162 - RNA, 13 nt, Homo sapiens
guugucacugaga

SEQ ID NO: 1405163 - RNA, 17 nt, Homo sapiens
guuuaaaaaaaguauau

SEQ ID NO: 1405164 - RNA, 22 nt, Homo sapiens
guuuaacugggagugauaugau

SEQ ID NO: 1405165 - RNA, 12 nt, Homo sapiens
guuuaccagaga

SEQ ID NO: 1405166 - RNA, 18 nt, Homo sapiens
guuuagcccaaaaccaag

SEQ ID NO: 1405167 - RNA, 19 nt, Homo sapiens
guuuuuaaaaaacugcuga

SEQ ID NO: 1405168 - RNA, 18 nt, Homo sapiens
uaaaaauggccauuugcu

SEQ ID NO: 1405169 - RNA, 12 nt, Homo sapiens
uaaaacaugugu

SEQ ID NO: 1405170 - RNA, 15 nt, Homo sapiens
uaaaagucuaugauc

SEQ ID NO: 1405171 - RNA, 12 nt, Homo sapiens
uaaaauacucuu

SEQ ID NO: 1405172 - RNA, 16 nt, Homo sapiens
uaaaaugggaagacug

SEQ ID NO: 1405173 - RNA, 20 nt, Homo sapiens
uaaaaugggaagacugagcu

SEQ ID NO: 1405174 - RNA, 17 nt, Homo sapiens
uaaaauguacucagcua

SEQ ID NO: 1405175 - RNA, 19 nt, Homo sapiens
uaaaauguacucagcuauc

SEQ ID NO: 1405176 - RNA, 14 nt, Homo sapiens
uaaaauugugaugu

SEQ ID NO: 1405177 - RNA, 18 nt, Homo sapiens
uaaacaagggucaauuca

SEQ ID NO: 1405178 - RNA, 20 nt, Homo sapiens
uaaacaagggucaauucaaa

SEQ ID NO: 1405179 - RNA, 10 nt, Homo sapiens
uaaacauuca

SEQ ID NO: 1405180 - RNA, 22 nt, Homo sapiens
uaaacuggcuggcccagaguuu

SEQ ID NO: 1405181 - RNA, 20 nt, Homo sapiens
uaaagaaaaauaugauacuc

SEQ ID NO: 1405182 - RNA, 15 nt, Homo sapiens
uaaagauuucugcuc

SEQ ID NO: 1405183 - RNA, 13 nt, Homo sapiens
uaaauaaccaauu

SEQ ID NO: 1405184 - RNA, 19 nt, Homo sapiens
uaaauaugccuaguaacac

SEQ ID NO: 1405185 - RNA, 12 nt, Homo sapiens
uaaauguaagaa

SEQ ID NO: 1405186 - RNA, 16 nt, Homo sapiens
uaaauguaucauagaa

SEQ ID NO: 1405187 - RNA, 22 nt, Homo sapiens
uaaauuauuuauuuauggagga

SEQ ID NO: 1405188 - RNA, 15 nt, Homo sapiens
uaaauugauguugcu

SEQ ID NO: 1405189 - RNA, 15 nt, Homo sapiens
uaacaaaaguauagu

SEQ ID NO: 1405190 - RNA, 19 nt, Homo sapiens
uaacaccaugauuaaccac

SEQ ID NO: 1405191 - RNA, 15 nt, Homo sapiens
uaacagaauacauag

SEQ ID NO: 1405192 - RNA, 13 nt, Homo sapiens
uaacagauuagua

SEQ ID NO: 1405193 - RNA, 18 nt, Homo sapiens
uaacagauuaguaguuac

SEQ ID NO: 1405194 - RNA, 12 nt, Homo sapiens
uaacggcacugu

SEQ ID NO: 1405195 - RNA, 17 nt, Homo sapiens
uaacuuuuguaagacaa

SEQ ID NO: 1405196 - RNA, 18 nt, Homo sapiens
uaagaggauagcuauauu

SEQ ID NO: 1405197 - RNA, 16 nt, Homo sapiens
uaaucccagcuauuca

SEQ ID NO: 1405198 - RNA, 19 nt, Homo sapiens
uaaucuucuuaugcaauuu

SEQ ID NO: 1405199 - RNA, 20 nt, Homo sapiens
uaauguggcagcugucucaa

SEQ ID NO: 1405200 - RNA, 14 nt, Homo sapiens
uaauugauuucaag

SEQ ID NO: 1405201 - RNA, 19 nt, Homo sapiens
uaauuugcauugugucaga

SEQ ID NO: 1405202 - RNA, 16 nt, Homo sapiens
uacaaagauaugcuaa

SEQ ID NO: 1405203 - RNA, 23 nt, Homo sapiens
uacaaaugucuucaugaccuacu

SEQ ID NO: 1405204 - RNA, 19 nt, Homo sapiens
auaaccuucaugaugaauu

SEQ ID NO: 1405205 - RNA, 23 nt, Homo sapiens
auaaccuucaugaugaauuacuu

SEQ ID NO: 1405206 - RNA, 17 nt, Homo sapiens
auaagcucgagugaauu

SEQ ID NO: 1405207 - RNA, 16 nt, Homo sapiens
auaauacaguaucuca

SEQ ID NO: 1405208 - RNA, 15 nt, Homo sapiens
auaauuaguuccuca

SEQ ID NO: 1405209 - RNA, 13 nt, Homo sapiens
auaauucagcucu

SEQ ID NO: 1405210 - RNA, 15 nt, Homo sapiens
auacacagugcugac

SEQ ID NO: 1405211 - RNA, 15 nt, Homo sapiens
auacaguaucucagg

SEQ ID NO: 1405212 - RNA, 23 nt, Homo sapiens
auagcuauggaaggucuugcgca

SEQ ID NO: 1405213 - RNA, 12 nt, Homo sapiens
auagguuuccac

SEQ ID NO: 1405214 - RNA, 14 nt, Homo sapiens
auauaauccuguga

SEQ ID NO: 1405215 - RNA, 15 nt, Homo sapiens
auauacacauggaug

SEQ ID NO: 1405216 - RNA, 18 nt, Homo sapiens
auaucuggccacacuggg

SEQ ID NO: 1405217 - RNA, 22 nt, Homo sapiens
auaucuggccacacugggcuca

SEQ ID NO: 1405218 - RNA, 17 nt, Homo sapiens
auaugacuuuuucucag

SEQ ID NO: 1405219 - RNA, 22 nt, Homo sapiens
auaugcacacacacggaugcac

SEQ ID NO: 1405220 - RNA, 14 nt, Homo sapiens
auaugcauuaugaa

SEQ ID NO: 1405221 - RNA, 17 nt, Homo sapiens
auauguaaguacuucca

SEQ ID NO: 1405222 - RNA, 18 nt, Homo sapiens
auauguaaguacuuccac

SEQ ID NO: 1405223 - RNA, 18 nt, Homo sapiens
auauucaauaaagcugcu

SEQ ID NO: 1405224 - RNA, 17 nt, Homo sapiens
aucaaagaacaaacauc

SEQ ID NO: 1405225 - RNA, 23 nt, Homo sapiens
aucacagggccccagaaggcagg

SEQ ID NO: 1405226 - RNA, 11 nt, Homo sapiens
aucaccagaca

SEQ ID NO: 1405227 - RNA, 23 nt, Homo sapiens
aucagccuuccgcaauucaugua

SEQ ID NO: 1405228 - RNA, 22 nt, Homo sapiens
aucagugcacacggaugcacag

SEQ ID NO: 1405229 - RNA, 15 nt, Homo sapiens
aucauuaucagccug

SEQ ID NO: 1405230 - RNA, 18 nt, Homo sapiens
aucauucuaauuacaaag

SEQ ID NO: 1405231 - RNA, 20 nt, Homo sapiens
aucauuggauccuacucaac

SEQ ID NO: 1405232 - RNA, 23 nt, Homo sapiens
aucccacggaaaaugccaaucuc

SEQ ID NO: 1405233 - RNA, 21 nt, Homo sapiens
aucccaggggaccacaccucc

SEQ ID NO: 1405234 - RNA, 16 nt, Homo sapiens
aucccuuaccucggug

SEQ ID NO: 1405235 - RNA, 21 nt, Homo sapiens
auccuacccccugugccuugu

SEQ ID NO: 1405236 - RNA, 13 nt, Homo sapiens
auccuacucaaca

SEQ ID NO: 1405237 - RNA, 15 nt, Homo sapiens
auccuagcacuuugg

SEQ ID NO: 1405238 - RNA, 19 nt, Homo sapiens
auccuguucucugaagaug

SEQ ID NO: 1405239 - RNA, 24 nt, Homo sapiens
auccuuggaaauuggaagagcaca

SEQ ID NO: 1405240 - RNA, 16 nt, Homo sapiens
aucguuagaggagcaa

SEQ ID NO: 1405241 - RNA, 13 nt, Homo sapiens
aucucaagcaagu

SEQ ID NO: 1405242 - RNA, 16 nt, Homo sapiens
aucucaagcaaguuuc

SEQ ID NO: 1405243 - RNA, 17 nt, Homo sapiens
aucucacucuguugccc

SEQ ID NO: 1405244 - RNA, 18 nt, Homo sapiens
aucucauucagguguucu

SEQ ID NO: 1405245 - RNA, 18 nt, Homo sapiens
aucucugcccucuucuca

SEQ ID NO: 1405246 - RNA, 17 nt, Homo sapiens
aucuggccacacugggc

SEQ ID NO: 1405247 - RNA, 13 nt, Homo sapiens
aucuguaccucug

SEQ ID NO: 1405248 - RNA, 18 nt, Homo sapiens
aucuuccccaacgaaaag

SEQ ID NO: 1405249 - RNA, 22 nt, Homo sapiens
augaaauccugcuucaguguau

SEQ ID NO: 1405250 - RNA, 18 nt, Homo sapiens
augaagacagauacuccu

SEQ ID NO: 1405251 - RNA, 20 nt, Homo sapiens
augaagcaagccccacuuau

SEQ ID NO: 1405252 - RNA, 12 nt, Homo sapiens
augaagcuggaa

SEQ ID NO: 1405253 - RNA, 13 nt, Homo sapiens
augaaguguuucc

SEQ ID NO: 1405254 - RNA, 16 nt, Homo sapiens
augaauaauacauuga

SEQ ID NO: 1405255 - RNA, 18 nt, Homo sapiens
augacaaacacacaucca

SEQ ID NO: 1405256 - RNA, 13 nt, Homo sapiens
augacaucacuug

SEQ ID NO: 1405257 - RNA, 20 nt, Homo sapiens
augacuuuaucauuuuguua

SEQ ID NO: 1405258 - RNA, 18 nt, Homo sapiens
augagaagucaacaguga

SEQ ID NO: 1405259 - RNA, 14 nt, Homo sapiens
augagcaacuccug

SEQ ID NO: 1405260 - RNA, 18 nt, Homo sapiens
augagcaaggacaaccug

SEQ ID NO: 1405261 - RNA, 18 nt, Homo sapiens
augagcuccuuaaggcuc

SEQ ID NO: 1405262 - RNA, 23 nt, Homo sapiens
augagcuggggaugucucucaug

SEQ ID NO: 1405263 - RNA, 22 nt, Homo sapiens
augaggucaauuuccugaugca

SEQ ID NO: 1405264 - RNA, 19 nt, Homo sapiens
augauuucaugcuaucucu

SEQ ID NO: 1405265 - RNA, 15 nt, Homo sapiens
augcacacacacaga

SEQ ID NO: 1405266 - RNA, 15 nt, Homo sapiens
augcacacacacgga

SEQ ID NO: 1405267 - RNA, 13 nt, Homo sapiens
augcacacacaga

SEQ ID NO: 1405268 - RNA, 18 nt, Homo sapiens
augcacacacagaugcac

SEQ ID NO: 1405269 - RNA, 17 nt, Homo sapiens
augcacacacauggaug

SEQ ID NO: 1405270 - RNA, 17 nt, Homo sapiens
augcacagagauaugca

SEQ ID NO: 1405271 - RNA, 21 nt, Homo sapiens
augcacgcacaugccaaugca

SEQ ID NO: 1405272 - RNA, 21 nt, Homo sapiens
augcagcaaggggacaucuua

SEQ ID NO: 1405273 - RNA, 18 nt, Homo sapiens
augcauauugcccuggag

SEQ ID NO: 1405274 - RNA, 19 nt, Homo sapiens
augcauucccggugcagaa

SEQ ID NO: 1405275 - RNA, 18 nt, Homo sapiens
augccagcuuaucucagg

SEQ ID NO: 1405276 - RNA, 15 nt, Homo sapiens
augcuaucucugugu

SEQ ID NO: 1405277 - RNA, 18 nt, Homo sapiens
augcugcucauccaaagu

SEQ ID NO: 1405278 - RNA, 20 nt, Homo sapiens
augcugcugggccucugccu

SEQ ID NO: 1405279 - RNA, 18 nt, Homo sapiens
auggaccacacuuugaga

SEQ ID NO: 1405280 - RNA, 14 nt, Homo sapiens
gaguuuacauucua

SEQ ID NO: 1405281 - RNA, 14 nt, Homo sapiens
gauaaaauuaauuu

SEQ ID NO: 1405282 - RNA, 12 nt, Homo sapiens
gauacauuucau

SEQ ID NO: 1405283 - RNA, 19 nt, Homo sapiens
gauacgcaaacacaccgau

SEQ ID NO: 1405284 - RNA, 16 nt, Homo sapiens
gauacugaagugcagc

SEQ ID NO: 1405285 - RNA, 14 nt, Homo sapiens
gauagaaggcuaug

SEQ ID NO: 1405286 - RNA, 20 nt, Homo sapiens
gauauaugacuuuuucucag

SEQ ID NO: 1405287 - RNA, 13 nt, Homo sapiens
gauaugcacacac

SEQ ID NO: 1405288 - RNA, 23 nt, Homo sapiens
gaucacagggccccagaaggcag

SEQ ID NO: 1405289 - RNA, 20 nt, Homo sapiens
gaucagccugggcaauguga

SEQ ID NO: 1405290 - RNA, 18 nt, Homo sapiens
gaucauuaucagccugug

SEQ ID NO: 1405291 - RNA, 21 nt, Homo sapiens
gaucauuuguuggaaugaauu

SEQ ID NO: 1405292 - RNA, 12 nt, Homo sapiens
gaucccaugagc

SEQ ID NO: 1405293 - RNA, 14 nt, Homo sapiens
gaugaacaucuaac

SEQ ID NO: 1405294 - RNA, 15 nt, Homo sapiens
gaugaggcacuggaa

SEQ ID NO: 1405295 - RNA, 19 nt, Homo sapiens
gaugcacacacagaugcac

SEQ ID NO: 1405296 - RNA, 19 nt, Homo sapiens
gaugcacagagauaugcac

SEQ ID NO: 1405297 - RNA, 19 nt, Homo sapiens
gaugcauucccggugcaga

SEQ ID NO: 1405298 - RNA, 13 nt, Homo sapiens
gauguacacacac

SEQ ID NO: 1405299 - RNA, 13 nt, Homo sapiens
cugaaggcuuuca

SEQ ID NO: 1405300 - RNA, 21 nt, Homo sapiens
cugaaguacuuaaacuuccac

SEQ ID NO: 1405301 - RNA, 20 nt, Homo sapiens
cugaaguucagcugcauaca

SEQ ID NO: 1405302 - RNA, 14 nt, Homo sapiens
cugaaugucccaga

SEQ ID NO: 1405303 - RNA, 14 nt, Homo sapiens
cugacagaaaugca

SEQ ID NO: 1405304 - RNA, 15 nt, Homo sapiens
cugaccaagagagaa

SEQ ID NO: 1405305 - RNA, 16 nt, Homo sapiens
cugacuuucucuccag

SEQ ID NO: 1405306 - RNA, 14 nt, Homo sapiens
cugagaaucuagcc

SEQ ID NO: 1405307 - RNA, 20 nt, Homo sapiens
cugagagcucucucuucucu

SEQ ID NO: 1405308 - RNA, 24 nt, Homo sapiens
cugagaggugaggugacuugccug

SEQ ID NO: 1405309 - RNA, 19 nt, Homo sapiens
cugagcagguguucuucau

SEQ ID NO: 1405310 - RNA, 23 nt, Homo sapiens
cugagcagguguucuucauuacc

SEQ ID NO: 1405311 - RNA, 14 nt, Homo sapiens
cugaggacauggag

SEQ ID NO: 1405312 - RNA, 13 nt, Homo sapiens
cugaggaguggag

SEQ ID NO: 1405313 - RNA, 14 nt, Homo sapiens
cugaggaguggagu

SEQ ID NO: 1405314 - RNA, 20 nt, Homo sapiens
cugaggugggaggaucucuu

SEQ ID NO: 1405315 - RNA, 21 nt, Homo sapiens
cugaguagcagugauuguuau

SEQ ID NO: 1405316 - RNA, 18 nt, Homo sapiens
cugauguuuaaaagucca

SEQ ID NO: 1405317 - RNA, 14 nt, Homo sapiens
cugauuugaugaua

SEQ ID NO: 1405318 - RNA, 20 nt, Homo sapiens
cugcacauuuuguacaaaga

SEQ ID NO: 1405319 - RNA, 15 nt, Homo sapiens
cugcagccccccaga

SEQ ID NO: 1405320 - RNA, 16 nt, Homo sapiens
cugcagccccccagag

SEQ ID NO: 1405321 - RNA, 22 nt, Homo sapiens
cugcaugacaaacacacaucca

SEQ ID NO: 1405322 - RNA, 13 nt, Homo sapiens
cugccccuuccac

SEQ ID NO: 1405323 - RNA, 15 nt, Homo sapiens
cugccgagaguccau

SEQ ID NO: 1405324 - RNA, 18 nt, Homo sapiens
cugccgagaguccaucag

SEQ ID NO: 1405325 - RNA, 21 nt, Homo sapiens
cugccuugccaugucuuguuc

SEQ ID NO: 1405326 - RNA, 17 nt, Homo sapiens
cugccuuguccugaugc

SEQ ID NO: 1405327 - RNA, 19 nt, Homo sapiens
cugcuaaaggacaguggau

SEQ ID NO: 1405328 - RNA, 15 nt, Homo sapiens
cugcucauccaaagu

SEQ ID NO: 1405329 - RNA, 15 nt, Homo sapiens
cugcuccccacguca

SEQ ID NO: 1405330 - RNA, 19 nt, Homo sapiens
cugcuucccagcuucacaa

SEQ ID NO: 1405331 - RNA, 20 nt, Homo sapiens
cuggaaaggaggaaggagcc

SEQ ID NO: 1405332 - RNA, 17 nt, Homo sapiens
cuggaagaccugaaaga

SEQ ID NO: 1405333 - RNA, 20 nt, Homo sapiens
cuggagugcaguggugcgau

SEQ ID NO: 1405334 - RNA, 20 nt, Homo sapiens
cuggaucugugaggggcucu

SEQ ID NO: 1405335 - RNA, 21 nt, Homo sapiens
cuggcaguaaccuagugaauu

SEQ ID NO: 1405336 - RNA, 12 nt, Homo sapiens
cuggcccugugc

SEQ ID NO: 1405337 - RNA, 16 nt, Homo sapiens
cuggcucagccucaaa

SEQ ID NO: 1405338 - RNA, 20 nt, Homo sapiens
cuggcucccagggccaugaa

SEQ ID NO: 1405339 - RNA, 22 nt, Homo sapiens
cugggagccggaggcugcagug

SEQ ID NO: 1405340 - RNA, 18 nt, Homo sapiens
cugggaugggaacacugg

SEQ ID NO: 1405341 - RNA, 22 nt, Homo sapiens
cugggauuacaggugugagcca

SEQ ID NO: 1405342 - RNA, 14 nt, Homo sapiens
cugggcucaagcaa

SEQ ID NO: 1405343 - RNA, 19 nt, Homo sapiens
cugggcuuugucaugucuc

SEQ ID NO: 1405344 - RNA, 21 nt, Homo sapiens
cuggggaugucucucaugacc

SEQ ID NO: 1405345 - RNA, 21 nt, Homo sapiens
cuggggccgaaagaacagucc

SEQ ID NO: 1405346 - RNA, 19 nt, Homo sapiens
cuggggucaggugccacug

SEQ ID NO: 1405347 - RNA, 20 nt, Homo sapiens
cugggugacccccacugccg

SEQ ID NO: 1405348 - RNA, 22 nt, Homo sapiens
cugggugagcugagauggaguc

SEQ ID NO: 1405349 - RNA, 18 nt, Homo sapiens
cuggguuuaagcaaugcu

SEQ ID NO: 1405350 - RNA, 18 nt, Homo sapiens
cuggugguggcaccaucu

SEQ ID NO: 1405351 - RNA, 22 nt, Homo sapiens
cuguagcagcauuacagaaaua

SEQ ID NO: 1405352 - RNA, 22 nt, Homo sapiens
cugucccaggagcaaaugcugg

SEQ ID NO: 1405353 - RNA, 20 nt, Homo sapiens
cugucucaaaccuccaaaag

SEQ ID NO: 1405354 - RNA, 14 nt, Homo sapiens
cugugccuuuugcc

SEQ ID NO: 1405355 - RNA, 18 nt, Homo sapiens
cuguggaugauaaaacac

SEQ ID NO: 1405356 - RNA, 17 nt, Homo sapiens
cuguucuagagugacag

SEQ ID NO: 1405357 - RNA, 16 nt, Homo sapiens
cuguucuuuuguccca

SEQ ID NO: 1405358 - RNA, 14 nt, Homo sapiens
cuguuggucugucc

SEQ ID NO: 1405359 - RNA, 22 nt, Homo sapiens
cuuaaaaaucauucuaauuaca

SEQ ID NO: 1405360 - RNA, 18 nt, Homo sapiens
cuuaaaagaacauguaua

SEQ ID NO: 1405361 - RNA, 23 nt, Homo sapiens
cuuaaaccgccaaggcuggggga

SEQ ID NO: 1405362 - RNA, 17 nt, Homo sapiens
cuuaccgugggcacuga

SEQ ID NO: 1405363 - RNA, 14 nt, Homo sapiens
cuuagaaaaaccac

SEQ ID NO: 1405364 - RNA, 14 nt, Homo sapiens
cuuauccagucaaa

SEQ ID NO: 1405365 - RNA, 15 nt, Homo sapiens
cuuauccuguucucu

SEQ ID NO: 1405366 - RNA, 22 nt, Homo sapiens
cuuaugacuccccccuuccaaa

SEQ ID NO: 1405367 - RNA, 17 nt, Homo sapiens
cuucaaaccccuacuga

SEQ ID NO: 1405368 - RNA, 15 nt, Homo sapiens
cuucacuaccaaaug

SEQ ID NO: 1405369 - RNA, 23 nt, Homo sapiens
cuucacuaccaaaugagcauuag

SEQ ID NO: 1405370 - RNA, 19 nt, Homo sapiens
cuucacugcucugccccca

SEQ ID NO: 1405371 - RNA, 20 nt, Homo sapiens
cuucagaggauaaauaucaa

SEQ ID NO: 1405372 - RNA, 20 nt, Homo sapiens
cuucaguccacuucugcucu

SEQ ID NO: 1405373 - RNA, 13 nt, Homo sapiens
cuuccaaaucagg

SEQ ID NO: 1405374 - RNA, 21 nt, Homo sapiens
cuuccaacucaaacucuuaaa

SEQ ID NO: 1405375 - RNA, 23 nt, Homo sapiens
cuuccuuaccgugggcacugaag

SEQ ID NO: 1405376 - RNA, 16 nt, Homo sapiens
cuucuaguucugccag

SEQ ID NO: 1405377 - RNA, 20 nt, Homo sapiens
cuucuaguucugccaggaga

SEQ ID NO: 1405378 - RNA, 18 nt, Homo sapiens
cuucucagagcagcacug

SEQ ID NO: 1405379 - RNA, 20 nt, Homo sapiens
cuucucagagcagcacuggg

SEQ ID NO: 1405380 - RNA, 19 nt, Homo sapiens
cuucucugagcuccagugg

SEQ ID NO: 1405381 - RNA, 19 nt, Homo sapiens
cuucuggggucaggugcca

SEQ ID NO: 1405382 - RNA, 15 nt, Homo sapiens
cuucuuuccuguaua

SEQ ID NO: 1405383 - RNA, 22 nt, Homo sapiens
cuugccuguaaucccagcacuu

SEQ ID NO: 1405384 - RNA, 17 nt, Homo sapiens
cuugggagcaccgccug

SEQ ID NO: 1405385 - RNA, 15 nt, Homo sapiens
cuuguccugaugcug

SEQ ID NO: 1405386 - RNA, 22 nt, Homo sapiens
cuuuaaaauaaaauaauuuuau

SEQ ID NO: 1405387 - RNA, 11 nt, Homo sapiens
cuuuagccaua

SEQ ID NO: 1405388 - RNA, 15 nt, Homo sapiens
cuuuauuaaaacagu

SEQ ID NO: 1405389 - RNA, 16 nt, Homo sapiens
cuuuccaaccggcuuu

SEQ ID NO: 1405390 - RNA, 17 nt, Homo sapiens
cuuuccccgugggccau

SEQ ID NO: 1405391 - RNA, 16 nt, Homo sapiens
cuuuccccucccucag

SEQ ID NO: 1405392 - RNA, 16 nt, Homo sapiens
cuuuccucaucaggcc

SEQ ID NO: 1405393 - RNA, 12 nt, Homo sapiens
cuuucucagugu

SEQ ID NO: 1405394 - RNA, 22 nt, Homo sapiens
cuuucucuuuuaggaggcacaa

SEQ ID NO: 1405395 - RNA, 11 nt, Homo sapiens
cuuucuucccu

SEQ ID NO: 1405396 - RNA, 20 nt, Homo sapiens
cuuucuucccuacaguugaa

SEQ ID NO: 1405397 - RNA, 15 nt, Homo sapiens
cuuugaagaaaaaga

SEQ ID NO: 1405398 - RNA, 14 nt, Homo sapiens
cuuuggccauucca

SEQ ID NO: 1405399 - RNA, 16 nt, Homo sapiens
cuuuguggcacugggg

SEQ ID NO: 1405400 - RNA, 15 nt, Homo sapiens
cuuuuaaaugcauaa

SEQ ID NO: 1405401 - RNA, 13 nt, Homo sapiens
cuuuuaauucaaa

SEQ ID NO: 1405402 - RNA, 22 nt, Homo sapiens
cuuuuccaugcacccucauaca

SEQ ID NO: 1405403 - RNA, 14 nt, Homo sapiens
cuuuuucuaccuuu

SEQ ID NO: 1405404 - RNA, 18 nt, Homo sapiens
cuuuuuuauacucaauca

SEQ ID NO: 1405405 - RNA, 18 nt, Homo sapiens
gaaaaaaaauaauagaaa

SEQ ID NO: 1405406 - RNA, 21 nt, Homo sapiens
ccucugacauuuauccaagac

SEQ ID NO: 1405407 - RNA, 17 nt, Homo sapiens
ccucuuagaaaaaccac

SEQ ID NO: 1405408 - RNA, 17 nt, Homo sapiens
ccucuuggcugccuugu

SEQ ID NO: 1405409 - RNA, 23 nt, Homo sapiens
ccugagaagagagaucaaaugga

SEQ ID NO: 1405410 - RNA, 20 nt, Homo sapiens
ccugagauacugaagugcag

SEQ ID NO: 1405411 - RNA, 16 nt, Homo sapiens
ccugcaggcugcaguc

SEQ ID NO: 1405412 - RNA, 18 nt, Homo sapiens
ccugccuguucuccagau

SEQ ID NO: 1405413 - RNA, 12 nt, Homo sapiens
ccuggcaagaau

SEQ ID NO: 1405414 - RNA, 16 nt, Homo sapiens
ccuggcucagccucaa

SEQ ID NO: 1405415 - RNA, 16 nt, Homo sapiens
ccuggcuggugacaga

SEQ ID NO: 1405416 - RNA, 16 nt, Homo sapiens
ccugggaaccaugaag

SEQ ID NO: 1405417 - RNA, 15 nt, Homo sapiens
ccugugccuuuugcc

SEQ ID NO: 1405418 - RNA, 21 nt, Homo sapiens
ccuguucuuugggcucaaggg

SEQ ID NO: 1405419 - RNA, 17 nt, Homo sapiens
ccuguuuaaaaaaagua

SEQ ID NO: 1405420 - RNA, 15 nt, Homo sapiens
ccuuagaagaucugc

SEQ ID NO: 1405421 - RNA, 15 nt, Homo sapiens
ccuuagcuggcauua

SEQ ID NO: 1405422 - RNA, 12 nt, Homo sapiens
ccuucaugauga

SEQ ID NO: 1405423 - RNA, 20 nt, Homo sapiens
ccuugucguaggaaaaccau

SEQ ID NO: 1405424 - RNA, 22 nt, Homo sapiens
ccuuuccaaaugcccagcuuaa

SEQ ID NO: 1405425 - RNA, 22 nt, Homo sapiens
ccuuuugcaacaagacaaagca

SEQ ID NO: 1405426 - RNA, 14 nt, Homo sapiens
cgaccccaucucau

SEQ ID NO: 1405427 - RNA, 18 nt, Homo sapiens
cgacguuugacuagccau

SEQ ID NO: 1405428 - RNA, 20 nt, Homo sapiens
cgaugaauguguugauuuga

SEQ ID NO: 1405429 - RNA, 15 nt, Homo sapiens
cgauguacacacaca

SEQ ID NO: 1405430 - RNA, 15 nt, Homo sapiens
cgcaaacacaccgau

SEQ ID NO: 1405431 - RNA, 14 nt, Homo sapiens
cgcaccauugcacu

SEQ ID NO: 1405432 - RNA, 14 nt, Homo sapiens
cgcggaagugacca

SEQ ID NO: 1405433 - RNA, 23 nt, Homo sapiens
cgcuaguuaggaaguuaccugga

SEQ ID NO: 1405434 - RNA, 19 nt, Homo sapiens
cggaagaggcugcugagaa

SEQ ID NO: 1405435 - RNA, 14 nt, Homo sapiens
cggaggcugcagug

SEQ ID NO: 1405436 - RNA, 17 nt, Homo sapiens
cggaugcacacacagau

SEQ ID NO: 1405437 - RNA, 23 nt, Homo sapiens
cggccaggcugggcucugggauu

SEQ ID NO: 1405438 - RNA, 19 nt, Homo sapiens
cggcuaugggacugcagug

SEQ ID NO: 1405439 - RNA, 23 nt, Homo sapiens
cgucacccuugguagaguuuauu

SEQ ID NO: 1405440 - RNA, 15 nt, Homo sapiens
cgugugacuacuccc

SEQ ID NO: 1405441 - RNA, 15 nt, Homo sapiens
cguuggcucaguccu

SEQ ID NO: 1405442 - RNA, 13 nt, Homo sapiens
cguuguguuguug

SEQ ID NO: 1405443 - RNA, 15 nt, Homo sapiens
cuaaagucacauaua

SEQ ID NO: 1405444 - RNA, 15 nt, Homo sapiens
cuaauaaguauauaa

SEQ ID NO: 1405445 - RNA, 18 nt, Homo sapiens
cuaaucaauaccuacaag

SEQ ID NO: 1405446 - RNA, 20 nt, Homo sapiens
cuaauguggcagcugucuca

SEQ ID NO: 1405447 - RNA, 17 nt, Homo sapiens
cuaauuccacacccuca

SEQ ID NO: 1405448 - RNA, 12 nt, Homo sapiens
cuacacauauau

SEQ ID NO: 1405449 - RNA, 13 nt, Homo sapiens
cuaccucuuggcu

SEQ ID NO: 1405450 - RNA, 17 nt, Homo sapiens
cuaccuuuguccaggcc

SEQ ID NO: 1405451 - RNA, 17 nt, Homo sapiens
cuacugagacaugacua

SEQ ID NO: 1405452 - RNA, 17 nt, Homo sapiens
cuacuugagaaaaugca

SEQ ID NO: 1405453 - RNA, 15 nt, Homo sapiens
cuacuuguaaaggug

SEQ ID NO: 1405454 - RNA, 16 nt, Homo sapiens
cuacuuguaaaggugc

SEQ ID NO: 1405455 - RNA, 18 nt, Homo sapiens
cuacuuuuugcaccuuau

SEQ ID NO: 1405456 - RNA, 19 nt, Homo sapiens
cuagaacacccacuggcca

SEQ ID NO: 1405457 - RNA, 21 nt, Homo sapiens
cuagagugacaggcaccagau

SEQ ID NO: 1405458 - RNA, 15 nt, Homo sapiens
cuagauccacacaca

SEQ ID NO: 1405459 - RNA, 16 nt, Homo sapiens
cuagcaccaggacuca

SEQ ID NO: 1405460 - RNA, 13 nt, Homo sapiens
cuagccaucucaa

SEQ ID NO: 1405461 - RNA, 16 nt, Homo sapiens
cuagccaucucaagca

SEQ ID NO: 1405462 - RNA, 22 nt, Homo sapiens
cuaggauuacaggcaugagcca

SEQ ID NO: 1405463 - RNA, 17 nt, Homo sapiens
cuaguucuuaugagcua

SEQ ID NO: 1405464 - RNA, 20 nt, Homo sapiens
cuaucuacugagacaugacu

SEQ ID NO: 1405465 - RNA, 20 nt, Homo sapiens
cuaucugcuguauauggaau

SEQ ID NO: 1405466 - RNA, 13 nt, Homo sapiens
cuaugaucuuggc

SEQ ID NO: 1405467 - RNA, 18 nt, Homo sapiens
cuaugcgcuaguuaggaa

SEQ ID NO: 1405468 - RNA, 15 nt, Homo sapiens
cuauggcaucuuccc

SEQ ID NO: 1405469 - RNA, 19 nt, Homo sapiens
cuauucaggaggcugaggc

SEQ ID NO: 1405470 - RNA, 21 nt, Homo sapiens
cuauuuuaauaaagauucuau

SEQ ID NO: 1405471 - RNA, 21 nt, Homo sapiens
cucaaggaaaagaugugcucc

SEQ ID NO: 1405472 - RNA, 23 nt, Homo sapiens
cucaaggaaaagaugugcuccca

SEQ ID NO: 1405473 - RNA, 17 nt, Homo sapiens
cucaagucuucccugau

SEQ ID NO: 1405474 - RNA, 19 nt, Homo sapiens
cucaagucuucccugauca

SEQ ID NO: 1405475 - RNA, 18 nt, Homo sapiens
cucaccuggacuccagua

SEQ ID NO: 1405476 - RNA, 12 nt, Homo sapiens
cucacgccugua

SEQ ID NO: 1405477 - RNA, 13 nt, Homo sapiens
cucacugccaaaa

SEQ ID NO: 1405478 - RNA, 15 nt, Homo sapiens
cucagaggguguccu

SEQ ID NO: 1405479 - RNA, 16 nt, Homo sapiens
cucaggggucauucau

SEQ ID NO: 1405480 - RNA, 14 nt, Homo sapiens
cucauacacagaaa

SEQ ID NO: 1405481 - RNA, 13 nt, Homo sapiens
cucauccaaaguu

SEQ ID NO: 1405482 - RNA, 21 nt, Homo sapiens
cucaucccccagccacagugg

SEQ ID NO: 1405483 - RNA, 22 nt, Homo sapiens
cucaucuuagguuggcaaaaag

SEQ ID NO: 1405484 - RNA, 16 nt, Homo sapiens
cucaucuuucuuccaa

SEQ ID NO: 1405485 - RNA, 15 nt, Homo sapiens
cucauuccagaggaa

SEQ ID NO: 1405486 - RNA, 19 nt, Homo sapiens
cuccaggcacccccaggau

SEQ ID NO: 1405487 - RNA, 20 nt, Homo sapiens
cuccagggacagaagcagga

SEQ ID NO: 1405488 - RNA, 14 nt, Homo sapiens
cuccauucugacca

SEQ ID NO: 1405489 - RNA, 19 nt, Homo sapiens
cuccauucugaccauuuca

SEQ ID NO: 1405490 - RNA, 15 nt, Homo sapiens
cuccauuuaccagua

SEQ ID NO: 1405491 - RNA, 20 nt, Homo sapiens
cuccauuuaccaguaacuua

SEQ ID NO: 1405492 - RNA, 14 nt, Homo sapiens
cucccacaaaggag

SEQ ID NO: 1405493 - RNA, 12 nt, Homo sapiens
cucccaccaggc

SEQ ID NO: 1405494 - RNA, 16 nt, Homo sapiens
cucccaccuccuggug

SEQ ID NO: 1405495 - RNA, 20 nt, Homo sapiens
cucccuguuaauaaacagcu

SEQ ID NO: 1405496 - RNA, 14 nt, Homo sapiens
cuccucccaccagu

SEQ ID NO: 1405497 - RNA, 22 nt, Homo sapiens
cuccucgagaucccaacacugc

SEQ ID NO: 1405498 - RNA, 23 nt, Homo sapiens
cuccuggaccugaaggcaucuga

SEQ ID NO: 1405499 - RNA, 16 nt, Homo sapiens
cuccuggcccacugca

SEQ ID NO: 1405500 - RNA, 16 nt, Homo sapiens
cuccuguugcaaugac

SEQ ID NO: 1405501 - RNA, 13 nt, Homo sapiens
cuccuuagacuga

SEQ ID NO: 1405502 - RNA, 21 nt, Homo sapiens
cucgaagucauggccaccucc

SEQ ID NO: 1405503 - RNA, 13 nt, Homo sapiens
cucgagaucccaa

SEQ ID NO: 1405504 - RNA, 12 nt, Homo sapiens
cucuacccugag

SEQ ID NO: 1405505 - RNA, 21 nt, Homo sapiens
cucuacucuagggaaaaacca

SEQ ID NO: 1405506 - RNA, 18 nt, Homo sapiens
cucuccaucuuccacgaa

SEQ ID NO: 1405507 - RNA, 16 nt, Homo sapiens
cucuccuuuggccauu

SEQ ID NO: 1405508 - RNA, 23 nt, Homo sapiens
cucucgcaagggaaguccuugca

SEQ ID NO: 1405509 - RNA, 11 nt, Homo sapiens
cucucucauga

SEQ ID NO: 1405510 - RNA, 14 nt, Homo sapiens
cucugaacaaaagc

SEQ ID NO: 1405511 - RNA, 13 nt, Homo sapiens
cucugcacaagcu

SEQ ID NO: 1405512 - RNA, 18 nt, Homo sapiens
cucugcaugacaaacaca

SEQ ID NO: 1405513 - RNA, 17 nt, Homo sapiens
cucugguuagaaaaagg

SEQ ID NO: 1405514 - RNA, 23 nt, Homo sapiens
cucuucuccaccucccacaaagg

SEQ ID NO: 1405515 - RNA, 21 nt, Homo sapiens
cugaaaagauguugugucuug

SEQ ID NO: 1405516 - RNA, 15 nt, Homo sapiens
cugaagauaaucuua

SEQ ID NO: 1405517 - RNA, 14 nt, Homo sapiens
cugaaguacuuaaa

SEQ ID NO: 1405518 - RNA, 20 nt, Homo sapiens
cugaaguacuuaaacuucca

SEQ ID NO: 1405519 - RNA, 20 nt, Homo sapiens
cugaagucucuucucucuua

SEQ ID NO: 1405520 - RNA, 12 nt, Homo sapiens
cugaagugcagc

SEQ ID NO: 1405521 - RNA, 20 nt, Homo sapiens
cugacagaaaugcaaucucc

SEQ ID NO: 1405522 - RNA, 12 nt, Homo sapiens
cugaccaagaga

SEQ ID NO: 1405523 - RNA, 22 nt, Homo sapiens
cugacccuaaauguggacauca

SEQ ID NO: 1405524 - RNA, 15 nt, Homo sapiens
cugacuuucucucca

SEQ ID NO: 1405525 - RNA, 21 nt, Homo sapiens
cugagaaagagaaugagaaga

SEQ ID NO: 1405526 - RNA, 18 nt, Homo sapiens
cugagacaugacuaggaa

SEQ ID NO: 1405527 - RNA, 20 nt, Homo sapiens
cugagacauucuucaccucc

SEQ ID NO: 1405528 - RNA, 23 nt, Homo sapiens
cugaguccagcuccccccaagau

SEQ ID NO: 1405529 - RNA, 15 nt, Homo sapiens
cugaguuugcuuuca

SEQ ID NO: 1405530 - RNA, 20 nt, Homo sapiens
cugauuuuaucauucugcuu

SEQ ID NO: 1405531 - RNA, 20 nt, Homo sapiens
cugcaccagugugacaucua

SEQ ID NO: 1405532 - RNA, 19 nt, Homo sapiens
cugcaccggggccugggca

SEQ ID NO: 1405533 - RNA, 21 nt, Homo sapiens
cugcagcacuucacuaccaaa

SEQ ID NO: 1405534 - RNA, 18 nt, Homo sapiens
cugcagcagagccuggaa

SEQ ID NO: 1405535 - RNA, 21 nt, Homo sapiens
cugcagcuuuguuuguuguca

SEQ ID NO: 1405536 - RNA, 22 nt, Homo sapiens
cugcagggggugugucugcuca

SEQ ID NO: 1405537 - RNA, 20 nt, Homo sapiens
cugcagguacuuccucaguc

SEQ ID NO: 1405538 - RNA, 16 nt, Homo sapiens
cugccagcauuucccu

SEQ ID NO: 1405539 - RNA, 15 nt, Homo sapiens
cugccaugccagcuu

SEQ ID NO: 1405540 - RNA, 20 nt, Homo sapiens
cugcccaggcuagagugcag

SEQ ID NO: 1405541 - RNA, 23 nt, Homo sapiens
cugccuccuuuccccucccucag

SEQ ID NO: 1405542 - RNA, 22 nt, Homo sapiens
cugccugggccucccaaagugc

SEQ ID NO: 1405543 - RNA, 20 nt, Homo sapiens
cugcucgaagaacaauguca

SEQ ID NO: 1405544 - RNA, 20 nt, Homo sapiens
cugcucugguuagaaaaagg

SEQ ID NO: 1405545 - RNA, 16 nt, Homo sapiens
cugcugcccaggcuag

SEQ ID NO: 1405546 - RNA, 14 nt, Homo sapiens
cuggaaggacaucu

SEQ ID NO: 1405547 - RNA, 15 nt, Homo sapiens
cuggaaggacaucua

SEQ ID NO: 1405548 - RNA, 18 nt, Homo sapiens
cuggacauauguuaggaa

SEQ ID NO: 1405549 - RNA, 15 nt, Homo sapiens
cuggaccacugggca

SEQ ID NO: 1405550 - RNA, 22 nt, Homo sapiens
cuggcaaugcccuaccugccug

SEQ ID NO: 1405551 - RNA, 13 nt, Homo sapiens
cuggccucuagaa

SEQ ID NO: 1405552 - RNA, 21 nt, Homo sapiens
cuggcucccagggccaugaac

SEQ ID NO: 1405553 - RNA, 17 nt, Homo sapiens
cuggggccgaaagaaca

SEQ ID NO: 1405554 - RNA, 23 nt, Homo sapiens
cuggguuuaagcaaugcuucugc

SEQ ID NO: 1405555 - RNA, 20 nt, Homo sapiens
cuguagcagcauuacagaaa

SEQ ID NO: 1405556 - RNA, 15 nt, Homo sapiens
cuguccaguuuccaa

SEQ ID NO: 1405557 - RNA, 12 nt, Homo sapiens
cugucccaaaga

SEQ ID NO: 1405558 - RNA, 16 nt, Homo sapiens
cugucuggcugaggau

SEQ ID NO: 1405559 - RNA, 16 nt, Homo sapiens
cugucugucccaaaga

SEQ ID NO: 1405560 - RNA, 21 nt, Homo sapiens
cugugaggggcucucucauga

SEQ ID NO: 1405561 - RNA, 13 nt, Homo sapiens
cugugcaugccau

SEQ ID NO: 1405562 - RNA, 17 nt, Homo sapiens
cuguguccgcuuucaug

SEQ ID NO: 1405563 - RNA, 23 nt, Homo sapiens
cugugucuuauagguuuccacug

SEQ ID NO: 1405564 - RNA, 14 nt, Homo sapiens
cuguuaauagucau

SEQ ID NO: 1405565 - RNA, 22 nt, Homo sapiens
cuguuacugcuugggcuauacc

SEQ ID NO: 1405566 - RNA, 12 nt, Homo sapiens
cuguuggucugu

SEQ ID NO: 1405567 - RNA, 15 nt, Homo sapiens
cuguuuauugaagaa

SEQ ID NO: 1405568 - RNA, 12 nt, Homo sapiens
cuuaaacuucca

SEQ ID NO: 1405569 - RNA, 17 nt, Homo sapiens
cuuaacucugaugguuc

SEQ ID NO: 1405570 - RNA, 16 nt, Homo sapiens
cuuagcugucugcuca

SEQ ID NO: 1405571 - RNA, 15 nt, Homo sapiens
cuuaggccagcacca

SEQ ID NO: 1405572 - RNA, 21 nt, Homo sapiens
cuuauagguuuccacugccaa

SEQ ID NO: 1405573 - RNA, 19 nt, Homo sapiens
cuuaucaacauuuguucca

SEQ ID NO: 1405574 - RNA, 17 nt, Homo sapiens
cuuaucaccacaccacu

SEQ ID NO: 1405575 - RNA, 17 nt, Homo sapiens
cuuauuuuugacagugu

SEQ ID NO: 1405576 - RNA, 15 nt, Homo sapiens
cuucacgccugggug

SEQ ID NO: 1405577 - RNA, 21 nt, Homo sapiens
cuucagaggauaaauaucaau

SEQ ID NO: 1405578 - RNA, 14 nt, Homo sapiens
cuucagauuugccu

SEQ ID NO: 1405579 - RNA, 13 nt, Homo sapiens
cuucauuaccuca

SEQ ID NO: 1405580 - RNA, 14 nt, Homo sapiens
cuucauuaccucag

SEQ ID NO: 1405581 - RNA, 14 nt, Homo sapiens
cuuccaaacaggcu

SEQ ID NO: 1405582 - RNA, 18 nt, Homo sapiens
cuuccacaagagugaauu

SEQ ID NO: 1405583 - RNA, 21 nt, Homo sapiens
cuucccacggcuccucgagau

SEQ ID NO: 1405584 - RNA, 23 nt, Homo sapiens
cuucccccaaggcugaugcauuc

SEQ ID NO: 1405585 - RNA, 12 nt, Homo sapiens
cuuccugcagua

SEQ ID NO: 1405586 - RNA, 23 nt, Homo sapiens
cuucuaccucuuggcugccuugu

SEQ ID NO: 1405587 - RNA, 18 nt, Homo sapiens
cuucuauuccauggcuaa

SEQ ID NO: 1405588 - RNA, 16 nt, Homo sapiens
cuucuguaugugacaa

SEQ ID NO: 1405589 - RNA, 22 nt, Homo sapiens
cuugaaagaaaauaccaaggaa

SEQ ID NO: 1405590 - RNA, 16 nt, Homo sapiens
cuugagaaaaugcagg

SEQ ID NO: 1405591 - RNA, 14 nt, Homo sapiens
cuugagucugaggc

SEQ ID NO: 1405592 - RNA, 19 nt, Homo sapiens
cuuggcagcccgggucauc

SEQ ID NO: 1405593 - RNA, 21 nt, Homo sapiens
cuugucacgccagacuuccca

SEQ ID NO: 1405594 - RNA, 13 nt, Homo sapiens
cuuguccugaugc

SEQ ID NO: 1405595 - RNA, 15 nt, Homo sapiens
cuuguggcacuccaa

SEQ ID NO: 1405596 - RNA, 12 nt, Homo sapiens
cuuuaaaugccu

SEQ ID NO: 1405597 - RNA, 19 nt, Homo sapiens
cuuuaccccucauccaaag

SEQ ID NO: 1405598 - RNA, 14 nt, Homo sapiens
cuuucauacauuau

SEQ ID NO: 1405599 - RNA, 15 nt, Homo sapiens
cuuuccaaaaucagg

SEQ ID NO: 1405600 - RNA, 14 nt, Homo sapiens
cuuuccaaccggcu

SEQ ID NO: 1405601 - RNA, 20 nt, Homo sapiens
cuuucugcaggaaauaguca

SEQ ID NO: 1405602 - RNA, 16 nt, Homo sapiens
cuuucuuccaaacagg

SEQ ID NO: 1405603 - RNA, 16 nt, Homo sapiens
cuuugcaggcccagca

SEQ ID NO: 1405604 - RNA, 14 nt, Homo sapiens
cuuugcugccugag

SEQ ID NO: 1405605 - RNA, 13 nt, Homo sapiens
cuuugucccagaa

SEQ ID NO: 1405606 - RNA, 16 nt, Homo sapiens
cuuuuaaaugcauaaa

SEQ ID NO: 1405607 - RNA, 15 nt, Homo sapiens
cuuuuaccaacccaa

SEQ ID NO: 1405608 - RNA, 23 nt, Homo sapiens
cuuuucggaacacuaaaaccaua

SEQ ID NO: 1405609 - RNA, 13 nt, Homo sapiens
cuuuugucccaga

SEQ ID NO: 1405610 - RNA, 17 nt, Homo sapiens
cuuuuguuuaccagaga

SEQ ID NO: 1405611 - RNA, 12 nt, Homo sapiens
cuuuuuccagag

SEQ ID NO: 1405612 - RNA, 22 nt, Homo sapiens
gaaaaaaaaaaaaaagaacaac

SEQ ID NO: 1405613 - RNA, 19 nt, Homo sapiens
gaaaaauaugauacucuca

SEQ ID NO: 1405614 - RNA, 12 nt, Homo sapiens
gaaaacauaugc

SEQ ID NO: 1405615 - RNA, 17 nt, Homo sapiens
gaaaauguuaugugcuc

SEQ ID NO: 1405616 - RNA, 15 nt, Homo sapiens
gaaacaaacaucuaa

SEQ ID NO: 1405617 - RNA, 16 nt, Homo sapiens
gaaacacugugcaaag

SEQ ID NO: 1405618 - RNA, 20 nt, Homo sapiens
gaaaccuguccauaaaguaa

SEQ ID NO: 1405619 - RNA, 21 nt, Homo sapiens
gaaacugaggccauuauuuca

SEQ ID NO: 1405620 - RNA, 18 nt, Homo sapiens
gaaagcuucaaacugcau

SEQ ID NO: 1405621 - RNA, 19 nt, Homo sapiens
gaaaggaggaaggagccua

SEQ ID NO: 1405622 - RNA, 14 nt, Homo sapiens
auggaugagcacac

SEQ ID NO: 1405623 - RNA, 17 nt, Homo sapiens
auggaugagcacacaca

SEQ ID NO: 1405624 - RNA, 14 nt, Homo sapiens
auggauuuccagcc

SEQ ID NO: 1405625 - RNA, 14 nt, Homo sapiens
augggaacacuggu

SEQ ID NO: 1405626 - RNA, 23 nt, Homo sapiens
augggauuucaccguauuagcca

SEQ ID NO: 1405627 - RNA, 17 nt, Homo sapiens
augguauuaguugacca

SEQ ID NO: 1405628 - RNA, 15 nt, Homo sapiens
auguaaguacuucca

SEQ ID NO: 1405629 - RNA, 15 nt, Homo sapiens
auguacacacacaga

SEQ ID NO: 1405630 - RNA, 20 nt, Homo sapiens
auguacacacacagaugcac

SEQ ID NO: 1405631 - RNA, 14 nt, Homo sapiens
augucaauugucag

SEQ ID NO: 1405632 - RNA, 16 nt, Homo sapiens
augucaugucagcucc

SEQ ID NO: 1405633 - RNA, 13 nt, Homo sapiens
augucucucauga

SEQ ID NO: 1405634 - RNA, 22 nt, Homo sapiens
augugauaaaaccccaucucua

SEQ ID NO: 1405635 - RNA, 18 nt, Homo sapiens
auguggcagcugucucaa

SEQ ID NO: 1405636 - RNA, 11 nt, Homo sapiens
auguguugccu

SEQ ID NO: 1405637 - RNA, 20 nt, Homo sapiens
auguguugccuggaagcaca

SEQ ID NO: 1405638 - RNA, 17 nt, Homo sapiens
auguugcuuuugcaccu

SEQ ID NO: 1405639 - RNA, 18 nt, Homo sapiens
auguugcuuuugcaccua

SEQ ID NO: 1405640 - RNA, 14 nt, Homo sapiens
auuaagugacuaua

SEQ ID NO: 1405641 - RNA, 17 nt, Homo sapiens
auuacaaaaacauggcc

SEQ ID NO: 1405642 - RNA, 18 nt, Homo sapiens
auuauaauuaguuccuca

SEQ ID NO: 1405643 - RNA, 14 nt, Homo sapiens
auucagcucugcaa

SEQ ID NO: 1405644 - RNA, 16 nt, Homo sapiens
auuccccacccugaaa

SEQ ID NO: 1405645 - RNA, 14 nt, Homo sapiens
auucucaccugccu

SEQ ID NO: 1405646 - RNA, 23 nt, Homo sapiens
auucuguuuuguaaauguaagaa

SEQ ID NO: 1405647 - RNA, 13 nt, Homo sapiens
auucuuccugcuu

SEQ ID NO: 1405648 - RNA, 13 nt, Homo sapiens
auucuuucccaac

SEQ ID NO: 1405649 - RNA, 17 nt, Homo sapiens
auucuuucccaacaccu

SEQ ID NO: 1405650 - RNA, 21 nt, Homo sapiens
auugaaagggaguauuacaaa

SEQ ID NO: 1405651 - RNA, 15 nt, Homo sapiens
auugaagaacuggca

SEQ ID NO: 1405652 - RNA, 16 nt, Homo sapiens
auugcaggagucccug

SEQ ID NO: 1405653 - RNA, 16 nt, Homo sapiens
auugccccauugcuca

SEQ ID NO: 1405654 - RNA, 22 nt, Homo sapiens
agagugcaguggcgugaucucg

SEQ ID NO: 1405655 - RNA, 20 nt, Homo sapiens
agauaacagauuaguaguua

SEQ ID NO: 1405656 - RNA, 20 nt, Homo sapiens
agauaaucuuagcugccaag

SEQ ID NO: 1405657 - RNA, 23 nt, Homo sapiens
agauacugaagugcagcucagga

SEQ ID NO: 1405658 - RNA, 15 nt, Homo sapiens
agauauacacaugga

SEQ ID NO: 1405659 - RNA, 20 nt, Homo sapiens
agauaugcacacacacggau

SEQ ID NO: 1405660 - RNA, 20 nt, Homo sapiens
agauaugcacacacauggau

SEQ ID NO: 1405661 - RNA, 14 nt, Homo sapiens
agaugccuucccuu

SEQ ID NO: 1405662 - RNA, 14 nt, Homo sapiens
agauucucaccugc

SEQ ID NO: 1405663 - RNA, 22 nt, Homo sapiens
agauuguucuguccaguuucca

SEQ ID NO: 1405664 - RNA, 17 nt, Homo sapiens
agauuuuaagggggaaa

SEQ ID NO: 1405665 - RNA, 14 nt, Homo sapiens
agcaacugugcuac

SEQ ID NO: 1405666 - RNA, 14 nt, Homo sapiens
agcaagaccuggag

SEQ ID NO: 1405667 - RNA, 17 nt, Homo sapiens
agcaagacucugucuca

SEQ ID NO: 1405668 - RNA, 16 nt, Homo sapiens
agcaagucacuggcca

SEQ ID NO: 1405669 - RNA, 11 nt, Homo sapiens
agcacaugugu

SEQ ID NO: 1405670 - RNA, 22 nt, Homo sapiens
agcagugauuguuaugccuugc

SEQ ID NO: 1405671 - RNA, 16 nt, Homo sapiens
agcaguggcuccauug

SEQ ID NO: 1405672 - RNA, 20 nt, Homo sapiens
agcauaggaaaccacacaga

SEQ ID NO: 1405673 - RNA, 20 nt, Homo sapiens
agcauggcccgggccuuauc

SEQ ID NO: 1405674 - RNA, 17 nt, Homo sapiens
agcauuuagucuugcca

SEQ ID NO: 1405675 - RNA, 17 nt, Homo sapiens
agccagaggucuggccc

SEQ ID NO: 1405676 - RNA, 15 nt, Homo sapiens
agccagccaggacuc

SEQ ID NO: 1405677 - RNA, 22 nt, Homo sapiens
agccaggauggucuugaucucc

SEQ ID NO: 1405678 - RNA, 13 nt, Homo sapiens
agcccaccccuca

SEQ ID NO: 1405679 - RNA, 19 nt, Homo sapiens
agcccaccccucaacaccu

SEQ ID NO: 1405680 - RNA, 23 nt, Homo sapiens
agcccgggucaucuguaccucug

SEQ ID NO: 1405681 - RNA, 20 nt, Homo sapiens
agccgagauugcaccacugc

SEQ ID NO: 1405682 - RNA, 17 nt, Homo sapiens
agccgggagccugaccc

SEQ ID NO: 1405683 - RNA, 11 nt, Homo sapiens
agccuauggca

SEQ ID NO: 1405684 - RNA, 16 nt, Homo sapiens
agccucaaaugcagua

SEQ ID NO: 1405685 - RNA, 16 nt, Homo sapiens
agccucugaaaaccaa

SEQ ID NO: 1405686 - RNA, 15 nt, Homo sapiens
agccugaguuugcuu

SEQ ID NO: 1405687 - RNA, 17 nt, Homo sapiens
agccugcuccagcuguu

SEQ ID NO: 1405688 - RNA, 14 nt, Homo sapiens
agccuggacccugu

SEQ ID NO: 1405689 - RNA, 18 nt, Homo sapiens
agccugggcgacagagca

SEQ ID NO: 1405690 - RNA, 20 nt, Homo sapiens
agcuauuagcaacugugcua

SEQ ID NO: 1405691 - RNA, 21 nt, Homo sapiens
agcucaagucuucccugauca

SEQ ID NO: 1405692 - RNA, 22 nt, Homo sapiens
agcucaggaaccgaggcaggga

SEQ ID NO: 1405693 - RNA, 19 nt, Homo sapiens
agcuccagcuguuaccuga

SEQ ID NO: 1405694 - RNA, 13 nt, Homo sapiens
agcucuacucugg

SEQ ID NO: 1405695 - RNA, 17 nt, Homo sapiens
agcugaacaaugaaugc

SEQ ID NO: 1405696 - RNA, 15 nt, Homo sapiens
agcuguagaacucug

SEQ ID NO: 1405697 - RNA, 15 nt, Homo sapiens
agcuuaaagagaaaa

SEQ ID NO: 1405698 - RNA, 19 nt, Homo sapiens
agcuuucugcuaucaaaga

SEQ ID NO: 1405699 - RNA, 15 nt, Homo sapiens
aggaaaaugaauaau

SEQ ID NO: 1405700 - RNA, 22 nt, Homo sapiens
aggaacugggccaacucaccug

SEQ ID NO: 1405701 - RNA, 23 nt, Homo sapiens
aggacaucucugcccucuucuca

SEQ ID NO: 1405702 - RNA, 16 nt, Homo sapiens
aggagaaucacuggaa

SEQ ID NO: 1405703 - RNA, 23 nt, Homo sapiens
aggagaaucacuggaaccuggga

SEQ ID NO: 1405704 - RNA, 20 nt, Homo sapiens
aggagagcuagcagcaggga

SEQ ID NO: 1405705 - RNA, 22 nt, Homo sapiens
aggagccggugcucuggaagac

SEQ ID NO: 1405706 - RNA, 15 nt, Homo sapiens
aggagggcaggcauc

SEQ ID NO: 1405707 - RNA, 15 nt, Homo sapiens
aggagucccugccau

SEQ ID NO: 1405708 - RNA, 21 nt, Homo sapiens
aggagucccugccaucauguu

SEQ ID NO: 1405709 - RNA, 13 nt, Homo sapiens
aggcaacugcauu

SEQ ID NO: 1405710 - RNA, 15 nt, Homo sapiens
aggcaauggccuaaa

SEQ ID NO: 1405711 - RNA, 20 nt, Homo sapiens
aggcagcuccagcuguuacc

SEQ ID NO: 1405712 - RNA, 15 nt, Homo sapiens
aggccacacuggcau

SEQ ID NO: 1405713 - RNA, 19 nt, Homo sapiens
aggccacacuggcaucucc

SEQ ID NO: 1405714 - RNA, 23 nt, Homo sapiens
aggccacacuggcaucucccuga

SEQ ID NO: 1405715 - RNA, 16 nt, Homo sapiens
aggccauggugcacaa

SEQ ID NO: 1405716 - RNA, 13 nt, Homo sapiens
aggcccaagagau

SEQ ID NO: 1405717 - RNA, 12 nt, Homo sapiens
aggccccggcug

SEQ ID NO: 1405718 - RNA, 18 nt, Homo sapiens
aggcugcagucccuggaa

SEQ ID NO: 1405719 - RNA, 20 nt, Homo sapiens
aggcuggguugucacugaga

SEQ ID NO: 1405720 - RNA, 18 nt, Homo sapiens
agggaaacccaucuucac

SEQ ID NO: 1405721 - RNA, 15 nt, Homo sapiens
agggcugccuuugga

SEQ ID NO: 1405722 - RNA, 21 nt, Homo sapiens
aggggaccacaccucccugaa

SEQ ID NO: 1405723 - RNA, 15 nt, Homo sapiens
aggggcucucucaug

SEQ ID NO: 1405724 - RNA, 23 nt, Homo sapiens
aggggcuguugaauuucccacau

SEQ ID NO: 1405725 - RNA, 12 nt, Homo sapiens
aggguaacucuu

SEQ ID NO: 1405726 - RNA, 14 nt, Homo sapiens
agggugacuaugga

SEQ ID NO: 1405727 - RNA, 21 nt, Homo sapiens
aggguugggcgugcuaccugc

SEQ ID NO: 1405728 - RNA, 16 nt, Homo sapiens
aggucaauuuccugau

SEQ ID NO: 1405729 - RNA, 18 nt, Homo sapiens
aggucaauuuccugaugc

SEQ ID NO: 1405730 - RNA, 20 nt, Homo sapiens
agguggagugucacaucucu

SEQ ID NO: 1405731 - RNA, 20 nt, Homo sapiens
aggugggaggauugcuugag

SEQ ID NO: 1405732 - RNA, 17 nt, Homo sapiens
agguuagcugcucccca

SEQ ID NO: 1405733 - RNA, 13 nt, Homo sapiens
aguaauugugaaa

SEQ ID NO: 1405734 - RNA, 13 nt, Homo sapiens
aguauccacuuug

SEQ ID NO: 1405735 - RNA, 15 nt, Homo sapiens
aguauguggaagugu

SEQ ID NO: 1405736 - RNA, 16 nt, Homo sapiens
aguccagcacuggaag

SEQ ID NO: 1405737 - RNA, 23 nt, Homo sapiens
agucccuggaaaaacagucacug

SEQ ID NO: 1405738 - RNA, 19 nt, Homo sapiens
agucugucugucugaugau

SEQ ID NO: 1405739 - RNA, 13 nt, Homo sapiens
agugaacacacuc

SEQ ID NO: 1405740 - RNA, 14 nt, Homo sapiens
agugaacacacuca

SEQ ID NO: 1405741 - RNA, 13 nt, Homo sapiens
agugagagggcau

SEQ ID NO: 1405742 - RNA, 16 nt, Homo sapiens
agugauuguuaugccu

SEQ ID NO: 1405743 - RNA, 20 nt, Homo sapiens
agugcaauggcacgaucuca

SEQ ID NO: 1405744 - RNA, 19 nt, Homo sapiens
agugcacacggaugcacag

SEQ ID NO: 1405745 - RNA, 20 nt, Homo sapiens
agugcaguggcgugaucucg

SEQ ID NO: 1405746 - RNA, 23 nt, Homo sapiens
agugcaguggugcgaucuuggcu

SEQ ID NO: 1405747 - RNA, 15 nt, Homo sapiens
agugcugaccagaca

SEQ ID NO: 1405748 - RNA, 17 nt, Homo sapiens
agugcuuguuccucuca

SEQ ID NO: 1405749 - RNA, 13 nt, Homo sapiens
aguggaguucucu

SEQ ID NO: 1405750 - RNA, 20 nt, Homo sapiens
aguggugcgaucuuggcuca

SEQ ID NO: 1405751 - RNA, 23 nt, Homo sapiens
aguguccagaccauugucuucca

SEQ ID NO: 1405752 - RNA, 23 nt, Homo sapiens
aguuacaugguaauuaugugaua

SEQ ID NO: 1405753 - RNA, 21 nt, Homo sapiens
aguucacaggccagaaaacau

SEQ ID NO: 1405754 - RNA, 21 nt, Homo sapiens
aguuccucauuagcauuuugc

SEQ ID NO: 1405755 - RNA, 20 nt, Homo sapiens
aguugaagggaauacugugc

SEQ ID NO: 1405756 - RNA, 15 nt, Homo sapiens
aguugauucagcucu

SEQ ID NO: 1405757 - RNA, 13 nt, Homo sapiens
aguuugcuuucaa

SEQ ID NO: 1405758 - RNA, 18 nt, Homo sapiens
aguuuucuuuccaaaauc

SEQ ID NO: 1405759 - RNA, 20 nt, Homo sapiens
auaaaauauucauauauuau

SEQ ID NO: 1405760 - RNA, 12 nt, Homo sapiens
auaaacagcucu

SEQ ID NO: 1405761 - RNA, 21 nt, Homo sapiens
auaaaguaugguauugaaacu

SEQ ID NO: 1405762 - RNA, 15 nt, Homo sapiens
accaaaugagcauua

SEQ ID NO: 1405763 - RNA, 11 nt, Homo sapiens
accaaccuggg

SEQ ID NO: 1405764 - RNA, 14 nt, Homo sapiens
accacuaggguccu

SEQ ID NO: 1405765 - RNA, 13 nt, Homo sapiens
accacucaggaau

SEQ ID NO: 1405766 - RNA, 21 nt, Homo sapiens
accacuuuccccgugggccau

SEQ ID NO: 1405767 - RNA, 21 nt, Homo sapiens
accagaauugcuugaacccag

SEQ ID NO: 1405768 - RNA, 12 nt, Homo sapiens
accagauuugcu

SEQ ID NO: 1405769 - RNA, 16 nt, Homo sapiens
accagcccugcugcuu

SEQ ID NO: 1405770 - RNA, 16 nt, Homo sapiens
accagggccaucuccu

SEQ ID NO: 1405771 - RNA, 18 nt, Homo sapiens
accaguggcccccacuca

SEQ ID NO: 1405772 - RNA, 23 nt, Homo sapiens
accaguggcccccacucacaggg

SEQ ID NO: 1405773 - RNA, 17 nt, Homo sapiens
accagugugacaucuac

SEQ ID NO: 1405774 - RNA, 17 nt, Homo sapiens
accaucucuuuaccucc

SEQ ID NO: 1405775 - RNA, 20 nt, Homo sapiens
accaucucuuuaccuccuaa

SEQ ID NO: 1405776 - RNA, 11 nt, Homo sapiens
accaugaagcu

SEQ ID NO: 1405777 - RNA, 20 nt, Homo sapiens
accaugauuaaccacuucag

SEQ ID NO: 1405778 - RNA, 14 nt, Homo sapiens
accauuucagagag

SEQ ID NO: 1405779 - RNA, 17 nt, Homo sapiens
acccagccugagugcac

SEQ ID NO: 1405780 - RNA, 16 nt, Homo sapiens
acccagcuaugguucu

SEQ ID NO: 1405781 - RNA, 21 nt, Homo sapiens
acccauuucuacuuuuugcac

SEQ ID NO: 1405782 - RNA, 20 nt, Homo sapiens
accccacaccccagcccacc

SEQ ID NO: 1405783 - RNA, 12 nt, Homo sapiens
accccaucucau

SEQ ID NO: 1405784 - RNA, 20 nt, Homo sapiens
acccccccuccugcugccua

SEQ ID NO: 1405785 - RNA, 16 nt, Homo sapiens
accccucaacaccucu

SEQ ID NO: 1405786 - RNA, 22 nt, Homo sapiens
acccgguccugcccuuccugaa

SEQ ID NO: 1405787 - RNA, 16 nt, Homo sapiens
acccuaaaacaugugu

SEQ ID NO: 1405788 - RNA, 15 nt, Homo sapiens
acccuaauguggcag

SEQ ID NO: 1405789 - RNA, 20 nt, Homo sapiens
acccuacuucuuuugcucuu

SEQ ID NO: 1405790 - RNA, 14 nt, Homo sapiens
accgcuugccauau

SEQ ID NO: 1405791 - RNA, 21 nt, Homo sapiens
accuaauaagugcuacuuugc

SEQ ID NO: 1405792 - RNA, 17 nt, Homo sapiens
accuacuuuuucuuuga

SEQ ID NO: 1405793 - RNA, 15 nt, Homo sapiens
accuccacauaccug

SEQ ID NO: 1405794 - RNA, 18 nt, Homo sapiens
accucguuacucucaccu

SEQ ID NO: 1405795 - RNA, 15 nt, Homo sapiens
accucugcacaagcu

SEQ ID NO: 1405796 - RNA, 22 nt, Homo sapiens
accugagauacugaagugcagc

SEQ ID NO: 1405797 - RNA, 18 nt, Homo sapiens
accuggcccugugccuug

SEQ ID NO: 1405798 - RNA, 18 nt, Homo sapiens
accuguccauaaaguaau

SEQ ID NO: 1405799 - RNA, 14 nt, Homo sapiens
accuucuaccucuu

SEQ ID NO: 1405800 - RNA, 14 nt, Homo sapiens
acgaaacacugugc

SEQ ID NO: 1405801 - RNA, 20 nt, Homo sapiens
acgaauucuucuggggucag

SEQ ID NO: 1405802 - RNA, 13 nt, Homo sapiens
acgaucucagcuc

SEQ ID NO: 1405803 - RNA, 14 nt, Homo sapiens
acgccaaugcacac

SEQ ID NO: 1405804 - RNA, 15 nt, Homo sapiens
acgccagaacugcuu

SEQ ID NO: 1405805 - RNA, 12 nt, Homo sapiens
acggacacucaa

SEQ ID NO: 1405806 - RNA, 17 nt, Homo sapiens
acguagauuuuugcucu

SEQ ID NO: 1405807 - RNA, 19 nt, Homo sapiens
acgugaguacaucaccuaa

SEQ ID NO: 1405808 - RNA, 16 nt, Homo sapiens
acuacauaucuaaagc

SEQ ID NO: 1405809 - RNA, 17 nt, Homo sapiens
acuacuuuuggugcuua

SEQ ID NO: 1405810 - RNA, 13 nt, Homo sapiens
acuagccaucuca

SEQ ID NO: 1405811 - RNA, 14 nt, Homo sapiens
acuagccaucucaa

SEQ ID NO: 1405812 - RNA, 15 nt, Homo sapiens
acuagccaucucaag

SEQ ID NO: 1405813 - RNA, 19 nt, Homo sapiens
acuagcuaaaaccaaagga

SEQ ID NO: 1405814 - RNA, 23 nt, Homo sapiens
acuaggcacuguggcucugcaug

SEQ ID NO: 1405815 - RNA, 20 nt, Homo sapiens
acuauagaaugcaacuccau

SEQ ID NO: 1405816 - RNA, 21 nt, Homo sapiens
acuauggagcugagcaggugu

SEQ ID NO: 1405817 - RNA, 19 nt, Homo sapiens
acuccaagauucaaagaga

SEQ ID NO: 1405818 - RNA, 13 nt, Homo sapiens
acuccaguaaaaa

SEQ ID NO: 1405819 - RNA, 15 nt, Homo sapiens
acuccucacagcauc

SEQ ID NO: 1405820 - RNA, 23 nt, Homo sapiens
acugaaaaaugguaauuguugcu

SEQ ID NO: 1405821 - RNA, 14 nt, Homo sapiens
acugaaggcuuuca

SEQ ID NO: 1405822 - RNA, 14 nt, Homo sapiens
acugagacuagauu

SEQ ID NO: 1405823 - RNA, 16 nt, Homo sapiens
acugcaagcucugccu

SEQ ID NO: 1405824 - RNA, 13 nt, Homo sapiens
acugcagcuuugu

SEQ ID NO: 1405825 - RNA, 20 nt, Homo sapiens
acugcgccacggcacuccag

SEQ ID NO: 1405826 - RNA, 17 nt, Homo sapiens
acuggucccaaguagua

SEQ ID NO: 1405827 - RNA, 19 nt, Homo sapiens
acuguauauaaacuccuua

SEQ ID NO: 1405828 - RNA, 16 nt, Homo sapiens
acuuauggacuccugu

SEQ ID NO: 1405829 - RNA, 18 nt, Homo sapiens
acuuccacaagagugaau

SEQ ID NO: 1405830 - RNA, 22 nt, Homo sapiens
acuugcaccugguacugcacau

SEQ ID NO: 1405831 - RNA, 15 nt, Homo sapiens
acuuugcacagcucu

SEQ ID NO: 1405832 - RNA, 23 nt, Homo sapiens
agaaacugaggccauuauuucaa

SEQ ID NO: 1405833 - RNA, 18 nt, Homo sapiens
agaaauuuuacugacaga

SEQ ID NO: 1405834 - RNA, 12 nt, Homo sapiens
agaacacccacu

SEQ ID NO: 1405835 - RNA, 17 nt, Homo sapiens
agaacacguuggcucag

SEQ ID NO: 1405836 - RNA, 18 nt, Homo sapiens
agaacugccccaucuccu

SEQ ID NO: 1405837 - RNA, 13 nt, Homo sapiens
agaagaggcugcu

SEQ ID NO: 1405838 - RNA, 13 nt, Homo sapiens
agaagccagcuuu

SEQ ID NO: 1405839 - RNA, 18 nt, Homo sapiens
agaaggugccgauuucau

SEQ ID NO: 1405840 - RNA, 15 nt, Homo sapiens
agaauaaaauacucu

SEQ ID NO: 1405841 - RNA, 18 nt, Homo sapiens
agaauuaguggcacuugc

SEQ ID NO: 1405842 - RNA, 18 nt, Homo sapiens
agacaaagugacauuccu

SEQ ID NO: 1405843 - RNA, 22 nt, Homo sapiens
agacaaugugaaaagaaaaaug

SEQ ID NO: 1405844 - RNA, 16 nt, Homo sapiens
agacaggcccaagaga

SEQ ID NO: 1405845 - RNA, 20 nt, Homo sapiens
agacaguaugucuacuccuc

SEQ ID NO: 1405846 - RNA, 14 nt, Homo sapiens
agacaguucaagaa

SEQ ID NO: 1405847 - RNA, 13 nt, Homo sapiens
agacaucucagga

SEQ ID NO: 1405848 - RNA, 18 nt, Homo sapiens
agacauuugcuaugagcu

SEQ ID NO: 1405849 - RNA, 13 nt, Homo sapiens
agaccaccucuca

SEQ ID NO: 1405850 - RNA, 15 nt, Homo sapiens
agacccgcucuccau

SEQ ID NO: 1405851 - RNA, 16 nt, Homo sapiens
agaccucugugcacuu

SEQ ID NO: 1405852 - RNA, 23 nt, Homo sapiens
agaccugaaagaugggcaaaaga

SEQ ID NO: 1405853 - RNA, 22 nt, Homo sapiens
agacgauuauuuaaaccugccc

SEQ ID NO: 1405854 - RNA, 17 nt, Homo sapiens
agacuagauucucaccu

SEQ ID NO: 1405855 - RNA, 21 nt, Homo sapiens
agacuagauucucaccugccu

SEQ ID NO: 1405856 - RNA, 17 nt, Homo sapiens
agacuuacuuacuccca

SEQ ID NO: 1405857 - RNA, 22 nt, Homo sapiens
agagaaugagaagaggcugcug

SEQ ID NO: 1405858 - RNA, 17 nt, Homo sapiens
agagagacgcugugauu

SEQ ID NO: 1405859 - RNA, 16 nt, Homo sapiens
agagaugggauuucac

SEQ ID NO: 1405860 - RNA, 12 nt, Homo sapiens
agagccuggaag

SEQ ID NO: 1405861 - RNA, 17 nt, Homo sapiens
agagcucucucuucucu

SEQ ID NO: 1405862 - RNA, 15 nt, Homo sapiens
agagcugaguggcag

SEQ ID NO: 1405863 - RNA, 21 nt, Homo sapiens
agaggaaggaaaaggaggaaa

SEQ ID NO: 1405864 - RNA, 13 nt, Homo sapiens
agaggcuagucuc

SEQ ID NO: 1405865 - RNA, 13 nt, Homo sapiens
agaggcugagaca

SEQ ID NO: 1405866 - RNA, 11 nt, Homo sapiens
agaggcugcug

SEQ ID NO: 1405867 - RNA, 23 nt, Homo sapiens
agaggggcagccaggacaucucu

SEQ ID NO: 1405868 - RNA, 22 nt, Homo sapiens
agagggggcgauauagagaaua

SEQ ID NO: 1405869 - RNA, 17 nt, Homo sapiens
agagguggagugucaca

SEQ ID NO: 1405870 - RNA, 15 nt, Homo sapiens
agagucaacauaugu

SEQ ID NO: 1405871 - RNA, 15 nt, Homo sapiens
aaggcugaugcauuc

SEQ ID NO: 1405872 - RNA, 16 nt, Homo sapiens
aaggcugcacagcuca

SEQ ID NO: 1405873 - RNA, 23 nt, Homo sapiens
aagggaauacugugcauaagcca

SEQ ID NO: 1405874 - RNA, 18 nt, Homo sapiens
aagggacaccaagccuug

SEQ ID NO: 1405875 - RNA, 23 nt, Homo sapiens
aagggggcuccaugcuggugugg

SEQ ID NO: 1405876 - RNA, 12 nt, Homo sapiens
aaguacuuccac

SEQ ID NO: 1405877 - RNA, 19 nt, Homo sapiens
aagucuaguuaccuacuuu

SEQ ID NO: 1405878 - RNA, 13 nt, Homo sapiens
aagucucuucucu

SEQ ID NO: 1405879 - RNA, 14 nt, Homo sapiens
aagucugucugucu

SEQ ID NO: 1405880 - RNA, 15 nt, Homo sapiens
aagugacuauagaau

SEQ ID NO: 1405881 - RNA, 18 nt, Homo sapiens
aauaaaaugcagagacau

SEQ ID NO: 1405882 - RNA, 23 nt, Homo sapiens
aauaaacuucuggugugauacuu

SEQ ID NO: 1405883 - RNA, 13 nt, Homo sapiens
aauaacauggccu

SEQ ID NO: 1405884 - RNA, 12 nt, Homo sapiens
aauaagugccag

SEQ ID NO: 1405885 - RNA, 20 nt, Homo sapiens
aauaauagggaaaauaccua

SEQ ID NO: 1405886 - RNA, 14 nt, Homo sapiens
aauaauugauuuca

SEQ ID NO: 1405887 - RNA, 21 nt, Homo sapiens
aauacagacuacuucuucccc

SEQ ID NO: 1405888 - RNA, 14 nt, Homo sapiens
aauacaguaucuca

SEQ ID NO: 1405889 - RNA, 17 nt, Homo sapiens
aauaugauacucucaga

SEQ ID NO: 1405890 - RNA, 11 nt, Homo sapiens
aauauucaaua

SEQ ID NO: 1405891 - RNA, 23 nt, Homo sapiens
aauauucaauaaagcugcugaga

SEQ ID NO: 1405892 - RNA, 14 nt, Homo sapiens
aauauuuaccagac

SEQ ID NO: 1405893 - RNA, 17 nt, Homo sapiens
aaucaaugaucaucuca

SEQ ID NO: 1405894 - RNA, 17 nt, Homo sapiens
aaucuccuucuuuccug

SEQ ID NO: 1405895 - RNA, 22 nt, Homo sapiens
aaucuuagcugccaaguaaaua

SEQ ID NO: 1405896 - RNA, 22 nt, Homo sapiens
aaugaaagcccucaugugcagu

SEQ ID NO: 1405897 - RNA, 22 nt, Homo sapiens
aaugagaagucaacagugaaau

SEQ ID NO: 1405898 - RNA, 14 nt, Homo sapiens
aaugaucaucucac

SEQ ID NO: 1405899 - RNA, 20 nt, Homo sapiens
aaugaugucaugucagcucc

SEQ ID NO: 1405900 - RNA, 21 nt, Homo sapiens
aaugcauuauaggaucauuug

SEQ ID NO: 1405901 - RNA, 17 nt, Homo sapiens
aaugccaaucucuucua

SEQ ID NO: 1405902 - RNA, 22 nt, Homo sapiens
aaugcccuaccugccuguucuc

SEQ ID NO: 1405903 - RNA, 19 nt, Homo sapiens
aaugcuucuuuccuguaua

SEQ ID NO: 1405904 - RNA, 20 nt, Homo sapiens
aauggcacgaucucagcuca

SEQ ID NO: 1405905 - RNA, 23 nt, Homo sapiens
aauggcacgaucucagcucacca

SEQ ID NO: 1405906 - RNA, 15 nt, Homo sapiens
aaugggaaaagagau

SEQ ID NO: 1405907 - RNA, 16 nt, Homo sapiens
aaugguaauuguugcu

SEQ ID NO: 1405908 - RNA, 14 nt, Homo sapiens
aaugucccagaggc

SEQ ID NO: 1405909 - RNA, 16 nt, Homo sapiens
aaugucuucaugaccu

SEQ ID NO: 1405910 - RNA, 13 nt, Homo sapiens
aauuaaaccagac

SEQ ID NO: 1405911 - RNA, 19 nt, Homo sapiens
aauuacuuauuguauuuau

SEQ ID NO: 1405912 - RNA, 15 nt, Homo sapiens
aauuagaaacauaaa

SEQ ID NO: 1405913 - RNA, 12 nt, Homo sapiens
aauuaguggcac

SEQ ID NO: 1405914 - RNA, 17 nt, Homo sapiens
aauuaguggcacuugcu

SEQ ID NO: 1405915 - RNA, 14 nt, Homo sapiens
aauuaugugauaua

SEQ ID NO: 1405916 - RNA, 18 nt, Homo sapiens
aauuauuugucaagcaaa

SEQ ID NO: 1405917 - RNA, 10 nt, Homo sapiens
aauucaccuc

SEQ ID NO: 1405918 - RNA, 19 nt, Homo sapiens
aauucuccuguugcaauga

SEQ ID NO: 1405919 - RNA, 22 nt, Homo sapiens
aauucugucacucaccacuaca

SEQ ID NO: 1405920 - RNA, 18 nt, Homo sapiens
aauucuucucgacuucag

SEQ ID NO: 1405921 - RNA, 23 nt, Homo sapiens
aauugauguugcuggacugucau

SEQ ID NO: 1405922 - RNA, 23 nt, Homo sapiens
aauugccuuaaggccacacuggc

SEQ ID NO: 1405923 - RNA, 14 nt, Homo sapiens
acaaaaacauggcc

SEQ ID NO: 1405924 - RNA, 17 nt, Homo sapiens
acaaaaacauggccuuu

SEQ ID NO: 1405925 - RNA, 18 nt, Homo sapiens
acaaauuguuuuuacugu

SEQ ID NO: 1405926 - RNA, 18 nt, Homo sapiens
acaacucuagucagcaca

SEQ ID NO: 1405927 - RNA, 14 nt, Homo sapiens
acaagaaccucucc

SEQ ID NO: 1405928 - RNA, 19 nt, Homo sapiens
acaagagugaauuugaccu

SEQ ID NO: 1405929 - RNA, 15 nt, Homo sapiens
acaaggcugaccaag

SEQ ID NO: 1405930 - RNA, 16 nt, Homo sapiens
acaaggcugaccaaga

SEQ ID NO: 1405931 - RNA, 22 nt, Homo sapiens
acaauccuccaagaauuugacu

SEQ ID NO: 1405932 - RNA, 20 nt, Homo sapiens
acacaaacgggcucagcaaa

SEQ ID NO: 1405933 - RNA, 19 nt, Homo sapiens
acacacagagauaugcaca

SEQ ID NO: 1405934 - RNA, 13 nt, Homo sapiens
acacacauccagc

SEQ ID NO: 1405935 - RNA, 12 nt, Homo sapiens
acacacauggau

SEQ ID NO: 1405936 - RNA, 18 nt, Homo sapiens
acacacauggaugcacac

SEQ ID NO: 1405937 - RNA, 20 nt, Homo sapiens
acacaccgaugcugacucca

SEQ ID NO: 1405938 - RNA, 16 nt, Homo sapiens
acacagagauaugcac

SEQ ID NO: 1405939 - RNA, 18 nt, Homo sapiens
acacagcaagacuccguc

SEQ ID NO: 1405940 - RNA, 16 nt, Homo sapiens
acacagccugggacca

SEQ ID NO: 1405941 - RNA, 19 nt, Homo sapiens
acacaucagugcacacgga

SEQ ID NO: 1405942 - RNA, 14 nt, Homo sapiens
acacccacuggcca

SEQ ID NO: 1405943 - RNA, 16 nt, Homo sapiens
acaccgaugugcgcac

SEQ ID NO: 1405944 - RNA, 14 nt, Homo sapiens
acacggaugcacag

SEQ ID NO: 1405945 - RNA, 14 nt, Homo sapiens
acacguuggcucag

SEQ ID NO: 1405946 - RNA, 23 nt, Homo sapiens
acacuacuugagaaaaugcagga

SEQ ID NO: 1405947 - RNA, 16 nt, Homo sapiens
acacucaaaagcuggg

SEQ ID NO: 1405948 - RNA, 16 nt, Homo sapiens
acagaaaggccacuca

SEQ ID NO: 1405949 - RNA, 14 nt, Homo sapiens
acagaauugcuccu

SEQ ID NO: 1405950 - RNA, 20 nt, Homo sapiens
acagacacucccacuuggca

SEQ ID NO: 1405951 - RNA, 22 nt, Homo sapiens
acagacuauuccccaccugcuu

SEQ ID NO: 1405952 - RNA, 16 nt, Homo sapiens
acagagauaugcacac

SEQ ID NO: 1405953 - RNA, 18 nt, Homo sapiens
acagauauacacauggau

SEQ ID NO: 1405954 - RNA, 14 nt, Homo sapiens
acagauaugcacac

SEQ ID NO: 1405955 - RNA, 16 nt, Homo sapiens
acagaugcacacacag

SEQ ID NO: 1405956 - RNA, 20 nt, Homo sapiens
acagcaagacuccgucucaa

SEQ ID NO: 1405957 - RNA, 15 nt, Homo sapiens
acaggccauggugca

SEQ ID NO: 1405958 - RNA, 12 nt, Homo sapiens
acaguaucucag

SEQ ID NO: 1405959 - RNA, 19 nt, Homo sapiens
acagucacugacucaagac

SEQ ID NO: 1405960 - RNA, 14 nt, Homo sapiens
acaguccauugaaa

SEQ ID NO: 1405961 - RNA, 21 nt, Homo sapiens
acaguguugccagagccuuaa

SEQ ID NO: 1405962 - RNA, 23 nt, Homo sapiens
acauaccuggcccugugccuugg

SEQ ID NO: 1405963 - RNA, 17 nt, Homo sapiens
acauagagauaugcaca

SEQ ID NO: 1405964 - RNA, 20 nt, Homo sapiens
acauagagauaugcacacac

SEQ ID NO: 1405965 - RNA, 22 nt, Homo sapiens
acauagagauaugcacacacag

SEQ ID NO: 1405966 - RNA, 20 nt, Homo sapiens
acauaggccugcucagccuc

SEQ ID NO: 1405967 - RNA, 22 nt, Homo sapiens
acauauaaaauguaauuacuua

SEQ ID NO: 1405968 - RNA, 19 nt, Homo sapiens
acauccaggcaauggccua

SEQ ID NO: 1405969 - RNA, 15 nt, Homo sapiens
acauccauguuccga

SEQ ID NO: 1405970 - RNA, 13 nt, Homo sapiens
acaugacuaggaa

SEQ ID NO: 1405971 - RNA, 13 nt, Homo sapiens
acaugcuucauga

SEQ ID NO: 1405972 - RNA, 23 nt, Homo sapiens
acaugcuugaauaacugagcuua

SEQ ID NO: 1405973 - RNA, 16 nt, Homo sapiens
acauggaugcacacac

SEQ ID NO: 1405974 - RNA, 19 nt, Homo sapiens
acauggccuuggagggcau

SEQ ID NO: 1405975 - RNA, 14 nt, Homo sapiens
acauguaucacuca

SEQ ID NO: 1405976 - RNA, 15 nt, Homo sapiens
acauucuaauuugca

SEQ ID NO: 1405977 - RNA, 12 nt, Homo sapiens
acauuguaagag

SEQ ID NO: 1405978 - RNA, 23 nt, Homo sapiens
acauuuugcauuagacagaugac

SEQ ID NO: 1405979 - RNA, 14 nt, Homo sapiens
gaaaaaaguauagg

SEQ ID NO: 1405980 - RNA, 15 nt, Homo sapiens
gaaaaagacacagac

SEQ ID NO: 1405981 - RNA, 22 nt, Homo sapiens
gaaaaaggacucugcuucaguc

SEQ ID NO: 1405982 - RNA, 19 nt, Homo sapiens
gaaaacacuaguaccuuca

SEQ ID NO: 1405983 - RNA, 16 nt, Homo sapiens
gaaaacaugacuuuau

SEQ ID NO: 1405984 - RNA, 22 nt, Homo sapiens
gaaaaccucauuuaccauaaaa

SEQ ID NO: 1405985 - RNA, 19 nt, Homo sapiens
gaaaagcaguggcuccauu

SEQ ID NO: 1405986 - RNA, 14 nt, Homo sapiens
gaaaauccuaccaa

SEQ ID NO: 1405987 - RNA, 22 nt, Homo sapiens
gaaaaugcaggagagcuucccc

SEQ ID NO: 1405988 - RNA, 15 nt, Homo sapiens
gaaaauuaugagucu

SEQ ID NO: 1405989 - RNA, 22 nt, Homo sapiens
gaaaauugggcaugccauuaca

SEQ ID NO: 1405990 - RNA, 18 nt, Homo sapiens
gaaaccacacagacuugg

SEQ ID NO: 1405991 - RNA, 18 nt, Homo sapiens
gaaagaugggcaaaagac

SEQ ID NO: 1405992 - RNA, 17 nt, Homo sapiens
gaaaguccagcacugga

SEQ ID NO: 1405993 - RNA, 18 nt, Homo sapiens
gaaaguccagcacuggaa

SEQ ID NO: 1405994 - RNA, 23 nt, Homo sapiens
gaacaccuccucaaaccuaccac

SEQ ID NO: 1405995 - RNA, 19 nt, Homo sapiens
gaacagaauugcuccugca

SEQ ID NO: 1405996 - RNA, 18 nt, Homo sapiens
gaaccugcccugcuccca

SEQ ID NO: 1405997 - RNA, 19 nt, Homo sapiens
gaacuacuuuuggugcuua

SEQ ID NO: 1405998 - RNA, 19 nt, Homo sapiens
gaacuccaguacucaccca

SEQ ID NO: 1405999 - RNA, 12 nt, Homo sapiens
gaacugcuuuau

SEQ ID NO: 1406000 - RNA, 17 nt, Homo sapiens
gaagaagaaaacacuag

SEQ ID NO: 1406001 - RNA, 17 nt, Homo sapiens
gaagacccgcucuccau

SEQ ID NO: 1406002 - RNA, 13 nt, Homo sapiens
gaagagaagggca

SEQ ID NO: 1406003 - RNA, 23 nt, Homo sapiens
gaagagccuugcggaagguucua

SEQ ID NO: 1406004 - RNA, 20 nt, Homo sapiens
gaagccaauaaaccuuccuu

SEQ ID NO: 1406005 - RNA, 16 nt, Homo sapiens
gaagccccaacuguga

SEQ ID NO: 1406006 - RNA, 17 nt, Homo sapiens
gaagcguuguccucagc

SEQ ID NO: 1406007 - RNA, 22 nt, Homo sapiens
gaagcuccugggggaugcucua

SEQ ID NO: 1406008 - RNA, 19 nt, Homo sapiens
gaaggaggagucagggaga

SEQ ID NO: 1406009 - RNA, 18 nt, Homo sapiens
gaaggcaucugaguguga

SEQ ID NO: 1406010 - RNA, 14 nt, Homo sapiens
gaaggcuaugggga

SEQ ID NO: 1406011 - RNA, 12 nt, Homo sapiens
gaaggcuuucag

SEQ ID NO: 1406012 - RNA, 20 nt, Homo sapiens
gaagguucuacgccagggga

SEQ ID NO: 1406013 - RNA, 13 nt, Homo sapiens
gaagugcagcuca

SEQ ID NO: 1406014 - RNA, 16 nt, Homo sapiens
gaaguguuuccuuacc

SEQ ID NO: 1406015 - RNA, 14 nt, Homo sapiens
gaauacugugcaua

SEQ ID NO: 1406016 - RNA, 21 nt, Homo sapiens
gaauaugggguugguguucuc

SEQ ID NO: 1406017 - RNA, 22 nt, Homo sapiens
gaaucagcauuuagucuugcca

SEQ ID NO: 1406018 - RNA, 13 nt, Homo sapiens
gaauuucccacau

SEQ ID NO: 1406019 - RNA, 14 nt, Homo sapiens
gacaaagugacauu

SEQ ID NO: 1406020 - RNA, 22 nt, Homo sapiens
gacaaaucuaugccacucagaa

SEQ ID NO: 1406021 - RNA, 15 nt, Homo sapiens
gacaaccucauuuua

SEQ ID NO: 1406022 - RNA, 16 nt, Homo sapiens
gacacacaaaucccau

SEQ ID NO: 1406023 - RNA, 19 nt, Homo sapiens
gacaccagcccugcugcuu

SEQ ID NO: 1406024 - RNA, 15 nt, Homo sapiens
gacagagcaagugag

SEQ ID NO: 1406025 - RNA, 18 nt, Homo sapiens
gacagcugcugugcauua

SEQ ID NO: 1406026 - RNA, 23 nt, Homo sapiens
gacaggcccaagagaugaagagu

SEQ ID NO: 1406027 - RNA, 19 nt, Homo sapiens
gaccaccucucaauauuca

SEQ ID NO: 1406028 - RNA, 14 nt, Homo sapiens
gaccauugucuucc

SEQ ID NO: 1406029 - RNA, 23 nt, Homo sapiens
gacccacggagcccuuaugacau

SEQ ID NO: 1406030 - RNA, 19 nt, Homo sapiens
gaccuaccugcagugggaa

SEQ ID NO: 1406031 - RNA, 14 nt, Homo sapiens
gaccuguugggagu

SEQ ID NO: 1406032 - RNA, 18 nt, Homo sapiens
gaccuucuccagggacag

SEQ ID NO: 1406033 - RNA, 19 nt, Homo sapiens
gaccuucuccagggacaga

SEQ ID NO: 1406034 - RNA, 17 nt, Homo sapiens
gaccuucuccccauucu

SEQ ID NO: 1406035 - RNA, 21 nt, Homo sapiens
gacggcugcucgaagaacaau

SEQ ID NO: 1406036 - RNA, 19 nt, Homo sapiens
gacgugagugugacuuuuu

SEQ ID NO: 1406037 - RNA, 16 nt, Homo sapiens
gacuagaggcagggag

SEQ ID NO: 1406038 - RNA, 15 nt, Homo sapiens
gacuagccaucucaa

SEQ ID NO: 1406039 - RNA, 12 nt, Homo sapiens
gacuauggagcu

SEQ ID NO: 1406040 - RNA, 18 nt, Homo sapiens
gacucuuuccaaccggcu

SEQ ID NO: 1406041 - RNA, 13 nt, Homo sapiens
gacuuaacucuaa

SEQ ID NO: 1406042 - RNA, 20 nt, Homo sapiens
gacuuaucaccacaccacug

SEQ ID NO: 1406043 - RNA, 18 nt, Homo sapiens
gacuucaggagcugacag

SEQ ID NO: 1406044 - RNA, 19 nt, Homo sapiens
gacuucaggagcugacaga

SEQ ID NO: 1406045 - RNA, 14 nt, Homo sapiens
gagaaaaagggagg

SEQ ID NO: 1406046 - RNA, 23 nt, Homo sapiens
gagaaacagagacaggcccaaga

SEQ ID NO: 1406047 - RNA, 17 nt, Homo sapiens
gagaagaggcugcugca

SEQ ID NO: 1406048 - RNA, 20 nt, Homo sapiens
gagaagccagcuuuccucau

SEQ ID NO: 1406049 - RNA, 13 nt, Homo sapiens
gagaaugucagua

SEQ ID NO: 1406050 - RNA, 15 nt, Homo sapiens
gagaccaauugcacu

SEQ ID NO: 1406051 - RNA, 18 nt, Homo sapiens
gagagcucucucuucucu

SEQ ID NO: 1406052 - RNA, 11 nt, Homo sapiens
gagaucccaac

SEQ ID NO: 1406053 - RNA, 14 nt, Homo sapiens
gagauggccugaga

SEQ ID NO: 1406054 - RNA, 18 nt, Homo sapiens
gagcaagugagacccugu

SEQ ID NO: 1406055 - RNA, 13 nt, Homo sapiens
gagcauucugcuc

SEQ ID NO: 1406056 - RNA, 13 nt, Homo sapiens
gagccacuaccuu

SEQ ID NO: 1406057 - RNA, 14 nt, Homo sapiens
gagccugacccuca

SEQ ID NO: 1406058 - RNA, 20 nt, Homo sapiens
gagccuggaagacacccuaa

SEQ ID NO: 1406059 - RNA, 22 nt, Homo sapiens
gagcuggggaugucucucauga

SEQ ID NO: 1406060 - RNA, 12 nt, Homo sapiens
gaggaagggaca

SEQ ID NO: 1406061 - RNA, 20 nt, Homo sapiens
gaggcaggaggaucacuuga

SEQ ID NO: 1406062 - RNA, 17 nt, Homo sapiens
gaggccauucuuuccca

SEQ ID NO: 1406063 - RNA, 16 nt, Homo sapiens
gaggccucucauucca

SEQ ID NO: 1406064 - RNA, 13 nt, Homo sapiens
gagggagguguuu

SEQ ID NO: 1406065 - RNA, 21 nt, Homo sapiens
gaggggacuauuuaugaaggc

SEQ ID NO: 1406066 - RNA, 16 nt, Homo sapiens
gagugcaguggcguga

SEQ ID NO: 1406067 - RNA, 21 nt, Homo sapiens
gaguugguguucauaauuuca

SEQ ID NO: 1406068 - RNA, 23 nt, Homo sapiens
ggagugaggaugucugggccacu

SEQ ID NO: 1406069 - RNA, 20 nt, Homo sapiens
ggaugcacagagauaugcac

SEQ ID NO: 1406070 - RNA, 17 nt, Homo sapiens
ggauggucuugaucucc

SEQ ID NO: 1406071 - RNA, 15 nt, Homo sapiens
ggaugucucucauga

SEQ ID NO: 1406072 - RNA, 22 nt, Homo sapiens
ggcaaugcccugugcaugccau

SEQ ID NO: 1406073 - RNA, 21 nt, Homo sapiens
ggcacagccuggcuguggccu

SEQ ID NO: 1406074 - RNA, 21 nt, Homo sapiens
ggcagggcugaggccucucau

SEQ ID NO: 1406075 - RNA, 19 nt, Homo sapiens
ggcaugaacacacauggau

SEQ ID NO: 1406076 - RNA, 20 nt, Homo sapiens
ggcaugagggaucacagggc

SEQ ID NO: 1406077 - RNA, 14 nt, Homo sapiens
ggcaugguggccca

SEQ ID NO: 1406078 - RNA, 12 nt, Homo sapiens
ggccacacuggg

SEQ ID NO: 1406079 - RNA, 16 nt, Homo sapiens
ggccagcaccaucucu

SEQ ID NO: 1406080 - RNA, 22 nt, Homo sapiens
ggccaucuccucccaccagugg

SEQ ID NO: 1406081 - RNA, 14 nt, Homo sapiens
ggccauggugcaca

SEQ ID NO: 1406082 - RNA, 16 nt, Homo sapiens
ggccauucuuucccaa

SEQ ID NO: 1406083 - RNA, 19 nt, Homo sapiens
ggcccagaguuuacauucu

SEQ ID NO: 1406084 - RNA, 19 nt, Homo sapiens
ggccgggcgcgguggcuca

SEQ ID NO: 1406085 - RNA, 18 nt, Homo sapiens
cugagcccccacauucuc

SEQ ID NO: 1406086 - RNA, 19 nt, Homo sapiens
cugagcucgugaucugccc

SEQ ID NO: 1406087 - RNA, 12 nt, Homo sapiens
cugaggugggag

SEQ ID NO: 1406088 - RNA, 11 nt, Homo sapiens
cugaguuugcu

SEQ ID NO: 1406089 - RNA, 17 nt, Homo sapiens
cugaucauuaaagccug

SEQ ID NO: 1406090 - RNA, 14 nt, Homo sapiens
cugcaacccuggug

SEQ ID NO: 1406091 - RNA, 15 nt, Homo sapiens
cugcacccucgauga

SEQ ID NO: 1406092 - RNA, 22 nt, Homo sapiens
cugcacucauagggugcucuga

SEQ ID NO: 1406093 - RNA, 13 nt, Homo sapiens
cugccaccugccc

SEQ ID NO: 1406094 - RNA, 18 nt, Homo sapiens
cugccauuucugagauca

SEQ ID NO: 1406095 - RNA, 17 nt, Homo sapiens
cugcccugcucccacag

SEQ ID NO: 1406096 - RNA, 14 nt, Homo sapiens
cugccgagagucca

SEQ ID NO: 1406097 - RNA, 20 nt, Homo sapiens
cugccuauuaguaguuaauu

SEQ ID NO: 1406098 - RNA, 23 nt, Homo sapiens
cugccuccauucugaccauuuca

SEQ ID NO: 1406099 - RNA, 13 nt, Homo sapiens
cugccuugccaug

SEQ ID NO: 1406100 - RNA, 12 nt, Homo sapiens
cugcuccagcug

SEQ ID NO: 1406101 - RNA, 13 nt, Homo sapiens
cugcuucagucca

SEQ ID NO: 1406102 - RNA, 20 nt, Homo sapiens
cugcuuccaauuuucuggaa

SEQ ID NO: 1406103 - RNA, 16 nt, Homo sapiens
cuggaagccagagaaa

SEQ ID NO: 1406104 - RNA, 14 nt, Homo sapiens
cuggaauacaugaa

SEQ ID NO: 1406105 - RNA, 11 nt, Homo sapiens
cuggacuguca

SEQ ID NO: 1406106 - RNA, 13 nt, Homo sapiens
cuggagugcagug

SEQ ID NO: 1406107 - RNA, 18 nt, Homo sapiens
cuggaugagcaacuccug

SEQ ID NO: 1406108 - RNA, 22 nt, Homo sapiens
cuggcaguaaccuagugaauuu

SEQ ID NO: 1406109 - RNA, 14 nt, Homo sapiens
cuggccacacuggg

SEQ ID NO: 1406110 - RNA, 21 nt, Homo sapiens
cuggccucuagaacacccacu

SEQ ID NO: 1406111 - RNA, 14 nt, Homo sapiens
cuggcucagccuca

SEQ ID NO: 1406112 - RNA, 18 nt, Homo sapiens
cuggcucccagggccaug

SEQ ID NO: 1406113 - RNA, 22 nt, Homo sapiens
cugggagugauaugauguguag

SEQ ID NO: 1406114 - RNA, 15 nt, Homo sapiens
cugguuagaaaugca

SEQ ID NO: 1406115 - RNA, 15 nt, Homo sapiens
aggcuagagugcagu

SEQ ID NO: 1406116 - RNA, 15 nt, Homo sapiens
aggcuggagugcaau

SEQ ID NO: 1406117 - RNA, 16 nt, Homo sapiens
agggaaaaaacaugua

SEQ ID NO: 1406118 - RNA, 13 nt, Homo sapiens
agggaaaaaccag

SEQ ID NO: 1406119 - RNA, 16 nt, Homo sapiens
agggaaggaucccaug

SEQ ID NO: 1406120 - RNA, 17 nt, Homo sapiens
agggaauucucuuggcu

SEQ ID NO: 1406121 - RNA, 16 nt, Homo sapiens
agggacuccaguucac

SEQ ID NO: 1406122 - RNA, 14 nt, Homo sapiens
agggagacagagac

SEQ ID NO: 1406123 - RNA, 23 nt, Homo sapiens
agggcagggcugaggccucucau

SEQ ID NO: 1406124 - RNA, 13 nt, Homo sapiens
aggggcacagggu

SEQ ID NO: 1406125 - RNA, 21 nt, Homo sapiens
agggggcgaagggaucagccc

SEQ ID NO: 1406126 - RNA, 18 nt, Homo sapiens
agggggugugucugcuca

SEQ ID NO: 1406127 - RNA, 14 nt, Homo sapiens
aggggucauucaug

SEQ ID NO: 1406128 - RNA, 17 nt, Homo sapiens
agguaaacaaacaaaua

SEQ ID NO: 1406129 - RNA, 19 nt, Homo sapiens
aggucaauuuccugaugca

SEQ ID NO: 1406130 - RNA, 18 nt, Homo sapiens
agguccuaaagaugcuga

SEQ ID NO: 1406131 - RNA, 15 nt, Homo sapiens
aggugccgauuucau

SEQ ID NO: 1406132 - RNA, 18 nt, Homo sapiens
agguggagguugcaguga

SEQ ID NO: 1406133 - RNA, 20 nt, Homo sapiens
aguagcugggacuacaggca

SEQ ID NO: 1406134 - RNA, 14 nt, Homo sapiens
aguagugucuuccu

SEQ ID NO: 1406135 - RNA, 20 nt, Homo sapiens
aguauuacaaaaacauggcc

SEQ ID NO: 1406136 - RNA, 21 nt, Homo sapiens
agucaucacauuucuaugcca

SEQ ID NO: 1406137 - RNA, 13 nt, Homo sapiens
agucauccucaga

SEQ ID NO: 1406138 - RNA, 16 nt, Homo sapiens
agucauccucagauca

SEQ ID NO: 1406139 - RNA, 21 nt, Homo sapiens
agucaucuguuuaauuuacac

SEQ ID NO: 1406140 - RNA, 15 nt, Homo sapiens
aguccagcacuggaa

SEQ ID NO: 1406141 - RNA, 17 nt, Homo sapiens
agucccugccaucaugu

SEQ ID NO: 1406142 - RNA, 10 nt, Homo sapiens
aguccucaca

SEQ ID NO: 1406143 - RNA, 13 nt, Homo sapiens
agucugaagcugg

SEQ ID NO: 1406144 - RNA, 15 nt, Homo sapiens
agucuggugcuccag

SEQ ID NO: 1406145 - RNA, 13 nt, Homo sapiens
agucuucccugau

SEQ ID NO: 1406146 - RNA, 20 nt, Homo sapiens
agugacuuuagaaacaaauu

SEQ ID NO: 1406147 - RNA, 22 nt, Homo sapiens
agugagccugaauuuuguugcu

SEQ ID NO: 1406148 - RNA, 17 nt, Homo sapiens
agugauaugauguguag

SEQ ID NO: 1406149 - RNA, 20 nt, Homo sapiens
agugcacacggaugcacaga

SEQ ID NO: 1406150 - RNA, 23 nt, Homo sapiens
agugcccaaggaauuucugcucu

SEQ ID NO: 1406151 - RNA, 18 nt, Homo sapiens
agugcuaaacaaguaaga

SEQ ID NO: 1406152 - RNA, 22 nt, Homo sapiens
agugcuuguuccucucaucucc

SEQ ID NO: 1406153 - RNA, 20 nt, Homo sapiens
agugggagcugaguggggga

SEQ ID NO: 1406154 - RNA, 17 nt, Homo sapiens
agugggaggacagagcc

SEQ ID NO: 1406155 - RNA, 19 nt, Homo sapiens
agugggaggugagaccacc

SEQ ID NO: 1406156 - RNA, 13 nt, Homo sapiens
agugguuacccag

SEQ ID NO: 1406157 - RNA, 14 nt, Homo sapiens
agugucacaucucu

SEQ ID NO: 1406158 - RNA, 13 nt, Homo sapiens
agugucagcacuc

SEQ ID NO: 1406159 - RNA, 18 nt, Homo sapiens
aguuccccucuacuccau

SEQ ID NO: 1406160 - RNA, 23 nt, Homo sapiens
aguucuuuucaaccuacuuucau

SEQ ID NO: 1406161 - RNA, 21 nt, Homo sapiens
aguugauugcgagaauuuuca

SEQ ID NO: 1406162 - RNA, 20 nt, Homo sapiens
aguugguguucauaauuuca

SEQ ID NO: 1406163 - RNA, 14 nt, Homo sapiens
aguuuaugauggaa

SEQ ID NO: 1406164 - RNA, 17 nt, Homo sapiens
aguuucgacguuugacu

SEQ ID NO: 1406165 - RNA, 23 nt, Homo sapiens
aguuucgacguuugacuagccau

SEQ ID NO: 1406166 - RNA, 19 nt, Homo sapiens
aguuugagaccaaccuggg

SEQ ID NO: 1406167 - RNA, 12 nt, Homo sapiens
auaaauaaccaa

SEQ ID NO: 1406168 - RNA, 21 nt, Homo sapiens
auaaauuggaacaccuccuca

SEQ ID NO: 1406169 - RNA, 13 nt, Homo sapiens
auaaauuucugcu

SEQ ID NO: 1406170 - RNA, 20 nt, Homo sapiens
auaacuuuguuuagcccaaa

SEQ ID NO: 1406171 - RNA, 17 nt, Homo sapiens
auaagugcuacuuugcc

SEQ ID NO: 1406172 - RNA, 23 nt, Homo sapiens
auaauaaacuucuggugugauac

SEQ ID NO: 1406173 - RNA, 23 nt, Homo sapiens
auaauacauugaauuagaaacau

SEQ ID NO: 1406174 - RNA, 18 nt, Homo sapiens
auaaucacaacccuucag

SEQ ID NO: 1406175 - RNA, 14 nt, Homo sapiens
auacaguaucucag

SEQ ID NO: 1406176 - RNA, 16 nt, Homo sapiens
auacaguaucucaggg

SEQ ID NO: 1406177 - RNA, 22 nt, Homo sapiens
auaccaaccugaagacaccguu

SEQ ID NO: 1406178 - RNA, 20 nt, Homo sapiens
auaccuggcccugugccuug

SEQ ID NO: 1406179 - RNA, 12 nt, Homo sapiens
auagaaacugau

SEQ ID NO: 1406180 - RNA, 13 nt, Homo sapiens
auagagauaugca

SEQ ID NO: 1406181 - RNA, 15 nt, Homo sapiens
auagcaccuccacau

SEQ ID NO: 1406182 - RNA, 20 nt, Homo sapiens
auagcaccuccacauaccug

SEQ ID NO: 1406183 - RNA, 12 nt, Homo sapiens
auauaacaugua

SEQ ID NO: 1406184 - RNA, 18 nt, Homo sapiens
auauaugacuuuuucuca

SEQ ID NO: 1406185 - RNA, 17 nt, Homo sapiens
auaugaggcuugauaau

SEQ ID NO: 1406186 - RNA, 19 nt, Homo sapiens
auaugauacucucagauuu

SEQ ID NO: 1406187 - RNA, 16 nt, Homo sapiens
auaugcacacacagau

SEQ ID NO: 1406188 - RNA, 16 nt, Homo sapiens
auaugcacacaccgau

SEQ ID NO: 1406189 - RNA, 21 nt, Homo sapiens
auaugggguugguguucucau

SEQ ID NO: 1406190 - RNA, 14 nt, Homo sapiens
auauguaguauaau

SEQ ID NO: 1406191 - RNA, 21 nt, Homo sapiens
auauuaaggaagacaauguga

SEQ ID NO: 1406192 - RNA, 18 nt, Homo sapiens
aucaacauuuguuccaug

SEQ ID NO: 1406193 - RNA, 17 nt, Homo sapiens
aucaaugaucaucucac

SEQ ID NO: 1406194 - RNA, 16 nt, Homo sapiens
aucacagccucugaaa

SEQ ID NO: 1406195 - RNA, 21 nt, Homo sapiens
aucagccugggcaaugugaua

SEQ ID NO: 1406196 - RNA, 15 nt, Homo sapiens
auccagcccaggacu

SEQ ID NO: 1406197 - RNA, 19 nt, Homo sapiens
auccccagggaaacccauc

SEQ ID NO: 1406198 - RNA, 19 nt, Homo sapiens
auccccuuuggcuaccuga

SEQ ID NO: 1406199 - RNA, 14 nt, Homo sapiens
auccuagcacuuug

SEQ ID NO: 1406200 - RNA, 18 nt, Homo sapiens
auccuccaagaauuugac

SEQ ID NO: 1406201 - RNA, 12 nt, Homo sapiens
auccuguucucu

SEQ ID NO: 1406202 - RNA, 16 nt, Homo sapiens
aucgcugccuugccau

SEQ ID NO: 1406203 - RNA, 18 nt, Homo sapiens
aucgcugccuugccaugu

SEQ ID NO: 1406204 - RNA, 18 nt, Homo sapiens
aucuacugagacaugacu

SEQ ID NO: 1406205 - RNA, 15 nt, Homo sapiens
aucuauuaaaccauc

SEQ ID NO: 1406206 - RNA, 20 nt, Homo sapiens
aucucaggauuucaccagaa

SEQ ID NO: 1406207 - RNA, 23 nt, Homo sapiens
aucucccuagccugcuuuugucc

SEQ ID NO: 1406208 - RNA, 14 nt, Homo sapiens
aucucuuuaccucc

SEQ ID NO: 1406209 - RNA, 14 nt, Homo sapiens
aucuggaaggacau

SEQ ID NO: 1406210 - RNA, 13 nt, Homo sapiens
aucuggacuuccu

SEQ ID NO: 1406211 - RNA, 21 nt, Homo sapiens
aucugucaaagaaaacuucca

SEQ ID NO: 1406212 - RNA, 23 nt, Homo sapiens
aucugugaggggcucucucauga

SEQ ID NO: 1406213 - RNA, 23 nt, Homo sapiens
aucuuccccaacgaaaagcacau

SEQ ID NO: 1406214 - RNA, 21 nt, Homo sapiens
aucuuucuuccaaacaggcuc

SEQ ID NO: 1406215 - RNA, 16 nt, Homo sapiens
augaaacgucaugugu

SEQ ID NO: 1406216 - RNA, 17 nt, Homo sapiens
augaacacacauggaug

SEQ ID NO: 1406217 - RNA, 19 nt, Homo sapiens
augaacacacauggaugca

SEQ ID NO: 1406218 - RNA, 20 nt, Homo sapiens
augaaccugcccugcuccca

SEQ ID NO: 1406219 - RNA, 18 nt, Homo sapiens
augaauaauacauugaau

SEQ ID NO: 1406220 - RNA, 20 nt, Homo sapiens
augacaucacuuguacaaaa

SEQ ID NO: 1406221 - RNA, 14 nt, Homo sapiens
augacaucagcaau

SEQ ID NO: 1406222 - RNA, 18 nt, Homo sapiens
augaccaguaauugugaa

SEQ ID NO: 1406223 - RNA, 20 nt, Homo sapiens
augagcaaggacaaccugcc

SEQ ID NO: 1406224 - RNA, 23 nt, Homo sapiens
augagcacacacacaccaaugcg

SEQ ID NO: 1406225 - RNA, 20 nt, Homo sapiens
augagcauuagcuacuuuuc

SEQ ID NO: 1406226 - RNA, 13 nt, Homo sapiens
augauacuuccaa

SEQ ID NO: 1406227 - RNA, 16 nt, Homo sapiens
augaucaaaacaugcu

SEQ ID NO: 1406228 - RNA, 23 nt, Homo sapiens
augaugggggaaaaaaaguaauc

SEQ ID NO: 1406229 - RNA, 17 nt, Homo sapiens
augaugugaguauuuag

SEQ ID NO: 1406230 - RNA, 21 nt, Homo sapiens
augauuucaaaugcuguaacu

SEQ ID NO: 1406231 - RNA, 23 nt, Homo sapiens
augcacacacacagagauaugca

SEQ ID NO: 1406232 - RNA, 22 nt, Homo sapiens
augcacacacacggaugcacac

SEQ ID NO: 1406233 - RNA, 15 nt, Homo sapiens
augcacacacagaug

SEQ ID NO: 1406234 - RNA, 16 nt, Homo sapiens
augcacagagauaugc

SEQ ID NO: 1406235 - RNA, 19 nt, Homo sapiens
augcacagagauaugcaca

SEQ ID NO: 1406236 - RNA, 23 nt, Homo sapiens
augcacgcacacaucagugcaca

SEQ ID NO: 1406237 - RNA, 17 nt, Homo sapiens
augcagcaaaaugugaa

SEQ ID NO: 1406238 - RNA, 20 nt, Homo sapiens
augcagcaaggggacaucuu

SEQ ID NO: 1406239 - RNA, 18 nt, Homo sapiens
augcauucuagugcagaa

SEQ ID NO: 1406240 - RNA, 21 nt, Homo sapiens
augccaaucucuucuaaaaaa

SEQ ID NO: 1406241 - RNA, 19 nt, Homo sapiens
augccagcuuaucucaggg

SEQ ID NO: 1406242 - RNA, 15 nt, Homo sapiens
augcccuaccugccu

SEQ ID NO: 1406243 - RNA, 17 nt, Homo sapiens
augcugcucauccaaag

SEQ ID NO: 1406244 - RNA, 14 nt, Homo sapiens
augcugugcucaau

SEQ ID NO: 1406245 - RNA, 18 nt, Homo sapiens
augcuucuuuccuguaua

SEQ ID NO: 1406246 - RNA, 15 nt, Homo sapiens
augcuugcauuauau

SEQ ID NO: 1406247 - RNA, 15 nt, Homo sapiens
auggaugcacacaca

SEQ ID NO: 1406248 - RNA, 14 nt, Homo sapiens
auggcaugcugaaa

SEQ ID NO: 1406249 - RNA, 23 nt, Homo sapiens
auggcccgggccuuauccaguca

SEQ ID NO: 1406250 - RNA, 16 nt, Homo sapiens
auggccuuugcuugaa

SEQ ID NO: 1406251 - RNA, 22 nt, Homo sapiens
auggcuguaaaucuauuggcca

SEQ ID NO: 1406252 - RNA, 18 nt, Homo sapiens
augggcuuucucaguguc

SEQ ID NO: 1406253 - RNA, 17 nt, Homo sapiens
auguaaaauggagacca

SEQ ID NO: 1406254 - RNA, 13 nt, Homo sapiens
auguaaaguaaga

SEQ ID NO: 1406255 - RNA, 18 nt, Homo sapiens
auguaggaucugucaaag

SEQ ID NO: 1406256 - RNA, 17 nt, Homo sapiens
auguauauguauaucua

SEQ ID NO: 1406257 - RNA, 16 nt, Homo sapiens
augucuacuccucaca

SEQ ID NO: 1406258 - RNA, 16 nt, Homo sapiens
augugacucuuuccaa

SEQ ID NO: 1406259 - RNA, 13 nt, Homo sapiens
auguuaugugcuc

SEQ ID NO: 1406260 - RNA, 19 nt, Homo sapiens
auuagcaauugacugucac

SEQ ID NO: 1406261 - RNA, 18 nt, Homo sapiens
auuagcauuuugcuaaau

SEQ ID NO: 1406262 - RNA, 17 nt, Homo sapiens
auuagccaaguguggua

SEQ ID NO: 1406263 - RNA, 23 nt, Homo sapiens
auuagccaagugugguagagugu

SEQ ID NO: 1406264 - RNA, 13 nt, Homo sapiens
auuaguggcacuu

SEQ ID NO: 1406265 - RNA, 14 nt, Homo sapiens
auuauccacugcaa

SEQ ID NO: 1406266 - RNA, 15 nt, Homo sapiens
auuauccacugcaaa

SEQ ID NO: 1406267 - RNA, 17 nt, Homo sapiens
auuauuugucaagcaaa

SEQ ID NO: 1406268 - RNA, 13 nt, Homo sapiens
auucacagcaagu

SEQ ID NO: 1406269 - RNA, 17 nt, Homo sapiens
auucagcucugcaagaa

SEQ ID NO: 1406270 - RNA, 17 nt, Homo sapiens
auucaggcaacgcacaa

SEQ ID NO: 1406271 - RNA, 15 nt, Homo sapiens
auuccacacccucac

SEQ ID NO: 1406272 - RNA, 14 nt, Homo sapiens
auucuaauuugcau

SEQ ID NO: 1406273 - RNA, 14 nt, Homo sapiens
auucuacacauaua

SEQ ID NO: 1406274 - RNA, 13 nt, Homo sapiens
auucuaggcaucc

SEQ ID NO: 1406275 - RNA, 21 nt, Homo sapiens
auucucuaggagaaacuuaga

SEQ ID NO: 1406276 - RNA, 11 nt, Homo sapiens
auucugaccau

SEQ ID NO: 1406277 - RNA, 15 nt, Homo sapiens
auucugaccauuuca

SEQ ID NO: 1406278 - RNA, 22 nt, Homo sapiens
auucugucacucaccacuacau

SEQ ID NO: 1406279 - RNA, 19 nt, Homo sapiens
auucuucucgacuucagga

SEQ ID NO: 1406280 - RNA, 19 nt, Homo sapiens
auucuuucccaacaccucu

SEQ ID NO: 1406281 - RNA, 19 nt, Homo sapiens
auugaaagggaguauuaca

SEQ ID NO: 1406282 - RNA, 13 nt, Homo sapiens
auugauguugcug

SEQ ID NO: 1406283 - RNA, 21 nt, Homo sapiens
auuguauuuaccuucuaccuc

SEQ ID NO: 1406284 - RNA, 10 nt, Homo sapiens
auugugaugu

SEQ ID NO: 1406285 - RNA, 20 nt, Homo sapiens
auuguuacuauuauuugcua

SEQ ID NO: 1406286 - RNA, 17 nt, Homo sapiens
auuuaccuucuaccucu

SEQ ID NO: 1406287 - RNA, 16 nt, Homo sapiens
auuuauccaagaccug

SEQ ID NO: 1406288 - RNA, 23 nt, Homo sapiens
auuuaugcugcucauccaaaguu

SEQ ID NO: 1406289 - RNA, 14 nt, Homo sapiens
auuucaccacugaa

SEQ ID NO: 1406290 - RNA, 19 nt, Homo sapiens
auuucugcuugugccuuua

SEQ ID NO: 1406291 - RNA, 13 nt, Homo sapiens
auuugcuaugagc

SEQ ID NO: 1406292 - RNA, 23 nt, Homo sapiens
auuuggaaaauguuaugugcucu

SEQ ID NO: 1406293 - RNA, 19 nt, Homo sapiens
auuuugcuaaaugugaaug

SEQ ID NO: 1406294 - RNA, 19 nt, Homo sapiens
auuuugggugccauuaaau

SEQ ID NO: 1406295 - RNA, 21 nt, Homo sapiens
auuuugugaaagaaggagcaa

SEQ ID NO: 1406296 - RNA, 21 nt, Homo sapiens
auuuuguuuuugucuuaaaaa

SEQ ID NO: 1406297 - RNA, 15 nt, Homo sapiens
auuuuuguacauuau

SEQ ID NO: 1406298 - RNA, 15 nt, Homo sapiens
caaaaacauggccuu

SEQ ID NO: 1406299 - RNA, 20 nt, Homo sapiens
caaaaagauuuauuaauuaa

SEQ ID NO: 1406300 - RNA, 11 nt, Homo sapiens
caaaacacagg

SEQ ID NO: 1406301 - RNA, 17 nt, Homo sapiens
caaaacagaaaaugaag

SEQ ID NO: 1406302 - RNA, 21 nt, Homo sapiens
caaaaucaggcuuugucugcu

SEQ ID NO: 1406303 - RNA, 19 nt, Homo sapiens
caaacacaccgaugcacac

SEQ ID NO: 1406304 - RNA, 12 nt, Homo sapiens
caaacaucuaau

SEQ ID NO: 1406305 - RNA, 22 nt, Homo sapiens
caaagaacaaacauccuugcaa

SEQ ID NO: 1406306 - RNA, 20 nt, Homo sapiens
caaagaacugccccaucucc

SEQ ID NO: 1406307 - RNA, 14 nt, Homo sapiens
caaagagguauuua

SEQ ID NO: 1406308 - RNA, 13 nt, Homo sapiens
caaagcaaagcca

SEQ ID NO: 1406309 - RNA, 23 nt, Homo sapiens
caaagccuccuccagccgccaug

SEQ ID NO: 1406310 - RNA, 17 nt, Homo sapiens
caaagugcuaggauuac

SEQ ID NO: 1406311 - RNA, 20 nt, Homo sapiens
caacaaggcugcacagcuca

SEQ ID NO: 1406312 - RNA, 18 nt, Homo sapiens
caacccagccugagugca

SEQ ID NO: 1406313 - RNA, 14 nt, Homo sapiens
caacgaaaagcaca

SEQ ID NO: 1406314 - RNA, 13 nt, Homo sapiens
caacucaucuuag

SEQ ID NO: 1406315 - RNA, 13 nt, Homo sapiens
caacugccaagaa

SEQ ID NO: 1406316 - RNA, 16 nt, Homo sapiens
caagaccuucucccca

SEQ ID NO: 1406317 - RNA, 22 nt, Homo sapiens
caagaccuucuccccauucugc

SEQ ID NO: 1406318 - RNA, 20 nt, Homo sapiens
caagacucuuuggacacuca

SEQ ID NO: 1406319 - RNA, 17 nt, Homo sapiens
caaggcugcacagcuca

SEQ ID NO: 1406320 - RNA, 19 nt, Homo sapiens
caaggcugggggaagaagc

SEQ ID NO: 1406321 - RNA, 17 nt, Homo sapiens
caagucaccggagcuuu

SEQ ID NO: 1406322 - RNA, 21 nt, Homo sapiens
caagucaggcccuuauuuuca

SEQ ID NO: 1406323 - RNA, 15 nt, Homo sapiens
caagugccuuagcaa

SEQ ID NO: 1406324 - RNA, 23 nt, Homo sapiens
caauaaauuggaacaccuccuca

SEQ ID NO: 1406325 - RNA, 16 nt, Homo sapiens
caauaccuacaaguca

SEQ ID NO: 1406326 - RNA, 13 nt, Homo sapiens
caaugacacauag

SEQ ID NO: 1406327 - RNA, 17 nt, Homo sapiens
caaugcacacacacaga

SEQ ID NO: 1406328 - RNA, 20 nt, Homo sapiens
caaugcccugugcaugccau

SEQ ID NO: 1406329 - RNA, 21 nt, Homo sapiens
caauuagcaauugacugucac

SEQ ID NO: 1406330 - RNA, 12 nt, Homo sapiens
cacaaaacagaa

SEQ ID NO: 1406331 - RNA, 23 nt, Homo sapiens
cacaacccuucagauuugccuua

SEQ ID NO: 1406332 - RNA, 20 nt, Homo sapiens
cacaaggcugaccaagagag

SEQ ID NO: 1406333 - RNA, 15 nt, Homo sapiens
cacaauccuccaaga

SEQ ID NO: 1406334 - RNA, 14 nt, Homo sapiens
cacacacacagaga

SEQ ID NO: 1406335 - RNA, 15 nt, Homo sapiens
cacacacacagagau

SEQ ID NO: 1406336 - RNA, 23 nt, Homo sapiens
cacacacagaugcacacacagau

SEQ ID NO: 1406337 - RNA, 13 nt, Homo sapiens
cacacacagaugg

SEQ ID NO: 1406338 - RNA, 22 nt, Homo sapiens
cacacacggaugcacacacaga

SEQ ID NO: 1406339 - RNA, 15 nt, Homo sapiens
cacacagagauaugc

SEQ ID NO: 1406340 - RNA, 17 nt, Homo sapiens
cacacagagauaugcac

SEQ ID NO: 1406341 - RNA, 18 nt, Homo sapiens
cacacagauggucacaca

SEQ ID NO: 1406342 - RNA, 15 nt, Homo sapiens
cacacauggaugcac

SEQ ID NO: 1406343 - RNA, 23 nt, Homo sapiens
cacaccgauguacacacacagau

SEQ ID NO: 1406344 - RNA, 15 nt, Homo sapiens
cacacggaugcacac

SEQ ID NO: 1406345 - RNA, 20 nt, Homo sapiens
cacacggaugcacagagaua

SEQ ID NO: 1406346 - RNA, 23 nt, Homo sapiens
cacacggaugcacagagauaugc

SEQ ID NO: 1406347 - RNA, 20 nt, Homo sapiens
cacagaacacagcaauuccu

SEQ ID NO: 1406348 - RNA, 16 nt, Homo sapiens
cacagacugcgauuug

SEQ ID NO: 1406349 - RNA, 16 nt, Homo sapiens
cacagagauaugcaca

SEQ ID NO: 1406350 - RNA, 23 nt, Homo sapiens
cacagauauacacauggaugcac

SEQ ID NO: 1406351 - RNA, 14 nt, Homo sapiens
cacagauaugcaca

SEQ ID NO: 1406352 - RNA, 17 nt, Homo sapiens
cacagaugauacuucca

SEQ ID NO: 1406353 - RNA, 18 nt, Homo sapiens
cacagaugauacuuccaa

SEQ ID NO: 1406354 - RNA, 20 nt, Homo sapiens
cacagauggucacacagaga

SEQ ID NO: 1406355 - RNA, 20 nt, Homo sapiens
cacagcaagacuccgucuca

SEQ ID NO: 1406356 - RNA, 17 nt, Homo sapiens
cacagugcugaccagac

SEQ ID NO: 1406357 - RNA, 21 nt, Homo sapiens
cacaguuggcccgggugcagg

SEQ ID NO: 1406358 - RNA, 23 nt, Homo sapiens
cacauaccuggcccugugccuug

SEQ ID NO: 1406359 - RNA, 24 nt, Homo sapiens
cacauagagauaugcacacacaga

SEQ ID NO: 1406360 - RNA, 14 nt, Homo sapiens
cacaucagugcaca

SEQ ID NO: 1406361 - RNA, 13 nt, Homo sapiens
caccagcagccug

SEQ ID NO: 1406362 - RNA, 18 nt, Homo sapiens
caccaucaccagacaggu

SEQ ID NO: 1406363 - RNA, 13 nt, Homo sapiens
cacccaugccaua

SEQ ID NO: 1406364 - RNA, 20 nt, Homo sapiens
caccgaugcacacgcacaua

SEQ ID NO: 1406365 - RNA, 21 nt, Homo sapiens
caccgauguacacacacagau

SEQ ID NO: 1406366 - RNA, 18 nt, Homo sapiens
caccuacgggggcaucug

SEQ ID NO: 1406367 - RNA, 14 nt, Homo sapiens
cacgccaaugcaca

SEQ ID NO: 1406368 - RNA, 14 nt, Homo sapiens
cacggaugcacaga

SEQ ID NO: 1406369 - RNA, 16 nt, Homo sapiens
cacggaugcacagaga

SEQ ID NO: 1406370 - RNA, 16 nt, Homo sapiens
cacuaagcuuucuccu

SEQ ID NO: 1406371 - RNA, 16 nt, Homo sapiens
cacucaggauguccuu

SEQ ID NO: 1406372 - RNA, 20 nt, Homo sapiens
cacucucccaccuccuggug

SEQ ID NO: 1406373 - RNA, 13 nt, Homo sapiens
cacucuguuccug

SEQ ID NO: 1406374 - RNA, 11 nt, Homo sapiens
cacugcuguag

SEQ ID NO: 1406375 - RNA, 22 nt, Homo sapiens
cacuguuuaacugggagugaua

SEQ ID NO: 1406376 - RNA, 17 nt, Homo sapiens
cacuuauccuguucucu

SEQ ID NO: 1406377 - RNA, 16 nt, Homo sapiens
cacuucacuaccaaau

SEQ ID NO: 1406378 - RNA, 21 nt, Homo sapiens
cacuucgaugacuggauacag

SEQ ID NO: 1406379 - RNA, 19 nt, Homo sapiens
cacuuugggaggccgaggu

SEQ ID NO: 1406380 - RNA, 16 nt, Homo sapiens
cagaaguuugagauca

SEQ ID NO: 1406381 - RNA, 23 nt, Homo sapiens
cagaauauuaaauuagacuuccu

SEQ ID NO: 1406382 - RNA, 21 nt, Homo sapiens
cagacuacuucuuccccagau

SEQ ID NO: 1406383 - RNA, 18 nt, Homo sapiens
cagagacaggcccaagag

SEQ ID NO: 1406384 - RNA, 19 nt, Homo sapiens
cagagacaggcccaagaga

SEQ ID NO: 1406385 - RNA, 20 nt, Homo sapiens
cagagacugggaugggaaca

SEQ ID NO: 1406386 - RNA, 19 nt, Homo sapiens
cagagauacgcaaacacac

SEQ ID NO: 1406387 - RNA, 15 nt, Homo sapiens
cagagauaugcacac

SEQ ID NO: 1406388 - RNA, 20 nt, Homo sapiens
cagagcaagacucugucuca

SEQ ID NO: 1406389 - RNA, 16 nt, Homo sapiens
cagagccacuaccuuu

SEQ ID NO: 1406390 - RNA, 15 nt, Homo sapiens
cagaggaugucacaa

SEQ ID NO: 1406391 - RNA, 13 nt, Homo sapiens
cagauacuccucc

SEQ ID NO: 1406392 - RNA, 12 nt, Homo sapiens
cagauacuuggg

SEQ ID NO: 1406393 - RNA, 23 nt, Homo sapiens
cagauaugcacacacauggauga

SEQ ID NO: 1406394 - RNA, 15 nt, Homo sapiens
cagaugauacuucca

SEQ ID NO: 1406395 - RNA, 15 nt, Homo sapiens
cagaugcacacacag

SEQ ID NO: 1406396 - RNA, 19 nt, Homo sapiens
cagauugauaaguaaugaa

SEQ ID NO: 1406397 - RNA, 23 nt, Homo sapiens
cagauuuuaagggggaaaacugu

SEQ ID NO: 1406398 - RNA, 13 nt, Homo sapiens
cagcaaaauguga

SEQ ID NO: 1406399 - RNA, 20 nt, Homo sapiens
cagcaaaaugugaaugggaa

SEQ ID NO: 1406400 - RNA, 23 nt, Homo sapiens
cagcaaggccagaugcacauccc

SEQ ID NO: 1406401 - RNA, 18 nt, Homo sapiens
cagcaaggggacaucuua

SEQ ID NO: 1406402 - RNA, 18 nt, Homo sapiens
cagcauuuagucuugcca

SEQ ID NO: 1406403 - RNA, 19 nt, Homo sapiens
cagccucuagcaccaggac

SEQ ID NO: 1406404 - RNA, 16 nt, Homo sapiens
cagccuguccaacaga

SEQ ID NO: 1406405 - RNA, 14 nt, Homo sapiens
cagcgccuccugga

SEQ ID NO: 1406406 - RNA, 22 nt, Homo sapiens
cagcuuaucucaggggugugcg

SEQ ID NO: 1406407 - RNA, 23 nt, Homo sapiens
cagcuuuguuuguugucagcuga

SEQ ID NO: 1406408 - RNA, 19 nt, Homo sapiens
caggaaauaaauuguaaaa

SEQ ID NO: 1406409 - RNA, 14 nt, Homo sapiens
caggaaauagucac

SEQ ID NO: 1406410 - RNA, 15 nt, Homo sapiens
caggaggcugaggca

SEQ ID NO: 1406411 - RNA, 18 nt, Homo sapiens
caggaggcugaggcacca

SEQ ID NO: 1406412 - RNA, 18 nt, Homo sapiens
caggccauugucccugaa

SEQ ID NO: 1406413 - RNA, 14 nt, Homo sapiens
caggcucugagauu

SEQ ID NO: 1406414 - RNA, 16 nt, Homo sapiens
caggcuggagugcagu

SEQ ID NO: 1406415 - RNA, 17 nt, Homo sapiens
caggcuuugucugcucc

SEQ ID NO: 1406416 - RNA, 18 nt, Homo sapiens
cagggauucuuccugcuu

SEQ ID NO: 1406417 - RNA, 18 nt, Homo sapiens
cagggcccuccaccgcca

SEQ ID NO: 1406418 - RNA, 18 nt, Homo sapiens
caggggucgucaccaccu

SEQ ID NO: 1406419 - RNA, 21 nt, Homo sapiens
caggggucgucaccaccucuc

SEQ ID NO: 1406420 - RNA, 19 nt, Homo sapiens
caggugccaaguuccacuu

SEQ ID NO: 1406421 - RNA, 20 nt, Homo sapiens
cagguuuucuguuucugugu

SEQ ID NO: 1406422 - RNA, 17 nt, Homo sapiens
caguaaccuagugaauu

SEQ ID NO: 1406423 - RNA, 13 nt, Homo sapiens
cagucuuggaaua

SEQ ID NO: 1406424 - RNA, 15 nt, Homo sapiens
cagugaacugagacu

SEQ ID NO: 1406425 - RNA, 17 nt, Homo sapiens
cagugacuuuagaaaca

SEQ ID NO: 1406426 - RNA, 18 nt, Homo sapiens
caguggcuggaucuguga

SEQ ID NO: 1406427 - RNA, 18 nt, Homo sapiens
caguguauuuggaaaaug

SEQ ID NO: 1406428 - RNA, 14 nt, Homo sapiens
caguuugcacuuau

SEQ ID NO: 1406429 - RNA, 18 nt, Homo sapiens
cauacauuauauuccucu

SEQ ID NO: 1406430 - RNA, 21 nt, Homo sapiens
cauaccuggcccugugccuug

SEQ ID NO: 1406431 - RNA, 22 nt, Homo sapiens
cauaccuggcccugugccuugg

SEQ ID NO: 1406432 - RNA, 19 nt, Homo sapiens
cauagaaauuacacccaaa

SEQ ID NO: 1406433 - RNA, 15 nt, Homo sapiens
cauagagauaugcac

SEQ ID NO: 1406434 - RNA, 14 nt, Homo sapiens
cauagggugcucug

SEQ ID NO: 1406435 - RNA, 14 nt, Homo sapiens
caucaaagcacugu

SEQ ID NO: 1406436 - RNA, 21 nt, Homo sapiens
cauccaaggagaaacagagac

SEQ ID NO: 1406437 - RNA, 24 nt, Homo sapiens
cauccauguuccgagaagaacaga

SEQ ID NO: 1406438 - RNA, 21 nt, Homo sapiens
cauccuacccccugugccuug

SEQ ID NO: 1406439 - RNA, 19 nt, Homo sapiens
caucuaauaaguauauaau

SEQ ID NO: 1406440 - RNA, 13 nt, Homo sapiens
caucucaagcaag

SEQ ID NO: 1406441 - RNA, 15 nt, Homo sapiens
caucucugccuggaa

SEQ ID NO: 1406442 - RNA, 20 nt, Homo sapiens
caugaaaaauauugcugaac

SEQ ID NO: 1406443 - RNA, 16 nt, Homo sapiens
caugaacacacaugga

SEQ ID NO: 1406444 - RNA, 19 nt, Homo sapiens
caugaacacacauggaugc

SEQ ID NO: 1406445 - RNA, 22 nt, Homo sapiens
caugaacacacauggaugcaca

SEQ ID NO: 1406446 - RNA, 23 nt, Homo sapiens
caugaacacacauggaugcacac

SEQ ID NO: 1406447 - RNA, 21 nt, Homo sapiens
caugagcuccuuaaggcucuu

SEQ ID NO: 1406448 - RNA, 17 nt, Homo sapiens
caugaguuggcugggaa

SEQ ID NO: 1406449 - RNA, 22 nt, Homo sapiens
caugcagcaaggggacaucuua

SEQ ID NO: 1406450 - RNA, 18 nt, Homo sapiens
caugcauucuagugcaga

SEQ ID NO: 1406451 - RNA, 21 nt, Homo sapiens
caugccaaugcacgcacacau

SEQ ID NO: 1406452 - RNA, 16 nt, Homo sapiens
cauggaugcacacaca

SEQ ID NO: 1406453 - RNA, 19 nt, Homo sapiens
cauggcaauuuuuacacaa

SEQ ID NO: 1406454 - RNA, 13 nt, Homo sapiens
caugggacugugc

SEQ ID NO: 1406455 - RNA, 18 nt, Homo sapiens
cauguguaauaugcacaa

SEQ ID NO: 1406456 - RNA, 16 nt, Homo sapiens
cauuagcuacuuuuca

SEQ ID NO: 1406457 - RNA, 17 nt, Homo sapiens
cauuauuucaaccgcuu

SEQ ID NO: 1406458 - RNA, 14 nt, Homo sapiens
cauucugaccauuu

SEQ ID NO: 1406459 - RNA, 16 nt, Homo sapiens
cauucugaccauuuca

SEQ ID NO: 1406460 - RNA, 18 nt, Homo sapiens
cauugaaagggaguauua

SEQ ID NO: 1406461 - RNA, 17 nt, Homo sapiens
cauuuagucuugccagg

SEQ ID NO: 1406462 - RNA, 22 nt, Homo sapiens
cauuucuacuuuuugcaccuua

SEQ ID NO: 1406463 - RNA, 13 nt, Homo sapiens
cauuuugcauuag

SEQ ID NO: 1406464 - RNA, 15 nt, Homo sapiens
cauuuuguuauagaa

SEQ ID NO: 1406465 - RNA, 12 nt, Homo sapiens
ccaaacacuggg

SEQ ID NO: 1406466 - RNA, 20 nt, Homo sapiens
ccaaagaaauggaaauugau

SEQ ID NO: 1406467 - RNA, 16 nt, Homo sapiens
ccaaagacuacacugu

SEQ ID NO: 1406468 - RNA, 19 nt, Homo sapiens
ccaaaguucccacuccuuc

SEQ ID NO: 1406469 - RNA, 18 nt, Homo sapiens
ccaacacugccagcauuu

SEQ ID NO: 1406470 - RNA, 22 nt, Homo sapiens
ccaacagaggggcagccaggac

SEQ ID NO: 1406471 - RNA, 21 nt, Homo sapiens
ccaacauuaaaagccaccccc

SEQ ID NO: 1406472 - RNA, 23 nt, Homo sapiens
ccaacgaaaagcacauccaggca

SEQ ID NO: 1406473 - RNA, 20 nt, Homo sapiens
ccaacuccgcccagccucuc

SEQ ID NO: 1406474 - RNA, 16 nt, Homo sapiens
ccaagaaguaacaaaa

SEQ ID NO: 1406475 - RNA, 16 nt, Homo sapiens
ccaaggaacaggaaac

SEQ ID NO: 1406476 - RNA, 24 nt, Homo sapiens
ccaaguuccacuuuucugcaggua

SEQ ID NO: 1406477 - RNA, 16 nt, Homo sapiens
ccaauauuuaccagac

SEQ ID NO: 1406478 - RNA, 23 nt, Homo sapiens
ccaaucucuucuaaaaaaaaaca

SEQ ID NO: 1406479 - RNA, 11 nt, Homo sapiens
ccaaugcacac

SEQ ID NO: 1406480 - RNA, 13 nt, Homo sapiens
ccaaugcacacac

SEQ ID NO: 1406481 - RNA, 21 nt, Homo sapiens
ccaaugcacgcacacaucagu

SEQ ID NO: 1406482 - RNA, 12 nt, Homo sapiens
ccaauuccucau

SEQ ID NO: 1406483 - RNA, 15 nt, Homo sapiens
ccaauugcugccaau

SEQ ID NO: 1406484 - RNA, 23 nt, Homo sapiens
ccacagaacacagcaauuccuca

SEQ ID NO: 1406485 - RNA, 18 nt, Homo sapiens
ccacagaugauacuucca

SEQ ID NO: 1406486 - RNA, 18 nt, Homo sapiens
ccacucaggggucauuca

SEQ ID NO: 1406487 - RNA, 19 nt, Homo sapiens
ccacucaggggucauucau

SEQ ID NO: 1406488 - RNA, 18 nt, Homo sapiens
ccacucaugugacucuuu

SEQ ID NO: 1406489 - RNA, 16 nt, Homo sapiens
ccacucuuugcuacaa

SEQ ID NO: 1406490 - RNA, 23 nt, Homo sapiens
ccacuuuccccgugggccauggc

SEQ ID NO: 1406491 - RNA, 18 nt, Homo sapiens
ccagaaugccuccugcag

SEQ ID NO: 1406492 - RNA, 19 nt, Homo sapiens
ccagagagacgcugugauu

SEQ ID NO: 1406493 - RNA, 14 nt, Homo sapiens
ccagagcaaaauaa

SEQ ID NO: 1406494 - RNA, 23 nt, Homo sapiens
ccagagccuuaauaaacguccac

SEQ ID NO: 1406495 - RNA, 18 nt, Homo sapiens
ccagaggaugucacaaag

SEQ ID NO: 1406496 - RNA, 12 nt, Homo sapiens
ccagaggcaccu

SEQ ID NO: 1406497 - RNA, 19 nt, Homo sapiens
ccagaggcuauuauuuuca

SEQ ID NO: 1406498 - RNA, 12 nt, Homo sapiens
ccagcacuggaa

SEQ ID NO: 1406499 - RNA, 14 nt, Homo sapiens
ccagccugccccag

SEQ ID NO: 1406500 - RNA, 19 nt, Homo sapiens
ccagccuguccaacagagg

SEQ ID NO: 1406501 - RNA, 18 nt, Homo sapiens
ccagcgugugacuacucc

SEQ ID NO: 1406502 - RNA, 14 nt, Homo sapiens
ccagcuuaucucag

SEQ ID NO: 1406503 - RNA, 13 nt, Homo sapiens
ccaggagacaguu

SEQ ID NO: 1406504 - RNA, 19 nt, Homo sapiens
ccaggagcaaaugcuggau

SEQ ID NO: 1406505 - RNA, 23 nt, Homo sapiens
ccaggagguggagguugcaguga

SEQ ID NO: 1406506 - RNA, 15 nt, Homo sapiens
ccaggcuagagugca

SEQ ID NO: 1406507 - RNA, 20 nt, Homo sapiens
ccaggcuagagugcaguggc

SEQ ID NO: 1406508 - RNA, 19 nt, Homo sapiens
ccaggcuggagugcaaugg

SEQ ID NO: 1406509 - RNA, 20 nt, Homo sapiens
ccaggcuggagugcaauggc

SEQ ID NO: 1406510 - RNA, 20 nt, Homo sapiens
ccaggcuggagugcaguggu

SEQ ID NO: 1406511 - RNA, 11 nt, Homo sapiens
ccagggccaug

SEQ ID NO: 1406512 - RNA, 14 nt, Homo sapiens
ccaguccuccagac

SEQ ID NO: 1406513 - RNA, 21 nt, Homo sapiens
ccaguggaagaagaaaacacu

SEQ ID NO: 1406514 - RNA, 15 nt, Homo sapiens
ccaucucauucaggu

SEQ ID NO: 1406515 - RNA, 16 nt, Homo sapiens
ccaucucuuuaccucc

SEQ ID NO: 1406516 - RNA, 17 nt, Homo sapiens
ccauggacccaauauuu

SEQ ID NO: 1406517 - RNA, 15 nt, Homo sapiens
ccauggugcacaaaa

SEQ ID NO: 1406518 - RNA, 17 nt, Homo sapiens
ccauguuggucaggcug

SEQ ID NO: 1406519 - RNA, 16 nt, Homo sapiens
ccauuaaauagggaaa

SEQ ID NO: 1406520 - RNA, 22 nt, Homo sapiens
ccauuaaauagggaaaaaacau

SEQ ID NO: 1406521 - RNA, 17 nt, Homo sapiens
ccauuccagacugcuuc

SEQ ID NO: 1406522 - RNA, 13 nt, Homo sapiens
ccauucugaccau

SEQ ID NO: 1406523 - RNA, 21 nt, Homo sapiens
ccauugugauuauuguuacua

SEQ ID NO: 1406524 - RNA, 23 nt, Homo sapiens
cccaaagucauugauuuugauga

SEQ ID NO: 1406525 - RNA, 18 nt, Homo sapiens
cccaacgaaaagcacauc

SEQ ID NO: 1406526 - RNA, 19 nt, Homo sapiens
cccaaggaccuuacaggcc

SEQ ID NO: 1406527 - RNA, 17 nt, Homo sapiens
cccaaguagcugagauu

SEQ ID NO: 1406528 - RNA, 13 nt, Homo sapiens
cccaaugccugcu

SEQ ID NO: 1406529 - RNA, 23 nt, Homo sapiens
cccaccuccgcugggaggaaccu

SEQ ID NO: 1406530 - RNA, 14 nt, Homo sapiens
cccacuuggcauca

SEQ ID NO: 1406531 - RNA, 19 nt, Homo sapiens
cccacuuggcaucauucac

SEQ ID NO: 1406532 - RNA, 14 nt, Homo sapiens
cccagcacacggcu

SEQ ID NO: 1406533 - RNA, 16 nt, Homo sapiens
cccagcccacccugcu

SEQ ID NO: 1406534 - RNA, 15 nt, Homo sapiens
cccagcuauucagga

SEQ ID NO: 1406535 - RNA, 19 nt, Homo sapiens
cccaggagcaaaugcugga

SEQ ID NO: 1406536 - RNA, 17 nt, Homo sapiens
cccaggcuggagugcag

SEQ ID NO: 1406537 - RNA, 22 nt, Homo sapiens
cccaggugguuauggagagggu

SEQ ID NO: 1406538 - RNA, 13 nt, Homo sapiens
cccaucucuacaa

SEQ ID NO: 1406539 - RNA, 24 nt, Homo sapiens
ccccagagccacuaccuuugucca

SEQ ID NO: 1406540 - RNA, 18 nt, Homo sapiens
cccccaggauucccagag

SEQ ID NO: 1406541 - RNA, 18 nt, Homo sapiens
cccuaaugagaagucaac

SEQ ID NO: 1406542 - RNA, 23 nt, Homo sapiens
cccuaccugccuguucuccagau

SEQ ID NO: 1406543 - RNA, 18 nt, Homo sapiens
cccucaacaccucugcac

SEQ ID NO: 1406544 - RNA, 22 nt, Homo sapiens
cccuccaccgccacuaugggcc

SEQ ID NO: 1406545 - RNA, 20 nt, Homo sapiens
cccucccaccuccgcuggga

SEQ ID NO: 1406546 - RNA, 13 nt, Homo sapiens
cccugcucccaca

SEQ ID NO: 1406547 - RNA, 11 nt, Homo sapiens
cccugcugcuu

SEQ ID NO: 1406548 - RNA, 14 nt, Homo sapiens
cccugucucaaaaa

SEQ ID NO: 1406549 - RNA, 17 nt, Homo sapiens
cccuuagccuugcugua

SEQ ID NO: 1406550 - RNA, 16 nt, Homo sapiens
cccuuauuuucaagaa

SEQ ID NO: 1406551 - RNA, 22 nt, Homo sapiens
ccgagcuuugaaaauucagugg

SEQ ID NO: 1406552 - RNA, 17 nt, Homo sapiens
ccgauguacacacacag

SEQ ID NO: 1406553 - RNA, 22 nt, Homo sapiens
ccgcucuggauccugcacucua

SEQ ID NO: 1406554 - RNA, 15 nt, Homo sapiens
ccggaggcugcagug

SEQ ID NO: 1406555 - RNA, 23 nt, Homo sapiens
ccgggucugcuucugcauucaca

SEQ ID NO: 1406556 - RNA, 13 nt, Homo sapiens
ccgggugccauuc

SEQ ID NO: 1406557 - RNA, 17 nt, Homo sapiens
ccuaauuccacacccuc

SEQ ID NO: 1406558 - RNA, 17 nt, Homo sapiens
ccucaaaugcaguauuu

SEQ ID NO: 1406559 - RNA, 23 nt, Homo sapiens
ccucacugcuguagacauuugcu

SEQ ID NO: 1406560 - RNA, 14 nt, Homo sapiens
ccucaggcaggugg

SEQ ID NO: 1406561 - RNA, 21 nt, Homo sapiens
ccucagucuggugcuccaguu

SEQ ID NO: 1406562 - RNA, 16 nt, Homo sapiens
ccucagugagaagcca

SEQ ID NO: 1406563 - RNA, 14 nt, Homo sapiens
ccucauacacagaa

SEQ ID NO: 1406564 - RNA, 14 nt, Homo sapiens
ccucauccauagca

SEQ ID NO: 1406565 - RNA, 19 nt, Homo sapiens
ccucauuagcauuuugcua

SEQ ID NO: 1406566 - RNA, 20 nt, Homo sapiens
ccucauuagcauuuugcuaa

SEQ ID NO: 1406567 - RNA, 20 nt, Homo sapiens
ccuccaaaagcccugaguuu

SEQ ID NO: 1406568 - RNA, 20 nt, Homo sapiens
ccuccagcccucucacugug

SEQ ID NO: 1406569 - RNA, 17 nt, Homo sapiens
ccuccagggacaaagag

SEQ ID NO: 1406570 - RNA, 12 nt, Homo sapiens
ccuccauucuga

SEQ ID NO: 1406571 - RNA, 13 nt, Homo sapiens
ccucccaccagag

SEQ ID NO: 1406572 - RNA, 22 nt, Homo sapiens
ccucccaggaacugggccaacu

SEQ ID NO: 1406573 - RNA, 13 nt, Homo sapiens
ccucccucaggcc

SEQ ID NO: 1406574 - RNA, 14 nt, Homo sapiens
ccuccucaaaccua

SEQ ID NO: 1406575 - RNA, 15 nt, Homo sapiens
ccuccugucccucau

SEQ ID NO: 1406576 - RNA, 18 nt, Homo sapiens
ccuccugucccucaucca

SEQ ID NO: 1406577 - RNA, 13 nt, Homo sapiens
ccucgacuuauca

SEQ ID NO: 1406578 - RNA, 13 nt, Homo sapiens
ccucgagauccca

SEQ ID NO: 1406579 - RNA, 22 nt, Homo sapiens
ccucuccacucaugugacucuu

SEQ ID NO: 1406580 - RNA, 19 nt, Homo sapiens
ccucuucuuauucaugcuu

SEQ ID NO: 1406581 - RNA, 17 nt, Homo sapiens
ccugaaaauuaugaguc

SEQ ID NO: 1406582 - RNA, 13 nt, Homo sapiens
ccugagaugauuu

SEQ ID NO: 1406583 - RNA, 20 nt, Homo sapiens
ccugagaugauuuggucaga

SEQ ID NO: 1406584 - RNA, 21 nt, Homo sapiens
ccugagugcaccacccuuuga

SEQ ID NO: 1406585 - RNA, 14 nt, Homo sapiens
ccugccuaggaauu

SEQ ID NO: 1406586 - RNA, 14 nt, Homo sapiens
ccuggacuccagua

SEQ ID NO: 1406587 - RNA, 18 nt, Homo sapiens
ccugggaaccaugaagcu

SEQ ID NO: 1406588 - RNA, 15 nt, Homo sapiens
ccugggcaaugugau

SEQ ID NO: 1406589 - RNA, 22 nt, Homo sapiens
ccugggcauacuaauaaaguau

SEQ ID NO: 1406590 - RNA, 17 nt, Homo sapiens
ccuggguaacuagggaa

SEQ ID NO: 1406591 - RNA, 18 nt, Homo sapiens
ccuggguaacuagggaag

SEQ ID NO: 1406592 - RNA, 20 nt, Homo sapiens
ccuguaccccagcacuugug

SEQ ID NO: 1406593 - RNA, 13 nt, Homo sapiens
ccugugacuaugg

SEQ ID NO: 1406594 - RNA, 23 nt, Homo sapiens
ccugugucuuauagguuuccacu

SEQ ID NO: 1406595 - RNA, 18 nt, Homo sapiens
ccuguucucugaagaugu

SEQ ID NO: 1406596 - RNA, 16 nt, Homo sapiens
ccuuaaacuccuguga

SEQ ID NO: 1406597 - RNA, 13 nt, Homo sapiens
ccuuaaggcucuu

SEQ ID NO: 1406598 - RNA, 14 nt, Homo sapiens
ccuucagauuugcc

SEQ ID NO: 1406599 - RNA, 21 nt, Homo sapiens
ccuucaugaugaauuacuucu

SEQ ID NO: 1406600 - RNA, 15 nt, Homo sapiens
ccuuccacaccccau

SEQ ID NO: 1406601 - RNA, 12 nt, Homo sapiens
ccuucuaccucu

SEQ ID NO: 1406602 - RNA, 22 nt, Homo sapiens
ccuugcaagcuaauucuuugac

SEQ ID NO: 1406603 - RNA, 11 nt, Homo sapiens
ccuuggcuuua

SEQ ID NO: 1406604 - RNA, 22 nt, Homo sapiens
ccuuguccugaugcugugcuca

SEQ ID NO: 1406605 - RNA, 13 nt, Homo sapiens
ccuugugaaggaa

SEQ ID NO: 1406606 - RNA, 19 nt, Homo sapiens
ccuuguugacacggccaug

SEQ ID NO: 1406607 - RNA, 17 nt, Homo sapiens
ccuuuccccucccucag

SEQ ID NO: 1406608 - RNA, 22 nt, Homo sapiens
ccuuuggacuugucccgggaca

SEQ ID NO: 1406609 - RNA, 16 nt, Homo sapiens
cgacguuugacuagcc

SEQ ID NO: 1406610 - RNA, 17 nt, Homo sapiens
cgacguuugacuagcca

SEQ ID NO: 1406611 - RNA, 19 nt, Homo sapiens
cgacguuugacuagccauc

SEQ ID NO: 1406612 - RNA, 11 nt, Homo sapiens
cgaucuuggcu

SEQ ID NO: 1406613 - RNA, 15 nt, Homo sapiens
cgaugcacacgcaca

SEQ ID NO: 1406614 - RNA, 17 nt, Homo sapiens
cgauguacacacacaga

SEQ ID NO: 1406615 - RNA, 19 nt, Homo sapiens
cgaugugcgcacacacaga

SEQ ID NO: 1406616 - RNA, 21 nt, Homo sapiens
cgcaaacacaccgaugcacac

SEQ ID NO: 1406617 - RNA, 20 nt, Homo sapiens
cgcacaaggcugaccaagag

SEQ ID NO: 1406618 - RNA, 13 nt, Homo sapiens
cgccaaugcacac

SEQ ID NO: 1406619 - RNA, 16 nt, Homo sapiens
cgccacggcacuccag

SEQ ID NO: 1406620 - RNA, 13 nt, Homo sapiens
cgcccuccacaaa

SEQ ID NO: 1406621 - RNA, 14 nt, Homo sapiens
cgcugccuugccau

SEQ ID NO: 1406622 - RNA, 14 nt, Homo sapiens
cggaacauguaaaa

SEQ ID NO: 1406623 - RNA, 17 nt, Homo sapiens
cggaagugaccacagaa

SEQ ID NO: 1406624 - RNA, 16 nt, Homo sapiens
cggaugcacacacaga

SEQ ID NO: 1406625 - RNA, 21 nt, Homo sapiens
cggcugcgucuccuccgcaca

SEQ ID NO: 1406626 - RNA, 21 nt, Homo sapiens
cgggaagcaagaugugaaaga

SEQ ID NO: 1406627 - RNA, 20 nt, Homo sapiens
cggggaggcuccugccugag

SEQ ID NO: 1406628 - RNA, 14 nt, Homo sapiens
cggugcucuggaag

SEQ ID NO: 1406629 - RNA, 15 nt, Homo sapiens
cgucagcugggacac

SEQ ID NO: 1406630 - RNA, 21 nt, Homo sapiens
cgugaucucggcucacugcaa

SEQ ID NO: 1406631 - RNA, 19 nt, Homo sapiens
cguuugacuagccaucuca

SEQ ID NO: 1406632 - RNA, 17 nt, Homo sapiens
cuaaagcuuuggacaag

SEQ ID NO: 1406633 - RNA, 21 nt, Homo sapiens
cuaaagucacauauaaaaguu

SEQ ID NO: 1406634 - RNA, 14 nt, Homo sapiens
cuaagacaccugca

SEQ ID NO: 1406635 - RNA, 20 nt, Homo sapiens
cuaagauacugcugaugcug

SEQ ID NO: 1406636 - RNA, 15 nt, Homo sapiens
cuaauuccacacccu

SEQ ID NO: 1406637 - RNA, 23 nt, Homo sapiens
cuacaaacucccacuugucaugu

SEQ ID NO: 1406638 - RNA, 20 nt, Homo sapiens
cuacccccugugccuuguca

SEQ ID NO: 1406639 - RNA, 16 nt, Homo sapiens
cuacuacucugccaau

SEQ ID NO: 1406640 - RNA, 20 nt, Homo sapiens
cuacucuagggaaaaaccag

SEQ ID NO: 1406641 - RNA, 16 nt, Homo sapiens
cuacuuucauacugaa

SEQ ID NO: 1406642 - RNA, 18 nt, Homo sapiens
cuagagugacaggcacca

SEQ ID NO: 1406643 - RNA, 12 nt, Homo sapiens
cuagagugcagu

SEQ ID NO: 1406644 - RNA, 14 nt, Homo sapiens
cuagccaucucaag

SEQ ID NO: 1406645 - RNA, 21 nt, Homo sapiens
cuaggagucuucacugcucug

SEQ ID NO: 1406646 - RNA, 17 nt, Homo sapiens
cuaggcauuugcugaau

SEQ ID NO: 1406647 - RNA, 19 nt, Homo sapiens
cuagucucuucucagagca

SEQ ID NO: 1406648 - RNA, 20 nt, Homo sapiens
cuaguucugccaggagacag

SEQ ID NO: 1406649 - RNA, 11 nt, Homo sapiens
cuaugguucuc

SEQ ID NO: 1406650 - RNA, 22 nt, Homo sapiens
cuauuaguaguuaauucuguca

SEQ ID NO: 1406651 - RNA, 14 nt, Homo sapiens
cuauuauuugcuau

SEQ ID NO: 1406652 - RNA, 21 nt, Homo sapiens
cucaaaagcugggcagguugg

SEQ ID NO: 1406653 - RNA, 22 nt, Homo sapiens
cucaaaccuaccacucaggaau

SEQ ID NO: 1406654 - RNA, 19 nt, Homo sapiens
cucaaacucuuaaaaccca

SEQ ID NO: 1406655 - RNA, 23 nt, Homo sapiens
cucacccccagcuuugcuaccaa

SEQ ID NO: 1406656 - RNA, 16 nt, Homo sapiens
cucaccuggacuccag

SEQ ID NO: 1406657 - RNA, 15 nt, Homo sapiens
cucagagcagcacug

SEQ ID NO: 1406658 - RNA, 18 nt, Homo sapiens
cucagaggguguccugca

SEQ ID NO: 1406659 - RNA, 13 nt, Homo sapiens
cucagcaaaagau

SEQ ID NO: 1406660 - RNA, 23 nt, Homo sapiens
cucagcuucccaaguagcugaga

SEQ ID NO: 1406661 - RNA, 15 nt, Homo sapiens
cucaggaauguuugc

SEQ ID NO: 1406662 - RNA, 18 nt, Homo sapiens
cucaggaguuugagacca

SEQ ID NO: 1406663 - RNA, 17 nt, Homo sapiens
cucagugucagcacuca

SEQ ID NO: 1406664 - RNA, 13 nt, Homo sapiens
cucauacacagaa

SEQ ID NO: 1406665 - RNA, 14 nt, Homo sapiens
cucaucaggccauu

SEQ ID NO: 1406666 - RNA, 12 nt, Homo sapiens
cucauccaaagu

SEQ ID NO: 1406667 - RNA, 18 nt, Homo sapiens
cucaugugacucuuucca

SEQ ID NO: 1406668 - RNA, 13 nt, Homo sapiens
cucaugugcagua

SEQ ID NO: 1406669 - RNA, 18 nt, Homo sapiens
cuccaagguaacccggcu

SEQ ID NO: 1406670 - RNA, 20 nt, Homo sapiens
cuccacaaaugggaaaacca

SEQ ID NO: 1406671 - RNA, 18 nt, Homo sapiens
cuccauugguguugacau

SEQ ID NO: 1406672 - RNA, 11 nt, Homo sapiens
cucccaaagug

SEQ ID NO: 1406673 - RNA, 22 nt, Homo sapiens
cucccagcuuucugugugcaca

SEQ ID NO: 1406674 - RNA, 16 nt, Homo sapiens
cucccagggccaugaa

SEQ ID NO: 1406675 - RNA, 21 nt, Homo sapiens
cuccccagcccuuugcaggcc

SEQ ID NO: 1406676 - RNA, 16 nt, Homo sapiens
cuccgucucaaaagaa

SEQ ID NO: 1406677 - RNA, 17 nt, Homo sapiens
cuccugaccucgugauu

SEQ ID NO: 1406678 - RNA, 17 nt, Homo sapiens
cuccugcugccuaauaa

SEQ ID NO: 1406679 - RNA, 14 nt, Homo sapiens
cucgugauuugccu

SEQ ID NO: 1406680 - RNA, 19 nt, Homo sapiens
cucgugauuugccugccug

SEQ ID NO: 1406681 - RNA, 15 nt, Homo sapiens
cucuaaaacucucaa

SEQ ID NO: 1406682 - RNA, 14 nt, Homo sapiens
cucuagucagcaca

SEQ ID NO: 1406683 - RNA, 17 nt, Homo sapiens
cucucggcuucaccagg

SEQ ID NO: 1406684 - RNA, 11 nt, Homo sapiens
cucugagauuu

SEQ ID NO: 1406685 - RNA, 16 nt, Homo sapiens
cucugaggaguggagu

SEQ ID NO: 1406686 - RNA, 13 nt, Homo sapiens
cucugcccgggag

SEQ ID NO: 1406687 - RNA, 14 nt, Homo sapiens
cucuggaagaccug

SEQ ID NO: 1406688 - RNA, 16 nt, Homo sapiens
cucuuagaagugacau

SEQ ID NO: 1406689 - RNA, 18 nt, Homo sapiens
cugaaccaucccugaugu

SEQ ID NO: 1406690 - RNA, 16 nt, Homo sapiens
cugaaccugggaacca

SEQ ID NO: 1406691 - RNA, 19 nt, Homo sapiens
cugaaggcugaaagacagg

SEQ ID NO: 1406692 - RNA, 12 nt, Homo sapiens
cugacagagcca

SEQ ID NO: 1406693 - RNA, 22 nt, Homo sapiens
cugacccucaucuuucuuccaa

SEQ ID NO: 1406694 - RNA, 18 nt, Homo sapiens
cugaccuggcuggugaca

SEQ ID NO: 1406695 - RNA, 19 nt, Homo sapiens
cugaccuggcuggugacag

SEQ ID NO: 1406696 - RNA, 16 nt, Homo sapiens
cugacuacuacucugc

SEQ ID NO: 1406697 - RNA, 14 nt, Homo sapiens
cugagagaggccau

SEQ ID NO: 1406698 - RNA, 13 nt, Homo sapiens
cugaggauuucaa

SEQ ID NO: 1406699 - RNA, 14 nt, Homo sapiens
cugaggcaccagaa

SEQ ID NO: 1406700 - RNA, 18 nt, Homo sapiens
cugagugggggaucacag

SEQ ID NO: 1406701 - RNA, 18 nt, Homo sapiens
cugaucauuaaagccuga

SEQ ID NO: 1406702 - RNA, 14 nt, Homo sapiens
cugcacuccagccu

SEQ ID NO: 1406703 - RNA, 15 nt, Homo sapiens
cugcaggcugcaguc

SEQ ID NO: 1406704 - RNA, 16 nt, Homo sapiens
cugccaaaacaaugcc

SEQ ID NO: 1406705 - RNA, 23 nt, Homo sapiens
cugccaucauguuuacagaggac

SEQ ID NO: 1406706 - RNA, 16 nt, Homo sapiens
cugcccaccuccugga

SEQ ID NO: 1406707 - RNA, 13 nt, Homo sapiens
cugccccaucucc

SEQ ID NO: 1406708 - RNA, 19 nt, Homo sapiens
cugcccgaccccaucucau

SEQ ID NO: 1406709 - RNA, 18 nt, Homo sapiens
cugcccugccaccugucu

SEQ ID NO: 1406710 - RNA, 16 nt, Homo sapiens
cugcccuucagcaucc

SEQ ID NO: 1406711 - RNA, 18 nt, Homo sapiens
cugccucagccuccugag

SEQ ID NO: 1406712 - RNA, 15 nt, Homo sapiens
cugccugacacugag

SEQ ID NO: 1406713 - RNA, 14 nt, Homo sapiens
cugcucauccaaag

SEQ ID NO: 1406714 - RNA, 14 nt, Homo sapiens
cugcucccacagaa

SEQ ID NO: 1406715 - RNA, 22 nt, Homo sapiens
cugcuccccacgucagcuggga

SEQ ID NO: 1406716 - RNA, 21 nt, Homo sapiens
cugcuucaguccacaguacau

SEQ ID NO: 1406717 - RNA, 18 nt, Homo sapiens
cuggaccagccucuccac

SEQ ID NO: 1406718 - RNA, 21 nt, Homo sapiens
cuggagaaagggaaguggaag

SEQ ID NO: 1406719 - RNA, 15 nt, Homo sapiens
cuggagugcaauggc

SEQ ID NO: 1406720 - RNA, 15 nt, Homo sapiens
cuggcaagaaugugu

SEQ ID NO: 1406721 - RNA, 17 nt, Homo sapiens
cuggcccugugccuugg

SEQ ID NO: 1406722 - RNA, 16 nt, Homo sapiens
cuggcccuuggcuuua

SEQ ID NO: 1406723 - RNA, 19 nt, Homo sapiens
cuggcuggugacagaacau

SEQ ID NO: 1406724 - RNA, 20 nt, Homo sapiens
cuggcuguggccuaaccugc

SEQ ID NO: 1406725 - RNA, 18 nt, Homo sapiens
cugggacuacaggcaccc

SEQ ID NO: 1406726 - RNA, 15 nt, Homo sapiens
cugggccucagccuc

SEQ ID NO: 1406727 - RNA, 14 nt, Homo sapiens
cugggccucccaaa

SEQ ID NO: 1406728 - RNA, 15 nt, Homo sapiens
cugggcuugucugua

SEQ ID NO: 1406729 - RNA, 19 nt, Homo sapiens
cuggggaugucucucauga

SEQ ID NO: 1406730 - RNA, 21 nt, Homo sapiens
cugggugccgggcugcacaga

SEQ ID NO: 1406731 - RNA, 13 nt, Homo sapiens
cuggucuugugga

SEQ ID NO: 1406732 - RNA, 14 nt, Homo sapiens
cuggugcuccaguu

SEQ ID NO: 1406733 - RNA, 18 nt, Homo sapiens
cuggugguggcucgggag

SEQ ID NO: 1406734 - RNA, 23 nt, Homo sapiens
cugguuagaaaaaggacucugcu

SEQ ID NO: 1406735 - RNA, 22 nt, Homo sapiens
cuguagaaugauuucaugcuau

SEQ ID NO: 1406736 - RNA, 20 nt, Homo sapiens
cugucaaagaaaacuuccaa

SEQ ID NO: 1406737 - RNA, 18 nt, Homo sapiens
cuguccaguuuccaaagg

SEQ ID NO: 1406738 - RNA, 15 nt, Homo sapiens
cugucccuacccacu

SEQ ID NO: 1406739 - RNA, 19 nt, Homo sapiens
cugucccucauccauagca

SEQ ID NO: 1406740 - RNA, 14 nt, Homo sapiens
cugucugucugucu

SEQ ID NO: 1406741 - RNA, 20 nt, Homo sapiens
cugugccuuggugugcugua

SEQ ID NO: 1406742 - RNA, 13 nt, Homo sapiens
cuguuaauaguca

SEQ ID NO: 1406743 - RNA, 18 nt, Homo sapiens
cuguugaauuucccacau

SEQ ID NO: 1406744 - RNA, 19 nt, Homo sapiens
cuguuuuugucuacacucu

SEQ ID NO: 1406745 - RNA, 21 nt, Homo sapiens
cuuaaauauauaauguugcca

SEQ ID NO: 1406746 - RNA, 17 nt, Homo sapiens
cuuagcugaacaaugaa

SEQ ID NO: 1406747 - RNA, 23 nt, Homo sapiens
cuuaucaacauuuguuccaugag

SEQ ID NO: 1406748 - RNA, 19 nt, Homo sapiens
cuuauuuguauaauggugu

SEQ ID NO: 1406749 - RNA, 17 nt, Homo sapiens
cuucauuaccucaguga

SEQ ID NO: 1406750 - RNA, 18 nt, Homo sapiens
cuucccaaguagcugaga

SEQ ID NO: 1406751 - RNA, 20 nt, Homo sapiens
cuucccaaguagcugagauu

SEQ ID NO: 1406752 - RNA, 16 nt, Homo sapiens
cuuccccaacgaaaag

SEQ ID NO: 1406753 - RNA, 22 nt, Homo sapiens
cuucuauuccauggcuaacugg

SEQ ID NO: 1406754 - RNA, 15 nt, Homo sapiens
cuucuccccauucug

SEQ ID NO: 1406755 - RNA, 17 nt, Homo sapiens
cuucugcauucacagcg

SEQ ID NO: 1406756 - RNA, 10 nt, Homo sapiens
cuucugccau

SEQ ID NO: 1406757 - RNA, 15 nt, Homo sapiens
cuucugccucagcuu

SEQ ID NO: 1406758 - RNA, 14 nt, Homo sapiens
cuucuggugugaua

SEQ ID NO: 1406759 - RNA, 17 nt, Homo sapiens
cuugaaagaaaauacca

SEQ ID NO: 1406760 - RNA, 19 nt, Homo sapiens
cuugagacaaaucuaugcc

SEQ ID NO: 1406761 - RNA, 22 nt, Homo sapiens
cuugagaggguggaauauccaa

SEQ ID NO: 1406762 - RNA, 21 nt, Homo sapiens
cuugauauguaaguacuucca

SEQ ID NO: 1406763 - RNA, 22 nt, Homo sapiens
cuugcuuaugacaucacuugua

SEQ ID NO: 1406764 - RNA, 14 nt, Homo sapiens
cuuggcuuuagcca

SEQ ID NO: 1406765 - RNA, 19 nt, Homo sapiens
cuugggaguguugucacac

SEQ ID NO: 1406766 - RNA, 20 nt, Homo sapiens
cuuguaaaggugcugcacug

SEQ ID NO: 1406767 - RNA, 16 nt, Homo sapiens
cuuguagcaguuuuca

SEQ ID NO: 1406768 - RNA, 17 nt, Homo sapiens
cuugucaugugacaggu

SEQ ID NO: 1406769 - RNA, 16 nt, Homo sapiens
cuuguccugaugcugu

SEQ ID NO: 1406770 - RNA, 15 nt, Homo sapiens
cuuuaaacagacucg

SEQ ID NO: 1406771 - RNA, 18 nt, Homo sapiens
cuuucaugaacacagccu

SEQ ID NO: 1406772 - RNA, 15 nt, Homo sapiens
cuuucugaaauaaca

SEQ ID NO: 1406773 - RNA, 20 nt, Homo sapiens
cuuucugaaauaacauggcc

SEQ ID NO: 1406774 - RNA, 18 nt, Homo sapiens
cuuucugcuaucaaagag

SEQ ID NO: 1406775 - RNA, 19 nt, Homo sapiens
cuuucugcuaucaaagagg

SEQ ID NO: 1406776 - RNA, 16 nt, Homo sapiens
cuuuggaaauacacag

SEQ ID NO: 1406777 - RNA, 13 nt, Homo sapiens
cuuuggacacuca

SEQ ID NO: 1406778 - RNA, 22 nt, Homo sapiens
cuuuggguuggagcuguuccau

SEQ ID NO: 1406779 - RNA, 21 nt, Homo sapiens
cuuuguuuagcccaaaaccaa

SEQ ID NO: 1406780 - RNA, 21 nt, Homo sapiens
cuuuguuuguugucagcugaa

SEQ ID NO: 1406781 - RNA, 15 nt, Homo sapiens
cuuuugcaacaagac

SEQ ID NO: 1406782 - RNA, 14 nt, Homo sapiens
cuuuugucccagaa

SEQ ID NO: 1406783 - RNA, 14 nt, Homo sapiens
cuuuuuuauacuca

SEQ ID NO: 1406784 - RNA, 19 nt, Homo sapiens
gaaaaaccaccaccaucac

SEQ ID NO: 1406785 - RNA, 12 nt, Homo sapiens
gaaaacaugacu

SEQ ID NO: 1406786 - RNA, 20 nt, Homo sapiens
gaaaagagauggccugagaa

SEQ ID NO: 1406787 - RNA, 13 nt, Homo sapiens
gaaaaugcauuau

SEQ ID NO: 1406788 - RNA, 18 nt, Homo sapiens
gaaaauguuaugugcucu

SEQ ID NO: 1406789 - RNA, 17 nt, Homo sapiens
gaaacaauaaauuggaa

SEQ ID NO: 1406790 - RNA, 16 nt, Homo sapiens
gaaagcccucaugugc

SEQ ID NO: 1406791 - RNA, 20 nt, Homo sapiens
gaaagcccucaugugcagua

SEQ ID NO: 1406792 - RNA, 17 nt, Homo sapiens
gaaaggccacucaggau

SEQ ID NO: 1406793 - RNA, 20 nt, Homo sapiens
gaacacacauggaugcacac

SEQ ID NO: 1406794 - RNA, 19 nt, Homo sapiens
gaacacagccugggaccag

SEQ ID NO: 1406795 - RNA, 21 nt, Homo sapiens
gaacauuccucugcagcacuu

SEQ ID NO: 1406796 - RNA, 19 nt, Homo sapiens
gaacccugccaggcugcua

SEQ ID NO: 1406797 - RNA, 15 nt, Homo sapiens
gaaccugggaaccau

SEQ ID NO: 1406798 - RNA, 23 nt, Homo sapiens
gaacuaggagucuucacugcucu

SEQ ID NO: 1406799 - RNA, 22 nt, Homo sapiens
gaacucagagaugaacaucuaa

SEQ ID NO: 1406800 - RNA, 15 nt, Homo sapiens
gaacuccaguacuca

SEQ ID NO: 1406801 - RNA, 20 nt, Homo sapiens
gaacugccccaucuccuccc

SEQ ID NO: 1406802 - RNA, 18 nt, Homo sapiens
gaagacagauacuccucc

SEQ ID NO: 1406803 - RNA, 15 nt, Homo sapiens
gaagaggcugcugag

SEQ ID NO: 1406804 - RNA, 21 nt, Homo sapiens
gaagcaggaguaaguuucuca

SEQ ID NO: 1406805 - RNA, 17 nt, Homo sapiens
gaaggccuucuuucuag

SEQ ID NO: 1406806 - RNA, 18 nt, Homo sapiens
gaagggaaggaagcaagc

SEQ ID NO: 1406807 - RNA, 19 nt, Homo sapiens
gaaguacuuaaacuuccac

SEQ ID NO: 1406808 - RNA, 18 nt, Homo sapiens
gaauaauacaguaucuca

SEQ ID NO: 1406809 - RNA, 22 nt, Homo sapiens
gaauaugggguugguguucuca

SEQ ID NO: 1406810 - RNA, 13 nt, Homo sapiens
gaaucacuggaac

SEQ ID NO: 1406811 - RNA, 21 nt, Homo sapiens
gaaugagaagaggcugcugca

SEQ ID NO: 1406812 - RNA, 15 nt, Homo sapiens
gaauggcaugcugaa

SEQ ID NO: 1406813 - RNA, 20 nt, Homo sapiens
gaauuauaauuaguuccuca

SEQ ID NO: 1406814 - RNA, 14 nt, Homo sapiens
gacacuacauaucu

SEQ ID NO: 1406815 - RNA, 21 nt, Homo sapiens
gacacucacacggacacucaa

SEQ ID NO: 1406816 - RNA, 16 nt, Homo sapiens
gacagauacuccucca

SEQ ID NO: 1406817 - RNA, 17 nt, Homo sapiens
gacagauacuccuccaa

SEQ ID NO: 1406818 - RNA, 16 nt, Homo sapiens
gacaguggaugcugcu

SEQ ID NO: 1406819 - RNA, 21 nt, Homo sapiens
gacauauguuaggaauacucu

SEQ ID NO: 1406820 - RNA, 15 nt, Homo sapiens
gacaugacuaggaag

SEQ ID NO: 1406821 - RNA, 16 nt, Homo sapiens
gaccauugucuuccaa

SEQ ID NO: 1406822 - RNA, 14 nt, Homo sapiens
gacccgcucuccau

SEQ ID NO: 1406823 - RNA, 21 nt, Homo sapiens
gacccuacuucuuuugcucuu

SEQ ID NO: 1406824 - RNA, 20 nt, Homo sapiens
gaccucugaaugucccagag

SEQ ID NO: 1406825 - RNA, 21 nt, Homo sapiens
gacguuugacuagccaucuca

SEQ ID NO: 1406826 - RNA, 22 nt, Homo sapiens
gacguuugacuagccaucucaa

SEQ ID NO: 1406827 - RNA, 19 nt, Homo sapiens
gacuagccaucucaagcaa

SEQ ID NO: 1406828 - RNA, 18 nt, Homo sapiens
gacuccccccuuccaaau

SEQ ID NO: 1406829 - RNA, 17 nt, Homo sapiens
gacucuuuggacacuca

SEQ ID NO: 1406830 - RNA, 23 nt, Homo sapiens
gacuggcaguaaccuagugaauu

SEQ ID NO: 1406831 - RNA, 20 nt, Homo sapiens
gacuuuuugaaaaaaguaua

SEQ ID NO: 1406832 - RNA, 18 nt, Homo sapiens
gagaaacaggcucugaga

SEQ ID NO: 1406833 - RNA, 20 nt, Homo sapiens
gagaacacguuggcucaguc

SEQ ID NO: 1406834 - RNA, 23 nt, Homo sapiens
gagaaccuaauaagugcuacuuu

SEQ ID NO: 1406835 - RNA, 14 nt, Homo sapiens
gagaaucacuggaa

SEQ ID NO: 1406836 - RNA, 15 nt, Homo sapiens
gagacaggcccaaga

SEQ ID NO: 1406837 - RNA, 14 nt, Homo sapiens
gagagagcucugca

SEQ ID NO: 1406838 - RNA, 14 nt, Homo sapiens
gagagagugcuauu

SEQ ID NO: 1406839 - RNA, 19 nt, Homo sapiens
gagaggccacagugcaauu

SEQ ID NO: 1406840 - RNA, 16 nt, Homo sapiens
gagauacgcaaacaca

SEQ ID NO: 1406841 - RNA, 18 nt, Homo sapiens
gagauacugaagugcagc

SEQ ID NO: 1406842 - RNA, 11 nt, Homo sapiens
gagauaugcac

SEQ ID NO: 1406843 - RNA, 13 nt, Homo sapiens
gagauaugcacac

SEQ ID NO: 1406844 - RNA, 22 nt, Homo sapiens
gagauuucacaggucuugccca

SEQ ID NO: 1406845 - RNA, 16 nt, Homo sapiens
gagcaccgccugugaa

SEQ ID NO: 1406846 - RNA, 15 nt, Homo sapiens
gagcagcacuggggu

SEQ ID NO: 1406847 - RNA, 16 nt, Homo sapiens
gagccacucuguuccu

SEQ ID NO: 1406848 - RNA, 14 nt, Homo sapiens
gagccccacacgga

SEQ ID NO: 1406849 - RNA, 14 nt, Homo sapiens
gagcuuucugcuau

SEQ ID NO: 1406850 - RNA, 20 nt, Homo sapiens
gaggagccggugcucuggaa

SEQ ID NO: 1406851 - RNA, 14 nt, Homo sapiens
gaggccccggcugg

SEQ ID NO: 1406852 - RNA, 15 nt, Homo sapiens
gaggccucgacccac

SEQ ID NO: 1406853 - RNA, 14 nt, Homo sapiens
gaggguugugccca

SEQ ID NO: 1406854 - RNA, 20 nt, Homo sapiens
gaggucaaggcugcagugag

SEQ ID NO: 1406855 - RNA, 16 nt, Homo sapiens
gaggugagaccaccuc

SEQ ID NO: 1406856 - RNA, 21 nt, Homo sapiens
gagguguuuaacggcacugug

SEQ ID NO: 1406857 - RNA, 21 nt, Homo sapiens
gaguugauucagcucugcaag

SEQ ID NO: 1406858 - RNA, 21 nt, Homo sapiens
gauaaaucaguuaugucaauu

SEQ ID NO: 1406859 - RNA, 22 nt, Homo sapiens
gauaacauguaucacucacugc

SEQ ID NO: 1406860 - RNA, 13 nt, Homo sapiens
gauacugcugaug

SEQ ID NO: 1406861 - RNA, 19 nt, Homo sapiens
gauauaugacuuuuucuca

SEQ ID NO: 1406862 - RNA, 14 nt, Homo sapiens
gauaugcacacaca

SEQ ID NO: 1406863 - RNA, 23 nt, Homo sapiens
gaucacagccucugaaaaccaau

SEQ ID NO: 1406864 - RNA, 19 nt, Homo sapiens
gaucagccugggcaaugug

SEQ ID NO: 1406865 - RNA, 22 nt, Homo sapiens
gaucauuaaagccugaguuugc

SEQ ID NO: 1406866 - RNA, 12 nt, Homo sapiens
gauccugcacuc

SEQ ID NO: 1406867 - RNA, 14 nt, Homo sapiens
gaugagcacacaca

SEQ ID NO: 1406868 - RNA, 12 nt, Homo sapiens
gaugcacacaca

SEQ ID NO: 1406869 - RNA, 18 nt, Homo sapiens
gaugcacagagauaugca

SEQ ID NO: 1406870 - RNA, 16 nt, Homo sapiens
gaugccagggacccac

SEQ ID NO: 1406871 - RNA, 21 nt, Homo sapiens
gauggaccuccuucgcuggaa

SEQ ID NO: 1406872 - RNA, 14 nt, Homo sapiens
gaugggaacacugg

SEQ ID NO: 1406873 - RNA, 20 nt, Homo sapiens
gauguaccagcaucucccag

SEQ ID NO: 1406874 - RNA, 18 nt, Homo sapiens
gauguugcuuuugcaccu

SEQ ID NO: 1406875 - RNA, 13 nt, Homo sapiens
gauuauccacugc

SEQ ID NO: 1406876 - RNA, 17 nt, Homo sapiens
gauugcgagaauuuuca

SEQ ID NO: 1406877 - RNA, 21 nt, Homo sapiens
gauuuauuaauuaaaccagac

SEQ ID NO: 1406878 - RNA, 19 nt, Homo sapiens
gauuuuuaugccaccugaa

SEQ ID NO: 1406879 - RNA, 21 nt, Homo sapiens
gcaaaaaaauuaaauuauuua

SEQ ID NO: 1406880 - RNA, 16 nt, Homo sapiens
gcaaaaccucauuuaa

SEQ ID NO: 1406881 - RNA, 15 nt, Homo sapiens
gcaacuccuguucuu

SEQ ID NO: 1406882 - RNA, 14 nt, Homo sapiens
gcaagaccaaauca

SEQ ID NO: 1406883 - RNA, 17 nt, Homo sapiens
gcaauacagacuacuuc

SEQ ID NO: 1406884 - RNA, 16 nt, Homo sapiens
gcaaugcccugugcau

SEQ ID NO: 1406885 - RNA, 17 nt, Homo sapiens
gcaaugcuucugccuca

SEQ ID NO: 1406886 - RNA, 18 nt, Homo sapiens
gcaaugcuucugccucag

SEQ ID NO: 1406887 - RNA, 14 nt, Homo sapiens
gcaauugacuguca

SEQ ID NO: 1406888 - RNA, 15 nt, Homo sapiens
gcacaaauuguacau

SEQ ID NO: 1406889 - RNA, 16 nt, Homo sapiens
gcacaaggcugaccaa

SEQ ID NO: 1406890 - RNA, 15 nt, Homo sapiens
gcacacacacagaga

SEQ ID NO: 1406891 - RNA, 22 nt, Homo sapiens
gcacacacacagagauaugcac

SEQ ID NO: 1406892 - RNA, 14 nt, Homo sapiens
gcacacacaccgau

SEQ ID NO: 1406893 - RNA, 19 nt, Homo sapiens
gcacacacaccgaugcuga

SEQ ID NO: 1406894 - RNA, 13 nt, Homo sapiens
gcacacacagaua

SEQ ID NO: 1406895 - RNA, 12 nt, Homo sapiens
gcacacacaugg

SEQ ID NO: 1406896 - RNA, 12 nt, Homo sapiens
gcacacaccgau

SEQ ID NO: 1406897 - RNA, 16 nt, Homo sapiens
gcacacaccgaugugc

SEQ ID NO: 1406898 - RNA, 19 nt, Homo sapiens
gcacaggccauggugcaca

SEQ ID NO: 1406899 - RNA, 17 nt, Homo sapiens
gcacagggucucuacca

SEQ ID NO: 1406900 - RNA, 17 nt, Homo sapiens
gcacauagagauaugca

SEQ ID NO: 1406901 - RNA, 18 nt, Homo sapiens
gcaccagugugacaucua

SEQ ID NO: 1406902 - RNA, 17 nt, Homo sapiens
gcaccccccaagcuguu

SEQ ID NO: 1406903 - RNA, 18 nt, Homo sapiens
gcagagcaaagugcggug

SEQ ID NO: 1406904 - RNA, 23 nt, Homo sapiens
gcagaggcuccgcggcaggagga

SEQ ID NO: 1406905 - RNA, 22 nt, Homo sapiens
gcagcagggagggcuucugcca

SEQ ID NO: 1406906 - RNA, 19 nt, Homo sapiens
gcagccuggggucugacaa

SEQ ID NO: 1406907 - RNA, 23 nt, Homo sapiens
gcagggcuggcaggaugccgugg

SEQ ID NO: 1406908 - RNA, 12 nt, Homo sapiens
gcaggugccaac

SEQ ID NO: 1406909 - RNA, 19 nt, Homo sapiens
gcagguguucuucauuacc

SEQ ID NO: 1406910 - RNA, 16 nt, Homo sapiens
gcagugaacacacuca

SEQ ID NO: 1406911 - RNA, 15 nt, Homo sapiens
gcagugacuuuagaa

SEQ ID NO: 1406912 - RNA, 15 nt, Homo sapiens
gcagugauuguuaug

SEQ ID NO: 1406913 - RNA, 14 nt, Homo sapiens
gcaucccaggggac

SEQ ID NO: 1406914 - RNA, 22 nt, Homo sapiens
gcaucuuccccaacgaaaagca

SEQ ID NO: 1406915 - RNA, 16 nt, Homo sapiens
gcaugaacacacaugg

SEQ ID NO: 1406916 - RNA, 14 nt, Homo sapiens
gcauucuagugcag

SEQ ID NO: 1406917 - RNA, 15 nt, Homo sapiens
gcauucuagugcaga

SEQ ID NO: 1406918 - RNA, 12 nt, Homo sapiens
gccaacccagcc

SEQ ID NO: 1406919 - RNA, 12 nt, Homo sapiens
gccaaugcacac

SEQ ID NO: 1406920 - RNA, 11 nt, Homo sapiens
gccacacuggg

SEQ ID NO: 1406921 - RNA, 13 nt, Homo sapiens
gccacaguggcca

SEQ ID NO: 1406922 - RNA, 14 nt, Homo sapiens
gccagaaaacauau

SEQ ID NO: 1406923 - RNA, 15 nt, Homo sapiens
gccagagcugagugg

SEQ ID NO: 1406924 - RNA, 19 nt, Homo sapiens
gccagcuuaucucaggggu

SEQ ID NO: 1406925 - RNA, 15 nt, Homo sapiens
gccauaccaggguga

SEQ ID NO: 1406926 - RNA, 18 nt, Homo sapiens
gccaucucaagcaaguuu

SEQ ID NO: 1406927 - RNA, 13 nt, Homo sapiens
gcccaaagucauu

SEQ ID NO: 1406928 - RNA, 15 nt, Homo sapiens
gccccaacugugauc

SEQ ID NO: 1406929 - RNA, 23 nt, Homo sapiens
gccccauuugccagauugcccca

SEQ ID NO: 1406930 - RNA, 21 nt, Homo sapiens
gccccugauuuuaucauucug

SEQ ID NO: 1406931 - RNA, 17 nt, Homo sapiens
gccggaggcugcaguga

SEQ ID NO: 1406932 - RNA, 16 nt, Homo sapiens
gccgggcugcacagac

SEQ ID NO: 1406933 - RNA, 23 nt, Homo sapiens
gccuagauccacacacagaggaa

SEQ ID NO: 1406934 - RNA, 16 nt, Homo sapiens
gccuccagcccucuca

SEQ ID NO: 1406935 - RNA, 20 nt, Homo sapiens
gccuccauucugaccauuuc

SEQ ID NO: 1406936 - RNA, 14 nt, Homo sapiens
gccugccucuucuc

SEQ ID NO: 1406937 - RNA, 17 nt, Homo sapiens
gccuggaccagccucuc

SEQ ID NO: 1406938 - RNA, 16 nt, Homo sapiens
gccugggggauguacc

SEQ ID NO: 1406939 - RNA, 23 nt, Homo sapiens
gccuggggucugacaauaccucg

SEQ ID NO: 1406940 - RNA, 19 nt, Homo sapiens
gccuuaaggccacacuggc

SEQ ID NO: 1406941 - RNA, 15 nt, Homo sapiens
gccuuaguuguuauc

SEQ ID NO: 1406942 - RNA, 15 nt, Homo sapiens
gccuugccaugucuu

SEQ ID NO: 1406943 - RNA, 13 nt, Homo sapiens
gccuuguggcacu

SEQ ID NO: 1406944 - RNA, 20 nt, Homo sapiens
gcgagagguggagugucaca

SEQ ID NO: 1406945 - RNA, 23 nt, Homo sapiens
gcguggaacucgugucuggcaca

SEQ ID NO: 1406946 - RNA, 17 nt, Homo sapiens
gcuaaaggacaguggau

SEQ ID NO: 1406947 - RNA, 20 nt, Homo sapiens
gcuaaauuuggguacugggu

SEQ ID NO: 1406948 - RNA, 19 nt, Homo sapiens
gcuaaucuucuuaugcaau

SEQ ID NO: 1406949 - RNA, 19 nt, Homo sapiens
gcuaauugguccaacccag

SEQ ID NO: 1406950 - RNA, 13 nt, Homo sapiens
gcuaggauuacag

SEQ ID NO: 1406951 - RNA, 18 nt, Homo sapiens
gcuaugguucucucgcaa

SEQ ID NO: 1406952 - RNA, 15 nt, Homo sapiens
gcuauuguagagcca

SEQ ID NO: 1406953 - RNA, 13 nt, Homo sapiens
gcucacauuccca

SEQ ID NO: 1406954 - RNA, 13 nt, Homo sapiens
gcucaccaagaag

SEQ ID NO: 1406955 - RNA, 16 nt, Homo sapiens
gcucacgugucuuuag

SEQ ID NO: 1406956 - RNA, 17 nt, Homo sapiens
gcuccacaguguugcca

SEQ ID NO: 1406957 - RNA, 13 nt, Homo sapiens
gcuccaguuccag

SEQ ID NO: 1406958 - RNA, 14 nt, Homo sapiens
gcucccacagaaca

SEQ ID NO: 1406959 - RNA, 20 nt, Homo sapiens
gcucccaccaggcagcucca

SEQ ID NO: 1406960 - RNA, 17 nt, Homo sapiens
gcucccagggccaugaa

SEQ ID NO: 1406961 - RNA, 21 nt, Homo sapiens
gcuccccacgucagcugggac

SEQ ID NO: 1406962 - RNA, 15 nt, Homo sapiens
gcucuccaucuucca

SEQ ID NO: 1406963 - RNA, 17 nt, Homo sapiens
gcucugaggaguggagu

SEQ ID NO: 1406964 - RNA, 20 nt, Homo sapiens
gcucuggauccugcacucua

SEQ ID NO: 1406965 - RNA, 22 nt, Homo sapiens
gcucuggcaccacuaggguccu

SEQ ID NO: 1406966 - RNA, 19 nt, Homo sapiens
gcugcagacaaguggacag

SEQ ID NO: 1406967 - RNA, 16 nt, Homo sapiens
gcugcagucccuggaa

SEQ ID NO: 1406968 - RNA, 21 nt, Homo sapiens
gcugccaaguaaauagcaaca

SEQ ID NO: 1406969 - RNA, 12 nt, Homo sapiens
gcugcucauggg

SEQ ID NO: 1406970 - RNA, 10 nt, Homo sapiens
gcugcugaga

SEQ ID NO: 1406971 - RNA, 20 nt, Homo sapiens
gcuggagugcaguggugcga

SEQ ID NO: 1406972 - RNA, 14 nt, Homo sapiens
gcuggcaccugauu

SEQ ID NO: 1406973 - RNA, 13 nt, Homo sapiens
gcugggauuacag

SEQ ID NO: 1406974 - RNA, 17 nt, Homo sapiens
gcugguugagguuucaa

SEQ ID NO: 1406975 - RNA, 15 nt, Homo sapiens
gcuguuuucuucuau

SEQ ID NO: 1406976 - RNA, 20 nt, Homo sapiens
gcuucugccucagcuuccca

SEQ ID NO: 1406977 - RNA, 11 nt, Homo sapiens
gcuugccauau

SEQ ID NO: 1406978 - RNA, 15 nt, Homo sapiens
gcuuugaaaauucag

SEQ ID NO: 1406979 - RNA, 12 nt, Homo sapiens
gcuuuguggcac

SEQ ID NO: 1406980 - RNA, 15 nt, Homo sapiens
gcuuuguggcacugg

SEQ ID NO: 1406981 - RNA, 18 nt, Homo sapiens
ggaaaaugaauaauacau

SEQ ID NO: 1406982 - RNA, 21 nt, Homo sapiens
uacucacccagggacuccagu

SEQ ID NO: 1406983 - RNA, 20 nt, Homo sapiens
uacugcacauuuuguacaaa

SEQ ID NO: 1406984 - RNA, 14 nt, Homo sapiens
uacuuaaacuucca

SEQ ID NO: 1406985 - RNA, 15 nt, Homo sapiens
uacuuugccauuaag

SEQ ID NO: 1406986 - RNA, 20 nt, Homo sapiens
uacuuuucagaauugaagga

SEQ ID NO: 1406987 - RNA, 13 nt, Homo sapiens
uagaaaaaccacc

SEQ ID NO: 1406988 - RNA, 22 nt, Homo sapiens
uagaaacugaggccauuauuuc

SEQ ID NO: 1406989 - RNA, 16 nt, Homo sapiens
uagaacuccaguacuc

SEQ ID NO: 1406990 - RNA, 13 nt, Homo sapiens
uagaauugccuua

SEQ ID NO: 1406991 - RNA, 14 nt, Homo sapiens
uagagauaugcaca

SEQ ID NO: 1406992 - RNA, 17 nt, Homo sapiens
uagagauaugcacacac

SEQ ID NO: 1406993 - RNA, 14 nt, Homo sapiens
uagagaugcaguuu

SEQ ID NO: 1406994 - RNA, 22 nt, Homo sapiens
uagaggcaugaacacacaugga

SEQ ID NO: 1406995 - RNA, 15 nt, Homo sapiens
uagaguauaccuccu

SEQ ID NO: 1406996 - RNA, 12 nt, Homo sapiens
uagcaacaugcu

SEQ ID NO: 1406997 - RNA, 16 nt, Homo sapiens
uagcaauugacuguca

SEQ ID NO: 1406998 - RNA, 17 nt, Homo sapiens
uagccauaccaggguga

SEQ ID NO: 1406999 - RNA, 15 nt, Homo sapiens
uagccaucucaagca

SEQ ID NO: 1407000 - RNA, 18 nt, Homo sapiens
uagccaucucaagcaagu

SEQ ID NO: 1407001 - RNA, 14 nt, Homo sapiens
uagcccaaaaccaa

SEQ ID NO: 1407002 - RNA, 22 nt, Homo sapiens
uagccugccucuucucuacucu

SEQ ID NO: 1407003 - RNA, 13 nt, Homo sapiens
uagccuugcugua

SEQ ID NO: 1407004 - RNA, 15 nt, Homo sapiens
uagcugucugcucag

SEQ ID NO: 1407005 - RNA, 19 nt, Homo sapiens
uagcuuuuaccaacccaaa

SEQ ID NO: 1407006 - RNA, 14 nt, Homo sapiens
uaggaaaaccauga

SEQ ID NO: 1407007 - RNA, 13 nt, Homo sapiens
uaggaauacucuu

SEQ ID NO: 1407008 - RNA, 15 nt, Homo sapiens
uaggcauuugcugaa

SEQ ID NO: 1407009 - RNA, 17 nt, Homo sapiens
uaggguccuggcccucu

SEQ ID NO: 1407010 - RNA, 13 nt, Homo sapiens
uaguucugccagg

SEQ ID NO: 1407011 - RNA, 15 nt, Homo sapiens
uauaauguugccagc

SEQ ID NO: 1407012 - RNA, 17 nt, Homo sapiens
uauaccugggcauacua

SEQ ID NO: 1407013 - RNA, 20 nt, Homo sapiens
uauaccugggcauacuaaua

SEQ ID NO: 1407014 - RNA, 14 nt, Homo sapiens
uauagguuuccacu

SEQ ID NO: 1407015 - RNA, 20 nt, Homo sapiens
uaucaaaauucuguuuugua

SEQ ID NO: 1407016 - RNA, 15 nt, Homo sapiens
uaucaggguauucca

SEQ ID NO: 1407017 - RNA, 13 nt, Homo sapiens
uaucauucugcuu

SEQ ID NO: 1407018 - RNA, 16 nt, Homo sapiens
uauccaagaccugaaa

SEQ ID NO: 1407019 - RNA, 13 nt, Homo sapiens
uaugaacuugagg

SEQ ID NO: 1407020 - RNA, 16 nt, Homo sapiens
uaugacaucacuugua

SEQ ID NO: 1407021 - RNA, 15 nt, Homo sapiens
uaugacaucagcaau

SEQ ID NO: 1407022 - RNA, 23 nt, Homo sapiens
uaugagucucuaugaucuuggca

SEQ ID NO: 1407023 - RNA, 15 nt, Homo sapiens
uaugaugggggaaaa

SEQ ID NO: 1407024 - RNA, 11 nt, Homo sapiens
uaugcacacac

SEQ ID NO: 1407025 - RNA, 17 nt, Homo sapiens
uaugcacacacauggau

SEQ ID NO: 1407026 - RNA, 19 nt, Homo sapiens
uaugcacacacauggauga

SEQ ID NO: 1407027 - RNA, 12 nt, Homo sapiens
uaugccacucag

SEQ ID NO: 1407028 - RNA, 20 nt, Homo sapiens
uauggacuccuguuguugaa

SEQ ID NO: 1407029 - RNA, 19 nt, Homo sapiens
uauggcucuggcaccacua

SEQ ID NO: 1407030 - RNA, 17 nt, Homo sapiens
uaugguucucucgcaag

SEQ ID NO: 1407031 - RNA, 16 nt, Homo sapiens
uaugugggggucugug

SEQ ID NO: 1407032 - RNA, 20 nt, Homo sapiens
uauuagcaacugugcuacac

SEQ ID NO: 1407033 - RNA, 15 nt, Homo sapiens
uauucccaugcauuu

SEQ ID NO: 1407034 - RNA, 13 nt, Homo sapiens
uauuuaccagacc

SEQ ID NO: 1407035 - RNA, 16 nt, Homo sapiens
uauuuauguguucaca

SEQ ID NO: 1407036 - RNA, 21 nt, Homo sapiens
uauuucaaccgcuugccauau

SEQ ID NO: 1407037 - RNA, 17 nt, Homo sapiens
uauuuguauaauggugu

SEQ ID NO: 1407038 - RNA, 18 nt, Homo sapiens
ucaaaccuccaaaagccc

SEQ ID NO: 1407039 - RNA, 21 nt, Homo sapiens
ucaaacugcaugauucaugcc

SEQ ID NO: 1407040 - RNA, 19 nt, Homo sapiens
ucaaagaaaacuuccaaaa

SEQ ID NO: 1407041 - RNA, 22 nt, Homo sapiens
ucaaagcggaugcuggccacag

SEQ ID NO: 1407042 - RNA, 22 nt, Homo sapiens
ucaaaggagagucaacauaugu

SEQ ID NO: 1407043 - RNA, 16 nt, Homo sapiens
ucaacaccucugcaca

SEQ ID NO: 1407044 - RNA, 22 nt, Homo sapiens
ucaagcagacgugagugugacu

SEQ ID NO: 1407045 - RNA, 16 nt, Homo sapiens
ucaagucuucccugau

SEQ ID NO: 1407046 - RNA, 17 nt, Homo sapiens
ucaauuuccugaugcau

SEQ ID NO: 1407047 - RNA, 19 nt, Homo sapiens
ucacaccauucuccugccu

SEQ ID NO: 1407048 - RNA, 13 nt, Homo sapiens
ucaccacaccacu

SEQ ID NO: 1407049 - RNA, 23 nt, Homo sapiens
ucaccacugaaacccugcacuua

SEQ ID NO: 1407050 - RNA, 14 nt, Homo sapiens
ucacccuaccugug

SEQ ID NO: 1407051 - RNA, 17 nt, Homo sapiens
ucacugacucaagacac

SEQ ID NO: 1407052 - RNA, 16 nt, Homo sapiens
ucacugcuguagacau

SEQ ID NO: 1407053 - RNA, 23 nt, Homo sapiens
ucacuguagaaugauuucaugcu

SEQ ID NO: 1407054 - RNA, 12 nt, Homo sapiens
ucagcagucagu

SEQ ID NO: 1407055 - RNA, 15 nt, Homo sapiens
ucagcugaaccuggg

SEQ ID NO: 1407056 - RNA, 16 nt, Homo sapiens
ucaggauuucaccaga

SEQ ID NO: 1407057 - RNA, 15 nt, Homo sapiens
ucaggcaacgcacaa

SEQ ID NO: 1407058 - RNA, 18 nt, Homo sapiens
ucaggguguuaaggcagu

SEQ ID NO: 1407059 - RNA, 11 nt, Homo sapiens
ucaguaugugg

SEQ ID NO: 1407060 - RNA, 20 nt, Homo sapiens
ucaguccacuucugcucugg

SEQ ID NO: 1407061 - RNA, 18 nt, Homo sapiens
ucagucuuuaaucugaga

SEQ ID NO: 1407062 - RNA, 22 nt, Homo sapiens
ucagugaugaaaauuugccuuu

SEQ ID NO: 1407063 - RNA, 23 nt, Homo sapiens
ucagugaugaaaauuugccuuug

SEQ ID NO: 1407064 - RNA, 15 nt, Homo sapiens
ucaucuuucuuccaa

SEQ ID NO: 1407065 - RNA, 22 nt, Homo sapiens
ucaugaacacagccugggacca

SEQ ID NO: 1407066 - RNA, 19 nt, Homo sapiens
ucaugcauucuagugcaga

SEQ ID NO: 1407067 - RNA, 21 nt, Homo sapiens
ucaugucuuuuuacccuuuaa

SEQ ID NO: 1407068 - RNA, 17 nt, Homo sapiens
ucaugugacucuuucca

SEQ ID NO: 1407069 - RNA, 18 nt, Homo sapiens
ucaugugacucuuuccaa

SEQ ID NO: 1407070 - RNA, 15 nt, Homo sapiens
ucauuuguucauuaa

SEQ ID NO: 1407071 - RNA, 19 nt, Homo sapiens
ucauuuuguuauagaaacu

SEQ ID NO: 1407072 - RNA, 13 nt, Homo sapiens
uccaaacacuggg

SEQ ID NO: 1407073 - RNA, 15 nt, Homo sapiens
uccaaagaaauggaa

SEQ ID NO: 1407074 - RNA, 16 nt, Homo sapiens
uccaaaugcccagcuu

SEQ ID NO: 1407075 - RNA, 17 nt, Homo sapiens
uccaacauuaaaagcca

SEQ ID NO: 1407076 - RNA, 17 nt, Homo sapiens
uccacacccucacugcu

SEQ ID NO: 1407077 - RNA, 17 nt, Homo sapiens
uccacaguguugccaga

SEQ ID NO: 1407078 - RNA, 21 nt, Homo sapiens
cacagcaagucacuggccagu

SEQ ID NO: 1407079 - RNA, 16 nt, Homo sapiens
cacaggucuugcccaa

SEQ ID NO: 1407080 - RNA, 21 nt, Homo sapiens
cacaguguugccagagccuua

SEQ ID NO: 1407081 - RNA, 24 nt, Homo sapiens
cacaguguuuccugaguagcagug

SEQ ID NO: 1407082 - RNA, 17 nt, Homo sapiens
cacauagagauaugcac

SEQ ID NO: 1407083 - RNA, 17 nt, Homo sapiens
cacaucucugccuggaa

SEQ ID NO: 1407084 - RNA, 16 nt, Homo sapiens
cacauggaugcacaca

SEQ ID NO: 1407085 - RNA, 15 nt, Homo sapiens
cacauuucuaugcca

SEQ ID NO: 1407086 - RNA, 17 nt, Homo sapiens
cacauuucuaugccaaa

SEQ ID NO: 1407087 - RNA, 19 nt, Homo sapiens
caccacaccacugccccaa

SEQ ID NO: 1407088 - RNA, 18 nt, Homo sapiens
caccaggacucagaggau

SEQ ID NO: 1407089 - RNA, 18 nt, Homo sapiens
caccaucucuuuaccucc

SEQ ID NO: 1407090 - RNA, 13 nt, Homo sapiens
caccucugcacaa

SEQ ID NO: 1407091 - RNA, 18 nt, Homo sapiens
caccugcacgugaucugc

SEQ ID NO: 1407092 - RNA, 15 nt, Homo sapiens
cacgccaaugcacac

SEQ ID NO: 1407093 - RNA, 15 nt, Homo sapiens
cacggaugcacagag

SEQ ID NO: 1407094 - RNA, 16 nt, Homo sapiens
cacuauucuugaauua

SEQ ID NO: 1407095 - RNA, 23 nt, Homo sapiens
cacucaaggaaaagaugugcucc

SEQ ID NO: 1407096 - RNA, 13 nt, Homo sapiens
cacucacugccaa

SEQ ID NO: 1407097 - RNA, 14 nt, Homo sapiens
cacucgacucugcu

SEQ ID NO: 1407098 - RNA, 19 nt, Homo sapiens
cacugagacuagauucuca

SEQ ID NO: 1407099 - RNA, 16 nt, Homo sapiens
cacugcaaaguuuucu

SEQ ID NO: 1407100 - RNA, 23 nt, Homo sapiens
cacugggcucugaggaguggagu

SEQ ID NO: 1407101 - RNA, 23 nt, Homo sapiens
cacugugaagagaaccauaucaa

SEQ ID NO: 1407102 - RNA, 15 nt, Homo sapiens
cacuucauagaugag

SEQ ID NO: 1407103 - RNA, 15 nt, Homo sapiens
cacuugcaugaauua

SEQ ID NO: 1407104 - RNA, 21 nt, Homo sapiens
cacuuuccccgugggccaugg

SEQ ID NO: 1407105 - RNA, 21 nt, Homo sapiens
cagaacacagcaauuccucag

SEQ ID NO: 1407106 - RNA, 18 nt, Homo sapiens
cagaaccccuacaugaaa

SEQ ID NO: 1407107 - RNA, 13 nt, Homo sapiens
cagagacagagag

SEQ ID NO: 1407108 - RNA, 12 nt, Homo sapiens
aacacagccugg

SEQ ID NO: 1407109 - RNA, 14 nt, Homo sapiens
aacacaguguuucc

SEQ ID NO: 1407110 - RNA, 13 nt, Homo sapiens
aacaccucugcac

SEQ ID NO: 1407111 - RNA, 21 nt, Homo sapiens
aacacuggugggcagcugagg

SEQ ID NO: 1407112 - RNA, 13 nt, Homo sapiens
aacacugugcaaa

SEQ ID NO: 1407113 - RNA, 16 nt, Homo sapiens
aacagagagagacaga

SEQ ID NO: 1407114 - RNA, 18 nt, Homo sapiens
aacagcuaggaaauauca

SEQ ID NO: 1407115 - RNA, 15 nt, Homo sapiens
aacaggcucugagau

SEQ ID NO: 1407116 - RNA, 15 nt, Homo sapiens
aacaguccauugaaa

SEQ ID NO: 1407117 - RNA, 20 nt, Homo sapiens
aacauaugcauuaugaaguu

SEQ ID NO: 1407118 - RNA, 23 nt, Homo sapiens
aacaucaacuggggaauugaagc

SEQ ID NO: 1407119 - RNA, 17 nt, Homo sapiens
aacaugaaaugcuucca

SEQ ID NO: 1407120 - RNA, 19 nt, Homo sapiens
aacauggccuuugcuugaa

SEQ ID NO: 1407121 - RNA, 15 nt, Homo sapiens
aaccaucccugaugu

SEQ ID NO: 1407122 - RNA, 16 nt, Homo sapiens
aacccagccugagugc

SEQ ID NO: 1407123 - RNA, 20 nt, Homo sapiens
aacccggcuaugggacugca

SEQ ID NO: 1407124 - RNA, 20 nt, Homo sapiens
aacccuucagauuugccuua

SEQ ID NO: 1407125 - RNA, 18 nt, Homo sapiens
aaccgacuuuucuaaagc

SEQ ID NO: 1407126 - RNA, 20 nt, Homo sapiens
aaccgcuugccauauuccga

SEQ ID NO: 1407127 - RNA, 21 nt, Homo sapiens
aaccggcuuuguggcacuggg

SEQ ID NO: 1407128 - RNA, 20 nt, Homo sapiens
aaccuacuuucauacugaag

SEQ ID NO: 1407129 - RNA, 22 nt, Homo sapiens
aaccugggagccggaggcugca

SEQ ID NO: 1407130 - RNA, 18 nt, Homo sapiens
aaccuguccauaaaguaa

SEQ ID NO: 1407131 - RNA, 12 nt, Homo sapiens
aacgcacaaaac

SEQ ID NO: 1407132 - RNA, 21 nt, Homo sapiens
aacuaaauaaaguguugaaca

SEQ ID NO: 1407133 - RNA, 19 nt, Homo sapiens
aacuagcuaaaaccaaagg

SEQ ID NO: 1407134 - RNA, 16 nt, Homo sapiens
aacucaaacucuuaaa

SEQ ID NO: 1407135 - RNA, 20 nt, Homo sapiens
aacucaaacucuuaaaaccc

SEQ ID NO: 1407136 - RNA, 15 nt, Homo sapiens
aacucucaagcagac

SEQ ID NO: 1407137 - RNA, 14 nt, Homo sapiens
aacucuuaaaaccc

SEQ ID NO: 1407138 - RNA, 19 nt, Homo sapiens
aacugaggccauuauuuca

SEQ ID NO: 1407139 - RNA, 18 nt, Homo sapiens
aacuguuacuguccuguu

SEQ ID NO: 1407140 - RNA, 22 nt, Homo sapiens
aacuuagaggaaaagggcacag

SEQ ID NO: 1407141 - RNA, 16 nt, Homo sapiens
aacuucuggugugaua

SEQ ID NO: 1407142 - RNA, 19 nt, Homo sapiens
aacuucuggugugauacuu

SEQ ID NO: 1407143 - RNA, 12 nt, Homo sapiens
aacuucuuguug

SEQ ID NO: 1407144 - RNA, 19 nt, Homo sapiens
aacuugaggacacaugucc

SEQ ID NO: 1407145 - RNA, 20 nt, Homo sapiens
aacuugaggacacaugucca

SEQ ID NO: 1407146 - RNA, 12 nt, Homo sapiens
aacuugggccac

SEQ ID NO: 1407147 - RNA, 21 nt, Homo sapiens
aagaaggaauucuaggcaucc

SEQ ID NO: 1407148 - RNA, 18 nt, Homo sapiens
aagaagggccaauucccu

SEQ ID NO: 1407149 - RNA, 14 nt, Homo sapiens
aagacuccgucuca

SEQ ID NO: 1407150 - RNA, 13 nt, Homo sapiens
aagagacugagcc

SEQ ID NO: 1407151 - RNA, 13 nt, Homo sapiens
aagagagaucaaa

SEQ ID NO: 1407152 - RNA, 13 nt, Homo sapiens
aagaggagcugcu

SEQ ID NO: 1407153 - RNA, 20 nt, Homo sapiens
aagauaaucuuagcugccaa

SEQ ID NO: 1407154 - RNA, 14 nt, Homo sapiens
aagaucgcaccauu

SEQ ID NO: 1407155 - RNA, 20 nt, Homo sapiens
aagaucgcaccauugcacuc

SEQ ID NO: 1407156 - RNA, 13 nt, Homo sapiens
aagaucugcuucc

SEQ ID NO: 1407157 - RNA, 16 nt, Homo sapiens
aagaugugcucccacc

SEQ ID NO: 1407158 - RNA, 23 nt, Homo sapiens
aagauuuauuaauuaaaccagac

SEQ ID NO: 1407159 - RNA, 17 nt, Homo sapiens
aagcaagcccuggccag

SEQ ID NO: 1407160 - RNA, 23 nt, Homo sapiens
aagcaaugcuucugccucagcuu

SEQ ID NO: 1407161 - RNA, 18 nt, Homo sapiens
aagcaccccagucacuag

SEQ ID NO: 1407162 - RNA, 20 nt, Homo sapiens
aagcaggaguaaguuucuca

SEQ ID NO: 1407163 - RNA, 20 nt, Homo sapiens
aagcauaaaaauuagccaag

SEQ ID NO: 1407164 - RNA, 14 nt, Homo sapiens
aagcucgagugaau

SEQ ID NO: 1407165 - RNA, 17 nt, Homo sapiens
aaggaagacaaugugaa

SEQ ID NO: 1407166 - RNA, 19 nt, Homo sapiens
aaggaucccaugagcuccu

SEQ ID NO: 1407167 - RNA, 20 nt, Homo sapiens
aaggcagugaacacacucag

SEQ ID NO: 1407168 - RNA, 17 nt, Homo sapiens
aagggaauacugugcau

SEQ ID NO: 1407169 - RNA, 22 nt, Homo sapiens
aaggucuuugacggcaccaucu

SEQ ID NO: 1407170 - RNA, 19 nt, Homo sapiens
aagguggaacaagcacaga

SEQ ID NO: 1407171 - RNA, 19 nt, Homo sapiens
aaguauauaauccugugaa

SEQ ID NO: 1407172 - RNA, 14 nt, Homo sapiens
aaguaugccuuccu

SEQ ID NO: 1407173 - RNA, 12 nt, Homo sapiens
aagucacauaua

SEQ ID NO: 1407174 - RNA, 18 nt, Homo sapiens
aagucaccggagcuuuca

SEQ ID NO: 1407175 - RNA, 20 nt, Homo sapiens
aagucacuggccaguggcug

SEQ ID NO: 1407176 - RNA, 20 nt, Homo sapiens
aagucaucauaauucagcuc

SEQ ID NO: 1407177 - RNA, 21 nt, Homo sapiens
aagucaucuguuuaauuuaca

SEQ ID NO: 1407178 - RNA, 18 nt, Homo sapiens
aagucuaguuaccuacuu

SEQ ID NO: 1407179 - RNA, 20 nt, Homo sapiens
aagucugucugucugaugau

SEQ ID NO: 1407180 - RNA, 19 nt, Homo sapiens
aagugagacccugucucaa

SEQ ID NO: 1407181 - RNA, 23 nt, Homo sapiens
aagugcugggauuacagguguga

SEQ ID NO: 1407182 - RNA, 13 nt, Homo sapiens
aaguuugagauca

SEQ ID NO: 1407183 - RNA, 21 nt, Homo sapiens
aauaaagcugcugagaaucua

SEQ ID NO: 1407184 - RNA, 18 nt, Homo sapiens
aauaaauuggaacaccuc

SEQ ID NO: 1407185 - RNA, 13 nt, Homo sapiens
aauaaauuguaaa

SEQ ID NO: 1407186 - RNA, 13 nt, Homo sapiens
aauaacagugugu

SEQ ID NO: 1407187 - RNA, 15 nt, Homo sapiens
aauaauugauuucaa

SEQ ID NO: 1407188 - RNA, 20 nt, Homo sapiens
aauacacaauccuccaagaa

SEQ ID NO: 1407189 - RNA, 17 nt, Homo sapiens
aauagagacacagagau

SEQ ID NO: 1407190 - RNA, 15 nt, Homo sapiens
aauaguggauaacau

SEQ ID NO: 1407191 - RNA, 22 nt, Homo sapiens
aauauuagguugucacgaugaa

SEQ ID NO: 1407192 - RNA, 19 nt, Homo sapiens
aauauugauguuaacaaga

SEQ ID NO: 1407193 - RNA, 13 nt, Homo sapiens
aaucagcauuuag

SEQ ID NO: 1407194 - RNA, 20 nt, Homo sapiens
aaucaggcuuugucugcucc

SEQ ID NO: 1407195 - RNA, 15 nt, Homo sapiens
aaucuaugccacuca

SEQ ID NO: 1407196 - RNA, 23 nt, Homo sapiens
aaucugagaggccacagugcaau

SEQ ID NO: 1407197 - RNA, 16 nt, Homo sapiens
aaucuucuuaugcaau

SEQ ID NO: 1407198 - RNA, 15 nt, Homo sapiens
aaugcacacacacag

SEQ ID NO: 1407199 - RNA, 19 nt, Homo sapiens
aaugcacacacacagagau

SEQ ID NO: 1407200 - RNA, 18 nt, Homo sapiens
aaugcacgcacacaucag

SEQ ID NO: 1407201 - RNA, 15 nt, Homo sapiens
aaugcuucugccuca

SEQ ID NO: 1407202 - RNA, 17 nt, Homo sapiens
aaugcuucugccucagc

SEQ ID NO: 1407203 - RNA, 22 nt, Homo sapiens
aauggcaugcugaaacucgaag

SEQ ID NO: 1407204 - RNA, 15 nt, Homo sapiens
aaugggaaaaccaga

SEQ ID NO: 1407205 - RNA, 16 nt, Homo sapiens
aauguaucauagaaau

SEQ ID NO: 1407206 - RNA, 17 nt, Homo sapiens
aaugucaguauguggaa

SEQ ID NO: 1407207 - RNA, 15 nt, Homo sapiens
aaugugaaugggaaa

SEQ ID NO: 1407208 - RNA, 12 nt, Homo sapiens
aauuacuucuuc

SEQ ID NO: 1407209 - RNA, 12 nt, Homo sapiens
aauuagcaauug

SEQ ID NO: 1407210 - RNA, 17 nt, Homo sapiens
aauucuaggcaucccag

SEQ ID NO: 1407211 - RNA, 14 nt, Homo sapiens
aauugauguugcug

SEQ ID NO: 1407212 - RNA, 12 nt, Homo sapiens
aauugauuucaa

SEQ ID NO: 1407213 - RNA, 16 nt, Homo sapiens
aauugcuccugcaugc

SEQ ID NO: 1407214 - RNA, 11 nt, Homo sapiens
aauuguugcua

SEQ ID NO: 1407215 - RNA, 13 nt, Homo sapiens
aauuuccugaugc

SEQ ID NO: 1407216 - RNA, 22 nt, Homo sapiens
aauuuccugaugcauauugccc

SEQ ID NO: 1407217 - RNA, 16 nt, Homo sapiens
uaugcacacacagaug

SEQ ID NO: 1407218 - RNA, 15 nt, Homo sapiens
uaugguucucaggcc

SEQ ID NO: 1407219 - RNA, 23 nt, Homo sapiens
uauguggaagugugggucugugu

SEQ ID NO: 1407220 - RNA, 17 nt, Homo sapiens
uaugugggggucugugu

SEQ ID NO: 1407221 - RNA, 18 nt, Homo sapiens
uauguuauuggaauuuuc

SEQ ID NO: 1407222 - RNA, 13 nt, Homo sapiens
uauuaaccugaau

SEQ ID NO: 1407223 - RNA, 17 nt, Homo sapiens
uauuagcaacugugcua

SEQ ID NO: 1407224 - RNA, 13 nt, Homo sapiens
uauucagcccacu

SEQ ID NO: 1407225 - RNA, 22 nt, Homo sapiens
uauuccauggcuaacuggcgag

SEQ ID NO: 1407226 - RNA, 12 nt, Homo sapiens
uauucccaugag

SEQ ID NO: 1407227 - RNA, 20 nt, Homo sapiens
uauuguuacuauuauuugcu

SEQ ID NO: 1407228 - RNA, 13 nt, Homo sapiens
uauuuauaaacua

SEQ ID NO: 1407229 - RNA, 13 nt, Homo sapiens
uauuuaugaaggc

SEQ ID NO: 1407230 - RNA, 22 nt, Homo sapiens
ucaaaccccuacugaccuggcu

SEQ ID NO: 1407231 - RNA, 17 nt, Homo sapiens
ucaaacugcaugauuca

SEQ ID NO: 1407232 - RNA, 21 nt, Homo sapiens
ucaaagcuuuuuccagaggcu

SEQ ID NO: 1407233 - RNA, 20 nt, Homo sapiens
ucaaagggagagagugcuau

SEQ ID NO: 1407234 - RNA, 15 nt, Homo sapiens
ucaaccgcuugccau

SEQ ID NO: 1407235 - RNA, 16 nt, Homo sapiens
ucaaccgcuugccaua

SEQ ID NO: 1407236 - RNA, 23 nt, Homo sapiens
ucaacuggggaauugaagccaau

SEQ ID NO: 1407237 - RNA, 13 nt, Homo sapiens
ucaagacacugag

SEQ ID NO: 1407238 - RNA, 15 nt, Homo sapiens
ucaaggcugcaguga

SEQ ID NO: 1407239 - RNA, 16 nt, Homo sapiens
ucaaggcugcagugag

SEQ ID NO: 1407240 - RNA, 17 nt, Homo sapiens
ucaaggggacuggugau

SEQ ID NO: 1407241 - RNA, 23 nt, Homo sapiens
ucaagucuucccugaucaaguca

SEQ ID NO: 1407242 - RNA, 23 nt, Homo sapiens
ucaaguggaaacaugcugaaauc

SEQ ID NO: 1407243 - RNA, 15 nt, Homo sapiens
ucaaugaucaucuca

SEQ ID NO: 1407244 - RNA, 16 nt, Homo sapiens
ucaaugaucaucucac

SEQ ID NO: 1407245 - RNA, 12 nt, Homo sapiens
ucacacagagau

SEQ ID NO: 1407246 - RNA, 20 nt, Homo sapiens
ucacagggccccagaaggca

SEQ ID NO: 1407247 - RNA, 15 nt, Homo sapiens
ucacaggucuugccc

SEQ ID NO: 1407248 - RNA, 21 nt, Homo sapiens
ucaccagaauauuucuuucau

SEQ ID NO: 1407249 - RNA, 14 nt, Homo sapiens
ucaccggagcuuuc

SEQ ID NO: 1407250 - RNA, 22 nt, Homo sapiens
ucaccggagcuuucaaagaagg

SEQ ID NO: 1407251 - RNA, 17 nt, Homo sapiens
ucaccuaacagaauauu

SEQ ID NO: 1407252 - RNA, 17 nt, Homo sapiens
ucacgcuuauugcccag

SEQ ID NO: 1407253 - RNA, 18 nt, Homo sapiens
ucacuuauccuguucucu

SEQ ID NO: 1407254 - RNA, 14 nt, Homo sapiens
ucacuucgaugacu

SEQ ID NO: 1407255 - RNA, 19 nt, Homo sapiens
ucacuucgaugacuggaua

SEQ ID NO: 1407256 - RNA, 13 nt, Homo sapiens
ucacuuguacaaa

SEQ ID NO: 1407257 - RNA, 16 nt, Homo sapiens
ucagacuuacuuacuc

SEQ ID NO: 1407258 - RNA, 14 nt, Homo sapiens
ucagaucauuauca

SEQ ID NO: 1407259 - RNA, 19 nt, Homo sapiens
ucagcaaaagaugcuucuc

SEQ ID NO: 1407260 - RNA, 15 nt, Homo sapiens
ucagccuccugagua

SEQ ID NO: 1407261 - RNA, 12 nt, Homo sapiens
ucaguaugugga

SEQ ID NO: 1407262 - RNA, 15 nt, Homo sapiens
ucauaaucacaaccc

SEQ ID NO: 1407263 - RNA, 12 nt, Homo sapiens
ucauacauuaua

SEQ ID NO: 1407264 - RNA, 22 nt, Homo sapiens
ucauagaugagaaaacugagag

SEQ ID NO: 1407265 - RNA, 20 nt, Homo sapiens
ucaucacauuucuaugccaa

SEQ ID NO: 1407266 - RNA, 19 nt, Homo sapiens
ucauguguaauaugcacaa

SEQ ID NO: 1407267 - RNA, 19 nt, Homo sapiens
ucauguuuacagaggacag

SEQ ID NO: 1407268 - RNA, 14 nt, Homo sapiens
ucauucaguacuua

SEQ ID NO: 1407269 - RNA, 18 nt, Homo sapiens
ucauuucuuccucugcau

SEQ ID NO: 1407270 - RNA, 22 nt, Homo sapiens
uccaaaguuauccccuccuuua

SEQ ID NO: 1407271 - RNA, 21 nt, Homo sapiens
uccaaaguugccacagaugau

SEQ ID NO: 1407272 - RNA, 13 nt, Homo sapiens
uccaaaucaggcu

SEQ ID NO: 1407273 - RNA, 18 nt, Homo sapiens
uccacaaaugcuauucag

SEQ ID NO: 1407274 - RNA, 22 nt, Homo sapiens
uccacaguaacacgcugaaggg

SEQ ID NO: 1407275 - RNA, 18 nt, Homo sapiens
uccagagucccugccugg

SEQ ID NO: 1407276 - RNA, 17 nt, Homo sapiens
uccagcuccccccaaga

SEQ ID NO: 1407277 - RNA, 19 nt, Homo sapiens
uccagcuguuaccugagau

SEQ ID NO: 1407278 - RNA, 15 nt, Homo sapiens
uccaguucaugagaa

SEQ ID NO: 1407279 - RNA, 10 nt, Homo sapiens
ucccaaagaa

SEQ ID NO: 1407280 - RNA, 18 nt, Homo sapiens
ucccaaguagcugagauu

SEQ ID NO: 1407281 - RNA, 16 nt, Homo sapiens
ucccacuccuucagga

SEQ ID NO: 1407282 - RNA, 21 nt, Homo sapiens
ucccagagagacgcugugauu

SEQ ID NO: 1407283 - RNA, 17 nt, Homo sapiens
ucccaguccuccagacc

SEQ ID NO: 1407284 - RNA, 22 nt, Homo sapiens
ucccaugggcgaccagggccau

SEQ ID NO: 1407285 - RNA, 20 nt, Homo sapiens
ucccuaaugagaagucaaca

SEQ ID NO: 1407286 - RNA, 11 nt, Homo sapiens
ucccucaggcc

SEQ ID NO: 1407287 - RNA, 19 nt, Homo sapiens
ucccucaggccgaaggagg

SEQ ID NO: 1407288 - RNA, 18 nt, Homo sapiens
ucccugaagagaagggca

SEQ ID NO: 1407289 - RNA, 22 nt, Homo sapiens
ucccugcccaccuccuggagaa

SEQ ID NO: 1407290 - RNA, 14 nt, Homo sapiens
uccgcgcaggugcc

SEQ ID NO: 1407291 - RNA, 13 nt, Homo sapiens
uccuagcacuuug

SEQ ID NO: 1407292 - RNA, 15 nt, Homo sapiens
uccuaguucuuauga

SEQ ID NO: 1407293 - RNA, 23 nt, Homo sapiens
uccuccaagaauuugacuuggaa

SEQ ID NO: 1407294 - RNA, 20 nt, Homo sapiens
uccucugcccgggagcucag

SEQ ID NO: 1407295 - RNA, 11 nt, Homo sapiens
uccucuucuau

SEQ ID NO: 1407296 - RNA, 15 nt, Homo sapiens
uccugagcucgugau

SEQ ID NO: 1407297 - RNA, 19 nt, Homo sapiens
uccugcccuuccugaagaa

SEQ ID NO: 1407298 - RNA, 15 nt, Homo sapiens
uccugucccuaccca

SEQ ID NO: 1407299 - RNA, 20 nt, Homo sapiens
uccuuaccgugggcacugaa

SEQ ID NO: 1407300 - RNA, 22 nt, Homo sapiens
uccuugucguaggaaaaccaug

SEQ ID NO: 1407301 - RNA, 17 nt, Homo sapiens
uccuugucuauccuucc

SEQ ID NO: 1407302 - RNA, 18 nt, Homo sapiens
uccuuuccccucccucag

SEQ ID NO: 1407303 - RNA, 20 nt, Homo sapiens
ucgacguuugacuagccauc

SEQ ID NO: 1407304 - RNA, 16 nt, Homo sapiens
ucuaaacugcuguuaa

SEQ ID NO: 1407305 - RNA, 19 nt, Homo sapiens
ucuaacuuuugugugaaau

SEQ ID NO: 1407306 - RNA, 18 nt, Homo sapiens
ucuacugagacaugacua

SEQ ID NO: 1407307 - RNA, 16 nt, Homo sapiens
ucuagcaccaggacuc

SEQ ID NO: 1407308 - RNA, 15 nt, Homo sapiens
ucuauaaacuucaga

SEQ ID NO: 1407309 - RNA, 19 nt, Homo sapiens
ucuaugaucuggacuuccu

SEQ ID NO: 1407310 - RNA, 17 nt, Homo sapiens
ucucaugaccaaaugcu

SEQ ID NO: 1407311 - RNA, 13 nt, Homo sapiens
ucuccagggacag

SEQ ID NO: 1407312 - RNA, 16 nt, Homo sapiens
ucucccuccucugccc

SEQ ID NO: 1407313 - RNA, 16 nt, Homo sapiens
ucuccucccauggccu

SEQ ID NO: 1407314 - RNA, 13 nt, Homo sapiens
ucuccuuugaggg

SEQ ID NO: 1407315 - RNA, 13 nt, Homo sapiens
ucuccuuuggcca

SEQ ID NO: 1407316 - RNA, 23 nt, Homo sapiens
ucucuccuaagacaccugcaaua

SEQ ID NO: 1407317 - RNA, 14 nt, Homo sapiens
ucucugguggugcu

SEQ ID NO: 1407318 - RNA, 12 nt, Homo sapiens
ucugaaguacuu

SEQ ID NO: 1407319 - RNA, 21 nt, Homo sapiens
ucugaaguacuuaaacuucca

SEQ ID NO: 1407320 - RNA, 13 nt, Homo sapiens
ucugaccauuuca

SEQ ID NO: 1407321 - RNA, 18 nt, Homo sapiens
ucugaccgggucugcuuc

SEQ ID NO: 1407322 - RNA, 20 nt, Homo sapiens
ucugaggaguggaguucucu

SEQ ID NO: 1407323 - RNA, 14 nt, Homo sapiens
ucugccucagcuuc

SEQ ID NO: 1407324 - RNA, 18 nt, Homo sapiens
ucugccuuguccugaugc

SEQ ID NO: 1407325 - RNA, 13 nt, Homo sapiens
ucuggaagaccug

SEQ ID NO: 1407326 - RNA, 20 nt, Homo sapiens
aagaugcuucucacugccau

SEQ ID NO: 1407327 - RNA, 15 nt, Homo sapiens
aagauuauauaucau

SEQ ID NO: 1407328 - RNA, 12 nt, Homo sapiens
aagauuucugcu

SEQ ID NO: 1407329 - RNA, 19 nt, Homo sapiens
aagcacagauguucuucaa

SEQ ID NO: 1407330 - RNA, 21 nt, Homo sapiens
aagcugcugagaaucuagccu

SEQ ID NO: 1407331 - RNA, 14 nt, Homo sapiens
aagcuuuggacaag

SEQ ID NO: 1407332 - RNA, 20 nt, Homo sapiens
aaggacucugcuucagucca

SEQ ID NO: 1407333 - RNA, 14 nt, Homo sapiens
aaggagaaaaugca

SEQ ID NO: 1407334 - RNA, 15 nt, Homo sapiens
aaggagccuauggca

SEQ ID NO: 1407335 - RNA, 21 nt, Homo sapiens
aaggccacacuggcaucuccc

SEQ ID NO: 1407336 - RNA, 17 nt, Homo sapiens
aaggcugaccaagagag

SEQ ID NO: 1407337 - RNA, 14 nt, Homo sapiens
aaggcuuucagggc

SEQ ID NO: 1407338 - RNA, 19 nt, Homo sapiens
aagggacaccaagccuugg

SEQ ID NO: 1407339 - RNA, 22 nt, Homo sapiens
aaggugccgauuucaugcauuc

SEQ ID NO: 1407340 - RNA, 16 nt, Homo sapiens
aaguaguagugucuuc

SEQ ID NO: 1407341 - RNA, 18 nt, Homo sapiens
aaguauauauucuacaca

SEQ ID NO: 1407342 - RNA, 15 nt, Homo sapiens
aagucacuggccagu

SEQ ID NO: 1407343 - RNA, 21 nt, Homo sapiens
aagucaucauaauucagcucu

SEQ ID NO: 1407344 - RNA, 20 nt, Homo sapiens
aagugagacccugucucaaa

SEQ ID NO: 1407345 - RNA, 15 nt, Homo sapiens
aaguguagcacccug

SEQ ID NO: 1407346 - RNA, 19 nt, Homo sapiens
aaguucugguaugaacuug

SEQ ID NO: 1407347 - RNA, 17 nt, Homo sapiens
aauaaacaacauugucu

SEQ ID NO: 1407348 - RNA, 15 nt, Homo sapiens
aauaaacccuuccug

SEQ ID NO: 1407349 - RNA, 14 nt, Homo sapiens
aauaaggcacaaaa

SEQ ID NO: 1407350 - RNA, 20 nt, Homo sapiens
aauagaagaacauccaagga

SEQ ID NO: 1407351 - RNA, 17 nt, Homo sapiens
aauauauaauguugcca

SEQ ID NO: 1407352 - RNA, 16 nt, Homo sapiens
aauauuguuguuuacc

SEQ ID NO: 1407353 - RNA, 17 nt, Homo sapiens
aauauuuaaacuucuug

SEQ ID NO: 1407354 - RNA, 19 nt, Homo sapiens
aauauuuuguuuugugcag

SEQ ID NO: 1407355 - RNA, 18 nt, Homo sapiens
aaucaaugaucaucucac

SEQ ID NO: 1407356 - RNA, 11 nt, Homo sapiens
aaucacuggaa

SEQ ID NO: 1407357 - RNA, 18 nt, Homo sapiens
aaucagguccucagagaa

SEQ ID NO: 1407358 - RNA, 22 nt, Homo sapiens
aaucagucuuggaauacuugaa

SEQ ID NO: 1407359 - RNA, 21 nt, Homo sapiens
aaucuccuucuuuccuggacu

SEQ ID NO: 1407360 - RNA, 18 nt, Homo sapiens
aaugaccaguaauuguga

SEQ ID NO: 1407361 - RNA, 15 nt, Homo sapiens
aaugagccuggcaag

SEQ ID NO: 1407362 - RNA, 23 nt, Homo sapiens
aaugauuucaugcuaucucugug

SEQ ID NO: 1407363 - RNA, 14 nt, Homo sapiens
aaugcccugugcau

SEQ ID NO: 1407364 - RNA, 13 nt, Homo sapiens
aaugcuuccaagc

SEQ ID NO: 1407365 - RNA, 13 nt, Homo sapiens
aaugcuucugccu

SEQ ID NO: 1407366 - RNA, 15 nt, Homo sapiens
aauggcaugcugaaa

SEQ ID NO: 1407367 - RNA, 20 nt, Homo sapiens
aauguaaaguaagacaucuc

SEQ ID NO: 1407368 - RNA, 22 nt, Homo sapiens
aaugucccagaggcuagucucu

SEQ ID NO: 1407369 - RNA, 12 nt, Homo sapiens
aauguugccagc

SEQ ID NO: 1407370 - RNA, 15 nt, Homo sapiens
aauuaugagucucua

SEQ ID NO: 1407371 - RNA, 23 nt, Homo sapiens
aauucaccucguuacucucaccu

SEQ ID NO: 1407372 - RNA, 13 nt, Homo sapiens
aauugacugucac

SEQ ID NO: 1407373 - RNA, 18 nt, Homo sapiens
aauuugcauugugucaga

SEQ ID NO: 1407374 - RNA, 19 nt, Homo sapiens
aauuuucuuucauacauua

SEQ ID NO: 1407375 - RNA, 21 nt, Homo sapiens
aauuuuuacacaaaccugaaa

SEQ ID NO: 1407376 - RNA, 24 nt, Homo sapiens
acaaaggagagcuagcagcaggga

SEQ ID NO: 1407377 - RNA, 21 nt, Homo sapiens
acaaaucuaugccacucagaa

SEQ ID NO: 1407378 - RNA, 20 nt, Homo sapiens
acaaauuguuuuuacugucu

SEQ ID NO: 1407379 - RNA, 18 nt, Homo sapiens
acaaggcugaccaagaga

SEQ ID NO: 1407380 - RNA, 13 nt, Homo sapiens
acaaugugaaaag

SEQ ID NO: 1407381 - RNA, 15 nt, Homo sapiens
acacacaccaaugcg

SEQ ID NO: 1407382 - RNA, 17 nt, Homo sapiens
acacacacgccaaugca

SEQ ID NO: 1407383 - RNA, 16 nt, Homo sapiens
acacacagagauaugc

SEQ ID NO: 1407384 - RNA, 17 nt, Homo sapiens
acacacagauaugcaca

SEQ ID NO: 1407385 - RNA, 18 nt, Homo sapiens
acacacagauaugcacac

SEQ ID NO: 1407386 - RNA, 13 nt, Homo sapiens
acacacagaugca

SEQ ID NO: 1407387 - RNA, 22 nt, Homo sapiens
acacaccgauguacacacacag

SEQ ID NO: 1407388 - RNA, 15 nt, Homo sapiens
acacacgccaaugca

SEQ ID NO: 1407389 - RNA, 14 nt, Homo sapiens
acacagauaugcac

SEQ ID NO: 1407390 - RNA, 19 nt, Homo sapiens
acacagaugcacacacaga

SEQ ID NO: 1407391 - RNA, 18 nt, Homo sapiens
acacaggcaaaauccuug

SEQ ID NO: 1407392 - RNA, 21 nt, Homo sapiens
acacaggccagcuccacagug

SEQ ID NO: 1407393 - RNA, 19 nt, Homo sapiens
acacaguguuuccugagua

SEQ ID NO: 1407394 - RNA, 15 nt, Homo sapiens
acaccaaugcgcaca

SEQ ID NO: 1407395 - RNA, 20 nt, Homo sapiens
acaccauucuccugccucag

SEQ ID NO: 1407396 - RNA, 21 nt, Homo sapiens
acaccgauguacacacacaga

SEQ ID NO: 1407397 - RNA, 23 nt, Homo sapiens
acaccgaugugcgcacacacaga

SEQ ID NO: 1407398 - RNA, 14 nt, Homo sapiens
acaccguucauuca

SEQ ID NO: 1407399 - RNA, 15 nt, Homo sapiens
acacggaugcacaga

SEQ ID NO: 1407400 - RNA, 20 nt, Homo sapiens
acacucccacuuggcaucau

SEQ ID NO: 1407401 - RNA, 18 nt, Homo sapiens
acacugagauauucagcc

SEQ ID NO: 1407402 - RNA, 13 nt, Homo sapiens
acagaaacagaga

SEQ ID NO: 1407403 - RNA, 23 nt, Homo sapiens
acagaagacccgcucuccaucuu

SEQ ID NO: 1407404 - RNA, 15 nt, Homo sapiens
acagacacucccacu

SEQ ID NO: 1407405 - RNA, 15 nt, Homo sapiens
auaaaucaguuaugu

SEQ ID NO: 1407406 - RNA, 14 nt, Homo sapiens
auaaauuacauuaa

SEQ ID NO: 1407407 - RNA, 22 nt, Homo sapiens
auaacauggccuuggagggcau

SEQ ID NO: 1407408 - RNA, 20 nt, Homo sapiens
auaagcagucauccucagau

SEQ ID NO: 1407409 - RNA, 23 nt, Homo sapiens
auaagcagucauccucagaucau

SEQ ID NO: 1407410 - RNA, 19 nt, Homo sapiens
auaauaaacaacauugucu

SEQ ID NO: 1407411 - RNA, 16 nt, Homo sapiens
auaaucagucaugugu

SEQ ID NO: 1407412 - RNA, 16 nt, Homo sapiens
auaaugaggaguuuau

SEQ ID NO: 1407413 - RNA, 15 nt, Homo sapiens
auaauugacaugggc

SEQ ID NO: 1407414 - RNA, 15 nt, Homo sapiens
auacacauggaugca

SEQ ID NO: 1407415 - RNA, 21 nt, Homo sapiens
auacacauggaugcacgcaca

SEQ ID NO: 1407416 - RNA, 14 nt, Homo sapiens
auacagaaugaauc

SEQ ID NO: 1407417 - RNA, 21 nt, Homo sapiens
auacccuccuuccaccaaguu

SEQ ID NO: 1407418 - RNA, 20 nt, Homo sapiens
auacccuggagcaagaccug

SEQ ID NO: 1407419 - RNA, 12 nt, Homo sapiens
auacugugcaua

SEQ ID NO: 1407420 - RNA, 14 nt, Homo sapiens
auagcaacaugcuu

SEQ ID NO: 1407421 - RNA, 18 nt, Homo sapiens
auagcaccuccacauacc

SEQ ID NO: 1407422 - RNA, 22 nt, Homo sapiens
auaggaaaccacacagacuugg

SEQ ID NO: 1407423 - RNA, 20 nt, Homo sapiens
auauagagaauaaggcacaa

SEQ ID NO: 1407424 - RNA, 14 nt, Homo sapiens
auaugauacucuca

SEQ ID NO: 1407425 - RNA, 17 nt, Homo sapiens
auaugcacacacacgga

SEQ ID NO: 1407426 - RNA, 20 nt, Homo sapiens
auaugcacacacagaugcac

SEQ ID NO: 1407427 - RNA, 22 nt, Homo sapiens
auaugcacacacagaugcacac

SEQ ID NO: 1407428 - RNA, 18 nt, Homo sapiens
auauguuaggaauacucu

SEQ ID NO: 1407429 - RNA, 20 nt, Homo sapiens
auauuccgggugccauuccc

SEQ ID NO: 1407430 - RNA, 21 nt, Homo sapiens
auauuuauuuauguguucaca

SEQ ID NO: 1407431 - RNA, 18 nt, Homo sapiens
auauuuuguuuugugcag

SEQ ID NO: 1407432 - RNA, 15 nt, Homo sapiens
aucaaagaacaaaca

SEQ ID NO: 1407433 - RNA, 17 nt, Homo sapiens
aucaaaucagucuugga

SEQ ID NO: 1407434 - RNA, 17 nt, Homo sapiens
aucaacauuuguuccau

SEQ ID NO: 1407435 - RNA, 17 nt, Homo sapiens
aucagccugcuccagcu

SEQ ID NO: 1407436 - RNA, 13 nt, Homo sapiens
aucagucaugugu

SEQ ID NO: 1407437 - RNA, 21 nt, Homo sapiens
aucagucuuggaauacuugaa

SEQ ID NO: 1407438 - RNA, 15 nt, Homo sapiens
aucagugcacacgga

SEQ ID NO: 1407439 - RNA, 23 nt, Homo sapiens
aucaugaaaguccagcacuggaa

SEQ ID NO: 1407440 - RNA, 12 nt, Homo sapiens
aucauucuaauu

SEQ ID NO: 1407441 - RNA, 19 nt, Homo sapiens
aucauuggauccuacucaa

SEQ ID NO: 1407442 - RNA, 12 nt, Homo sapiens
auccaagaccug

SEQ ID NO: 1407443 - RNA, 13 nt, Homo sapiens
auccaggugccaa

SEQ ID NO: 1407444 - RNA, 20 nt, Homo sapiens
aucccacggaaaaugccaau

SEQ ID NO: 1407445 - RNA, 12 nt, Homo sapiens
aucccagcacuu

SEQ ID NO: 1407446 - RNA, 11 nt, Homo sapiens
aucccaugagc

SEQ ID NO: 1407447 - RNA, 23 nt, Homo sapiens
auccuacccccugugccuuguca

SEQ ID NO: 1407448 - RNA, 14 nt, Homo sapiens
auccuaggcauuug

SEQ ID NO: 1407449 - RNA, 15 nt, Homo sapiens
auccuaggcauuugc

SEQ ID NO: 1407450 - RNA, 21 nt, Homo sapiens
aucgcaccauugcacuccagc

SEQ ID NO: 1407451 - RNA, 14 nt, Homo sapiens
aucuacaacuccaa

SEQ ID NO: 1407452 - RNA, 12 nt, Homo sapiens
aucuauaucucu

SEQ ID NO: 1407453 - RNA, 22 nt, Homo sapiens
aucucaagcaaguuuaaucaau

SEQ ID NO: 1407454 - RNA, 15 nt, Homo sapiens
aucucaggauuucac

SEQ ID NO: 1407455 - RNA, 20 nt, Homo sapiens
aucucuaaacugcuguuaau

SEQ ID NO: 1407456 - RNA, 22 nt, Homo sapiens
aucugucaaagaaaacuuccaa

SEQ ID NO: 1407457 - RNA, 15 nt, Homo sapiens
aucuucuuaugcaau

SEQ ID NO: 1407458 - RNA, 13 nt, Homo sapiens
aucuuucuuccaa

SEQ ID NO: 1407459 - RNA, 23 nt, Homo sapiens
augaaaaauauugcugaacuacu

SEQ ID NO: 1407460 - RNA, 13 nt, Homo sapiens
augaaauacucuu

SEQ ID NO: 1407461 - RNA, 22 nt, Homo sapiens
augaacacacauggaugcacac

SEQ ID NO: 1407462 - RNA, 21 nt, Homo sapiens
augaacacagccugggaccag

SEQ ID NO: 1407463 - RNA, 23 nt, Homo sapiens
augaaccugcccugcucccacag

SEQ ID NO: 1407464 - RNA, 13 nt, Homo sapiens
augaagcaugcua

SEQ ID NO: 1407465 - RNA, 18 nt, Homo sapiens
augaagguggaacaagca

SEQ ID NO: 1407466 - RNA, 21 nt, Homo sapiens
augaagguggaacaagcacag

SEQ ID NO: 1407467 - RNA, 22 nt, Homo sapiens
augacacacaaaucccauuaaa

SEQ ID NO: 1407468 - RNA, 22 nt, Homo sapiens
augacggcugcucgaagaacaa

SEQ ID NO: 1407469 - RNA, 16 nt, Homo sapiens
augagcacacacacac

SEQ ID NO: 1407470 - RNA, 20 nt, Homo sapiens
augagccuggcaagaaugug

SEQ ID NO: 1407471 - RNA, 22 nt, Homo sapiens
augagcuggggaugucucucau

SEQ ID NO: 1407472 - RNA, 20 nt, Homo sapiens
augauaaauuaagcaugaaa

SEQ ID NO: 1407473 - RNA, 13 nt, Homo sapiens
augaucaucucac

SEQ ID NO: 1407474 - RNA, 12 nt, Homo sapiens
augaucuuggca

SEQ ID NO: 1407475 - RNA, 22 nt, Homo sapiens
augaugagguuuucuuaacuua

SEQ ID NO: 1407476 - RNA, 21 nt, Homo sapiens
augcacacacacggaugcaca

SEQ ID NO: 1407477 - RNA, 17 nt, Homo sapiens
augcacacacagaugca

SEQ ID NO: 1407478 - RNA, 21 nt, Homo sapiens
augcaggcaugcuggcuccca

SEQ ID NO: 1407479 - RNA, 14 nt, Homo sapiens
augcauucccggug

SEQ ID NO: 1407480 - RNA, 17 nt, Homo sapiens
augccacucagaaucuc

SEQ ID NO: 1407481 - RNA, 13 nt, Homo sapiens
augcccuaccugc

SEQ ID NO: 1407482 - RNA, 16 nt, Homo sapiens
augcgcacaaggcuga

SEQ ID NO: 1407483 - RNA, 15 nt, Homo sapiens
augcugaaugaaucc

SEQ ID NO: 1407484 - RNA, 20 nt, Homo sapiens
augcuggcucccagggccau

SEQ ID NO: 1407485 - RNA, 21 nt, Homo sapiens
cacagaaaggccacucaggau

SEQ ID NO: 1407486 - RNA, 17 nt, Homo sapiens
cacagagauaugcacac

SEQ ID NO: 1407487 - RNA, 19 nt, Homo sapiens
cacagauauacacauggau

SEQ ID NO: 1407488 - RNA, 13 nt, Homo sapiens
cacagauaugcac

SEQ ID NO: 1407489 - RNA, 15 nt, Homo sapiens
cacagauaugcacac

SEQ ID NO: 1407490 - RNA, 13 nt, Homo sapiens
cacagaugcacac

SEQ ID NO: 1407491 - RNA, 19 nt, Homo sapiens
cacagaugcacacacagau

SEQ ID NO: 1407492 - RNA, 18 nt, Homo sapiens
cacagauggucacacaga

SEQ ID NO: 1407493 - RNA, 13 nt, Homo sapiens
cacaggggagcag

SEQ ID NO: 1407494 - RNA, 12 nt, Homo sapiens
cacauaaaggua

SEQ ID NO: 1407495 - RNA, 15 nt, Homo sapiens
cacauagagauaugc

SEQ ID NO: 1407496 - RNA, 16 nt, Homo sapiens
cacauauguaguauaa

SEQ ID NO: 1407497 - RNA, 23 nt, Homo sapiens
cacaucccuggaaggacauccau

SEQ ID NO: 1407498 - RNA, 22 nt, Homo sapiens
caccacugaaacccugcacuua

SEQ ID NO: 1407499 - RNA, 19 nt, Homo sapiens
caccaucucuuuaccuccu

SEQ ID NO: 1407500 - RNA, 17 nt, Homo sapiens
caccaugcccggccuaa

SEQ ID NO: 1407501 - RNA, 15 nt, Homo sapiens
cacccugaaagcccu

SEQ ID NO: 1407502 - RNA, 19 nt, Homo sapiens
caccucugcacaagcugca

SEQ ID NO: 1407503 - RNA, 22 nt, Homo sapiens
cacgcacauagagauaugcaca

SEQ ID NO: 1407504 - RNA, 19 nt, Homo sapiens
cacuagaggaaaccaguuu

SEQ ID NO: 1407505 - RNA, 17 nt, Homo sapiens
cacuauguggagcucag

SEQ ID NO: 1407506 - RNA, 17 nt, Homo sapiens
cacucagaaucuccuuc

SEQ ID NO: 1407507 - RNA, 18 nt, Homo sapiens
cacucaggaauguuugcu

SEQ ID NO: 1407508 - RNA, 22 nt, Homo sapiens
cacucuaccugaaccugcacac

SEQ ID NO: 1407509 - RNA, 15 nt, Homo sapiens
cacugcaagcucugc

SEQ ID NO: 1407510 - RNA, 16 nt, Homo sapiens
cacuggaagccagaga

SEQ ID NO: 1407511 - RNA, 21 nt, Homo sapiens
cacugugucccucucucugga

SEQ ID NO: 1407512 - RNA, 17 nt, Homo sapiens
cacuguuuauugaagaa

SEQ ID NO: 1407513 - RNA, 19 nt, Homo sapiens
ccacagucauuagugaauu

SEQ ID NO: 1407514 - RNA, 16 nt, Homo sapiens
ccaccucuccuuuggc

SEQ ID NO: 1407515 - RNA, 17 nt, Homo sapiens
ccacuuggcaucauuca

SEQ ID NO: 1407516 - RNA, 16 nt, Homo sapiens
ccacuuuuaaaacuau

SEQ ID NO: 1407517 - RNA, 17 nt, Homo sapiens
ccagagaaaaagggagg

SEQ ID NO: 1407518 - RNA, 21 nt, Homo sapiens
ccagaggcuagucucuucuca

SEQ ID NO: 1407519 - RNA, 13 nt, Homo sapiens
ccagaugccaggg

SEQ ID NO: 1407520 - RNA, 22 nt, Homo sapiens
ccagaugggaugggcuuucuca

SEQ ID NO: 1407521 - RNA, 16 nt, Homo sapiens
ccagcaaucugcauuu

SEQ ID NO: 1407522 - RNA, 20 nt, Homo sapiens
ccagcacacggcugccugac

SEQ ID NO: 1407523 - RNA, 19 nt, Homo sapiens
ccagccuggccaacauggc

SEQ ID NO: 1407524 - RNA, 23 nt, Homo sapiens
ccagcuccacaguguugccagag

SEQ ID NO: 1407525 - RNA, 19 nt, Homo sapiens
ccagcuguuaccugagaua

SEQ ID NO: 1407526 - RNA, 22 nt, Homo sapiens
ccaggagguggagguugcagug

SEQ ID NO: 1407527 - RNA, 17 nt, Homo sapiens
ccaggcuggagugcagu

SEQ ID NO: 1407528 - RNA, 19 nt, Homo sapiens
ccaggcugggcucugggau

SEQ ID NO: 1407529 - RNA, 18 nt, Homo sapiens
ccaguacuuccugcagua

SEQ ID NO: 1407530 - RNA, 11 nt, Homo sapiens
ccaguuuccaa

SEQ ID NO: 1407531 - RNA, 16 nt, Homo sapiens
ccauagaaacugaggc

SEQ ID NO: 1407532 - RNA, 19 nt, Homo sapiens
ccaucucuacaaaaagcau

SEQ ID NO: 1407533 - RNA, 21 nt, Homo sapiens
ccauggggcugauuguauuua

SEQ ID NO: 1407534 - RNA, 12 nt, Homo sapiens
cccaacugugau

SEQ ID NO: 1407535 - RNA, 21 nt, Homo sapiens
cccacgacugcccggcagggu

SEQ ID NO: 1407536 - RNA, 18 nt, Homo sapiens
cccagaaugccuccugca

SEQ ID NO: 1407537 - RNA, 18 nt, Homo sapiens
cccagagcaaaauaauuu

SEQ ID NO: 1407538 - RNA, 21 nt, Homo sapiens
cccaggcccuaggauuccucc

SEQ ID NO: 1407539 - RNA, 19 nt, Homo sapiens
cccaggcuagagugcagug

SEQ ID NO: 1407540 - RNA, 19 nt, Homo sapiens
cccaggcuggagugcaaug

SEQ ID NO: 1407541 - RNA, 15 nt, Homo sapiens
cccaguccuccagac

SEQ ID NO: 1407542 - RNA, 16 nt, Homo sapiens
cccaguuagcucucaa

SEQ ID NO: 1407543 - RNA, 15 nt, Homo sapiens
ccccaacugugauca

SEQ ID NO: 1407544 - RNA, 17 nt, Homo sapiens
ccccaucucauucaggu

SEQ ID NO: 1407545 - RNA, 23 nt, Homo sapiens
ccccggcugggugagcugagaug

SEQ ID NO: 1407546 - RNA, 19 nt, Homo sapiens
ccccgugggccauggcaau

SEQ ID NO: 1407547 - RNA, 14 nt, Homo sapiens
cccgcccccagauu

SEQ ID NO: 1407548 - RNA, 19 nt, Homo sapiens
cccggaugugaauggcaug

SEQ ID NO: 1407549 - RNA, 18 nt, Homo sapiens
cccggcuugccuguaauc

SEQ ID NO: 1407550 - RNA, 18 nt, Homo sapiens
cccucaucuuucuuccaa

SEQ ID NO: 1407551 - RNA, 21 nt, Homo sapiens
cccucuguaacaacucuaguc

SEQ ID NO: 1407552 - RNA, 18 nt, Homo sapiens
cccugagcuuucugcuau

SEQ ID NO: 1407553 - RNA, 14 nt, Homo sapiens
cccuggagcaagac

SEQ ID NO: 1407554 - RNA, 22 nt, Homo sapiens
ccgacuuuuguuuaccagagaa

SEQ ID NO: 1407555 - RNA, 22 nt, Homo sapiens
ccgcauuuugggugccauuaaa

SEQ ID NO: 1407556 - RNA, 19 nt, Homo sapiens
ccggccuccugucccucau

SEQ ID NO: 1407557 - RNA, 21 nt, Homo sapiens
ccggcuaugggacugcagugc

SEQ ID NO: 1407558 - RNA, 21 nt, Homo sapiens
ccuaaauguggacaucaugaa

SEQ ID NO: 1407559 - RNA, 18 nt, Homo sapiens
ccuaaugagaagucaaca

SEQ ID NO: 1407560 - RNA, 15 nt, Homo sapiens
ccuaauguggcagcu

SEQ ID NO: 1407561 - RNA, 22 nt, Homo sapiens
ccuacaagucaucauaauucag

SEQ ID NO: 1407562 - RNA, 23 nt, Homo sapiens
ccuacaguugaaaaacagcugag

SEQ ID NO: 1407563 - RNA, 16 nt, Homo sapiens
ccuacuucuuuugcuc

SEQ ID NO: 1407564 - RNA, 15 nt, Homo sapiens
ccuaggcauuugcug

SEQ ID NO: 1407565 - RNA, 15 nt, Homo sapiens
ccuaggcuagggugg

SEQ ID NO: 1407566 - RNA, 16 nt, Homo sapiens
ccucaaaugcaguauu

SEQ ID NO: 1407567 - RNA, 15 nt, Homo sapiens
ccucacagcaucucu

SEQ ID NO: 1407568 - RNA, 14 nt, Homo sapiens
ccucagccuccuga

SEQ ID NO: 1407569 - RNA, 15 nt, Homo sapiens
ccucagcugccucau

SEQ ID NO: 1407570 - RNA, 14 nt, Homo sapiens
ccucauuuaccaua

SEQ ID NO: 1407571 - RNA, 21 nt, Homo sapiens
ccuccaaacacugggcucuga

SEQ ID NO: 1407572 - RNA, 17 nt, Homo sapiens
ccuccauucugaccauu

SEQ ID NO: 1407573 - RNA, 16 nt, Homo sapiens
ccuccucugcccggga

SEQ ID NO: 1407574 - RNA, 15 nt, Homo sapiens
ccucgcccuccacaa

SEQ ID NO: 1407575 - RNA, 16 nt, Homo sapiens
ccucgcccuccacaaa

SEQ ID NO: 1407576 - RNA, 12 nt, Homo sapiens
ccucucauucca

SEQ ID NO: 1407577 - RNA, 14 nt, Homo sapiens
ccucugcagcacuu

SEQ ID NO: 1407578 - RNA, 17 nt, Homo sapiens
ccugacccuacuucuuu

SEQ ID NO: 1407579 - RNA, 22 nt, Homo sapiens
ccugacccucaucuuucuucca

SEQ ID NO: 1407580 - RNA, 12 nt, Homo sapiens
ccugaguuucaa

SEQ ID NO: 1407581 - RNA, 21 nt, Homo sapiens
ccuggaccugaaggcaucuga

SEQ ID NO: 1407582 - RNA, 18 nt, Homo sapiens
ccuggguuuaagcaaugc

SEQ ID NO: 1407583 - RNA, 14 nt, Homo sapiens
ccugugaaauacca

SEQ ID NO: 1407584 - RNA, 20 nt, Homo sapiens
ccuguuuaaaaaaaguauau

SEQ ID NO: 1407585 - RNA, 18 nt, Homo sapiens
ccuuaaggccacacuggc

SEQ ID NO: 1407586 - RNA, 23 nt, Homo sapiens
ccuuggugugcuguauccaucca

SEQ ID NO: 1407587 - RNA, 22 nt, Homo sapiens
ccuuugggaggcagcaucaggg

SEQ ID NO: 1407588 - RNA, 15 nt, Homo sapiens
ccuuuuucuaccuuu

SEQ ID NO: 1407589 - RNA, 16 nt, Homo sapiens
ccuuuuuuguuauuau

SEQ ID NO: 1407590 - RNA, 15 nt, Homo sapiens
cgaagggaucagccc

SEQ ID NO: 1407591 - RNA, 23 nt, Homo sapiens
uacaaucaggagugguggaaccu

SEQ ID NO: 1407592 - RNA, 15 nt, Homo sapiens
uacacacacagaugc

SEQ ID NO: 1407593 - RNA, 18 nt, Homo sapiens
uacacacacagaugcaca

SEQ ID NO: 1407594 - RNA, 20 nt, Homo sapiens
uacacauggaugcacgcaca

SEQ ID NO: 1407595 - RNA, 14 nt, Homo sapiens
uacacauugcauuu

SEQ ID NO: 1407596 - RNA, 19 nt, Homo sapiens
uacagaaugaaucccauaa

SEQ ID NO: 1407597 - RNA, 16 nt, Homo sapiens
uacaguaucucagggc

SEQ ID NO: 1407598 - RNA, 16 nt, Homo sapiens
uacauuauauuccucu

SEQ ID NO: 1407599 - RNA, 13 nt, Homo sapiens
uacauuucauuaa

SEQ ID NO: 1407600 - RNA, 19 nt, Homo sapiens
uacccuggagcaagaccug

SEQ ID NO: 1407601 - RNA, 23 nt, Homo sapiens
uaccuccuaauuccacacccuca

SEQ ID NO: 1407602 - RNA, 19 nt, Homo sapiens
uaccuggcccugugccuug

SEQ ID NO: 1407603 - RNA, 16 nt, Homo sapiens
uacuccaugcacauag

SEQ ID NO: 1407604 - RNA, 15 nt, Homo sapiens
uacucccauuuuccc

SEQ ID NO: 1407605 - RNA, 11 nt, Homo sapiens
uacuucauuaa

SEQ ID NO: 1407606 - RNA, 12 nt, Homo sapiens
uagaaacaaaca

SEQ ID NO: 1407607 - RNA, 19 nt, Homo sapiens
uagaacacccacuggccag

SEQ ID NO: 1407608 - RNA, 17 nt, Homo sapiens
uagaagacaacaggcau

SEQ ID NO: 1407609 - RNA, 18 nt, Homo sapiens
uagaagcuguaacagaau

SEQ ID NO: 1407610 - RNA, 19 nt, Homo sapiens
uagaauuaguggcacuugc

SEQ ID NO: 1407611 - RNA, 15 nt, Homo sapiens
uagagaaugauuuca

SEQ ID NO: 1407612 - RNA, 15 nt, Homo sapiens
uagagacacagagau

SEQ ID NO: 1407613 - RNA, 14 nt, Homo sapiens
uagagcugccugug

SEQ ID NO: 1407614 - RNA, 12 nt, Homo sapiens
uagaggagcaac

SEQ ID NO: 1407615 - RNA, 17 nt, Homo sapiens
uagauucucaccugccu

SEQ ID NO: 1407616 - RNA, 15 nt, Homo sapiens
uagcacaugauuuuc

SEQ ID NO: 1407617 - RNA, 22 nt, Homo sapiens
uagcagcagggagggcuucugc

SEQ ID NO: 1407618 - RNA, 15 nt, Homo sapiens
uagccaaguguggua

SEQ ID NO: 1407619 - RNA, 12 nt, Homo sapiens
uagccaucucaa

SEQ ID NO: 1407620 - RNA, 22 nt, Homo sapiens
ugucuuugacuugguuaaagga

SEQ ID NO: 1407621 - RNA, 13 nt, Homo sapiens
ugugcaugccaug

SEQ ID NO: 1407622 - RNA, 14 nt, Homo sapiens
ugugcuacacuugc

SEQ ID NO: 1407623 - RNA, 15 nt, Homo sapiens
ugugcucccaccagg

SEQ ID NO: 1407624 - RNA, 18 nt, Homo sapiens
uguggccaaggcugagag

SEQ ID NO: 1407625 - RNA, 20 nt, Homo sapiens
uguguccauugaugucauuc

SEQ ID NO: 1407626 - RNA, 14 nt, Homo sapiens
ugugugaccccaaa

SEQ ID NO: 1407627 - RNA, 17 nt, Homo sapiens
uguuagugguuacccag

SEQ ID NO: 1407628 - RNA, 16 nt, Homo sapiens
uguugcaaugacacau

SEQ ID NO: 1407629 - RNA, 16 nt, Homo sapiens
uguugucacaccugaa

SEQ ID NO: 1407630 - RNA, 19 nt, Homo sapiens
uguuuacagaggacaguau

SEQ ID NO: 1407631 - RNA, 14 nt, Homo sapiens
uguuuucucuugag

SEQ ID NO: 1407632 - RNA, 20 nt, Homo sapiens
uuaaaaaaaguauauauucu

SEQ ID NO: 1407633 - RNA, 15 nt, Homo sapiens
uuaaaaagaaugacg

SEQ ID NO: 1407634 - RNA, 18 nt, Homo sapiens
uuaaaaguccacuuuuaa

SEQ ID NO: 1407635 - RNA, 16 nt, Homo sapiens
uuaaaauccaaaugag

SEQ ID NO: 1407636 - RNA, 11 nt, Homo sapiens
uuaaacgucau

SEQ ID NO: 1407637 - RNA, 15 nt, Homo sapiens
uuaacggcacugugg

SEQ ID NO: 1407638 - RNA, 21 nt, Homo sapiens
uuaacuuaaaagaacauguau

SEQ ID NO: 1407639 - RNA, 16 nt, Homo sapiens
uuaagcucaguggcaa

SEQ ID NO: 1407640 - RNA, 15 nt, Homo sapiens
uuaaggccacacugg

SEQ ID NO: 1407641 - RNA, 16 nt, Homo sapiens
uuaagugacuauagaa

SEQ ID NO: 1407642 - RNA, 19 nt, Homo sapiens
uuaaucaaugaucaucuca

SEQ ID NO: 1407643 - RNA, 20 nt, Homo sapiens
uuaccuucuaccucuuggcu

SEQ ID NO: 1407644 - RNA, 19 nt, Homo sapiens
uuagaagaucugcuucccu

SEQ ID NO: 1407645 - RNA, 23 nt, Homo sapiens
uuagaauugccuuaaggccacac

SEQ ID NO: 1407646 - RNA, 17 nt, Homo sapiens
uuagcaauugacuguca

SEQ ID NO: 1407647 - RNA, 13 nt, Homo sapiens
uuagcugaacaau

SEQ ID NO: 1407648 - RNA, 13 nt, Homo sapiens
uuauauacaaugc

SEQ ID NO: 1407649 - RNA, 13 nt, Homo sapiens
uuauauacaauuu

SEQ ID NO: 1407650 - RNA, 22 nt, Homo sapiens
uuaugaagcaagccccacuuau

SEQ ID NO: 1407651 - RNA, 20 nt, Homo sapiens
agagucaacauaugugauug

SEQ ID NO: 1407652 - RNA, 21 nt, Homo sapiens
agagugggguagguugggaga

SEQ ID NO: 1407653 - RNA, 17 nt, Homo sapiens
agauacgcaaacacacc

SEQ ID NO: 1407654 - RNA, 16 nt, Homo sapiens
agauauacacauggau

SEQ ID NO: 1407655 - RNA, 12 nt, Homo sapiens
agauaugcacac

SEQ ID NO: 1407656 - RNA, 14 nt, Homo sapiens
agaucccagaggau

SEQ ID NO: 1407657 - RNA, 15 nt, Homo sapiens
agauccuaccccuga

SEQ ID NO: 1407658 - RNA, 16 nt, Homo sapiens
agaugaggcacuggaa

SEQ ID NO: 1407659 - RNA, 21 nt, Homo sapiens
agaugaguaauuucuuuggca

SEQ ID NO: 1407660 - RNA, 20 nt, Homo sapiens
agauuagaagacaacaggca

SEQ ID NO: 1407661 - RNA, 23 nt, Homo sapiens
agauuguucuguccaguuuccaa

SEQ ID NO: 1407662 - RNA, 23 nt, Homo sapiens
agcacaggccauggugcacaaaa

SEQ ID NO: 1407663 - RNA, 14 nt, Homo sapiens
agcaccugcucaac

SEQ ID NO: 1407664 - RNA, 23 nt, Homo sapiens
agcacugcuguguccgcuuucau

SEQ ID NO: 1407665 - RNA, 13 nt, Homo sapiens
agcagcacugggg

SEQ ID NO: 1407666 - RNA, 14 nt, Homo sapiens
agcaucaaagcacu

SEQ ID NO: 1407667 - RNA, 16 nt, Homo sapiens
agcauccucaguuccu

SEQ ID NO: 1407668 - RNA, 18 nt, Homo sapiens
agcauuagcuacuuuuca

SEQ ID NO: 1407669 - RNA, 20 nt, Homo sapiens
agcauuuugcuaaaugugaa

SEQ ID NO: 1407670 - RNA, 16 nt, Homo sapiens
agccacaguggccaaa

SEQ ID NO: 1407671 - RNA, 13 nt, Homo sapiens
agccaggacaucu

SEQ ID NO: 1407672 - RNA, 18 nt, Homo sapiens
agccaggacaucucugcc

SEQ ID NO: 1407673 - RNA, 16 nt, Homo sapiens
agccauaccaggguga

SEQ ID NO: 1407674 - RNA, 16 nt, Homo sapiens
agccaucucaagcaag

SEQ ID NO: 1407675 - RNA, 17 nt, Homo sapiens
agccaucucaagcaagu

SEQ ID NO: 1407676 - RNA, 15 nt, Homo sapiens
agcccaggacucuaa

SEQ ID NO: 1407677 - RNA, 22 nt, Homo sapiens
agcccugaguuucaaguauccu

SEQ ID NO: 1407678 - RNA, 21 nt, Homo sapiens
agccgccucccuuaugcagga

SEQ ID NO: 1407679 - RNA, 19 nt, Homo sapiens
agccuacacuauucuagca

SEQ ID NO: 1407680 - RNA, 15 nt, Homo sapiens
agccuauggcaucuu

SEQ ID NO: 1407681 - RNA, 18 nt, Homo sapiens
agccuccauccuaccccc

SEQ ID NO: 1407682 - RNA, 19 nt, Homo sapiens
agccucuccccgcucugga

SEQ ID NO: 1407683 - RNA, 13 nt, Homo sapiens
agccugggaccag

SEQ ID NO: 1407684 - RNA, 15 nt, Homo sapiens
agccugggcaaugug

SEQ ID NO: 1407685 - RNA, 23 nt, Homo sapiens
agcggcuggcagcccaccccuca

SEQ ID NO: 1407686 - RNA, 20 nt, Homo sapiens
agcucagcaacaaggcugca

SEQ ID NO: 1407687 - RNA, 23 nt, Homo sapiens
agcuccccccaagaugagcugca

SEQ ID NO: 1407688 - RNA, 16 nt, Homo sapiens
agcucugaacaaaagc

SEQ ID NO: 1407689 - RNA, 13 nt, Homo sapiens
agcugacagagcc

SEQ ID NO: 1407690 - RNA, 12 nt, Homo sapiens
agcugucugcuc

SEQ ID NO: 1407691 - RNA, 13 nt, Homo sapiens
agcuguucagcug

SEQ ID NO: 1407692 - RNA, 14 nt, Homo sapiens
agcuuaucucaggg

SEQ ID NO: 1407693 - RNA, 14 nt, Homo sapiens
agcuucaaacugca

SEQ ID NO: 1407694 - RNA, 16 nt, Homo sapiens
agcuuugaaaauucag

SEQ ID NO: 1407695 - RNA, 12 nt, Homo sapiens
agcuuugcucuu

SEQ ID NO: 1407696 - RNA, 15 nt, Homo sapiens
aggaagacaauguga

SEQ ID NO: 1407697 - RNA, 15 nt, Homo sapiens
aggaauuucugcucu

SEQ ID NO: 1407698 - RNA, 17 nt, Homo sapiens
aggaauuucugcucugg

SEQ ID NO: 1407699 - RNA, 18 nt, Homo sapiens
aggacaaccauuccagac

SEQ ID NO: 1407700 - RNA, 21 nt, Homo sapiens
aggacaaccauuccagacugc

SEQ ID NO: 1407701 - RNA, 17 nt, Homo sapiens
aggacaguggaugcugc

SEQ ID NO: 1407702 - RNA, 19 nt, Homo sapiens
aggacaguggaugcugcug

SEQ ID NO: 1407703 - RNA, 14 nt, Homo sapiens
aggacucagaggau

SEQ ID NO: 1407704 - RNA, 16 nt, Homo sapiens
aggagaaaaugcauua

SEQ ID NO: 1407705 - RNA, 17 nt, Homo sapiens
aggagaaucacuggaac

SEQ ID NO: 1407706 - RNA, 18 nt, Homo sapiens
aggagaggggcacagggu

SEQ ID NO: 1407707 - RNA, 14 nt, Homo sapiens
aggagggaggugcu

SEQ ID NO: 1407708 - RNA, 14 nt, Homo sapiens
aggagucagggaga

SEQ ID NO: 1407709 - RNA, 21 nt, Homo sapiens
aggaugaaagugaccauguuu

SEQ ID NO: 1407710 - RNA, 19 nt, Homo sapiens
aggauggucuugaucuccu

SEQ ID NO: 1407711 - RNA, 18 nt, Homo sapiens
aggcacaacaguucucuu

SEQ ID NO: 1407712 - RNA, 20 nt, Homo sapiens
aggcagacuaggguucaugu

SEQ ID NO: 1407713 - RNA, 14 nt, Homo sapiens
aggcaucugagugu

SEQ ID NO: 1407714 - RNA, 19 nt, Homo sapiens
aggcaucugagugugagac

SEQ ID NO: 1407715 - RNA, 14 nt, Homo sapiens
aggcaugaacacac

SEQ ID NO: 1407716 - RNA, 22 nt, Homo sapiens
aggcaugagggaucacagggcc

SEQ ID NO: 1407717 - RNA, 12 nt, Homo sapiens
aggccacacugg

SEQ ID NO: 1407718 - RNA, 23 nt, Homo sapiens
aggccagaaaacauaugcauuau

SEQ ID NO: 1407719 - RNA, 15 nt, Homo sapiens
aggccagcaccaucu

SEQ ID NO: 1407720 - RNA, 21 nt, Homo sapiens
aggccauugggauauucugaa

SEQ ID NO: 1407721 - RNA, 15 nt, Homo sapiens
aggcugaaagacagg

SEQ ID NO: 1407722 - RNA, 15 nt, Homo sapiens
aggcugcaacccugg

SEQ ID NO: 1407723 - RNA, 20 nt, Homo sapiens
agggacaccaagccuuggcu

SEQ ID NO: 1407724 - RNA, 13 nt, Homo sapiens
agggagacagaga

SEQ ID NO: 1407725 - RNA, 16 nt, Homo sapiens
agggagagagugcuau

SEQ ID NO: 1407726 - RNA, 16 nt, Homo sapiens
aggggcagccaggaca

SEQ ID NO: 1407727 - RNA, 13 nt, Homo sapiens
aggggucauucau

SEQ ID NO: 1407728 - RNA, 20 nt, Homo sapiens
aggugggaggaucucuugag

SEQ ID NO: 1407729 - RNA, 20 nt, Homo sapiens
agguguucuucauuaccuca

SEQ ID NO: 1407730 - RNA, 21 nt, Homo sapiens
agguuuguuuagaagaagugu

SEQ ID NO: 1407731 - RNA, 23 nt, Homo sapiens
uuaugagucucuaugaucuuggc

SEQ ID NO: 1407732 - RNA, 17 nt, Homo sapiens
uuaugucaccagaauau

SEQ ID NO: 1407733 - RNA, 16 nt, Homo sapiens
uuauuaauuaaaccag

SEQ ID NO: 1407734 - RNA, 17 nt, Homo sapiens
uuauuaauuaaaccaga

SEQ ID NO: 1407735 - RNA, 17 nt, Homo sapiens
uucaaacugcaugauuc

SEQ ID NO: 1407736 - RNA, 15 nt, Homo sapiens
uucaaaugcuguaac

SEQ ID NO: 1407737 - RNA, 15 nt, Homo sapiens
uucaaccuacuuuca

SEQ ID NO: 1407738 - RNA, 15 nt, Homo sapiens
uucaagaaagcuuca

SEQ ID NO: 1407739 - RNA, 15 nt, Homo sapiens
uucagauuugccuua

SEQ ID NO: 1407740 - RNA, 23 nt, Homo sapiens
uucagcccacugcccaaugccug

SEQ ID NO: 1407741 - RNA, 14 nt, Homo sapiens
uucagcucugcaag

SEQ ID NO: 1407742 - RNA, 13 nt, Homo sapiens
uucagcugcauac

SEQ ID NO: 1407743 - RNA, 20 nt, Homo sapiens
uucaugcauucuagugcaga

SEQ ID NO: 1407744 - RNA, 12 nt, Homo sapiens
uucauuaccuca

SEQ ID NO: 1407745 - RNA, 17 nt, Homo sapiens
uuccacaagagugaauu

SEQ ID NO: 1407746 - RNA, 23 nt, Homo sapiens
uuccagauguggauuuggcaaaa

SEQ ID NO: 1407747 - RNA, 17 nt, Homo sapiens
uucccuacaguugaaaa

SEQ ID NO: 1407748 - RNA, 17 nt, Homo sapiens
uucccugggccucagcc

SEQ ID NO: 1407749 - RNA, 23 nt, Homo sapiens
uuccucauuagcauuuugcuaaa

SEQ ID NO: 1407750 - RNA, 15 nt, Homo sapiens
uuccugaguagcagu

SEQ ID NO: 1407751 - RNA, 12 nt, Homo sapiens
uuccuguaagau

SEQ ID NO: 1407752 - RNA, 20 nt, Homo sapiens
uucgaaaccuguccauaaag

SEQ ID NO: 1407753 - RNA, 20 nt, Homo sapiens
uucgacguuugacuagccau

SEQ ID NO: 1407754 - RNA, 15 nt, Homo sapiens
uucuaguucugccag

SEQ ID NO: 1407755 - RNA, 21 nt, Homo sapiens
uucuauggguuggacaaccuc

SEQ ID NO: 1407756 - RNA, 20 nt, Homo sapiens
uucucaguaaauauuaaccu

SEQ ID NO: 1407757 - RNA, 23 nt, Homo sapiens
uucucaguaaauauuaaccugaa

SEQ ID NO: 1407758 - RNA, 21 nt, Homo sapiens
uucucaucccccagccacagu

SEQ ID NO: 1407759 - RNA, 14 nt, Homo sapiens
uucuccugccucag

SEQ ID NO: 1407760 - RNA, 22 nt, Homo sapiens
uucucuugagaggguggaauau

SEQ ID NO: 1407761 - RNA, 20 nt, Homo sapiens
uucuguccgagcuuugaaaa

SEQ ID NO: 1407762 - RNA, 15 nt, Homo sapiens
uucuucucgacuuca

SEQ ID NO: 1407763 - RNA, 14 nt, Homo sapiens
uugacacggccaug

SEQ ID NO: 1407764 - RNA, 15 nt, Homo sapiens
uugacacggccauga

SEQ ID NO: 1407765 - RNA, 20 nt, Homo sapiens
uugagcucaggaguuugaga

SEQ ID NO: 1407766 - RNA, 17 nt, Homo sapiens
uugaggacacaugucca

SEQ ID NO: 1407767 - RNA, 17 nt, Homo sapiens
uugaucuccugagcucg

SEQ ID NO: 1407768 - RNA, 19 nt, Homo sapiens
uugauuuaauaucugagaa

SEQ ID NO: 1407769 - RNA, 18 nt, Homo sapiens
uugccacagaugauacuu

SEQ ID NO: 1407770 - RNA, 21 nt, Homo sapiens
uugccacagaugauacuucca

SEQ ID NO: 1407771 - RNA, 13 nt, Homo sapiens
uugccagagccuu

SEQ ID NO: 1407772 - RNA, 22 nt, Homo sapiens
uugccagcgauuuuaguucaau

SEQ ID NO: 1407773 - RNA, 20 nt, Homo sapiens
uugccuuauuggcagcucua

SEQ ID NO: 1407774 - RNA, 19 nt, Homo sapiens
uugcucuacaaugacacac

SEQ ID NO: 1407775 - RNA, 11 nt, Homo sapiens
uugcugccaau

SEQ ID NO: 1407776 - RNA, 14 nt, Homo sapiens
uugcuggacuguca

SEQ ID NO: 1407777 - RNA, 14 nt, Homo sapiens
uuggaauacuugaa

SEQ ID NO: 1407778 - RNA, 19 nt, Homo sapiens
uuggaauacuugaaaaccu

SEQ ID NO: 1407779 - RNA, 21 nt, Homo sapiens
uuggacaaguccuugaccucu

SEQ ID NO: 1407780 - RNA, 15 nt, Homo sapiens
uuggagcuguuccau

SEQ ID NO: 1407781 - RNA, 16 nt, Homo sapiens
uuggcucacugcaacu

SEQ ID NO: 1407782 - RNA, 15 nt, Homo sapiens
uuggcucuacccuga

SEQ ID NO: 1407783 - RNA, 13 nt, Homo sapiens
uugguguucucau

SEQ ID NO: 1407784 - RNA, 23 nt, Homo sapiens
uugguuaaaggaaguuuguucac

SEQ ID NO: 1407785 - RNA, 20 nt, Homo sapiens
uuguaguuuuggcuaguccu

SEQ ID NO: 1407786 - RNA, 13 nt, Homo sapiens
uugucacugagac

SEQ ID NO: 1407787 - RNA, 13 nt, Homo sapiens
uugucuacacucu

SEQ ID NO: 1407788 - RNA, 16 nt, Homo sapiens
uugugauguguccuga

SEQ ID NO: 1407789 - RNA, 14 nt, Homo sapiens
uugugcccacuuca

SEQ ID NO: 1407790 - RNA, 22 nt, Homo sapiens
uuguguccauugaugucauuca

SEQ ID NO: 1407791 - RNA, 20 nt, Homo sapiens
uuguucuuuggaaauacaca

SEQ ID NO: 1407792 - RNA, 16 nt, Homo sapiens
uuguugacacggccau

SEQ ID NO: 1407793 - RNA, 23 nt, Homo sapiens
uuuaaagaaaaauaugauacucu

SEQ ID NO: 1407794 - RNA, 17 nt, Homo sapiens
uuuaauuuacugauucc

SEQ ID NO: 1407795 - RNA, 22 nt, Homo sapiens
uuuagauggcuguaaaucuauu

SEQ ID NO: 1407796 - RNA, 19 nt, Homo sapiens
uuucaaguaauaaaacaau

SEQ ID NO: 1407797 - RNA, 13 nt, Homo sapiens
uuucauacauuau

SEQ ID NO: 1407798 - RNA, 22 nt, Homo sapiens
uuucauacauuauauuccucua

SEQ ID NO: 1407799 - RNA, 12 nt, Homo sapiens
uuucaugcauuc

SEQ ID NO: 1407800 - RNA, 21 nt, Homo sapiens
uuuccacugccaaaacaaugc

SEQ ID NO: 1407801 - RNA, 15 nt, Homo sapiens
uuucccaacaccucu

SEQ ID NO: 1407802 - RNA, 22 nt, Homo sapiens
uuucuaaagcucugaacaaaag

SEQ ID NO: 1407803 - RNA, 23 nt, Homo sapiens
uuucuaaagcucugaacaaaagc

SEQ ID NO: 1407804 - RNA, 19 nt, Homo sapiens
uuucugaaauaacauggcc

SEQ ID NO: 1407805 - RNA, 18 nt, Homo sapiens
uuucuuccuuaaacuccu

SEQ ID NO: 1407806 - RNA, 20 nt, Homo sapiens
uuucuuccuuaaacuccugu

SEQ ID NO: 1407807 - RNA, 17 nt, Homo sapiens
uuucuuuuuuauacuca

SEQ ID NO: 1407808 - RNA, 23 nt, Homo sapiens
agaaucagcauuuagucuugcca

SEQ ID NO: 1407809 - RNA, 13 nt, Homo sapiens
agaaucuagccuc

SEQ ID NO: 1407810 - RNA, 14 nt, Homo sapiens
agaauuaguggcac

SEQ ID NO: 1407811 - RNA, 20 nt, Homo sapiens
agaauugccuuaaggccaca

SEQ ID NO: 1407812 - RNA, 23 nt, Homo sapiens
agaauugcuccugcaugcaacua

SEQ ID NO: 1407813 - RNA, 17 nt, Homo sapiens
aggcuagucucuucuca

SEQ ID NO: 1407814 - RNA, 15 nt, Homo sapiens
aggcuccugccugag

SEQ ID NO: 1407815 - RNA, 16 nt, Homo sapiens
aggcugaccaagagag

SEQ ID NO: 1407816 - RNA, 15 nt, Homo sapiens
aggcugcacagcuca

SEQ ID NO: 1407817 - RNA, 22 nt, Homo sapiens
cacacagauggucacacagaga

SEQ ID NO: 1407818 - RNA, 15 nt, Homo sapiens
cacacaucagugcac

SEQ ID NO: 1407819 - RNA, 15 nt, Homo sapiens
cacaccgaugcacac

SEQ ID NO: 1407820 - RNA, 19 nt, Homo sapiens
aagagaaaaaauauuuucc

SEQ ID NO: 1407821 - RNA, 21 nt, Homo sapiens
aagagguuuuaaaaaaauccc

SEQ ID NO: 1407822 - RNA, 17 nt, Homo sapiens
aagaugugcucccacca

SEQ ID NO: 1407823 - RNA, 12 nt, Homo sapiens
aagcacaugugu

SEQ ID NO: 1407824 - RNA, 19 nt, Homo sapiens
aagcaggacuaaaugucua

SEQ ID NO: 1407825 - RNA, 19 nt, Homo sapiens
aagcaucaaagcacuguuu

SEQ ID NO: 1407826 - RNA, 18 nt, Homo sapiens
acauggucaaaauuucac

SEQ ID NO: 1407827 - RNA, 17 nt, Homo sapiens
acauuaaaauagcacau

SEQ ID NO: 1407828 - RNA, 20 nt, Homo sapiens
acauuccucugcagcacuuc

SEQ ID NO: 1407829 - RNA, 20 nt, Homo sapiens
acauugaauuagaaacauaa

SEQ ID NO: 1407830 - RNA, 12 nt, Homo sapiens
acauuuguucca

SEQ ID NO: 1407831 - RNA, 15 nt, Homo sapiens
acauuuugcauuaga

SEQ ID NO: 1407832 - RNA, 23 nt, Homo sapiens
acauuuuguacaaagauaugcua

SEQ ID NO: 1407833 - RNA, 18 nt, Homo sapiens
accaaaugcuuuuccuca

SEQ ID NO: 1407834 - RNA, 21 nt, Homo sapiens
accaaauuagcaggugcaccu

SEQ ID NO: 1407835 - RNA, 23 nt, Homo sapiens
accaagccuuggcucuacccuga

SEQ ID NO: 1407836 - RNA, 22 nt, Homo sapiens
accacuuuccccgugggccaug

SEQ ID NO: 1407837 - RNA, 18 nt, Homo sapiens
accagaugggaugggcuu

SEQ ID NO: 1407838 - RNA, 17 nt, Homo sapiens
accagccucuccacuca

SEQ ID NO: 1407839 - RNA, 14 nt, Homo sapiens
accaguaauuguga

SEQ ID NO: 1407840 - RNA, 15 nt, Homo sapiens
accaguaauugugaa

SEQ ID NO: 1407841 - RNA, 21 nt, Homo sapiens
accaucuggaaggacaucuac

SEQ ID NO: 1407842 - RNA, 22 nt, Homo sapiens
accaugaagcuggaagcacugc

SEQ ID NO: 1407843 - RNA, 24 nt, Homo sapiens
accaugauuaaccacuucagcuga

SEQ ID NO: 1407844 - RNA, 14 nt, Homo sapiens
accauugucuucca

SEQ ID NO: 1407845 - RNA, 11 nt, Homo sapiens
acccaccauug

SEQ ID NO: 1407846 - RNA, 15 nt, Homo sapiens
acccaugccauagaa

SEQ ID NO: 1407847 - RNA, 11 nt, Homo sapiens
accccaucuca

SEQ ID NO: 1407848 - RNA, 15 nt, Homo sapiens
acccuaaauguggac

SEQ ID NO: 1407849 - RNA, 19 nt, Homo sapiens
acccucuuagaaaaaccac

SEQ ID NO: 1407850 - RNA, 13 nt, Homo sapiens
acccugaguucau

SEQ ID NO: 1407851 - RNA, 20 nt, Homo sapiens
acccugccaggcugcuaaag

SEQ ID NO: 1407852 - RNA, 14 nt, Homo sapiens
acccuuaggccagc

SEQ ID NO: 1407853 - RNA, 19 nt, Homo sapiens
accgaggcagggaaggauc

SEQ ID NO: 1407854 - RNA, 12 nt, Homo sapiens
accgaugcacac

SEQ ID NO: 1407855 - RNA, 23 nt, Homo sapiens
accgauuugcacccaugccauag

SEQ ID NO: 1407856 - RNA, 17 nt, Homo sapiens
accuacuuucauacuga

SEQ ID NO: 1407857 - RNA, 21 nt, Homo sapiens
accucauuuaccauaaaaauc

SEQ ID NO: 1407858 - RNA, 17 nt, Homo sapiens
accucuuggcugccuug

SEQ ID NO: 1407859 - RNA, 13 nt, Homo sapiens
accugaaagaagc

SEQ ID NO: 1407860 - RNA, 18 nt, Homo sapiens
accugaaccugggaacca

SEQ ID NO: 1407861 - RNA, 19 nt, Homo sapiens
accugaaccugggaaccau

SEQ ID NO: 1407862 - RNA, 13 nt, Homo sapiens
accugaagacacc

SEQ ID NO: 1407863 - RNA, 23 nt, Homo sapiens
accugugucuuauagguuuccac

SEQ ID NO: 1407864 - RNA, 17 nt, Homo sapiens
accuucagauccuaccc

SEQ ID NO: 1407865 - RNA, 19 nt, Homo sapiens
accuuuuuuaugaugcuau

SEQ ID NO: 1407866 - RNA, 13 nt, Homo sapiens
acgauuucagcua

SEQ ID NO: 1407867 - RNA, 17 nt, Homo sapiens
acgcacaugccaaugca

SEQ ID NO: 1407868 - RNA, 11 nt, Homo sapiens
acgccaaugca

SEQ ID NO: 1407869 - RNA, 21 nt, Homo sapiens
acgccaaugcacacacacaga

SEQ ID NO: 1407870 - RNA, 23 nt, Homo sapiens
acgccaaugcacacacacagaga

SEQ ID NO: 1407871 - RNA, 14 nt, Homo sapiens
acggaaaaugccaa

SEQ ID NO: 1407872 - RNA, 16 nt, Homo sapiens
acggaagaggcugcug

SEQ ID NO: 1407873 - RNA, 12 nt, Homo sapiens
acggcacugugg

SEQ ID NO: 1407874 - RNA, 17 nt, Homo sapiens
acggcugccccuuccac

SEQ ID NO: 1407875 - RNA, 18 nt, Homo sapiens
acgucauguguuuugcca

SEQ ID NO: 1407876 - RNA, 12 nt, Homo sapiens
acgucauucagu

SEQ ID NO: 1407877 - RNA, 13 nt, Homo sapiens
acguuguuaaaug

SEQ ID NO: 1407878 - RNA, 17 nt, Homo sapiens
acguuugacuagccauc

SEQ ID NO: 1407879 - RNA, 20 nt, Homo sapiens
acguuugacuagccaucuca

SEQ ID NO: 1407880 - RNA, 12 nt, Homo sapiens
acuaaccuggua

SEQ ID NO: 1407881 - RNA, 15 nt, Homo sapiens
acuaauagagacaca

SEQ ID NO: 1407882 - RNA, 18 nt, Homo sapiens
acuaccaaaugagcauua

SEQ ID NO: 1407883 - RNA, 13 nt, Homo sapiens
acuacuacucugc

SEQ ID NO: 1407884 - RNA, 20 nt, Homo sapiens
acuagccaucucaagcaagu

SEQ ID NO: 1407885 - RNA, 15 nt, Homo sapiens
acuaguaccuucaga

SEQ ID NO: 1407886 - RNA, 19 nt, Homo sapiens
acuaugggcccgagcucau

SEQ ID NO: 1407887 - RNA, 15 nt, Homo sapiens
acuauuauuugcuau

SEQ ID NO: 1407888 - RNA, 17 nt, Homo sapiens
acuauuuaugaaggcaa

SEQ ID NO: 1407889 - RNA, 18 nt, Homo sapiens
acucagucuuuaaucuga

SEQ ID NO: 1407890 - RNA, 20 nt, Homo sapiens
acucaugugacucuuuccaa

SEQ ID NO: 1407891 - RNA, 16 nt, Homo sapiens
acuccugaccucguga

SEQ ID NO: 1407892 - RNA, 20 nt, Homo sapiens
acuccuguucuuugggcuca

SEQ ID NO: 1407893 - RNA, 20 nt, Homo sapiens
acucucagcagcuaugguag

SEQ ID NO: 1407894 - RNA, 17 nt, Homo sapiens
acucugaggacauggag

SEQ ID NO: 1407895 - RNA, 17 nt, Homo sapiens
acucugcuucaguccac

SEQ ID NO: 1407896 - RNA, 16 nt, Homo sapiens
acucuuuaagaccuca

SEQ ID NO: 1407897 - RNA, 22 nt, Homo sapiens
acugcaucguuucaucuuccaa

SEQ ID NO: 1407898 - RNA, 21 nt, Homo sapiens
acugccccaaggaccuuacag

SEQ ID NO: 1407899 - RNA, 16 nt, Homo sapiens
acugcugggcuuggca

SEQ ID NO: 1407900 - RNA, 13 nt, Homo sapiens
acugcuguagaca

SEQ ID NO: 1407901 - RNA, 18 nt, Homo sapiens
acugggcucacauuccca

SEQ ID NO: 1407902 - RNA, 14 nt, Homo sapiens
acugggcucugagg

SEQ ID NO: 1407903 - RNA, 22 nt, Homo sapiens
acugugaagagaaccauaucaa

SEQ ID NO: 1407904 - RNA, 21 nt, Homo sapiens
acuuaucaccacaccacugcc

SEQ ID NO: 1407905 - RNA, 13 nt, Homo sapiens
acuuccaagugau

SEQ ID NO: 1407906 - RNA, 14 nt, Homo sapiens
acuucccacggcuc

SEQ ID NO: 1407907 - RNA, 16 nt, Homo sapiens
acuuccgucacccuug

SEQ ID NO: 1407908 - RNA, 23 nt, Homo sapiens
acuuccucagucuggugcuccag

SEQ ID NO: 1407909 - RNA, 13 nt, Homo sapiens
acuuccugcagua

SEQ ID NO: 1407910 - RNA, 15 nt, Homo sapiens
acuucuaccaggacg

SEQ ID NO: 1407911 - RNA, 15 nt, Homo sapiens
acuuggcaucauuca

SEQ ID NO: 1407912 - RNA, 20 nt, Homo sapiens
acuugggccacugugaagag

SEQ ID NO: 1407913 - RNA, 14 nt, Homo sapiens
acuugucccgggac

SEQ ID NO: 1407914 - RNA, 23 nt, Homo sapiens
acuugucccgggacaccuaggcu

SEQ ID NO: 1407915 - RNA, 22 nt, Homo sapiens
acuuguguauauuuuaaugaau

SEQ ID NO: 1407916 - RNA, 22 nt, Homo sapiens
acuuuccccgugggccauggca

SEQ ID NO: 1407917 - RNA, 16 nt, Homo sapiens
acuuuguccgguggaa

SEQ ID NO: 1407918 - RNA, 11 nt, Homo sapiens
agaaaaaccac

SEQ ID NO: 1407919 - RNA, 16 nt, Homo sapiens
agaaaagcaguggcuc

SEQ ID NO: 1407920 - RNA, 21 nt, Homo sapiens
agaaacaccacccauuucuac

SEQ ID NO: 1407921 - RNA, 17 nt, Homo sapiens
agaaacaggcucugaga

SEQ ID NO: 1407922 - RNA, 19 nt, Homo sapiens
agaaacugaggccauuauu

SEQ ID NO: 1407923 - RNA, 17 nt, Homo sapiens
agaaacuguuacugucc

SEQ ID NO: 1407924 - RNA, 22 nt, Homo sapiens
agaaagacuuaucaacauuugu

SEQ ID NO: 1407925 - RNA, 17 nt, Homo sapiens
agaacugccccaucucc

SEQ ID NO: 1407926 - RNA, 17 nt, Homo sapiens
agaagaacauccaagga

SEQ ID NO: 1407927 - RNA, 14 nt, Homo sapiens
agaagguugcucua

SEQ ID NO: 1407928 - RNA, 23 nt, Homo sapiens
agaagucugucugucugaugaug

SEQ ID NO: 1407929 - RNA, 15 nt, Homo sapiens
ccuccaaacacuggg

SEQ ID NO: 1407930 - RNA, 13 nt, Homo sapiens
ccucuauaaacuu

SEQ ID NO: 1407931 - RNA, 14 nt, Homo sapiens
ccucugaaaaccaa

SEQ ID NO: 1407932 - RNA, 18 nt, Homo sapiens
ucgcaccauugcacucca

SEQ ID NO: 1407933 - RNA, 19 nt, Homo sapiens
ucuacaaacucccacuugu

SEQ ID NO: 1407934 - RNA, 21 nt, Homo sapiens
ucuacaaacucccacuuguca

SEQ ID NO: 1407935 - RNA, 16 nt, Homo sapiens
ucuacaaaugucuuca

SEQ ID NO: 1407936 - RNA, 13 nt, Homo sapiens
ucuacacauauau

SEQ ID NO: 1407937 - RNA, 21 nt, Homo sapiens
ucuaccuuuuuuucucuccua

SEQ ID NO: 1407938 - RNA, 16 nt, Homo sapiens
ucuacuccaugcacau

SEQ ID NO: 1407939 - RNA, 18 nt, Homo sapiens
ucuaggcaucccagggga

SEQ ID NO: 1407940 - RNA, 19 nt, Homo sapiens
ucuauggguuggacaaccu

SEQ ID NO: 1407941 - RNA, 13 nt, Homo sapiens
ucucaagcaaguu

SEQ ID NO: 1407942 - RNA, 17 nt, Homo sapiens
ucucacuaaaauggaua

SEQ ID NO: 1407943 - RNA, 18 nt, Homo sapiens
ucuccacucaugugacuc

SEQ ID NO: 1407944 - RNA, 13 nt, Homo sapiens
ucucuaugaucuu

SEQ ID NO: 1407945 - RNA, 13 nt, Homo sapiens
ucucucaugacca

SEQ ID NO: 1407946 - RNA, 13 nt, Homo sapiens
ucucucuucucca

SEQ ID NO: 1407947 - RNA, 15 nt, Homo sapiens
ucucugagcuccagu

SEQ ID NO: 1407948 - RNA, 18 nt, Homo sapiens
ucucugcccucuucucau

SEQ ID NO: 1407949 - RNA, 21 nt, Homo sapiens
ucugaagaguaaggaguagua

SEQ ID NO: 1407950 - RNA, 15 nt, Homo sapiens
ucugaggaguggagu

SEQ ID NO: 1407951 - RNA, 23 nt, Homo sapiens
ucugcagggggugugucugcuca

SEQ ID NO: 1407952 - RNA, 16 nt, Homo sapiens
ucugcagguacuuccu

SEQ ID NO: 1407953 - RNA, 17 nt, Homo sapiens
ucuggaagaccugaaag

SEQ ID NO: 1407954 - RNA, 21 nt, Homo sapiens
ucugucaaagaaaacuuccaa

SEQ ID NO: 1407955 - RNA, 21 nt, Homo sapiens
ucugugaggggcucucucaug

SEQ ID NO: 1407956 - RNA, 19 nt, Homo sapiens
ucuguguguguguaugugg

SEQ ID NO: 1407957 - RNA, 23 nt, Homo sapiens
ucuguguguguguaugugggggu

SEQ ID NO: 1407958 - RNA, 20 nt, Homo sapiens
ucuguuaauagucaucacau

SEQ ID NO: 1407959 - RNA, 19 nt, Homo sapiens
ucuuaaguugaucuaauga

SEQ ID NO: 1407960 - RNA, 18 nt, Homo sapiens
ucuuaauguacacauugc

SEQ ID NO: 1407961 - RNA, 18 nt, Homo sapiens
ucuuauucaugcuuucuc

SEQ ID NO: 1407962 - RNA, 19 nt, Homo sapiens
ucuuauuuguaaagcucac

SEQ ID NO: 1407963 - RNA, 18 nt, Homo sapiens
ucuucaugaccuacuuca

SEQ ID NO: 1407964 - RNA, 13 nt, Homo sapiens
ucuuccccagaua

SEQ ID NO: 1407965 - RNA, 16 nt, Homo sapiens
ucuuccuaguauauua

SEQ ID NO: 1407966 - RNA, 23 nt, Homo sapiens
ucuucuauauuccgggugccauu

SEQ ID NO: 1407967 - RNA, 17 nt, Homo sapiens
ucuucucuguuacaaaa

SEQ ID NO: 1407968 - RNA, 17 nt, Homo sapiens
ucuucuuauucaugcuu

SEQ ID NO: 1407969 - RNA, 14 nt, Homo sapiens
ucuugcccaaaguc

SEQ ID NO: 1407970 - RNA, 21 nt, Homo sapiens
ucuugcucuaaugaucaaaac

SEQ ID NO: 1407971 - RNA, 19 nt, Homo sapiens
ucuuguguuuuugucuuau

SEQ ID NO: 1407972 - RNA, 13 nt, Homo sapiens
ucuuucccaacac

SEQ ID NO: 1407973 - RNA, 11 nt, Homo sapiens
ucuuuugcucu

SEQ ID NO: 1407974 - RNA, 13 nt, Homo sapiens
ugaaaaaaguaua

SEQ ID NO: 1407975 - RNA, 17 nt, Homo sapiens
ugaaaccgcauuuuggg

SEQ ID NO: 1407976 - RNA, 19 nt, Homo sapiens
ugaaauaacauggccuugg

SEQ ID NO: 1407977 - RNA, 12 nt, Homo sapiens
ugaaauacucuu

SEQ ID NO: 1407978 - RNA, 13 nt, Homo sapiens
ugaaaugcuucca

SEQ ID NO: 1407979 - RNA, 17 nt, Homo sapiens
ugaacacacauggaugc

SEQ ID NO: 1407980 - RNA, 17 nt, Homo sapiens
ugaaggagaaaaugcau

SEQ ID NO: 1407981 - RNA, 19 nt, Homo sapiens
ugaagguggaacaagcaca

SEQ ID NO: 1407982 - RNA, 14 nt, Homo sapiens
ugaauaacugagcu

SEQ ID NO: 1407983 - RNA, 13 nt, Homo sapiens
ugaauaauacagu

SEQ ID NO: 1407984 - RNA, 19 nt, Homo sapiens
ugaauguguugauuugaga

SEQ ID NO: 1407985 - RNA, 23 nt, Homo sapiens
ugacaacauuuuuguacauuaug

SEQ ID NO: 1407986 - RNA, 14 nt, Homo sapiens
ugacacggccauga

SEQ ID NO: 1407987 - RNA, 21 nt, Homo sapiens
ugacccucaucuuucuuccaa

SEQ ID NO: 1407988 - RNA, 19 nt, Homo sapiens
ugacggcaccaucuggaag

SEQ ID NO: 1407989 - RNA, 15 nt, Homo sapiens
ugagacccuguucua

SEQ ID NO: 1407990 - RNA, 15 nt, Homo sapiens
ugagauuucacaggu

SEQ ID NO: 1407991 - RNA, 18 nt, Homo sapiens
ugagcaacuccuguucuu

SEQ ID NO: 1407992 - RNA, 23 nt, Homo sapiens
ugagcagguguucuucauuaccu

SEQ ID NO: 1407993 - RNA, 16 nt, Homo sapiens
ugagcuccaguggaag

SEQ ID NO: 1407994 - RNA, 17 nt, Homo sapiens
ugagcuggggaugucuc

SEQ ID NO: 1407995 - RNA, 18 nt, Homo sapiens
ugaggggcucucucauga

SEQ ID NO: 1407996 - RNA, 20 nt, Homo sapiens
ugagggugacuauggagcug

SEQ ID NO: 1407997 - RNA, 22 nt, Homo sapiens
ugaguacaucaccuaacagaau

SEQ ID NO: 1407998 - RNA, 22 nt, Homo sapiens
ugauaaaagauuuuccuauucc

SEQ ID NO: 1407999 - RNA, 16 nt, Homo sapiens
ugaucuuggcacaaau

SEQ ID NO: 1408000 - RNA, 11 nt, Homo sapiens
ugauguugcug

SEQ ID NO: 1408001 - RNA, 22 nt, Homo sapiens
ugcaaaccuuuuuuaugaugcu

SEQ ID NO: 1408002 - RNA, 17 nt, Homo sapiens
ugcacacacacagagau

SEQ ID NO: 1408003 - RNA, 22 nt, Homo sapiens
ugcacacacacagagauaugca

SEQ ID NO: 1408004 - RNA, 23 nt, Homo sapiens
ugcacacacacagagauaugcac

SEQ ID NO: 1408005 - RNA, 18 nt, Homo sapiens
ugcacagagauaugcaca

SEQ ID NO: 1408006 - RNA, 19 nt, Homo sapiens
ugcacagagauaugcacac

SEQ ID NO: 1408007 - RNA, 19 nt, Homo sapiens
ugcacauuuuguacaaaga

SEQ ID NO: 1408008 - RNA, 15 nt, Homo sapiens
ugcaccacccuuuga

SEQ ID NO: 1408009 - RNA, 16 nt, Homo sapiens
ugcacuccagccuggg

SEQ ID NO: 1408010 - RNA, 13 nt, Homo sapiens
ugcagaacagggg

SEQ ID NO: 1408011 - RNA, 21 nt, Homo sapiens
ugcagaagccccaacugugau

SEQ ID NO: 1408012 - RNA, 13 nt, Homo sapiens
ugcagcagagccu

SEQ ID NO: 1408013 - RNA, 13 nt, Homo sapiens
ugcagcucaggag

SEQ ID NO: 1408014 - RNA, 16 nt, Homo sapiens
ugcaggaccucaggug

SEQ ID NO: 1408015 - RNA, 21 nt, Homo sapiens
ugcaggagucccugccaucau

SEQ ID NO: 1408016 - RNA, 21 nt, Homo sapiens
ugcagggggugugucugcuca

SEQ ID NO: 1408017 - RNA, 21 nt, Homo sapiens
ugcaugacaaacacacaucca

SEQ ID NO: 1408018 - RNA, 21 nt, Homo sapiens
ugccacagaugauacuuccaa

SEQ ID NO: 1408019 - RNA, 16 nt, Homo sapiens
ugccagcuuaucucag

SEQ ID NO: 1408020 - RNA, 15 nt, Homo sapiens
ugccaugccagcuua

SEQ ID NO: 1408021 - RNA, 14 nt, Homo sapiens
ugccauuacauugc

SEQ ID NO: 1408022 - RNA, 18 nt, Homo sapiens
ugccccggcuugccugua

SEQ ID NO: 1408023 - RNA, 18 nt, Homo sapiens
ugcccugugcaugccaug

SEQ ID NO: 1408024 - RNA, 15 nt, Homo sapiens
ugccuaguaacacau

SEQ ID NO: 1408025 - RNA, 19 nt, Homo sapiens
ugccuaguaacacauaugu

SEQ ID NO: 1408026 - RNA, 16 nt, Homo sapiens
ugccucagcuucccaa

SEQ ID NO: 1408027 - RNA, 22 nt, Homo sapiens
ugccucauuucuuccucugcau

SEQ ID NO: 1408028 - RNA, 15 nt, Homo sapiens
ugccuuccuguuuaa

SEQ ID NO: 1408029 - RNA, 16 nt, Homo sapiens
ugccuuggugugcugu

SEQ ID NO: 1408030 - RNA, 17 nt, Homo sapiens
ugccuuuggacuugucc

SEQ ID NO: 1408031 - RNA, 19 nt, Homo sapiens
ugcgcacacacagauaugc

SEQ ID NO: 1408032 - RNA, 20 nt, Homo sapiens
ugcgcggaagugaccacaga

SEQ ID NO: 1408033 - RNA, 20 nt, Homo sapiens
ugcuaaucuucuuaugcaau

SEQ ID NO: 1408034 - RNA, 17 nt, Homo sapiens
ugcuaggauuacaggca

SEQ ID NO: 1408035 - RNA, 19 nt, Homo sapiens
ugcuauuguagagccagag

SEQ ID NO: 1408036 - RNA, 14 nt, Homo sapiens
ugcucccacagaac

SEQ ID NO: 1408037 - RNA, 19 nt, Homo sapiens
ugcucuggaagaccugaaa

SEQ ID NO: 1408038 - RNA, 20 nt, Homo sapiens
ugcuguagacauuugcuaug

SEQ ID NO: 1408039 - RNA, 16 nt, Homo sapiens
uggaacaagcacagau

SEQ ID NO: 1408040 - RNA, 17 nt, Homo sapiens
uggaacaagcacagaug

SEQ ID NO: 1408041 - RNA, 16 nt, Homo sapiens
uggaagagcacaagag

SEQ ID NO: 1408042 - RNA, 17 nt, Homo sapiens
uggaccagccucuccac

SEQ ID NO: 1408043 - RNA, 19 nt, Homo sapiens
uggagaaagggaaguggaa

SEQ ID NO: 1408044 - RNA, 13 nt, Homo sapiens
uggagugucacau

SEQ ID NO: 1408045 - RNA, 21 nt, Homo sapiens
uggauacagaaugaaucccau

SEQ ID NO: 1408046 - RNA, 12 nt, Homo sapiens
uggaucugugag

SEQ ID NO: 1408047 - RNA, 21 nt, Homo sapiens
uggauguugcuuuugcaccua

SEQ ID NO: 1408048 - RNA, 17 nt, Homo sapiens
uggcagcaaagugucag

SEQ ID NO: 1408049 - RNA, 14 nt, Homo sapiens
uggcucagccucaa

SEQ ID NO: 1408050 - RNA, 20 nt, Homo sapiens
uggcucugcaugacaaacac

SEQ ID NO: 1408051 - RNA, 14 nt, Homo sapiens
ugggaaaaccagac

SEQ ID NO: 1408052 - RNA, 17 nt, Homo sapiens
ugggagaaugucaguau

SEQ ID NO: 1408053 - RNA, 16 nt, Homo sapiens
ugggcaugccauuaca

SEQ ID NO: 1408054 - RNA, 14 nt, Homo sapiens
ugggccacugugaa

SEQ ID NO: 1408055 - RNA, 18 nt, Homo sapiens
uggggaugucucucauga

SEQ ID NO: 1408056 - RNA, 11 nt, Homo sapiens
uggggccacau

SEQ ID NO: 1408057 - RNA, 21 nt, Homo sapiens
ugggggccuuguggcacucca

SEQ ID NO: 1408058 - RNA, 20 nt, Homo sapiens
ugggugaauaauacaguauc

SEQ ID NO: 1408059 - RNA, 20 nt, Homo sapiens
ugggugccgggcugcacaga

SEQ ID NO: 1408060 - RNA, 22 nt, Homo sapiens
ugguacugcacauuuuguacaa

SEQ ID NO: 1408061 - RNA, 13 nt, Homo sapiens
uggucuugaucuc

SEQ ID NO: 1408062 - RNA, 20 nt, Homo sapiens
uggucuuguggaauugggag

SEQ ID NO: 1408063 - RNA, 14 nt, Homo sapiens
ugguuuuugagcca

SEQ ID NO: 1408064 - RNA, 23 nt, Homo sapiens
uguaaauauuuauuuauguguuc

SEQ ID NO: 1408065 - RNA, 15 nt, Homo sapiens
uguaaucccagcuau

SEQ ID NO: 1408066 - RNA, 16 nt, Homo sapiens
uguacaaauccacgaa

SEQ ID NO: 1408067 - RNA, 21 nt, Homo sapiens
uguacacacacagaugcacac

SEQ ID NO: 1408068 - RNA, 23 nt, Homo sapiens
uguacacacacagaugcacacac

SEQ ID NO: 1408069 - RNA, 17 nt, Homo sapiens
uguacauuugagugucu

SEQ ID NO: 1408070 - RNA, 21 nt, Homo sapiens
uguagcagcauuacagaaaua

SEQ ID NO: 1408071 - RNA, 15 nt, Homo sapiens
uguagcuuugcucuu

SEQ ID NO: 1408072 - RNA, 13 nt, Homo sapiens
uguauaauggugu

SEQ ID NO: 1408073 - RNA, 19 nt, Homo sapiens
uguaucacucacugccaaa

SEQ ID NO: 1408074 - RNA, 14 nt, Homo sapiens
uguauccauccaug

SEQ ID NO: 1408075 - RNA, 11 nt, Homo sapiens
uguaugugaca

SEQ ID NO: 1408076 - RNA, 14 nt, Homo sapiens
ugucacaccugaaa

SEQ ID NO: 1408077 - RNA, 22 nt, Homo sapiens
uguccagaccauugucuuccaa

SEQ ID NO: 1408078 - RNA, 12 nt, Homo sapiens
ugucccaaagaa

SEQ ID NO: 1408079 - RNA, 21 nt, Homo sapiens
ugucccagaaugccuccugca

SEQ ID NO: 1408080 - RNA, 16 nt, Homo sapiens
ugucccgggacaccua

SEQ ID NO: 1408081 - RNA, 15 nt, Homo sapiens
ugucccucauccaua

SEQ ID NO: 1408082 - RNA, 22 nt, Homo sapiens
ugucccucauccauagcaccuc

SEQ ID NO: 1408083 - RNA, 16 nt, Homo sapiens
ugucguaggaaaacca

SEQ ID NO: 1408084 - RNA, 12 nt, Homo sapiens
ugucucucauga

SEQ ID NO: 1408085 - RNA, 15 nt, Homo sapiens
ugucuggugguggca

SEQ ID NO: 1408086 - RNA, 14 nt, Homo sapiens
ugucugucccaaag

SEQ ID NO: 1408087 - RNA, 22 nt, Homo sapiens
ugucuuauagguuuccacugcc

SEQ ID NO: 1408088 - RNA, 19 nt, Homo sapiens
ugucuuccaaccccagcug

SEQ ID NO: 1408089 - RNA, 19 nt, Homo sapiens
ugugaaauaccaaccugaa

SEQ ID NO: 1408090 - RNA, 23 nt, Homo sapiens
ugugaaugaugauccuaggcauu

SEQ ID NO: 1408091 - RNA, 13 nt, Homo sapiens
ugugauaaaaccc

SEQ ID NO: 1408092 - RNA, 18 nt, Homo sapiens
ugugccuuggugugcugu

SEQ ID NO: 1408093 - RNA, 13 nt, Homo sapiens
ugugcgcacacac

SEQ ID NO: 1408094 - RNA, 15 nt, Homo sapiens
ugugcucucggcuuc

SEQ ID NO: 1408095 - RNA, 18 nt, Homo sapiens
uguggaugauaaaacaca

SEQ ID NO: 1408096 - RNA, 16 nt, Homo sapiens
uguggccuuggucuaa

SEQ ID NO: 1408097 - RNA, 12 nt, Homo sapiens
ugugucagcaua

SEQ ID NO: 1408098 - RNA, 18 nt, Homo sapiens
uguuauuuuuuauuucca

SEQ ID NO: 1408099 - RNA, 21 nt, Homo sapiens
uguucuguccaguuuccaaag

SEQ ID NO: 1408100 - RNA, 15 nt, Homo sapiens
uguucuuagcugaac

SEQ ID NO: 1408101 - RNA, 15 nt, Homo sapiens
uguugacacggccau

SEQ ID NO: 1408102 - RNA, 18 nt, Homo sapiens
uguugccuggaagcacau

SEQ ID NO: 1408103 - RNA, 21 nt, Homo sapiens
uguugcuggacugucauagaa

SEQ ID NO: 1408104 - RNA, 16 nt, Homo sapiens
uuaaaggcuuuuggca

SEQ ID NO: 1408105 - RNA, 17 nt, Homo sapiens
uuaaauauauaauguug

SEQ ID NO: 1408106 - RNA, 15 nt, Homo sapiens
uuaaaucagccuucc

SEQ ID NO: 1408107 - RNA, 21 nt, Homo sapiens
uuaaccugaauuauuccaacu

SEQ ID NO: 1408108 - RNA, 20 nt, Homo sapiens
uuaauauuguuguuuaccaa

SEQ ID NO: 1408109 - RNA, 17 nt, Homo sapiens
uuacaaauuguuuuuac

SEQ ID NO: 1408110 - RNA, 16 nt, Homo sapiens
uuaccgugggcacuga

SEQ ID NO: 1408111 - RNA, 22 nt, Homo sapiens
uuaccugauuugaugauacauu

SEQ ID NO: 1408112 - RNA, 21 nt, Homo sapiens
uuacuguauauaaacuccuua

SEQ ID NO: 1408113 - RNA, 19 nt, Homo sapiens
uuagaaaaaccaccaccau

SEQ ID NO: 1408114 - RNA, 16 nt, Homo sapiens
uuagacccgguccugc

SEQ ID NO: 1408115 - RNA, 16 nt, Homo sapiens
uuagagcugccugugc

SEQ ID NO: 1408116 - RNA, 20 nt, Homo sapiens
uuagagcugccugugccuuu

SEQ ID NO: 1408117 - RNA, 22 nt, Homo sapiens
uuagaguugcucuacaaugaca

SEQ ID NO: 1408118 - RNA, 14 nt, Homo sapiens
uuagcuaccugcua

SEQ ID NO: 1408119 - RNA, 16 nt, Homo sapiens
uuagcugaacaaugaa

SEQ ID NO: 1408120 - RNA, 14 nt, Homo sapiens
uuauccuguucucu

SEQ ID NO: 1408121 - RNA, 20 nt, Homo sapiens
uuaugacuccccccuuccaa

SEQ ID NO: 1408122 - RNA, 19 nt, Homo sapiens
uucaaacugcaugauucau

SEQ ID NO: 1408123 - RNA, 20 nt, Homo sapiens
uucaauaaagcugcugagaa

SEQ ID NO: 1408124 - RNA, 18 nt, Homo sapiens
uucacacaguaaagcagg

SEQ ID NO: 1408125 - RNA, 15 nt, Homo sapiens
uucaccagauuugcu

SEQ ID NO: 1408126 - RNA, 18 nt, Homo sapiens
uucacuguagaaugauuu

SEQ ID NO: 1408127 - RNA, 20 nt, Homo sapiens
uucacuguagaaugauuuca

SEQ ID NO: 1408128 - RNA, 19 nt, Homo sapiens
uucacuuauccuguucucu

SEQ ID NO: 1408129 - RNA, 14 nt, Homo sapiens
uucagauuugccuu

SEQ ID NO: 1408130 - RNA, 17 nt, Homo sapiens
uucaguccacaguacau

SEQ ID NO: 1408131 - RNA, 14 nt, Homo sapiens
uucaugaaaauccu

SEQ ID NO: 1408132 - RNA, 11 nt, Homo sapiens
uucaugaacac

SEQ ID NO: 1408133 - RNA, 21 nt, Homo sapiens
uucaugaacacagccugggac

SEQ ID NO: 1408134 - RNA, 17 nt, Homo sapiens
uuccacuuguguauauu

SEQ ID NO: 1408135 - RNA, 14 nt, Homo sapiens
uuccaguacuuccu

SEQ ID NO: 1408136 - RNA, 16 nt, Homo sapiens
uuccccgugggccaug

SEQ ID NO: 1408137 - RNA, 13 nt, Homo sapiens
uuccucacucaga

SEQ ID NO: 1408138 - RNA, 18 nt, Homo sapiens
uuccucauuagcauuuug

SEQ ID NO: 1408139 - RNA, 18 nt, Homo sapiens
uuccuuugaagaggaaaa

SEQ ID NO: 1408140 - RNA, 11 nt, Homo sapiens
uucuaggcauc

SEQ ID NO: 1408141 - RNA, 15 nt, Homo sapiens
uucuaggcaucccag

SEQ ID NO: 1408142 - RNA, 19 nt, Homo sapiens
uucuaguucugccaggaga

SEQ ID NO: 1408143 - RNA, 15 nt, Homo sapiens
uucuccuguugcaau

SEQ ID NO: 1408144 - RNA, 22 nt, Homo sapiens
uucuccuguugcaaugacacau

SEQ ID NO: 1408145 - RNA, 15 nt, Homo sapiens
uucucucuucuccac

SEQ ID NO: 1408146 - RNA, 13 nt, Homo sapiens
aaaaacauggccu

SEQ ID NO: 1408147 - RNA, 13 nt, Homo sapiens
aaaaaggacucug

SEQ ID NO: 1408148 - RNA, 21 nt, Homo sapiens
aaaaauagccugccucuucuc

SEQ ID NO: 1408149 - RNA, 24 nt, Homo sapiens
aaaaccaauguucucucuucucca

SEQ ID NO: 1408150 - RNA, 17 nt, Homo sapiens
aaaaccagcgugugacu

SEQ ID NO: 1408151 - RNA, 19 nt, Homo sapiens
aaaaccucauuuaccauaa

SEQ ID NO: 1408152 - RNA, 23 nt, Homo sapiens
aaaagaugcuucucacugccaug

SEQ ID NO: 1408153 - RNA, 15 nt, Homo sapiens
aaaagauuauauauc

SEQ ID NO: 1408154 - RNA, 13 nt, Homo sapiens
aaaagcugggcag

SEQ ID NO: 1408155 - RNA, 22 nt, Homo sapiens
aaaaggacucugcuucagucca

SEQ ID NO: 1408156 - RNA, 14 nt, Homo sapiens
aaaauagcacauga

SEQ ID NO: 1408157 - RNA, 19 nt, Homo sapiens
aaaaugaauaauacauuga

SEQ ID NO: 1408158 - RNA, 16 nt, Homo sapiens
aaaaugauggaaugac

SEQ ID NO: 1408159 - RNA, 14 nt, Homo sapiens
aaaauguacucagc

SEQ ID NO: 1408160 - RNA, 16 nt, Homo sapiens
aaacugucacaaguug

SEQ ID NO: 1408161 - RNA, 20 nt, Homo sapiens
aaacuuuucuaauacucuac

SEQ ID NO: 1408162 - RNA, 19 nt, Homo sapiens
aaagaacugccccaucucc

SEQ ID NO: 1408163 - RNA, 15 nt, Homo sapiens
aaagcaccuuagcug

SEQ ID NO: 1408164 - RNA, 16 nt, Homo sapiens
aaagccucgggccaca

SEQ ID NO: 1408165 - RNA, 21 nt, Homo sapiens
aaagccucgggccacaugggu

SEQ ID NO: 1408166 - RNA, 21 nt, Homo sapiens
aaaggcuagguacacagcucu

SEQ ID NO: 1408167 - RNA, 22 nt, Homo sapiens
aaauacacagugcugaccagac

SEQ ID NO: 1408168 - RNA, 15 nt, Homo sapiens
aaaucaguuauguca

SEQ ID NO: 1408169 - RNA, 19 nt, Homo sapiens
aaauccuaccaaccucuga

SEQ ID NO: 1408170 - RNA, 21 nt, Homo sapiens
aaaugaugucaugucagcucc

SEQ ID NO: 1408171 - RNA, 12 nt, Homo sapiens
aaaugccuuagu

SEQ ID NO: 1408172 - RNA, 15 nt, Homo sapiens
aaaugcuuuuccuca

SEQ ID NO: 1408173 - RNA, 21 nt, Homo sapiens
aaauucuguuuuucuaggccu

SEQ ID NO: 1408174 - RNA, 15 nt, Homo sapiens
aaauuguacauuuga

SEQ ID NO: 1408175 - RNA, 14 nt, Homo sapiens
aaauuucaccacug

SEQ ID NO: 1408176 - RNA, 18 nt, Homo sapiens
aaauuuuacugacagaaa

SEQ ID NO: 1408177 - RNA, 13 nt, Homo sapiens
aacaacucuaguc

SEQ ID NO: 1408178 - RNA, 20 nt, Homo sapiens
aacacaguguuuccugagua

SEQ ID NO: 1408179 - RNA, 13 nt, Homo sapiens
aacaccuccucaa

SEQ ID NO: 1408180 - RNA, 14 nt, Homo sapiens
aacacgcugaaggg

SEQ ID NO: 1408181 - RNA, 22 nt, Homo sapiens
aacagaggggcagccaggacau

SEQ ID NO: 1408182 - RNA, 22 nt, Homo sapiens
aacagauaaucccuguauuuca

SEQ ID NO: 1408183 - RNA, 21 nt, Homo sapiens
aacagauuaguaguuacaugg

SEQ ID NO: 1408184 - RNA, 23 nt, Homo sapiens
aacauggccuuggagggcaugaa

SEQ ID NO: 1408185 - RNA, 16 nt, Homo sapiens
aacauggccuuugcuu

SEQ ID NO: 1408186 - RNA, 18 nt, Homo sapiens
aacauucauagcuggucu

SEQ ID NO: 1408187 - RNA, 22 nt, Homo sapiens
aaccacuucagcugacuuuucu

SEQ ID NO: 1408188 - RNA, 16 nt, Homo sapiens
aaccccaucucuacaa

SEQ ID NO: 1408189 - RNA, 13 nt, Homo sapiens
aaccgacuuuucu

SEQ ID NO: 1408190 - RNA, 20 nt, Homo sapiens
gcagaagccccaacugugau

SEQ ID NO: 1408191 - RNA, 22 nt, Homo sapiens
gcagacgugagugugacuuuuu

SEQ ID NO: 1408192 - RNA, 13 nt, Homo sapiens
gcagcucuacucu

SEQ ID NO: 1408193 - RNA, 18 nt, Homo sapiens
gcaggagaaucacuggaa

SEQ ID NO: 1408194 - RNA, 20 nt, Homo sapiens
gcagggaaggaucccaugag

SEQ ID NO: 1408195 - RNA, 20 nt, Homo sapiens
gcagggggugugucugcuca

SEQ ID NO: 1408196 - RNA, 23 nt, Homo sapiens
gcagguuggugggggccucggug

SEQ ID NO: 1408197 - RNA, 14 nt, Homo sapiens
gcaguggcgugauc

SEQ ID NO: 1408198 - RNA, 17 nt, Homo sapiens
gcaucucccaguucaua

SEQ ID NO: 1408199 - RNA, 16 nt, Homo sapiens
gcauuuagucuugcca

SEQ ID NO: 1408200 - RNA, 18 nt, Homo sapiens
gcauuuagucuugccagg

SEQ ID NO: 1408201 - RNA, 14 nt, Homo sapiens
gccaauuagcaauu

SEQ ID NO: 1408202 - RNA, 18 nt, Homo sapiens
gccagacuucccacggcu

SEQ ID NO: 1408203 - RNA, 14 nt, Homo sapiens
gccaucucaagcaa

SEQ ID NO: 1408204 - RNA, 16 nt, Homo sapiens
gcccaagagaugaaga

SEQ ID NO: 1408205 - RNA, 16 nt, Homo sapiens
gcccaccugcacguga

SEQ ID NO: 1408206 - RNA, 21 nt, Homo sapiens
gcccacugcccaaugccugcu

SEQ ID NO: 1408207 - RNA, 18 nt, Homo sapiens
gcccagcaaucugcauuu

SEQ ID NO: 1408208 - RNA, 20 nt, Homo sapiens
gcccaggcuggagugcagug

SEQ ID NO: 1408209 - RNA, 17 nt, Homo sapiens
gcccagguuacaaagac

SEQ ID NO: 1408210 - RNA, 22 nt, Homo sapiens
gccccacccaguuucuggaaaa

SEQ ID NO: 1408211 - RNA, 16 nt, Homo sapiens
gccccauuugccagau

SEQ ID NO: 1408212 - RNA, 16 nt, Homo sapiens
gcccgaccccaucuca

SEQ ID NO: 1408213 - RNA, 22 nt, Homo sapiens
gcccucuacagccugacuuucu

SEQ ID NO: 1408214 - RNA, 13 nt, Homo sapiens
gcccuuggcuuua

SEQ ID NO: 1408215 - RNA, 21 nt, Homo sapiens
gccgagaguccaucagccucc

SEQ ID NO: 1408216 - RNA, 21 nt, Homo sapiens
gccggaaaaggcgcaucuaac

SEQ ID NO: 1408217 - RNA, 21 nt, Homo sapiens
gccguacucuuuggggcagcu

SEQ ID NO: 1408218 - RNA, 13 nt, Homo sapiens
gccuauggcaucu

SEQ ID NO: 1408219 - RNA, 19 nt, Homo sapiens
gccuccucccacaagcacc

SEQ ID NO: 1408220 - RNA, 18 nt, Homo sapiens
gccuccuucuuaacucug

SEQ ID NO: 1408221 - RNA, 21 nt, Homo sapiens
gccuccuuuccccucccucag

SEQ ID NO: 1408222 - RNA, 23 nt, Homo sapiens
gccucuagaacacccacuggcca

SEQ ID NO: 1408223 - RNA, 20 nt, Homo sapiens
gccugagugcaccacccuuu

SEQ ID NO: 1408224 - RNA, 14 nt, Homo sapiens
gccuggacccugug

SEQ ID NO: 1408225 - RNA, 17 nt, Homo sapiens
gccuggggucugacaau

SEQ ID NO: 1408226 - RNA, 16 nt, Homo sapiens
gccuggucguuuucaa

SEQ ID NO: 1408227 - RNA, 15 nt, Homo sapiens
gccuuauuggcagcu

SEQ ID NO: 1408228 - RNA, 21 nt, Homo sapiens
gccuuugccccggcuugccug

SEQ ID NO: 1408229 - RNA, 14 nt, Homo sapiens
gccuuugcuugaaa

SEQ ID NO: 1408230 - RNA, 14 nt, Homo sapiens
gcgcacacacagau

SEQ ID NO: 1408231 - RNA, 20 nt, Homo sapiens
gcgcacacacagauaugcac

SEQ ID NO: 1408232 - RNA, 20 nt, Homo sapiens
gcgccacggcacuccagccu

SEQ ID NO: 1408233 - RNA, 13 nt, Homo sapiens
gcggaagugacca

SEQ ID NO: 1408234 - RNA, 13 nt, Homo sapiens
gcggcuggcagcc

SEQ ID NO: 1408235 - RNA, 14 nt, Homo sapiens
gcgugccuguaauc

SEQ ID NO: 1408236 - RNA, 12 nt, Homo sapiens
gcuaccugaugg

SEQ ID NO: 1408237 - RNA, 21 nt, Homo sapiens
gcuacuuuucagaauugaagg

SEQ ID NO: 1408238 - RNA, 13 nt, Homo sapiens
gcuagagugcagu

SEQ ID NO: 1408239 - RNA, 13 nt, Homo sapiens
gcuagcauuacca

SEQ ID NO: 1408240 - RNA, 17 nt, Homo sapiens
gcuagcauuaccacuuc

SEQ ID NO: 1408241 - RNA, 23 nt, Homo sapiens
gcuauaccugggcauacuaauaa

SEQ ID NO: 1408242 - RNA, 22 nt, Homo sapiens
gcuauuuuaauaaagauucuau

SEQ ID NO: 1408243 - RNA, 14 nt, Homo sapiens
gcuauuuucauuua

SEQ ID NO: 1408244 - RNA, 19 nt, Homo sapiens
gcucacaaaccaugcaaau

SEQ ID NO: 1408245 - RNA, 22 nt, Homo sapiens
gcucagcaaaagaugcuucuca

SEQ ID NO: 1408246 - RNA, 20 nt, Homo sapiens
gcuccauugguguugacaua

SEQ ID NO: 1408247 - RNA, 15 nt, Homo sapiens
gcucuggcaccacua

SEQ ID NO: 1408248 - RNA, 16 nt, Homo sapiens
gcucugguuagaaaaa

SEQ ID NO: 1408249 - RNA, 18 nt, Homo sapiens
gcugaggccucucauucc

SEQ ID NO: 1408250 - RNA, 17 nt, Homo sapiens
gcugcauacaguuugca

SEQ ID NO: 1408251 - RNA, 12 nt, Homo sapiens
gcugccuaauaa

SEQ ID NO: 1408252 - RNA, 15 nt, Homo sapiens
gcugcuaaaggacag

SEQ ID NO: 1408253 - RNA, 22 nt, Homo sapiens
gcuggcaaugcccuaccugccu

SEQ ID NO: 1408254 - RNA, 18 nt, Homo sapiens
gcuggcagccuccagugg

SEQ ID NO: 1408255 - RNA, 19 nt, Homo sapiens
gcuguagacauuugcuaug

SEQ ID NO: 1408256 - RNA, 12 nt, Homo sapiens
gcugucugcuca

SEQ ID NO: 1408257 - RNA, 19 nt, Homo sapiens
gcuguggccuaaccugccg

SEQ ID NO: 1408258 - RNA, 14 nt, Homo sapiens
gcuguuaccugaga

SEQ ID NO: 1408259 - RNA, 21 nt, Homo sapiens
gcuguuuugauuuguacugaa

SEQ ID NO: 1408260 - RNA, 20 nt, Homo sapiens
gcuuaaaggggcuagaguga

SEQ ID NO: 1408261 - RNA, 16 nt, Homo sapiens
gcuuaaaguugucacu

SEQ ID NO: 1408262 - RNA, 15 nt, Homo sapiens
gcuuauauacaaugc

SEQ ID NO: 1408263 - RNA, 22 nt, Homo sapiens
gcuucucacugccaugccagcu

SEQ ID NO: 1408264 - RNA, 22 nt, Homo sapiens
gcuucucugagcuccaguggaa

SEQ ID NO: 1408265 - RNA, 11 nt, Homo sapiens
gcuucugccau

SEQ ID NO: 1408266 - RNA, 23 nt, Homo sapiens
gcuugccuguaaucccagcacuu

SEQ ID NO: 1408267 - RNA, 19 nt, Homo sapiens
gcuuuagccauaccagggu

SEQ ID NO: 1408268 - RNA, 16 nt, Homo sapiens
gcuuuaucccacggaa

SEQ ID NO: 1408269 - RNA, 21 nt, Homo sapiens
gcuuucucagugucagcacuc

SEQ ID NO: 1408270 - RNA, 21 nt, Homo sapiens
ggaaaccaguuuggugauaua

SEQ ID NO: 1408271 - RNA, 22 nt, Homo sapiens
ggaaacugaucauuaaagccug

SEQ ID NO: 1408272 - RNA, 12 nt, Homo sapiens
ggaacaauccau

SEQ ID NO: 1408273 - RNA, 14 nt, Homo sapiens
ggaaccaugaagcu

SEQ ID NO: 1408274 - RNA, 19 nt, Homo sapiens
ggaagacacagcccagaca

SEQ ID NO: 1408275 - RNA, 15 nt, Homo sapiens
ggaagcaagauguga

SEQ ID NO: 1408276 - RNA, 22 nt, Homo sapiens
ggaagccucccacgacugcccg

SEQ ID NO: 1408277 - RNA, 17 nt, Homo sapiens
ggaagguucuacgccag

SEQ ID NO: 1408278 - RNA, 20 nt, Homo sapiens
ggaaugaccagccuguccaa

SEQ ID NO: 1408279 - RNA, 16 nt, Homo sapiens
ggaauuauucccauga

SEQ ID NO: 1408280 - RNA, 16 nt, Homo sapiens
ggacaaccucauuuua

SEQ ID NO: 1408281 - RNA, 12 nt, Homo sapiens
ggacacaggcca

SEQ ID NO: 1408282 - RNA, 14 nt, Homo sapiens
ggaccuuacaggcc

SEQ ID NO: 1408283 - RNA, 17 nt, Homo sapiens
ggagauaaucuagaaca

SEQ ID NO: 1408284 - RNA, 10 nt, Homo sapiens
ggagccacuc

SEQ ID NO: 1408285 - RNA, 21 nt, Homo sapiens
ggagccuggcuccguccagga

SEQ ID NO: 1408286 - RNA, 15 nt, Homo sapiens
ggagcugcggccacu

SEQ ID NO: 1408287 - RNA, 15 nt, Homo sapiens
ggauacuucauuaaa

SEQ ID NO: 1408288 - RNA, 18 nt, Homo sapiens
ggauguugcuuuugcacc

SEQ ID NO: 1408289 - RNA, 23 nt, Homo sapiens
ggcaauuuuuacacaaaccugaa

SEQ ID NO: 1408290 - RNA, 15 nt, Homo sapiens
ggccacucuaccuga

SEQ ID NO: 1408291 - RNA, 18 nt, Homo sapiens
ggccaucugggcuucaca

SEQ ID NO: 1408292 - RNA, 19 nt, Homo sapiens
ggcgaccagggccaucucc

SEQ ID NO: 1408293 - RNA, 21 nt, Homo sapiens
ggcgagagguggagugucaca

SEQ ID NO: 1408294 - RNA, 21 nt, Homo sapiens
ggcucagccucaaaugcagua

SEQ ID NO: 1408295 - RNA, 15 nt, Homo sapiens
ggcucccagggccau

SEQ ID NO: 1408296 - RNA, 17 nt, Homo sapiens
ggcucccagggccauga

SEQ ID NO: 1408297 - RNA, 20 nt, Homo sapiens
ggcucccagggccaugaacu

SEQ ID NO: 1408298 - RNA, 22 nt, Homo sapiens
auugcuuuaagaaacuguuacu

SEQ ID NO: 1408299 - RNA, 14 nt, Homo sapiens
auuggaagagcaca

SEQ ID NO: 1408300 - RNA, 22 nt, Homo sapiens
auuggaauuuucuuucauacau

SEQ ID NO: 1408301 - RNA, 18 nt, Homo sapiens
auugguguugacauacau

SEQ ID NO: 1408302 - RNA, 13 nt, Homo sapiens
auuuaaacuucuu

SEQ ID NO: 1408303 - RNA, 18 nt, Homo sapiens
auuuaccuucuaccucuu

SEQ ID NO: 1408304 - RNA, 16 nt, Homo sapiens
auuuagucuugccagg

SEQ ID NO: 1408305 - RNA, 16 nt, Homo sapiens
auuuauuuauggagga

SEQ ID NO: 1408306 - RNA, 20 nt, Homo sapiens
auuucaaccgcuugccauau

SEQ ID NO: 1408307 - RNA, 18 nt, Homo sapiens
auuugagugucuuugacu

SEQ ID NO: 1408308 - RNA, 17 nt, Homo sapiens
auuuggaaaauguuaug

SEQ ID NO: 1408309 - RNA, 21 nt, Homo sapiens
auuuguaaagcucacuuuacu

SEQ ID NO: 1408310 - RNA, 20 nt, Homo sapiens
auuuguaaauuuaugugaug

SEQ ID NO: 1408311 - RNA, 14 nt, Homo sapiens
auuuuauauacaau

SEQ ID NO: 1408312 - RNA, 22 nt, Homo sapiens
auuuucccuucgauauaugacu

SEQ ID NO: 1408313 - RNA, 13 nt, Homo sapiens
auuuugcauuaga

SEQ ID NO: 1408314 - RNA, 19 nt, Homo sapiens
auuuuguaacgaagacaca

SEQ ID NO: 1408315 - RNA, 21 nt, Homo sapiens
auuuuucaaguaauaaaacaa

SEQ ID NO: 1408316 - RNA, 14 nt, Homo sapiens
auuuuuguacauua

SEQ ID NO: 1408317 - RNA, 16 nt, Homo sapiens
auuuuuuauuuccaca

SEQ ID NO: 1408318 - RNA, 16 nt, Homo sapiens
caaaaaaagaaaaaga

SEQ ID NO: 1408319 - RNA, 18 nt, Homo sapiens
caaaaugaugucauguca

SEQ ID NO: 1408320 - RNA, 15 nt, Homo sapiens
caaaauuacuggaca

SEQ ID NO: 1408321 - RNA, 17 nt, Homo sapiens
caaaccuccaaaagccc

SEQ ID NO: 1408322 - RNA, 20 nt, Homo sapiens
caaacucucccccaaaugua

SEQ ID NO: 1408323 - RNA, 17 nt, Homo sapiens
caaagaaaagacauuga

SEQ ID NO: 1408324 - RNA, 20 nt, Homo sapiens
caaagaaggaauucuaggca

SEQ ID NO: 1408325 - RNA, 20 nt, Homo sapiens
caaagugacauuccugaguc

SEQ ID NO: 1408326 - RNA, 19 nt, Homo sapiens
caaagugcuaggauuacag

SEQ ID NO: 1408327 - RNA, 13 nt, Homo sapiens
caaauauucuccu

SEQ ID NO: 1408328 - RNA, 15 nt, Homo sapiens
caaaucaggcugggu

SEQ ID NO: 1408329 - RNA, 15 nt, Homo sapiens
caacauaggccugcu

SEQ ID NO: 1408330 - RNA, 18 nt, Homo sapiens
caacauuuuuguacauua

SEQ ID NO: 1408331 - RNA, 16 nt, Homo sapiens
caaccgcuugccauau

SEQ ID NO: 1408332 - RNA, 15 nt, Homo sapiens
caaccuacuuucaua

SEQ ID NO: 1408333 - RNA, 14 nt, Homo sapiens
caaccugaagacac

SEQ ID NO: 1408334 - RNA, 23 nt, Homo sapiens
caacugugcuacacuugcaccug

SEQ ID NO: 1408335 - RNA, 19 nt, Homo sapiens
caagaaguaacaaaaguau

SEQ ID NO: 1408336 - RNA, 18 nt, Homo sapiens
caagaccucugugcacuu

SEQ ID NO: 1408337 - RNA, 15 nt, Homo sapiens
caagacucugucuca

SEQ ID NO: 1408338 - RNA, 20 nt, Homo sapiens
caagaucgcaccauugcacu

SEQ ID NO: 1408339 - RNA, 21 nt, Homo sapiens
caagaucgcaccauugcacuc

SEQ ID NO: 1408340 - RNA, 15 nt, Homo sapiens
caagcaaauguuuaa

SEQ ID NO: 1408341 - RNA, 22 nt, Homo sapiens
caagcaaauguuuaaaauccaa

SEQ ID NO: 1408342 - RNA, 16 nt, Homo sapiens
caagccccacuuauuc

SEQ ID NO: 1408343 - RNA, 17 nt, Homo sapiens
caaggcugaccaagaga

SEQ ID NO: 1408344 - RNA, 19 nt, Homo sapiens
caaggcugaugcauucccg

SEQ ID NO: 1408345 - RNA, 14 nt, Homo sapiens
caaggcugcaguga

SEQ ID NO: 1408346 - RNA, 21 nt, Homo sapiens
caaguaguagugucuuccuag

SEQ ID NO: 1408347 - RNA, 21 nt, Homo sapiens
caaguccuugaccucuauaaa

SEQ ID NO: 1408348 - RNA, 12 nt, Homo sapiens
caagucuucccu

SEQ ID NO: 1408349 - RNA, 14 nt, Homo sapiens
caauaaaccuuccu

SEQ ID NO: 1408350 - RNA, 20 nt, Homo sapiens
caauaaauuggaacaccucc

SEQ ID NO: 1408351 - RNA, 16 nt, Homo sapiens
caaugauggcaauuuu

SEQ ID NO: 1408352 - RNA, 16 nt, Homo sapiens
caaugcccuaccugcc

SEQ ID NO: 1408353 - RNA, 16 nt, Homo sapiens
caauggcacgaucuca

SEQ ID NO: 1408354 - RNA, 17 nt, Homo sapiens
caauuaaagguccugcc

SEQ ID NO: 1408355 - RNA, 20 nt, Homo sapiens
caauuauguuucuugcugua

SEQ ID NO: 1408356 - RNA, 19 nt, Homo sapiens
caauucuccuguugcaaug

SEQ ID NO: 1408357 - RNA, 14 nt, Homo sapiens
cacaagagugaauu

SEQ ID NO: 1408358 - RNA, 14 nt, Homo sapiens
cacacacagagaua

SEQ ID NO: 1408359 - RNA, 13 nt, Homo sapiens
cacacacagaugc

SEQ ID NO: 1408360 - RNA, 13 nt, Homo sapiens
cacacacauggau

SEQ ID NO: 1408361 - RNA, 22 nt, Homo sapiens
cacacaccgaugugcgcacaca

SEQ ID NO: 1408362 - RNA, 19 nt, Homo sapiens
cacacacgccaaugcacac

SEQ ID NO: 1408363 - RNA, 15 nt, Homo sapiens
cacacagauaugcac

SEQ ID NO: 1408364 - RNA, 11 nt, Homo sapiens
cacacauggau

SEQ ID NO: 1408365 - RNA, 17 nt, Homo sapiens
cacacauggaugagcac

SEQ ID NO: 1408366 - RNA, 15 nt, Homo sapiens
cacaccaaugcgcac

SEQ ID NO: 1408367 - RNA, 14 nt, Homo sapiens
cacaccauucuccu

SEQ ID NO: 1408368 - RNA, 16 nt, Homo sapiens
cacaccgauguacaca

SEQ ID NO: 1408369 - RNA, 15 nt, Homo sapiens
cacaccgaugugcgc

SEQ ID NO: 1408370 - RNA, 17 nt, Homo sapiens
cacacgccaaugcacac

SEQ ID NO: 1408371 - RNA, 21 nt, Homo sapiens
cacacggaugcacacacagau

SEQ ID NO: 1408372 - RNA, 15 nt, Homo sapiens
cacacggaugcacag

SEQ ID NO: 1408373 - RNA, 19 nt, Homo sapiens
cacacggaugcacagagau

SEQ ID NO: 1408374 - RNA, 15 nt, Homo sapiens
cacagaagacccgcu

SEQ ID NO: 1408375 - RNA, 18 nt, Homo sapiens
cacagagauaugcacaca

SEQ ID NO: 1408376 - RNA, 23 nt, Homo sapiens
caugaccaaaugcuuuuccucaa

SEQ ID NO: 1408377 - RNA, 15 nt, Homo sapiens
caugaccacuuuccc

SEQ ID NO: 1408378 - RNA, 15 nt, Homo sapiens
caugaugaauuacuu

SEQ ID NO: 1408379 - RNA, 18 nt, Homo sapiens
caugcacccucauacaca

SEQ ID NO: 1408380 - RNA, 21 nt, Homo sapiens
caugcagcaaggggacaucuu

SEQ ID NO: 1408381 - RNA, 20 nt, Homo sapiens
caugccaaugcacgcacaca

SEQ ID NO: 1408382 - RNA, 20 nt, Homo sapiens
caugcugguguggccaaggc

SEQ ID NO: 1408383 - RNA, 14 nt, Homo sapiens
cauggccaccucca

SEQ ID NO: 1408384 - RNA, 15 nt, Homo sapiens
cauggccuucccucc

SEQ ID NO: 1408385 - RNA, 20 nt, Homo sapiens
cauguaucacucacugccaa

SEQ ID NO: 1408386 - RNA, 23 nt, Homo sapiens
cauuagugaauuacacucaagga

SEQ ID NO: 1408387 - RNA, 23 nt, Homo sapiens
cauuauuucaaccgcuugccaua

SEQ ID NO: 1408388 - RNA, 15 nt, Homo sapiens
cauucaaaaugucca

SEQ ID NO: 1408389 - RNA, 20 nt, Homo sapiens
cauugauuuugaugauuaaa

SEQ ID NO: 1408390 - RNA, 21 nt, Homo sapiens
cauuggaccuuuccugaggaa

SEQ ID NO: 1408391 - RNA, 12 nt, Homo sapiens
cauugguguuga

SEQ ID NO: 1408392 - RNA, 21 nt, Homo sapiens
cauuguaaaguuuaugucacc

SEQ ID NO: 1408393 - RNA, 12 nt, Homo sapiens
cauugucccuga

SEQ ID NO: 1408394 - RNA, 18 nt, Homo sapiens
cauuuaaaaaaaaucccu

SEQ ID NO: 1408395 - RNA, 23 nt, Homo sapiens
cauuucagagaggccuuuuggaa

SEQ ID NO: 1408396 - RNA, 15 nt, Homo sapiens
cauuugccagauugc

SEQ ID NO: 1408397 - RNA, 17 nt, Homo sapiens
cauuuuaugucauuaaa

SEQ ID NO: 1408398 - RNA, 16 nt, Homo sapiens
cauuuuguacaaagau

SEQ ID NO: 1408399 - RNA, 15 nt, Homo sapiens
ccaagauucaaagag

SEQ ID NO: 1408400 - RNA, 20 nt, Homo sapiens
ccaaggaauuucugcucugg

SEQ ID NO: 1408401 - RNA, 15 nt, Homo sapiens
ccaaguagcugagau

SEQ ID NO: 1408402 - RNA, 14 nt, Homo sapiens
ccaagugauaauuu

SEQ ID NO: 1408403 - RNA, 21 nt, Homo sapiens
ccaauacguagauuuuugcuc

SEQ ID NO: 1408404 - RNA, 17 nt, Homo sapiens
ccaaugcacacacacag

SEQ ID NO: 1408405 - RNA, 19 nt, Homo sapiens
uccagcccucucacugugu

SEQ ID NO: 1408406 - RNA, 16 nt, Homo sapiens
uccagggcaaggccau

SEQ ID NO: 1408407 - RNA, 15 nt, Homo sapiens
uccauaauaaacuuc

SEQ ID NO: 1408408 - RNA, 20 nt, Homo sapiens
uccauccauggggcugauug

SEQ ID NO: 1408409 - RNA, 22 nt, Homo sapiens
uccaucuuccacgaaaugggcc

SEQ ID NO: 1408410 - RNA, 10 nt, Homo sapiens
ucccaaagug

SEQ ID NO: 1408411 - RNA, 20 nt, Homo sapiens
ucccaaagugcuaggauuac

SEQ ID NO: 1408412 - RNA, 20 nt, Homo sapiens
ucccagagagacgcugugau

SEQ ID NO: 1408413 - RNA, 9 nt, Homo sapiens
ucccagugc

SEQ ID NO: 1408414 - RNA, 13 nt, Homo sapiens
uccccaacgaaaa

SEQ ID NO: 1408415 - RNA, 19 nt, Homo sapiens
uccccaacgaaaagcacau

SEQ ID NO: 1408416 - RNA, 20 nt, Homo sapiens
ucccgggacaccuaggcuag

SEQ ID NO: 1408417 - RNA, 23 nt, Homo sapiens
ucccuacccacucuuugcuacaa

SEQ ID NO: 1408418 - RNA, 16 nt, Homo sapiens
ugcacagagauaugca

SEQ ID NO: 1408419 - RNA, 21 nt, Homo sapiens
ugcacagagauaugcacacac

SEQ ID NO: 1408420 - RNA, 18 nt, Homo sapiens
ugcacagcucaacggaag

SEQ ID NO: 1408421 - RNA, 14 nt, Homo sapiens
ugcaccacugcacu

SEQ ID NO: 1408422 - RNA, 21 nt, Homo sapiens
ugcaccuacgggggcaucuga

SEQ ID NO: 1408423 - RNA, 20 nt, Homo sapiens
ugcacgcacaugccaaugca

SEQ ID NO: 1408424 - RNA, 17 nt, Homo sapiens
ugcagguacuuccucag

SEQ ID NO: 1408425 - RNA, 19 nt, Homo sapiens
ugcaguacaagaaccucuc

SEQ ID NO: 1408426 - RNA, 15 nt, Homo sapiens
ugcagucccuggaaa

SEQ ID NO: 1408427 - RNA, 16 nt, Homo sapiens
ugcagugaacugagac

SEQ ID NO: 1408428 - RNA, 19 nt, Homo sapiens
ugcaucguuucaucuucca

SEQ ID NO: 1408429 - RNA, 16 nt, Homo sapiens
ugcauucuagugcaga

SEQ ID NO: 1408430 - RNA, 14 nt, Homo sapiens
ugccaaaacaaugc

SEQ ID NO: 1408431 - RNA, 18 nt, Homo sapiens
ugccaagaauaaagaagu

SEQ ID NO: 1408432 - RNA, 16 nt, Homo sapiens
ugccaaguaaauagca

SEQ ID NO: 1408433 - RNA, 15 nt, Homo sapiens
ugccaccugucuguc

SEQ ID NO: 1408434 - RNA, 23 nt, Homo sapiens
ugccaugccagcuuaucucaggg

SEQ ID NO: 1408435 - RNA, 14 nt, Homo sapiens
ugccccauugcuca

SEQ ID NO: 1408436 - RNA, 16 nt, Homo sapiens
ugccccucuguaacaa

SEQ ID NO: 1408437 - RNA, 17 nt, Homo sapiens
ugcccugugcaugccau

SEQ ID NO: 1408438 - RNA, 20 nt, Homo sapiens
ugcccuucagcauccucagu

SEQ ID NO: 1408439 - RNA, 11 nt, Homo sapiens
ugccuguucuc

SEQ ID NO: 1408440 - RNA, 16 nt, Homo sapiens
ugccuugccaugucuu

SEQ ID NO: 1408441 - RNA, 21 nt, Homo sapiens
ugccuuugggaggcagcauca

SEQ ID NO: 1408442 - RNA, 19 nt, Homo sapiens
ugcgcacaaggcugaccaa

SEQ ID NO: 1408443 - RNA, 11 nt, Homo sapiens
ugcgcacacac

SEQ ID NO: 1408444 - RNA, 15 nt, Homo sapiens
ugcgcacacacagau

SEQ ID NO: 1408445 - RNA, 16 nt, Homo sapiens
ugcgcacacacagaua

SEQ ID NO: 1408446 - RNA, 13 nt, Homo sapiens
ugcuaaaugugaa

SEQ ID NO: 1408447 - RNA, 13 nt, Homo sapiens
ugcuagaagaaaa

SEQ ID NO: 1408448 - RNA, 18 nt, Homo sapiens
ugcugaccagacagccuc

SEQ ID NO: 1408449 - RNA, 17 nt, Homo sapiens
ugcugacuacuacucug

SEQ ID NO: 1408450 - RNA, 21 nt, Homo sapiens
ugcugacuacuacucugccaa

SEQ ID NO: 1408451 - RNA, 16 nt, Homo sapiens
ugcuggggccgaaaga

SEQ ID NO: 1408452 - RNA, 16 nt, Homo sapiens
ugcuuaugacaucacu

SEQ ID NO: 1408453 - RNA, 13 nt, Homo sapiens
ugcuucaguccac

SEQ ID NO: 1408454 - RNA, 23 nt, Homo sapiens
ugcuugauauguaaguacuucca

SEQ ID NO: 1408455 - RNA, 18 nt, Homo sapiens
ugcuugggcuauaccugg

SEQ ID NO: 1408456 - RNA, 14 nt, Homo sapiens
uggaacaagcacag

SEQ ID NO: 1408457 - RNA, 13 nt, Homo sapiens
uggaacaccuccu

SEQ ID NO: 1408458 - RNA, 15 nt, Homo sapiens
uggaacaccuccuca

SEQ ID NO: 1408459 - RNA, 21 nt, Homo sapiens
uggaauacuugaaaaccucau

SEQ ID NO: 1408460 - RNA, 21 nt, Homo sapiens
uggagaaacaggcucugagau

SEQ ID NO: 1408461 - RNA, 15 nt, Homo sapiens
uggaugagcacacac

SEQ ID NO: 1408462 - RNA, 13 nt, Homo sapiens
uggaugcacacac

SEQ ID NO: 1408463 - RNA, 14 nt, Homo sapiens
uggaugcacgcaca

SEQ ID NO: 1408464 - RNA, 16 nt, Homo sapiens
uggcaacccucagcug

SEQ ID NO: 1408465 - RNA, 13 nt, Homo sapiens
uggcaaccuuccu

SEQ ID NO: 1408466 - RNA, 20 nt, Homo sapiens
uggcaagaaugaaauacucu

SEQ ID NO: 1408467 - RNA, 18 nt, Homo sapiens
uggcacgaucucagcuca

SEQ ID NO: 1408468 - RNA, 17 nt, Homo sapiens
uggccagacuucagcug

SEQ ID NO: 1408469 - RNA, 12 nt, Homo sapiens
uggcuguggcau

SEQ ID NO: 1408470 - RNA, 18 nt, Homo sapiens
ugggagacacagcaagac

SEQ ID NO: 1408471 - RNA, 15 nt, Homo sapiens
ugggagcaccgccug

SEQ ID NO: 1408472 - RNA, 12 nt, Homo sapiens
ugggagcuuucc

SEQ ID NO: 1408473 - RNA, 15 nt, Homo sapiens
ugggaggaaccugaa

SEQ ID NO: 1408474 - RNA, 22 nt, Homo sapiens
ugggauuucaccguauuagcca

SEQ ID NO: 1408475 - RNA, 20 nt, Homo sapiens
ugggccucagccuccaggca

SEQ ID NO: 1408476 - RNA, 18 nt, Homo sapiens
uggggagggagguguuua

SEQ ID NO: 1408477 - RNA, 20 nt, Homo sapiens
ugggguuugggggcuucccu

SEQ ID NO: 1408478 - RNA, 17 nt, Homo sapiens
uggguuggacaaccuca

SEQ ID NO: 1408479 - RNA, 17 nt, Homo sapiens
uggguugucacugagac

SEQ ID NO: 1408480 - RNA, 20 nt, Homo sapiens
uggucguuuucaacagaauu

SEQ ID NO: 1408481 - RNA, 13 nt, Homo sapiens
uggugugcuguau

SEQ ID NO: 1408482 - RNA, 15 nt, Homo sapiens
ugguguucucaucua

SEQ ID NO: 1408483 - RNA, 21 nt, Homo sapiens
uguaaaaaauguaaaauggag

SEQ ID NO: 1408484 - RNA, 19 nt, Homo sapiens
uguaaaaucccaucugcua

SEQ ID NO: 1408485 - RNA, 16 nt, Homo sapiens
uguaaauuuaugugau

SEQ ID NO: 1408486 - RNA, 15 nt, Homo sapiens
uguacacacacagau

SEQ ID NO: 1408487 - RNA, 17 nt, Homo sapiens
uguacacacacagaugc

SEQ ID NO: 1408488 - RNA, 23 nt, Homo sapiens
uguagcuuugcucuuugguagaa

SEQ ID NO: 1408489 - RNA, 19 nt, Homo sapiens
ugucaaguggaaacaugcu

SEQ ID NO: 1408490 - RNA, 12 nt, Homo sapiens
ugucacaaagau

SEQ ID NO: 1408491 - RNA, 12 nt, Homo sapiens
ugucacaucucu

SEQ ID NO: 1408492 - RNA, 18 nt, Homo sapiens
ugucagaaacucgaugaa

SEQ ID NO: 1408493 - RNA, 23 nt, Homo sapiens
ugucaugucucugguggugcugg

SEQ ID NO: 1408494 - RNA, 23 nt, Homo sapiens
ugucauuaaauggggcucacaaa

SEQ ID NO: 1408495 - RNA, 16 nt, Homo sapiens
ugucccagaaugccuc

SEQ ID NO: 1408496 - RNA, 16 nt, Homo sapiens
uguccuggcaccaaau

SEQ ID NO: 1408497 - RNA, 19 nt, Homo sapiens
uguccuuuguguccauuga

SEQ ID NO: 1408498 - RNA, 20 nt, Homo sapiens
ugucguaggaaaaccaugac

SEQ ID NO: 1408499 - RNA, 16 nt, Homo sapiens
ugucucaaaccuccaa

SEQ ID NO: 1408500 - RNA, 17 nt, Homo sapiens
ugucugcucaguaauuu

SEQ ID NO: 1408501 - RNA, 23 nt, Homo sapiens
ugugaaauucaaccugugucuua

SEQ ID NO: 1408502 - RNA, 23 nt, Homo sapiens
ugugaaggaauuauucccaugag

SEQ ID NO: 1408503 - RNA, 19 nt, Homo sapiens
ugugacaucuacaacucca

SEQ ID NO: 1408504 - RNA, 15 nt, Homo sapiens
ugugacucuuuccaa

SEQ ID NO: 1408505 - RNA, 16 nt, Homo sapiens
ugugauggcaaagaag

SEQ ID NO: 1408506 - RNA, 14 nt, Homo sapiens
ugugauguguccug

SEQ ID NO: 1408507 - RNA, 22 nt, Homo sapiens
ugugauuccuuugaagaggaaa

SEQ ID NO: 1408508 - RNA, 18 nt, Homo sapiens
ugugauuguuccauaaua

SEQ ID NO: 1408509 - RNA, 15 nt, Homo sapiens
ugugccucagccucc

SEQ ID NO: 1408510 - RNA, 17 nt, Homo sapiens
ugugccugaagucccag

SEQ ID NO: 1408511 - RNA, 12 nt, Homo sapiens
uguggcacucca

SEQ ID NO: 1408512 - RNA, 13 nt, Homo sapiens
uguggcacuccaa

SEQ ID NO: 1408513 - RNA, 21 nt, Homo sapiens
uguggggagggauuuggggcu

SEQ ID NO: 1408514 - RNA, 13 nt, Homo sapiens
uguguaauaugca

SEQ ID NO: 1408515 - RNA, 21 nt, Homo sapiens
uguuacuaaagucacauauaa

SEQ ID NO: 1408516 - RNA, 15 nt, Homo sapiens
uguuacugucuucag

SEQ ID NO: 1408517 - RNA, 18 nt, Homo sapiens
uguuccauuggguccucu

SEQ ID NO: 1408518 - RNA, 14 nt, Homo sapiens
uguucucuucuaua

SEQ ID NO: 1408519 - RNA, 23 nt, Homo sapiens
uguucuucauuaccucagugaga

SEQ ID NO: 1408520 - RNA, 17 nt, Homo sapiens
uguugaaaauguucaga

SEQ ID NO: 1408521 - RNA, 18 nt, Homo sapiens
uguuuagcccaaaaccaa

SEQ ID NO: 1408522 - RNA, 16 nt, Homo sapiens
uuaaaaguccacuuuu

SEQ ID NO: 1408523 - RNA, 23 nt, Homo sapiens
uuaaagccugaguuugcuuucaa

SEQ ID NO: 1408524 - RNA, 24 nt, Homo sapiens
uuaaaucagccguguaaccaugga

SEQ ID NO: 1408525 - RNA, 23 nt, Homo sapiens
uuaaggccacacuggcaucuccc

SEQ ID NO: 1408526 - RNA, 19 nt, Homo sapiens
ugauauguaaguacuucca

SEQ ID NO: 1408527 - RNA, 13 nt, Homo sapiens
ugaugucauguca

SEQ ID NO: 1408528 - RNA, 21 nt, Homo sapiens
ugaugucauucagcagucagu

SEQ ID NO: 1408529 - RNA, 18 nt, Homo sapiens
ugauuaaaaucuggcaaa

SEQ ID NO: 1408530 - RNA, 16 nt, Homo sapiens
ugauuguuccauaaua

SEQ ID NO: 1408531 - RNA, 21 nt, Homo sapiens
ugcacacacacagagauaugc

SEQ ID NO: 1408532 - RNA, 21 nt, Homo sapiens
ugcacacacacggaugcacac

SEQ ID NO: 1408533 - RNA, 13 nt, Homo sapiens
ugcacacacagau

SEQ ID NO: 1408534 - RNA, 14 nt, Homo sapiens
ugcacacacagaug

SEQ ID NO: 1408535 - RNA, 15 nt, Homo sapiens
ugcacacacagaugc

SEQ ID NO: 1408536 - RNA, 21 nt, Homo sapiens
ugcacacggaugcacagagau

SEQ ID NO: 1408537 - RNA, 15 nt, Homo sapiens
gaaauaacauggccu

SEQ ID NO: 1408538 - RNA, 16 nt, Homo sapiens
gaaauaacauggccuu

SEQ ID NO: 1408539 - RNA, 23 nt, Homo sapiens
gaaauacacagugcugaccagac

SEQ ID NO: 1408540 - RNA, 17 nt, Homo sapiens
gaaaucagagcuggcag

SEQ ID NO: 1408541 - RNA, 20 nt, Homo sapiens
gaaauucaaccugugucuua

SEQ ID NO: 1408542 - RNA, 17 nt, Homo sapiens
gaacaauccauaacuuu

SEQ ID NO: 1408543 - RNA, 14 nt, Homo sapiens
gaacaccuccucaa

SEQ ID NO: 1408544 - RNA, 20 nt, Homo sapiens
gaacacguuggcucaguccu

SEQ ID NO: 1408545 - RNA, 14 nt, Homo sapiens
gaaccaugaagcug

SEQ ID NO: 1408546 - RNA, 17 nt, Homo sapiens
gaacuacuuuuggugcu

SEQ ID NO: 1408547 - RNA, 22 nt, Homo sapiens
gaacuuuguccgguggaaggcc

SEQ ID NO: 1408548 - RNA, 22 nt, Homo sapiens
gaagaacagaauugcuccugca

SEQ ID NO: 1408549 - RNA, 13 nt, Homo sapiens
gaagacaauguga

SEQ ID NO: 1408550 - RNA, 16 nt, Homo sapiens
gaagaucugcuucccu

SEQ ID NO: 1408551 - RNA, 13 nt, Homo sapiens
gaagcacugcugu

SEQ ID NO: 1408552 - RNA, 18 nt, Homo sapiens
gaagcaucaaagcacugu

SEQ ID NO: 1408553 - RNA, 17 nt, Homo sapiens
gaagccagcuuuccuca

SEQ ID NO: 1408554 - RNA, 21 nt, Homo sapiens
gaagcuccugggggaugcucu

SEQ ID NO: 1408555 - RNA, 16 nt, Homo sapiens
gaagcuggaagcacug

SEQ ID NO: 1408556 - RNA, 14 nt, Homo sapiens
gaaggaauuauucc

SEQ ID NO: 1408557 - RNA, 15 nt, Homo sapiens
gaaggaauuauuccc

SEQ ID NO: 1408558 - RNA, 12 nt, Homo sapiens
gaaggagaaaau

SEQ ID NO: 1408559 - RNA, 12 nt, Homo sapiens
gaaggaucccau

SEQ ID NO: 1408560 - RNA, 14 nt, Homo sapiens
gaauaaaauacucu

SEQ ID NO: 1408561 - RNA, 18 nt, Homo sapiens
gaaugaccagccugucca

SEQ ID NO: 1408562 - RNA, 18 nt, Homo sapiens
gaaugcaacuccauuuac

SEQ ID NO: 1408563 - RNA, 22 nt, Homo sapiens
gaauugaaggagaaaaugcauu

SEQ ID NO: 1408564 - RNA, 22 nt, Homo sapiens
gacaaagugacauuccugaguc

SEQ ID NO: 1408565 - RNA, 16 nt, Homo sapiens
gacaaccucauuuuaa

SEQ ID NO: 1408566 - RNA, 18 nt, Homo sapiens
gacacagacaaagugaca

SEQ ID NO: 1408567 - RNA, 15 nt, Homo sapiens
gacagaaaugcaauc

SEQ ID NO: 1408568 - RNA, 19 nt, Homo sapiens
gacaggcaccagaugggau

SEQ ID NO: 1408569 - RNA, 22 nt, Homo sapiens
gacauuuauccaagaccugaaa

SEQ ID NO: 1408570 - RNA, 22 nt, Homo sapiens
gaccaccucucaauauucaaua

SEQ ID NO: 1408571 - RNA, 17 nt, Homo sapiens
gaccacugggcaaugau

SEQ ID NO: 1408572 - RNA, 24 nt, Homo sapiens
gaccacugggcaaugauggcaauu

SEQ ID NO: 1408573 - RNA, 23 nt, Homo sapiens
gaccacuuuccccgugggccaug

SEQ ID NO: 1408574 - RNA, 17 nt, Homo sapiens
gaccagggccaucuccu

SEQ ID NO: 1408575 - RNA, 16 nt, Homo sapiens
gacguuugacuagcca

SEQ ID NO: 1408576 - RNA, 23 nt, Homo sapiens
gacguuugacuagccaucucaag

SEQ ID NO: 1408577 - RNA, 19 nt, Homo sapiens
gacuaauagagacacagag

SEQ ID NO: 1408578 - RNA, 14 nt, Homo sapiens
gacuagccaucuca

SEQ ID NO: 1408579 - RNA, 16 nt, Homo sapiens
gacuauuuaugaaggc

SEQ ID NO: 1408580 - RNA, 18 nt, Homo sapiens
gacucaagacacugagau

SEQ ID NO: 1408581 - RNA, 14 nt, Homo sapiens
gacucucagcagcu

SEQ ID NO: 1408582 - RNA, 16 nt, Homo sapiens
gacucugcuucagucc

SEQ ID NO: 1408583 - RNA, 13 nt, Homo sapiens
gagaaucacugga

SEQ ID NO: 1408584 - RNA, 23 nt, Homo sapiens
gagacaaaucuaugccacucaga

SEQ ID NO: 1408585 - RNA, 16 nt, Homo sapiens
gagacaggcccaagag

SEQ ID NO: 1408586 - RNA, 14 nt, Homo sapiens
gagacaguucaaga

SEQ ID NO: 1408587 - RNA, 17 nt, Homo sapiens
gagacuagauucucacc

SEQ ID NO: 1408588 - RNA, 21 nt, Homo sapiens
gagagacgcugugauuggcag

SEQ ID NO: 1408589 - RNA, 16 nt, Homo sapiens
gagagcauucugcucu

SEQ ID NO: 1408590 - RNA, 13 nt, Homo sapiens
gagaguccaucag

SEQ ID NO: 1408591 - RNA, 14 nt, Homo sapiens
gagaguccaucagc

SEQ ID NO: 1408592 - RNA, 20 nt, Homo sapiens
gagaguccaucagccuccau

SEQ ID NO: 1408593 - RNA, 15 nt, Homo sapiens
gagauaugcacacac

SEQ ID NO: 1408594 - RNA, 18 nt, Homo sapiens
gagauucuugugccucag

SEQ ID NO: 1408595 - RNA, 13 nt, Homo sapiens
gagcaagacucug

SEQ ID NO: 1408596 - RNA, 18 nt, Homo sapiens
gagcaagacucugucuca

SEQ ID NO: 1408597 - RNA, 21 nt, Homo sapiens
gagccgagauugcaccacugc

SEQ ID NO: 1408598 - RNA, 16 nt, Homo sapiens
gagccgggagccugac

SEQ ID NO: 1408599 - RNA, 16 nt, Homo sapiens
gagccuggcaagaaug

SEQ ID NO: 1408600 - RNA, 17 nt, Homo sapiens
gagcuccuuagccuuug

SEQ ID NO: 1408601 - RNA, 19 nt, Homo sapiens
gaggacuugugucucugug

SEQ ID NO: 1408602 - RNA, 18 nt, Homo sapiens
gaggaguggaguucucug

SEQ ID NO: 1408603 - RNA, 19 nt, Homo sapiens
gaggauugcuugagcucag

SEQ ID NO: 1408604 - RNA, 18 nt, Homo sapiens
gaggcuagucucuucuca

SEQ ID NO: 1408605 - RNA, 16 nt, Homo sapiens
gagggaaaagcuaaga

SEQ ID NO: 1408606 - RNA, 15 nt, Homo sapiens
gaggugacuugccug

SEQ ID NO: 1408607 - RNA, 15 nt, Homo sapiens
gagugucacaucucu

SEQ ID NO: 1408608 - RNA, 20 nt, Homo sapiens
gauaaaucaguuaugucaau

SEQ ID NO: 1408609 - RNA, 18 nt, Homo sapiens
gauaaucuuagcugccaa

SEQ ID NO: 1408610 - RNA, 19 nt, Homo sapiens
gauaugcacacacacggau

SEQ ID NO: 1408611 - RNA, 23 nt, Homo sapiens
gaucauuaucagccugugccacg

SEQ ID NO: 1408612 - RNA, 16 nt, Homo sapiens
gaucccaacacugcca

SEQ ID NO: 1408613 - RNA, 13 nt, Homo sapiens
gauccugcacucu

SEQ ID NO: 1408614 - RNA, 16 nt, Homo sapiens
gaugauaaaacacaaa

SEQ ID NO: 1408615 - RNA, 23 nt, Homo sapiens
gauggaaugaccagccuguccaa

SEQ ID NO: 1408616 - RNA, 13 nt, Homo sapiens
gauggauuuccag

SEQ ID NO: 1408617 - RNA, 15 nt, Homo sapiens
gaugggauuucaccg

SEQ ID NO: 1408618 - RNA, 12 nt, Homo sapiens
gauguacacaca

SEQ ID NO: 1408619 - RNA, 23 nt, Homo sapiens
gauguacacacacagaugcacac

SEQ ID NO: 1408620 - RNA, 16 nt, Homo sapiens
gaugugcgcacacaca

SEQ ID NO: 1408621 - RNA, 13 nt, Homo sapiens
gauguguggacac

SEQ ID NO: 1408622 - RNA, 19 nt, Homo sapiens
gauuacaggcaugagccac

SEQ ID NO: 1408623 - RNA, 20 nt, Homo sapiens
gauuugcacccaugccauag

SEQ ID NO: 1408624 - RNA, 20 nt, Homo sapiens
gcaaaaaaauuaaauuauuu

SEQ ID NO: 1408625 - RNA, 23 nt, Homo sapiens
gcaacuccuguucuuugggcuca

SEQ ID NO: 1408626 - RNA, 16 nt, Homo sapiens
gcaagacucugucuca

SEQ ID NO: 1408627 - RNA, 17 nt, Homo sapiens
gcaagugagacccuguc

SEQ ID NO: 1408628 - RNA, 18 nt, Homo sapiens
gcaauucauguaguuucu

SEQ ID NO: 1408629 - RNA, 21 nt, Homo sapiens
gcacacacacagagauaugca

SEQ ID NO: 1408630 - RNA, 17 nt, Homo sapiens
gcacacacaccgaugua

SEQ ID NO: 1408631 - RNA, 18 nt, Homo sapiens
gcacacacagauaugcac

SEQ ID NO: 1408632 - RNA, 20 nt, Homo sapiens
gcacacacagauaugcacac

SEQ ID NO: 1408633 - RNA, 15 nt, Homo sapiens
gcacacacagaugca

SEQ ID NO: 1408634 - RNA, 18 nt, Homo sapiens
gcacacacagaugcacac

SEQ ID NO: 1408635 - RNA, 24 nt, Homo sapiens
gcacacacagaugcacacacagau

SEQ ID NO: 1408636 - RNA, 16 nt, Homo sapiens
gcacacggaugcacag

SEQ ID NO: 1408637 - RNA, 13 nt, Homo sapiens
gcacagccuggcu

SEQ ID NO: 1408638 - RNA, 15 nt, Homo sapiens
gcacauccaggcaau

SEQ ID NO: 1408639 - RNA, 14 nt, Homo sapiens
gcaccagaugggau

SEQ ID NO: 1408640 - RNA, 22 nt, Homo sapiens
gcaccaucuggaaggacaucua

SEQ ID NO: 1408641 - RNA, 13 nt, Homo sapiens
gcaccugcucaac

SEQ ID NO: 1408642 - RNA, 17 nt, Homo sapiens
gcacucauagggugcuc

SEQ ID NO: 1408643 - RNA, 22 nt, Homo sapiens
ggccucccaccagagacuggga

SEQ ID NO: 1408644 - RNA, 17 nt, Homo sapiens
ggccuccugucccucau

SEQ ID NO: 1408645 - RNA, 17 nt, Homo sapiens
ggccuggucguuuucaa

SEQ ID NO: 1408646 - RNA, 14 nt, Homo sapiens
ggcuagagugcagu

SEQ ID NO: 1408647 - RNA, 16 nt, Homo sapiens
ggcugcacagcucaac

SEQ ID NO: 1408648 - RNA, 11 nt, Homo sapiens
ggcugccuugu

SEQ ID NO: 1408649 - RNA, 12 nt, Homo sapiens
ggcugcugagaa

SEQ ID NO: 1408650 - RNA, 18 nt, Homo sapiens
ggcugggugagcugagau

SEQ ID NO: 1408651 - RNA, 14 nt, Homo sapiens
ggcuuuguggcacu

SEQ ID NO: 1408652 - RNA, 11 nt, Homo sapiens
gggaaccauga

SEQ ID NO: 1408653 - RNA, 16 nt, Homo sapiens
gggacuccaguucaca

SEQ ID NO: 1408654 - RNA, 16 nt, Homo sapiens
gggagagagugcuauu

SEQ ID NO: 1408655 - RNA, 14 nt, Homo sapiens
gggaguguguaauu

SEQ ID NO: 1408656 - RNA, 15 nt, Homo sapiens
gggaguguugucaca

SEQ ID NO: 1408657 - RNA, 15 nt, Homo sapiens
gggccccauuugcca

SEQ ID NO: 1408658 - RNA, 12 nt, Homo sapiens
gggcucagcaaa

SEQ ID NO: 1408659 - RNA, 22 nt, Homo sapiens
gggcuugguguuuguaagaaaa

SEQ ID NO: 1408660 - RNA, 13 nt, Homo sapiens
ggggcucucucau

SEQ ID NO: 1408661 - RNA, 20 nt, Homo sapiens
ggggucgucaccaccucucc

SEQ ID NO: 1408662 - RNA, 20 nt, Homo sapiens
ggggugguuuuugagccaug

SEQ ID NO: 1408663 - RNA, 10 nt, Homo sapiens
gggucugugu

SEQ ID NO: 1408664 - RNA, 15 nt, Homo sapiens
gguaauuaugugaua

SEQ ID NO: 1408665 - RNA, 14 nt, Homo sapiens
gguagguugggaga

SEQ ID NO: 1408666 - RNA, 17 nt, Homo sapiens
gguccugcccuuccuga

SEQ ID NO: 1408667 - RNA, 16 nt, Homo sapiens
ggucuugaucuccuga

SEQ ID NO: 1408668 - RNA, 15 nt, Homo sapiens
ggugccaaguuccac

SEQ ID NO: 1408669 - RNA, 12 nt, Homo sapiens
ggugugcuguau

SEQ ID NO: 1408670 - RNA, 17 nt, Homo sapiens
gguguuacuaaagucac

SEQ ID NO: 1408671 - RNA, 19 nt, Homo sapiens
gguucagcuaagcuaggaa

SEQ ID NO: 1408672 - RNA, 15 nt, Homo sapiens
gguuuuacugcagcu

SEQ ID NO: 1408673 - RNA, 14 nt, Homo sapiens
guaaaacaguuaca

SEQ ID NO: 1408674 - RNA, 14 nt, Homo sapiens
guaaguacuuccac

SEQ ID NO: 1408675 - RNA, 18 nt, Homo sapiens
guaauuuaaaauugugau

SEQ ID NO: 1408676 - RNA, 19 nt, Homo sapiens
guaauuuugugaaagaagg

SEQ ID NO: 1408677 - RNA, 21 nt, Homo sapiens
guacauuaaagauuucugcuc

SEQ ID NO: 1408678 - RNA, 13 nt, Homo sapiens
guagagaugggau

SEQ ID NO: 1408679 - RNA, 16 nt, Homo sapiens
guagcugagauuacag

SEQ ID NO: 1408680 - RNA, 18 nt, Homo sapiens
guagggagcuaaggaaga

SEQ ID NO: 1408681 - RNA, 16 nt, Homo sapiens
gucaacauaugugauu

SEQ ID NO: 1408682 - RNA, 22 nt, Homo sapiens
gucacucaccacuacaucacuu

SEQ ID NO: 1408683 - RNA, 21 nt, Homo sapiens
gucacugacucaagacacuga

SEQ ID NO: 1408684 - RNA, 16 nt, Homo sapiens
gucaucuguaccucug

SEQ ID NO: 1408685 - RNA, 13 nt, Homo sapiens
guccaguuuccaa

SEQ ID NO: 1408686 - RNA, 12 nt, Homo sapiens
guccauugaaag

SEQ ID NO: 1408687 - RNA, 18 nt, Homo sapiens
guccuaaagaugcugacu

SEQ ID NO: 1408688 - RNA, 18 nt, Homo sapiens
guccuccagaccaccagc

SEQ ID NO: 1408689 - RNA, 19 nt, Homo sapiens
gucuggcugaggauuucaa

SEQ ID NO: 1408690 - RNA, 17 nt, Homo sapiens
gucugggccacucaggg

SEQ ID NO: 1408691 - RNA, 11 nt, Homo sapiens
gucuugcccaa

SEQ ID NO: 1408692 - RNA, 12 nt, Homo sapiens
gugaaaauauga

SEQ ID NO: 1408693 - RNA, 11 nt, Homo sapiens
gugauuugccu

SEQ ID NO: 1408694 - RNA, 19 nt, Homo sapiens
gugcaguggcgugaucucg

SEQ ID NO: 1408695 - RNA, 19 nt, Homo sapiens
gugccauucccacuaagcu

SEQ ID NO: 1408696 - RNA, 16 nt, Homo sapiens
gugcucugauuugaua

SEQ ID NO: 1408697 - RNA, 15 nt, Homo sapiens
guggaacaagcacag

SEQ ID NO: 1408698 - RNA, 18 nt, Homo sapiens
guggccccaaauuugcua

SEQ ID NO: 1408699 - RNA, 15 nt, Homo sapiens
guguuagaauugccu

SEQ ID NO: 1408700 - RNA, 19 nt, Homo sapiens
guguucuucauuaccucag

SEQ ID NO: 1408701 - RNA, 17 nt, Homo sapiens
guuaaacuacuuguaaa

SEQ ID NO: 1408702 - RNA, 15 nt, Homo sapiens
guuaauaaacagcuc

SEQ ID NO: 1408703 - RNA, 15 nt, Homo sapiens
guuauagaaacugau

SEQ ID NO: 1408704 - RNA, 11 nt, Homo sapiens
guucucaggcc

SEQ ID NO: 1408705 - RNA, 23 nt, Homo sapiens
guucucuguucuagagugacagg

SEQ ID NO: 1408706 - RNA, 19 nt, Homo sapiens
guucuuagcugaacaauga

SEQ ID NO: 1408707 - RNA, 19 nt, Homo sapiens
guugcaggaccucagguga

SEQ ID NO: 1408708 - RNA, 18 nt, Homo sapiens
guugcugacuacuacucu

SEQ ID NO: 1408709 - RNA, 13 nt, Homo sapiens
guuggaacauccu

SEQ ID NO: 1408710 - RNA, 23 nt, Homo sapiens
uaaaaugaccaguaauugugaaa

SEQ ID NO: 1408711 - RNA, 14 nt, Homo sapiens
uaaacaaauaacaa

SEQ ID NO: 1408712 - RNA, 17 nt, Homo sapiens
uaaacaaauaacaaugu

SEQ ID NO: 1408713 - RNA, 15 nt, Homo sapiens
uaaacagacucgcuu

SEQ ID NO: 1408714 - RNA, 21 nt, Homo sapiens
uaaacagcucuaacacggcca

SEQ ID NO: 1408715 - RNA, 20 nt, Homo sapiens
uaaacagugagccugaauuu

SEQ ID NO: 1408716 - RNA, 14 nt, Homo sapiens
uaaacaugcuugca

SEQ ID NO: 1408717 - RNA, 17 nt, Homo sapiens
uaaacuaucuuggugaa

SEQ ID NO: 1408718 - RNA, 14 nt, Homo sapiens
uaaaguaagacauc

SEQ ID NO: 1408719 - RNA, 15 nt, Homo sapiens
uaaauaacagugugu

SEQ ID NO: 1408720 - RNA, 18 nt, Homo sapiens
uaaauaaccaauuccuca

SEQ ID NO: 1408721 - RNA, 21 nt, Homo sapiens
uaaaugugaaugaugauccua

SEQ ID NO: 1408722 - RNA, 18 nt, Homo sapiens
uaaauuagacuuccugua

SEQ ID NO: 1408723 - RNA, 16 nt, Homo sapiens
uaaauuuaugugaugg

SEQ ID NO: 1408724 - RNA, 19 nt, Homo sapiens
uaacagauuaguaguuaca

SEQ ID NO: 1408725 - RNA, 15 nt, Homo sapiens
uaaccuagugaauuu

SEQ ID NO: 1408726 - RNA, 13 nt, Homo sapiens
uaacggcacugug

SEQ ID NO: 1408727 - RNA, 22 nt, Homo sapiens
uaacucagucuuuaaucugaga

SEQ ID NO: 1408728 - RNA, 20 nt, Homo sapiens
uaacuuauuuuaaauaugcc

SEQ ID NO: 1408729 - RNA, 20 nt, Homo sapiens
uaagcugagcuccuuagccu

SEQ ID NO: 1408730 - RNA, 18 nt, Homo sapiens
uaaggaagacacagccca

SEQ ID NO: 1408731 - RNA, 21 nt, Homo sapiens
uaagugcuacuuugccauuaa

SEQ ID NO: 1408732 - RNA, 18 nt, Homo sapiens
uaaucaaugaucaucuca

SEQ ID NO: 1408733 - RNA, 22 nt, Homo sapiens
uaaucagguccucagagaauuu

SEQ ID NO: 1408734 - RNA, 16 nt, Homo sapiens
uaaucugagaggccac

SEQ ID NO: 1408735 - RNA, 20 nt, Homo sapiens
uaaugccccugauuuuauca

SEQ ID NO: 1408736 - RNA, 14 nt, Homo sapiens
uaauuaguuccuca

SEQ ID NO: 1408737 - RNA, 14 nt, Homo sapiens
gauguacacacaca

SEQ ID NO: 1408738 - RNA, 17 nt, Homo sapiens
gauguacacacacagau

SEQ ID NO: 1408739 - RNA, 14 nt, Homo sapiens
gaugucacaaagau

SEQ ID NO: 1408740 - RNA, 18 nt, Homo sapiens
gauuacaggcgcacacca

SEQ ID NO: 1408741 - RNA, 19 nt, Homo sapiens
gauucucaccugccuucaa

SEQ ID NO: 1408742 - RNA, 16 nt, Homo sapiens
gauucuuccugcuuag

SEQ ID NO: 1408743 - RNA, 22 nt, Homo sapiens
gauuguucuguccaguuuccaa

SEQ ID NO: 1408744 - RNA, 14 nt, Homo sapiens
gauuucaaaugcug

SEQ ID NO: 1408745 - RNA, 20 nt, Homo sapiens
gauuucaccguauuagccag

SEQ ID NO: 1408746 - RNA, 20 nt, Homo sapiens
gcaaacacaccgaugcacac

SEQ ID NO: 1408747 - RNA, 15 nt, Homo sapiens
gcaagcucugccucc

SEQ ID NO: 1408748 - RNA, 14 nt, Homo sapiens
gcaagucacuggcc

SEQ ID NO: 1408749 - RNA, 22 nt, Homo sapiens
gcaauggcacgaucucagcuca

SEQ ID NO: 1408750 - RNA, 19 nt, Homo sapiens
gcacaacaguucucuucua

SEQ ID NO: 1408751 - RNA, 18 nt, Homo sapiens
gcacaaggcugaccaaga

SEQ ID NO: 1408752 - RNA, 20 nt, Homo sapiens
gcacacacacggaugcacac

SEQ ID NO: 1408753 - RNA, 22 nt, Homo sapiens
gcacacacagauaugcacacac

SEQ ID NO: 1408754 - RNA, 16 nt, Homo sapiens
gcacagagauaugcac

SEQ ID NO: 1408755 - RNA, 16 nt, Homo sapiens
gcacauagagauaugc

SEQ ID NO: 1408756 - RNA, 22 nt, Homo sapiens
gcacauagagauaugcacacac

SEQ ID NO: 1408757 - RNA, 15 nt, Homo sapiens
gcacaugccaaugca

SEQ ID NO: 1408758 - RNA, 20 nt, Homo sapiens
gcaccacugcacuccagccu

SEQ ID NO: 1408759 - RNA, 14 nt, Homo sapiens
gcaccagugugaca

SEQ ID NO: 1408760 - RNA, 13 nt, Homo sapiens
gcaccaucucuga

SEQ ID NO: 1408761 - RNA, 16 nt, Homo sapiens
gcaccaucuggaagga

SEQ ID NO: 1408762 - RNA, 20 nt, Homo sapiens
gcacgcacaugccaaugcac

SEQ ID NO: 1408763 - RNA, 22 nt, Homo sapiens
gcacguguggccuguucuucua

SEQ ID NO: 1408764 - RNA, 21 nt, Homo sapiens
gcacuguggcucugcaugaca

SEQ ID NO: 1408765 - RNA, 14 nt, Homo sapiens
gcacuugcuuuuau

SEQ ID NO: 1408766 - RNA, 23 nt, Homo sapiens
gcagaucuuuuugugaaauucaa

SEQ ID NO: 1408767 - RNA, 18 nt, Homo sapiens
gcagccuggggucugaca

SEQ ID NO: 1408768 - RNA, 12 nt, Homo sapiens
gcaggaccucag

SEQ ID NO: 1408769 - RNA, 19 nt, Homo sapiens
gcaggagaaucacuggaac

SEQ ID NO: 1408770 - RNA, 16 nt, Homo sapiens
gcaggcugcagucccu

SEQ ID NO: 1408771 - RNA, 21 nt, Homo sapiens
gcagugacuuuagaaacaaau

SEQ ID NO: 1408772 - RNA, 22 nt, Homo sapiens
gcaguggcgugaucucggcuca

SEQ ID NO: 1408773 - RNA, 13 nt, Homo sapiens
gcauacaguuugc

SEQ ID NO: 1408774 - RNA, 15 nt, Homo sapiens
gcauacaguuugcac

SEQ ID NO: 1408775 - RNA, 19 nt, Homo sapiens
gcauacaguuugcacuuau

SEQ ID NO: 1408776 - RNA, 21 nt, Homo sapiens
gcauccagagucccugccugg

SEQ ID NO: 1408777 - RNA, 22 nt, Homo sapiens
gcaugaucuuucugcaggaaau

SEQ ID NO: 1408778 - RNA, 13 nt, Homo sapiens
gcauuagcuacuu

SEQ ID NO: 1408779 - RNA, 14 nt, Homo sapiens
gccacagugcaauu

SEQ ID NO: 1408780 - RNA, 14 nt, Homo sapiens
gccacggcacucca

SEQ ID NO: 1408781 - RNA, 19 nt, Homo sapiens
gccagaaaacauaugcauu

SEQ ID NO: 1408782 - RNA, 13 nt, Homo sapiens
gccagagccuuaa

SEQ ID NO: 1408783 - RNA, 21 nt, Homo sapiens
gccagcauuucccuuccuucc

SEQ ID NO: 1408784 - RNA, 17 nt, Homo sapiens
gccagcuuaucucaggg

SEQ ID NO: 1408785 - RNA, 14 nt, Homo sapiens
gccaggacaucucu

SEQ ID NO: 1408786 - RNA, 18 nt, Homo sapiens
gccaggauggucuugauc

SEQ ID NO: 1408787 - RNA, 22 nt, Homo sapiens
gccaggauggucuugaucuccu

SEQ ID NO: 1408788 - RNA, 18 nt, Homo sapiens
gccaggcaugguggccca

SEQ ID NO: 1408789 - RNA, 17 nt, Homo sapiens
gccauucccacuaagcu

SEQ ID NO: 1408790 - RNA, 20 nt, Homo sapiens
gcccacacccgacaccagcc

SEQ ID NO: 1408791 - RNA, 20 nt, Homo sapiens
gcccacuucauagaugagaa

SEQ ID NO: 1408792 - RNA, 18 nt, Homo sapiens
gccccagaaggcagggaa

SEQ ID NO: 1408793 - RNA, 16 nt, Homo sapiens
gcccgggagcucagga

SEQ ID NO: 1408794 - RNA, 15 nt, Homo sapiens
gcccuuccugaagaa

SEQ ID NO: 1408795 - RNA, 16 nt, Homo sapiens
gccgagaguccaucag

SEQ ID NO: 1408796 - RNA, 20 nt, Homo sapiens
gccgugauuuucauugcugg

SEQ ID NO: 1408797 - RNA, 13 nt, Homo sapiens
gccucccaccaga

SEQ ID NO: 1408798 - RNA, 22 nt, Homo sapiens
gccuggcuguggccuaaccugc

SEQ ID NO: 1408799 - RNA, 14 nt, Homo sapiens
gccuguaaucccag

SEQ ID NO: 1408800 - RNA, 12 nt, Homo sapiens
gccugugccuuu

SEQ ID NO: 1408801 - RNA, 14 nt, Homo sapiens
gccuugccaugucu

SEQ ID NO: 1408802 - RNA, 20 nt, Homo sapiens
gccuugucacgccagacuuc

SEQ ID NO: 1408803 - RNA, 14 nt, Homo sapiens
gcgcgguggcucac

SEQ ID NO: 1408804 - RNA, 18 nt, Homo sapiens
gcguuuggcccugugacu

SEQ ID NO: 1408805 - RNA, 15 nt, Homo sapiens
gcuacacuugcaccu

SEQ ID NO: 1408806 - RNA, 22 nt, Homo sapiens
gcuccaguggaagaagaaaaca

SEQ ID NO: 1408807 - RNA, 14 nt, Homo sapiens
gcucccagggccau

SEQ ID NO: 1408808 - RNA, 13 nt, Homo sapiens
gcucgagugaauu

SEQ ID NO: 1408809 - RNA, 23 nt, Homo sapiens
gcucuauaagagcuggaugcaca

SEQ ID NO: 1408810 - RNA, 15 nt, Homo sapiens
gcucugagauuucac

SEQ ID NO: 1408811 - RNA, 23 nt, Homo sapiens
gcugagcagguguucuucauuac

SEQ ID NO: 1408812 - RNA, 15 nt, Homo sapiens
gcugaggcaccagaa

SEQ ID NO: 1408813 - RNA, 15 nt, Homo sapiens
gcugaugcauucccg

SEQ ID NO: 1408814 - RNA, 15 nt, Homo sapiens
gcugccugacacuga

SEQ ID NO: 1408815 - RNA, 22 nt, Homo sapiens
gcugcgucuccuccgcacaccu

SEQ ID NO: 1408816 - RNA, 18 nt, Homo sapiens
gcugcugagaaucuagcc

SEQ ID NO: 1408817 - RNA, 19 nt, Homo sapiens
gcugcugagaaucuagccu

SEQ ID NO: 1408818 - RNA, 12 nt, Homo sapiens
gcuggccucuag

SEQ ID NO: 1408819 - RNA, 19 nt, Homo sapiens
gcugggaauaagugccagg

SEQ ID NO: 1408820 - RNA, 13 nt, Homo sapiens
gcugggagacaca

SEQ ID NO: 1408821 - RNA, 12 nt, Homo sapiens
gcuucaguccac

SEQ ID NO: 1408822 - RNA, 23 nt, Homo sapiens
gcuucucuugaaaacuugguaua

SEQ ID NO: 1408823 - RNA, 15 nt, Homo sapiens
gcuucugcauucaca

SEQ ID NO: 1408824 - RNA, 17 nt, Homo sapiens
gcuuuuaccaacccaaa

SEQ ID NO: 1408825 - RNA, 13 nt, Homo sapiens
ggaagggacacca

SEQ ID NO: 1408826 - RNA, 14 nt, Homo sapiens
ggacccggauguga

SEQ ID NO: 1408827 - RNA, 13 nt, Homo sapiens
ggagggcaggcau

SEQ ID NO: 1408828 - RNA, 13 nt, Homo sapiens
aauuugccuuugc

SEQ ID NO: 1408829 - RNA, 15 nt, Homo sapiens
acaaagauaugcuaa

SEQ ID NO: 1408830 - RNA, 21 nt, Homo sapiens
acaaagcaaagccacauuuug

SEQ ID NO: 1408831 - RNA, 15 nt, Homo sapiens
acaaagugacauucc

SEQ ID NO: 1408832 - RNA, 19 nt, Homo sapiens
acaaagugacauuccugag

SEQ ID NO: 1408833 - RNA, 17 nt, Homo sapiens
acaaauuguacauuuga

SEQ ID NO: 1408834 - RNA, 23 nt, Homo sapiens
acaacaggcauagcaaaugacau

SEQ ID NO: 1408835 - RNA, 14 nt, Homo sapiens
acaacucuagucag

SEQ ID NO: 1408836 - RNA, 16 nt, Homo sapiens
acaagagugaauuuga

SEQ ID NO: 1408837 - RNA, 16 nt, Homo sapiens
acaagcugcacccuca

SEQ ID NO: 1408838 - RNA, 22 nt, Homo sapiens
acaagucaucauaauucagcuc

SEQ ID NO: 1408839 - RNA, 22 nt, Homo sapiens
acaauaaaugcugaaugaaucc

SEQ ID NO: 1408840 - RNA, 12 nt, Homo sapiens
acaauccuccaa

SEQ ID NO: 1408841 - RNA, 15 nt, Homo sapiens
acacacacagaugca

SEQ ID NO: 1408842 - RNA, 16 nt, Homo sapiens
acacacagauaugcac

SEQ ID NO: 1408843 - RNA, 16 nt, Homo sapiens
acacacagaugcacac

SEQ ID NO: 1408844 - RNA, 17 nt, Homo sapiens
acacacgccaaugcaca

SEQ ID NO: 1408845 - RNA, 15 nt, Homo sapiens
acacacggaugcaca

SEQ ID NO: 1408846 - RNA, 20 nt, Homo sapiens
acacacggaugcacacacag

SEQ ID NO: 1408847 - RNA, 21 nt, Homo sapiens
acacacggaugcacacacaga

SEQ ID NO: 1408848 - RNA, 15 nt, Homo sapiens
acacagacugcgauu

SEQ ID NO: 1408849 - RNA, 15 nt, Homo sapiens
acacagagauaugca

SEQ ID NO: 1408850 - RNA, 18 nt, Homo sapiens
acacagagauaugcacac

SEQ ID NO: 1408851 - RNA, 22 nt, Homo sapiens
acacagauggucacacagagau

SEQ ID NO: 1408852 - RNA, 20 nt, Homo sapiens
acacagcaagacuccgucuc

SEQ ID NO: 1408853 - RNA, 14 nt, Homo sapiens
acacaggcaaaauc

SEQ ID NO: 1408854 - RNA, 16 nt, Homo sapiens
acacauggaugcacac

SEQ ID NO: 1408855 - RNA, 16 nt, Homo sapiens
acacauggaugcacgc

SEQ ID NO: 1408856 - RNA, 20 nt, Homo sapiens
acacauugcauuuugauaaa

SEQ ID NO: 1408857 - RNA, 17 nt, Homo sapiens
acaccaugauuaaccac

SEQ ID NO: 1408858 - RNA, 14 nt, Homo sapiens
acaccgaugcacac

SEQ ID NO: 1408859 - RNA, 20 nt, Homo sapiens
acaccugaaaauuaugaguc

SEQ ID NO: 1408860 - RNA, 14 nt, Homo sapiens
acacggaugcacac

SEQ ID NO: 1408861 - RNA, 17 nt, Homo sapiens
acacggaugcacagaga

SEQ ID NO: 1408862 - RNA, 22 nt, Homo sapiens
acacucaaggaaaagaugugcu

SEQ ID NO: 1408863 - RNA, 17 nt, Homo sapiens
acacugagauauucagc

SEQ ID NO: 1408864 - RNA, 20 nt, Homo sapiens
acacugagauauucagccca

SEQ ID NO: 1408865 - RNA, 15 nt, Homo sapiens
acagagauaugcaca

SEQ ID NO: 1408866 - RNA, 20 nt, Homo sapiens
acagagcaagacucugucuc

SEQ ID NO: 1408867 - RNA, 22 nt, Homo sapiens
acagauaugcacacacauggau

SEQ ID NO: 1408868 - RNA, 19 nt, Homo sapiens
acagaugcacacacaccga

SEQ ID NO: 1408869 - RNA, 18 nt, Homo sapiens
acagccucugaaaaccaa

SEQ ID NO: 1408870 - RNA, 22 nt, Homo sapiens
acaggccauggugcacaaaagg

SEQ ID NO: 1408871 - RNA, 13 nt, Homo sapiens
acaggcucugaga

SEQ ID NO: 1408872 - RNA, 14 nt, Homo sapiens
acaguaucucaggg

SEQ ID NO: 1408873 - RNA, 15 nt, Homo sapiens
acaguggaugcugcu

SEQ ID NO: 1408874 - RNA, 18 nt, Homo sapiens
acauagagauaugcacac

SEQ ID NO: 1408875 - RNA, 14 nt, Homo sapiens
acauauauguauau

SEQ ID NO: 1408876 - RNA, 18 nt, Homo sapiens
acauccaggcaauggccu

SEQ ID NO: 1408877 - RNA, 14 nt, Homo sapiens
acaucuuguaagac

SEQ ID NO: 1408878 - RNA, 22 nt, Homo sapiens
acauggagagagacucaaagag

SEQ ID NO: 1408879 - RNA, 16 nt, Homo sapiens
acauguaucacucacu

SEQ ID NO: 1408880 - RNA, 16 nt, Homo sapiens
acauucaaaaaccccu

SEQ ID NO: 1408881 - RNA, 14 nt, Homo sapiens
acauuuguuccaug

SEQ ID NO: 1408882 - RNA, 15 nt, Homo sapiens
accacaccacugccc

SEQ ID NO: 1408883 - RNA, 15 nt, Homo sapiens
accaccaccaucacc

SEQ ID NO: 1408884 - RNA, 17 nt, Homo sapiens
accagacucuguugcaa

SEQ ID NO: 1408885 - RNA, 13 nt, Homo sapiens
accagauuugcua

SEQ ID NO: 1408886 - RNA, 16 nt, Homo sapiens
accagugugacaucua

SEQ ID NO: 1408887 - RNA, 18 nt, Homo sapiens
accagugugacaucuaca

SEQ ID NO: 1408888 - RNA, 16 nt, Homo sapiens
accauaacaacuucau

SEQ ID NO: 1408889 - RNA, 22 nt, Homo sapiens
accaucuggaaggacaucuaca

SEQ ID NO: 1408890 - RNA, 23 nt, Homo sapiens
accaugauuaaccacuucagcug

SEQ ID NO: 1408891 - RNA, 19 nt, Homo sapiens
acccaauauuuaccagacc

SEQ ID NO: 1408892 - RNA, 12 nt, Homo sapiens
acccacuggcca

SEQ ID NO: 1408893 - RNA, 17 nt, Homo sapiens
acccaguuagcucucaa

SEQ ID NO: 1408894 - RNA, 13 nt, Homo sapiens
acccaugccauag

SEQ ID NO: 1408895 - RNA, 22 nt, Homo sapiens
accccagugcuuguuccucuca

SEQ ID NO: 1408896 - RNA, 11 nt, Homo sapiens
acccucagcug

SEQ ID NO: 1408897 - RNA, 14 nt, Homo sapiens
acccucaucuuucu

SEQ ID NO: 1408898 - RNA, 18 nt, Homo sapiens
acccucaucuuucuucca

SEQ ID NO: 1408899 - RNA, 19 nt, Homo sapiens
acccucaucuuucuuccaa

SEQ ID NO: 1408900 - RNA, 22 nt, Homo sapiens
acccuuaggccagcaccaucuc

SEQ ID NO: 1408901 - RNA, 17 nt, Homo sapiens
acccuucagauuugccu

SEQ ID NO: 1408902 - RNA, 16 nt, Homo sapiens
accggggccugggcag

SEQ ID NO: 1408903 - RNA, 23 nt, Homo sapiens
accguucauucaggcaacgcaca

SEQ ID NO: 1408904 - RNA, 22 nt, Homo sapiens
accucagguugaaauaccaggg

SEQ ID NO: 1408905 - RNA, 17 nt, Homo sapiens
accuccaaaagcccuga

SEQ ID NO: 1408906 - RNA, 23 nt, Homo sapiens
accuccuaauuccacacccucac

SEQ ID NO: 1408907 - RNA, 18 nt, Homo sapiens
accugaaagaagcccagg

SEQ ID NO: 1408908 - RNA, 13 nt, Homo sapiens
accugaaccuggg

SEQ ID NO: 1408909 - RNA, 21 nt, Homo sapiens
accuggagcggcuauuccagg

SEQ ID NO: 1408910 - RNA, 19 nt, Homo sapiens
accuggcccugugccuugg

SEQ ID NO: 1408911 - RNA, 22 nt, Homo sapiens
acgcaaacacaccgaugcacac

SEQ ID NO: 1408912 - RNA, 13 nt, Homo sapiens
acgcacacaucag

SEQ ID NO: 1408913 - RNA, 19 nt, Homo sapiens
acgcacauagagauaugca

SEQ ID NO: 1408914 - RNA, 15 nt, Homo sapiens
acgccagacuuccca

SEQ ID NO: 1408915 - RNA, 17 nt, Homo sapiens
acggacacucaaaagcu

SEQ ID NO: 1408916 - RNA, 12 nt, Homo sapiens
acggaugcacag

SEQ ID NO: 1408917 - RNA, 20 nt, Homo sapiens
acggcugccugacacugagc

SEQ ID NO: 1408918 - RNA, 14 nt, Homo sapiens
acgggaagcaagau

SEQ ID NO: 1408919 - RNA, 14 nt, Homo sapiens
acgggcucagcaaa

SEQ ID NO: 1408920 - RNA, 18 nt, Homo sapiens
acgucagcugggacaccc

SEQ ID NO: 1408921 - RNA, 14 nt, Homo sapiens
acuacaucacuuga

SEQ ID NO: 1408922 - RNA, 18 nt, Homo sapiens
acuagccaucucaagcaa

SEQ ID NO: 1408923 - RNA, 16 nt, Homo sapiens
acuauucuagcaggag

SEQ ID NO: 1408924 - RNA, 23 nt, Homo sapiens
acucacacggacacucaaaagcu

SEQ ID NO: 1408925 - RNA, 18 nt, Homo sapiens
acucaggaauguuugcug

SEQ ID NO: 1408926 - RNA, 17 nt, Homo sapiens
acucaggggucauucau

SEQ ID NO: 1408927 - RNA, 18 nt, Homo sapiens
acucauagggugcucuga

SEQ ID NO: 1408928 - RNA, 19 nt, Homo sapiens
acucaugugacucuuucca

SEQ ID NO: 1408929 - RNA, 20 nt, Homo sapiens
acuccagcugggagacacag

SEQ ID NO: 1408930 - RNA, 15 nt, Homo sapiens
acucccacuuggcau

SEQ ID NO: 1408931 - RNA, 14 nt, Homo sapiens
acucccauuuuccc

SEQ ID NO: 1408932 - RNA, 15 nt, Homo sapiens
acuccugaccucgug

SEQ ID NO: 1408933 - RNA, 23 nt, Homo sapiens
acuccugaccucgugauuugccu

SEQ ID NO: 1408934 - RNA, 15 nt, Homo sapiens
acucucaccucguga

SEQ ID NO: 1408935 - RNA, 21 nt, Homo sapiens
acucuggagguuuguuuagaa

SEQ ID NO: 1408936 - RNA, 13 nt, Homo sapiens
ggaaaauguuaug

SEQ ID NO: 1408937 - RNA, 13 nt, Homo sapiens
ggaacacuggugg

SEQ ID NO: 1408938 - RNA, 13 nt, Homo sapiens
ggaaccaugaagc

SEQ ID NO: 1408939 - RNA, 23 nt, Homo sapiens
ggaacugggccaacucaccugag

SEQ ID NO: 1408940 - RNA, 15 nt, Homo sapiens
ggaagacaaugugaa

SEQ ID NO: 1408941 - RNA, 17 nt, Homo sapiens
ggaaggacauccauguu

SEQ ID NO: 1408942 - RNA, 15 nt, Homo sapiens
ggaaguuuguucacu

SEQ ID NO: 1408943 - RNA, 15 nt, Homo sapiens
ggaauacugugcaua

SEQ ID NO: 1408944 - RNA, 16 nt, Homo sapiens
ggacaguggaugcugc

SEQ ID NO: 1408945 - RNA, 13 nt, Homo sapiens
ggaccacaccucc

SEQ ID NO: 1408946 - RNA, 13 nt, Homo sapiens
ggagaggggcaca

SEQ ID NO: 1408947 - RNA, 18 nt, Homo sapiens
ggaguccucgacuuauca

SEQ ID NO: 1408948 - RNA, 19 nt, Homo sapiens
ggauacccuggagcaagac

SEQ ID NO: 1408949 - RNA, 12 nt, Homo sapiens
ggaugcacacac

SEQ ID NO: 1408950 - RNA, 16 nt, Homo sapiens
ggaugcacacacagau

SEQ ID NO: 1408951 - RNA, 14 nt, Homo sapiens
ggaugcacagagau

SEQ ID NO: 1408952 - RNA, 16 nt, Homo sapiens
ggaugggaacacuggu

SEQ ID NO: 1408953 - RNA, 16 nt, Homo sapiens
ggauguaccagcaucu

SEQ ID NO: 1408954 - RNA, 12 nt, Homo sapiens
ggaugucucuca

SEQ ID NO: 1408955 - RNA, 19 nt, Homo sapiens
ggauguugcuuuugcaccu

SEQ ID NO: 1408956 - RNA, 16 nt, Homo sapiens
ggcaaaaaaauuaaau

SEQ ID NO: 1408957 - RNA, 19 nt, Homo sapiens
ggcaagaaugaaauacucu

SEQ ID NO: 1408958 - RNA, 20 nt, Homo sapiens
ggcacaaauuguacauuuga

SEQ ID NO: 1408959 - RNA, 14 nt, Homo sapiens
ggccacacuggcau

SEQ ID NO: 1408960 - RNA, 18 nt, Homo sapiens
ggccacagugcaauuuua

SEQ ID NO: 1408961 - RNA, 16 nt, Homo sapiens
ggccacucuaccugaa

SEQ ID NO: 1408962 - RNA, 17 nt, Homo sapiens
ggccagaugcacauccc

SEQ ID NO: 1408963 - RNA, 13 nt, Homo sapiens
ggccauggcaauu

SEQ ID NO: 1408964 - RNA, 15 nt, Homo sapiens
ggcccucuucuuauu

SEQ ID NO: 1408965 - RNA, 15 nt, Homo sapiens
ggcccugugccuugg

SEQ ID NO: 1408966 - RNA, 21 nt, Homo sapiens
ggcuauaccugggcauacuaa

SEQ ID NO: 1408967 - RNA, 22 nt, Homo sapiens
ggcuccaccccauccaguucau

SEQ ID NO: 1408968 - RNA, 21 nt, Homo sapiens
ggcuccucgagaucccaacac

SEQ ID NO: 1408969 - RNA, 18 nt, Homo sapiens
ggcucugaggaguggagu

SEQ ID NO: 1408970 - RNA, 23 nt, Homo sapiens
ggcuggugacagaacaugcagca

SEQ ID NO: 1408971 - RNA, 18 nt, Homo sapiens
ggcuguggccuaaccugc

SEQ ID NO: 1408972 - RNA, 23 nt, Homo sapiens
ggcuucucucucuagcagcaccu

SEQ ID NO: 1408973 - RNA, 23 nt, Homo sapiens
gggaauacugugcauaagccauu

SEQ ID NO: 1408974 - RNA, 16 nt, Homo sapiens
gggaccacaccucccu

SEQ ID NO: 1408975 - RNA, 16 nt, Homo sapiens
gggagaaugucaguau

SEQ ID NO: 1408976 - RNA, 22 nt, Homo sapiens
gggagcaugggacugugccuuu

SEQ ID NO: 1408977 - RNA, 20 nt, Homo sapiens
gggaggucaaggcugcagug

SEQ ID NO: 1408978 - RNA, 17 nt, Homo sapiens
gggaugggaacacuggu

SEQ ID NO: 1408979 - RNA, 23 nt, Homo sapiens
gggcaaaagacgggaagcaagau

SEQ ID NO: 1408980 - RNA, 23 nt, Homo sapiens
gggcaaagaacugccccaucucc

SEQ ID NO: 1408981 - RNA, 19 nt, Homo sapiens
gggcagugcccaccaugca

SEQ ID NO: 1408982 - RNA, 22 nt, Homo sapiens
gggccacucaggggucauucau

SEQ ID NO: 1408983 - RNA, 16 nt, Homo sapiens
gggccucccaccagag

SEQ ID NO: 1408984 - RNA, 17 nt, Homo sapiens
gggcugaggccucucau

SEQ ID NO: 1408985 - RNA, 23 nt, Homo sapiens
ggggcacccuccaaacacugggc

SEQ ID NO: 1408986 - RNA, 18 nt, Homo sapiens
ggguuagcucacgugucu

SEQ ID NO: 1408987 - RNA, 14 nt, Homo sapiens
gguaauuguugcua

SEQ ID NO: 1408988 - RNA, 21 nt, Homo sapiens
gguacagacacucccacuugg

SEQ ID NO: 1408989 - RNA, 21 nt, Homo sapiens
gguauuaaauugauguugcug

SEQ ID NO: 1408990 - RNA, 17 nt, Homo sapiens
gguccuaaagaugcuga

SEQ ID NO: 1408991 - RNA, 16 nt, Homo sapiens
ggucucgaacuccuga

SEQ ID NO: 1408992 - RNA, 16 nt, Homo sapiens
ggugccaaguuccacu

SEQ ID NO: 1408993 - RNA, 15 nt, Homo sapiens
gguggaacaagcaca

SEQ ID NO: 1408994 - RNA, 14 nt, Homo sapiens
gguggagugucaca

SEQ ID NO: 1408995 - RNA, 22 nt, Homo sapiens
ggugguuuuugagccaugcgug

SEQ ID NO: 1408996 - RNA, 14 nt, Homo sapiens
gguuagcuaccugc

SEQ ID NO: 1408997 - RNA, 11 nt, Homo sapiens
gguucucaggc

SEQ ID NO: 1408998 - RNA, 23 nt, Homo sapiens
guaaaagucuaguuaccuacuuu

SEQ ID NO: 1408999 - RNA, 17 nt, Homo sapiens
guaaguuucucauccca

SEQ ID NO: 1409000 - RNA, 17 nt, Homo sapiens
guaauaaaacaauguuu

SEQ ID NO: 1409001 - RNA, 18 nt, Homo sapiens
guaaucccagcuauucag

SEQ ID NO: 1409002 - RNA, 13 nt, Homo sapiens
guacacacacaga

SEQ ID NO: 1409003 - RNA, 20 nt, Homo sapiens
guacacacacagaugcacac

SEQ ID NO: 1409004 - RNA, 12 nt, Homo sapiens
guacagacacuc

SEQ ID NO: 1409005 - RNA, 14 nt, Homo sapiens
guaggaacugcugg

SEQ ID NO: 1409006 - RNA, 13 nt, Homo sapiens
guaguauuuuggc

SEQ ID NO: 1409007 - RNA, 21 nt, Homo sapiens
guauauauucuacacauauau

SEQ ID NO: 1409008 - RNA, 20 nt, Homo sapiens
guauuacaaaaacauggccu

SEQ ID NO: 1409009 - RNA, 20 nt, Homo sapiens
guauuuuguuuuugucuuaa

SEQ ID NO: 1409010 - RNA, 16 nt, Homo sapiens
gucaacagcgugcagg

SEQ ID NO: 1409011 - RNA, 19 nt, Homo sapiens
gucacaucucugccuggaa

SEQ ID NO: 1409012 - RNA, 21 nt, Homo sapiens
gucagcacaggccauggugca

SEQ ID NO: 1409013 - RNA, 15 nt, Homo sapiens
gucaguauguggaag

SEQ ID NO: 1409014 - RNA, 16 nt, Homo sapiens
gucauguguuuugcca

SEQ ID NO: 1409015 - RNA, 13 nt, Homo sapiens
guccagcacugga

SEQ ID NO: 1409016 - RNA, 23 nt, Homo sapiens
gucccagaaugccuccugcaggg

SEQ ID NO: 1409017 - RNA, 16 nt, Homo sapiens
gucccucucucuggaa

SEQ ID NO: 1409018 - RNA, 16 nt, Homo sapiens
guccuaaagaugcuga

SEQ ID NO: 1409019 - RNA, 21 nt, Homo sapiens
guccucauuauaaaaugggaa

SEQ ID NO: 1409020 - RNA, 18 nt, Homo sapiens
guccugaugcugugcuca

SEQ ID NO: 1409021 - RNA, 22 nt, Homo sapiens
gucucaaaccuccaaaagcccu

SEQ ID NO: 1409022 - RNA, 21 nt, Homo sapiens
gucugcucccaauucaccucg

SEQ ID NO: 1409023 - RNA, 12 nt, Homo sapiens
gucugucccaaa

SEQ ID NO: 1409024 - RNA, 19 nt, Homo sapiens
gucuguguguuuaugugug

SEQ ID NO: 1409025 - RNA, 14 nt, Homo sapiens
gugacucuuuccaa

SEQ ID NO: 1409026 - RNA, 13 nt, Homo sapiens
gugagaccaccuc

SEQ ID NO: 1409027 - RNA, 16 nt, Homo sapiens
gugagacccuguucua

SEQ ID NO: 1409028 - RNA, 14 nt, Homo sapiens
gugaggggcucucu

SEQ ID NO: 1409029 - RNA, 17 nt, Homo sapiens
gugaggggcucucucau

SEQ ID NO: 1409030 - RNA, 16 nt, Homo sapiens
gugaggugacuugccu

SEQ ID NO: 1409031 - RNA, 21 nt, Homo sapiens
gugauguguccugauaagcug

SEQ ID NO: 1409032 - RNA, 20 nt, Homo sapiens
gugauuguuaugccuugcua

SEQ ID NO: 1409033 - RNA, 17 nt, Homo sapiens
gugauuuucauugcugg

SEQ ID NO: 1409034 - RNA, 16 nt, Homo sapiens
gugccaggauggaaug

SEQ ID NO: 1409035 - RNA, 14 nt, Homo sapiens
gugcuccaguucca

SEQ ID NO: 1409036 - RNA, 18 nt, Homo sapiens
guggaagaagaaaacacu

SEQ ID NO: 1409037 - RNA, 12 nt, Homo sapiens
guggacaccugc

SEQ ID NO: 1409038 - RNA, 18 nt, Homo sapiens
guggaguucucuguucua

SEQ ID NO: 1409039 - RNA, 12 nt, Homo sapiens
guggaugcugcu

SEQ ID NO: 1409040 - RNA, 23 nt, Homo sapiens
guggcagcugucucaaaccucca

SEQ ID NO: 1409041 - RNA, 14 nt, Homo sapiens
guguaauaugcaca

SEQ ID NO: 1409042 - RNA, 19 nt, Homo sapiens
guguaucgcugccuugcca

SEQ ID NO: 1409043 - RNA, 13 nt, Homo sapiens
gugucacccuuag

SEQ ID NO: 1409044 - RNA, 21 nt, Homo sapiens
guguccauugaugucauucag

SEQ ID NO: 1409045 - RNA, 15 nt, Homo sapiens
ucuggaaggacaucu

SEQ ID NO: 1409046 - RNA, 20 nt, Homo sapiens
ucugguuagaaaaaggacuc

SEQ ID NO: 1409047 - RNA, 14 nt, Homo sapiens
ucugucccaaagaa

SEQ ID NO: 1409048 - RNA, 13 nt, Homo sapiens
ucuguucacuuuu

SEQ ID NO: 1409049 - RNA, 15 nt, Homo sapiens
ucuuaaaauucuugg

SEQ ID NO: 1409050 - RNA, 19 nt, Homo sapiens
ucuuaccuguaugucucca

SEQ ID NO: 1409051 - RNA, 16 nt, Homo sapiens
ucuuagaaaaaccacc

SEQ ID NO: 1409052 - RNA, 15 nt, Homo sapiens
ucuuagaagugacau

SEQ ID NO: 1409053 - RNA, 18 nt, Homo sapiens
ucuuagcugaacaaugaa

SEQ ID NO: 1409054 - RNA, 11 nt, Homo sapiens
ucuuagcuguc

SEQ ID NO: 1409055 - RNA, 22 nt, Homo sapiens
ucuucaggguguuaaggcagug

SEQ ID NO: 1409056 - RNA, 15 nt, Homo sapiens
ucuucauuaccucag

SEQ ID NO: 1409057 - RNA, 20 nt, Homo sapiens
ucuucauuaccucagugaga

SEQ ID NO: 1409058 - RNA, 18 nt, Homo sapiens
ucuuccaaacaggcucag

SEQ ID NO: 1409059 - RNA, 15 nt, Homo sapiens
ucuuucauacauuau

SEQ ID NO: 1409060 - RNA, 12 nt, Homo sapiens
ucuuugcuacaa

SEQ ID NO: 1409061 - RNA, 23 nt, Homo sapiens
ucuuuuaggaggcacaacaguuc

SEQ ID NO: 1409062 - RNA, 15 nt, Homo sapiens
ucuuuucaaccuacu

SEQ ID NO: 1409063 - RNA, 16 nt, Homo sapiens
ucuuuugucccagaaa

SEQ ID NO: 1409064 - RNA, 21 nt, Homo sapiens
ugaaaaaugguaauuguugcu

SEQ ID NO: 1409065 - RNA, 22 nt, Homo sapiens
ugaaaaaugguaauuguugcua

SEQ ID NO: 1409066 - RNA, 16 nt, Homo sapiens
ugaaaagaaucagcau

SEQ ID NO: 1409067 - RNA, 17 nt, Homo sapiens
ugaaaaugaaaccgcau

SEQ ID NO: 1409068 - RNA, 20 nt, Homo sapiens
ugaaaauugggcaugccauu

SEQ ID NO: 1409069 - RNA, 23 nt, Homo sapiens
ugaaauaccaaccugaagacacc

SEQ ID NO: 1409070 - RNA, 15 nt, Homo sapiens
ugaacacacauggau

SEQ ID NO: 1409071 - RNA, 21 nt, Homo sapiens
ugaacacacauggaugcacac

SEQ ID NO: 1409072 - RNA, 15 nt, Homo sapiens
ugaacacacucagca

SEQ ID NO: 1409073 - RNA, 19 nt, Homo sapiens
ugaacuauuagagcugccu

SEQ ID NO: 1409074 - RNA, 19 nt, Homo sapiens
ugaagaacuggcaucuuaa

SEQ ID NO: 1409075 - RNA, 15 nt, Homo sapiens
ugaagaaguucuuaa

SEQ ID NO: 1409076 - RNA, 16 nt, Homo sapiens
ugaaggagaaaaugca

SEQ ID NO: 1409077 - RNA, 19 nt, Homo sapiens
ugaagucccagauacuugg

SEQ ID NO: 1409078 - RNA, 15 nt, Homo sapiens
ugaagugcagcucag

SEQ ID NO: 1409079 - RNA, 16 nt, Homo sapiens
ugaauaauacaguauc

SEQ ID NO: 1409080 - RNA, 23 nt, Homo sapiens
ugaauaugggguugguguucuca

SEQ ID NO: 1409081 - RNA, 18 nt, Homo sapiens
ugaauuacacucaaggaa

SEQ ID NO: 1409082 - RNA, 16 nt, Homo sapiens
ugaauuucccacauac

SEQ ID NO: 1409083 - RNA, 21 nt, Homo sapiens
ugacacacaaaucccauuaaa

SEQ ID NO: 1409084 - RNA, 20 nt, Homo sapiens
ugacacggccaugaccacuu

SEQ ID NO: 1409085 - RNA, 15 nt, Homo sapiens
ugacaggcaccagau

SEQ ID NO: 1409086 - RNA, 14 nt, Homo sapiens
ugacaucacuugua

SEQ ID NO: 1409087 - RNA, 18 nt, Homo sapiens
ugacaucagcaauacaga

SEQ ID NO: 1409088 - RNA, 20 nt, Homo sapiens
ugaccaagagagaaagaagu

SEQ ID NO: 1409089 - RNA, 15 nt, Homo sapiens
ugacggcaccaucug

SEQ ID NO: 1409090 - RNA, 22 nt, Homo sapiens
ugacggcugcucgaagaacaau

SEQ ID NO: 1409091 - RNA, 18 nt, Homo sapiens
ugacuacuacucugccaa

SEQ ID NO: 1409092 - RNA, 16 nt, Homo sapiens
ugacuagccaucucaa

SEQ ID NO: 1409093 - RNA, 16 nt, Homo sapiens
ugacucucagcagcua

SEQ ID NO: 1409094 - RNA, 17 nt, Homo sapiens
ugagaagaggcugcugc

SEQ ID NO: 1409095 - RNA, 16 nt, Homo sapiens
ugagaccgaaucucac

SEQ ID NO: 1409096 - RNA, 14 nt, Homo sapiens
ugagagcauucugc

SEQ ID NO: 1409097 - RNA, 16 nt, Homo sapiens
ugagauuacaggcgca

SEQ ID NO: 1409098 - RNA, 11 nt, Homo sapiens
ugagcacacac

SEQ ID NO: 1409099 - RNA, 15 nt, Homo sapiens
ugagccaccaugccc

SEQ ID NO: 1409100 - RNA, 12 nt, Homo sapiens
ugaggauuucaa

SEQ ID NO: 1409101 - RNA, 13 nt, Homo sapiens
ugaggauuucaag

SEQ ID NO: 1409102 - RNA, 16 nt, Homo sapiens
ugaggggcucucucau

SEQ ID NO: 1409103 - RNA, 17 nt, Homo sapiens
ugauaagcugagcuccu

SEQ ID NO: 1409104 - RNA, 11 nt, Homo sapiens
ugaucaaguca

SEQ ID NO: 1409105 - RNA, 22 nt, Homo sapiens
ugauggaccuccuucgcuggaa

SEQ ID NO: 1409106 - RNA, 15 nt, Homo sapiens
ugauuguauuuaccu

SEQ ID NO: 1409107 - RNA, 14 nt, Homo sapiens
ugauuuaaaucagc

SEQ ID NO: 1409108 - RNA, 13 nt, Homo sapiens
ugauuucaagacc

SEQ ID NO: 1409109 - RNA, 17 nt, Homo sapiens
ugcaacuaauucaauaa

SEQ ID NO: 1409110 - RNA, 22 nt, Homo sapiens
ugcaauggcacgaucucagcuc

SEQ ID NO: 1409111 - RNA, 21 nt, Homo sapiens
ugcacaaaagggacuuggaaa

SEQ ID NO: 1409112 - RNA, 23 nt, Homo sapiens
ugcacacgcacauagagauaugc

SEQ ID NO: 1409113 - RNA, 17 nt, Homo sapiens
ugcacacggaugcacag

SEQ ID NO: 1409114 - RNA, 17 nt, Homo sapiens
ugcacagagauaugcac

SEQ ID NO: 1409115 - RNA, 17 nt, Homo sapiens
ugcaccagugugacauc

SEQ ID NO: 1409116 - RNA, 13 nt, Homo sapiens
ugcacgcacacau

SEQ ID NO: 1409117 - RNA, 17 nt, Homo sapiens
ugcacgucaccaaguaa

SEQ ID NO: 1409118 - RNA, 21 nt, Homo sapiens
ugcaggcugcagucccuggaa

SEQ ID NO: 1409119 - RNA, 20 nt, Homo sapiens
ugcaguggugcgaucuuggc

SEQ ID NO: 1409120 - RNA, 20 nt, Homo sapiens
ugccacagaugauacuucca

SEQ ID NO: 1409121 - RNA, 14 nt, Homo sapiens
ugccagcauuuccc

SEQ ID NO: 1409122 - RNA, 15 nt, Homo sapiens
ugccagcauuucccu

SEQ ID NO: 1409123 - RNA, 20 nt, Homo sapiens
ugccagcuuaucucaggggu

SEQ ID NO: 1409124 - RNA, 17 nt, Homo sapiens
ugccaugucuuguucag

SEQ ID NO: 1409125 - RNA, 18 nt, Homo sapiens
ugccauucccacuaagcu

SEQ ID NO: 1409126 - RNA, 20 nt, Homo sapiens
ugcccaggcuagagugcagu

SEQ ID NO: 1409127 - RNA, 20 nt, Homo sapiens
ugcccaggcuggagugcaau

SEQ ID NO: 1409128 - RNA, 20 nt, Homo sapiens
ugcccaggcuggagugcagu

SEQ ID NO: 1409129 - RNA, 16 nt, Homo sapiens
ugccccaaggaccuua

SEQ ID NO: 1409130 - RNA, 22 nt, Homo sapiens
ugccccacccaguuucuggaaa

SEQ ID NO: 1409131 - RNA, 18 nt, Homo sapiens
ugccccgcuauuccucac

SEQ ID NO: 1409132 - RNA, 17 nt, Homo sapiens
ugcccgaccccaucuca

SEQ ID NO: 1409133 - RNA, 18 nt, Homo sapiens
ugcccggcaggguccuag

SEQ ID NO: 1409134 - RNA, 15 nt, Homo sapiens
ugcccgggagcucag

SEQ ID NO: 1409135 - RNA, 16 nt, Homo sapiens
ugccgggcugcacaga

SEQ ID NO: 1409136 - RNA, 18 nt, Homo sapiens
ugccucauuucuuccucu

SEQ ID NO: 1409137 - RNA, 22 nt, Homo sapiens
ugccuccauucugaccauuuca

SEQ ID NO: 1409138 - RNA, 22 nt, Homo sapiens
ugccucccguguucacaccauu

SEQ ID NO: 1409139 - RNA, 14 nt, Homo sapiens
ugccuuaaggccac

SEQ ID NO: 1409140 - RNA, 20 nt, Homo sapiens
ugccuuaguuguuaucaucu

SEQ ID NO: 1409141 - RNA, 22 nt, Homo sapiens
ugccuucagaggauaaauauca

SEQ ID NO: 1409142 - RNA, 21 nt, Homo sapiens
ugcgcacacacagauaugcac

SEQ ID NO: 1409143 - RNA, 23 nt, Homo sapiens
ugcgcacacacagauaugcacac

SEQ ID NO: 1409144 - RNA, 18 nt, Homo sapiens
ugcggccuuuggcuucac

SEQ ID NO: 1409145 - RNA, 17 nt, Homo sapiens
ugcuacuuugccauuaa

SEQ ID NO: 1409146 - RNA, 15 nt, Homo sapiens
ugcuagaagcuguaa

SEQ ID NO: 1409147 - RNA, 21 nt, Homo sapiens
ugcuauuguagagccagaggu

SEQ ID NO: 1409148 - RNA, 14 nt, Homo sapiens
ugcucaccaagaag

SEQ ID NO: 1409149 - RNA, 13 nt, Homo sapiens
ugcucccacagaa

SEQ ID NO: 1409150 - RNA, 16 nt, Homo sapiens
ugcucuggaagaccug

SEQ ID NO: 1409151 - RNA, 21 nt, Homo sapiens
ugcucugguuagaaaaaggac

SEQ ID NO: 1409152 - RNA, 21 nt, Homo sapiens
ugcucuucagagauguuaaaa

SEQ ID NO: 1409153 - RNA, 16 nt, Homo sapiens
aguaacaaaaguauag

SEQ ID NO: 1409154 - RNA, 17 nt, Homo sapiens
aguacuuaaacuuccac

SEQ ID NO: 1409155 - RNA, 23 nt, Homo sapiens
aguauaggauaaauuacauuaaa

SEQ ID NO: 1409156 - RNA, 14 nt, Homo sapiens
agucaacagugaaa

SEQ ID NO: 1409157 - RNA, 20 nt, Homo sapiens
agucagacuuacuuacuccc

SEQ ID NO: 1409158 - RNA, 16 nt, Homo sapiens
aguccacaguacauaa

SEQ ID NO: 1409159 - RNA, 16 nt, Homo sapiens
aguccacuucugcucu

SEQ ID NO: 1409160 - RNA, 13 nt, Homo sapiens
agucccugaagga

SEQ ID NO: 1409161 - RNA, 21 nt, Homo sapiens
agucccuuagaagaucugcuu

SEQ ID NO: 1409162 - RNA, 16 nt, Homo sapiens
aguccucgacuuauca

SEQ ID NO: 1409163 - RNA, 18 nt, Homo sapiens
agucucuaugaucuuggc

SEQ ID NO: 1409164 - RNA, 14 nt, Homo sapiens
agucucuucucaga

SEQ ID NO: 1409165 - RNA, 17 nt, Homo sapiens
agugaacacacucagca

SEQ ID NO: 1409166 - RNA, 18 nt, Homo sapiens
agugaugaaaauuugccu

SEQ ID NO: 1409167 - RNA, 23 nt, Homo sapiens
agugcacacggaugcacagagau

SEQ ID NO: 1409168 - RNA, 20 nt, Homo sapiens
aguggcgugaucucggcuca

SEQ ID NO: 1409169 - RNA, 17 nt, Homo sapiens
aguggugcgaucuuggc

SEQ ID NO: 1409170 - RNA, 17 nt, Homo sapiens
aguuccacgaaacacug

SEQ ID NO: 1409171 - RNA, 20 nt, Homo sapiens
aguuccagauuguucugucc

SEQ ID NO: 1409172 - RNA, 22 nt, Homo sapiens
aguuucgacguuugacuagcca

SEQ ID NO: 1409173 - RNA, 19 nt, Homo sapiens
aguuuggaaugaagaaauu

SEQ ID NO: 1409174 - RNA, 13 nt, Homo sapiens
auaaaacaauguu

SEQ ID NO: 1409175 - RNA, 17 nt, Homo sapiens
auaaaaccccaucucua

SEQ ID NO: 1409176 - RNA, 14 nt, Homo sapiens
auaaaagauuuucc

SEQ ID NO: 1409177 - RNA, 19 nt, Homo sapiens
auaaaagauuuuccuauuc

SEQ ID NO: 1409178 - RNA, 17 nt, Homo sapiens
auaaaauguaauuacuu

SEQ ID NO: 1409179 - RNA, 16 nt, Homo sapiens
auaaacaacauugucu

SEQ ID NO: 1409180 - RNA, 18 nt, Homo sapiens
auaaacaugcuugcauua

SEQ ID NO: 1409181 - RNA, 13 nt, Homo sapiens
augcugugcucaa

SEQ ID NO: 1409182 - RNA, 20 nt, Homo sapiens
augcugugcucaaucagccu

SEQ ID NO: 1409183 - RNA, 17 nt, Homo sapiens
auggaaaggagaggaaa

SEQ ID NO: 1409184 - RNA, 15 nt, Homo sapiens
auggaacucagagau

SEQ ID NO: 1409185 - RNA, 18 nt, Homo sapiens
auggagucucgcucugcu

SEQ ID NO: 1409186 - RNA, 12 nt, Homo sapiens
auggaugcacac

SEQ ID NO: 1409187 - RNA, 19 nt, Homo sapiens
augggguugguguucucau

SEQ ID NO: 1409188 - RNA, 16 nt, Homo sapiens
augguaauuguugcua

SEQ ID NO: 1409189 - RNA, 16 nt, Homo sapiens
auguaaguacuuccac

SEQ ID NO: 1409190 - RNA, 16 nt, Homo sapiens
auguacacacacagau

SEQ ID NO: 1409191 - RNA, 21 nt, Homo sapiens
auguacacacacagaugcaca

SEQ ID NO: 1409192 - RNA, 22 nt, Homo sapiens
auguacacacacagaugcacac

SEQ ID NO: 1409193 - RNA, 14 nt, Homo sapiens
auguaccagcaucu

SEQ ID NO: 1409194 - RNA, 15 nt, Homo sapiens
auguaccagcaucuc

SEQ ID NO: 1409195 - RNA, 16 nt, Homo sapiens
augucuuuuuacccuu

SEQ ID NO: 1409196 - RNA, 15 nt, Homo sapiens
augugacucuuucca

SEQ ID NO: 1409197 - RNA, 17 nt, Homo sapiens
augugcgcacacacaga

SEQ ID NO: 1409198 - RNA, 23 nt, Homo sapiens
augugcgcacacacagauaugca

SEQ ID NO: 1409199 - RNA, 18 nt, Homo sapiens
augugcucccaccaggca

SEQ ID NO: 1409200 - RNA, 21 nt, Homo sapiens
auguggagcucagcaacaagg

SEQ ID NO: 1409201 - RNA, 17 nt, Homo sapiens
auguuccgagaagaaca

SEQ ID NO: 1409202 - RNA, 22 nt, Homo sapiens
auuaagugacuauagaaugcaa

SEQ ID NO: 1409203 - RNA, 15 nt, Homo sapiens
auuaauuaaaccaga

SEQ ID NO: 1409204 - RNA, 24 nt, Homo sapiens
auuagaagacaacaggcauagcaa

SEQ ID NO: 1409205 - RNA, 12 nt, Homo sapiens
auuauucccaug

SEQ ID NO: 1409206 - RNA, 21 nt, Homo sapiens
auuauuucaaccgcuugccau

SEQ ID NO: 1409207 - RNA, 19 nt, Homo sapiens
auucaaccugugucuuaua

SEQ ID NO: 1409208 - RNA, 20 nt, Homo sapiens
auucacagcaagucacuggc

SEQ ID NO: 1409209 - RNA, 22 nt, Homo sapiens
uccaaacacugggcucugagga

SEQ ID NO: 1409210 - RNA, 16 nt, Homo sapiens
uccaaauuuucaauaa

SEQ ID NO: 1409211 - RNA, 21 nt, Homo sapiens
uccaacccagccugagugcac

SEQ ID NO: 1409212 - RNA, 20 nt, Homo sapiens
uccaagucucucugugaaua

SEQ ID NO: 1409213 - RNA, 20 nt, Homo sapiens
uccaauauucgcugugucag

SEQ ID NO: 1409214 - RNA, 23 nt, Homo sapiens
uccacucaugugacucuuuccaa

SEQ ID NO: 1409215 - RNA, 19 nt, Homo sapiens
uccagaccauugucuucca

SEQ ID NO: 1409216 - RNA, 19 nt, Homo sapiens
uccagauggagaaacaggc

SEQ ID NO: 1409217 - RNA, 16 nt, Homo sapiens
uccagcaagaccaaau

SEQ ID NO: 1409218 - RNA, 14 nt, Homo sapiens
uccagcacuggaag

SEQ ID NO: 1409219 - RNA, 15 nt, Homo sapiens
uccagcccaggacuc

SEQ ID NO: 1409220 - RNA, 20 nt, Homo sapiens
uccagcuguuaccugagaua

SEQ ID NO: 1409221 - RNA, 17 nt, Homo sapiens
uccaguauccacuuugc

SEQ ID NO: 1409222 - RNA, 22 nt, Homo sapiens
uccagugggaggugagaccacc

SEQ ID NO: 1409223 - RNA, 23 nt, Homo sapiens
uccauaaaguaauuuugugaaag

SEQ ID NO: 1409224 - RNA, 18 nt, Homo sapiens
uccaucagccuccauccu

SEQ ID NO: 1409225 - RNA, 20 nt, Homo sapiens
ucccaaagugcugggauuac

SEQ ID NO: 1409226 - RNA, 20 nt, Homo sapiens
ucccaaguagcugagauuac

SEQ ID NO: 1409227 - RNA, 13 nt, Homo sapiens
ucccaccagagac

SEQ ID NO: 1409228 - RNA, 15 nt, Homo sapiens
ucccacuugucaugu

SEQ ID NO: 1409229 - RNA, 18 nt, Homo sapiens
ucccagaggcuagucucu

SEQ ID NO: 1409230 - RNA, 15 nt, Homo sapiens
uccccgugggccaug

SEQ ID NO: 1409231 - RNA, 19 nt, Homo sapiens
uccccgugggccauggcaa

SEQ ID NO: 1409232 - RNA, 13 nt, Homo sapiens
uccccucaaccca

SEQ ID NO: 1409233 - RNA, 13 nt, Homo sapiens
uccccucccucag

SEQ ID NO: 1409234 - RNA, 21 nt, Homo sapiens
uccccuuuggcuaccugaugg

SEQ ID NO: 1409235 - RNA, 11 nt, Homo sapiens
ucccucuagcu

SEQ ID NO: 1409236 - RNA, 17 nt, Homo sapiens
ucccucucucuggaaag

SEQ ID NO: 1409237 - RNA, 13 nt, Homo sapiens
ucccuuucuuccc

SEQ ID NO: 1409238 - RNA, 14 nt, Homo sapiens
ugacagaaaugcaa

SEQ ID NO: 1409239 - RNA, 16 nt, Homo sapiens
ugacauacauccaaca

SEQ ID NO: 1409240 - RNA, 21 nt, Homo sapiens
ugaccucuauaaacuucagag

SEQ ID NO: 1409241 - RNA, 22 nt, Homo sapiens
ugacgucacuggaccacugggc

SEQ ID NO: 1409242 - RNA, 15 nt, Homo sapiens
ugacuagccaucuca

SEQ ID NO: 1409243 - RNA, 20 nt, Homo sapiens
ugacuagccaucucaagcaa

SEQ ID NO: 1409244 - RNA, 23 nt, Homo sapiens
ugacuagccaucucaagcaaguu

SEQ ID NO: 1409245 - RNA, 16 nt, Homo sapiens
ugacuggggagucuga

SEQ ID NO: 1409246 - RNA, 15 nt, Homo sapiens
ugagcagguguucuu

SEQ ID NO: 1409247 - RNA, 17 nt, Homo sapiens
ugagcugagauggaguc

SEQ ID NO: 1409248 - RNA, 21 nt, Homo sapiens
ugagcuggaguucagcaguga

SEQ ID NO: 1409249 - RNA, 22 nt, Homo sapiens
ugagcuggggaugucucucaug

SEQ ID NO: 1409250 - RNA, 22 nt, Homo sapiens
ugaggacauggagagagacuca

SEQ ID NO: 1409251 - RNA, 13 nt, Homo sapiens
ugaggccucucau

SEQ ID NO: 1409252 - RNA, 20 nt, Homo sapiens
ugauacuuccaagugauaau

SEQ ID NO: 1409253 - RNA, 16 nt, Homo sapiens
ugauauguaaguacuu

SEQ ID NO: 1409254 - RNA, 12 nt, Homo sapiens
ugaucaucucac

SEQ ID NO: 1409255 - RNA, 19 nt, Homo sapiens
ugauccuaggcauuugcug

SEQ ID NO: 1409256 - RNA, 14 nt, Homo sapiens
ugaugaauuacuuc

SEQ ID NO: 1409257 - RNA, 22 nt, Homo sapiens
ugaugcauauugcccuggagaa

SEQ ID NO: 1409258 - RNA, 14 nt, Homo sapiens
ugauuugccugccu

SEQ ID NO: 1409259 - RNA, 16 nt, Homo sapiens
ugcaacuucuaccucc

SEQ ID NO: 1409260 - RNA, 22 nt, Homo sapiens
ugcaagaauugaagcaggacua

SEQ ID NO: 1409261 - RNA, 14 nt, Homo sapiens
ugcacacacacaga

SEQ ID NO: 1409262 - RNA, 12 nt, Homo sapiens
ugcacacacaga

SEQ ID NO: 1409263 - RNA, 16 nt, Homo sapiens
ugcacacacagaugca

SEQ ID NO: 1409264 - RNA, 19 nt, Homo sapiens
ugcacacacagaugcacac

SEQ ID NO: 1409265 - RNA, 12 nt, Homo sapiens
ugcacacgcaca

SEQ ID NO: 1409266 - RNA, 15 nt, Homo sapiens
ugcacagagauaugc

SEQ ID NO: 1409267 - RNA, 18 nt, Homo sapiens
ugcagcaaggggacaucu

SEQ ID NO: 1409268 - RNA, 14 nt, Homo sapiens
ugcagcagagccug

SEQ ID NO: 1409269 - RNA, 17 nt, Homo sapiens
ugcaggagagcuucccc

SEQ ID NO: 1409270 - RNA, 16 nt, Homo sapiens
ugccaaugcacgcaca

SEQ ID NO: 1409271 - RNA, 15 nt, Homo sapiens
ugccaauuagcaauu

SEQ ID NO: 1409272 - RNA, 16 nt, Homo sapiens
ugccacagaugauacu

SEQ ID NO: 1409273 - RNA, 19 nt, Homo sapiens
ugccagcuuaucucagggg

SEQ ID NO: 1409274 - RNA, 15 nt, Homo sapiens
ugccaggcugcuaaa

SEQ ID NO: 1409275 - RNA, 22 nt, Homo sapiens
ugcccaauuagggccuagccuu

SEQ ID NO: 1409276 - RNA, 19 nt, Homo sapiens
ugcccaggcuagagugcag

SEQ ID NO: 1409277 - RNA, 19 nt, Homo sapiens
ugcccaggcuggagugcaa

SEQ ID NO: 1409278 - RNA, 18 nt, Homo sapiens
ugcccgaccccaucucau

SEQ ID NO: 1409279 - RNA, 17 nt, Homo sapiens
ugcccugcccaugggag

SEQ ID NO: 1409280 - RNA, 15 nt, Homo sapiens
ugccucagcuuccca

SEQ ID NO: 1409281 - RNA, 18 nt, Homo sapiens
ugccugugccuuuugcca

SEQ ID NO: 1409282 - RNA, 20 nt, Homo sapiens
ugcgcacacacagauaugca

SEQ ID NO: 1409283 - RNA, 19 nt, Homo sapiens
ugcuccaaauuuucaauaa

SEQ ID NO: 1409284 - RNA, 15 nt, Homo sapiens
ugcucuuagcugucu

SEQ ID NO: 1409285 - RNA, 14 nt, Homo sapiens
ugcucuucuuuaga

SEQ ID NO: 1409286 - RNA, 20 nt, Homo sapiens
ugcugcagacaaguggacag

SEQ ID NO: 1409287 - RNA, 10 nt, Homo sapiens
ugcugccuaa

SEQ ID NO: 1409288 - RNA, 18 nt, Homo sapiens
ugcugccuaauaaagaga

SEQ ID NO: 1409289 - RNA, 13 nt, Homo sapiens
ugcuggacuguca

SEQ ID NO: 1409290 - RNA, 19 nt, Homo sapiens
ugcuggcucccagggccau

SEQ ID NO: 1409291 - RNA, 18 nt, Homo sapiens
ugcuguagacauuugcua

SEQ ID NO: 1409292 - RNA, 21 nt, Homo sapiens
ugcuguagacauuugcuauga

SEQ ID NO: 1409293 - RNA, 18 nt, Homo sapiens
ugcuguauccauccaugg

SEQ ID NO: 1409294 - RNA, 17 nt, Homo sapiens
ugcuucaugaaaauccu

SEQ ID NO: 1409295 - RNA, 23 nt, Homo sapiens
ugcuucccuggggccccauuugc

SEQ ID NO: 1409296 - RNA, 21 nt, Homo sapiens
ugcuucugccucagcuuccca

SEQ ID NO: 1409297 - RNA, 19 nt, Homo sapiens
ugcuuuucggaacacuaaa

SEQ ID NO: 1409298 - RNA, 17 nt, Homo sapiens
ugcuuuuguccuguuau

SEQ ID NO: 1409299 - RNA, 13 nt, Homo sapiens
uggaacaagcaca

SEQ ID NO: 1409300 - RNA, 15 nt, Homo sapiens
uggaaccacagucau

SEQ ID NO: 1409301 - RNA, 15 nt, Homo sapiens
uggaagcacaugugu

SEQ ID NO: 1409302 - RNA, 18 nt, Homo sapiens
uggaaggccuucuuucua

SEQ ID NO: 1409303 - RNA, 15 nt, Homo sapiens
uggaagugcuugaua

SEQ ID NO: 1409304 - RNA, 18 nt, Homo sapiens
uggaagugugggucugug

SEQ ID NO: 1409305 - RNA, 18 nt, Homo sapiens
uggagggcaugaagacag

SEQ ID NO: 1409306 - RNA, 18 nt, Homo sapiens
uggagugcaguggugcga

SEQ ID NO: 1409307 - RNA, 17 nt, Homo sapiens
uggagugucacaucucu

SEQ ID NO: 1409308 - RNA, 16 nt, Homo sapiens
uggauccugcacucua

SEQ ID NO: 1409309 - RNA, 19 nt, Homo sapiens
uggcacgaucucagcucac

SEQ ID NO: 1409310 - RNA, 15 nt, Homo sapiens
uggcagcugucucaa

SEQ ID NO: 1409311 - RNA, 23 nt, Homo sapiens
uggccaccuccagggacaaagag

SEQ ID NO: 1409312 - RNA, 16 nt, Homo sapiens
uggcccacgcacuucg

SEQ ID NO: 1409313 - RNA, 13 nt, Homo sapiens
uggcccacugcau

SEQ ID NO: 1409314 - RNA, 14 nt, Homo sapiens
uggcccuaugcuuc

SEQ ID NO: 1409315 - RNA, 16 nt, Homo sapiens
uggccuuugcuugaaa

SEQ ID NO: 1409316 - RNA, 20 nt, Homo sapiens
uggcuaagauacugcugaug

SEQ ID NO: 1409317 - RNA, 17 nt, Homo sapiens
uggcugacuggcaguaa

SEQ ID NO: 1409318 - RNA, 15 nt, Homo sapiens
uggcuggaucuguga

SEQ ID NO: 1409319 - RNA, 21 nt, Homo sapiens
uggcugggaauaagugccagg

SEQ ID NO: 1409320 - RNA, 16 nt, Homo sapiens
ugggaggccaaggugg

SEQ ID NO: 1409321 - RNA, 15 nt, Homo sapiens
ugggauggauuucca

SEQ ID NO: 1409322 - RNA, 17 nt, Homo sapiens
ugggcauagccauggaa

SEQ ID NO: 1409323 - RNA, 22 nt, Homo sapiens
ugggccacucaggggucauuca

SEQ ID NO: 1409324 - RNA, 20 nt, Homo sapiens
ugggcucugaggaguggagu

SEQ ID NO: 1409325 - RNA, 15 nt, Homo sapiens
uggggagggagacag

SEQ ID NO: 1409326 - RNA, 16 nt, Homo sapiens
uggggaugucucucau

SEQ ID NO: 1409327 - RNA, 17 nt, Homo sapiens
uggggccccauuugcca

SEQ ID NO: 1409328 - RNA, 20 nt, Homo sapiens
uggggccgaaagaacagucc

SEQ ID NO: 1409329 - RNA, 22 nt, Homo sapiens
ugggggaucacagccucugaaa

SEQ ID NO: 1409330 - RNA, 20 nt, Homo sapiens
ugggugacagagcaagugag

SEQ ID NO: 1409331 - RNA, 20 nt, Homo sapiens
uggucacacagagauacgca

SEQ ID NO: 1409332 - RNA, 21 nt, Homo sapiens
uggucacacagagauacgcaa

SEQ ID NO: 1409333 - RNA, 18 nt, Homo sapiens
ugguggggaccagcuaau

SEQ ID NO: 1409334 - RNA, 22 nt, Homo sapiens
ugguuuuuaaaaaacugcugac

SEQ ID NO: 1409335 - RNA, 14 nt, Homo sapiens
uguaauaugcacaa

SEQ ID NO: 1409336 - RNA, 15 nt, Homo sapiens
uguacaaagauaugc

SEQ ID NO: 1409337 - RNA, 18 nt, Homo sapiens
uguagaacucugcaggca

SEQ ID NO: 1409338 - RNA, 20 nt, Homo sapiens
uguagaaugauuucaugcua

SEQ ID NO: 1409339 - RNA, 22 nt, Homo sapiens
uguauaaugguguuacuaaagu

SEQ ID NO: 1409340 - RNA, 21 nt, Homo sapiens
ugucaaagaaaacuuccaaaa

SEQ ID NO: 1409341 - RNA, 22 nt, Homo sapiens
ugucaaagaaaacuuccaaaaa

SEQ ID NO: 1409342 - RNA, 18 nt, Homo sapiens
ugucccagaaugccuccu

SEQ ID NO: 1409343 - RNA, 18 nt, Homo sapiens
uguccgcuuucaugaaca

SEQ ID NO: 1409344 - RNA, 22 nt, Homo sapiens
ugucucaaaccuccaaaagccc

SEQ ID NO: 1409345 - RNA, 19 nt, Homo sapiens
uuugaagguauaaccuuca

SEQ ID NO: 1409346 - RNA, 17 nt, Homo sapiens
uuugacuagccaucuca

SEQ ID NO: 1409347 - RNA, 15 nt, Homo sapiens
uuugggggcuucccu

SEQ ID NO: 1409348 - RNA, 15 nt, Homo sapiens
uuuguuggagccacu

SEQ ID NO: 1409349 - RNA, 12 nt, Homo sapiens
uuuguuuaccag

SEQ ID NO: 1409350 - RNA, 21 nt, Homo sapiens
uuuuaaaaaaaucccauuuaa

SEQ ID NO: 1409351 - RNA, 23 nt, Homo sapiens
uuuuccccccaauugcugccaau

SEQ ID NO: 1409352 - RNA, 14 nt, Homo sapiens
uuuuccugccaggc

SEQ ID NO: 1409353 - RNA, 19 nt, Homo sapiens
uuuucuggaauacaugaaa

SEQ ID NO: 1409354 - RNA, 16 nt, Homo sapiens
acaugcuugcauuaua

SEQ ID NO: 1409355 - RNA, 16 nt, Homo sapiens
acauggaugagcacac

SEQ ID NO: 1409356 - RNA, 14 nt, Homo sapiens
acauggaugcacac

SEQ ID NO: 1409357 - RNA, 18 nt, Homo sapiens
acaugguaauuaugugau

SEQ ID NO: 1409358 - RNA, 19 nt, Homo sapiens
acaugguaauuaugugaua

SEQ ID NO: 1409359 - RNA, 18 nt, Homo sapiens
agaauuuucaaauaagga

SEQ ID NO: 1409360 - RNA, 21 nt, Homo sapiens
agacagaaccccuacaugaaa

SEQ ID NO: 1409361 - RNA, 15 nt, Homo sapiens
agacagagacagaga

SEQ ID NO: 1409362 - RNA, 20 nt, Homo sapiens
agacaggcgcuggacagagg

SEQ ID NO: 1409363 - RNA, 15 nt, Homo sapiens
agacaguucaagaaa

SEQ ID NO: 1409364 - RNA, 22 nt, Homo sapiens
agacaucucaggauuucaccag

SEQ ID NO: 1409365 - RNA, 12 nt, Homo sapiens
agaccaaaauaa

SEQ ID NO: 1409366 - RNA, 14 nt, Homo sapiens
agaccgaaucucac

SEQ ID NO: 1409367 - RNA, 12 nt, Homo sapiens
agacuuccugua

SEQ ID NO: 1409368 - RNA, 16 nt, Homo sapiens
agacuuccuguaagau

SEQ ID NO: 1409369 - RNA, 21 nt, Homo sapiens
agagacuaauagagacacaga

SEQ ID NO: 1409370 - RNA, 12 nt, Homo sapiens
agagacugagcc

SEQ ID NO: 1409371 - RNA, 12 nt, Homo sapiens
agagauguuaaa

SEQ ID NO: 1409372 - RNA, 17 nt, Homo sapiens
agagcugaacuauuaga

SEQ ID NO: 1409373 - RNA, 23 nt, Homo sapiens
agagcugccugugccuuuugcca

SEQ ID NO: 1409374 - RNA, 22 nt, Homo sapiens
agaggaaaccaguuuggugaua

SEQ ID NO: 1409375 - RNA, 14 nt, Homo sapiens
agaggacaguauuu

SEQ ID NO: 1409376 - RNA, 13 nt, Homo sapiens
agaggcugcugca

SEQ ID NO: 1409377 - RNA, 17 nt, Homo sapiens
agagggcugccuuugga

SEQ ID NO: 1409378 - RNA, 22 nt, Homo sapiens
agaggguguugaguucacugug

SEQ ID NO: 1409379 - RNA, 22 nt, Homo sapiens
agagguccuaaagaugcugacu

SEQ ID NO: 1409380 - RNA, 18 nt, Homo sapiens
agaguauaaauaaccaau

SEQ ID NO: 1409381 - RNA, 16 nt, Homo sapiens
agagucccugccugga

SEQ ID NO: 1409382 - RNA, 16 nt, Homo sapiens
agagugagagggcaug

SEQ ID NO: 1409383 - RNA, 13 nt, Homo sapiens
agauaaagaccuu

SEQ ID NO: 1409384 - RNA, 14 nt, Homo sapiens
agauaugcacacac

SEQ ID NO: 1409385 - RNA, 17 nt, Homo sapiens
agauaugcacacacaga

SEQ ID NO: 1409386 - RNA, 19 nt, Homo sapiens
agauaugcacacacaugga

SEQ ID NO: 1409387 - RNA, 21 nt, Homo sapiens
agaucagccugggcaauguga

SEQ ID NO: 1409388 - RNA, 13 nt, Homo sapiens
agaucccaacacu

SEQ ID NO: 1409389 - RNA, 19 nt, Homo sapiens
agaucgcaccauugcacuc

SEQ ID NO: 1409390 - RNA, 17 nt, Homo sapiens
agaugaggcacuggaag

SEQ ID NO: 1409391 - RNA, 15 nt, Homo sapiens
agaugauacuuccaa

SEQ ID NO: 1409392 - RNA, 14 nt, Homo sapiens
agaugauuugguca

SEQ ID NO: 1409393 - RNA, 15 nt, Homo sapiens
agaugcacacacacc

SEQ ID NO: 1409394 - RNA, 21 nt, Homo sapiens
agaugggcaaaagacgggaag

SEQ ID NO: 1409395 - RNA, 12 nt, Homo sapiens
agauuaacaaca

SEQ ID NO: 1409396 - RNA, 23 nt, Homo sapiens
agauuauauaucauaaaguaugc

SEQ ID NO: 1409397 - RNA, 12 nt, Homo sapiens
agauucucaccu

SEQ ID NO: 1409398 - RNA, 20 nt, Homo sapiens
agauuucacaggucuugccc

SEQ ID NO: 1409399 - RNA, 21 nt, Homo sapiens
agcaaauguuuaaaauccaaa

SEQ ID NO: 1409400 - RNA, 19 nt, Homo sapiens
agcaacaugcuucaugaaa

SEQ ID NO: 1409401 - RNA, 19 nt, Homo sapiens
agcaagucacuggccagug

SEQ ID NO: 1409402 - RNA, 18 nt, Homo sapiens
agcaauacagacuacuuc

SEQ ID NO: 1409403 - RNA, 20 nt, Homo sapiens
agcaaugcuucugccucagc

SEQ ID NO: 1409404 - RNA, 21 nt, Homo sapiens
agcaccaucucuuuaccuccu

SEQ ID NO: 1409405 - RNA, 15 nt, Homo sapiens
agcagugauuguuau

SEQ ID NO: 1409406 - RNA, 17 nt, Homo sapiens
agcaucucccaguucau

SEQ ID NO: 1409407 - RNA, 22 nt, Homo sapiens
agcaucucccaguucauaauca

SEQ ID NO: 1409408 - RNA, 17 nt, Homo sapiens
agccacauuuugcauua

SEQ ID NO: 1409409 - RNA, 14 nt, Homo sapiens
agccaggacaucuc

SEQ ID NO: 1409410 - RNA, 15 nt, Homo sapiens
agccaggacaucucu

SEQ ID NO: 1409411 - RNA, 11 nt, Homo sapiens
agccaucucaa

SEQ ID NO: 1409412 - RNA, 12 nt, Homo sapiens
agccaucucaag

SEQ ID NO: 1409413 - RNA, 14 nt, Homo sapiens
agccaucucaagca

SEQ ID NO: 1409414 - RNA, 17 nt, Homo sapiens
agccauggaacccugcc

SEQ ID NO: 1409415 - RNA, 16 nt, Homo sapiens
agcccucucacugugu

SEQ ID NO: 1409416 - RNA, 15 nt, Homo sapiens
agcccugagcuuucu

SEQ ID NO: 1409417 - RNA, 15 nt, Homo sapiens
agccucucaccugga

SEQ ID NO: 1409418 - RNA, 16 nt, Homo sapiens
agccucucaccuggac

SEQ ID NO: 1409419 - RNA, 23 nt, Homo sapiens
agccucucaccuggacuccagua

SEQ ID NO: 1409420 - RNA, 19 nt, Homo sapiens
agccugaauuuuguugcug

SEQ ID NO: 1409421 - RNA, 14 nt, Homo sapiens
agccugaguuugcu

SEQ ID NO: 1409422 - RNA, 21 nt, Homo sapiens
agccugcuuuuguccuguuau

SEQ ID NO: 1409423 - RNA, 18 nt, Homo sapiens
agccuuggcucuacccug

SEQ ID NO: 1409424 - RNA, 13 nt, Homo sapiens
agcgguccaaagu

SEQ ID NO: 1409425 - RNA, 13 nt, Homo sapiens
agcucaguggcaa

SEQ ID NO: 1409426 - RNA, 13 nt, Homo sapiens
agcuccacagugu

SEQ ID NO: 1409427 - RNA, 23 nt, Homo sapiens
agcuccagcuguuaccugagaua

SEQ ID NO: 1409428 - RNA, 14 nt, Homo sapiens
agcuccaguggaag

SEQ ID NO: 1409429 - RNA, 15 nt, Homo sapiens
agcuccuuaaggcuc

SEQ ID NO: 1409430 - RNA, 17 nt, Homo sapiens
agcucuauaagagcugg

SEQ ID NO: 1409431 - RNA, 20 nt, Homo sapiens
agcucuauggauuauccacu

SEQ ID NO: 1409432 - RNA, 13 nt, Homo sapiens
agcugaaccuggg

SEQ ID NO: 1409433 - RNA, 14 nt, Homo sapiens
agcugagauuacag

SEQ ID NO: 1409434 - RNA, 15 nt, Homo sapiens
agcugaggacacacc

SEQ ID NO: 1409435 - RNA, 13 nt, Homo sapiens
agcugaguggcag

SEQ ID NO: 1409436 - RNA, 13 nt, Homo sapiens
agcugcacccuca

SEQ ID NO: 1409437 - RNA, 18 nt, Homo sapiens
agcugucucaaaccucca

SEQ ID NO: 1409438 - RNA, 13 nt, Homo sapiens
agcugucugcuca

SEQ ID NO: 1409439 - RNA, 21 nt, Homo sapiens
agcuugagggugacuauggag

SEQ ID NO: 1409440 - RNA, 20 nt, Homo sapiens
agcuuuccaaagaaauggaa

SEQ ID NO: 1409441 - RNA, 19 nt, Homo sapiens
agcuuuccucaucaggcca

SEQ ID NO: 1409442 - RNA, 20 nt, Homo sapiens
aggaagccucccacgacugc

SEQ ID NO: 1409443 - RNA, 12 nt, Homo sapiens
aggaauacucuu

SEQ ID NO: 1409444 - RNA, 15 nt, Homo sapiens
aggacaguggaugcu

SEQ ID NO: 1409445 - RNA, 13 nt, Homo sapiens
aggacaugugcuc

SEQ ID NO: 1409446 - RNA, 21 nt, Homo sapiens
aggagccuauggcaucuuccc

SEQ ID NO: 1409447 - RNA, 23 nt, Homo sapiens
aggaggaaggagccuauggcauc

SEQ ID NO: 1409448 - RNA, 18 nt, Homo sapiens
aggagggaggugcuucua

SEQ ID NO: 1409449 - RNA, 14 nt, Homo sapiens
aggagucuucacug

SEQ ID NO: 1409450 - RNA, 22 nt, Homo sapiens
aggaguggaguucucuguucua

SEQ ID NO: 1409451 - RNA, 13 nt, Homo sapiens
aggcacaacaguu

SEQ ID NO: 1409452 - RNA, 20 nt, Homo sapiens
aggcaggaggaucacuugag

SEQ ID NO: 1409453 - RNA, 21 nt, Homo sapiens
aggcagggaaggaucccauga

SEQ ID NO: 1409454 - RNA, 12 nt, Homo sapiens
aggcaugaacac

SEQ ID NO: 1409455 - RNA, 19 nt, Homo sapiens
aggcaugaacacacaugga

SEQ ID NO: 1409456 - RNA, 17 nt, Homo sapiens
aggccacagugcaauuu

SEQ ID NO: 1409457 - RNA, 15 nt, Homo sapiens
aggccagaugcacau

SEQ ID NO: 1409458 - RNA, 17 nt, Homo sapiens
aggccagcaccaucucu

SEQ ID NO: 1409459 - RNA, 17 nt, Homo sapiens
aggccauggugcacaaa

SEQ ID NO: 1409460 - RNA, 19 nt, Homo sapiens
aggccauucuuucccaaca

SEQ ID NO: 1409461 - RNA, 23 nt, Homo sapiens
aggccggaaaaggcgcaucuaac

SEQ ID NO: 1409462 - RNA, 20 nt, Homo sapiens
aggcuagagugcaguggcgu

SEQ ID NO: 1409463 - RNA, 21 nt, Homo sapiens
augccaaacaggaacaaucca

SEQ ID NO: 1409464 - RNA, 16 nt, Homo sapiens
augccagcuuaucuca

SEQ ID NO: 1409465 - RNA, 17 nt, Homo sapiens
augccagcuuaucucag

SEQ ID NO: 1409466 - RNA, 19 nt, Homo sapiens
cacagacacuacauaucua

SEQ ID NO: 1409467 - RNA, 15 nt, Homo sapiens
cacagagauaugcac

SEQ ID NO: 1409468 - RNA, 16 nt, Homo sapiens
cacagauaugcacaca

SEQ ID NO: 1409469 - RNA, 14 nt, Homo sapiens
cacagaugcacaca

SEQ ID NO: 1409470 - RNA, 18 nt, Homo sapiens
cacagaugcacacacaga

SEQ ID NO: 1409471 - RNA, 15 nt, Homo sapiens
cacagccugggacca

SEQ ID NO: 1409472 - RNA, 15 nt, Homo sapiens
cacaguggccaaaga

SEQ ID NO: 1409473 - RNA, 23 nt, Homo sapiens
cacaguguuuccugaguagcagu

SEQ ID NO: 1409474 - RNA, 16 nt, Homo sapiens
cacauagagauaugca

SEQ ID NO: 1409475 - RNA, 20 nt, Homo sapiens
cacauuuugcauuagacaga

SEQ ID NO: 1409476 - RNA, 23 nt, Homo sapiens
cacauuuugcauuagacagauga

SEQ ID NO: 1409477 - RNA, 19 nt, Homo sapiens
caccaggcagcuccagcug

SEQ ID NO: 1409478 - RNA, 13 nt, Homo sapiens
caccaucuggaag

SEQ ID NO: 1409479 - RNA, 15 nt, Homo sapiens
caccaugcaccccug

SEQ ID NO: 1409480 - RNA, 14 nt, Homo sapiens
cacccaugccauag

SEQ ID NO: 1409481 - RNA, 19 nt, Homo sapiens
cacccaugccauagaaacu

SEQ ID NO: 1409482 - RNA, 13 nt, Homo sapiens
caccgaugcacac

SEQ ID NO: 1409483 - RNA, 14 nt, Homo sapiens
caccuccuggagaa

SEQ ID NO: 1409484 - RNA, 16 nt, Homo sapiens
caccucugcacaagcu

SEQ ID NO: 1409485 - RNA, 21 nt, Homo sapiens
cacgaaaugggccauuccagu

SEQ ID NO: 1409486 - RNA, 19 nt, Homo sapiens
cacgacugcccggcagggu

SEQ ID NO: 1409487 - RNA, 15 nt, Homo sapiens
cacggaugcacacac

SEQ ID NO: 1409488 - RNA, 16 nt, Homo sapiens
cacggaugcacacaca

SEQ ID NO: 1409489 - RNA, 20 nt, Homo sapiens
cacucaaggaaaagaugugc

SEQ ID NO: 1409490 - RNA, 21 nt, Homo sapiens
cacucacacggacacucaaaa

SEQ ID NO: 1409491 - RNA, 13 nt, Homo sapiens
cacuccuucagga

SEQ ID NO: 1409492 - RNA, 15 nt, Homo sapiens
cacugacucaagaca

SEQ ID NO: 1409493 - RNA, 16 nt, Homo sapiens
cacugcaagcucugcc

SEQ ID NO: 1409494 - RNA, 12 nt, Homo sapiens
cacugcucugcc

SEQ ID NO: 1409495 - RNA, 13 nt, Homo sapiens
cacuggcaucucc

SEQ ID NO: 1409496 - RNA, 17 nt, Homo sapiens
cacuuaaaaaaaugccu

SEQ ID NO: 1409497 - RNA, 22 nt, Homo sapiens
cagaaaacauaugcauuaugaa

SEQ ID NO: 1409498 - RNA, 18 nt, Homo sapiens
cagaaacaaaaacacuaa

SEQ ID NO: 1409499 - RNA, 11 nt, Homo sapiens
cagaaaugcaa

SEQ ID NO: 1409500 - RNA, 19 nt, Homo sapiens
cagaacugcuuuaucccac

SEQ ID NO: 1409501 - RNA, 17 nt, Homo sapiens
cagaagacccgcucucc

SEQ ID NO: 1409502 - RNA, 18 nt, Homo sapiens
cagaagccccaacuguga

SEQ ID NO: 1409503 - RNA, 21 nt, Homo sapiens
cagaagccccaacugugauca

SEQ ID NO: 1409504 - RNA, 15 nt, Homo sapiens
cagaagguugcucua

SEQ ID NO: 1409505 - RNA, 21 nt, Homo sapiens
cagaaguuugagaucagccug

SEQ ID NO: 1409506 - RNA, 19 nt, Homo sapiens
cagacuaggguucaugucu

SEQ ID NO: 1409507 - RNA, 13 nt, Homo sapiens
cagaggacaguau

SEQ ID NO: 1409508 - RNA, 20 nt, Homo sapiens
cagaggcuagucucuucuca

SEQ ID NO: 1409509 - RNA, 16 nt, Homo sapiens
cagauauacacaugga

SEQ ID NO: 1409510 - RNA, 17 nt, Homo sapiens
cagauauacacauggau

SEQ ID NO: 1409511 - RNA, 18 nt, Homo sapiens
cagaucuuuuugugaaau

SEQ ID NO: 1409512 - RNA, 16 nt, Homo sapiens
cagaugcacacacaga

SEQ ID NO: 1409513 - RNA, 21 nt, Homo sapiens
cagaugggaugggcuuucuca

SEQ ID NO: 1409514 - RNA, 20 nt, Homo sapiens
cagauggucacacagagaua

SEQ ID NO: 1409515 - RNA, 15 nt, Homo sapiens
cagauucccagagca

SEQ ID NO: 1409516 - RNA, 14 nt, Homo sapiens
cagcaaaaugugaa

SEQ ID NO: 1409517 - RNA, 19 nt, Homo sapiens
cagcaaagugucaguguug

SEQ ID NO: 1409518 - RNA, 16 nt, Homo sapiens
cagcaccacauugccu

SEQ ID NO: 1409519 - RNA, 21 nt, Homo sapiens
cagcaccaucucuuuaccucc

SEQ ID NO: 1409520 - RNA, 12 nt, Homo sapiens
cagcacuggaag

SEQ ID NO: 1409521 - RNA, 21 nt, Homo sapiens
cagcagagccuggaagacacc

SEQ ID NO: 1409522 - RNA, 18 nt, Homo sapiens
cagcauccucaguuccug

SEQ ID NO: 1409523 - RNA, 11 nt, Homo sapiens
cagcauuuccc

SEQ ID NO: 1409524 - RNA, 21 nt, Homo sapiens
cagccaagaauaaaauacucu

SEQ ID NO: 1409525 - RNA, 14 nt, Homo sapiens
cagccaggacaucu

SEQ ID NO: 1409526 - RNA, 18 nt, Homo sapiens
cagcccgggucaucugua

SEQ ID NO: 1409527 - RNA, 17 nt, Homo sapiens
cagccuaggcagaggcu

SEQ ID NO: 1409528 - RNA, 16 nt, Homo sapiens
cagccuccaggcaccc

SEQ ID NO: 1409529 - RNA, 15 nt, Homo sapiens
cagccugcuccagcu

SEQ ID NO: 1409530 - RNA, 19 nt, Homo sapiens
cagcuccacaguguugcca

SEQ ID NO: 1409531 - RNA, 20 nt, Homo sapiens
cagcuccagcuguuaccuga

SEQ ID NO: 1409532 - RNA, 21 nt, Homo sapiens
cagcuccagcuguuaccugag

SEQ ID NO: 1409533 - RNA, 11 nt, Homo sapiens
cagcucugcaa

SEQ ID NO: 1409534 - RNA, 15 nt, Homo sapiens
cagcucugcaagaau

SEQ ID NO: 1409535 - RNA, 20 nt, Homo sapiens
cagcugcauacaguuugcac

SEQ ID NO: 1409536 - RNA, 15 nt, Homo sapiens
cagcugcugugcauu

SEQ ID NO: 1409537 - RNA, 12 nt, Homo sapiens
cagcugggacac

SEQ ID NO: 1409538 - RNA, 14 nt, Homo sapiens
cagcuguuaccuga

SEQ ID NO: 1409539 - RNA, 20 nt, Homo sapiens
cagcuucccaaguagcugag

SEQ ID NO: 1409540 - RNA, 22 nt, Homo sapiens
cagcuucccaaguagcugagau

SEQ ID NO: 1409541 - RNA, 10 nt, Homo sapiens
caggacaucu

SEQ ID NO: 1409542 - RNA, 12 nt, Homo sapiens
caggacaucucu

SEQ ID NO: 1409543 - RNA, 21 nt, Homo sapiens
caggaggcugaggcaccagaa

SEQ ID NO: 1409544 - RNA, 15 nt, Homo sapiens
caggcaacgcacaaa

SEQ ID NO: 1409545 - RNA, 18 nt, Homo sapiens
caggcaacgcacaaaaca

SEQ ID NO: 1409546 - RNA, 20 nt, Homo sapiens
caggcaacgcacaaaacaga

SEQ ID NO: 1409547 - RNA, 16 nt, Homo sapiens
caggcuagagugcagu

SEQ ID NO: 1409548 - RNA, 20 nt, Homo sapiens
caggcugcagucccuggaaa

SEQ ID NO: 1409549 - RNA, 16 nt, Homo sapiens
caggcuggagugcaau

SEQ ID NO: 1409550 - RNA, 17 nt, Homo sapiens
caggggaccacaccucc

SEQ ID NO: 1409551 - RNA, 18 nt, Homo sapiens
caggguuggggugguuuu

SEQ ID NO: 1409552 - RNA, 17 nt, Homo sapiens
cagguuuguguuuucuu

SEQ ID NO: 1409553 - RNA, 19 nt, Homo sapiens
caguaaauauuaaccugaa

SEQ ID NO: 1409554 - RNA, 17 nt, Homo sapiens
cagugagaagccagcuu

SEQ ID NO: 1409555 - RNA, 20 nt, Homo sapiens
cagugcacacggaugcacag

SEQ ID NO: 1409556 - RNA, 19 nt, Homo sapiens
cagugggaggacagagccg

SEQ ID NO: 1409557 - RNA, 14 nt, Homo sapiens
caguuagcucucaa

SEQ ID NO: 1409558 - RNA, 17 nt, Homo sapiens
caguuucuggaaaaagu

SEQ ID NO: 1409559 - RNA, 15 nt, Homo sapiens
cauacacagaaacca

SEQ ID NO: 1409560 - RNA, 14 nt, Homo sapiens
cauacaguuugcac

SEQ ID NO: 1409561 - RNA, 21 nt, Homo sapiens
cauacugaagaugcagcaaaa

SEQ ID NO: 1409562 - RNA, 17 nt, Homo sapiens
cauagagauaugcacac

SEQ ID NO: 1409563 - RNA, 21 nt, Homo sapiens
cauagggugcucugaggucaa

SEQ ID NO: 1409564 - RNA, 23 nt, Homo sapiens
cauauguaguauaauuucuagaa

SEQ ID NO: 1409565 - RNA, 17 nt, Homo sapiens
cauccaguucaugagaa

SEQ ID NO: 1409566 - RNA, 18 nt, Homo sapiens
caucccugaugucugucu

SEQ ID NO: 1409567 - RNA, 18 nt, Homo sapiens
caucuccucccaccagug

SEQ ID NO: 1409568 - RNA, 18 nt, Homo sapiens
caucuggaaggacaucua

SEQ ID NO: 1409569 - RNA, 22 nt, Homo sapiens
caucuuccgcgcaggugccaac

SEQ ID NO: 1409570 - RNA, 21 nt, Homo sapiens
caucuuucuuccaaacaggcu

SEQ ID NO: 1409571 - RNA, 15 nt, Homo sapiens
caugaaaugcuucca

SEQ ID NO: 1409572 - RNA, 17 nt, Homo sapiens
caugaacacacauggau

SEQ ID NO: 1409573 - RNA, 22 nt, Homo sapiens
caugcuccuggcccacugcauc

SEQ ID NO: 1409574 - RNA, 12 nt, Homo sapiens
ggcuggcuuccu

SEQ ID NO: 1409575 - RNA, 15 nt, Homo sapiens
gggacacaggggcaa

SEQ ID NO: 1409576 - RNA, 24 nt, Homo sapiens
gggaugggcuuucucagugucagc

SEQ ID NO: 1409577 - RNA, 18 nt, Homo sapiens
gggccacauggguccacu

SEQ ID NO: 1409578 - RNA, 16 nt, Homo sapiens
gggcucagaguggggu

SEQ ID NO: 1409579 - RNA, 14 nt, Homo sapiens
gggcucucucauga

SEQ ID NO: 1409580 - RNA, 19 nt, Homo sapiens
gggcucucucaugauagaa

SEQ ID NO: 1409581 - RNA, 15 nt, Homo sapiens
ggggagcaugggacu

SEQ ID NO: 1409582 - RNA, 15 nt, Homo sapiens
ggggaugucucucau

SEQ ID NO: 1409583 - RNA, 16 nt, Homo sapiens
gggguugguguucuca

SEQ ID NO: 1409584 - RNA, 15 nt, Homo sapiens
gggucaggugccacu

SEQ ID NO: 1409585 - RNA, 19 nt, Homo sapiens
gggugacagagcaagugag

SEQ ID NO: 1409586 - RNA, 14 nt, Homo sapiens
gggugugucugcuc

SEQ ID NO: 1409587 - RNA, 19 nt, Homo sapiens
ggguguuaaggcagugacu

SEQ ID NO: 1409588 - RNA, 20 nt, Homo sapiens
gguagaaaaggcuagguaca

SEQ ID NO: 1409589 - RNA, 21 nt, Homo sapiens
ggucugcuucugcauucacag

SEQ ID NO: 1409590 - RNA, 15 nt, Homo sapiens
gguuuuuucaauuua

SEQ ID NO: 1409591 - RNA, 16 nt, Homo sapiens
guaaagcucacuuuac

SEQ ID NO: 1409592 - RNA, 16 nt, Homo sapiens
guaacaaaaguauagu

SEQ ID NO: 1409593 - RNA, 15 nt, Homo sapiens
guaaccuagugaauu

SEQ ID NO: 1409594 - RNA, 18 nt, Homo sapiens
guaaccuagugaauuucu

SEQ ID NO: 1409595 - RNA, 20 nt, Homo sapiens
guaacuuauuuuaaauaugc

SEQ ID NO: 1409596 - RNA, 13 nt, Homo sapiens
guacagacacucc

SEQ ID NO: 1409597 - RNA, 14 nt, Homo sapiens
guaggaucugucaa

SEQ ID NO: 1409598 - RNA, 22 nt, Homo sapiens
guauccuuguugacacggccau

SEQ ID NO: 1409599 - RNA, 21 nt, Homo sapiens
gucaccagaauauuucuuuca

SEQ ID NO: 1409600 - RNA, 19 nt, Homo sapiens
gucagaaacucgaugaaug

SEQ ID NO: 1409601 - RNA, 15 nt, Homo sapiens
gucagagaaccuaau

SEQ ID NO: 1409602 - RNA, 14 nt, Homo sapiens
gucaugucagcucc

SEQ ID NO: 1409603 - RNA, 21 nt, Homo sapiens
gucaugucucugguggugcug

SEQ ID NO: 1409604 - RNA, 13 nt, Homo sapiens
guccgagcuuuga

SEQ ID NO: 1409605 - RNA, 21 nt, Homo sapiens
guccgcuuucaugaacacagc

SEQ ID NO: 1409606 - RNA, 13 nt, Homo sapiens
guccugaugcugu

SEQ ID NO: 1409607 - RNA, 20 nt, Homo sapiens
guccugaugcugugcucaau

SEQ ID NO: 1409608 - RNA, 17 nt, Homo sapiens
gucgucaaguugcagau

SEQ ID NO: 1409609 - RNA, 19 nt, Homo sapiens
gucuucccugaucaaguca

SEQ ID NO: 1409610 - RNA, 16 nt, Homo sapiens
gugaacacacucagca

SEQ ID NO: 1409611 - RNA, 23 nt, Homo sapiens
gugagaccaccucucaauauuca

SEQ ID NO: 1409612 - RNA, 22 nt, Homo sapiens
gugaggaugucugggccacuca

SEQ ID NO: 1409613 - RNA, 17 nt, Homo sapiens
gugaugaaaauuugccu

SEQ ID NO: 1409614 - RNA, 20 nt, Homo sapiens
gugcaauggcacgaucucag

SEQ ID NO: 1409615 - RNA, 18 nt, Homo sapiens
gugccuuggugugcugua

SEQ ID NO: 1409616 - RNA, 15 nt, Homo sapiens
gugcgcacacacaga

SEQ ID NO: 1409617 - RNA, 17 nt, Homo sapiens
guggaaggcagugaaca

SEQ ID NO: 1409618 - RNA, 13 nt, Homo sapiens
guggcauccagag

SEQ ID NO: 1409619 - RNA, 19 nt, Homo sapiens
guggccccaaauuugcuau

SEQ ID NO: 1409620 - RNA, 11 nt, Homo sapiens
gugggccaugg

SEQ ID NO: 1409621 - RNA, 13 nt, Homo sapiens
gugucagcacuca

SEQ ID NO: 1409622 - RNA, 15 nt, Homo sapiens
guguccgcuuucaug

SEQ ID NO: 1409623 - RNA, 14 nt, Homo sapiens
guguccugcaccgg

SEQ ID NO: 1409624 - RNA, 14 nt, Homo sapiens
guguggagcuguau

SEQ ID NO: 1409625 - RNA, 19 nt, Homo sapiens
gugugggggaagcaccaua

SEQ ID NO: 1409626 - RNA, 13 nt, Homo sapiens
guguguguguaug

SEQ ID NO: 1409627 - RNA, 19 nt, Homo sapiens
guuaaggcagugacuuuag

SEQ ID NO: 1409628 - RNA, 24 nt, Homo sapiens
guuaauauuuauuaagugacuaua

SEQ ID NO: 1409629 - RNA, 15 nt, Homo sapiens
guuacucucaccucg

SEQ ID NO: 1409630 - RNA, 15 nt, Homo sapiens
guuccagauguggau

SEQ ID NO: 1409631 - RNA, 15 nt, Homo sapiens
guuccgagaagaaca

SEQ ID NO: 1409632 - RNA, 16 nt, Homo sapiens
guucugguaugaacuu

SEQ ID NO: 1409633 - RNA, 13 nt, Homo sapiens
guucuuagcugaa

SEQ ID NO: 1409634 - RNA, 16 nt, Homo sapiens
guucuucauuaccuca

SEQ ID NO: 1409635 - RNA, 23 nt, Homo sapiens
guugaauuucccacauacccucc

SEQ ID NO: 1409636 - RNA, 19 nt, Homo sapiens
guugauucagcucugcaag

SEQ ID NO: 1409637 - RNA, 15 nt, Homo sapiens
guugcuggacuguca

SEQ ID NO: 1409638 - RNA, 18 nt, Homo sapiens
guuuaaaaaaaguauaua

SEQ ID NO: 1409639 - RNA, 13 nt, Homo sapiens
guuuaaaauccaa

SEQ ID NO: 1409640 - RNA, 18 nt, Homo sapiens
guuucgacguuugacuag

SEQ ID NO: 1409641 - RNA, 14 nt, Homo sapiens
guuucucaucccau

SEQ ID NO: 1409642 - RNA, 16 nt, Homo sapiens
guuugacuagccaucu

SEQ ID NO: 1409643 - RNA, 18 nt, Homo sapiens
guuugacuagccaucuca

SEQ ID NO: 1409644 - RNA, 19 nt, Homo sapiens
guuugacuagccaucucaa

SEQ ID NO: 1409645 - RNA, 14 nt, Homo sapiens
guuuuacugcagcu

SEQ ID NO: 1409646 - RNA, 13 nt, Homo sapiens
guuuuugagccau

SEQ ID NO: 1409647 - RNA, 16 nt, Homo sapiens
uaaaacccaagugccu

SEQ ID NO: 1409648 - RNA, 22 nt, Homo sapiens
uaaaagucuaguuaccuacuuu

SEQ ID NO: 1409649 - RNA, 14 nt, Homo sapiens
uaaaauucuuggga

SEQ ID NO: 1409650 - RNA, 19 nt, Homo sapiens
uaaagcucugaacaaaagc

SEQ ID NO: 1409651 - RNA, 13 nt, Homo sapiens
uaaagcugcugag

SEQ ID NO: 1409652 - RNA, 18 nt, Homo sapiens
uaaaguaauuuugugaaa

SEQ ID NO: 1409653 - RNA, 18 nt, Homo sapiens
uaaaguaugguauugaaa

SEQ ID NO: 1409654 - RNA, 16 nt, Homo sapiens
uaaauagcaacaugcu

SEQ ID NO: 1409655 - RNA, 22 nt, Homo sapiens
uaaauauuaaccugaauuauuc

SEQ ID NO: 1409656 - RNA, 17 nt, Homo sapiens
uaaauguaucauagaaa

SEQ ID NO: 1409657 - RNA, 21 nt, Homo sapiens
uaaauuuaugguucucaggcc

SEQ ID NO: 1409658 - RNA, 15 nt, Homo sapiens
uaaauuuaugugaug

SEQ ID NO: 1409659 - RNA, 14 nt, Homo sapiens
uaacaccaugauua

SEQ ID NO: 1409660 - RNA, 12 nt, Homo sapiens
uaaccugaauua

SEQ ID NO: 1409661 - RNA, 14 nt, Homo sapiens
uaacggcacugugg

SEQ ID NO: 1409662 - RNA, 19 nt, Homo sapiens
uaagcuguagaacucugca

SEQ ID NO: 1409663 - RNA, 12 nt, Homo sapiens
uaauagucauca

SEQ ID NO: 1409664 - RNA, 19 nt, Homo sapiens
uaaucaaugaucaucucac

SEQ ID NO: 1409665 - RNA, 18 nt, Homo sapiens
uaaucucuuuauuaaaac

SEQ ID NO: 1409666 - RNA, 16 nt, Homo sapiens
uaaugaucaaaacaug

SEQ ID NO: 1409667 - RNA, 20 nt, Homo sapiens
uaauguacacauugcauuuu

SEQ ID NO: 1409668 - RNA, 23 nt, Homo sapiens
uaauuccacacccucacugcugu

SEQ ID NO: 1409669 - RNA, 14 nt, Homo sapiens
uaauuuuguuguuu

SEQ ID NO: 1409670 - RNA, 19 nt, Homo sapiens
uacaaaaacauggccuuug

SEQ ID NO: 1409671 - RNA, 22 nt, Homo sapiens
uacaaugaaagcccucaugugc

SEQ ID NO: 1409672 - RNA, 23 nt, Homo sapiens
uacacaauccuccaagaauuuga

SEQ ID NO: 1409673 - RNA, 19 nt, Homo sapiens
uacacacacagaugcacac

SEQ ID NO: 1409674 - RNA, 15 nt, Homo sapiens
uaccagcaucuccca

SEQ ID NO: 1409675 - RNA, 23 nt, Homo sapiens
uaccugagauacugaagugcagc

SEQ ID NO: 1409676 - RNA, 14 nt, Homo sapiens
uaccugauggaccu

SEQ ID NO: 1409677 - RNA, 13 nt, Homo sapiens
uaccugcuaugcg

SEQ ID NO: 1409678 - RNA, 14 nt, Homo sapiens
uaccuucuaccucu

SEQ ID NO: 1409679 - RNA, 23 nt, Homo sapiens
uacgcaaacacaccgaugcacac

SEQ ID NO: 1409680 - RNA, 13 nt, Homo sapiens
uacgccaggggaa

SEQ ID NO: 1409681 - RNA, 15 nt, Homo sapiens
uacuauuauuugcua

SEQ ID NO: 1409682 - RNA, 17 nt, Homo sapiens
uucugaaauaacauggc

SEQ ID NO: 1409683 - RNA, 24 nt, Homo sapiens
uucugaagaguaaggaguaguauu

SEQ ID NO: 1409684 - RNA, 22 nt, Homo sapiens
uucugauuugaagguauaaccu

SEQ ID NO: 1409685 - RNA, 16 nt, Homo sapiens
uucuucauuaccucag

SEQ ID NO: 1409686 - RNA, 17 nt, Homo sapiens
uucuuccaaacaggcuc

SEQ ID NO: 1409687 - RNA, 16 nt, Homo sapiens
uucuucccuacaguug

SEQ ID NO: 1409688 - RNA, 15 nt, Homo sapiens
uucuucuggggucag

SEQ ID NO: 1409689 - RNA, 13 nt, Homo sapiens
uucuuuugcucuu

SEQ ID NO: 1409690 - RNA, 14 nt, Homo sapiens
uugaaaauguucag

SEQ ID NO: 1409691 - RNA, 20 nt, Homo sapiens
uugaaggagaaaaugcauua

SEQ ID NO: 1409692 - RNA, 21 nt, Homo sapiens
uugaccucuauaaacuucaga

SEQ ID NO: 1409693 - RNA, 17 nt, Homo sapiens
uugacuagccaucucaa

SEQ ID NO: 1409694 - RNA, 23 nt, Homo sapiens
uugacugucacuguuccuuguca

SEQ ID NO: 1409695 - RNA, 18 nt, Homo sapiens
uugauuaaaaucuggcaa

SEQ ID NO: 1409696 - RNA, 10 nt, Homo sapiens
uugauuucaa

SEQ ID NO: 1409697 - RNA, 23 nt, Homo sapiens
uugcacagcucuccggucucucu

SEQ ID NO: 1409698 - RNA, 21 nt, Homo sapiens
uugcauuuugauaaaauuaau

SEQ ID NO: 1409699 - RNA, 19 nt, Homo sapiens
uugcccaggcuggagugca

SEQ ID NO: 1409700 - RNA, 22 nt, Homo sapiens
uugccuggggccacauagcuca

SEQ ID NO: 1409701 - RNA, 18 nt, Homo sapiens
uugcuauucccaugcauu

SEQ ID NO: 1409702 - RNA, 13 nt, Homo sapiens
uugcucuuuggua

SEQ ID NO: 1409703 - RNA, 20 nt, Homo sapiens
uuggcuaucuacugagacau

SEQ ID NO: 1409704 - RNA, 16 nt, Homo sapiens
uugggauauucugaaa

SEQ ID NO: 1409705 - RNA, 21 nt, Homo sapiens
uuguaaauguaagaaagcaua

SEQ ID NO: 1409706 - RNA, 18 nt, Homo sapiens
uuguacaaagauaugcua

SEQ ID NO: 1409707 - RNA, 13 nt, Homo sapiens
uuguacucuugcu

SEQ ID NO: 1409708 - RNA, 16 nt, Homo sapiens
uuguauuuaccuucua

SEQ ID NO: 1409709 - RNA, 20 nt, Homo sapiens
uuguauuuaccuucuaccuc

SEQ ID NO: 1409710 - RNA, 12 nt, Homo sapiens
uugugccuuuag

SEQ ID NO: 1409711 - RNA, 16 nt, Homo sapiens
uugugucagaaacaug

SEQ ID NO: 1409712 - RNA, 16 nt, Homo sapiens
uuguucagaagacaca

SEQ ID NO: 1409713 - RNA, 15 nt, Homo sapiens
uuuaaaaaaaguaua

SEQ ID NO: 1409714 - RNA, 14 nt, Homo sapiens
uuuaaaauugugau

SEQ ID NO: 1409715 - RNA, 12 nt, Homo sapiens
uuuaaacaguga

SEQ ID NO: 1409716 - RNA, 14 nt, Homo sapiens
uuuaacggcacugu

SEQ ID NO: 1409717 - RNA, 23 nt, Homo sapiens
uuuaagggggaaaacuguucucu

SEQ ID NO: 1409718 - RNA, 20 nt, Homo sapiens
uuuaaucaaugaucaucuca

SEQ ID NO: 1409719 - RNA, 16 nt, Homo sapiens
uuuacugauuccagca

SEQ ID NO: 1409720 - RNA, 13 nt, Homo sapiens
uuuagccauacca

SEQ ID NO: 1409721 - RNA, 22 nt, Homo sapiens
uuuauuuauguaggaucuguca

SEQ ID NO: 1409722 - RNA, 23 nt, Homo sapiens
uuucaaagaaggaauucuaggca

SEQ ID NO: 1409723 - RNA, 23 nt, Homo sapiens
uuucaagaccuucuccccauucu

SEQ ID NO: 1409724 - RNA, 17 nt, Homo sapiens
uuucaccguauuagcca

SEQ ID NO: 1409725 - RNA, 21 nt, Homo sapiens
uuucagaauugaaggagaaaa

SEQ ID NO: 1409726 - RNA, 12 nt, Homo sapiens
uuucauugcugg

SEQ ID NO: 1409727 - RNA, 14 nt, Homo sapiens
uuuccaaccggcuu

SEQ ID NO: 1409728 - RNA, 16 nt, Homo sapiens
uuucccaacaccucuu

SEQ ID NO: 1409729 - RNA, 18 nt, Homo sapiens
uuuccuuugguccuucaa

SEQ ID NO: 1409730 - RNA, 16 nt, Homo sapiens
uuucgacguuugacua

SEQ ID NO: 1409731 - RNA, 23 nt, Homo sapiens
uuucucuccagcgguccaaaguu

SEQ ID NO: 1409732 - RNA, 21 nt, Homo sapiens
uuucuucauuucucuugcuca

SEQ ID NO: 1409733 - RNA, 18 nt, Homo sapiens
uuucuuuuuuauacucaa

SEQ ID NO: 1409734 - RNA, 22 nt, Homo sapiens
uuugacuagccaucucaagcaa

SEQ ID NO: 1409735 - RNA, 23 nt, Homo sapiens
uuugauuuucgacguuugacuag

SEQ ID NO: 1409736 - RNA, 16 nt, Homo sapiens
uuugcacccaugccau

SEQ ID NO: 1409737 - RNA, 22 nt, Homo sapiens
uuugcucuuagcugucugcuca

SEQ ID NO: 1409738 - RNA, 19 nt, Homo sapiens
uuuguucacuucgaugacu

SEQ ID NO: 1409739 - RNA, 18 nt, Homo sapiens
uuuuauuuccacauaaag

SEQ ID NO: 1409740 - RNA, 16 nt, Homo sapiens
uuuucauuuagugcua

SEQ ID NO: 1409741 - RNA, 20 nt, Homo sapiens
uuuugagaauacacuaucaa

SEQ ID NO: 1409742 - RNA, 21 nt, Homo sapiens
uuuuuacugucuuuugaagaa

SEQ ID NO: 1409743 - RNA, 11 nt, Homo sapiens
uuuuugcucuu

SEQ ID NO: 1409744 - RNA, 14 nt, Homo sapiens
aaaaagaaguuucu

SEQ ID NO: 1409745 - RNA, 13 nt, Homo sapiens
aaaaccugggcac

SEQ ID NO: 1409746 - RNA, 19 nt, Homo sapiens
aaaagcuucugcaauauua

SEQ ID NO: 1409747 - RNA, 15 nt, Homo sapiens
aaaagguuguguaca

SEQ ID NO: 1409748 - RNA, 16 nt, Homo sapiens
aaaaguaacaucuccu

SEQ ID NO: 1409749 - RNA, 14 nt, Homo sapiens
aaaauaagccacau

SEQ ID NO: 1409750 - RNA, 18 nt, Homo sapiens
aaaauaagccacauaucu

SEQ ID NO: 1409751 - RNA, 13 nt, Homo sapiens
aaaaucccuuaau

SEQ ID NO: 1409752 - RNA, 12 nt, Homo sapiens
aaaaugccacag

SEQ ID NO: 1409753 - RNA, 19 nt, Homo sapiens
aaaaugcuaaaacaugaug

SEQ ID NO: 1409754 - RNA, 21 nt, Homo sapiens
aaaauuagugguacuucaggu

SEQ ID NO: 1409755 - RNA, 14 nt, Homo sapiens
aaaauuaugcugca

SEQ ID NO: 1409756 - RNA, 19 nt, Homo sapiens
aaacaaaaaaugugcuguu

SEQ ID NO: 1409757 - RNA, 20 nt, Homo sapiens
aaacaagggguuacuuuaca

SEQ ID NO: 1409758 - RNA, 12 nt, Homo sapiens
aaacacugugua

SEQ ID NO: 1409759 - RNA, 15 nt, Homo sapiens
aaacccuguccuccc

SEQ ID NO: 1409760 - RNA, 23 nt, Homo sapiens
aaaccucaugccacccugcauuu

SEQ ID NO: 1409761 - RNA, 23 nt, Homo sapiens
aaaccuggccuuauaucauuuca

SEQ ID NO: 1409762 - RNA, 13 nt, Homo sapiens
aaacuacaccaca

SEQ ID NO: 1409763 - RNA, 13 nt, Homo sapiens
aaacuacuucaca

SEQ ID NO: 1409764 - RNA, 13 nt, Homo sapiens
aaacucaucucau

SEQ ID NO: 1409765 - RNA, 21 nt, Homo sapiens
aaacucaucucauuacccuuu

SEQ ID NO: 1409766 - RNA, 21 nt, Homo sapiens
aaacuuauaaucaauacaaac

SEQ ID NO: 1409767 - RNA, 14 nt, Homo sapiens
aaacuuuaucucac

SEQ ID NO: 1409768 - RNA, 18 nt, Homo sapiens
aaagaaaaaaaaacuggg

SEQ ID NO: 1409769 - RNA, 19 nt, Homo sapiens
aaagaaaaaaaaacugggg

SEQ ID NO: 1409770 - RNA, 14 nt, Homo sapiens
aaagaaaaaaaagu

SEQ ID NO: 1409771 - RNA, 13 nt, Homo sapiens
aaagaaauaaucu

SEQ ID NO: 1409772 - RNA, 17 nt, Homo sapiens
aaagaaaugucugccau

SEQ ID NO: 1409773 - RNA, 20 nt, Homo sapiens
aaagacaaaacuuccuguuu

SEQ ID NO: 1409774 - RNA, 14 nt, Homo sapiens
aaagacuguuuuca

SEQ ID NO: 1409775 - RNA, 12 nt, Homo sapiens
aaagccuuucag

SEQ ID NO: 1409776 - RNA, 21 nt, Homo sapiens
aaagcuaaacguaauuuccac

SEQ ID NO: 1409777 - RNA, 17 nt, Homo sapiens
aaagcuaccaucacuuc

SEQ ID NO: 1409778 - RNA, 20 nt, Homo sapiens
aaagcuaccaucacuuccuc

SEQ ID NO: 1409779 - RNA, 14 nt, Homo sapiens
aaagcuucugcaau

SEQ ID NO: 1409780 - RNA, 23 nt, Homo sapiens
aaaggucuauggcucaugucuga

SEQ ID NO: 1409781 - RNA, 13 nt, Homo sapiens
aaagguuguguac

SEQ ID NO: 1409782 - RNA, 17 nt, Homo sapiens
aaaguaaaaacaaagaa

SEQ ID NO: 1409783 - RNA, 20 nt, Homo sapiens
aaaguaaaaacaaagaaauu

SEQ ID NO: 1409784 - RNA, 17 nt, Homo sapiens
aaaguagauuaaaauau

SEQ ID NO: 1409785 - RNA, 16 nt, Homo sapiens
aaagucuguggcccaa

SEQ ID NO: 1409786 - RNA, 15 nt, Homo sapiens
aaagucuugugacua

SEQ ID NO: 1409787 - RNA, 17 nt, Homo sapiens
aaagugcugagauuaca

SEQ ID NO: 1409788 - RNA, 22 nt, Homo sapiens
aaaguuaaacuuuaucucacag

SEQ ID NO: 1409789 - RNA, 14 nt, Homo sapiens
aaauaaacacugug

SEQ ID NO: 1409790 - RNA, 15 nt, Homo sapiens
aaauaaacacugugu

SEQ ID NO: 1409791 - RNA, 16 nt, Homo sapiens
aaauaagcugaugucc

SEQ ID NO: 1409792 - RNA, 16 nt, Homo sapiens
aaauaagcuuaucuua

SEQ ID NO: 1409793 - RNA, 18 nt, Homo sapiens
aaauaauuccacaguccu

SEQ ID NO: 1409794 - RNA, 19 nt, Homo sapiens
aaauacaaaggaagaacau

SEQ ID NO: 1409795 - RNA, 12 nt, Homo sapiens
aaauaguuccau

SEQ ID NO: 1409796 - RNA, 13 nt, Homo sapiens
aaauauagucaca

SEQ ID NO: 1409797 - RNA, 18 nt, Homo sapiens
aaaucaauacacuaguug

SEQ ID NO: 1409798 - RNA, 18 nt, Homo sapiens
gcgauucucaugccucag

SEQ ID NO: 1409799 - RNA, 20 nt, Homo sapiens
gcggggcuacaguccuucca

SEQ ID NO: 1409800 - RNA, 21 nt, Homo sapiens
gcguggaguucuccucagguc

SEQ ID NO: 1409801 - RNA, 21 nt, Homo sapiens
gcuaaagcccgggcacccgcc

SEQ ID NO: 1409802 - RNA, 14 nt, Homo sapiens
gcuaacauggagcu

SEQ ID NO: 1409803 - RNA, 14 nt, Homo sapiens
gcuaacauggugaa

SEQ ID NO: 1409804 - RNA, 22 nt, Homo sapiens
gcuaagcuuuauggguguuaau

SEQ ID NO: 1409805 - RNA, 21 nt, Homo sapiens
gcuaccgucuuggaugcauga

SEQ ID NO: 1409806 - RNA, 14 nt, Homo sapiens
gcuaucugaacuaa

SEQ ID NO: 1409807 - RNA, 15 nt, Homo sapiens
gcuaugguugccacc

SEQ ID NO: 1409808 - RNA, 14 nt, Homo sapiens
gcuaugucuuccca

SEQ ID NO: 1409809 - RNA, 13 nt, Homo sapiens
gcucaaacccugu

SEQ ID NO: 1409810 - RNA, 14 nt, Homo sapiens
gcucaucugccaaa

SEQ ID NO: 1409811 - RNA, 19 nt, Homo sapiens
gcucauucuaaugauggcc

SEQ ID NO: 1409812 - RNA, 19 nt, Homo sapiens
gcucccaggagggcuuugu

SEQ ID NO: 1409813 - RNA, 16 nt, Homo sapiens
gcucccugaagccagc

SEQ ID NO: 1409814 - RNA, 21 nt, Homo sapiens
gcucccugccagcuuccuguc

SEQ ID NO: 1409815 - RNA, 19 nt, Homo sapiens
gcucggacuauacugcuga

SEQ ID NO: 1409816 - RNA, 21 nt, Homo sapiens
gcucucagcuugugccuugua

SEQ ID NO: 1409817 - RNA, 18 nt, Homo sapiens
gcugaacacccuccuuca

SEQ ID NO: 1409818 - RNA, 16 nt, Homo sapiens
gcugaagccacacagc

SEQ ID NO: 1409819 - RNA, 17 nt, Homo sapiens
gcugaauuaaugugauu

SEQ ID NO: 1409820 - RNA, 20 nt, Homo sapiens
gcugagaucacaccacugca

SEQ ID NO: 1409821 - RNA, 23 nt, Homo sapiens
gcugaggacccucagccccagga

SEQ ID NO: 1409822 - RNA, 18 nt, Homo sapiens
gcugagguuccucugccu

SEQ ID NO: 1409823 - RNA, 16 nt, Homo sapiens
gcugagucgcucucau

SEQ ID NO: 1409824 - RNA, 17 nt, Homo sapiens
gcugaucgggaagcccu

SEQ ID NO: 1409825 - RNA, 17 nt, Homo sapiens
gcugauggagacaguaa

SEQ ID NO: 1409826 - RNA, 19 nt, Homo sapiens
guagaagccacgguguucu

SEQ ID NO: 1409827 - RNA, 12 nt, Homo sapiens
guagccaugacc

SEQ ID NO: 1409828 - RNA, 22 nt, Homo sapiens
guaucagucagugcuggagaaa

SEQ ID NO: 1409829 - RNA, 15 nt, Homo sapiens
guauucuacccuguu

SEQ ID NO: 1409830 - RNA, 22 nt, Homo sapiens
guauucuacccuguugcaaagg

SEQ ID NO: 1409831 - RNA, 22 nt, Homo sapiens
guauuuauuguuuaagcagaaa

SEQ ID NO: 1409832 - RNA, 13 nt, Homo sapiens
guauuucaccucu

SEQ ID NO: 1409833 - RNA, 16 nt, Homo sapiens
gucaaauaaacacugu

SEQ ID NO: 1409834 - RNA, 19 nt, Homo sapiens
gucacaauuuucugugcca

SEQ ID NO: 1409835 - RNA, 13 nt, Homo sapiens
gucacacagggaa

SEQ ID NO: 1409836 - RNA, 21 nt, Homo sapiens
gucacuuguuucuacucaaaa

SEQ ID NO: 1409837 - RNA, 20 nt, Homo sapiens
gucagcggggcuacaguccu

SEQ ID NO: 1409838 - RNA, 19 nt, Homo sapiens
gucauaucuagucacuugu

SEQ ID NO: 1409839 - RNA, 22 nt, Homo sapiens
gucauauucgauguacuuuaag

SEQ ID NO: 1409840 - RNA, 18 nt, Homo sapiens
gucaugggagcuacuuau

SEQ ID NO: 1409841 - RNA, 20 nt, Homo sapiens
gucauugaauuuaaggccca

SEQ ID NO: 1409842 - RNA, 21 nt, Homo sapiens
guccaggaaaugugcacaaaa

SEQ ID NO: 1409843 - RNA, 17 nt, Homo sapiens
gucccagaaugacccca

SEQ ID NO: 1409844 - RNA, 18 nt, Homo sapiens
gucccagcucccugggca

SEQ ID NO: 1409845 - RNA, 20 nt, Homo sapiens
guccuugaguccccaccagc

SEQ ID NO: 1409846 - RNA, 16 nt, Homo sapiens
gucuaaguaugccuca

SEQ ID NO: 1409847 - RNA, 18 nt, Homo sapiens
gucuagaaaauaaugcaa

SEQ ID NO: 1409848 - RNA, 18 nt, Homo sapiens
gucuauuuuuucuugaca

SEQ ID NO: 1409849 - RNA, 13 nt, Homo sapiens
gucucaugcagaa

SEQ ID NO: 1409850 - RNA, 16 nt, Homo sapiens
gucugagcuucaguau

SEQ ID NO: 1409851 - RNA, 23 nt, Homo sapiens
gucugcaggauugauuaugcaga

SEQ ID NO: 1409852 - RNA, 18 nt, Homo sapiens
gucuuauaucccagguga

SEQ ID NO: 1409853 - RNA, 15 nt, Homo sapiens
gugaaacucaucuca

SEQ ID NO: 1409854 - RNA, 23 nt, Homo sapiens
gugaccuguaguguaccauucuc

SEQ ID NO: 1409855 - RNA, 20 nt, Homo sapiens
gugagccaaauaaaccucuu

SEQ ID NO: 1409856 - RNA, 18 nt, Homo sapiens
gugaggcccucaccagaa

SEQ ID NO: 1409857 - RNA, 14 nt, Homo sapiens
ucucagguggugau

SEQ ID NO: 1409858 - RNA, 17 nt, Homo sapiens
ucucagguggugauaug

SEQ ID NO: 1409859 - RNA, 14 nt, Homo sapiens
ucucaugaagcccu

SEQ ID NO: 1409860 - RNA, 19 nt, Homo sapiens
ucucauggugaaaucugcu

SEQ ID NO: 1409861 - RNA, 23 nt, Homo sapiens
ucuccagagcuccugaguggaau

SEQ ID NO: 1409862 - RNA, 13 nt, Homo sapiens
ucucccguuacaa

SEQ ID NO: 1409863 - RNA, 22 nt, Homo sapiens
ucuccuagcucccugccagcuu

SEQ ID NO: 1409864 - RNA, 15 nt, Homo sapiens
ucuccucuuccagag

SEQ ID NO: 1409865 - RNA, 18 nt, Homo sapiens
ucucucaccaugugacac

SEQ ID NO: 1409866 - RNA, 23 nt, Homo sapiens
ucucuccaucuaccuuccaguca

SEQ ID NO: 1409867 - RNA, 15 nt, Homo sapiens
ucucucucuuagcau

SEQ ID NO: 1409868 - RNA, 13 nt, Homo sapiens
ucucucugagcug

SEQ ID NO: 1409869 - RNA, 17 nt, Homo sapiens
ucucucuggaguuuucu

SEQ ID NO: 1409870 - RNA, 22 nt, Homo sapiens
ucucucuuagcauccugccuua

SEQ ID NO: 1409871 - RNA, 21 nt, Homo sapiens
ucucugaacuaggugaucuca

SEQ ID NO: 1409872 - RNA, 22 nt, Homo sapiens
ucucugaacuaggugaucucag

SEQ ID NO: 1409873 - RNA, 13 nt, Homo sapiens
ucucugagcucug

SEQ ID NO: 1409874 - RNA, 19 nt, Homo sapiens
ucugaaguuauaaacuuau

SEQ ID NO: 1409875 - RNA, 14 nt, Homo sapiens
ucugcaauauuauu

SEQ ID NO: 1409876 - RNA, 18 nt, Homo sapiens
ucugccagcauaauacuu

SEQ ID NO: 1409877 - RNA, 13 nt, Homo sapiens
ucugccauuugcu

SEQ ID NO: 1409878 - RNA, 18 nt, Homo sapiens
ucugccauuugcugcuua

SEQ ID NO: 1409879 - RNA, 14 nt, Homo sapiens
ucugccugcuuaca

SEQ ID NO: 1409880 - RNA, 16 nt, Homo sapiens
ucugcucauucuaaug

SEQ ID NO: 1409881 - RNA, 19 nt, Homo sapiens
ucuggaaaacucaggauuc

SEQ ID NO: 1409882 - RNA, 20 nt, Homo sapiens
ucuggaacgcucuaggcaga

SEQ ID NO: 1409883 - RNA, 18 nt, Homo sapiens
ucuggagagagagcaaga

SEQ ID NO: 1409884 - RNA, 17 nt, Homo sapiens
ucuggcgucuguuucaa

SEQ ID NO: 1409885 - RNA, 17 nt, Homo sapiens
ucugggaagggacaucu

SEQ ID NO: 1409886 - RNA, 19 nt, Homo sapiens
ucuggggcucagcccugag

SEQ ID NO: 1409887 - RNA, 22 nt, Homo sapiens
ucuggggcucagcccugagcua

SEQ ID NO: 1409888 - RNA, 22 nt, Homo sapiens
ucuguacaucagacaauugcau

SEQ ID NO: 1409889 - RNA, 14 nt, Homo sapiens
ucugucccuaccuu

SEQ ID NO: 1409890 - RNA, 14 nt, Homo sapiens
ucuguuagccaugu

SEQ ID NO: 1409891 - RNA, 19 nt, Homo sapiens
ucuguuagccauguggcug

SEQ ID NO: 1409892 - RNA, 21 nt, Homo sapiens
ucuguucuuugguguaaucuc

SEQ ID NO: 1409893 - RNA, 14 nt, Homo sapiens
ucuuagaacucugc

SEQ ID NO: 1409894 - RNA, 14 nt, Homo sapiens
ucuuauaucccagg

SEQ ID NO: 1409895 - RNA, 14 nt, Homo sapiens
ucuucgauguacuu

SEQ ID NO: 1409896 - RNA, 16 nt, Homo sapiens
ucuuggcccgcacaga

SEQ ID NO: 1409897 - RNA, 22 nt, Homo sapiens
ucuuuggggagagcuggcagug

SEQ ID NO: 1409898 - RNA, 20 nt, Homo sapiens
ucuuugugccucaacauacu

SEQ ID NO: 1409899 - RNA, 19 nt, Homo sapiens
ucuuuguuggcucagaaaa

SEQ ID NO: 1409900 - RNA, 20 nt, Homo sapiens
ucuuuugauaaggcuguuaa

SEQ ID NO: 1409901 - RNA, 14 nt, Homo sapiens
ucuuuuuuugcaua

SEQ ID NO: 1409902 - RNA, 15 nt, Homo sapiens
ugaaaaaacaccaug

SEQ ID NO: 1409903 - RNA, 15 nt, Homo sapiens
ugaaaacagucccag

SEQ ID NO: 1409904 - RNA, 11 nt, Homo sapiens
ugaaaacuggg

SEQ ID NO: 1409905 - RNA, 15 nt, Homo sapiens
ugaaaaucaguuuua

SEQ ID NO: 1409906 - RNA, 13 nt, Homo sapiens
ugaaacacuuugc

SEQ ID NO: 1409907 - RNA, 14 nt, Homo sapiens
ugaaacuaaucaua

SEQ ID NO: 1409908 - RNA, 23 nt, Homo sapiens
ugaaagggaaggagacacauuca

SEQ ID NO: 1409909 - RNA, 17 nt, Homo sapiens
ugaacuaggugaucuca

SEQ ID NO: 1409910 - RNA, 11 nt, Homo sapiens
ugaacugccaa

SEQ ID NO: 1409911 - RNA, 21 nt, Homo sapiens
ugaagaagaaaucguucauca

SEQ ID NO: 1409912 - RNA, 10 nt, Homo sapiens
ugaagccagc

SEQ ID NO: 1409913 - RNA, 16 nt, Homo sapiens
ugaagccgucucaugc

SEQ ID NO: 1409914 - RNA, 16 nt, Homo sapiens
ugaaggaacuagggau

SEQ ID NO: 1409915 - RNA, 15 nt, Homo sapiens
ugaaguuugcuauuc

SEQ ID NO: 1409916 - RNA, 13 nt, Homo sapiens
ugaauagcuuaug

SEQ ID NO: 1409917 - RNA, 17 nt, Homo sapiens
ugaauuuuguaaguaua

SEQ ID NO: 1409918 - RNA, 14 nt, Homo sapiens
ugacaauacaaaua

SEQ ID NO: 1409919 - RNA, 15 nt, Homo sapiens
ugacaauacaaauac

SEQ ID NO: 1409920 - RNA, 15 nt, Homo sapiens
ugacaccugccauac

SEQ ID NO: 1409921 - RNA, 17 nt, Homo sapiens
ugacaguaguaccaaau

SEQ ID NO: 1409922 - RNA, 14 nt, Homo sapiens
ugacauuuaaacuc

SEQ ID NO: 1409923 - RNA, 15 nt, Homo sapiens
ugaccacagcaguuu

SEQ ID NO: 1409924 - RNA, 18 nt, Homo sapiens
ugaccucauuuacaaagc

SEQ ID NO: 1409925 - RNA, 19 nt, Homo sapiens
ugaccuguaguguaccauu

SEQ ID NO: 1409926 - RNA, 13 nt, Homo sapiens
ugacggacuucau

SEQ ID NO: 1409927 - RNA, 15 nt, Homo sapiens
ugacucaagauuccc

SEQ ID NO: 1409928 - RNA, 16 nt, Homo sapiens
ugacucugucugccag

SEQ ID NO: 1409929 - RNA, 22 nt, Homo sapiens
ugacugaagacaggcacaaaau

SEQ ID NO: 1409930 - RNA, 12 nt, Homo sapiens
ugacugcaauga

SEQ ID NO: 1409931 - RNA, 19 nt, Homo sapiens
ugacuuauguaaucaaagc

SEQ ID NO: 1409932 - RNA, 14 nt, Homo sapiens
ugacuuugugccau

SEQ ID NO: 1409933 - RNA, 16 nt, Homo sapiens
ugagacagaguuucac

SEQ ID NO: 1409934 - RNA, 18 nt, Homo sapiens
ugagagcucuucagagau

SEQ ID NO: 1409935 - RNA, 22 nt, Homo sapiens
ugagaggguuuccuaacagcuu

SEQ ID NO: 1409936 - RNA, 22 nt, Homo sapiens
ugagauagucacuggaucaaga

SEQ ID NO: 1409937 - RNA, 15 nt, Homo sapiens
ugagcccgugucaca

SEQ ID NO: 1409938 - RNA, 20 nt, Homo sapiens
ugagcugagaucacaccacu

SEQ ID NO: 1409939 - RNA, 14 nt, Homo sapiens
ugagucgcucucau

SEQ ID NO: 1409940 - RNA, 14 nt, Homo sapiens
ugagucuccuuuag

SEQ ID NO: 1409941 - RNA, 14 nt, Homo sapiens
ugagugaguucuca

SEQ ID NO: 1409942 - RNA, 14 nt, Homo sapiens
ugagugucaucuca

SEQ ID NO: 1409943 - RNA, 14 nt, Homo sapiens
ugauauuuuaguca

SEQ ID NO: 1409944 - RNA, 19 nt, Homo sapiens
ugaucucagcucacucugc

SEQ ID NO: 1409945 - RNA, 14 nt, Homo sapiens
ugaugacuauggaa

SEQ ID NO: 1409946 - RNA, 15 nt, Homo sapiens
ugaugaguccagaac

SEQ ID NO: 1409947 - RNA, 23 nt, Homo sapiens
ugaugauuucuuauuuguaaaau

SEQ ID NO: 1409948 - RNA, 15 nt, Homo sapiens
ugauggagcagagca

SEQ ID NO: 1409949 - RNA, 19 nt, Homo sapiens
ugauuaagugcacaccgug

SEQ ID NO: 1409950 - RNA, 23 nt, Homo sapiens
ugauucuccugccucagccucuu

SEQ ID NO: 1409951 - RNA, 18 nt, Homo sapiens
ugcacaccgugugccaua

SEQ ID NO: 1409952 - RNA, 19 nt, Homo sapiens
aauuugagugguguuguca

SEQ ID NO: 1409953 - RNA, 15 nt, Homo sapiens
aauuuguuugugcuu

SEQ ID NO: 1409954 - RNA, 22 nt, Homo sapiens
acaaaaaagaaaaaaaaacugg

SEQ ID NO: 1409955 - RNA, 14 nt, Homo sapiens
acaaaaaaugugcu

SEQ ID NO: 1409956 - RNA, 20 nt, Homo sapiens
acaaaccagcaacuaauaaa

SEQ ID NO: 1409957 - RNA, 14 nt, Homo sapiens
acaaggucagagag

SEQ ID NO: 1409958 - RNA, 17 nt, Homo sapiens
acaagucggcuguggag

SEQ ID NO: 1409959 - RNA, 18 nt, Homo sapiens
acaagugccccuggccaa

SEQ ID NO: 1409960 - RNA, 16 nt, Homo sapiens
acaauacagccacuaa

SEQ ID NO: 1409961 - RNA, 13 nt, Homo sapiens
acaauccaucaaa

SEQ ID NO: 1409962 - RNA, 16 nt, Homo sapiens
acaauggcgugaucuc

SEQ ID NO: 1409963 - RNA, 21 nt, Homo sapiens
acaauggcgugaucucagcuc

SEQ ID NO: 1409964 - RNA, 16 nt, Homo sapiens
acaaugucuggggaca

SEQ ID NO: 1409965 - RNA, 11 nt, Homo sapiens
acacacugugc

SEQ ID NO: 1409966 - RNA, 16 nt, Homo sapiens
acacaggaacucugug

SEQ ID NO: 1409967 - RNA, 15 nt, Homo sapiens
acacaggagaccacc

SEQ ID NO: 1409968 - RNA, 14 nt, Homo sapiens
acaccaauugauuu

SEQ ID NO: 1409969 - RNA, 13 nt, Homo sapiens
acacccuccuuca

SEQ ID NO: 1409970 - RNA, 18 nt, Homo sapiens
acagacacuuuaaaagcu

SEQ ID NO: 1409971 - RNA, 15 nt, Homo sapiens
acagaguuucacucu

SEQ ID NO: 1409972 - RNA, 22 nt, Homo sapiens
acagauccugcagucaauguuu

SEQ ID NO: 1409973 - RNA, 22 nt, Homo sapiens
acagccucugaccccuccucac

SEQ ID NO: 1409974 - RNA, 17 nt, Homo sapiens
acagccugugugcagug

SEQ ID NO: 1409975 - RNA, 20 nt, Homo sapiens
acaggaaacuacuucacagu

SEQ ID NO: 1409976 - RNA, 18 nt, Homo sapiens
acaggaugaugacuaugg

SEQ ID NO: 1409977 - RNA, 19 nt, Homo sapiens
acaggaugaugacuaugga

SEQ ID NO: 1409978 - RNA, 21 nt, Homo sapiens
acaggaugaugacuauggaaa

SEQ ID NO: 1409979 - RNA, 14 nt, Homo sapiens
acagguuacucagg

SEQ ID NO: 1409980 - RNA, 22 nt, Homo sapiens
acaguaguaccaaaugcuuuaa

SEQ ID NO: 1409981 - RNA, 23 nt, Homo sapiens
acaguaguaccaaaugcuuuaaa

SEQ ID NO: 1409982 - RNA, 22 nt, Homo sapiens
acaguggccggggcugaagcca

SEQ ID NO: 1409983 - RNA, 16 nt, Homo sapiens
acaguucuauuugcua

SEQ ID NO: 1409984 - RNA, 19 nt, Homo sapiens
acaguuucaaaaacuguau

SEQ ID NO: 1409985 - RNA, 18 nt, Homo sapiens
acauaaggagugccugaa

SEQ ID NO: 1409986 - RNA, 21 nt, Homo sapiens
acauaugguuaaguaauugca

SEQ ID NO: 1409987 - RNA, 17 nt, Homo sapiens
acaucagacaauugcau

SEQ ID NO: 1409988 - RNA, 16 nt, Homo sapiens
acaucugcuucaccaa

SEQ ID NO: 1409989 - RNA, 14 nt, Homo sapiens
acaucuggagagag

SEQ ID NO: 1409990 - RNA, 13 nt, Homo sapiens
acaucuggcucaa

SEQ ID NO: 1409991 - RNA, 22 nt, Homo sapiens
acaucuguucuuugguguaauc

SEQ ID NO: 1409992 - RNA, 12 nt, Homo sapiens
acauuacauuaa

SEQ ID NO: 1409993 - RNA, 20 nt, Homo sapiens
acauuccaaauaauuccaca

SEQ ID NO: 1409994 - RNA, 21 nt, Homo sapiens
acauuugcuagugacauguac

SEQ ID NO: 1409995 - RNA, 17 nt, Homo sapiens
accaaaauuuuguccca

SEQ ID NO: 1409996 - RNA, 16 nt, Homo sapiens
accaaagagggcuucc

SEQ ID NO: 1409997 - RNA, 20 nt, Homo sapiens
accaacuuuuucauucccug

SEQ ID NO: 1409998 - RNA, 17 nt, Homo sapiens
accaauaccuacugaau

SEQ ID NO: 1409999 - RNA, 13 nt, Homo sapiens
accaauccucacc

SEQ ID NO: 1410000 - RNA, 19 nt, Homo sapiens
accacaggcccuuuccuca

SEQ ID NO: 1410001 - RNA, 13 nt, Homo sapiens
accacucggggcc

SEQ ID NO: 1410002 - RNA, 13 nt, Homo sapiens
accagaagcagau

SEQ ID NO: 1410003 - RNA, 19 nt, Homo sapiens
accagagaccguccucacc

SEQ ID NO: 1410004 - RNA, 15 nt, Homo sapiens
accagagcuguggag

SEQ ID NO: 1410005 - RNA, 16 nt, Homo sapiens
accaggagcugcucac

SEQ ID NO: 1410006 - RNA, 14 nt, Homo sapiens
accaugaagaagaa

SEQ ID NO: 1410007 - RNA, 13 nt, Homo sapiens
accaugugacaca

SEQ ID NO: 1410008 - RNA, 17 nt, Homo sapiens
acccaauaaaacugaug

SEQ ID NO: 1410009 - RNA, 14 nt, Homo sapiens
acccaauauugcua

SEQ ID NO: 1410010 - RNA, 22 nt, Homo sapiens
acccaccuuccuugcgaccacc

SEQ ID NO: 1410011 - RNA, 15 nt, Homo sapiens
acccagaacugggcu

SEQ ID NO: 1410012 - RNA, 15 nt, Homo sapiens
acccagagcugccua

SEQ ID NO: 1410013 - RNA, 16 nt, Homo sapiens
accccaggcagcuccu

SEQ ID NO: 1410014 - RNA, 13 nt, Homo sapiens
acccccaacccaa

SEQ ID NO: 1410015 - RNA, 14 nt, Homo sapiens
acccccagccaggc

SEQ ID NO: 1410016 - RNA, 17 nt, Homo sapiens
accccgauagugacaca

SEQ ID NO: 1410017 - RNA, 15 nt, Homo sapiens
accgagagccaaaca

SEQ ID NO: 1410018 - RNA, 19 nt, Homo sapiens
accuaaauugaacugccaa

SEQ ID NO: 1410019 - RNA, 13 nt, Homo sapiens
accuaagcaauga

SEQ ID NO: 1410020 - RNA, 12 nt, Homo sapiens
accuagauucca

SEQ ID NO: 1410021 - RNA, 16 nt, Homo sapiens
accuagauuccauaca

SEQ ID NO: 1410022 - RNA, 23 nt, Homo sapiens
accucacucuugccaaccuguaa

SEQ ID NO: 1410023 - RNA, 13 nt, Homo sapiens
accucagcugcuu

SEQ ID NO: 1410024 - RNA, 12 nt, Homo sapiens
accucaggugau

SEQ ID NO: 1410025 - RNA, 13 nt, Homo sapiens
accucaugccacc

SEQ ID NO: 1410026 - RNA, 12 nt, Homo sapiens
accuccccagac

SEQ ID NO: 1410027 - RNA, 15 nt, Homo sapiens
accucguauuucacc

SEQ ID NO: 1410028 - RNA, 15 nt, Homo sapiens
accucuccagcuccu

SEQ ID NO: 1410029 - RNA, 19 nt, Homo sapiens
accugccaggcaggggugg

SEQ ID NO: 1410030 - RNA, 23 nt, Homo sapiens
accugccuccggccugcacuccc

SEQ ID NO: 1410031 - RNA, 15 nt, Homo sapiens
accugccucugccca

SEQ ID NO: 1410032 - RNA, 17 nt, Homo sapiens
accuugacuucauuuau

SEQ ID NO: 1410033 - RNA, 15 nt, Homo sapiens
accuuuccccacucc

SEQ ID NO: 1410034 - RNA, 17 nt, Homo sapiens
acgccuccugccaaggc

SEQ ID NO: 1410035 - RNA, 17 nt, Homo sapiens
acgcuaaagagcccuug

SEQ ID NO: 1410036 - RNA, 19 nt, Homo sapiens
acgcuuuuuuggaucagcu

SEQ ID NO: 1410037 - RNA, 14 nt, Homo sapiens
acggcucaacuccu

SEQ ID NO: 1410038 - RNA, 17 nt, Homo sapiens
acguggcuuuuagacag

SEQ ID NO: 1410039 - RNA, 13 nt, Homo sapiens
acuaaaugaucug

SEQ ID NO: 1410040 - RNA, 14 nt, Homo sapiens
acuaauugcccaaa

SEQ ID NO: 1410041 - RNA, 21 nt, Homo sapiens
acuacaccuggcugagguucc

SEQ ID NO: 1410042 - RNA, 13 nt, Homo sapiens
acuagcuucccag

SEQ ID NO: 1410043 - RNA, 16 nt, Homo sapiens
acuauauauacaauau

SEQ ID NO: 1410044 - RNA, 15 nt, Homo sapiens
acucauuuaaauuaa

SEQ ID NO: 1410045 - RNA, 15 nt, Homo sapiens
acucccacuucuuca

SEQ ID NO: 1410046 - RNA, 14 nt, Homo sapiens
acuccugaccucag

SEQ ID NO: 1410047 - RNA, 22 nt, Homo sapiens
acucugguuguuuaugcaagag

SEQ ID NO: 1410048 - RNA, 19 nt, Homo sapiens
acugauguuacuagccucu

SEQ ID NO: 1410049 - RNA, 16 nt, Homo sapiens
acugcauuucacucug

SEQ ID NO: 1410050 - RNA, 18 nt, Homo sapiens
acugcugaauuaauguga

SEQ ID NO: 1410051 - RNA, 20 nt, Homo sapiens
acugcugccaacuccauguc

SEQ ID NO: 1410052 - RNA, 19 nt, Homo sapiens
acuggagguugaagccaag

SEQ ID NO: 1410053 - RNA, 21 nt, Homo sapiens
acuguugaugucuaaguaugc

SEQ ID NO: 1410054 - RNA, 16 nt, Homo sapiens
acuucauuuauaugaa

SEQ ID NO: 1410055 - RNA, 22 nt, Homo sapiens
acuuccucaucaugaaaacugg

SEQ ID NO: 1410056 - RNA, 18 nt, Homo sapiens
acuucuucagcuugggca

SEQ ID NO: 1410057 - RNA, 21 nt, Homo sapiens
acuugaaaauuaacaugaaua

SEQ ID NO: 1410058 - RNA, 18 nt, Homo sapiens
acuuguuucuacucaaaa

SEQ ID NO: 1410059 - RNA, 12 nt, Homo sapiens
acuuuaucucac

SEQ ID NO: 1410060 - RNA, 14 nt, Homo sapiens
acuuuaucucacag

SEQ ID NO: 1410061 - RNA, 18 nt, Homo sapiens
acuuucccacgucacuug

SEQ ID NO: 1410062 - RNA, 19 nt, Homo sapiens
acuuucccacgucacuuga

SEQ ID NO: 1410063 - RNA, 15 nt, Homo sapiens
agaaaaaaaaacugg

SEQ ID NO: 1410064 - RNA, 16 nt, Homo sapiens
agaaaaaaaaacuggg

SEQ ID NO: 1410065 - RNA, 13 nt, Homo sapiens
agaaaaaaaagua

SEQ ID NO: 1410066 - RNA, 15 nt, Homo sapiens
agaaaauauagucac

SEQ ID NO: 1410067 - RNA, 18 nt, Homo sapiens
agaaagaaaugucugcca

SEQ ID NO: 1410068 - RNA, 23 nt, Homo sapiens
agaaaucuugaauagcuuaugua

SEQ ID NO: 1410069 - RNA, 19 nt, Homo sapiens
agaaauguaacauacucau

SEQ ID NO: 1410070 - RNA, 21 nt, Homo sapiens
agaaauuuuauuagacauucu

SEQ ID NO: 1410071 - RNA, 17 nt, Homo sapiens
agaacaacaacaaaaua

SEQ ID NO: 1410072 - RNA, 19 nt, Homo sapiens
agaagauugagauguguuc

SEQ ID NO: 1410073 - RNA, 16 nt, Homo sapiens
agaagugccaucucaa

SEQ ID NO: 1410074 - RNA, 20 nt, Homo sapiens
agaagugccaucucaauugu

SEQ ID NO: 1410075 - RNA, 12 nt, Homo sapiens
agaauacauauu

SEQ ID NO: 1410076 - RNA, 23 nt, Homo sapiens
agaaugaccucgcaagacccuua

SEQ ID NO: 1410077 - RNA, 17 nt, Homo sapiens
agaauuaggaaggccau

SEQ ID NO: 1410078 - RNA, 14 nt, Homo sapiens
agaauuuaauguac

SEQ ID NO: 1410079 - RNA, 16 nt, Homo sapiens
agagaacaacuggcag

SEQ ID NO: 1410080 - RNA, 15 nt, Homo sapiens
agagaacaucuggag

SEQ ID NO: 1410081 - RNA, 13 nt, Homo sapiens
agagagagcaaga

SEQ ID NO: 1410082 - RNA, 14 nt, Homo sapiens
agagagagcaagau

SEQ ID NO: 1410083 - RNA, 18 nt, Homo sapiens
agagccauaaaugaccua

SEQ ID NO: 1410084 - RNA, 19 nt, Homo sapiens
agagcccuugccuccccau

SEQ ID NO: 1410085 - RNA, 16 nt, Homo sapiens
agaggaaaagguguag

SEQ ID NO: 1410086 - RNA, 16 nt, Homo sapiens
agagggaggucacugg

SEQ ID NO: 1410087 - RNA, 12 nt, Homo sapiens
agaggugaccua

SEQ ID NO: 1410088 - RNA, 16 nt, Homo sapiens
agaguugaugguugua

SEQ ID NO: 1410089 - RNA, 19 nt, Homo sapiens
agauaagugcagucacaga

SEQ ID NO: 1410090 - RNA, 23 nt, Homo sapiens
agaucuguccugggggaugcaaa

SEQ ID NO: 1410091 - RNA, 14 nt, Homo sapiens
agaugaaaagcuac

SEQ ID NO: 1410092 - RNA, 20 nt, Homo sapiens
agaugcauguuacugccaaa

SEQ ID NO: 1410093 - RNA, 16 nt, Homo sapiens
agauuccauacaguga

SEQ ID NO: 1410094 - RNA, 15 nt, Homo sapiens
agauuuuucugugaa

SEQ ID NO: 1410095 - RNA, 18 nt, Homo sapiens
agcaacccaauauugcua

SEQ ID NO: 1410096 - RNA, 19 nt, Homo sapiens
agcaccuguugugugccug

SEQ ID NO: 1410097 - RNA, 16 nt, Homo sapiens
agcacuugaugccacc

SEQ ID NO: 1410098 - RNA, 20 nt, Homo sapiens
agcacuugaugccacccaga

SEQ ID NO: 1410099 - RNA, 15 nt, Homo sapiens
agcagaacacacucu

SEQ ID NO: 1410100 - RNA, 14 nt, Homo sapiens
agcagaagcuguuu

SEQ ID NO: 1410101 - RNA, 21 nt, Homo sapiens
agcagaugccagcgccaugcu

SEQ ID NO: 1410102 - RNA, 21 nt, Homo sapiens
agcagcugugaccacagcagu

SEQ ID NO: 1410103 - RNA, 14 nt, Homo sapiens
agcaggcuuuguga

SEQ ID NO: 1410104 - RNA, 23 nt, Homo sapiens
agcagggaggaagaagcuuaggc

SEQ ID NO: 1410105 - RNA, 12 nt, Homo sapiens
agcaugcugcug

SEQ ID NO: 1410106 - RNA, 16 nt, Homo sapiens
agccaagggacacagg

SEQ ID NO: 1410107 - RNA, 18 nt, Homo sapiens
agccacacacccgcucca

SEQ ID NO: 1410108 - RNA, 19 nt, Homo sapiens
agccaggcacacacugugc

SEQ ID NO: 1410109 - RNA, 22 nt, Homo sapiens
agccaggccugggggcagccuc

SEQ ID NO: 1410110 - RNA, 23 nt, Homo sapiens
agccaggccugggggcagccucu

SEQ ID NO: 1410111 - RNA, 17 nt, Homo sapiens
agccaggcuaugguugc

SEQ ID NO: 1410112 - RNA, 17 nt, Homo sapiens
agccagggggacuagcc

SEQ ID NO: 1410113 - RNA, 16 nt, Homo sapiens
agccauaaaugaccua

SEQ ID NO: 1410114 - RNA, 16 nt, Homo sapiens
agccauagagccugaa

SEQ ID NO: 1410115 - RNA, 17 nt, Homo sapiens
agccauagagccugaaa

SEQ ID NO: 1410116 - RNA, 15 nt, Homo sapiens
agcccagaaggccag

SEQ ID NO: 1410117 - RNA, 15 nt, Homo sapiens
agccccaaggccacc

SEQ ID NO: 1410118 - RNA, 18 nt, Homo sapiens
agccccagagcagggugu

SEQ ID NO: 1410119 - RNA, 19 nt, Homo sapiens
agcccccggucaccuuccu

SEQ ID NO: 1410120 - RNA, 13 nt, Homo sapiens
agcccgugucaca

SEQ ID NO: 1410121 - RNA, 22 nt, Homo sapiens
agcccugucucagcaauccacc

SEQ ID NO: 1410122 - RNA, 17 nt, Homo sapiens
agccgacucagcaacuu

SEQ ID NO: 1410123 - RNA, 15 nt, Homo sapiens
agccuccccgugcca

SEQ ID NO: 1410124 - RNA, 20 nt, Homo sapiens
agccuccccgugccaaaaau

SEQ ID NO: 1410125 - RNA, 15 nt, Homo sapiens
agccucugaccccuc

SEQ ID NO: 1410126 - RNA, 21 nt, Homo sapiens
agccucugaccccuccucacu

SEQ ID NO: 1410127 - RNA, 18 nt, Homo sapiens
agccugcugccugcuuuu

SEQ ID NO: 1410128 - RNA, 18 nt, Homo sapiens
agccuggacgcagccaca

SEQ ID NO: 1410129 - RNA, 19 nt, Homo sapiens
agccuggccauguccucaa

SEQ ID NO: 1410130 - RNA, 23 nt, Homo sapiens
agccuggccuccuucaccaaaga

SEQ ID NO: 1410131 - RNA, 19 nt, Homo sapiens
agccugugugcaguggagc

SEQ ID NO: 1410132 - RNA, 16 nt, Homo sapiens
agccuuucaguauuug

SEQ ID NO: 1410133 - RNA, 17 nt, Homo sapiens
agccuuuggcucuggag

SEQ ID NO: 1410134 - RNA, 21 nt, Homo sapiens
agcuacaggcuugagcuuuaa

SEQ ID NO: 1410135 - RNA, 17 nt, Homo sapiens
agcuagugucaccugca

SEQ ID NO: 1410136 - RNA, 15 nt, Homo sapiens
agcuaucugcaccuc

SEQ ID NO: 1410137 - RNA, 19 nt, Homo sapiens
agcuauguggcugcugcug

SEQ ID NO: 1410138 - RNA, 20 nt, Homo sapiens
agcucccagccucuucccau

SEQ ID NO: 1410139 - RNA, 22 nt, Homo sapiens
agcuccggguguagauucccuu

SEQ ID NO: 1410140 - RNA, 10 nt, Homo sapiens
agcugauguc

SEQ ID NO: 1410141 - RNA, 21 nt, Homo sapiens
agcugcaagacaucugcuuca

SEQ ID NO: 1410142 - RNA, 22 nt, Homo sapiens
agcugcuucucccacuuggcca

SEQ ID NO: 1410143 - RNA, 23 nt, Homo sapiens
agcugcuucucccacuuggccaa

SEQ ID NO: 1410144 - RNA, 16 nt, Homo sapiens
agcuggcaccauucag

SEQ ID NO: 1410145 - RNA, 13 nt, Homo sapiens
agcuggcccucca

SEQ ID NO: 1410146 - RNA, 19 nt, Homo sapiens
agcugggauuacaggcaca

SEQ ID NO: 1410147 - RNA, 20 nt, Homo sapiens
agcuucccccccaccacagg

SEQ ID NO: 1410148 - RNA, 21 nt, Homo sapiens
agcuucccccccaccacaggc

SEQ ID NO: 1410149 - RNA, 14 nt, Homo sapiens
agcuucugcaauau

SEQ ID NO: 1410150 - RNA, 16 nt, Homo sapiens
agcuuggaaaaguaac

SEQ ID NO: 1410151 - RNA, 15 nt, Homo sapiens
aggaaaauaagcuua

SEQ ID NO: 1410152 - RNA, 21 nt, Homo sapiens
aggaaacuccacaucugccuu

SEQ ID NO: 1410153 - RNA, 12 nt, Homo sapiens
aggaacuacuga

SEQ ID NO: 1410154 - RNA, 21 nt, Homo sapiens
aggaagcuuggcugcucaguu

SEQ ID NO: 1410155 - RNA, 18 nt, Homo sapiens
aggaauaaagcuucucuc

SEQ ID NO: 1410156 - RNA, 12 nt, Homo sapiens
aggacauucuau

SEQ ID NO: 1410157 - RNA, 16 nt, Homo sapiens
aggacucaacauuaca

SEQ ID NO: 1410158 - RNA, 13 nt, Homo sapiens
aggagcucuaggc

SEQ ID NO: 1410159 - RNA, 15 nt, Homo sapiens
aggagggcccugagg

SEQ ID NO: 1410160 - RNA, 17 nt, Homo sapiens
aggagggcccugaggaa

SEQ ID NO: 1410161 - RNA, 22 nt, Homo sapiens
aggagggcuuugugucuggcca

SEQ ID NO: 1410162 - RNA, 16 nt, Homo sapiens
aggcaaagaaagcucu

SEQ ID NO: 1410163 - RNA, 21 nt, Homo sapiens
aggcacaagucaccaugccug

SEQ ID NO: 1410164 - RNA, 14 nt, Homo sapiens
aggcacacacugug

SEQ ID NO: 1410165 - RNA, 16 nt, Homo sapiens
aggcacacacugugcu

SEQ ID NO: 1410166 - RNA, 20 nt, Homo sapiens
aggcaccucugugcugcauc

SEQ ID NO: 1410167 - RNA, 21 nt, Homo sapiens
aggcacuagccuuuggcucug

SEQ ID NO: 1410168 - RNA, 17 nt, Homo sapiens
aggcaggagaauggcau

SEQ ID NO: 1410169 - RNA, 14 nt, Homo sapiens
aggcagggcucucu

SEQ ID NO: 1410170 - RNA, 18 nt, Homo sapiens
aggcaucagaaacaucug

SEQ ID NO: 1410171 - RNA, 17 nt, Homo sapiens
aggcauuccagcuccuc

SEQ ID NO: 1410172 - RNA, 18 nt, Homo sapiens
aggcccuuuccucaggca

SEQ ID NO: 1410173 - RNA, 20 nt, Homo sapiens
aggccgggcacaguggcuca

SEQ ID NO: 1410174 - RNA, 20 nt, Homo sapiens
aggccgggcaugguggcuca

SEQ ID NO: 1410175 - RNA, 14 nt, Homo sapiens
aggccuuacagucu

SEQ ID NO: 1410176 - RNA, 18 nt, Homo sapiens
aggcuaauauauuccaac

SEQ ID NO: 1410177 - RNA, 15 nt, Homo sapiens
aggcucucaugucuc

SEQ ID NO: 1410178 - RNA, 22 nt, Homo sapiens
aggcugaggcaggagaauggca

SEQ ID NO: 1410179 - RNA, 23 nt, Homo sapiens
aggcugaggcaggagaauggcau

SEQ ID NO: 1410180 - RNA, 19 nt, Homo sapiens
aggcugaucgacgacauuu

SEQ ID NO: 1410181 - RNA, 13 nt, Homo sapiens
aggcugcuccuuc

SEQ ID NO: 1410182 - RNA, 17 nt, Homo sapiens
aggcuggucuugaacuc

SEQ ID NO: 1410183 - RNA, 17 nt, Homo sapiens
agggaaugagcuuccau

SEQ ID NO: 1410184 - RNA, 19 nt, Homo sapiens
agggaaugagcuuccauua

SEQ ID NO: 1410185 - RNA, 14 nt, Homo sapiens
agggaaugugagca

SEQ ID NO: 1410186 - RNA, 12 nt, Homo sapiens
agggccaggacu

SEQ ID NO: 1410187 - RNA, 21 nt, Homo sapiens
agggcccucugaggcucagcc

SEQ ID NO: 1410188 - RNA, 17 nt, Homo sapiens
agggcccugaggaauaa

SEQ ID NO: 1410189 - RNA, 23 nt, Homo sapiens
agggccugaggucuggcugcuug

SEQ ID NO: 1410190 - RNA, 23 nt, Homo sapiens
agggcucucuuuccuucuugccu

SEQ ID NO: 1410191 - RNA, 13 nt, Homo sapiens
aggggagcagggg

SEQ ID NO: 1410192 - RNA, 13 nt, Homo sapiens
aggggcucuggag

SEQ ID NO: 1410193 - RNA, 19 nt, Homo sapiens
agggggaggugaaaagggc

SEQ ID NO: 1410194 - RNA, 15 nt, Homo sapiens
aggguagaccaaauc

SEQ ID NO: 1410195 - RNA, 12 nt, Homo sapiens
aggguggcagag

SEQ ID NO: 1410196 - RNA, 18 nt, Homo sapiens
agguaaucgccaaauagu

SEQ ID NO: 1410197 - RNA, 20 nt, Homo sapiens
agguaccagcugcgcuugcu

SEQ ID NO: 1410198 - RNA, 21 nt, Homo sapiens
agguaccagcugcgcuugcuu

SEQ ID NO: 1410199 - RNA, 23 nt, Homo sapiens
agguauaauucacauuguauuca

SEQ ID NO: 1410200 - RNA, 21 nt, Homo sapiens
aggugagcaaccaguuggcua

SEQ ID NO: 1410201 - RNA, 12 nt, Homo sapiens
aggugaucucag

SEQ ID NO: 1410202 - RNA, 14 nt, Homo sapiens
cguuucugcucugu

SEQ ID NO: 1410203 - RNA, 16 nt, Homo sapiens
cuaaauugaacugcca

SEQ ID NO: 1410204 - RNA, 16 nt, Homo sapiens
cuaaauuuuaauugca

SEQ ID NO: 1410205 - RNA, 13 nt, Homo sapiens
cuaacauacugca

SEQ ID NO: 1410206 - RNA, 23 nt, Homo sapiens
cuaagggcaggcccaaauuauca

SEQ ID NO: 1410207 - RNA, 18 nt, Homo sapiens
cuaauauaauagaugaca

SEQ ID NO: 1410208 - RNA, 19 nt, Homo sapiens
cuaauauauuccaacguaa

SEQ ID NO: 1410209 - RNA, 20 nt, Homo sapiens
cuaaugauggcccauucuac

SEQ ID NO: 1410210 - RNA, 20 nt, Homo sapiens
cuacaggcacaagucaccau

SEQ ID NO: 1410211 - RNA, 18 nt, Homo sapiens
cuaccaaguuucauacca

SEQ ID NO: 1410212 - RNA, 20 nt, Homo sapiens
cuacucgggaggcugaggca

SEQ ID NO: 1410213 - RNA, 19 nt, Homo sapiens
cuacugccccugcccugag

SEQ ID NO: 1410214 - RNA, 17 nt, Homo sapiens
cuagaagugccaucuca

SEQ ID NO: 1410215 - RNA, 18 nt, Homo sapiens
cuagagugagggccugag

SEQ ID NO: 1410216 - RNA, 19 nt, Homo sapiens
cuaggaauuguguuuauaa

SEQ ID NO: 1410217 - RNA, 13 nt, Homo sapiens
cuaggugaucuca

SEQ ID NO: 1410218 - RNA, 15 nt, Homo sapiens
cuagugcugaagcuu

SEQ ID NO: 1410219 - RNA, 18 nt, Homo sapiens
cuaguggguuagugugaa

SEQ ID NO: 1410220 - RNA, 15 nt, Homo sapiens
cuaguugaggaguag

SEQ ID NO: 1410221 - RNA, 14 nt, Homo sapiens
cuauagcuuuuccc

SEQ ID NO: 1410222 - RNA, 18 nt, Homo sapiens
cuauaggcaaagaaagcu

SEQ ID NO: 1410223 - RNA, 20 nt, Homo sapiens
cuaucaauccaaauucccuc

SEQ ID NO: 1410224 - RNA, 14 nt, Homo sapiens
cuauggaaagagua

SEQ ID NO: 1410225 - RNA, 18 nt, Homo sapiens
cuauggcucaugucugaa

SEQ ID NO: 1410226 - RNA, 22 nt, Homo sapiens
cucaaaagaaaauauagucaca

SEQ ID NO: 1410227 - RNA, 21 nt, Homo sapiens
cucaacauacuguugaugucu

SEQ ID NO: 1410228 - RNA, 19 nt, Homo sapiens
cucacucugcaaccuccac

SEQ ID NO: 1410229 - RNA, 15 nt, Homo sapiens
cucacucugguuguu

SEQ ID NO: 1410230 - RNA, 17 nt, Homo sapiens
cucagcucacucugcaa

SEQ ID NO: 1410231 - RNA, 17 nt, Homo sapiens
cucagcuggacugcauu

SEQ ID NO: 1410232 - RNA, 16 nt, Homo sapiens
cucaggcuggugggag

SEQ ID NO: 1410233 - RNA, 21 nt, Homo sapiens
cucaggucgugcgaaacaccc

SEQ ID NO: 1410234 - RNA, 23 nt, Homo sapiens
cucaguguccagacuuucuguaa

SEQ ID NO: 1410235 - RNA, 15 nt, Homo sapiens
cuccaaaucucaugu

SEQ ID NO: 1410236 - RNA, 21 nt, Homo sapiens
cuccacaaccaccuccagccu

SEQ ID NO: 1410237 - RNA, 22 nt, Homo sapiens
cuccacuguuaccuaaguucuc

SEQ ID NO: 1410238 - RNA, 18 nt, Homo sapiens
cuccagcccccagugucc

SEQ ID NO: 1410239 - RNA, 16 nt, Homo sapiens
cuccaggcaguucucu

SEQ ID NO: 1410240 - RNA, 20 nt, Homo sapiens
cuccaucccuuccccagaga

SEQ ID NO: 1410241 - RNA, 17 nt, Homo sapiens
cuccauccuuucugccu

SEQ ID NO: 1410242 - RNA, 20 nt, Homo sapiens
cucccaccucugugaccuca

SEQ ID NO: 1410243 - RNA, 16 nt, Homo sapiens
cucccagguaccagcu

SEQ ID NO: 1410244 - RNA, 22 nt, Homo sapiens
cucccauggcuuugugcugcug

SEQ ID NO: 1410245 - RNA, 23 nt, Homo sapiens
cucccauggcuuugugcugcuga

SEQ ID NO: 1410246 - RNA, 19 nt, Homo sapiens
cuccccaccccacgcgugc

SEQ ID NO: 1410247 - RNA, 20 nt, Homo sapiens
cuccccugggcagacuugac

SEQ ID NO: 1410248 - RNA, 14 nt, Homo sapiens
cuccgugcuuccuc

SEQ ID NO: 1410249 - RNA, 19 nt, Homo sapiens
cuccucaccucaugcccac

SEQ ID NO: 1410250 - RNA, 22 nt, Homo sapiens
cuccuccugcucugcccaggag

SEQ ID NO: 1410251 - RNA, 15 nt, Homo sapiens
cuccucucagcugaa

SEQ ID NO: 1410252 - RNA, 22 nt, Homo sapiens
cuccucuggacggcaggcucac

SEQ ID NO: 1410253 - RNA, 12 nt, Homo sapiens
cuccugaccuca

SEQ ID NO: 1410254 - RNA, 22 nt, Homo sapiens
cuccuggccaucccuucauuua

SEQ ID NO: 1410255 - RNA, 15 nt, Homo sapiens
cuccugugcugcgau

SEQ ID NO: 1410256 - RNA, 20 nt, Homo sapiens
cuccuugggaggaagcagaa

SEQ ID NO: 1410257 - RNA, 20 nt, Homo sapiens
cucuaagaugaauccaaaug

SEQ ID NO: 1410258 - RNA, 14 nt, Homo sapiens
cucuagaagccaag

SEQ ID NO: 1410259 - RNA, 19 nt, Homo sapiens
cucuagaagugccaucuca

SEQ ID NO: 1410260 - RNA, 18 nt, Homo sapiens
cucucaccaugugacaca

SEQ ID NO: 1410261 - RNA, 18 nt, Homo sapiens
cucucaguggaggccaga

SEQ ID NO: 1410262 - RNA, 16 nt, Homo sapiens
cucuccuuccucagaa

SEQ ID NO: 1410263 - RNA, 19 nt, Homo sapiens
cucucgugaguauauugau

SEQ ID NO: 1410264 - RNA, 22 nt, Homo sapiens
cucucuuagcauccugccuuag

SEQ ID NO: 1410265 - RNA, 19 nt, Homo sapiens
cucugaacuaggugaucuc

SEQ ID NO: 1410266 - RNA, 13 nt, Homo sapiens
cucugccaccaga

SEQ ID NO: 1410267 - RNA, 21 nt, Homo sapiens
cucugccagcccugcaguaau

SEQ ID NO: 1410268 - RNA, 22 nt, Homo sapiens
cucuggaaaacucaggauucuc

SEQ ID NO: 1410269 - RNA, 21 nt, Homo sapiens
cucuggauuccauuuggguca

SEQ ID NO: 1410270 - RNA, 12 nt, Homo sapiens
cucuggggcuca

SEQ ID NO: 1410271 - RNA, 19 nt, Homo sapiens
cucugugcagucacuggag

SEQ ID NO: 1410272 - RNA, 22 nt, Homo sapiens
cugaaaaaugccugcugcugcc

SEQ ID NO: 1410273 - RNA, 13 nt, Homo sapiens
cugaacuguggaa

SEQ ID NO: 1410274 - RNA, 21 nt, Homo sapiens
cugaagcuuauuaaugcuaag

SEQ ID NO: 1410275 - RNA, 17 nt, Homo sapiens
cugaaucagaaauguaa

SEQ ID NO: 1410276 - RNA, 14 nt, Homo sapiens
cugaauuaauguga

SEQ ID NO: 1410277 - RNA, 13 nt, Homo sapiens
cugaccucaggua

SEQ ID NO: 1410278 - RNA, 23 nt, Homo sapiens
cugacuuauguaaucaaagccac

SEQ ID NO: 1410279 - RNA, 15 nt, Homo sapiens
cugacuucuguccac

SEQ ID NO: 1410280 - RNA, 21 nt, Homo sapiens
cugagagccauaaaugaccua

SEQ ID NO: 1410281 - RNA, 20 nt, Homo sapiens
cugagaucaccccacuucca

SEQ ID NO: 1410282 - RNA, 18 nt, Homo sapiens
cugagccccauacagggc

SEQ ID NO: 1410283 - RNA, 21 nt, Homo sapiens
cugagcuucccccccaccaca

SEQ ID NO: 1410284 - RNA, 15 nt, Homo sapiens
cugaggaauaaagcu

SEQ ID NO: 1410285 - RNA, 19 nt, Homo sapiens
cugaggaauaaagcuucuc

SEQ ID NO: 1410286 - RNA, 17 nt, Homo sapiens
cugaggagggcccugag

SEQ ID NO: 1410287 - RNA, 16 nt, Homo sapiens
cugaguggguguugca

SEQ ID NO: 1410288 - RNA, 16 nt, Homo sapiens
cugaguucuggucugu

SEQ ID NO: 1410289 - RNA, 14 nt, Homo sapiens
cugaguuggcauca

SEQ ID NO: 1410290 - RNA, 17 nt, Homo sapiens
cugauaacauuuuccca

SEQ ID NO: 1410291 - RNA, 12 nt, Homo sapiens
cugauugcugag

SEQ ID NO: 1410292 - RNA, 15 nt, Homo sapiens
cugauuguccugcca

SEQ ID NO: 1410293 - RNA, 19 nt, Homo sapiens
cugauuuagccaugugaaa

SEQ ID NO: 1410294 - RNA, 12 nt, Homo sapiens
cugcacucaaga

SEQ ID NO: 1410295 - RNA, 15 nt, Homo sapiens
cugcacuggggccac

SEQ ID NO: 1410296 - RNA, 16 nt, Homo sapiens
cugcacuggggccacc

SEQ ID NO: 1410297 - RNA, 20 nt, Homo sapiens
cugcagccccaucuaccaca

SEQ ID NO: 1410298 - RNA, 14 nt, Homo sapiens
cugcaguaaucucc

SEQ ID NO: 1410299 - RNA, 16 nt, Homo sapiens
cugcaugaccuaucag

SEQ ID NO: 1410300 - RNA, 16 nt, Homo sapiens
cugcauuucacucugg

SEQ ID NO: 1410301 - RNA, 15 nt, Homo sapiens
cugccaacuccaugu

SEQ ID NO: 1410302 - RNA, 18 nt, Homo sapiens
cugccaacuccaugucag

SEQ ID NO: 1410303 - RNA, 15 nt, Homo sapiens
cugccacacuagcuu

SEQ ID NO: 1410304 - RNA, 20 nt, Homo sapiens
cugccagcauaauacuugcu

SEQ ID NO: 1410305 - RNA, 17 nt, Homo sapiens
cugccagcccugcagua

SEQ ID NO: 1410306 - RNA, 22 nt, Homo sapiens
cugccccauuuauccaccucca

SEQ ID NO: 1410307 - RNA, 17 nt, Homo sapiens
cugcccccacacccacu

SEQ ID NO: 1410308 - RNA, 19 nt, Homo sapiens
cugcccccuuuacuccucg

SEQ ID NO: 1410309 - RNA, 23 nt, Homo sapiens
cugccuccggccugcacuccccc

SEQ ID NO: 1410310 - RNA, 24 nt, Homo sapiens
cugccucgggaaccucacucuugc

SEQ ID NO: 1410311 - RNA, 19 nt, Homo sapiens
cugccuuaaaaccaaagag

SEQ ID NO: 1410312 - RNA, 14 nt, Homo sapiens
cugccuuaccgaga

SEQ ID NO: 1410313 - RNA, 15 nt, Homo sapiens
gacuuuucaccuuaa

SEQ ID NO: 1410314 - RNA, 19 nt, Homo sapiens
gagaagggauccuaauccc

SEQ ID NO: 1410315 - RNA, 13 nt, Homo sapiens
gagagccaaacag

SEQ ID NO: 1410316 - RNA, 21 nt, Homo sapiens
gagagccauaaaugaccuaac

SEQ ID NO: 1410317 - RNA, 13 nt, Homo sapiens
gagaggcaggcau

SEQ ID NO: 1410318 - RNA, 17 nt, Homo sapiens
gagaugcggaaagcccu

SEQ ID NO: 1410319 - RNA, 18 nt, Homo sapiens
gagcaagcccugacccaa

SEQ ID NO: 1410320 - RNA, 17 nt, Homo sapiens
gagcagagaacaucugg

SEQ ID NO: 1410321 - RNA, 16 nt, Homo sapiens
gagcccgguacagggc

SEQ ID NO: 1410322 - RNA, 15 nt, Homo sapiens
gagcccgguguucag

SEQ ID NO: 1410323 - RNA, 17 nt, Homo sapiens
gagcccgugucacagau

SEQ ID NO: 1410324 - RNA, 18 nt, Homo sapiens
gagcuagugucaccugca

SEQ ID NO: 1410325 - RNA, 22 nt, Homo sapiens
gagcucagcuuccuaggcauua

SEQ ID NO: 1410326 - RNA, 14 nt, Homo sapiens
gagcugccuaugcc

SEQ ID NO: 1410327 - RNA, 18 nt, Homo sapiens
gagcugcucacuaccucc

SEQ ID NO: 1410328 - RNA, 14 nt, Homo sapiens
gagcuggccucacc

SEQ ID NO: 1410329 - RNA, 21 nt, Homo sapiens
gagcuguggagaggggacccu

SEQ ID NO: 1410330 - RNA, 20 nt, Homo sapiens
gaggaagaagcuuaggcagg

SEQ ID NO: 1410331 - RNA, 17 nt, Homo sapiens
gaggaagcaagugacaa

SEQ ID NO: 1410332 - RNA, 15 nt, Homo sapiens
gaggaagccuucuua

SEQ ID NO: 1410333 - RNA, 18 nt, Homo sapiens
gaggaguuagccaaacaa

SEQ ID NO: 1410334 - RNA, 16 nt, Homo sapiens
gaggcacaagugcccg

SEQ ID NO: 1410335 - RNA, 14 nt, Homo sapiens
gaggcccucaccag

SEQ ID NO: 1410336 - RNA, 23 nt, Homo sapiens
gagggcuuccucuagaagccaag

SEQ ID NO: 1410337 - RNA, 15 nt, Homo sapiens
gaggggagaagccaa

SEQ ID NO: 1410338 - RNA, 16 nt, Homo sapiens
gaggggagaagccaag

SEQ ID NO: 1410339 - RNA, 18 nt, Homo sapiens
aaaaagcaucuaucucau

SEQ ID NO: 1410340 - RNA, 18 nt, Homo sapiens
aaaaagccaccacacacu

SEQ ID NO: 1410341 - RNA, 20 nt, Homo sapiens
aaaaaucuuuucauuaaaga

SEQ ID NO: 1410342 - RNA, 12 nt, Homo sapiens
aaaacaaugaag

SEQ ID NO: 1410343 - RNA, 12 nt, Homo sapiens
aaaaccaaagag

SEQ ID NO: 1410344 - RNA, 22 nt, Homo sapiens
aaaagguacuggugagggcaag

SEQ ID NO: 1410345 - RNA, 13 nt, Homo sapiens
aaaauaagccaca

SEQ ID NO: 1410346 - RNA, 17 nt, Homo sapiens
aaaaucacugugcugau

SEQ ID NO: 1410347 - RNA, 17 nt, Homo sapiens
aaaaugcuaaaacauga

SEQ ID NO: 1410348 - RNA, 15 nt, Homo sapiens
aaaauucuacuguau

SEQ ID NO: 1410349 - RNA, 15 nt, Homo sapiens
aaacaaacacacaca

SEQ ID NO: 1410350 - RNA, 16 nt, Homo sapiens
aaacagggauuuugaa

SEQ ID NO: 1410351 - RNA, 19 nt, Homo sapiens
aaacaguagccccaucaca

SEQ ID NO: 1410352 - RNA, 18 nt, Homo sapiens
aaaccucauuguucugua

SEQ ID NO: 1410353 - RNA, 17 nt, Homo sapiens
aaaccugggcaccuaag

SEQ ID NO: 1410354 - RNA, 21 nt, Homo sapiens
aaaccugggcaccuaagcaau

SEQ ID NO: 1410355 - RNA, 21 nt, Homo sapiens
aaaccuguaagcccagcauuu

SEQ ID NO: 1410356 - RNA, 23 nt, Homo sapiens
aaacuauuuaacuugagcuuuaa

SEQ ID NO: 1410357 - RNA, 19 nt, Homo sapiens
aaacuccacaucugccuua

SEQ ID NO: 1410358 - RNA, 15 nt, Homo sapiens
aaagaaaauauaguc

SEQ ID NO: 1410359 - RNA, 14 nt, Homo sapiens
aaagaaauaaucuc

SEQ ID NO: 1410360 - RNA, 23 nt, Homo sapiens
aaagaccugcuguaauaaaugua

SEQ ID NO: 1410361 - RNA, 15 nt, Homo sapiens
aaagauaagugcagu

SEQ ID NO: 1410362 - RNA, 12 nt, Homo sapiens
aaagcagcccuu

SEQ ID NO: 1410363 - RNA, 17 nt, Homo sapiens
aaagcagcccuuggcca

SEQ ID NO: 1410364 - RNA, 15 nt, Homo sapiens
aaagcuucucucuga

SEQ ID NO: 1410365 - RNA, 20 nt, Homo sapiens
aaagguaaaucagacuauga

SEQ ID NO: 1410366 - RNA, 18 nt, Homo sapiens
aaggaaaaauagcagaga

SEQ ID NO: 1410367 - RNA, 17 nt, Homo sapiens
aaggaauuuucaccucc

SEQ ID NO: 1410368 - RNA, 19 nt, Homo sapiens
aaggaccucagcugcuucu

SEQ ID NO: 1410369 - RNA, 21 nt, Homo sapiens
aaggacuauuuauaacuaaua

SEQ ID NO: 1410370 - RNA, 15 nt, Homo sapiens
aaggacucaacauua

SEQ ID NO: 1410371 - RNA, 15 nt, Homo sapiens
aaggagaaauagcug

SEQ ID NO: 1410372 - RNA, 22 nt, Homo sapiens
aaggagccuugggggugugaug

SEQ ID NO: 1410373 - RNA, 23 nt, Homo sapiens
aaggcaagccccccaucuagcaa

SEQ ID NO: 1410374 - RNA, 20 nt, Homo sapiens
aaggcaucagaaacaucuga

SEQ ID NO: 1410375 - RNA, 15 nt, Homo sapiens
aaggcuccugaccua

SEQ ID NO: 1410376 - RNA, 20 nt, Homo sapiens
aaggcuccugugugagccca

SEQ ID NO: 1410377 - RNA, 23 nt, Homo sapiens
aaggcucgaguuaaaacaaugaa

SEQ ID NO: 1410378 - RNA, 16 nt, Homo sapiens
aagggaggguggcaga

SEQ ID NO: 1410379 - RNA, 12 nt, Homo sapiens
aagggcauuuaa

SEQ ID NO: 1410380 - RNA, 15 nt, Homo sapiens
aaggugucuuuauga

SEQ ID NO: 1410381 - RNA, 18 nt, Homo sapiens
aagugauugcugguuuua

SEQ ID NO: 1410382 - RNA, 13 nt, Homo sapiens
aagugccaucuca

SEQ ID NO: 1410383 - RNA, 16 nt, Homo sapiens
aagugccuuauucuca

SEQ ID NO: 1410384 - RNA, 17 nt, Homo sapiens
aagugccuuauucucac

SEQ ID NO: 1410385 - RNA, 22 nt, Homo sapiens
aagugcugggauuacaggugua

SEQ ID NO: 1410386 - RNA, 22 nt, Homo sapiens
aaguggccuuaagucuuuuuga

SEQ ID NO: 1410387 - RNA, 17 nt, Homo sapiens
aagugggaaaguugcau

SEQ ID NO: 1410388 - RNA, 19 nt, Homo sapiens
aaguguguauccagaagaa

SEQ ID NO: 1410389 - RNA, 13 nt, Homo sapiens
aagugugucuccu

SEQ ID NO: 1410390 - RNA, 17 nt, Homo sapiens
aaguuaaacuuuaucuc

SEQ ID NO: 1410391 - RNA, 22 nt, Homo sapiens
aaguuaguuuuaguucuguaga

SEQ ID NO: 1410392 - RNA, 22 nt, Homo sapiens
aaguugcagaacagacacuuua

SEQ ID NO: 1410393 - RNA, 18 nt, Homo sapiens
aaguuucauaccaaauau

SEQ ID NO: 1410394 - RNA, 19 nt, Homo sapiens
aaguuuccccaccagugaa

SEQ ID NO: 1410395 - RNA, 15 nt, Homo sapiens
aaguuuucagcuuua

SEQ ID NO: 1410396 - RNA, 14 nt, Homo sapiens
aauaaacacugugu

SEQ ID NO: 1410397 - RNA, 15 nt, Homo sapiens
aauaaacagccagga

SEQ ID NO: 1410398 - RNA, 15 nt, Homo sapiens
aauaaagaaccaguc

SEQ ID NO: 1410399 - RNA, 14 nt, Homo sapiens
aauaagcugauguc

SEQ ID NO: 1410400 - RNA, 14 nt, Homo sapiens
aauaaguugcagaa

SEQ ID NO: 1410401 - RNA, 19 nt, Homo sapiens
aauaaucucuauguagaaa

SEQ ID NO: 1410402 - RNA, 13 nt, Homo sapiens
aauacauuugcua

SEQ ID NO: 1410403 - RNA, 23 nt, Homo sapiens
aauagcguucagcagcacucacc

SEQ ID NO: 1410404 - RNA, 13 nt, Homo sapiens
aauaguuccauuu

SEQ ID NO: 1410405 - RNA, 13 nt, Homo sapiens
aauaugagugcca

SEQ ID NO: 1410406 - RNA, 19 nt, Homo sapiens
aauauuacuaauugcccaa

SEQ ID NO: 1410407 - RNA, 11 nt, Homo sapiens
aauauuuccau

SEQ ID NO: 1410408 - RNA, 19 nt, Homo sapiens
aauauuuuuggcauuccuc

SEQ ID NO: 1410409 - RNA, 20 nt, Homo sapiens
aaucaaguucuugucuuuag

SEQ ID NO: 1410410 - RNA, 22 nt, Homo sapiens
aauccaaaugugaaagaugcau

SEQ ID NO: 1410411 - RNA, 22 nt, Homo sapiens
aaucucuauguagaaaucucau

SEQ ID NO: 1410412 - RNA, 18 nt, Homo sapiens
aaucuggcgucuguuuca

SEQ ID NO: 1410413 - RNA, 15 nt, Homo sapiens
aaucuguuaccucug

SEQ ID NO: 1410414 - RNA, 23 nt, Homo sapiens
aaucuguuaccucugacaucaag

SEQ ID NO: 1410415 - RNA, 21 nt, Homo sapiens
aaugaaguguuuuacaaugau

SEQ ID NO: 1410416 - RNA, 14 nt, Homo sapiens
aaugcaaugagcaa

SEQ ID NO: 1410417 - RNA, 21 nt, Homo sapiens
aaugccaaauagaaaaccacu

SEQ ID NO: 1410418 - RNA, 17 nt, Homo sapiens
aaugccacaagacauaa

SEQ ID NO: 1410419 - RNA, 16 nt, Homo sapiens
aaugcuaaaacaugau

SEQ ID NO: 1410420 - RNA, 13 nt, Homo sapiens
aaugcucacuggg

SEQ ID NO: 1410421 - RNA, 15 nt, Homo sapiens
aaugcucacuggggu

SEQ ID NO: 1410422 - RNA, 22 nt, Homo sapiens
aaugcuuauuauuucuaauuca

SEQ ID NO: 1410423 - RNA, 17 nt, Homo sapiens
aauggcauguauuccaa

SEQ ID NO: 1410424 - RNA, 12 nt, Homo sapiens
aauggccuucca

SEQ ID NO: 1410425 - RNA, 20 nt, Homo sapiens
aauguacucuccuuuuaugu

SEQ ID NO: 1410426 - RNA, 22 nt, Homo sapiens
aaugugugucuuuuuguaucuc

SEQ ID NO: 1410427 - RNA, 20 nt, Homo sapiens
aauuagugguacuucagguu

SEQ ID NO: 1410428 - RNA, 17 nt, Homo sapiens
aauuaucaagcuaauaa

SEQ ID NO: 1410429 - RNA, 23 nt, Homo sapiens
aauuaucaccaugacaccugcca

SEQ ID NO: 1410430 - RNA, 16 nt, Homo sapiens
aauuaugugccagauu

SEQ ID NO: 1410431 - RNA, 15 nt, Homo sapiens
aauugcagauuuuga

SEQ ID NO: 1410432 - RNA, 19 nt, Homo sapiens
aauugcccaaaaugucaau

SEQ ID NO: 1410433 - RNA, 17 nt, Homo sapiens
aauugugcuuuguauca

SEQ ID NO: 1410434 - RNA, 23 nt, Homo sapiens
aauugugucugcaggauugauua

SEQ ID NO: 1410435 - RNA, 15 nt, Homo sapiens
aauuugaaacacuuu

SEQ ID NO: 1410436 - RNA, 15 nt, Homo sapiens
aauuugaagcucaga

SEQ ID NO: 1410437 - RNA, 16 nt, Homo sapiens
acaaaaggagccaagc

SEQ ID NO: 1410438 - RNA, 21 nt, Homo sapiens
acaaaggaagaacaucuggau

SEQ ID NO: 1410439 - RNA, 22 nt, Homo sapiens
acaaaggaagaacaucuggauu

SEQ ID NO: 1410440 - RNA, 15 nt, Homo sapiens
acaaaugagugauuc

SEQ ID NO: 1410441 - RNA, 22 nt, Homo sapiens
acaaauuguugacugcugaauu

SEQ ID NO: 1410442 - RNA, 13 nt, Homo sapiens
acaagucaccucc

SEQ ID NO: 1410443 - RNA, 14 nt, Homo sapiens
acaauuaaaucucu

SEQ ID NO: 1410444 - RNA, 18 nt, Homo sapiens
acacaaaggaccucagcu

SEQ ID NO: 1410445 - RNA, 18 nt, Homo sapiens
acacagcccagaaggcca

SEQ ID NO: 1410446 - RNA, 10 nt, Homo sapiens
acacauucac

SEQ ID NO: 1410447 - RNA, 12 nt, Homo sapiens
acaccaguaaua

SEQ ID NO: 1410448 - RNA, 15 nt, Homo sapiens
acacccacuccacac

SEQ ID NO: 1410449 - RNA, 17 nt, Homo sapiens
acaccgugugccauaga

SEQ ID NO: 1410450 - RNA, 15 nt, Homo sapiens
acacucuuguuugau

SEQ ID NO: 1410451 - RNA, 14 nt, Homo sapiens
acagaaaaucacug

SEQ ID NO: 1410452 - RNA, 13 nt, Homo sapiens
acagagacacuuu

SEQ ID NO: 1410453 - RNA, 14 nt, Homo sapiens
acagaguuucacuc

SEQ ID NO: 1410454 - RNA, 13 nt, Homo sapiens
acagcauaccuca

SEQ ID NO: 1410455 - RNA, 13 nt, Homo sapiens
acaggagaccacc

SEQ ID NO: 1410456 - RNA, 18 nt, Homo sapiens
acaggcacaaaaugugac

SEQ ID NO: 1410457 - RNA, 17 nt, Homo sapiens
acaggcccuuuccucag

SEQ ID NO: 1410458 - RNA, 20 nt, Homo sapiens
acaggcccuuuccucaggca

SEQ ID NO: 1410459 - RNA, 20 nt, Homo sapiens
acagggauuuugaauaugcc

SEQ ID NO: 1410460 - RNA, 14 nt, Homo sapiens
acagguuaugcuuu

SEQ ID NO: 1410461 - RNA, 18 nt, Homo sapiens
acaguccgcccuacuucc

SEQ ID NO: 1410462 - RNA, 18 nt, Homo sapiens
acaguggcaccugggaag

SEQ ID NO: 1410463 - RNA, 17 nt, Homo sapiens
acauaauuaagcuguau

SEQ ID NO: 1410464 - RNA, 19 nt, Homo sapiens
acauaccaagugguuucca

SEQ ID NO: 1410465 - RNA, 18 nt, Homo sapiens
acauacccaaaguagcca

SEQ ID NO: 1410466 - RNA, 17 nt, Homo sapiens
acaucuacccagauaaa

SEQ ID NO: 1410467 - RNA, 19 nt, Homo sapiens
acaugaugauuaagugcac

SEQ ID NO: 1410468 - RNA, 12 nt, Homo sapiens
acauggagcucu

SEQ ID NO: 1410469 - RNA, 19 nt, Homo sapiens
acauuacaaggucagagag

SEQ ID NO: 1410470 - RNA, 13 nt, Homo sapiens
acauuccuaucaa

SEQ ID NO: 1410471 - RNA, 22 nt, Homo sapiens
accaaaauuuugucccaucucu

SEQ ID NO: 1410472 - RNA, 19 nt, Homo sapiens
accaaauauuugaaaggau

SEQ ID NO: 1410473 - RNA, 14 nt, Homo sapiens
accaacacacagga

SEQ ID NO: 1410474 - RNA, 22 nt, Homo sapiens
accaaccuggccaacaugguga

SEQ ID NO: 1410475 - RNA, 14 nt, Homo sapiens
accaagcuauucaa

SEQ ID NO: 1410476 - RNA, 14 nt, Homo sapiens
accaaugccuuaau

SEQ ID NO: 1410477 - RNA, 20 nt, Homo sapiens
accacaggcccuuuccucag

SEQ ID NO: 1410478 - RNA, 21 nt, Homo sapiens
accacccccgagcuugccuca

SEQ ID NO: 1410479 - RNA, 20 nt, Homo sapiens
accacuucccgccuccauga

SEQ ID NO: 1410480 - RNA, 22 nt, Homo sapiens
accagaaggggauggacuucau

SEQ ID NO: 1410481 - RNA, 21 nt, Homo sapiens
accagagaccguccucacccc

SEQ ID NO: 1410482 - RNA, 13 nt, Homo sapiens
accagcaacuaau

SEQ ID NO: 1410483 - RNA, 12 nt, Homo sapiens
accagugaauga

SEQ ID NO: 1410484 - RNA, 18 nt, Homo sapiens
accaugugacacacuggc

SEQ ID NO: 1410485 - RNA, 14 nt, Homo sapiens
accauucucaggug

SEQ ID NO: 1410486 - RNA, 21 nt, Homo sapiens
accauuuguaaaacauuccaa

SEQ ID NO: 1410487 - RNA, 22 nt, Homo sapiens
acccaauaaaacugauguuacu

SEQ ID NO: 1410488 - RNA, 13 nt, Homo sapiens
acccagagcugcc

SEQ ID NO: 1410489 - RNA, 16 nt, Homo sapiens
accccaacccaauaaa

SEQ ID NO: 1410490 - RNA, 16 nt, Homo sapiens
accccaucuggcugug

SEQ ID NO: 1410491 - RNA, 13 nt, Homo sapiens
acccccaccucaa

SEQ ID NO: 1410492 - RNA, 22 nt, Homo sapiens
acccccacuaaaugaucugauu

SEQ ID NO: 1410493 - RNA, 20 nt, Homo sapiens
accccggggacccugugaca

SEQ ID NO: 1410494 - RNA, 15 nt, Homo sapiens
accccuaacauacug

SEQ ID NO: 1410495 - RNA, 17 nt, Homo sapiens
accccuaacauacugca

SEQ ID NO: 1410496 - RNA, 13 nt, Homo sapiens
accccuccucacu

SEQ ID NO: 1410497 - RNA, 23 nt, Homo sapiens
accccugcccccagccccggggu

SEQ ID NO: 1410498 - RNA, 11 nt, Homo sapiens
agccuucuuag

SEQ ID NO: 1410499 - RNA, 15 nt, Homo sapiens
agcgagcacccucau

SEQ ID NO: 1410500 - RNA, 17 nt, Homo sapiens
agcuaauaaaauaucau

SEQ ID NO: 1410501 - RNA, 13 nt, Homo sapiens
agcuaaugucuuc

SEQ ID NO: 1410502 - RNA, 17 nt, Homo sapiens
agcuacuuaugguugga

SEQ ID NO: 1410503 - RNA, 19 nt, Homo sapiens
agcuaggaauuguguuuau

SEQ ID NO: 1410504 - RNA, 16 nt, Homo sapiens
agcuauucaaguauuc

SEQ ID NO: 1410505 - RNA, 17 nt, Homo sapiens
agcucaucugccaaaau

SEQ ID NO: 1410506 - RNA, 20 nt, Homo sapiens
agcugagaucacaccacugc

SEQ ID NO: 1410507 - RNA, 15 nt, Homo sapiens
agcugauaacauuuu

SEQ ID NO: 1410508 - RNA, 21 nt, Homo sapiens
agcugaugacucaagauuccc

SEQ ID NO: 1410509 - RNA, 14 nt, Homo sapiens
agcuggcagugugc

SEQ ID NO: 1410510 - RNA, 21 nt, Homo sapiens
agcugggcuagaggcugagca

SEQ ID NO: 1410511 - RNA, 19 nt, Homo sapiens
agcuggggcugagggaugg

SEQ ID NO: 1410512 - RNA, 20 nt, Homo sapiens
agcugguaggcauuccagcu

SEQ ID NO: 1410513 - RNA, 14 nt, Homo sapiens
agcuguauauauua

SEQ ID NO: 1410514 - RNA, 21 nt, Homo sapiens
agcuguguaccaaucgucuca

SEQ ID NO: 1410515 - RNA, 17 nt, Homo sapiens
agcuucucucugagcug

SEQ ID NO: 1410516 - RNA, 13 nt, Homo sapiens
agcuuuaaauuca

SEQ ID NO: 1410517 - RNA, 17 nt, Homo sapiens
agcuuugaaaaaacacc

SEQ ID NO: 1410518 - RNA, 20 nt, Homo sapiens
agcuuugaaaaaacaccaug

SEQ ID NO: 1410519 - RNA, 14 nt, Homo sapiens
aggaaacuacuuca

SEQ ID NO: 1410520 - RNA, 14 nt, Homo sapiens
aggaagaacaucug

SEQ ID NO: 1410521 - RNA, 14 nt, Homo sapiens
aggaauuguguuua

SEQ ID NO: 1410522 - RNA, 16 nt, Homo sapiens
aggaauuguguuuaua

SEQ ID NO: 1410523 - RNA, 22 nt, Homo sapiens
aggaauuugaagcucagaaagg

SEQ ID NO: 1410524 - RNA, 16 nt, Homo sapiens
aggacagucagcauuu

SEQ ID NO: 1410525 - RNA, 14 nt, Homo sapiens
aggagcuacacucc

SEQ ID NO: 1410526 - RNA, 12 nt, Homo sapiens
aggagggagcau

SEQ ID NO: 1410527 - RNA, 19 nt, Homo sapiens
aggagggcuuugugucugg

SEQ ID NO: 1410528 - RNA, 21 nt, Homo sapiens
aggagguggcguccagcaguc

SEQ ID NO: 1410529 - RNA, 14 nt, Homo sapiens
aggaguucugcuca

SEQ ID NO: 1410530 - RNA, 15 nt, Homo sapiens
aggaguucugcucau

SEQ ID NO: 1410531 - RNA, 23 nt, Homo sapiens
aggaugacgguauuaugcuucuu

SEQ ID NO: 1410532 - RNA, 14 nt, Homo sapiens
aggaugguauugaa

SEQ ID NO: 1410533 - RNA, 17 nt, Homo sapiens
aggcaaagaaagcucua

SEQ ID NO: 1410534 - RNA, 19 nt, Homo sapiens
aggcacaagucaccaugcc

SEQ ID NO: 1410535 - RNA, 15 nt, Homo sapiens
aggcacacacugugc

SEQ ID NO: 1410536 - RNA, 20 nt, Homo sapiens
aggcacuagccuuuggcucu

SEQ ID NO: 1410537 - RNA, 22 nt, Homo sapiens
aggcagagcccgguacagggcc

SEQ ID NO: 1410538 - RNA, 16 nt, Homo sapiens
aggcauagaggcuucu

SEQ ID NO: 1410539 - RNA, 19 nt, Homo sapiens
aggcgcagagacagugugu

SEQ ID NO: 1410540 - RNA, 18 nt, Homo sapiens
aggcggguggaucacuug

SEQ ID NO: 1410541 - RNA, 17 nt, Homo sapiens
aggcuaauauauuccaa

SEQ ID NO: 1410542 - RNA, 15 nt, Homo sapiens
aggcucagcccugag

SEQ ID NO: 1410543 - RNA, 19 nt, Homo sapiens
aggcuggagugcaguggcu

SEQ ID NO: 1410544 - RNA, 14 nt, Homo sapiens
aggcuggucuugaa

SEQ ID NO: 1410545 - RNA, 18 nt, Homo sapiens
aggcuuaacgugucugag

SEQ ID NO: 1410546 - RNA, 21 nt, Homo sapiens
agggaacauccugcugcauga

SEQ ID NO: 1410547 - RNA, 16 nt, Homo sapiens
agggaaugagcuucca

SEQ ID NO: 1410548 - RNA, 21 nt, Homo sapiens
agggacuugugucacaucucu

SEQ ID NO: 1410549 - RNA, 16 nt, Homo sapiens
agggaggaagaagcuu

SEQ ID NO: 1410550 - RNA, 14 nt, Homo sapiens
agggaggucacugg

SEQ ID NO: 1410551 - RNA, 19 nt, Homo sapiens
agggauauuuaacuggagc

SEQ ID NO: 1410552 - RNA, 22 nt, Homo sapiens
agggauuuugaauaugccaaac

SEQ ID NO: 1410553 - RNA, 20 nt, Homo sapiens
agggcaucgagccaccaagc

SEQ ID NO: 1410554 - RNA, 19 nt, Homo sapiens
agggcaugggagugaucuc

SEQ ID NO: 1410555 - RNA, 16 nt, Homo sapiens
agggccaggacugagc

SEQ ID NO: 1410556 - RNA, 14 nt, Homo sapiens
agggcccucugggg

SEQ ID NO: 1410557 - RNA, 22 nt, Homo sapiens
agggcucucuuuccuucuugcc

SEQ ID NO: 1410558 - RNA, 16 nt, Homo sapiens
aggggauggacuucau

SEQ ID NO: 1410559 - RNA, 12 nt, Homo sapiens
agggugcucagu

SEQ ID NO: 1410560 - RNA, 13 nt, Homo sapiens
aggguuucaccau

SEQ ID NO: 1410561 - RNA, 19 nt, Homo sapiens
agguccaccauauuugaau

SEQ ID NO: 1410562 - RNA, 23 nt, Homo sapiens
agguccugcuugaacugcugcca

SEQ ID NO: 1410563 - RNA, 17 nt, Homo sapiens
aggucuggcugcuugcc

SEQ ID NO: 1410564 - RNA, 19 nt, Homo sapiens
aggugaguuugagcugccu

SEQ ID NO: 1410565 - RNA, 11 nt, Homo sapiens
aggugaucuca

SEQ ID NO: 1410566 - RNA, 20 nt, Homo sapiens
aggugcuggaggugggagca

SEQ ID NO: 1410567 - RNA, 13 nt, Homo sapiens
agguggugauaug

SEQ ID NO: 1410568 - RNA, 19 nt, Homo sapiens
agguucaagcgauucucau

SEQ ID NO: 1410569 - RNA, 22 nt, Homo sapiens
agguugaagcagaauugcuuga

SEQ ID NO: 1410570 - RNA, 14 nt, Homo sapiens
agguugaagccaag

SEQ ID NO: 1410571 - RNA, 14 nt, Homo sapiens
aguaaauucucucc

SEQ ID NO: 1410572 - RNA, 15 nt, Homo sapiens
aguaacuuguuuaca

SEQ ID NO: 1410573 - RNA, 14 nt, Homo sapiens
aguaagaguuuaca

SEQ ID NO: 1410574 - RNA, 21 nt, Homo sapiens
aguaaguaguaaugauucuca

SEQ ID NO: 1410575 - RNA, 16 nt, Homo sapiens
aguaauccaagcaaau

SEQ ID NO: 1410576 - RNA, 23 nt, Homo sapiens
aguaauuuuaguuauacuccuca

SEQ ID NO: 1410577 - RNA, 22 nt, Homo sapiens
aguaccaaaugcuuuaaaaacu

SEQ ID NO: 1410578 - RNA, 19 nt, Homo sapiens
aguaccgccucugucccua

SEQ ID NO: 1410579 - RNA, 14 nt, Homo sapiens
aguacugcuuuacu

SEQ ID NO: 1410580 - RNA, 12 nt, Homo sapiens
aguagacagggu

SEQ ID NO: 1410581 - RNA, 18 nt, Homo sapiens
aguaguaaugauucucaa

SEQ ID NO: 1410582 - RNA, 12 nt, Homo sapiens
aguaugccucag

SEQ ID NO: 1410583 - RNA, 19 nt, Homo sapiens
aguauucauguuguuauua

SEQ ID NO: 1410584 - RNA, 23 nt, Homo sapiens
agucaaaguucaaaaauauucau

SEQ ID NO: 1410585 - RNA, 19 nt, Homo sapiens
agucacuuguuucuacuca

SEQ ID NO: 1410586 - RNA, 20 nt, Homo sapiens
agucacuuguuucuacucaa

SEQ ID NO: 1410587 - RNA, 23 nt, Homo sapiens
aguccugaguggguguugcacag

SEQ ID NO: 1410588 - RNA, 22 nt, Homo sapiens
agucgcucucaugaagcccuua

SEQ ID NO: 1410589 - RNA, 22 nt, Homo sapiens
agugagcauccuuuugcucugu

SEQ ID NO: 1410590 - RNA, 12 nt, Homo sapiens
agugcaguggcu

SEQ ID NO: 1410591 - RNA, 16 nt, Homo sapiens
agugccuuauucucac

SEQ ID NO: 1410592 - RNA, 12 nt, Homo sapiens
aguggggugcug

SEQ ID NO: 1410593 - RNA, 17 nt, Homo sapiens
aguggguaaaucaggga

SEQ ID NO: 1410594 - RNA, 17 nt, Homo sapiens
aguggguguugcacaga

SEQ ID NO: 1410595 - RNA, 12 nt, Homo sapiens
agugguguuguc

SEQ ID NO: 1410596 - RNA, 12 nt, Homo sapiens
agugguuucccu

SEQ ID NO: 1410597 - RNA, 15 nt, Homo sapiens
aguguaauuagcuuu

SEQ ID NO: 1410598 - RNA, 20 nt, Homo sapiens
aguguaccauucucaggugg

SEQ ID NO: 1410599 - RNA, 21 nt, Homo sapiens
aguguaccauucucagguggu

SEQ ID NO: 1410600 - RNA, 23 nt, Homo sapiens
agugucccauccucucacacuca

SEQ ID NO: 1410601 - RNA, 22 nt, Homo sapiens
agugugacauucaguguuagag

SEQ ID NO: 1410602 - RNA, 20 nt, Homo sapiens
aguguugggaacuaauuuca

SEQ ID NO: 1410603 - RNA, 17 nt, Homo sapiens
aguuaaacuuuaucuca

SEQ ID NO: 1410604 - RNA, 21 nt, Homo sapiens
aguuauaaacuuauaaucaau

SEQ ID NO: 1410605 - RNA, 14 nt, Homo sapiens
aguucccaaaggga

SEQ ID NO: 1410606 - RNA, 16 nt, Homo sapiens
aguuccgaauuccugc

SEQ ID NO: 1410607 - RNA, 13 nt, Homo sapiens
aguucuaugcaga

SEQ ID NO: 1410608 - RNA, 21 nt, Homo sapiens
aguucugcucauucuaaugau

SEQ ID NO: 1410609 - RNA, 22 nt, Homo sapiens
aguucuuuucaugcaaguauaa

SEQ ID NO: 1410610 - RNA, 22 nt, Homo sapiens
aguugaagccgucucaugcaga

SEQ ID NO: 1410611 - RNA, 15 nt, Homo sapiens
aguugacaaaugcca

SEQ ID NO: 1410612 - RNA, 14 nt, Homo sapiens
aguuucauaccaaa

SEQ ID NO: 1410613 - RNA, 17 nt, Homo sapiens
aguuucauaccaaauau

SEQ ID NO: 1410614 - RNA, 12 nt, Homo sapiens
aguuucugugac

SEQ ID NO: 1410615 - RNA, 15 nt, Homo sapiens
aguuucugugaccug

SEQ ID NO: 1410616 - RNA, 14 nt, Homo sapiens
aguuuuaguucugu

SEQ ID NO: 1410617 - RNA, 15 nt, Homo sapiens
aguuuucagcuuuaa

SEQ ID NO: 1410618 - RNA, 16 nt, Homo sapiens
auaaaagguuguguac

SEQ ID NO: 1410619 - RNA, 22 nt, Homo sapiens
auaaaagguuguguacaacucc

SEQ ID NO: 1410620 - RNA, 13 nt, Homo sapiens
auaaacacugugu

SEQ ID NO: 1410621 - RNA, 12 nt, Homo sapiens
auaaacaucaca

SEQ ID NO: 1410622 - RNA, 18 nt, Homo sapiens
auaaacuuauaaucaaua

SEQ ID NO: 1410623 - RNA, 10 nt, Homo sapiens
auaacccaua

SEQ ID NO: 1410624 - RNA, 22 nt, Homo sapiens
auaaggagugccugaauagcuu

SEQ ID NO: 1410625 - RNA, 15 nt, Homo sapiens
auaaguuguauaagu

SEQ ID NO: 1410626 - RNA, 19 nt, Homo sapiens
auaauagcguucagcagca

SEQ ID NO: 1410627 - RNA, 11 nt, Homo sapiens
auaauuccaca

SEQ ID NO: 1410628 - RNA, 22 nt, Homo sapiens
auacaaaggaagaacaucugga

SEQ ID NO: 1410629 - RNA, 21 nt, Homo sapiens
auacaauguuacaaauaugca

SEQ ID NO: 1410630 - RNA, 18 nt, Homo sapiens
auaccucaaaaggcccua

SEQ ID NO: 1410631 - RNA, 18 nt, Homo sapiens
cugggcucgucuuugcag

SEQ ID NO: 1410632 - RNA, 19 nt, Homo sapiens
cugggggagaggugaccua

SEQ ID NO: 1410633 - RNA, 17 nt, Homo sapiens
cugguaggcauuccagc

SEQ ID NO: 1410634 - RNA, 18 nt, Homo sapiens
cuggucuugaacuccuga

SEQ ID NO: 1410635 - RNA, 16 nt, Homo sapiens
cuguaagcaacacuuu

SEQ ID NO: 1410636 - RNA, 19 nt, Homo sapiens
cuguaagcccagcauuuga

SEQ ID NO: 1410637 - RNA, 20 nt, Homo sapiens
cuguaauaaacagccaggag

SEQ ID NO: 1410638 - RNA, 20 nt, Homo sapiens
cuguaaucccagcacuuugg

SEQ ID NO: 1410639 - RNA, 20 nt, Homo sapiens
cuguaguguaccauucucag

SEQ ID NO: 1410640 - RNA, 14 nt, Homo sapiens
cugucacacaggga

SEQ ID NO: 1410641 - RNA, 18 nt, Homo sapiens
cuguccuugagaaguuga

SEQ ID NO: 1410642 - RNA, 21 nt, Homo sapiens
cugugaaacuaaucauaagcu

SEQ ID NO: 1410643 - RNA, 15 nt, Homo sapiens
cugugaccucaggca

SEQ ID NO: 1410644 - RNA, 17 nt, Homo sapiens
cugugcauaucacuuga

SEQ ID NO: 1410645 - RNA, 14 nt, Homo sapiens
cugugucaauguga

SEQ ID NO: 1410646 - RNA, 17 nt, Homo sapiens
cuguugcugccacucua

SEQ ID NO: 1410647 - RNA, 12 nt, Homo sapiens
cuguugcugucc

SEQ ID NO: 1410648 - RNA, 13 nt, Homo sapiens
cuuaaacugccaa

SEQ ID NO: 1410649 - RNA, 12 nt, Homo sapiens
cuuaacaaucaa

SEQ ID NO: 1410650 - RNA, 15 nt, Homo sapiens
cuuaacaaucaaauc

SEQ ID NO: 1410651 - RNA, 13 nt, Homo sapiens
cuuaacgugucug

SEQ ID NO: 1410652 - RNA, 18 nt, Homo sapiens
cuuacagauccugcaguc

SEQ ID NO: 1410653 - RNA, 21 nt, Homo sapiens
cuuacagauccugcagucaau

SEQ ID NO: 1410654 - RNA, 11 nt, Homo sapiens
cuuacaguggg

SEQ ID NO: 1410655 - RNA, 17 nt, Homo sapiens
cuuacuaauguauuaau

SEQ ID NO: 1410656 - RNA, 23 nt, Homo sapiens
cuuagagccaggcacacacugug

SEQ ID NO: 1410657 - RNA, 18 nt, Homo sapiens
cuuaggcagggcucucuu

SEQ ID NO: 1410658 - RNA, 19 nt, Homo sapiens
cuuaugguuuuaaugcaau

SEQ ID NO: 1410659 - RNA, 17 nt, Homo sapiens
cuuauguauuuucuucc

SEQ ID NO: 1410660 - RNA, 15 nt, Homo sapiens
cuuauucucacagca

SEQ ID NO: 1410661 - RNA, 15 nt, Homo sapiens
cuucccaugcuggug

SEQ ID NO: 1410662 - RNA, 21 nt, Homo sapiens
cuucccccgcuuuggacagaa

SEQ ID NO: 1410663 - RNA, 22 nt, Homo sapiens
cuuccgguuggaggcucucaug

SEQ ID NO: 1410664 - RNA, 23 nt, Homo sapiens
cuuccgguuggaggcucucaugu

SEQ ID NO: 1410665 - RNA, 20 nt, Homo sapiens
cuuccucaggggcacagacc

SEQ ID NO: 1410666 - RNA, 17 nt, Homo sapiens
cuuccugccuacugccc

SEQ ID NO: 1410667 - RNA, 15 nt, Homo sapiens
cuucugcaauauuau

SEQ ID NO: 1410668 - RNA, 23 nt, Homo sapiens
cuucugccagcauaauacuugcu

SEQ ID NO: 1410669 - RNA, 19 nt, Homo sapiens
cuucugccguugcugccag

SEQ ID NO: 1410670 - RNA, 16 nt, Homo sapiens
cuugaacugcugccaa

SEQ ID NO: 1410671 - RNA, 16 nt, Homo sapiens
cuugaagaagaaggag

SEQ ID NO: 1410672 - RNA, 11 nt, Homo sapiens
cuugaagccaa

SEQ ID NO: 1410673 - RNA, 22 nt, Homo sapiens
cuugaugucccgaccguugcca

SEQ ID NO: 1410674 - RNA, 14 nt, Homo sapiens
cuuggccaagcagg

SEQ ID NO: 1410675 - RNA, 16 nt, Homo sapiens
cuuggcccgcacagag

SEQ ID NO: 1410676 - RNA, 15 nt, Homo sapiens
cuugggggugugaug

SEQ ID NO: 1410677 - RNA, 12 nt, Homo sapiens
cuuggugccaca

SEQ ID NO: 1410678 - RNA, 16 nt, Homo sapiens
cuuggugccacagagg

SEQ ID NO: 1410679 - RNA, 23 nt, Homo sapiens
cuugguucuacguggaugauuuc

SEQ ID NO: 1410680 - RNA, 14 nt, Homo sapiens
cuugugacagauua

SEQ ID NO: 1410681 - RNA, 19 nt, Homo sapiens
cuugugacuagugcugaag

SEQ ID NO: 1410682 - RNA, 12 nt, Homo sapiens
cuugugucacau

SEQ ID NO: 1410683 - RNA, 15 nt, Homo sapiens
cuuuaaaaagcaugu

SEQ ID NO: 1410684 - RNA, 17 nt, Homo sapiens
cuuuaaaagcuucugca

SEQ ID NO: 1410685 - RNA, 19 nt, Homo sapiens
cuuuaacugacuucugucc

SEQ ID NO: 1410686 - RNA, 18 nt, Homo sapiens
cuuuacucuuucaugcca

SEQ ID NO: 1410687 - RNA, 18 nt, Homo sapiens
cuuucccacgucacuuga

SEQ ID NO: 1410688 - RNA, 10 nt, Homo sapiens
cuuuccucag

SEQ ID NO: 1410689 - RNA, 13 nt, Homo sapiens
cuuuccucaggca

SEQ ID NO: 1410690 - RNA, 17 nt, Homo sapiens
cuuugccccacugggag

SEQ ID NO: 1410691 - RNA, 23 nt, Homo sapiens
cuuugcucuuggaauuacugaaa

SEQ ID NO: 1410692 - RNA, 14 nt, Homo sapiens
cuuugcuguucgca

SEQ ID NO: 1410693 - RNA, 18 nt, Homo sapiens
cuuuggggauagucugga

SEQ ID NO: 1410694 - RNA, 19 nt, Homo sapiens
cuuugugcaggguccuccg

SEQ ID NO: 1410695 - RNA, 13 nt, Homo sapiens
cuuugugccucaa

SEQ ID NO: 1410696 - RNA, 17 nt, Homo sapiens
cuuuuagcuacaccccu

SEQ ID NO: 1410697 - RNA, 14 nt, Homo sapiens
cuuuuauagaggcu

SEQ ID NO: 1410698 - RNA, 17 nt, Homo sapiens
cuuuuaugauacuugaa

SEQ ID NO: 1410699 - RNA, 18 nt, Homo sapiens
cuuuuaugauacuugaaa

SEQ ID NO: 1410700 - RNA, 18 nt, Homo sapiens
cuuuucauuaaagaaugu

SEQ ID NO: 1410701 - RNA, 19 nt, Homo sapiens
cuuuugugccauguucaaa

SEQ ID NO: 1410702 - RNA, 17 nt, Homo sapiens
cuuuuuaucuucuuagc

SEQ ID NO: 1410703 - RNA, 21 nt, Homo sapiens
cuuuuuaucuucuuagcucau

SEQ ID NO: 1410704 - RNA, 14 nt, Homo sapiens
gaaaaaaaaacugg

SEQ ID NO: 1410705 - RNA, 17 nt, Homo sapiens
gaaaaaaaaacuggggc

SEQ ID NO: 1410706 - RNA, 12 nt, Homo sapiens
gagacacuuuac

SEQ ID NO: 1410707 - RNA, 15 nt, Homo sapiens
gagaccguccucacc

SEQ ID NO: 1410708 - RNA, 23 nt, Homo sapiens
gagacugucucaaaaaaacaaaa

SEQ ID NO: 1410709 - RNA, 14 nt, Homo sapiens
gagagaaagccagg

SEQ ID NO: 1410710 - RNA, 11 nt, Homo sapiens
gagagcuguuc

SEQ ID NO: 1410711 - RNA, 18 nt, Homo sapiens
gagagggaggucacugga

SEQ ID NO: 1410712 - RNA, 21 nt, Homo sapiens
gagaugaccuugacauaccaa

SEQ ID NO: 1410713 - RNA, 14 nt, Homo sapiens
gagaugcuggagaa

SEQ ID NO: 1410714 - RNA, 18 nt, Homo sapiens
gagccaggcacacacugu

SEQ ID NO: 1410715 - RNA, 19 nt, Homo sapiens
gagccaggcacacacugug

SEQ ID NO: 1410716 - RNA, 16 nt, Homo sapiens
gagccccauacagggc

SEQ ID NO: 1410717 - RNA, 17 nt, Homo sapiens
gagccccgcagaccucc

SEQ ID NO: 1410718 - RNA, 15 nt, Homo sapiens
gagcgagacugucuc

SEQ ID NO: 1410719 - RNA, 21 nt, Homo sapiens
gagcuacacucccacuucuuc

SEQ ID NO: 1410720 - RNA, 14 nt, Homo sapiens
gagcugcuggccau

SEQ ID NO: 1410721 - RNA, 20 nt, Homo sapiens
gagcuggcaccauucagacu

SEQ ID NO: 1410722 - RNA, 19 nt, Homo sapiens
gagcuggggcugagggaug

SEQ ID NO: 1410723 - RNA, 13 nt, Homo sapiens
gagcuucaguaua

SEQ ID NO: 1410724 - RNA, 21 nt, Homo sapiens
gaggcaaaaggucuauggcuc

SEQ ID NO: 1410725 - RNA, 19 nt, Homo sapiens
gaggcggguggaucacuug

SEQ ID NO: 1410726 - RNA, 16 nt, Homo sapiens
gaggcucucaugucuc

SEQ ID NO: 1410727 - RNA, 15 nt, Homo sapiens
gagggaacauccugc

SEQ ID NO: 1410728 - RNA, 15 nt, Homo sapiens
gaggugggaggugga

SEQ ID NO: 1410729 - RNA, 21 nt, Homo sapiens
gaguacaauggcgugaucuca

SEQ ID NO: 1410730 - RNA, 14 nt, Homo sapiens
gaguagcugggauu

SEQ ID NO: 1410731 - RNA, 15 nt, Homo sapiens
gagucaaaguucaaa

SEQ ID NO: 1410732 - RNA, 13 nt, Homo sapiens
gaguccauuugaa

SEQ ID NO: 1410733 - RNA, 23 nt, Homo sapiens
gagucgcucucaugaagcccuua

SEQ ID NO: 1410734 - RNA, 18 nt, Homo sapiens
gagucuuucuccauuaua

SEQ ID NO: 1410735 - RNA, 13 nt, Homo sapiens
gagugaguucuca

SEQ ID NO: 1410736 - RNA, 14 nt, Homo sapiens
gagugguugcuaua

SEQ ID NO: 1410737 - RNA, 16 nt, Homo sapiens
gaguguggauuguaua

SEQ ID NO: 1410738 - RNA, 13 nt, Homo sapiens
gaguugggggcca

SEQ ID NO: 1410739 - RNA, 13 nt, Homo sapiens
gaguugggggcua

SEQ ID NO: 1410740 - RNA, 20 nt, Homo sapiens
gaguuucauguuaugccugu

SEQ ID NO: 1410741 - RNA, 15 nt, Homo sapiens
gauaaagguucaugc

SEQ ID NO: 1410742 - RNA, 17 nt, Homo sapiens
gauaaagguucaugcaa

SEQ ID NO: 1410743 - RNA, 18 nt, Homo sapiens
gauauauuaaaccuucag

SEQ ID NO: 1410744 - RNA, 22 nt, Homo sapiens
gauauucccccugagcugccac

SEQ ID NO: 1410745 - RNA, 18 nt, Homo sapiens
gauccuaaucccuuccuc

SEQ ID NO: 1410746 - RNA, 22 nt, Homo sapiens
gauccuuuugugccauguucaa

SEQ ID NO: 1410747 - RNA, 19 nt, Homo sapiens
gaucuaauaaacuuccaaa

SEQ ID NO: 1410748 - RNA, 13 nt, Homo sapiens
gaucucaguucuc

SEQ ID NO: 1410749 - RNA, 14 nt, Homo sapiens
gaucucaguucucu

SEQ ID NO: 1410750 - RNA, 10 nt, Homo sapiens
gaucugcuca

SEQ ID NO: 1410751 - RNA, 16 nt, Homo sapiens
gaucuuuuaaguuucc

SEQ ID NO: 1410752 - RNA, 19 nt, Homo sapiens
gaugaagaggguagagugg

SEQ ID NO: 1410753 - RNA, 19 nt, Homo sapiens
gaugacaguggcaacugaa

SEQ ID NO: 1410754 - RNA, 16 nt, Homo sapiens
gaugaugacuauggaa

SEQ ID NO: 1410755 - RNA, 12 nt, Homo sapiens
gaugcaccgugg

SEQ ID NO: 1410756 - RNA, 17 nt, Homo sapiens
gaugcggaaagcccuga

SEQ ID NO: 1410757 - RNA, 23 nt, Homo sapiens
gauggagacaguaacacuggcga

SEQ ID NO: 1410758 - RNA, 23 nt, Homo sapiens
gauggcccauucuacuugcucug

SEQ ID NO: 1410759 - RNA, 18 nt, Homo sapiens
gauguacacauuuuguaa

SEQ ID NO: 1410760 - RNA, 23 nt, Homo sapiens
gauguauauuugaacuccucuca

SEQ ID NO: 1410761 - RNA, 17 nt, Homo sapiens
gauguggggaagagcua

SEQ ID NO: 1410762 - RNA, 19 nt, Homo sapiens
gauuaagugcacaccgugu

SEQ ID NO: 1410763 - RNA, 23 nt, Homo sapiens
gauuacagguguaagccaucaca

SEQ ID NO: 1410764 - RNA, 17 nt, Homo sapiens
gauuagaaauguaacau

SEQ ID NO: 1410765 - RNA, 21 nt, Homo sapiens
gauucagauauaaauguuuaa

SEQ ID NO: 1410766 - RNA, 16 nt, Homo sapiens
gauuccauacagugac

SEQ ID NO: 1410767 - RNA, 19 nt, Homo sapiens
gauugaaauuaaacccuga

SEQ ID NO: 1410768 - RNA, 18 nt, Homo sapiens
gauugagcgucugcagaa

SEQ ID NO: 1410769 - RNA, 14 nt, Homo sapiens
gcaaaaagcaacuu

SEQ ID NO: 1410770 - RNA, 23 nt, Homo sapiens
gcaaccaguuggcuaggggagca

SEQ ID NO: 1410771 - RNA, 23 nt, Homo sapiens
gcaagaguaggguagaccaaauc

SEQ ID NO: 1410772 - RNA, 19 nt, Homo sapiens
gcaaguugacaaaugccaa

SEQ ID NO: 1410773 - RNA, 16 nt, Homo sapiens
gcaauaaaggcaccuc

SEQ ID NO: 1410774 - RNA, 19 nt, Homo sapiens
gcaauguggauaugaccaa

SEQ ID NO: 1410775 - RNA, 22 nt, Homo sapiens
gcacaagucaccaugccuggcu

SEQ ID NO: 1410776 - RNA, 13 nt, Homo sapiens
gcacacacugugc

SEQ ID NO: 1410777 - RNA, 15 nt, Homo sapiens
gcacaugucauugcc

SEQ ID NO: 1410778 - RNA, 19 nt, Homo sapiens
gccuccccgugccaaaaau

SEQ ID NO: 1410779 - RNA, 19 nt, Homo sapiens
gccucugaccccuccucac

SEQ ID NO: 1410780 - RNA, 21 nt, Homo sapiens
gccucuggaaaacucaggauu

SEQ ID NO: 1410781 - RNA, 15 nt, Homo sapiens
gccugagcccccuga

SEQ ID NO: 1410782 - RNA, 23 nt, Homo sapiens
gccugaggccagccugcgggaag

SEQ ID NO: 1410783 - RNA, 13 nt, Homo sapiens
gccugcacucccc

SEQ ID NO: 1410784 - RNA, 14 nt, Homo sapiens
gccugugugcagug

SEQ ID NO: 1410785 - RNA, 18 nt, Homo sapiens
gccuuaaccuagaggguc

SEQ ID NO: 1410786 - RNA, 21 nt, Homo sapiens
gccuuacagugggccauucau

SEQ ID NO: 1410787 - RNA, 13 nt, Homo sapiens
gccuuccaauccu

SEQ ID NO: 1410788 - RNA, 17 nt, Homo sapiens
gccuugggggugugaug

SEQ ID NO: 1410789 - RNA, 18 nt, Homo sapiens
gccuugggggugugaugu

SEQ ID NO: 1410790 - RNA, 23 nt, Homo sapiens
gccuuucggcuuugggcuuuuau

SEQ ID NO: 1410791 - RNA, 14 nt, Homo sapiens
gcgagcaggugccc

SEQ ID NO: 1410792 - RNA, 15 nt, Homo sapiens
gcgcagcugaagccu

SEQ ID NO: 1410793 - RNA, 17 nt, Homo sapiens
gcgucaccugugcaggg

SEQ ID NO: 1410794 - RNA, 15 nt, Homo sapiens
gcguucaacaaugcu

SEQ ID NO: 1410795 - RNA, 15 nt, Homo sapiens
gcuacagaguaacaa

SEQ ID NO: 1410796 - RNA, 23 nt, Homo sapiens
gcuagacucccauggaauuggaa

SEQ ID NO: 1410797 - RNA, 13 nt, Homo sapiens
gcucaacauuuaa

SEQ ID NO: 1410798 - RNA, 14 nt, Homo sapiens
gcucacgcaggacc

SEQ ID NO: 1410799 - RNA, 20 nt, Homo sapiens
gcucacuaccuccucaggga

SEQ ID NO: 1410800 - RNA, 16 nt, Homo sapiens
gcucagcccugagcug

SEQ ID NO: 1410801 - RNA, 22 nt, Homo sapiens
gcuccacaaccaccuccagccu

SEQ ID NO: 1410802 - RNA, 14 nt, Homo sapiens
gcuccccucagaca

SEQ ID NO: 1410803 - RNA, 20 nt, Homo sapiens
gcuccucccucugacccaga

SEQ ID NO: 1410804 - RNA, 22 nt, Homo sapiens
gcucucucucaccaugugacac

SEQ ID NO: 1410805 - RNA, 19 nt, Homo sapiens
gcucucuuuccuucuugcc

SEQ ID NO: 1410806 - RNA, 19 nt, Homo sapiens
gcucuguacaucagacaau

SEQ ID NO: 1410807 - RNA, 13 nt, Homo sapiens
gcugaagccacac

SEQ ID NO: 1410808 - RNA, 12 nt, Homo sapiens
gcugaccuuuaa

SEQ ID NO: 1410809 - RNA, 22 nt, Homo sapiens
gcugaggcggguggaucacuug

SEQ ID NO: 1410810 - RNA, 18 nt, Homo sapiens
gcugaucgggaagcccuu

SEQ ID NO: 1410811 - RNA, 15 nt, Homo sapiens
gcugcucaaaaugcc

SEQ ID NO: 1410812 - RNA, 15 nt, Homo sapiens
gcugcucacuaccuc

SEQ ID NO: 1410813 - RNA, 21 nt, Homo sapiens
gcugcuucugccguugcugcc

SEQ ID NO: 1410814 - RNA, 16 nt, Homo sapiens
gcuggcagugugcgga

SEQ ID NO: 1410815 - RNA, 17 nt, Homo sapiens
gcugguggccaccgugu

SEQ ID NO: 1410816 - RNA, 13 nt, Homo sapiens
gcuggugucgcau

SEQ ID NO: 1410817 - RNA, 17 nt, Homo sapiens
gcugugaccacagcagu

SEQ ID NO: 1410818 - RNA, 20 nt, Homo sapiens
gcuuacagaauggaucaugu

SEQ ID NO: 1410819 - RNA, 13 nt, Homo sapiens
gcuucucucugag

SEQ ID NO: 1410820 - RNA, 17 nt, Homo sapiens
gcuugaacugcugccaa

SEQ ID NO: 1410821 - RNA, 13 nt, Homo sapiens
gcuugaagccaaa

SEQ ID NO: 1410822 - RNA, 16 nt, Homo sapiens
gcuugcucucucucac

SEQ ID NO: 1410823 - RNA, 17 nt, Homo sapiens
gcuuuaaaaacuauuua

SEQ ID NO: 1410824 - RNA, 20 nt, Homo sapiens
gcuuuccugccuccuugaaa

SEQ ID NO: 1410825 - RNA, 16 nt, Homo sapiens
gcuuugugucuggcca

SEQ ID NO: 1410826 - RNA, 23 nt, Homo sapiens
ggaaaagcagcccuuggccagaa

SEQ ID NO: 1410827 - RNA, 14 nt, Homo sapiens
ggaaaggggugcuu

SEQ ID NO: 1410828 - RNA, 14 nt, Homo sapiens
ggaaaguugcauuu

SEQ ID NO: 1410829 - RNA, 14 nt, Homo sapiens
ggaaccucacucuu

SEQ ID NO: 1410830 - RNA, 17 nt, Homo sapiens
ggaaccucacucuugcc

SEQ ID NO: 1410831 - RNA, 19 nt, Homo sapiens
ggaaccucacucuugccaa

SEQ ID NO: 1410832 - RNA, 23 nt, Homo sapiens
ggaaccucacucuugccaaccug

SEQ ID NO: 1410833 - RNA, 17 nt, Homo sapiens
ggaauuggaacuccuau

SEQ ID NO: 1410834 - RNA, 17 nt, Homo sapiens
ggacagucagcauuucu

SEQ ID NO: 1410835 - RNA, 19 nt, Homo sapiens
ggacagucagcauuucuag

SEQ ID NO: 1410836 - RNA, 19 nt, Homo sapiens
ggacuugugucacaucucu

SEQ ID NO: 1410837 - RNA, 13 nt, Homo sapiens
ggagaacuugaac

SEQ ID NO: 1410838 - RNA, 17 nt, Homo sapiens
ggagaguugggggccag

SEQ ID NO: 1410839 - RNA, 19 nt, Homo sapiens
ggagaugcggaaagcccug

SEQ ID NO: 1410840 - RNA, 12 nt, Homo sapiens
ggaggcucucau

SEQ ID NO: 1410841 - RNA, 23 nt, Homo sapiens
ggagguugugucacugacucagg

SEQ ID NO: 1410842 - RNA, 19 nt, Homo sapiens
ggaguucugcucauucuaa

SEQ ID NO: 1410843 - RNA, 20 nt, Homo sapiens
ggauaauagcguucagcagc

SEQ ID NO: 1410844 - RNA, 14 nt, Homo sapiens
ggauaucacuucau

SEQ ID NO: 1410845 - RNA, 23 nt, Homo sapiens
ggauauucccccugagcugccac

SEQ ID NO: 1410846 - RNA, 23 nt, Homo sapiens
ggaucuaauaaacuuccaaacag

SEQ ID NO: 1410847 - RNA, 21 nt, Homo sapiens
guagaccaaaucaaaugcuca

SEQ ID NO: 1410848 - RNA, 23 nt, Homo sapiens
guagagaaagaaaugucugccau

SEQ ID NO: 1410849 - RNA, 16 nt, Homo sapiens
guagauuucauugaag

SEQ ID NO: 1410850 - RNA, 14 nt, Homo sapiens
guagccaugaccuu

SEQ ID NO: 1410851 - RNA, 19 nt, Homo sapiens
guagccggaucaaggcaag

SEQ ID NO: 1410852 - RNA, 10 nt, Homo sapiens
guaguuugca

SEQ ID NO: 1410853 - RNA, 14 nt, Homo sapiens
guaucguggagaaa

SEQ ID NO: 1410854 - RNA, 17 nt, Homo sapiens
guauggaauacaaugua

SEQ ID NO: 1410855 - RNA, 20 nt, Homo sapiens
guauugaaucuaaaaccaaa

SEQ ID NO: 1410856 - RNA, 22 nt, Homo sapiens
guauugaaucuaaaaccaaaua

SEQ ID NO: 1410857 - RNA, 23 nt, Homo sapiens
guauuucaccucuacauuugaaa

SEQ ID NO: 1410858 - RNA, 18 nt, Homo sapiens
gucaaauaaacacugugu

SEQ ID NO: 1410859 - RNA, 22 nt, Homo sapiens
gucacacaaaauuaucaugaca

SEQ ID NO: 1410860 - RNA, 18 nt, Homo sapiens
gucacagcggcagcagcu

SEQ ID NO: 1410861 - RNA, 14 nt, Homo sapiens
gucacuggaucaag

SEQ ID NO: 1410862 - RNA, 20 nt, Homo sapiens
gucacuugacaauuucuuuu

SEQ ID NO: 1410863 - RNA, 22 nt, Homo sapiens
gucaggcugauggagacaguaa

SEQ ID NO: 1410864 - RNA, 16 nt, Homo sapiens
gucauaucuagucacu

SEQ ID NO: 1410865 - RNA, 18 nt, Homo sapiens
gucaugcgucucuggccc

SEQ ID NO: 1410866 - RNA, 22 nt, Homo sapiens
guccaggaaaugugcacaaaau

SEQ ID NO: 1410867 - RNA, 20 nt, Homo sapiens
guccucagguucaauaugaa

SEQ ID NO: 1410868 - RNA, 17 nt, Homo sapiens
gucuaaguaugccucag

SEQ ID NO: 1410869 - RNA, 16 nt, Homo sapiens
gucuccugaggguccu

SEQ ID NO: 1410870 - RNA, 22 nt, Homo sapiens
gucuccuuuaguuucagagugu

SEQ ID NO: 1410871 - RNA, 22 nt, Homo sapiens
gucugagcuucaguauaaaaga

SEQ ID NO: 1410872 - RNA, 20 nt, Homo sapiens
gucugccagcauaugcagag

SEQ ID NO: 1410873 - RNA, 17 nt, Homo sapiens
gucuuauaucccaggug

SEQ ID NO: 1410874 - RNA, 16 nt, Homo sapiens
gucuugugacuagugc

SEQ ID NO: 1410875 - RNA, 10 nt, Homo sapiens
gucuuugcag

SEQ ID NO: 1410876 - RNA, 13 nt, Homo sapiens
gucuuugucaugc

SEQ ID NO: 1410877 - RNA, 17 nt, Homo sapiens
gucuuuuuguaucucau

SEQ ID NO: 1410878 - RNA, 12 nt, Homo sapiens
gugaaacuaauc

SEQ ID NO: 1410879 - RNA, 13 nt, Homo sapiens
gugaacauuccua

SEQ ID NO: 1410880 - RNA, 20 nt, Homo sapiens
gugauaggacauucuaugcu

SEQ ID NO: 1410881 - RNA, 19 nt, Homo sapiens
gugauccuuuugugccaug

SEQ ID NO: 1410882 - RNA, 22 nt, Homo sapiens
gugcacaccgugugccauagaa

SEQ ID NO: 1410883 - RNA, 15 nt, Homo sapiens
gugcagucacuggag

SEQ ID NO: 1410884 - RNA, 12 nt, Homo sapiens
gugccaccgugc

SEQ ID NO: 1410885 - RNA, 19 nt, Homo sapiens
gugccagauuuaugcauau

SEQ ID NO: 1410886 - RNA, 11 nt, Homo sapiens
gugcugggauu

SEQ ID NO: 1410887 - RNA, 15 nt, Homo sapiens
gugcugggauuacag

SEQ ID NO: 1410888 - RNA, 18 nt, Homo sapiens
guggacuuagaaagcagg

SEQ ID NO: 1410889 - RNA, 15 nt, Homo sapiens
guggcaggcggguga

SEQ ID NO: 1410890 - RNA, 22 nt, Homo sapiens
guggcucacgccuguaauccca

SEQ ID NO: 1410891 - RNA, 14 nt, Homo sapiens
guguaaucucucau

SEQ ID NO: 1410892 - RNA, 17 nt, Homo sapiens
guguacaacuccacgag

SEQ ID NO: 1410893 - RNA, 21 nt, Homo sapiens
guguacaacuccacgagguga

SEQ ID NO: 1410894 - RNA, 22 nt, Homo sapiens
guguauccagaagaagagauca

SEQ ID NO: 1410895 - RNA, 18 nt, Homo sapiens
gugucaaauaaacacugu

SEQ ID NO: 1410896 - RNA, 18 nt, Homo sapiens
gugucaaugugauuuaug

SEQ ID NO: 1410897 - RNA, 15 nt, Homo sapiens
gugucacagccauag

SEQ ID NO: 1410898 - RNA, 17 nt, Homo sapiens
gugucugagagccauaa

SEQ ID NO: 1410899 - RNA, 18 nt, Homo sapiens
gugucugcaggauugauu

SEQ ID NO: 1410900 - RNA, 17 nt, Homo sapiens
gugugacauucaguguu

SEQ ID NO: 1410901 - RNA, 17 nt, Homo sapiens
gugugcggagcugauaa

SEQ ID NO: 1410902 - RNA, 14 nt, Homo sapiens
guguucugugauau

SEQ ID NO: 1410903 - RNA, 15 nt, Homo sapiens
guuacaaauaugcag

SEQ ID NO: 1410904 - RNA, 16 nt, Homo sapiens
guuagucucugaacua

SEQ ID NO: 1410905 - RNA, 13 nt, Homo sapiens
guuauacuccuca

SEQ ID NO: 1410906 - RNA, 18 nt, Homo sapiens
guuaucugaacuguggaa

SEQ ID NO: 1410907 - RNA, 19 nt, Homo sapiens
guucaccuuuuccuugcug

SEQ ID NO: 1410908 - RNA, 20 nt, Homo sapiens
guucccccuccuccaucucu

SEQ ID NO: 1410909 - RNA, 17 nt, Homo sapiens
guucccuccccagcucc

SEQ ID NO: 1410910 - RNA, 17 nt, Homo sapiens
guucuguacaaaguacu

SEQ ID NO: 1410911 - RNA, 13 nt, Homo sapiens
guucuugugacag

SEQ ID NO: 1410912 - RNA, 23 nt, Homo sapiens
guucuugugacagauuauacaga

SEQ ID NO: 1410913 - RNA, 19 nt, Homo sapiens
guugccaccccaacccaau

SEQ ID NO: 1410914 - RNA, 11 nt, Homo sapiens
guugcugccag

SEQ ID NO: 1410915 - RNA, 16 nt, Homo sapiens
guugcugccagccagu

SEQ ID NO: 1410916 - RNA, 15 nt, Homo sapiens
guuggaggcucucau

SEQ ID NO: 1410917 - RNA, 19 nt, Homo sapiens
guuuaagucagcaaaucuu

SEQ ID NO: 1410918 - RNA, 16 nt, Homo sapiens
guuuaauuuugcagug

SEQ ID NO: 1410919 - RNA, 16 nt, Homo sapiens
guuuacauagcauuug

SEQ ID NO: 1410920 - RNA, 19 nt, Homo sapiens
guuuaggaacuacugagga

SEQ ID NO: 1410921 - RNA, 20 nt, Homo sapiens
guuuauuuugcuugucauau

SEQ ID NO: 1410922 - RNA, 19 nt, Homo sapiens
guuucaccauguuggccag

SEQ ID NO: 1410923 - RNA, 14 nt, Homo sapiens
guuucauaccaaau

SEQ ID NO: 1410924 - RNA, 15 nt, Homo sapiens
guuucauaccaaaua

SEQ ID NO: 1410925 - RNA, 17 nt, Homo sapiens
guuuccccaccagugaa

SEQ ID NO: 1410926 - RNA, 16 nt, Homo sapiens
guuucuacaacauauu

SEQ ID NO: 1410927 - RNA, 23 nt, Homo sapiens
guuucugugaccuguaguguacc

SEQ ID NO: 1410928 - RNA, 15 nt, Homo sapiens
guuuuaaaaugagaa

SEQ ID NO: 1410929 - RNA, 13 nt, Homo sapiens
guuuuaaugcaau

SEQ ID NO: 1410930 - RNA, 17 nt, Homo sapiens
guuuuuuaaaaauaagc

SEQ ID NO: 1410931 - RNA, 20 nt, Homo sapiens
uaaaaauaagccacauaucu

SEQ ID NO: 1410932 - RNA, 12 nt, Homo sapiens
uaaaaccaaaga

SEQ ID NO: 1410933 - RNA, 13 nt, Homo sapiens
uaaaacucugcca

SEQ ID NO: 1410934 - RNA, 16 nt, Homo sapiens
uaaaagacuguuuuca

SEQ ID NO: 1410935 - RNA, 14 nt, Homo sapiens
uaaaagagccugga

SEQ ID NO: 1410936 - RNA, 17 nt, Homo sapiens
uaaaagauaagugcagu

SEQ ID NO: 1410937 - RNA, 19 nt, Homo sapiens
uaaaaugugcgaggauccu

SEQ ID NO: 1410938 - RNA, 16 nt, Homo sapiens
uaaaauguuaagcugc

SEQ ID NO: 1410939 - RNA, 16 nt, Homo sapiens
uaaaauguuuaggaaa

SEQ ID NO: 1410940 - RNA, 15 nt, Homo sapiens
uaaacgggcugcguu

SEQ ID NO: 1410941 - RNA, 16 nt, Homo sapiens
uaaacuuuaucucaca

SEQ ID NO: 1410942 - RNA, 19 nt, Homo sapiens
uaaagcaagcuaucugcac

SEQ ID NO: 1410943 - RNA, 22 nt, Homo sapiens
uaaagcgacggcuuuuguuuca

SEQ ID NO: 1410944 - RNA, 20 nt, Homo sapiens
uaaauaguuuaacacuuucu

SEQ ID NO: 1410945 - RNA, 21 nt, Homo sapiens
uaaauuauuacauaugguuaa

SEQ ID NO: 1410946 - RNA, 16 nt, Homo sapiens
uaaauuuuaaacaaua

SEQ ID NO: 1410947 - RNA, 17 nt, Homo sapiens
uaacaauagguauuucu

SEQ ID NO: 1410948 - RNA, 23 nt, Homo sapiens
uaacaaucaaaucugguauugaa

SEQ ID NO: 1410949 - RNA, 13 nt, Homo sapiens
uaacagcuuugua

SEQ ID NO: 1410950 - RNA, 20 nt, Homo sapiens
uaacaggcuuugugucaggu

SEQ ID NO: 1410951 - RNA, 22 nt, Homo sapiens
uaacaguugcuuuggauucucu

SEQ ID NO: 1410952 - RNA, 10 nt, Homo sapiens
uaacaucaaa

SEQ ID NO: 1410953 - RNA, 22 nt, Homo sapiens
uaacauggugaaacauggugaa

SEQ ID NO: 1410954 - RNA, 18 nt, Homo sapiens
uaacugacuucuguccac

SEQ ID NO: 1410955 - RNA, 15 nt, Homo sapiens
uaacuggagcagaga

SEQ ID NO: 1410956 - RNA, 21 nt, Homo sapiens
uaacuuguuuacauagcauuu

SEQ ID NO: 1410957 - RNA, 12 nt, Homo sapiens
uaagaauguaua

SEQ ID NO: 1410958 - RNA, 20 nt, Homo sapiens
uaagacaucucaaauacagu

SEQ ID NO: 1410959 - RNA, 16 nt, Homo sapiens
uaagcccagcauuuga

SEQ ID NO: 1410960 - RNA, 20 nt, Homo sapiens
uaaggcccaccccaagucca

SEQ ID NO: 1410961 - RNA, 12 nt, Homo sapiens
uaaguugcagaa

SEQ ID NO: 1410962 - RNA, 15 nt, Homo sapiens
uaaguuucugugacc

SEQ ID NO: 1410963 - RNA, 17 nt, Homo sapiens
uaaguuugggcugaaga

SEQ ID NO: 1410964 - RNA, 13 nt, Homo sapiens
uaauaaaaagcca

SEQ ID NO: 1410965 - RNA, 13 nt, Homo sapiens
uaauaaaccugua

SEQ ID NO: 1410966 - RNA, 14 nt, Homo sapiens
uaauaaacuuccaa

SEQ ID NO: 1410967 - RNA, 16 nt, Homo sapiens
uaauaaauugucauca

SEQ ID NO: 1410968 - RNA, 20 nt, Homo sapiens
uaauauuugucugugugcua

SEQ ID NO: 1410969 - RNA, 17 nt, Homo sapiens
uaaucucucauggugaa

SEQ ID NO: 1410970 - RNA, 19 nt, Homo sapiens
uaaugacagaaguauuuau

SEQ ID NO: 1410971 - RNA, 16 nt, Homo sapiens
uaauggucucaucucc

SEQ ID NO: 1410972 - RNA, 14 nt, Homo sapiens
uaauguucugggaa

SEQ ID NO: 1410973 - RNA, 14 nt, Homo sapiens
uaauuaacaucaaa

SEQ ID NO: 1410974 - RNA, 16 nt, Homo sapiens
uaauuguugaccuaag

SEQ ID NO: 1410975 - RNA, 24 nt, Homo sapiens
uaauuuccacuugggacuagauca

SEQ ID NO: 1410976 - RNA, 19 nt, Homo sapiens
uacaauggcgugaucucag

SEQ ID NO: 1410977 - RNA, 16 nt, Homo sapiens
uacacccugcccucau

SEQ ID NO: 1410978 - RNA, 20 nt, Homo sapiens
uacaggaugaugacuaugga

SEQ ID NO: 1410979 - RNA, 14 nt, Homo sapiens
uacaguaaauucuc

SEQ ID NO: 1410980 - RNA, 12 nt, Homo sapiens
uacagugguuuu

SEQ ID NO: 1410981 - RNA, 21 nt, Homo sapiens
uacaguucuaugcagaacagu

SEQ ID NO: 1410982 - RNA, 15 nt, Homo sapiens
ucccacggggucccc

SEQ ID NO: 1410983 - RNA, 15 nt, Homo sapiens
ucccacucaccaggc

SEQ ID NO: 1410984 - RNA, 15 nt, Homo sapiens
ucccagccucuuccc

SEQ ID NO: 1410985 - RNA, 17 nt, Homo sapiens
uccccacgcccccaugc

SEQ ID NO: 1410986 - RNA, 18 nt, Homo sapiens
ucccccaaaggugccacc

SEQ ID NO: 1410987 - RNA, 17 nt, Homo sapiens
ucccccgaguaccgccu

SEQ ID NO: 1410988 - RNA, 13 nt, Homo sapiens
uccccgugccaaa

SEQ ID NO: 1410989 - RNA, 21 nt, Homo sapiens
uccccgugccaaaaaucuuuu

SEQ ID NO: 1410990 - RNA, 16 nt, Homo sapiens
ucccgccuccaugacu

SEQ ID NO: 1410991 - RNA, 15 nt, Homo sapiens
ucccguacugucugu

SEQ ID NO: 1410992 - RNA, 22 nt, Homo sapiens
ucccuuugccagccuugaguua

SEQ ID NO: 1410993 - RNA, 13 nt, Homo sapiens
uccuaacagcuuu

SEQ ID NO: 1410994 - RNA, 22 nt, Homo sapiens
uccuaaugagcuuuacagcaga

SEQ ID NO: 1410995 - RNA, 14 nt, Homo sapiens
uccuaucaauccaa

SEQ ID NO: 1410996 - RNA, 17 nt, Homo sapiens
uccucaguuacacaaag

SEQ ID NO: 1410997 - RNA, 12 nt, Homo sapiens
uccuccaucucu

SEQ ID NO: 1410998 - RNA, 11 nt, Homo sapiens
uccuccccaaa

SEQ ID NO: 1410999 - RNA, 15 nt, Homo sapiens
uccuccggggcucag

SEQ ID NO: 1411000 - RNA, 18 nt, Homo sapiens
uccuccgugcuuccucag

SEQ ID NO: 1411001 - RNA, 16 nt, Homo sapiens
uccucucucacaaauc

SEQ ID NO: 1411002 - RNA, 16 nt, Homo sapiens
uccugaagcugcuuaa

SEQ ID NO: 1411003 - RNA, 21 nt, Homo sapiens
uccugaaguuugcauuaauaa

SEQ ID NO: 1411004 - RNA, 21 nt, Homo sapiens
uccugcagcuuauuggcuuaa

SEQ ID NO: 1411005 - RNA, 16 nt, Homo sapiens
uccugcugcaugaccu

SEQ ID NO: 1411006 - RNA, 20 nt, Homo sapiens
uccuguaagcaacacuuuaa

SEQ ID NO: 1411007 - RNA, 17 nt, Homo sapiens
uccuuaauucugccuaa

SEQ ID NO: 1411008 - RNA, 15 nt, Homo sapiens
uccuucaccaaagau

SEQ ID NO: 1411009 - RNA, 19 nt, Homo sapiens
uccuucacucccaaaugca

SEQ ID NO: 1411010 - RNA, 17 nt, Homo sapiens
uccuuuuauguggucuc

SEQ ID NO: 1411011 - RNA, 19 nt, Homo sapiens
ucgaguuaaaacaaugaag

SEQ ID NO: 1411012 - RNA, 18 nt, Homo sapiens
ucgccaaauaguuccauu

SEQ ID NO: 1411013 - RNA, 21 nt, Homo sapiens
ucggccacccgccucccucuc

SEQ ID NO: 1411014 - RNA, 20 nt, Homo sapiens
ucggcuucccaaagugcuga

SEQ ID NO: 1411015 - RNA, 18 nt, Homo sapiens
ucuaaaacagggauuuug

SEQ ID NO: 1411016 - RNA, 15 nt, Homo sapiens
ucuaaauauuuccau

SEQ ID NO: 1411017 - RNA, 18 nt, Homo sapiens
ucuaaauuuuaauugcac

SEQ ID NO: 1411018 - RNA, 16 nt, Homo sapiens
ucuaauucaguucuga

SEQ ID NO: 1411019 - RNA, 21 nt, Homo sapiens
ucuaccaaguaagacaucuca

SEQ ID NO: 1411020 - RNA, 18 nt, Homo sapiens
ucuacccagauaaacaaa

SEQ ID NO: 1411021 - RNA, 13 nt, Homo sapiens
ucuagaagccaag

SEQ ID NO: 1411022 - RNA, 18 nt, Homo sapiens
ucuagaagugccaucuca

SEQ ID NO: 1411023 - RNA, 18 nt, Homo sapiens
ucuagauuuuucugugaa

SEQ ID NO: 1411024 - RNA, 12 nt, Homo sapiens
ucuauucuugga

SEQ ID NO: 1411025 - RNA, 21 nt, Homo sapiens
ucuauuuugggaaaaugaagg

SEQ ID NO: 1411026 - RNA, 12 nt, Homo sapiens
ucucaguucucu

SEQ ID NO: 1411027 - RNA, 22 nt, Homo sapiens
ucucauuguguggucauaucua

SEQ ID NO: 1411028 - RNA, 20 nt, Homo sapiens
ucucccgcguggaguucucc

SEQ ID NO: 1411029 - RNA, 18 nt, Homo sapiens
ucuccuagcucccugcca

SEQ ID NO: 1411030 - RNA, 16 nt, Homo sapiens
ucucgaauacuuugaa

SEQ ID NO: 1411031 - RNA, 19 nt, Homo sapiens
ucucggggccugugccgca

SEQ ID NO: 1411032 - RNA, 20 nt, Homo sapiens
ucucucgugaguauauugau

SEQ ID NO: 1411033 - RNA, 11 nt, Homo sapiens
ucucucugagc

SEQ ID NO: 1411034 - RNA, 15 nt, Homo sapiens
ucugaaaaaugccug

SEQ ID NO: 1411035 - RNA, 12 nt, Homo sapiens
ucugaacuaauu

SEQ ID NO: 1411036 - RNA, 19 nt, Homo sapiens
ucugaacuaggugaucuca

SEQ ID NO: 1411037 - RNA, 23 nt, Homo sapiens
ucugaagacucaggcagagcagc

SEQ ID NO: 1411038 - RNA, 13 nt, Homo sapiens
ucugaggcucagc

SEQ ID NO: 1411039 - RNA, 12 nt, Homo sapiens
ucugcaauauua

SEQ ID NO: 1411040 - RNA, 20 nt, Homo sapiens
ucugccuuaaaaccaaagag

SEQ ID NO: 1411041 - RNA, 21 nt, Homo sapiens
ugcaguguuuaagucagcaaa

SEQ ID NO: 1411042 - RNA, 13 nt, Homo sapiens
ugcaucuuccagu

SEQ ID NO: 1411043 - RNA, 19 nt, Homo sapiens
ugcauuucacucuggguac

SEQ ID NO: 1411044 - RNA, 13 nt, Homo sapiens
ugccaaccuguaa

SEQ ID NO: 1411045 - RNA, 17 nt, Homo sapiens
ugccaccccaacccaau

SEQ ID NO: 1411046 - RNA, 14 nt, Homo sapiens
ugccagcauaugca

SEQ ID NO: 1411047 - RNA, 20 nt, Homo sapiens
ugccaguuuaaucauugccu

SEQ ID NO: 1411048 - RNA, 13 nt, Homo sapiens
ugccauguucaaa

SEQ ID NO: 1411049 - RNA, 20 nt, Homo sapiens
ugcccaggcuggaguacaau

SEQ ID NO: 1411050 - RNA, 22 nt, Homo sapiens
ugccccacugggagaguccuua

SEQ ID NO: 1411051 - RNA, 20 nt, Homo sapiens
ugcccccacgccuccugcca

SEQ ID NO: 1411052 - RNA, 19 nt, Homo sapiens
ugccgaaccaggagcugcu

SEQ ID NO: 1411053 - RNA, 16 nt, Homo sapiens
ugccucaacauacugu

SEQ ID NO: 1411054 - RNA, 14 nt, Homo sapiens
ugccucccaaagug

SEQ ID NO: 1411055 - RNA, 21 nt, Homo sapiens
ugccuccuccugagagcuguu

SEQ ID NO: 1411056 - RNA, 21 nt, Homo sapiens
ugccucucccauggcuuugug

SEQ ID NO: 1411057 - RNA, 18 nt, Homo sapiens
ugccuuaaaaccaaagag

SEQ ID NO: 1411058 - RNA, 19 nt, Homo sapiens
ugcgaaaucuguugugcau

SEQ ID NO: 1411059 - RNA, 20 nt, Homo sapiens
ugcgaaaucuguugugcaug

SEQ ID NO: 1411060 - RNA, 19 nt, Homo sapiens
ugcuaagggcaggcccaaa

SEQ ID NO: 1411061 - RNA, 23 nt, Homo sapiens
ugcuaauauaauagaugacagug

SEQ ID NO: 1411062 - RNA, 14 nt, Homo sapiens
ugcuacuaacagau

SEQ ID NO: 1411063 - RNA, 20 nt, Homo sapiens
ugcuagugucuuugucaugc

SEQ ID NO: 1411064 - RNA, 12 nt, Homo sapiens
ugcuauucuggc

SEQ ID NO: 1411065 - RNA, 15 nt, Homo sapiens
ugcucucucucacca

SEQ ID NO: 1411066 - RNA, 21 nt, Homo sapiens
ugcugaaagggaaggagacac

SEQ ID NO: 1411067 - RNA, 17 nt, Homo sapiens
ugcugaccagcacugac

SEQ ID NO: 1411068 - RNA, 18 nt, Homo sapiens
ugcugagugucaucucaa

SEQ ID NO: 1411069 - RNA, 13 nt, Homo sapiens
ugcugcugccacc

SEQ ID NO: 1411070 - RNA, 17 nt, Homo sapiens
ugcuggagaaaucuuga

SEQ ID NO: 1411071 - RNA, 13 nt, Homo sapiens
ugcuggugucgca

SEQ ID NO: 1411072 - RNA, 18 nt, Homo sapiens
ugcugguguuuaugugaa

SEQ ID NO: 1411073 - RNA, 17 nt, Homo sapiens
ugcuguaugucauuaaa

SEQ ID NO: 1411074 - RNA, 21 nt, Homo sapiens
ugcuucugccguugcugccag

SEQ ID NO: 1411075 - RNA, 19 nt, Homo sapiens
ugcuucuuggagucuucca

SEQ ID NO: 1411076 - RNA, 20 nt, Homo sapiens
ugcuugaacugcugccaacu

SEQ ID NO: 1411077 - RNA, 15 nt, Homo sapiens
ugcuugucauauucg

SEQ ID NO: 1411078 - RNA, 12 nt, Homo sapiens
ugcuuugagauc

SEQ ID NO: 1411079 - RNA, 22 nt, Homo sapiens
uggaaaguugggauuugcaaau

SEQ ID NO: 1411080 - RNA, 13 nt, Homo sapiens
uggaaauccaucc

SEQ ID NO: 1411081 - RNA, 22 nt, Homo sapiens
uggaaccuaaauugaacugcca

SEQ ID NO: 1411082 - RNA, 20 nt, Homo sapiens
uggaaggcugcuuucuccuu

SEQ ID NO: 1411083 - RNA, 20 nt, Homo sapiens
uggaaggugacuuuucaccu

SEQ ID NO: 1411084 - RNA, 10 nt, Homo sapiens
uggaccuucu

SEQ ID NO: 1411085 - RNA, 22 nt, Homo sapiens
uggacugaugcuuuuagcucaa

SEQ ID NO: 1411086 - RNA, 17 nt, Homo sapiens
uggagacaguaacacug

SEQ ID NO: 1411087 - RNA, 15 nt, Homo sapiens
uggagaggggacccu

SEQ ID NO: 1411088 - RNA, 19 nt, Homo sapiens
uggagcagagaacaucugg

SEQ ID NO: 1411089 - RNA, 17 nt, Homo sapiens
uggaggccgcugcugac

SEQ ID NO: 1411090 - RNA, 16 nt, Homo sapiens
uggagguugaagccaa

SEQ ID NO: 1411091 - RNA, 21 nt, Homo sapiens
uggauaauagcguucagcagc

SEQ ID NO: 1411092 - RNA, 19 nt, Homo sapiens
uggauauaccuagauucca

SEQ ID NO: 1411093 - RNA, 19 nt, Homo sapiens
uggcaccugggaagccugg

SEQ ID NO: 1411094 - RNA, 16 nt, Homo sapiens
uggcagcaauggauga

SEQ ID NO: 1411095 - RNA, 19 nt, Homo sapiens
uggccuuauaucauuucau

SEQ ID NO: 1411096 - RNA, 13 nt, Homo sapiens
uggcgucaccugu

SEQ ID NO: 1411097 - RNA, 21 nt, Homo sapiens
accaaguuucauaccaaauau

SEQ ID NO: 1411098 - RNA, 18 nt, Homo sapiens
accaauggguuugccaag

SEQ ID NO: 1411099 - RNA, 23 nt, Homo sapiens
accaauggguuugccaagcccuu

SEQ ID NO: 1411100 - RNA, 13 nt, Homo sapiens
accacaucuucau

SEQ ID NO: 1411101 - RNA, 16 nt, Homo sapiens
accaccaacacacagg

SEQ ID NO: 1411102 - RNA, 15 nt, Homo sapiens
accacuuaauugcuu

SEQ ID NO: 1411103 - RNA, 17 nt, Homo sapiens
accagaagcagaugcca

SEQ ID NO: 1411104 - RNA, 17 nt, Homo sapiens
accagagcaaaguguaa

SEQ ID NO: 1411105 - RNA, 18 nt, Homo sapiens
accaugaaaaugaaugcu

SEQ ID NO: 1411106 - RNA, 19 nt, Homo sapiens
acccacggcucaacuccuc

SEQ ID NO: 1411107 - RNA, 13 nt, Homo sapiens
acccccugcccug

SEQ ID NO: 1411108 - RNA, 16 nt, Homo sapiens
accccucccuacuguu

SEQ ID NO: 1411109 - RNA, 21 nt, Homo sapiens
acccugagccaccguguccuu

SEQ ID NO: 1411110 - RNA, 18 nt, Homo sapiens
acccugcugcugcuccuc

SEQ ID NO: 1411111 - RNA, 21 nt, Homo sapiens
acccuguaaguuacagucaca

SEQ ID NO: 1411112 - RNA, 17 nt, Homo sapiens
accgaaaaguugcugaa

SEQ ID NO: 1411113 - RNA, 19 nt, Homo sapiens
accgcaggccuuacagucu

SEQ ID NO: 1411114 - RNA, 21 nt, Homo sapiens
accgcccuggcuaacauggug

SEQ ID NO: 1411115 - RNA, 15 nt, Homo sapiens
accgcccuugccgaa

SEQ ID NO: 1411116 - RNA, 14 nt, Homo sapiens
accuaaaugaguca

SEQ ID NO: 1411117 - RNA, 17 nt, Homo sapiens
accuaagcaaugagcca

SEQ ID NO: 1411118 - RNA, 13 nt, Homo sapiens
accuaaguucuca

SEQ ID NO: 1411119 - RNA, 21 nt, Homo sapiens
accuagauuccauacagugac

SEQ ID NO: 1411120 - RNA, 15 nt, Homo sapiens
accucaagugccuua

SEQ ID NO: 1411121 - RNA, 23 nt, Homo sapiens
accucaagugccuuauucucaca

SEQ ID NO: 1411122 - RNA, 20 nt, Homo sapiens
accucauuguucuguacaaa

SEQ ID NO: 1411123 - RNA, 16 nt, Homo sapiens
accuccucagggaugg

SEQ ID NO: 1411124 - RNA, 14 nt, Homo sapiens
accucuacauuuga

SEQ ID NO: 1411125 - RNA, 16 nt, Homo sapiens
accucugugaccucag

SEQ ID NO: 1411126 - RNA, 16 nt, Homo sapiens
accugcauuuccucua

SEQ ID NO: 1411127 - RNA, 20 nt, Homo sapiens
accuggccuuauaucauuuc

SEQ ID NO: 1411128 - RNA, 15 nt, Homo sapiens
accuguaagcccagc

SEQ ID NO: 1411129 - RNA, 16 nt, Homo sapiens
accuguaauaaauaug

SEQ ID NO: 1411130 - RNA, 18 nt, Homo sapiens
accuguaguguaccauuc

SEQ ID NO: 1411131 - RNA, 21 nt, Homo sapiens
accuuuggaaacaacauuuaa

SEQ ID NO: 1411132 - RNA, 14 nt, Homo sapiens
acgaaucuucucaa

SEQ ID NO: 1411133 - RNA, 22 nt, Homo sapiens
acgacauuuuggaacagcaugc

SEQ ID NO: 1411134 - RNA, 12 nt, Homo sapiens
acgaggugaaaa

SEQ ID NO: 1411135 - RNA, 21 nt, Homo sapiens
acggccagcaccgcugcucac

SEQ ID NO: 1411136 - RNA, 18 nt, Homo sapiens
acguaaauuauuacauau

SEQ ID NO: 1411137 - RNA, 21 nt, Homo sapiens
acgucuuacauuuucucugau

SEQ ID NO: 1411138 - RNA, 21 nt, Homo sapiens
acguuucccguuagucucuga

SEQ ID NO: 1411139 - RNA, 16 nt, Homo sapiens
acuaaguguguaucca

SEQ ID NO: 1411140 - RNA, 12 nt, Homo sapiens
acuaaucuuucu

SEQ ID NO: 1411141 - RNA, 22 nt, Homo sapiens
acuaauguauuaauaccacuga

SEQ ID NO: 1411142 - RNA, 23 nt, Homo sapiens
acuagcuaaaccagaaaggugau

SEQ ID NO: 1411143 - RNA, 15 nt, Homo sapiens
acuaggugaucucag

SEQ ID NO: 1411144 - RNA, 15 nt, Homo sapiens
acuauauccuuccua

SEQ ID NO: 1411145 - RNA, 17 nt, Homo sapiens
acucaccuucuggccag

SEQ ID NO: 1411146 - RNA, 21 nt, Homo sapiens
acucauuuaaauuaaauaagu

SEQ ID NO: 1411147 - RNA, 12 nt, Homo sapiens
acuccacaccag

SEQ ID NO: 1411148 - RNA, 18 nt, Homo sapiens
acuccugaccucagguga

SEQ ID NO: 1411149 - RNA, 18 nt, Homo sapiens
acucgccagcccaaaugc

SEQ ID NO: 1411150 - RNA, 19 nt, Homo sapiens
acucugcaaccuccacuuc

SEQ ID NO: 1411151 - RNA, 11 nt, Homo sapiens
acucuugccaa

SEQ ID NO: 1411152 - RNA, 12 nt, Homo sapiens
acucuugccaac

SEQ ID NO: 1411153 - RNA, 18 nt, Homo sapiens
acucuugccaaccuguaa

SEQ ID NO: 1411154 - RNA, 16 nt, Homo sapiens
acucuuguuugaugua

SEQ ID NO: 1411155 - RNA, 18 nt, Homo sapiens
acucuuuaagugaaggau

SEQ ID NO: 1411156 - RNA, 13 nt, Homo sapiens
acugaaaacaguc

SEQ ID NO: 1411157 - RNA, 19 nt, Homo sapiens
acugaagacaggcacaaaa

SEQ ID NO: 1411158 - RNA, 22 nt, Homo sapiens
acugagccccgcagaccucccc

SEQ ID NO: 1411159 - RNA, 18 nt, Homo sapiens
acugaugcuuuuagcuca

SEQ ID NO: 1411160 - RNA, 19 nt, Homo sapiens
acugcaggugacuuuggca

SEQ ID NO: 1411161 - RNA, 20 nt, Homo sapiens
acugccaaaaccaaauugag

SEQ ID NO: 1411162 - RNA, 22 nt, Homo sapiens
acugcccccacgccuccugcca

SEQ ID NO: 1411163 - RNA, 21 nt, Homo sapiens
acugcugccaacuccauguca

SEQ ID NO: 1411164 - RNA, 23 nt, Homo sapiens
acugugcugaucgggaagcccuu

SEQ ID NO: 1411165 - RNA, 19 nt, Homo sapiens
acuguuaccuaaguucuca

SEQ ID NO: 1411166 - RNA, 19 nt, Homo sapiens
acuuaauugcuuuccugcc

SEQ ID NO: 1411167 - RNA, 14 nt, Homo sapiens
acuucacuuccauu

SEQ ID NO: 1411168 - RNA, 21 nt, Homo sapiens
acuuccacaaaauuaugcugc

SEQ ID NO: 1411169 - RNA, 22 nt, Homo sapiens
acuuccacaaaauuaugcugca

SEQ ID NO: 1411170 - RNA, 14 nt, Homo sapiens
acuugagcuuuaaa

SEQ ID NO: 1411171 - RNA, 20 nt, Homo sapiens
acuugauaugugcaccaaua

SEQ ID NO: 1411172 - RNA, 19 nt, Homo sapiens
acuuggauguagccaugac

SEQ ID NO: 1411173 - RNA, 17 nt, Homo sapiens
acuuggccaagcaggga

SEQ ID NO: 1411174 - RNA, 18 nt, Homo sapiens
acuuggccaagcagggag

SEQ ID NO: 1411175 - RNA, 21 nt, Homo sapiens
acuuguuuacauagcauuugu

SEQ ID NO: 1411176 - RNA, 18 nt, Homo sapiens
acuuucagccgacucagc

SEQ ID NO: 1411177 - RNA, 22 nt, Homo sapiens
agaaaacccacacccacugucc

SEQ ID NO: 1411178 - RNA, 16 nt, Homo sapiens
agaaaaucacugugcu

SEQ ID NO: 1411179 - RNA, 16 nt, Homo sapiens
agaaagaagacugugu

SEQ ID NO: 1411180 - RNA, 12 nt, Homo sapiens
agaaagauuaaa

SEQ ID NO: 1411181 - RNA, 19 nt, Homo sapiens
agaaagauuaaauauaucu

SEQ ID NO: 1411182 - RNA, 20 nt, Homo sapiens
agaaagugggugagaugcug

SEQ ID NO: 1411183 - RNA, 15 nt, Homo sapiens
agaaaucaugugcau

SEQ ID NO: 1411184 - RNA, 21 nt, Homo sapiens
agaacaucuggauuucauccu

SEQ ID NO: 1411185 - RNA, 15 nt, Homo sapiens
agaaccccugucaca

SEQ ID NO: 1411186 - RNA, 22 nt, Homo sapiens
agaacuugaacuaacauaaucu

SEQ ID NO: 1411187 - RNA, 21 nt, Homo sapiens
agaagagggaaugagcuucca

SEQ ID NO: 1411188 - RNA, 16 nt, Homo sapiens
agaaggaagugagcau

SEQ ID NO: 1411189 - RNA, 23 nt, Homo sapiens
agaagugccaucucaauugugcu

SEQ ID NO: 1411190 - RNA, 23 nt, Homo sapiens
agaagugucacagccauagucaa

SEQ ID NO: 1411191 - RNA, 14 nt, Homo sapiens
agaaguucauuccu

SEQ ID NO: 1411192 - RNA, 17 nt, Homo sapiens
agaauaaauguuuuaca

SEQ ID NO: 1411193 - RNA, 20 nt, Homo sapiens
agaaugaugaguccagaacc

SEQ ID NO: 1411194 - RNA, 22 nt, Homo sapiens
agaauucugggcaagucaccca

SEQ ID NO: 1411195 - RNA, 18 nt, Homo sapiens
agaauuuaauguacagua

SEQ ID NO: 1411196 - RNA, 13 nt, Homo sapiens
agacacauucaca

SEQ ID NO: 1411197 - RNA, 20 nt, Homo sapiens
agacagccccagagcagggu

SEQ ID NO: 1411198 - RNA, 13 nt, Homo sapiens
agacagggcucca

SEQ ID NO: 1411199 - RNA, 20 nt, Homo sapiens
agacagugggcacuaagggu

SEQ ID NO: 1411200 - RNA, 15 nt, Homo sapiens
agacagugugugagc

SEQ ID NO: 1411201 - RNA, 19 nt, Homo sapiens
agacccucucaagugcccu

SEQ ID NO: 1411202 - RNA, 12 nt, Homo sapiens
agaccucuccca

SEQ ID NO: 1411203 - RNA, 19 nt, Homo sapiens
agacuguuuucagaccuuu

SEQ ID NO: 1411204 - RNA, 18 nt, Homo sapiens
agagaaaaagcccagcuu

SEQ ID NO: 1411205 - RNA, 13 nt, Homo sapiens
agagaaagccagg

SEQ ID NO: 1411206 - RNA, 17 nt, Homo sapiens
agagacacaaguggccu

SEQ ID NO: 1411207 - RNA, 19 nt, Homo sapiens
agagacacaaguggccuua

SEQ ID NO: 1411208 - RNA, 15 nt, Homo sapiens
agagagaaagccagg

SEQ ID NO: 1411209 - RNA, 21 nt, Homo sapiens
agagcaaaguguaacggccaa

SEQ ID NO: 1411210 - RNA, 23 nt, Homo sapiens
agagccaggcacacacugugcuu

SEQ ID NO: 1411211 - RNA, 17 nt, Homo sapiens
agagcccgguacagggc

SEQ ID NO: 1411212 - RNA, 13 nt, Homo sapiens
agagcucuucaga

SEQ ID NO: 1411213 - RNA, 21 nt, Homo sapiens
agagcuguggcacagaccccc

SEQ ID NO: 1411214 - RNA, 13 nt, Homo sapiens
agagcuguucccc

SEQ ID NO: 1411215 - RNA, 17 nt, Homo sapiens
agaggaccuccaugccc

SEQ ID NO: 1411216 - RNA, 16 nt, Homo sapiens
agaggauuuaacugug

SEQ ID NO: 1411217 - RNA, 19 nt, Homo sapiens
agaggauuuaacugugaac

SEQ ID NO: 1411218 - RNA, 20 nt, Homo sapiens
agaguaggguagaccaaauc

SEQ ID NO: 1411219 - RNA, 14 nt, Homo sapiens
agaguuucacucuu

SEQ ID NO: 1411220 - RNA, 17 nt, Homo sapiens
agaucacaccacugcac

SEQ ID NO: 1411221 - RNA, 22 nt, Homo sapiens
agaugaagaaggagcagaauaa

SEQ ID NO: 1411222 - RNA, 17 nt, Homo sapiens
agaugcggaaagcccug

SEQ ID NO: 1411223 - RNA, 17 nt, Homo sapiens
agauuaggucacauuac

SEQ ID NO: 1411224 - RNA, 21 nt, Homo sapiens
agauuccauacagugacaaua

SEQ ID NO: 1411225 - RNA, 18 nt, Homo sapiens
agauucccuugcacugua

SEQ ID NO: 1411226 - RNA, 13 nt, Homo sapiens
agauuugggagag

SEQ ID NO: 1411227 - RNA, 14 nt, Homo sapiens
agauuuuaugugcu

SEQ ID NO: 1411228 - RNA, 19 nt, Homo sapiens
cagccccagagcagggugu

SEQ ID NO: 1411229 - RNA, 16 nt, Homo sapiens
cagccuccccgugcca

SEQ ID NO: 1411230 - RNA, 19 nt, Homo sapiens
cagccucccgaguagcugg

SEQ ID NO: 1411231 - RNA, 21 nt, Homo sapiens
cagccuggccuguggcugccc

SEQ ID NO: 1411232 - RNA, 20 nt, Homo sapiens
cagcuagacucccauggaau

SEQ ID NO: 1411233 - RNA, 14 nt, Homo sapiens
cagcucagacauau

SEQ ID NO: 1411234 - RNA, 22 nt, Homo sapiens
cagcuccuccgugcuuccucag

SEQ ID NO: 1411235 - RNA, 14 nt, Homo sapiens
cagcugaugacuca

SEQ ID NO: 1411236 - RNA, 16 nt, Homo sapiens
cagcugcuucucccac

SEQ ID NO: 1411237 - RNA, 15 nt, Homo sapiens
cagcuggucuucagc

SEQ ID NO: 1411238 - RNA, 19 nt, Homo sapiens
cagcuggucuucagcaaaa

SEQ ID NO: 1411239 - RNA, 21 nt, Homo sapiens
caggaaacuccacaucugccu

SEQ ID NO: 1411240 - RNA, 18 nt, Homo sapiens
caggaaaugugcacaaaa

SEQ ID NO: 1411241 - RNA, 18 nt, Homo sapiens
caggaaguuaguuuuagu

SEQ ID NO: 1411242 - RNA, 18 nt, Homo sapiens
caggaaugaucccacuca

SEQ ID NO: 1411243 - RNA, 19 nt, Homo sapiens
caggagagagaaagccagg

SEQ ID NO: 1411244 - RNA, 16 nt, Homo sapiens
caggagcugcucacua

SEQ ID NO: 1411245 - RNA, 19 nt, Homo sapiens
caggagcugcucacuaccu

SEQ ID NO: 1411246 - RNA, 20 nt, Homo sapiens
caggagguggagguugcagu

SEQ ID NO: 1411247 - RNA, 15 nt, Homo sapiens
caggaguucugcuca

SEQ ID NO: 1411248 - RNA, 19 nt, Homo sapiens
caggaugaugacuauggaa

SEQ ID NO: 1411249 - RNA, 16 nt, Homo sapiens
caggcccuuuccucag

SEQ ID NO: 1411250 - RNA, 19 nt, Homo sapiens
caggcuggagugcaguggc

SEQ ID NO: 1411251 - RNA, 21 nt, Homo sapiens
cagggaaaugccucgagccau

SEQ ID NO: 1411252 - RNA, 22 nt, Homo sapiens
cagggaggaagaagcuuaggca

SEQ ID NO: 1411253 - RNA, 17 nt, Homo sapiens
cagggcaugccccggcc

SEQ ID NO: 1411254 - RNA, 17 nt, Homo sapiens
caggguauggccagcuu

SEQ ID NO: 1411255 - RNA, 19 nt, Homo sapiens
caggguccuccggggcuca

SEQ ID NO: 1411256 - RNA, 21 nt, Homo sapiens
caggguuguuagaucuucugg

SEQ ID NO: 1411257 - RNA, 16 nt, Homo sapiens
caguaacacuggcgag

SEQ ID NO: 1411258 - RNA, 16 nt, Homo sapiens
caguagagugauagga

SEQ ID NO: 1411259 - RNA, 17 nt, Homo sapiens
caguaguaccaaaugcu

SEQ ID NO: 1411260 - RNA, 21 nt, Homo sapiens
cagucaauguuucgguuuaga

SEQ ID NO: 1411261 - RNA, 19 nt, Homo sapiens
cagucuccgcuagcucuuu

SEQ ID NO: 1411262 - RNA, 23 nt, Homo sapiens
cagucuucucuggacgcucccuu

SEQ ID NO: 1411263 - RNA, 16 nt, Homo sapiens
cagugauuuggaugaa

SEQ ID NO: 1411264 - RNA, 13 nt, Homo sapiens
caguggcaccugg

SEQ ID NO: 1411265 - RNA, 23 nt, Homo sapiens
caguguccagacuuucuguaauc

SEQ ID NO: 1411266 - RNA, 23 nt, Homo sapiens
caguguucaaauaaacugaagga

SEQ ID NO: 1411267 - RNA, 21 nt, Homo sapiens
caguucuaugcagaacaguga

SEQ ID NO: 1411268 - RNA, 22 nt, Homo sapiens
caguucuaugcagaacagugag

SEQ ID NO: 1411269 - RNA, 14 nt, Homo sapiens
caguuucaaaaacu

SEQ ID NO: 1411270 - RNA, 11 nt, Homo sapiens
cauacagggca

SEQ ID NO: 1411271 - RNA, 13 nt, Homo sapiens
cauacagugacaa

SEQ ID NO: 1411272 - RNA, 19 nt, Homo sapiens
cauagaauggcacauguca

SEQ ID NO: 1411273 - RNA, 21 nt, Homo sapiens
cauaucuagauuuuucuguga

SEQ ID NO: 1411274 - RNA, 16 nt, Homo sapiens
caucaaagugaugauu

SEQ ID NO: 1411275 - RNA, 13 nt, Homo sapiens
caucaaguguaau

SEQ ID NO: 1411276 - RNA, 21 nt, Homo sapiens
caucagaaacaucugauuuga

SEQ ID NO: 1411277 - RNA, 21 nt, Homo sapiens
caucauccugccccuguggca

SEQ ID NO: 1411278 - RNA, 16 nt, Homo sapiens
caucaugaaaacuggg

SEQ ID NO: 1411279 - RNA, 14 nt, Homo sapiens
cauccagaggccau

SEQ ID NO: 1411280 - RNA, 20 nt, Homo sapiens
cauccagaggccauguucca

SEQ ID NO: 1411281 - RNA, 20 nt, Homo sapiens
cauccagggaaaugccucga

SEQ ID NO: 1411282 - RNA, 15 nt, Homo sapiens
caucccugugaagga

SEQ ID NO: 1411283 - RNA, 19 nt, Homo sapiens
cauccugaaguuugcauua

SEQ ID NO: 1411284 - RNA, 13 nt, Homo sapiens
caucgguagcuug

SEQ ID NO: 1411285 - RNA, 17 nt, Homo sapiens
caucuaaauauuuccau

SEQ ID NO: 1411286 - RNA, 12 nt, Homo sapiens
caucuaccuucc

SEQ ID NO: 1411287 - RNA, 23 nt, Homo sapiens
caucuagcaagcacuugaugcca

SEQ ID NO: 1411288 - RNA, 23 nt, Homo sapiens
caucucaaccccaucauccugcc

SEQ ID NO: 1411289 - RNA, 19 nt, Homo sapiens
caucugccuuaaaaccaaa

SEQ ID NO: 1411290 - RNA, 11 nt, Homo sapiens
caucuguaaac

SEQ ID NO: 1411291 - RNA, 17 nt, Homo sapiens
caugaauauuuaguguu

SEQ ID NO: 1411292 - RNA, 13 nt, Homo sapiens
caugaccuaucag

SEQ ID NO: 1411293 - RNA, 18 nt, Homo sapiens
caugcuuccuauacaguu

SEQ ID NO: 1411294 - RNA, 18 nt, Homo sapiens
caugggguagggugagaa

SEQ ID NO: 1411295 - RNA, 14 nt, Homo sapiens
cauguacauacugu

SEQ ID NO: 1411296 - RNA, 16 nt, Homo sapiens
caugugacacacuggc

SEQ ID NO: 1411297 - RNA, 19 nt, Homo sapiens
cauguucaaagugugacau

SEQ ID NO: 1411298 - RNA, 22 nt, Homo sapiens
cauguucaaagugugacauuca

SEQ ID NO: 1411299 - RNA, 18 nt, Homo sapiens
cauguugaaaaucaguuu

SEQ ID NO: 1411300 - RNA, 15 nt, Homo sapiens
cauuaaaagacuguu

SEQ ID NO: 1411301 - RNA, 23 nt, Homo sapiens
cauuacauuaacauuuaggaacc

SEQ ID NO: 1411302 - RNA, 17 nt, Homo sapiens
cauuacccaaaagcaag

SEQ ID NO: 1411303 - RNA, 15 nt, Homo sapiens
cauucagacuuucag

SEQ ID NO: 1411304 - RNA, 18 nt, Homo sapiens
cauuguauggauaguaaa

SEQ ID NO: 1411305 - RNA, 22 nt, Homo sapiens
cauuguguggucauaucuaguc

SEQ ID NO: 1411306 - RNA, 23 nt, Homo sapiens
cauuuaaacucagcugaucugau

SEQ ID NO: 1411307 - RNA, 15 nt, Homo sapiens
cauuuacaaagcaaa

SEQ ID NO: 1411308 - RNA, 15 nt, Homo sapiens
cauuucuauaggcaa

SEQ ID NO: 1411309 - RNA, 20 nt, Homo sapiens
cauuugaagccguccaagaa

SEQ ID NO: 1411310 - RNA, 15 nt, Homo sapiens
cauuugcuagugaca

SEQ ID NO: 1411311 - RNA, 17 nt, Homo sapiens
cauuugugucauugaca

SEQ ID NO: 1411312 - RNA, 18 nt, Homo sapiens
cauuuuagcucaaacccu

SEQ ID NO: 1411313 - RNA, 18 nt, Homo sapiens
cauuuucacaacauauca

SEQ ID NO: 1411314 - RNA, 19 nt, Homo sapiens
cauuuuuuaaaacaagaaa

SEQ ID NO: 1411315 - RNA, 23 nt, Homo sapiens
ccaaaaguuaaacuuuaucucac

SEQ ID NO: 1411316 - RNA, 16 nt, Homo sapiens
ccaaauuaucaagcua

SEQ ID NO: 1411317 - RNA, 13 nt, Homo sapiens
ccaacacacagga

SEQ ID NO: 1411318 - RNA, 16 nt, Homo sapiens
ccaacagcgacauagc

SEQ ID NO: 1411319 - RNA, 22 nt, Homo sapiens
ccaagaacaagucaccuccaag

SEQ ID NO: 1411320 - RNA, 17 nt, Homo sapiens
ccaagaguuguugugca

SEQ ID NO: 1411321 - RNA, 15 nt, Homo sapiens
ccaaggccaccccac

SEQ ID NO: 1411322 - RNA, 15 nt, Homo sapiens
ccaagggacacagga

SEQ ID NO: 1411323 - RNA, 15 nt, Homo sapiens
ccaaguacagaauua

SEQ ID NO: 1411324 - RNA, 13 nt, Homo sapiens
ccaauaaaacuga

SEQ ID NO: 1411325 - RNA, 18 nt, Homo sapiens
ccaauccucaccuaacag

SEQ ID NO: 1411326 - RNA, 19 nt, Homo sapiens
ccacaaaauuaugcugcau

SEQ ID NO: 1411327 - RNA, 22 nt, Homo sapiens
ccacacaguggccggggcugaa

SEQ ID NO: 1411328 - RNA, 18 nt, Homo sapiens
ccacaggcccuuuccuca

SEQ ID NO: 1411329 - RNA, 23 nt, Homo sapiens
ccacaucugccuuaaaaccaaag

SEQ ID NO: 1411330 - RNA, 11 nt, Homo sapiens
ccaccagugaa

SEQ ID NO: 1411331 - RNA, 24 nt, Homo sapiens
ccaccucaagugccuuauucucac

SEQ ID NO: 1411332 - RNA, 14 nt, Homo sapiens
ccacgaggugaaaa

SEQ ID NO: 1411333 - RNA, 21 nt, Homo sapiens
ccacuucccgccuccaugacu

SEQ ID NO: 1411334 - RNA, 21 nt, Homo sapiens
ccagauucuucgcacaguguc

SEQ ID NO: 1411335 - RNA, 15 nt, Homo sapiens
ccagauuuaugcaua

SEQ ID NO: 1411336 - RNA, 21 nt, Homo sapiens
ccagcauuuugagaggcugag

SEQ ID NO: 1411337 - RNA, 22 nt, Homo sapiens
ccagccaccccgcagucacuuu

SEQ ID NO: 1411338 - RNA, 16 nt, Homo sapiens
ccagccccgugccagg

SEQ ID NO: 1411339 - RNA, 14 nt, Homo sapiens
ccagccugggagau

SEQ ID NO: 1411340 - RNA, 13 nt, Homo sapiens
ccagcuaguuccu

SEQ ID NO: 1411341 - RNA, 16 nt, Homo sapiens
ccaggaguucugcuca

SEQ ID NO: 1411342 - RNA, 11 nt, Homo sapiens
ccaggauuuug

SEQ ID NO: 1411343 - RNA, 17 nt, Homo sapiens
ccaggcuggaguacaau

SEQ ID NO: 1411344 - RNA, 12 nt, Homo sapiens
ccaggguuguua

SEQ ID NO: 1411345 - RNA, 19 nt, Homo sapiens
ccauacagugacaauacaa

SEQ ID NO: 1411346 - RNA, 21 nt, Homo sapiens
ccauccagaggccauguucca

SEQ ID NO: 1411347 - RNA, 16 nt, Homo sapiens
ccaucccaaggcuccu

SEQ ID NO: 1411348 - RNA, 16 nt, Homo sapiens
ccaucgguagcuugaa

SEQ ID NO: 1411349 - RNA, 19 nt, Homo sapiens
ccaugauugaaaucaaaua

SEQ ID NO: 1411350 - RNA, 23 nt, Homo sapiens
ccaugcuuccuauacaguucuau

SEQ ID NO: 1411351 - RNA, 15 nt, Homo sapiens
ccauggggacugggu

SEQ ID NO: 1411352 - RNA, 19 nt, Homo sapiens
ccauuauaaacauguuuua

SEQ ID NO: 1411353 - RNA, 17 nt, Homo sapiens
ccauucacccuguguaa

SEQ ID NO: 1411354 - RNA, 18 nt, Homo sapiens
cccaaggccccacucucg

SEQ ID NO: 1411355 - RNA, 17 nt, Homo sapiens
cccaaguucaagugauu

SEQ ID NO: 1411356 - RNA, 19 nt, Homo sapiens
cccacggcucaacuccucc

SEQ ID NO: 1411357 - RNA, 14 nt, Homo sapiens
cccagaaugacccc

SEQ ID NO: 1411358 - RNA, 15 nt, Homo sapiens
cccagacuccaggcc

SEQ ID NO: 1411359 - RNA, 15 nt, Homo sapiens
cccagagcagggugu

SEQ ID NO: 1411360 - RNA, 18 nt, Homo sapiens
cugguucucucucuuagc

SEQ ID NO: 1411361 - RNA, 18 nt, Homo sapiens
cuguaagcaacacuuuaa

SEQ ID NO: 1411362 - RNA, 12 nt, Homo sapiens
cuguaauaaaua

SEQ ID NO: 1411363 - RNA, 21 nt, Homo sapiens
cuguaaucccagcacuuuggg

SEQ ID NO: 1411364 - RNA, 17 nt, Homo sapiens
cuguaauuauuguguau

SEQ ID NO: 1411365 - RNA, 13 nt, Homo sapiens
cugucacacaggg

SEQ ID NO: 1411366 - RNA, 16 nt, Homo sapiens
cugucugccagcauau

SEQ ID NO: 1411367 - RNA, 15 nt, Homo sapiens
cugugcagucacugg

SEQ ID NO: 1411368 - RNA, 22 nt, Homo sapiens
cuguucugagccaaauucuaaa

SEQ ID NO: 1411369 - RNA, 12 nt, Homo sapiens
cuuaaacugcca

SEQ ID NO: 1411370 - RNA, 14 nt, Homo sapiens
cuuaaacugccaau

SEQ ID NO: 1411371 - RNA, 14 nt, Homo sapiens
cuuaacgugucuga

SEQ ID NO: 1411372 - RNA, 20 nt, Homo sapiens
cuuacagaaaauauagccau

SEQ ID NO: 1411373 - RNA, 19 nt, Homo sapiens
cuuacagaauggaucaugu

SEQ ID NO: 1411374 - RNA, 14 nt, Homo sapiens
cuuacuagggguca

SEQ ID NO: 1411375 - RNA, 22 nt, Homo sapiens
cuuagagccaggcacacacugu

SEQ ID NO: 1411376 - RNA, 19 nt, Homo sapiens
cuuagagugcugugagaug

SEQ ID NO: 1411377 - RNA, 21 nt, Homo sapiens
cuuaugguuuuaaugcaauga

SEQ ID NO: 1411378 - RNA, 23 nt, Homo sapiens
cuuauguaugacuuugugccauc

SEQ ID NO: 1411379 - RNA, 12 nt, Homo sapiens
cuucaccaaaga

SEQ ID NO: 1411380 - RNA, 18 nt, Homo sapiens
cuucagaacaaucugagu

SEQ ID NO: 1411381 - RNA, 14 nt, Homo sapiens
cuucagauguucuc

SEQ ID NO: 1411382 - RNA, 21 nt, Homo sapiens
cuucagauuaaugacuggcua

SEQ ID NO: 1411383 - RNA, 21 nt, Homo sapiens
cuucagguuuuaucaguagaa

SEQ ID NO: 1411384 - RNA, 22 nt, Homo sapiens
cuuccaauccuuaaacugccaa

SEQ ID NO: 1411385 - RNA, 21 nt, Homo sapiens
cuuccccagagauggcuccuu

SEQ ID NO: 1411386 - RNA, 22 nt, Homo sapiens
cuuccuaggcauuacccaaaag

SEQ ID NO: 1411387 - RNA, 18 nt, Homo sapiens
cuuccucaucaugaaaac

SEQ ID NO: 1411388 - RNA, 16 nt, Homo sapiens
cuuccucuagaagcca

SEQ ID NO: 1411389 - RNA, 16 nt, Homo sapiens
cuuccucucccauuca

SEQ ID NO: 1411390 - RNA, 12 nt, Homo sapiens
cuucgauguacu

SEQ ID NO: 1411391 - RNA, 13 nt, Homo sapiens
cuucucuccagag

SEQ ID NO: 1411392 - RNA, 13 nt, Homo sapiens
cuucucucugagc

SEQ ID NO: 1411393 - RNA, 13 nt, Homo sapiens
cuucuuagcucau

SEQ ID NO: 1411394 - RNA, 18 nt, Homo sapiens
cuugaaaauuaacaugaa

SEQ ID NO: 1411395 - RNA, 17 nt, Homo sapiens
cuugaacaaagucucug

SEQ ID NO: 1411396 - RNA, 15 nt, Homo sapiens
cuugaacugcugcca

SEQ ID NO: 1411397 - RNA, 12 nt, Homo sapiens
cuugaagccaaa

SEQ ID NO: 1411398 - RNA, 20 nt, Homo sapiens
cuugacaauuucuuuuucca

SEQ ID NO: 1411399 - RNA, 17 nt, Homo sapiens
cuugacauuuaaacuca

SEQ ID NO: 1411400 - RNA, 17 nt, Homo sapiens
cuugaguuuucauuuca

SEQ ID NO: 1411401 - RNA, 22 nt, Homo sapiens
cuugauuuuccuaauggucuca

SEQ ID NO: 1411402 - RNA, 14 nt, Homo sapiens
cuugcacuguauca

SEQ ID NO: 1411403 - RNA, 14 nt, Homo sapiens
cuugccaaccugua

SEQ ID NO: 1411404 - RNA, 16 nt, Homo sapiens
cuugcucucucucacc

SEQ ID NO: 1411405 - RNA, 14 nt, Homo sapiens
cuugggcaauaaag

SEQ ID NO: 1411406 - RNA, 16 nt, Homo sapiens
cuugucucuguagaag

SEQ ID NO: 1411407 - RNA, 15 nt, Homo sapiens
cuugucuguuagcca

SEQ ID NO: 1411408 - RNA, 18 nt, Homo sapiens
cuugugacuagugcugaa

SEQ ID NO: 1411409 - RNA, 18 nt, Homo sapiens
cuuuaauuuuacauuucc

SEQ ID NO: 1411410 - RNA, 22 nt, Homo sapiens
cuuuaauuuuacauuuccuaaa

SEQ ID NO: 1411411 - RNA, 21 nt, Homo sapiens
cuuuaccauucagaccgagag

SEQ ID NO: 1411412 - RNA, 21 nt, Homo sapiens
cuuuagauuaggucacauuac

SEQ ID NO: 1411413 - RNA, 19 nt, Homo sapiens
cuuuaguuucagagugugg

SEQ ID NO: 1411414 - RNA, 21 nt, Homo sapiens
cuuucccacgucacuugacaa

SEQ ID NO: 1411415 - RNA, 16 nt, Homo sapiens
cuuugguguaaucucu

SEQ ID NO: 1411416 - RNA, 19 nt, Homo sapiens
cuuuuagaugaucuaagaa

SEQ ID NO: 1411417 - RNA, 18 nt, Homo sapiens
cuuuuauaccaucaugag

SEQ ID NO: 1411418 - RNA, 13 nt, Homo sapiens
cuuuuaugauacu

SEQ ID NO: 1411419 - RNA, 20 nt, Homo sapiens
cuuuucuuuggucaaaguuu

SEQ ID NO: 1411420 - RNA, 22 nt, Homo sapiens
cuuuugagagcucuucagagau

SEQ ID NO: 1411421 - RNA, 13 nt, Homo sapiens
cuuuugcuugucc

SEQ ID NO: 1411422 - RNA, 13 nt, Homo sapiens
cuuuugugccaug

SEQ ID NO: 1411423 - RNA, 15 nt, Homo sapiens
cuuuuucauucccug

SEQ ID NO: 1411424 - RNA, 15 nt, Homo sapiens
cuuuuuguaucucau

SEQ ID NO: 1411425 - RNA, 19 nt, Homo sapiens
gaaaagcagcccuuggcca

SEQ ID NO: 1411426 - RNA, 19 nt, Homo sapiens
gaaaagcuaccaucacuuc

SEQ ID NO: 1411427 - RNA, 18 nt, Homo sapiens
gaaaagggcagaggcaag

SEQ ID NO: 1411428 - RNA, 18 nt, Homo sapiens
gaaaauaccuuagcuuca

SEQ ID NO: 1411429 - RNA, 16 nt, Homo sapiens
gaaaaucacugugcug

SEQ ID NO: 1411430 - RNA, 14 nt, Homo sapiens
gaaacagaaccaua

SEQ ID NO: 1411431 - RNA, 16 nt, Homo sapiens
gaaacaucugauuuga

SEQ ID NO: 1411432 - RNA, 14 nt, Homo sapiens
gaaacuaaucauaa

SEQ ID NO: 1411433 - RNA, 18 nt, Homo sapiens
gaaagaaagcaccuguuu

SEQ ID NO: 1411434 - RNA, 22 nt, Homo sapiens
gaaagauuuuaugugcuugaag

SEQ ID NO: 1411435 - RNA, 10 nt, Homo sapiens
gaaagccagg

SEQ ID NO: 1411436 - RNA, 14 nt, Homo sapiens
gaaaugucugccau

SEQ ID NO: 1411437 - RNA, 15 nt, Homo sapiens
gaacaacaacaaaau

SEQ ID NO: 1411438 - RNA, 22 nt, Homo sapiens
gaacacaagugccccuggccaa

SEQ ID NO: 1411439 - RNA, 14 nt, Homo sapiens
gaacagacacuuua

SEQ ID NO: 1411440 - RNA, 15 nt, Homo sapiens
gaacagcaugcugcu

SEQ ID NO: 1411441 - RNA, 16 nt, Homo sapiens
gaacauuccuaucaau

SEQ ID NO: 1411442 - RNA, 15 nt, Homo sapiens
gaaccccugucacac

SEQ ID NO: 1411443 - RNA, 20 nt, Homo sapiens
gaaccuaaauugaacugcca

SEQ ID NO: 1411444 - RNA, 16 nt, Homo sapiens
gaaccucacucuugcc

SEQ ID NO: 1411445 - RNA, 20 nt, Homo sapiens
gaacuaauuucaagauuuua

SEQ ID NO: 1411446 - RNA, 22 nt, Homo sapiens
gaacuacugaggaucagaguaa

SEQ ID NO: 1411447 - RNA, 21 nt, Homo sapiens
gaacucccgggccccaaucca

SEQ ID NO: 1411448 - RNA, 19 nt, Homo sapiens
gaacugcaggugacuuugg

SEQ ID NO: 1411449 - RNA, 16 nt, Homo sapiens
gaacugcugccaacuc

SEQ ID NO: 1411450 - RNA, 23 nt, Homo sapiens
gaacugggcuucuucagaacaau

SEQ ID NO: 1411451 - RNA, 12 nt, Homo sapiens
gaacuguggaau

SEQ ID NO: 1411452 - RNA, 19 nt, Homo sapiens
gaagcaaaaucccuuaauc

SEQ ID NO: 1411453 - RNA, 12 nt, Homo sapiens
gaagccaaagaa

SEQ ID NO: 1411454 - RNA, 14 nt, Homo sapiens
gaaggaacuaggga

SEQ ID NO: 1411455 - RNA, 17 nt, Homo sapiens
gaaggaagccccuggau

SEQ ID NO: 1411456 - RNA, 13 nt, Homo sapiens
gaagugccaucuc

SEQ ID NO: 1411457 - RNA, 15 nt, Homo sapiens
gaagugccaucucaa

SEQ ID NO: 1411458 - RNA, 18 nt, Homo sapiens
gaaguuaguuuuaguucu

SEQ ID NO: 1411459 - RNA, 11 nt, Homo sapiens
gaaguuugcau

SEQ ID NO: 1411460 - RNA, 13 nt, Homo sapiens
gaauaaagcaauu

SEQ ID NO: 1411461 - RNA, 22 nt, Homo sapiens
gaauacccugcucaacauuuaa

SEQ ID NO: 1411462 - RNA, 18 nt, Homo sapiens
gaauccccgaaggugcug

SEQ ID NO: 1411463 - RNA, 12 nt, Homo sapiens
gaauccuagggc

SEQ ID NO: 1411464 - RNA, 17 nt, Homo sapiens
gaaugaccccaucgaga

SEQ ID NO: 1411465 - RNA, 23 nt, Homo sapiens
gaaugagcuuccauuaugcugca

SEQ ID NO: 1411466 - RNA, 15 nt, Homo sapiens
gaaugcuauuuucaa

SEQ ID NO: 1411467 - RNA, 16 nt, Homo sapiens
gaauuaggaaggccau

SEQ ID NO: 1411468 - RNA, 17 nt, Homo sapiens
gaauugugucugcagga

SEQ ID NO: 1411469 - RNA, 12 nt, Homo sapiens
gacaaaugccaa

SEQ ID NO: 1411470 - RNA, 15 nt, Homo sapiens
gacaauacaaauaca

SEQ ID NO: 1411471 - RNA, 14 nt, Homo sapiens
gacagaaguauuua

SEQ ID NO: 1411472 - RNA, 16 nt, Homo sapiens
gacagucagcauuucu

SEQ ID NO: 1411473 - RNA, 15 nt, Homo sapiens
gacaucaaguguaau

SEQ ID NO: 1411474 - RNA, 13 nt, Homo sapiens
gacaucugcuuca

SEQ ID NO: 1411475 - RNA, 18 nt, Homo sapiens
gaccaccaacacacagga

SEQ ID NO: 1411476 - RNA, 11 nt, Homo sapiens
gaccacuuaau

SEQ ID NO: 1411477 - RNA, 16 nt, Homo sapiens
gaccagccuccuggga

SEQ ID NO: 1411478 - RNA, 19 nt, Homo sapiens
gaccccgagaccgcgcugg

SEQ ID NO: 1411479 - RNA, 20 nt, Homo sapiens
gaccccuccucacuggccau

SEQ ID NO: 1411480 - RNA, 18 nt, Homo sapiens
gacccucucaagugcccu

SEQ ID NO: 1411481 - RNA, 23 nt, Homo sapiens
gaccuccccagccccuagcccag

SEQ ID NO: 1411482 - RNA, 17 nt, Homo sapiens
gaccucugagaccaaaa

SEQ ID NO: 1411483 - RNA, 12 nt, Homo sapiens
gacuagaucaca

SEQ ID NO: 1411484 - RNA, 19 nt, Homo sapiens
gacuauacugcugaguucu

SEQ ID NO: 1411485 - RNA, 18 nt, Homo sapiens
gacuauuuauaacuaaua

SEQ ID NO: 1411486 - RNA, 18 nt, Homo sapiens
gacucaagauucccagga

SEQ ID NO: 1411487 - RNA, 15 nt, Homo sapiens
gacucuccacuguua

SEQ ID NO: 1411488 - RNA, 11 nt, Homo sapiens
gacugcaauga

SEQ ID NO: 1411489 - RNA, 12 nt, Homo sapiens
gacugcaaugag

SEQ ID NO: 1411490 - RNA, 20 nt, Homo sapiens
gacuggcuacagaguaacaa

SEQ ID NO: 1411491 - RNA, 13 nt, Homo sapiens
gacuuugugccau

SEQ ID NO: 1411492 - RNA, 15 nt, Homo sapiens
gagaacaacuggcag

SEQ ID NO: 1411493 - RNA, 23 nt, Homo sapiens
gagacacaaguggccuuaagucu

SEQ ID NO: 1411494 - RNA, 21 nt, Homo sapiens
caaguaguauucauguuguua

SEQ ID NO: 1411495 - RNA, 22 nt, Homo sapiens
caaguauuccuaugccagagca

SEQ ID NO: 1411496 - RNA, 15 nt, Homo sapiens
caagucaccaugccu

SEQ ID NO: 1411497 - RNA, 16 nt, Homo sapiens
caagucaccaugccug

SEQ ID NO: 1411498 - RNA, 11 nt, Homo sapiens
caagugacaag

SEQ ID NO: 1411499 - RNA, 18 nt, Homo sapiens
caagugccuuauucucac

SEQ ID NO: 1411500 - RNA, 23 nt, Homo sapiens
caagugguuaagaauguauauca

SEQ ID NO: 1411501 - RNA, 13 nt, Homo sapiens
caagugguuucca

SEQ ID NO: 1411502 - RNA, 19 nt, Homo sapiens
caaguugacaaaugccaaa

SEQ ID NO: 1411503 - RNA, 14 nt, Homo sapiens
caaguuucauacca

SEQ ID NO: 1411504 - RNA, 14 nt, Homo sapiens
caauagguauuucu

SEQ ID NO: 1411505 - RNA, 16 nt, Homo sapiens
caaucaugcuguguaa

SEQ ID NO: 1411506 - RNA, 15 nt, Homo sapiens
caaucaugugccaga

SEQ ID NO: 1411507 - RNA, 12 nt, Homo sapiens
caauccaucaaa

SEQ ID NO: 1411508 - RNA, 20 nt, Homo sapiens
caaugagccacagcaaaaag

SEQ ID NO: 1411509 - RNA, 17 nt, Homo sapiens
caauggcgugaucucag

SEQ ID NO: 1411510 - RNA, 21 nt, Homo sapiens
caauugugcuuuguaucaguc

SEQ ID NO: 1411511 - RNA, 22 nt, Homo sapiens
caauuugauguaguucuuuuca

SEQ ID NO: 1411512 - RNA, 19 nt, Homo sapiens
cacaauuuucugugccaaa

SEQ ID NO: 1411513 - RNA, 12 nt, Homo sapiens
cacacacugugc

SEQ ID NO: 1411514 - RNA, 19 nt, Homo sapiens
cacacccgcuccaccugca

SEQ ID NO: 1411515 - RNA, 14 nt, Homo sapiens
cacagaccucuccc

SEQ ID NO: 1411516 - RNA, 18 nt, Homo sapiens
cacaggaaacuacuucac

SEQ ID NO: 1411517 - RNA, 18 nt, Homo sapiens
cacauaucuagauuuuuc

SEQ ID NO: 1411518 - RNA, 14 nt, Homo sapiens
cacaucuggcucaa

SEQ ID NO: 1411519 - RNA, 17 nt, Homo sapiens
cacaugucauugcccac

SEQ ID NO: 1411520 - RNA, 17 nt, Homo sapiens
caccaugacaccugcca

SEQ ID NO: 1411521 - RNA, 21 nt, Homo sapiens
caccccggggacccugugaca

SEQ ID NO: 1411522 - RNA, 14 nt, Homo sapiens
caccgugugccaua

SEQ ID NO: 1411523 - RNA, 15 nt, Homo sapiens
caccgugugccauag

SEQ ID NO: 1411524 - RNA, 16 nt, Homo sapiens
caccuccccacuccag

SEQ ID NO: 1411525 - RNA, 19 nt, Homo sapiens
caccucguauuucaccucu

SEQ ID NO: 1411526 - RNA, 16 nt, Homo sapiens
caccucuacauuugaa

SEQ ID NO: 1411527 - RNA, 16 nt, Homo sapiens
caccugacugcaauga

SEQ ID NO: 1411528 - RNA, 21 nt, Homo sapiens
caccuggcccuagugacaggu

SEQ ID NO: 1411529 - RNA, 16 nt, Homo sapiens
caccugggaagccugg

SEQ ID NO: 1411530 - RNA, 14 nt, Homo sapiens
cacguggagccuag

SEQ ID NO: 1411531 - RNA, 21 nt, Homo sapiens
cacucagcuggacugcauuga

SEQ ID NO: 1411532 - RNA, 14 nt, Homo sapiens
cacucaucacuaaa

SEQ ID NO: 1411533 - RNA, 15 nt, Homo sapiens
cacucuacaggucca

SEQ ID NO: 1411534 - RNA, 22 nt, Homo sapiens
cacucugguuguuuaugcaaga

SEQ ID NO: 1411535 - RNA, 19 nt, Homo sapiens
cacucuugccaaccuguaa

SEQ ID NO: 1411536 - RNA, 18 nt, Homo sapiens
cacucuuuaagugaagga

SEQ ID NO: 1411537 - RNA, 21 nt, Homo sapiens
cacugcagucugggccccauc

SEQ ID NO: 1411538 - RNA, 19 nt, Homo sapiens
cacugccaggccagccucc

SEQ ID NO: 1411539 - RNA, 19 nt, Homo sapiens
cacuggagguugaagccaa

SEQ ID NO: 1411540 - RNA, 14 nt, Homo sapiens
cacuugaugccacc

SEQ ID NO: 1411541 - RNA, 16 nt, Homo sapiens
cagaacagacacuuua

SEQ ID NO: 1411542 - RNA, 17 nt, Homo sapiens
cagaacagugagccaaa

SEQ ID NO: 1411543 - RNA, 18 nt, Homo sapiens
cagaaccauaaagcauau

SEQ ID NO: 1411544 - RNA, 21 nt, Homo sapiens
cagaaggggauggacuucauu

SEQ ID NO: 1411545 - RNA, 17 nt, Homo sapiens
cagaauugugucugcag

SEQ ID NO: 1411546 - RNA, 14 nt, Homo sapiens
cagagauggcuccu

SEQ ID NO: 1411547 - RNA, 13 nt, Homo sapiens
cagagcagggugu

SEQ ID NO: 1411548 - RNA, 18 nt, Homo sapiens
cagagcagugccaacucu

SEQ ID NO: 1411549 - RNA, 23 nt, Homo sapiens
cagagcuggcagcaauggaugaa

SEQ ID NO: 1411550 - RNA, 19 nt, Homo sapiens
cagaggccaggaugccuga

SEQ ID NO: 1411551 - RNA, 20 nt, Homo sapiens
cagauaaagguucaugcaaa

SEQ ID NO: 1411552 - RNA, 20 nt, Homo sapiens
cagaugccagcgccaugcuu

SEQ ID NO: 1411553 - RNA, 14 nt, Homo sapiens
cagcagcacucacc

SEQ ID NO: 1411554 - RNA, 22 nt, Homo sapiens
cagcauaauacuugcuuuggaa

SEQ ID NO: 1411555 - RNA, 12 nt, Homo sapiens
cagcauaugcag

SEQ ID NO: 1411556 - RNA, 21 nt, Homo sapiens
cagcaucugaagacucaggca

SEQ ID NO: 1411557 - RNA, 13 nt, Homo sapiens
cagcaugcugcug

SEQ ID NO: 1411558 - RNA, 22 nt, Homo sapiens
cagccaacuauggccuguggau

SEQ ID NO: 1411559 - RNA, 12 nt, Homo sapiens
cagccaggcuau

SEQ ID NO: 1411560 - RNA, 13 nt, Homo sapiens
cagcccagggugg

SEQ ID NO: 1411561 - RNA, 18 nt, Homo sapiens
cagccuccccgugccaaa

SEQ ID NO: 1411562 - RNA, 14 nt, Homo sapiens
cagcuagacuccca

SEQ ID NO: 1411563 - RNA, 15 nt, Homo sapiens
cagcuagacucccau

SEQ ID NO: 1411564 - RNA, 14 nt, Homo sapiens
cagcucaucugcca

SEQ ID NO: 1411565 - RNA, 20 nt, Homo sapiens
cagcucccagccucuuccca

SEQ ID NO: 1411566 - RNA, 18 nt, Homo sapiens
cagcugcuucucccacuu

SEQ ID NO: 1411567 - RNA, 16 nt, Homo sapiens
cagcuggacugcauug

SEQ ID NO: 1411568 - RNA, 20 nt, Homo sapiens
cagcuggucuucagcaaaaa

SEQ ID NO: 1411569 - RNA, 21 nt, Homo sapiens
cagcugguggccgugcugguc

SEQ ID NO: 1411570 - RNA, 15 nt, Homo sapiens
caggaaaugugcaca

SEQ ID NO: 1411571 - RNA, 20 nt, Homo sapiens
caggagaauuaggaaggcca

SEQ ID NO: 1411572 - RNA, 23 nt, Homo sapiens
caggcaaauguaaagucuagaaa

SEQ ID NO: 1411573 - RNA, 19 nt, Homo sapiens
caggcacaaaaugugacau

SEQ ID NO: 1411574 - RNA, 15 nt, Homo sapiens
caggcacacacugug

SEQ ID NO: 1411575 - RNA, 17 nt, Homo sapiens
caggcauagaggcuucu

SEQ ID NO: 1411576 - RNA, 20 nt, Homo sapiens
caggcuggaguacaauggcg

SEQ ID NO: 1411577 - RNA, 19 nt, Homo sapiens
cagggaggaagaagcuuag

SEQ ID NO: 1411578 - RNA, 17 nt, Homo sapiens
cagggccaggacugagc

SEQ ID NO: 1411579 - RNA, 16 nt, Homo sapiens
cagggcccucuggggc

SEQ ID NO: 1411580 - RNA, 18 nt, Homo sapiens
caggugaggaauuugaag

SEQ ID NO: 1411581 - RNA, 16 nt, Homo sapiens
cagguuaugcuuugag

SEQ ID NO: 1411582 - RNA, 19 nt, Homo sapiens
cagguucaagcgauucuca

SEQ ID NO: 1411583 - RNA, 20 nt, Homo sapiens
cagguucaagcgauucucau

SEQ ID NO: 1411584 - RNA, 17 nt, Homo sapiens
caguaacuuguuuacau

SEQ ID NO: 1411585 - RNA, 22 nt, Homo sapiens
caguaguauaauguaugaauuu

SEQ ID NO: 1411586 - RNA, 18 nt, Homo sapiens
cagucugggccccaucau

SEQ ID NO: 1411587 - RNA, 13 nt, Homo sapiens
cagugacaauaca

SEQ ID NO: 1411588 - RNA, 19 nt, Homo sapiens
cagugagcugagaucacac

SEQ ID NO: 1411589 - RNA, 20 nt, Homo sapiens
cagugaggaauuaaucuugc

SEQ ID NO: 1411590 - RNA, 15 nt, Homo sapiens
caguguccagacuuu

SEQ ID NO: 1411591 - RNA, 19 nt, Homo sapiens
caguguuuaagucagcaaa

SEQ ID NO: 1411592 - RNA, 22 nt, Homo sapiens
caguguuuaagucagcaaaucu

SEQ ID NO: 1411593 - RNA, 17 nt, Homo sapiens
caguuucugagucuggg

SEQ ID NO: 1411594 - RNA, 13 nt, Homo sapiens
cauaaaugaccua

SEQ ID NO: 1411595 - RNA, 13 nt, Homo sapiens
cauacaacaaaga

SEQ ID NO: 1411596 - RNA, 17 nt, Homo sapiens
cauacuguugaugucua

SEQ ID NO: 1411597 - RNA, 13 nt, Homo sapiens
cauagaggcuucu

SEQ ID NO: 1411598 - RNA, 13 nt, Homo sapiens
cauagcauuugug

SEQ ID NO: 1411599 - RNA, 22 nt, Homo sapiens
cauaucuagauuuuucugugaa

SEQ ID NO: 1411600 - RNA, 12 nt, Homo sapiens
cauaucuaguca

SEQ ID NO: 1411601 - RNA, 18 nt, Homo sapiens
cauauucgauguacuuua

SEQ ID NO: 1411602 - RNA, 21 nt, Homo sapiens
caucaaguguaauuagcuuuu

SEQ ID NO: 1411603 - RNA, 11 nt, Homo sapiens
caucaccugcg

SEQ ID NO: 1411604 - RNA, 14 nt, Homo sapiens
caucacucuaggaa

SEQ ID NO: 1411605 - RNA, 14 nt, Homo sapiens
caucagaaacaucu

SEQ ID NO: 1411606 - RNA, 16 nt, Homo sapiens
caucagacaauugcau

SEQ ID NO: 1411607 - RNA, 21 nt, Homo sapiens
cauccuugaccucauuuacaa

SEQ ID NO: 1411608 - RNA, 17 nt, Homo sapiens
caucgagaugaaauuaa

SEQ ID NO: 1411609 - RNA, 17 nt, Homo sapiens
caucuagcaagcacuug

SEQ ID NO: 1411610 - RNA, 19 nt, Homo sapiens
caucuagcaagcacuugau

SEQ ID NO: 1411611 - RNA, 15 nt, Homo sapiens
caucuggauuucauc

SEQ ID NO: 1411612 - RNA, 10 nt, Homo sapiens
caucuuccag

SEQ ID NO: 1411613 - RNA, 12 nt, Homo sapiens
caugaaaacugg

SEQ ID NO: 1411614 - RNA, 13 nt, Homo sapiens
caugaaaacuggg

SEQ ID NO: 1411615 - RNA, 23 nt, Homo sapiens
caugaauauuuaguguucauaaa

SEQ ID NO: 1411616 - RNA, 15 nt, Homo sapiens
caugacaccugccau

SEQ ID NO: 1411617 - RNA, 15 nt, Homo sapiens
caugagcuugccuaa

SEQ ID NO: 1411618 - RNA, 17 nt, Homo sapiens
caugcuguguaauauca

SEQ ID NO: 1411619 - RNA, 16 nt, Homo sapiens
cauggcuuugugcugc

SEQ ID NO: 1411620 - RNA, 18 nt, Homo sapiens
caugggagugaucucacc

SEQ ID NO: 1411621 - RNA, 23 nt, Homo sapiens
cauguaaauauuuuguuaucuga

SEQ ID NO: 1411622 - RNA, 19 nt, Homo sapiens
caugugaaacucaucucau

SEQ ID NO: 1411623 - RNA, 15 nt, Homo sapiens
cauguuaugccuguu

SEQ ID NO: 1411624 - RNA, 20 nt, Homo sapiens
cauguucaaagugugacauu

SEQ ID NO: 1411625 - RNA, 18 nt, Homo sapiens
cauguugugauguacaca

SEQ ID NO: 1411626 - RNA, 16 nt, Homo sapiens
cauuaaagugcacugu

SEQ ID NO: 1411627 - RNA, 20 nt, Homo sapiens
cauuaaagugcacugugucc

SEQ ID NO: 1411628 - RNA, 13 nt, Homo sapiens
cauuaacauuuag

SEQ ID NO: 1411629 - RNA, 23 nt, Homo sapiens
ccugcauuugugucauugacaaa

SEQ ID NO: 1411630 - RNA, 15 nt, Homo sapiens
ccugccuccccggaa

SEQ ID NO: 1411631 - RNA, 20 nt, Homo sapiens
ccugcuagcaccuccccaga

SEQ ID NO: 1411632 - RNA, 23 nt, Homo sapiens
ccugcugcaggggcucuggagag

SEQ ID NO: 1411633 - RNA, 14 nt, Homo sapiens
ccugcugcaugacc

SEQ ID NO: 1411634 - RNA, 12 nt, Homo sapiens
ccugcugugauu

SEQ ID NO: 1411635 - RNA, 22 nt, Homo sapiens
ccuggacgcagccacacagugg

SEQ ID NO: 1411636 - RNA, 16 nt, Homo sapiens
ccuguaagcccagcau

SEQ ID NO: 1411637 - RNA, 20 nt, Homo sapiens
aguccaggaccccugcagcu

SEQ ID NO: 1411638 - RNA, 21 nt, Homo sapiens
aguccgugggcuggcaguuug

SEQ ID NO: 1411639 - RNA, 16 nt, Homo sapiens
aguccugagugggugu

SEQ ID NO: 1411640 - RNA, 23 nt, Homo sapiens
agucucugaacuaggugaucuca

SEQ ID NO: 1411641 - RNA, 21 nt, Homo sapiens
agucugggccccaucauuaaa

SEQ ID NO: 1411642 - RNA, 20 nt, Homo sapiens
agugagggccugaggucugg

SEQ ID NO: 1411643 - RNA, 21 nt, Homo sapiens
agugauucuccugccucagcc

SEQ ID NO: 1411644 - RNA, 13 nt, Homo sapiens
agugccaucucaa

SEQ ID NO: 1411645 - RNA, 15 nt, Homo sapiens
agugccuuauucuca

SEQ ID NO: 1411646 - RNA, 21 nt, Homo sapiens
aguggaaucaaguucuugucu

SEQ ID NO: 1411647 - RNA, 16 nt, Homo sapiens
aguggcaccugggaag

SEQ ID NO: 1411648 - RNA, 14 nt, Homo sapiens
aguggcucaaugca

SEQ ID NO: 1411649 - RNA, 17 nt, Homo sapiens
agugggcugacaucaag

SEQ ID NO: 1411650 - RNA, 20 nt, Homo sapiens
aguguaacggccaacacuuu

SEQ ID NO: 1411651 - RNA, 18 nt, Homo sapiens
agugucaaauaaacacug

SEQ ID NO: 1411652 - RNA, 13 nt, Homo sapiens
agugucaucucaa

SEQ ID NO: 1411653 - RNA, 14 nt, Homo sapiens
aguguguauccaga

SEQ ID NO: 1411654 - RNA, 18 nt, Homo sapiens
aguguguauccagaagaa

SEQ ID NO: 1411655 - RNA, 14 nt, Homo sapiens
aguguuagaggugg

SEQ ID NO: 1411656 - RNA, 22 nt, Homo sapiens
aguguucaaauaaacugaagga

SEQ ID NO: 1411657 - RNA, 14 nt, Homo sapiens
aguuaagcaugacu

SEQ ID NO: 1411658 - RNA, 12 nt, Homo sapiens
aguuagccaaac

SEQ ID NO: 1411659 - RNA, 13 nt, Homo sapiens
aguuagccaaaca

SEQ ID NO: 1411660 - RNA, 14 nt, Homo sapiens
aguuauacuccuca

SEQ ID NO: 1411661 - RNA, 20 nt, Homo sapiens
aguucuaugcagaacaguga

SEQ ID NO: 1411662 - RNA, 13 nt, Homo sapiens
aguucucacucug

SEQ ID NO: 1411663 - RNA, 14 nt, Homo sapiens
aguucucacucugg

SEQ ID NO: 1411664 - RNA, 17 nt, Homo sapiens
aguuggcuaggggagca

SEQ ID NO: 1411665 - RNA, 22 nt, Homo sapiens
aguugggggccagcacagcuga

SEQ ID NO: 1411666 - RNA, 13 nt, Homo sapiens
aguuucaaaaacu

SEQ ID NO: 1411667 - RNA, 16 nt, Homo sapiens
aguuucauaccaaaua

SEQ ID NO: 1411668 - RNA, 13 nt, Homo sapiens
aguuugcugccau

SEQ ID NO: 1411669 - RNA, 17 nt, Homo sapiens
aguuuuaguucuguaga

SEQ ID NO: 1411670 - RNA, 18 nt, Homo sapiens
aguuuucuauucuuggag

SEQ ID NO: 1411671 - RNA, 17 nt, Homo sapiens
aguuuuuauuaaacuca

SEQ ID NO: 1411672 - RNA, 21 nt, Homo sapiens
aguuuuuauuaaacucauggg

SEQ ID NO: 1411673 - RNA, 18 nt, Homo sapiens
auaaagcuucucucugag

SEQ ID NO: 1411674 - RNA, 19 nt, Homo sapiens
auaaagcuucucucugagc

SEQ ID NO: 1411675 - RNA, 14 nt, Homo sapiens
auaaaggcaccucc

SEQ ID NO: 1411676 - RNA, 15 nt, Homo sapiens
auaagccacauaucu

SEQ ID NO: 1411677 - RNA, 15 nt, Homo sapiens
auaaggagugccuga

SEQ ID NO: 1411678 - RNA, 20 nt, Homo sapiens
auaaggcuguuaacauuaca

SEQ ID NO: 1411679 - RNA, 18 nt, Homo sapiens
auaauagcguucagcagc

SEQ ID NO: 1411680 - RNA, 15 nt, Homo sapiens
auaauguucugggaa

SEQ ID NO: 1411681 - RNA, 13 nt, Homo sapiens
auacacacacaca

SEQ ID NO: 1411682 - RNA, 17 nt, Homo sapiens
auacaguucuaugcaga

SEQ ID NO: 1411683 - RNA, 13 nt, Homo sapiens
auaccccuaacau

SEQ ID NO: 1411684 - RNA, 12 nt, Homo sapiens
auaccuacugaa

SEQ ID NO: 1411685 - RNA, 20 nt, Homo sapiens
auaccuagauuccauacagu

SEQ ID NO: 1411686 - RNA, 12 nt, Homo sapiens
auagaauggcac

SEQ ID NO: 1411687 - RNA, 14 nt, Homo sapiens
auagaggcuagcuu

SEQ ID NO: 1411688 - RNA, 21 nt, Homo sapiens
auaguaaugagugaguucuca

SEQ ID NO: 1411689 - RNA, 22 nt, Homo sapiens
auaguggacauuguuggcagca

SEQ ID NO: 1411690 - RNA, 21 nt, Homo sapiens
auauuauacacaucuggcuca

SEQ ID NO: 1411691 - RNA, 16 nt, Homo sapiens
auauuuaguguucaua

SEQ ID NO: 1411692 - RNA, 23 nt, Homo sapiens
aucaaaucugguauugaacugca

SEQ ID NO: 1411693 - RNA, 21 nt, Homo sapiens
aucacuugaauccuagggccu

SEQ ID NO: 1411694 - RNA, 11 nt, Homo sapiens
aucacuugagg

SEQ ID NO: 1411695 - RNA, 12 nt, Homo sapiens
aucagacuauga

SEQ ID NO: 1411696 - RNA, 17 nt, Homo sapiens
aucaugcuguguaauau

SEQ ID NO: 1411697 - RNA, 15 nt, Homo sapiens
aucauuucauauaaa

SEQ ID NO: 1411698 - RNA, 15 nt, Homo sapiens
auccagcugggcuag

SEQ ID NO: 1411699 - RNA, 18 nt, Homo sapiens
aucccucgugguccccaa

SEQ ID NO: 1411700 - RNA, 16 nt, Homo sapiens
aucccugccuggucac

SEQ ID NO: 1411701 - RNA, 20 nt, Homo sapiens
aucccuuaaucuaugugcac

SEQ ID NO: 1411702 - RNA, 22 nt, Homo sapiens
auccuacaguuggaaauccauc

SEQ ID NO: 1411703 - RNA, 15 nt, Homo sapiens
auccugcuagcaccu

SEQ ID NO: 1411704 - RNA, 14 nt, Homo sapiens
auccuugaccucau

SEQ ID NO: 1411705 - RNA, 21 nt, Homo sapiens
auccuuuugcucuguccuccc

SEQ ID NO: 1411706 - RNA, 16 nt, Homo sapiens
aucgccagcugaugac

SEQ ID NO: 1411707 - RNA, 12 nt, Homo sapiens
aucggcuuccuc

SEQ ID NO: 1411708 - RNA, 15 nt, Homo sapiens
aucuaaaaccaaaua

SEQ ID NO: 1411709 - RNA, 12 nt, Homo sapiens
aucuaccuucca

SEQ ID NO: 1411710 - RNA, 13 nt, Homo sapiens
aucuaccuuccag

SEQ ID NO: 1411711 - RNA, 20 nt, Homo sapiens
aucuauaacaaaugcuuuau

SEQ ID NO: 1411712 - RNA, 12 nt, Homo sapiens
aucucaguucuc

SEQ ID NO: 1411713 - RNA, 14 nt, Homo sapiens
aucucucaugguga

SEQ ID NO: 1411714 - RNA, 16 nt, Homo sapiens
aucucucauggugaaa

SEQ ID NO: 1411715 - RNA, 21 nt, Homo sapiens
aucugaaagcaauaagcucuu

SEQ ID NO: 1411716 - RNA, 14 nt, Homo sapiens
aucugaacugugga

SEQ ID NO: 1411717 - RNA, 17 nt, Homo sapiens
aucugaacuguggaauc

SEQ ID NO: 1411718 - RNA, 19 nt, Homo sapiens
aucuuaacuucacuuccau

SEQ ID NO: 1411719 - RNA, 14 nt, Homo sapiens
aucuugggggucac

SEQ ID NO: 1411720 - RNA, 23 nt, Homo sapiens
aucuugggggucacccauggccu

SEQ ID NO: 1411721 - RNA, 17 nt, Homo sapiens
aucuuucugaacuguaa

SEQ ID NO: 1411722 - RNA, 15 nt, Homo sapiens
aucuuugugccucaa

SEQ ID NO: 1411723 - RNA, 16 nt, Homo sapiens
augaaaguugcaggaa

SEQ ID NO: 1411724 - RNA, 16 nt, Homo sapiens
augaaggcaucagaaa

SEQ ID NO: 1411725 - RNA, 23 nt, Homo sapiens
augaaggcaucagaaacaucuga

SEQ ID NO: 1411726 - RNA, 19 nt, Homo sapiens
augaauauuuaguguucau

SEQ ID NO: 1411727 - RNA, 19 nt, Homo sapiens
augacaaacgggaccaaug

SEQ ID NO: 1411728 - RNA, 17 nt, Homo sapiens
augagcuuuacagcaga

SEQ ID NO: 1411729 - RNA, 21 nt, Homo sapiens
augagcuuuacagcagaagcu

SEQ ID NO: 1411730 - RNA, 20 nt, Homo sapiens
augagguagauuucauugaa

SEQ ID NO: 1411731 - RNA, 20 nt, Homo sapiens
augauauauuaaaccuucag

SEQ ID NO: 1411732 - RNA, 16 nt, Homo sapiens
augauuaagugcacac

SEQ ID NO: 1411733 - RNA, 19 nt, Homo sapiens
augcagugaccgcuucccc

SEQ ID NO: 1411734 - RNA, 17 nt, Homo sapiens
augccacccugcauuug

SEQ ID NO: 1411735 - RNA, 20 nt, Homo sapiens
augccacgauuuagauuuaa

SEQ ID NO: 1411736 - RNA, 16 nt, Homo sapiens
augccccggccaccuc

SEQ ID NO: 1411737 - RNA, 20 nt, Homo sapiens
augccgccccggacaguggc

SEQ ID NO: 1411738 - RNA, 22 nt, Homo sapiens
augccgccccggacaguggcac

SEQ ID NO: 1411739 - RNA, 15 nt, Homo sapiens
augcgucucuggccc

SEQ ID NO: 1411740 - RNA, 20 nt, Homo sapiens
augcgucucuggcccucgug

SEQ ID NO: 1411741 - RNA, 21 nt, Homo sapiens
augcugcugcucaaaaugcca

SEQ ID NO: 1411742 - RNA, 18 nt, Homo sapiens
augcuguaugucauuaaa

SEQ ID NO: 1411743 - RNA, 20 nt, Homo sapiens
augcuuccuauacaguucua

SEQ ID NO: 1411744 - RNA, 14 nt, Homo sapiens
augcuuuaaaaacu

SEQ ID NO: 1411745 - RNA, 17 nt, Homo sapiens
auggaccuucucuccag

SEQ ID NO: 1411746 - RNA, 16 nt, Homo sapiens
auggaugaaaguugca

SEQ ID NO: 1411747 - RNA, 14 nt, Homo sapiens
auggcacaugucau

SEQ ID NO: 1411748 - RNA, 12 nt, Homo sapiens
auggcuuugugc

SEQ ID NO: 1411749 - RNA, 22 nt, Homo sapiens
augggagugaucucaccaacuc

SEQ ID NO: 1411750 - RNA, 20 nt, Homo sapiens
auggguacuucguggccgca

SEQ ID NO: 1411751 - RNA, 17 nt, Homo sapiens
auggugaaaucugcucu

SEQ ID NO: 1411752 - RNA, 23 nt, Homo sapiens
auggugcuaagcgggcccggguc

SEQ ID NO: 1411753 - RNA, 16 nt, Homo sapiens
augguugccaccccaa

SEQ ID NO: 1411754 - RNA, 18 nt, Homo sapiens
augguuucuaucugcaau

SEQ ID NO: 1411755 - RNA, 14 nt, Homo sapiens
auguaacauacuca

SEQ ID NO: 1411756 - RNA, 15 nt, Homo sapiens
auguauaucaggguu

SEQ ID NO: 1411757 - RNA, 19 nt, Homo sapiens
auguaugacuuugugccau

SEQ ID NO: 1411758 - RNA, 16 nt, Homo sapiens
auguauuaauaccacu

SEQ ID NO: 1411759 - RNA, 17 nt, Homo sapiens
auuaauaauccuuccag

SEQ ID NO: 1411760 - RNA, 15 nt, Homo sapiens
auuacauuugaacua

SEQ ID NO: 1411761 - RNA, 15 nt, Homo sapiens
auuagaaguuaccaa

SEQ ID NO: 1411762 - RNA, 18 nt, Homo sapiens
auuagaaguuaccaaauu

SEQ ID NO: 1411763 - RNA, 23 nt, Homo sapiens
auuagggacuugugucacaucuc

SEQ ID NO: 1411764 - RNA, 23 nt, Homo sapiens
auuaucaccaugacaccugccau

SEQ ID NO: 1411765 - RNA, 21 nt, Homo sapiens
auuaugugccagauuuaugca

SEQ ID NO: 1411766 - RNA, 16 nt, Homo sapiens
auuauuuuauguugca

SEQ ID NO: 1411767 - RNA, 23 nt, Homo sapiens
auucacaaagaaacguugcgaaa

SEQ ID NO: 1411768 - RNA, 20 nt, Homo sapiens
auucaugguuuuaaagcuaa

SEQ ID NO: 1411769 - RNA, 15 nt, Homo sapiens
auuccauacagugac

SEQ ID NO: 1411770 - RNA, 22 nt, Homo sapiens
auuccauggugauuccugggaa

SEQ ID NO: 1411771 - RNA, 19 nt, Homo sapiens
auuccauuugggucagccu

SEQ ID NO: 1411772 - RNA, 16 nt, Homo sapiens
auuccucuaauguugu

SEQ ID NO: 1411773 - RNA, 16 nt, Homo sapiens
auuccuugcuuagaca

SEQ ID NO: 1411774 - RNA, 15 nt, Homo sapiens
auucuacuugcucug

SEQ ID NO: 1411775 - RNA, 17 nt, Homo sapiens
auucucagguggugaua

SEQ ID NO: 1411776 - RNA, 15 nt, Homo sapiens
auucucaugccucag

SEQ ID NO: 1411777 - RNA, 17 nt, Homo sapiens
auugaacugcaggugac

SEQ ID NO: 1411778 - RNA, 20 nt, Homo sapiens
auugaaucuaaaaccaaaua

SEQ ID NO: 1411779 - RNA, 16 nt, Homo sapiens
auugagcgccauaagc

SEQ ID NO: 1411780 - RNA, 21 nt, Homo sapiens
auugagcgucugcagaaagaa

SEQ ID NO: 1411781 - RNA, 14 nt, Homo sapiens
auugauacauucag

SEQ ID NO: 1411782 - RNA, 23 nt, Homo sapiens
auugccaccucguauuucaccuc

SEQ ID NO: 1411783 - RNA, 18 nt, Homo sapiens
auugggagcaaucuggaa

SEQ ID NO: 1411784 - RNA, 18 nt, Homo sapiens
auuguucagacauuccau

SEQ ID NO: 1411785 - RNA, 15 nt, Homo sapiens
auuguugaccuaaga

SEQ ID NO: 1411786 - RNA, 15 nt, Homo sapiens
auuguuuaagcagaa

SEQ ID NO: 1411787 - RNA, 13 nt, Homo sapiens
auuuaagcaagau

SEQ ID NO: 1411788 - RNA, 20 nt, Homo sapiens
auuuaagggaaugugagcac

SEQ ID NO: 1411789 - RNA, 23 nt, Homo sapiens
auuuaagggaaugugagcacaau

SEQ ID NO: 1411790 - RNA, 23 nt, Homo sapiens
auuuaaguuuuaagggcauuuaa

SEQ ID NO: 1411791 - RNA, 14 nt, Homo sapiens
auuuccauauucug

SEQ ID NO: 1411792 - RNA, 15 nt, Homo sapiens
auuucuacguggaug

SEQ ID NO: 1411793 - RNA, 16 nt, Homo sapiens
auuucugaaacaauua

SEQ ID NO: 1411794 - RNA, 14 nt, Homo sapiens
auuucugugccuag

SEQ ID NO: 1411795 - RNA, 18 nt, Homo sapiens
auuugcuaucugaacuaa

SEQ ID NO: 1411796 - RNA, 13 nt, Homo sapiens
auuugcugcuuaa

SEQ ID NO: 1411797 - RNA, 14 nt, Homo sapiens
auuugggucagccu

SEQ ID NO: 1411798 - RNA, 21 nt, Homo sapiens
auuuguaaaacauuccaaaua

SEQ ID NO: 1411799 - RNA, 12 nt, Homo sapiens
auuugugucauu

SEQ ID NO: 1411800 - RNA, 14 nt, Homo sapiens
auuuuaaagaggaa

SEQ ID NO: 1411801 - RNA, 21 nt, Homo sapiens
auuuuaccuuugacaaaggua

SEQ ID NO: 1411802 - RNA, 18 nt, Homo sapiens
auuuuaguuauacuccuc

SEQ ID NO: 1411803 - RNA, 12 nt, Homo sapiens
auuuucaccucc

SEQ ID NO: 1411804 - RNA, 18 nt, Homo sapiens
auuuucauuuucugcaag

SEQ ID NO: 1411805 - RNA, 21 nt, Homo sapiens
auuuucuaaauucuuucauga

SEQ ID NO: 1411806 - RNA, 16 nt, Homo sapiens
auuuuuaaaucauuca

SEQ ID NO: 1411807 - RNA, 15 nt, Homo sapiens
auuuuuaguagagaa

SEQ ID NO: 1411808 - RNA, 21 nt, Homo sapiens
caaaaaagaaaaaaaaacugg

SEQ ID NO: 1411809 - RNA, 13 nt, Homo sapiens
caaaaacuguauu

SEQ ID NO: 1411810 - RNA, 21 nt, Homo sapiens
caaaaggucuauggcucaugu

SEQ ID NO: 1411811 - RNA, 22 nt, Homo sapiens
caaaaguuaaacuuuaucucac

SEQ ID NO: 1411812 - RNA, 15 nt, Homo sapiens
caaaauuaugcugca

SEQ ID NO: 1411813 - RNA, 18 nt, Homo sapiens
caaaauuuugucccaucu

SEQ ID NO: 1411814 - RNA, 20 nt, Homo sapiens
caaaauuuugucccaucucu

SEQ ID NO: 1411815 - RNA, 22 nt, Homo sapiens
caaagguaaaucagacuaugaa

SEQ ID NO: 1411816 - RNA, 20 nt, Homo sapiens
caaaguagccagcuggucuu

SEQ ID NO: 1411817 - RNA, 14 nt, Homo sapiens
caaagugugacauu

SEQ ID NO: 1411818 - RNA, 14 nt, Homo sapiens
caaauaaacacugu

SEQ ID NO: 1411819 - RNA, 15 nt, Homo sapiens
caaauaaacugaagg

SEQ ID NO: 1411820 - RNA, 13 nt, Homo sapiens
caaauaaagccug

SEQ ID NO: 1411821 - RNA, 13 nt, Homo sapiens
caaauaguuccau

SEQ ID NO: 1411822 - RNA, 15 nt, Homo sapiens
caaaugagugauucc

SEQ ID NO: 1411823 - RNA, 18 nt, Homo sapiens
caacaacaaaauaaagcu

SEQ ID NO: 1411824 - RNA, 15 nt, Homo sapiens
caacaaccccagcuu

SEQ ID NO: 1411825 - RNA, 18 nt, Homo sapiens
caacaacuucuccauccu

SEQ ID NO: 1411826 - RNA, 14 nt, Homo sapiens
caacagaacucccg

SEQ ID NO: 1411827 - RNA, 22 nt, Homo sapiens
caacagaacucccgggccccaa

SEQ ID NO: 1411828 - RNA, 21 nt, Homo sapiens
caacagaugaguccauuugaa

SEQ ID NO: 1411829 - RNA, 14 nt, Homo sapiens
caacaguugcuaaa

SEQ ID NO: 1411830 - RNA, 22 nt, Homo sapiens
caacauuuaagggaaugugagc

SEQ ID NO: 1411831 - RNA, 20 nt, Homo sapiens
caacccaauaaaacugaugu

SEQ ID NO: 1411832 - RNA, 21 nt, Homo sapiens
caacccaauaaaacugauguu

SEQ ID NO: 1411833 - RNA, 16 nt, Homo sapiens
caacccaauauugcua

SEQ ID NO: 1411834 - RNA, 22 nt, Homo sapiens
caaccuggccaacauggugaaa

SEQ ID NO: 1411835 - RNA, 18 nt, Homo sapiens
caagaacaagucaccucc

SEQ ID NO: 1411836 - RNA, 20 nt, Homo sapiens
caagagaugggaaugaggug

SEQ ID NO: 1411837 - RNA, 21 nt, Homo sapiens
caagaggggguggaggggugu

SEQ ID NO: 1411838 - RNA, 17 nt, Homo sapiens
caagaguuguugugcaa

SEQ ID NO: 1411839 - RNA, 20 nt, Homo sapiens
caagccugcguucuugugac

SEQ ID NO: 1411840 - RNA, 14 nt, Homo sapiens
caagcgauucucau

SEQ ID NO: 1411841 - RNA, 16 nt, Homo sapiens
caagcgauucucaugc

SEQ ID NO: 1411842 - RNA, 18 nt, Homo sapiens
caagcgauucucaugccu

SEQ ID NO: 1411843 - RNA, 19 nt, Homo sapiens
caagcuaauaaaauaucau

SEQ ID NO: 1411844 - RNA, 21 nt, Homo sapiens
caagcuauguggcugcugcug

SEQ ID NO: 1411845 - RNA, 17 nt, Homo sapiens
caagcucuucuccucag

SEQ ID NO: 1411846 - RNA, 22 nt, Homo sapiens
caaggccgagccacacacccgc

SEQ ID NO: 1411847 - RNA, 13 nt, Homo sapiens
caaguacugcgca

SEQ ID NO: 1411848 - RNA, 17 nt, Homo sapiens
caaguaguauucauguu

SEQ ID NO: 1411849 - RNA, 18 nt, Homo sapiens
caaguugacaaaugccaa

SEQ ID NO: 1411850 - RNA, 19 nt, Homo sapiens
caaguuucauaccaaauau

SEQ ID NO: 1411851 - RNA, 15 nt, Homo sapiens
caauaaaacugaugu

SEQ ID NO: 1411852 - RNA, 23 nt, Homo sapiens
caauaaaacugauguuacuagcc

SEQ ID NO: 1411853 - RNA, 16 nt, Homo sapiens
caauaaaggcaccucc

SEQ ID NO: 1411854 - RNA, 22 nt, Homo sapiens
caauauugagcaguucccaagg

SEQ ID NO: 1411855 - RNA, 16 nt, Homo sapiens
caauccaaauucccuc

SEQ ID NO: 1411856 - RNA, 14 nt, Homo sapiens
caauccaccuggag

SEQ ID NO: 1411857 - RNA, 15 nt, Homo sapiens
caaucgucucagccu

SEQ ID NO: 1411858 - RNA, 11 nt, Homo sapiens
caaucuggaaa

SEQ ID NO: 1411859 - RNA, 16 nt, Homo sapiens
caauggcgugaucuca

SEQ ID NO: 1411860 - RNA, 16 nt, Homo sapiens
caauggguuugccaag

SEQ ID NO: 1411861 - RNA, 17 nt, Homo sapiens
cacaaaauuaugcugca

SEQ ID NO: 1411862 - RNA, 20 nt, Homo sapiens
cacaaagaaacguugcgaaa

SEQ ID NO: 1411863 - RNA, 14 nt, Homo sapiens
cacaacacaauaca

SEQ ID NO: 1411864 - RNA, 22 nt, Homo sapiens
cacacaggaacucugugugaga

SEQ ID NO: 1411865 - RNA, 14 nt, Homo sapiens
cacacccacuccac

SEQ ID NO: 1411866 - RNA, 13 nt, Homo sapiens
cacacccagccuc

SEQ ID NO: 1411867 - RNA, 13 nt, Homo sapiens
cacacccguguca

SEQ ID NO: 1411868 - RNA, 15 nt, Homo sapiens
cacagugucuagauc

SEQ ID NO: 1411869 - RNA, 21 nt, Homo sapiens
cacauccuacaguuggaaauc

SEQ ID NO: 1411870 - RNA, 13 nt, Homo sapiens
cacaucuucaggc

SEQ ID NO: 1411871 - RNA, 14 nt, Homo sapiens
cacaucuucaugug

SEQ ID NO: 1411872 - RNA, 12 nt, Homo sapiens
cacaugucauug

SEQ ID NO: 1411873 - RNA, 21 nt, Homo sapiens
cacauuggccgggcuggucuu

SEQ ID NO: 1411874 - RNA, 18 nt, Homo sapiens
caccaaagaucugcuccu

SEQ ID NO: 1411875 - RNA, 17 nt, Homo sapiens
caccaaggagcuacacu

SEQ ID NO: 1411876 - RNA, 19 nt, Homo sapiens
caccaugacaccugccaua

SEQ ID NO: 1411877 - RNA, 19 nt, Homo sapiens
caccauguuggccaggcug

SEQ ID NO: 1411878 - RNA, 14 nt, Homo sapiens
cagaaaaucacugu

SEQ ID NO: 1411879 - RNA, 12 nt, Homo sapiens
cagaaacaucug

SEQ ID NO: 1411880 - RNA, 19 nt, Homo sapiens
cagaaaggugauuccagga

SEQ ID NO: 1411881 - RNA, 19 nt, Homo sapiens
cagaaccauaaagcauaug

SEQ ID NO: 1411882 - RNA, 18 nt, Homo sapiens
cagaaccccugucacaca

SEQ ID NO: 1411883 - RNA, 22 nt, Homo sapiens
cagaagagggaaugagcuucca

SEQ ID NO: 1411884 - RNA, 15 nt, Homo sapiens
cagaauaaagcaauu

SEQ ID NO: 1411885 - RNA, 14 nt, Homo sapiens
cagaccguguuguu

SEQ ID NO: 1411886 - RNA, 13 nt, Homo sapiens
cagaccuuugucu

SEQ ID NO: 1411887 - RNA, 14 nt, Homo sapiens
cagagaacaucugg

SEQ ID NO: 1411888 - RNA, 15 nt, Homo sapiens
cagagagcggucuca

SEQ ID NO: 1411889 - RNA, 15 nt, Homo sapiens
cagagauggcuccuu

SEQ ID NO: 1411890 - RNA, 21 nt, Homo sapiens
cagagcuccugaguggaauca

SEQ ID NO: 1411891 - RNA, 15 nt, Homo sapiens
cagagcuguggcaca

SEQ ID NO: 1411892 - RNA, 17 nt, Homo sapiens
cagaguaauccaagcaa

SEQ ID NO: 1411893 - RNA, 17 nt, Homo sapiens
cagauggaaagaaagca

SEQ ID NO: 1411894 - RNA, 21 nt, Homo sapiens
cagauuugcccuccuccugcu

SEQ ID NO: 1411895 - RNA, 16 nt, Homo sapiens
cagcaugcugcugcuc

SEQ ID NO: 1411896 - RNA, 21 nt, Homo sapiens
cagccaggcuaugguugccac

SEQ ID NO: 1411897 - RNA, 14 nt, Homo sapiens
cagcccugagcugg

SEQ ID NO: 1411898 - RNA, 17 nt, Homo sapiens
cagcccuuggccagaag

SEQ ID NO: 1411899 - RNA, 15 nt, Homo sapiens
cagccucaguccucc

SEQ ID NO: 1411900 - RNA, 15 nt, Homo sapiens
cagccuccaacucca

SEQ ID NO: 1411901 - RNA, 22 nt, Homo sapiens
cagccuggcugguccccaaggc

SEQ ID NO: 1411902 - RNA, 18 nt, Homo sapiens
cagcgccaugcuuccuau

SEQ ID NO: 1411903 - RNA, 17 nt, Homo sapiens
cagcggggcuacagucc

SEQ ID NO: 1411904 - RNA, 19 nt, Homo sapiens
cagcuagacucccauggaa

SEQ ID NO: 1411905 - RNA, 21 nt, Homo sapiens
cagcucggacuauacugcuga

SEQ ID NO: 1411906 - RNA, 17 nt, Homo sapiens
cagcucggcgagcuccu

SEQ ID NO: 1411907 - RNA, 16 nt, Homo sapiens
cagcugaacacccucc

SEQ ID NO: 1411908 - RNA, 16 nt, Homo sapiens
cagcugcgcuugcuuu

SEQ ID NO: 1411909 - RNA, 16 nt, Homo sapiens
cagcuggucuucagca

SEQ ID NO: 1411910 - RNA, 16 nt, Homo sapiens
cagcuuggggcagcca

SEQ ID NO: 1411911 - RNA, 20 nt, Homo sapiens
caggaaugaucccacucacc

SEQ ID NO: 1411912 - RNA, 22 nt, Homo sapiens
caggaucggcuuccucaggggc

SEQ ID NO: 1411913 - RNA, 18 nt, Homo sapiens
caggaugaugacuaugga

SEQ ID NO: 1411914 - RNA, 19 nt, Homo sapiens
caggaugcuggggcacuuu

SEQ ID NO: 1411915 - RNA, 22 nt, Homo sapiens
caggaugcuggggcacuuuaaa

SEQ ID NO: 1411916 - RNA, 23 nt, Homo sapiens
caggauugauuaugcagaauacu

SEQ ID NO: 1411917 - RNA, 18 nt, Homo sapiens
caggcagagcagcuccac

SEQ ID NO: 1411918 - RNA, 18 nt, Homo sapiens
caggcauagaggcuucuc

SEQ ID NO: 1411919 - RNA, 21 nt, Homo sapiens
caggccuuucuggccugcuau

SEQ ID NO: 1411920 - RNA, 18 nt, Homo sapiens
caggcuaugguugccacc

SEQ ID NO: 1411921 - RNA, 16 nt, Homo sapiens
caggcugauggagaca

SEQ ID NO: 1411922 - RNA, 18 nt, Homo sapiens
caggcugauggagacagu

SEQ ID NO: 1411923 - RNA, 19 nt, Homo sapiens
caggcuggcccccacccac

SEQ ID NO: 1411924 - RNA, 15 nt, Homo sapiens
caggcuugcauuaaa

SEQ ID NO: 1411925 - RNA, 13 nt, Homo sapiens
cagggaaaugccu

SEQ ID NO: 1411926 - RNA, 14 nt, Homo sapiens
caggggcucuggag

SEQ ID NO: 1411927 - RNA, 14 nt, Homo sapiens
cagggggacuagcc

SEQ ID NO: 1411928 - RNA, 13 nt, Homo sapiens
caguaacacuggc

SEQ ID NO: 1411929 - RNA, 15 nt, Homo sapiens
caguaacacuggcga

SEQ ID NO: 1411930 - RNA, 17 nt, Homo sapiens
caguaauaaaaagccac

SEQ ID NO: 1411931 - RNA, 23 nt, Homo sapiens
caguacucuguaaguuucuguga

SEQ ID NO: 1411932 - RNA, 13 nt, Homo sapiens
cagucagugcugg

SEQ ID NO: 1411933 - RNA, 22 nt, Homo sapiens
cagucugggccccaucauuaaa

SEQ ID NO: 1411934 - RNA, 22 nt, Homo sapiens
caguggcaccugggaagccugg

SEQ ID NO: 1411935 - RNA, 17 nt, Homo sapiens
caguguuggcaagcucu

SEQ ID NO: 1411936 - RNA, 18 nt, Homo sapiens
caguuaccugcacaacag

SEQ ID NO: 1411937 - RNA, 19 nt, Homo sapiens
caguuuaaucauugccugg

SEQ ID NO: 1411938 - RNA, 23 nt, Homo sapiens
cauaagcagaagaucaaaaugcu

SEQ ID NO: 1411939 - RNA, 17 nt, Homo sapiens
cauaccaaauauuugaa

SEQ ID NO: 1411940 - RNA, 13 nt, Homo sapiens
cauacucauuuaa

SEQ ID NO: 1411941 - RNA, 14 nt, Homo sapiens
cauacucauuuaaa

SEQ ID NO: 1411942 - RNA, 14 nt, Homo sapiens
cauacugcauuuca

SEQ ID NO: 1411943 - RNA, 20 nt, Homo sapiens
cauagaauggcacaugucau

SEQ ID NO: 1411944 - RNA, 18 nt, Homo sapiens
cauagcauuuguguaaag

SEQ ID NO: 1411945 - RNA, 20 nt, Homo sapiens
cauaguaaugagugaguucu

SEQ ID NO: 1411946 - RNA, 23 nt, Homo sapiens
cauaguaaugagugaguucucac

SEQ ID NO: 1411947 - RNA, 18 nt, Homo sapiens
cauauaucucccaacaga

SEQ ID NO: 1411948 - RNA, 20 nt, Homo sapiens
cauaucacuugauaugugca

SEQ ID NO: 1411949 - RNA, 18 nt, Homo sapiens
caucacacuugucugcag

SEQ ID NO: 1411950 - RNA, 16 nt, Homo sapiens
caucagaaacaucuga

SEQ ID NO: 1411951 - RNA, 17 nt, Homo sapiens
caucaugaaaacuggga

SEQ ID NO: 1411952 - RNA, 16 nt, Homo sapiens
caucauuaaacgggcu

SEQ ID NO: 1411953 - RNA, 17 nt, Homo sapiens
caucccaggacaccaca

SEQ ID NO: 1411954 - RNA, 14 nt, Homo sapiens
cauccuugaccuca

SEQ ID NO: 1411955 - RNA, 14 nt, Homo sapiens
caucgguagcuuga

SEQ ID NO: 1411956 - RNA, 22 nt, Homo sapiens
caucuaaauauuuccauauucu

SEQ ID NO: 1411957 - RNA, 23 nt, Homo sapiens
caucugaccuuaguuugcugcca

SEQ ID NO: 1411958 - RNA, 14 nt, Homo sapiens
caucuuuguaauac

SEQ ID NO: 1411959 - RNA, 17 nt, Homo sapiens
caucuuuguaauacaug

SEQ ID NO: 1411960 - RNA, 20 nt, Homo sapiens
caucuuuguuggcucagaaa

SEQ ID NO: 1411961 - RNA, 14 nt, Homo sapiens
caugacaccugcca

SEQ ID NO: 1411962 - RNA, 16 nt, Homo sapiens
caugcuggcuccugaa

SEQ ID NO: 1411963 - RNA, 15 nt, Homo sapiens
caugcuguguaauau

SEQ ID NO: 1411964 - RNA, 14 nt, Homo sapiens
cauggaaugacuga

SEQ ID NO: 1411965 - RNA, 12 nt, Homo sapiens
cauggacaucua

SEQ ID NO: 1411966 - RNA, 18 nt, Homo sapiens
cauggagcucugagauca

SEQ ID NO: 1411967 - RNA, 14 nt, Homo sapiens
caugggagugaucu

SEQ ID NO: 1411968 - RNA, 18 nt, Homo sapiens
caugugaaacucaucuca

SEQ ID NO: 1411969 - RNA, 15 nt, Homo sapiens
cauguuacugccaaa

SEQ ID NO: 1411970 - RNA, 16 nt, Homo sapiens
cauguucaaaguguga

SEQ ID NO: 1411971 - RNA, 20 nt, Homo sapiens
cauguugugauguacacauu

SEQ ID NO: 1411972 - RNA, 23 nt, Homo sapiens
cauuaaaggaaaaauagcagaga

SEQ ID NO: 1411973 - RNA, 12 nt, Homo sapiens
cauuaagugugg

SEQ ID NO: 1411974 - RNA, 15 nt, Homo sapiens
cauuaauaauccuuc

SEQ ID NO: 1411975 - RNA, 24 nt, Homo sapiens
cauuacauuugaacuauauccuuc

SEQ ID NO: 1411976 - RNA, 19 nt, Homo sapiens
cauuauaaacauguuuuaa

SEQ ID NO: 1411977 - RNA, 16 nt, Homo sapiens
cauucagaccgagaga

SEQ ID NO: 1411978 - RNA, 12 nt, Homo sapiens
cauucaguguua

SEQ ID NO: 1411979 - RNA, 14 nt, Homo sapiens
cauucaguguuaga

SEQ ID NO: 1411980 - RNA, 19 nt, Homo sapiens
cauucuaaugauggcccau

SEQ ID NO: 1411981 - RNA, 23 nt, Homo sapiens
cauucuaaugauggcccauucua

SEQ ID NO: 1411982 - RNA, 15 nt, Homo sapiens
cauucugcuucucau

SEQ ID NO: 1411983 - RNA, 23 nt, Homo sapiens
cauuguacaguuuguuuacacac

SEQ ID NO: 1411984 - RNA, 13 nt, Homo sapiens
cauuuacaaagca

SEQ ID NO: 1411985 - RNA, 13 nt, Homo sapiens
cauuucaaucuuu

SEQ ID NO: 1411986 - RNA, 20 nt, Homo sapiens
cauuuuagcucaaacccugu

SEQ ID NO: 1411987 - RNA, 18 nt, Homo sapiens
cauuuucugguaagguuu

SEQ ID NO: 1411988 - RNA, 21 nt, Homo sapiens
ccaaaauuuugucccaucucu

SEQ ID NO: 1411989 - RNA, 16 nt, Homo sapiens
ccaaagagagcacugu

SEQ ID NO: 1411990 - RNA, 19 nt, Homo sapiens
ccaaagggaggguggcaga

SEQ ID NO: 1411991 - RNA, 16 nt, Homo sapiens
ccaaaucaaaugcuca

SEQ ID NO: 1411992 - RNA, 17 nt, Homo sapiens
ccaacaaccccagcuuc

SEQ ID NO: 1411993 - RNA, 17 nt, Homo sapiens
ccaaccuguaauaaaua

SEQ ID NO: 1411994 - RNA, 15 nt, Homo sapiens
ccaaggaccugccuc

SEQ ID NO: 1411995 - RNA, 14 nt, Homo sapiens
ccaauaaaacugau

SEQ ID NO: 1411996 - RNA, 14 nt, Homo sapiens
ccaauccucaccua

SEQ ID NO: 1411997 - RNA, 22 nt, Homo sapiens
ccaaucgccccacccguuccua

SEQ ID NO: 1411998 - RNA, 17 nt, Homo sapiens
ccaauguuuauugggca

SEQ ID NO: 1411999 - RNA, 22 nt, Homo sapiens
ccacaccaguaauaaaaagcca

SEQ ID NO: 1412000 - RNA, 11 nt, Homo sapiens
ccacacccacu

SEQ ID NO: 1412001 - RNA, 14 nt, Homo sapiens
ccacacccacuguc

SEQ ID NO: 1412002 - RNA, 23 nt, Homo sapiens
ccacaggcccuuuccucaggcaa

SEQ ID NO: 1412003 - RNA, 13 nt, Homo sapiens
ccaccaaguuccu

SEQ ID NO: 1412004 - RNA, 12 nt, Homo sapiens
ccaccacaggcc

SEQ ID NO: 1412005 - RNA, 22 nt, Homo sapiens
ccaccgacccuuccuggccuaa

SEQ ID NO: 1412006 - RNA, 22 nt, Homo sapiens
ccaccuaaaagagaaugaugcu

SEQ ID NO: 1412007 - RNA, 14 nt, Homo sapiens
ccacgcccccaugc

SEQ ID NO: 1412008 - RNA, 17 nt, Homo sapiens
ccacgcuggagcugugu

SEQ ID NO: 1412009 - RNA, 18 nt, Homo sapiens
ccacuaaaugaucugauu

SEQ ID NO: 1412010 - RNA, 13 nt, Homo sapiens
ccacuaagugugu

SEQ ID NO: 1412011 - RNA, 21 nt, Homo sapiens
ccacuuucccacgucacuuga

SEQ ID NO: 1412012 - RNA, 17 nt, Homo sapiens
ccagaaccccugucaca

SEQ ID NO: 1412013 - RNA, 22 nt, Homo sapiens
ccuuuagauuaggucacauuac

SEQ ID NO: 1412014 - RNA, 20 nt, Homo sapiens
ccuuuggaaacaacauuuaa

SEQ ID NO: 1412015 - RNA, 21 nt, Homo sapiens
cgaccgcccaacguuugccuc

SEQ ID NO: 1412016 - RNA, 23 nt, Homo sapiens
cgacgguuucaaaccaggauuuu

SEQ ID NO: 1412017 - RNA, 14 nt, Homo sapiens
cgagagccaaacag

SEQ ID NO: 1412018 - RNA, 19 nt, Homo sapiens
cgagccauagagccugaaa

SEQ ID NO: 1412019 - RNA, 23 nt, Homo sapiens
cgaugggggaucagcagggcagu

SEQ ID NO: 1412020 - RNA, 13 nt, Homo sapiens
cgccugacagcau

SEQ ID NO: 1412021 - RNA, 20 nt, Homo sapiens
cgcuuaugguuuuaaugcaa

SEQ ID NO: 1412022 - RNA, 17 nt, Homo sapiens
cggacuauacugcugag

SEQ ID NO: 1412023 - RNA, 13 nt, Homo sapiens
cggccaacacuuu

SEQ ID NO: 1412024 - RNA, 19 nt, Homo sapiens
cggccagcaccgcugcuca

SEQ ID NO: 1412025 - RNA, 15 nt, Homo sapiens
cggcugcaucuucca

SEQ ID NO: 1412026 - RNA, 14 nt, Homo sapiens
cggggcuacagucc

SEQ ID NO: 1412027 - RNA, 11 nt, Homo sapiens
cgguacagggc

SEQ ID NO: 1412028 - RNA, 17 nt, Homo sapiens
cggugccucucccaugg

SEQ ID NO: 1412029 - RNA, 21 nt, Homo sapiens
cgguuggaggcucucaugucu

SEQ ID NO: 1412030 - RNA, 15 nt, Homo sapiens
cguccauggugcuaa

SEQ ID NO: 1412031 - RNA, 13 nt, Homo sapiens
cgugcuuccucag

SEQ ID NO: 1412032 - RNA, 19 nt, Homo sapiens
cgugguccccaacagcgac

SEQ ID NO: 1412033 - RNA, 13 nt, Homo sapiens
aauaaacacugug

SEQ ID NO: 1412034 - RNA, 21 nt, Homo sapiens
aauaaagcuucucucugagcu

SEQ ID NO: 1412035 - RNA, 13 nt, Homo sapiens
aauaaaggcaccu

SEQ ID NO: 1412036 - RNA, 16 nt, Homo sapiens
aauaaaggcaccuccc

SEQ ID NO: 1412037 - RNA, 16 nt, Homo sapiens
aauaaaggcucuggaa

SEQ ID NO: 1412038 - RNA, 17 nt, Homo sapiens
aauaaauaugagugcca

SEQ ID NO: 1412039 - RNA, 22 nt, Homo sapiens
aauaagauuuuguuagccaaca

SEQ ID NO: 1412040 - RNA, 22 nt, Homo sapiens
aauaagccacauaucuagauuu

SEQ ID NO: 1412041 - RNA, 12 nt, Homo sapiens
auagucacagga

SEQ ID NO: 1412042 - RNA, 16 nt, Homo sapiens
auagucuggaaaguug

SEQ ID NO: 1412043 - RNA, 16 nt, Homo sapiens
auaucuagucacuugu

SEQ ID NO: 1412044 - RNA, 23 nt, Homo sapiens
auaugguuuuguuuucaaugaau

SEQ ID NO: 1412045 - RNA, 15 nt, Homo sapiens
auauuaaaccuucag

SEQ ID NO: 1412046 - RNA, 21 nt, Homo sapiens
auauuuuccaaauuaugugga

SEQ ID NO: 1412047 - RNA, 19 nt, Homo sapiens
aucaacaaaaggagccaag

SEQ ID NO: 1412048 - RNA, 18 nt, Homo sapiens
aucaauccaaauucccuc

SEQ ID NO: 1412049 - RNA, 17 nt, Homo sapiens
agccguccaagaacaag

SEQ ID NO: 1412050 - RNA, 18 nt, Homo sapiens
agccuccccgugccaaaa

SEQ ID NO: 1412051 - RNA, 16 nt, Homo sapiens
agccugaaaucaucuu

SEQ ID NO: 1412052 - RNA, 20 nt, Homo sapiens
agccugggccuccuccuagc

SEQ ID NO: 1412053 - RNA, 16 nt, Homo sapiens
agcgauucucaugccu

SEQ ID NO: 1412054 - RNA, 17 nt, Homo sapiens
agcgauucucaugccuc

SEQ ID NO: 1412055 - RNA, 15 nt, Homo sapiens
agcuaaugucuucua

SEQ ID NO: 1412056 - RNA, 20 nt, Homo sapiens
agcuacacucccacuucuuc

SEQ ID NO: 1412057 - RNA, 22 nt, Homo sapiens
aaaugccgcucuucacucuggc

SEQ ID NO: 1412058 - RNA, 15 nt, Homo sapiens
aaaugcucacugggg

SEQ ID NO: 1412059 - RNA, 18 nt, Homo sapiens
aaauguaaagucuagaaa

SEQ ID NO: 1412060 - RNA, 21 nt, Homo sapiens
aaaugucugccauuugcugcu

SEQ ID NO: 1412061 - RNA, 14 nt, Homo sapiens
aaauguuaugcagg

SEQ ID NO: 1412062 - RNA, 20 nt, Homo sapiens
aaauguuuaauuuugcagug

SEQ ID NO: 1412063 - RNA, 18 nt, Homo sapiens
aaauuaacaaagugucac

SEQ ID NO: 1412064 - RNA, 13 nt, Homo sapiens
aaauuaagcuuaa

SEQ ID NO: 1412065 - RNA, 14 nt, Homo sapiens
aaauuccccuuccc

SEQ ID NO: 1412066 - RNA, 15 nt, Homo sapiens
aaauuuuuaaucuuu

SEQ ID NO: 1412067 - RNA, 24 nt, Homo sapiens
aacaaugaaguguuuuacaaugau

SEQ ID NO: 1412068 - RNA, 18 nt, Homo sapiens
aacacaauacagccacua

SEQ ID NO: 1412069 - RNA, 21 nt, Homo sapiens
aacacaauuaaaucucuccuu

SEQ ID NO: 1412070 - RNA, 22 nt, Homo sapiens
aacacuuuaacgucuuacauuu

SEQ ID NO: 1412071 - RNA, 11 nt, Homo sapiens
aacagcuccuu

SEQ ID NO: 1412072 - RNA, 21 nt, Homo sapiens
aacagucccagaaugacccca

SEQ ID NO: 1412073 - RNA, 14 nt, Homo sapiens
aacagucucuucua

SEQ ID NO: 1412074 - RNA, 11 nt, Homo sapiens
aacaguuauaa

SEQ ID NO: 1412075 - RNA, 20 nt, Homo sapiens
aacaucauauaccucuugaa

SEQ ID NO: 1412076 - RNA, 15 nt, Homo sapiens
aacaucugauuugag

SEQ ID NO: 1412077 - RNA, 16 nt, Homo sapiens
aacaucuggauuucau

SEQ ID NO: 1412078 - RNA, 16 nt, Homo sapiens
aacaugaauauuuagu

SEQ ID NO: 1412079 - RNA, 16 nt, Homo sapiens
aacauguccccuuccc

SEQ ID NO: 1412080 - RNA, 17 nt, Homo sapiens
aacauguuuuaacauua

SEQ ID NO: 1412081 - RNA, 20 nt, Homo sapiens
aaccaagcauuuuggaauga

SEQ ID NO: 1412082 - RNA, 20 nt, Homo sapiens
aacccaggagguggagguug

SEQ ID NO: 1412083 - RNA, 15 nt, Homo sapiens
aaccucacucuugcc

SEQ ID NO: 1412084 - RNA, 17 nt, Homo sapiens
aaccucauuguucugua

SEQ ID NO: 1412085 - RNA, 22 nt, Homo sapiens
aaccuggccuuauaucauuuca

SEQ ID NO: 1412086 - RNA, 14 nt, Homo sapiens
aaccuucagauuaa

SEQ ID NO: 1412087 - RNA, 19 nt, Homo sapiens
aaccuuguaaauuccccuu

SEQ ID NO: 1412088 - RNA, 14 nt, Homo sapiens
aacgccacggagcu

SEQ ID NO: 1412089 - RNA, 15 nt, Homo sapiens
aacuaggugaucuca

SEQ ID NO: 1412090 - RNA, 16 nt, Homo sapiens
aacuaggugaucucag

SEQ ID NO: 1412091 - RNA, 21 nt, Homo sapiens
aacuauuuaacuugagcuuua

SEQ ID NO: 1412092 - RNA, 18 nt, Homo sapiens
aacucagcugaucugauu

SEQ ID NO: 1412093 - RNA, 13 nt, Homo sapiens
aacucaugggaag

SEQ ID NO: 1412094 - RNA, 14 nt, Homo sapiens
aacuccugaccuca

SEQ ID NO: 1412095 - RNA, 19 nt, Homo sapiens
aacuccugaccucagguga

SEQ ID NO: 1412096 - RNA, 13 nt, Homo sapiens
aacugcaggugac

SEQ ID NO: 1412097 - RNA, 23 nt, Homo sapiens
aacuggaaggcugcuuucuccuu

SEQ ID NO: 1412098 - RNA, 13 nt, Homo sapiens
aacuggagcagag

SEQ ID NO: 1412099 - RNA, 12 nt, Homo sapiens
aacuguggaauc

SEQ ID NO: 1412100 - RNA, 15 nt, Homo sapiens
aacuugagcuuuaaa

SEQ ID NO: 1412101 - RNA, 19 nt, Homo sapiens
aacuuggauguagccauga

SEQ ID NO: 1412102 - RNA, 17 nt, Homo sapiens
aagaaaaaaaaacuggg

SEQ ID NO: 1412103 - RNA, 21 nt, Homo sapiens
aagaaaacuuguauuaugugu

SEQ ID NO: 1412104 - RNA, 22 nt, Homo sapiens
aagaaaauauagucacaggaaa

SEQ ID NO: 1412105 - RNA, 15 nt, Homo sapiens
aagaaaucaugugca

SEQ ID NO: 1412106 - RNA, 19 nt, Homo sapiens
aagaagagaucagaaugau

SEQ ID NO: 1412107 - RNA, 15 nt, Homo sapiens
aagaauuuaauguac

SEQ ID NO: 1412108 - RNA, 19 nt, Homo sapiens
aagaccucugagaccaaaa

SEQ ID NO: 1412109 - RNA, 15 nt, Homo sapiens
aagacuaugaucuca

SEQ ID NO: 1412110 - RNA, 20 nt, Homo sapiens
aagacuaugaucucauccca

SEQ ID NO: 1412111 - RNA, 22 nt, Homo sapiens
aagacuuuuaugauacuugaaa

SEQ ID NO: 1412112 - RNA, 13 nt, Homo sapiens
aagaggaauucca

SEQ ID NO: 1412113 - RNA, 19 nt, Homo sapiens
aagagggaaugagcuucca

SEQ ID NO: 1412114 - RNA, 21 nt, Homo sapiens
aagaucccaccgacccuuccu

SEQ ID NO: 1412115 - RNA, 15 nt, Homo sapiens
aagcacuugaugcca

SEQ ID NO: 1412116 - RNA, 17 nt, Homo sapiens
aagcagaauaaagcaau

SEQ ID NO: 1412117 - RNA, 19 nt, Homo sapiens
aagcagaauaaagcaauuu

SEQ ID NO: 1412118 - RNA, 23 nt, Homo sapiens
aagccaaagaaaaauaacccuuu

SEQ ID NO: 1412119 - RNA, 12 nt, Homo sapiens
aagccacauauc

SEQ ID NO: 1412120 - RNA, 14 nt, Homo sapiens
aagcccagcauuug

SEQ ID NO: 1412121 - RNA, 13 nt, Homo sapiens
aagcccugaccca

SEQ ID NO: 1412122 - RNA, 14 nt, Homo sapiens
aagccgucucaugc

SEQ ID NO: 1412123 - RNA, 23 nt, Homo sapiens
aagcuccggguguagauucccuu

SEQ ID NO: 1412124 - RNA, 13 nt, Homo sapiens
aagcugaugucca

SEQ ID NO: 1412125 - RNA, 19 nt, Homo sapiens
aagcugggagggaggggga

SEQ ID NO: 1412126 - RNA, 16 nt, Homo sapiens
aagcuguauauauuau

SEQ ID NO: 1412127 - RNA, 13 nt, Homo sapiens
aagcuuaaugugu

SEQ ID NO: 1412128 - RNA, 22 nt, Homo sapiens
aagcuucgugaggcccucacca

SEQ ID NO: 1412129 - RNA, 15 nt, Homo sapiens
aagcuucucucugag

SEQ ID NO: 1412130 - RNA, 18 nt, Homo sapiens
aaggaccucagcugcuuc

SEQ ID NO: 1412131 - RNA, 20 nt, Homo sapiens
aaggacgcccgaagcacagu

SEQ ID NO: 1412132 - RNA, 22 nt, Homo sapiens
aaggacucaacauuacauuuga

SEQ ID NO: 1412133 - RNA, 16 nt, Homo sapiens
aaggagacacauucac

SEQ ID NO: 1412134 - RNA, 15 nt, Homo sapiens
aaggaugguauugaa

SEQ ID NO: 1412135 - RNA, 22 nt, Homo sapiens
aagggacaaaagguacugguga

SEQ ID NO: 1412136 - RNA, 18 nt, Homo sapiens
aaggggauggacuucauu

SEQ ID NO: 1412137 - RNA, 20 nt, Homo sapiens
aagguaggguguguauauau

SEQ ID NO: 1412138 - RNA, 15 nt, Homo sapiens
aaggucuauggcuca

SEQ ID NO: 1412139 - RNA, 16 nt, Homo sapiens
aaggucuauggcucau

SEQ ID NO: 1412140 - RNA, 19 nt, Homo sapiens
aagguuucuacaacauauu

SEQ ID NO: 1412141 - RNA, 18 nt, Homo sapiens
aaguaguaaugauucuca

SEQ ID NO: 1412142 - RNA, 13 nt, Homo sapiens
aaguaugccucag

SEQ ID NO: 1412143 - RNA, 15 nt, Homo sapiens
aagucaccaugccug

SEQ ID NO: 1412144 - RNA, 19 nt, Homo sapiens
aagucgcuuuuggugccug

SEQ ID NO: 1412145 - RNA, 16 nt, Homo sapiens
aaguucucaagcugcc

SEQ ID NO: 1412146 - RNA, 17 nt, Homo sapiens
aaguugcagaacagaca

SEQ ID NO: 1412147 - RNA, 21 nt, Homo sapiens
aaguugcagaacagacacuuu

SEQ ID NO: 1412148 - RNA, 23 nt, Homo sapiens
aaguuucauaccaaauauuugaa

SEQ ID NO: 1412149 - RNA, 17 nt, Homo sapiens
aaguuugggcugaagaa

SEQ ID NO: 1412150 - RNA, 11 nt, Homo sapiens
aauaaaacuga

SEQ ID NO: 1412151 - RNA, 14 nt, Homo sapiens
aauaaauacauuuc

SEQ ID NO: 1412152 - RNA, 23 nt, Homo sapiens
aauaaucucuauguagaaaucuc

SEQ ID NO: 1412153 - RNA, 15 nt, Homo sapiens
aauacaaauacaaag

SEQ ID NO: 1412154 - RNA, 18 nt, Homo sapiens
aauaccccuaacauacug

SEQ ID NO: 1412155 - RNA, 20 nt, Homo sapiens
aauaccccuaacauacugca

SEQ ID NO: 1412156 - RNA, 14 nt, Homo sapiens
aauauaauacauuu

SEQ ID NO: 1412157 - RNA, 16 nt, Homo sapiens
aauauuuccauauucu

SEQ ID NO: 1412158 - RNA, 20 nt, Homo sapiens
aaucaaucuuugugccucaa

SEQ ID NO: 1412159 - RNA, 19 nt, Homo sapiens
aaucacauuuuaauugcca

SEQ ID NO: 1412160 - RNA, 16 nt, Homo sapiens
aaucagacuaugaagu

SEQ ID NO: 1412161 - RNA, 11 nt, Homo sapiens
aaucagggaca

SEQ ID NO: 1412162 - RNA, 23 nt, Homo sapiens
aaucaugugcauauaucuuucag

SEQ ID NO: 1412163 - RNA, 19 nt, Homo sapiens
aauccaucaaagugaugau

SEQ ID NO: 1412164 - RNA, 16 nt, Homo sapiens
aaucccagcauuuuga

SEQ ID NO: 1412165 - RNA, 17 nt, Homo sapiens
aaucccuuccucuccca

SEQ ID NO: 1412166 - RNA, 17 nt, Homo sapiens
aaucuaaaaccaaauau

SEQ ID NO: 1412167 - RNA, 13 nt, Homo sapiens
aaugaagguuucu

SEQ ID NO: 1412168 - RNA, 17 nt, Homo sapiens
aaugaccccaucgagau

SEQ ID NO: 1412169 - RNA, 13 nt, Homo sapiens
aaugacguccuuc

SEQ ID NO: 1412170 - RNA, 20 nt, Homo sapiens
aaugacugaagacaggcaca

SEQ ID NO: 1412171 - RNA, 15 nt, Homo sapiens
aaugagcuuccauua

SEQ ID NO: 1412172 - RNA, 14 nt, Homo sapiens
aaugagugaguucu

SEQ ID NO: 1412173 - RNA, 16 nt, Homo sapiens
aaugagugaguucuca

SEQ ID NO: 1412174 - RNA, 17 nt, Homo sapiens
aaugauggcccauucua

SEQ ID NO: 1412175 - RNA, 20 nt, Homo sapiens
aaugauucucaagaucaaag

SEQ ID NO: 1412176 - RNA, 14 nt, Homo sapiens
aaugcagagauaau

SEQ ID NO: 1412177 - RNA, 19 nt, Homo sapiens
aaugcauaaugucuuuaaa

SEQ ID NO: 1412178 - RNA, 14 nt, Homo sapiens
aaugccugcugcug

SEQ ID NO: 1412179 - RNA, 22 nt, Homo sapiens
aauggcacaugucauugcccac

SEQ ID NO: 1412180 - RNA, 20 nt, Homo sapiens
aauggcgugaucucagcuca

SEQ ID NO: 1412181 - RNA, 21 nt, Homo sapiens
aauggguuugccaagcccuuu

SEQ ID NO: 1412182 - RNA, 20 nt, Homo sapiens
aauguaauguuuuagugccu

SEQ ID NO: 1412183 - RNA, 18 nt, Homo sapiens
aauguucugggaagggac

SEQ ID NO: 1412184 - RNA, 18 nt, Homo sapiens
aauuaaauggaucacuga

SEQ ID NO: 1412185 - RNA, 16 nt, Homo sapiens
aauuaucaccaugaca

SEQ ID NO: 1412186 - RNA, 20 nt, Homo sapiens
agacaauugcauugcuacca

SEQ ID NO: 1412187 - RNA, 14 nt, Homo sapiens
agacagaguuucac

SEQ ID NO: 1412188 - RNA, 18 nt, Homo sapiens
agacagauuuguucauag

SEQ ID NO: 1412189 - RNA, 14 nt, Homo sapiens
agacaggcacaaaa

SEQ ID NO: 1412190 - RNA, 15 nt, Homo sapiens
agacagggcuccagc

SEQ ID NO: 1412191 - RNA, 16 nt, Homo sapiens
agacaggguuucacca

SEQ ID NO: 1412192 - RNA, 16 nt, Homo sapiens
agacucuccacuguua

SEQ ID NO: 1412193 - RNA, 19 nt, Homo sapiens
agacuuuuaugauacuuga

SEQ ID NO: 1412194 - RNA, 19 nt, Homo sapiens
agagaaagaaagaacguuc

SEQ ID NO: 1412195 - RNA, 15 nt, Homo sapiens
aguaacaacaaaaua

SEQ ID NO: 1412196 - RNA, 21 nt, Homo sapiens
aguaauuauuagcauugaucu

SEQ ID NO: 1412197 - RNA, 15 nt, Homo sapiens
aguagaagugucaca

SEQ ID NO: 1412198 - RNA, 17 nt, Homo sapiens
aguagacaggguuucac

SEQ ID NO: 1412199 - RNA, 16 nt, Homo sapiens
aguaguaaugauucuc

SEQ ID NO: 1412200 - RNA, 20 nt, Homo sapiens
agucacaggaaacuacuuca

SEQ ID NO: 1412201 - RNA, 17 nt, Homo sapiens
agucacuggaucaagaa

SEQ ID NO: 1412202 - RNA, 17 nt, Homo sapiens
agucacuuguuucuacu

SEQ ID NO: 1412203 - RNA, 13 nt, Homo sapiens
agucagcaaaucu

SEQ ID NO: 1412204 - RNA, 22 nt, Homo sapiens
agucagccaucgccaacuuguc

SEQ ID NO: 1412205 - RNA, 21 nt, Homo sapiens
aguccagaaccccugucacac

SEQ ID NO: 1412206 - RNA, 21 nt, Homo sapiens
cuguaauaaauaugagugcca

SEQ ID NO: 1412207 - RNA, 13 nt, Homo sapiens
cuguaguguacca

SEQ ID NO: 1412208 - RNA, 18 nt, Homo sapiens
cugucgccugacagcaua

SEQ ID NO: 1412209 - RNA, 18 nt, Homo sapiens
cuguguaauaucaaacac

SEQ ID NO: 1412210 - RNA, 23 nt, Homo sapiens
cuguguaauaucaaacacaauua

SEQ ID NO: 1412211 - RNA, 12 nt, Homo sapiens
cugugugcuacu

SEQ ID NO: 1412212 - RNA, 16 nt, Homo sapiens
cuguugugugccugac

SEQ ID NO: 1412213 - RNA, 23 nt, Homo sapiens
cuguuuuuuaaaaauaagccaca

SEQ ID NO: 1412214 - RNA, 23 nt, Homo sapiens
cuuaacgugucugagagccauaa

SEQ ID NO: 1412215 - RNA, 16 nt, Homo sapiens
cuuaauugaaacaaca

SEQ ID NO: 1412216 - RNA, 14 nt, Homo sapiens
cuuaguaucaguca

SEQ ID NO: 1412217 - RNA, 19 nt, Homo sapiens
cuuauuuguaaaaugcaga

SEQ ID NO: 1412218 - RNA, 14 nt, Homo sapiens
cuucagguuuuauc

SEQ ID NO: 1412219 - RNA, 21 nt, Homo sapiens
cuuccaaaccaccuucccuca

SEQ ID NO: 1412220 - RNA, 15 nt, Homo sapiens
cuuccauuaggugaa

SEQ ID NO: 1412221 - RNA, 13 nt, Homo sapiens
cuuccuggccuaa

SEQ ID NO: 1412222 - RNA, 15 nt, Homo sapiens
cuucguucuguaaua

SEQ ID NO: 1412223 - RNA, 21 nt, Homo sapiens
cuucucagguguuucuagacc

SEQ ID NO: 1412224 - RNA, 17 nt, Homo sapiens
cuucuccgccagccucc

SEQ ID NO: 1412225 - RNA, 16 nt, Homo sapiens
cuucugccguugcugc

SEQ ID NO: 1412226 - RNA, 12 nt, Homo sapiens
cuucugccugag

SEQ ID NO: 1412227 - RNA, 23 nt, Homo sapiens
cuucuuaagauggcuacaccuca

SEQ ID NO: 1412228 - RNA, 12 nt, Homo sapiens
cuugaacuaaca

SEQ ID NO: 1412229 - RNA, 15 nt, Homo sapiens
cuugaagccaaagaa

SEQ ID NO: 1412230 - RNA, 18 nt, Homo sapiens
cuugagauaguaacaaca

SEQ ID NO: 1412231 - RNA, 21 nt, Homo sapiens
cuugccaaccuguaauaaaua

SEQ ID NO: 1412232 - RNA, 23 nt, Homo sapiens
cuugccgaaccaggagcugcuca

SEQ ID NO: 1412233 - RNA, 16 nt, Homo sapiens
cuugccugggauauca

SEQ ID NO: 1412234 - RNA, 19 nt, Homo sapiens
cuugggcaauaaaggcacc

SEQ ID NO: 1412235 - RNA, 19 nt, Homo sapiens
cuuggugauuaagguccug

SEQ ID NO: 1412236 - RNA, 13 nt, Homo sapiens
cuugucauauucg

SEQ ID NO: 1412237 - RNA, 18 nt, Homo sapiens
cuugugacagauuauaca

SEQ ID NO: 1412238 - RNA, 11 nt, Homo sapiens
cuugugacuag

SEQ ID NO: 1412239 - RNA, 14 nt, Homo sapiens
cuuguuucuacuca

SEQ ID NO: 1412240 - RNA, 18 nt, Homo sapiens
cuuuaaaaaucauuguau

SEQ ID NO: 1412241 - RNA, 12 nt, Homo sapiens
cuuuaccaggag

SEQ ID NO: 1412242 - RNA, 11 nt, Homo sapiens
cuuuacuccuc

SEQ ID NO: 1412243 - RNA, 12 nt, Homo sapiens
cuuuacuccucg

SEQ ID NO: 1412244 - RNA, 21 nt, Homo sapiens
cuuuagacacuggcugccagc

SEQ ID NO: 1412245 - RNA, 20 nt, Homo sapiens
cuuucaacuccaguacucug

SEQ ID NO: 1412246 - RNA, 20 nt, Homo sapiens
cuuucauauuuuccaaauua

SEQ ID NO: 1412247 - RNA, 13 nt, Homo sapiens
cuuucugaugucu

SEQ ID NO: 1412248 - RNA, 19 nt, Homo sapiens
cuuucuggccugcuauguc

SEQ ID NO: 1412249 - RNA, 16 nt, Homo sapiens
cuuucuugaauugcau

SEQ ID NO: 1412250 - RNA, 18 nt, Homo sapiens
cuuuggucaaaguuuucu

SEQ ID NO: 1412251 - RNA, 20 nt, Homo sapiens
cuuuucaccuuaaugcauau

SEQ ID NO: 1412252 - RNA, 22 nt, Homo sapiens
cuuuucuaaaacagggauuuug

SEQ ID NO: 1412253 - RNA, 17 nt, Homo sapiens
cuuuucuacgagaugac

SEQ ID NO: 1412254 - RNA, 21 nt, Homo sapiens
cuuuugagagcucuucagaga

SEQ ID NO: 1412255 - RNA, 15 nt, Homo sapiens
cuuuuggaaggugac

SEQ ID NO: 1412256 - RNA, 16 nt, Homo sapiens
cuuuugugugugucua

SEQ ID NO: 1412257 - RNA, 13 nt, Homo sapiens
cuuuuuccaaaag

SEQ ID NO: 1412258 - RNA, 22 nt, Homo sapiens
gaaaaaugccugcugcugccaa

SEQ ID NO: 1412259 - RNA, 18 nt, Homo sapiens
gaaaacaccccucagcca

SEQ ID NO: 1412260 - RNA, 16 nt, Homo sapiens
gaaaaggcagccagau

SEQ ID NO: 1412261 - RNA, 15 nt, Homo sapiens
gaaaauauagucaca

SEQ ID NO: 1412262 - RNA, 12 nt, Homo sapiens
gaaacaucugau

SEQ ID NO: 1412263 - RNA, 19 nt, Homo sapiens
gaaaccuggccuuauauca

SEQ ID NO: 1412264 - RNA, 15 nt, Homo sapiens
gaaagccucuggaaa

SEQ ID NO: 1412265 - RNA, 13 nt, Homo sapiens
gaaaggggugcuu

SEQ ID NO: 1412266 - RNA, 21 nt, Homo sapiens
gaaaucaucuuuguuggcuca

SEQ ID NO: 1412267 - RNA, 17 nt, Homo sapiens
gaaauggauauuugccu

SEQ ID NO: 1412268 - RNA, 13 nt, Homo sapiens
gaaauguaacaua

SEQ ID NO: 1412269 - RNA, 15 nt, Homo sapiens
gaaauguaacauacu

SEQ ID NO: 1412270 - RNA, 16 nt, Homo sapiens
gaaauguaacauacuc

SEQ ID NO: 1412271 - RNA, 15 nt, Homo sapiens
gaacaagucaccucc

SEQ ID NO: 1412272 - RNA, 15 nt, Homo sapiens
gaacagacacuuuaa

SEQ ID NO: 1412273 - RNA, 17 nt, Homo sapiens
gaacaucuggauuucau

SEQ ID NO: 1412274 - RNA, 17 nt, Homo sapiens
gaaccucacucuugcca

SEQ ID NO: 1412275 - RNA, 18 nt, Homo sapiens
gaaccucacucuugccaa

SEQ ID NO: 1412276 - RNA, 22 nt, Homo sapiens
gaaccucacucuugccaaccug

SEQ ID NO: 1412277 - RNA, 13 nt, Homo sapiens
gaacuaggugauc

SEQ ID NO: 1412278 - RNA, 22 nt, Homo sapiens
gaacuaggugaucucaguucuc

SEQ ID NO: 1412279 - RNA, 16 nt, Homo sapiens
gaacuccugaccucag

SEQ ID NO: 1412280 - RNA, 19 nt, Homo sapiens
gaacuccugaccucaggua

SEQ ID NO: 1412281 - RNA, 17 nt, Homo sapiens
gaagacugggugugcaa

SEQ ID NO: 1412282 - RNA, 14 nt, Homo sapiens
gaagagggaaugag

SEQ ID NO: 1412283 - RNA, 17 nt, Homo sapiens
gaagcagaauugcuuga

SEQ ID NO: 1412284 - RNA, 23 nt, Homo sapiens
gaagccacgguguucugugauau

SEQ ID NO: 1412285 - RNA, 19 nt, Homo sapiens
gaagcuguuuuaucguuaa

SEQ ID NO: 1412286 - RNA, 13 nt, Homo sapiens
gaaguuugcuauu

SEQ ID NO: 1412287 - RNA, 13 nt, Homo sapiens
gaauaaagcuucu

SEQ ID NO: 1412288 - RNA, 15 nt, Homo sapiens
gaauaaagcuucucu

SEQ ID NO: 1412289 - RNA, 17 nt, Homo sapiens
gaaugaucccacucacc

SEQ ID NO: 1412290 - RNA, 23 nt, Homo sapiens
gaauggcacaugucauugcccac

SEQ ID NO: 1412291 - RNA, 12 nt, Homo sapiens
gaauguauauca

SEQ ID NO: 1412292 - RNA, 21 nt, Homo sapiens
gaaugugagcacaaugcauaa

SEQ ID NO: 1412293 - RNA, 18 nt, Homo sapiens
gaauguuguguaacaguu

SEQ ID NO: 1412294 - RNA, 15 nt, Homo sapiens
gaauuaaucuugcuu

SEQ ID NO: 1412295 - RNA, 15 nt, Homo sapiens
gaauugugucugcag

SEQ ID NO: 1412296 - RNA, 14 nt, Homo sapiens
gaauuuucaccucc

SEQ ID NO: 1412297 - RNA, 15 nt, Homo sapiens
gacaagcuuaaugug

SEQ ID NO: 1412298 - RNA, 20 nt, Homo sapiens
gacaauuucuuuuuccaaaa

SEQ ID NO: 1412299 - RNA, 12 nt, Homo sapiens
gacacauucaca

SEQ ID NO: 1412300 - RNA, 14 nt, Homo sapiens
gacaguaacacugg

SEQ ID NO: 1412301 - RNA, 15 nt, Homo sapiens
gacaguaacacuggc

SEQ ID NO: 1412302 - RNA, 16 nt, Homo sapiens
gacaguaacacuggcg

SEQ ID NO: 1412303 - RNA, 22 nt, Homo sapiens
gacaguaguaccaaaugcuuua

SEQ ID NO: 1412304 - RNA, 16 nt, Homo sapiens
gacauuccauggugau

SEQ ID NO: 1412305 - RNA, 16 nt, Homo sapiens
gacccucgcucucugu

SEQ ID NO: 1412306 - RNA, 15 nt, Homo sapiens
gaccucagcugcuuc

SEQ ID NO: 1412307 - RNA, 11 nt, Homo sapiens
gaccucaggua

SEQ ID NO: 1412308 - RNA, 23 nt, Homo sapiens
gaccugcuguaauaaauguauua

SEQ ID NO: 1412309 - RNA, 14 nt, Homo sapiens
gaccuuugucugaa

SEQ ID NO: 1412310 - RNA, 21 nt, Homo sapiens
gacgguuucaaaccaggauuu

SEQ ID NO: 1412311 - RNA, 19 nt, Homo sapiens
gacuaaagaccugcuguaa

SEQ ID NO: 1412312 - RNA, 13 nt, Homo sapiens
gacuagugcugaa

SEQ ID NO: 1412313 - RNA, 14 nt, Homo sapiens
gacuauacugcuga

SEQ ID NO: 1412314 - RNA, 22 nt, Homo sapiens
gacucaacauuacauuugaacu

SEQ ID NO: 1412315 - RNA, 12 nt, Homo sapiens
gacuuauguaau

SEQ ID NO: 1412316 - RNA, 15 nt, Homo sapiens
ucccagcuacuuggg

SEQ ID NO: 1412317 - RNA, 23 nt, Homo sapiens
ucccagguucaagcgauucucau

SEQ ID NO: 1412318 - RNA, 16 nt, Homo sapiens
ucccaguuaccugcac

SEQ ID NO: 1412319 - RNA, 16 nt, Homo sapiens
uccccaaauagccucu

SEQ ID NO: 1412320 - RNA, 21 nt, Homo sapiens
uccccagcccaggguggacuu

SEQ ID NO: 1412321 - RNA, 23 nt, Homo sapiens
uccccagccuccccgugccaaaa

SEQ ID NO: 1412322 - RNA, 15 nt, Homo sapiens
ucccccuaaggcagc

SEQ ID NO: 1412323 - RNA, 21 nt, Homo sapiens
uccccuccaaaucucauguuc

SEQ ID NO: 1412324 - RNA, 16 nt, Homo sapiens
ucccuaggcaccucug

SEQ ID NO: 1412325 - RNA, 13 nt, Homo sapiens
uccgaauuccugc

SEQ ID NO: 1412326 - RNA, 19 nt, Homo sapiens
uccgguuggaggcucucau

SEQ ID NO: 1412327 - RNA, 13 nt, Homo sapiens
uccuaaaacucug

SEQ ID NO: 1412328 - RNA, 14 nt, Homo sapiens
uccuaaaacucugc

SEQ ID NO: 1412329 - RNA, 14 nt, Homo sapiens
uccuauacaguucu

SEQ ID NO: 1412330 - RNA, 20 nt, Homo sapiens
uccucccuuccuuuucccug

SEQ ID NO: 1412331 - RNA, 17 nt, Homo sapiens
uccuccgugcuuccuca

SEQ ID NO: 1412332 - RNA, 19 nt, Homo sapiens
uccucuuccagagucaccu

SEQ ID NO: 1412333 - RNA, 16 nt, Homo sapiens
uccugcccuguagaag

SEQ ID NO: 1412334 - RNA, 13 nt, Homo sapiens
uccugcugcauga

SEQ ID NO: 1412335 - RNA, 14 nt, Homo sapiens
uccugggcacccca

SEQ ID NO: 1412336 - RNA, 18 nt, Homo sapiens
ucggacuauacugcugag

SEQ ID NO: 1412337 - RNA, 18 nt, Homo sapiens
ucgggaaccucacucuug

SEQ ID NO: 1412338 - RNA, 19 nt, Homo sapiens
ucuaaagaaaaaauaaaua

SEQ ID NO: 1412339 - RNA, 21 nt, Homo sapiens
ucuaaauucuuucaugagcuu

SEQ ID NO: 1412340 - RNA, 18 nt, Homo sapiens
ucuaagaaaucaugugca

SEQ ID NO: 1412341 - RNA, 12 nt, Homo sapiens
ucuacauuugaa

SEQ ID NO: 1412342 - RNA, 15 nt, Homo sapiens
ucuaccagagugaug

SEQ ID NO: 1412343 - RNA, 20 nt, Homo sapiens
ucuaccagagugauggauuu

SEQ ID NO: 1412344 - RNA, 17 nt, Homo sapiens
ucuacccuguugcaaag

SEQ ID NO: 1412345 - RNA, 18 nt, Homo sapiens
ucuagaaaauaaugcaaa

SEQ ID NO: 1412346 - RNA, 12 nt, Homo sapiens
ucuagaagccaa

SEQ ID NO: 1412347 - RNA, 16 nt, Homo sapiens
ucuagacagauuggaa

SEQ ID NO: 1412348 - RNA, 15 nt, Homo sapiens
ucuaggcagaagaag

SEQ ID NO: 1412349 - RNA, 16 nt, Homo sapiens
ucuauggcucaugucu

SEQ ID NO: 1412350 - RNA, 20 nt, Homo sapiens
ucucaaccccaucauccugc

SEQ ID NO: 1412351 - RNA, 12 nt, Homo sapiens
ucucacaaauca

SEQ ID NO: 1412352 - RNA, 22 nt, Homo sapiens
ucucaccaugugacacacuggc

SEQ ID NO: 1412353 - RNA, 13 nt, Homo sapiens
ucucagcaaucca

SEQ ID NO: 1412354 - RNA, 15 nt, Homo sapiens
acugcugaguucugg

SEQ ID NO: 1412355 - RNA, 17 nt, Homo sapiens
acuguguuuuugccacu

SEQ ID NO: 1412356 - RNA, 18 nt, Homo sapiens
acuucccgccuccaugac

SEQ ID NO: 1412357 - RNA, 19 nt, Homo sapiens
acuucccgccuccaugacu

SEQ ID NO: 1412358 - RNA, 20 nt, Homo sapiens
acuucccgccuccaugacuc

SEQ ID NO: 1412359 - RNA, 19 nt, Homo sapiens
acuucuguccacucuggag

SEQ ID NO: 1412360 - RNA, 19 nt, Homo sapiens
acuucuguguagacauggu

SEQ ID NO: 1412361 - RNA, 21 nt, Homo sapiens
acuugauaugugcaccaauac

SEQ ID NO: 1412362 - RNA, 17 nt, Homo sapiens
acuugaugccacccaga

SEQ ID NO: 1412363 - RNA, 13 nt, Homo sapiens
acuugcucuggac

SEQ ID NO: 1412364 - RNA, 21 nt, Homo sapiens
acuugggagguugaagcagaa

SEQ ID NO: 1412365 - RNA, 16 nt, Homo sapiens
acuuguuucuacucaa

SEQ ID NO: 1412366 - RNA, 13 nt, Homo sapiens
acuuucuguaauc

SEQ ID NO: 1412367 - RNA, 14 nt, Homo sapiens
acuuucuguaauca

SEQ ID NO: 1412368 - RNA, 16 nt, Homo sapiens
acuuucuguaaucaca

SEQ ID NO: 1412369 - RNA, 16 nt, Homo sapiens
acuuuuggaaggugac

SEQ ID NO: 1412370 - RNA, 19 nt, Homo sapiens
agaaagaaaugucugccau

SEQ ID NO: 1412371 - RNA, 24 nt, Homo sapiens
agaaagaaauugagcgccauaagc

SEQ ID NO: 1412372 - RNA, 18 nt, Homo sapiens
agaaagauuuuaugugcu

SEQ ID NO: 1412373 - RNA, 22 nt, Homo sapiens
agaaaguuuccccaccagugaa

SEQ ID NO: 1412374 - RNA, 23 nt, Homo sapiens
agaaaguuuccccaccagugaau

SEQ ID NO: 1412375 - RNA, 16 nt, Homo sapiens
agaaauguaacauacu

SEQ ID NO: 1412376 - RNA, 14 nt, Homo sapiens
agaaauuaugugcc

SEQ ID NO: 1412377 - RNA, 21 nt, Homo sapiens
agaagcagaugccagcgccau

SEQ ID NO: 1412378 - RNA, 23 nt, Homo sapiens
agaaggcaggugagcaaccaguu

SEQ ID NO: 1412379 - RNA, 15 nt, Homo sapiens
agaagugccaucuca

SEQ ID NO: 1412380 - RNA, 17 nt, Homo sapiens
agaagugucacagccau

SEQ ID NO: 1412381 - RNA, 20 nt, Homo sapiens
agaauaaaauuuuuaaucuu

SEQ ID NO: 1412382 - RNA, 14 nt, Homo sapiens
agaauaaagcaauu

SEQ ID NO: 1412383 - RNA, 23 nt, Homo sapiens
agaaugaugcugugcauaucacu

SEQ ID NO: 1412384 - RNA, 16 nt, Homo sapiens
agaauggcacauguca

SEQ ID NO: 1412385 - RNA, 18 nt, Homo sapiens
agacaauugcauugcuac

SEQ ID NO: 1412386 - RNA, 12 nt, Homo sapiens
agacacauucac

SEQ ID NO: 1412387 - RNA, 17 nt, Homo sapiens
agacacuuuaccaggag

SEQ ID NO: 1412388 - RNA, 22 nt, Homo sapiens
agacagccaacuauggccugug

SEQ ID NO: 1412389 - RNA, 16 nt, Homo sapiens
agacaguaacacuggc

SEQ ID NO: 1412390 - RNA, 18 nt, Homo sapiens
agacaguaacacuggcga

SEQ ID NO: 1412391 - RNA, 21 nt, Homo sapiens
agacccuuuauuggccuuaca

SEQ ID NO: 1412392 - RNA, 14 nt, Homo sapiens
agacucccauggaa

SEQ ID NO: 1412393 - RNA, 19 nt, Homo sapiens
agacucuccacuguuaccu

SEQ ID NO: 1412394 - RNA, 23 nt, Homo sapiens
agacuuucuguaaucacauuuua

SEQ ID NO: 1412395 - RNA, 16 nt, Homo sapiens
agagaacaucuggaga

SEQ ID NO: 1412396 - RNA, 23 nt, Homo sapiens
agagaauauuuuuggcauuccuc

SEQ ID NO: 1412397 - RNA, 14 nt, Homo sapiens
agagcucuucagag

SEQ ID NO: 1412398 - RNA, 19 nt, Homo sapiens
agagcucuucagagaucau

SEQ ID NO: 1412399 - RNA, 15 nt, Homo sapiens
agagcuguggcacag

SEQ ID NO: 1412400 - RNA, 12 nt, Homo sapiens
agaggccauguu

SEQ ID NO: 1412401 - RNA, 17 nt, Homo sapiens
agaggcugagcaccuuu

SEQ ID NO: 1412402 - RNA, 20 nt, Homo sapiens
agaguaauccaagcaaaugu

SEQ ID NO: 1412403 - RNA, 22 nt, Homo sapiens
agauaagacuuccucuaccacc

SEQ ID NO: 1412404 - RNA, 10 nt, Homo sapiens
agauagucac

SEQ ID NO: 1412405 - RNA, 22 nt, Homo sapiens
agaugaaaagcuaccaucacuu

SEQ ID NO: 1412406 - RNA, 21 nt, Homo sapiens
agaugaagacugggugugcaa

SEQ ID NO: 1412407 - RNA, 21 nt, Homo sapiens
agauggaccggcccacacucc

SEQ ID NO: 1412408 - RNA, 15 nt, Homo sapiens
agauguucucuccca

SEQ ID NO: 1412409 - RNA, 22 nt, Homo sapiens
agauuauaauaaauugucauca

SEQ ID NO: 1412410 - RNA, 22 nt, Homo sapiens
agauucccuugcacuguaucau

SEQ ID NO: 1412411 - RNA, 18 nt, Homo sapiens
agauucuucgcacagugu

SEQ ID NO: 1412412 - RNA, 21 nt, Homo sapiens
agauuggaauaggaaauggau

SEQ ID NO: 1412413 - RNA, 15 nt, Homo sapiens
agcaagcccugaccc

SEQ ID NO: 1412414 - RNA, 16 nt, Homo sapiens
agcaagcccugaccca

SEQ ID NO: 1412415 - RNA, 17 nt, Homo sapiens
agcaauguggauaugac

SEQ ID NO: 1412416 - RNA, 14 nt, Homo sapiens
agcaccgcugcuca

SEQ ID NO: 1412417 - RNA, 12 nt, Homo sapiens
agcacuugaugc

SEQ ID NO: 1412418 - RNA, 11 nt, Homo sapiens
agcagaugcca

SEQ ID NO: 1412419 - RNA, 18 nt, Homo sapiens
agcagaugccagcgccau

SEQ ID NO: 1412420 - RNA, 23 nt, Homo sapiens
agcagcuccacaaccaccuccag

SEQ ID NO: 1412421 - RNA, 16 nt, Homo sapiens
agcaggagauugagaa

SEQ ID NO: 1412422 - RNA, 16 nt, Homo sapiens
agcaucacacuugucu

SEQ ID NO: 1412423 - RNA, 15 nt, Homo sapiens
agcauguugugaugu

SEQ ID NO: 1412424 - RNA, 14 nt, Homo sapiens
agccaagggacaca

SEQ ID NO: 1412425 - RNA, 17 nt, Homo sapiens
agccaagggacacagga

SEQ ID NO: 1412426 - RNA, 17 nt, Homo sapiens
agccaaguggggugcug

SEQ ID NO: 1412427 - RNA, 20 nt, Homo sapiens
agccacagcaaaaaguaaag

SEQ ID NO: 1412428 - RNA, 16 nt, Homo sapiens
agccacugcugguguu

SEQ ID NO: 1412429 - RNA, 19 nt, Homo sapiens
agccagcccuggcuuccaa

SEQ ID NO: 1412430 - RNA, 17 nt, Homo sapiens
agccaggcacacacugu

SEQ ID NO: 1412431 - RNA, 21 nt, Homo sapiens
agccaggcuaugguugccacc

SEQ ID NO: 1412432 - RNA, 11 nt, Homo sapiens
agccagugugu

SEQ ID NO: 1412433 - RNA, 21 nt, Homo sapiens
agccaucccaaggcuccugac

SEQ ID NO: 1412434 - RNA, 22 nt, Homo sapiens
agccaugugaaacucaucucau

SEQ ID NO: 1412435 - RNA, 15 nt, Homo sapiens
agccccauacagggc

SEQ ID NO: 1412436 - RNA, 22 nt, Homo sapiens
agccguccaagaacaagucacc

SEQ ID NO: 1412437 - RNA, 18 nt, Homo sapiens
agccuagagugagggccu

SEQ ID NO: 1412438 - RNA, 17 nt, Homo sapiens
agccuccccgugccaaa

SEQ ID NO: 1412439 - RNA, 19 nt, Homo sapiens
agccuccccgugccaaaaa

SEQ ID NO: 1412440 - RNA, 13 nt, Homo sapiens
agccugcacuggg

SEQ ID NO: 1412441 - RNA, 12 nt, Homo sapiens
agccuggcucuu

SEQ ID NO: 1412442 - RNA, 23 nt, Homo sapiens
agccugggaguguuugucccauc

SEQ ID NO: 1412443 - RNA, 16 nt, Homo sapiens
cuccucgucuuugaac

SEQ ID NO: 1412444 - RNA, 15 nt, Homo sapiens
cuccuuuaguuucag

SEQ ID NO: 1412445 - RNA, 17 nt, Homo sapiens
cucggacuauacugcug

SEQ ID NO: 1412446 - RNA, 13 nt, Homo sapiens
cucgucuuugcag

SEQ ID NO: 1412447 - RNA, 13 nt, Homo sapiens
cucguggucccca

SEQ ID NO: 1412448 - RNA, 12 nt, Homo sapiens
cucucaagugcc

SEQ ID NO: 1412449 - RNA, 18 nt, Homo sapiens
cucucagcugaacacccu

SEQ ID NO: 1412450 - RNA, 12 nt, Homo sapiens
cucucaugguga

SEQ ID NO: 1412451 - RNA, 16 nt, Homo sapiens
cucuccucugucccca

SEQ ID NO: 1412452 - RNA, 22 nt, Homo sapiens
cucuccuuuuauguggucucuu

SEQ ID NO: 1412453 - RNA, 19 nt, Homo sapiens
cucucuccaucuaccuucc

SEQ ID NO: 1412454 - RNA, 13 nt, Homo sapiens
cucugacaucaag

SEQ ID NO: 1412455 - RNA, 18 nt, Homo sapiens
cucugagcccgugucaca

SEQ ID NO: 1412456 - RNA, 22 nt, Homo sapiens
cucugaugaugucacacaaaau

SEQ ID NO: 1412457 - RNA, 15 nt, Homo sapiens
cucuucagagaucau

SEQ ID NO: 1412458 - RNA, 20 nt, Homo sapiens
cucuucccggagaauccagc

SEQ ID NO: 1412459 - RNA, 22 nt, Homo sapiens
cucuuccgguuggaggcucuca

SEQ ID NO: 1412460 - RNA, 16 nt, Homo sapiens
cucuugccaaccugua

SEQ ID NO: 1412461 - RNA, 17 nt, Homo sapiens
cucuugccaaccuguaa

SEQ ID NO: 1412462 - RNA, 19 nt, Homo sapiens
cucuugccaaccuguaaua

SEQ ID NO: 1412463 - RNA, 15 nt, Homo sapiens
cucuuuccuucuugc

SEQ ID NO: 1412464 - RNA, 23 nt, Homo sapiens
cugaaagggaaggagacacauuc

SEQ ID NO: 1412465 - RNA, 17 nt, Homo sapiens
cugaacacccuccuuca

SEQ ID NO: 1412466 - RNA, 18 nt, Homo sapiens
cugaacuaggugaucuca

SEQ ID NO: 1412467 - RNA, 19 nt, Homo sapiens
cugaacuaggugaucucag

SEQ ID NO: 1412468 - RNA, 15 nt, Homo sapiens
cugaagacucaggca

SEQ ID NO: 1412469 - RNA, 20 nt, Homo sapiens
cugaaggacucaacauuaca

SEQ ID NO: 1412470 - RNA, 15 nt, Homo sapiens
cugacggacuucauu

SEQ ID NO: 1412471 - RNA, 22 nt, Homo sapiens
cugagaggcaggcauagaggcu

SEQ ID NO: 1412472 - RNA, 14 nt, Homo sapiens
cugagccaccgugu

SEQ ID NO: 1412473 - RNA, 16 nt, Homo sapiens
cugaggaauaaagcuu

SEQ ID NO: 1412474 - RNA, 17 nt, Homo sapiens
cugagucgcucucauga

SEQ ID NO: 1412475 - RNA, 16 nt, Homo sapiens
cugagugucaucucaa

SEQ ID NO: 1412476 - RNA, 17 nt, Homo sapiens
cugaucgggaagcccuu

SEQ ID NO: 1412477 - RNA, 19 nt, Homo sapiens
cugaugcuuuuagcucaaa

SEQ ID NO: 1412478 - RNA, 18 nt, Homo sapiens
cugauguuacuagccucu

SEQ ID NO: 1412479 - RNA, 16 nt, Homo sapiens
cugcacgccggcacca

SEQ ID NO: 1412480 - RNA, 18 nt, Homo sapiens
cugcagaaagaaauugag

SEQ ID NO: 1412481 - RNA, 20 nt, Homo sapiens
cugcagucugggccccauca

SEQ ID NO: 1412482 - RNA, 22 nt, Homo sapiens
cugcauuugucuauucuccagc

SEQ ID NO: 1412483 - RNA, 16 nt, Homo sapiens
cugcccgaggucgcug

SEQ ID NO: 1412484 - RNA, 16 nt, Homo sapiens
cugccguugcugccag

SEQ ID NO: 1412485 - RNA, 17 nt, Homo sapiens
cugcugaccagcacuga

SEQ ID NO: 1412486 - RNA, 14 nt, Homo sapiens
cugcuuaggaguau

SEQ ID NO: 1412487 - RNA, 20 nt, Homo sapiens
cugcuuuugagagcucuuca

SEQ ID NO: 1412488 - RNA, 22 nt, Homo sapiens
cuggaaaacucaggauucucac

SEQ ID NO: 1412489 - RNA, 20 nt, Homo sapiens
cuggaguacaauggcgugau

SEQ ID NO: 1412490 - RNA, 23 nt, Homo sapiens
cuggaguacaauggcgugaucuc

SEQ ID NO: 1412491 - RNA, 18 nt, Homo sapiens
cuggauggagcccaggcg

SEQ ID NO: 1412492 - RNA, 18 nt, Homo sapiens
cuggcaauaaacuuuuag

SEQ ID NO: 1412493 - RNA, 12 nt, Homo sapiens
cuggcagcuuug

SEQ ID NO: 1412494 - RNA, 14 nt, Homo sapiens
cuggcagcuuugaa

SEQ ID NO: 1412495 - RNA, 20 nt, Homo sapiens
cuggccaucccuucauuuaa

SEQ ID NO: 1412496 - RNA, 14 nt, Homo sapiens
cuggcugagguucc

SEQ ID NO: 1412497 - RNA, 14 nt, Homo sapiens
cugggcagacuuga

SEQ ID NO: 1412498 - RNA, 17 nt, Homo sapiens
cugggcagccagagccu

SEQ ID NO: 1412499 - RNA, 19 nt, Homo sapiens
cugggccuccuccuagcug

SEQ ID NO: 1412500 - RNA, 17 nt, Homo sapiens
cugggcucgucuuugca

SEQ ID NO: 1412501 - RNA, 15 nt, Homo sapiens
gaaaaauauggccuu

SEQ ID NO: 1412502 - RNA, 13 nt, Homo sapiens
gaaaauaagcuua

SEQ ID NO: 1412503 - RNA, 14 nt, Homo sapiens
gaaaauaaugcaaa

SEQ ID NO: 1412504 - RNA, 19 nt, Homo sapiens
gaaaaucccggugcuugca

SEQ ID NO: 1412505 - RNA, 21 nt, Homo sapiens
gaaagauuuuaugugcuugaa

SEQ ID NO: 1412506 - RNA, 23 nt, Homo sapiens
gaaagccuaucaaagaccuugug

SEQ ID NO: 1412507 - RNA, 22 nt, Homo sapiens
gaaaggauaggauugacauacc

SEQ ID NO: 1412508 - RNA, 19 nt, Homo sapiens
gaaaguuuccccaccagug

SEQ ID NO: 1412509 - RNA, 22 nt, Homo sapiens
gaaauaaacgcuccccucagac

SEQ ID NO: 1412510 - RNA, 12 nt, Homo sapiens
gaaauaaucucu

SEQ ID NO: 1412511 - RNA, 21 nt, Homo sapiens
gaaaucucaucuuuguaauac

SEQ ID NO: 1412512 - RNA, 14 nt, Homo sapiens
gaaauguaacauac

SEQ ID NO: 1412513 - RNA, 18 nt, Homo sapiens
gaaauguuuucacuuuug

SEQ ID NO: 1412514 - RNA, 20 nt, Homo sapiens
gaaauuaaacagauuagaaa

SEQ ID NO: 1412515 - RNA, 17 nt, Homo sapiens
gaaauuuauaaacuuuu

SEQ ID NO: 1412516 - RNA, 19 nt, Homo sapiens
gaacaagucggcuguggag

SEQ ID NO: 1412517 - RNA, 15 nt, Homo sapiens
gaacacaagugcccc

SEQ ID NO: 1412518 - RNA, 23 nt, Homo sapiens
gaacaucuggagagagagcaaga

SEQ ID NO: 1412519 - RNA, 12 nt, Homo sapiens
gaacaucuguaa

SEQ ID NO: 1412520 - RNA, 18 nt, Homo sapiens
gaaccaaguaguauucau

SEQ ID NO: 1412521 - RNA, 16 nt, Homo sapiens
gaacuaggugaucuca

SEQ ID NO: 1412522 - RNA, 19 nt, Homo sapiens
gaacuccuauuccuugcuu

SEQ ID NO: 1412523 - RNA, 21 nt, Homo sapiens
gaagagggaaugagcuuccau

SEQ ID NO: 1412524 - RNA, 23 nt, Homo sapiens
gaagaggguagagugggcugcug

SEQ ID NO: 1412525 - RNA, 17 nt, Homo sapiens
gaagcaaaaucccuuaa

SEQ ID NO: 1412526 - RNA, 18 nt, Homo sapiens
gaagcccuucagugcccu

SEQ ID NO: 1412527 - RNA, 22 nt, Homo sapiens
gaagccucuaacaaaugaucua

SEQ ID NO: 1412528 - RNA, 20 nt, Homo sapiens
gaaggcaucagaaacaucug

SEQ ID NO: 1412529 - RNA, 22 nt, Homo sapiens
gaaggcaucagaaacaucugau

SEQ ID NO: 1412530 - RNA, 21 nt, Homo sapiens
gaagugucacagccauaguca

SEQ ID NO: 1412531 - RNA, 13 nt, Homo sapiens
gaaguuggggaaa

SEQ ID NO: 1412532 - RNA, 14 nt, Homo sapiens
gaauauaauacauu

SEQ ID NO: 1412533 - RNA, 22 nt, Homo sapiens
gaauauuuuuggcauuccucua

SEQ ID NO: 1412534 - RNA, 16 nt, Homo sapiens
gaaucuaaaaccaaau

SEQ ID NO: 1412535 - RNA, 22 nt, Homo sapiens
gaauggcacaugucauugccca

SEQ ID NO: 1412536 - RNA, 21 nt, Homo sapiens
gaauucugggcaagucaccca

SEQ ID NO: 1412537 - RNA, 10 nt, Homo sapiens
gaauuuccac

SEQ ID NO: 1412538 - RNA, 16 nt, Homo sapiens
gaauuugaaacacuuu

SEQ ID NO: 1412539 - RNA, 20 nt, Homo sapiens
gacaauacaaauacaaagga

SEQ ID NO: 1412540 - RNA, 12 nt, Homo sapiens
gacacacuggcu

SEQ ID NO: 1412541 - RNA, 22 nt, Homo sapiens
gacaccacgcuggagcugugua

SEQ ID NO: 1412542 - RNA, 12 nt, Homo sapiens
gacaguggcacc

SEQ ID NO: 1412543 - RNA, 16 nt, Homo sapiens
gacauaaggagugccu

SEQ ID NO: 1412544 - RNA, 18 nt, Homo sapiens
gacauaaggagugccuga

SEQ ID NO: 1412545 - RNA, 18 nt, Homo sapiens
gacauguacauacuguau

SEQ ID NO: 1412546 - RNA, 17 nt, Homo sapiens
gacauucuaugcuuaca

SEQ ID NO: 1412547 - RNA, 17 nt, Homo sapiens
gaccaauggguuugcca

SEQ ID NO: 1412548 - RNA, 14 nt, Homo sapiens
gaccccuccucacu

SEQ ID NO: 1412549 - RNA, 22 nt, Homo sapiens
gaccguuucuuaacaaucaaau

SEQ ID NO: 1412550 - RNA, 13 nt, Homo sapiens
gaccucaggugau

SEQ ID NO: 1412551 - RNA, 12 nt, Homo sapiens
gaccucauuuac

SEQ ID NO: 1412552 - RNA, 18 nt, Homo sapiens
gaccucauuuacaaagca

SEQ ID NO: 1412553 - RNA, 15 nt, Homo sapiens
gacgcagccacacag

SEQ ID NO: 1412554 - RNA, 14 nt, Homo sapiens
gacucaacauuaca

SEQ ID NO: 1412555 - RNA, 17 nt, Homo sapiens
gacugcaaugagguaga

SEQ ID NO: 1412556 - RNA, 16 nt, Homo sapiens
gacuuuucaccuuaau

SEQ ID NO: 1412557 - RNA, 23 nt, Homo sapiens
gagaaagagaaaucaauagugca

SEQ ID NO: 1412558 - RNA, 16 nt, Homo sapiens
gagaagggacaaaagg

SEQ ID NO: 1412559 - RNA, 18 nt, Homo sapiens
gagaauuaggaaggccau

SEQ ID NO: 1412560 - RNA, 18 nt, Homo sapiens
gagacacauucacaaaga

SEQ ID NO: 1412561 - RNA, 16 nt, Homo sapiens
gcaccccaggcagcuc

SEQ ID NO: 1412562 - RNA, 21 nt, Homo sapiens
gcaccuguugugugccugaca

SEQ ID NO: 1412563 - RNA, 22 nt, Homo sapiens
gcacugaccccgaccucagaga

SEQ ID NO: 1412564 - RNA, 15 nt, Homo sapiens
gcagaacacacucuu

SEQ ID NO: 1412565 - RNA, 16 nt, Homo sapiens
gcagcagcugugacca

SEQ ID NO: 1412566 - RNA, 18 nt, Homo sapiens
gcagcugugaccacagca

SEQ ID NO: 1412567 - RNA, 18 nt, Homo sapiens
gcaggauugauuaugcag

SEQ ID NO: 1412568 - RNA, 15 nt, Homo sapiens
gcaggguauggccag

SEQ ID NO: 1412569 - RNA, 13 nt, Homo sapiens
gcagucacuggag

SEQ ID NO: 1412570 - RNA, 19 nt, Homo sapiens
gcagugccaacucuuggag

SEQ ID NO: 1412571 - RNA, 21 nt, Homo sapiens
gcaguucccaaggacagucag

SEQ ID NO: 1412572 - RNA, 22 nt, Homo sapiens
gcauauuauuuuauguugcaua

SEQ ID NO: 1412573 - RNA, 13 nt, Homo sapiens
gcaucgagccacc

SEQ ID NO: 1412574 - RNA, 13 nt, Homo sapiens
gcaugaccuauca

SEQ ID NO: 1412575 - RNA, 11 nt, Homo sapiens
gcaugguggcu

SEQ ID NO: 1412576 - RNA, 20 nt, Homo sapiens
gcauucaggcuucucaggug

SEQ ID NO: 1412577 - RNA, 16 nt, Homo sapiens
gccaaccuguaauaaa

SEQ ID NO: 1412578 - RNA, 22 nt, Homo sapiens
gccaaccuguaauaaauaugag

SEQ ID NO: 1412579 - RNA, 12 nt, Homo sapiens
gccaagcccuuu

SEQ ID NO: 1412580 - RNA, 20 nt, Homo sapiens
gccaagggaaaggggugcuu

SEQ ID NO: 1412581 - RNA, 17 nt, Homo sapiens
gccacaccccagacucc

SEQ ID NO: 1412582 - RNA, 15 nt, Homo sapiens
gccaccgcugcugcu

SEQ ID NO: 1412583 - RNA, 19 nt, Homo sapiens
gccacgucuuccuucugcc

SEQ ID NO: 1412584 - RNA, 15 nt, Homo sapiens
gccacucuacagguc

SEQ ID NO: 1412585 - RNA, 17 nt, Homo sapiens
gccacucuacaggucca

SEQ ID NO: 1412586 - RNA, 19 nt, Homo sapiens
gccagccaguucccagguc

SEQ ID NO: 1412587 - RNA, 20 nt, Homo sapiens
gccagcugaugacucaagau

SEQ ID NO: 1412588 - RNA, 17 nt, Homo sapiens
gccaucccaaggcuccu

SEQ ID NO: 1412589 - RNA, 23 nt, Homo sapiens
gccaugcuuccuauacaguucua

SEQ ID NO: 1412590 - RNA, 19 nt, Homo sapiens
gccauuugcugcuuaacag

SEQ ID NO: 1412591 - RNA, 18 nt, Homo sapiens
gcccaccgcaggccuuac

SEQ ID NO: 1412592 - RNA, 22 nt, Homo sapiens
gcccaggagagagaaagccagg

SEQ ID NO: 1412593 - RNA, 16 nt, Homo sapiens
gccccauacagggcau

SEQ ID NO: 1412594 - RNA, 22 nt, Homo sapiens
gcccccacccaccuuccuugcg

SEQ ID NO: 1412595 - RNA, 13 nt, Homo sapiens
gccccuacauuuu

SEQ ID NO: 1412596 - RNA, 22 nt, Homo sapiens
gccccucccccuaaggcagcug

SEQ ID NO: 1412597 - RNA, 20 nt, Homo sapiens
gccccuuaguccccaagccc

SEQ ID NO: 1412598 - RNA, 15 nt, Homo sapiens
gcccgguguucagug

SEQ ID NO: 1412599 - RNA, 23 nt, Homo sapiens
gcccucaccagaagcagaugcca

SEQ ID NO: 1412600 - RNA, 16 nt, Homo sapiens
gcccucugcuaaagcc

SEQ ID NO: 1412601 - RNA, 19 nt, Homo sapiens
gcccugacggacuucauuc

SEQ ID NO: 1412602 - RNA, 22 nt, Homo sapiens
gcccugaggaauaaagcuucuc

SEQ ID NO: 1412603 - RNA, 17 nt, Homo sapiens
gcccuuacccaccuguc

SEQ ID NO: 1412604 - RNA, 13 nt, Homo sapiens
gcccuuggccaga

SEQ ID NO: 1412605 - RNA, 20 nt, Homo sapiens
gcccuuggccagaagucaag

SEQ ID NO: 1412606 - RNA, 12 nt, Homo sapiens
gccgacucagca

SEQ ID NO: 1412607 - RNA, 19 nt, Homo sapiens
gccgagccugcacuggggc

SEQ ID NO: 1412608 - RNA, 19 nt, Homo sapiens
gccgcucccgguucccucc

SEQ ID NO: 1412609 - RNA, 13 nt, Homo sapiens
gccgcucuucacu

SEQ ID NO: 1412610 - RNA, 13 nt, Homo sapiens
gccgcugcugacc

SEQ ID NO: 1412611 - RNA, 14 nt, Homo sapiens
gccgcugcugacca

SEQ ID NO: 1412612 - RNA, 22 nt, Homo sapiens
gccgggccggccccaccugccu

SEQ ID NO: 1412613 - RNA, 22 nt, Homo sapiens
gccguccaagaacaagucaccu

SEQ ID NO: 1412614 - RNA, 18 nt, Homo sapiens
gccuaaaacacuugccaa

SEQ ID NO: 1412615 - RNA, 19 nt, Homo sapiens
gccuaggugggagccacca

SEQ ID NO: 1412616 - RNA, 20 nt, Homo sapiens
gccuaggugggagccaccac

SEQ ID NO: 1412617 - RNA, 20 nt, Homo sapiens
gccuaugguuuuucuguguc

SEQ ID NO: 1412618 - RNA, 16 nt, Homo sapiens
gccucaacauacuguu

SEQ ID NO: 1412619 - RNA, 12 nt, Homo sapiens
gccucaugaaca

SEQ ID NO: 1412620 - RNA, 12 nt, Homo sapiens
gccuccaugacu

SEQ ID NO: 1412621 - RNA, 17 nt, Homo sapiens
gccuccccgugccaaaa

SEQ ID NO: 1412622 - RNA, 18 nt, Homo sapiens
gccuccccgugccaaaaa

SEQ ID NO: 1412623 - RNA, 17 nt, Homo sapiens
ggaugcaaauaaagccu

SEQ ID NO: 1412624 - RNA, 22 nt, Homo sapiens
ggaugucccaccucucugagcu

SEQ ID NO: 1412625 - RNA, 18 nt, Homo sapiens
ggauuuuaaaugcuguau

SEQ ID NO: 1412626 - RNA, 17 nt, Homo sapiens
ggcaacgacgguuucaa

SEQ ID NO: 1412627 - RNA, 13 nt, Homo sapiens
ggcacacacugug

SEQ ID NO: 1412628 - RNA, 12 nt, Homo sapiens
ggcaccauucag

SEQ ID NO: 1412629 - RNA, 22 nt, Homo sapiens
ggcacccgcccagccgggcugg

SEQ ID NO: 1412630 - RNA, 17 nt, Homo sapiens
ggcagagcuguggcaca

SEQ ID NO: 1412631 - RNA, 14 nt, Homo sapiens
ggcagcagcuguga

SEQ ID NO: 1412632 - RNA, 22 nt, Homo sapiens
ggcaggcucacugccaggccag

SEQ ID NO: 1412633 - RNA, 16 nt, Homo sapiens
ggcaugccccggccac

SEQ ID NO: 1412634 - RNA, 19 nt, Homo sapiens
ggccacaccccagacucca

SEQ ID NO: 1412635 - RNA, 16 nt, Homo sapiens
ggccaccccaccagaa

SEQ ID NO: 1412636 - RNA, 20 nt, Homo sapiens
ggccaggcuggucuugaacu

SEQ ID NO: 1412637 - RNA, 23 nt, Homo sapiens
ggcccuagcuaauaaaccuguaa

SEQ ID NO: 1412638 - RNA, 20 nt, Homo sapiens
ggccgccuacucccagcugg

SEQ ID NO: 1412639 - RNA, 16 nt, Homo sapiens
ggccuguggaucaaau

SEQ ID NO: 1412640 - RNA, 16 nt, Homo sapiens
ggccuugccugggaua

SEQ ID NO: 1412641 - RNA, 12 nt, Homo sapiens
ggcgagcuguuc

SEQ ID NO: 1412642 - RNA, 22 nt, Homo sapiens
ggcgccugauugcugaguguca

SEQ ID NO: 1412643 - RNA, 16 nt, Homo sapiens
ggcgggcagggguucc

SEQ ID NO: 1412644 - RNA, 12 nt, Homo sapiens
ggcucuggagac

SEQ ID NO: 1412645 - RNA, 21 nt, Homo sapiens
ggcucugugcagucacuggag

SEQ ID NO: 1412646 - RNA, 15 nt, Homo sapiens
gggaaaacaccccuc

SEQ ID NO: 1412647 - RNA, 21 nt, Homo sapiens
gggaaccucacucuugccaac

SEQ ID NO: 1412648 - RNA, 17 nt, Homo sapiens
gggaagcugaccuuuaa

SEQ ID NO: 1412649 - RNA, 21 nt, Homo sapiens
gggagauaggccuugcuugcu

SEQ ID NO: 1412650 - RNA, 17 nt, Homo sapiens
gggagcugcuggccaug

SEQ ID NO: 1412651 - RNA, 21 nt, Homo sapiens
gggaggcucggggcuccccac

SEQ ID NO: 1412652 - RNA, 23 nt, Homo sapiens
gggcagcucccagccucuuccca

SEQ ID NO: 1412653 - RNA, 14 nt, Homo sapiens
gggccacccagcca

SEQ ID NO: 1412654 - RNA, 14 nt, Homo sapiens
gggcgcccagccca

SEQ ID NO: 1412655 - RNA, 17 nt, Homo sapiens
ggggagagcuggcagug

SEQ ID NO: 1412656 - RNA, 17 nt, Homo sapiens
ggguggcagagacagug

SEQ ID NO: 1412657 - RNA, 20 nt, Homo sapiens
gggugggcuugggcaauaaa

SEQ ID NO: 1412658 - RNA, 13 nt, Homo sapiens
gggugggggugga

SEQ ID NO: 1412659 - RNA, 20 nt, Homo sapiens
gggugugguggcaugugccu

SEQ ID NO: 1412660 - RNA, 13 nt, Homo sapiens
gguaggcauucca

SEQ ID NO: 1412661 - RNA, 19 nt, Homo sapiens
gguauugaacugcagguga

SEQ ID NO: 1412662 - RNA, 15 nt, Homo sapiens
ggucccaggaccuga

SEQ ID NO: 1412663 - RNA, 14 nt, Homo sapiens
ggucucagcaugua

SEQ ID NO: 1412664 - RNA, 12 nt, Homo sapiens
ggucucaucucc

SEQ ID NO: 1412665 - RNA, 15 nt, Homo sapiens
ggugaaaucugcucu

SEQ ID NO: 1412666 - RNA, 15 nt, Homo sapiens
ggugauuccugggaa

SEQ ID NO: 1412667 - RNA, 13 nt, Homo sapiens
ggugcucagucuc

SEQ ID NO: 1412668 - RNA, 17 nt, Homo sapiens
gguggagguugcaguga

SEQ ID NO: 1412669 - RNA, 14 nt, Homo sapiens
ggugugguggcaug

SEQ ID NO: 1412670 - RNA, 17 nt, Homo sapiens
gguuauuguucagacau

SEQ ID NO: 1412671 - RNA, 19 nt, Homo sapiens
gguuguuuaaaagagccug

SEQ ID NO: 1412672 - RNA, 18 nt, Homo sapiens
gguuucuaucugcaauua

SEQ ID NO: 1412673 - RNA, 19 nt, Homo sapiens
gguuugaagcugcugucuc

SEQ ID NO: 1412674 - RNA, 21 nt, Homo sapiens
guaaaacauuccaaauaauuc

SEQ ID NO: 1412675 - RNA, 16 nt, Homo sapiens
guaaauuccccuuccc

SEQ ID NO: 1412676 - RNA, 15 nt, Homo sapiens
guaaauucucuccca

SEQ ID NO: 1412677 - RNA, 11 nt, Homo sapiens
guaacacuggc

SEQ ID NO: 1412678 - RNA, 13 nt, Homo sapiens
guaacagcuccuu

SEQ ID NO: 1412679 - RNA, 21 nt, Homo sapiens
guaaguaguaaugauucucaa

SEQ ID NO: 1412680 - RNA, 20 nt, Homo sapiens
guaaguuucugugaccugua

SEQ ID NO: 1412681 - RNA, 14 nt, Homo sapiens
guaauaaaaagcca

SEQ ID NO: 1412682 - RNA, 16 nt, Homo sapiens
guaauaaacagccagg

SEQ ID NO: 1412683 - RNA, 19 nt, Homo sapiens
guacaaaguacuagcuaaa

SEQ ID NO: 1412684 - RNA, 19 nt, Homo sapiens
guacaauggcgugaucuca

SEQ ID NO: 1412685 - RNA, 14 nt, Homo sapiens
guacacauuuugua

SEQ ID NO: 1412686 - RNA, 21 nt, Homo sapiens
guacacauuuuguaauuaccu

SEQ ID NO: 1412687 - RNA, 19 nt, Homo sapiens
guaccaaauuuaagcaaga

SEQ ID NO: 1412688 - RNA, 15 nt, Homo sapiens
guagaagugucacag

SEQ ID NO: 1412689 - RNA, 18 nt, Homo sapiens
uacauagcauuuguguaa

SEQ ID NO: 1412690 - RNA, 18 nt, Homo sapiens
uacauccugcagcuuauu

SEQ ID NO: 1412691 - RNA, 20 nt, Homo sapiens
uacauuagcugaaaagagaa

SEQ ID NO: 1412692 - RNA, 22 nt, Homo sapiens
uacauuugaacuauauccuucc

SEQ ID NO: 1412693 - RNA, 15 nt, Homo sapiens
uaccaaauauuugaa

SEQ ID NO: 1412694 - RNA, 14 nt, Homo sapiens
uaccaaaugcuuua

SEQ ID NO: 1412695 - RNA, 21 nt, Homo sapiens
uaccaaguuucauaccaaaua

SEQ ID NO: 1412696 - RNA, 14 nt, Homo sapiens
uaccaaucgucuca

SEQ ID NO: 1412697 - RNA, 17 nt, Homo sapiens
uaccacugagaccuuca

SEQ ID NO: 1412698 - RNA, 23 nt, Homo sapiens
uaccccuaacauacugcauuuca

SEQ ID NO: 1412699 - RNA, 17 nt, Homo sapiens
uaccuuagcuucacuca

SEQ ID NO: 1412700 - RNA, 14 nt, Homo sapiens
uaccuuuccccaaa

SEQ ID NO: 1412701 - RNA, 15 nt, Homo sapiens
uacgcugucucugac

SEQ ID NO: 1412702 - RNA, 15 nt, Homo sapiens
uacggugauccuuuu

SEQ ID NO: 1412703 - RNA, 18 nt, Homo sapiens
uacguggaugauuucuac

SEQ ID NO: 1412704 - RNA, 13 nt, Homo sapiens
uacuaugcauugu

SEQ ID NO: 1412705 - RNA, 13 nt, Homo sapiens
uacugcauuucac

SEQ ID NO: 1412706 - RNA, 18 nt, Homo sapiens
uacugcauuucacucugg

SEQ ID NO: 1412707 - RNA, 23 nt, Homo sapiens
uacuuuacaauuaaacucaaagc

SEQ ID NO: 1412708 - RNA, 23 nt, Homo sapiens
uacuuuucucuuucuucucugcu

SEQ ID NO: 1412709 - RNA, 21 nt, Homo sapiens
uagaaaucucaucuuuguaau

SEQ ID NO: 1412710 - RNA, 20 nt, Homo sapiens
uagaaauguaacauacucau

SEQ ID NO: 1412711 - RNA, 16 nt, Homo sapiens
uagaagugccaucuca

SEQ ID NO: 1412712 - RNA, 19 nt, Homo sapiens
uagaagugucacagccaua

SEQ ID NO: 1412713 - RNA, 13 nt, Homo sapiens
uagaauggcacau

SEQ ID NO: 1412714 - RNA, 17 nt, Homo sapiens
uagaauggcacauguca

SEQ ID NO: 1412715 - RNA, 15 nt, Homo sapiens
uagacacuggcugcc

SEQ ID NO: 1412716 - RNA, 23 nt, Homo sapiens
uagagaaagaaaugucugccauu

SEQ ID NO: 1412717 - RNA, 22 nt, Homo sapiens
uagagccaggcacacacugugc

SEQ ID NO: 1412718 - RNA, 15 nt, Homo sapiens
uagaugacaguggca

SEQ ID NO: 1412719 - RNA, 20 nt, Homo sapiens
uagcaaacaccaccaaguuc

SEQ ID NO: 1412720 - RNA, 20 nt, Homo sapiens
uagccaaacaacaacaaaaa

SEQ ID NO: 1412721 - RNA, 15 nt, Homo sapiens
uaggauugacauacc

SEQ ID NO: 1412722 - RNA, 22 nt, Homo sapiens
uaggcaaagaaagcucuagaca

SEQ ID NO: 1412723 - RNA, 17 nt, Homo sapiens
uaggcaccucugugcug

SEQ ID NO: 1412724 - RNA, 17 nt, Homo sapiens
uaggguaguuugcaaac

SEQ ID NO: 1412725 - RNA, 19 nt, Homo sapiens
uagucucugaacuagguga

SEQ ID NO: 1412726 - RNA, 17 nt, Homo sapiens
uagugcugaagcuuauu

SEQ ID NO: 1412727 - RNA, 14 nt, Homo sapiens
uagugguauuauac

SEQ ID NO: 1412728 - RNA, 14 nt, Homo sapiens
uaguuauacuccuc

SEQ ID NO: 1412729 - RNA, 13 nt, Homo sapiens
uaguucuuuucau

SEQ ID NO: 1412730 - RNA, 17 nt, Homo sapiens
uaguucuuuucaugcaa

SEQ ID NO: 1412731 - RNA, 14 nt, Homo sapiens
uaguuuuaguucug

SEQ ID NO: 1412732 - RNA, 18 nt, Homo sapiens
uaguuuuuauuaaacuca

SEQ ID NO: 1412733 - RNA, 19 nt, Homo sapiens
uauaaaagguuguguacaa

SEQ ID NO: 1412734 - RNA, 14 nt, Homo sapiens
uauaauagaugaca

SEQ ID NO: 1412735 - RNA, 13 nt, Homo sapiens
uauaccucuugaa

SEQ ID NO: 1412736 - RNA, 18 nt, Homo sapiens
uauacuccucaagcugaa

SEQ ID NO: 1412737 - RNA, 19 nt, Homo sapiens
uaucaaccuaaaugaguca

SEQ ID NO: 1412738 - RNA, 11 nt, Homo sapiens
uaucauuucau

SEQ ID NO: 1412739 - RNA, 19 nt, Homo sapiens
uaucauuucaugcuuugau

SEQ ID NO: 1412740 - RNA, 22 nt, Homo sapiens
uaugcagaacagugagccaaau

SEQ ID NO: 1412741 - RNA, 19 nt, Homo sapiens
uauguaugacuuugugcca

SEQ ID NO: 1412742 - RNA, 13 nt, Homo sapiens
uauuaaaccuuca

SEQ ID NO: 1412743 - RNA, 14 nt, Homo sapiens
uauuaaacucaugg

SEQ ID NO: 1412744 - RNA, 12 nt, Homo sapiens
uauuaagugaaa

SEQ ID NO: 1412745 - RNA, 21 nt, Homo sapiens
uauuaguuuuuauuaaacuca

SEQ ID NO: 1412746 - RNA, 21 nt, Homo sapiens
uauucugugaaacuaaucaua

SEQ ID NO: 1412747 - RNA, 18 nt, Homo sapiens
uauugaacugcaggugac

SEQ ID NO: 1412748 - RNA, 19 nt, Homo sapiens
uauugaaucuaaaaccaaa

SEQ ID NO: 1412749 - RNA, 19 nt, Homo sapiens
uauuucuaauucaguucug

SEQ ID NO: 1412750 - RNA, 18 nt, Homo sapiens
uauuucugaaacaauuaa

SEQ ID NO: 1412751 - RNA, 22 nt, Homo sapiens
uggcucuggagacagccccaga

SEQ ID NO: 1412752 - RNA, 17 nt, Homo sapiens
uggcugagguuccucug

SEQ ID NO: 1412753 - RNA, 15 nt, Homo sapiens
uggcugcaagugguu

SEQ ID NO: 1412754 - RNA, 16 nt, Homo sapiens
ugggaacuaauuucaa

SEQ ID NO: 1412755 - RNA, 17 nt, Homo sapiens
ugggacuguuuacaaau

SEQ ID NO: 1412756 - RNA, 19 nt, Homo sapiens
ugggacuguuuacaaauga

SEQ ID NO: 1412757 - RNA, 18 nt, Homo sapiens
ugggagcaaucuggaaaa

SEQ ID NO: 1412758 - RNA, 18 nt, Homo sapiens
ugggaggaagcagaauaa

SEQ ID NO: 1412759 - RNA, 18 nt, Homo sapiens
ugggaggagggagaggga

SEQ ID NO: 1412760 - RNA, 20 nt, Homo sapiens
ugggauuacaggcacaugca

SEQ ID NO: 1412761 - RNA, 15 nt, Homo sapiens
ugggauuacaggugu

SEQ ID NO: 1412762 - RNA, 14 nt, Homo sapiens
ugggccccaucauu

SEQ ID NO: 1412763 - RNA, 19 nt, Homo sapiens
ugggcccucccugccacac

SEQ ID NO: 1412764 - RNA, 22 nt, Homo sapiens
ugggcccuuccuggcuaggacu

SEQ ID NO: 1412765 - RNA, 16 nt, Homo sapiens
ugggcuugggcaauaa

SEQ ID NO: 1412766 - RNA, 15 nt, Homo sapiens
uggggagagcuggca

SEQ ID NO: 1412767 - RNA, 22 nt, Homo sapiens
uggggagggggucgggguccca

SEQ ID NO: 1412768 - RNA, 14 nt, Homo sapiens
ugggguagggugag

SEQ ID NO: 1412769 - RNA, 16 nt, Homo sapiens
uggguaaaucagggac

SEQ ID NO: 1412770 - RNA, 23 nt, Homo sapiens
uggguaccaaauuuaagcaagau

SEQ ID NO: 1412771 - RNA, 17 nt, Homo sapiens
ugggugugcaacuugag

SEQ ID NO: 1412772 - RNA, 20 nt, Homo sapiens
ugguaagaccucugagacca

SEQ ID NO: 1412773 - RNA, 22 nt, Homo sapiens
uggucccugcccucaucucucu

SEQ ID NO: 1412774 - RNA, 14 nt, Homo sapiens
uggucuucagcaaa

SEQ ID NO: 1412775 - RNA, 21 nt, Homo sapiens
ugguuauuguucagacauucc

SEQ ID NO: 1412776 - RNA, 23 nt, Homo sapiens
ugguugguuuuauacuauauuaa

SEQ ID NO: 1412777 - RNA, 22 nt, Homo sapiens
ugguuuuaaagcuaaacguaau

SEQ ID NO: 1412778 - RNA, 15 nt, Homo sapiens
uguaagcaacacuuu

SEQ ID NO: 1412779 - RNA, 19 nt, Homo sapiens
uguaagccaucacaccugg

SEQ ID NO: 1412780 - RNA, 17 nt, Homo sapiens
uguaauaaauaugagug

SEQ ID NO: 1412781 - RNA, 14 nt, Homo sapiens
uguagaaaucucau

SEQ ID NO: 1412782 - RNA, 16 nt, Homo sapiens
uguauauguagcaaaa

SEQ ID NO: 1412783 - RNA, 21 nt, Homo sapiens
uguauauuugaacuccucuca

SEQ ID NO: 1412784 - RNA, 18 nt, Homo sapiens
ugucaaauaaacacugug

SEQ ID NO: 1412785 - RNA, 16 nt, Homo sapiens
ugucacuccauaaaaa

SEQ ID NO: 1412786 - RNA, 15 nt, Homo sapiens
ugucccucccaccuc

SEQ ID NO: 1412787 - RNA, 18 nt, Homo sapiens
uguccuuguagagcacag

SEQ ID NO: 1412788 - RNA, 22 nt, Homo sapiens
ugucucuagaagugccaucuca

SEQ ID NO: 1412789 - RNA, 23 nt, Homo sapiens
ugucugaaaaaugccugcugcug

SEQ ID NO: 1412790 - RNA, 18 nt, Homo sapiens
ugucugagagccauaaau

SEQ ID NO: 1412791 - RNA, 18 nt, Homo sapiens
ugucuuuuuucuaaagua

SEQ ID NO: 1412792 - RNA, 15 nt, Homo sapiens
ugugacacacuggcu

SEQ ID NO: 1412793 - RNA, 15 nt, Homo sapiens
ugugaccacagcagu

SEQ ID NO: 1412794 - RNA, 18 nt, Homo sapiens
ugugagcacaaugcauaa

SEQ ID NO: 1412795 - RNA, 22 nt, Homo sapiens
ugugagcuaggaauuguguuua

SEQ ID NO: 1412796 - RNA, 19 nt, Homo sapiens
ugugauguggggaagagcu

SEQ ID NO: 1412797 - RNA, 10 nt, Homo sapiens
ugugccucaa

SEQ ID NO: 1412798 - RNA, 13 nt, Homo sapiens
uguggcagugguu

SEQ ID NO: 1412799 - RNA, 18 nt, Homo sapiens
uguggucauaucuaguca

SEQ ID NO: 1412800 - RNA, 19 nt, Homo sapiens
uguguauauguagcaaaau

SEQ ID NO: 1412801 - RNA, 12 nt, Homo sapiens
ugugucaaugug

SEQ ID NO: 1412802 - RNA, 16 nt, Homo sapiens
uguguucgcgugugug

SEQ ID NO: 1412803 - RNA, 19 nt, Homo sapiens
uguuaccucugacaucaag

SEQ ID NO: 1412804 - RNA, 13 nt, Homo sapiens
uguuacugccaaa

SEQ ID NO: 1412805 - RNA, 18 nt, Homo sapiens
uguuaucugaacugugga

SEQ ID NO: 1412806 - RNA, 15 nt, Homo sapiens
uguucaaagugugac

SEQ ID NO: 1412807 - RNA, 21 nt, Homo sapiens
uguuggcagcauaaaggccuu

SEQ ID NO: 1412808 - RNA, 17 nt, Homo sapiens
uguuuaugugaacauuc

SEQ ID NO: 1412809 - RNA, 19 nt, Homo sapiens
uguuuccuuauauuaugga

SEQ ID NO: 1412810 - RNA, 14 nt, Homo sapiens
uguuugugcuucua

SEQ ID NO: 1412811 - RNA, 16 nt, Homo sapiens
uguuuguggaacaaaa

SEQ ID NO: 1412812 - RNA, 23 nt, Homo sapiens
uguuuuguccccuccaaaucuca

SEQ ID NO: 1412813 - RNA, 15 nt, Homo sapiens
uuaaaacaaugaagu

SEQ ID NO: 1412814 - RNA, 14 nt, Homo sapiens
uuaaaaccaaagag

SEQ ID NO: 1412815 - RNA, 14 nt, Homo sapiens
uuaaacagauuaga

SEQ ID NO: 1412816 - RNA, 13 nt, Homo sapiens
uuaaacgggcugc

SEQ ID NO: 1412817 - RNA, 11 nt, Homo sapiens
uuaaacugcca

SEQ ID NO: 1412818 - RNA, 16 nt, Homo sapiens
uuaaacuuuaucucac

SEQ ID NO: 1412819 - RNA, 17 nt, Homo sapiens
uuaaacuuuaucucaca

SEQ ID NO: 1412820 - RNA, 19 nt, Homo sapiens
uuaaaugcuguaugucauu

SEQ ID NO: 1412821 - RNA, 16 nt, Homo sapiens
uuaaauguucauguca

SEQ ID NO: 1412822 - RNA, 19 nt, Homo sapiens
uuaagauggcuacaccuca

SEQ ID NO: 1412823 - RNA, 21 nt, Homo sapiens
uuaagugcacaccgugugcca

SEQ ID NO: 1412824 - RNA, 22 nt, Homo sapiens
uuaaugacuggcuacagaguaa

SEQ ID NO: 1412825 - RNA, 15 nt, Homo sapiens
uuaaugcaaugagca

SEQ ID NO: 1412826 - RNA, 16 nt, Homo sapiens
uuaauuuugcaguguu

SEQ ID NO: 1412827 - RNA, 16 nt, Homo sapiens
uuacaagaaaacuaca

SEQ ID NO: 1412828 - RNA, 12 nt, Homo sapiens
uuacagucuucu

SEQ ID NO: 1412829 - RNA, 15 nt, Homo sapiens
aaaguacuagcuaaa

SEQ ID NO: 1412830 - RNA, 22 nt, Homo sapiens
aaaguguaacggccaacacuuu

SEQ ID NO: 1412831 - RNA, 19 nt, Homo sapiens
aaaguugggauuugcaaau

SEQ ID NO: 1412832 - RNA, 21 nt, Homo sapiens
aaaguuuccccaccagugaau

SEQ ID NO: 1412833 - RNA, 13 nt, Homo sapiens
aaauaagccacau

SEQ ID NO: 1412834 - RNA, 14 nt, Homo sapiens
aaauaugagugcca

SEQ ID NO: 1412835 - RNA, 23 nt, Homo sapiens
aaauauucaguaacuuguuuaca

SEQ ID NO: 1412836 - RNA, 15 nt, Homo sapiens
aaaucagacuaugaa

SEQ ID NO: 1412837 - RNA, 21 nt, Homo sapiens
aaaucaguuuuaauguagaga

SEQ ID NO: 1412838 - RNA, 20 nt, Homo sapiens
aaauccccauugaagauguc

SEQ ID NO: 1412839 - RNA, 19 nt, Homo sapiens
aaaucguucaucauaagaa

SEQ ID NO: 1412840 - RNA, 22 nt, Homo sapiens
aaaucugcuuuucauguugaaa

SEQ ID NO: 1412841 - RNA, 13 nt, Homo sapiens
aaaugucugccau

SEQ ID NO: 1412842 - RNA, 20 nt, Homo sapiens
aaauguuaagcugcuggaaa

SEQ ID NO: 1412843 - RNA, 14 nt, Homo sapiens
aaauuaagcuuaaa

SEQ ID NO: 1412844 - RNA, 15 nt, Homo sapiens
aaauuagugguacuu

SEQ ID NO: 1412845 - RNA, 21 nt, Homo sapiens
aaauucccucuggaguuucau

SEQ ID NO: 1412846 - RNA, 19 nt, Homo sapiens
aaauucuacuguauggaau

SEQ ID NO: 1412847 - RNA, 16 nt, Homo sapiens
aaauucucucuuguca

SEQ ID NO: 1412848 - RNA, 14 nt, Homo sapiens
aaauugaacugcca

SEQ ID NO: 1412849 - RNA, 20 nt, Homo sapiens
aacaacgcaaaccucuccuu

SEQ ID NO: 1412850 - RNA, 21 nt, Homo sapiens
aacaagagauuuaaguuuuaa

SEQ ID NO: 1412851 - RNA, 20 nt, Homo sapiens
aacaaucugaguccaggaau

SEQ ID NO: 1412852 - RNA, 13 nt, Homo sapiens
aacacaagcaaaa

SEQ ID NO: 1412853 - RNA, 13 nt, Homo sapiens
aacacaauacagc

SEQ ID NO: 1412854 - RNA, 16 nt, Homo sapiens
aacacaauuaaaucuc

SEQ ID NO: 1412855 - RNA, 12 nt, Homo sapiens
aacaccaugaag

SEQ ID NO: 1412856 - RNA, 15 nt, Homo sapiens
aacagcaugcugcug

SEQ ID NO: 1412857 - RNA, 15 nt, Homo sapiens
aacagugagccaaau

SEQ ID NO: 1412858 - RNA, 18 nt, Homo sapiens
aacagugagccaaauaaa

SEQ ID NO: 1412859 - RNA, 23 nt, Homo sapiens
aacauacugcauuucacucuggg

SEQ ID NO: 1412860 - RNA, 13 nt, Homo sapiens
aacauacuguuga

SEQ ID NO: 1412861 - RNA, 14 nt, Homo sapiens
aacauacuguugau

SEQ ID NO: 1412862 - RNA, 20 nt, Homo sapiens
aacauggugaaacaugguga

SEQ ID NO: 1412863 - RNA, 13 nt, Homo sapiens
aacauguccccuu

SEQ ID NO: 1412864 - RNA, 19 nt, Homo sapiens
aacauguuuuaacauuauu

SEQ ID NO: 1412865 - RNA, 18 nt, Homo sapiens
aacauuuaggaacccaga

SEQ ID NO: 1412866 - RNA, 14 nt, Homo sapiens
aacauuuucccaau

SEQ ID NO: 1412867 - RNA, 19 nt, Homo sapiens
aaccaaagagggcuuccuc

SEQ ID NO: 1412868 - RNA, 13 nt, Homo sapiens
aaccacucggggc

SEQ ID NO: 1412869 - RNA, 19 nt, Homo sapiens
aaccagaaaggugauucca

SEQ ID NO: 1412870 - RNA, 16 nt, Homo sapiens
aaccagcaacuaauaa

SEQ ID NO: 1412871 - RNA, 22 nt, Homo sapiens
aaccauauccauguugcugacu

SEQ ID NO: 1412872 - RNA, 19 nt, Homo sapiens
aacccauauacucuucgau

SEQ ID NO: 1412873 - RNA, 17 nt, Homo sapiens
aaccccgucugcuccuc

SEQ ID NO: 1412874 - RNA, 23 nt, Homo sapiens
aaccccucccuacuguuggaugu

SEQ ID NO: 1412875 - RNA, 16 nt, Homo sapiens
aaccucacucuugcca

SEQ ID NO: 1412876 - RNA, 19 nt, Homo sapiens
aaccucacucuugccaacc

SEQ ID NO: 1412877 - RNA, 13 nt, Homo sapiens
aaccucuccuucc

SEQ ID NO: 1412878 - RNA, 23 nt, Homo sapiens
aaccucugccccccaaguucaag

SEQ ID NO: 1412879 - RNA, 19 nt, Homo sapiens
aaccuggccaacaugguga

SEQ ID NO: 1412880 - RNA, 20 nt, Homo sapiens
aaccuguaagcccagcauuu

SEQ ID NO: 1412881 - RNA, 22 nt, Homo sapiens
aaccuguaagcccagcauuuga

SEQ ID NO: 1412882 - RNA, 16 nt, Homo sapiens
aaccuguaauaaauau

SEQ ID NO: 1412883 - RNA, 21 nt, Homo sapiens
aacgacgguuucaaaccagga

SEQ ID NO: 1412884 - RNA, 18 nt, Homo sapiens
aacgcaaaccucuccuuc

SEQ ID NO: 1412885 - RNA, 22 nt, Homo sapiens
aacgugaggaagcaagugacaa

SEQ ID NO: 1412886 - RNA, 23 nt, Homo sapiens
aacgugaggaagcaagugacaag

SEQ ID NO: 1412887 - RNA, 21 nt, Homo sapiens
aacuagggauauuuaacugga

SEQ ID NO: 1412888 - RNA, 14 nt, Homo sapiens
aacuaggugaucuc

SEQ ID NO: 1412889 - RNA, 15 nt, Homo sapiens
aacucagcugaucug

SEQ ID NO: 1412890 - RNA, 13 nt, Homo sapiens
aacucaucucauu

SEQ ID NO: 1412891 - RNA, 21 nt, Homo sapiens
aacuccuauuccuugcuuaga

SEQ ID NO: 1412892 - RNA, 14 nt, Homo sapiens
aacugcgaguggcu

SEQ ID NO: 1412893 - RNA, 23 nt, Homo sapiens
aacugcugccaacuccaugucag

SEQ ID NO: 1412894 - RNA, 16 nt, Homo sapiens
aacugguucuacaaau

SEQ ID NO: 1412895 - RNA, 18 nt, Homo sapiens
aacuuauaaucaauacaa

SEQ ID NO: 1412896 - RNA, 21 nt, Homo sapiens
aacuucuccauccuuucugcc

SEQ ID NO: 1412897 - RNA, 22 nt, Homo sapiens
aacuuguuuacauagcauuugu

SEQ ID NO: 1412898 - RNA, 16 nt, Homo sapiens
aagaaaaaaaaacugg

SEQ ID NO: 1412899 - RNA, 23 nt, Homo sapiens
aagaaaguuuccccaccagugaa

SEQ ID NO: 1412900 - RNA, 15 nt, Homo sapiens
aagaaauaaucucua

SEQ ID NO: 1412901 - RNA, 15 nt, Homo sapiens
aagaaaugucugcca

SEQ ID NO: 1412902 - RNA, 15 nt, Homo sapiens
aagaaguucauuccu

SEQ ID NO: 1412903 - RNA, 19 nt, Homo sapiens
aagaauuuaauguacagua

SEQ ID NO: 1412904 - RNA, 19 nt, Homo sapiens
aagacuaugaucucauccc

SEQ ID NO: 1412905 - RNA, 13 nt, Homo sapiens
aagagaucagaau

SEQ ID NO: 1412906 - RNA, 21 nt, Homo sapiens
aagauaucuuuggauaauguu

SEQ ID NO: 1412907 - RNA, 15 nt, Homo sapiens
aagauuuuaugugcu

SEQ ID NO: 1412908 - RNA, 13 nt, Homo sapiens
aagcaacacuuua

SEQ ID NO: 1412909 - RNA, 13 nt, Homo sapiens
aagcaagcucuuc

SEQ ID NO: 1412910 - RNA, 14 nt, Homo sapiens
aagcaauaagcucu

SEQ ID NO: 1412911 - RNA, 19 nt, Homo sapiens
aagcagaaauaaaguuuaa

SEQ ID NO: 1412912 - RNA, 15 nt, Homo sapiens
aagcagaacacacuc

SEQ ID NO: 1412913 - RNA, 15 nt, Homo sapiens
aagcauaaacaucac

SEQ ID NO: 1412914 - RNA, 14 nt, Homo sapiens
aagcaucacacuug

SEQ ID NO: 1412915 - RNA, 19 nt, Homo sapiens
aagccccuuaguccccaag

SEQ ID NO: 1412916 - RNA, 18 nt, Homo sapiens
aagccgucucaugcagaa

SEQ ID NO: 1412917 - RNA, 16 nt, Homo sapiens
aagccugcaugcauuc

SEQ ID NO: 1412918 - RNA, 19 nt, Homo sapiens
aagccuggacgcagccaca

SEQ ID NO: 1412919 - RNA, 20 nt, Homo sapiens
aagccuggacgcagccacac

SEQ ID NO: 1412920 - RNA, 18 nt, Homo sapiens
aagcgauucucaugccuc

SEQ ID NO: 1412921 - RNA, 23 nt, Homo sapiens
aagcugcuggaaaccucaugcca

SEQ ID NO: 1412922 - RNA, 13 nt, Homo sapiens
aagcuucucucug

SEQ ID NO: 1412923 - RNA, 16 nt, Homo sapiens
acccugcccucaugcu

SEQ ID NO: 1412924 - RNA, 20 nt, Homo sapiens
accgagagaaaaagcccagc

SEQ ID NO: 1412925 - RNA, 22 nt, Homo sapiens
accguccucaccccuguccuca

SEQ ID NO: 1412926 - RNA, 22 nt, Homo sapiens
accguggaggaggaaggcaaga

SEQ ID NO: 1412927 - RNA, 18 nt, Homo sapiens
accuaaauugaacugcca

SEQ ID NO: 1412928 - RNA, 18 nt, Homo sapiens
accuaucaguauggugcu

SEQ ID NO: 1412929 - RNA, 21 nt, Homo sapiens
accucaagugccuuauucuca

SEQ ID NO: 1412930 - RNA, 17 nt, Homo sapiens
accucacucuugccaac

SEQ ID NO: 1412931 - RNA, 16 nt, Homo sapiens
accucaggcacuagcc

SEQ ID NO: 1412932 - RNA, 18 nt, Homo sapiens
accucaggcacuagccuu

SEQ ID NO: 1412933 - RNA, 21 nt, Homo sapiens
accucauuuacaaagcaaaaa

SEQ ID NO: 1412934 - RNA, 20 nt, Homo sapiens
accuccccagccccuagccc

SEQ ID NO: 1412935 - RNA, 23 nt, Homo sapiens
accuccccagccccuagcccagg

SEQ ID NO: 1412936 - RNA, 15 nt, Homo sapiens
accuccucagggaug

SEQ ID NO: 1412937 - RNA, 16 nt, Homo sapiens
accucugagaccaaaa

SEQ ID NO: 1412938 - RNA, 15 nt, Homo sapiens
accugacugcaauga

SEQ ID NO: 1412939 - RNA, 23 nt, Homo sapiens
accuguaauaaauaugagugcca

SEQ ID NO: 1412940 - RNA, 21 nt, Homo sapiens
accuguaguguaccauucuca

SEQ ID NO: 1412941 - RNA, 16 nt, Homo sapiens
accuugugaacaucag

SEQ ID NO: 1412942 - RNA, 14 nt, Homo sapiens
acgcugucucugac

SEQ ID NO: 1412943 - RNA, 14 nt, Homo sapiens
acgggcugcguuua

SEQ ID NO: 1412944 - RNA, 21 nt, Homo sapiens
acuaaguguguauccagaaga

SEQ ID NO: 1412945 - RNA, 22 nt, Homo sapiens
acuacuucacaguaaguaguaa

SEQ ID NO: 1412946 - RNA, 16 nt, Homo sapiens
acuagcuaaaccagaa

SEQ ID NO: 1412947 - RNA, 17 nt, Homo sapiens
acuagcuaaaccagaaa

SEQ ID NO: 1412948 - RNA, 14 nt, Homo sapiens
acuaggugaucuca

SEQ ID NO: 1412949 - RNA, 21 nt, Homo sapiens
acucaaaagaaaauauaguca

SEQ ID NO: 1412950 - RNA, 17 nt, Homo sapiens
acucaccaggcaccaga

SEQ ID NO: 1412951 - RNA, 12 nt, Homo sapiens
acucagauuuaa

SEQ ID NO: 1412952 - RNA, 20 nt, Homo sapiens
acucaggcagagcagcucca

SEQ ID NO: 1412953 - RNA, 13 nt, Homo sapiens
acucaggcugcuc

SEQ ID NO: 1412954 - RNA, 16 nt, Homo sapiens
acucaggcugcuccuu

SEQ ID NO: 1412955 - RNA, 13 nt, Homo sapiens
acuccacaccagu

SEQ ID NO: 1412956 - RNA, 15 nt, Homo sapiens
acucccuccccagau

SEQ ID NO: 1412957 - RNA, 19 nt, Homo sapiens
acuccucggccuggcuccu

SEQ ID NO: 1412958 - RNA, 21 nt, Homo sapiens
acuccucggggaacccaaggc

SEQ ID NO: 1412959 - RNA, 15 nt, Homo sapiens
acucugcaaccucca

SEQ ID NO: 1412960 - RNA, 19 nt, Homo sapiens
acucugguuguuuaugcaa

SEQ ID NO: 1412961 - RNA, 19 nt, Homo sapiens
acucuugccaaccuguaau

SEQ ID NO: 1412962 - RNA, 20 nt, Homo sapiens
acucuugccaaccuguaaua

SEQ ID NO: 1412963 - RNA, 13 nt, Homo sapiens
acugauguuacua

SEQ ID NO: 1412964 - RNA, 19 nt, Homo sapiens
acugcucccugaagccagc

SEQ ID NO: 1412965 - RNA, 18 nt, Homo sapiens
aacuaauaaaaccucuaa

SEQ ID NO: 1412966 - RNA, 17 nt, Homo sapiens
aacuaggugaucucagu

SEQ ID NO: 1412967 - RNA, 12 nt, Homo sapiens
aacucaucucau

SEQ ID NO: 1412968 - RNA, 17 nt, Homo sapiens
aacugauguuacuagcc

SEQ ID NO: 1412969 - RNA, 12 nt, Homo sapiens
aacuguauugau

SEQ ID NO: 1412970 - RNA, 20 nt, Homo sapiens
aacuuccuccucucucgcuu

SEQ ID NO: 1412971 - RNA, 21 nt, Homo sapiens
aacuuggauguagccaugacc

SEQ ID NO: 1412972 - RNA, 18 nt, Homo sapiens
aacuugucucuguagaag

SEQ ID NO: 1412973 - RNA, 19 nt, Homo sapiens
aacuuuuuucuuacugucu

SEQ ID NO: 1412974 - RNA, 15 nt, Homo sapiens
aagaaagcucuagac

SEQ ID NO: 1412975 - RNA, 14 nt, Homo sapiens
aagaacaucuggau

SEQ ID NO: 1412976 - RNA, 12 nt, Homo sapiens
aagacgcccucu

SEQ ID NO: 1412977 - RNA, 15 nt, Homo sapiens
aagagaugcuggauu

SEQ ID NO: 1412978 - RNA, 22 nt, Homo sapiens
aagagaugcuggauucagauau

SEQ ID NO: 1412979 - RNA, 13 nt, Homo sapiens
aagagggcuuccu

SEQ ID NO: 1412980 - RNA, 21 nt, Homo sapiens
aagagggcuuccucuagaagc

SEQ ID NO: 1412981 - RNA, 19 nt, Homo sapiens
aagauaacaagagauuuaa

SEQ ID NO: 1412982 - RNA, 19 nt, Homo sapiens
aagauuccuguccuugaga

SEQ ID NO: 1412983 - RNA, 16 nt, Homo sapiens
aagcagaacacacucu

SEQ ID NO: 1412984 - RNA, 17 nt, Homo sapiens
aagcaguacacuuggau

SEQ ID NO: 1412985 - RNA, 12 nt, Homo sapiens
aagcauuuugga

SEQ ID NO: 1412986 - RNA, 11 nt, Homo sapiens
aagccaaagaa

SEQ ID NO: 1412987 - RNA, 12 nt, Homo sapiens
aagccacacagc

SEQ ID NO: 1412988 - RNA, 22 nt, Homo sapiens
aagccuaucaaagaccuugugu

SEQ ID NO: 1412989 - RNA, 23 nt, Homo sapiens
aagccuggacgcagccacacagu

SEQ ID NO: 1412990 - RNA, 13 nt, Homo sapiens
aagcgauucucau

SEQ ID NO: 1412991 - RNA, 15 nt, Homo sapiens
aagcuaaacguaauu

SEQ ID NO: 1412992 - RNA, 15 nt, Homo sapiens
aagcuuauuaaugcu

SEQ ID NO: 1412993 - RNA, 14 nt, Homo sapiens
aagcuucucucuga

SEQ ID NO: 1412994 - RNA, 19 nt, Homo sapiens
aaggauuuuaaaugcugua

SEQ ID NO: 1412995 - RNA, 13 nt, Homo sapiens
aaggcgauagcug

SEQ ID NO: 1412996 - RNA, 18 nt, Homo sapiens
aaggcuguuaacauuaca

SEQ ID NO: 1412997 - RNA, 17 nt, Homo sapiens
aagggacugagaaauuu

SEQ ID NO: 1412998 - RNA, 15 nt, Homo sapiens
aagggcaggcccaaa

SEQ ID NO: 1412999 - RNA, 21 nt, Homo sapiens
aaggggagucaaguucccugg

SEQ ID NO: 1413000 - RNA, 17 nt, Homo sapiens
aaggugaguuugagcug

SEQ ID NO: 1413001 - RNA, 21 nt, Homo sapiens
aaguauuguguuuaugcauuu

SEQ ID NO: 1413002 - RNA, 14 nt, Homo sapiens
aagucucuggguca

SEQ ID NO: 1413003 - RNA, 16 nt, Homo sapiens
aagugccaucucaauu

SEQ ID NO: 1413004 - RNA, 20 nt, Homo sapiens
aagugcugagauuacaggca

SEQ ID NO: 1413005 - RNA, 16 nt, Homo sapiens
aagugucacagccaua

SEQ ID NO: 1413006 - RNA, 17 nt, Homo sapiens
aaguguuuuacaaugau

SEQ ID NO: 1413007 - RNA, 19 nt, Homo sapiens
aaguguuuuacaaugauuu

SEQ ID NO: 1413008 - RNA, 18 nt, Homo sapiens
aaguuaaacuuuaucuca

SEQ ID NO: 1413009 - RNA, 19 nt, Homo sapiens
aaguuaaacuuuaucucac

SEQ ID NO: 1413010 - RNA, 17 nt, Homo sapiens
aaguugacaaaugccaa

SEQ ID NO: 1413011 - RNA, 12 nt, Homo sapiens
aaguuugcuauu

SEQ ID NO: 1413012 - RNA, 12 nt, Homo sapiens
aauaaaacugau

SEQ ID NO: 1413013 - RNA, 21 nt, Homo sapiens
aauaaacgcuccccucagaca

SEQ ID NO: 1413014 - RNA, 12 nt, Homo sapiens
aauaaagcauag

SEQ ID NO: 1413015 - RNA, 16 nt, Homo sapiens
aauaaagcuucucucu

SEQ ID NO: 1413016 - RNA, 20 nt, Homo sapiens
aauaaagcuucucucugagc

SEQ ID NO: 1413017 - RNA, 15 nt, Homo sapiens
aauaaaggcaccucc

SEQ ID NO: 1413018 - RNA, 19 nt, Homo sapiens
aauaaaggcaccuccccca

SEQ ID NO: 1413019 - RNA, 13 nt, Homo sapiens
aauaaauaugagu

SEQ ID NO: 1413020 - RNA, 13 nt, Homo sapiens
aauaaauugucau

SEQ ID NO: 1413021 - RNA, 17 nt, Homo sapiens
aauacuaauagccuaaa

SEQ ID NO: 1413022 - RNA, 17 nt, Homo sapiens
aauagcuuauguacaaa

SEQ ID NO: 1413023 - RNA, 20 nt, Homo sapiens
aauauauauauccucuguau

SEQ ID NO: 1413024 - RNA, 19 nt, Homo sapiens
aaucaaucuuugugccuca

SEQ ID NO: 1413025 - RNA, 13 nt, Homo sapiens
aaucagacuauga

SEQ ID NO: 1413026 - RNA, 13 nt, Homo sapiens
aauccaaauuccc

SEQ ID NO: 1413027 - RNA, 15 nt, Homo sapiens
aauccaaauucccuc

SEQ ID NO: 1413028 - RNA, 15 nt, Homo sapiens
aaucccuuucucacu

SEQ ID NO: 1413029 - RNA, 18 nt, Homo sapiens
aaucuuucugaacuguaa

SEQ ID NO: 1413030 - RNA, 17 nt, Homo sapiens
aaugacuacuacacacu

SEQ ID NO: 1413031 - RNA, 23 nt, Homo sapiens
aaugacuggcuacagaguaacaa

SEQ ID NO: 1413032 - RNA, 23 nt, Homo sapiens
aaugagugauuccaguauuucau

SEQ ID NO: 1413033 - RNA, 17 nt, Homo sapiens
aaugauucucaagauca

SEQ ID NO: 1413034 - RNA, 14 nt, Homo sapiens
aaugcauuaagugu

SEQ ID NO: 1413035 - RNA, 19 nt, Homo sapiens
aaugccugcugcugccaag

SEQ ID NO: 1413036 - RNA, 13 nt, Homo sapiens
aaugcuaaaacau

SEQ ID NO: 1413037 - RNA, 14 nt, Homo sapiens
aaugcuaagggcag

SEQ ID NO: 1413038 - RNA, 19 nt, Homo sapiens
aaugcuguaugucauuaaa

SEQ ID NO: 1413039 - RNA, 20 nt, Homo sapiens
aauggaucacugauauuuua

SEQ ID NO: 1413040 - RNA, 13 nt, Homo sapiens
aauggcauguauu

SEQ ID NO: 1413041 - RNA, 21 nt, Homo sapiens
aauggcauguauuccaaguac

SEQ ID NO: 1413042 - RNA, 16 nt, Homo sapiens
aauguaacauacucau

SEQ ID NO: 1413043 - RNA, 15 nt, Homo sapiens
aaugucuggggacag

SEQ ID NO: 1413044 - RNA, 14 nt, Homo sapiens
aauguuaugcaggc

SEQ ID NO: 1413045 - RNA, 14 nt, Homo sapiens
aauguucugggaag

SEQ ID NO: 1413046 - RNA, 23 nt, Homo sapiens
aauguuuucgcaaauguugcucu

SEQ ID NO: 1413047 - RNA, 13 nt, Homo sapiens
aauuaaacagauu

SEQ ID NO: 1413048 - RNA, 20 nt, Homo sapiens
aauuaagaugguaagaccuc

SEQ ID NO: 1413049 - RNA, 13 nt, Homo sapiens
aauuaagcuuaaa

SEQ ID NO: 1413050 - RNA, 13 nt, Homo sapiens
aauuauguggauc

SEQ ID NO: 1413051 - RNA, 14 nt, Homo sapiens
aauuauuacauaug

SEQ ID NO: 1413052 - RNA, 15 nt, Homo sapiens
aauucaguucugaag

SEQ ID NO: 1413053 - RNA, 15 nt, Homo sapiens
aauucucucuuguca

SEQ ID NO: 1413054 - RNA, 17 nt, Homo sapiens
aauucuuucaugagcuu

SEQ ID NO: 1413055 - RNA, 14 nt, Homo sapiens
aauugugucugcag

SEQ ID NO: 1413056 - RNA, 17 nt, Homo sapiens
aauuugaagcucagaaa

SEQ ID NO: 1413057 - RNA, 17 nt, Homo sapiens
aauuugacugugcauga

SEQ ID NO: 1413058 - RNA, 17 nt, Homo sapiens
acaaaaaaugugcuguu

SEQ ID NO: 1413059 - RNA, 19 nt, Homo sapiens
acaaaauuaugcugcauuu

SEQ ID NO: 1413060 - RNA, 13 nt, Homo sapiens
acaaauaugcaga

SEQ ID NO: 1413061 - RNA, 20 nt, Homo sapiens
acaacuccacgaggugaaaa

SEQ ID NO: 1413062 - RNA, 17 nt, Homo sapiens
acaacuuuccacugaca

SEQ ID NO: 1413063 - RNA, 17 nt, Homo sapiens
acaagauuaaauuccuu

SEQ ID NO: 1413064 - RNA, 21 nt, Homo sapiens
acaaggacgcccgaagcacag

SEQ ID NO: 1413065 - RNA, 21 nt, Homo sapiens
acaauccaucaaagugaugau

SEQ ID NO: 1413066 - RNA, 14 nt, Homo sapiens
acacacacauacac

SEQ ID NO: 1413067 - RNA, 20 nt, Homo sapiens
acaccacgcuggagcugugu

SEQ ID NO: 1413068 - RNA, 21 nt, Homo sapiens
acaccacgcuggagcugugua

SEQ ID NO: 1413069 - RNA, 13 nt, Homo sapiens
acacccagccuca

SEQ ID NO: 1413070 - RNA, 17 nt, Homo sapiens
acaccuggcccuaguga

SEQ ID NO: 1413071 - RNA, 15 nt, Homo sapiens
acacggccagcaccg

SEQ ID NO: 1413072 - RNA, 18 nt, Homo sapiens
acagaauugugucugcag

SEQ ID NO: 1413073 - RNA, 23 nt, Homo sapiens
acagagaaaagcuuggaaagcca

SEQ ID NO: 1413074 - RNA, 18 nt, Homo sapiens
acagagcgagacugucuc

SEQ ID NO: 1413075 - RNA, 22 nt, Homo sapiens
acagcccuggaggccgcugcug

SEQ ID NO: 1413076 - RNA, 19 nt, Homo sapiens
acaggaaacuacuucacag

SEQ ID NO: 1413077 - RNA, 16 nt, Homo sapiens
acaggcacaugcacca

SEQ ID NO: 1413078 - RNA, 14 nt, Homo sapiens
acagugagccaaau

SEQ ID NO: 1413079 - RNA, 14 nt, Homo sapiens
acaguggccggggc

SEQ ID NO: 1413080 - RNA, 18 nt, Homo sapiens
acagugggccauucauuu

SEQ ID NO: 1413081 - RNA, 20 nt, Homo sapiens
acaguuucaaaaacuguauu

SEQ ID NO: 1413082 - RNA, 16 nt, Homo sapiens
acauacugcauuucac

SEQ ID NO: 1413083 - RNA, 18 nt, Homo sapiens
acauacuguugaugucua

SEQ ID NO: 1413084 - RNA, 12 nt, Homo sapiens
acauagcauuug

SEQ ID NO: 1413085 - RNA, 20 nt, Homo sapiens
acaucaaguguaauuagcuu

SEQ ID NO: 1413086 - RNA, 23 nt, Homo sapiens
acaucugccuuaaaaccaaagag

SEQ ID NO: 1413087 - RNA, 20 nt, Homo sapiens
acaucugcuucaccaaggag

SEQ ID NO: 1413088 - RNA, 15 nt, Homo sapiens
acaucuggauuucau

SEQ ID NO: 1413089 - RNA, 19 nt, Homo sapiens
acauucuaugcuuacagaa

SEQ ID NO: 1413090 - RNA, 15 nt, Homo sapiens
acauuuaaacucagc

SEQ ID NO: 1413091 - RNA, 18 nt, Homo sapiens
acauuuaagggaauguga

SEQ ID NO: 1413092 - RNA, 13 nt, Homo sapiens
acauuugaacuau

SEQ ID NO: 1413093 - RNA, 22 nt, Homo sapiens
acauuugaacuauauccuuccu

SEQ ID NO: 1413094 - RNA, 13 nt, Homo sapiens
accaaagaucugc

SEQ ID NO: 1413095 - RNA, 13 nt, Homo sapiens
accaacacacagg

SEQ ID NO: 1413096 - RNA, 19 nt, Homo sapiens
accaacuuuuucauucccu

SEQ ID NO: 1413097 - RNA, 17 nt, Homo sapiens
accaaguaagacaucuc

SEQ ID NO: 1413098 - RNA, 15 nt, Homo sapiens
accaagugguuucca

SEQ ID NO: 1413099 - RNA, 20 nt, Homo sapiens
auucaagaggaauuccagca

SEQ ID NO: 1413100 - RNA, 13 nt, Homo sapiens
auucacccugugu

SEQ ID NO: 1413101 - RNA, 16 nt, Homo sapiens
auuccaaguacagaau

SEQ ID NO: 1413102 - RNA, 23 nt, Homo sapiens
auuccagcuccuccgugcuuccu

SEQ ID NO: 1413103 - RNA, 22 nt, Homo sapiens
auuccaggaggaguuagccaaa

SEQ ID NO: 1413104 - RNA, 13 nt, Homo sapiens
auuccauggugau

SEQ ID NO: 1413105 - RNA, 21 nt, Homo sapiens
auucccagcccaucccuguga

SEQ ID NO: 1413106 - RNA, 21 nt, Homo sapiens
auuccuugcuuagacauuaca

SEQ ID NO: 1413107 - RNA, 22 nt, Homo sapiens
auucuaccagagugauggauuu

SEQ ID NO: 1413108 - RNA, 13 nt, Homo sapiens
auucuacccuguu

SEQ ID NO: 1413109 - RNA, 16 nt, Homo sapiens
auucuucgcacagugu

SEQ ID NO: 1413110 - RNA, 17 nt, Homo sapiens
auugagauguguucaca

SEQ ID NO: 1413111 - RNA, 18 nt, Homo sapiens
auugagcagcaugauuau

SEQ ID NO: 1413112 - RNA, 23 nt, Homo sapiens
auugagcgccauaagcagaagau

SEQ ID NO: 1413113 - RNA, 19 nt, Homo sapiens
auugaugacaguaguacca

SEQ ID NO: 1413114 - RNA, 13 nt, Homo sapiens
auuguaacuugga

SEQ ID NO: 1413115 - RNA, 18 nt, Homo sapiens
auuguaacuuggauguag

SEQ ID NO: 1413116 - RNA, 21 nt, Homo sapiens
auuguaggcucccccuccucu

SEQ ID NO: 1413117 - RNA, 20 nt, Homo sapiens
auugugcuuuguaucaguca

SEQ ID NO: 1413118 - RNA, 18 nt, Homo sapiens
auuuauaugaauuuccac

SEQ ID NO: 1413119 - RNA, 21 nt, Homo sapiens
auuucauccagggaaaugccu

SEQ ID NO: 1413120 - RNA, 19 nt, Homo sapiens
auuucuaauucaguucuga

SEQ ID NO: 1413121 - RNA, 13 nt, Homo sapiens
auuucuacgugga

SEQ ID NO: 1413122 - RNA, 19 nt, Homo sapiens
auuucuccucccuuccuuu

SEQ ID NO: 1413123 - RNA, 14 nt, Homo sapiens
auuugaagcucaga

SEQ ID NO: 1413124 - RNA, 17 nt, Homo sapiens
auuugacugugcaugac

SEQ ID NO: 1413125 - RNA, 13 nt, Homo sapiens
auuugaguggugu

SEQ ID NO: 1413126 - RNA, 15 nt, Homo sapiens
auuuguaaaagcuaa

SEQ ID NO: 1413127 - RNA, 22 nt, Homo sapiens
auuuuaaaaaauguuaugcagg

SEQ ID NO: 1413128 - RNA, 16 nt, Homo sapiens
auuuuaauugcaccug

SEQ ID NO: 1413129 - RNA, 17 nt, Homo sapiens
auuuuaguuguccucag

SEQ ID NO: 1413130 - RNA, 19 nt, Homo sapiens
auuuuaguuguccucaggu

SEQ ID NO: 1413131 - RNA, 11 nt, Homo sapiens
auuuucaccuc

SEQ ID NO: 1413132 - RNA, 15 nt, Homo sapiens
auuuuccucucucac

SEQ ID NO: 1413133 - RNA, 16 nt, Homo sapiens
auuuugucccaucucu

SEQ ID NO: 1413134 - RNA, 23 nt, Homo sapiens
auuuuguguuuaggaacuacuga

SEQ ID NO: 1413135 - RNA, 14 nt, Homo sapiens
auuuuucugugaaa

SEQ ID NO: 1413136 - RNA, 14 nt, Homo sapiens
auuuuuucuugaca

SEQ ID NO: 1413137 - RNA, 14 nt, Homo sapiens
caaaaaaguuauaa

SEQ ID NO: 1413138 - RNA, 23 nt, Homo sapiens
caaaacuuccuguuuguggaaca

SEQ ID NO: 1413139 - RNA, 21 nt, Homo sapiens
caaaagaaaauauagucacag

SEQ ID NO: 1413140 - RNA, 14 nt, Homo sapiens
caaaagcagaacac

SEQ ID NO: 1413141 - RNA, 18 nt, Homo sapiens
caaaauuaugcugcauuu

SEQ ID NO: 1413142 - RNA, 17 nt, Homo sapiens
caaagcaaaaagagaug

SEQ ID NO: 1413143 - RNA, 19 nt, Homo sapiens
caaaguucaaaaauauuca

SEQ ID NO: 1413144 - RNA, 17 nt, Homo sapiens
caaauauuaccagagca

SEQ ID NO: 1413145 - RNA, 19 nt, Homo sapiens
caaaucugguauugaacug

SEQ ID NO: 1413146 - RNA, 17 nt, Homo sapiens
caaaugcuuuaaaaacu

SEQ ID NO: 1413147 - RNA, 20 nt, Homo sapiens
caacauauuguuucaguguu

SEQ ID NO: 1413148 - RNA, 17 nt, Homo sapiens
caacccaauaaaacuga

SEQ ID NO: 1413149 - RNA, 14 nt, Homo sapiens
caacgcaaaccucu

SEQ ID NO: 1413150 - RNA, 15 nt, Homo sapiens
caagaacuccuccca

SEQ ID NO: 1413151 - RNA, 18 nt, Homo sapiens
caagaguaggguagacca

SEQ ID NO: 1413152 - RNA, 18 nt, Homo sapiens
caagaguuguugugcaag

SEQ ID NO: 1413153 - RNA, 15 nt, Homo sapiens
caagcacuugaugcc

SEQ ID NO: 1413154 - RNA, 19 nt, Homo sapiens
caagccccuuaguccccaa

SEQ ID NO: 1413155 - RNA, 18 nt, Homo sapiens
caaggacagucagcauuu

SEQ ID NO: 1413156 - RNA, 23 nt, Homo sapiens
caaggcucccguacugucugugu

SEQ ID NO: 1413157 - RNA, 13 nt, Homo sapiens
caagucaccaugc

SEQ ID NO: 1413158 - RNA, 20 nt, Homo sapiens
caagucacccaggaugcugg

SEQ ID NO: 1413159 - RNA, 12 nt, Homo sapiens
caagucaccucc

SEQ ID NO: 1413160 - RNA, 18 nt, Homo sapiens
caagugauucuccugccu

SEQ ID NO: 1413161 - RNA, 17 nt, Homo sapiens
caagugccuuauucuca

SEQ ID NO: 1413162 - RNA, 17 nt, Homo sapiens
caagugugugccugugu

SEQ ID NO: 1413163 - RNA, 12 nt, Homo sapiens
caauaaaacuga

SEQ ID NO: 1413164 - RNA, 20 nt, Homo sapiens
caauaaaagauaagugcagu

SEQ ID NO: 1413165 - RNA, 14 nt, Homo sapiens
caauaaaggcaccu

SEQ ID NO: 1413166 - RNA, 24 nt, Homo sapiens
caauaugaaccaaguaguauucau

SEQ ID NO: 1413167 - RNA, 20 nt, Homo sapiens
caaucaugcuguguaauauc

SEQ ID NO: 1413168 - RNA, 17 nt, Homo sapiens
caauccuuaaacugcca

SEQ ID NO: 1413169 - RNA, 21 nt, Homo sapiens
caaugagccacagcaaaaagu

SEQ ID NO: 1413170 - RNA, 13 nt, Homo sapiens
caaugcauaaugu

SEQ ID NO: 1413171 - RNA, 14 nt, Homo sapiens
caauuaaacucaaa

SEQ ID NO: 1413172 - RNA, 20 nt, Homo sapiens
caauuaauugagcagcauga

SEQ ID NO: 1413173 - RNA, 22 nt, Homo sapiens
cacaaaauuaugcugcauuugg

SEQ ID NO: 1413174 - RNA, 20 nt, Homo sapiens
cacaaaggaccucagcugcu

SEQ ID NO: 1413175 - RNA, 10 nt, Homo sapiens
cacacccacu

SEQ ID NO: 1413176 - RNA, 17 nt, Homo sapiens
cacaccccagacuccag

SEQ ID NO: 1413177 - RNA, 16 nt, Homo sapiens
cacaccgugugccaua

SEQ ID NO: 1413178 - RNA, 13 nt, Homo sapiens
cacacugugcuuu

SEQ ID NO: 1413179 - RNA, 17 nt, Homo sapiens
cacaggaaacuacuuca

SEQ ID NO: 1413180 - RNA, 21 nt, Homo sapiens
cacaucucucuggaguuuucu

SEQ ID NO: 1413181 - RNA, 14 nt, Homo sapiens
caccaacacacagg

SEQ ID NO: 1413182 - RNA, 14 nt, Homo sapiens
caccaauccucacc

SEQ ID NO: 1413183 - RNA, 15 nt, Homo sapiens
caccacgcccggcug

SEQ ID NO: 1413184 - RNA, 19 nt, Homo sapiens
caccaguaauaaaaagcca

SEQ ID NO: 1413185 - RNA, 22 nt, Homo sapiens
cacccaguccuugaguccccac

SEQ ID NO: 1413186 - RNA, 14 nt, Homo sapiens
cacccauggccuca

SEQ ID NO: 1413187 - RNA, 14 nt, Homo sapiens
caccccaccagaag

SEQ ID NO: 1413188 - RNA, 21 nt, Homo sapiens
caccccuuugucugucuuccu

SEQ ID NO: 1413189 - RNA, 17 nt, Homo sapiens
cacccgccucccucuca

SEQ ID NO: 1413190 - RNA, 24 nt, Homo sapiens
cacccugcauuugugucauugaca

SEQ ID NO: 1413191 - RNA, 23 nt, Homo sapiens
caccgcccuugccgaaccaggag

SEQ ID NO: 1413192 - RNA, 16 nt, Homo sapiens
caccucaagugccuua

SEQ ID NO: 1413193 - RNA, 16 nt, Homo sapiens
caccucuccagcuccu

SEQ ID NO: 1413194 - RNA, 18 nt, Homo sapiens
cacgucuuccuucugccu

SEQ ID NO: 1413195 - RNA, 15 nt, Homo sapiens
cacuaaggguggaga

SEQ ID NO: 1413196 - RNA, 15 nt, Homo sapiens
cacucugguuguuua

SEQ ID NO: 1413197 - RNA, 13 nt, Homo sapiens
cacucuugccaac

SEQ ID NO: 1413198 - RNA, 12 nt, Homo sapiens
cacuuccauuag

SEQ ID NO: 1413199 - RNA, 18 nt, Homo sapiens
cacuucccgccuccauga

SEQ ID NO: 1413200 - RNA, 15 nt, Homo sapiens
cacuuggccauuuau

SEQ ID NO: 1413201 - RNA, 17 nt, Homo sapiens
cacuuguuucuacucaa

SEQ ID NO: 1413202 - RNA, 16 nt, Homo sapiens
cagaaaaucacugugc

SEQ ID NO: 1413203 - RNA, 12 nt, Homo sapiens
cagaaaggugau

SEQ ID NO: 1413204 - RNA, 17 nt, Homo sapiens
cagaacagacacuuuaa

SEQ ID NO: 1413205 - RNA, 19 nt, Homo sapiens
cagaacagugagccaaaua

SEQ ID NO: 1413206 - RNA, 23 nt, Homo sapiens
cagaaccccugucacacagggaa

SEQ ID NO: 1413207 - RNA, 14 nt, Homo sapiens
cagaagaaaggagc

SEQ ID NO: 1413208 - RNA, 13 nt, Homo sapiens
cagacagacagau

SEQ ID NO: 1413209 - RNA, 20 nt, Homo sapiens
cagacggccuagugugccaa

SEQ ID NO: 1413210 - RNA, 21 nt, Homo sapiens
cagagacccucugccaccaga

SEQ ID NO: 1413211 - RNA, 19 nt, Homo sapiens
cagagagcggucucaggcu

SEQ ID NO: 1413212 - RNA, 22 nt, Homo sapiens
cagagauggcuccuugggauga

SEQ ID NO: 1413213 - RNA, 19 nt, Homo sapiens
cagagcccgguacagggcc

SEQ ID NO: 1413214 - RNA, 13 nt, Homo sapiens
cagagcuguggag

SEQ ID NO: 1413215 - RNA, 21 nt, Homo sapiens
cagaggauuuaacugugaacc

SEQ ID NO: 1413216 - RNA, 15 nt, Homo sapiens
cagaguggucccugc

SEQ ID NO: 1413217 - RNA, 19 nt, Homo sapiens
cagauaaagguucaugcaa

SEQ ID NO: 1413218 - RNA, 17 nt, Homo sapiens
cagauccugcagucaau

SEQ ID NO: 1413219 - RNA, 20 nt, Homo sapiens
cagauccugcagucaauguu

SEQ ID NO: 1413220 - RNA, 19 nt, Homo sapiens
cagaugaguccauuugaag

SEQ ID NO: 1413221 - RNA, 15 nt, Homo sapiens
cagaugcaccguggc

SEQ ID NO: 1413222 - RNA, 18 nt, Homo sapiens
cagaugccagcgccaugc

SEQ ID NO: 1413223 - RNA, 21 nt, Homo sapiens
cagcaccagccccccucucaa

SEQ ID NO: 1413224 - RNA, 23 nt, Homo sapiens
cagcagauaaggccgagcccaca

SEQ ID NO: 1413225 - RNA, 22 nt, Homo sapiens
cagcauuucuagacuuccacaa

SEQ ID NO: 1413226 - RNA, 14 nt, Homo sapiens
cagccaacuauggc

SEQ ID NO: 1413227 - RNA, 15 nt, Homo sapiens
cagccaaugccuuug

SEQ ID NO: 1413228 - RNA, 20 nt, Homo sapiens
cagcccaaccuagaccugua

SEQ ID NO: 1413229 - RNA, 24 nt, Homo sapiens
cagcccaaccuagaccuguagauu

SEQ ID NO: 1413230 - RNA, 17 nt, Homo sapiens
cagcccagaaggccaga

SEQ ID NO: 1413231 - RNA, 22 nt, Homo sapiens
gagacagugggcacuaagggug

SEQ ID NO: 1413232 - RNA, 11 nt, Homo sapiens
gagagccaaac

SEQ ID NO: 1413233 - RNA, 15 nt, Homo sapiens
gagaguucuccagau

SEQ ID NO: 1413234 - RNA, 19 nt, Homo sapiens
gagaugaccuugacauacc

SEQ ID NO: 1413235 - RNA, 20 nt, Homo sapiens
gagaugcuggagaagagagg

SEQ ID NO: 1413236 - RNA, 18 nt, Homo sapiens
gagcaauguggauaugac

SEQ ID NO: 1413237 - RNA, 21 nt, Homo sapiens
gagcagcaugauuauaagcca

SEQ ID NO: 1413238 - RNA, 15 nt, Homo sapiens
gagcaggaugcccau

SEQ ID NO: 1413239 - RNA, 12 nt, Homo sapiens
gagccaccgugu

SEQ ID NO: 1413240 - RNA, 13 nt, Homo sapiens
gagccaccguguc

SEQ ID NO: 1413241 - RNA, 20 nt, Homo sapiens
gagccuuggcuguuggcagu

SEQ ID NO: 1413242 - RNA, 13 nt, Homo sapiens
gagcggcaggacu

SEQ ID NO: 1413243 - RNA, 23 nt, Homo sapiens
gagcggcaggacuggauggagcu

SEQ ID NO: 1413244 - RNA, 15 nt, Homo sapiens
gagcuccuccagacc

SEQ ID NO: 1413245 - RNA, 14 nt, Homo sapiens
gagcugagaucaca

SEQ ID NO: 1413246 - RNA, 16 nt, Homo sapiens
gagcuggcagcaaugg

SEQ ID NO: 1413247 - RNA, 18 nt, Homo sapiens
gagcuggggcugagggau

SEQ ID NO: 1413248 - RNA, 22 nt, Homo sapiens
gagcuguguaccaaucgucuca

SEQ ID NO: 1413249 - RNA, 18 nt, Homo sapiens
gagcuucaguauaaaaga

SEQ ID NO: 1413250 - RNA, 20 nt, Homo sapiens
gagcuuuacagcagaagcug

SEQ ID NO: 1413251 - RNA, 17 nt, Homo sapiens
gaggaauaaagcuucuc

SEQ ID NO: 1413252 - RNA, 21 nt, Homo sapiens
gaggaauuugaagcucagaaa

SEQ ID NO: 1413253 - RNA, 14 nt, Homo sapiens
gaggagggcccuga

SEQ ID NO: 1413254 - RNA, 21 nt, Homo sapiens
gaggcccucaccagaagcaga

SEQ ID NO: 1413255 - RNA, 22 nt, Homo sapiens
gaggcugaggcaggagaauggc

SEQ ID NO: 1413256 - RNA, 19 nt, Homo sapiens
gaggguagagugggcugcu

SEQ ID NO: 1413257 - RNA, 18 nt, Homo sapiens
gagguaaucgccaaauag

SEQ ID NO: 1413258 - RNA, 12 nt, Homo sapiens
gaggucacugga

SEQ ID NO: 1413259 - RNA, 20 nt, Homo sapiens
gaggucuggcugcuugcccc

SEQ ID NO: 1413260 - RNA, 22 nt, Homo sapiens
gaggugaaaagggcagaggcaa

SEQ ID NO: 1413261 - RNA, 14 nt, Homo sapiens
gagguugaagccaa

SEQ ID NO: 1413262 - RNA, 17 nt, Homo sapiens
gaguccagaaccccugu

SEQ ID NO: 1413263 - RNA, 14 nt, Homo sapiens
gagugucaucucaa

SEQ ID NO: 1413264 - RNA, 22 nt, Homo sapiens
gaguugggggccagcacagcug

SEQ ID NO: 1413265 - RNA, 23 nt, Homo sapiens
gaguuguguuuacuaugcauugu

SEQ ID NO: 1413266 - RNA, 16 nt, Homo sapiens
gaucagcucagacaua

SEQ ID NO: 1413267 - RNA, 22 nt, Homo sapiens
gauccagaaagaaaacuuguau

SEQ ID NO: 1413268 - RNA, 15 nt, Homo sapiens
gaucccacucaccag

SEQ ID NO: 1413269 - RNA, 19 nt, Homo sapiens
gaucggcuuccucaggggc

SEQ ID NO: 1413270 - RNA, 23 nt, Homo sapiens
gaucuaguucagaaggaagcaaa

SEQ ID NO: 1413271 - RNA, 14 nt, Homo sapiens
gaucugauucuacc

SEQ ID NO: 1413272 - RNA, 22 nt, Homo sapiens
gaucugcccccuuuacuccucg

SEQ ID NO: 1413273 - RNA, 13 nt, Homo sapiens
gaugacaguggca

SEQ ID NO: 1413274 - RNA, 16 nt, Homo sapiens
gaugauuaagugcaca

SEQ ID NO: 1413275 - RNA, 15 nt, Homo sapiens
gauggcccauucuac

SEQ ID NO: 1413276 - RNA, 18 nt, Homo sapiens
gaugguuucuaucugcaa

SEQ ID NO: 1413277 - RNA, 12 nt, Homo sapiens
gauuauacagaa

SEQ ID NO: 1413278 - RNA, 22 nt, Homo sapiens
gauuccaggaggaguuagccaa

SEQ ID NO: 1413279 - RNA, 19 nt, Homo sapiens
gauuguucauaauacauaa

SEQ ID NO: 1413280 - RNA, 15 nt, Homo sapiens
gauuuaacugugaac

SEQ ID NO: 1413281 - RNA, 23 nt, Homo sapiens
gauuuggcaggaucggcuuccuc

SEQ ID NO: 1413282 - RNA, 15 nt, Homo sapiens
gauuuuaaaugcugu

SEQ ID NO: 1413283 - RNA, 16 nt, Homo sapiens
gcaaaagcagaacaca

SEQ ID NO: 1413284 - RNA, 13 nt, Homo sapiens
gcaaccauuugua

SEQ ID NO: 1413285 - RNA, 15 nt, Homo sapiens
gcaacuugaggcuga

SEQ ID NO: 1413286 - RNA, 13 nt, Homo sapiens
gcaagacaucugc

SEQ ID NO: 1413287 - RNA, 15 nt, Homo sapiens
gcaagcccugaccca

SEQ ID NO: 1413288 - RNA, 15 nt, Homo sapiens
gcaauaaacuuuuag

SEQ ID NO: 1413289 - RNA, 17 nt, Homo sapiens
gcacaaaaugugacauc

SEQ ID NO: 1413290 - RNA, 18 nt, Homo sapiens
gcacaagucaccaugccu

SEQ ID NO: 1413291 - RNA, 17 nt, Homo sapiens
gcacaaugcauaauguc

SEQ ID NO: 1413292 - RNA, 14 nt, Homo sapiens
gcacacacugugcu

SEQ ID NO: 1413293 - RNA, 16 nt, Homo sapiens
gcacagaccucuccca

SEQ ID NO: 1413294 - RNA, 21 nt, Homo sapiens
gcacagacugguccacagggc

SEQ ID NO: 1413295 - RNA, 18 nt, Homo sapiens
gcaccugccuccggccug

SEQ ID NO: 1413296 - RNA, 22 nt, Homo sapiens
gcaccuuuggaaacaacauuua

SEQ ID NO: 1413297 - RNA, 19 nt, Homo sapiens
gcacugaccccgaccucag

SEQ ID NO: 1413298 - RNA, 13 nt, Homo sapiens
gcacuggggccac

SEQ ID NO: 1413299 - RNA, 19 nt, Homo sapiens
gcacuggggccacccagcc

SEQ ID NO: 1413300 - RNA, 18 nt, Homo sapiens
gcagaacagugagccaaa

SEQ ID NO: 1413301 - RNA, 16 nt, Homo sapiens
gcagaauugcuugaac

SEQ ID NO: 1413302 - RNA, 20 nt, Homo sapiens
gcagacagacagauggaccg

SEQ ID NO: 1413303 - RNA, 15 nt, Homo sapiens
gcagagacagugggc

SEQ ID NO: 1413304 - RNA, 16 nt, Homo sapiens
gcagagcuguggcaca

SEQ ID NO: 1413305 - RNA, 21 nt, Homo sapiens
gcagcaugauuauaagccaaa

SEQ ID NO: 1413306 - RNA, 19 nt, Homo sapiens
gcagccagauccccagggc

SEQ ID NO: 1413307 - RNA, 12 nt, Homo sapiens
gcagucacugga

SEQ ID NO: 1413308 - RNA, 20 nt, Homo sapiens
gcaguguuuaagucagcaaa

SEQ ID NO: 1413309 - RNA, 17 nt, Homo sapiens
gcaucagaaacaucuga

SEQ ID NO: 1413310 - RNA, 20 nt, Homo sapiens
gcaugggagugaucucacca

SEQ ID NO: 1413311 - RNA, 12 nt, Homo sapiens
gcauguauucca

SEQ ID NO: 1413312 - RNA, 18 nt, Homo sapiens
gcauguuacugccaaaac

SEQ ID NO: 1413313 - RNA, 19 nt, Homo sapiens
gccaaacugucucugccuc

SEQ ID NO: 1413314 - RNA, 14 nt, Homo sapiens
gccaacaacuucuc

SEQ ID NO: 1413315 - RNA, 13 nt, Homo sapiens
gccaacacuuugu

SEQ ID NO: 1413316 - RNA, 14 nt, Homo sapiens
gccaagaaugccca

SEQ ID NO: 1413317 - RNA, 22 nt, Homo sapiens
gccaagcccuuugcuguucgca

SEQ ID NO: 1413318 - RNA, 19 nt, Homo sapiens
gccaagccggcccaaccca

SEQ ID NO: 1413319 - RNA, 17 nt, Homo sapiens
gccaagggacacaggag

SEQ ID NO: 1413320 - RNA, 16 nt, Homo sapiens
gccaaguggggugcug

SEQ ID NO: 1413321 - RNA, 14 nt, Homo sapiens
gccacacuagcuuc

SEQ ID NO: 1413322 - RNA, 22 nt, Homo sapiens
gccaccccaccagaagugcccc

SEQ ID NO: 1413323 - RNA, 14 nt, Homo sapiens
gccacccugcauuu

SEQ ID NO: 1413324 - RNA, 12 nt, Homo sapiens
gccagaagucaa

SEQ ID NO: 1413325 - RNA, 18 nt, Homo sapiens
gccagagccucaggcaga

SEQ ID NO: 1413326 - RNA, 14 nt, Homo sapiens
gccagcauaugcag

SEQ ID NO: 1413327 - RNA, 21 nt, Homo sapiens
gccagcccugcaguaaucucc

SEQ ID NO: 1413328 - RNA, 20 nt, Homo sapiens
gccagccuucuuccauccca

SEQ ID NO: 1413329 - RNA, 19 nt, Homo sapiens
gcccaaccuagaccuguag

SEQ ID NO: 1413330 - RNA, 13 nt, Homo sapiens
gcccacaccaucu

SEQ ID NO: 1413331 - RNA, 16 nt, Homo sapiens
gcccagagccaagcug

SEQ ID NO: 1413332 - RNA, 12 nt, Homo sapiens
gcccagcauuug

SEQ ID NO: 1413333 - RNA, 22 nt, Homo sapiens
gccccagcucggacuauacugc

SEQ ID NO: 1413334 - RNA, 15 nt, Homo sapiens
gccccauacagggca

SEQ ID NO: 1413335 - RNA, 18 nt, Homo sapiens
gcccccacgccuccugcc

SEQ ID NO: 1413336 - RNA, 15 nt, Homo sapiens
gcccccaucuugggg

SEQ ID NO: 1413337 - RNA, 16 nt, Homo sapiens
gcccgaggaggagcuc

SEQ ID NO: 1413338 - RNA, 18 nt, Homo sapiens
gcccuaggaggagaacuu

SEQ ID NO: 1413339 - RNA, 20 nt, Homo sapiens
gcccuccacccccaccucaa

SEQ ID NO: 1413340 - RNA, 14 nt, Homo sapiens
gcccucugcuaaag

SEQ ID NO: 1413341 - RNA, 15 nt, Homo sapiens
gcccugaggaauaaa

SEQ ID NO: 1413342 - RNA, 23 nt, Homo sapiens
gcccugaggagggcccugaggaa

SEQ ID NO: 1413343 - RNA, 14 nt, Homo sapiens
gcccuuggccagaa

SEQ ID NO: 1413344 - RNA, 18 nt, Homo sapiens
gcccuuuccucaggcaag

SEQ ID NO: 1413345 - RNA, 17 nt, Homo sapiens
gccgccccggacagugg

SEQ ID NO: 1413346 - RNA, 22 nt, Homo sapiens
gccgggcuggucuugaacuccu

SEQ ID NO: 1413347 - RNA, 14 nt, Homo sapiens
gccuagagucuuuc

SEQ ID NO: 1413348 - RNA, 21 nt, Homo sapiens
gccuagugugccaagaaugcc

SEQ ID NO: 1413349 - RNA, 21 nt, Homo sapiens
gccucccaaagugcugggauu

SEQ ID NO: 1413350 - RNA, 19 nt, Homo sapiens
gccucugcccagauuugcc

SEQ ID NO: 1413351 - RNA, 12 nt, Homo sapiens
gccucuggaaaa

SEQ ID NO: 1413352 - RNA, 20 nt, Homo sapiens
gccugagaggcaggcauaga

SEQ ID NO: 1413353 - RNA, 21 nt, Homo sapiens
gccugcaccucuccagcuccu

SEQ ID NO: 1413354 - RNA, 19 nt, Homo sapiens
gccugugccgcacuagccu

SEQ ID NO: 1413355 - RNA, 16 nt, Homo sapiens
gccuguguaacagcuc

SEQ ID NO: 1413356 - RNA, 18 nt, Homo sapiens
gccuugcuugcugccuuc

SEQ ID NO: 1413357 - RNA, 20 nt, Homo sapiens
gcgagcuccuccagaccucc

SEQ ID NO: 1413358 - RNA, 17 nt, Homo sapiens
gcggcugcaucuuccag

SEQ ID NO: 1413359 - RNA, 23 nt, Homo sapiens
gcgggucuccuagcucccugcca

SEQ ID NO: 1413360 - RNA, 23 nt, Homo sapiens
gcgucugcagaaagaaauugagc

SEQ ID NO: 1413361 - RNA, 22 nt, Homo sapiens
gcuaccaaguuucauaccaaau

SEQ ID NO: 1413362 - RNA, 14 nt, Homo sapiens
gcucaaaaugccac

SEQ ID NO: 1413363 - RNA, 19 nt, Homo sapiens
gacugcugaauuaauguga

SEQ ID NO: 1413364 - RNA, 18 nt, Homo sapiens
gacuuacagauccugcag

SEQ ID NO: 1413365 - RNA, 23 nt, Homo sapiens
gacuuauguaaucaaagccacuu

SEQ ID NO: 1413366 - RNA, 19 nt, Homo sapiens
gagaauuaggaaggccaug

SEQ ID NO: 1413367 - RNA, 23 nt, Homo sapiens
gagaccccuaaagaaauaaucuc

SEQ ID NO: 1413368 - RNA, 14 nt, Homo sapiens
gagaccguccucac

SEQ ID NO: 1413369 - RNA, 15 nt, Homo sapiens
gagagcaagauuccu

SEQ ID NO: 1413370 - RNA, 17 nt, Homo sapiens
gagaggaccuccaugcc

SEQ ID NO: 1413371 - RNA, 16 nt, Homo sapiens
gagaggcaggcauaga

SEQ ID NO: 1413372 - RNA, 20 nt, Homo sapiens
gagaguggguaaaucaggga

SEQ ID NO: 1413373 - RNA, 20 nt, Homo sapiens
gagaucacaccacugcacuc

SEQ ID NO: 1413374 - RNA, 15 nt, Homo sapiens
gagcaagauuccugu

SEQ ID NO: 1413375 - RNA, 12 nt, Homo sapiens
gagcagugccaa

SEQ ID NO: 1413376 - RNA, 14 nt, Homo sapiens
gagcaguucccaag

SEQ ID NO: 1413377 - RNA, 17 nt, Homo sapiens
gagccugaaaucaucuu

SEQ ID NO: 1413378 - RNA, 23 nt, Homo sapiens
gagcuagugucaccugcacaggg

SEQ ID NO: 1413379 - RNA, 20 nt, Homo sapiens
gagcuguggagaggggaccc

SEQ ID NO: 1413380 - RNA, 16 nt, Homo sapiens
gaggaauaaagcuucu

SEQ ID NO: 1413381 - RNA, 12 nt, Homo sapiens
gaggaaucugaa

SEQ ID NO: 1413382 - RNA, 21 nt, Homo sapiens
gaggagggcccugaggaauaa

SEQ ID NO: 1413383 - RNA, 12 nt, Homo sapiens
gaggagguugug

SEQ ID NO: 1413384 - RNA, 16 nt, Homo sapiens
gaggaguuagccaaac

SEQ ID NO: 1413385 - RNA, 16 nt, Homo sapiens
gaggccaggaugccug

SEQ ID NO: 1413386 - RNA, 21 nt, Homo sapiens
gaggcuucuccgccagccucc

SEQ ID NO: 1413387 - RNA, 15 nt, Homo sapiens
gagggagagggaggu

SEQ ID NO: 1413388 - RNA, 22 nt, Homo sapiens
gagggagcauagaaggcaggug

SEQ ID NO: 1413389 - RNA, 17 nt, Homo sapiens
gagggaggucacuggaa

SEQ ID NO: 1413390 - RNA, 14 nt, Homo sapiens
gagggcccugagga

SEQ ID NO: 1413391 - RNA, 22 nt, Homo sapiens
gagggcuuccucuagaagccaa

SEQ ID NO: 1413392 - RNA, 21 nt, Homo sapiens
gagggcuuugugucuggccag

SEQ ID NO: 1413393 - RNA, 19 nt, Homo sapiens
gaggucuguuagguguaca

SEQ ID NO: 1413394 - RNA, 19 nt, Homo sapiens
gagguggagguugcaguga

SEQ ID NO: 1413395 - RNA, 15 nt, Homo sapiens
gagguugaagccaag

SEQ ID NO: 1413396 - RNA, 20 nt, Homo sapiens
gaguaggguagaccaaauca

SEQ ID NO: 1413397 - RNA, 23 nt, Homo sapiens
gagucaccuuuccccacuccuau

SEQ ID NO: 1413398 - RNA, 14 nt, Homo sapiens
gaguccauuugaag

SEQ ID NO: 1413399 - RNA, 17 nt, Homo sapiens
gaguccauuugaagccg

SEQ ID NO: 1413400 - RNA, 14 nt, Homo sapiens
gagugaucucacca

SEQ ID NO: 1413401 - RNA, 15 nt, Homo sapiens
gagugaucucaccaa

SEQ ID NO: 1413402 - RNA, 13 nt, Homo sapiens
gaguuagccaaac

SEQ ID NO: 1413403 - RNA, 20 nt, Homo sapiens
gaguuaucuuuaacugacuu

SEQ ID NO: 1413404 - RNA, 21 nt, Homo sapiens
gaguuugagcugccuucccua

SEQ ID NO: 1413405 - RNA, 19 nt, Homo sapiens
gauaaaguugguaaaccuu

SEQ ID NO: 1413406 - RNA, 12 nt, Homo sapiens
gauaagugcagu

SEQ ID NO: 1413407 - RNA, 16 nt, Homo sapiens
gauaauugugcacacc

SEQ ID NO: 1413408 - RNA, 23 nt, Homo sapiens
gaucaagaaugcauuaagugugg

SEQ ID NO: 1413409 - RNA, 15 nt, Homo sapiens
gaucagcagggcagu

SEQ ID NO: 1413410 - RNA, 18 nt, Homo sapiens
gauccugcagucaauguu

SEQ ID NO: 1413411 - RNA, 23 nt, Homo sapiens
gauccugguauuguaauauuaaa

SEQ ID NO: 1413412 - RNA, 17 nt, Homo sapiens
gaucuaauaaacuucca

SEQ ID NO: 1413413 - RNA, 21 nt, Homo sapiens
gaucuaauaaacuuccaaaca

SEQ ID NO: 1413414 - RNA, 15 nt, Homo sapiens
gaucuuaacuucacu

SEQ ID NO: 1413415 - RNA, 20 nt, Homo sapiens
gaugaaauuaaacagauuag

SEQ ID NO: 1413416 - RNA, 22 nt, Homo sapiens
gaugauuaagugcacaccgugu

SEQ ID NO: 1413417 - RNA, 23 nt, Homo sapiens
gaugauuaagugcacaccgugug

SEQ ID NO: 1413418 - RNA, 19 nt, Homo sapiens
gaugcauguuacugccaaa

SEQ ID NO: 1413419 - RNA, 16 nt, Homo sapiens
gauggacugaugcuuu

SEQ ID NO: 1413420 - RNA, 19 nt, Homo sapiens
gauggcuccuugggaugaa

SEQ ID NO: 1413421 - RNA, 22 nt, Homo sapiens
gaugggggaucagcagggcagu

SEQ ID NO: 1413422 - RNA, 20 nt, Homo sapiens
gaugguuucuaucugcaauu

SEQ ID NO: 1413423 - RNA, 22 nt, Homo sapiens
gauguuuuguccccuccaaauc

SEQ ID NO: 1413424 - RNA, 17 nt, Homo sapiens
gauuccuaaaacucugc

SEQ ID NO: 1413425 - RNA, 16 nt, Homo sapiens
gauugauuaugcagaa

SEQ ID NO: 1413426 - RNA, 16 nt, Homo sapiens
gauuguauaacccaua

SEQ ID NO: 1413427 - RNA, 15 nt, Homo sapiens
gauuuacaguuucaa

SEQ ID NO: 1413428 - RNA, 16 nt, Homo sapiens
gauuucauugaagcuc

SEQ ID NO: 1413429 - RNA, 22 nt, Homo sapiens
gauuuuaaaaaauguuaugcag

SEQ ID NO: 1413430 - RNA, 15 nt, Homo sapiens
gcaaacuuuauuuug

SEQ ID NO: 1413431 - RNA, 11 nt, Homo sapiens
gcaaagcccca

SEQ ID NO: 1413432 - RNA, 23 nt, Homo sapiens
gcaacuuauguauuuucuuccac

SEQ ID NO: 1413433 - RNA, 12 nt, Homo sapiens
gcaagcacuuga

SEQ ID NO: 1413434 - RNA, 19 nt, Homo sapiens
gcaaggaauuuucaccucc

SEQ ID NO: 1413435 - RNA, 14 nt, Homo sapiens
gcaaggucuggccu

SEQ ID NO: 1413436 - RNA, 17 nt, Homo sapiens
gcaaguauaaauucaau

SEQ ID NO: 1413437 - RNA, 18 nt, Homo sapiens
gcaauaaaggcaccuccc

SEQ ID NO: 1413438 - RNA, 18 nt, Homo sapiens
gcaauauuauuucugugc

SEQ ID NO: 1413439 - RNA, 18 nt, Homo sapiens
gcaaugagguagauuuca

SEQ ID NO: 1413440 - RNA, 15 nt, Homo sapiens
gcacaaaaugugaca

SEQ ID NO: 1413441 - RNA, 12 nt, Homo sapiens
gcacacacugug

SEQ ID NO: 1413442 - RNA, 20 nt, Homo sapiens
gcacaccgugugccauagaa

SEQ ID NO: 1413443 - RNA, 15 nt, Homo sapiens
gcaccauucagacuu

SEQ ID NO: 1413444 - RNA, 13 nt, Homo sapiens
gcacucccaguua

SEQ ID NO: 1413445 - RNA, 18 nt, Homo sapiens
gcagaacagacacuuuaa

SEQ ID NO: 1413446 - RNA, 14 nt, Homo sapiens
gcagaagaucaaaa

SEQ ID NO: 1413447 - RNA, 15 nt, Homo sapiens
gcagagaacaucugg

SEQ ID NO: 1413448 - RNA, 17 nt, Homo sapiens
gcagaugccagcgccau

SEQ ID NO: 1413449 - RNA, 22 nt, Homo sapiens
gcagcaugauuauaagccaaac

SEQ ID NO: 1413450 - RNA, 14 nt, Homo sapiens
gcagcccuuggcca

SEQ ID NO: 1413451 - RNA, 12 nt, Homo sapiens
gcagcuccuucc

SEQ ID NO: 1413452 - RNA, 12 nt, Homo sapiens
gcagcugugacc

SEQ ID NO: 1413453 - RNA, 18 nt, Homo sapiens
gcagcuuauuggcuuaaa

SEQ ID NO: 1413454 - RNA, 14 nt, Homo sapiens
gcaggauugauuau

SEQ ID NO: 1413455 - RNA, 21 nt, Homo sapiens
gcagugaggaauuaaucuugc

SEQ ID NO: 1413456 - RNA, 14 nt, Homo sapiens
gcagugagugagcc

SEQ ID NO: 1413457 - RNA, 21 nt, Homo sapiens
gcauaauacuugcuuuggaaa

SEQ ID NO: 1413458 - RNA, 14 nt, Homo sapiens
gcauaucacuugau

SEQ ID NO: 1413459 - RNA, 12 nt, Homo sapiens
gcauuccagcuc

SEQ ID NO: 1413460 - RNA, 18 nt, Homo sapiens
gcauugaucugagugcuu

SEQ ID NO: 1413461 - RNA, 17 nt, Homo sapiens
gccaaagcagcuacaau

SEQ ID NO: 1413462 - RNA, 21 nt, Homo sapiens
gccaaccuguaauaaauauga

SEQ ID NO: 1413463 - RNA, 14 nt, Homo sapiens
gccacacacccgcu

SEQ ID NO: 1413464 - RNA, 22 nt, Homo sapiens
gccacccugcauuugugucauu

SEQ ID NO: 1413465 - RNA, 11 nt, Homo sapiens
gccaccuuccc

SEQ ID NO: 1413466 - RNA, 19 nt, Homo sapiens
gccagaaaaggcagccaga

SEQ ID NO: 1413467 - RNA, 22 nt, Homo sapiens
gccagccugcgggaagcugacc

SEQ ID NO: 1413468 - RNA, 17 nt, Homo sapiens
gccagcuuuaguccccu

SEQ ID NO: 1413469 - RNA, 16 nt, Homo sapiens
gccaggcacacacugu

SEQ ID NO: 1413470 - RNA, 15 nt, Homo sapiens
gccauaaaugaccua

SEQ ID NO: 1413471 - RNA, 18 nt, Homo sapiens
gccauaaaugaccuaacg

SEQ ID NO: 1413472 - RNA, 15 nt, Homo sapiens
gccauagaauggcac

SEQ ID NO: 1413473 - RNA, 21 nt, Homo sapiens
gccauagaauggcacauguca

SEQ ID NO: 1413474 - RNA, 22 nt, Homo sapiens
gccauagaauggcacaugucau

SEQ ID NO: 1413475 - RNA, 19 nt, Homo sapiens
gccaugugaaacucaucuc

SEQ ID NO: 1413476 - RNA, 20 nt, Homo sapiens
gccaugugaaacucaucuca

SEQ ID NO: 1413477 - RNA, 12 nt, Homo sapiens
gcccaccagagc

SEQ ID NO: 1413478 - RNA, 24 nt, Homo sapiens
gcccagaauucugggcaagucacc

SEQ ID NO: 1413479 - RNA, 21 nt, Homo sapiens
gcccaucccugugaaggagua

SEQ ID NO: 1413480 - RNA, 23 nt, Homo sapiens
gccccaugcuggagccuguguaa

SEQ ID NO: 1413481 - RNA, 21 nt, Homo sapiens
gcccccagcagauggaaagaa

SEQ ID NO: 1413482 - RNA, 12 nt, Homo sapiens
gcccccaguguc

SEQ ID NO: 1413483 - RNA, 13 nt, Homo sapiens
gccccugcccuga

SEQ ID NO: 1413484 - RNA, 14 nt, Homo sapiens
gccccugcccugag

SEQ ID NO: 1413485 - RNA, 23 nt, Homo sapiens
gccccugcccugaggagggcccu

SEQ ID NO: 1413486 - RNA, 19 nt, Homo sapiens
gccccuuaguccccaagcc

SEQ ID NO: 1413487 - RNA, 23 nt, Homo sapiens
gcccgcugcgaugggaacacaag

SEQ ID NO: 1413488 - RNA, 23 nt, Homo sapiens
gcccuaggaggagaacuugaaca

SEQ ID NO: 1413489 - RNA, 19 nt, Homo sapiens
acgugucugagagccauaa

SEQ ID NO: 1413490 - RNA, 17 nt, Homo sapiens
acguucauccacucugc

SEQ ID NO: 1413491 - RNA, 22 nt, Homo sapiens
acuaaagaccugcuguaauaaa

SEQ ID NO: 1413492 - RNA, 14 nt, Homo sapiens
acuaaagugugcuu

SEQ ID NO: 1413493 - RNA, 14 nt, Homo sapiens
acuaauagccuaaa

SEQ ID NO: 1413494 - RNA, 14 nt, Homo sapiens
acuagaucacaacu

SEQ ID NO: 1413495 - RNA, 20 nt, Homo sapiens
acuagccuuuggcucuggag

SEQ ID NO: 1413496 - RNA, 21 nt, Homo sapiens
acuaggugaucucaguucucu

SEQ ID NO: 1413497 - RNA, 13 nt, Homo sapiens
acuauacugcuga

SEQ ID NO: 1413498 - RNA, 17 nt, Homo sapiens
acuauuuauaacuaaua

SEQ ID NO: 1413499 - RNA, 15 nt, Homo sapiens
acucaacauuacauu

SEQ ID NO: 1413500 - RNA, 17 nt, Homo sapiens
acucaagauucccagga

SEQ ID NO: 1413501 - RNA, 15 nt, Homo sapiens
acuccaguacucugu

SEQ ID NO: 1413502 - RNA, 17 nt, Homo sapiens
acuccaguacucuguaa

SEQ ID NO: 1413503 - RNA, 18 nt, Homo sapiens
acucccacuucuucagcu

SEQ ID NO: 1413504 - RNA, 21 nt, Homo sapiens
acucccucgucgagcuggaug

SEQ ID NO: 1413505 - RNA, 17 nt, Homo sapiens
acuccugaccucaggua

SEQ ID NO: 1413506 - RNA, 16 nt, Homo sapiens
acucuugccaaccugu

SEQ ID NO: 1413507 - RNA, 17 nt, Homo sapiens
acugaagacaggcacaa

SEQ ID NO: 1413508 - RNA, 23 nt, Homo sapiens
acugaagauaacaagagauuuaa

SEQ ID NO: 1413509 - RNA, 17 nt, Homo sapiens
acugaaucagaaaugua

SEQ ID NO: 1413510 - RNA, 16 nt, Homo sapiens
acugauguuacuagcc

SEQ ID NO: 1413511 - RNA, 18 nt, Homo sapiens
acugauguuacuagccuc

SEQ ID NO: 1413512 - RNA, 23 nt, Homo sapiens
acugcauugaaggcgaggcugcc

SEQ ID NO: 1413513 - RNA, 13 nt, Homo sapiens
acugcauuucacu

SEQ ID NO: 1413514 - RNA, 18 nt, Homo sapiens
acugcauuucacucuggg

SEQ ID NO: 1413515 - RNA, 19 nt, Homo sapiens
acugccucgggaaccucac

SEQ ID NO: 1413516 - RNA, 22 nt, Homo sapiens
acugccucgggaaccucacucu

SEQ ID NO: 1413517 - RNA, 19 nt, Homo sapiens
acugcuuuugagagcucuu

SEQ ID NO: 1413518 - RNA, 23 nt, Homo sapiens
acuggcagcuuugaaaaaacacc

SEQ ID NO: 1413519 - RNA, 19 nt, Homo sapiens
acuggcuccccuucaccuu

SEQ ID NO: 1413520 - RNA, 22 nt, Homo sapiens
acugggaggccgggcauggugg

SEQ ID NO: 1413521 - RNA, 22 nt, Homo sapiens
acuggggccuguguagccagug

SEQ ID NO: 1413522 - RNA, 14 nt, Homo sapiens
acuggugagggcaa

SEQ ID NO: 1413523 - RNA, 19 nt, Homo sapiens
acuguucugagccaaauuc

SEQ ID NO: 1413524 - RNA, 22 nt, Homo sapiens
acuuaaggagaaauagcuguau

SEQ ID NO: 1413525 - RNA, 20 nt, Homo sapiens
acuuaugguuggacaccauc

SEQ ID NO: 1413526 - RNA, 16 nt, Homo sapiens
acuucagguuuuauca

SEQ ID NO: 1413527 - RNA, 23 nt, Homo sapiens
acuucauucaagaggaauuccag

SEQ ID NO: 1413528 - RNA, 17 nt, Homo sapiens
acuucccgccuccauga

SEQ ID NO: 1413529 - RNA, 23 nt, Homo sapiens
acuuccucaucaugaaaacuggg

SEQ ID NO: 1413530 - RNA, 19 nt, Homo sapiens
acuugaaaauuaacaugaa

SEQ ID NO: 1413531 - RNA, 20 nt, Homo sapiens
acuuuaaaagcuucugcaau

SEQ ID NO: 1413532 - RNA, 14 nt, Homo sapiens
acuuuucaccuuaa

SEQ ID NO: 1413533 - RNA, 19 nt, Homo sapiens
agaaacaacgcaaaccucu

SEQ ID NO: 1413534 - RNA, 20 nt, Homo sapiens
agaaaccuggccuuauauca

SEQ ID NO: 1413535 - RNA, 21 nt, Homo sapiens
agaaaccuggccuuauaucau

SEQ ID NO: 1413536 - RNA, 19 nt, Homo sapiens
agaaauugagcgccauaag

SEQ ID NO: 1413537 - RNA, 16 nt, Homo sapiens
agaaauuuauaaacuu

SEQ ID NO: 1413538 - RNA, 16 nt, Homo sapiens
agaacaagucaccucc

SEQ ID NO: 1413539 - RNA, 22 nt, Homo sapiens
agaacaagucggcuguggagau

SEQ ID NO: 1413540 - RNA, 16 nt, Homo sapiens
agaagagggaaugagc

SEQ ID NO: 1413541 - RNA, 22 nt, Homo sapiens
agaagagggaaugagcuuccau

SEQ ID NO: 1413542 - RNA, 16 nt, Homo sapiens
agaagcucaaccaugg

SEQ ID NO: 1413543 - RNA, 14 nt, Homo sapiens
agaagucaagccca

SEQ ID NO: 1413544 - RNA, 19 nt, Homo sapiens
agaagugucacagccauag

SEQ ID NO: 1413545 - RNA, 21 nt, Homo sapiens
agaaugaccucgcaagacccu

SEQ ID NO: 1413546 - RNA, 19 nt, Homo sapiens
agaauuucuuuaugaucuu

SEQ ID NO: 1413547 - RNA, 18 nt, Homo sapiens
agacacaaguggccuuaa

SEQ ID NO: 1413548 - RNA, 22 nt, Homo sapiens
agacacuuuaaaagcuucugca

SEQ ID NO: 1413549 - RNA, 22 nt, Homo sapiens
agacaggcacaaaaugugacau

SEQ ID NO: 1413550 - RNA, 19 nt, Homo sapiens
agaccgaaaaguugcugaa

SEQ ID NO: 1413551 - RNA, 23 nt, Homo sapiens
agacuccucggccuggcuccuac

SEQ ID NO: 1413552 - RNA, 23 nt, Homo sapiens
agacuuucagccgacucagcaac

SEQ ID NO: 1413553 - RNA, 16 nt, Homo sapiens
agagaaauguuuucac

SEQ ID NO: 1413554 - RNA, 23 nt, Homo sapiens
agagaaugaugcugugcauauca

SEQ ID NO: 1413555 - RNA, 20 nt, Homo sapiens
agagacacaaguggccuuaa

SEQ ID NO: 1413556 - RNA, 14 nt, Homo sapiens
agagaugcuggauu

SEQ ID NO: 1413557 - RNA, 16 nt, Homo sapiens
agagcagcuccacaac

SEQ ID NO: 1413558 - RNA, 19 nt, Homo sapiens
agagcaggcuuugugagag

SEQ ID NO: 1413559 - RNA, 12 nt, Homo sapiens
agagccaaacag

SEQ ID NO: 1413560 - RNA, 18 nt, Homo sapiens
agagcccgguacagggcc

SEQ ID NO: 1413561 - RNA, 13 nt, Homo sapiens
agagcccuugccu

SEQ ID NO: 1413562 - RNA, 14 nt, Homo sapiens
agagcccuugccuc

SEQ ID NO: 1413563 - RNA, 16 nt, Homo sapiens
agagcggucucaggcu

SEQ ID NO: 1413564 - RNA, 18 nt, Homo sapiens
agagcuguggcacagacc

SEQ ID NO: 1413565 - RNA, 21 nt, Homo sapiens
agaggaauuccagcaucugaa

SEQ ID NO: 1413566 - RNA, 15 nt, Homo sapiens
agagggaggucacug

SEQ ID NO: 1413567 - RNA, 18 nt, Homo sapiens
agagggaggucacuggaa

SEQ ID NO: 1413568 - RNA, 13 nt, Homo sapiens
agagggcuuccuc

SEQ ID NO: 1413569 - RNA, 11 nt, Homo sapiens
agaggugaccu

SEQ ID NO: 1413570 - RNA, 23 nt, Homo sapiens
agaguauccuccucccuuuacca

SEQ ID NO: 1413571 - RNA, 20 nt, Homo sapiens
agagugauaggacauucuau

SEQ ID NO: 1413572 - RNA, 16 nt, Homo sapiens
agaguguggauuguau

SEQ ID NO: 1413573 - RNA, 17 nt, Homo sapiens
agaguguggauuguaua

SEQ ID NO: 1413574 - RNA, 13 nt, Homo sapiens
agauaagugcagu

SEQ ID NO: 1413575 - RNA, 14 nt, Homo sapiens
agauagucacugga

SEQ ID NO: 1413576 - RNA, 20 nt, Homo sapiens
agaucaaaaugcuaaaacau

SEQ ID NO: 1413577 - RNA, 15 nt, Homo sapiens
agaucacaccacugc

SEQ ID NO: 1413578 - RNA, 16 nt, Homo sapiens
agaugcggaaagcccu

SEQ ID NO: 1413579 - RNA, 13 nt, Homo sapiens
agauguacaugug

SEQ ID NO: 1413580 - RNA, 14 nt, Homo sapiens
agauguguucacaa

SEQ ID NO: 1413581 - RNA, 14 nt, Homo sapiens
agauguucaccuuu

SEQ ID NO: 1413582 - RNA, 17 nt, Homo sapiens
agauucacaugcuggcu

SEQ ID NO: 1413583 - RNA, 19 nt, Homo sapiens
agauucaggcuugcauuaa

SEQ ID NO: 1413584 - RNA, 16 nt, Homo sapiens
agauuuuguuagccaa

SEQ ID NO: 1413585 - RNA, 18 nt, Homo sapiens
agauuuuguuagccaaca

SEQ ID NO: 1413586 - RNA, 23 nt, Homo sapiens
agauuuuucugugaaagcucuca

SEQ ID NO: 1413587 - RNA, 16 nt, Homo sapiens
agcaaaagcagaacac

SEQ ID NO: 1413588 - RNA, 19 nt, Homo sapiens
agcaaaaucccuuaaucua

SEQ ID NO: 1413589 - RNA, 17 nt, Homo sapiens
agcaaccauuuguaaaa

SEQ ID NO: 1413590 - RNA, 14 nt, Homo sapiens
agcaacuuauguau

SEQ ID NO: 1413591 - RNA, 18 nt, Homo sapiens
agcaagcacuugaugcca

SEQ ID NO: 1413592 - RNA, 18 nt, Homo sapiens
agcacaaugcauaauguc

SEQ ID NO: 1413593 - RNA, 15 nt, Homo sapiens
agcaccuccccagac

SEQ ID NO: 1413594 - RNA, 13 nt, Homo sapiens
agcacgccuuagc

SEQ ID NO: 1413595 - RNA, 15 nt, Homo sapiens
agcagagaacaucug

SEQ ID NO: 1413596 - RNA, 17 nt, Homo sapiens
agcagagauguucaccu

SEQ ID NO: 1413597 - RNA, 12 nt, Homo sapiens
agcauaauacuu

SEQ ID NO: 1413598 - RNA, 15 nt, Homo sapiens
agcauaauacuugcu

SEQ ID NO: 1413599 - RNA, 19 nt, Homo sapiens
agcauccuuuugcucuguc

SEQ ID NO: 1413600 - RNA, 23 nt, Homo sapiens
agcaucuaucucaucuaucucaa

SEQ ID NO: 1413601 - RNA, 20 nt, Homo sapiens
agccaaacagagcccaggga

SEQ ID NO: 1413602 - RNA, 16 nt, Homo sapiens
agccacagcaaaaagu

SEQ ID NO: 1413603 - RNA, 11 nt, Homo sapiens
agccaccacuc

SEQ ID NO: 1413604 - RNA, 20 nt, Homo sapiens
agccacgguguucugugaua

SEQ ID NO: 1413605 - RNA, 16 nt, Homo sapiens
agccaggcacacacug

SEQ ID NO: 1413606 - RNA, 14 nt, Homo sapiens
agccagggggacua

SEQ ID NO: 1413607 - RNA, 19 nt, Homo sapiens
agccagggggacuagcccc

SEQ ID NO: 1413608 - RNA, 21 nt, Homo sapiens
agccaugugaaacucaucuca

SEQ ID NO: 1413609 - RNA, 23 nt, Homo sapiens
agcccagaaggccagaaaaggca

SEQ ID NO: 1413610 - RNA, 16 nt, Homo sapiens
agcccagcuugugugc

SEQ ID NO: 1413611 - RNA, 12 nt, Homo sapiens
agcccagggugg

SEQ ID NO: 1413612 - RNA, 20 nt, Homo sapiens
agccccaucuaccacaucuu

SEQ ID NO: 1413613 - RNA, 17 nt, Homo sapiens
agcccuggcuuccaagg

SEQ ID NO: 1413614 - RNA, 21 nt, Homo sapiens
agccggcccaacccaaccacu

SEQ ID NO: 1413615 - RNA, 21 nt, Homo sapiens
uccugccaaggccgagccaca

SEQ ID NO: 1413616 - RNA, 15 nt, Homo sapiens
uccugcccgcccucc

SEQ ID NO: 1413617 - RNA, 17 nt, Homo sapiens
uccugcuagcaccuccc

SEQ ID NO: 1413618 - RNA, 17 nt, Homo sapiens
uccugugugagcccaga

SEQ ID NO: 1413619 - RNA, 15 nt, Homo sapiens
uccuuaaacugccaa

SEQ ID NO: 1413620 - RNA, 13 nt, Homo sapiens
uccuucaccaaag

SEQ ID NO: 1413621 - RNA, 14 nt, Homo sapiens
uccuucaccaaaga

SEQ ID NO: 1413622 - RNA, 12 nt, Homo sapiens
uccuucuugccu

SEQ ID NO: 1413623 - RNA, 22 nt, Homo sapiens
uccuuuccccagcccagggugg

SEQ ID NO: 1413624 - RNA, 21 nt, Homo sapiens
ucgaaauaaaggcgauagcug

SEQ ID NO: 1413625 - RNA, 18 nt, Homo sapiens
ucgagauuaacggugcua

SEQ ID NO: 1413626 - RNA, 14 nt, Homo sapiens
ucgcaagacccuua

SEQ ID NO: 1413627 - RNA, 15 nt, Homo sapiens
ucgccagcugaugac

SEQ ID NO: 1413628 - RNA, 15 nt, Homo sapiens
ucgccccacccguuc

SEQ ID NO: 1413629 - RNA, 17 nt, Homo sapiens
ucggcuuccucaggggc

SEQ ID NO: 1413630 - RNA, 20 nt, Homo sapiens
ucgggaaccucacucuugcc

SEQ ID NO: 1413631 - RNA, 22 nt, Homo sapiens
ucggggaggagguugugucacu

SEQ ID NO: 1413632 - RNA, 11 nt, Homo sapiens
ucgguagcuug

SEQ ID NO: 1413633 - RNA, 21 nt, Homo sapiens
ucguauuucaccucuacauuu

SEQ ID NO: 1413634 - RNA, 13 nt, Homo sapiens
ucgucuuugcaga

SEQ ID NO: 1413635 - RNA, 17 nt, Homo sapiens
ucgugcgaaacaccccc

SEQ ID NO: 1413636 - RNA, 14 nt, Homo sapiens
ucuaaaaccaaaua

SEQ ID NO: 1413637 - RNA, 20 nt, Homo sapiens
ucuaaaggcuuuugcccuac

SEQ ID NO: 1413638 - RNA, 12 nt, Homo sapiens
ucuacacucauu

SEQ ID NO: 1413639 - RNA, 19 nt, Homo sapiens
ucuagaagugccaucucaa

SEQ ID NO: 1413640 - RNA, 15 nt, Homo sapiens
ucuagaauacauauu

SEQ ID NO: 1413641 - RNA, 20 nt, Homo sapiens
ucuagacccccgacuccgca

SEQ ID NO: 1413642 - RNA, 14 nt, Homo sapiens
ucuaggcagaagaa

SEQ ID NO: 1413643 - RNA, 18 nt, Homo sapiens
ucuaugcagaacagugag

SEQ ID NO: 1413644 - RNA, 13 nt, Homo sapiens
ucucaacaucacu

SEQ ID NO: 1413645 - RNA, 18 nt, Homo sapiens
ucucaauugugcuuugua

SEQ ID NO: 1413646 - RNA, 23 nt, Homo sapiens
ucucacucugguuguuuaugcaa

SEQ ID NO: 1413647 - RNA, 17 nt, Homo sapiens
ucuccaucuaccuucca

SEQ ID NO: 1413648 - RNA, 21 nt, Homo sapiens
ucuccuggccaucccuucauu

SEQ ID NO: 1413649 - RNA, 14 nt, Homo sapiens
ucuccugugcugcg

SEQ ID NO: 1413650 - RNA, 13 nt, Homo sapiens
ucucgcucuggau

SEQ ID NO: 1413651 - RNA, 15 nt, Homo sapiens
ucucucaccauguga

SEQ ID NO: 1413652 - RNA, 18 nt, Homo sapiens
ucucuccaucuaccuucc

SEQ ID NO: 1413653 - RNA, 18 nt, Homo sapiens
ucucucuaccugugacaa

SEQ ID NO: 1413654 - RNA, 20 nt, Homo sapiens
ucucucuuagcauccugccu

SEQ ID NO: 1413655 - RNA, 17 nt, Homo sapiens
ucucugaacuaggugau

SEQ ID NO: 1413656 - RNA, 19 nt, Homo sapiens
ucucugagcccgugucaca

SEQ ID NO: 1413657 - RNA, 15 nt, Homo sapiens
ucucugaugauguca

SEQ ID NO: 1413658 - RNA, 22 nt, Homo sapiens
ucugaaccauauccauguugcu

SEQ ID NO: 1413659 - RNA, 20 nt, Homo sapiens
ucugaacuaggugaucucag

SEQ ID NO: 1413660 - RNA, 15 nt, Homo sapiens
ucugaacuguggaau

SEQ ID NO: 1413661 - RNA, 18 nt, Homo sapiens
ucugagccaaauucuaaa

SEQ ID NO: 1413662 - RNA, 20 nt, Homo sapiens
ucugagucuggggugagaua

SEQ ID NO: 1413663 - RNA, 21 nt, Homo sapiens
ucugagucuggggugagauaa

SEQ ID NO: 1413664 - RNA, 23 nt, Homo sapiens
ucugagugcuuucauauuuucca

SEQ ID NO: 1413665 - RNA, 16 nt, Homo sapiens
ucugaugucuucuuac

SEQ ID NO: 1413666 - RNA, 13 nt, Homo sapiens
ucugcaauauuau

SEQ ID NO: 1413667 - RNA, 17 nt, Homo sapiens
ucugccucucaacauca

SEQ ID NO: 1413668 - RNA, 13 nt, Homo sapiens
ucugccugagcuu

SEQ ID NO: 1413669 - RNA, 14 nt, Homo sapiens
ucugcucauucuaa

SEQ ID NO: 1413670 - RNA, 17 nt, Homo sapiens
ucugcucuguucuggau

SEQ ID NO: 1413671 - RNA, 13 nt, Homo sapiens
ucuggggcucagc

SEQ ID NO: 1413672 - RNA, 16 nt, Homo sapiens
ucugugaccucaggca

SEQ ID NO: 1413673 - RNA, 20 nt, Homo sapiens
ucugugguuguggaugggag

SEQ ID NO: 1413674 - RNA, 17 nt, Homo sapiens
ucugugucaaugugauu

SEQ ID NO: 1413675 - RNA, 20 nt, Homo sapiens
ucuuagaacucugcuuacua

SEQ ID NO: 1413676 - RNA, 11 nt, Homo sapiens
ucuuagcucau

SEQ ID NO: 1413677 - RNA, 13 nt, Homo sapiens
ucuucgauguacu

SEQ ID NO: 1413678 - RNA, 14 nt, Homo sapiens
ucuucuuugcagcc

SEQ ID NO: 1413679 - RNA, 14 nt, Homo sapiens
ucuugaaaguauug

SEQ ID NO: 1413680 - RNA, 14 nt, Homo sapiens
ucuugaauagcuua

SEQ ID NO: 1413681 - RNA, 14 nt, Homo sapiens
ucuugccaaccugu

SEQ ID NO: 1413682 - RNA, 16 nt, Homo sapiens
ucuugccaaccuguaa

SEQ ID NO: 1413683 - RNA, 14 nt, Homo sapiens
ucuugucaccuuaa

SEQ ID NO: 1413684 - RNA, 21 nt, Homo sapiens
ucuuuaacugacuucugucca

SEQ ID NO: 1413685 - RNA, 18 nt, Homo sapiens
ucuuucuuuuuauuuaca

SEQ ID NO: 1413686 - RNA, 13 nt, Homo sapiens
ugaaaaauauuca

SEQ ID NO: 1413687 - RNA, 19 nt, Homo sapiens
ugaaaauuaacaugaauau

SEQ ID NO: 1413688 - RNA, 11 nt, Homo sapiens
ugaaagcucuc

SEQ ID NO: 1413689 - RNA, 13 nt, Homo sapiens
ugaaaguugcagg

SEQ ID NO: 1413690 - RNA, 15 nt, Homo sapiens
ugaaauuaaacagau

SEQ ID NO: 1413691 - RNA, 16 nt, Homo sapiens
ugaaauuuauacacca

SEQ ID NO: 1413692 - RNA, 16 nt, Homo sapiens
ugaacauuccuaucaa

SEQ ID NO: 1413693 - RNA, 23 nt, Homo sapiens
ugaacuaggugaucucaguucuc

SEQ ID NO: 1413694 - RNA, 13 nt, Homo sapiens
ugaagccaaagaa

SEQ ID NO: 1413695 - RNA, 22 nt, Homo sapiens
ugaagccuggacgcagccacac

SEQ ID NO: 1413696 - RNA, 13 nt, Homo sapiens
ugaagcucagaaa

SEQ ID NO: 1413697 - RNA, 19 nt, Homo sapiens
ugaaguguuauuucaucca

SEQ ID NO: 1413698 - RNA, 13 nt, Homo sapiens
ugaaguuugcuau

SEQ ID NO: 1413699 - RNA, 19 nt, Homo sapiens
ugaauauuuaguguucaua

SEQ ID NO: 1413700 - RNA, 18 nt, Homo sapiens
ugaaucuaaaaccaaaua

SEQ ID NO: 1413701 - RNA, 16 nt, Homo sapiens
ugaaugaaagucuugu

SEQ ID NO: 1413702 - RNA, 20 nt, Homo sapiens
ugacaccuuuaaaaagcagu

SEQ ID NO: 1413703 - RNA, 23 nt, Homo sapiens
ugacauacccaaaguagccagcu

SEQ ID NO: 1413704 - RNA, 19 nt, Homo sapiens
ugacauguacauacuguau

SEQ ID NO: 1413705 - RNA, 17 nt, Homo sapiens
ugacauuuaaacucagc

SEQ ID NO: 1413706 - RNA, 18 nt, Homo sapiens
ugaccuguaguguaccau

SEQ ID NO: 1413707 - RNA, 14 nt, Homo sapiens
ugacuagugcugaa

SEQ ID NO: 1413708 - RNA, 12 nt, Homo sapiens
ugacuauggaaa

SEQ ID NO: 1413709 - RNA, 15 nt, Homo sapiens
ugacuuauguaauca

SEQ ID NO: 1413710 - RNA, 14 nt, Homo sapiens
ugacuuuucaccuu

SEQ ID NO: 1413711 - RNA, 20 nt, Homo sapiens
ugagaauuaucaccaugaca

SEQ ID NO: 1413712 - RNA, 17 nt, Homo sapiens
ugagagcucuucagaga

SEQ ID NO: 1413713 - RNA, 22 nt, Homo sapiens
ugagaguggguaaaucagggac

SEQ ID NO: 1413714 - RNA, 13 nt, Homo sapiens
ugagaucacccca

SEQ ID NO: 1413715 - RNA, 22 nt, Homo sapiens
ugagaucaccccacuuccauca

SEQ ID NO: 1413716 - RNA, 18 nt, Homo sapiens
ugagccccauacagggca

SEQ ID NO: 1413717 - RNA, 22 nt, Homo sapiens
ugagcuucccccccaccacagg

SEQ ID NO: 1413718 - RNA, 15 nt, Homo sapiens
ugagcuuuacagcag

SEQ ID NO: 1413719 - RNA, 21 nt, Homo sapiens
ugaggauggagcaacccaaua

SEQ ID NO: 1413720 - RNA, 15 nt, Homo sapiens
ugagggccugagguc

SEQ ID NO: 1413721 - RNA, 20 nt, Homo sapiens
ugagguagauuucauugaag

SEQ ID NO: 1413722 - RNA, 21 nt, Homo sapiens
ugagugauuccaguauuucau

SEQ ID NO: 1413723 - RNA, 15 nt, Homo sapiens
ugaguucccaaaggg

SEQ ID NO: 1413724 - RNA, 15 nt, Homo sapiens
ugauaacagaaaaau

SEQ ID NO: 1413725 - RNA, 20 nt, Homo sapiens
ugauccagaaagaaaacuug

SEQ ID NO: 1413726 - RNA, 16 nt, Homo sapiens
ugaucgggaagcccuu

SEQ ID NO: 1413727 - RNA, 14 nt, Homo sapiens
ugaucucaguucuc

SEQ ID NO: 1413728 - RNA, 12 nt, Homo sapiens
ugaugacuaugg

SEQ ID NO: 1413729 - RNA, 23 nt, Homo sapiens
ugauggagacaguaacacuggcg

SEQ ID NO: 1413730 - RNA, 16 nt, Homo sapiens
ugcaacuuuguauaaa

SEQ ID NO: 1413731 - RNA, 17 nt, Homo sapiens
ugcacaccgugugccau

SEQ ID NO: 1413732 - RNA, 12 nt, Homo sapiens
ugcagaacagug

SEQ ID NO: 1413733 - RNA, 21 nt, Homo sapiens
ugcagaacagugagccaaaua

SEQ ID NO: 1413734 - RNA, 18 nt, Homo sapiens
ugcagcugcaagacaucu

SEQ ID NO: 1413735 - RNA, 14 nt, Homo sapiens
ugcagucacuggag

SEQ ID NO: 1413736 - RNA, 23 nt, Homo sapiens
ugcauaucacuugauaugugcac

SEQ ID NO: 1413737 - RNA, 14 nt, Homo sapiens
ugcauuaagugugg

SEQ ID NO: 1413738 - RNA, 15 nt, Homo sapiens
ugcauuucacucugg

SEQ ID NO: 1413739 - RNA, 14 nt, Homo sapiens
ugccaaccuguaau

SEQ ID NO: 1413740 - RNA, 15 nt, Homo sapiens
ugccagcauaugcag

SEQ ID NO: 1413741 - RNA, 12 nt, Homo sapiens
ugccagcuuccu

SEQ ID NO: 1413742 - RNA, 17 nt, Homo sapiens
ugccauagaauggcaca

SEQ ID NO: 1413743 - RNA, 22 nt, Homo sapiens
ugccauagaauggcacauguca

SEQ ID NO: 1413744 - RNA, 23 nt, Homo sapiens
ugccaucucaauugugcuuugua

SEQ ID NO: 1413745 - RNA, 17 nt, Homo sapiens
ugcccacuucuguguag

SEQ ID NO: 1413746 - RNA, 16 nt, Homo sapiens
ugcccaggcuggagua

SEQ ID NO: 1413747 - RNA, 19 nt, Homo sapiens
ugcccugaggagggcccug

SEQ ID NO: 1413748 - RNA, 14 nt, Homo sapiens
ugccgcucuucacu

SEQ ID NO: 1413749 - RNA, 14 nt, Homo sapiens
ugccuauaauccca

SEQ ID NO: 1413750 - RNA, 14 nt, Homo sapiens
ugccuccuugaaag

SEQ ID NO: 1413751 - RNA, 21 nt, Homo sapiens
gccuccauguagaacuugaac

SEQ ID NO: 1413752 - RNA, 22 nt, Homo sapiens
gccuccccauuucccaucugca

SEQ ID NO: 1413753 - RNA, 18 nt, Homo sapiens
gccugaauagcuuggaaa

SEQ ID NO: 1413754 - RNA, 11 nt, Homo sapiens
gccugcacugg

SEQ ID NO: 1413755 - RNA, 22 nt, Homo sapiens
gccugccuuaccgagagccaaa

SEQ ID NO: 1413756 - RNA, 14 nt, Homo sapiens
gccugcugcugcca

SEQ ID NO: 1413757 - RNA, 15 nt, Homo sapiens
gccugcugcugccaa

SEQ ID NO: 1413758 - RNA, 22 nt, Homo sapiens
gccuggccuccuucaccaaaga

SEQ ID NO: 1413759 - RNA, 15 nt, Homo sapiens
gccugggaguguuug

SEQ ID NO: 1413760 - RNA, 18 nt, Homo sapiens
gccugggggcagccucuc

SEQ ID NO: 1413761 - RNA, 16 nt, Homo sapiens
gccuguaaucccagca

SEQ ID NO: 1413762 - RNA, 16 nt, Homo sapiens
gccuguagcaaacacc

SEQ ID NO: 1413763 - RNA, 20 nt, Homo sapiens
gccuucagaggccaucugau

SEQ ID NO: 1413764 - RNA, 19 nt, Homo sapiens
gccuuccugccuacugccc

SEQ ID NO: 1413765 - RNA, 15 nt, Homo sapiens
gccuugccugggaua

SEQ ID NO: 1413766 - RNA, 14 nt, Homo sapiens
gcgaaaauugcgaa

SEQ ID NO: 1413767 - RNA, 14 nt, Homo sapiens
gcgacauagcccau

SEQ ID NO: 1413768 - RNA, 21 nt, Homo sapiens
gcgaccaccaacacacaggaa

SEQ ID NO: 1413769 - RNA, 21 nt, Homo sapiens
gcgaugggggaucagcagggc

SEQ ID NO: 1413770 - RNA, 19 nt, Homo sapiens
gcgccaugcuuccuauaca

SEQ ID NO: 1413771 - RNA, 19 nt, Homo sapiens
gcggaccccagcugugagc

SEQ ID NO: 1413772 - RNA, 16 nt, Homo sapiens
gcucagcccugagcua

SEQ ID NO: 1413773 - RNA, 18 nt, Homo sapiens
gcuccucccucugaccca

SEQ ID NO: 1413774 - RNA, 13 nt, Homo sapiens
gcucgucuuugca

SEQ ID NO: 1413775 - RNA, 14 nt, Homo sapiens
gcucgucuuugcag

SEQ ID NO: 1413776 - RNA, 19 nt, Homo sapiens
gcucuguucuggaucugcc

SEQ ID NO: 1413777 - RNA, 19 nt, Homo sapiens
gcugaagccuggacgcagc

SEQ ID NO: 1413778 - RNA, 23 nt, Homo sapiens
gcugaagccuggacgcagccaca

SEQ ID NO: 1413779 - RNA, 19 nt, Homo sapiens
gcugaucuuuaacuggaag

SEQ ID NO: 1413780 - RNA, 22 nt, Homo sapiens
gcugauuccuaaaacucugcca

SEQ ID NO: 1413781 - RNA, 17 nt, Homo sapiens
gcugcaagacaucugcu

SEQ ID NO: 1413782 - RNA, 17 nt, Homo sapiens
gcugcaucccaccagcc

SEQ ID NO: 1413783 - RNA, 13 nt, Homo sapiens
gcugcaucuucca

SEQ ID NO: 1413784 - RNA, 20 nt, Homo sapiens
gcugcaugggucacagcggc

SEQ ID NO: 1413785 - RNA, 19 nt, Homo sapiens
gcugcuccucccucugacc

SEQ ID NO: 1413786 - RNA, 18 nt, Homo sapiens
gcugcuccuucucuaguu

SEQ ID NO: 1413787 - RNA, 16 nt, Homo sapiens
gcugcugaccagcacu

SEQ ID NO: 1413788 - RNA, 21 nt, Homo sapiens
gcugcugagucgcucucauga

SEQ ID NO: 1413789 - RNA, 12 nt, Homo sapiens
gcugcugcugcc

SEQ ID NO: 1413790 - RNA, 21 nt, Homo sapiens
gcuggagcccgguguucagug

SEQ ID NO: 1413791 - RNA, 17 nt, Homo sapiens
gcuggauucagauauaa

SEQ ID NO: 1413792 - RNA, 15 nt, Homo sapiens
gcuggggcacuuuaa

SEQ ID NO: 1413793 - RNA, 15 nt, Homo sapiens
gcuggugaccggccu

SEQ ID NO: 1413794 - RNA, 14 nt, Homo sapiens
gcuguaugucauua

SEQ ID NO: 1413795 - RNA, 21 nt, Homo sapiens
gcugugggaaaccucauuguu

SEQ ID NO: 1413796 - RNA, 23 nt, Homo sapiens
gcuguuuuaucguuaagugcccc

SEQ ID NO: 1413797 - RNA, 15 nt, Homo sapiens
gcuuaacgugucuga

SEQ ID NO: 1413798 - RNA, 17 nt, Homo sapiens
gcuuccauuaugcugca

SEQ ID NO: 1413799 - RNA, 19 nt, Homo sapiens
gcuuccucaguuacacaaa

SEQ ID NO: 1413800 - RNA, 18 nt, Homo sapiens
gcuuccucuagaagccaa

SEQ ID NO: 1413801 - RNA, 23 nt, Homo sapiens
gcuucucaucuaaauauuuccau

SEQ ID NO: 1413802 - RNA, 15 nt, Homo sapiens
gcuucugcaauauua

SEQ ID NO: 1413803 - RNA, 13 nt, Homo sapiens
gcuugaagauuca

SEQ ID NO: 1413804 - RNA, 22 nt, Homo sapiens
gcuugucauauucgauguacuu

SEQ ID NO: 1413805 - RNA, 23 nt, Homo sapiens
gcuuuagacacuggcugccagcu

SEQ ID NO: 1413806 - RNA, 13 nt, Homo sapiens
gcuuuggacagaa

SEQ ID NO: 1413807 - RNA, 12 nt, Homo sapiens
ggaaaaauagca

SEQ ID NO: 1413808 - RNA, 14 nt, Homo sapiens
ggaaacuacuucac

SEQ ID NO: 1413809 - RNA, 16 nt, Homo sapiens
ggaacacaagugcccc

SEQ ID NO: 1413810 - RNA, 17 nt, Homo sapiens
ggaaccuaaauugaacu

SEQ ID NO: 1413811 - RNA, 13 nt, Homo sapiens
ggaaccucacucu

SEQ ID NO: 1413812 - RNA, 14 nt, Homo sapiens
ggaagaacaucugg

SEQ ID NO: 1413813 - RNA, 19 nt, Homo sapiens
ggaagcccuucagugcccu

SEQ ID NO: 1413814 - RNA, 12 nt, Homo sapiens
ggaauaaagcuu

SEQ ID NO: 1413815 - RNA, 14 nt, Homo sapiens
ggaauaaagcuucu

SEQ ID NO: 1413816 - RNA, 14 nt, Homo sapiens
ggacgcagccacac

SEQ ID NO: 1413817 - RNA, 15 nt, Homo sapiens
ggacuauacugcuga

SEQ ID NO: 1413818 - RNA, 19 nt, Homo sapiens
ggacuauuuauaacuaaua

SEQ ID NO: 1413819 - RNA, 22 nt, Homo sapiens
ggacugggugcauaucuuccca

SEQ ID NO: 1413820 - RNA, 13 nt, Homo sapiens
ggagaaauagcug

SEQ ID NO: 1413821 - RNA, 15 nt, Homo sapiens
ggagacacauucaca

SEQ ID NO: 1413822 - RNA, 17 nt, Homo sapiens
ggagacacauucacaaa

SEQ ID NO: 1413823 - RNA, 21 nt, Homo sapiens
ggagccuguguaacagcuccu

SEQ ID NO: 1413824 - RNA, 17 nt, Homo sapiens
ggaggccguugcagaca

SEQ ID NO: 1413825 - RNA, 11 nt, Homo sapiens
ggaggcuuccu

SEQ ID NO: 1413826 - RNA, 20 nt, Homo sapiens
ggagguggagguugcaguga

SEQ ID NO: 1413827 - RNA, 15 nt, Homo sapiens
ggagguugaagccaa

SEQ ID NO: 1413828 - RNA, 14 nt, Homo sapiens
ggaguucuccucag

SEQ ID NO: 1413829 - RNA, 16 nt, Homo sapiens
ggauaaaguugguaaa

SEQ ID NO: 1413830 - RNA, 17 nt, Homo sapiens
ggaucggcuuccucagg

SEQ ID NO: 1413831 - RNA, 19 nt, Homo sapiens
ggaugcuggggcacuuuaa

SEQ ID NO: 1413832 - RNA, 15 nt, Homo sapiens
ggauuuuaguugucc

SEQ ID NO: 1413833 - RNA, 20 nt, Homo sapiens
ggcaagugugugccugugug

SEQ ID NO: 1413834 - RNA, 22 nt, Homo sapiens
ggcaauaaaagauaagugcagu

SEQ ID NO: 1413835 - RNA, 20 nt, Homo sapiens
ggcagagcccgguacagggc

SEQ ID NO: 1413836 - RNA, 22 nt, Homo sapiens
ggcagaugaaaagcuaccauca

SEQ ID NO: 1413837 - RNA, 21 nt, Homo sapiens
ggcauuuguaaaaaguagauu

SEQ ID NO: 1413838 - RNA, 20 nt, Homo sapiens
ggccacccgccucccucuca

SEQ ID NO: 1413839 - RNA, 14 nt, Homo sapiens
ggccauucauuucu

SEQ ID NO: 1413840 - RNA, 16 nt, Homo sapiens
ggcccugaggaauaaa

SEQ ID NO: 1413841 - RNA, 19 nt, Homo sapiens
ggcccugaggaauaaagcu

SEQ ID NO: 1413842 - RNA, 15 nt, Homo sapiens
ggccgggcuggucuu

SEQ ID NO: 1413843 - RNA, 20 nt, Homo sapiens
ggccucagaugaugggguca

SEQ ID NO: 1413844 - RNA, 17 nt, Homo sapiens
ggccugguuauuguuca

SEQ ID NO: 1413845 - RNA, 14 nt, Homo sapiens
ggccuguggcugcc

SEQ ID NO: 1413846 - RNA, 18 nt, Homo sapiens
ggccuuauaucauuucau

SEQ ID NO: 1413847 - RNA, 22 nt, Homo sapiens
ggccuuauaucauuucauauaa

SEQ ID NO: 1413848 - RNA, 23 nt, Homo sapiens
ggccuugccugggauaucacuuc

SEQ ID NO: 1413849 - RNA, 23 nt, Homo sapiens
ggcgugaucucagcucacucugc

SEQ ID NO: 1413850 - RNA, 15 nt, Homo sapiens
ggcuaugguugccac

SEQ ID NO: 1413851 - RNA, 15 nt, Homo sapiens
ggcuccuugggauga

SEQ ID NO: 1413852 - RNA, 15 nt, Homo sapiens
ggcugcaucuuccag

SEQ ID NO: 1413853 - RNA, 19 nt, Homo sapiens
ggcuggaguacaauggcgu

SEQ ID NO: 1413854 - RNA, 19 nt, Homo sapiens
ggcuuggccugcugugauu

SEQ ID NO: 1413855 - RNA, 22 nt, Homo sapiens
gggaaaccccucccuacuguug

SEQ ID NO: 1413856 - RNA, 18 nt, Homo sapiens
gggaaccucacucuugcc

SEQ ID NO: 1413857 - RNA, 20 nt, Homo sapiens
gggacuacaggcacaaguca

SEQ ID NO: 1413858 - RNA, 16 nt, Homo sapiens
gggaggggggagccag

SEQ ID NO: 1413859 - RNA, 15 nt, Homo sapiens
gggcagggguuccca

SEQ ID NO: 1413860 - RNA, 18 nt, Homo sapiens
gggcuacaguccuuccag

SEQ ID NO: 1413861 - RNA, 17 nt, Homo sapiens
gggcugaagccacacag

SEQ ID NO: 1413862 - RNA, 12 nt, Homo sapiens
ggggcagccucc

SEQ ID NO: 1413863 - RNA, 16 nt, Homo sapiens
ggggcugaagccacac

SEQ ID NO: 1413864 - RNA, 15 nt, Homo sapiens
gggguggaggggugu

SEQ ID NO: 1413865 - RNA, 22 nt, Homo sapiens
gguaaucgccaaauaguuccau

SEQ ID NO: 1413866 - RNA, 20 nt, Homo sapiens
gguauugaacugcaggugac

SEQ ID NO: 1413867 - RNA, 22 nt, Homo sapiens
gguauugaaucuaaaaccaaau

SEQ ID NO: 1413868 - RNA, 19 nt, Homo sapiens
ggugacaucacucuaggaa

SEQ ID NO: 1413869 - RNA, 18 nt, Homo sapiens
ggugacuuuucaccuuaa

SEQ ID NO: 1413870 - RNA, 20 nt, Homo sapiens
ggugauccuuuugugccaug

SEQ ID NO: 1413871 - RNA, 19 nt, Homo sapiens
ggugggcuugggcaauaaa

SEQ ID NO: 1413872 - RNA, 17 nt, Homo sapiens
gguguucugugauauaa

SEQ ID NO: 1413873 - RNA, 20 nt, Homo sapiens
gguucuacguggaugauuuc

SEQ ID NO: 1413874 - RNA, 16 nt, Homo sapiens
gguuuuaaugcaauga

SEQ ID NO: 1413875 - RNA, 20 nt, Homo sapiens
guaacacuggcgagcaggug

SEQ ID NO: 1413876 - RNA, 15 nt, Homo sapiens
guaacugaagcauaa

SEQ ID NO: 1413877 - RNA, 14 nt, Homo sapiens
ugccucugcccaga

SEQ ID NO: 1413878 - RNA, 23 nt, Homo sapiens
ugccugcccccacacccacucca

SEQ ID NO: 1413879 - RNA, 15 nt, Homo sapiens
ugccuucuguugaga

SEQ ID NO: 1413880 - RNA, 21 nt, Homo sapiens
ugccuucuguugagaauuauc

SEQ ID NO: 1413881 - RNA, 14 nt, Homo sapiens
ugcgaguggcuuag

SEQ ID NO: 1413882 - RNA, 14 nt, Homo sapiens
ugcgcagcuccuuc

SEQ ID NO: 1413883 - RNA, 18 nt, Homo sapiens
ugcggcugcaucuuccag

SEQ ID NO: 1413884 - RNA, 20 nt, Homo sapiens
ugcgggaagcugaccuuuaa

SEQ ID NO: 1413885 - RNA, 21 nt, Homo sapiens
ugcuaaagcccgggcacccgc

SEQ ID NO: 1413886 - RNA, 15 nt, Homo sapiens
ugcuauucuggcaau

SEQ ID NO: 1413887 - RNA, 14 nt, Homo sapiens
ugcucaaaaugcca

SEQ ID NO: 1413888 - RNA, 17 nt, Homo sapiens
ugcucccugaagccagc

SEQ ID NO: 1413889 - RNA, 21 nt, Homo sapiens
ugcugcaugggucacagcggc

SEQ ID NO: 1413890 - RNA, 13 nt, Homo sapiens
ugcugccacucua

SEQ ID NO: 1413891 - RNA, 14 nt, Homo sapiens
ugcugcugccaagu

SEQ ID NO: 1413892 - RNA, 20 nt, Homo sapiens
ugcuguguaauaucaaacac

SEQ ID NO: 1413893 - RNA, 20 nt, Homo sapiens
ugcuucucccacuuggccaa

SEQ ID NO: 1413894 - RNA, 22 nt, Homo sapiens
ugcuucugccguugcugccagc

SEQ ID NO: 1413895 - RNA, 16 nt, Homo sapiens
uggaaaccucaugcca

SEQ ID NO: 1413896 - RNA, 17 nt, Homo sapiens
uggaaggcugcuuucuc

SEQ ID NO: 1413897 - RNA, 17 nt, Homo sapiens
uggaaggugacuuuuca

SEQ ID NO: 1413898 - RNA, 16 nt, Homo sapiens
uggaauuacugaaagu

SEQ ID NO: 1413899 - RNA, 18 nt, Homo sapiens
uggaauuugaaacacuuu

SEQ ID NO: 1413900 - RNA, 20 nt, Homo sapiens
uggaccggcccacacuccca

SEQ ID NO: 1413901 - RNA, 22 nt, Homo sapiens
uggagagugggcugacaucaag

SEQ ID NO: 1413902 - RNA, 20 nt, Homo sapiens
uggagcaacccaauauugcu

SEQ ID NO: 1413903 - RNA, 16 nt, Homo sapiens
uggagccuguguaaca

SEQ ID NO: 1413904 - RNA, 21 nt, Homo sapiens
uggagccuguguaacagcucc

SEQ ID NO: 1413905 - RNA, 11 nt, Homo sapiens
uggaggcuucc

SEQ ID NO: 1413906 - RNA, 13 nt, Homo sapiens
uggaguucagaga

SEQ ID NO: 1413907 - RNA, 19 nt, Homo sapiens
uggaucacugauauuuuag

SEQ ID NO: 1413908 - RNA, 16 nt, Homo sapiens
uggaucuaauaaacuu

SEQ ID NO: 1413909 - RNA, 23 nt, Homo sapiens
uggaucugcccccuuuacuccuc

SEQ ID NO: 1413910 - RNA, 20 nt, Homo sapiens
uggaugaaaguugcaggaag

SEQ ID NO: 1413911 - RNA, 20 nt, Homo sapiens
uggaugaaggcaucagaaac

SEQ ID NO: 1413912 - RNA, 15 nt, Homo sapiens
uggaugcaugagcua

SEQ ID NO: 1413913 - RNA, 12 nt, Homo sapiens
uggcacauguca

SEQ ID NO: 1413914 - RNA, 13 nt, Homo sapiens
uggcaucaccugc

SEQ ID NO: 1413915 - RNA, 18 nt, Homo sapiens
uggccaccgugucccuug

SEQ ID NO: 1413916 - RNA, 18 nt, Homo sapiens
uggccuccuucaccaaag

SEQ ID NO: 1413917 - RNA, 20 nt, Homo sapiens
uggccuuucacuucugccuu

SEQ ID NO: 1413918 - RNA, 15 nt, Homo sapiens
uggcuaggggagcag

SEQ ID NO: 1413919 - RNA, 23 nt, Homo sapiens
uggcuaggggagcagggggccca

SEQ ID NO: 1413920 - RNA, 13 nt, Homo sapiens
uggcucagaaaau

SEQ ID NO: 1413921 - RNA, 20 nt, Homo sapiens
ugggacuguuuacaaaugag

SEQ ID NO: 1413922 - RNA, 15 nt, Homo sapiens
ugggagcaaucugga

SEQ ID NO: 1413923 - RNA, 14 nt, Homo sapiens
ugggagcaggagau

SEQ ID NO: 1413924 - RNA, 19 nt, Homo sapiens
ugggaggcucggggcuccc

SEQ ID NO: 1413925 - RNA, 13 nt, Homo sapiens
ugggaguguuugu

SEQ ID NO: 1413926 - RNA, 14 nt, Homo sapiens
ugggcacuaagggu

SEQ ID NO: 1413927 - RNA, 13 nt, Homo sapiens
ugggccccaucau

SEQ ID NO: 1413928 - RNA, 16 nt, Homo sapiens
ugggcuucuucagaac

SEQ ID NO: 1413929 - RNA, 19 nt, Homo sapiens
ugggcuucuucagaacaau

SEQ ID NO: 1413930 - RNA, 20 nt, Homo sapiens
ugggggaucagcagggcagu

SEQ ID NO: 1413931 - RNA, 14 nt, Homo sapiens
ugggggcuagggga

SEQ ID NO: 1413932 - RNA, 23 nt, Homo sapiens
ugguaagaccucugagaccaaaa

SEQ ID NO: 1413933 - RNA, 20 nt, Homo sapiens
ugguauugaacugcagguga

SEQ ID NO: 1413934 - RNA, 21 nt, Homo sapiens
uggucucaucuccuuugcuag

SEQ ID NO: 1413935 - RNA, 17 nt, Homo sapiens
uggucuucagcaaaaaa

SEQ ID NO: 1413936 - RNA, 17 nt, Homo sapiens
uggucuugaacuccuga

SEQ ID NO: 1413937 - RNA, 17 nt, Homo sapiens
uggugaaacauggugaa

SEQ ID NO: 1413938 - RNA, 22 nt, Homo sapiens
uggugccuggcugguuugccca

SEQ ID NO: 1413939 - RNA, 16 nt, Homo sapiens
ugguuaaguaauugca

SEQ ID NO: 1413940 - RNA, 22 nt, Homo sapiens
ugguuauuguucagacauucca

SEQ ID NO: 1413941 - RNA, 15 nt, Homo sapiens
ugguuuaaagccuuu

SEQ ID NO: 1413942 - RNA, 14 nt, Homo sapiens
ugguuuaacuaaua

SEQ ID NO: 1413943 - RNA, 14 nt, Homo sapiens
ugguuuuaaugcaa

SEQ ID NO: 1413944 - RNA, 22 nt, Homo sapiens
ugguuuuguuuucaaugaauua

SEQ ID NO: 1413945 - RNA, 14 nt, Homo sapiens
uguaaagacuauga

SEQ ID NO: 1413946 - RNA, 21 nt, Homo sapiens
uguaaauaguuuaacacuuuc

SEQ ID NO: 1413947 - RNA, 19 nt, Homo sapiens
uguaacaggaccccaagga

SEQ ID NO: 1413948 - RNA, 15 nt, Homo sapiens
uguagaaggcaagag

SEQ ID NO: 1413949 - RNA, 11 nt, Homo sapiens
uguagacaugg

SEQ ID NO: 1413950 - RNA, 23 nt, Homo sapiens
uguaugaauuuuguaaguauaag

SEQ ID NO: 1413951 - RNA, 19 nt, Homo sapiens
uguauucagaguugauggu

SEQ ID NO: 1413952 - RNA, 14 nt, Homo sapiens
uguauuuucuucca

SEQ ID NO: 1413953 - RNA, 20 nt, Homo sapiens
ugucaccuuaaaauaagauu

SEQ ID NO: 1413954 - RNA, 20 nt, Homo sapiens
ugucagguuuuucaguguug

SEQ ID NO: 1413955 - RNA, 17 nt, Homo sapiens
ugucauauucgauguac

SEQ ID NO: 1413956 - RNA, 15 nt, Homo sapiens
ugucaugugucuguu

SEQ ID NO: 1413957 - RNA, 18 nt, Homo sapiens
ugucauugacaaagcugu

SEQ ID NO: 1413958 - RNA, 19 nt, Homo sapiens
ugucccaucucuacccccu

SEQ ID NO: 1413959 - RNA, 12 nt, Homo sapiens
ugucucagcaau

SEQ ID NO: 1413960 - RNA, 13 nt, Homo sapiens
ugucugaaggauu

SEQ ID NO: 1413961 - RNA, 18 nt, Homo sapiens
ugucugccagcauaugca

SEQ ID NO: 1413962 - RNA, 14 nt, Homo sapiens
ugucugugugcuac

SEQ ID NO: 1413963 - RNA, 15 nt, Homo sapiens
ugucugugugcuacu

SEQ ID NO: 1413964 - RNA, 20 nt, Homo sapiens
ugugacagauuauacagaau

SEQ ID NO: 1413965 - RNA, 18 nt, Homo sapiens
ugugacauucaguguuag

SEQ ID NO: 1413966 - RNA, 13 nt, Homo sapiens
uguguaacagcuc

SEQ ID NO: 1413967 - RNA, 18 nt, Homo sapiens
uguguauauguagcaaaa

SEQ ID NO: 1413968 - RNA, 12 nt, Homo sapiens
uguuaagcugcu

SEQ ID NO: 1413969 - RNA, 13 nt, Homo sapiens
uguuacuagccuc

SEQ ID NO: 1413970 - RNA, 22 nt, Homo sapiens
uguucagacauuccauggugau

SEQ ID NO: 1413971 - RNA, 20 nt, Homo sapiens
uguucccuuuuaaaucugcu

SEQ ID NO: 1413972 - RNA, 16 nt, Homo sapiens
uguuuaagucagcaaa

SEQ ID NO: 1413973 - RNA, 13 nt, Homo sapiens
uguuuacuaugca

SEQ ID NO: 1413974 - RNA, 13 nt, Homo sapiens
uguuuaugcaaga

SEQ ID NO: 1413975 - RNA, 12 nt, Homo sapiens
uguuugcauuua

SEQ ID NO: 1413976 - RNA, 15 nt, Homo sapiens
uguuuuauaguauua

SEQ ID NO: 1413977 - RNA, 16 nt, Homo sapiens
uguuuuauaguauuaa

SEQ ID NO: 1413978 - RNA, 20 nt, Homo sapiens
uguuuuccccuaauuuucca

SEQ ID NO: 1413979 - RNA, 13 nt, Homo sapiens
uguuuuguagcaa

SEQ ID NO: 1413980 - RNA, 14 nt, Homo sapiens
uuaaaaaacugaca

SEQ ID NO: 1413981 - RNA, 12 nt, Homo sapiens
uuaaaaagaagu

SEQ ID NO: 1413982 - RNA, 15 nt, Homo sapiens
uuaaaauauuugccu

SEQ ID NO: 1413983 - RNA, 13 nt, Homo sapiens
uuaaaccauaaaa

SEQ ID NO: 1413984 - RNA, 12 nt, Homo sapiens
uuaaacugccaa

SEQ ID NO: 1413985 - RNA, 13 nt, Homo sapiens
uuaaauaagcagu

SEQ ID NO: 1413986 - RNA, 16 nt, Homo sapiens
uuaaauaugauuugca

SEQ ID NO: 1413987 - RNA, 12 nt, Homo sapiens
uuaaaucauuca

SEQ ID NO: 1413988 - RNA, 21 nt, Homo sapiens
uuaaaugcuguaugucauuaa

SEQ ID NO: 1413989 - RNA, 17 nt, Homo sapiens
uuaacugugaaccugga

SEQ ID NO: 1413990 - RNA, 22 nt, Homo sapiens
uuaagaaagauuaaauauaucu

SEQ ID NO: 1413991 - RNA, 22 nt, Homo sapiens
uuaagaauguauaucaggguuu

SEQ ID NO: 1413992 - RNA, 22 nt, Homo sapiens
uuaagugcacaccgugugccau

SEQ ID NO: 1413993 - RNA, 14 nt, Homo sapiens
uuaaucaaucuuug

SEQ ID NO: 1413994 - RNA, 17 nt, Homo sapiens
uuaaugcauauuccccu

SEQ ID NO: 1413995 - RNA, 17 nt, Homo sapiens
uuacacaaaggaccuca

SEQ ID NO: 1413996 - RNA, 18 nt, Homo sapiens
uuacagaauggaucaugu

SEQ ID NO: 1413997 - RNA, 21 nt, Homo sapiens
uuacauagcauuuguguaaag

SEQ ID NO: 1413998 - RNA, 16 nt, Homo sapiens
uuacauccuacuaaga

SEQ ID NO: 1413999 - RNA, 15 nt, Homo sapiens
uuaggucacauuaca

SEQ ID NO: 1414000 - RNA, 20 nt, Homo sapiens
uuauacaggaugaugacuau

SEQ ID NO: 1414001 - RNA, 19 nt, Homo sapiens
uuaucaugacaaauauuac

SEQ ID NO: 1414002 - RNA, 20 nt, Homo sapiens
uuaugguuuuaaugcaauga

SEQ ID NO: 1414003 - RNA, 18 nt, Homo sapiens
uucaaagugugacauuca

SEQ ID NO: 1414004 - RNA, 20 nt, Homo sapiens
uucacacggacuaaucuuuc

SEQ ID NO: 1414005 - RNA, 10 nt, Homo sapiens
uucaccaaag

SEQ ID NO: 1414006 - RNA, 23 nt, Homo sapiens
uucaccuuaaugcauauuccccu

SEQ ID NO: 1414007 - RNA, 11 nt, Homo sapiens
uucacucagcu

SEQ ID NO: 1414008 - RNA, 16 nt, Homo sapiens
uucauauaaaaaagac

SEQ ID NO: 1414009 - RNA, 20 nt, Homo sapiens
uuccaauccuuaaacugcca

SEQ ID NO: 1414010 - RNA, 22 nt, Homo sapiens
uuccacaaaauuaugcugcauu

SEQ ID NO: 1414011 - RNA, 12 nt, Homo sapiens
uuccccacuccu

SEQ ID NO: 1414012 - RNA, 19 nt, Homo sapiens
uucccccgcuuuggacaga

SEQ ID NO: 1414013 - RNA, 13 nt, Homo sapiens
gcucagcccugag

SEQ ID NO: 1414014 - RNA, 23 nt, Homo sapiens
gcucauuuuacgcugucucugac

SEQ ID NO: 1414015 - RNA, 19 nt, Homo sapiens
gcucccguacugucugugu

SEQ ID NO: 1414016 - RNA, 14 nt, Homo sapiens
gcuccuccgugcuu

SEQ ID NO: 1414017 - RNA, 20 nt, Homo sapiens
gcuccucgcucgcaccugcc

SEQ ID NO: 1414018 - RNA, 14 nt, Homo sapiens
gcucucucucacca

SEQ ID NO: 1414019 - RNA, 15 nt, Homo sapiens
gcucucucucaccau

SEQ ID NO: 1414020 - RNA, 21 nt, Homo sapiens
gcucuggagcaagcccugacc

SEQ ID NO: 1414021 - RNA, 20 nt, Homo sapiens
gcucugugcagucacuggag

SEQ ID NO: 1414022 - RNA, 15 nt, Homo sapiens
gcugaagaaaccugg

SEQ ID NO: 1414023 - RNA, 16 nt, Homo sapiens
gcugagauuacaggca

SEQ ID NO: 1414024 - RNA, 14 nt, Homo sapiens
gcugauaacauuuu

SEQ ID NO: 1414025 - RNA, 21 nt, Homo sapiens
gcugcaucuuccagucucucc

SEQ ID NO: 1414026 - RNA, 12 nt, Homo sapiens
gcugccacucua

SEQ ID NO: 1414027 - RNA, 14 nt, Homo sapiens
gcugccacucuaca

SEQ ID NO: 1414028 - RNA, 20 nt, Homo sapiens
gcugccagggaagacagagc

SEQ ID NO: 1414029 - RNA, 14 nt, Homo sapiens
gcugccaucagucu

SEQ ID NO: 1414030 - RNA, 14 nt, Homo sapiens
gcugcugaccagca

SEQ ID NO: 1414031 - RNA, 17 nt, Homo sapiens
gcugcuuucuccuuuca

SEQ ID NO: 1414032 - RNA, 18 nt, Homo sapiens
gcuggaaaccucaugcca

SEQ ID NO: 1414033 - RNA, 17 nt, Homo sapiens
gcuggagaaaucuugaa

SEQ ID NO: 1414034 - RNA, 16 nt, Homo sapiens
gcugggauuacaggug

SEQ ID NO: 1414035 - RNA, 22 nt, Homo sapiens
gcuuaacgugucugagagccau

SEQ ID NO: 1414036 - RNA, 19 nt, Homo sapiens
gcuuaugguuuuaaugcaa

SEQ ID NO: 1414037 - RNA, 16 nt, Homo sapiens
gcuucccagggcugcc

SEQ ID NO: 1414038 - RNA, 10 nt, Homo sapiens
gcuuccucua

SEQ ID NO: 1414039 - RNA, 19 nt, Homo sapiens
gcuucugcaauauuauuuc

SEQ ID NO: 1414040 - RNA, 14 nt, Homo sapiens
gcuugaagccaaag

SEQ ID NO: 1414041 - RNA, 15 nt, Homo sapiens
gcuugaagccaaaga

SEQ ID NO: 1414042 - RNA, 16 nt, Homo sapiens
gcuugaagccaaagaa

SEQ ID NO: 1414043 - RNA, 19 nt, Homo sapiens
gcuugggcaagugugugcc

SEQ ID NO: 1414044 - RNA, 21 nt, Homo sapiens
gcuuguccuuuggccuuucac

SEQ ID NO: 1414045 - RNA, 22 nt, Homo sapiens
gcuuuguaucagucagugcugg

SEQ ID NO: 1414046 - RNA, 13 nt, Homo sapiens
gcuuugugucugg

SEQ ID NO: 1414047 - RNA, 13 nt, Homo sapiens
gcuuuucuguauu

SEQ ID NO: 1414048 - RNA, 12 nt, Homo sapiens
ggaaaguugcau

SEQ ID NO: 1414049 - RNA, 15 nt, Homo sapiens
ggaaccuaaauugaa

SEQ ID NO: 1414050 - RNA, 16 nt, Homo sapiens
ggaacgcucuaggcag

SEQ ID NO: 1414051 - RNA, 11 nt, Homo sapiens
ggaaggugacu

SEQ ID NO: 1414052 - RNA, 16 nt, Homo sapiens
ggaauaggaaauggau

SEQ ID NO: 1414053 - RNA, 15 nt, Homo sapiens
ggaauuguguuuaua

SEQ ID NO: 1414054 - RNA, 15 nt, Homo sapiens
ggacaccacacccag

SEQ ID NO: 1414055 - RNA, 12 nt, Homo sapiens
ggacaguggcac

SEQ ID NO: 1414056 - RNA, 13 nt, Homo sapiens
ggacaguggcacc

SEQ ID NO: 1414057 - RNA, 15 nt, Homo sapiens
ggaccccagcuguga

SEQ ID NO: 1414058 - RNA, 15 nt, Homo sapiens
ggacggcaggcucac

SEQ ID NO: 1414059 - RNA, 14 nt, Homo sapiens
ggacuauacugcug

SEQ ID NO: 1414060 - RNA, 16 nt, Homo sapiens
ggacucaacauuacau

SEQ ID NO: 1414061 - RNA, 16 nt, Homo sapiens
ggagacacauucacaa

SEQ ID NO: 1414062 - RNA, 17 nt, Homo sapiens
ggagagagaaagccagg

SEQ ID NO: 1414063 - RNA, 17 nt, Homo sapiens
ggagauggcgucuacca

SEQ ID NO: 1414064 - RNA, 17 nt, Homo sapiens
ggagcaaaaagcaacuu

SEQ ID NO: 1414065 - RNA, 22 nt, Homo sapiens
ggagcauagaaggcaggugagc

SEQ ID NO: 1414066 - RNA, 23 nt, Homo sapiens
ggagcugauaacauuuucccaau

SEQ ID NO: 1414067 - RNA, 22 nt, Homo sapiens
ggagcuguguaccaaucgucuc

SEQ ID NO: 1414068 - RNA, 16 nt, Homo sapiens
ggaggcacaagugccc

SEQ ID NO: 1414069 - RNA, 22 nt, Homo sapiens
ggaggcaggaguuucguuuuca

SEQ ID NO: 1414070 - RNA, 14 nt, Homo sapiens
ggaggccgggcaug

SEQ ID NO: 1414071 - RNA, 16 nt, Homo sapiens
ggaggcucucaugucu

SEQ ID NO: 1414072 - RNA, 17 nt, Homo sapiens
ggaggggagaagccaag

SEQ ID NO: 1414073 - RNA, 22 nt, Homo sapiens
ggaguacaauggcgugaucuca

SEQ ID NO: 1414074 - RNA, 14 nt, Homo sapiens
ggagugguugcuau

SEQ ID NO: 1414075 - RNA, 15 nt, Homo sapiens
ggagugguugcuaua

SEQ ID NO: 1414076 - RNA, 16 nt, Homo sapiens
ggagugguugcuauac

SEQ ID NO: 1414077 - RNA, 18 nt, Homo sapiens
ggaguucugcucauucua

SEQ ID NO: 1414078 - RNA, 16 nt, Homo sapiens
ggaucagcagggcagu

SEQ ID NO: 1414079 - RNA, 22 nt, Homo sapiens
ggaucugcccccuuuacuccuc

SEQ ID NO: 1414080 - RNA, 17 nt, Homo sapiens
ggaugaugacuauggaa

SEQ ID NO: 1414081 - RNA, 16 nt, Homo sapiens
ggauguagccaugacc

SEQ ID NO: 1414082 - RNA, 21 nt, Homo sapiens
ggauuacaggcacaugcacca

SEQ ID NO: 1414083 - RNA, 14 nt, Homo sapiens
ggauuacaggugua

SEQ ID NO: 1414084 - RNA, 20 nt, Homo sapiens
ggcaaggaauuuucaccucc

SEQ ID NO: 1414085 - RNA, 15 nt, Homo sapiens
ggcaagggguuucca

SEQ ID NO: 1414086 - RNA, 17 nt, Homo sapiens
ggcacaaaaugugacau

SEQ ID NO: 1414087 - RNA, 11 nt, Homo sapiens
ggcaccuggga

SEQ ID NO: 1414088 - RNA, 10 nt, Homo sapiens
ggcagccaga

SEQ ID NO: 1414089 - RNA, 23 nt, Homo sapiens
ggcagccagcuacaggcuugagc

SEQ ID NO: 1414090 - RNA, 23 nt, Homo sapiens
ggcagcucccagccucuucccau

SEQ ID NO: 1414091 - RNA, 18 nt, Homo sapiens
ggcagguagccaggggga

SEQ ID NO: 1414092 - RNA, 20 nt, Homo sapiens
ggcagugugcggagcugaua

SEQ ID NO: 1414093 - RNA, 18 nt, Homo sapiens
ggcaucagaaacaucuga

SEQ ID NO: 1414094 - RNA, 20 nt, Homo sapiens
ggcccccaucuuggggguca

SEQ ID NO: 1414095 - RNA, 21 nt, Homo sapiens
ggcccuccacccccaccucaa

SEQ ID NO: 1414096 - RNA, 13 nt, Homo sapiens
ggcccugaggaau

SEQ ID NO: 1414097 - RNA, 15 nt, Homo sapiens
ggcccugaggaauaa

SEQ ID NO: 1414098 - RNA, 16 nt, Homo sapiens
ggccgagcccacacca

SEQ ID NO: 1414099 - RNA, 17 nt, Homo sapiens
ggccuccuucaccaaag

SEQ ID NO: 1414100 - RNA, 15 nt, Homo sapiens
ggccuggauccaucc

SEQ ID NO: 1414101 - RNA, 16 nt, Homo sapiens
ggccuuacagucuucu

SEQ ID NO: 1414102 - RNA, 21 nt, Homo sapiens
ggccuugaugguguagugcau

SEQ ID NO: 1414103 - RNA, 13 nt, Homo sapiens
ggcgugaucucag

SEQ ID NO: 1414104 - RNA, 14 nt, Homo sapiens
ggcuagcuucugcu

SEQ ID NO: 1414105 - RNA, 23 nt, Homo sapiens
ggcuccuugggaugaagagggua

SEQ ID NO: 1414106 - RNA, 22 nt, Homo sapiens
ggcugagggauggacugaugcu

SEQ ID NO: 1414107 - RNA, 14 nt, Homo sapiens
ggcugcacucaaga

SEQ ID NO: 1414108 - RNA, 20 nt, Homo sapiens
ggcugcaucuuccagucucu

SEQ ID NO: 1414109 - RNA, 22 nt, Homo sapiens
ggcuggcuucaggagggagcau

SEQ ID NO: 1414110 - RNA, 19 nt, Homo sapiens
ggcuuccucuagaagccaa

SEQ ID NO: 1414111 - RNA, 14 nt, Homo sapiens
ggcuugaagccaaa

SEQ ID NO: 1414112 - RNA, 17 nt, Homo sapiens
ggcuugaagccaaagaa

SEQ ID NO: 1414113 - RNA, 20 nt, Homo sapiens
ggcuuugugucuggccagcu

SEQ ID NO: 1414114 - RNA, 11 nt, Homo sapiens
gggaaccucac

SEQ ID NO: 1414115 - RNA, 12 nt, Homo sapiens
gggacacaggag

SEQ ID NO: 1414116 - RNA, 16 nt, Homo sapiens
gggagaguccuuagcc

SEQ ID NO: 1414117 - RNA, 14 nt, Homo sapiens
gggagccaccacuc

SEQ ID NO: 1414118 - RNA, 17 nt, Homo sapiens
gggagguugaagcagaa

SEQ ID NO: 1414119 - RNA, 16 nt, Homo sapiens
gggauauuuaacugga

SEQ ID NO: 1414120 - RNA, 18 nt, Homo sapiens
gggauggccguuggccac

SEQ ID NO: 1414121 - RNA, 23 nt, Homo sapiens
gggauuuuaguuguccucagguu

SEQ ID NO: 1414122 - RNA, 21 nt, Homo sapiens
gggcaauaaaggcaccucccc

SEQ ID NO: 1414123 - RNA, 12 nt, Homo sapiens
gggcagccagcc

SEQ ID NO: 1414124 - RNA, 15 nt, Homo sapiens
gggcagccuccaguc

SEQ ID NO: 1414125 - RNA, 18 nt, Homo sapiens
gggcagcucccagccucu

SEQ ID NO: 1414126 - RNA, 22 nt, Homo sapiens
gggccagccccacccccagcca

SEQ ID NO: 1414127 - RNA, 15 nt, Homo sapiens
gggcccucccugcca

SEQ ID NO: 1414128 - RNA, 13 nt, Homo sapiens
gggcccugaggaa

SEQ ID NO: 1414129 - RNA, 14 nt, Homo sapiens
gggcuacaguccuu

SEQ ID NO: 1414130 - RNA, 16 nt, Homo sapiens
gggcucuggggcagcu

SEQ ID NO: 1414131 - RNA, 18 nt, Homo sapiens
ggggaucagcagggcagu

SEQ ID NO: 1414132 - RNA, 15 nt, Homo sapiens
gggggccagcacagc

SEQ ID NO: 1414133 - RNA, 22 nt, Homo sapiens
ggguguccugaugcaaaggugg

SEQ ID NO: 1414134 - RNA, 17 nt, Homo sapiens
gguacuggugagggcaa

SEQ ID NO: 1414135 - RNA, 22 nt, Homo sapiens
gguagaccaaaucaaaugcuca

SEQ ID NO: 1414136 - RNA, 14 nt, Homo sapiens
gguaguuugcaaac

SEQ ID NO: 1414137 - RNA, 13 nt, Homo sapiens
ggucacauuacau

SEQ ID NO: 1414138 - RNA, 21 nt, Homo sapiens
ggucacauuacauuaacauuu

SEQ ID NO: 1414139 - RNA, 20 nt, Homo sapiens
ggucucaucuccuuugcuag

SEQ ID NO: 1414140 - RNA, 18 nt, Homo sapiens
ggucuggcugcuugcccc

SEQ ID NO: 1414141 - RNA, 19 nt, Homo sapiens
ggugaaaaauauucaguaa

SEQ ID NO: 1414142 - RNA, 15 nt, Homo sapiens
ggugacguccaggag

SEQ ID NO: 1414143 - RNA, 22 nt, Homo sapiens
gguuauuguucagacauuccau

SEQ ID NO: 1414144 - RNA, 19 nt, Homo sapiens
gguucccuccccagcuccu

SEQ ID NO: 1414145 - RNA, 22 nt, Homo sapiens
gguuuuaucaguagaaguguca

SEQ ID NO: 1414146 - RNA, 18 nt, Homo sapiens
guaaaucagacuaugaag

SEQ ID NO: 1414147 - RNA, 13 nt, Homo sapiens
guaaaugcuguaa

SEQ ID NO: 1414148 - RNA, 14 nt, Homo sapiens
guaacugaagcaua

SEQ ID NO: 1414149 - RNA, 23 nt, Homo sapiens
guaacuuguuuacauagcauuug

SEQ ID NO: 1414150 - RNA, 22 nt, Homo sapiens
guaagaccucugagaccaaaau

SEQ ID NO: 1414151 - RNA, 14 nt, Homo sapiens
guaagcaacacuuu

SEQ ID NO: 1414152 - RNA, 16 nt, Homo sapiens
guaagcccagcauuug

SEQ ID NO: 1414153 - RNA, 22 nt, Homo sapiens
guaagcuucgugaggcccucac

SEQ ID NO: 1414154 - RNA, 15 nt, Homo sapiens
guaaucaaagccacu

SEQ ID NO: 1414155 - RNA, 19 nt, Homo sapiens
guaaucacauuuuaauugc

SEQ ID NO: 1414156 - RNA, 13 nt, Homo sapiens
guaauugcauguu

SEQ ID NO: 1414157 - RNA, 19 nt, Homo sapiens
guacagaauuauaugacca

SEQ ID NO: 1414158 - RNA, 18 nt, Homo sapiens
guacauccugcagcuuau

SEQ ID NO: 1414159 - RNA, 22 nt, Homo sapiens
guagagaaagaaaugucugcca

SEQ ID NO: 1414160 - RNA, 15 nt, Homo sapiens
guagauucccuugca

SEQ ID NO: 1414161 - RNA, 22 nt, Homo sapiens
guagauucccuugcacuguauc

SEQ ID NO: 1414162 - RNA, 15 nt, Homo sapiens
guagauuucauugaa

SEQ ID NO: 1414163 - RNA, 14 nt, Homo sapiens
guagccagcugguc

SEQ ID NO: 1414164 - RNA, 18 nt, Homo sapiens
guauaaaagggacugaga

SEQ ID NO: 1414165 - RNA, 13 nt, Homo sapiens
guaucucauugug

SEQ ID NO: 1414166 - RNA, 15 nt, Homo sapiens
guauggauaguaaaa

SEQ ID NO: 1414167 - RNA, 20 nt, Homo sapiens
guauuaaacuguaaaucaua

SEQ ID NO: 1414168 - RNA, 22 nt, Homo sapiens
guauugaugacaguaguaccaa

SEQ ID NO: 1414169 - RNA, 22 nt, Homo sapiens
guauuucaccucuacauuugaa

SEQ ID NO: 1414170 - RNA, 16 nt, Homo sapiens
gucacagccauaguca

SEQ ID NO: 1414171 - RNA, 10 nt, Homo sapiens
gucacuggaa

SEQ ID NO: 1414172 - RNA, 16 nt, Homo sapiens
gucauugacaaagcug

SEQ ID NO: 1414173 - RNA, 20 nt, Homo sapiens
gucccaucgguagcuugaaa

SEQ ID NO: 1414174 - RNA, 19 nt, Homo sapiens
gucccucccaccucuguga

SEQ ID NO: 1414175 - RNA, 20 nt, Homo sapiens
guccucaccccuguccucac

SEQ ID NO: 1414176 - RNA, 14 nt, Homo sapiens
guccuccccucaca

SEQ ID NO: 1414177 - RNA, 17 nt, Homo sapiens
guccuccggggcucagc

SEQ ID NO: 1414178 - RNA, 23 nt, Homo sapiens
guccugaugcaaagguggggaga

SEQ ID NO: 1414179 - RNA, 13 nt, Homo sapiens
gucuccucuucca

SEQ ID NO: 1414180 - RNA, 22 nt, Homo sapiens
gucucuagaagugccaucucaa

SEQ ID NO: 1414181 - RNA, 14 nt, Homo sapiens
gucucuauugauau

SEQ ID NO: 1414182 - RNA, 22 nt, Homo sapiens
gucucugaacuaggugaucuca

SEQ ID NO: 1414183 - RNA, 15 nt, Homo sapiens
gucugaagugcuaau

SEQ ID NO: 1414184 - RNA, 15 nt, Homo sapiens
gucugagagccauaa

SEQ ID NO: 1414185 - RNA, 19 nt, Homo sapiens
gucuggccucaggugggcc

SEQ ID NO: 1414186 - RNA, 19 nt, Homo sapiens
gucugggccccaucauuaa

SEQ ID NO: 1414187 - RNA, 16 nt, Homo sapiens
gucuguuagccaugug

SEQ ID NO: 1414188 - RNA, 15 nt, Homo sapiens
gucuguugcugccac

SEQ ID NO: 1414189 - RNA, 14 nt, Homo sapiens
gucuuccuucugcc

SEQ ID NO: 1414190 - RNA, 15 nt, Homo sapiens
gucuugaacuccuga

SEQ ID NO: 1414191 - RNA, 16 nt, Homo sapiens
gucuuuuuguaucuca

SEQ ID NO: 1414192 - RNA, 16 nt, Homo sapiens
gugaaacucaucucau

SEQ ID NO: 1414193 - RNA, 14 nt, Homo sapiens
gugaaagcucucaa

SEQ ID NO: 1414194 - RNA, 20 nt, Homo sapiens
gugaaggaacuagggauauu

SEQ ID NO: 1414195 - RNA, 13 nt, Homo sapiens
gugacacacuggc

SEQ ID NO: 1414196 - RNA, 15 nt, Homo sapiens
gugagaugcuggaga

SEQ ID NO: 1414197 - RNA, 13 nt, Homo sapiens
gugagccaaauaa

SEQ ID NO: 1414198 - RNA, 16 nt, Homo sapiens
gugaggaagcaaguga

SEQ ID NO: 1414199 - RNA, 13 nt, Homo sapiens
gugagggcaagag

SEQ ID NO: 1414200 - RNA, 17 nt, Homo sapiens
gugagggcaagaggugc

SEQ ID NO: 1414201 - RNA, 17 nt, Homo sapiens
gugaguucucacucugg

SEQ ID NO: 1414202 - RNA, 18 nt, Homo sapiens
gugauccuuuugugccau

SEQ ID NO: 1414203 - RNA, 14 nt, Homo sapiens
gugauuuuggucuc

SEQ ID NO: 1414204 - RNA, 12 nt, Homo sapiens
gugccaaaaauc

SEQ ID NO: 1414205 - RNA, 19 nt, Homo sapiens
gugccauagaauggcacau

SEQ ID NO: 1414206 - RNA, 20 nt, Homo sapiens
gugccuuaaccuagaggguc

SEQ ID NO: 1414207 - RNA, 18 nt, Homo sapiens
gugcugagauuacaggca

SEQ ID NO: 1414208 - RNA, 13 nt, Homo sapiens
guggaacaaaagu

SEQ ID NO: 1414209 - RNA, 21 nt, Homo sapiens
guggagaguugggggccagca

SEQ ID NO: 1414210 - RNA, 22 nt, Homo sapiens
guggagaugcggaaagcccuga

SEQ ID NO: 1414211 - RNA, 13 nt, Homo sapiens
guggaggcuuccu

SEQ ID NO: 1414212 - RNA, 19 nt, Homo sapiens
guggccaccgugucccuug

SEQ ID NO: 1414213 - RNA, 19 nt, Homo sapiens
guggcucaaugcaaccucu

SEQ ID NO: 1414214 - RNA, 16 nt, Homo sapiens
gugggguccccuccag

SEQ ID NO: 1414215 - RNA, 20 nt, Homo sapiens
guguaaagacuaugaucuca

SEQ ID NO: 1414216 - RNA, 11 nt, Homo sapiens
guguaaucucu

SEQ ID NO: 1414217 - RNA, 20 nt, Homo sapiens
guguaaucucucauggugaa

SEQ ID NO: 1414218 - RNA, 15 nt, Homo sapiens
guguacauauuugaa

SEQ ID NO: 1414219 - RNA, 19 nt, Homo sapiens
gugucuuuuuguaucucau

SEQ ID NO: 1414220 - RNA, 14 nt, Homo sapiens
gugugagcccagau

SEQ ID NO: 1414221 - RNA, 17 nt, Homo sapiens
guuaaacuuuaucucac

SEQ ID NO: 1414222 - RNA, 16 nt, Homo sapiens
guuacaaauaugcaga

SEQ ID NO: 1414223 - RNA, 17 nt, Homo sapiens
guuacaaauaugcagac

SEQ ID NO: 1414224 - RNA, 14 nt, Homo sapiens
guuacuagccucuc

SEQ ID NO: 1414225 - RNA, 21 nt, Homo sapiens
guuagagacuaucuaauugag

SEQ ID NO: 1414226 - RNA, 21 nt, Homo sapiens
guuaggacaaggcugugccag

SEQ ID NO: 1414227 - RNA, 16 nt, Homo sapiens
guucaaagugugacau

SEQ ID NO: 1414228 - RNA, 16 nt, Homo sapiens
guucaauaugaaccaa

SEQ ID NO: 1414229 - RNA, 19 nt, Homo sapiens
guucagagaucguuccuau

SEQ ID NO: 1414230 - RNA, 12 nt, Homo sapiens
guucaugcaaac

SEQ ID NO: 1414231 - RNA, 19 nt, Homo sapiens
guucuauuugcuaucugaa

SEQ ID NO: 1414232 - RNA, 15 nt, Homo sapiens
guucugcucauucua

SEQ ID NO: 1414233 - RNA, 16 nt, Homo sapiens
guucugcucauucuaa

SEQ ID NO: 1414234 - RNA, 13 nt, Homo sapiens
guugaagcagaau

SEQ ID NO: 1414235 - RNA, 12 nt, Homo sapiens
guugacugcuga

SEQ ID NO: 1414236 - RNA, 17 nt, Homo sapiens
guugacugcugaauuaa

SEQ ID NO: 1414237 - RNA, 23 nt, Homo sapiens
guugacugcugaauuaaugugau

SEQ ID NO: 1414238 - RNA, 13 nt, Homo sapiens
guugaucuuuuaa

SEQ ID NO: 1414239 - RNA, 21 nt, Homo sapiens
guugcugccacucuacagguc

SEQ ID NO: 1414240 - RNA, 19 nt, Homo sapiens
guuggacaccaucuucuaa

SEQ ID NO: 1414241 - RNA, 17 nt, Homo sapiens
guuguugugcaaguuga

SEQ ID NO: 1414242 - RNA, 19 nt, Homo sapiens
guuguuuaugcaagagcug

SEQ ID NO: 1414243 - RNA, 20 nt, Homo sapiens
guuuccccucucaucugacc

SEQ ID NO: 1414244 - RNA, 19 nt, Homo sapiens
guuuccuucccuacccagu

SEQ ID NO: 1414245 - RNA, 18 nt, Homo sapiens
guuucgugguuucgucua

SEQ ID NO: 1414246 - RNA, 19 nt, Homo sapiens
guuucgugguuucgucuau

SEQ ID NO: 1414247 - RNA, 11 nt, Homo sapiens
guuucugugac

SEQ ID NO: 1414248 - RNA, 15 nt, Homo sapiens
guuugaagcugcugu

SEQ ID NO: 1414249 - RNA, 15 nt, Homo sapiens
guuugcuccagugau

SEQ ID NO: 1414250 - RNA, 20 nt, Homo sapiens
guuugcugccaucagucuag

SEQ ID NO: 1414251 - RNA, 12 nt, Homo sapiens
guuugucccauc

SEQ ID NO: 1414252 - RNA, 15 nt, Homo sapiens
guuuuaaugcaauga

SEQ ID NO: 1414253 - RNA, 17 nt, Homo sapiens
uaaaaaucauuguaugg

SEQ ID NO: 1414254 - RNA, 13 nt, Homo sapiens
uaaaaccaaagag

SEQ ID NO: 1414255 - RNA, 14 nt, Homo sapiens
uaaaagcuucugca

SEQ ID NO: 1414256 - RNA, 17 nt, Homo sapiens
uaaaagcuucugcaaua

SEQ ID NO: 1414257 - RNA, 18 nt, Homo sapiens
uaaaagcuucugcaauau

SEQ ID NO: 1414258 - RNA, 16 nt, Homo sapiens
uaaaagguuguguaca

SEQ ID NO: 1414259 - RNA, 18 nt, Homo sapiens
uaaaaucagugauuugga

SEQ ID NO: 1414260 - RNA, 22 nt, Homo sapiens
uaaaaugauauauuaaaccuuc

SEQ ID NO: 1414261 - RNA, 17 nt, Homo sapiens
uaaaauguacucuccuu

SEQ ID NO: 1414262 - RNA, 17 nt, Homo sapiens
uaaaauucuacuguaug

SEQ ID NO: 1414263 - RNA, 20 nt, Homo sapiens
uaaaauucuacuguauggaa

SEQ ID NO: 1414264 - RNA, 12 nt, Homo sapiens
uaaacacugugu

SEQ ID NO: 1414265 - RNA, 22 nt, Homo sapiens
uaaacagauuagaaauguaaca

SEQ ID NO: 1414266 - RNA, 18 nt, Homo sapiens
uaaacauguccccuuccc

SEQ ID NO: 1414267 - RNA, 15 nt, Homo sapiens
uaaacauuaaugaca

SEQ ID NO: 1414268 - RNA, 20 nt, Homo sapiens
uaaacccugagccaccgugu

SEQ ID NO: 1414269 - RNA, 11 nt, Homo sapiens
uaaacuaaagu

SEQ ID NO: 1414270 - RNA, 14 nt, Homo sapiens
uaaacuuuaucuca

SEQ ID NO: 1414271 - RNA, 22 nt, Homo sapiens
uaaagcauaggguaguuugcaa

SEQ ID NO: 1414272 - RNA, 16 nt, Homo sapiens
uaaagcuucucucuga

SEQ ID NO: 1414273 - RNA, 17 nt, Homo sapiens
uaaagcuucucucugag

SEQ ID NO: 1414274 - RNA, 14 nt, Homo sapiens
uaaaggcaccuccc

SEQ ID NO: 1414275 - RNA, 15 nt, Homo sapiens
uaaaggcucuggaag

SEQ ID NO: 1414276 - RNA, 22 nt, Homo sapiens
uaaagucuagaaaauaaugcaa

SEQ ID NO: 1414277 - RNA, 23 nt, Homo sapiens
uaaauauuuaaagaaaaaaaagu

SEQ ID NO: 1414278 - RNA, 13 nt, Homo sapiens
uaaauauuuccau

SEQ ID NO: 1414279 - RNA, 15 nt, Homo sapiens
uaacaaaugcuuuau

SEQ ID NO: 1414280 - RNA, 15 nt, Homo sapiens
uaacauacucauuua

SEQ ID NO: 1414281 - RNA, 16 nt, Homo sapiens
uaacauacucauuuaa

SEQ ID NO: 1414282 - RNA, 23 nt, Homo sapiens
uaacauacugcauuucacucugg

SEQ ID NO: 1414283 - RNA, 21 nt, Homo sapiens
uaacgugucugagagccauaa

SEQ ID NO: 1414284 - RNA, 22 nt, Homo sapiens
uaagcugcuggaaaccucaugc

SEQ ID NO: 1414285 - RNA, 13 nt, Homo sapiens
uaaguaugccuca

SEQ ID NO: 1414286 - RNA, 14 nt, Homo sapiens
uaaguaugccucag

SEQ ID NO: 1414287 - RNA, 21 nt, Homo sapiens
uaagugcacaccgugugccau

SEQ ID NO: 1414288 - RNA, 17 nt, Homo sapiens
uaaguguguauccagaa

SEQ ID NO: 1414289 - RNA, 13 nt, Homo sapiens
uaaguguugggaa

SEQ ID NO: 1414290 - RNA, 14 nt, Homo sapiens
uaauaaaaagccac

SEQ ID NO: 1414291 - RNA, 18 nt, Homo sapiens
uaauacaguuuucuauuc

SEQ ID NO: 1414292 - RNA, 22 nt, Homo sapiens
uaauacaguuuucuauucuugg

SEQ ID NO: 1414293 - RNA, 15 nt, Homo sapiens
uaauauuuauugcuu

SEQ ID NO: 1414294 - RNA, 20 nt, Homo sapiens
uaaucccagcauuuugagag

SEQ ID NO: 1414295 - RNA, 20 nt, Homo sapiens
uaaucccagcuacuugggag

SEQ ID NO: 1414296 - RNA, 15 nt, Homo sapiens
uaaucccuuccucuc

SEQ ID NO: 1414297 - RNA, 20 nt, Homo sapiens
uaaugacuaaagaccugcug

SEQ ID NO: 1414298 - RNA, 23 nt, Homo sapiens
uaaugagugaguucucacucugg

SEQ ID NO: 1414299 - RNA, 19 nt, Homo sapiens
uaaugauggcccauucuac

SEQ ID NO: 1414300 - RNA, 14 nt, Homo sapiens
uaaugauucucaag

SEQ ID NO: 1414301 - RNA, 20 nt, Homo sapiens
uaauuguugaccuaagaaua

SEQ ID NO: 1414302 - RNA, 18 nt, Homo sapiens
uaauuuuaguuauacucc

SEQ ID NO: 1414303 - RNA, 16 nt, Homo sapiens
uaauuuugcaguguuu

SEQ ID NO: 1414304 - RNA, 19 nt, Homo sapiens
uacaaaugagugauuccag

SEQ ID NO: 1414305 - RNA, 20 nt, Homo sapiens
uacacuuggaugcagugcgu

SEQ ID NO: 1414306 - RNA, 20 nt, Homo sapiens
uacaguuucaaaaacuguau

SEQ ID NO: 1414307 - RNA, 15 nt, Homo sapiens
uacauacuguauaua

SEQ ID NO: 1414308 - RNA, 15 nt, Homo sapiens
uacauuugaacuaua

SEQ ID NO: 1414309 - RNA, 17 nt, Homo sapiens
uacauuugaacuauauc

SEQ ID NO: 1414310 - RNA, 19 nt, Homo sapiens
uacauuugaacuauauccu

SEQ ID NO: 1414311 - RNA, 15 nt, Homo sapiens
uacauuuucucugau

SEQ ID NO: 1414312 - RNA, 15 nt, Homo sapiens
uaccaaaugcuuuaa

SEQ ID NO: 1414313 - RNA, 16 nt, Homo sapiens
uaccaaaugcuuuaaa

SEQ ID NO: 1414314 - RNA, 17 nt, Homo sapiens
uaccaaauuuaagcaag

SEQ ID NO: 1414315 - RNA, 15 nt, Homo sapiens
uaccauucucaggug

SEQ ID NO: 1414316 - RNA, 19 nt, Homo sapiens
uacccaccgcccuugccga

SEQ ID NO: 1414317 - RNA, 21 nt, Homo sapiens
uaccccuaacauacugcauuu

SEQ ID NO: 1414318 - RNA, 19 nt, Homo sapiens
uacccuccuguaagcaaca

SEQ ID NO: 1414319 - RNA, 15 nt, Homo sapiens
uacccuguugcaaag

SEQ ID NO: 1414320 - RNA, 15 nt, Homo sapiens
uaccucugacaucaa

SEQ ID NO: 1414321 - RNA, 22 nt, Homo sapiens
uacgagaugaccuugacauacc

SEQ ID NO: 1414322 - RNA, 12 nt, Homo sapiens
uacguggauguu

SEQ ID NO: 1414323 - RNA, 11 nt, Homo sapiens
uacuagccucu

SEQ ID NO: 1414324 - RNA, 15 nt, Homo sapiens
uacuccucggggaac

SEQ ID NO: 1414325 - RNA, 13 nt, Homo sapiens
uacucuauauacu

SEQ ID NO: 1414326 - RNA, 16 nt, Homo sapiens
uacugccccugcccug

SEQ ID NO: 1414327 - RNA, 15 nt, Homo sapiens
uacuguucugagcca

SEQ ID NO: 1414328 - RNA, 19 nt, Homo sapiens
uacuuguuugguuugguau

SEQ ID NO: 1414329 - RNA, 16 nt, Homo sapiens
uagaaagcaggggcua

SEQ ID NO: 1414330 - RNA, 14 nt, Homo sapiens
uagaaaucucaucu

SEQ ID NO: 1414331 - RNA, 13 nt, Homo sapiens
uagacccucucaa

SEQ ID NO: 1414332 - RNA, 18 nt, Homo sapiens
uagacucuccacuguuac

SEQ ID NO: 1414333 - RNA, 21 nt, Homo sapiens
uagagccaggcacacacugug

SEQ ID NO: 1414334 - RNA, 19 nt, Homo sapiens
uagauuaaaauauuugccu

SEQ ID NO: 1414335 - RNA, 16 nt, Homo sapiens
uagauuuuucugugaa

SEQ ID NO: 1414336 - RNA, 22 nt, Homo sapiens
uagcaaaagcagaacacacucu

SEQ ID NO: 1414337 - RNA, 23 nt, Homo sapiens
uagccaugugaaacucaucucau

SEQ ID NO: 1414338 - RNA, 16 nt, Homo sapiens
uagccauguggcugcc

SEQ ID NO: 1414339 - RNA, 22 nt, Homo sapiens
uaggaacuacugaggaucagag

SEQ ID NO: 1414340 - RNA, 20 nt, Homo sapiens
uagggauauuuaacuggagc

SEQ ID NO: 1414341 - RNA, 21 nt, Homo sapiens
uagggcccugucuuauucaac

SEQ ID NO: 1414342 - RNA, 14 nt, Homo sapiens
uaggguguguauau

SEQ ID NO: 1414343 - RNA, 23 nt, Homo sapiens
uaggugaucucaguucucuuuca

SEQ ID NO: 1414344 - RNA, 16 nt, Homo sapiens
uaguacagguuacuca

SEQ ID NO: 1414345 - RNA, 21 nt, Homo sapiens
uagucucugaacuaggugauc

SEQ ID NO: 1414346 - RNA, 22 nt, Homo sapiens
uagugccgcaauaaaugcucaa

SEQ ID NO: 1414347 - RNA, 20 nt, Homo sapiens
uaguguaccauucucaggug

SEQ ID NO: 1414348 - RNA, 16 nt, Homo sapiens
uaguuguccucagguu

SEQ ID NO: 1414349 - RNA, 20 nt, Homo sapiens
uauaaacauguccccuuccc

SEQ ID NO: 1414350 - RNA, 11 nt, Homo sapiens
uauaacuaaua

SEQ ID NO: 1414351 - RNA, 20 nt, Homo sapiens
uauaauacaguuuucuauuc

SEQ ID NO: 1414352 - RNA, 16 nt, Homo sapiens
uauacaguucuaugca

SEQ ID NO: 1414353 - RNA, 18 nt, Homo sapiens
uauaugaauuuccacuuu

SEQ ID NO: 1414354 - RNA, 22 nt, Homo sapiens
uaucaaacacaauuaaaucucu

SEQ ID NO: 1414355 - RNA, 15 nt, Homo sapiens
uaucauuaccaucuc

SEQ ID NO: 1414356 - RNA, 20 nt, Homo sapiens
uauccagaagaagagaucag

SEQ ID NO: 1414357 - RNA, 14 nt, Homo sapiens
uaucugaacuaauu

SEQ ID NO: 1414358 - RNA, 15 nt, Homo sapiens
uaucuucuuagcuca

SEQ ID NO: 1414359 - RNA, 13 nt, Homo sapiens
uaugaauuuccac

SEQ ID NO: 1414360 - RNA, 15 nt, Homo sapiens
uaugaucucauccca

SEQ ID NO: 1414361 - RNA, 23 nt, Homo sapiens
uaugaucuuaacuucacuuccau

SEQ ID NO: 1414362 - RNA, 11 nt, Homo sapiens
uaugucuuccc

SEQ ID NO: 1414363 - RNA, 19 nt, Homo sapiens
uaugugaacauuccuauca

SEQ ID NO: 1414364 - RNA, 16 nt, Homo sapiens
uauucagaguugaugg

SEQ ID NO: 1414365 - RNA, 14 nt, Homo sapiens
uauucagcucaugg

SEQ ID NO: 1414366 - RNA, 12 nt, Homo sapiens
uauucauguugu

SEQ ID NO: 1414367 - RNA, 19 nt, Homo sapiens
uauuccaaguacagaauua

SEQ ID NO: 1414368 - RNA, 15 nt, Homo sapiens
uauucgauguacuuu

SEQ ID NO: 1414369 - RNA, 17 nt, Homo sapiens
uauucgauguacuuuaa

SEQ ID NO: 1414370 - RNA, 19 nt, Homo sapiens
uauugagcaguucccaagg

SEQ ID NO: 1414371 - RNA, 22 nt, Homo sapiens
uauugauggccacuaagugugu

SEQ ID NO: 1414372 - RNA, 23 nt, Homo sapiens
uauugcuaauauaauagaugaca

SEQ ID NO: 1414373 - RNA, 18 nt, Homo sapiens
uauuguaggcucccccuc

SEQ ID NO: 1414374 - RNA, 21 nt, Homo sapiens
uauuguucagacauuccaugg

SEQ ID NO: 1414375 - RNA, 22 nt, Homo sapiens
uauuucauccagggaaaugccu

SEQ ID NO: 1414376 - RNA, 17 nt, Homo sapiens
uauuugccuccauguag

SEQ ID NO: 1414377 - RNA, 12 nt, Homo sapiens
uauuuucuucca

SEQ ID NO: 1414378 - RNA, 15 nt, Homo sapiens
uauuuuuucuugaca

SEQ ID NO: 1414379 - RNA, 21 nt, Homo sapiens
ucaaacacaauuaaaucucuc

SEQ ID NO: 1414380 - RNA, 23 nt, Homo sapiens
ucaaacguggcuuuuagacagau

SEQ ID NO: 1414381 - RNA, 15 nt, Homo sapiens
ucaaagugugacauu

SEQ ID NO: 1414382 - RNA, 23 nt, Homo sapiens
ucaaagugugacauucaguguua

SEQ ID NO: 1414383 - RNA, 12 nt, Homo sapiens
ucaaaugcucac

SEQ ID NO: 1414384 - RNA, 20 nt, Homo sapiens
ucaacauacuguugaugucu

SEQ ID NO: 1414385 - RNA, 20 nt, Homo sapiens
ucaacuuuacuuuuaaaauc

SEQ ID NO: 1414386 - RNA, 23 nt, Homo sapiens
ucaagaggaauuccagcaucuga

SEQ ID NO: 1414387 - RNA, 22 nt, Homo sapiens
ucaagcuaauaaaauaucauuc

SEQ ID NO: 1414388 - RNA, 18 nt, Homo sapiens
ucaagugccuuauucuca

SEQ ID NO: 1414389 - RNA, 17 nt, Homo sapiens
ucaauaugaaccaagua

SEQ ID NO: 1414390 - RNA, 22 nt, Homo sapiens
ucaaucaugcuguguaauauca

SEQ ID NO: 1414391 - RNA, 18 nt, Homo sapiens
ucacaggaaacuacuuca

SEQ ID NO: 1414392 - RNA, 16 nt, Homo sapiens
ucacauuacauuaaca

SEQ ID NO: 1414393 - RNA, 20 nt, Homo sapiens
ucaccagaagcagaugccag

SEQ ID NO: 1414394 - RNA, 22 nt, Homo sapiens
ucaccccuguccucacugcucc

SEQ ID NO: 1414395 - RNA, 20 nt, Homo sapiens
ucaccugcacagggcccucu

SEQ ID NO: 1414396 - RNA, 21 nt, Homo sapiens
ucaccugcacagggcccucug

SEQ ID NO: 1414397 - RNA, 21 nt, Homo sapiens
ucaccugcgcagggcccucug

SEQ ID NO: 1414398 - RNA, 20 nt, Homo sapiens
ucaccugugcagggcccucu

SEQ ID NO: 1414399 - RNA, 19 nt, Homo sapiens
ucaccuucuggccaggccu

SEQ ID NO: 1414400 - RNA, 14 nt, Homo sapiens
ucacuaccuccuca

SEQ ID NO: 1414401 - RNA, 16 nt, Homo sapiens
ucacucccaaaugcaa

SEQ ID NO: 1414402 - RNA, 12 nt, Homo sapiens
ucacucuugcca

SEQ ID NO: 1414403 - RNA, 13 nt, Homo sapiens
ucacucuugccaa

SEQ ID NO: 1414404 - RNA, 15 nt, Homo sapiens
ucacucuugccaacc

SEQ ID NO: 1414405 - RNA, 16 nt, Homo sapiens
ucacucuugccaaccu

SEQ ID NO: 1414406 - RNA, 19 nt, Homo sapiens
ucacucuugccaaccugua

SEQ ID NO: 1414407 - RNA, 21 nt, Homo sapiens
ucacucuugccaaccuguaau

SEQ ID NO: 1414408 - RNA, 13 nt, Homo sapiens
ucacucuuguugc

SEQ ID NO: 1414409 - RNA, 21 nt, Homo sapiens
ucacuggagguugaagccaag

SEQ ID NO: 1414410 - RNA, 13 nt, Homo sapiens
ucagaaaauaccu

SEQ ID NO: 1414411 - RNA, 15 nt, Homo sapiens
ucagaaaauaccuua

SEQ ID NO: 1414412 - RNA, 16 nt, Homo sapiens
ucagaaacaucugauu

SEQ ID NO: 1414413 - RNA, 17 nt, Homo sapiens
ucagaagaaaggagcug

SEQ ID NO: 1414414 - RNA, 18 nt, Homo sapiens
ucagaaugaugaguccag

SEQ ID NO: 1414415 - RNA, 19 nt, Homo sapiens
ucagacauuccauggugau

SEQ ID NO: 1414416 - RNA, 15 nt, Homo sapiens
ucagaggccaucuga

SEQ ID NO: 1414417 - RNA, 17 nt, Homo sapiens
ucagaguaauccaagca

SEQ ID NO: 1414418 - RNA, 21 nt, Homo sapiens
ucagauuaaugacuggcuaca

SEQ ID NO: 1414419 - RNA, 17 nt, Homo sapiens
ucagcccaaccuagacc

SEQ ID NO: 1414420 - RNA, 14 nt, Homo sapiens
ucagcccugagcua

SEQ ID NO: 1414421 - RNA, 19 nt, Homo sapiens
ucagcggggcuacaguccu

SEQ ID NO: 1414422 - RNA, 16 nt, Homo sapiens
ucagcugaacacccuc

SEQ ID NO: 1414423 - RNA, 17 nt, Homo sapiens
ucaggagggagcauaga

SEQ ID NO: 1414424 - RNA, 17 nt, Homo sapiens
ucaggcugcuccuucuc

SEQ ID NO: 1414425 - RNA, 18 nt, Homo sapiens
ucaguauaaaagacaaaa

SEQ ID NO: 1414426 - RNA, 17 nt, Homo sapiens
ucagugauuuggaugaa

SEQ ID NO: 1414427 - RNA, 18 nt, Homo sapiens
ucaguggaggccagagau

SEQ ID NO: 1414428 - RNA, 14 nt, Homo sapiens
ucauccacucugcc

SEQ ID NO: 1414429 - RNA, 19 nt, Homo sapiens
ucauccacucugccugcuu

SEQ ID NO: 1414430 - RNA, 20 nt, Homo sapiens
ucaucuaaauauuuccauau

SEQ ID NO: 1414431 - RNA, 19 nt, Homo sapiens
ucauguccugaugccaugg

SEQ ID NO: 1414432 - RNA, 21 nt, Homo sapiens
ucauucaagaggaauuccagc

SEQ ID NO: 1414433 - RNA, 19 nt, Homo sapiens
ucauugcccacuucugugu

SEQ ID NO: 1414434 - RNA, 15 nt, Homo sapiens
ucauuuucugcaagc

SEQ ID NO: 1414435 - RNA, 15 nt, Homo sapiens
ucauuuugauuuucc

SEQ ID NO: 1414436 - RNA, 18 nt, Homo sapiens
uccaaacagguccaccau

SEQ ID NO: 1414437 - RNA, 15 nt, Homo sapiens
uccaagcaaauguga

SEQ ID NO: 1414438 - RNA, 19 nt, Homo sapiens
uccaauccuuaaacugcca

SEQ ID NO: 1414439 - RNA, 18 nt, Homo sapiens
uccagcccuggaucuccc

SEQ ID NO: 1414440 - RNA, 23 nt, Homo sapiens
uccagcuccuccgugcuuccuca

SEQ ID NO: 1414441 - RNA, 21 nt, Homo sapiens
uccagcugacccugguucucu

SEQ ID NO: 1414442 - RNA, 21 nt, Homo sapiens
uccaggaacagacauggaccu

SEQ ID NO: 1414443 - RNA, 22 nt, Homo sapiens
uccaggaaugaucccacucacc

SEQ ID NO: 1414444 - RNA, 17 nt, Homo sapiens
uccaguugccacuuucc

SEQ ID NO: 1414445 - RNA, 19 nt, Homo sapiens
uccauacccgcaguugucu

SEQ ID NO: 1414446 - RNA, 17 nt, Homo sapiens
uccauaguggacauugu

SEQ ID NO: 1414447 - RNA, 23 nt, Homo sapiens
uccauccugcuagcaccucccca

SEQ ID NO: 1414448 - RNA, 21 nt, Homo sapiens
uccauccuuucugccucucaa

SEQ ID NO: 1414449 - RNA, 15 nt, Homo sapiens
uccauccuuugcauu

SEQ ID NO: 1414450 - RNA, 21 nt, Homo sapiens
uccaucucugagcccguguca

SEQ ID NO: 1414451 - RNA, 15 nt, Homo sapiens
uccaucuucuuugca

SEQ ID NO: 1414452 - RNA, 23 nt, Homo sapiens
uccaugcccccgccaccucccca

SEQ ID NO: 1414453 - RNA, 22 nt, Homo sapiens
ucccaaggacagucagcauuuc

SEQ ID NO: 1414454 - RNA, 16 nt, Homo sapiens
ucccacgucacuugac

SEQ ID NO: 1414455 - RNA, 17 nt, Homo sapiens
ucccaggagggcuuugu

SEQ ID NO: 1414456 - RNA, 21 nt, Homo sapiens
ucccauggcuuugugcugcug

SEQ ID NO: 1414457 - RNA, 19 nt, Homo sapiens
uccccagagauggcuccuu

SEQ ID NO: 1414458 - RNA, 18 nt, Homo sapiens
uccccauaguaaugagug

SEQ ID NO: 1414459 - RNA, 18 nt, Homo sapiens
ucccccacacccguguca

SEQ ID NO: 1414460 - RNA, 18 nt, Homo sapiens
uccccgaaggugcuggag

SEQ ID NO: 1414461 - RNA, 14 nt, Homo sapiens
ucccugaagccagc

SEQ ID NO: 1414462 - RNA, 14 nt, Homo sapiens
uccuaauggucuca

SEQ ID NO: 1414463 - RNA, 20 nt, Homo sapiens
uccuacaguguaucaacaaa

SEQ ID NO: 1414464 - RNA, 10 nt, Homo sapiens
uccucagguu

SEQ ID NO: 1414465 - RNA, 19 nt, Homo sapiens
uccucaguuacacaaagga

SEQ ID NO: 1414466 - RNA, 14 nt, Homo sapiens
uccuccgucuuccu

SEQ ID NO: 1414467 - RNA, 17 nt, Homo sapiens
uccugaccucaggugau

SEQ ID NO: 1414468 - RNA, 21 nt, Homo sapiens
uccugcacagaucgauaccuu

SEQ ID NO: 1414469 - RNA, 20 nt, Homo sapiens
uccugcuugaacugcugcca

SEQ ID NO: 1414470 - RNA, 18 nt, Homo sapiens
uccuggccuaauccuuua

SEQ ID NO: 1414471 - RNA, 14 nt, Homo sapiens
uccugugcugcgau

SEQ ID NO: 1414472 - RNA, 20 nt, Homo sapiens
uccuugaguccccaccagcu

SEQ ID NO: 1414473 - RNA, 17 nt, Homo sapiens
ucgccaaauaguuccau

SEQ ID NO: 1414474 - RNA, 19 nt, Homo sapiens
ucgccagcugaugacucaa

SEQ ID NO: 1414475 - RNA, 22 nt, Homo sapiens
ucggccacccgccucccucuca

SEQ ID NO: 1414476 - RNA, 16 nt, Homo sapiens
ucggccuggcuccuac

SEQ ID NO: 1414477 - RNA, 21 nt, Homo sapiens
ucgggaaccucacucuugcca

SEQ ID NO: 1414478 - RNA, 22 nt, Homo sapiens
ucgggaaccucacucuugccaa

SEQ ID NO: 1414479 - RNA, 23 nt, Homo sapiens
ucgggaaccucacucuugccaac

SEQ ID NO: 1414480 - RNA, 15 nt, Homo sapiens
ucguauuucaccucu

SEQ ID NO: 1414481 - RNA, 16 nt, Homo sapiens
ucuaacaaaugaucua

SEQ ID NO: 1414482 - RNA, 17 nt, Homo sapiens
ucuaauucaguucugaa

SEQ ID NO: 1414483 - RNA, 19 nt, Homo sapiens
ucuagauuuuucugugaaa

SEQ ID NO: 1414484 - RNA, 15 nt, Homo sapiens
ucucaaccccaucau

SEQ ID NO: 1414485 - RNA, 13 nt, Homo sapiens
ucucacaaaucag

SEQ ID NO: 1414486 - RNA, 16 nt, Homo sapiens
ucucaugaagcccuua

SEQ ID NO: 1414487 - RNA, 15 nt, Homo sapiens
ucucaugcagaagag

SEQ ID NO: 1414488 - RNA, 23 nt, Homo sapiens
ucucauguucaaagugugacauu

SEQ ID NO: 1414489 - RNA, 23 nt, Homo sapiens
ucucauuguguggucauaucuag

SEQ ID NO: 1414490 - RNA, 16 nt, Homo sapiens
ucuccaaaacaaccca

SEQ ID NO: 1414491 - RNA, 17 nt, Homo sapiens
ucuccaggcaguucucu

SEQ ID NO: 1414492 - RNA, 16 nt, Homo sapiens
ucucccauggcuuugu

SEQ ID NO: 1414493 - RNA, 23 nt, Homo sapiens
ucucccgcguggaguucuccuca

SEQ ID NO: 1414494 - RNA, 12 nt, Homo sapiens
ucuccucagguc

SEQ ID NO: 1414495 - RNA, 22 nt, Homo sapiens
ucuccucuuccagagucaccuu

SEQ ID NO: 1414496 - RNA, 15 nt, Homo sapiens
ucucuagaagugcca

SEQ ID NO: 1414497 - RNA, 16 nt, Homo sapiens
ucugaccccuccucac

SEQ ID NO: 1414498 - RNA, 13 nt, Homo sapiens
ucugagagccaua

SEQ ID NO: 1414499 - RNA, 14 nt, Homo sapiens
ucugagcucugcau

SEQ ID NO: 1414500 - RNA, 18 nt, Homo sapiens
ucugaugucuucuuacua

SEQ ID NO: 1414501 - RNA, 20 nt, Homo sapiens
ucugcccccuuuacuccucg

SEQ ID NO: 1414502 - RNA, 16 nt, Homo sapiens
ucugccguugcugcca

SEQ ID NO: 1414503 - RNA, 15 nt, Homo sapiens
ucugcuucaccaagg

SEQ ID NO: 1414504 - RNA, 20 nt, Homo sapiens
ucuggauuucauccuugacc

SEQ ID NO: 1414505 - RNA, 16 nt, Homo sapiens
ucugguaagguuucua

SEQ ID NO: 1414506 - RNA, 16 nt, Homo sapiens
ucugugcagucacugg

SEQ ID NO: 1414507 - RNA, 18 nt, Homo sapiens
ucuguuucaagccagugu

SEQ ID NO: 1414508 - RNA, 19 nt, Homo sapiens
ucuuaacaaucaaaucugg

SEQ ID NO: 1414509 - RNA, 22 nt, Homo sapiens
ucuuaacaaucaaaucugguau

SEQ ID NO: 1414510 - RNA, 19 nt, Homo sapiens
ucuuaacuucacuuccauu

SEQ ID NO: 1414511 - RNA, 19 nt, Homo sapiens
ucuuacauuuucucugaug

SEQ ID NO: 1414512 - RNA, 18 nt, Homo sapiens
ucuuccaaaccaccuucc

SEQ ID NO: 1414513 - RNA, 18 nt, Homo sapiens
ucuuccagugauguugaa

SEQ ID NO: 1414514 - RNA, 23 nt, Homo sapiens
ucuuccaucccaggacaccacac

SEQ ID NO: 1414515 - RNA, 14 nt, Homo sapiens
ucuucuuacuaggg

SEQ ID NO: 1414516 - RNA, 17 nt, Homo sapiens
ucuugaguagcugggau

SEQ ID NO: 1414517 - RNA, 14 nt, Homo sapiens
ucuugaucugcuca

SEQ ID NO: 1414518 - RNA, 13 nt, Homo sapiens
ucuugugcuggau

SEQ ID NO: 1414519 - RNA, 22 nt, Homo sapiens
ucuuguuuccuuauauuaugga

SEQ ID NO: 1414520 - RNA, 19 nt, Homo sapiens
ucuuuaugaaguuugcuau

SEQ ID NO: 1414521 - RNA, 20 nt, Homo sapiens
ugaaaaaccugggcaccuaa

SEQ ID NO: 1414522 - RNA, 22 nt, Homo sapiens
ugaaaaaccugggcaccuaagc

SEQ ID NO: 1414523 - RNA, 22 nt, Homo sapiens
ugaaaacagucccagaaugacc

SEQ ID NO: 1414524 - RNA, 16 nt, Homo sapiens
ugaaaagcuaccauca

SEQ ID NO: 1414525 - RNA, 18 nt, Homo sapiens
ugaaagcaauaagcucuu

SEQ ID NO: 1414526 - RNA, 23 nt, Homo sapiens
ugaaaggauaggauugacauacc

SEQ ID NO: 1414527 - RNA, 15 nt, Homo sapiens
ugaaauaaagaacca

SEQ ID NO: 1414528 - RNA, 12 nt, Homo sapiens
ugaacauuccua

SEQ ID NO: 1414529 - RNA, 20 nt, Homo sapiens
ugaacuccugaccucaggua

SEQ ID NO: 1414530 - RNA, 15 nt, Homo sapiens
ugaacugcaggugac

SEQ ID NO: 1414531 - RNA, 20 nt, Homo sapiens
ugaagccguccaagaacaag

SEQ ID NO: 1414532 - RNA, 18 nt, Homo sapiens
ugaagcugcugucucuag

SEQ ID NO: 1414533 - RNA, 16 nt, Homo sapiens
ugaaggaaaaacacaa

SEQ ID NO: 1414534 - RNA, 14 nt, Homo sapiens
ugaaggcaucagaa

SEQ ID NO: 1414535 - RNA, 19 nt, Homo sapiens
ugaauagcuuauguacaaa

SEQ ID NO: 1414536 - RNA, 20 nt, Homo sapiens
ugaaucauuuuaccuuugac

SEQ ID NO: 1414537 - RNA, 18 nt, Homo sapiens
ugaaugcuauuuucaaau

SEQ ID NO: 1414538 - RNA, 12 nt, Homo sapiens
ugacaaaugcca

SEQ ID NO: 1414539 - RNA, 16 nt, Homo sapiens
ugacaucuuuggucau

SEQ ID NO: 1414540 - RNA, 18 nt, Homo sapiens
ugacauuuuacaauguaa

SEQ ID NO: 1414541 - RNA, 18 nt, Homo sapiens
ugaccagcuagacuccca

SEQ ID NO: 1414542 - RNA, 14 nt, Homo sapiens
ugaccccuccucac

SEQ ID NO: 1414543 - RNA, 12 nt, Homo sapiens
ugacguccuucc

SEQ ID NO: 1414544 - RNA, 21 nt, Homo sapiens
ugacugcugaauuaaugugau

SEQ ID NO: 1414545 - RNA, 23 nt, Homo sapiens
ugacugugcaugacagcggcaau

SEQ ID NO: 1414546 - RNA, 15 nt, Homo sapiens
ugacuuugugccauc

SEQ ID NO: 1414547 - RNA, 21 nt, Homo sapiens
ugagaaguugaagccgucuca

SEQ ID NO: 1414548 - RNA, 17 nt, Homo sapiens
ugagaauuaucaccaug

SEQ ID NO: 1414549 - RNA, 12 nt, Homo sapiens
ugagaccuucag

SEQ ID NO: 1414550 - RNA, 20 nt, Homo sapiens
ugagagaggaccuccaugcc

SEQ ID NO: 1414551 - RNA, 21 nt, Homo sapiens
ugagaguggguaaaucaggga

SEQ ID NO: 1414552 - RNA, 13 nt, Homo sapiens
ugagauguguuca

SEQ ID NO: 1414553 - RNA, 15 nt, Homo sapiens
ugagauguguucaca

SEQ ID NO: 1414554 - RNA, 13 nt, Homo sapiens
ugagcaaccaguu

SEQ ID NO: 1414555 - RNA, 15 nt, Homo sapiens
ugagcaguucccaag

SEQ ID NO: 1414556 - RNA, 21 nt, Homo sapiens
ugagccuggccauguccucaa

SEQ ID NO: 1414557 - RNA, 17 nt, Homo sapiens
ugagcuaggaauugugu

SEQ ID NO: 1414558 - RNA, 14 nt, Homo sapiens
ugagcuucaguaua

SEQ ID NO: 1414559 - RNA, 22 nt, Homo sapiens
ugagcuuccauuaugcugcaga

SEQ ID NO: 1414560 - RNA, 22 nt, Homo sapiens
ugaggaauaaagcuucucucug

SEQ ID NO: 1414561 - RNA, 17 nt, Homo sapiens
ugaggcaggagaauggc

SEQ ID NO: 1414562 - RNA, 23 nt, Homo sapiens
ugagggauggacugaugcuuuua

SEQ ID NO: 1414563 - RNA, 17 nt, Homo sapiens
ugaggucuggcugcuug

SEQ ID NO: 1414564 - RNA, 15 nt, Homo sapiens
ugaggugaccacuua

SEQ ID NO: 1414565 - RNA, 18 nt, Homo sapiens
ugaguccccaccagcuca

SEQ ID NO: 1414566 - RNA, 20 nt, Homo sapiens
ugaguccuuaauucugccua

SEQ ID NO: 1414567 - RNA, 13 nt, Homo sapiens
ugagugaguucuc

SEQ ID NO: 1414568 - RNA, 16 nt, Homo sapiens
ugaguucccaaaggga

SEQ ID NO: 1414569 - RNA, 16 nt, Homo sapiens
ugaucaggucuuuacu

SEQ ID NO: 1414570 - RNA, 17 nt, Homo sapiens
ugauccuuuugugccau

SEQ ID NO: 1414571 - RNA, 17 nt, Homo sapiens
ugaugauuaagugcaca

SEQ ID NO: 1414572 - RNA, 14 nt, Homo sapiens
ugaugucuucuuac

SEQ ID NO: 1414573 - RNA, 21 nt, Homo sapiens
ugauuccuaaaacucugccag

SEQ ID NO: 1414574 - RNA, 15 nt, Homo sapiens
ugauuguccugccag

SEQ ID NO: 1414575 - RNA, 23 nt, Homo sapiens
ugcagaaagaaauugagcgccau

SEQ ID NO: 1414576 - RNA, 22 nt, Homo sapiens
ugcagagcuggcagcaauggau

SEQ ID NO: 1414577 - RNA, 21 nt, Homo sapiens
ugcaggcuuaacgugucugag

SEQ ID NO: 1414578 - RNA, 13 nt, Homo sapiens
ugcaguaaucucc

SEQ ID NO: 1414579 - RNA, 16 nt, Homo sapiens
ugcaguggagcuggca

SEQ ID NO: 1414580 - RNA, 16 nt, Homo sapiens
ugcaguguuuaaguca

SEQ ID NO: 1414581 - RNA, 15 nt, Homo sapiens
ugcaugaccuaucag

SEQ ID NO: 1414582 - RNA, 13 nt, Homo sapiens
ugcauuuguguca

SEQ ID NO: 1414583 - RNA, 21 nt, Homo sapiens
ugcauuugugucauugacaaa

SEQ ID NO: 1414584 - RNA, 20 nt, Homo sapiens
ugcauuuuuuaaauuugcca

SEQ ID NO: 1414585 - RNA, 16 nt, Homo sapiens
ugccaaccuguaauaa

SEQ ID NO: 1414586 - RNA, 17 nt, Homo sapiens
ugccaacuccaugucag

SEQ ID NO: 1414587 - RNA, 17 nt, Homo sapiens
ugccacacuagcuuccc

SEQ ID NO: 1414588 - RNA, 22 nt, Homo sapiens
ugccacguauagggcacuccca

SEQ ID NO: 1414589 - RNA, 16 nt, Homo sapiens
ugccagcauaugcaga

SEQ ID NO: 1414590 - RNA, 17 nt, Homo sapiens
ugccauggaaugacuga

SEQ ID NO: 1414591 - RNA, 21 nt, Homo sapiens
ugccauggcuggggggucuca

SEQ ID NO: 1414592 - RNA, 19 nt, Homo sapiens
ugccccacagagacacuuu

SEQ ID NO: 1414593 - RNA, 18 nt, Homo sapiens
ugcccccagccccggggu

SEQ ID NO: 1414594 - RNA, 19 nt, Homo sapiens
ugcccucuccgagcuggua

SEQ ID NO: 1414595 - RNA, 21 nt, Homo sapiens
ugccgccccggacaguggcac

SEQ ID NO: 1414596 - RNA, 16 nt, Homo sapiens
ugccucccaaagugcu

SEQ ID NO: 1414597 - RNA, 18 nt, Homo sapiens
ugccucgggaaccucacu

SEQ ID NO: 1414598 - RNA, 23 nt, Homo sapiens
ugccucgggaaccucacucuugc

SEQ ID NO: 1414599 - RNA, 14 nt, Homo sapiens
ugccucucccaugg

SEQ ID NO: 1414600 - RNA, 18 nt, Homo sapiens
ugccugcuuacacccugc

SEQ ID NO: 1414601 - RNA, 17 nt, Homo sapiens
ugccuuaccgagagcca

SEQ ID NO: 1414602 - RNA, 20 nt, Homo sapiens
ugccuuaccgagagccaaac

SEQ ID NO: 1414603 - RNA, 22 nt, Homo sapiens
ugccuuaccgagagccaaacag

SEQ ID NO: 1414604 - RNA, 19 nt, Homo sapiens
ugcgaaccuuucagucucc

SEQ ID NO: 1414605 - RNA, 15 nt, Homo sapiens
ugcgcagcuccuucc

SEQ ID NO: 1414606 - RNA, 14 nt, Homo sapiens
ugcggaaagcccug

SEQ ID NO: 1414607 - RNA, 17 nt, Homo sapiens
ugcggcugcaucuucca

SEQ ID NO: 1414608 - RNA, 22 nt, Homo sapiens
ugcuaagcgggcccggguccca

SEQ ID NO: 1414609 - RNA, 21 nt, Homo sapiens
ugcuaccaaguuucauaccaa

SEQ ID NO: 1414610 - RNA, 15 nt, Homo sapiens
ugcuauaccuugacu

SEQ ID NO: 1414611 - RNA, 23 nt, Homo sapiens
ugcucaaaaugccacagcccaga

SEQ ID NO: 1414612 - RNA, 18 nt, Homo sapiens
ugcucaaucaugugccag

SEQ ID NO: 1414613 - RNA, 18 nt, Homo sapiens
ugcucacuaccuccucag

SEQ ID NO: 1414614 - RNA, 22 nt, Homo sapiens
ugcucacuaccuccucagggau

SEQ ID NO: 1414615 - RNA, 22 nt, Homo sapiens
ugcucagcccuggaggugccag

SEQ ID NO: 1414616 - RNA, 15 nt, Homo sapiens
ugcucauucuaauga

SEQ ID NO: 1414617 - RNA, 21 nt, Homo sapiens
ugcucccaggagggcuuugug

SEQ ID NO: 1414618 - RNA, 20 nt, Homo sapiens
ugcugccaacuccaugucag

SEQ ID NO: 1414619 - RNA, 14 nt, Homo sapiens
ugcugugauuccac

SEQ ID NO: 1414620 - RNA, 19 nt, Homo sapiens
ugcuuccuauacaguucua

SEQ ID NO: 1414621 - RNA, 16 nt, Homo sapiens
ugcuuuccugccuccu

SEQ ID NO: 1414622 - RNA, 15 nt, Homo sapiens
ugcuuugagaucucu

SEQ ID NO: 1414623 - RNA, 20 nt, Homo sapiens
ugcuuuuuauggccugugag

SEQ ID NO: 1414624 - RNA, 15 nt, Homo sapiens
uggaaagcuggugau

SEQ ID NO: 1414625 - RNA, 23 nt, Homo sapiens
uggacuucauuuuggagaagcuc

SEQ ID NO: 1414626 - RNA, 13 nt, Homo sapiens
uggagaagcucaa

SEQ ID NO: 1414627 - RNA, 17 nt, Homo sapiens
uggagagagagcaagau

SEQ ID NO: 1414628 - RNA, 15 nt, Homo sapiens
uggagcagagaacau

SEQ ID NO: 1414629 - RNA, 11 nt, Homo sapiens
uggaggggugu

SEQ ID NO: 1414630 - RNA, 14 nt, Homo sapiens
uggauauuugccuu

SEQ ID NO: 1414631 - RNA, 21 nt, Homo sapiens
uggcaacugaaaacaguccca

SEQ ID NO: 1414632 - RNA, 23 nt, Homo sapiens
uggcacaugucauugcccacuuc

SEQ ID NO: 1414633 - RNA, 14 nt, Homo sapiens
uggcaccugggaag

SEQ ID NO: 1414634 - RNA, 18 nt, Homo sapiens
uggcagagacagugggca

SEQ ID NO: 1414635 - RNA, 22 nt, Homo sapiens
uggcagugugcggagcugauaa

SEQ ID NO: 1414636 - RNA, 21 nt, Homo sapiens
uggcccuccacccccaccuca

SEQ ID NO: 1414637 - RNA, 21 nt, Homo sapiens
uggccggggcugaagccacac

SEQ ID NO: 1414638 - RNA, 13 nt, Homo sapiens
uggccucaccugg

SEQ ID NO: 1414639 - RNA, 21 nt, Homo sapiens
uggccugcugugauuccacua

SEQ ID NO: 1414640 - RNA, 15 nt, Homo sapiens
uggcugcacucaaga

SEQ ID NO: 1414641 - RNA, 22 nt, Homo sapiens
uggcugccccauuuauccaccu

SEQ ID NO: 1414642 - RNA, 16 nt, Homo sapiens
uggcuuuagacacugg

SEQ ID NO: 1414643 - RNA, 13 nt, Homo sapiens
ugggaaaguugca

SEQ ID NO: 1414644 - RNA, 16 nt, Homo sapiens
ugggagguggaagaag

SEQ ID NO: 1414645 - RNA, 15 nt, Homo sapiens
ugggcaauaaaggca

SEQ ID NO: 1414646 - RNA, 15 nt, Homo sapiens
ugggcaccuaagcaa

SEQ ID NO: 1414647 - RNA, 15 nt, Homo sapiens
ugggccccaucauua

SEQ ID NO: 1414648 - RNA, 15 nt, Homo sapiens
uggguaaaucaggga

SEQ ID NO: 1414649 - RNA, 16 nt, Homo sapiens
ugggugcauaucuucc

SEQ ID NO: 1414650 - RNA, 19 nt, Homo sapiens
ugggugcauaucuucccag

SEQ ID NO: 1414651 - RNA, 18 nt, Homo sapiens
uggguuugccaagcccuu

SEQ ID NO: 1414652 - RNA, 19 nt, Homo sapiens
uggguuugccaagcccuuu

SEQ ID NO: 1414653 - RNA, 15 nt, Homo sapiens
ugguaagaccucuga

SEQ ID NO: 1414654 - RNA, 20 nt, Homo sapiens
uggucauaucuagucacuug

SEQ ID NO: 1414655 - RNA, 16 nt, Homo sapiens
uggucuccucuuccag

SEQ ID NO: 1414656 - RNA, 21 nt, Homo sapiens
uggucuguugcugccacucua

SEQ ID NO: 1414657 - RNA, 15 nt, Homo sapiens
uggucuucagcaaaa

SEQ ID NO: 1414658 - RNA, 16 nt, Homo sapiens
uggugauuccugggaa

SEQ ID NO: 1414659 - RNA, 13 nt, Homo sapiens
ugguguaaucucu

SEQ ID NO: 1414660 - RNA, 22 nt, Homo sapiens
ugguguagugcauggacaucua

SEQ ID NO: 1414661 - RNA, 16 nt, Homo sapiens
ugguuucuaucugcaa

SEQ ID NO: 1414662 - RNA, 13 nt, Homo sapiens
ugguuuggauguu

SEQ ID NO: 1414663 - RNA, 19 nt, Homo sapiens
uguaaagacuaugaucuca

SEQ ID NO: 1414664 - RNA, 11 nt, Homo sapiens
uguaacauacu

SEQ ID NO: 1414665 - RNA, 13 nt, Homo sapiens
uguaacauacuca

SEQ ID NO: 1414666 - RNA, 15 nt, Homo sapiens
uguaacauacucauu

SEQ ID NO: 1414667 - RNA, 18 nt, Homo sapiens
uguaacggccaacacuuu

SEQ ID NO: 1414668 - RNA, 19 nt, Homo sapiens
uguaacggccaacacuuug

SEQ ID NO: 1414669 - RNA, 14 nt, Homo sapiens
uguaagccaucaca

SEQ ID NO: 1414670 - RNA, 16 nt, Homo sapiens
uguaaguuucugugac

SEQ ID NO: 1414671 - RNA, 13 nt, Homo sapiens
uguaaucccagca

SEQ ID NO: 1414672 - RNA, 16 nt, Homo sapiens
uguaaucccagcacuu

SEQ ID NO: 1414673 - RNA, 19 nt, Homo sapiens
uguaaucccagcauuuuga

SEQ ID NO: 1414674 - RNA, 20 nt, Homo sapiens
uguacaacuccacgagguga

SEQ ID NO: 1414675 - RNA, 14 nt, Homo sapiens
uguacauacuguau

SEQ ID NO: 1414676 - RNA, 13 nt, Homo sapiens
uguagauucccuu

SEQ ID NO: 1414677 - RNA, 16 nt, Homo sapiens
uguaguguaccauucu

SEQ ID NO: 1414678 - RNA, 17 nt, Homo sapiens
uguaguguaccauucuc

SEQ ID NO: 1414679 - RNA, 19 nt, Homo sapiens
uguaguguaccauucucag

SEQ ID NO: 1414680 - RNA, 21 nt, Homo sapiens
uguaguuaaggaaaacugagg

SEQ ID NO: 1414681 - RNA, 17 nt, Homo sapiens
ugucaaauaaacacugu

SEQ ID NO: 1414682 - RNA, 15 nt, Homo sapiens
ugucaauuugaugua

SEQ ID NO: 1414683 - RNA, 14 nt, Homo sapiens
ugucacacagggaa

SEQ ID NO: 1414684 - RNA, 17 nt, Homo sapiens
ugucacagccauaguca

SEQ ID NO: 1414685 - RNA, 19 nt, Homo sapiens
ugucuauuuuuucuugaca

SEQ ID NO: 1414686 - RNA, 16 nt, Homo sapiens
ugugaaacucaucuca

SEQ ID NO: 1414687 - RNA, 17 nt, Homo sapiens
ugugaaacucaucucau

SEQ ID NO: 1414688 - RNA, 18 nt, Homo sapiens
ugugaacauuccuaucaa

SEQ ID NO: 1414689 - RNA, 16 nt, Homo sapiens
ugugacaucuuugguc

SEQ ID NO: 1414690 - RNA, 16 nt, Homo sapiens
ugugagcacaaugcau

SEQ ID NO: 1414691 - RNA, 12 nt, Homo sapiens
ugugccauagaa

SEQ ID NO: 1414692 - RNA, 19 nt, Homo sapiens
ugugccugacaccacgcug

SEQ ID NO: 1414693 - RNA, 14 nt, Homo sapiens
uguggaggggagcu

SEQ ID NO: 1414694 - RNA, 18 nt, Homo sapiens
uguguaccaaucgucuca

SEQ ID NO: 1414695 - RNA, 13 nt, Homo sapiens
ugugucuccugug

SEQ ID NO: 1414696 - RNA, 20 nt, Homo sapiens
ugugucuuuuuguaucucau

SEQ ID NO: 1414697 - RNA, 20 nt, Homo sapiens
uguguggucauaucuaguca

SEQ ID NO: 1414698 - RNA, 17 nt, Homo sapiens
uguguuuacuaugcauu

SEQ ID NO: 1414699 - RNA, 18 nt, Homo sapiens
uguucaaagugugacauu

SEQ ID NO: 1414700 - RNA, 20 nt, Homo sapiens
uguucaaagugugacauuca

SEQ ID NO: 1414701 - RNA, 19 nt, Homo sapiens
uguucacaauggauaggca

SEQ ID NO: 1414702 - RNA, 14 nt, Homo sapiens
uguucuuuggugua

SEQ ID NO: 1414703 - RNA, 16 nt, Homo sapiens
uguugugauguacaca

SEQ ID NO: 1414704 - RNA, 16 nt, Homo sapiens
uguugugcaugcucaa

SEQ ID NO: 1414705 - RNA, 17 nt, Homo sapiens
uguuuaaguaauugcca

SEQ ID NO: 1414706 - RNA, 15 nt, Homo sapiens
uguuuuaacauuauu

SEQ ID NO: 1414707 - RNA, 22 nt, Homo sapiens
uguuuucagaccuuugucugaa

SEQ ID NO: 1414708 - RNA, 15 nt, Homo sapiens
uuaaacucaugggaa

SEQ ID NO: 1414709 - RNA, 12 nt, Homo sapiens
uuaaauuugcca

SEQ ID NO: 1414710 - RNA, 16 nt, Homo sapiens
uuaaauuuuaaacaau

SEQ ID NO: 1414711 - RNA, 19 nt, Homo sapiens
uuaacugacuucuguccac

SEQ ID NO: 1414712 - RNA, 18 nt, Homo sapiens
uuaagauggcuacaccuc

SEQ ID NO: 1414713 - RNA, 17 nt, Homo sapiens
uuaagaugguaagaccu

SEQ ID NO: 1414714 - RNA, 14 nt, Homo sapiens
uuaagggcauuuaa

SEQ ID NO: 1414715 - RNA, 14 nt, Homo sapiens
uuaaguaauugcau

SEQ ID NO: 1414716 - RNA, 14 nt, Homo sapiens
uuaaguaauugcca

SEQ ID NO: 1414717 - RNA, 16 nt, Homo sapiens
uuaagugccccacaga

SEQ ID NO: 1414718 - RNA, 16 nt, Homo sapiens
uuaauaauccuuccag

SEQ ID NO: 1414719 - RNA, 15 nt, Homo sapiens
uuaauuaacaucaaa

SEQ ID NO: 1414720 - RNA, 15 nt, Homo sapiens
uuacaaagcaaaaag

SEQ ID NO: 1414721 - RNA, 21 nt, Homo sapiens
uuacaagccuuauaagaaaua

SEQ ID NO: 1414722 - RNA, 23 nt, Homo sapiens
uuacauuuucucugaugauguca

SEQ ID NO: 1414723 - RNA, 21 nt, Homo sapiens
uuacccaccugucacccccuc

SEQ ID NO: 1414724 - RNA, 20 nt, Homo sapiens
uuacguaaaccugaaauaua

SEQ ID NO: 1414725 - RNA, 15 nt, Homo sapiens
uuacuaauguauuaa

SEQ ID NO: 1414726 - RNA, 15 nt, Homo sapiens
uuacuguguaucuca

SEQ ID NO: 1414727 - RNA, 20 nt, Homo sapiens
uuacuuuuaaaaucagugau

SEQ ID NO: 1414728 - RNA, 12 nt, Homo sapiens
uuagaaaucagu

SEQ ID NO: 1414729 - RNA, 11 nt, Homo sapiens
uuagacacugg

SEQ ID NO: 1414730 - RNA, 22 nt, Homo sapiens
uuagagccaggcacacacugug

SEQ ID NO: 1414731 - RNA, 22 nt, Homo sapiens
uuagaggugggccuaguaggag

SEQ ID NO: 1414732 - RNA, 15 nt, Homo sapiens
uuagaucuucugggu

SEQ ID NO: 1414733 - RNA, 13 nt, Homo sapiens
uuagcuacacccc

SEQ ID NO: 1414734 - RNA, 19 nt, Homo sapiens
uuaggauuuguuucuucuc

SEQ ID NO: 1414735 - RNA, 21 nt, Homo sapiens
uuaguagagaagggguuucac

SEQ ID NO: 1414736 - RNA, 13 nt, Homo sapiens
uuaguuauacucc

SEQ ID NO: 1414737 - RNA, 15 nt, Homo sapiens
uuaguuauacuccuc

SEQ ID NO: 1414738 - RNA, 16 nt, Homo sapiens
uuaguuauacuccuca

SEQ ID NO: 1414739 - RNA, 23 nt, Homo sapiens
uuaguucuguagaaggcaagagu

SEQ ID NO: 1414740 - RNA, 19 nt, Homo sapiens
uuauauuauggaggcagga

SEQ ID NO: 1414741 - RNA, 15 nt, Homo sapiens
uuaugguaguaccau

SEQ ID NO: 1414742 - RNA, 17 nt, Homo sapiens
uuauuuuaugacauuuu

SEQ ID NO: 1414743 - RNA, 16 nt, Homo sapiens
uucaaaaauauucauu

SEQ ID NO: 1414744 - RNA, 13 nt, Homo sapiens
uucaaaccaggau

SEQ ID NO: 1414745 - RNA, 15 nt, Homo sapiens
uucaaauaaacugaa

SEQ ID NO: 1414746 - RNA, 15 nt, Homo sapiens
uucaagccagugugu

SEQ ID NO: 1414747 - RNA, 22 nt, Homo sapiens
uucaauaugaaccaaguaguau

SEQ ID NO: 1414748 - RNA, 12 nt, Homo sapiens
uucaccaaagau

SEQ ID NO: 1414749 - RNA, 23 nt, Homo sapiens
uucaccuccagcccccagugucc

SEQ ID NO: 1414750 - RNA, 14 nt, Homo sapiens
uucagacauuccau

SEQ ID NO: 1414751 - RNA, 19 nt, Homo sapiens
uucagacauuccaugguga

SEQ ID NO: 1414752 - RNA, 20 nt, Homo sapiens
uucagacauuccauggugau

SEQ ID NO: 1414753 - RNA, 21 nt, Homo sapiens
uucaggcagagcuguggcaca

SEQ ID NO: 1414754 - RNA, 14 nt, Homo sapiens
uucauaccaaauau

SEQ ID NO: 1414755 - RNA, 17 nt, Homo sapiens
uucauagacccucucaa

SEQ ID NO: 1414756 - RNA, 20 nt, Homo sapiens
uucauccagggaaaugccuc

SEQ ID NO: 1414757 - RNA, 22 nt, Homo sapiens
uucauccugaaguuugcauuaa

SEQ ID NO: 1414758 - RNA, 21 nt, Homo sapiens
uuccacuugggacuagaucac

SEQ ID NO: 1414759 - RNA, 22 nt, Homo sapiens
uuccaggaggaguuagccaaac

SEQ ID NO: 1414760 - RNA, 23 nt, Homo sapiens
uuccaggggcucuggggcagcuc

SEQ ID NO: 1414761 - RNA, 22 nt, Homo sapiens
uucccaaggacagucagcauuu

SEQ ID NO: 1414762 - RNA, 20 nt, Homo sapiens
uucccaggaguucugcucau

SEQ ID NO: 1414763 - RNA, 14 nt, Homo sapiens
uuccccaccaguga

SEQ ID NO: 1414764 - RNA, 19 nt, Homo sapiens
uucccccugagcugccacc

SEQ ID NO: 1414765 - RNA, 15 nt, Homo sapiens
uuccccuuagagugc

SEQ ID NO: 1414766 - RNA, 21 nt, Homo sapiens
uuccuaaggcccagcugccag

SEQ ID NO: 1414767 - RNA, 16 nt, Homo sapiens
uuccuauacaguucua

SEQ ID NO: 1414768 - RNA, 17 nt, Homo sapiens
uuccucuagaagccaag

SEQ ID NO: 1414769 - RNA, 19 nt, Homo sapiens
uuccuuuccccagcccagg

SEQ ID NO: 1414770 - RNA, 20 nt, Homo sapiens
uuccuuuucccugcuuccag

SEQ ID NO: 1414771 - RNA, 13 nt, Homo sapiens
uucgauguacuug

SEQ ID NO: 1414772 - RNA, 21 nt, Homo sapiens
uucuaaugauggcccauucua

SEQ ID NO: 1414773 - RNA, 16 nt, Homo sapiens
uucuaggaggucuguu

SEQ ID NO: 1414774 - RNA, 22 nt, Homo sapiens
uucuguccacucuggagagcag

SEQ ID NO: 1414775 - RNA, 15 nt, Homo sapiens
uucuguucaucuuaa

SEQ ID NO: 1414776 - RNA, 14 nt, Homo sapiens
uucuucagaacaau

SEQ ID NO: 1414777 - RNA, 19 nt, Homo sapiens
uucuugacauuuaaacuca

SEQ ID NO: 1414778 - RNA, 19 nt, Homo sapiens
uucuuggcccgcacagagc

SEQ ID NO: 1414779 - RNA, 12 nt, Homo sapiens
uugaaacuaacu

SEQ ID NO: 1414780 - RNA, 17 nt, Homo sapiens
uugaacuaacauaaucu

SEQ ID NO: 1414781 - RNA, 17 nt, Homo sapiens
uugaagccgucucaugc

SEQ ID NO: 1414782 - RNA, 18 nt, Homo sapiens
uugaauaugccaaacaca

SEQ ID NO: 1414783 - RNA, 16 nt, Homo sapiens
uugaaucuaaaaccaa

SEQ ID NO: 1414784 - RNA, 12 nt, Homo sapiens
uugacugcugaa

SEQ ID NO: 1414785 - RNA, 22 nt, Homo sapiens
uugacugcugaauuaaugugau

SEQ ID NO: 1414786 - RNA, 17 nt, Homo sapiens
uugagaaauacuauaua

SEQ ID NO: 1414787 - RNA, 16 nt, Homo sapiens
uugagacagaguuuca

SEQ ID NO: 1414788 - RNA, 16 nt, Homo sapiens
uugaugccacccagaa

SEQ ID NO: 1414789 - RNA, 19 nt, Homo sapiens
uugauuuuccucucucaca

SEQ ID NO: 1414790 - RNA, 20 nt, Homo sapiens
uugcagugagcugagaucac

SEQ ID NO: 1414791 - RNA, 10 nt, Homo sapiens
uugcauuuaa

SEQ ID NO: 1414792 - RNA, 14 nt, Homo sapiens
uugccaaccuguaa

SEQ ID NO: 1414793 - RNA, 16 nt, Homo sapiens
uugccgaaccaggagc

SEQ ID NO: 1414794 - RNA, 21 nt, Homo sapiens
uugcgaccaccaacacacagg

SEQ ID NO: 1414795 - RNA, 18 nt, Homo sapiens
uuggauguagccaugacc

SEQ ID NO: 1414796 - RNA, 19 nt, Homo sapiens
uugggagaaagagaaauca

SEQ ID NO: 1414797 - RNA, 11 nt, Homo sapiens
uugggcaauaa

SEQ ID NO: 1414798 - RNA, 23 nt, Homo sapiens
uugguguaaucucucauggugaa

SEQ ID NO: 1414799 - RNA, 13 nt, Homo sapiens
uuguaauaagaaa

SEQ ID NO: 1414800 - RNA, 13 nt, Homo sapiens
uuguagagcacag

SEQ ID NO: 1414801 - RNA, 16 nt, Homo sapiens
uuguccccuccaaauc

SEQ ID NO: 1414802 - RNA, 19 nt, Homo sapiens
uugugucacugacucaggc

SEQ ID NO: 1414803 - RNA, 14 nt, Homo sapiens
uuguugugcaaguu

SEQ ID NO: 1414804 - RNA, 13 nt, Homo sapiens
uuuaacacuuucu

SEQ ID NO: 1414805 - RNA, 18 nt, Homo sapiens
uuuaacugugaaccugga

SEQ ID NO: 1414806 - RNA, 15 nt, Homo sapiens
uuuaagggaauguga

SEQ ID NO: 1414807 - RNA, 14 nt, Homo sapiens
uuuagacacauuag

SEQ ID NO: 1414808 - RNA, 22 nt, Homo sapiens
uuuagauuaggucacauuacau

SEQ ID NO: 1414809 - RNA, 22 nt, Homo sapiens
uuuauaauauucauacaacaaa

SEQ ID NO: 1414810 - RNA, 21 nt, Homo sapiens
uuuaucaguagaagugucaca

SEQ ID NO: 1414811 - RNA, 15 nt, Homo sapiens
uuuaugauacuugaa

SEQ ID NO: 1414812 - RNA, 17 nt, Homo sapiens
uuuauuagacauucucu

SEQ ID NO: 1414813 - RNA, 16 nt, Homo sapiens
uuucacaacauaucag

SEQ ID NO: 1414814 - RNA, 15 nt, Homo sapiens
uuucauaccaaauau

SEQ ID NO: 1414815 - RNA, 16 nt, Homo sapiens
uuucauauaucuauau

SEQ ID NO: 1414816 - RNA, 17 nt, Homo sapiens
uuuccccaccagugaau

SEQ ID NO: 1414817 - RNA, 20 nt, Homo sapiens
uuuccucaggcaaggucugg

SEQ ID NO: 1414818 - RNA, 15 nt, Homo sapiens
uuuccucucucacaa

SEQ ID NO: 1414819 - RNA, 12 nt, Homo sapiens
uuuccuucccua

SEQ ID NO: 1414820 - RNA, 23 nt, Homo sapiens
uuucuacguggauguucuccuga

SEQ ID NO: 1414821 - RNA, 14 nt, Homo sapiens
uuucuacucaaaag

SEQ ID NO: 1414822 - RNA, 16 nt, Homo sapiens
uuucucaguguccaga

SEQ ID NO: 1414823 - RNA, 13 nt, Homo sapiens
uuucuuugcuuca

SEQ ID NO: 1414824 - RNA, 17 nt, Homo sapiens
uuugaaauaaagaacca

SEQ ID NO: 1414825 - RNA, 21 nt, Homo sapiens
uuugccagccuugaguuaucu

SEQ ID NO: 1414826 - RNA, 14 nt, Homo sapiens
uuugcuauucuggc

SEQ ID NO: 1414827 - RNA, 14 nt, Homo sapiens
uuuggaaacaacau

SEQ ID NO: 1414828 - RNA, 14 nt, Homo sapiens
uuugggcugaagaa

SEQ ID NO: 1414829 - RNA, 19 nt, Homo sapiens
uuuguccccuccaaaucuc

SEQ ID NO: 1414830 - RNA, 10 nt, Homo sapiens
uuugugagag

SEQ ID NO: 1414831 - RNA, 17 nt, Homo sapiens
uuugugccauguucaaa

SEQ ID NO: 1414832 - RNA, 14 nt, Homo sapiens
uuuguuucaguaga

SEQ ID NO: 1414833 - RNA, 15 nt, Homo sapiens
uuuuaguucuguaga

SEQ ID NO: 1414834 - RNA, 12 nt, Homo sapiens
uuuuauggguac

SEQ ID NO: 1414835 - RNA, 13 nt, Homo sapiens
uuuuaugugcuug

SEQ ID NO: 1414836 - RNA, 19 nt, Homo sapiens
uuuucacuuuuggucuccu

SEQ ID NO: 1414837 - RNA, 15 nt, Homo sapiens
uuuugugccauguuc

SEQ ID NO: 1414838 - RNA, 15 nt, Homo sapiens
uuuuuaaaucauuca

SEQ ID NO: 1414839 - RNA, 19 nt, Homo sapiens
uuuuuaaauguucauguca

SEQ ID NO: 1414840 - RNA, 13 nt, Homo sapiens
uuuuuauacagga

SEQ ID NO: 1414841 - RNA, 19 nt, Homo sapiens
uuuuuauucagcucaugga

SEQ ID NO: 1414842 - RNA, 21 nt, Homo sapiens
uuuuugaaauaaagaaccagu

SEQ ID NO: 1414843 - RNA, 22 nt, Homo sapiens
uuuuugagacagaguuucacuc

SEQ ID NO: 1414844 - RNA, 16 nt, Homo sapiens
auacuuugaauguugu

SEQ ID NO: 1414845 - RNA, 12 nt, Homo sapiens
auagaggcuagc

SEQ ID NO: 1414846 - RNA, 18 nt, Homo sapiens
auagcauuuguguaaaga

SEQ ID NO: 1414847 - RNA, 14 nt, Homo sapiens
auaguaacaacaaa

SEQ ID NO: 1414848 - RNA, 21 nt, Homo sapiens
auauagucacaggaaacuacu

SEQ ID NO: 1414849 - RNA, 19 nt, Homo sapiens
auaucacuugauaugugca

SEQ ID NO: 1414850 - RNA, 21 nt, Homo sapiens
auaucuagauuuuucugugaa

SEQ ID NO: 1414851 - RNA, 13 nt, Homo sapiens
auaucuagucacu

SEQ ID NO: 1414852 - RNA, 15 nt, Homo sapiens
auaucuagucacuug

SEQ ID NO: 1414853 - RNA, 17 nt, Homo sapiens
auaugccaaacacauua

SEQ ID NO: 1414854 - RNA, 23 nt, Homo sapiens
auauucccccugagcugccaccu

SEQ ID NO: 1414855 - RNA, 21 nt, Homo sapiens
auauuuaacuggagcagagaa

SEQ ID NO: 1414856 - RNA, 22 nt, Homo sapiens
auauuuuaagacgaaacauuug

SEQ ID NO: 1414857 - RNA, 22 nt, Homo sapiens
aucaaacacaauuaaaucucuc

SEQ ID NO: 1414858 - RNA, 20 nt, Homo sapiens
aucaaguguaauuagcuuuu

SEQ ID NO: 1414859 - RNA, 12 nt, Homo sapiens
aucaaucagaag

SEQ ID NO: 1414860 - RNA, 19 nt, Homo sapiens
aucaaucuuugugccucaa

SEQ ID NO: 1414861 - RNA, 14 nt, Homo sapiens
aucacacuugucug

SEQ ID NO: 1414862 - RNA, 14 nt, Homo sapiens
aucagcagggcagu

SEQ ID NO: 1414863 - RNA, 14 nt, Homo sapiens
aucaugaaaacugg

SEQ ID NO: 1414864 - RNA, 20 nt, Homo sapiens
aucccaaggcuccugaccua

SEQ ID NO: 1414865 - RNA, 13 nt, Homo sapiens
aucccucucucua

SEQ ID NO: 1414866 - RNA, 17 nt, Homo sapiens
aucccuuauguaugacu

SEQ ID NO: 1414867 - RNA, 16 nt, Homo sapiens
aucccuuccucuccca

SEQ ID NO: 1414868 - RNA, 23 nt, Homo sapiens
auccugcugcaugaccuaucagu

SEQ ID NO: 1414869 - RNA, 15 nt, Homo sapiens
auccuuaaacugcca

SEQ ID NO: 1414870 - RNA, 13 nt, Homo sapiens
auccuugaccuca

SEQ ID NO: 1414871 - RNA, 17 nt, Homo sapiens
aucucaauugugcuuug

SEQ ID NO: 1414872 - RNA, 19 nt, Homo sapiens
aucucaauugugcuuugua

SEQ ID NO: 1414873 - RNA, 13 nt, Homo sapiens
aucucauguucaa

SEQ ID NO: 1414874 - RNA, 24 nt, Homo sapiens
aucucuauguagaaaucucaucuu

SEQ ID NO: 1414875 - RNA, 13 nt, Homo sapiens
aucucucauggug

SEQ ID NO: 1414876 - RNA, 22 nt, Homo sapiens
aucucuuuugcgaaccuuucag

SEQ ID NO: 1414877 - RNA, 17 nt, Homo sapiens
aucugccuuaaaaccaa

SEQ ID NO: 1414878 - RNA, 21 nt, Homo sapiens
aucugccuuaaaaccaaagag

SEQ ID NO: 1414879 - RNA, 14 nt, Homo sapiens
aucuggauuucauc

SEQ ID NO: 1414880 - RNA, 21 nt, Homo sapiens
aucuuaacuucacuuccauua

SEQ ID NO: 1414881 - RNA, 18 nt, Homo sapiens
aucuucauguggacauug

SEQ ID NO: 1414882 - RNA, 12 nt, Homo sapiens
aucuucuuugca

SEQ ID NO: 1414883 - RNA, 15 nt, Homo sapiens
aucuugaucugcuca

SEQ ID NO: 1414884 - RNA, 14 nt, Homo sapiens
aucuuuaacugacu

SEQ ID NO: 1414885 - RNA, 12 nt, Homo sapiens
aucuuuggucau

SEQ ID NO: 1414886 - RNA, 23 nt, Homo sapiens
aucuuuguaauacauguaaauau

SEQ ID NO: 1414887 - RNA, 17 nt, Homo sapiens
aucuuuguuggcucaga

SEQ ID NO: 1414888 - RNA, 13 nt, Homo sapiens
aucuuuucauuaa

SEQ ID NO: 1414889 - RNA, 13 nt, Homo sapiens
augaacacuggcu

SEQ ID NO: 1414890 - RNA, 16 nt, Homo sapiens
augagcaauguggaua

SEQ ID NO: 1414891 - RNA, 14 nt, Homo sapiens
caaaccaccuuccc

SEQ ID NO: 1414892 - RNA, 18 nt, Homo sapiens
caaagugcugagauuaca

SEQ ID NO: 1414893 - RNA, 23 nt, Homo sapiens
caaauacaaaggaagaacaucug

SEQ ID NO: 1414894 - RNA, 16 nt, Homo sapiens
caaaucucauguucaa

SEQ ID NO: 1414895 - RNA, 16 nt, Homo sapiens
caaauuaucaagcuaa

SEQ ID NO: 1414896 - RNA, 13 nt, Homo sapiens
caaauuuaagcaa

SEQ ID NO: 1414897 - RNA, 15 nt, Homo sapiens
caaauuuaagcaaga

SEQ ID NO: 1414898 - RNA, 20 nt, Homo sapiens
caacaacuucuccauccuuu

SEQ ID NO: 1414899 - RNA, 15 nt, Homo sapiens
caacaguugcuaaac

SEQ ID NO: 1414900 - RNA, 11 nt, Homo sapiens
caacauacugu

SEQ ID NO: 1414901 - RNA, 12 nt, Homo sapiens
caacaucacuug

SEQ ID NO: 1414902 - RNA, 20 nt, Homo sapiens
caaccuguaauaaauaugag

SEQ ID NO: 1414903 - RNA, 23 nt, Homo sapiens
caaccuguaauaaauaugagugc

SEQ ID NO: 1414904 - RNA, 19 nt, Homo sapiens
caaccuuguaaauuccccu

SEQ ID NO: 1414905 - RNA, 18 nt, Homo sapiens
caacuuuuucauucccug

SEQ ID NO: 1414906 - RNA, 14 nt, Homo sapiens
caagaaugcauuaa

SEQ ID NO: 1414907 - RNA, 12 nt, Homo sapiens
caagccagugug

SEQ ID NO: 1414908 - RNA, 15 nt, Homo sapiens
caagccugcaugcau

SEQ ID NO: 1414909 - RNA, 21 nt, Homo sapiens
caagccugcguucuugugaca

SEQ ID NO: 1414910 - RNA, 18 nt, Homo sapiens
caaggaauuuucaccucc

SEQ ID NO: 1414911 - RNA, 16 nt, Homo sapiens
caagucggcuguggag

SEQ ID NO: 1414912 - RNA, 11 nt, Homo sapiens
caagucugcag

SEQ ID NO: 1414913 - RNA, 20 nt, Homo sapiens
caagugugucuccugugcug

SEQ ID NO: 1414914 - RNA, 22 nt, Homo sapiens
caagugugucuccugugcugcg

SEQ ID NO: 1414915 - RNA, 17 nt, Homo sapiens
caaguugacaaaugcca

SEQ ID NO: 1414916 - RNA, 16 nt, Homo sapiens
caaguuucauaccaaa

SEQ ID NO: 1414917 - RNA, 14 nt, Homo sapiens
caauaaaacugaug

SEQ ID NO: 1414918 - RNA, 17 nt, Homo sapiens
caauaaaggcaccuccc

SEQ ID NO: 1414919 - RNA, 21 nt, Homo sapiens
caauaaaggcaccucccccaa

SEQ ID NO: 1414920 - RNA, 13 nt, Homo sapiens
caauacaaauaca

SEQ ID NO: 1414921 - RNA, 23 nt, Homo sapiens
caaucuuugugccucaacauacu

SEQ ID NO: 1414922 - RNA, 10 nt, Homo sapiens
caaugaauua

SEQ ID NO: 1414923 - RNA, 15 nt, Homo sapiens
caaugagccacagca

SEQ ID NO: 1414924 - RNA, 19 nt, Homo sapiens
cacaaaauuaucaugacaa

SEQ ID NO: 1414925 - RNA, 18 nt, Homo sapiens
cacaaugcauaaugucuu

SEQ ID NO: 1414926 - RNA, 23 nt, Homo sapiens
cacaaugcauaaugucuuuaaaa

SEQ ID NO: 1414927 - RNA, 17 nt, Homo sapiens
cacaauuaaaucucucc

SEQ ID NO: 1414928 - RNA, 19 nt, Homo sapiens
cacaccgugugccauagaa

SEQ ID NO: 1414929 - RNA, 21 nt, Homo sapiens
cacaggaacucugugugagag

SEQ ID NO: 1414930 - RNA, 18 nt, Homo sapiens
cacaggcccuuuccucag

SEQ ID NO: 1414931 - RNA, 19 nt, Homo sapiens
cacaggcccuuuccucagg

SEQ ID NO: 1414932 - RNA, 14 nt, Homo sapiens
cacauaucuagauu

SEQ ID NO: 1414933 - RNA, 21 nt, Homo sapiens
cacauuaaaggaaaaauagca

SEQ ID NO: 1414934 - RNA, 15 nt, Homo sapiens
cacauuacauuaaca

SEQ ID NO: 1414935 - RNA, 9 nt, Homo sapiens
cacauucac

SEQ ID NO: 1414936 - RNA, 23 nt, Homo sapiens
caccacacccagccucaguccuc

SEQ ID NO: 1414937 - RNA, 18 nt, Homo sapiens
caccacaggcccuuuccu

SEQ ID NO: 1414938 - RNA, 21 nt, Homo sapiens
caccacaggcccuuuccucag

SEQ ID NO: 1414939 - RNA, 15 nt, Homo sapiens
caccccaaguccaga

SEQ ID NO: 1414940 - RNA, 14 nt, Homo sapiens
cacccccaccucaa

SEQ ID NO: 1414941 - RNA, 16 nt, Homo sapiens
caccccuguccucacu

SEQ ID NO: 1414942 - RNA, 16 nt, Homo sapiens
cacccuccuucacucc

SEQ ID NO: 1414943 - RNA, 14 nt, Homo sapiens
caccgcugcugcug

SEQ ID NO: 1414944 - RNA, 18 nt, Homo sapiens
caccgugugccauagaau

SEQ ID NO: 1414945 - RNA, 22 nt, Homo sapiens
caccucucugagcucugcauuu

SEQ ID NO: 1414946 - RNA, 20 nt, Homo sapiens
caccucugugaccucaggca

SEQ ID NO: 1414947 - RNA, 19 nt, Homo sapiens
caccuuaaugcauauuccc

SEQ ID NO: 1414948 - RNA, 17 nt, Homo sapiens
caccuucugccaugauu

SEQ ID NO: 1414949 - RNA, 14 nt, Homo sapiens
cacgccuccugcca

SEQ ID NO: 1414950 - RNA, 20 nt, Homo sapiens
cacgguguucugugauauaa

SEQ ID NO: 1414951 - RNA, 11 nt, Homo sapiens
cacgucacuug

SEQ ID NO: 1414952 - RNA, 21 nt, Homo sapiens
cacugauauuuuagucauucu

SEQ ID NO: 1414953 - RNA, 19 nt, Homo sapiens
cacugcagucugggcccca

SEQ ID NO: 1414954 - RNA, 15 nt, Homo sapiens
cacuggaucaagaau

SEQ ID NO: 1414955 - RNA, 19 nt, Homo sapiens
cacuggcgagcaggugccc

SEQ ID NO: 1414956 - RNA, 22 nt, Homo sapiens
cacuucauccugaaguuugcau

SEQ ID NO: 1414957 - RNA, 12 nt, Homo sapiens
cacuucuucagc

SEQ ID NO: 1414958 - RNA, 20 nt, Homo sapiens
cacuugggacuagaucacaa

SEQ ID NO: 1414959 - RNA, 14 nt, Homo sapiens
cacuugugucaauc

SEQ ID NO: 1414960 - RNA, 16 nt, Homo sapiens
cacuuguuucuacuca

SEQ ID NO: 1414961 - RNA, 14 nt, Homo sapiens
cagaaaauaccuua

SEQ ID NO: 1414962 - RNA, 13 nt, Homo sapiens
cagaaacaucuga

SEQ ID NO: 1414963 - RNA, 12 nt, Homo sapiens
cagaagugcccc

SEQ ID NO: 1414964 - RNA, 16 nt, Homo sapiens
cagaaugaugagucca

SEQ ID NO: 1414965 - RNA, 19 nt, Homo sapiens
cagaaugaugaguccagaa

SEQ ID NO: 1414966 - RNA, 17 nt, Homo sapiens
cagacauuccaugguga

SEQ ID NO: 1414967 - RNA, 15 nt, Homo sapiens
cagagaccguccuca

SEQ ID NO: 1414968 - RNA, 12 nt, Homo sapiens
cagagauguuca

SEQ ID NO: 1414969 - RNA, 18 nt, Homo sapiens
cagagcgagacugucuca

SEQ ID NO: 1414970 - RNA, 11 nt, Homo sapiens
cagagcugccu

SEQ ID NO: 1414971 - RNA, 14 nt, Homo sapiens
cagagcuggcagca

SEQ ID NO: 1414972 - RNA, 17 nt, Homo sapiens
cagaggucacacagccu

SEQ ID NO: 1414973 - RNA, 21 nt, Homo sapiens
cagaguuucacucuuguugcc

SEQ ID NO: 1414974 - RNA, 12 nt, Homo sapiens
cagauaaagguu

SEQ ID NO: 1414975 - RNA, 15 nt, Homo sapiens
cagaugaaaagcuac

SEQ ID NO: 1414976 - RNA, 24 nt, Homo sapiens
cagauuagaaauguaacauacuca

SEQ ID NO: 1414977 - RNA, 16 nt, Homo sapiens
cagauuggaauaggaa

SEQ ID NO: 1414978 - RNA, 12 nt, Homo sapiens
cagcaauggaug

SEQ ID NO: 1414979 - RNA, 14 nt, Homo sapiens
cagcaauggaugaa

SEQ ID NO: 1414980 - RNA, 20 nt, Homo sapiens
cagcacgccuuagcuuugca

SEQ ID NO: 1414981 - RNA, 13 nt, Homo sapiens
cagcaugauuaua

SEQ ID NO: 1414982 - RNA, 12 nt, Homo sapiens
cagccccggggu

SEQ ID NO: 1414983 - RNA, 14 nt, Homo sapiens
cagccccuagccca

SEQ ID NO: 1414984 - RNA, 17 nt, Homo sapiens
cagccuccccgugccaa

SEQ ID NO: 1414985 - RNA, 19 nt, Homo sapiens
cagccuccccgugccaaaa

SEQ ID NO: 1414986 - RNA, 19 nt, Homo sapiens
cagccuccugggacuguga

SEQ ID NO: 1414987 - RNA, 22 nt, Homo sapiens
cagccucugaccccuccucacu

SEQ ID NO: 1414988 - RNA, 21 nt, Homo sapiens
cagccucuucccaugcuggug

SEQ ID NO: 1414989 - RNA, 22 nt, Homo sapiens
cagccucuucccaugcuggugg

SEQ ID NO: 1414990 - RNA, 19 nt, Homo sapiens
cagccuggcugguccccaa

SEQ ID NO: 1414991 - RNA, 15 nt, Homo sapiens
cagcggcaaucuuuu

SEQ ID NO: 1414992 - RNA, 13 nt, Homo sapiens
cagcucacucugc

SEQ ID NO: 1414993 - RNA, 22 nt, Homo sapiens
cagcucggacuauacugcugag

SEQ ID NO: 1414994 - RNA, 15 nt, Homo sapiens
cagcugaacacccuc

SEQ ID NO: 1414995 - RNA, 15 nt, Homo sapiens
cagcugaugacucaa

SEQ ID NO: 1414996 - RNA, 21 nt, Homo sapiens
cagcugugaccacagcaguuu

SEQ ID NO: 1414997 - RNA, 19 nt, Homo sapiens
cagcuuugaaaaaacacca

SEQ ID NO: 1414998 - RNA, 21 nt, Homo sapiens
cagcuuugaaaaaacaccaug

SEQ ID NO: 1414999 - RNA, 14 nt, Homo sapiens
caggaggaaagguu

SEQ ID NO: 1415000 - RNA, 15 nt, Homo sapiens
caggagggagcauag

SEQ ID NO: 1415001 - RNA, 15 nt, Homo sapiens
caggcuaugguugcc

SEQ ID NO: 1415002 - RNA, 18 nt, Homo sapiens
caggcuggucuugaacuc

SEQ ID NO: 1415003 - RNA, 14 nt, Homo sapiens
caggcuugcauuaa

SEQ ID NO: 1415004 - RNA, 17 nt, Homo sapiens
caggggcuggcuucagg

SEQ ID NO: 1415005 - RNA, 23 nt, Homo sapiens
cagggguggggguggaggcuucc

SEQ ID NO: 1415006 - RNA, 19 nt, Homo sapiens
caggugggccgcaggcggg

SEQ ID NO: 1415007 - RNA, 17 nt, Homo sapiens
caguagaagugucacag

SEQ ID NO: 1415008 - RNA, 23 nt, Homo sapiens
caguagaagugucacagccauag

SEQ ID NO: 1415009 - RNA, 17 nt, Homo sapiens
caguagaguuguguuua

SEQ ID NO: 1415010 - RNA, 15 nt, Homo sapiens
caguggcucaaugca

SEQ ID NO: 1415011 - RNA, 19 nt, Homo sapiens
cagugggcacuaagggugg

SEQ ID NO: 1415012 - RNA, 19 nt, Homo sapiens
cagugguuuuauacugaag

SEQ ID NO: 1415013 - RNA, 20 nt, Homo sapiens
caguuguaacaauagcacaa

SEQ ID NO: 1415014 - RNA, 11 nt, Homo sapiens
cauaccaaaua

SEQ ID NO: 1415015 - RNA, 16 nt, Homo sapiens
cauacugcauuucacu

SEQ ID NO: 1415016 - RNA, 15 nt, Homo sapiens
cauagacccucucaa

SEQ ID NO: 1415017 - RNA, 23 nt, Homo sapiens
cauagaggagaggaaaaggugua

SEQ ID NO: 1415018 - RNA, 16 nt, Homo sapiens
cauagcauuuguguaa

SEQ ID NO: 1415019 - RNA, 14 nt, Homo sapiens
cauaugcagagccc

SEQ ID NO: 1415020 - RNA, 20 nt, Homo sapiens
cauauucgauguacuuuaag

SEQ ID NO: 1415021 - RNA, 22 nt, Homo sapiens
caucauccugccccuguggcau

SEQ ID NO: 1415022 - RNA, 18 nt, Homo sapiens
caucccucguggucccca

SEQ ID NO: 1415023 - RNA, 13 nt, Homo sapiens
cauccuuucugcc

SEQ ID NO: 1415024 - RNA, 14 nt, Homo sapiens
ccacagcaaaaagu

SEQ ID NO: 1415025 - RNA, 16 nt, Homo sapiens
ccacaucuugaucugc

SEQ ID NO: 1415026 - RNA, 19 nt, Homo sapiens
ccacaucuugaucugcuca

SEQ ID NO: 1415027 - RNA, 16 nt, Homo sapiens
ccacccagaacugggc

SEQ ID NO: 1415028 - RNA, 16 nt, Homo sapiens
ccaccccaaauuaaaa

SEQ ID NO: 1415029 - RNA, 15 nt, Homo sapiens
ccaccccaccagaag

SEQ ID NO: 1415030 - RNA, 19 nt, Homo sapiens
ccaccucguauuucaccuc

SEQ ID NO: 1415031 - RNA, 14 nt, Homo sapiens
ccacucuacagguc

SEQ ID NO: 1415032 - RNA, 23 nt, Homo sapiens
ccacugauuuagccaugugaaac

SEQ ID NO: 1415033 - RNA, 18 nt, Homo sapiens
ccacuucuucagcuuggg

SEQ ID NO: 1415034 - RNA, 20 nt, Homo sapiens
ccacuuggccaagcagggag

SEQ ID NO: 1415035 - RNA, 14 nt, Homo sapiens
ccagaaugacccca

SEQ ID NO: 1415036 - RNA, 22 nt, Homo sapiens
ccagaaugaccccaucgagaug

SEQ ID NO: 1415037 - RNA, 16 nt, Homo sapiens
ccagaauucugggcaa

SEQ ID NO: 1415038 - RNA, 15 nt, Homo sapiens
ccagagcagugccaa

SEQ ID NO: 1415039 - RNA, 22 nt, Homo sapiens
ccagauaaacaaauuguugacu

SEQ ID NO: 1415040 - RNA, 22 nt, Homo sapiens
ccagcaccgcugcucacucgga

SEQ ID NO: 1415041 - RNA, 17 nt, Homo sapiens
ccagcuacaggcuugag

SEQ ID NO: 1415042 - RNA, 17 nt, Homo sapiens
ccaggaaaugugcacaa

SEQ ID NO: 1415043 - RNA, 21 nt, Homo sapiens
ccaggagcugcucacuaccuc

SEQ ID NO: 1415044 - RNA, 21 nt, Homo sapiens
ccaggaggaguuagccaaaca

SEQ ID NO: 1415045 - RNA, 19 nt, Homo sapiens
ccaggcacacacugugcuu

SEQ ID NO: 1415046 - RNA, 14 nt, Homo sapiens
ccaguacucuguaa

SEQ ID NO: 1415047 - RNA, 21 nt, Homo sapiens
ccaguacucuguaaguuucug

SEQ ID NO: 1415048 - RNA, 14 nt, Homo sapiens
ccaguuggcuaggg

SEQ ID NO: 1415049 - RNA, 20 nt, Homo sapiens
ccauagaauggcacauguca

SEQ ID NO: 1415050 - RNA, 23 nt, Homo sapiens
ccauaguggacauuguuggcagc

SEQ ID NO: 1415051 - RNA, 22 nt, Homo sapiens
ccaucaugaguggugacuuaag

SEQ ID NO: 1415052 - RNA, 14 nt, Homo sapiens
ccaucuucuuugca

SEQ ID NO: 1415053 - RNA, 22 nt, Homo sapiens
ccaugcuuaucccucucucuac

SEQ ID NO: 1415054 - RNA, 18 nt, Homo sapiens
ccaugcuuccuauacagu

SEQ ID NO: 1415055 - RNA, 13 nt, Homo sapiens
ccauucuacuugc

SEQ ID NO: 1415056 - RNA, 19 nt, Homo sapiens
ccauuuguaaaacauucca

SEQ ID NO: 1415057 - RNA, 19 nt, Homo sapiens
cccagacagggcuccagcc

SEQ ID NO: 1415058 - RNA, 13 nt, Homo sapiens
cccagaucugucc

SEQ ID NO: 1415059 - RNA, 11 nt, Homo sapiens
cccagcauuug

SEQ ID NO: 1415060 - RNA, 15 nt, Homo sapiens
cccagcccagggugg

SEQ ID NO: 1415061 - RNA, 20 nt, Homo sapiens
cccagccuccaacuccagcu

SEQ ID NO: 1415062 - RNA, 21 nt, Homo sapiens
cccaggaccugagccuggcca

SEQ ID NO: 1415063 - RNA, 12 nt, Homo sapiens
cccaguccccau

SEQ ID NO: 1415064 - RNA, 17 nt, Homo sapiens
cccaguuaccugcacaa

SEQ ID NO: 1415065 - RNA, 12 nt, Homo sapiens
cccauacagggc

SEQ ID NO: 1415066 - RNA, 13 nt, Homo sapiens
cccauacagggca

SEQ ID NO: 1415067 - RNA, 17 nt, Homo sapiens
cccauaguaaugaguga

SEQ ID NO: 1415068 - RNA, 18 nt, Homo sapiens
cccaucuugggggucacc

SEQ ID NO: 1415069 - RNA, 19 nt, Homo sapiens
cccauggcuuugugcugcu

SEQ ID NO: 1415070 - RNA, 12 nt, Homo sapiens
ccccaccaguga

SEQ ID NO: 1415071 - RNA, 15 nt, Homo sapiens
ccccaggcagcuccu

SEQ ID NO: 1415072 - RNA, 22 nt, Homo sapiens
ccccaucuagcaagcacuugau

SEQ ID NO: 1415073 - RNA, 11 nt, Homo sapiens
cccccaaaggu

SEQ ID NO: 1415074 - RNA, 16 nt, Homo sapiens
cccccaacagaacucc

SEQ ID NO: 1415075 - RNA, 21 nt, Homo sapiens
cccccaaguucaagugauucu

SEQ ID NO: 1415076 - RNA, 17 nt, Homo sapiens
cccccgagcuugccuca

SEQ ID NO: 1415077 - RNA, 14 nt, Homo sapiens
ccccuaauuuucca

SEQ ID NO: 1415078 - RNA, 17 nt, Homo sapiens
ccccuccucacuggcca

SEQ ID NO: 1415079 - RNA, 16 nt, Homo sapiens
ccccugcagcugcaag

SEQ ID NO: 1415080 - RNA, 18 nt, Homo sapiens
ccccugucacacagggaa

SEQ ID NO: 1415081 - RNA, 13 nt, Homo sapiens
cccgguacagggc

SEQ ID NO: 1415082 - RNA, 15 nt, Homo sapiens
cccucucaagugccc

SEQ ID NO: 1415083 - RNA, 14 nt, Homo sapiens
cccugagcucugga

SEQ ID NO: 1415084 - RNA, 16 nt, Homo sapiens
cccugagcuggccuca

SEQ ID NO: 1415085 - RNA, 18 nt, Homo sapiens
cccugcacgccggcacca

SEQ ID NO: 1415086 - RNA, 14 nt, Homo sapiens
cccugcccugagga

SEQ ID NO: 1415087 - RNA, 21 nt, Homo sapiens
cccuguaaguuacagucacaa

SEQ ID NO: 1415088 - RNA, 19 nt, Homo sapiens
cccuuggccagaagucaag

SEQ ID NO: 1415089 - RNA, 16 nt, Homo sapiens
ccgaaaaguugcugaa

SEQ ID NO: 1415090 - RNA, 22 nt, Homo sapiens
ccgaaggugcuggaggugggag

SEQ ID NO: 1415091 - RNA, 16 nt, Homo sapiens
ccgaauuccugcguuu

SEQ ID NO: 1415092 - RNA, 17 nt, Homo sapiens
ccggggcugaagccaca

SEQ ID NO: 1415093 - RNA, 13 nt, Homo sapiens
ccgugccaaaaau

SEQ ID NO: 1415094 - RNA, 21 nt, Homo sapiens
ccgugccaaaaaucuuuucau

SEQ ID NO: 1415095 - RNA, 14 nt, Homo sapiens
ccgugcuuccucag

SEQ ID NO: 1415096 - RNA, 13 nt, Homo sapiens
ccguugcugccag

SEQ ID NO: 1415097 - RNA, 21 nt, Homo sapiens
ccuaacauacugcauuucacu

SEQ ID NO: 1415098 - RNA, 14 nt, Homo sapiens
ccuagauuccauac

SEQ ID NO: 1415099 - RNA, 20 nt, Homo sapiens
ccuagauuccauacagugac

SEQ ID NO: 1415100 - RNA, 22 nt, Homo sapiens
ccuagguauaauucacauugua

SEQ ID NO: 1415101 - RNA, 12 nt, Homo sapiens
ccuaggugggag

SEQ ID NO: 1415102 - RNA, 23 nt, Homo sapiens
ccuauacauuucuguucaucuua

SEQ ID NO: 1415103 - RNA, 20 nt, Homo sapiens
ccuaugguuuuucuguguca

SEQ ID NO: 1415104 - RNA, 11 nt, Homo sapiens
aaaaaaccaca

SEQ ID NO: 1415105 - RNA, 19 nt, Homo sapiens
aaaaauaagcugaugucca

SEQ ID NO: 1415106 - RNA, 21 nt, Homo sapiens
aaaaccugggcaccuaagcaa

SEQ ID NO: 1415107 - RNA, 19 nt, Homo sapiens
aaaacuauuuaacuugagc

SEQ ID NO: 1415108 - RNA, 20 nt, Homo sapiens
aaaacugaggccuaaaugug

SEQ ID NO: 1415109 - RNA, 16 nt, Homo sapiens
aaaacugauguuacua

SEQ ID NO: 1415110 - RNA, 22 nt, Homo sapiens
guaacuuguuuacauagcauuu

SEQ ID NO: 1415111 - RNA, 19 nt, Homo sapiens
guaagaccucugagaccaa

SEQ ID NO: 1415112 - RNA, 15 nt, Homo sapiens
guaaguuucugugac

SEQ ID NO: 1415113 - RNA, 18 nt, Homo sapiens
guaaguuucugugaccug

SEQ ID NO: 1415114 - RNA, 15 nt, Homo sapiens
guaauccaagcaaau

SEQ ID NO: 1415115 - RNA, 18 nt, Homo sapiens
guaaucucucauggugaa

SEQ ID NO: 1415116 - RNA, 14 nt, Homo sapiens
guacauauuugaaa

SEQ ID NO: 1415117 - RNA, 16 nt, Homo sapiens
guaccauucucaggug

SEQ ID NO: 1415118 - RNA, 16 nt, Homo sapiens
uagaguuguguuuacu

SEQ ID NO: 1415119 - RNA, 19 nt, Homo sapiens
uagauuaggucacauuaca

SEQ ID NO: 1415120 - RNA, 17 nt, Homo sapiens
uagauuccauacaguga

SEQ ID NO: 1415121 - RNA, 13 nt, Homo sapiens
uagcaagcacuug

SEQ ID NO: 1415122 - RNA, 15 nt, Homo sapiens
uagcaagcacuugau

SEQ ID NO: 1415123 - RNA, 22 nt, Homo sapiens
uagccaugugaaacucaucuca

SEQ ID NO: 1415124 - RNA, 12 nt, Homo sapiens
uagcuucacuca

SEQ ID NO: 1415125 - RNA, 22 nt, Homo sapiens
uagcuucugcuuuucugcccug

SEQ ID NO: 1415126 - RNA, 19 nt, Homo sapiens
uaggaugaccguuucuuaa

SEQ ID NO: 1415127 - RNA, 15 nt, Homo sapiens
uaggcagggcucucu

SEQ ID NO: 1415128 - RNA, 15 nt, Homo sapiens
uaggcauuccagcuc

SEQ ID NO: 1415129 - RNA, 16 nt, Homo sapiens
uagggacuugugucac

SEQ ID NO: 1415130 - RNA, 19 nt, Homo sapiens
uaggugaucucaguucucu

SEQ ID NO: 1415131 - RNA, 22 nt, Homo sapiens
uagugcaacuguuuugauacug

SEQ ID NO: 1415132 - RNA, 20 nt, Homo sapiens
uagugguacuucagguuuua

SEQ ID NO: 1415133 - RNA, 19 nt, Homo sapiens
uaguuguccucagguucaa

SEQ ID NO: 1415134 - RNA, 20 nt, Homo sapiens
uaguuuuguaucaaccuaaa

SEQ ID NO: 1415135 - RNA, 16 nt, Homo sapiens
uauaacaaaugcuuua

SEQ ID NO: 1415136 - RNA, 21 nt, Homo sapiens
uauaauagaugacaguggcaa

SEQ ID NO: 1415137 - RNA, 13 nt, Homo sapiens
uauaaugcuugga

SEQ ID NO: 1415138 - RNA, 14 nt, Homo sapiens
uauacaauguuaca

SEQ ID NO: 1415139 - RNA, 15 nt, Homo sapiens
uauacaauguuacaa

SEQ ID NO: 1415140 - RNA, 20 nt, Homo sapiens
uauaggcaaagaaagcucua

SEQ ID NO: 1415141 - RNA, 18 nt, Homo sapiens
uaucaguagaagugucac

SEQ ID NO: 1415142 - RNA, 16 nt, Homo sapiens
uaucauuucauauaaa

SEQ ID NO: 1415143 - RNA, 19 nt, Homo sapiens
uauccauaguggacauugu

SEQ ID NO: 1415144 - RNA, 14 nt, Homo sapiens
uaucucccaacaga

SEQ ID NO: 1415145 - RNA, 15 nt, Homo sapiens
uaucugaacugugga

SEQ ID NO: 1415146 - RNA, 21 nt, Homo sapiens
uaugaaccaaguaguauucau

SEQ ID NO: 1415147 - RNA, 12 nt, Homo sapiens
uaugaccaagag

SEQ ID NO: 1415148 - RNA, 21 nt, Homo sapiens
uaugcuucuuggagucuucca

SEQ ID NO: 1415149 - RNA, 16 nt, Homo sapiens
uauguggcugcugcug

SEQ ID NO: 1415150 - RNA, 16 nt, Homo sapiens
uauguguacgugugug

SEQ ID NO: 1415151 - RNA, 15 nt, Homo sapiens
uauuauacaauguua

SEQ ID NO: 1415152 - RNA, 13 nt, Homo sapiens
uauucaaguauuc

SEQ ID NO: 1415153 - RNA, 22 nt, Homo sapiens
uauugaaucuaaaaccaaauau

SEQ ID NO: 1415154 - RNA, 16 nt, Homo sapiens
uauuuacauuagcuga

SEQ ID NO: 1415155 - RNA, 15 nt, Homo sapiens
uauuuauaacuaaua

SEQ ID NO: 1415156 - RNA, 20 nt, Homo sapiens
uauuugucugugugcuacua

SEQ ID NO: 1415157 - RNA, 18 nt, Homo sapiens
uauuuuaugacauuuuac

SEQ ID NO: 1415158 - RNA, 17 nt, Homo sapiens
uauuuuauuuagacaag

SEQ ID NO: 1415159 - RNA, 20 nt, Homo sapiens
uauuuugggaaaaugaaggu

SEQ ID NO: 1415160 - RNA, 14 nt, Homo sapiens
ucaaaccaggauuu

SEQ ID NO: 1415161 - RNA, 18 nt, Homo sapiens
ucaaacccccaacccaaa

SEQ ID NO: 1415162 - RNA, 22 nt, Homo sapiens
ucaaagugugacauucaguguu

SEQ ID NO: 1415163 - RNA, 15 nt, Homo sapiens
ucaaaguucaaaaau

SEQ ID NO: 1415164 - RNA, 15 nt, Homo sapiens
ucaaauaaacacugu

SEQ ID NO: 1415165 - RNA, 16 nt, Homo sapiens
ucaaauaaacugaagg

SEQ ID NO: 1415166 - RNA, 15 nt, Homo sapiens
ucaacauuacauuug

SEQ ID NO: 1415167 - RNA, 15 nt, Homo sapiens
ucaacauuuaaucaa

SEQ ID NO: 1415168 - RNA, 23 nt, Homo sapiens
ucaagcccagccacguggagccu

SEQ ID NO: 1415169 - RNA, 21 nt, Homo sapiens
ucaaggcaagccccccaucua

SEQ ID NO: 1415170 - RNA, 14 nt, Homo sapiens
ucaauagugcaacu

SEQ ID NO: 1415171 - RNA, 18 nt, Homo sapiens
ucaauaugaaccaaguag

SEQ ID NO: 1415172 - RNA, 20 nt, Homo sapiens
ucaauugugcuuuguaucag

SEQ ID NO: 1415173 - RNA, 19 nt, Homo sapiens
ucacaaaucaguaaaugug

SEQ ID NO: 1415174 - RNA, 10 nt, Homo sapiens
ucacacagcc

SEQ ID NO: 1415175 - RNA, 18 nt, Homo sapiens
ucacagcaagccccuuag

SEQ ID NO: 1415176 - RNA, 18 nt, Homo sapiens
ucacauuuuaauugccac

SEQ ID NO: 1415177 - RNA, 15 nt, Homo sapiens
ucaccaugacaccug

SEQ ID NO: 1415178 - RNA, 18 nt, Homo sapiens
ucaccaugacaccugcca

SEQ ID NO: 1415179 - RNA, 15 nt, Homo sapiens
ucaccaugugacaca

SEQ ID NO: 1415180 - RNA, 15 nt, Homo sapiens
ucacccauggccuca

SEQ ID NO: 1415181 - RNA, 20 nt, Homo sapiens
ucaccugcgcagggcccucu

SEQ ID NO: 1415182 - RNA, 17 nt, Homo sapiens
ucaccuucugccaugau

SEQ ID NO: 1415183 - RNA, 19 nt, Homo sapiens
ucacucuggguaccaaauu

SEQ ID NO: 1415184 - RNA, 22 nt, Homo sapiens
ucacuugaggucaggaguuuga

SEQ ID NO: 1415185 - RNA, 17 nt, Homo sapiens
ucacuuguuucuacuca

SEQ ID NO: 1415186 - RNA, 20 nt, Homo sapiens
ucacuuguuucuacucaaaa

SEQ ID NO: 1415187 - RNA, 13 nt, Homo sapiens
ucagaaacaucug

SEQ ID NO: 1415188 - RNA, 20 nt, Homo sapiens
ucagacaauugcauugcuac

SEQ ID NO: 1415189 - RNA, 15 nt, Homo sapiens
ucagccccaggagaa

SEQ ID NO: 1415190 - RNA, 14 nt, Homo sapiens
ucagcucacucugc

SEQ ID NO: 1415191 - RNA, 15 nt, Homo sapiens
ucagcucagacauau

SEQ ID NO: 1415192 - RNA, 13 nt, Homo sapiens
ucagcugcuucuc

SEQ ID NO: 1415193 - RNA, 20 nt, Homo sapiens
ucagcuggacugcauugaag

SEQ ID NO: 1415194 - RNA, 18 nt, Homo sapiens
ucaggcaaggucuggccu

SEQ ID NO: 1415195 - RNA, 19 nt, Homo sapiens
ucaggccuugccugggaua

SEQ ID NO: 1415196 - RNA, 16 nt, Homo sapiens
ucaggcuugcauuaaa

SEQ ID NO: 1415197 - RNA, 22 nt, Homo sapiens
ucagugucaaauaaacacugug

SEQ ID NO: 1415198 - RNA, 22 nt, Homo sapiens
ucaguucugaaguuauaaacuu

SEQ ID NO: 1415199 - RNA, 15 nt, Homo sapiens
ucauagacccucuca

SEQ ID NO: 1415200 - RNA, 21 nt, Homo sapiens
ucauccuugaccucauuuaca

SEQ ID NO: 1415201 - RNA, 14 nt, Homo sapiens
ucaugaaaacuggg

SEQ ID NO: 1415202 - RNA, 13 nt, Homo sapiens
ucaugaagcccuu

SEQ ID NO: 1415203 - RNA, 18 nt, Homo sapiens
ucaugcuguguaauauca

SEQ ID NO: 1415204 - RNA, 19 nt, Homo sapiens
ucaugggagggggcuugaa

SEQ ID NO: 1415205 - RNA, 20 nt, Homo sapiens
ucauuaggaggccgagguag

SEQ ID NO: 1415206 - RNA, 13 nt, Homo sapiens
ucauuuaaccaag

SEQ ID NO: 1415207 - RNA, 16 nt, Homo sapiens
ucauuuauuaaguaua

SEQ ID NO: 1415208 - RNA, 16 nt, Homo sapiens
ucauuucaaucuuuuc

SEQ ID NO: 1415209 - RNA, 21 nt, Homo sapiens
uccaaagucucuggaauuuga

SEQ ID NO: 1415210 - RNA, 17 nt, Homo sapiens
uccaagaacaagucacc

SEQ ID NO: 1415211 - RNA, 20 nt, Homo sapiens
uccaagcaaaugugaaucau

SEQ ID NO: 1415212 - RNA, 20 nt, Homo sapiens
uccaauccuuaaacugccaa

SEQ ID NO: 1415213 - RNA, 23 nt, Homo sapiens
uccacaccaguaauaaaaagcca

SEQ ID NO: 1415214 - RNA, 21 nt, Homo sapiens
uccacgaggugaaaaauauuc

SEQ ID NO: 1415215 - RNA, 14 nt, Homo sapiens
uccagaggccaugu

SEQ ID NO: 1415216 - RNA, 16 nt, Homo sapiens
uccagcucaucugcca

SEQ ID NO: 1415217 - RNA, 16 nt, Homo sapiens
uccaggaaaugugcac

SEQ ID NO: 1415218 - RNA, 23 nt, Homo sapiens
uccaggaggaguuagccaaacaa

SEQ ID NO: 1415219 - RNA, 15 nt, Homo sapiens
uccaggcaguucucu

SEQ ID NO: 1415220 - RNA, 19 nt, Homo sapiens
uccaggcaguucucucgaa

SEQ ID NO: 1415221 - RNA, 16 nt, Homo sapiens
uccagugauaccuugu

SEQ ID NO: 1415222 - RNA, 16 nt, Homo sapiens
uccauauucuguauua

SEQ ID NO: 1415223 - RNA, 20 nt, Homo sapiens
uccauccuuucugccucuca

SEQ ID NO: 1415224 - RNA, 15 nt, Homo sapiens
uccauuaugcugcag

SEQ ID NO: 1415225 - RNA, 21 nt, Homo sapiens
ucccaaagggaggguggcaga

SEQ ID NO: 1415226 - RNA, 19 nt, Homo sapiens
ucccaaagugcugagauua

SEQ ID NO: 1415227 - RNA, 16 nt, Homo sapiens
ucccaauggccuucca

SEQ ID NO: 1415228 - RNA, 23 nt, Homo sapiens
ucccaccucucugagcucugcau

SEQ ID NO: 1415229 - RNA, 17 nt, Homo sapiens
ucccacucaccaggcac

SEQ ID NO: 1415230 - RNA, 14 nt, Homo sapiens
ucccacuuggccaa

SEQ ID NO: 1415231 - RNA, 22 nt, Homo sapiens
ucccacuuggccaagcagggag

SEQ ID NO: 1415232 - RNA, 14 nt, Homo sapiens
ucccagcauuuuga

SEQ ID NO: 1415233 - RNA, 22 nt, Homo sapiens
ucccaggggcuggcuucaggag

SEQ ID NO: 1415234 - RNA, 22 nt, Homo sapiens
ucccagguucaagcgauucuca

SEQ ID NO: 1415235 - RNA, 16 nt, Homo sapiens
ucccauggaauuggaa

SEQ ID NO: 1415236 - RNA, 21 nt, Homo sapiens
uccccagcuccucgucuuuga

SEQ ID NO: 1415237 - RNA, 17 nt, Homo sapiens
ucccccuaaggcagcug

SEQ ID NO: 1415238 - RNA, 14 nt, Homo sapiens
uccccgugccaaaa

SEQ ID NO: 1415239 - RNA, 20 nt, Homo sapiens
ucccgcguggaguucuccuc

SEQ ID NO: 1415240 - RNA, 18 nt, Homo sapiens
ucccugcccucaucucuc

SEQ ID NO: 1415241 - RNA, 13 nt, Homo sapiens
ucccuucauuuaa

SEQ ID NO: 1415242 - RNA, 12 nt, Homo sapiens
ucccuucuugga

SEQ ID NO: 1415243 - RNA, 16 nt, Homo sapiens
ucccuuugccagccuu

SEQ ID NO: 1415244 - RNA, 18 nt, Homo sapiens
uccuaaucccuuccucuc

SEQ ID NO: 1415245 - RNA, 22 nt, Homo sapiens
uccuacccaccgcccuugccga

SEQ ID NO: 1415246 - RNA, 16 nt, Homo sapiens
uccuauuccuugcuua

SEQ ID NO: 1415247 - RNA, 11 nt, Homo sapiens
uccuccaucuc

SEQ ID NO: 1415248 - RNA, 19 nt, Homo sapiens
uccuccuuuaucauuacca

SEQ ID NO: 1415249 - RNA, 17 nt, Homo sapiens
uccucucucacaaauca

SEQ ID NO: 1415250 - RNA, 15 nt, Homo sapiens
uccugaccucaggua

SEQ ID NO: 1415251 - RNA, 18 nt, Homo sapiens
uccugaugccauggaaug

SEQ ID NO: 1415252 - RNA, 16 nt, Homo sapiens
uccugcagucaauguu

SEQ ID NO: 1415253 - RNA, 23 nt, Homo sapiens
agcuauguggcugcugcugccac

SEQ ID NO: 1415254 - RNA, 12 nt, Homo sapiens
agcucacucugc

SEQ ID NO: 1415255 - RNA, 21 nt, Homo sapiens
agcucagacggccuagugugc

SEQ ID NO: 1415256 - RNA, 18 nt, Homo sapiens
agcucccagccucuuccc

SEQ ID NO: 1415257 - RNA, 18 nt, Homo sapiens
agcuccugaguggaauca

SEQ ID NO: 1415258 - RNA, 20 nt, Homo sapiens
agcucuugguucuacgugga

SEQ ID NO: 1415259 - RNA, 13 nt, Homo sapiens
agcugaugacuca

SEQ ID NO: 1415260 - RNA, 19 nt, Homo sapiens
agcugccuucccuagcuuu

SEQ ID NO: 1415261 - RNA, 23 nt, Homo sapiens
agcugggauuacaggcacaugca

SEQ ID NO: 1415262 - RNA, 12 nt, Homo sapiens
agcuguggcaca

SEQ ID NO: 1415263 - RNA, 20 nt, Homo sapiens
agcuuccauuaugcugcaga

SEQ ID NO: 1415264 - RNA, 15 nt, Homo sapiens
agcuucugcaauauu

SEQ ID NO: 1415265 - RNA, 19 nt, Homo sapiens
agcuucugcuuuucugccc

SEQ ID NO: 1415266 - RNA, 22 nt, Homo sapiens
agcuuuaguccccugagcccca

SEQ ID NO: 1415267 - RNA, 14 nt, Homo sapiens
aggaagcaagugac

SEQ ID NO: 1415268 - RNA, 12 nt, Homo sapiens
aggaaguggugu

SEQ ID NO: 1415269 - RNA, 13 nt, Homo sapiens
aggaaugauccca

SEQ ID NO: 1415270 - RNA, 16 nt, Homo sapiens
aggaaugaucccacuc

SEQ ID NO: 1415271 - RNA, 15 nt, Homo sapiens
aggaauuccagcauc

SEQ ID NO: 1415272 - RNA, 17 nt, Homo sapiens
aggaccucagcugcuuc

SEQ ID NO: 1415273 - RNA, 16 nt, Homo sapiens
aggacuguggagggga

SEQ ID NO: 1415274 - RNA, 15 nt, Homo sapiens
aggagacacauucac

SEQ ID NO: 1415275 - RNA, 18 nt, Homo sapiens
aggagagagaaagccagg

SEQ ID NO: 1415276 - RNA, 14 nt, Homo sapiens
aggagcugcucacu

SEQ ID NO: 1415277 - RNA, 15 nt, Homo sapiens
aggaggaaacuacac

SEQ ID NO: 1415278 - RNA, 14 nt, Homo sapiens
aggagggcuuugug

SEQ ID NO: 1415279 - RNA, 20 nt, Homo sapiens
aggagguggagguugcagug

SEQ ID NO: 1415280 - RNA, 19 nt, Homo sapiens
aggaguucugcucauucua

SEQ ID NO: 1415281 - RNA, 15 nt, Homo sapiens
aggauuagacaguaa

SEQ ID NO: 1415282 - RNA, 21 nt, Homo sapiens
aggcagccagauccccagggc

SEQ ID NO: 1415283 - RNA, 16 nt, Homo sapiens
aggcauuacccaaaag

SEQ ID NO: 1415284 - RNA, 15 nt, Homo sapiens
aggcccaaauuauca

SEQ ID NO: 1415285 - RNA, 16 nt, Homo sapiens
aggcucucaugucucu

SEQ ID NO: 1415286 - RNA, 12 nt, Homo sapiens
aggcugagcacc

SEQ ID NO: 1415287 - RNA, 19 nt, Homo sapiens
aggcugauggagacaguaa

SEQ ID NO: 1415288 - RNA, 16 nt, Homo sapiens
agggaaaggggugcuu

SEQ ID NO: 1415289 - RNA, 13 nt, Homo sapiens
agggaacauccug

SEQ ID NO: 1415290 - RNA, 16 nt, Homo sapiens
agggaaugugagcaca

SEQ ID NO: 1415291 - RNA, 13 nt, Homo sapiens
agggagagcaccu

SEQ ID NO: 1415292 - RNA, 16 nt, Homo sapiens
agggaggucacuggaa

SEQ ID NO: 1415293 - RNA, 21 nt, Homo sapiens
agggccugaggucuggcugcu

SEQ ID NO: 1415294 - RNA, 19 nt, Homo sapiens
agggcuuugugucuggcca

SEQ ID NO: 1415295 - RNA, 14 nt, Homo sapiens
aggggagaagccaa

SEQ ID NO: 1415296 - RNA, 19 nt, Homo sapiens
aggggaggggggagccaga

SEQ ID NO: 1415297 - RNA, 14 nt, Homo sapiens
aggggcucuggaga

SEQ ID NO: 1415298 - RNA, 14 nt, Homo sapiens
aggggcuggcuuca

SEQ ID NO: 1415299 - RNA, 21 nt, Homo sapiens
agggggacuagccccugugga

SEQ ID NO: 1415300 - RNA, 14 nt, Homo sapiens
aggggggagccaga

SEQ ID NO: 1415301 - RNA, 15 nt, Homo sapiens
aggguggacuuagaa

SEQ ID NO: 1415302 - RNA, 23 nt, Homo sapiens
aggguggacuuagaaagcagggg

SEQ ID NO: 1415303 - RNA, 19 nt, Homo sapiens
agguacuggugagggcaag

SEQ ID NO: 1415304 - RNA, 22 nt, Homo sapiens
aggugaaaagggcagaggcaag

SEQ ID NO: 1415305 - RNA, 14 nt, Homo sapiens
aggugccaccgugc

SEQ ID NO: 1415306 - RNA, 19 nt, Homo sapiens
agguucaauaugaaccaag

SEQ ID NO: 1415307 - RNA, 18 nt, Homo sapiens
agguuucuacaacauauu

SEQ ID NO: 1415308 - RNA, 18 nt, Homo sapiens
aguaaaauucuacuguau

SEQ ID NO: 1415309 - RNA, 13 nt, Homo sapiens
aguaacacuggcg

SEQ ID NO: 1415310 - RNA, 20 nt, Homo sapiens
aguagaagugucacagccau

SEQ ID NO: 1415311 - RNA, 21 nt, Homo sapiens
aguaguuuuguaucaaccuaa

SEQ ID NO: 1415312 - RNA, 14 nt, Homo sapiens
aguauauugaucca

SEQ ID NO: 1415313 - RNA, 23 nt, Homo sapiens
agucacuggagguugaagccaag

SEQ ID NO: 1415314 - RNA, 19 nt, Homo sapiens
agucccagaaugaccccau

SEQ ID NO: 1415315 - RNA, 15 nt, Homo sapiens
aguccccaccagcuc

SEQ ID NO: 1415316 - RNA, 21 nt, Homo sapiens
agucucugaacuaggugaucu

SEQ ID NO: 1415317 - RNA, 20 nt, Homo sapiens
agucugggccccaucauuaa

SEQ ID NO: 1415318 - RNA, 20 nt, Homo sapiens
agucuuccaaaccaccuucc

SEQ ID NO: 1415319 - RNA, 21 nt, Homo sapiens
agugacauguacauacuguau

SEQ ID NO: 1415320 - RNA, 19 nt, Homo sapiens
agugauuccaguauuucau

SEQ ID NO: 1415321 - RNA, 16 nt, Homo sapiens
agugcauggacaucua

SEQ ID NO: 1415322 - RNA, 15 nt, Homo sapiens
agugccccuggccaa

SEQ ID NO: 1415323 - RNA, 17 nt, Homo sapiens
agugccuuauucucaca

SEQ ID NO: 1415324 - RNA, 20 nt, Homo sapiens
agugcugggauuacaggugu

SEQ ID NO: 1415325 - RNA, 18 nt, Homo sapiens
aguggcccugauccagga

SEQ ID NO: 1415326 - RNA, 12 nt, Homo sapiens
agugggcugcug

SEQ ID NO: 1415327 - RNA, 16 nt, Homo sapiens
aguguaccauucucag

SEQ ID NO: 1415328 - RNA, 19 nt, Homo sapiens
aguguaccauucucaggug

SEQ ID NO: 1415329 - RNA, 20 nt, Homo sapiens
agugucaaauaaacacugug

SEQ ID NO: 1415330 - RNA, 16 nt, Homo sapiens
agugucacagccauag

SEQ ID NO: 1415331 - RNA, 21 nt, Homo sapiens
agugucuuugucaugcgucuc

SEQ ID NO: 1415332 - RNA, 21 nt, Homo sapiens
agugugaaaaagaguuuggcu

SEQ ID NO: 1415333 - RNA, 15 nt, Homo sapiens
aguguguauccagaa

SEQ ID NO: 1415334 - RNA, 11 nt, Homo sapiens
aguuagccaaa

SEQ ID NO: 1415335 - RNA, 14 nt, Homo sapiens
aguuagccaaacaa

SEQ ID NO: 1415336 - RNA, 13 nt, Homo sapiens
aguucagaaggaa

SEQ ID NO: 1415337 - RNA, 14 nt, Homo sapiens
aguucuaugcagaa

SEQ ID NO: 1415338 - RNA, 15 nt, Homo sapiens
aguucuuuucaugca

SEQ ID NO: 1415339 - RNA, 17 nt, Homo sapiens
aguugaagccgucucau

SEQ ID NO: 1415340 - RNA, 18 nt, Homo sapiens
aguugcaacuuuguauaa

SEQ ID NO: 1415341 - RNA, 12 nt, Homo sapiens
aguugcauuuaa

SEQ ID NO: 1415342 - RNA, 18 nt, Homo sapiens
aguuggcuaggggagcag

SEQ ID NO: 1415343 - RNA, 16 nt, Homo sapiens
aguuucagagugugga

SEQ ID NO: 1415344 - RNA, 15 nt, Homo sapiens
aguuuccccucucau

SEQ ID NO: 1415345 - RNA, 18 nt, Homo sapiens
aguuuccuucccuaccca

SEQ ID NO: 1415346 - RNA, 14 nt, Homo sapiens
aguuucugugaccu

SEQ ID NO: 1415347 - RNA, 19 nt, Homo sapiens
aguuuuguaucaaccuaaa

SEQ ID NO: 1415348 - RNA, 17 nt, Homo sapiens
auaaaagguuguguaca

SEQ ID NO: 1415349 - RNA, 14 nt, Homo sapiens
auaaacacugugua

SEQ ID NO: 1415350 - RNA, 16 nt, Homo sapiens
auaaacuuauaaucaa

SEQ ID NO: 1415351 - RNA, 20 nt, Homo sapiens
auaaagcaauuuuccuugaa

SEQ ID NO: 1415352 - RNA, 23 nt, Homo sapiens
auaaagcauaggguaguuugcaa

SEQ ID NO: 1415353 - RNA, 16 nt, Homo sapiens
auaaagcuucucucug

SEQ ID NO: 1415354 - RNA, 20 nt, Homo sapiens
auaaagguucaugcaaacuu

SEQ ID NO: 1415355 - RNA, 15 nt, Homo sapiens
auaaaguuuguugaa

SEQ ID NO: 1415356 - RNA, 14 nt, Homo sapiens
auaaauaugagugc

SEQ ID NO: 1415357 - RNA, 13 nt, Homo sapiens
auaacaguuauaa

SEQ ID NO: 1415358 - RNA, 14 nt, Homo sapiens
auaacauuuuccca

SEQ ID NO: 1415359 - RNA, 19 nt, Homo sapiens
auaagauuuuguuagccaa

SEQ ID NO: 1415360 - RNA, 16 nt, Homo sapiens
auaagcugauguccag

SEQ ID NO: 1415361 - RNA, 22 nt, Homo sapiens
auaagcugccuaggcagccagc

SEQ ID NO: 1415362 - RNA, 21 nt, Homo sapiens
auaaguguguguuuuucauaa

SEQ ID NO: 1415363 - RNA, 22 nt, Homo sapiens
auaaguguguguuuuucauaaa

SEQ ID NO: 1415364 - RNA, 14 nt, Homo sapiens
auaauaaauuguca

SEQ ID NO: 1415365 - RNA, 20 nt, Homo sapiens
auaaucccagcuacuuggga

SEQ ID NO: 1415366 - RNA, 15 nt, Homo sapiens
auaauggcauguauu

SEQ ID NO: 1415367 - RNA, 15 nt, Homo sapiens
auaauuguugaccua

SEQ ID NO: 1415368 - RNA, 21 nt, Homo sapiens
auacaaaggaagaacaucugg

SEQ ID NO: 1415369 - RNA, 19 nt, Homo sapiens
auacagaauugugucugca

SEQ ID NO: 1415370 - RNA, 21 nt, Homo sapiens
auacaggaugaugacuaugga

SEQ ID NO: 1415371 - RNA, 18 nt, Homo sapiens
auacaguucuaugcagaa

SEQ ID NO: 1415372 - RNA, 18 nt, Homo sapiens
auacugaaggaaaaacac

SEQ ID NO: 1415373 - RNA, 19 nt, Homo sapiens
auacugcauuucacucugg

SEQ ID NO: 1415374 - RNA, 21 nt, Homo sapiens
auagacccucucaagugcccu

SEQ ID NO: 1415375 - RNA, 12 nt, Homo sapiens
auagaggcuucu

SEQ ID NO: 1415376 - RNA, 14 nt, Homo sapiens
auaggcacaggaaa

SEQ ID NO: 1415377 - RNA, 22 nt, Homo sapiens
auaggugaaggaacuagggaua

SEQ ID NO: 1415378 - RNA, 20 nt, Homo sapiens
auaguaaaauucuacuguau

SEQ ID NO: 1415379 - RNA, 11 nt, Homo sapiens
auaguauuaag

SEQ ID NO: 1415380 - RNA, 19 nt, Homo sapiens
gaccaccaacacacaggaa

SEQ ID NO: 1415381 - RNA, 20 nt, Homo sapiens
gaccucauuuacaaagcaaa

SEQ ID NO: 1415382 - RNA, 20 nt, Homo sapiens
gaccugagccuggccauguc

SEQ ID NO: 1415383 - RNA, 14 nt, Homo sapiens
gacgccaccuuccc

SEQ ID NO: 1415384 - RNA, 18 nt, Homo sapiens
gacuagauuucaagcuaa

SEQ ID NO: 1415385 - RNA, 18 nt, Homo sapiens
gacuaugaucucauccca

SEQ ID NO: 1415386 - RNA, 15 nt, Homo sapiens
gacucaacauuacau

SEQ ID NO: 1415387 - RNA, 14 nt, Homo sapiens
gacuccccugggca

SEQ ID NO: 1415388 - RNA, 13 nt, Homo sapiens
aauaaugacuaaa

SEQ ID NO: 1415389 - RNA, 15 nt, Homo sapiens
aauaaugacuaaaga

SEQ ID NO: 1415390 - RNA, 13 nt, Homo sapiens
aauagauaccacc

SEQ ID NO: 1415391 - RNA, 15 nt, Homo sapiens
aauagaugacagugg

SEQ ID NO: 1415392 - RNA, 23 nt, Homo sapiens
aauagcuuggaaaaguaacaucu

SEQ ID NO: 1415393 - RNA, 12 nt, Homo sapiens
aauauagccaug

SEQ ID NO: 1415394 - RNA, 17 nt, Homo sapiens
aauauccugauuuucag

SEQ ID NO: 1415395 - RNA, 16 nt, Homo sapiens
aauaugccaaacacau

SEQ ID NO: 1415396 - RNA, 13 nt, Homo sapiens
aaucaaagccacu

SEQ ID NO: 1415397 - RNA, 12 nt, Homo sapiens
aaucaauagugc

SEQ ID NO: 1415398 - RNA, 20 nt, Homo sapiens
aaucacauuuuaauugccac

SEQ ID NO: 1415399 - RNA, 17 nt, Homo sapiens
aaucaugcuguguaaua

SEQ ID NO: 1415400 - RNA, 13 nt, Homo sapiens
aaucaugugccag

SEQ ID NO: 1415401 - RNA, 21 nt, Homo sapiens
aauccagccugcugccugcuu

SEQ ID NO: 1415402 - RNA, 16 nt, Homo sapiens
aaucccggugcuugca

SEQ ID NO: 1415403 - RNA, 16 nt, Homo sapiens
aauccuuaaacugcca

SEQ ID NO: 1415404 - RNA, 17 nt, Homo sapiens
aaucuaugugcaccguu

SEQ ID NO: 1415405 - RNA, 16 nt, Homo sapiens
aaucugcuuuucaugu

SEQ ID NO: 1415406 - RNA, 16 nt, Homo sapiens
aaucuuugugccucaa

SEQ ID NO: 1415407 - RNA, 19 nt, Homo sapiens
aaugagugaguucucacuc

SEQ ID NO: 1415408 - RNA, 22 nt, Homo sapiens
aaugagugaguucucacucugg

SEQ ID NO: 1415409 - RNA, 12 nt, Homo sapiens
aaugauucucaa

SEQ ID NO: 1415410 - RNA, 15 nt, Homo sapiens
aauggcacaugucau

SEQ ID NO: 1415411 - RNA, 20 nt, Homo sapiens
aauggguuugccaagcccuu

SEQ ID NO: 1415412 - RNA, 14 nt, Homo sapiens
aauguaacauacuc

SEQ ID NO: 1415413 - RNA, 18 nt, Homo sapiens
aaugucacggcuacucua

SEQ ID NO: 1415414 - RNA, 13 nt, Homo sapiens
aaugugauuuugg

SEQ ID NO: 1415415 - RNA, 11 nt, Homo sapiens
aaugugcuguu

SEQ ID NO: 1415416 - RNA, 13 nt, Homo sapiens
aauuaacaucaaa

SEQ ID NO: 1415417 - RNA, 19 nt, Homo sapiens
aauuagugguacuucaggu

SEQ ID NO: 1415418 - RNA, 17 nt, Homo sapiens
aauuaugcugcauuugg

SEQ ID NO: 1415419 - RNA, 17 nt, Homo sapiens
aauugagcagcaugauu

SEQ ID NO: 1415420 - RNA, 19 nt, Homo sapiens
aauugcaccugaaaaaccu

SEQ ID NO: 1415421 - RNA, 22 nt, Homo sapiens
aauuggaacuccuauuccuugc

SEQ ID NO: 1415422 - RNA, 15 nt, Homo sapiens
aauuuccacuuuauu

SEQ ID NO: 1415423 - RNA, 19 nt, Homo sapiens
aauuucuccucccuuccuu

SEQ ID NO: 1415424 - RNA, 16 nt, Homo sapiens
aauuuucugugccaaa

SEQ ID NO: 1415425 - RNA, 15 nt, Homo sapiens
acaaaaaaguuauaa

SEQ ID NO: 1415426 - RNA, 20 nt, Homo sapiens
acaaaaaaugugcuguucaa

SEQ ID NO: 1415427 - RNA, 22 nt, Homo sapiens
acaaaauuaucaugacaaauau

SEQ ID NO: 1415428 - RNA, 23 nt, Homo sapiens
acaaagcaaaaagagaugcugga

SEQ ID NO: 1415429 - RNA, 12 nt, Homo sapiens
acaaauaugcag

SEQ ID NO: 1415430 - RNA, 17 nt, Homo sapiens
acaaaugagugauucca

SEQ ID NO: 1415431 - RNA, 15 nt, Homo sapiens
acaaccggaugccag

SEQ ID NO: 1415432 - RNA, 12 nt, Homo sapiens
acaacgcugcug

SEQ ID NO: 1415433 - RNA, 17 nt, Homo sapiens
acaauggcgugaucuca

SEQ ID NO: 1415434 - RNA, 18 nt, Homo sapiens
acaauggcgugaucucag

SEQ ID NO: 1415435 - RNA, 22 nt, Homo sapiens
acaauggcgugaucucagcuca

SEQ ID NO: 1415436 - RNA, 16 nt, Homo sapiens
acaauuaaaucucucc

SEQ ID NO: 1415437 - RNA, 17 nt, Homo sapiens
acacaaguggccuuaag

SEQ ID NO: 1415438 - RNA, 22 nt, Homo sapiens
acacaggaacucugugugagag

SEQ ID NO: 1415439 - RNA, 13 nt, Homo sapiens
acacauacacaca

SEQ ID NO: 1415440 - RNA, 22 nt, Homo sapiens
acacauuaaaggaaaaauagca

SEQ ID NO: 1415441 - RNA, 21 nt, Homo sapiens
acacccagccucaguccuccc

SEQ ID NO: 1415442 - RNA, 18 nt, Homo sapiens
acaccgugugccauagaa

SEQ ID NO: 1415443 - RNA, 15 nt, Homo sapiens
acacuuuaccaggag

SEQ ID NO: 1415444 - RNA, 19 nt, Homo sapiens
acagaaccauaaagcauau

SEQ ID NO: 1415445 - RNA, 13 nt, Homo sapiens
acagacacuuuaa

SEQ ID NO: 1415446 - RNA, 21 nt, Homo sapiens
acagacacuuuaaaagcuucu

SEQ ID NO: 1415447 - RNA, 17 nt, Homo sapiens
acagagacacuuuacca

SEQ ID NO: 1415448 - RNA, 22 nt, Homo sapiens
acagauuauaauaaauugucau

SEQ ID NO: 1415449 - RNA, 14 nt, Homo sapiens
acagcauaccucaa

SEQ ID NO: 1415450 - RNA, 16 nt, Homo sapiens
acagcgacauagccca

SEQ ID NO: 1415451 - RNA, 22 nt, Homo sapiens
acagcuuuguaauaagaaaaau

SEQ ID NO: 1415452 - RNA, 15 nt, Homo sapiens
acaggaugaugacua

SEQ ID NO: 1415453 - RNA, 14 nt, Homo sapiens
acaggcacaaguca

SEQ ID NO: 1415454 - RNA, 14 nt, Homo sapiens
acaguaacacuggc

SEQ ID NO: 1415455 - RNA, 20 nt, Homo sapiens
acaguaaguaguaaugauuc

SEQ ID NO: 1415456 - RNA, 22 nt, Homo sapiens
acagugagccaaauaaaccucu

SEQ ID NO: 1415457 - RNA, 16 nt, Homo sapiens
acaguguaucaacaaa

SEQ ID NO: 1415458 - RNA, 23 nt, Homo sapiens
acaguucuaugcagaacagugag

SEQ ID NO: 1415459 - RNA, 15 nt, Homo sapiens
acaguuuucuauucu

SEQ ID NO: 1415460 - RNA, 18 nt, Homo sapiens
acauacugcauuucacuc

SEQ ID NO: 1415461 - RNA, 21 nt, Homo sapiens
acauacugcauuucacucugg

SEQ ID NO: 1415462 - RNA, 15 nt, Homo sapiens
acauaucuagauuuu

SEQ ID NO: 1415463 - RNA, 22 nt, Homo sapiens
acauaugguuaaguaauugcau

SEQ ID NO: 1415464 - RNA, 22 nt, Homo sapiens
acaucaaguguaauuagcuuuu

SEQ ID NO: 1415465 - RNA, 13 nt, Homo sapiens
acaucauauaccu

SEQ ID NO: 1415466 - RNA, 15 nt, Homo sapiens
acauccugcagcuua

SEQ ID NO: 1415467 - RNA, 14 nt, Homo sapiens
acaucuguucuuug

SEQ ID NO: 1415468 - RNA, 23 nt, Homo sapiens
acaugaauauuuaguguucauaa

SEQ ID NO: 1415469 - RNA, 14 nt, Homo sapiens
acauuacaagguca

SEQ ID NO: 1415470 - RNA, 22 nt, Homo sapiens
acauuacagguuaugcuuugag

SEQ ID NO: 1415471 - RNA, 17 nt, Homo sapiens
acauuugcuagugacau

SEQ ID NO: 1415472 - RNA, 23 nt, Homo sapiens
acauuuucucugaugaugucaca

SEQ ID NO: 1415473 - RNA, 19 nt, Homo sapiens
accaauggguuugccaagc

SEQ ID NO: 1415474 - RNA, 11 nt, Homo sapiens
accacagcagu

SEQ ID NO: 1415475 - RNA, 21 nt, Homo sapiens
accacaggcccuuuccucagg

SEQ ID NO: 1415476 - RNA, 14 nt, Homo sapiens
accacgcccagcua

SEQ ID NO: 1415477 - RNA, 22 nt, Homo sapiens
accacuucccgccuccaugacu

SEQ ID NO: 1415478 - RNA, 17 nt, Homo sapiens
accagagugauggauuu

SEQ ID NO: 1415479 - RNA, 23 nt, Homo sapiens
accagccuccugggacugugacu

SEQ ID NO: 1415480 - RNA, 15 nt, Homo sapiens
accaggagcugcuca

SEQ ID NO: 1415481 - RNA, 22 nt, Homo sapiens
accaguaauaaaaagccaccac

SEQ ID NO: 1415482 - RNA, 17 nt, Homo sapiens
accaugacaccugccau

SEQ ID NO: 1415483 - RNA, 19 nt, Homo sapiens
acccaauaaaacugauguu

SEQ ID NO: 1415484 - RNA, 16 nt, Homo sapiens
acccacaagaacuccu

SEQ ID NO: 1415485 - RNA, 20 nt, Homo sapiens
acccacaagaacuccuccca

SEQ ID NO: 1415486 - RNA, 12 nt, Homo sapiens
acccagccaggc

SEQ ID NO: 1415487 - RNA, 17 nt, Homo sapiens
accccaaggaccugccu

SEQ ID NO: 1415488 - RNA, 12 nt, Homo sapiens
accccaagucca

SEQ ID NO: 1415489 - RNA, 19 nt, Homo sapiens
accccaccagaagugcccc

SEQ ID NO: 1415490 - RNA, 23 nt, Homo sapiens
acccccauggugacaucacucua

SEQ ID NO: 1415491 - RNA, 16 nt, Homo sapiens
accccgauagugacac

SEQ ID NO: 1415492 - RNA, 21 nt, Homo sapiens
accccgauagugacacaucuu

SEQ ID NO: 1415493 - RNA, 18 nt, Homo sapiens
accccuguccucacugcu

SEQ ID NO: 1415494 - RNA, 19 nt, Homo sapiens
acccucugccaccagagac

SEQ ID NO: 1415495 - RNA, 13 nt, Homo sapiens
acccuguccuccc

SEQ ID NO: 1415496 - RNA, 14 nt, Homo sapiens
accgagagccaaac

SEQ ID NO: 1415497 - RNA, 22 nt, Homo sapiens
accgcccuggcuaacaugguga

SEQ ID NO: 1415498 - RNA, 13 nt, Homo sapiens
accgcugcugcug

SEQ ID NO: 1415499 - RNA, 12 nt, Homo sapiens
accuaagcaaug

SEQ ID NO: 1415500 - RNA, 22 nt, Homo sapiens
accuacugaaucagaaauguaa

SEQ ID NO: 1415501 - RNA, 14 nt, Homo sapiens
accuagauuccaua

SEQ ID NO: 1415502 - RNA, 15 nt, Homo sapiens
accuagauuccauac

SEQ ID NO: 1415503 - RNA, 14 nt, Homo sapiens
accucaagugccuu

SEQ ID NO: 1415504 - RNA, 22 nt, Homo sapiens
accucaagugccuuauucucac

SEQ ID NO: 1415505 - RNA, 14 nt, Homo sapiens
accucacucuugcc

SEQ ID NO: 1415506 - RNA, 15 nt, Homo sapiens
accucacucuugcca

SEQ ID NO: 1415507 - RNA, 16 nt, Homo sapiens
accucacucuugccaa

SEQ ID NO: 1415508 - RNA, 22 nt, Homo sapiens
accucacucuugccaaccugua

SEQ ID NO: 1415509 - RNA, 19 nt, Homo sapiens
accuccaucuucuuugcag

SEQ ID NO: 1415510 - RNA, 16 nt, Homo sapiens
accuccccagacaggg

SEQ ID NO: 1415511 - RNA, 12 nt, Homo sapiens
accucuccuucc

SEQ ID NO: 1415512 - RNA, 17 nt, Homo sapiens
accuguaauaaauauga

SEQ ID NO: 1415513 - RNA, 11 nt, Homo sapiens
accugugacaa

SEQ ID NO: 1415514 - RNA, 12 nt, Homo sapiens
accuuccuugcg

SEQ ID NO: 1415515 - RNA, 19 nt, Homo sapiens
uucccguuagucucugaac

SEQ ID NO: 1415516 - RNA, 12 nt, Homo sapiens
uuccucaggcaa

SEQ ID NO: 1415517 - RNA, 12 nt, Homo sapiens
uuccuucuugcc

SEQ ID NO: 1415518 - RNA, 13 nt, Homo sapiens
uucgauguacuuu

SEQ ID NO: 1415519 - RNA, 15 nt, Homo sapiens
uucuacguggaugau

SEQ ID NO: 1415520 - RNA, 17 nt, Homo sapiens
uucuacguggauguucu

SEQ ID NO: 1415521 - RNA, 20 nt, Homo sapiens
uucucaucuaaauauuucca

SEQ ID NO: 1415522 - RNA, 20 nt, Homo sapiens
uucucuccagagcuccugag

SEQ ID NO: 1415523 - RNA, 21 nt, Homo sapiens
uucugaccuugugaacaucag

SEQ ID NO: 1415524 - RNA, 18 nt, Homo sapiens
uucugagccaaauucuaa

SEQ ID NO: 1415525 - RNA, 18 nt, Homo sapiens
uucugcucuguucuggau

SEQ ID NO: 1415526 - RNA, 17 nt, Homo sapiens
uucuggauucuuggccc

SEQ ID NO: 1415527 - RNA, 19 nt, Homo sapiens
uucuguagaaggcaagagu

SEQ ID NO: 1415528 - RNA, 15 nt, Homo sapiens
uugaaaggaugguau

SEQ ID NO: 1415529 - RNA, 23 nt, Homo sapiens
uugaaaggaugguauugaaucua

SEQ ID NO: 1415530 - RNA, 11 nt, Homo sapiens
uugaacaaagu

SEQ ID NO: 1415531 - RNA, 12 nt, Homo sapiens
uugaacugccaa

SEQ ID NO: 1415532 - RNA, 11 nt, Homo sapiens
uugaagccaaa

SEQ ID NO: 1415533 - RNA, 20 nt, Homo sapiens
uugaaucuaaaaccaaauau

SEQ ID NO: 1415534 - RNA, 13 nt, Homo sapiens
uugauacauucag

SEQ ID NO: 1415535 - RNA, 21 nt, Homo sapiens
uugccacugauuuagccaugu

SEQ ID NO: 1415536 - RNA, 18 nt, Homo sapiens
uugcccaaaaugucaauu

SEQ ID NO: 1415537 - RNA, 21 nt, Homo sapiens
uugccgaaccaggagcugcuc

SEQ ID NO: 1415538 - RNA, 21 nt, Homo sapiens
uugccugggauaucacuucau

SEQ ID NO: 1415539 - RNA, 22 nt, Homo sapiens
uugcuaaacgccacggagcuca

SEQ ID NO: 1415540 - RNA, 19 nt, Homo sapiens
uugcuaauauaauagauga

SEQ ID NO: 1415541 - RNA, 22 nt, Homo sapiens
uugcucucucucaccaugugac

SEQ ID NO: 1415542 - RNA, 13 nt, Homo sapiens
uuggcugauuccu

SEQ ID NO: 1415543 - RNA, 21 nt, Homo sapiens
uugguauuaauuugacugugc

SEQ ID NO: 1415544 - RNA, 12 nt, Homo sapiens
uuguaucucauu

SEQ ID NO: 1415545 - RNA, 12 nt, Homo sapiens
uuguccucaggu

SEQ ID NO: 1415546 - RNA, 14 nt, Homo sapiens
uugucugugugcua

SEQ ID NO: 1415547 - RNA, 23 nt, Homo sapiens
uugugcaaguugacaaaugccaa

SEQ ID NO: 1415548 - RNA, 23 nt, Homo sapiens
uugugccucaacauacuguugau

SEQ ID NO: 1415549 - RNA, 23 nt, Homo sapiens
uugugucaaucaugcuguguaau

SEQ ID NO: 1415550 - RNA, 17 nt, Homo sapiens
uugugucacugacucag

SEQ ID NO: 1415551 - RNA, 16 nt, Homo sapiens
uugugucugcaggauu

SEQ ID NO: 1415552 - RNA, 16 nt, Homo sapiens
uuguucagacauucca

SEQ ID NO: 1415553 - RNA, 13 nt, Homo sapiens
uuguuggcucaga

SEQ ID NO: 1415554 - RNA, 23 nt, Homo sapiens
uuuaaaaauaagccacauaucua

SEQ ID NO: 1415555 - RNA, 15 nt, Homo sapiens
uuuaaaaucagugau

SEQ ID NO: 1415556 - RNA, 12 nt, Homo sapiens
uuuaaauucaug

SEQ ID NO: 1415557 - RNA, 17 nt, Homo sapiens
uuuaacuggagcagaga

SEQ ID NO: 1415558 - RNA, 14 nt, Homo sapiens
uuuaagucagcaaa

SEQ ID NO: 1415559 - RNA, 13 nt, Homo sapiens
uuuaaugcaauga

SEQ ID NO: 1415560 - RNA, 20 nt, Homo sapiens
uuuaaugcaaugagcaaugu

SEQ ID NO: 1415561 - RNA, 17 nt, Homo sapiens
uuuaauuuuacauuucc

SEQ ID NO: 1415562 - RNA, 20 nt, Homo sapiens
uuuacccuccuguaagcaac

SEQ ID NO: 1415563 - RNA, 14 nt, Homo sapiens
uuuaugacauuuua

SEQ ID NO: 1415564 - RNA, 15 nt, Homo sapiens
uuuauuggccuuaca

SEQ ID NO: 1415565 - RNA, 19 nt, Homo sapiens
uuucagcuuuaagauaucu

SEQ ID NO: 1415566 - RNA, 20 nt, Homo sapiens
uuucaguguuggcaagcucu

SEQ ID NO: 1415567 - RNA, 16 nt, Homo sapiens
uuuccucucucacaaa

SEQ ID NO: 1415568 - RNA, 13 nt, Homo sapiens
uuuccuucuugcc

SEQ ID NO: 1415569 - RNA, 22 nt, Homo sapiens
uuucgucaccugacugcaauga

SEQ ID NO: 1415570 - RNA, 15 nt, Homo sapiens
uuucuccuuucacca

SEQ ID NO: 1415571 - RNA, 18 nt, Homo sapiens
uuugagacagaguuucac

SEQ ID NO: 1415572 - RNA, 14 nt, Homo sapiens
uuugauugagagua

SEQ ID NO: 1415573 - RNA, 22 nt, Homo sapiens
uuugcaagccugcaugcauuca

SEQ ID NO: 1415574 - RNA, 12 nt, Homo sapiens
uuugccacugau

SEQ ID NO: 1415575 - RNA, 18 nt, Homo sapiens
uuugcuagugacauguac

SEQ ID NO: 1415576 - RNA, 20 nt, Homo sapiens
uuuggaacagcaugcugcug

SEQ ID NO: 1415577 - RNA, 22 nt, Homo sapiens
uuuggucauuucccucuguaau

SEQ ID NO: 1415578 - RNA, 22 nt, Homo sapiens
uuugucccaucgguagcuugaa

SEQ ID NO: 1415579 - RNA, 14 nt, Homo sapiens
uuuguuuucaauga

SEQ ID NO: 1415580 - RNA, 14 nt, Homo sapiens
uuuuaccuuugaca

SEQ ID NO: 1415581 - RNA, 16 nt, Homo sapiens
uuuucaagcuacgugu

SEQ ID NO: 1415582 - RNA, 13 nt, Homo sapiens
uuuuccucucuca

SEQ ID NO: 1415583 - RNA, 15 nt, Homo sapiens
uuuucucagugucca

SEQ ID NO: 1415584 - RNA, 17 nt, Homo sapiens
uuuucuguuuauuuugc

SEQ ID NO: 1415585 - RNA, 13 nt, Homo sapiens
uuuuguaucucau

SEQ ID NO: 1415586 - RNA, 15 nt, Homo sapiens
uuuugugugugucua

SEQ ID NO: 1415587 - RNA, 18 nt, Homo sapiens
uuuuguuagccaacauaa

SEQ ID NO: 1415588 - RNA, 13 nt, Homo sapiens
uuuuguuaucuga

SEQ ID NO: 1415589 - RNA, 14 nt, Homo sapiens
aaaaaaaaaaccac

SEQ ID NO: 1415590 - RNA, 13 nt, Homo sapiens
aaaaagcuuuacu

SEQ ID NO: 1415591 - RNA, 17 nt, Homo sapiens
aaaaaucuuuucauuaa

SEQ ID NO: 1415592 - RNA, 17 nt, Homo sapiens
aaaacaaaaaaugugcu

SEQ ID NO: 1415593 - RNA, 22 nt, Homo sapiens
aaaacaacccacggcucaacuc

SEQ ID NO: 1415594 - RNA, 23 nt, Homo sapiens
aaaacagggauuuugaauaugcc

SEQ ID NO: 1415595 - RNA, 19 nt, Homo sapiens
aaaacauuccaaauaauuc

SEQ ID NO: 1415596 - RNA, 23 nt, Homo sapiens
aaaacuaacucagguguauuuau

SEQ ID NO: 1415597 - RNA, 22 nt, Homo sapiens
aaaagagaaugaugcugugcau

SEQ ID NO: 1415598 - RNA, 16 nt, Homo sapiens
aaaagagaugcuggau

SEQ ID NO: 1415599 - RNA, 22 nt, Homo sapiens
aaaagagaugcuggauucagau

SEQ ID NO: 1415600 - RNA, 18 nt, Homo sapiens
aaaagcuaaugucuucua

SEQ ID NO: 1415601 - RNA, 15 nt, Homo sapiens
aaaagggacugagaa

SEQ ID NO: 1415602 - RNA, 17 nt, Homo sapiens
aaaagggcagaggcaag

SEQ ID NO: 1415603 - RNA, 19 nt, Homo sapiens
aaaauaccccuaacauacu

SEQ ID NO: 1415604 - RNA, 23 nt, Homo sapiens
aaaauaccccuaacauacugcau

SEQ ID NO: 1415605 - RNA, 14 nt, Homo sapiens
aaaauagcagagau

SEQ ID NO: 1415606 - RNA, 17 nt, Homo sapiens
aaaaucccuuaaucuau

SEQ ID NO: 1415607 - RNA, 14 nt, Homo sapiens
aaaauguuaugcag

SEQ ID NO: 1415608 - RNA, 12 nt, Homo sapiens
aaacaccaugaa

SEQ ID NO: 1415609 - RNA, 13 nt, Homo sapiens
aaacaccaugaag

SEQ ID NO: 1415610 - RNA, 23 nt, Homo sapiens
aaacacccccagauucuucgcac

SEQ ID NO: 1415611 - RNA, 18 nt, Homo sapiens
aaaccaaagagggcuucc

SEQ ID NO: 1415612 - RNA, 13 nt, Homo sapiens
aaaccaccuuccc

SEQ ID NO: 1415613 - RNA, 19 nt, Homo sapiens
aaacccugagccaccgugu

SEQ ID NO: 1415614 - RNA, 12 nt, Homo sapiens
aaaccucauugu

SEQ ID NO: 1415615 - RNA, 21 nt, Homo sapiens
aaaccugaaauauauuuuaaa

SEQ ID NO: 1415616 - RNA, 18 nt, Homo sapiens
aaacuuuaucucacaggg

SEQ ID NO: 1415617 - RNA, 21 nt, Homo sapiens
aaacuuuuuaauaaaguauau

SEQ ID NO: 1415618 - RNA, 16 nt, Homo sapiens
aaagaaguucauuccu

SEQ ID NO: 1415619 - RNA, 21 nt, Homo sapiens
aaagacuaugaucucauccca

SEQ ID NO: 1415620 - RNA, 23 nt, Homo sapiens
aaagaugcauguuacugccaaaa

SEQ ID NO: 1415621 - RNA, 17 nt, Homo sapiens
aaagcaagcucuucucc

SEQ ID NO: 1415622 - RNA, 13 nt, Homo sapiens
aaagcaauaagcu

SEQ ID NO: 1415623 - RNA, 17 nt, Homo sapiens
aaagcaucuaucucauc

SEQ ID NO: 1415624 - RNA, 14 nt, Homo sapiens
aaagcccugacgga

SEQ ID NO: 1415625 - RNA, 14 nt, Homo sapiens
aaagccucuggaaa

SEQ ID NO: 1415626 - RNA, 22 nt, Homo sapiens
aaagccucuggaaaacucagga

SEQ ID NO: 1415627 - RNA, 19 nt, Homo sapiens
aaagcuaaacguaauuucc

SEQ ID NO: 1415628 - RNA, 13 nt, Homo sapiens
aaagcuaaugucu

SEQ ID NO: 1415629 - RNA, 19 nt, Homo sapiens
aaagcucucaauuaagugu

SEQ ID NO: 1415630 - RNA, 18 nt, Homo sapiens
aaagcuucugcaauauua

SEQ ID NO: 1415631 - RNA, 20 nt, Homo sapiens
aaaggaugguauugaaucua

SEQ ID NO: 1415632 - RNA, 17 nt, Homo sapiens
aaaggcaccucccccaa

SEQ ID NO: 1415633 - RNA, 15 nt, Homo sapiens
aaagggacugagaaa

SEQ ID NO: 1415634 - RNA, 21 nt, Homo sapiens
aaagguaaaucagacuaugaa

SEQ ID NO: 1415635 - RNA, 21 nt, Homo sapiens
aaaguaaagaacaacaacaaa

SEQ ID NO: 1415636 - RNA, 20 nt, Homo sapiens
aaagucuguggcccaagaga

SEQ ID NO: 1415637 - RNA, 23 nt, Homo sapiens
aaaguguaacggccaacacuuug

SEQ ID NO: 1415638 - RNA, 15 nt, Homo sapiens
aaagugugacauuca

SEQ ID NO: 1415639 - RNA, 20 nt, Homo sapiens
aaaguuaaacuuuaucucac

SEQ ID NO: 1415640 - RNA, 17 nt, Homo sapiens
aaaguuuuguaccauuu

SEQ ID NO: 1415641 - RNA, 15 nt, Homo sapiens
aaauacaguaguaua

SEQ ID NO: 1415642 - RNA, 12 nt, Homo sapiens
aaauaguuuaac

SEQ ID NO: 1415643 - RNA, 13 nt, Homo sapiens
aaauauucaguaa

SEQ ID NO: 1415644 - RNA, 21 nt, Homo sapiens
aaaucauuguauggauaguaa

SEQ ID NO: 1415645 - RNA, 22 nt, Homo sapiens
aaaucuaaaaaacgaaaagucu

SEQ ID NO: 1415646 - RNA, 14 nt, Homo sapiens
aaaugcucacuggg

SEQ ID NO: 1415647 - RNA, 18 nt, Homo sapiens
aaauggggaaauugcaga

SEQ ID NO: 1415648 - RNA, 15 nt, Homo sapiens
aaauguaacauacuc

SEQ ID NO: 1415649 - RNA, 22 nt, Homo sapiens
aaaugucugccauuugcugcuu

SEQ ID NO: 1415650 - RNA, 11 nt, Homo sapiens
aaaugugcaca

SEQ ID NO: 1415651 - RNA, 12 nt, Homo sapiens
aaauuaugugga

SEQ ID NO: 1415652 - RNA, 22 nt, Homo sapiens
aaauucaugguuuuaaagcuaa

SEQ ID NO: 1415653 - RNA, 20 nt, Homo sapiens
aaauucccucuggaguuuca

SEQ ID NO: 1415654 - RNA, 15 nt, Homo sapiens
aaauucuacuguaug

SEQ ID NO: 1415655 - RNA, 15 nt, Homo sapiens
aacaacaaaauaaag

SEQ ID NO: 1415656 - RNA, 14 nt, Homo sapiens
aacacccuccuuca

SEQ ID NO: 1415657 - RNA, 16 nt, Homo sapiens
aacauacugcauuuca

SEQ ID NO: 1415658 - RNA, 20 nt, Homo sapiens
aacauacugcauuucacucu

SEQ ID NO: 1415659 - RNA, 14 nt, Homo sapiens
aacaucugauuuga

SEQ ID NO: 1415660 - RNA, 18 nt, Homo sapiens
aacauuacauuugaacua

SEQ ID NO: 1415661 - RNA, 15 nt, Homo sapiens
aaccaagcuauucaa

SEQ ID NO: 1415662 - RNA, 19 nt, Homo sapiens
aaccaaguaguauucaugu

SEQ ID NO: 1415663 - RNA, 14 nt, Homo sapiens
aaccauaaagcaua

SEQ ID NO: 1415664 - RNA, 21 nt, Homo sapiens
aaccauuuguaaaacauucca

SEQ ID NO: 1415665 - RNA, 15 nt, Homo sapiens
aacccccaacccaaa

SEQ ID NO: 1415666 - RNA, 20 nt, Homo sapiens
aaccccugucacacagggaa

SEQ ID NO: 1415667 - RNA, 19 nt, Homo sapiens
aaccuaaauugaacugcca

SEQ ID NO: 1415668 - RNA, 18 nt, Homo sapiens
aaccucacucuugccaac

SEQ ID NO: 1415669 - RNA, 21 nt, Homo sapiens
aaccucauuguucuguacaaa

SEQ ID NO: 1415670 - RNA, 19 nt, Homo sapiens
aacgugucugagagccaua

SEQ ID NO: 1415671 - RNA, 20 nt, Homo sapiens
aacgugucugagagccauaa

SEQ ID NO: 1415672 - RNA, 12 nt, Homo sapiens
agugccaucuca

SEQ ID NO: 1415673 - RNA, 16 nt, Homo sapiens
agugggcugacaucaa

SEQ ID NO: 1415674 - RNA, 14 nt, Homo sapiens
agugguacuucagg

SEQ ID NO: 1415675 - RNA, 16 nt, Homo sapiens
aguguaauuagcuuuu

SEQ ID NO: 1415676 - RNA, 22 nt, Homo sapiens
agugucaaauaaacacugugua

SEQ ID NO: 1415677 - RNA, 21 nt, Homo sapiens
aguguggccuggauccauccu

SEQ ID NO: 1415678 - RNA, 19 nt, Homo sapiens
aguguucaaauaaacugaa

SEQ ID NO: 1415679 - RNA, 21 nt, Homo sapiens
aguucuaugcagaacagugag

SEQ ID NO: 1415680 - RNA, 12 nt, Homo sapiens
aguucugcucau

SEQ ID NO: 1415681 - RNA, 12 nt, Homo sapiens
aguucuguagaa

SEQ ID NO: 1415682 - RNA, 15 nt, Homo sapiens
aguugcaacuuugua

SEQ ID NO: 1415683 - RNA, 15 nt, Homo sapiens
aguuuaacacuuucu

SEQ ID NO: 1415684 - RNA, 23 nt, Homo sapiens
aguuugcauuaauaauccuucca

SEQ ID NO: 1415685 - RNA, 18 nt, Homo sapiens
aguuuuaagggcauuuaa

SEQ ID NO: 1415686 - RNA, 15 nt, Homo sapiens
aguuuuaauguagag

SEQ ID NO: 1415687 - RNA, 13 nt, Homo sapiens
auaaaacugaugu

SEQ ID NO: 1415688 - RNA, 16 nt, Homo sapiens
auaaaagggacugaga

SEQ ID NO: 1415689 - RNA, 20 nt, Homo sapiens
auaaacauguuuuaacauua

SEQ ID NO: 1415690 - RNA, 17 nt, Homo sapiens
auaaagcuucucucuga

SEQ ID NO: 1415691 - RNA, 12 nt, Homo sapiens
auaaagguucau

SEQ ID NO: 1415692 - RNA, 18 nt, Homo sapiens
auaaauugguuccugaga

SEQ ID NO: 1415693 - RNA, 16 nt, Homo sapiens
auaacuaauaugguuu

SEQ ID NO: 1415694 - RNA, 15 nt, Homo sapiens
auaagcugaugucca

SEQ ID NO: 1415695 - RNA, 13 nt, Homo sapiens
auaaguugcagaa

SEQ ID NO: 1415696 - RNA, 12 nt, Homo sapiens
auaauccuucca

SEQ ID NO: 1415697 - RNA, 14 nt, Homo sapiens
auaaugcaaauguc

SEQ ID NO: 1415698 - RNA, 19 nt, Homo sapiens
auaauggcauguauuccaa

SEQ ID NO: 1415699 - RNA, 15 nt, Homo sapiens
auaauguaugaauuu

SEQ ID NO: 1415700 - RNA, 20 nt, Homo sapiens
auacagugacaauacaaaua

SEQ ID NO: 1415701 - RNA, 18 nt, Homo sapiens
auacuaauagccuaaaag

SEQ ID NO: 1415702 - RNA, 14 nt, Homo sapiens
auacugaauauuga

SEQ ID NO: 1415703 - RNA, 21 nt, Homo sapiens
auacugcagggccaggacuga

SEQ ID NO: 1415704 - RNA, 22 nt, Homo sapiens
auacugcugaguucuggucugu

SEQ ID NO: 1415705 - RNA, 17 nt, Homo sapiens
auagaaaacccacaccc

SEQ ID NO: 1415706 - RNA, 17 nt, Homo sapiens
auagaauggcacauguc

SEQ ID NO: 1415707 - RNA, 19 nt, Homo sapiens
auagaauggcacaugucau

SEQ ID NO: 1415708 - RNA, 17 nt, Homo sapiens
auagcauuuguguaaag

SEQ ID NO: 1415709 - RNA, 21 nt, Homo sapiens
auaguaaaauucuacuguaug

SEQ ID NO: 1415710 - RNA, 23 nt, Homo sapiens
auagucacaggaaacuacuucac

SEQ ID NO: 1415711 - RNA, 20 nt, Homo sapiens
auauaauagaugacaguggc

SEQ ID NO: 1415712 - RNA, 17 nt, Homo sapiens
auauaccuagauuccau

SEQ ID NO: 1415713 - RNA, 22 nt, Homo sapiens
auauacucuucgauguacuugu

SEQ ID NO: 1415714 - RNA, 12 nt, Homo sapiens
auauagucacag

SEQ ID NO: 1415715 - RNA, 12 nt, Homo sapiens
auauauuccaac

SEQ ID NO: 1415716 - RNA, 22 nt, Homo sapiens
auaucacuugauaugugcacca

SEQ ID NO: 1415717 - RNA, 14 nt, Homo sapiens
auaugaccaagagu

SEQ ID NO: 1415718 - RNA, 13 nt, Homo sapiens
auauguagcaaaa

SEQ ID NO: 1415719 - RNA, 15 nt, Homo sapiens
auauguagcaaaaug

SEQ ID NO: 1415720 - RNA, 20 nt, Homo sapiens
auauguuuguggaauggauu

SEQ ID NO: 1415721 - RNA, 21 nt, Homo sapiens
auauugagcaguucccaagga

SEQ ID NO: 1415722 - RNA, 16 nt, Homo sapiens
aucacacuugucugca

SEQ ID NO: 1415723 - RNA, 14 nt, Homo sapiens
aucaggucuuuacu

SEQ ID NO: 1415724 - RNA, 15 nt, Homo sapiens
aucaugaaaacuggg

SEQ ID NO: 1415725 - RNA, 21 nt, Homo sapiens
aucaugucccccuuauguuga

SEQ ID NO: 1415726 - RNA, 13 nt, Homo sapiens
aucaugugccaga

SEQ ID NO: 1415727 - RNA, 17 nt, Homo sapiens
auccaagcaaaugugaa

SEQ ID NO: 1415728 - RNA, 19 nt, Homo sapiens
auccauaguggacauuguu

SEQ ID NO: 1415729 - RNA, 22 nt, Homo sapiens
aucccagcuacuugggagguug

SEQ ID NO: 1415730 - RNA, 15 nt, Homo sapiens
auccccugccuccau

SEQ ID NO: 1415731 - RNA, 14 nt, Homo sapiens
auccugcagucaau

SEQ ID NO: 1415732 - RNA, 14 nt, Homo sapiens
auccuuaaacugcc

SEQ ID NO: 1415733 - RNA, 21 nt, Homo sapiens
aucgccaaauaguuccauuuu

SEQ ID NO: 1415734 - RNA, 11 nt, Homo sapiens
aucgguagcuu

SEQ ID NO: 1415735 - RNA, 16 nt, Homo sapiens
aucuaaaaccaaauau

SEQ ID NO: 1415736 - RNA, 21 nt, Homo sapiens
aucuaaauauuuccauauucu

SEQ ID NO: 1415737 - RNA, 11 nt, Homo sapiens
aucuaccacau

SEQ ID NO: 1415738 - RNA, 21 nt, Homo sapiens
aucuaccacaucuucaugugg

SEQ ID NO: 1415739 - RNA, 18 nt, Homo sapiens
aucucaaccccaucaucc

SEQ ID NO: 1415740 - RNA, 21 nt, Homo sapiens
aucucaaccccaucauccugc

SEQ ID NO: 1415741 - RNA, 13 nt, Homo sapiens
aucucaguucucu

SEQ ID NO: 1415742 - RNA, 22 nt, Homo sapiens
aucucauguucaaagugugaca

SEQ ID NO: 1415743 - RNA, 12 nt, Homo sapiens
aucucucuggag

SEQ ID NO: 1415744 - RNA, 13 nt, Homo sapiens
aucugaacuaauu

SEQ ID NO: 1415745 - RNA, 18 nt, Homo sapiens
aucugaagacucaggcag

SEQ ID NO: 1415746 - RNA, 19 nt, Homo sapiens
aucugauuucgucaccuga

SEQ ID NO: 1415747 - RNA, 15 nt, Homo sapiens
aucugcucuguacau

SEQ ID NO: 1415748 - RNA, 19 nt, Homo sapiens
aucugcucuguacaucaga

SEQ ID NO: 1415749 - RNA, 22 nt, Homo sapiens
aucuggaacgcucuaggcagaa

SEQ ID NO: 1415750 - RNA, 19 nt, Homo sapiens
aucuucuuagcucaucuua

SEQ ID NO: 1415751 - RNA, 16 nt, Homo sapiens
aucuuuucauuaaaga

SEQ ID NO: 1415752 - RNA, 19 nt, Homo sapiens
augaacacuggcugcaagu

SEQ ID NO: 1415753 - RNA, 17 nt, Homo sapiens
augaaugcuauuuucaa

SEQ ID NO: 1415754 - RNA, 12 nt, Homo sapiens
augaauuuccac

SEQ ID NO: 1415755 - RNA, 17 nt, Homo sapiens
augaccuugacauacca

SEQ ID NO: 1415756 - RNA, 17 nt, Homo sapiens
augacgguauuaugcuu

SEQ ID NO: 1415757 - RNA, 13 nt, Homo sapiens
augacuacuacac

SEQ ID NO: 1415758 - RNA, 13 nt, Homo sapiens
augagcuuuacag

SEQ ID NO: 1415759 - RNA, 15 nt, Homo sapiens
augagugaguucuca

SEQ ID NO: 1415760 - RNA, 14 nt, Homo sapiens
augagugauuccag

SEQ ID NO: 1415761 - RNA, 20 nt, Homo sapiens
augaugaguccagaaccccu

SEQ ID NO: 1415762 - RNA, 14 nt, Homo sapiens
augcaaccucugcc

SEQ ID NO: 1415763 - RNA, 15 nt, Homo sapiens
augcuaaaacaugau

SEQ ID NO: 1415764 - RNA, 22 nt, Homo sapiens
augcugcugcucaaaaugccac

SEQ ID NO: 1415765 - RNA, 18 nt, Homo sapiens
augcuggauucagauaua

SEQ ID NO: 1415766 - RNA, 22 nt, Homo sapiens
augcuggcgccaacaacuucuc

SEQ ID NO: 1415767 - RNA, 16 nt, Homo sapiens
augcuuccuauacagu

SEQ ID NO: 1415768 - RNA, 15 nt, Homo sapiens
augcuuuuagcucaa

SEQ ID NO: 1415769 - RNA, 16 nt, Homo sapiens
auggagcaacccaaua

SEQ ID NO: 1415770 - RNA, 17 nt, Homo sapiens
auggcacaugucauugc

SEQ ID NO: 1415771 - RNA, 15 nt, Homo sapiens
auggccacuaagugu

SEQ ID NO: 1415772 - RNA, 23 nt, Homo sapiens
auggccuguggaucaaauccagc

SEQ ID NO: 1415773 - RNA, 14 nt, Homo sapiens
auggcgugaucuca

SEQ ID NO: 1415774 - RNA, 15 nt, Homo sapiens
auggcgugaucucag

SEQ ID NO: 1415775 - RNA, 14 nt, Homo sapiens
auggcucaugucug

SEQ ID NO: 1415776 - RNA, 14 nt, Homo sapiens
augggaacacaagu

SEQ ID NO: 1415777 - RNA, 23 nt, Homo sapiens
augggagggggcuugaagccaaa

SEQ ID NO: 1415778 - RNA, 11 nt, Homo sapiens
augggggauca

SEQ ID NO: 1415779 - RNA, 19 nt, Homo sapiens
augguuuuaaugcaaugag

SEQ ID NO: 1415780 - RNA, 19 nt, Homo sapiens
augguuuuucugugucaau

SEQ ID NO: 1415781 - RNA, 20 nt, Homo sapiens
auguacaguaaauucucucc

SEQ ID NO: 1415782 - RNA, 16 nt, Homo sapiens
auguagaaaucucauc

SEQ ID NO: 1415783 - RNA, 22 nt, Homo sapiens
auguagaacuugaacuaacaua

SEQ ID NO: 1415784 - RNA, 17 nt, Homo sapiens
augucugaaaaaugccu

SEQ ID NO: 1415785 - RNA, 18 nt, Homo sapiens
augugaaacucaucucau

SEQ ID NO: 1415786 - RNA, 15 nt, Homo sapiens
augugacacacuggc

SEQ ID NO: 1415787 - RNA, 22 nt, Homo sapiens
augugugucuuuuuguaucuca

SEQ ID NO: 1415788 - RNA, 22 nt, Homo sapiens
auguuagaagaggccuuuggaa

SEQ ID NO: 1415789 - RNA, 21 nt, Homo sapiens
auguucaaagugugacauuca

SEQ ID NO: 1415790 - RNA, 23 nt, Homo sapiens
auguucaccuuuuccuugcugau

SEQ ID NO: 1415791 - RNA, 21 nt, Homo sapiens
auguucccuuuuaaaucugcu

SEQ ID NO: 1415792 - RNA, 14 nt, Homo sapiens
auguugaggugacc

SEQ ID NO: 1415793 - RNA, 16 nt, Homo sapiens
auuaaaauauuugccu

SEQ ID NO: 1415794 - RNA, 22 nt, Homo sapiens
auuaaacccugagccaccgugu

SEQ ID NO: 1415795 - RNA, 17 nt, Homo sapiens
auuaaagugcacugugu

SEQ ID NO: 1415796 - RNA, 18 nt, Homo sapiens
auuaagugcacaccgugu

SEQ ID NO: 1415797 - RNA, 19 nt, Homo sapiens
auuaauugagcagcaugau

SEQ ID NO: 1415798 - RNA, 18 nt, Homo sapiens
auuacuucuagucaguca

SEQ ID NO: 1415799 - RNA, 21 nt, Homo sapiens
auuagaaauguaacauacuca

SEQ ID NO: 1415800 - RNA, 15 nt, Homo sapiens
auuaucaccaugaca

SEQ ID NO: 1415801 - RNA, 20 nt, Homo sapiens
auuauuuauaaugcuuggaa

SEQ ID NO: 1415802 - RNA, 17 nt, Homo sapiens
auuauuuuauguugcau

SEQ ID NO: 1415803 - RNA, 20 nt, Homo sapiens
auucaacgugaggaagcaag

SEQ ID NO: 1415804 - RNA, 18 nt, Homo sapiens
auucaagaggaauuccag

SEQ ID NO: 1415805 - RNA, 23 nt, Homo sapiens
cuaaugauggcccauucuacuug

SEQ ID NO: 1415806 - RNA, 15 nt, Homo sapiens
cuaauucaguucuga

SEQ ID NO: 1415807 - RNA, 14 nt, Homo sapiens
cuaauuuuccagag

SEQ ID NO: 1415808 - RNA, 16 nt, Homo sapiens
cuacaccacacuaaaa

SEQ ID NO: 1415809 - RNA, 22 nt, Homo sapiens
cuacagguccaggguuguuaga

SEQ ID NO: 1415810 - RNA, 15 nt, Homo sapiens
cuaccuccucaggga

SEQ ID NO: 1415811 - RNA, 14 nt, Homo sapiens
cuacuaacagauua

SEQ ID NO: 1415812 - RNA, 11 nt, Homo sapiens
cuacuucacag

SEQ ID NO: 1415813 - RNA, 16 nt, Homo sapiens
cuagauuccauacagu

SEQ ID NO: 1415814 - RNA, 15 nt, Homo sapiens
cuagcaagcacuuga

SEQ ID NO: 1415815 - RNA, 16 nt, Homo sapiens
cuagcaccuccccaga

SEQ ID NO: 1415816 - RNA, 18 nt, Homo sapiens
cuaggggaggggggagcc

SEQ ID NO: 1415817 - RNA, 21 nt, Homo sapiens
cuauaguuauauagauaaaga

SEQ ID NO: 1415818 - RNA, 13 nt, Homo sapiens
cuauauccuuccu

SEQ ID NO: 1415819 - RNA, 22 nt, Homo sapiens
cuauccauaguggacauuguug

SEQ ID NO: 1415820 - RNA, 15 nt, Homo sapiens
cuauguggcugcugc

SEQ ID NO: 1415821 - RNA, 15 nt, Homo sapiens
cuauucuggcaauaa

SEQ ID NO: 1415822 - RNA, 20 nt, Homo sapiens
cuauuuaacuugagcuuuaa

SEQ ID NO: 1415823 - RNA, 15 nt, Homo sapiens
cuauuuuuucuugac

SEQ ID NO: 1415824 - RNA, 16 nt, Homo sapiens
cuauuuuuucuugaca

SEQ ID NO: 1415825 - RNA, 22 nt, Homo sapiens
cucaaaaggcccuagcuaauaa

SEQ ID NO: 1415826 - RNA, 18 nt, Homo sapiens
cucaacauuacauuugaa

SEQ ID NO: 1415827 - RNA, 12 nt, Homo sapiens
cucaagugcccu

SEQ ID NO: 1415828 - RNA, 14 nt, Homo sapiens
cucaagugccuuau

SEQ ID NO: 1415829 - RNA, 12 nt, Homo sapiens
cucacacucagg

SEQ ID NO: 1415830 - RNA, 21 nt, Homo sapiens
cucaccagaagcagaugccag

SEQ ID NO: 1415831 - RNA, 21 nt, Homo sapiens
cucaccaugugacacacuggc

SEQ ID NO: 1415832 - RNA, 20 nt, Homo sapiens
cucacgccuguaaucccagc

SEQ ID NO: 1415833 - RNA, 13 nt, Homo sapiens
cucacuaccuccu

SEQ ID NO: 1415834 - RNA, 13 nt, Homo sapiens
cucacucuugcca

SEQ ID NO: 1415835 - RNA, 22 nt, Homo sapiens
cucacucuugccaaccuguaau

SEQ ID NO: 1415836 - RNA, 23 nt, Homo sapiens
cucacucuugccaaccuguaaua

SEQ ID NO: 1415837 - RNA, 21 nt, Homo sapiens
cucagagaguacucgcagggg

SEQ ID NO: 1415838 - RNA, 20 nt, Homo sapiens
cucagcccuggaggugccag

SEQ ID NO: 1415839 - RNA, 12 nt, Homo sapiens
cucaguccuccc

SEQ ID NO: 1415840 - RNA, 13 nt, Homo sapiens
cucaguccucccc

SEQ ID NO: 1415841 - RNA, 16 nt, Homo sapiens
cucaguucucuuucaa

SEQ ID NO: 1415842 - RNA, 15 nt, Homo sapiens
cucaucacuaaacag

SEQ ID NO: 1415843 - RNA, 20 nt, Homo sapiens
cucaugucugaaaaaugccu

SEQ ID NO: 1415844 - RNA, 17 nt, Homo sapiens
cucauuuacaaagcaaa

SEQ ID NO: 1415845 - RNA, 18 nt, Homo sapiens
cuccacaaccaccuccag

SEQ ID NO: 1415846 - RNA, 16 nt, Homo sapiens
cuccacaccaguaaua

SEQ ID NO: 1415847 - RNA, 22 nt, Homo sapiens
cuccacaucugccuuaaaacca

SEQ ID NO: 1415848 - RNA, 19 nt, Homo sapiens
cuccaggcccccguugaag

SEQ ID NO: 1415849 - RNA, 19 nt, Homo sapiens
cucccacuuggccaagcag

SEQ ID NO: 1415850 - RNA, 16 nt, Homo sapiens
cucccaguuaccugca

SEQ ID NO: 1415851 - RNA, 18 nt, Homo sapiens
cucccuuugccagccuug

SEQ ID NO: 1415852 - RNA, 21 nt, Homo sapiens
cuccgagcugguaggcauucc

SEQ ID NO: 1415853 - RNA, 14 nt, Homo sapiens
cuccgcaggcugcc

SEQ ID NO: 1415854 - RNA, 16 nt, Homo sapiens
cuccuagcucccugcc

SEQ ID NO: 1415855 - RNA, 20 nt, Homo sapiens
cuccuaggccugauuguccu

SEQ ID NO: 1415856 - RNA, 18 nt, Homo sapiens
cuccuccugcucugccca

SEQ ID NO: 1415857 - RNA, 14 nt, Homo sapiens
cuccucuuccagag

SEQ ID NO: 1415858 - RNA, 16 nt, Homo sapiens
cuccugaccucaggug

SEQ ID NO: 1415859 - RNA, 15 nt, Homo sapiens
cuccugagagcuguu

SEQ ID NO: 1415860 - RNA, 13 nt, Homo sapiens
cucgcaccugccu

SEQ ID NO: 1415861 - RNA, 21 nt, Homo sapiens
cucuacagguccaggguuguu

SEQ ID NO: 1415862 - RNA, 13 nt, Homo sapiens
cucuagaagccaa

SEQ ID NO: 1415863 - RNA, 15 nt, Homo sapiens
cucuagaagugccau

SEQ ID NO: 1415864 - RNA, 20 nt, Homo sapiens
cucuagaagugccaucucaa

SEQ ID NO: 1415865 - RNA, 17 nt, Homo sapiens
cucucaauuaaguguug

SEQ ID NO: 1415866 - RNA, 16 nt, Homo sapiens
cucucaccaugugaca

SEQ ID NO: 1415867 - RNA, 19 nt, Homo sapiens
cucucucaccaugugacac

SEQ ID NO: 1415868 - RNA, 22 nt, Homo sapiens
cucucuuuauaagaacccuggu

SEQ ID NO: 1415869 - RNA, 20 nt, Homo sapiens
cucugaacuaggugaucuca

SEQ ID NO: 1415870 - RNA, 14 nt, Homo sapiens
cucugaugauguca

SEQ ID NO: 1415871 - RNA, 14 nt, Homo sapiens
cucuggggcagcuc

SEQ ID NO: 1415872 - RNA, 23 nt, Homo sapiens
cucugguuguuuaugcaagagcu

SEQ ID NO: 1415873 - RNA, 18 nt, Homo sapiens
cucugugcugcaucccac

SEQ ID NO: 1415874 - RNA, 14 nt, Homo sapiens
cucuucgauguacu

SEQ ID NO: 1415875 - RNA, 18 nt, Homo sapiens
cucuucgauguacuuguu

SEQ ID NO: 1415876 - RNA, 20 nt, Homo sapiens
cucuugguucuacguggaug

SEQ ID NO: 1415877 - RNA, 18 nt, Homo sapiens
cucuuuccuucuugccuu

SEQ ID NO: 1415878 - RNA, 16 nt, Homo sapiens
cugaaagcaauaagcu

SEQ ID NO: 1415879 - RNA, 21 nt, Homo sapiens
cugaacacccuccuucacucc

SEQ ID NO: 1415880 - RNA, 17 nt, Homo sapiens
cugaacuaggugaucuc

SEQ ID NO: 1415881 - RNA, 16 nt, Homo sapiens
cugaagacaggcacaa

SEQ ID NO: 1415882 - RNA, 11 nt, Homo sapiens
cugaagccaca

SEQ ID NO: 1415883 - RNA, 12 nt, Homo sapiens
cugaagccacac

SEQ ID NO: 1415884 - RNA, 23 nt, Homo sapiens
cugaagccuggacgcagccacac

SEQ ID NO: 1415885 - RNA, 19 nt, Homo sapiens
cugaccccgaccucagaga

SEQ ID NO: 1415886 - RNA, 22 nt, Homo sapiens
cugaccuuaguuugcugccauc

SEQ ID NO: 1415887 - RNA, 16 nt, Homo sapiens
cugagagcuguucccc

SEQ ID NO: 1415888 - RNA, 19 nt, Homo sapiens
cugagccccauacagggca

SEQ ID NO: 1415889 - RNA, 12 nt, Homo sapiens
cugagcugccac

SEQ ID NO: 1415890 - RNA, 20 nt, Homo sapiens
cugaggagggcccugaggaa

SEQ ID NO: 1415891 - RNA, 12 nt, Homo sapiens
cugauauuuuag

SEQ ID NO: 1415892 - RNA, 21 nt, Homo sapiens
cugauccaacaguugcuaaac

SEQ ID NO: 1415893 - RNA, 23 nt, Homo sapiens
cugaugacucaagauucccagga

SEQ ID NO: 1415894 - RNA, 21 nt, Homo sapiens
cugauggagacaguaacacug

SEQ ID NO: 1415895 - RNA, 14 nt, Homo sapiens
cugcagaggauuua

SEQ ID NO: 1415896 - RNA, 21 nt, Homo sapiens
cugcagcuuauuggcuuaaaa

SEQ ID NO: 1415897 - RNA, 19 nt, Homo sapiens
cugcaggauugauuaugca

SEQ ID NO: 1415898 - RNA, 14 nt, Homo sapiens
cugcagucaauguu

SEQ ID NO: 1415899 - RNA, 14 nt, Homo sapiens
cugcauuuguguca

SEQ ID NO: 1415900 - RNA, 17 nt, Homo sapiens
cugccaaaaccaaauug

SEQ ID NO: 1415901 - RNA, 22 nt, Homo sapiens
cugccagggugggcagacagac

SEQ ID NO: 1415902 - RNA, 12 nt, Homo sapiens
cugccccugugg

SEQ ID NO: 1415903 - RNA, 16 nt, Homo sapiens
cugccuaugguuuuuc

SEQ ID NO: 1415904 - RNA, 12 nt, Homo sapiens
cugccugagcuu

SEQ ID NO: 1415905 - RNA, 20 nt, Homo sapiens
cugccuucuggauucuuggc

SEQ ID NO: 1415906 - RNA, 21 nt, Homo sapiens
cugcguccuccucaccucaug

SEQ ID NO: 1415907 - RNA, 15 nt, Homo sapiens
cugcucaaaaugcca

SEQ ID NO: 1415908 - RNA, 15 nt, Homo sapiens
cugcucaacauuuaa

SEQ ID NO: 1415909 - RNA, 14 nt, Homo sapiens
cugcucaguuucug

SEQ ID NO: 1415910 - RNA, 13 nt, Homo sapiens
cugcucauucuaa

SEQ ID NO: 1415911 - RNA, 18 nt, Homo sapiens
cugcucccugaagccagc

SEQ ID NO: 1415912 - RNA, 21 nt, Homo sapiens
cugcugcccccaccccgggga

SEQ ID NO: 1415913 - RNA, 13 nt, Homo sapiens
cugcugcugccaa

SEQ ID NO: 1415914 - RNA, 13 nt, Homo sapiens
cugcugcugccac

SEQ ID NO: 1415915 - RNA, 18 nt, Homo sapiens
cuggaaaacucaggauuc

SEQ ID NO: 1415916 - RNA, 15 nt, Homo sapiens
cuggaaucgggguca

SEQ ID NO: 1415917 - RNA, 22 nt, Homo sapiens
cuggaauuugaaacacuuugca

SEQ ID NO: 1415918 - RNA, 22 nt, Homo sapiens
cuggacggcaggcucacugcca

SEQ ID NO: 1415919 - RNA, 22 nt, Homo sapiens
cuggagagagagcaagauuccu

SEQ ID NO: 1415920 - RNA, 19 nt, Homo sapiens
cuggagcagagaacaucug

SEQ ID NO: 1415921 - RNA, 19 nt, Homo sapiens
cuggaggugccagcaaagc

SEQ ID NO: 1415922 - RNA, 15 nt, Homo sapiens
cuggauucuuggccc

SEQ ID NO: 1415923 - RNA, 20 nt, Homo sapiens
cuggauucuuggcccgcaca

SEQ ID NO: 1415924 - RNA, 22 nt, Homo sapiens
cuggauuucauccuugaccuca

SEQ ID NO: 1415925 - RNA, 23 nt, Homo sapiens
cuggcccuccacccccaccucaa

SEQ ID NO: 1415926 - RNA, 17 nt, Homo sapiens
cuggcccucugcuaaag

SEQ ID NO: 1415927 - RNA, 20 nt, Homo sapiens
cuggccuccuucaccaaaga

SEQ ID NO: 1415928 - RNA, 16 nt, Homo sapiens
cuggccuuauaucauu

SEQ ID NO: 1415929 - RNA, 13 nt, Homo sapiens
cugggauaucacu

SEQ ID NO: 1415930 - RNA, 16 nt, Homo sapiens
cugggccccaucauua

SEQ ID NO: 1415931 - RNA, 20 nt, Homo sapiens
cugggccucuuggaaaaagu

SEQ ID NO: 1415932 - RNA, 20 nt, Homo sapiens
cugggcuucuucagaacaau

SEQ ID NO: 1415933 - RNA, 21 nt, Homo sapiens
cuggguaccaaauuuaagcaa

SEQ ID NO: 1415934 - RNA, 13 nt, Homo sapiens
cugggugugcaac

SEQ ID NO: 1415935 - RNA, 18 nt, Homo sapiens
cugguggccgugcugguc

SEQ ID NO: 1415936 - RNA, 23 nt, Homo sapiens
cugguuauuguucagacauucca

SEQ ID NO: 1415937 - RNA, 14 nt, Homo sapiens
aaaucagacuauga

SEQ ID NO: 1415938 - RNA, 20 nt, Homo sapiens
aaaucaucuuuguuggcuca

SEQ ID NO: 1415939 - RNA, 23 nt, Homo sapiens
aaaugaagguuucuacaacauau

SEQ ID NO: 1415940 - RNA, 15 nt, Homo sapiens
cugcgaguggcuuag

SEQ ID NO: 1415941 - RNA, 19 nt, Homo sapiens
cugcguucaacaaugcugc

SEQ ID NO: 1415942 - RNA, 18 nt, Homo sapiens
cugcucacuaccuccuca

SEQ ID NO: 1415943 - RNA, 20 nt, Homo sapiens
cugcucacuaccuccucagg

SEQ ID NO: 1415944 - RNA, 20 nt, Homo sapiens
cugcugagucgcucucauga

SEQ ID NO: 1415945 - RNA, 20 nt, Homo sapiens
cugcuggaaaccucaugcca

SEQ ID NO: 1415946 - RNA, 19 nt, Homo sapiens
cugcugugauuccacuaca

SEQ ID NO: 1415947 - RNA, 20 nt, Homo sapiens
cugcuucaccaaggagcuac

SEQ ID NO: 1415948 - RNA, 21 nt, Homo sapiens
cugcuucucccacuuggccaa

SEQ ID NO: 1415949 - RNA, 16 nt, Homo sapiens
cuggaaaacucaggau

SEQ ID NO: 1415950 - RNA, 15 nt, Homo sapiens
cuggagccuguguaa

SEQ ID NO: 1415951 - RNA, 17 nt, Homo sapiens
cuggagguugaagccaa

SEQ ID NO: 1415952 - RNA, 15 nt, Homo sapiens
cuggcuccuacccac

SEQ ID NO: 1415953 - RNA, 22 nt, Homo sapiens
cuggcuccugaagggugcucag

SEQ ID NO: 1415954 - RNA, 20 nt, Homo sapiens
cuggcuucaggagggagcau

SEQ ID NO: 1415955 - RNA, 22 nt, Homo sapiens
cuggcuucaggagggagcauag

SEQ ID NO: 1415956 - RNA, 16 nt, Homo sapiens
cugggaagggacaucu

SEQ ID NO: 1415957 - RNA, 15 nt, Homo sapiens
cugggauuacaggug

SEQ ID NO: 1415958 - RNA, 14 nt, Homo sapiens
cuggggcugaggga

SEQ ID NO: 1415959 - RNA, 14 nt, Homo sapiens
cuggucuugaacuc

SEQ ID NO: 1415960 - RNA, 17 nt, Homo sapiens
cuguaagcaacacuuua

SEQ ID NO: 1415961 - RNA, 18 nt, Homo sapiens
cuguaauaaauaugagug

SEQ ID NO: 1415962 - RNA, 18 nt, Homo sapiens
gagggggcuugaagccaa

SEQ ID NO: 1415963 - RNA, 19 nt, Homo sapiens
gagggggcuugaagccaaa

SEQ ID NO: 1415964 - RNA, 18 nt, Homo sapiens
gagguagauuucauugaa

SEQ ID NO: 1415965 - RNA, 13 nt, Homo sapiens
gaggucacuggaa

SEQ ID NO: 1415966 - RNA, 20 nt, Homo sapiens
gagguggagguugcagugag

SEQ ID NO: 1415967 - RNA, 21 nt, Homo sapiens
gagguggcguccagcagucca

SEQ ID NO: 1415968 - RNA, 14 nt, Homo sapiens
gagguugugucacu

SEQ ID NO: 1415969 - RNA, 15 nt, Homo sapiens
gaguccccaccagcu

SEQ ID NO: 1415970 - RNA, 22 nt, Homo sapiens
gagucuuccaaaccaccuuccc

SEQ ID NO: 1415971 - RNA, 20 nt, Homo sapiens
gagugcuuucauauuuucca

SEQ ID NO: 1415972 - RNA, 13 nt, Homo sapiens
gaguucuggucug

SEQ ID NO: 1415973 - RNA, 16 nt, Homo sapiens
gaguuguugugcaagu

SEQ ID NO: 1415974 - RNA, 15 nt, Homo sapiens
gauaacauuuuccca

SEQ ID NO: 1415975 - RNA, 21 nt, Homo sapiens
gauaaggcuguuaacauuaca

SEQ ID NO: 1415976 - RNA, 20 nt, Homo sapiens
gauaauagcguucagcagca

SEQ ID NO: 1415977 - RNA, 16 nt, Homo sapiens
gauauaccuagauucc

SEQ ID NO: 1415978 - RNA, 12 nt, Homo sapiens
gauaucacuuca

SEQ ID NO: 1415979 - RNA, 18 nt, Homo sapiens
gauaucuuuggauaaugu

SEQ ID NO: 1415980 - RNA, 19 nt, Homo sapiens
gauaugugcaccaauaccu

SEQ ID NO: 1415981 - RNA, 18 nt, Homo sapiens
gauauucccccugagcug

SEQ ID NO: 1415982 - RNA, 16 nt, Homo sapiens
gaucugauucuaccag

SEQ ID NO: 1415983 - RNA, 15 nt, Homo sapiens
gaucugcucagcccu

SEQ ID NO: 1415984 - RNA, 20 nt, Homo sapiens
gaugaccagcuagacuccca

SEQ ID NO: 1415985 - RNA, 16 nt, Homo sapiens
gaugaguccauuugaa

SEQ ID NO: 1415986 - RNA, 18 nt, Homo sapiens
gaugccagcgccaugcuu

SEQ ID NO: 1415987 - RNA, 16 nt, Homo sapiens
gaugcuuuuagcucaa

SEQ ID NO: 1415988 - RNA, 17 nt, Homo sapiens
gaugcuuuuagcucaaa

SEQ ID NO: 1415989 - RNA, 22 nt, Homo sapiens
gauggaccggcccacacuccca

SEQ ID NO: 1415990 - RNA, 20 nt, Homo sapiens
gauggagcuguucauugaca

SEQ ID NO: 1415991 - RNA, 19 nt, Homo sapiens
gaugguggggcccccagca

SEQ ID NO: 1415992 - RNA, 20 nt, Homo sapiens
gauguaguucuuuucaugca

SEQ ID NO: 1415993 - RNA, 16 nt, Homo sapiens
gauguuacuagccucu

SEQ ID NO: 1415994 - RNA, 18 nt, Homo sapiens
gauugagauguguucaca

SEQ ID NO: 1415995 - RNA, 19 nt, Homo sapiens
gcaaaccucuccuuccuca

SEQ ID NO: 1415996 - RNA, 22 nt, Homo sapiens
gcaaaugucacggcuacucuau

SEQ ID NO: 1415997 - RNA, 21 nt, Homo sapiens
gcaauaaaagauaagugcagu

SEQ ID NO: 1415998 - RNA, 15 nt, Homo sapiens
gcaauaaaggcaccu

SEQ ID NO: 1415999 - RNA, 22 nt, Homo sapiens
gcaauaaaggcaccucccccaa

SEQ ID NO: 1416000 - RNA, 16 nt, Homo sapiens
gcaauaaaugcucaau

SEQ ID NO: 1416001 - RNA, 22 nt, Homo sapiens
gcaauuguacaaaaaaguuaua

SEQ ID NO: 1416002 - RNA, 16 nt, Homo sapiens
gcaccucugugcugca

SEQ ID NO: 1416003 - RNA, 19 nt, Homo sapiens
gcaccuguugugugccuga

SEQ ID NO: 1416004 - RNA, 19 nt, Homo sapiens
gcacucaccuucuggccag

SEQ ID NO: 1416005 - RNA, 13 nt, Homo sapiens
gcagaacagugag

SEQ ID NO: 1416006 - RNA, 14 nt, Homo sapiens
gcagagaacaucug

SEQ ID NO: 1416007 - RNA, 21 nt, Homo sapiens
gcagcucccagccucuuccca

SEQ ID NO: 1416008 - RNA, 22 nt, Homo sapiens
gcaguccugaguggguguugca

SEQ ID NO: 1416009 - RNA, 21 nt, Homo sapiens
gcagucugggccccaucauua

SEQ ID NO: 1416010 - RNA, 17 nt, Homo sapiens
gcauaauacuugcuuug

SEQ ID NO: 1416011 - RNA, 18 nt, Homo sapiens
gcauauaucuuucagauu

SEQ ID NO: 1416012 - RNA, 11 nt, Homo sapiens
gcaucuuccag

SEQ ID NO: 1416013 - RNA, 17 nt, Homo sapiens
gcaugaccuaucaguau

SEQ ID NO: 1416014 - RNA, 21 nt, Homo sapiens
gcaugggagugaucucaccaa

SEQ ID NO: 1416015 - RNA, 21 nt, Homo sapiens
gcauuugucuauucuccagcu

SEQ ID NO: 1416016 - RNA, 14 nt, Homo sapiens
gcauuuuaagcaua

SEQ ID NO: 1416017 - RNA, 15 nt, Homo sapiens
gcauuuuaagcauaa

SEQ ID NO: 1416018 - RNA, 14 nt, Homo sapiens
gccaaacacauuaa

SEQ ID NO: 1416019 - RNA, 14 nt, Homo sapiens
gccaaccuguaaua

SEQ ID NO: 1416020 - RNA, 23 nt, Homo sapiens
gccaagcagggaggaagaagcuu

SEQ ID NO: 1416021 - RNA, 16 nt, Homo sapiens
gccaagggacacagga

SEQ ID NO: 1416022 - RNA, 15 nt, Homo sapiens
gccaccacuccugcc

SEQ ID NO: 1416023 - RNA, 16 nt, Homo sapiens
gccaccccaacccaau

SEQ ID NO: 1416024 - RNA, 14 nt, Homo sapiens
gccaccccaccaga

SEQ ID NO: 1416025 - RNA, 22 nt, Homo sapiens
gccacuuucccacgucacuuga

SEQ ID NO: 1416026 - RNA, 19 nt, Homo sapiens
gccacuuuugugugugucu

SEQ ID NO: 1416027 - RNA, 22 nt, Homo sapiens
gccagaaaaggcagccagaucc

SEQ ID NO: 1416028 - RNA, 21 nt, Homo sapiens
gccagccuucuuccaucccag

SEQ ID NO: 1416029 - RNA, 22 nt, Homo sapiens
gccaggacacaacgcugcugcc

SEQ ID NO: 1416030 - RNA, 14 nt, Homo sapiens
gccaggacugagcc

SEQ ID NO: 1416031 - RNA, 19 nt, Homo sapiens
gccagggugggcagacaga

SEQ ID NO: 1416032 - RNA, 16 nt, Homo sapiens
gccauaaaugaccuaa

SEQ ID NO: 1416033 - RNA, 17 nt, Homo sapiens
gccaucccuucauuuaa

SEQ ID NO: 1416034 - RNA, 18 nt, Homo sapiens
gccaugcuuccuauacag

SEQ ID NO: 1416035 - RNA, 17 nt, Homo sapiens
gccauggggcagccucc

SEQ ID NO: 1416036 - RNA, 11 nt, Homo sapiens
gcccaccagag

SEQ ID NO: 1416037 - RNA, 17 nt, Homo sapiens
gcccagaauucugggca

SEQ ID NO: 1416038 - RNA, 18 nt, Homo sapiens
gcccagaauucugggcaa

SEQ ID NO: 1416039 - RNA, 19 nt, Homo sapiens
gcccaggcuggaguacaau

SEQ ID NO: 1416040 - RNA, 20 nt, Homo sapiens
gcccaggcuggaguacaaug

SEQ ID NO: 1416041 - RNA, 17 nt, Homo sapiens
gccccagagcagggugu

SEQ ID NO: 1416042 - RNA, 12 nt, Homo sapiens
gcccccaugcug

SEQ ID NO: 1416043 - RNA, 20 nt, Homo sapiens
gccccccaucuagcaagcac

SEQ ID NO: 1416044 - RNA, 21 nt, Homo sapiens
gcccccgacaggcuggcucuc

SEQ ID NO: 1416045 - RNA, 17 nt, Homo sapiens
gcccccugaguucccaa

SEQ ID NO: 1416046 - RNA, 11 nt, Homo sapiens
gcccucaccag

SEQ ID NO: 1416047 - RNA, 19 nt, Homo sapiens
gcccucaccagaagcagau

SEQ ID NO: 1416048 - RNA, 22 nt, Homo sapiens
gcccuggaggccgcugcugacc

SEQ ID NO: 1416049 - RNA, 14 nt, Homo sapiens
gcccuucagugccc

SEQ ID NO: 1416050 - RNA, 19 nt, Homo sapiens
gccgaaccaggagcugcuc

SEQ ID NO: 1416051 - RNA, 18 nt, Homo sapiens
gccgacucagcaacuuuc

SEQ ID NO: 1416052 - RNA, 17 nt, Homo sapiens
gccggggcugaagccac

SEQ ID NO: 1416053 - RNA, 21 nt, Homo sapiens
gccguccaagaacaagucacc

SEQ ID NO: 1416054 - RNA, 18 nt, Homo sapiens
gccuaaaugugaccaaac

SEQ ID NO: 1416055 - RNA, 23 nt, Homo sapiens
gccuagugugccaagaaugccca

SEQ ID NO: 1416056 - RNA, 13 nt, Homo sapiens
gccucagggccaa

SEQ ID NO: 1416057 - RNA, 21 nt, Homo sapiens
gccucaguccuccccucacag

SEQ ID NO: 1416058 - RNA, 16 nt, Homo sapiens
gccuccugccaaggcc

SEQ ID NO: 1416059 - RNA, 20 nt, Homo sapiens
gccuccugggacugugacug

SEQ ID NO: 1416060 - RNA, 17 nt, Homo sapiens
gccuccuucaccaaaga

SEQ ID NO: 1416061 - RNA, 21 nt, Homo sapiens
gccugcuuugugcaggguccu

SEQ ID NO: 1416062 - RNA, 16 nt, Homo sapiens
gccuggacgcagccac

SEQ ID NO: 1416063 - RNA, 21 nt, Homo sapiens
gccugucggccacaccccaga

SEQ ID NO: 1416064 - RNA, 17 nt, Homo sapiens
gccuuauaucauuucau

SEQ ID NO: 1416065 - RNA, 19 nt, Homo sapiens
gcgaaaucuguugugcaug

SEQ ID NO: 1416066 - RNA, 22 nt, Homo sapiens
gcgagcccccggucaccuuccu

SEQ ID NO: 1416067 - RNA, 17 nt, Homo sapiens
uggacaucuacccagau

SEQ ID NO: 1416068 - RNA, 14 nt, Homo sapiens
uggagacaguaaca

SEQ ID NO: 1416069 - RNA, 21 nt, Homo sapiens
uggagagagagcaagauuccu

SEQ ID NO: 1416070 - RNA, 19 nt, Homo sapiens
uggaggaggaaggcaagag

SEQ ID NO: 1416071 - RNA, 15 nt, Homo sapiens
uggauauuugccuuu

SEQ ID NO: 1416072 - RNA, 12 nt, Homo sapiens
uggcaagcucuu

SEQ ID NO: 1416073 - RNA, 20 nt, Homo sapiens
uggcaggaucggcuuccuca

SEQ ID NO: 1416074 - RNA, 22 nt, Homo sapiens
uggcaguuuguugaucuuuuaa

SEQ ID NO: 1416075 - RNA, 14 nt, Homo sapiens
uggccagaagucaa

SEQ ID NO: 1416076 - RNA, 23 nt, Homo sapiens
uggccuaggugggagccaccacu

SEQ ID NO: 1416077 - RNA, 24 nt, Homo sapiens
uggccucagaugauggggucagca

SEQ ID NO: 1416078 - RNA, 19 nt, Homo sapiens
uggccugcugugauuccac

SEQ ID NO: 1416079 - RNA, 15 nt, Homo sapiens
uggcuaacaugguga

SEQ ID NO: 1416080 - RNA, 16 nt, Homo sapiens
uggcuaacauggugaa

SEQ ID NO: 1416081 - RNA, 16 nt, Homo sapiens
uggcugcugcugccac

SEQ ID NO: 1416082 - RNA, 17 nt, Homo sapiens
uggcuuugugcugcuga

SEQ ID NO: 1416083 - RNA, 15 nt, Homo sapiens
ugggaaaguugcauu

SEQ ID NO: 1416084 - RNA, 15 nt, Homo sapiens
ugggaacuaauuuca

SEQ ID NO: 1416085 - RNA, 17 nt, Homo sapiens
ugggaacuaauuucaag

SEQ ID NO: 1416086 - RNA, 16 nt, Homo sapiens
ugggaagggacaucug

SEQ ID NO: 1416087 - RNA, 18 nt, Homo sapiens
ugggacuguuuacaaaug

SEQ ID NO: 1416088 - RNA, 15 nt, Homo sapiens
ugggagaguucucca

SEQ ID NO: 1416089 - RNA, 22 nt, Homo sapiens
ugggagauaggccuugcuugcu

SEQ ID NO: 1416090 - RNA, 21 nt, Homo sapiens
ugggagggggcuugaagccaa

SEQ ID NO: 1416091 - RNA, 19 nt, Homo sapiens
ugggaguguuugucccauc

SEQ ID NO: 1416092 - RNA, 17 nt, Homo sapiens
ugggccccaucauuaaa

SEQ ID NO: 1416093 - RNA, 23 nt, Homo sapiens
ugggcucugugcagucacuggag

SEQ ID NO: 1416094 - RNA, 15 nt, Homo sapiens
ugggggcggaucccu

SEQ ID NO: 1416095 - RNA, 17 nt, Homo sapiens
ugggguccccuccagca

SEQ ID NO: 1416096 - RNA, 16 nt, Homo sapiens
uggucauaucuaguca

SEQ ID NO: 1416097 - RNA, 13 nt, Homo sapiens
uggucucaucucc

SEQ ID NO: 1416098 - RNA, 16 nt, Homo sapiens
uggugucgcaucaaga

SEQ ID NO: 1416099 - RNA, 15 nt, Homo sapiens
ugguuggacaccauc

SEQ ID NO: 1416100 - RNA, 18 nt, Homo sapiens
uguaagcccagcauuuga

SEQ ID NO: 1416101 - RNA, 18 nt, Homo sapiens
uguaauaaauaugagugc

SEQ ID NO: 1416102 - RNA, 19 nt, Homo sapiens
uguaaucucucauggugaa

SEQ ID NO: 1416103 - RNA, 17 nt, Homo sapiens
uguacauauaagugauu

SEQ ID NO: 1416104 - RNA, 19 nt, Homo sapiens
uguacaucagacaauugca

SEQ ID NO: 1416105 - RNA, 16 nt, Homo sapiens
uguaccauucucaggu

SEQ ID NO: 1416106 - RNA, 13 nt, Homo sapiens
uguagccaugacc

SEQ ID NO: 1416107 - RNA, 18 nt, Homo sapiens
uguauaaguuugggcuga

SEQ ID NO: 1416108 - RNA, 19 nt, Homo sapiens
uguauauaaaaugugcgag

SEQ ID NO: 1416109 - RNA, 21 nt, Homo sapiens
uguaucaacaaaaggagccaa

SEQ ID NO: 1416110 - RNA, 17 nt, Homo sapiens
uguaugacuuugugcca

SEQ ID NO: 1416111 - RNA, 22 nt, Homo sapiens
uguauucuacccuguugcaaag

SEQ ID NO: 1416112 - RNA, 16 nt, Homo sapiens
ugucauugacaaagcu

SEQ ID NO: 1416113 - RNA, 19 nt, Homo sapiens
uguccugggggaugcaaau

SEQ ID NO: 1416114 - RNA, 16 nt, Homo sapiens
ugucugagagccauaa

SEQ ID NO: 1416115 - RNA, 13 nt, Homo sapiens
ugucuggggacag

SEQ ID NO: 1416116 - RNA, 17 nt, Homo sapiens
ugucugugugcuacuaa

SEQ ID NO: 1416117 - RNA, 13 nt, Homo sapiens
ugugacacacugg

SEQ ID NO: 1416118 - RNA, 17 nt, Homo sapiens
ugugaccuguaguguac

SEQ ID NO: 1416119 - RNA, 16 nt, Homo sapiens
ugugcaggguccuccg

SEQ ID NO: 1416120 - RNA, 14 nt, Homo sapiens
ugugcaugcucaaa

SEQ ID NO: 1416121 - RNA, 21 nt, Homo sapiens
ugugccucaacauacuguuga

SEQ ID NO: 1416122 - RNA, 15 nt, Homo sapiens
ugugcuguucaaguu

SEQ ID NO: 1416123 - RNA, 15 nt, Homo sapiens
uguggcagugguuuu

SEQ ID NO: 1416124 - RNA, 17 nt, Homo sapiens
uguggcugcugcugcca

SEQ ID NO: 1416125 - RNA, 23 nt, Homo sapiens
uguggucauaucuagucacuugu

SEQ ID NO: 1416126 - RNA, 17 nt, Homo sapiens
ugugucauugacaaagc

SEQ ID NO: 1416127 - RNA, 14 nt, Homo sapiens
ugugucugcaggau

SEQ ID NO: 1416128 - RNA, 18 nt, Homo sapiens
uguguuuaggaacuacug

SEQ ID NO: 1416129 - RNA, 17 nt, Homo sapiens
uguguuuuugccacuga

SEQ ID NO: 1416130 - RNA, 15 nt, Homo sapiens
uguuacaaauaugca

SEQ ID NO: 1416131 - RNA, 17 nt, Homo sapiens
uguuagguguacauccu

SEQ ID NO: 1416132 - RNA, 17 nt, Homo sapiens
uguucaaagugugacau

SEQ ID NO: 1416133 - RNA, 23 nt, Homo sapiens
uguucaaagugugacauucagug

SEQ ID NO: 1416134 - RNA, 14 nt, Homo sapiens
uguucagacauucc

SEQ ID NO: 1416135 - RNA, 23 nt, Homo sapiens
uguucagacauuccauggugauu

SEQ ID NO: 1416136 - RNA, 21 nt, Homo sapiens
uguugcugccacucuacaggu

SEQ ID NO: 1416137 - RNA, 16 nt, Homo sapiens
uguuggauguaugugu

SEQ ID NO: 1416138 - RNA, 20 nt, Homo sapiens
uguugucagcccaugcuuau

SEQ ID NO: 1416139 - RNA, 19 nt, Homo sapiens
uguugugcaaguugacaaa

SEQ ID NO: 1416140 - RNA, 18 nt, Homo sapiens
uguuguuauuauaugaua

SEQ ID NO: 1416141 - RNA, 13 nt, Homo sapiens
uuaaaaccaaaga

SEQ ID NO: 1416142 - RNA, 21 nt, Homo sapiens
uuaaagacuuuuaugauacuu

SEQ ID NO: 1416143 - RNA, 22 nt, Homo sapiens
uuaagaugggguauucuuucac

SEQ ID NO: 1416144 - RNA, 15 nt, Homo sapiens
uuaagucagcaaauc

SEQ ID NO: 1416145 - RNA, 19 nt, Homo sapiens
uuaauaccacugagaccuu

SEQ ID NO: 1416146 - RNA, 22 nt, Homo sapiens
uuaaucaaucuuugugccucaa

SEQ ID NO: 1416147 - RNA, 18 nt, Homo sapiens
uuaaugcauauuccccuc

SEQ ID NO: 1416148 - RNA, 14 nt, Homo sapiens
uuaauguacaguaa

SEQ ID NO: 1416149 - RNA, 19 nt, Homo sapiens
uuacaauuaaacucaaagc

SEQ ID NO: 1416150 - RNA, 18 nt, Homo sapiens
uuacacaaaggaccucag

SEQ ID NO: 1416151 - RNA, 15 nt, Homo sapiens
uuacagugggccauu

SEQ ID NO: 1416152 - RNA, 16 nt, Homo sapiens
uuacauuaacauuuag

SEQ ID NO: 1416153 - RNA, 21 nt, Homo sapiens
uuacauuagcugaaaagagaa

SEQ ID NO: 1416154 - RNA, 22 nt, Homo sapiens
uuacauuuucucugaugauguc

SEQ ID NO: 1416155 - RNA, 14 nt, Homo sapiens
uuacccuccuguaa

SEQ ID NO: 1416156 - RNA, 16 nt, Homo sapiens
uuaccgagagccaaac

SEQ ID NO: 1416157 - RNA, 11 nt, Homo sapiens
uuacugccaaa

SEQ ID NO: 1416158 - RNA, 18 nt, Homo sapiens
gcugcaucccaccagccu

SEQ ID NO: 1416159 - RNA, 14 nt, Homo sapiens
gcugccccauggcu

SEQ ID NO: 1416160 - RNA, 20 nt, Homo sapiens
gcugccugcuuugugcaggg

SEQ ID NO: 1416161 - RNA, 23 nt, Homo sapiens
gcugccuucccuagcuuuagacc

SEQ ID NO: 1416162 - RNA, 19 nt, Homo sapiens
gcugcggcugcaucuucca

SEQ ID NO: 1416163 - RNA, 13 nt, Homo sapiens
gcugcugccaagu

SEQ ID NO: 1416164 - RNA, 14 nt, Homo sapiens
gcuggagugccaug

SEQ ID NO: 1416165 - RNA, 19 nt, Homo sapiens
gcuggcuccugaagggugc

SEQ ID NO: 1416166 - RNA, 20 nt, Homo sapiens
gcugggccucccuuugccag

SEQ ID NO: 1416167 - RNA, 16 nt, Homo sapiens
gcuggggcacuuuaaa

SEQ ID NO: 1416168 - RNA, 16 nt, Homo sapiens
gcuggucuucagcaaa

SEQ ID NO: 1416169 - RNA, 21 nt, Homo sapiens
gcuggugucugagcuucagua

SEQ ID NO: 1416170 - RNA, 13 nt, Homo sapiens
gcugguuugccca

SEQ ID NO: 1416171 - RNA, 20 nt, Homo sapiens
gcugguuugcccagagccaa

SEQ ID NO: 1416172 - RNA, 21 nt, Homo sapiens
gcuuaaaaaagaaagauuuua

SEQ ID NO: 1416173 - RNA, 15 nt, Homo sapiens
gcuucccaaagugcu

SEQ ID NO: 1416174 - RNA, 19 nt, Homo sapiens
gcuuccucuagaagccaag

SEQ ID NO: 1416175 - RNA, 20 nt, Homo sapiens
gcuucucaucuaaauauuuc

SEQ ID NO: 1416176 - RNA, 14 nt, Homo sapiens
gcuugccucagggc

SEQ ID NO: 1416177 - RNA, 18 nt, Homo sapiens
gcuuuaaaaaucauugua

SEQ ID NO: 1416178 - RNA, 20 nt, Homo sapiens
gcuuugaaaaaacaccauga

SEQ ID NO: 1416179 - RNA, 17 nt, Homo sapiens
gcuuugccccacuggga

SEQ ID NO: 1416180 - RNA, 16 nt, Homo sapiens
gcuuuuugaaauaagg

SEQ ID NO: 1416181 - RNA, 14 nt, Homo sapiens
ggaaaacucaggau

SEQ ID NO: 1416182 - RNA, 18 nt, Homo sapiens
ggaaccucacucuugcca

SEQ ID NO: 1416183 - RNA, 20 nt, Homo sapiens
ggaaccucacucuugccaac

SEQ ID NO: 1416184 - RNA, 20 nt, Homo sapiens
ggaacgaauacccugcucaa

SEQ ID NO: 1416185 - RNA, 19 nt, Homo sapiens
ggaaggcuaauauauucca

SEQ ID NO: 1416186 - RNA, 20 nt, Homo sapiens
ggaauaaagcuucucucuga

SEQ ID NO: 1416187 - RNA, 13 nt, Homo sapiens
ggacaucuguucu

SEQ ID NO: 1416188 - RNA, 19 nt, Homo sapiens
ggagaagggacaaaaggua

SEQ ID NO: 1416189 - RNA, 18 nt, Homo sapiens
ggagacaguaacacuggc

SEQ ID NO: 1416190 - RNA, 15 nt, Homo sapiens
ggagccagaggccag

SEQ ID NO: 1416191 - RNA, 17 nt, Homo sapiens
ggagcugauaacauuuu

SEQ ID NO: 1416192 - RNA, 17 nt, Homo sapiens
ggaggaguuagccaaac

SEQ ID NO: 1416193 - RNA, 15 nt, Homo sapiens
ggaggggggagccag

SEQ ID NO: 1416194 - RNA, 20 nt, Homo sapiens
ggaucacgaggucaggagau

SEQ ID NO: 1416195 - RNA, 21 nt, Homo sapiens
ggauccauccugcuagcaccu

SEQ ID NO: 1416196 - RNA, 14 nt, Homo sapiens
ggcaagggguuucc

SEQ ID NO: 1416197 - RNA, 14 nt, Homo sapiens
ggcacaagugcccg

SEQ ID NO: 1416198 - RNA, 19 nt, Homo sapiens
ggcagaaugcauauaucuc

SEQ ID NO: 1416199 - RNA, 15 nt, Homo sapiens
ggcauuccucuaaug

SEQ ID NO: 1416200 - RNA, 15 nt, Homo sapiens
ggccacccagccagg

SEQ ID NO: 1416201 - RNA, 23 nt, Homo sapiens
ggccagccccacccccagccagg

SEQ ID NO: 1416202 - RNA, 21 nt, Homo sapiens
ggccucaagaaacaaugucug

SEQ ID NO: 1416203 - RNA, 23 nt, Homo sapiens
ggccuccuucaccaaagaucugc

SEQ ID NO: 1416204 - RNA, 15 nt, Homo sapiens
ggcuaacauggugaa

SEQ ID NO: 1416205 - RNA, 15 nt, Homo sapiens
ggcuacaguccuucc

SEQ ID NO: 1416206 - RNA, 19 nt, Homo sapiens
ggcucaacuccuccuuuau

SEQ ID NO: 1416207 - RNA, 20 nt, Homo sapiens
ggcuccugaagggugcucag

SEQ ID NO: 1416208 - RNA, 23 nt, Homo sapiens
ggcuccugaagggugcucagucu

SEQ ID NO: 1416209 - RNA, 14 nt, Homo sapiens
ggcugcaucuucca

SEQ ID NO: 1416210 - RNA, 15 nt, Homo sapiens
ggcugcugcugccac

SEQ ID NO: 1416211 - RNA, 23 nt, Homo sapiens
ggcuuaacgugucugagagccau

SEQ ID NO: 1416212 - RNA, 16 nt, Homo sapiens
ggcuuccucaggggca

SEQ ID NO: 1416213 - RNA, 13 nt, Homo sapiens
ggcuugaagccaa

SEQ ID NO: 1416214 - RNA, 13 nt, Homo sapiens
ggcuugggcaaua

SEQ ID NO: 1416215 - RNA, 15 nt, Homo sapiens
ggcuugggcaauaaa

SEQ ID NO: 1416216 - RNA, 13 nt, Homo sapiens
ggcuuugugcugc

SEQ ID NO: 1416217 - RNA, 19 nt, Homo sapiens
gggaaccucacucuugcca

SEQ ID NO: 1416218 - RNA, 17 nt, Homo sapiens
gggcaacgacgguuuca

SEQ ID NO: 1416219 - RNA, 14 nt, Homo sapiens
gggcaagucaccca

SEQ ID NO: 1416220 - RNA, 23 nt, Homo sapiens
gggcaauaaaagauaagugcagu

SEQ ID NO: 1416221 - RNA, 18 nt, Homo sapiens
gggcagaggcaaggaugg

SEQ ID NO: 1416222 - RNA, 20 nt, Homo sapiens
gggcaugccccggccaccuc

SEQ ID NO: 1416223 - RNA, 14 nt, Homo sapiens
gggcugacaucaag

SEQ ID NO: 1416224 - RNA, 14 nt, Homo sapiens
gggcugagggaugg

SEQ ID NO: 1416225 - RNA, 15 nt, Homo sapiens
gggcugcccccgaca

SEQ ID NO: 1416226 - RNA, 15 nt, Homo sapiens
gggcuugaagccaaa

SEQ ID NO: 1416227 - RNA, 15 nt, Homo sapiens
ggguccccuccagca

SEQ ID NO: 1416228 - RNA, 17 nt, Homo sapiens
gggugcauaucuuccca

SEQ ID NO: 1416229 - RNA, 17 nt, Homo sapiens
ggguuugccaagcccuu

SEQ ID NO: 1416230 - RNA, 20 nt, Homo sapiens
gguauugaaucuaaaaccaa

SEQ ID NO: 1416231 - RNA, 14 nt, Homo sapiens
ggucaggaguuuga

SEQ ID NO: 1416232 - RNA, 19 nt, Homo sapiens
ggucauaucuagucacuug

SEQ ID NO: 1416233 - RNA, 16 nt, Homo sapiens
ggugaaggauugaaau

SEQ ID NO: 1416234 - RNA, 21 nt, Homo sapiens
ggugagauaauguucugggaa

SEQ ID NO: 1416235 - RNA, 18 nt, Homo sapiens
ggugauguuugcauuuac

SEQ ID NO: 1416236 - RNA, 15 nt, Homo sapiens
gguuaagaauguaua

SEQ ID NO: 1416237 - RNA, 16 nt, Homo sapiens
gguuacccuaaauguu

SEQ ID NO: 1416238 - RNA, 21 nt, Homo sapiens
gguugccaccccaacccaaua

SEQ ID NO: 1416239 - RNA, 15 nt, Homo sapiens
gguuguuccccucau

SEQ ID NO: 1416240 - RNA, 20 nt, Homo sapiens
gguuugcccagagccaagcu

SEQ ID NO: 1416241 - RNA, 14 nt, Homo sapiens
gguuuugauugaga

SEQ ID NO: 1416242 - RNA, 23 nt, Homo sapiens
gguuuuucccaccaauccucacc

SEQ ID NO: 1416243 - RNA, 19 nt, Homo sapiens
gguuuuuuucuucuguauu

SEQ ID NO: 1416244 - RNA, 15 nt, Homo sapiens
guaaaaacaaagaaa

SEQ ID NO: 1416245 - RNA, 17 nt, Homo sapiens
guaaaauucuacuguau

SEQ ID NO: 1416246 - RNA, 22 nt, Homo sapiens
guaaaauucuacuguauggaau

SEQ ID NO: 1416247 - RNA, 23 nt, Homo sapiens
guaaauauuuuguuaucugaacu

SEQ ID NO: 1416248 - RNA, 17 nt, Homo sapiens
guaaaucagacuaugaa

SEQ ID NO: 1416249 - RNA, 20 nt, Homo sapiens
guaaauuauuuuaugucaua

SEQ ID NO: 1416250 - RNA, 17 nt, Homo sapiens
guaagcccagcauuuga

SEQ ID NO: 1416251 - RNA, 16 nt, Homo sapiens
guaaguuucauucuaa

SEQ ID NO: 1416252 - RNA, 13 nt, Homo sapiens
guaauaaauauga

SEQ ID NO: 1416253 - RNA, 16 nt, Homo sapiens
guaaucccagcacuuu

SEQ ID NO: 1416254 - RNA, 17 nt, Homo sapiens
guaauuuccacuuggga

SEQ ID NO: 1416255 - RNA, 21 nt, Homo sapiens
guaauuuuaguuauacuccuc

SEQ ID NO: 1416256 - RNA, 17 nt, Homo sapiens
guaccaaauuuaagcaa

SEQ ID NO: 1416257 - RNA, 21 nt, Homo sapiens
guaccauuuauuuuaugacau

SEQ ID NO: 1416258 - RNA, 20 nt, Homo sapiens
guacucuuguuuccuuauau

SEQ ID NO: 1416259 - RNA, 23 nt, Homo sapiens
guagaaaucucaucuuuguaaua

SEQ ID NO: 1416260 - RNA, 23 nt, Homo sapiens
guagaagauugagauguguucac

SEQ ID NO: 1416261 - RNA, 12 nt, Homo sapiens
aauuaugcugca

SEQ ID NO: 1416262 - RNA, 13 nt, Homo sapiens
aauucaguucuga

SEQ ID NO: 1416263 - RNA, 18 nt, Homo sapiens
aauuccagcaucugaaga

SEQ ID NO: 1416264 - RNA, 19 nt, Homo sapiens
aauugagcagcaugauuau

SEQ ID NO: 1416265 - RNA, 16 nt, Homo sapiens
aauuguugacugcuga

SEQ ID NO: 1416266 - RNA, 21 nt, Homo sapiens
aauuugaaacacuuugcauaa

SEQ ID NO: 1416267 - RNA, 21 nt, Homo sapiens
agcaaaaagagaugcuggauu

SEQ ID NO: 1416268 - RNA, 23 nt, Homo sapiens
agcaaaaugguuuuuaaguacuu

SEQ ID NO: 1416269 - RNA, 17 nt, Homo sapiens
agcaaacaccaccaagu

SEQ ID NO: 1416270 - RNA, 12 nt, Homo sapiens
agcaagauuccu

SEQ ID NO: 1416271 - RNA, 21 nt, Homo sapiens
agcaaucgaaucccuuucuca

SEQ ID NO: 1416272 - RNA, 17 nt, Homo sapiens
agcacgcgacuucucag

SEQ ID NO: 1416273 - RNA, 15 nt, Homo sapiens
agcacuugaugccac

SEQ ID NO: 1416274 - RNA, 13 nt, Homo sapiens
agcagauaaggcc

SEQ ID NO: 1416275 - RNA, 22 nt, Homo sapiens
agcagcaugauuauaagccaaa

SEQ ID NO: 1416276 - RNA, 21 nt, Homo sapiens
agcaggguauggccagcuuua

SEQ ID NO: 1416277 - RNA, 18 nt, Homo sapiens
agcauaugcagagcccca

SEQ ID NO: 1416278 - RNA, 23 nt, Homo sapiens
agcauugaucugagugcuuucau

SEQ ID NO: 1416279 - RNA, 12 nt, Homo sapiens
agcauuuuggaa

SEQ ID NO: 1416280 - RNA, 19 nt, Homo sapiens
agccaagggaaaggggugc

SEQ ID NO: 1416281 - RNA, 14 nt, Homo sapiens
agccaccguguccu

SEQ ID NO: 1416282 - RNA, 22 nt, Homo sapiens
agccacuaauugccuuacaagc

SEQ ID NO: 1416283 - RNA, 16 nt, Homo sapiens
agccagcuggucuuca

SEQ ID NO: 1416284 - RNA, 18 nt, Homo sapiens
agccaggcacacacugug

SEQ ID NO: 1416285 - RNA, 19 nt, Homo sapiens
agcccaaaugccgcucuuc

SEQ ID NO: 1416286 - RNA, 18 nt, Homo sapiens
agcccugacggacuucau

SEQ ID NO: 1416287 - RNA, 23 nt, Homo sapiens
agcccuggaucucccaauggccu

SEQ ID NO: 1416288 - RNA, 19 nt, Homo sapiens
agccgacucagcaacuuuc

SEQ ID NO: 1416289 - RNA, 21 nt, Homo sapiens
agccggaucaaggcaagcccc

SEQ ID NO: 1416290 - RNA, 15 nt, Homo sapiens
agccugcaugcauuc

SEQ ID NO: 1416291 - RNA, 18 nt, Homo sapiens
agccugcuggcacccacc

SEQ ID NO: 1416292 - RNA, 23 nt, Homo sapiens
agccugucggccacaccccagac

SEQ ID NO: 1416293 - RNA, 21 nt, Homo sapiens
agccuucuuccaucccaggac

SEQ ID NO: 1416294 - RNA, 16 nt, Homo sapiens
agcggggcuacagucc

SEQ ID NO: 1416295 - RNA, 20 nt, Homo sapiens
agcuaauaaaauaucauuca

SEQ ID NO: 1416296 - RNA, 22 nt, Homo sapiens
agcuacaggcuugagcuuuaaa

SEQ ID NO: 1416297 - RNA, 19 nt, Homo sapiens
agcuacguguacauauuug

SEQ ID NO: 1416298 - RNA, 20 nt, Homo sapiens
agcuacguguacauauuuga

SEQ ID NO: 1416299 - RNA, 19 nt, Homo sapiens
agcuacuugggagguugaa

SEQ ID NO: 1416300 - RNA, 12 nt, Homo sapiens
agcucaaacccu

SEQ ID NO: 1416301 - RNA, 14 nt, Homo sapiens
agcucaaacccugu

SEQ ID NO: 1416302 - RNA, 13 nt, Homo sapiens
agcucagacauau

SEQ ID NO: 1416303 - RNA, 17 nt, Homo sapiens
agcucauggacuucugc

SEQ ID NO: 1416304 - RNA, 23 nt, Homo sapiens
agcucauggacuucugccagcau

SEQ ID NO: 1416305 - RNA, 22 nt, Homo sapiens
agcucccugccagcuuccuguc

SEQ ID NO: 1416306 - RNA, 20 nt, Homo sapiens
agcuccggguguagauuccc

SEQ ID NO: 1416307 - RNA, 18 nt, Homo sapiens
agcucuuuccuaaugagc

SEQ ID NO: 1416308 - RNA, 21 nt, Homo sapiens
agcugauguccaguugccacu

SEQ ID NO: 1416309 - RNA, 22 nt, Homo sapiens
agcugauguccaguugccacuu

SEQ ID NO: 1416310 - RNA, 15 nt, Homo sapiens
agcugcucacuaccu

SEQ ID NO: 1416311 - RNA, 14 nt, Homo sapiens
agcugcuucuccca

SEQ ID NO: 1416312 - RNA, 22 nt, Homo sapiens
agcugggggagaggugaccuag

SEQ ID NO: 1416313 - RNA, 11 nt, Homo sapiens
agcugguggcc

SEQ ID NO: 1416314 - RNA, 21 nt, Homo sapiens
agcuguuuuaucguuaagugc

SEQ ID NO: 1416315 - RNA, 11 nt, Homo sapiens
agcuuaggcag

SEQ ID NO: 1416316 - RNA, 18 nt, Homo sapiens
agcuuccauuaugcugca

SEQ ID NO: 1416317 - RNA, 15 nt, Homo sapiens
agcuugccucagggc

SEQ ID NO: 1416318 - RNA, 14 nt, Homo sapiens
agcuuggcugcuca

SEQ ID NO: 1416319 - RNA, 15 nt, Homo sapiens
agcuuggcugcucag

SEQ ID NO: 1416320 - RNA, 19 nt, Homo sapiens
aggaaaaacacaagcaaaa

SEQ ID NO: 1416321 - RNA, 20 nt, Homo sapiens
aggaaacuccacaucugccu

SEQ ID NO: 1416322 - RNA, 17 nt, Homo sapiens
aggaaaugugcacaaaa

SEQ ID NO: 1416323 - RNA, 16 nt, Homo sapiens
aggaacuagggauauu

SEQ ID NO: 1416324 - RNA, 15 nt, Homo sapiens
aggaagaacaucugg

SEQ ID NO: 1416325 - RNA, 18 nt, Homo sapiens
aggaagaacaucuggauu

SEQ ID NO: 1416326 - RNA, 13 nt, Homo sapiens
aggaagcuuggcu

SEQ ID NO: 1416327 - RNA, 18 nt, Homo sapiens
aggaagcuuggcugcuca

SEQ ID NO: 1416328 - RNA, 15 nt, Homo sapiens
aggaauaaagcuucu

SEQ ID NO: 1416329 - RNA, 23 nt, Homo sapiens
aggaauaaagcuucucucugagc

SEQ ID NO: 1416330 - RNA, 21 nt, Homo sapiens
aggaaugaucccacucaccag

SEQ ID NO: 1416331 - RNA, 22 nt, Homo sapiens
aggacccucagccccaggagaa

SEQ ID NO: 1416332 - RNA, 19 nt, Homo sapiens
aggaccucagcugcuucuc

SEQ ID NO: 1416333 - RNA, 15 nt, Homo sapiens
aggacuuacagaucc

SEQ ID NO: 1416334 - RNA, 16 nt, Homo sapiens
aggagacacauucaca

SEQ ID NO: 1416335 - RNA, 20 nt, Homo sapiens
aggagagaaagugggugaga

SEQ ID NO: 1416336 - RNA, 20 nt, Homo sapiens
aggaggaguuagccaaacaa

SEQ ID NO: 1416337 - RNA, 15 nt, Homo sapiens
aggaggcugggagag

SEQ ID NO: 1416338 - RNA, 15 nt, Homo sapiens
aggagggcuuugugu

SEQ ID NO: 1416339 - RNA, 22 nt, Homo sapiens
aggagucuuauaucccagguga

SEQ ID NO: 1416340 - RNA, 17 nt, Homo sapiens
aggauccugguauugua

SEQ ID NO: 1416341 - RNA, 17 nt, Homo sapiens
aggauuuuaaaugcugu

SEQ ID NO: 1416342 - RNA, 15 nt, Homo sapiens
aggcaagaguagggu

SEQ ID NO: 1416343 - RNA, 16 nt, Homo sapiens
aggcaaggucuggccu

SEQ ID NO: 1416344 - RNA, 11 nt, Homo sapiens
aggcaccagag

SEQ ID NO: 1416345 - RNA, 18 nt, Homo sapiens
aggcagagcuguggcaca

SEQ ID NO: 1416346 - RNA, 12 nt, Homo sapiens
aggcaguucucu

SEQ ID NO: 1416347 - RNA, 16 nt, Homo sapiens
aggcauuccagcuccu

SEQ ID NO: 1416348 - RNA, 18 nt, Homo sapiens
aggccgggcacaguggcu

SEQ ID NO: 1416349 - RNA, 19 nt, Homo sapiens
aggccgggcacaguggcuc

SEQ ID NO: 1416350 - RNA, 20 nt, Homo sapiens
aggcggguggaucacuugag

SEQ ID NO: 1416351 - RNA, 20 nt, Homo sapiens
aggcucccccuccucugacu

SEQ ID NO: 1416352 - RNA, 20 nt, Homo sapiens
aggcuggaguacaauggcgu

SEQ ID NO: 1416353 - RNA, 20 nt, Homo sapiens
aggcuggagugcaguggcuc

SEQ ID NO: 1416354 - RNA, 21 nt, Homo sapiens
aggcuggagugcaguggcuca

SEQ ID NO: 1416355 - RNA, 19 nt, Homo sapiens
aggcugggaggcucggggc

SEQ ID NO: 1416356 - RNA, 10 nt, Homo sapiens
aggcuuccug

SEQ ID NO: 1416357 - RNA, 15 nt, Homo sapiens
aggcuuugugucagg

SEQ ID NO: 1416358 - RNA, 20 nt, Homo sapiens
agggagacuccgcuguggga

SEQ ID NO: 1416359 - RNA, 17 nt, Homo sapiens
agggauauuuaacugga

SEQ ID NO: 1416360 - RNA, 18 nt, Homo sapiens
agggauauuuaacuggag

SEQ ID NO: 1416361 - RNA, 14 nt, Homo sapiens
agggcaggcccaaa

SEQ ID NO: 1416362 - RNA, 20 nt, Homo sapiens
agggcaugggagugaucuca

SEQ ID NO: 1416363 - RNA, 20 nt, Homo sapiens
agggcccggugccuguagca

SEQ ID NO: 1416364 - RNA, 21 nt, Homo sapiens
agggcccucuggggcucagcc

SEQ ID NO: 1416365 - RNA, 22 nt, Homo sapiens
agggguggggguggaggcuucc

SEQ ID NO: 1416366 - RNA, 18 nt, Homo sapiens
agguacuggugagggcaa

SEQ ID NO: 1416367 - RNA, 20 nt, Homo sapiens
agguagccagggggacuagc

SEQ ID NO: 1416368 - RNA, 12 nt, Homo sapiens
aggucacuggaa

SEQ ID NO: 1416369 - RNA, 12 nt, Homo sapiens
aggucaggagau

SEQ ID NO: 1416370 - RNA, 23 nt, Homo sapiens
agguccaggguuguuagaucuuc

SEQ ID NO: 1416371 - RNA, 21 nt, Homo sapiens
aggucuauggcucaugucuga

SEQ ID NO: 1416372 - RNA, 18 nt, Homo sapiens
aggucuggcugcuugccc

SEQ ID NO: 1416373 - RNA, 18 nt, Homo sapiens
aggugaucucaguucucu

SEQ ID NO: 1416374 - RNA, 20 nt, Homo sapiens
agguguaagccaucacaccu

SEQ ID NO: 1416375 - RNA, 22 nt, Homo sapiens
agguuuuaucaguagaaguguc

SEQ ID NO: 1416376 - RNA, 12 nt, Homo sapiens
aguaacacuggc

SEQ ID NO: 1416377 - RNA, 17 nt, Homo sapiens
aguaauaaaaagccacc

SEQ ID NO: 1416378 - RNA, 20 nt, Homo sapiens
aguacaauggcgugaucuca

SEQ ID NO: 1416379 - RNA, 21 nt, Homo sapiens
aguacaauggcgugaucucag

SEQ ID NO: 1416380 - RNA, 18 nt, Homo sapiens
aguaccaaaugcuuuaaa

SEQ ID NO: 1416381 - RNA, 19 nt, Homo sapiens
aguagcugggacuacaggc

SEQ ID NO: 1416382 - RNA, 19 nt, Homo sapiens
aguauggugcuaauguguc

SEQ ID NO: 1416383 - RNA, 14 nt, Homo sapiens
agucaccaugccug

SEQ ID NO: 1416384 - RNA, 20 nt, Homo sapiens
aguccagaaccccugucaca

SEQ ID NO: 1416385 - RNA, 22 nt, Homo sapiens
aguccagcccuggaucucccaa

SEQ ID NO: 1416386 - RNA, 21 nt, Homo sapiens
aguccagcucaucugccaaaa

SEQ ID NO: 1416387 - RNA, 16 nt, Homo sapiens
aguccaggaaugaucc

SEQ ID NO: 1416388 - RNA, 18 nt, Homo sapiens
aguccaggaaugauccca

SEQ ID NO: 1416389 - RNA, 12 nt, Homo sapiens
agucgcucucau

SEQ ID NO: 1416390 - RNA, 21 nt, Homo sapiens
agucgcucucaugaagcccuu

SEQ ID NO: 1416391 - RNA, 19 nt, Homo sapiens
agucucugaacuaggugau

SEQ ID NO: 1416392 - RNA, 22 nt, Homo sapiens
agucuuccaaaccaccuucccu

SEQ ID NO: 1416393 - RNA, 24 nt, Homo sapiens
agugaaugaaagucuugugacuag

SEQ ID NO: 1416394 - RNA, 13 nt, Homo sapiens
agugacagguuuu

SEQ ID NO: 1416395 - RNA, 13 nt, Homo sapiens
agugagcauccuu

SEQ ID NO: 1416396 - RNA, 18 nt, Homo sapiens
agugcacaccgugugcca

SEQ ID NO: 1416397 - RNA, 17 nt, Homo sapiens
agugcaguggcucaaug

SEQ ID NO: 1416398 - RNA, 18 nt, Homo sapiens
cccaggaguucugcucau

SEQ ID NO: 1416399 - RNA, 19 nt, Homo sapiens
cccaggcuggagugcagug

SEQ ID NO: 1416400 - RNA, 12 nt, Homo sapiens
cccaucauuaaa

SEQ ID NO: 1416401 - RNA, 23 nt, Homo sapiens
cccaucgccagcugaugacucaa

SEQ ID NO: 1416402 - RNA, 20 nt, Homo sapiens
cccaucuaccacaucuucau

SEQ ID NO: 1416403 - RNA, 18 nt, Homo sapiens
cccaucuggcugugacag

SEQ ID NO: 1416404 - RNA, 14 nt, Homo sapiens
cccaugcagugacc

SEQ ID NO: 1416405 - RNA, 22 nt, Homo sapiens
ccccaaaucccccgacucccuc

SEQ ID NO: 1416406 - RNA, 17 nt, Homo sapiens
ccccacagagacacuuu

SEQ ID NO: 1416407 - RNA, 19 nt, Homo sapiens
ccccacagagacacuuuac

SEQ ID NO: 1416408 - RNA, 13 nt, Homo sapiens
ccccuggccaaca

SEQ ID NO: 1416409 - RNA, 23 nt, Homo sapiens
ccccuucaccuucugccaugauu

SEQ ID NO: 1416410 - RNA, 15 nt, Homo sapiens
ccccuuuacuccucg

SEQ ID NO: 1416411 - RNA, 14 nt, Homo sapiens
cccgaccguugcca

SEQ ID NO: 1416412 - RNA, 14 nt, Homo sapiens
cccguuagucucug

SEQ ID NO: 1416413 - RNA, 20 nt, Homo sapiens
cccuccaaaucucauguuca

SEQ ID NO: 1416414 - RNA, 22 nt, Homo sapiens
cccuccaucccuuccccagaga

SEQ ID NO: 1416415 - RNA, 17 nt, Homo sapiens
cccucccccuaaggcag

SEQ ID NO: 1416416 - RNA, 13 nt, Homo sapiens
cccucugcuaaag

SEQ ID NO: 1416417 - RNA, 13 nt, Homo sapiens
cccugaagccagc

SEQ ID NO: 1416418 - RNA, 13 nt, Homo sapiens
cccugaggaauaa

SEQ ID NO: 1416419 - RNA, 22 nt, Homo sapiens
cccuguaaguuacagucacaau

SEQ ID NO: 1416420 - RNA, 22 nt, Homo sapiens
cccugucccucccaccucugug

SEQ ID NO: 1416421 - RNA, 11 nt, Homo sapiens
cccuguugcaa

SEQ ID NO: 1416422 - RNA, 13 nt, Homo sapiens
cccuguugcaaag

SEQ ID NO: 1416423 - RNA, 17 nt, Homo sapiens
cccuuacccaccuguca

SEQ ID NO: 1416424 - RNA, 13 nt, Homo sapiens
cccuuuacuccuc

SEQ ID NO: 1416425 - RNA, 17 nt, Homo sapiens
cccuuuccucaggcaag

SEQ ID NO: 1416426 - RNA, 22 nt, Homo sapiens
cccuuuggggauagucuggaaa

SEQ ID NO: 1416427 - RNA, 18 nt, Homo sapiens
ccgacaggcuggcucuca

SEQ ID NO: 1416428 - RNA, 16 nt, Homo sapiens
ccgagcccacaccauc

SEQ ID NO: 1416429 - RNA, 23 nt, Homo sapiens
ccgcacagagcuggggcugaggg

SEQ ID NO: 1416430 - RNA, 18 nt, Homo sapiens
ccgcccuggcuaacaugg

SEQ ID NO: 1416431 - RNA, 11 nt, Homo sapiens
ccggacagugg

SEQ ID NO: 1416432 - RNA, 13 nt, Homo sapiens
ccgggcauggugg

SEQ ID NO: 1416433 - RNA, 21 nt, Homo sapiens
ccgguuggaggcucucauguc

SEQ ID NO: 1416434 - RNA, 22 nt, Homo sapiens
ccguccucaccccuguccucac

SEQ ID NO: 1416435 - RNA, 14 nt, Homo sapiens
ccuaaaacacuugc

SEQ ID NO: 1416436 - RNA, 14 nt, Homo sapiens
ccuaaauguucccu

SEQ ID NO: 1416437 - RNA, 17 nt, Homo sapiens
ccuaaauugaacugcca

SEQ ID NO: 1416438 - RNA, 20 nt, Homo sapiens
ccuaacauacugcauuucac

SEQ ID NO: 1416439 - RNA, 20 nt, Homo sapiens
ccuacuguuggauguaugug

SEQ ID NO: 1416440 - RNA, 14 nt, Homo sapiens
ccuauacaguucua

SEQ ID NO: 1416441 - RNA, 13 nt, Homo sapiens
ccucaagugccuu

SEQ ID NO: 1416442 - RNA, 12 nt, Homo sapiens
ccucagggaugg

SEQ ID NO: 1416443 - RNA, 22 nt, Homo sapiens
ccucaggggcacagaccucucc

SEQ ID NO: 1416444 - RNA, 23 nt, Homo sapiens
ccucaguuacacaaaggaccuca

SEQ ID NO: 1416445 - RNA, 15 nt, Homo sapiens
ccucauuguucugua

SEQ ID NO: 1416446 - RNA, 16 nt, Homo sapiens
ccucauuuuguuccuu

SEQ ID NO: 1416447 - RNA, 22 nt, Homo sapiens
ccuccagcacgcgacuucucag

SEQ ID NO: 1416448 - RNA, 11 nt, Homo sapiens
ccuccaucucu

SEQ ID NO: 1416449 - RNA, 20 nt, Homo sapiens
ccuccccagacagggcucca

SEQ ID NO: 1416450 - RNA, 18 nt, Homo sapiens
ccuccccgugccaaaaau

SEQ ID NO: 1416451 - RNA, 13 nt, Homo sapiens
ccucccuuugcca

SEQ ID NO: 1416452 - RNA, 13 nt, Homo sapiens
ccuccgucuuccu

SEQ ID NO: 1416453 - RNA, 16 nt, Homo sapiens
ccuccucacuggccau

SEQ ID NO: 1416454 - RNA, 16 nt, Homo sapiens
ccuccugcucugccca

SEQ ID NO: 1416455 - RNA, 20 nt, Homo sapiens
ccuccuguaagcaacacuuu

SEQ ID NO: 1416456 - RNA, 14 nt, Homo sapiens
ccucuacauuugaa

SEQ ID NO: 1416457 - RNA, 16 nt, Homo sapiens
ccucucaacaucacuu

SEQ ID NO: 1416458 - RNA, 20 nt, Homo sapiens
ccucugcccagauuugcccu

SEQ ID NO: 1416459 - RNA, 14 nt, Homo sapiens
ccucuggggcucag

SEQ ID NO: 1416460 - RNA, 15 nt, Homo sapiens
ccucuuccagaguca

SEQ ID NO: 1416461 - RNA, 14 nt, Homo sapiens
ccugaccucaggua

SEQ ID NO: 1416462 - RNA, 22 nt, Homo sapiens
ccugaggaauaaagcuucucuc

SEQ ID NO: 1416463 - RNA, 16 nt, Homo sapiens
ccugaggagggcccug

SEQ ID NO: 1416464 - RNA, 21 nt, Homo sapiens
ccugaggagggcccugaggaa

SEQ ID NO: 1416465 - RNA, 13 nt, Homo sapiens
ccugaguccuuaa

SEQ ID NO: 1416466 - RNA, 22 nt, Homo sapiens
ccugauugcugagugucaucuc

SEQ ID NO: 1416467 - RNA, 16 nt, Homo sapiens
ccugcccccacaccca

SEQ ID NO: 1416468 - RNA, 15 nt, Homo sapiens
ccugccuccuugaaa

SEQ ID NO: 1416469 - RNA, 16 nt, Homo sapiens
ccugcucaacauuuaa

SEQ ID NO: 1416470 - RNA, 20 nt, Homo sapiens
ccugcuugaacugcugccaa

SEQ ID NO: 1416471 - RNA, 16 nt, Homo sapiens
ccuggacgcagccaca

SEQ ID NO: 1416472 - RNA, 22 nt, Homo sapiens
ccuggccuuauaucauuucaua

SEQ ID NO: 1416473 - RNA, 23 nt, Homo sapiens
ccugggcuuggccugcugugauu

SEQ ID NO: 1416474 - RNA, 18 nt, Homo sapiens
ccuguaagcaacacuuua

SEQ ID NO: 1416475 - RNA, 14 nt, Homo sapiens
ccugucacacaggg

SEQ ID NO: 1416476 - RNA, 22 nt, Homo sapiens
ccugugagcuaggaauuguguu

SEQ ID NO: 1416477 - RNA, 15 nt, Homo sapiens
ccuguggcugcccuc

SEQ ID NO: 1416478 - RNA, 19 nt, Homo sapiens
ccuguguaucguggagaaa

SEQ ID NO: 1416479 - RNA, 14 nt, Homo sapiens
ccugugugagccca

SEQ ID NO: 1416480 - RNA, 12 nt, Homo sapiens
ccuguugugugc

SEQ ID NO: 1416481 - RNA, 14 nt, Homo sapiens
ccuucaccaaagau

SEQ ID NO: 1416482 - RNA, 17 nt, Homo sapiens
ccuucacccagagcugc

SEQ ID NO: 1416483 - RNA, 16 nt, Homo sapiens
ccuucaccuucugcca

SEQ ID NO: 1416484 - RNA, 22 nt, Homo sapiens
ccuucucuaguuuccccucuca

SEQ ID NO: 1416485 - RNA, 20 nt, Homo sapiens
ccuucuuagaacucugcuua

SEQ ID NO: 1416486 - RNA, 23 nt, Homo sapiens
ccuuggauauaccuagauuccau

SEQ ID NO: 1416487 - RNA, 17 nt, Homo sapiens
ccuuucuggccugcuau

SEQ ID NO: 1416488 - RNA, 15 nt, Homo sapiens
ccuuuggcucuggag

SEQ ID NO: 1416489 - RNA, 20 nt, Homo sapiens
ccuuugugugguaguucuaa

SEQ ID NO: 1416490 - RNA, 14 nt, Homo sapiens
ccuuuuaugugguc

SEQ ID NO: 1416491 - RNA, 14 nt, Homo sapiens
cgagccugcacugg

SEQ ID NO: 1416492 - RNA, 13 nt, Homo sapiens
cgauagugacaca

SEQ ID NO: 1416493 - RNA, 16 nt, Homo sapiens
cgcagccucacauucc

SEQ ID NO: 1416494 - RNA, 17 nt, Homo sapiens
cgcauccccugccucca

SEQ ID NO: 1416495 - RNA, 19 nt, Homo sapiens
cgccaccuccccacuccag

SEQ ID NO: 1416496 - RNA, 14 nt, Homo sapiens
cgccagcugaugac

SEQ ID NO: 1416497 - RNA, 20 nt, Homo sapiens
cgccuacucccagcuggugg

SEQ ID NO: 1416498 - RNA, 21 nt, Homo sapiens
cgccugacagcauaccucaaa

SEQ ID NO: 1416499 - RNA, 19 nt, Homo sapiens
cgcugauuccuaaggccca

SEQ ID NO: 1416500 - RNA, 15 nt, Homo sapiens
cgcuggcugcacuca

SEQ ID NO: 1416501 - RNA, 23 nt, Homo sapiens
cgcuuaugguuuuaaugcaauga

SEQ ID NO: 1416502 - RNA, 21 nt, Homo sapiens
cggccacccgccucccucuca

SEQ ID NO: 1416503 - RNA, 20 nt, Homo sapiens
cggcuucccaaagugcugag

SEQ ID NO: 1416504 - RNA, 14 nt, Homo sapiens
cggcuuccucaggg

SEQ ID NO: 1416505 - RNA, 22 nt, Homo sapiens
cgggaaaagcagcccuuggcca

SEQ ID NO: 1416506 - RNA, 21 nt, Homo sapiens
cggggaggagguugugucacu

SEQ ID NO: 1416507 - RNA, 15 nt, Homo sapiens
cgggucuccuagcuc

SEQ ID NO: 1416508 - RNA, 19 nt, Homo sapiens
cgggucuccuagcucccug

SEQ ID NO: 1416509 - RNA, 11 nt, Homo sapiens
cgguagcuuga

SEQ ID NO: 1416510 - RNA, 13 nt, Homo sapiens
cggucaccuuccu

SEQ ID NO: 1416511 - RNA, 12 nt, Homo sapiens
cggucucaggcu

SEQ ID NO: 1416512 - RNA, 18 nt, Homo sapiens
cgguucccuccccagcuc

SEQ ID NO: 1416513 - RNA, 17 nt, Homo sapiens
cguauagggcacuccca

SEQ ID NO: 1416514 - RNA, 15 nt, Homo sapiens
cguggcuuuuagaca

SEQ ID NO: 1416515 - RNA, 19 nt, Homo sapiens
cguuaagugccccacagag

SEQ ID NO: 1416516 - RNA, 15 nt, Homo sapiens
cguuagucucugaac

SEQ ID NO: 1416517 - RNA, 19 nt, Homo sapiens
cguuucccguuagucucug

SEQ ID NO: 1416518 - RNA, 12 nt, Homo sapiens
cuaaaacaugau

SEQ ID NO: 1416519 - RNA, 14 nt, Homo sapiens
cuaaaaccaaauau

SEQ ID NO: 1416520 - RNA, 18 nt, Homo sapiens
cuaaaccagaaaggugau

SEQ ID NO: 1416521 - RNA, 15 nt, Homo sapiens
cuaaaugaucugauu

SEQ ID NO: 1416522 - RNA, 15 nt, Homo sapiens
cuaacauacugcauu

SEQ ID NO: 1416523 - RNA, 21 nt, Homo sapiens
cuaacguuucccguuagucuc

SEQ ID NO: 1416524 - RNA, 18 nt, Homo sapiens
cuaaguguguauccagaa

SEQ ID NO: 1416525 - RNA, 19 nt, Homo sapiens
cuaauaaaaccucuaauuc

SEQ ID NO: 1416526 - RNA, 21 nt, Homo sapiens
cuaauaaaccuguaagcccag

SEQ ID NO: 1416527 - RNA, 20 nt, Homo sapiens
cuaauaaacuuccaaacagg

SEQ ID NO: 1416528 - RNA, 13 nt, Homo sapiens
cuaauauauucca

SEQ ID NO: 1416529 - RNA, 15 nt, Homo sapiens
cuaauauauuccaac

SEQ ID NO: 1416530 - RNA, 16 nt, Homo sapiens
cuaaucccuuccucuc

SEQ ID NO: 1416531 - RNA, 17 nt, Homo sapiens
uauuugucugugugcua

SEQ ID NO: 1416532 - RNA, 16 nt, Homo sapiens
uauuuugaaacuuugc

SEQ ID NO: 1416533 - RNA, 19 nt, Homo sapiens
ucaaaagaaaauauaguca

SEQ ID NO: 1416534 - RNA, 21 nt, Homo sapiens
ucaaaauaccccuaacauacu

SEQ ID NO: 1416535 - RNA, 17 nt, Homo sapiens
ucaagcgauucucaugc

SEQ ID NO: 1416536 - RNA, 12 nt, Homo sapiens
ucaagugccuua

SEQ ID NO: 1416537 - RNA, 18 nt, Homo sapiens
ucaaguguaauuagcuuu

SEQ ID NO: 1416538 - RNA, 16 nt, Homo sapiens
ucaauacaaaccagca

SEQ ID NO: 1416539 - RNA, 13 nt, Homo sapiens
ucaaucuuuucau

SEQ ID NO: 1416540 - RNA, 19 nt, Homo sapiens
ucacacggacuaaucuuuc

SEQ ID NO: 1416541 - RNA, 21 nt, Homo sapiens
ucacagcaagccccuuagucc

SEQ ID NO: 1416542 - RNA, 12 nt, Homo sapiens
ucacagccauag

SEQ ID NO: 1416543 - RNA, 12 nt, Homo sapiens
ucaccaugccug

SEQ ID NO: 1416544 - RNA, 17 nt, Homo sapiens
ucaccugacugcaauga

SEQ ID NO: 1416545 - RNA, 13 nt, Homo sapiens
ucaccuucugcca

SEQ ID NO: 1416546 - RNA, 14 nt, Homo sapiens
ucaccuucugccau

SEQ ID NO: 1416547 - RNA, 15 nt, Homo sapiens
ucaccuucugccaug

SEQ ID NO: 1416548 - RNA, 18 nt, Homo sapiens
ucaccuuuuccuugcuga

SEQ ID NO: 1416549 - RNA, 19 nt, Homo sapiens
ucaccuuuuccuugcugau

SEQ ID NO: 1416550 - RNA, 19 nt, Homo sapiens
ucacuaccuccucagggau

SEQ ID NO: 1416551 - RNA, 14 nt, Homo sapiens
ucacucuugccaac

SEQ ID NO: 1416552 - RNA, 20 nt, Homo sapiens
ucacucuugccaaccuguaa

SEQ ID NO: 1416553 - RNA, 15 nt, Homo sapiens
ucacuggaaagggga

SEQ ID NO: 1416554 - RNA, 19 nt, Homo sapiens
ucacuuguuucuacucaaa

SEQ ID NO: 1416555 - RNA, 16 nt, Homo sapiens
ucagaacaaucugagu

SEQ ID NO: 1416556 - RNA, 20 nt, Homo sapiens
ucagaaugaugaguccagaa

SEQ ID NO: 1416557 - RNA, 23 nt, Homo sapiens
ucagaccuuugucugaaggauuu

SEQ ID NO: 1416558 - RNA, 11 nt, Homo sapiens
ucagacuauga

SEQ ID NO: 1416559 - RNA, 19 nt, Homo sapiens
ucagagagaggaauggaau

SEQ ID NO: 1416560 - RNA, 17 nt, Homo sapiens
ucagaggccaucugauu

SEQ ID NO: 1416561 - RNA, 21 nt, Homo sapiens
ucagauuucuauuuugggaaa

SEQ ID NO: 1416562 - RNA, 14 nt, Homo sapiens
ucagcaaaucuucu

SEQ ID NO: 1416563 - RNA, 13 nt, Homo sapiens
ucagcagggcagu

SEQ ID NO: 1416564 - RNA, 21 nt, Homo sapiens
ucagcugaucugauucuacca

SEQ ID NO: 1416565 - RNA, 19 nt, Homo sapiens
ucaggaggccguugcagac

SEQ ID NO: 1416566 - RNA, 17 nt, Homo sapiens
ucagguguuucuagacc

SEQ ID NO: 1416567 - RNA, 15 nt, Homo sapiens
ucaguguuagaggug

SEQ ID NO: 1416568 - RNA, 21 nt, Homo sapiens
ucaguugggagugguugcuau

SEQ ID NO: 1416569 - RNA, 20 nt, Homo sapiens
ucauaauuguugaccuaaga

SEQ ID NO: 1416570 - RNA, 22 nt, Homo sapiens
ucauaauuguugaccuaagaau

SEQ ID NO: 1416571 - RNA, 12 nt, Homo sapiens
ucauaccaaaua

SEQ ID NO: 1416572 - RNA, 13 nt, Homo sapiens
ucauaucuaguca

SEQ ID NO: 1416573 - RNA, 14 nt, Homo sapiens
ucauaucuagucac

SEQ ID NO: 1416574 - RNA, 15 nt, Homo sapiens
ucaucaugaaaacug

SEQ ID NO: 1416575 - RNA, 15 nt, Homo sapiens
ucaucucaaccccau

SEQ ID NO: 1416576 - RNA, 22 nt, Homo sapiens
ucaugcaaguauaaauucaauu

SEQ ID NO: 1416577 - RNA, 18 nt, Homo sapiens
ucaugccacccugcauuu

SEQ ID NO: 1416578 - RNA, 20 nt, Homo sapiens
ucaugcuaauauaaguuucu

SEQ ID NO: 1416579 - RNA, 20 nt, Homo sapiens
ucaugggagggggcuugaag

SEQ ID NO: 1416580 - RNA, 16 nt, Homo sapiens
ucaugugcauauaucu

SEQ ID NO: 1416581 - RNA, 23 nt, Homo sapiens
ucauucaagaggaauuccagcau

SEQ ID NO: 1416582 - RNA, 17 nt, Homo sapiens
ucauuuacaaagcaaaa

SEQ ID NO: 1416583 - RNA, 15 nt, Homo sapiens
ucauuucaaucuuuu

SEQ ID NO: 1416584 - RNA, 13 nt, Homo sapiens
ucauuucaugcuu

SEQ ID NO: 1416585 - RNA, 23 nt, Homo sapiens
uccaaaaguuaaacuuuaucuca

SEQ ID NO: 1416586 - RNA, 16 nt, Homo sapiens
uccaaauaauuccaca

SEQ ID NO: 1416587 - RNA, 14 nt, Homo sapiens
uccaaaucucaugu

SEQ ID NO: 1416588 - RNA, 17 nt, Homo sapiens
uccaaaucucauguuca

SEQ ID NO: 1416589 - RNA, 19 nt, Homo sapiens
uccaaaucucauguucaaa

SEQ ID NO: 1416590 - RNA, 17 nt, Homo sapiens
uccaacaguugcuaaac

SEQ ID NO: 1416591 - RNA, 18 nt, Homo sapiens
uccaccggcgggucucca

SEQ ID NO: 1416592 - RNA, 15 nt, Homo sapiens
uccacgaggugaaaa

SEQ ID NO: 1416593 - RNA, 13 nt, Homo sapiens
uccacucuggaga

SEQ ID NO: 1416594 - RNA, 22 nt, Homo sapiens
uccacuguuaccuaaguucuca

SEQ ID NO: 1416595 - RNA, 16 nt, Homo sapiens
uccagcccccaguguc

SEQ ID NO: 1416596 - RNA, 14 nt, Homo sapiens
uccagcccuggauc

SEQ ID NO: 1416597 - RNA, 22 nt, Homo sapiens
uccagccugucggccacacccc

SEQ ID NO: 1416598 - RNA, 20 nt, Homo sapiens
uccaggaggaguuagccaaa

SEQ ID NO: 1416599 - RNA, 21 nt, Homo sapiens
uccaggguuguuagaucuucu

SEQ ID NO: 1416600 - RNA, 14 nt, Homo sapiens
uccauacagugaca

SEQ ID NO: 1416601 - RNA, 15 nt, Homo sapiens
uccaucuaccuucca

SEQ ID NO: 1416602 - RNA, 21 nt, Homo sapiens
uccaugcccccgccaccuccc

SEQ ID NO: 1416603 - RNA, 13 nt, Homo sapiens
uccauuauaaaca

SEQ ID NO: 1416604 - RNA, 23 nt, Homo sapiens
ucugcuucucaucuaaauauuuc

SEQ ID NO: 1416605 - RNA, 19 nt, Homo sapiens
ucuguaaguuucugugacc

SEQ ID NO: 1416606 - RNA, 16 nt, Homo sapiens
ucuguacaaaguacua

SEQ ID NO: 1416607 - RNA, 21 nt, Homo sapiens
ucuguacaaaguacuagcuaa

SEQ ID NO: 1416608 - RNA, 19 nt, Homo sapiens
ucuguauuuuauuuagaca

SEQ ID NO: 1416609 - RNA, 14 nt, Homo sapiens
ucugucccagcucc

SEQ ID NO: 1416610 - RNA, 16 nt, Homo sapiens
ucugugaaagcucuca

SEQ ID NO: 1416611 - RNA, 18 nt, Homo sapiens
ucugugcagucacuggag

SEQ ID NO: 1416612 - RNA, 14 nt, Homo sapiens
ucugugucaaugug

SEQ ID NO: 1416613 - RNA, 13 nt, Homo sapiens
ucuguugugcaug

SEQ ID NO: 1416614 - RNA, 17 nt, Homo sapiens
ucuucgcacagugucua

SEQ ID NO: 1416615 - RNA, 22 nt, Homo sapiens
ucuucuaaaggcuuuugcccua

SEQ ID NO: 1416616 - RNA, 11 nt, Homo sapiens
ucuugaacucc

SEQ ID NO: 1416617 - RNA, 20 nt, Homo sapiens
ucuuuaacugacuucugucc

SEQ ID NO: 1416618 - RNA, 16 nt, Homo sapiens
ucuuucagauuucuau

SEQ ID NO: 1416619 - RNA, 14 nt, Homo sapiens
ucuuucaucaauca

SEQ ID NO: 1416620 - RNA, 20 nt, Homo sapiens
ucuuuccuucuugccuucag

SEQ ID NO: 1416621 - RNA, 23 nt, Homo sapiens
ucuuugcagccuggguggcuaug

SEQ ID NO: 1416622 - RNA, 17 nt, Homo sapiens
ucuuugguguaaucucu

SEQ ID NO: 1416623 - RNA, 16 nt, Homo sapiens
ucuuuuuguaucucau

SEQ ID NO: 1416624 - RNA, 19 nt, Homo sapiens
ugaaaagagaaaaauaagc

SEQ ID NO: 1416625 - RNA, 17 nt, Homo sapiens
ugaaaagggcagaggca

SEQ ID NO: 1416626 - RNA, 22 nt, Homo sapiens
ugaaacucaucucauuacccuu

SEQ ID NO: 1416627 - RNA, 18 nt, Homo sapiens
ugaaaucugcucuguaca

SEQ ID NO: 1416628 - RNA, 18 nt, Homo sapiens
ugaacaagauuaaauucc

SEQ ID NO: 1416629 - RNA, 21 nt, Homo sapiens
ugaacauuccuaucaauccaa

SEQ ID NO: 1416630 - RNA, 16 nt, Homo sapiens
ugaacuaggugaucuc

SEQ ID NO: 1416631 - RNA, 19 nt, Homo sapiens
ugaacuauauccuuccuag

SEQ ID NO: 1416632 - RNA, 13 nt, Homo sapiens
ugaacuccucuca

SEQ ID NO: 1416633 - RNA, 16 nt, Homo sapiens
ugaacuccugaccuca

SEQ ID NO: 1416634 - RNA, 22 nt, Homo sapiens
ugaacuccugaccucaggugau

SEQ ID NO: 1416635 - RNA, 18 nt, Homo sapiens
ugaacugccaaguacugc

SEQ ID NO: 1416636 - RNA, 14 nt, Homo sapiens
ugaacugcugccaa

SEQ ID NO: 1416637 - RNA, 14 nt, Homo sapiens
ugaagaaaccuggc

SEQ ID NO: 1416638 - RNA, 19 nt, Homo sapiens
ugaagauucaggcuugcau

SEQ ID NO: 1416639 - RNA, 11 nt, Homo sapiens
ugaagccacac

SEQ ID NO: 1416640 - RNA, 21 nt, Homo sapiens
ugaauaugccaaacacauuaa

SEQ ID NO: 1416641 - RNA, 22 nt, Homo sapiens
ugaaugaaagucuugugacuag

SEQ ID NO: 1416642 - RNA, 14 nt, Homo sapiens
ugacaucacucuag

SEQ ID NO: 1416643 - RNA, 17 nt, Homo sapiens
ugacauguacauacugu

SEQ ID NO: 1416644 - RNA, 12 nt, Homo sapiens
ugaccacagcag

SEQ ID NO: 1416645 - RNA, 18 nt, Homo sapiens
ugaccccgaccucagaga

SEQ ID NO: 1416646 - RNA, 20 nt, Homo sapiens
ugaccccugcuuugccccac

SEQ ID NO: 1416647 - RNA, 14 nt, Homo sapiens
ugaccucaggugau

SEQ ID NO: 1416648 - RNA, 17 nt, Homo sapiens
ugacuauggaaagagua

SEQ ID NO: 1416649 - RNA, 18 nt, Homo sapiens
ugacucaggcugcuccuu

SEQ ID NO: 1416650 - RNA, 17 nt, Homo sapiens
ugacuuauguaaucaaa

SEQ ID NO: 1416651 - RNA, 23 nt, Homo sapiens
ugacuuuucaccuuaaugcauau

SEQ ID NO: 1416652 - RNA, 13 nt, Homo sapiens
ugagaguggguaa

SEQ ID NO: 1416653 - RNA, 13 nt, Homo sapiens
ugagaugcuggag

SEQ ID NO: 1416654 - RNA, 17 nt, Homo sapiens
ugagccaccguguccuu

SEQ ID NO: 1416655 - RNA, 19 nt, Homo sapiens
ugagccaccguguccuugu

SEQ ID NO: 1416656 - RNA, 17 nt, Homo sapiens
ugagccccauacagggc

SEQ ID NO: 1416657 - RNA, 21 nt, Homo sapiens
ugaggaagcaagugacaagga

SEQ ID NO: 1416658 - RNA, 15 nt, Homo sapiens
ugaggaauaaagcuu

SEQ ID NO: 1416659 - RNA, 21 nt, Homo sapiens
ugaggagggcccugaggaaua

SEQ ID NO: 1416660 - RNA, 13 nt, Homo sapiens
ugaggcaggagaa

SEQ ID NO: 1416661 - RNA, 16 nt, Homo sapiens
ugaguagcugggauua

SEQ ID NO: 1416662 - RNA, 19 nt, Homo sapiens
ugaguuaucuuuaacugac

SEQ ID NO: 1416663 - RNA, 16 nt, Homo sapiens
ugaguucucacucugg

SEQ ID NO: 1416664 - RNA, 17 nt, Homo sapiens
ugauaacauuuucccaa

SEQ ID NO: 1416665 - RNA, 22 nt, Homo sapiens
ugaucaauucuuuaauuuugga

SEQ ID NO: 1416666 - RNA, 15 nt, Homo sapiens
ugaucgggaagcccu

SEQ ID NO: 1416667 - RNA, 16 nt, Homo sapiens
ugaugcuuuuagcuca

SEQ ID NO: 1416668 - RNA, 21 nt, Homo sapiens
ugauggagacaguaacacugg

SEQ ID NO: 1416669 - RNA, 13 nt, Homo sapiens
ugauguuacuagc

SEQ ID NO: 1416670 - RNA, 14 nt, Homo sapiens
ugauuccugggaag

SEQ ID NO: 1416671 - RNA, 22 nt, Homo sapiens
ugauucucaagaucaaagggga

SEQ ID NO: 1416672 - RNA, 16 nt, Homo sapiens
ugauuuuccucucuca

SEQ ID NO: 1416673 - RNA, 23 nt, Homo sapiens
ugcaaacagucucuucuauuucu

SEQ ID NO: 1416674 - RNA, 14 nt, Homo sapiens
ugcacuggggccac

SEQ ID NO: 1416675 - RNA, 18 nt, Homo sapiens
ugcagaaagaaauugagc

SEQ ID NO: 1416676 - RNA, 18 nt, Homo sapiens
ugcagaacagacacuuua

SEQ ID NO: 1416677 - RNA, 12 nt, Homo sapiens
ugcagucacugg

SEQ ID NO: 1416678 - RNA, 23 nt, Homo sapiens
ugcagucugggccccaucauuaa

SEQ ID NO: 1416679 - RNA, 21 nt, Homo sapiens
ugcaguggcucaaugcaaccu

SEQ ID NO: 1416680 - RNA, 15 nt, Homo sapiens
uuacauuaacauuua

SEQ ID NO: 1416681 - RNA, 16 nt, Homo sapiens
uuacauuugaacuaua

SEQ ID NO: 1416682 - RNA, 18 nt, Homo sapiens
uuaccgagagccaaacag

SEQ ID NO: 1416683 - RNA, 21 nt, Homo sapiens
uuacuucuagucagucaucca

SEQ ID NO: 1416684 - RNA, 18 nt, Homo sapiens
uuagaaauguaacauacu

SEQ ID NO: 1416685 - RNA, 20 nt, Homo sapiens
uuagauuaggucacauuaca

SEQ ID NO: 1416686 - RNA, 17 nt, Homo sapiens
uuaguugcaacuuugua

SEQ ID NO: 1416687 - RNA, 17 nt, Homo sapiens
uuaguuuugcuccuucu

SEQ ID NO: 1416688 - RNA, 20 nt, Homo sapiens
uuaucccucucucuaccugu

SEQ ID NO: 1416689 - RNA, 23 nt, Homo sapiens
uuaugcaggcuuaacgugucuga

SEQ ID NO: 1416690 - RNA, 11 nt, Homo sapiens
uuauguacaaa

SEQ ID NO: 1416691 - RNA, 20 nt, Homo sapiens
uuauguauuuucuuccaccc

SEQ ID NO: 1416692 - RNA, 18 nt, Homo sapiens
uuauuagcauugaucuga

SEQ ID NO: 1416693 - RNA, 18 nt, Homo sapiens
uucaagcgauucucaugc

SEQ ID NO: 1416694 - RNA, 19 nt, Homo sapiens
uucaagcuacguguacaua

SEQ ID NO: 1416695 - RNA, 19 nt, Homo sapiens
uucaaguuuucagcuuuaa

SEQ ID NO: 1416696 - RNA, 16 nt, Homo sapiens
uucacccuguguaaca

SEQ ID NO: 1416697 - RNA, 20 nt, Homo sapiens
uucacucuggguaccaaauu

SEQ ID NO: 1416698 - RNA, 18 nt, Homo sapiens
uucauccuugaccucauu

SEQ ID NO: 1416699 - RNA, 22 nt, Homo sapiens
uuccaacguaaauuauuacaua

SEQ ID NO: 1416700 - RNA, 14 nt, Homo sapiens
uuccauauucugua

SEQ ID NO: 1416701 - RNA, 17 nt, Homo sapiens
uuccauauucuguauua

SEQ ID NO: 1416702 - RNA, 19 nt, Homo sapiens
uucccaggaguucugcuca

SEQ ID NO: 1416703 - RNA, 17 nt, Homo sapiens
uucccaucugcaccccu

SEQ ID NO: 1416704 - RNA, 17 nt, Homo sapiens
uucccguuagucucuga

SEQ ID NO: 1416705 - RNA, 12 nt, Homo sapiens
uucccuagcuuu

SEQ ID NO: 1416706 - RNA, 18 nt, Homo sapiens
uucccuugcacuguauca

SEQ ID NO: 1416707 - RNA, 14 nt, Homo sapiens
uucuacaacauauu

SEQ ID NO: 1416708 - RNA, 19 nt, Homo sapiens
uucuacguggauguucucc

SEQ ID NO: 1416709 - RNA, 17 nt, Homo sapiens
uucuauguucacuaaaa

SEQ ID NO: 1416710 - RNA, 12 nt, Homo sapiens
uucucagugucc

SEQ ID NO: 1416711 - RNA, 16 nt, Homo sapiens
uucucccacuuggcca

SEQ ID NO: 1416712 - RNA, 19 nt, Homo sapiens
uucugaagccucuaacaaa

SEQ ID NO: 1416713 - RNA, 16 nt, Homo sapiens
uucugcucauucuaau

SEQ ID NO: 1416714 - RNA, 18 nt, Homo sapiens
uucuggccugcuaugucu

SEQ ID NO: 1416715 - RNA, 23 nt, Homo sapiens
uucuucgcacagugucuagaucc

SEQ ID NO: 1416716 - RNA, 17 nt, Homo sapiens
uucuuggagucuuccaa

SEQ ID NO: 1416717 - RNA, 18 nt, Homo sapiens
uucuuucugaugucuucu

SEQ ID NO: 1416718 - RNA, 12 nt, Homo sapiens
uucuuuggucaa

SEQ ID NO: 1416719 - RNA, 18 nt, Homo sapiens
uucuuugguguaaucucu

SEQ ID NO: 1416720 - RNA, 15 nt, Homo sapiens
uugaacugcagguga

SEQ ID NO: 1416721 - RNA, 15 nt, Homo sapiens
uugaacugcugccaa

SEQ ID NO: 1416722 - RNA, 13 nt, Homo sapiens
uugaagccaaaga

SEQ ID NO: 1416723 - RNA, 22 nt, Homo sapiens
uugaagccgucucaugcagaag

SEQ ID NO: 1416724 - RNA, 15 nt, Homo sapiens
uugaagcucagaaag

SEQ ID NO: 1416725 - RNA, 21 nt, Homo sapiens
uugaauaugccaaacacauua

SEQ ID NO: 1416726 - RNA, 15 nt, Homo sapiens
uugacauacccaaag

SEQ ID NO: 1416727 - RNA, 14 nt, Homo sapiens
uugagcaguuccca

SEQ ID NO: 1416728 - RNA, 20 nt, Homo sapiens
uugaugguuucuaucugcaa

SEQ ID NO: 1416729 - RNA, 16 nt, Homo sapiens
uugauuaugcagaaua

SEQ ID NO: 1416730 - RNA, 17 nt, Homo sapiens
uugauuuuccucucuca

SEQ ID NO: 1416731 - RNA, 23 nt, Homo sapiens
uugauuuuccucucucacaaauc

SEQ ID NO: 1416732 - RNA, 16 nt, Homo sapiens
uugccaaccuguaaua

SEQ ID NO: 1416733 - RNA, 14 nt, Homo sapiens
gugaguuugagcug

SEQ ID NO: 1416734 - RNA, 14 nt, Homo sapiens
gugaucucaccaac

SEQ ID NO: 1416735 - RNA, 23 nt, Homo sapiens
gugaucucagcucacucugcaac

SEQ ID NO: 1416736 - RNA, 15 nt, Homo sapiens
gugauuuuggucucu

SEQ ID NO: 1416737 - RNA, 20 nt, Homo sapiens
gugcaccaauaccuacugaa

SEQ ID NO: 1416738 - RNA, 19 nt, Homo sapiens
gugccaaaaaucuuuucau

SEQ ID NO: 1416739 - RNA, 17 nt, Homo sapiens
gugccauguucaaaaga

SEQ ID NO: 1416740 - RNA, 18 nt, Homo sapiens
gugcugggauuacaggug

SEQ ID NO: 1416741 - RNA, 20 nt, Homo sapiens
gugcugggauuacaggugua

SEQ ID NO: 1416742 - RNA, 20 nt, Homo sapiens
gugcuuucauauuuuccaaa

SEQ ID NO: 1416743 - RNA, 23 nt, Homo sapiens
guggauaauagcguucagcagca

SEQ ID NO: 1416744 - RNA, 22 nt, Homo sapiens
guggcccugucccucccaccuc

SEQ ID NO: 1416745 - RNA, 13 nt, Homo sapiens
guggcugcugcug

SEQ ID NO: 1416746 - RNA, 21 nt, Homo sapiens
gugggcucugugcagucacug

SEQ ID NO: 1416747 - RNA, 23 nt, Homo sapiens
gugggcucugugcagucacugga

SEQ ID NO: 1416748 - RNA, 15 nt, Homo sapiens
guguaccauucucag

SEQ ID NO: 1416749 - RNA, 20 nt, Homo sapiens
gugucaaucaugcuguguaa

SEQ ID NO: 1416750 - RNA, 15 nt, Homo sapiens
gugugacaagugugu

SEQ ID NO: 1416751 - RNA, 20 nt, Homo sapiens
gugugucuuuuuguaucuca

SEQ ID NO: 1416752 - RNA, 12 nt, Homo sapiens
guuaagugcccc

SEQ ID NO: 1416753 - RNA, 17 nt, Homo sapiens
guuacuuuacauccuac

SEQ ID NO: 1416754 - RNA, 18 nt, Homo sapiens
guuaggucucaauaccug

SEQ ID NO: 1416755 - RNA, 12 nt, Homo sapiens
guuauacuccuc

SEQ ID NO: 1416756 - RNA, 20 nt, Homo sapiens
guuauuguucagacauucca

SEQ ID NO: 1416757 - RNA, 20 nt, Homo sapiens
guucaaagugugacauucag

SEQ ID NO: 1416758 - RNA, 19 nt, Homo sapiens
guucuacguggaugauuuc

SEQ ID NO: 1416759 - RNA, 13 nt, Homo sapiens
guucuaugcagaa

SEQ ID NO: 1416760 - RNA, 20 nt, Homo sapiens
guugagaauuaucaccauga

SEQ ID NO: 1416761 - RNA, 18 nt, Homo sapiens
guuguaacaauagcacaa

SEQ ID NO: 1416762 - RNA, 22 nt, Homo sapiens
guuguuuaaaagagccuggaac

SEQ ID NO: 1416763 - RNA, 14 nt, Homo sapiens
guuucaaaccagga

SEQ ID NO: 1416764 - RNA, 19 nt, Homo sapiens
guuucgauuuuugaucaau

SEQ ID NO: 1416765 - RNA, 13 nt, Homo sapiens
guuuuaaagcuaa

SEQ ID NO: 1416766 - RNA, 15 nt, Homo sapiens
guuuuaacauuauuu

SEQ ID NO: 1416767 - RNA, 21 nt, Homo sapiens
guuuuaucaguagaaguguca

SEQ ID NO: 1416768 - RNA, 15 nt, Homo sapiens
guuuucagcuuuaag

SEQ ID NO: 1416769 - RNA, 14 nt, Homo sapiens
guuuugcuccuucu

SEQ ID NO: 1416770 - RNA, 23 nt, Homo sapiens
guuuuuaaaugccacaagacaua

SEQ ID NO: 1416771 - RNA, 22 nt, Homo sapiens
uaaaaaauguuaugcaggcuua

SEQ ID NO: 1416772 - RNA, 15 nt, Homo sapiens
uaaaaagccaccaca

SEQ ID NO: 1416773 - RNA, 17 nt, Homo sapiens
uaaaacugauguuacua

SEQ ID NO: 1416774 - RNA, 16 nt, Homo sapiens
uaaaccauaaaaagcu

SEQ ID NO: 1416775 - RNA, 22 nt, Homo sapiens
uaaaccuguaagcccagcauuu

SEQ ID NO: 1416776 - RNA, 18 nt, Homo sapiens
uaaacgcuccccucagac

SEQ ID NO: 1416777 - RNA, 11 nt, Homo sapiens
uaaacugccaa

SEQ ID NO: 1416778 - RNA, 15 nt, Homo sapiens
uaaacuuuaucucac

SEQ ID NO: 1416779 - RNA, 16 nt, Homo sapiens
uaaagaaauaaucucu

SEQ ID NO: 1416780 - RNA, 17 nt, Homo sapiens
uaaagacuaugaucuca

SEQ ID NO: 1416781 - RNA, 15 nt, Homo sapiens
uaaagcuucucucug

SEQ ID NO: 1416782 - RNA, 23 nt, Homo sapiens
uaaaggacuauuuauaacuaaua

SEQ ID NO: 1416783 - RNA, 17 nt, Homo sapiens
uaaaggcaccuccccca

SEQ ID NO: 1416784 - RNA, 12 nt, Homo sapiens
uaaauacauuuc

SEQ ID NO: 1416785 - RNA, 15 nt, Homo sapiens
uaaauaugagugcca

SEQ ID NO: 1416786 - RNA, 14 nt, Homo sapiens
uaaauauuuccaua

SEQ ID NO: 1416787 - RNA, 17 nt, Homo sapiens
uaaauuuuaauugcacc

SEQ ID NO: 1416788 - RNA, 14 nt, Homo sapiens
uaacaaaugaucua

SEQ ID NO: 1416789 - RNA, 15 nt, Homo sapiens
uaacaaaugaucuag

SEQ ID NO: 1416790 - RNA, 15 nt, Homo sapiens
uaacaguuauaaaga

SEQ ID NO: 1416791 - RNA, 17 nt, Homo sapiens
uaacauacugcauuuca

SEQ ID NO: 1416792 - RNA, 22 nt, Homo sapiens
uaacauuauuucuuuucuaaaa

SEQ ID NO: 1416793 - RNA, 23 nt, Homo sapiens
uaacuggagcagagaacaucugg

SEQ ID NO: 1416794 - RNA, 14 nt, Homo sapiens
uaacuugagcuuua

SEQ ID NO: 1416795 - RNA, 22 nt, Homo sapiens
uaacuuggauguagccaugacc

SEQ ID NO: 1416796 - RNA, 13 nt, Homo sapiens
uaacuuguuuaca

SEQ ID NO: 1416797 - RNA, 17 nt, Homo sapiens
uaagaaaggauaaaguu

SEQ ID NO: 1416798 - RNA, 15 nt, Homo sapiens
uaagaauguauauca

SEQ ID NO: 1416799 - RNA, 13 nt, Homo sapiens
uaagcaacacuuu

SEQ ID NO: 1416800 - RNA, 17 nt, Homo sapiens
uaagcagaaauaaaguu

SEQ ID NO: 1416801 - RNA, 21 nt, Homo sapiens
uaagcagaagaucaaaaugcu

SEQ ID NO: 1416802 - RNA, 15 nt, Homo sapiens
uaagccacauaucua

SEQ ID NO: 1416803 - RNA, 14 nt, Homo sapiens
uaagcccagcauuu

SEQ ID NO: 1416804 - RNA, 15 nt, Homo sapiens
uaagcugcuggaaac

SEQ ID NO: 1416805 - RNA, 22 nt, Homo sapiens
uaaggaaaauaagcuuaucuua

SEQ ID NO: 1416806 - RNA, 13 nt, Homo sapiens
uaaguaaggaauu

SEQ ID NO: 1416807 - RNA, 16 nt, Homo sapiens
uaagugcacaccgugu

SEQ ID NO: 1416808 - RNA, 15 nt, Homo sapiens
uaauacauguaaaua

SEQ ID NO: 1416809 - RNA, 21 nt, Homo sapiens
uaaucuauaacaaaugcuuua

SEQ ID NO: 1416810 - RNA, 16 nt, Homo sapiens
uaaugcauauuccccu

SEQ ID NO: 1416811 - RNA, 18 nt, Homo sapiens
uaaugucuucuaauaucc

SEQ ID NO: 1416812 - RNA, 19 nt, Homo sapiens
uaauguuagggguauuuaa

SEQ ID NO: 1416813 - RNA, 18 nt, Homo sapiens
uaauuuauuuuaauguaa

SEQ ID NO: 1416814 - RNA, 18 nt, Homo sapiens
uacaaaccagcaacuaau

SEQ ID NO: 1416815 - RNA, 20 nt, Homo sapiens
uacaagaaauaaaucuauau

SEQ ID NO: 1416816 - RNA, 21 nt, Homo sapiens
uacaauggcgugaucucagcu

SEQ ID NO: 1416817 - RNA, 13 nt, Homo sapiens
uacagauccugca

SEQ ID NO: 1416818 - RNA, 20 nt, Homo sapiens
uacagccacuaauugccuua

SEQ ID NO: 1416819 - RNA, 23 nt, Homo sapiens
uacagggcaucgagccaccaagc

SEQ ID NO: 1416820 - RNA, 21 nt, Homo sapiens
uacagguuaugcuuugagauc

SEQ ID NO: 1416821 - RNA, 19 nt, Homo sapiens
uacagugacaauacaaaua

SEQ ID NO: 1416822 - RNA, 13 nt, Homo sapiens
uacauagcauuug

SEQ ID NO: 1416823 - RNA, 15 nt, Homo sapiens
uacauuagcugaaaa

SEQ ID NO: 1416824 - RNA, 23 nt, Homo sapiens
uacauuauguguuucuccucaga

SEQ ID NO: 1416825 - RNA, 18 nt, Homo sapiens
uacauuugaacuauaucc

SEQ ID NO: 1416826 - RNA, 16 nt, Homo sapiens
uaccacaucuucaugu

SEQ ID NO: 1416827 - RNA, 14 nt, Homo sapiens
uaccauucucaggu

SEQ ID NO: 1416828 - RNA, 19 nt, Homo sapiens
uacccugcucaacauuuaa

SEQ ID NO: 1416829 - RNA, 14 nt, Homo sapiens
uaccgagagccaaa

SEQ ID NO: 1416830 - RNA, 18 nt, Homo sapiens
uaccguauagagagccaa

SEQ ID NO: 1416831 - RNA, 13 nt, Homo sapiens
uaccuaaguucuc

SEQ ID NO: 1416832 - RNA, 15 nt, Homo sapiens
uaccuggugccuugg

SEQ ID NO: 1416833 - RNA, 17 nt, Homo sapiens
uacgcugucucugacau

SEQ ID NO: 1416834 - RNA, 18 nt, Homo sapiens
uacuauauuaacuuuuau

SEQ ID NO: 1416835 - RNA, 21 nt, Homo sapiens
uacugccccugcccugaggag

SEQ ID NO: 1416836 - RNA, 12 nt, Homo sapiens
uacugucugugu

SEQ ID NO: 1416837 - RNA, 20 nt, Homo sapiens
uacuugaaaauuaacaugaa

SEQ ID NO: 1416838 - RNA, 11 nt, Homo sapiens
uagaagccaag

SEQ ID NO: 1416839 - RNA, 14 nt, Homo sapiens
uagaagccaaggga

SEQ ID NO: 1416840 - RNA, 20 nt, Homo sapiens
uagaagccaagggaaagggg

SEQ ID NO: 1416841 - RNA, 20 nt, Homo sapiens
uagaagugucacagccauag

SEQ ID NO: 1416842 - RNA, 14 nt, Homo sapiens
uagaggagaggaaa

SEQ ID NO: 1416843 - RNA, 17 nt, Homo sapiens
uagaggcuagcuucugc

SEQ ID NO: 1416844 - RNA, 14 nt, Homo sapiens
uagaucacaacuga

SEQ ID NO: 1416845 - RNA, 18 nt, Homo sapiens
uagauucccuugcacugu

SEQ ID NO: 1416846 - RNA, 15 nt, Homo sapiens
uagccagggggacua

SEQ ID NO: 1416847 - RNA, 13 nt, Homo sapiens
uagcccaggagag

SEQ ID NO: 1416848 - RNA, 23 nt, Homo sapiens
uagcccaucccugccuggucaca

SEQ ID NO: 1416849 - RNA, 17 nt, Homo sapiens
uagcuggagugccaugg

SEQ ID NO: 1416850 - RNA, 17 nt, Homo sapiens
uagcugggacuacaggc

SEQ ID NO: 1416851 - RNA, 14 nt, Homo sapiens
uagggauauuuaac

SEQ ID NO: 1416852 - RNA, 18 nt, Homo sapiens
uagggauauuuaacugga

SEQ ID NO: 1416853 - RNA, 17 nt, Homo sapiens
uaggggaggggggagcc

SEQ ID NO: 1416854 - RNA, 18 nt, Homo sapiens
uaggucacauuacauuaa

SEQ ID NO: 1416855 - RNA, 18 nt, Homo sapiens
uaggugggagccaccacu

SEQ ID NO: 1416856 - RNA, 19 nt, Homo sapiens
uaguaaugagugaguucuc

SEQ ID NO: 1416857 - RNA, 22 nt, Homo sapiens
uaguaaugagugaguucucacu

SEQ ID NO: 1416858 - RNA, 23 nt, Homo sapiens
uaguaauuuuaguuauacuccuc

SEQ ID NO: 1416859 - RNA, 21 nt, Homo sapiens
uagucacuuguuucuacucaa

SEQ ID NO: 1416860 - RNA, 17 nt, Homo sapiens
uagugcauggacaucua

SEQ ID NO: 1416861 - RNA, 16 nt, Homo sapiens
uaguguaccauucuca

SEQ ID NO: 1416862 - RNA, 17 nt, Homo sapiens
uaguguaccauucucag

SEQ ID NO: 1416863 - RNA, 13 nt, Homo sapiens
uagugucaccugc

SEQ ID NO: 1416864 - RNA, 15 nt, Homo sapiens
uaguuuaauuggucu

SEQ ID NO: 1416865 - RNA, 17 nt, Homo sapiens
uaguuucagagugugga

SEQ ID NO: 1416866 - RNA, 12 nt, Homo sapiens
uaguuugcaaac

SEQ ID NO: 1416867 - RNA, 13 nt, Homo sapiens
uaguuugcccaga

SEQ ID NO: 1416868 - RNA, 21 nt, Homo sapiens
uauaaucccagcuacuuggga

SEQ ID NO: 1416869 - RNA, 18 nt, Homo sapiens
uauacaggaugaugacua

SEQ ID NO: 1416870 - RNA, 22 nt, Homo sapiens
uauacugaaggaaaaacacaag

SEQ ID NO: 1416871 - RNA, 23 nt, Homo sapiens
uauagucacaggaaacuacuuca

SEQ ID NO: 1416872 - RNA, 21 nt, Homo sapiens
uauauaaaagguuguguacaa

SEQ ID NO: 1416873 - RNA, 16 nt, Homo sapiens
uauaugaauuuccacu

SEQ ID NO: 1416874 - RNA, 19 nt, Homo sapiens
uauauuugaacuccucuca

SEQ ID NO: 1416875 - RNA, 20 nt, Homo sapiens
uaucaggguuuaacaauagg

SEQ ID NO: 1416876 - RNA, 14 nt, Homo sapiens
uaucauucagcaac

SEQ ID NO: 1416877 - RNA, 20 nt, Homo sapiens
uauccaccuccaucuucuuu

SEQ ID NO: 1416878 - RNA, 16 nt, Homo sapiens
uaucccucucucuacc

SEQ ID NO: 1416879 - RNA, 12 nt, Homo sapiens
uaucugcaauua

SEQ ID NO: 1416880 - RNA, 16 nt, Homo sapiens
uaugcaagagcugguu

SEQ ID NO: 1416881 - RNA, 19 nt, Homo sapiens
uaugguuaaguaauugcau

SEQ ID NO: 1416882 - RNA, 23 nt, Homo sapiens
uauuauuuuauguugcauagaau

SEQ ID NO: 1416883 - RNA, 21 nt, Homo sapiens
uauucaaguauuccuaugcca

SEQ ID NO: 1416884 - RNA, 12 nt, Homo sapiens
uauucauuucaa

SEQ ID NO: 1416885 - RNA, 17 nt, Homo sapiens
uauucugugaaacuaau

SEQ ID NO: 1416886 - RNA, 19 nt, Homo sapiens
uauucugugaaacuaauca

SEQ ID NO: 1416887 - RNA, 21 nt, Homo sapiens
uauugaaucuaaaaccaaaua

SEQ ID NO: 1416888 - RNA, 18 nt, Homo sapiens
uauuguacagaagcucuu

SEQ ID NO: 1416889 - RNA, 19 nt, Homo sapiens
uauuuaacuggagcagaga

SEQ ID NO: 1416890 - RNA, 18 nt, Homo sapiens
uauuuuaaauguggaaug

SEQ ID NO: 1416891 - RNA, 17 nt, Homo sapiens
uauuuucuacagugguu

SEQ ID NO: 1416892 - RNA, 14 nt, Homo sapiens
ucaaaaacuguauu

SEQ ID NO: 1416893 - RNA, 14 nt, Homo sapiens
ucaaaauuguuaca

SEQ ID NO: 1416894 - RNA, 15 nt, Homo sapiens
ucaaaauuguuacaa

SEQ ID NO: 1416895 - RNA, 21 nt, Homo sapiens
ucaaaauuguuacaaauugua

SEQ ID NO: 1416896 - RNA, 13 nt, Homo sapiens
ucaaagugugaca

SEQ ID NO: 1416897 - RNA, 16 nt, Homo sapiens
ucaaauaaacacugug

SEQ ID NO: 1416898 - RNA, 15 nt, Homo sapiens
ucaacauacuguuga

SEQ ID NO: 1416899 - RNA, 17 nt, Homo sapiens
ucaacauuacauuugaa

SEQ ID NO: 1416900 - RNA, 16 nt, Homo sapiens
ucaacauuuaaucaau

SEQ ID NO: 1416901 - RNA, 21 nt, Homo sapiens
ucaacauuuaaucaaucuuug

SEQ ID NO: 1416902 - RNA, 18 nt, Homo sapiens
ucaacuuacuuaaaaauc

SEQ ID NO: 1416903 - RNA, 20 nt, Homo sapiens
ucaagcgauucucaugccuc

SEQ ID NO: 1416904 - RNA, 22 nt, Homo sapiens
ucaagcgauucucaugccucag

SEQ ID NO: 1416905 - RNA, 19 nt, Homo sapiens
ucaagugccuuauucucac

SEQ ID NO: 1416906 - RNA, 18 nt, Homo sapiens
ucaaguuuucagcuuuaa

SEQ ID NO: 1416907 - RNA, 17 nt, Homo sapiens
ucaauuguuaguuauaa

SEQ ID NO: 1416908 - RNA, 13 nt, Homo sapiens
ucacacagccugu

SEQ ID NO: 1416909 - RNA, 15 nt, Homo sapiens
ucacauuacauuaac

SEQ ID NO: 1416910 - RNA, 19 nt, Homo sapiens
ucaccaugacaccugccau

SEQ ID NO: 1416911 - RNA, 15 nt, Homo sapiens
ucaccccacuuccau

SEQ ID NO: 1416912 - RNA, 21 nt, Homo sapiens
ucaccugugcagggcccucug

SEQ ID NO: 1416913 - RNA, 22 nt, Homo sapiens
ucacgacucuaccauguccaau

SEQ ID NO: 1416914 - RNA, 11 nt, Homo sapiens
ucacuaccucc

SEQ ID NO: 1416915 - RNA, 18 nt, Homo sapiens
ucacucuugccaaccugu

SEQ ID NO: 1416916 - RNA, 17 nt, Homo sapiens
ucacugauauuuuaguc

SEQ ID NO: 1416917 - RNA, 14 nt, Homo sapiens
ucagaaacaucuga

SEQ ID NO: 1416918 - RNA, 16 nt, Homo sapiens
ucagaccuuugucuga

SEQ ID NO: 1416919 - RNA, 21 nt, Homo sapiens
ucagacggccuagugugccaa

SEQ ID NO: 1416920 - RNA, 12 nt, Homo sapiens
ucagacuaugaa

SEQ ID NO: 1416921 - RNA, 18 nt, Homo sapiens
ucagaguaauccaagcaa

SEQ ID NO: 1416922 - RNA, 18 nt, Homo sapiens
ucagaguguggauuguau

SEQ ID NO: 1416923 - RNA, 19 nt, Homo sapiens
ucagauauaaauguuuaau

SEQ ID NO: 1416924 - RNA, 14 nt, Homo sapiens
ucagcccaugcuua

SEQ ID NO: 1416925 - RNA, 14 nt, Homo sapiens
ucagcccugagcug

SEQ ID NO: 1416926 - RNA, 18 nt, Homo sapiens
ucagcggggcuacagucc

SEQ ID NO: 1416927 - RNA, 23 nt, Homo sapiens
ucaggcagagcccgguacagggc

SEQ ID NO: 1416928 - RNA, 15 nt, Homo sapiens
ucagguggugauaug

SEQ ID NO: 1416929 - RNA, 18 nt, Homo sapiens
ucaguagaagugucacag

SEQ ID NO: 1416930 - RNA, 22 nt, Homo sapiens
ucaguugggagugguugcuaua

SEQ ID NO: 1416931 - RNA, 18 nt, Homo sapiens
ucauagggcccugucuua

SEQ ID NO: 1416932 - RNA, 16 nt, Homo sapiens
ucauaucuagucacuu

SEQ ID NO: 1416933 - RNA, 16 nt, Homo sapiens
ucauauucgauguacu

SEQ ID NO: 1416934 - RNA, 13 nt, Homo sapiens
ucauauuuuccaa

SEQ ID NO: 1416935 - RNA, 20 nt, Homo sapiens
ucaucacuugugucaaucau

SEQ ID NO: 1416936 - RNA, 16 nt, Homo sapiens
ucaucaugaaaacugg

SEQ ID NO: 1416937 - RNA, 13 nt, Homo sapiens
ucaugaaaacugg

SEQ ID NO: 1416938 - RNA, 15 nt, Homo sapiens
ucaugcuguguaaua

SEQ ID NO: 1416939 - RNA, 23 nt, Homo sapiens
ucaugcuuugauuuacacucgaa

SEQ ID NO: 1416940 - RNA, 22 nt, Homo sapiens
ucauguccugaugccauggaau

SEQ ID NO: 1416941 - RNA, 23 nt, Homo sapiens
ucauguuuuugaaacagaaccau

SEQ ID NO: 1416942 - RNA, 18 nt, Homo sapiens
ucauuagaaguuaccaaa

SEQ ID NO: 1416943 - RNA, 16 nt, Homo sapiens
ucauugacaaagcugu

SEQ ID NO: 1416944 - RNA, 15 nt, Homo sapiens
uccaaaaguuaaacu

SEQ ID NO: 1416945 - RNA, 16 nt, Homo sapiens
uccaaaccaccuuccc

SEQ ID NO: 1416946 - RNA, 16 nt, Homo sapiens
uccacccccaccucaa

SEQ ID NO: 1416947 - RNA, 21 nt, Homo sapiens
uccacuugggacuagaucaca

SEQ ID NO: 1416948 - RNA, 20 nt, Homo sapiens
uccagcaggguauggccagc

SEQ ID NO: 1416949 - RNA, 23 nt, Homo sapiens
uccagcaucugaagacucaggca

SEQ ID NO: 1416950 - RNA, 17 nt, Homo sapiens
uccagcccuggaucucc

SEQ ID NO: 1416951 - RNA, 14 nt, Homo sapiens
uccaggaaugaucc

SEQ ID NO: 1416952 - RNA, 21 nt, Homo sapiens
uccaggaggaguuagccaaac

SEQ ID NO: 1416953 - RNA, 21 nt, Homo sapiens
uccaguacucuguaaguuucu

SEQ ID NO: 1416954 - RNA, 12 nt, Homo sapiens
uccagucucucc

SEQ ID NO: 1416955 - RNA, 10 nt, Homo sapiens
uccaucucug

SEQ ID NO: 1416956 - RNA, 21 nt, Homo sapiens
uccauggugauuccugggaag

SEQ ID NO: 1416957 - RNA, 21 nt, Homo sapiens
uccauguagaacuugaacuaa

SEQ ID NO: 1416958 - RNA, 14 nt, Homo sapiens
uccauguugcugac

SEQ ID NO: 1416959 - RNA, 20 nt, Homo sapiens
ucccaaagugcugagauuac

SEQ ID NO: 1416960 - RNA, 19 nt, Homo sapiens
ucccaaggcuccugaccua

SEQ ID NO: 1416961 - RNA, 20 nt, Homo sapiens
ucccaccucugugaccucag

SEQ ID NO: 1416962 - RNA, 17 nt, Homo sapiens
ucccagccucuucccau

SEQ ID NO: 1416963 - RNA, 15 nt, Homo sapiens
ucccagcuacucggg

SEQ ID NO: 1416964 - RNA, 16 nt, Homo sapiens
ugcacucccccaguuc

SEQ ID NO: 1416965 - RNA, 14 nt, Homo sapiens
ugcaggcaaaugua

SEQ ID NO: 1416966 - RNA, 15 nt, Homo sapiens
ugcauaacguauaaa

SEQ ID NO: 1416967 - RNA, 15 nt, Homo sapiens
ugcauauaucuuuca

SEQ ID NO: 1416968 - RNA, 21 nt, Homo sapiens
ugcaucccaccagccugagca

SEQ ID NO: 1416969 - RNA, 12 nt, Homo sapiens
ugcaugcucaaa

SEQ ID NO: 1416970 - RNA, 10 nt, Homo sapiens
ugccaaaaau

SEQ ID NO: 1416971 - RNA, 15 nt, Homo sapiens
ugccaaaaaucuuuu

SEQ ID NO: 1416972 - RNA, 13 nt, Homo sapiens
ugccaaagcagcu

SEQ ID NO: 1416973 - RNA, 21 nt, Homo sapiens
ugccacaucuugaucugcuca

SEQ ID NO: 1416974 - RNA, 22 nt, Homo sapiens
ugccacuuucccacgucacuug

SEQ ID NO: 1416975 - RNA, 17 nt, Homo sapiens
ugccauuugcugcuuaa

SEQ ID NO: 1416976 - RNA, 22 nt, Homo sapiens
ugccccauuuauccaccuccau

SEQ ID NO: 1416977 - RNA, 17 nt, Homo sapiens
ugcccccaccccgggga

SEQ ID NO: 1416978 - RNA, 13 nt, Homo sapiens
ugccgaaccagga

SEQ ID NO: 1416979 - RNA, 18 nt, Homo sapiens
ugccgccccggacagugg

SEQ ID NO: 1416980 - RNA, 23 nt, Homo sapiens
ugccuagagucuuucuccauuau

SEQ ID NO: 1416981 - RNA, 22 nt, Homo sapiens
ugccugcuuuuuauggccugug

SEQ ID NO: 1416982 - RNA, 14 nt, Homo sapiens
ugccuguaauccca

SEQ ID NO: 1416983 - RNA, 22 nt, Homo sapiens
ugccuguagcaaacaccaccaa

SEQ ID NO: 1416984 - RNA, 17 nt, Homo sapiens
ugcuaucugaacuaauu

SEQ ID NO: 1416985 - RNA, 17 nt, Homo sapiens
ugcugagucgcucucau

SEQ ID NO: 1416986 - RNA, 14 nt, Homo sapiens
ugcugaguucuggu

SEQ ID NO: 1416987 - RNA, 11 nt, Homo sapiens
ugcugcugcuu

SEQ ID NO: 1416988 - RNA, 21 nt, Homo sapiens
ugcuggcgccaacaacuucuc

SEQ ID NO: 1416989 - RNA, 19 nt, Homo sapiens
ugcugggauuacaggugua

SEQ ID NO: 1416990 - RNA, 16 nt, Homo sapiens
ugcuggucuacaccgc

SEQ ID NO: 1416991 - RNA, 19 nt, Homo sapiens
ugcuguaauaaauguauua

SEQ ID NO: 1416992 - RNA, 20 nt, Homo sapiens
ugcugugcauaucacuugau

SEQ ID NO: 1416993 - RNA, 15 nt, Homo sapiens
ugcuuagacauuaca

SEQ ID NO: 1416994 - RNA, 12 nt, Homo sapiens
ugcuucaccaag

SEQ ID NO: 1416995 - RNA, 11 nt, Homo sapiens
ugcuuccucag

SEQ ID NO: 1416996 - RNA, 22 nt, Homo sapiens
ugcuuccucaguuacacaaagg

SEQ ID NO: 1416997 - RNA, 20 nt, Homo sapiens
ugcuucugccguugcugcca

SEQ ID NO: 1416998 - RNA, 16 nt, Homo sapiens
ugcuuucauauuuucc

SEQ ID NO: 1416999 - RNA, 17 nt, Homo sapiens
ugcuuucuauuguacag

SEQ ID NO: 1417000 - RNA, 19 nt, Homo sapiens
ugcuuuguaguuugcccag

SEQ ID NO: 1417001 - RNA, 16 nt, Homo sapiens
uggaaaacucaggauu

SEQ ID NO: 1417002 - RNA, 12 nt, Homo sapiens
uggaagaaggga

SEQ ID NO: 1417003 - RNA, 13 nt, Homo sapiens
uggaagccuauaa

SEQ ID NO: 1417004 - RNA, 14 nt, Homo sapiens
uggaaucaucacuu

SEQ ID NO: 1417005 - RNA, 19 nt, Homo sapiens
uuagaacucugcuuacuaa

SEQ ID NO: 1417006 - RNA, 21 nt, Homo sapiens
uuagagccaggcacacacugu

SEQ ID NO: 1417007 - RNA, 18 nt, Homo sapiens
uuagcauccugccuuaga

SEQ ID NO: 1417008 - RNA, 17 nt, Homo sapiens
uuaguacagguuacuca

SEQ ID NO: 1417009 - RNA, 13 nt, Homo sapiens
uuagucauucugc

SEQ ID NO: 1417010 - RNA, 17 nt, Homo sapiens
uuaguuguccucagguu

SEQ ID NO: 1417011 - RNA, 16 nt, Homo sapiens
uuauuacggugauccu

SEQ ID NO: 1417012 - RNA, 16 nt, Homo sapiens
uuauuagacauucucu

SEQ ID NO: 1417013 - RNA, 19 nt, Homo sapiens
uuauuaugcccucuucuca

SEQ ID NO: 1417014 - RNA, 11 nt, Homo sapiens
uucaccaaaga

SEQ ID NO: 1417015 - RNA, 15 nt, Homo sapiens
uucaccuucugccau

SEQ ID NO: 1417016 - RNA, 22 nt, Homo sapiens
uucacucagcuggacugcauug

SEQ ID NO: 1417017 - RNA, 20 nt, Homo sapiens
uucacucccaaaugcaaaca

SEQ ID NO: 1417018 - RNA, 19 nt, Homo sapiens
uucacucuggguaccaaau

SEQ ID NO: 1417019 - RNA, 16 nt, Homo sapiens
uucagaaggaagcaaa

SEQ ID NO: 1417020 - RNA, 16 nt, Homo sapiens
uucaggcuugcauuaa

SEQ ID NO: 1417021 - RNA, 22 nt, Homo sapiens
uucaguguuagaggugggccua

SEQ ID NO: 1417022 - RNA, 16 nt, Homo sapiens
uucauuucaaucuuuu

SEQ ID NO: 1417023 - RNA, 17 nt, Homo sapiens
uucauuucuauaggcaa

SEQ ID NO: 1417024 - RNA, 18 nt, Homo sapiens
uucauuuucugcaagccu

SEQ ID NO: 1417025 - RNA, 20 nt, Homo sapiens
uuccauacagugacaauaca

SEQ ID NO: 1417026 - RNA, 12 nt, Homo sapiens
uuccauuugggu

SEQ ID NO: 1417027 - RNA, 15 nt, Homo sapiens
uuccccgaugugagc

SEQ ID NO: 1417028 - RNA, 18 nt, Homo sapiens
uucccguuagucucugaa

SEQ ID NO: 1417029 - RNA, 23 nt, Homo sapiens
uucccugcuuccaggaaacucca

SEQ ID NO: 1417030 - RNA, 20 nt, Homo sapiens
uuccuaguggguuaguguga

SEQ ID NO: 1417031 - RNA, 17 nt, Homo sapiens
uuccucucccauucacc

SEQ ID NO: 1417032 - RNA, 18 nt, Homo sapiens
uucuacccuguugcaaag

SEQ ID NO: 1417033 - RNA, 18 nt, Homo sapiens
uucuauguucauguuagu

SEQ ID NO: 1417034 - RNA, 19 nt, Homo sapiens
uucucaagaucaaagggga

SEQ ID NO: 1417035 - RNA, 12 nt, Homo sapiens
uucucacucugg

SEQ ID NO: 1417036 - RNA, 20 nt, Homo sapiens
uucucagguguuucuagacc

SEQ ID NO: 1417037 - RNA, 23 nt, Homo sapiens
uucucucccaggggcuggcuuca

SEQ ID NO: 1417038 - RNA, 15 nt, Homo sapiens
uucuggucuguugcu

SEQ ID NO: 1417039 - RNA, 17 nt, Homo sapiens
uucugguuuaacuaaua

SEQ ID NO: 1417040 - RNA, 20 nt, Homo sapiens
uucuguguagacaugguucu

SEQ ID NO: 1417041 - RNA, 21 nt, Homo sapiens
uucuuaagauggcuacaccuc

SEQ ID NO: 1417042 - RNA, 21 nt, Homo sapiens
uucuuauggaacgaauacccu

SEQ ID NO: 1417043 - RNA, 21 nt, Homo sapiens
uucuuggaaccuaaauugaac

SEQ ID NO: 1417044 - RNA, 16 nt, Homo sapiens
uugaaaaaacaccaug

SEQ ID NO: 1417045 - RNA, 18 nt, Homo sapiens
uugaaaaaacaccaugaa

SEQ ID NO: 1417046 - RNA, 14 nt, Homo sapiens
uugaaaaucaguuu

SEQ ID NO: 1417047 - RNA, 17 nt, Homo sapiens
uugaaacuaacuguugg

SEQ ID NO: 1417048 - RNA, 20 nt, Homo sapiens
uugaaaggauaggauugaca

SEQ ID NO: 1417049 - RNA, 23 nt, Homo sapiens
uugaacuccucucagcugaacac

SEQ ID NO: 1417050 - RNA, 20 nt, Homo sapiens
uugaacuccugaccucaggu

SEQ ID NO: 1417051 - RNA, 22 nt, Homo sapiens
uugaacuccugaccucagguga

SEQ ID NO: 1417052 - RNA, 14 nt, Homo sapiens
uugaagccaaagaa

SEQ ID NO: 1417053 - RNA, 17 nt, Homo sapiens
uugaagccguccaagaa

SEQ ID NO: 1417054 - RNA, 13 nt, Homo sapiens
uugaagcucagaa

SEQ ID NO: 1417055 - RNA, 19 nt, Homo sapiens
uugaaucuaaaaccaaaua

SEQ ID NO: 1417056 - RNA, 12 nt, Homo sapiens
uugacugugcau

SEQ ID NO: 1417057 - RNA, 18 nt, Homo sapiens
uugaugccacccagaacu

SEQ ID NO: 1417058 - RNA, 23 nt, Homo sapiens
uugauguauauuugaacuccucu

SEQ ID NO: 1417059 - RNA, 22 nt, Homo sapiens
uugaugucuaaguaugccucag

SEQ ID NO: 1417060 - RNA, 20 nt, Homo sapiens
uugauuuuccucucucacaa

SEQ ID NO: 1417061 - RNA, 21 nt, Homo sapiens
uugcaaauaaaggcucuggaa

SEQ ID NO: 1417062 - RNA, 23 nt, Homo sapiens
uugcuaccaaguuucauaccaaa

SEQ ID NO: 1417063 - RNA, 16 nt, Homo sapiens
uugcuagugacaugua

SEQ ID NO: 1417064 - RNA, 19 nt, Homo sapiens
uugcugccacucuacaggu

SEQ ID NO: 1417065 - RNA, 15 nt, Homo sapiens
uugcugccaucaguc

SEQ ID NO: 1417066 - RNA, 12 nt, Homo sapiens
uuggaaaugggg

SEQ ID NO: 1417067 - RNA, 24 nt, Homo sapiens
uuggaacagcaugcugcugcucaa

SEQ ID NO: 1417068 - RNA, 17 nt, Homo sapiens
uuggaaugagucuccuu

SEQ ID NO: 1417069 - RNA, 20 nt, Homo sapiens
uuggauauaccuagauucca

SEQ ID NO: 1417070 - RNA, 15 nt, Homo sapiens
uuggccugcugugau

SEQ ID NO: 1417071 - RNA, 20 nt, Homo sapiens
uugggggggaacaucuguaa

SEQ ID NO: 1417072 - RNA, 21 nt, Homo sapiens
uuguaucaaccuaaaugaguc

SEQ ID NO: 1417073 - RNA, 22 nt, Homo sapiens
uugucauauucgauguacuuua

SEQ ID NO: 1417074 - RNA, 12 nt, Homo sapiens
uugugacagauu

SEQ ID NO: 1417075 - RNA, 15 nt, Homo sapiens
uugugacuagugcug

SEQ ID NO: 1417076 - RNA, 22 nt, Homo sapiens
uugugccauguucaaaagaagu

SEQ ID NO: 1417077 - RNA, 21 nt, Homo sapiens
uugugcuggauggagcccagg

SEQ ID NO: 1417078 - RNA, 21 nt, Homo sapiens
uuguguggucauaucuaguca

SEQ ID NO: 1417079 - RNA, 17 nt, Homo sapiens
uuguuacaaauuguaga

SEQ ID NO: 1417080 - RNA, 19 nt, Homo sapiens
uuguuuuguagcaaccauu

SEQ ID NO: 1417081 - RNA, 23 nt, Homo sapiens
uuuaaaaaucauuguauggauag

SEQ ID NO: 1417082 - RNA, 23 nt, Homo sapiens
uuuaaaauaaguugcagaacaga

SEQ ID NO: 1417083 - RNA, 11 nt, Homo sapiens
uuuaacauuau

SEQ ID NO: 1417084 - RNA, 18 nt, Homo sapiens
uuuaacuugagcuuuaaa

SEQ ID NO: 1417085 - RNA, 16 nt, Homo sapiens
uuuaauuuugcagugu

SEQ ID NO: 1417086 - RNA, 14 nt, Homo sapiens
uuuacaaagcaaaa

SEQ ID NO: 1417087 - RNA, 22 nt, Homo sapiens
uuuacauuagcugaaaagagaa

SEQ ID NO: 1417088 - RNA, 18 nt, Homo sapiens
uuuauagaggcuagcuuc

SEQ ID NO: 1417089 - RNA, 17 nt, Homo sapiens
uuuaucaguagaagugu

SEQ ID NO: 1417090 - RNA, 12 nt, Homo sapiens
uuuaugugaaca

SEQ ID NO: 1417091 - RNA, 18 nt, Homo sapiens
uuucaacuccaguacucu

SEQ ID NO: 1417092 - RNA, 23 nt, Homo sapiens
uuucagaguguggauuguauaac

SEQ ID NO: 1417093 - RNA, 16 nt, Homo sapiens
uuucaguguuggcaag

SEQ ID NO: 1417094 - RNA, 17 nt, Homo sapiens
uuucauauaaaaaagac

SEQ ID NO: 1417095 - RNA, 18 nt, Homo sapiens
uuucauuaaagaauguuu

SEQ ID NO: 1417096 - RNA, 16 nt, Homo sapiens
uuucccguuagucucu

SEQ ID NO: 1417097 - RNA, 18 nt, Homo sapiens
uuucccguuagucucuga

SEQ ID NO: 1417098 - RNA, 15 nt, Homo sapiens
uuucccuaaagggga

SEQ ID NO: 1417099 - RNA, 13 nt, Homo sapiens
uuucuaagagaag

SEQ ID NO: 1417100 - RNA, 18 nt, Homo sapiens
uuucugugccaaagcagc

SEQ ID NO: 1417101 - RNA, 20 nt, Homo sapiens
uuugaagccguccaagaaca

SEQ ID NO: 1417102 - RNA, 15 nt, Homo sapiens
uuugaagcucagaaa

SEQ ID NO: 1417103 - RNA, 20 nt, Homo sapiens
uuugacaaagguaaaucaga

SEQ ID NO: 1417104 - RNA, 20 nt, Homo sapiens
uuugauuuuccucucucaca

SEQ ID NO: 1417105 - RNA, 23 nt, Homo sapiens
uuugcuuguccuuuggccuuuca

SEQ ID NO: 1417106 - RNA, 14 nt, Homo sapiens
uuuggauaauguua

SEQ ID NO: 1417107 - RNA, 17 nt, Homo sapiens
uuuggucuccucuucca

SEQ ID NO: 1417108 - RNA, 17 nt, Homo sapiens
uuugguuaccaauuuaa

SEQ ID NO: 1417109 - RNA, 22 nt, Homo sapiens
uuuguggaauggauuuuccuga

SEQ ID NO: 1417110 - RNA, 11 nt, Homo sapiens
uuugugucauu

SEQ ID NO: 1417111 - RNA, 23 nt, Homo sapiens
uuuuaaaaauaagccacauaucu

SEQ ID NO: 1417112 - RNA, 20 nt, Homo sapiens
uuuuaaucuuuaauuuuaca

SEQ ID NO: 1417113 - RNA, 15 nt, Homo sapiens
uuuuagucauucugc

SEQ ID NO: 1417114 - RNA, 14 nt, Homo sapiens
uuuuaucaguagaa

SEQ ID NO: 1417115 - RNA, 14 nt, Homo sapiens
uuuuauuaaacuca

SEQ ID NO: 1417116 - RNA, 14 nt, Homo sapiens
uuuucuauucuugg

SEQ ID NO: 1417117 - RNA, 13 nt, Homo sapiens
uuuucugugccaa

SEQ ID NO: 1417118 - RNA, 13 nt, Homo sapiens
uuuucugugucaa

SEQ ID NO: 1417119 - RNA, 15 nt, Homo sapiens
uuuugaauaugccaa

SEQ ID NO: 1417120 - RNA, 19 nt, Homo sapiens
uuuuuauaauauucauaca

SEQ ID NO: 1417121 - RNA, 15 nt, Homo sapiens
augucccccuuaugu

SEQ ID NO: 1417122 - RNA, 13 nt, Homo sapiens
augugcaccaaua

SEQ ID NO: 1417123 - RNA, 22 nt, Homo sapiens
augugcauauaucuuucagauu

SEQ ID NO: 1417124 - RNA, 22 nt, Homo sapiens
augugcuugaagauucaggcuu

SEQ ID NO: 1417125 - RNA, 19 nt, Homo sapiens
auguucaaagugugacauu

SEQ ID NO: 1417126 - RNA, 14 nt, Homo sapiens
auguuguguaacag

SEQ ID NO: 1417127 - RNA, 15 nt, Homo sapiens
auguuuaauuuugca

SEQ ID NO: 1417128 - RNA, 13 nt, Homo sapiens
auuaaacgggcug

SEQ ID NO: 1417129 - RNA, 15 nt, Homo sapiens
auuaaacgggcugcg

SEQ ID NO: 1417130 - RNA, 19 nt, Homo sapiens
auuaaagaauguuuuggaa

SEQ ID NO: 1417131 - RNA, 18 nt, Homo sapiens
auuaaauggaucacugau

SEQ ID NO: 1417132 - RNA, 12 nt, Homo sapiens
auuaagcuuaaa

SEQ ID NO: 1417133 - RNA, 23 nt, Homo sapiens
auuaagugcacaccgugugccau

SEQ ID NO: 1417134 - RNA, 18 nt, Homo sapiens
caccccgauagugacaca

SEQ ID NO: 1417135 - RNA, 19 nt, Homo sapiens
cacccuggccaccccaucu

SEQ ID NO: 1417136 - RNA, 17 nt, Homo sapiens
caccgugugccauagaa

SEQ ID NO: 1417137 - RNA, 19 nt, Homo sapiens
caccucucugagcucugca

SEQ ID NO: 1417138 - RNA, 12 nt, Homo sapiens
cacgucacuuga

SEQ ID NO: 1417139 - RNA, 20 nt, Homo sapiens
cacuaaaugaucugauuucg

SEQ ID NO: 1417140 - RNA, 16 nt, Homo sapiens
cacuaccuccucaggg

SEQ ID NO: 1417141 - RNA, 22 nt, Homo sapiens
cacuccauaaaaagaaagcuaa

SEQ ID NO: 1417142 - RNA, 17 nt, Homo sapiens
cacucuugccaaccugu

SEQ ID NO: 1417143 - RNA, 21 nt, Homo sapiens
cacucuugccaaccuguaaua

SEQ ID NO: 1417144 - RNA, 14 nt, Homo sapiens
cacugacucaggcu

SEQ ID NO: 1417145 - RNA, 20 nt, Homo sapiens
cacugacucaggcugcuccu

SEQ ID NO: 1417146 - RNA, 17 nt, Homo sapiens
cacuugugucaaucaug

SEQ ID NO: 1417147 - RNA, 18 nt, Homo sapiens
cacuuucccacgucacuu

SEQ ID NO: 1417148 - RNA, 23 nt, Homo sapiens
cacuuuuggaaggugacuuuuca

SEQ ID NO: 1417149 - RNA, 23 nt, Homo sapiens
ccagaaggggauggacuucauuu

SEQ ID NO: 1417150 - RNA, 12 nt, Homo sapiens
ccagaagugccc

SEQ ID NO: 1417151 - RNA, 19 nt, Homo sapiens
ccagagcuccugaguggaa

SEQ ID NO: 1417152 - RNA, 21 nt, Homo sapiens
ccagauaaagguucaugcaaa

SEQ ID NO: 1417153 - RNA, 22 nt, Homo sapiens
ccagcaucugaagacucaggca

SEQ ID NO: 1417154 - RNA, 23 nt, Homo sapiens
ccagcaucugaagacucaggcag

SEQ ID NO: 1417155 - RNA, 12 nt, Homo sapiens
ccagcauuugag

SEQ ID NO: 1417156 - RNA, 19 nt, Homo sapiens
ccagccuccccgugccaaa

SEQ ID NO: 1417157 - RNA, 16 nt, Homo sapiens
ccagcgagcacccuca

SEQ ID NO: 1417158 - RNA, 15 nt, Homo sapiens
ccagcuacucgggag

SEQ ID NO: 1417159 - RNA, 13 nt, Homo sapiens
ccagcuagacucc

SEQ ID NO: 1417160 - RNA, 23 nt, Homo sapiens
ccagcuccuccgugcuuccucag

SEQ ID NO: 1417161 - RNA, 21 nt, Homo sapiens
ccagcucggcgagcuccucca

SEQ ID NO: 1417162 - RNA, 15 nt, Homo sapiens
ccaggaaugauccca

SEQ ID NO: 1417163 - RNA, 20 nt, Homo sapiens
ccaggaaugaucccacucac

SEQ ID NO: 1417164 - RNA, 21 nt, Homo sapiens
ccaggagggcuuugugucugg

SEQ ID NO: 1417165 - RNA, 23 nt, Homo sapiens
ccagggugggcagacagacagau

SEQ ID NO: 1417166 - RNA, 20 nt, Homo sapiens
ccaguacucuguaaguuucu

SEQ ID NO: 1417167 - RNA, 12 nt, Homo sapiens
ccauaagcagaa

SEQ ID NO: 1417168 - RNA, 14 nt, Homo sapiens
ccauacagugacaa

SEQ ID NO: 1417169 - RNA, 23 nt, Homo sapiens
ccaucccucgugguccccaacag

SEQ ID NO: 1417170 - RNA, 23 nt, Homo sapiens
ccaucucccgcguggaguucucc

SEQ ID NO: 1417171 - RNA, 18 nt, Homo sapiens
ccaugacaccugccauac

SEQ ID NO: 1417172 - RNA, 18 nt, Homo sapiens
ccaugaccuuacauuucc

SEQ ID NO: 1417173 - RNA, 15 nt, Homo sapiens
ccauggaaugacuga

SEQ ID NO: 1417174 - RNA, 13 nt, Homo sapiens
ccauggcuuugug

SEQ ID NO: 1417175 - RNA, 20 nt, Homo sapiens
ccauggugacaucacucuag

SEQ ID NO: 1417176 - RNA, 20 nt, Homo sapiens
ccauguagaacuugaacuaa

SEQ ID NO: 1417177 - RNA, 17 nt, Homo sapiens
ccaugugaaacucaucu

SEQ ID NO: 1417178 - RNA, 16 nt, Homo sapiens
ccauucagacuuucag

SEQ ID NO: 1417179 - RNA, 13 nt, Homo sapiens
ccauucucaggug

SEQ ID NO: 1417180 - RNA, 18 nt, Homo sapiens
ccauucucagguggugau

SEQ ID NO: 1417181 - RNA, 17 nt, Homo sapiens
cccaaccuagaccugua

SEQ ID NO: 1417182 - RNA, 16 nt, Homo sapiens
cccacgccuccugcca

SEQ ID NO: 1417183 - RNA, 17 nt, Homo sapiens
cccacuguccuguaaac

SEQ ID NO: 1417184 - RNA, 21 nt, Homo sapiens
cccagccaggcuaugguugcc

SEQ ID NO: 1417185 - RNA, 22 nt, Homo sapiens
cccagcucggacuauacugcug

SEQ ID NO: 1417186 - RNA, 21 nt, Homo sapiens
cccaggagagagaaagccagg

SEQ ID NO: 1417187 - RNA, 18 nt, Homo sapiens
cccaucccugccugguca

SEQ ID NO: 1417188 - RNA, 18 nt, Homo sapiens
cccaucccugugaaggag

SEQ ID NO: 1417189 - RNA, 18 nt, Homo sapiens
cccauggugacaucacuc

SEQ ID NO: 1417190 - RNA, 20 nt, Homo sapiens
ccccacuuccaucauuuccu

SEQ ID NO: 1417191 - RNA, 22 nt, Homo sapiens
ccccagaggucacacagccugu

SEQ ID NO: 1417192 - RNA, 17 nt, Homo sapiens
ccccagccccuagccca

SEQ ID NO: 1417193 - RNA, 22 nt, Homo sapiens
ccccaucgccagcugaugacuc

SEQ ID NO: 1417194 - RNA, 15 nt, Homo sapiens
cccccaccacaggcc

SEQ ID NO: 1417195 - RNA, 15 nt, Homo sapiens
cccccaccucaagug

SEQ ID NO: 1417196 - RNA, 16 nt, Homo sapiens
ccccuccccugcugca

SEQ ID NO: 1417197 - RNA, 15 nt, Homo sapiens
ccccuccuccaucuc

SEQ ID NO: 1417198 - RNA, 15 nt, Homo sapiens
cccgauagugacaca

SEQ ID NO: 1417199 - RNA, 15 nt, Homo sapiens
cccggacaguggcac

SEQ ID NO: 1417200 - RNA, 16 nt, Homo sapiens
cccggggugaguccau

SEQ ID NO: 1417201 - RNA, 14 nt, Homo sapiens
cccgguacagggcc

SEQ ID NO: 1417202 - RNA, 18 nt, Homo sapiens
cccucaccagaagcagau

SEQ ID NO: 1417203 - RNA, 14 nt, Homo sapiens
cccucucaagugcc

SEQ ID NO: 1417204 - RNA, 15 nt, Homo sapiens
cccucuggggcucag

SEQ ID NO: 1417205 - RNA, 14 nt, Homo sapiens
cccugagcugccac

SEQ ID NO: 1417206 - RNA, 19 nt, Homo sapiens
cccugaggaauaaagcuuc

SEQ ID NO: 1417207 - RNA, 22 nt, Homo sapiens
cccugaggagggcccugaggaa

SEQ ID NO: 1417208 - RNA, 16 nt, Homo sapiens
cccugaguuggcauca

SEQ ID NO: 1417209 - RNA, 18 nt, Homo sapiens
cccugaguuggcaucacc

SEQ ID NO: 1417210 - RNA, 23 nt, Homo sapiens
cccugauccaggaaaaugugagg

SEQ ID NO: 1417211 - RNA, 19 nt, Homo sapiens
cccuucauuuaaccaagcu

SEQ ID NO: 1417212 - RNA, 16 nt, Homo sapiens
cccuuccucucccauu

SEQ ID NO: 1417213 - RNA, 22 nt, Homo sapiens
cccuuggccagaagucaagccc

SEQ ID NO: 1417214 - RNA, 15 nt, Homo sapiens
ccgaggaggagcucu

SEQ ID NO: 1417215 - RNA, 18 nt, Homo sapiens
ccgcaggccuuacagucu

SEQ ID NO: 1417216 - RNA, 20 nt, Homo sapiens
ccgcccuugccgaaccagga

SEQ ID NO: 1417217 - RNA, 13 nt, Homo sapiens
ccgcuagcucuuu

SEQ ID NO: 1417218 - RNA, 15 nt, Homo sapiens
ccggacaguggcacc

SEQ ID NO: 1417219 - RNA, 12 nt, Homo sapiens
ccguccaagaac

SEQ ID NO: 1417220 - RNA, 13 nt, Homo sapiens
ccgucuuccugug

SEQ ID NO: 1417221 - RNA, 17 nt, Homo sapiens
ccgugucaugugucugu

SEQ ID NO: 1417222 - RNA, 18 nt, Homo sapiens
ccuaaauugaacugccaa

SEQ ID NO: 1417223 - RNA, 20 nt, Homo sapiens
ccuaaucccuuccucuccca

SEQ ID NO: 1417224 - RNA, 20 nt, Homo sapiens
ccuaugccagagcagugcca

SEQ ID NO: 1417225 - RNA, 14 nt, Homo sapiens
ccucacucuugcca

SEQ ID NO: 1417226 - RNA, 15 nt, Homo sapiens
ccucacucuugccaa

SEQ ID NO: 1417227 - RNA, 15 nt, Homo sapiens
ccucagguucaauau

SEQ ID NO: 1417228 - RNA, 23 nt, Homo sapiens
ccuccugggacugugacugcuuu

SEQ ID NO: 1417229 - RNA, 23 nt, Homo sapiens
ccucgggaaccucacucuugcca

SEQ ID NO: 1417230 - RNA, 18 nt, Homo sapiens
ccucguuaggacaaggcu

SEQ ID NO: 1417231 - RNA, 22 nt, Homo sapiens
ccucucacacucaggccagacu

SEQ ID NO: 1417232 - RNA, 21 nt, Homo sapiens
ccucucagcugaacacccucc

SEQ ID NO: 1417233 - RNA, 14 nt, Homo sapiens
ccucuccagcuccu

SEQ ID NO: 1417234 - RNA, 15 nt, Homo sapiens
ccucuccuuccucag

SEQ ID NO: 1417235 - RNA, 22 nt, Homo sapiens
ccucugcggaccccagcuguga

SEQ ID NO: 1417236 - RNA, 12 nt, Homo sapiens
ccucugcuaaag

SEQ ID NO: 1417237 - RNA, 15 nt, Homo sapiens
ccucuggaguuucau

SEQ ID NO: 1417238 - RNA, 21 nt, Homo sapiens
ccucugugcugcaucccacca

SEQ ID NO: 1417239 - RNA, 15 nt, Homo sapiens
ccugaagggugcuca

SEQ ID NO: 1417240 - RNA, 13 nt, Homo sapiens
ccugagcugccac

SEQ ID NO: 1417241 - RNA, 23 nt, Homo sapiens
ccugagcuucccccccaccacag

SEQ ID NO: 1417242 - RNA, 23 nt, Homo sapiens
ccugaggagggcccugaggaaua

SEQ ID NO: 1417243 - RNA, 22 nt, Homo sapiens
ccugcacagaucgauaccuuuc

SEQ ID NO: 1417244 - RNA, 15 nt, Homo sapiens
ccugcaguaaucucc

SEQ ID NO: 1417245 - RNA, 22 nt, Homo sapiens
ccugcgggaagcugaccuuuaa

SEQ ID NO: 1417246 - RNA, 14 nt, Homo sapiens
ccugcugcugccaa

SEQ ID NO: 1417247 - RNA, 17 nt, Homo sapiens
ccuggacgcagccacac

SEQ ID NO: 1417248 - RNA, 21 nt, Homo sapiens
ccuggaggagcuagaguaucc

SEQ ID NO: 1417249 - RNA, 13 nt, Homo sapiens
ccuggaggugcca

SEQ ID NO: 1417250 - RNA, 17 nt, Homo sapiens
ccuggccauguccucaa

SEQ ID NO: 1417251 - RNA, 21 nt, Homo sapiens
ccuggccuuauaucauuucau

SEQ ID NO: 1417252 - RNA, 19 nt, Homo sapiens
ccuguaagcaacacuuuaa

SEQ ID NO: 1417253 - RNA, 16 nt, Homo sapiens
ccuguaauaaauauga

SEQ ID NO: 1417254 - RNA, 13 nt, Homo sapiens
ccugugcugcgau

SEQ ID NO: 1417255 - RNA, 17 nt, Homo sapiens
ccuguggcugcccucca

SEQ ID NO: 1417256 - RNA, 17 nt, Homo sapiens
ccuuaguccccaagccc

SEQ ID NO: 1417257 - RNA, 17 nt, Homo sapiens
ccuuaguuugcugccau

SEQ ID NO: 1417258 - RNA, 16 nt, Homo sapiens
ccuuauaucauuucau

SEQ ID NO: 1417259 - RNA, 12 nt, Homo sapiens
ccuucaccaaag

SEQ ID NO: 1417260 - RNA, 20 nt, Homo sapiens
ccuucagaggccaucugauu

SEQ ID NO: 1417261 - RNA, 16 nt, Homo sapiens
ccuuccuaguggguua

SEQ ID NO: 1417262 - RNA, 18 nt, Homo sapiens
ccuugcacuguaucauuu

SEQ ID NO: 1417263 - RNA, 12 nt, Homo sapiens
ccugugacaugg

SEQ ID NO: 1417264 - RNA, 19 nt, Homo sapiens
ccuguguaacaggacccca

SEQ ID NO: 1417265 - RNA, 13 nt, Homo sapiens
ccuuaaacugcca

SEQ ID NO: 1417266 - RNA, 11 nt, Homo sapiens
ccuuacagucu

SEQ ID NO: 1417267 - RNA, 21 nt, Homo sapiens
ccuuauucucacagcaagccc

SEQ ID NO: 1417268 - RNA, 13 nt, Homo sapiens
ccuucaccaaaga

SEQ ID NO: 1417269 - RNA, 22 nt, Homo sapiens
ccuucaggccuugccugggaua

SEQ ID NO: 1417270 - RNA, 22 nt, Homo sapiens
ccuuccaauccuuaaacugcca

SEQ ID NO: 1417271 - RNA, 23 nt, Homo sapiens
ccuucccuagcuuuagacccugg

SEQ ID NO: 1417272 - RNA, 17 nt, Homo sapiens
ccuugaccucauuuaca

SEQ ID NO: 1417273 - RNA, 23 nt, Homo sapiens
ccuugaccucauuuacaaagcaa

SEQ ID NO: 1417274 - RNA, 23 nt, Homo sapiens
ccuugcugcggcugcaucuucca

SEQ ID NO: 1417275 - RNA, 18 nt, Homo sapiens
ccuuggccagaagucaag

SEQ ID NO: 1417276 - RNA, 20 nt, Homo sapiens
ccuuguagagcacagaguag

SEQ ID NO: 1417277 - RNA, 13 nt, Homo sapiens
ccuuuacuccucg

SEQ ID NO: 1417278 - RNA, 22 nt, Homo sapiens
ccuuucggcuuugggcuuuuau

SEQ ID NO: 1417279 - RNA, 16 nt, Homo sapiens
cgaaggugcuggaggu

SEQ ID NO: 1417280 - RNA, 16 nt, Homo sapiens
cgacgaaucuucucaa

SEQ ID NO: 1417281 - RNA, 14 nt, Homo sapiens
cgagaugaaauuaa

SEQ ID NO: 1417282 - RNA, 20 nt, Homo sapiens
cgaugggaacacaagugccc

SEQ ID NO: 1417283 - RNA, 16 nt, Homo sapiens
cgcauuguuuugcauc

SEQ ID NO: 1417284 - RNA, 18 nt, Homo sapiens
cgcccaacguuugccucc

SEQ ID NO: 1417285 - RNA, 19 nt, Homo sapiens
cgccccggacaguggcacc

SEQ ID NO: 1417286 - RNA, 13 nt, Homo sapiens
cgccuuagcuuug

SEQ ID NO: 1417287 - RNA, 14 nt, Homo sapiens
cggacaguggcacc

SEQ ID NO: 1417288 - RNA, 16 nt, Homo sapiens
cggacgccaccuuccc

SEQ ID NO: 1417289 - RNA, 15 nt, Homo sapiens
cggccaacacuuugu

SEQ ID NO: 1417290 - RNA, 14 nt, Homo sapiens
cggccccaccugcc

SEQ ID NO: 1417291 - RNA, 20 nt, Homo sapiens
cggccuagugugccaagaau

SEQ ID NO: 1417292 - RNA, 15 nt, Homo sapiens
cggcucaacuccucc

SEQ ID NO: 1417293 - RNA, 13 nt, Homo sapiens
cggcuguggagau

SEQ ID NO: 1417294 - RNA, 20 nt, Homo sapiens
cgggaaccucacucuugcca

SEQ ID NO: 1417295 - RNA, 21 nt, Homo sapiens
cgggaaccucacucuugccaa

SEQ ID NO: 1417296 - RNA, 14 nt, Homo sapiens
cggggacccuguga

SEQ ID NO: 1417297 - RNA, 18 nt, Homo sapiens
cguauagggcacucccag

SEQ ID NO: 1417298 - RNA, 12 nt, Homo sapiens
cgugcauaaaaa

SEQ ID NO: 1417299 - RNA, 15 nt, Homo sapiens
cgugccaaaaaucuu

SEQ ID NO: 1417300 - RNA, 17 nt, Homo sapiens
cguggcuuuuagacaga

SEQ ID NO: 1417301 - RNA, 12 nt, Homo sapiens
cguuaagugccc

SEQ ID NO: 1417302 - RNA, 22 nt, Homo sapiens
cguuucacacggacuaaucuuu

SEQ ID NO: 1417303 - RNA, 20 nt, Homo sapiens
cguuucccguuagucucuga

SEQ ID NO: 1417304 - RNA, 19 nt, Homo sapiens
cuaaaagagaaugaugcug

SEQ ID NO: 1417305 - RNA, 17 nt, Homo sapiens
cuaaagaaauaaucucu

SEQ ID NO: 1417306 - RNA, 21 nt, Homo sapiens
cuaaagaaauaaucucuaugu

SEQ ID NO: 1417307 - RNA, 15 nt, Homo sapiens
cuaaagagcccuugc

SEQ ID NO: 1417308 - RNA, 20 nt, Homo sapiens
cuaaagugggaaaguugcau

SEQ ID NO: 1417309 - RNA, 14 nt, Homo sapiens
cuaaauauuuccau

SEQ ID NO: 1417310 - RNA, 16 nt, Homo sapiens
cuaacaaaugaucuag

SEQ ID NO: 1417311 - RNA, 12 nt, Homo sapiens
cuaacaugguga

SEQ ID NO: 1417312 - RNA, 13 nt, Homo sapiens
cuaacauggugaa

SEQ ID NO: 1417313 - RNA, 19 nt, Homo sapiens
cuaaguguguauccagaag

SEQ ID NO: 1417314 - RNA, 14 nt, Homo sapiens
cuaauaaaauauca

SEQ ID NO: 1417315 - RNA, 20 nt, Homo sapiens
cuaaugagcuuuacagcaga

SEQ ID NO: 1417316 - RNA, 14 nt, Homo sapiens
cuaauucaguucug

SEQ ID NO: 1417317 - RNA, 20 nt, Homo sapiens
cuacaaauuuuuacuugaag

SEQ ID NO: 1417318 - RNA, 15 nt, Homo sapiens
cuacagaguaacaaa

SEQ ID NO: 1417319 - RNA, 22 nt, Homo sapiens
cuacaguccuuccaggggcucu

SEQ ID NO: 1417320 - RNA, 15 nt, Homo sapiens
cuacgagaugaccuu

SEQ ID NO: 1417321 - RNA, 12 nt, Homo sapiens
cuacugccccug

SEQ ID NO: 1417322 - RNA, 23 nt, Homo sapiens
cuacuugggagguugaagcagaa

SEQ ID NO: 1417323 - RNA, 12 nt, Homo sapiens
cuagaagccaag

SEQ ID NO: 1417324 - RNA, 18 nt, Homo sapiens
cuagauuccauacaguga

SEQ ID NO: 1417325 - RNA, 13 nt, Homo sapiens
cuagucacuuguu

SEQ ID NO: 1417326 - RNA, 17 nt, Homo sapiens
cuauaauacaguuuucu

SEQ ID NO: 1417327 - RNA, 17 nt, Homo sapiens
cuauacugcugaguucu

SEQ ID NO: 1417328 - RNA, 15 nt, Homo sapiens
cuaucugaacuaauu

SEQ ID NO: 1417329 - RNA, 17 nt, Homo sapiens
cuaugcagaacagugag

SEQ ID NO: 1417330 - RNA, 22 nt, Homo sapiens
cuaugcagaacagugagccaaa

SEQ ID NO: 1417331 - RNA, 23 nt, Homo sapiens
cuauucuggcaauaaacuuuuag

SEQ ID NO: 1417332 - RNA, 13 nt, Homo sapiens
cuauucugugaaa

SEQ ID NO: 1417333 - RNA, 19 nt, Homo sapiens
cuauuuuuguagaugcuau

SEQ ID NO: 1417334 - RNA, 21 nt, Homo sapiens
cucaaaagaaaauauagucac

SEQ ID NO: 1417335 - RNA, 22 nt, Homo sapiens
cucaaacccuguaaguuacagu

SEQ ID NO: 1417336 - RNA, 17 nt, Homo sapiens
cucaacauuacauuuga

SEQ ID NO: 1417337 - RNA, 17 nt, Homo sapiens
cucacgccuguaauccc

SEQ ID NO: 1417338 - RNA, 19 nt, Homo sapiens
cucacuaccuccucaggga

SEQ ID NO: 1417339 - RNA, 14 nt, Homo sapiens
cucacucuugccaa

SEQ ID NO: 1417340 - RNA, 14 nt, Homo sapiens
cucagcaacuuucc

SEQ ID NO: 1417341 - RNA, 14 nt, Homo sapiens
cucagcaauccacc

SEQ ID NO: 1417342 - RNA, 11 nt, Homo sapiens
cucagugucca

SEQ ID NO: 1417343 - RNA, 13 nt, Homo sapiens
cucaucugccaaa

SEQ ID NO: 1417344 - RNA, 20 nt, Homo sapiens
cucaugccuguaaucccagc

SEQ ID NO: 1417345 - RNA, 14 nt, Homo sapiens
cucauggugaaauc

SEQ ID NO: 1417346 - RNA, 15 nt, Homo sapiens
cuccaacuccagcug

SEQ ID NO: 1417347 - RNA, 17 nt, Homo sapiens
cuccacaccaguaauaa

SEQ ID NO: 1417348 - RNA, 17 nt, Homo sapiens
cuccacaucugccuuaa

SEQ ID NO: 1417349 - RNA, 17 nt, Homo sapiens
cuccacccccaccucaa

SEQ ID NO: 1417350 - RNA, 22 nt, Homo sapiens
cuccaucccuuccccagagaug

SEQ ID NO: 1417351 - RNA, 20 nt, Homo sapiens
cucccaaaugcaaacagucu

SEQ ID NO: 1417352 - RNA, 16 nt, Homo sapiens
cucccagccugacucc

SEQ ID NO: 1417353 - RNA, 21 nt, Homo sapiens
cucccauggaauuggaacucc

SEQ ID NO: 1417354 - RNA, 19 nt, Homo sapiens
cuccggggcucagcccuga

SEQ ID NO: 1417355 - RNA, 15 nt, Homo sapiens
cuccgucuuccugug

SEQ ID NO: 1417356 - RNA, 16 nt, Homo sapiens
cuccuccagaccuccu

SEQ ID NO: 1417357 - RNA, 16 nt, Homo sapiens
cuccuccgcccagcuc

SEQ ID NO: 1417358 - RNA, 19 nt, Homo sapiens
cuccuccgugcuuccucag

SEQ ID NO: 1417359 - RNA, 17 nt, Homo sapiens
cuccucuuccagaguca

SEQ ID NO: 1417360 - RNA, 19 nt, Homo sapiens
cuccucuuccagagucacc

SEQ ID NO: 1417361 - RNA, 16 nt, Homo sapiens
cuccugcccuguagaa

SEQ ID NO: 1417362 - RNA, 20 nt, Homo sapiens
cuccuguaagcaacacuuua

SEQ ID NO: 1417363 - RNA, 17 nt, Homo sapiens
cuccuuuaucauuacca

SEQ ID NO: 1417364 - RNA, 17 nt, Homo sapiens
cuccuuugcuagugucu

SEQ ID NO: 1417365 - RNA, 22 nt, Homo sapiens
cucgggaaccucacucuugcca

SEQ ID NO: 1417366 - RNA, 19 nt, Homo sapiens
cucggggaacccaaggccc

SEQ ID NO: 1417367 - RNA, 22 nt, Homo sapiens
cucucaccaugugacacacugg

SEQ ID NO: 1417368 - RNA, 21 nt, Homo sapiens
cucuccccagccuccccgugc

SEQ ID NO: 1417369 - RNA, 15 nt, Homo sapiens
cucucucacaaauca

SEQ ID NO: 1417370 - RNA, 17 nt, Homo sapiens
cucucuuuccuucuugc

SEQ ID NO: 1417371 - RNA, 21 nt, Homo sapiens
cucugaacuaggugaucucag

SEQ ID NO: 1417372 - RNA, 22 nt, Homo sapiens
cucuggagcaagcccugaccca

SEQ ID NO: 1417373 - RNA, 18 nt, Homo sapiens
cucugguuguuuaugcaa

SEQ ID NO: 1417374 - RNA, 22 nt, Homo sapiens
cucuguacaucagacaauugca

SEQ ID NO: 1417375 - RNA, 20 nt, Homo sapiens
cucuugaguagcugggauua

SEQ ID NO: 1417376 - RNA, 17 nt, Homo sapiens
cucuuuccuucuugccu

SEQ ID NO: 1417377 - RNA, 13 nt, Homo sapiens
cugaaaaaugccu

SEQ ID NO: 1417378 - RNA, 16 nt, Homo sapiens
cugaaaacagucccag

SEQ ID NO: 1417379 - RNA, 22 nt, Homo sapiens
cugaaagucuguggcccaagag

SEQ ID NO: 1417380 - RNA, 14 nt, Homo sapiens
cugaagaaaccugg

SEQ ID NO: 1417381 - RNA, 22 nt, Homo sapiens
cugaaggaaaaacacaagcaaa

SEQ ID NO: 1417382 - RNA, 20 nt, Homo sapiens
cugaaguuauaaacuuauaa

SEQ ID NO: 1417383 - RNA, 17 nt, Homo sapiens
cugaaguuugcauuaau

SEQ ID NO: 1417384 - RNA, 23 nt, Homo sapiens
cugaauagcuuggaaaaguaaca

SEQ ID NO: 1417385 - RNA, 16 nt, Homo sapiens
cugacagcauaccuca

SEQ ID NO: 1417386 - RNA, 13 nt, Homo sapiens
cugacugcaauga

SEQ ID NO: 1417387 - RNA, 18 nt, Homo sapiens
cugaggcaggagaauggc

SEQ ID NO: 1417388 - RNA, 15 nt, Homo sapiens
cugagugucaucuca

SEQ ID NO: 1417389 - RNA, 17 nt, Homo sapiens
cugagugucaucucaac

SEQ ID NO: 1417390 - RNA, 23 nt, Homo sapiens
cugauggagacaguaacacuggc

SEQ ID NO: 1417391 - RNA, 11 nt, Homo sapiens
cugcacucaag

SEQ ID NO: 1417392 - RNA, 21 nt, Homo sapiens
cugcagccaucccaaggcucc

SEQ ID NO: 1417393 - RNA, 17 nt, Homo sapiens
cugcauuucacucuggg

SEQ ID NO: 1417394 - RNA, 21 nt, Homo sapiens
cugcauuugugucauugacaa

SEQ ID NO: 1417395 - RNA, 17 nt, Homo sapiens
cugcauuuuaagcauaa

SEQ ID NO: 1417396 - RNA, 16 nt, Homo sapiens
cugccacucuacaggu

SEQ ID NO: 1417397 - RNA, 16 nt, Homo sapiens
cugccagcauaauacu

SEQ ID NO: 1417398 - RNA, 22 nt, Homo sapiens
cauuuacaaagcaaaaagagau

SEQ ID NO: 1417399 - RNA, 19 nt, Homo sapiens
cauuuauaugaauuuccac

SEQ ID NO: 1417400 - RNA, 16 nt, Homo sapiens
cauuucaaucuuuuca

SEQ ID NO: 1417401 - RNA, 14 nt, Homo sapiens
cauuucacucuggg

SEQ ID NO: 1417402 - RNA, 16 nt, Homo sapiens
cauuuguaaaaaguag

SEQ ID NO: 1417403 - RNA, 13 nt, Homo sapiens
cauuuucucugau

SEQ ID NO: 1417404 - RNA, 22 nt, Homo sapiens
cauuuuuuaaauguucauguca

SEQ ID NO: 1417405 - RNA, 18 nt, Homo sapiens
cauuuuuuaaauuugcca

SEQ ID NO: 1417406 - RNA, 13 nt, Homo sapiens
ccaaacacauuaa

SEQ ID NO: 1417407 - RNA, 18 nt, Homo sapiens
ccaaaucaaaugcucacu

SEQ ID NO: 1417408 - RNA, 12 nt, Homo sapiens
ccaaauuaucaa

SEQ ID NO: 1417409 - RNA, 14 nt, Homo sapiens
ccaaauuuaagcaa

SEQ ID NO: 1417410 - RNA, 13 nt, Homo sapiens
ccaacagaacucc

SEQ ID NO: 1417411 - RNA, 12 nt, Homo sapiens
ccaacaugguga

SEQ ID NO: 1417412 - RNA, 20 nt, Homo sapiens
ccaacccaauaaaacugaug

SEQ ID NO: 1417413 - RNA, 13 nt, Homo sapiens
ccaaccuguaaua

SEQ ID NO: 1417414 - RNA, 14 nt, Homo sapiens
ccaaccuguaauaa

SEQ ID NO: 1417415 - RNA, 21 nt, Homo sapiens
ccaagcuauguggcugcugcu

SEQ ID NO: 1417416 - RNA, 18 nt, Homo sapiens
ccaaggacagucagcauu

SEQ ID NO: 1417417 - RNA, 21 nt, Homo sapiens
ccaaggacagucagcauuucu

SEQ ID NO: 1417418 - RNA, 14 nt, Homo sapiens
ccaaggagcuacac

SEQ ID NO: 1417419 - RNA, 17 nt, Homo sapiens
ccaaggcuccugaccua

SEQ ID NO: 1417420 - RNA, 20 nt, Homo sapiens
ccaaguuucauaccaaauau

SEQ ID NO: 1417421 - RNA, 18 nt, Homo sapiens
ccaauccuuaaacugcca

SEQ ID NO: 1417422 - RNA, 22 nt, Homo sapiens
ccacaggcccuuuccucaggca

SEQ ID NO: 1417423 - RNA, 21 nt, Homo sapiens
ccaccacaggcccuuuccuca

SEQ ID NO: 1417424 - RNA, 14 nt, Homo sapiens
ccaccucaagugcc

SEQ ID NO: 1417425 - RNA, 12 nt, Homo sapiens
ccacuaagugug

SEQ ID NO: 1417426 - RNA, 15 nt, Homo sapiens
ccacuaauugccuua

SEQ ID NO: 1417427 - RNA, 20 nt, Homo sapiens
ccacucaccaggcaccagag

SEQ ID NO: 1417428 - RNA, 23 nt, Homo sapiens
ccacucucgcucuggauuccauu

SEQ ID NO: 1417429 - RNA, 22 nt, Homo sapiens
ccacugauuuagccaugugaaa

SEQ ID NO: 1417430 - RNA, 23 nt, Homo sapiens
ccacugcguucaacaaugcugca

SEQ ID NO: 1417431 - RNA, 21 nt, Homo sapiens
ccacuugggacuagaucacaa

SEQ ID NO: 1417432 - RNA, 18 nt, Homo sapiens
ccagaaggggauggacuu

SEQ ID NO: 1417433 - RNA, 22 nt, Homo sapiens
ccagaauucugggcaagucacc

SEQ ID NO: 1417434 - RNA, 23 nt, Homo sapiens
ccagaauucugggcaagucaccc

SEQ ID NO: 1417435 - RNA, 16 nt, Homo sapiens
ccagagcaaaguguaa

SEQ ID NO: 1417436 - RNA, 23 nt, Homo sapiens
ccagagcuguggagaggggaccc

SEQ ID NO: 1417437 - RNA, 22 nt, Homo sapiens
ccagaggucacacagccugugu

SEQ ID NO: 1417438 - RNA, 13 nt, Homo sapiens
ccagccaggcuau

SEQ ID NO: 1417439 - RNA, 17 nt, Homo sapiens
ccagccuccaacuccag

SEQ ID NO: 1417440 - RNA, 16 nt, Homo sapiens
ccagccugggagauag

SEQ ID NO: 1417441 - RNA, 17 nt, Homo sapiens
ccagccuugaguuaucu

SEQ ID NO: 1417442 - RNA, 21 nt, Homo sapiens
ccagcuacuugggagguugaa

SEQ ID NO: 1417443 - RNA, 19 nt, Homo sapiens
ccagcugaugacucaagau

SEQ ID NO: 1417444 - RNA, 14 nt, Homo sapiens
ccagcuggucuuca

SEQ ID NO: 1417445 - RNA, 12 nt, Homo sapiens
ccaggacugagc

SEQ ID NO: 1417446 - RNA, 20 nt, Homo sapiens
ccaggaugcuggggcacuuu

SEQ ID NO: 1417447 - RNA, 14 nt, Homo sapiens
ccaggcaggggugg

SEQ ID NO: 1417448 - RNA, 14 nt, Homo sapiens
ccaggcaguucucu

SEQ ID NO: 1417449 - RNA, 18 nt, Homo sapiens
ccaggccgggcacagugg

SEQ ID NO: 1417450 - RNA, 21 nt, Homo sapiens
ccaggcugggaggcucggggc

SEQ ID NO: 1417451 - RNA, 16 nt, Homo sapiens
ccagggugggcagaca

SEQ ID NO: 1417452 - RNA, 20 nt, Homo sapiens
ccaggguuguuagaucuucu

SEQ ID NO: 1417453 - RNA, 12 nt, Homo sapiens
ccaguuaaauau

SEQ ID NO: 1417454 - RNA, 20 nt, Homo sapiens
ccaguuggcuaggggagcag

SEQ ID NO: 1417455 - RNA, 23 nt, Homo sapiens
ccauaguaaugagugaguucuca

SEQ ID NO: 1417456 - RNA, 17 nt, Homo sapiens
ccaucuagcaagcacuu

SEQ ID NO: 1417457 - RNA, 15 nt, Homo sapiens
ccaugacaccugcca

SEQ ID NO: 1417458 - RNA, 19 nt, Homo sapiens
ccaugggguagggugagaa

SEQ ID NO: 1417459 - RNA, 19 nt, Homo sapiens
ccaugugaaacucaucuca

SEQ ID NO: 1417460 - RNA, 17 nt, Homo sapiens
ccauuauaaacauguuu

SEQ ID NO: 1417461 - RNA, 11 nt, Homo sapiens
cccaagcagua

SEQ ID NO: 1417462 - RNA, 21 nt, Homo sapiens
cccaaggacagucagcauuuc

SEQ ID NO: 1417463 - RNA, 17 nt, Homo sapiens
cccacacccacuguccu

SEQ ID NO: 1417464 - RNA, 18 nt, Homo sapiens
cccaccagagcuguggag

SEQ ID NO: 1417465 - RNA, 14 nt, Homo sapiens
cccacgucacuuga

SEQ ID NO: 1417466 - RNA, 16 nt, Homo sapiens
cccacuucuucagcuu

SEQ ID NO: 1417467 - RNA, 19 nt, Homo sapiens
cccagccuccccgugccaa

SEQ ID NO: 1417468 - RNA, 20 nt, Homo sapiens
cccagccuccccgugccaaa

SEQ ID NO: 1417469 - RNA, 16 nt, Homo sapiens
cccagccucuucccau

SEQ ID NO: 1417470 - RNA, 18 nt, Homo sapiens
cccaggcuggaguacaau

SEQ ID NO: 1417471 - RNA, 23 nt, Homo sapiens
cccaggcuggaguacaauggcgu

SEQ ID NO: 1417472 - RNA, 14 nt, Homo sapiens
cccagguaccagcu

SEQ ID NO: 1417473 - RNA, 15 nt, Homo sapiens
cccauaguaaugagu

SEQ ID NO: 1417474 - RNA, 12 nt, Homo sapiens
cccaucuagcaa

SEQ ID NO: 1417475 - RNA, 16 nt, Homo sapiens
cccaugcuuaucccuc

SEQ ID NO: 1417476 - RNA, 17 nt, Homo sapiens
cccauggcuaagcuuua

SEQ ID NO: 1417477 - RNA, 21 nt, Homo sapiens
ccccaacagcgacauagccca

SEQ ID NO: 1417478 - RNA, 19 nt, Homo sapiens
ccccacacccgugucaugu

SEQ ID NO: 1417479 - RNA, 23 nt, Homo sapiens
ccccagcuucagccugcugggca

SEQ ID NO: 1417480 - RNA, 19 nt, Homo sapiens
ccccaggcuggagugcagu

SEQ ID NO: 1417481 - RNA, 12 nt, Homo sapiens
ccccaucauuaa

SEQ ID NO: 1417482 - RNA, 18 nt, Homo sapiens
cccccaccucaagugccu

SEQ ID NO: 1417483 - RNA, 13 nt, Homo sapiens
ccccccaccacag

SEQ ID NO: 1417484 - RNA, 20 nt, Homo sapiens
ccccgacucccuccccagau

SEQ ID NO: 1417485 - RNA, 18 nt, Homo sapiens
ccccucccccuaaggcag

SEQ ID NO: 1417486 - RNA, 15 nt, Homo sapiens
cccgaggucgcugca

SEQ ID NO: 1417487 - RNA, 16 nt, Homo sapiens
cccggacaguggcacc

SEQ ID NO: 1417488 - RNA, 13 nt, Homo sapiens
cccgugccaaaaa

SEQ ID NO: 1417489 - RNA, 16 nt, Homo sapiens
cccguuagucucugaa

SEQ ID NO: 1417490 - RNA, 14 nt, Homo sapiens
cccuaagacuccuc

SEQ ID NO: 1417491 - RNA, 21 nt, Homo sapiens
cccuaccuugucuguuagcca

SEQ ID NO: 1417492 - RNA, 15 nt, Homo sapiens
cccucgaagugggcc

SEQ ID NO: 1417493 - RNA, 20 nt, Homo sapiens
cccugagccccauacagggc

SEQ ID NO: 1417494 - RNA, 21 nt, Homo sapiens
cccugaguucccaaagggagg

SEQ ID NO: 1417495 - RNA, 15 nt, Homo sapiens
cccuggaucucccaa

SEQ ID NO: 1417496 - RNA, 15 nt, Homo sapiens
cccuggccaccccau

SEQ ID NO: 1417497 - RNA, 20 nt, Homo sapiens
cccuguaaguuacagucaca

SEQ ID NO: 1417498 - RNA, 18 nt, Homo sapiens
cccuugcacuguaucauu

SEQ ID NO: 1417499 - RNA, 21 nt, Homo sapiens
cccuugccgaaccaggagcug

SEQ ID NO: 1417500 - RNA, 18 nt, Homo sapiens
ccgagcuugccucagggc

SEQ ID NO: 1417501 - RNA, 14 nt, Homo sapiens
ccggacaguggcac

SEQ ID NO: 1417502 - RNA, 18 nt, Homo sapiens
ccggguguagauucccuu

SEQ ID NO: 1417503 - RNA, 18 nt, Homo sapiens
ccuaaacauuaaugacag

SEQ ID NO: 1417504 - RNA, 18 nt, Homo sapiens
ccuaaagaaauaaucucu

SEQ ID NO: 1417505 - RNA, 17 nt, Homo sapiens
ccuaacauacugcauuu

SEQ ID NO: 1417506 - RNA, 15 nt, Homo sapiens
ccuauacaguucuau

SEQ ID NO: 1417507 - RNA, 20 nt, Homo sapiens
ccuauacaguucuaugcaga

SEQ ID NO: 1417508 - RNA, 15 nt, Homo sapiens
ccucaagugccuuau

SEQ ID NO: 1417509 - RNA, 20 nt, Homo sapiens
ccucaagugccuuauucuca

SEQ ID NO: 1417510 - RNA, 21 nt, Homo sapiens
ccucaagugccuuauucucac

SEQ ID NO: 1417511 - RNA, 22 nt, Homo sapiens
ccucacucuugccaaccuguaa

SEQ ID NO: 1417512 - RNA, 19 nt, Homo sapiens
ccucauuguucuguacaaa

SEQ ID NO: 1417513 - RNA, 23 nt, Homo sapiens
ccuccagcaggguauggccagcu

SEQ ID NO: 1417514 - RNA, 16 nt, Homo sapiens
ccuccgugcuuccuca

SEQ ID NO: 1417515 - RNA, 17 nt, Homo sapiens
ccuccgugcuuccucag

SEQ ID NO: 1417516 - RNA, 16 nt, Homo sapiens
ccuccuucaccaaaga

SEQ ID NO: 1417517 - RNA, 16 nt, Homo sapiens
ccuccuucccuguguc

SEQ ID NO: 1417518 - RNA, 14 nt, Homo sapiens
ccucuagaagccaa

SEQ ID NO: 1417519 - RNA, 18 nt, Homo sapiens
ccucucucgcuugcucuc

SEQ ID NO: 1417520 - RNA, 21 nt, Homo sapiens
ccucucugagcucugcauuug

SEQ ID NO: 1417521 - RNA, 17 nt, Homo sapiens
ccucuguccccauagcu

SEQ ID NO: 1417522 - RNA, 21 nt, Homo sapiens
ccugaguuggcaucaccugcg

SEQ ID NO: 1417523 - RNA, 18 nt, Homo sapiens
ccugcagucaauguuucg

SEQ ID NO: 1417524 - RNA, 19 nt, Homo sapiens
aucaccguuucugcucugu

SEQ ID NO: 1417525 - RNA, 15 nt, Homo sapiens
aucagaaacaucuga

SEQ ID NO: 1417526 - RNA, 13 nt, Homo sapiens
aucagacuaugaa

SEQ ID NO: 1417527 - RNA, 19 nt, Homo sapiens
aucaugcuguguaauauca

SEQ ID NO: 1417528 - RNA, 23 nt, Homo sapiens
aucccaaggcuccugaccuaccu

SEQ ID NO: 1417529 - RNA, 11 nt, Homo sapiens
aucccaggaca

SEQ ID NO: 1417530 - RNA, 15 nt, Homo sapiens
aucccuuauguauga

SEQ ID NO: 1417531 - RNA, 22 nt, Homo sapiens
auccuagggccuggguuuucau

SEQ ID NO: 1417532 - RNA, 18 nt, Homo sapiens
auccuuucugccucucaa

SEQ ID NO: 1417533 - RNA, 17 nt, Homo sapiens
aucgaaucccuuucuca

SEQ ID NO: 1417534 - RNA, 14 nt, Homo sapiens
aucgguagcuugaa

SEQ ID NO: 1417535 - RNA, 16 nt, Homo sapiens
aucuaaauauuuccau

SEQ ID NO: 1417536 - RNA, 16 nt, Homo sapiens
aucuaauaaacuucca

SEQ ID NO: 1417537 - RNA, 14 nt, Homo sapiens
aucuaccuuccagu

SEQ ID NO: 1417538 - RNA, 16 nt, Homo sapiens
aucucagcucacucug

SEQ ID NO: 1417539 - RNA, 23 nt, Homo sapiens
aucucaucccaauaaaaugauau

SEQ ID NO: 1417540 - RNA, 15 nt, Homo sapiens
aucugaacuguggaa

SEQ ID NO: 1417541 - RNA, 17 nt, Homo sapiens
aucugcucuguacauca

SEQ ID NO: 1417542 - RNA, 19 nt, Homo sapiens
aucuggaacgcucuaggca

SEQ ID NO: 1417543 - RNA, 17 nt, Homo sapiens
aucuguugugcaugcuc

SEQ ID NO: 1417544 - RNA, 13 nt, Homo sapiens
aucuucuuugcag

SEQ ID NO: 1417545 - RNA, 14 nt, Homo sapiens
aucuuugugccuca

SEQ ID NO: 1417546 - RNA, 15 nt, Homo sapiens
augaaaaugaaugcu

SEQ ID NO: 1417547 - RNA, 15 nt, Homo sapiens
augaaaguugcagga

SEQ ID NO: 1417548 - RNA, 17 nt, Homo sapiens
augaaguuugcuauucu

SEQ ID NO: 1417549 - RNA, 17 nt, Homo sapiens
augacaguaguaccaaa

SEQ ID NO: 1417550 - RNA, 16 nt, Homo sapiens
augacucaagauuccc

SEQ ID NO: 1417551 - RNA, 15 nt, Homo sapiens
augacugaagacagg

SEQ ID NO: 1417552 - RNA, 21 nt, Homo sapiens
augagcaauguggauaugacc

SEQ ID NO: 1417553 - RNA, 15 nt, Homo sapiens
augagcuugccuaaa

SEQ ID NO: 1417554 - RNA, 16 nt, Homo sapiens
augaucccacucacca

SEQ ID NO: 1417555 - RNA, 15 nt, Homo sapiens
augauucucaagauc

SEQ ID NO: 1417556 - RNA, 23 nt, Homo sapiens
augcaaacuuuauuuuguguuua

SEQ ID NO: 1417557 - RNA, 18 nt, Homo sapiens
augcaaugagcaaugugg

SEQ ID NO: 1417558 - RNA, 16 nt, Homo sapiens
augcauauaucuccca

SEQ ID NO: 1417559 - RNA, 21 nt, Homo sapiens
augccauggaaugacugaaga

SEQ ID NO: 1417560 - RNA, 13 nt, Homo sapiens
augccugcugcug

SEQ ID NO: 1417561 - RNA, 17 nt, Homo sapiens
augccuguaaucccagc

SEQ ID NO: 1417562 - RNA, 17 nt, Homo sapiens
augcuaaaacaugauga

SEQ ID NO: 1417563 - RNA, 23 nt, Homo sapiens
augcucacuggggucaggcugau

SEQ ID NO: 1417564 - RNA, 15 nt, Homo sapiens
augcuggggcacuuu

SEQ ID NO: 1417565 - RNA, 17 nt, Homo sapiens
auggaauuggaacuccu

SEQ ID NO: 1417566 - RNA, 13 nt, Homo sapiens
auggaucaugucc

SEQ ID NO: 1417567 - RNA, 15 nt, Homo sapiens
auggcuaagcuuuau

SEQ ID NO: 1417568 - RNA, 14 nt, Homo sapiens
auggcuacaccuca

SEQ ID NO: 1417569 - RNA, 11 nt, Homo sapiens
auggcuccuug

SEQ ID NO: 1417570 - RNA, 19 nt, Homo sapiens
auggguuugccaagcccuu

SEQ ID NO: 1417571 - RNA, 12 nt, Homo sapiens
auguagcaaaau

SEQ ID NO: 1417572 - RNA, 14 nt, Homo sapiens
auguagccaugacc

SEQ ID NO: 1417573 - RNA, 20 nt, Homo sapiens
auguauauuugaacuccucu

SEQ ID NO: 1417574 - RNA, 18 nt, Homo sapiens
auguaugacuuugugcca

SEQ ID NO: 1417575 - RNA, 14 nt, Homo sapiens
auguauuaauacca

SEQ ID NO: 1417576 - RNA, 22 nt, Homo sapiens
auguccaauggaguucagagau

SEQ ID NO: 1417577 - RNA, 22 nt, Homo sapiens
augucccagccuggccuguggc

SEQ ID NO: 1417578 - RNA, 16 nt, Homo sapiens
augugaaugaauacac

SEQ ID NO: 1417579 - RNA, 19 nt, Homo sapiens
augugcauauaucuuucag

SEQ ID NO: 1417580 - RNA, 19 nt, Homo sapiens
augugccuauaaucccagc

SEQ ID NO: 1417581 - RNA, 23 nt, Homo sapiens
augugugucuuuuuguaucucau

SEQ ID NO: 1417582 - RNA, 19 nt, Homo sapiens
auguuaguuuugcuccuuc

SEQ ID NO: 1417583 - RNA, 13 nt, Homo sapiens
auguuguguaaca

SEQ ID NO: 1417584 - RNA, 19 nt, Homo sapiens
auuaaaauguuaagcugcu

SEQ ID NO: 1417585 - RNA, 14 nt, Homo sapiens
auuaaacgggcugc

SEQ ID NO: 1417586 - RNA, 14 nt, Homo sapiens
auuaaacucaaagc

SEQ ID NO: 1417587 - RNA, 21 nt, Homo sapiens
auuaauaccacugagaccuuc

SEQ ID NO: 1417588 - RNA, 17 nt, Homo sapiens
auuaauuugacugugca

SEQ ID NO: 1417589 - RNA, 22 nt, Homo sapiens
auuacaaggucagagagaggaa

SEQ ID NO: 1417590 - RNA, 14 nt, Homo sapiens
auuagcuuuuggag

SEQ ID NO: 1417591 - RNA, 22 nt, Homo sapiens
auuccaacguaaauuauuacau

SEQ ID NO: 1417592 - RNA, 15 nt, Homo sapiens
auuccaguauuucau

SEQ ID NO: 1417593 - RNA, 14 nt, Homo sapiens
auuccauacaguga

SEQ ID NO: 1417594 - RNA, 21 nt, Homo sapiens
auucccugcccccaauuuccc

SEQ ID NO: 1417595 - RNA, 12 nt, Homo sapiens
auuccuaugcca

SEQ ID NO: 1417596 - RNA, 17 nt, Homo sapiens
auucuacccuguugcaa

SEQ ID NO: 1417597 - RNA, 15 nt, Homo sapiens
auucugaccuuguga

SEQ ID NO: 1417598 - RNA, 17 nt, Homo sapiens
auucugcuucucaucua

SEQ ID NO: 1417599 - RNA, 13 nt, Homo sapiens
auucuuucaugag

SEQ ID NO: 1417600 - RNA, 20 nt, Homo sapiens
auugaagauguccuguccac

SEQ ID NO: 1417601 - RNA, 22 nt, Homo sapiens
auugagauguguucacaaugga

SEQ ID NO: 1417602 - RNA, 20 nt, Homo sapiens
auugagcgccauaagcagaa

SEQ ID NO: 1417603 - RNA, 16 nt, Homo sapiens
auugggaggcacaagu

SEQ ID NO: 1417604 - RNA, 17 nt, Homo sapiens
auuguguuuaugcauuu

SEQ ID NO: 1417605 - RNA, 22 nt, Homo sapiens
auuguucagacauuccauggug

SEQ ID NO: 1417606 - RNA, 24 nt, Homo sapiens
auuguucagacauuccauggugau

SEQ ID NO: 1417607 - RNA, 13 nt, Homo sapiens
auuuaacuugagc

SEQ ID NO: 1417608 - RNA, 19 nt, Homo sapiens
auuuaacuugagcuuuaaa

SEQ ID NO: 1417609 - RNA, 17 nt, Homo sapiens
auuuacaaagcaaaaag

SEQ ID NO: 1417610 - RNA, 14 nt, Homo sapiens
auuuauaacuaaua

SEQ ID NO: 1417611 - RNA, 13 nt, Homo sapiens
auuucaagauuuu

SEQ ID NO: 1417612 - RNA, 11 nt, Homo sapiens
auuucaccucu

SEQ ID NO: 1417613 - RNA, 13 nt, Homo sapiens
auuuccauauucu

SEQ ID NO: 1417614 - RNA, 16 nt, Homo sapiens
auuucuuuuuccaaaa

SEQ ID NO: 1417615 - RNA, 15 nt, Homo sapiens
auuuguuucuucucu

SEQ ID NO: 1417616 - RNA, 15 nt, Homo sapiens
auuuuaaaugcacag

SEQ ID NO: 1417617 - RNA, 23 nt, Homo sapiens
auuuuaugacauuuuacaaugua

SEQ ID NO: 1417618 - RNA, 13 nt, Homo sapiens
auuuuccucucuc

SEQ ID NO: 1417619 - RNA, 19 nt, Homo sapiens
auuuugcuugucauauucg

SEQ ID NO: 1417620 - RNA, 14 nt, Homo sapiens
caaaagaaguucau

SEQ ID NO: 1417621 - RNA, 18 nt, Homo sapiens
caaaaucccuuaaucuau

SEQ ID NO: 1417622 - RNA, 12 nt, Homo sapiens
caaaaugccaca

SEQ ID NO: 1417623 - RNA, 20 nt, Homo sapiens
caaaaugucaauuugaugua

SEQ ID NO: 1417624 - RNA, 20 nt, Homo sapiens
caaagaaaaauaacccuuug

SEQ ID NO: 1417625 - RNA, 16 nt, Homo sapiens
caaagcaucacacuug

SEQ ID NO: 1417626 - RNA, 19 nt, Homo sapiens
caaaggaaauaaagcauag

SEQ ID NO: 1417627 - RNA, 16 nt, Homo sapiens
caaaggaagaacaucu

SEQ ID NO: 1417628 - RNA, 13 nt, Homo sapiens
caaaggaccucag

SEQ ID NO: 1417629 - RNA, 22 nt, Homo sapiens
caaaguagccagcuggucuuca

SEQ ID NO: 1417630 - RNA, 17 nt, Homo sapiens
caaagugcugagauuac

SEQ ID NO: 1417631 - RNA, 21 nt, Homo sapiens
caaaguguaacggccaacacu

SEQ ID NO: 1417632 - RNA, 15 nt, Homo sapiens
caaauaaacacugug

SEQ ID NO: 1417633 - RNA, 16 nt, Homo sapiens
caaauaaacacugugu

SEQ ID NO: 1417634 - RNA, 22 nt, Homo sapiens
caaauauuaguuuuuauuaaac

SEQ ID NO: 1417635 - RNA, 22 nt, Homo sapiens
caaaucucauguucaaagugug

SEQ ID NO: 1417636 - RNA, 14 nt, Homo sapiens
caaauuauguggau

SEQ ID NO: 1417637 - RNA, 19 nt, Homo sapiens
caacauuacauuugaacua

SEQ ID NO: 1417638 - RNA, 23 nt, Homo sapiens
caacauuacauuugaacuauauc

SEQ ID NO: 1417639 - RNA, 22 nt, Homo sapiens
caaccauuuguaaaacauucca

SEQ ID NO: 1417640 - RNA, 22 nt, Homo sapiens
caaccccgaggggcuugcaggg

SEQ ID NO: 1417641 - RNA, 18 nt, Homo sapiens
caacgcuuuuuuggauca

SEQ ID NO: 1417642 - RNA, 22 nt, Homo sapiens
caacgcuuuuuuggaucagcuc

SEQ ID NO: 1417643 - RNA, 19 nt, Homo sapiens
caacuccacgaggugaaaa

SEQ ID NO: 1417644 - RNA, 16 nt, Homo sapiens
caagaaacaaugucug

SEQ ID NO: 1417645 - RNA, 22 nt, Homo sapiens
caagagaaagaaagaacguucc

SEQ ID NO: 1417646 - RNA, 22 nt, Homo sapiens
caagaggaauuccagcaucuga

SEQ ID NO: 1417647 - RNA, 14 nt, Homo sapiens
caagaggugccugg

SEQ ID NO: 1417648 - RNA, 22 nt, Homo sapiens
caagauucccaggaguucugcu

SEQ ID NO: 1417649 - RNA, 18 nt, Homo sapiens
caagcuaauaaaauauca

SEQ ID NO: 1417650 - RNA, 15 nt, Homo sapiens
caaggcugugccagg

SEQ ID NO: 1417651 - RNA, 11 nt, Homo sapiens
cauuagcugaa

SEQ ID NO: 1417652 - RNA, 14 nt, Homo sapiens
cauuccagcuccuc

SEQ ID NO: 1417653 - RNA, 13 nt, Homo sapiens
cauuccaugguga

SEQ ID NO: 1417654 - RNA, 23 nt, Homo sapiens
cauuccauggugauuccugggaa

SEQ ID NO: 1417655 - RNA, 16 nt, Homo sapiens
cauucuacuugcucug

SEQ ID NO: 1417656 - RNA, 23 nt, Homo sapiens
cauuguguggucauaucuaguca

SEQ ID NO: 1417657 - RNA, 16 nt, Homo sapiens
cauuguuuuguguuua

SEQ ID NO: 1417658 - RNA, 19 nt, Homo sapiens
cauuuaaccaagcuauuca

SEQ ID NO: 1417659 - RNA, 10 nt, Homo sapiens
aaaacugggg

SEQ ID NO: 1417660 - RNA, 18 nt, Homo sapiens
aaaagcuaccaucacuuc

SEQ ID NO: 1417661 - RNA, 17 nt, Homo sapiens
aaaagcuucugcaauau

SEQ ID NO: 1417662 - RNA, 14 nt, Homo sapiens
aaaaggcagccaga

SEQ ID NO: 1417663 - RNA, 14 nt, Homo sapiens
aaaaguagauuaaa

SEQ ID NO: 1417664 - RNA, 14 nt, Homo sapiens
aaaauaaugcaaau

SEQ ID NO: 1417665 - RNA, 17 nt, Homo sapiens
aaaauaccccuaacaua

SEQ ID NO: 1417666 - RNA, 20 nt, Homo sapiens
aaaauauuugccuccaugua

SEQ ID NO: 1417667 - RNA, 16 nt, Homo sapiens
aaaaugccugcugcug

SEQ ID NO: 1417668 - RNA, 23 nt, Homo sapiens
aaaauuagcugggugugguggca

SEQ ID NO: 1417669 - RNA, 13 nt, Homo sapiens
aaaauuguuacaa

SEQ ID NO: 1417670 - RNA, 11 nt, Homo sapiens
aaacaaugaag

SEQ ID NO: 1417671 - RNA, 18 nt, Homo sapiens
aaacaaugucuggggaca

SEQ ID NO: 1417672 - RNA, 23 nt, Homo sapiens
aaacaauuaauugagcagcauga

SEQ ID NO: 1417673 - RNA, 11 nt, Homo sapiens
aaacaugguga

SEQ ID NO: 1417674 - RNA, 19 nt, Homo sapiens
aaacauguccccuucccuu

SEQ ID NO: 1417675 - RNA, 14 nt, Homo sapiens
aaacauuuguucua

SEQ ID NO: 1417676 - RNA, 14 nt, Homo sapiens
aaaccaccuucccu

SEQ ID NO: 1417677 - RNA, 22 nt, Homo sapiens
aaaccagcaacuaauaaaaccu

SEQ ID NO: 1417678 - RNA, 14 nt, Homo sapiens
aaacccacaaucca

SEQ ID NO: 1417679 - RNA, 19 nt, Homo sapiens
aaaccuggccuuauaucau

SEQ ID NO: 1417680 - RNA, 16 nt, Homo sapiens
aaaccugggcaccuaa

SEQ ID NO: 1417681 - RNA, 12 nt, Homo sapiens
aaacucaucuca

SEQ ID NO: 1417682 - RNA, 13 nt, Homo sapiens
aaacuuauaauca

SEQ ID NO: 1417683 - RNA, 15 nt, Homo sapiens
aaacuuuaucucaca

SEQ ID NO: 1417684 - RNA, 18 nt, Homo sapiens
aaagacuaugaucucauc

SEQ ID NO: 1417685 - RNA, 14 nt, Homo sapiens
aaagagggcuuccu

SEQ ID NO: 1417686 - RNA, 17 nt, Homo sapiens
aaagagggcuuccucua

SEQ ID NO: 1417687 - RNA, 17 nt, Homo sapiens
aaagaucugcuccucgc

SEQ ID NO: 1417688 - RNA, 22 nt, Homo sapiens
aaagaugcauguuacugccaaa

SEQ ID NO: 1417689 - RNA, 20 nt, Homo sapiens
aaagcccugacggacuucau

SEQ ID NO: 1417690 - RNA, 13 nt, Homo sapiens
aaagcucuagaca

SEQ ID NO: 1417691 - RNA, 20 nt, Homo sapiens
aaagcuguugcugucccuaa

SEQ ID NO: 1417692 - RNA, 12 nt, Homo sapiens
aaagcuucucuc

SEQ ID NO: 1417693 - RNA, 21 nt, Homo sapiens
aaaguagccagcuggucuuca

SEQ ID NO: 1417694 - RNA, 14 nt, Homo sapiens
aaagugcugagauu

SEQ ID NO: 1417695 - RNA, 18 nt, Homo sapiens
aaagugugacauucagug

SEQ ID NO: 1417696 - RNA, 19 nt, Homo sapiens
aaaguuaaacuuuaucuca

SEQ ID NO: 1417697 - RNA, 15 nt, Homo sapiens
aaauaaguugcagaa

SEQ ID NO: 1417698 - RNA, 19 nt, Homo sapiens
aaauaaguugcagaacaga

SEQ ID NO: 1417699 - RNA, 23 nt, Homo sapiens
aaauacaaaggaagaacaucugg

SEQ ID NO: 1417700 - RNA, 18 nt, Homo sapiens
aaauaccccuaacauacu

SEQ ID NO: 1417701 - RNA, 18 nt, Homo sapiens
aaaucauuguauggauag

SEQ ID NO: 1417702 - RNA, 15 nt, Homo sapiens
aaaucccuuaaucua

SEQ ID NO: 1417703 - RNA, 18 nt, Homo sapiens
aaaucugguauugaacug

SEQ ID NO: 1417704 - RNA, 22 nt, Homo sapiens
aaaugagucaaaguucaaaaau

SEQ ID NO: 1417705 - RNA, 23 nt, Homo sapiens
aaaugccugcugcugccaaguua

SEQ ID NO: 1417706 - RNA, 22 nt, Homo sapiens
aaaugcucaaucaugugccaga

SEQ ID NO: 1417707 - RNA, 21 nt, Homo sapiens
aaaugcuuuaaaaacuauuua

SEQ ID NO: 1417708 - RNA, 15 nt, Homo sapiens
aaauguuaugcaggc

SEQ ID NO: 1417709 - RNA, 13 nt, Homo sapiens
aaauuaugcugca

SEQ ID NO: 1417710 - RNA, 16 nt, Homo sapiens
aacaaaaggagccaag

SEQ ID NO: 1417711 - RNA, 17 nt, Homo sapiens
aacacuggcgagcaggu

SEQ ID NO: 1417712 - RNA, 23 nt, Homo sapiens
aacagauuauaauaaauugucau

SEQ ID NO: 1417713 - RNA, 21 nt, Homo sapiens
aacagggauuuugaauaugcc

SEQ ID NO: 1417714 - RNA, 14 nt, Homo sapiens
aacauaauuaagcu

SEQ ID NO: 1417715 - RNA, 14 nt, Homo sapiens
aacauacucauuua

SEQ ID NO: 1417716 - RNA, 17 nt, Homo sapiens
aacaucauauaccucuu

SEQ ID NO: 1417717 - RNA, 23 nt, Homo sapiens
aacaucuggagagagagcaagau

SEQ ID NO: 1417718 - RNA, 23 nt, Homo sapiens
aacaucuggauuucauccuugac

SEQ ID NO: 1417719 - RNA, 12 nt, Homo sapiens
aacauggugaaa

SEQ ID NO: 1417720 - RNA, 17 nt, Homo sapiens
aacauuauuucuuuucu

SEQ ID NO: 1417721 - RNA, 19 nt, Homo sapiens
aacauuccaaauaauucca

SEQ ID NO: 1417722 - RNA, 14 nt, Homo sapiens
aacauuccuaucaa

SEQ ID NO: 1417723 - RNA, 21 nt, Homo sapiens
aacauuccuaucaauccaaau

SEQ ID NO: 1417724 - RNA, 20 nt, Homo sapiens
aacauuuaggaacccagacc

SEQ ID NO: 1417725 - RNA, 19 nt, Homo sapiens
aacccaauaaaacugaugu

SEQ ID NO: 1417726 - RNA, 22 nt, Homo sapiens
aaccucacucuugccaaccugu

SEQ ID NO: 1417727 - RNA, 20 nt, Homo sapiens
aaccuccacuucccagguuc

SEQ ID NO: 1417728 - RNA, 23 nt, Homo sapiens
aaccuggccuuauaucauuucau

SEQ ID NO: 1417729 - RNA, 14 nt, Homo sapiens
aaccuguaagccca

SEQ ID NO: 1417730 - RNA, 15 nt, Homo sapiens
aacgccacggagcuc

SEQ ID NO: 1417731 - RNA, 15 nt, Homo sapiens
aacguauaaaagccu

SEQ ID NO: 1417732 - RNA, 19 nt, Homo sapiens
aacuaaagugugcuuuaua

SEQ ID NO: 1417733 - RNA, 18 nt, Homo sapiens
aacuaggugaucucaguu

SEQ ID NO: 1417734 - RNA, 19 nt, Homo sapiens
aacuccuccuuuaucauua

SEQ ID NO: 1417735 - RNA, 20 nt, Homo sapiens
aacuccugaccucaggugau

SEQ ID NO: 1417736 - RNA, 20 nt, Homo sapiens
aacugagggcugaucuuuaa

SEQ ID NO: 1417737 - RNA, 16 nt, Homo sapiens
aacuggcagcuuugaa

SEQ ID NO: 1417738 - RNA, 13 nt, Homo sapiens
aacuugagcuuua

SEQ ID NO: 1417739 - RNA, 13 nt, Homo sapiens
aacuuuaucucac

SEQ ID NO: 1417740 - RNA, 13 nt, Homo sapiens
aagaaaacuugua

SEQ ID NO: 1417741 - RNA, 22 nt, Homo sapiens
aagaaaccuggccuuauaucau

SEQ ID NO: 1417742 - RNA, 21 nt, Homo sapiens
aagaauuuaauguacaguaaa

SEQ ID NO: 1417743 - RNA, 20 nt, Homo sapiens
aagacaucucaaauacagua

SEQ ID NO: 1417744 - RNA, 17 nt, Homo sapiens
aagacuguguuuuugcc

SEQ ID NO: 1417745 - RNA, 23 nt, Homo sapiens
aagagaugcuggauucagauaua

SEQ ID NO: 1417746 - RNA, 18 nt, Homo sapiens
aagagccuggaacuuccu

SEQ ID NO: 1417747 - RNA, 15 nt, Homo sapiens
aagaucccaccgacc

SEQ ID NO: 1417748 - RNA, 18 nt, Homo sapiens
aagauuccuguccuugag

SEQ ID NO: 1417749 - RNA, 20 nt, Homo sapiens
aagcaaaaagagaugcugga

SEQ ID NO: 1417750 - RNA, 17 nt, Homo sapiens
aagcaacuuauguauuu

SEQ ID NO: 1417751 - RNA, 21 nt, Homo sapiens
aagcaagguguuuaaguaauu

SEQ ID NO: 1417752 - RNA, 16 nt, Homo sapiens
aagcagcccuuggcca

SEQ ID NO: 1417753 - RNA, 21 nt, Homo sapiens
aagccacgguguucugugaua

SEQ ID NO: 1417754 - RNA, 17 nt, Homo sapiens
aagccgucucaugcaga

SEQ ID NO: 1417755 - RNA, 22 nt, Homo sapiens
aagccucuggaaaacucaggau

SEQ ID NO: 1417756 - RNA, 20 nt, Homo sapiens
aagccugcguucuugugaca

SEQ ID NO: 1417757 - RNA, 15 nt, Homo sapiens
aagcgauucucaugc

SEQ ID NO: 1417758 - RNA, 19 nt, Homo sapiens
aagcgauucucaugccuca

SEQ ID NO: 1417759 - RNA, 17 nt, Homo sapiens
aagcucuucuccucagc

SEQ ID NO: 1417760 - RNA, 13 nt, Homo sapiens
aagcuuuacucuu

SEQ ID NO: 1417761 - RNA, 18 nt, Homo sapiens
aagggaaagugaacauga

SEQ ID NO: 1417762 - RNA, 22 nt, Homo sapiens
aagggcagggguguccugaugc

SEQ ID NO: 1417763 - RNA, 17 nt, Homo sapiens
aaggggauggacuucau

SEQ ID NO: 1417764 - RNA, 21 nt, Homo sapiens
aagguacuggugagggcaaga

SEQ ID NO: 1417765 - RNA, 21 nt, Homo sapiens
aaggucuauggcucaugucug

SEQ ID NO: 1417766 - RNA, 17 nt, Homo sapiens
aaggucuggccucaggu

SEQ ID NO: 1417767 - RNA, 21 nt, Homo sapiens
aagguguuuaaguaauugcca

SEQ ID NO: 1417768 - RNA, 22 nt, Homo sapiens
aaguagauuaaaauauuugccu

SEQ ID NO: 1417769 - RNA, 22 nt, Homo sapiens
aaguaguaaugauucucaagau

SEQ ID NO: 1417770 - RNA, 19 nt, Homo sapiens
aagucuugugacuagugcu

SEQ ID NO: 1417771 - RNA, 15 nt, Homo sapiens
aagugcacugugucc

SEQ ID NO: 1417772 - RNA, 14 nt, Homo sapiens
aagugccaucucaa

SEQ ID NO: 1417773 - RNA, 22 nt, Homo sapiens
aagugccuuaaccuagaggguc

SEQ ID NO: 1417774 - RNA, 21 nt, Homo sapiens
aagugcugggauuacaggugu

SEQ ID NO: 1417775 - RNA, 13 nt, Homo sapiens
aagugucuguuau

SEQ ID NO: 1417776 - RNA, 19 nt, Homo sapiens
aaguucucaagcugccuau

SEQ ID NO: 1417777 - RNA, 22 nt, Homo sapiens
aaguucuugucuuuaggaugac

SEQ ID NO: 1417778 - RNA, 16 nt, Homo sapiens
aaguugacaaaugcca

SEQ ID NO: 1417779 - RNA, 23 nt, Homo sapiens
aaguugcagaacagacacuuuaa

SEQ ID NO: 1417780 - RNA, 18 nt, Homo sapiens
aaguugggauuugcaaau

SEQ ID NO: 1417781 - RNA, 13 nt, Homo sapiens
aaguuucugugac

SEQ ID NO: 1417782 - RNA, 16 nt, Homo sapiens
aaguuuucagcuuuaa

SEQ ID NO: 1417783 - RNA, 15 nt, Homo sapiens
aauaaaaagccacca

SEQ ID NO: 1417784 - RNA, 17 nt, Homo sapiens
aauaaaacugauguuac

SEQ ID NO: 1417785 - RNA, 19 nt, Homo sapiens
accuugugaacaucagaag

SEQ ID NO: 1417786 - RNA, 15 nt, Homo sapiens
accuuuuccuugcug

SEQ ID NO: 1417787 - RNA, 14 nt, Homo sapiens
acgacgcccugggc

SEQ ID NO: 1417788 - RNA, 15 nt, Homo sapiens
acgaggucaggagau

SEQ ID NO: 1417789 - RNA, 23 nt, Homo sapiens
acgaggugaaaaauauucaguaa

SEQ ID NO: 1417790 - RNA, 13 nt, Homo sapiens
acgccaccuuccc

SEQ ID NO: 1417791 - RNA, 14 nt, Homo sapiens
acggccaacacuuu

SEQ ID NO: 1417792 - RNA, 16 nt, Homo sapiens
acgugucugagagcca

SEQ ID NO: 1417793 - RNA, 19 nt, Homo sapiens
guaccauucucagguggug

SEQ ID NO: 1417794 - RNA, 22 nt, Homo sapiens
guaccauucucagguggugaua

SEQ ID NO: 1417795 - RNA, 17 nt, Homo sapiens
guacugcgcaugcaaga

SEQ ID NO: 1417796 - RNA, 19 nt, Homo sapiens
guagcaaacaccaccaagu

SEQ ID NO: 1417797 - RNA, 16 nt, Homo sapiens
guagccagcuggucuu

SEQ ID NO: 1417798 - RNA, 19 nt, Homo sapiens
guagcugggacuacaggca

SEQ ID NO: 1417799 - RNA, 12 nt, Homo sapiens
guagcugggauu

SEQ ID NO: 1417800 - RNA, 16 nt, Homo sapiens
guagcugggauuacag

SEQ ID NO: 1417801 - RNA, 19 nt, Homo sapiens
guagcugggauuacaggca

SEQ ID NO: 1417802 - RNA, 18 nt, Homo sapiens
guauaaauugguuccuga

SEQ ID NO: 1417803 - RNA, 23 nt, Homo sapiens
guauauauaaaagguuguguaca

SEQ ID NO: 1417804 - RNA, 23 nt, Homo sapiens
guaucauuucaugcuuugauuua

SEQ ID NO: 1417805 - RNA, 21 nt, Homo sapiens
guaucuuuuuauucagcucau

SEQ ID NO: 1417806 - RNA, 17 nt, Homo sapiens
guaugacuuugugccau

SEQ ID NO: 1417807 - RNA, 19 nt, Homo sapiens
gucacaggaaacuacuuca

SEQ ID NO: 1417808 - RNA, 11 nt, Homo sapiens
gucaccuuccu

SEQ ID NO: 1417809 - RNA, 16 nt, Homo sapiens
gucccaucucuacccc

SEQ ID NO: 1417810 - RNA, 12 nt, Homo sapiens
guccccaccagc

SEQ ID NO: 1417811 - RNA, 19 nt, Homo sapiens
guccucacugcucccugaa

SEQ ID NO: 1417812 - RNA, 21 nt, Homo sapiens
guccugcuugaacugcugcca

SEQ ID NO: 1417813 - RNA, 22 nt, Homo sapiens
guccugcuugaacugcugccaa

SEQ ID NO: 1417814 - RNA, 22 nt, Homo sapiens
guccuuguauaaggagcuuugc

SEQ ID NO: 1417815 - RNA, 20 nt, Homo sapiens
gucgcucucaugaagcccuu

SEQ ID NO: 1417816 - RNA, 23 nt, Homo sapiens
gucuaccaaguaagacaucucaa

SEQ ID NO: 1417817 - RNA, 19 nt, Homo sapiens
gucuauggcucaugucuga

SEQ ID NO: 1417818 - RNA, 21 nt, Homo sapiens
gucucuagaagugccaucuca

SEQ ID NO: 1417819 - RNA, 22 nt, Homo sapiens
gucucuucuauuucuuucuuuu

SEQ ID NO: 1417820 - RNA, 19 nt, Homo sapiens
gucugccagcauaugcaga

SEQ ID NO: 1417821 - RNA, 15 nt, Homo sapiens
gucugugugcuacua

SEQ ID NO: 1417822 - RNA, 15 nt, Homo sapiens
gucuucagcaaaaaa

SEQ ID NO: 1417823 - RNA, 20 nt, Homo sapiens
gucuuuaugaaguuugcuau

SEQ ID NO: 1417824 - RNA, 15 nt, Homo sapiens
gucuuucuccauuau

SEQ ID NO: 1417825 - RNA, 17 nt, Homo sapiens
gucuuuuucgccaaacu

SEQ ID NO: 1417826 - RNA, 22 nt, Homo sapiens
gucuuuuucgccaaacugucuc

SEQ ID NO: 1417827 - RNA, 15 nt, Homo sapiens
gugaacaugaguucc

SEQ ID NO: 1417828 - RNA, 14 nt, Homo sapiens
gugacacacuggcu

SEQ ID NO: 1417829 - RNA, 16 nt, Homo sapiens
gugaccaaaccaacau

SEQ ID NO: 1417830 - RNA, 17 nt, Homo sapiens
gugagcacaaugcauaa

SEQ ID NO: 1417831 - RNA, 14 nt, Homo sapiens
gugagggcaagagg

SEQ ID NO: 1417832 - RNA, 18 nt, Homo sapiens
gugcacaccgugugccau

SEQ ID NO: 1417833 - RNA, 11 nt, Homo sapiens
gugccaaaaau

SEQ ID NO: 1417834 - RNA, 15 nt, Homo sapiens
gugcuuccucaguua

SEQ ID NO: 1417835 - RNA, 20 nt, Homo sapiens
guggagcuggcaccauucag

SEQ ID NO: 1417836 - RNA, 17 nt, Homo sapiens
guggcugcugcugccac

SEQ ID NO: 1417837 - RNA, 20 nt, Homo sapiens
gugggaggggcgcccaccuc

SEQ ID NO: 1417838 - RNA, 20 nt, Homo sapiens
guggucauaucuagucacuu

SEQ ID NO: 1417839 - RNA, 22 nt, Homo sapiens
gugguuuuauacugaaggaaaa

SEQ ID NO: 1417840 - RNA, 20 nt, Homo sapiens
gugucagguuuuucaguguu

SEQ ID NO: 1417841 - RNA, 15 nt, Homo sapiens
guguggucauaucua

SEQ ID NO: 1417842 - RNA, 15 nt, Homo sapiens
guguucugugauaua

SEQ ID NO: 1417843 - RNA, 16 nt, Homo sapiens
guuaaggaaaacugag

SEQ ID NO: 1417844 - RNA, 12 nt, Homo sapiens
guuaggucucaa

SEQ ID NO: 1417845 - RNA, 13 nt, Homo sapiens
guuagucucugaa

SEQ ID NO: 1417846 - RNA, 17 nt, Homo sapiens
guucaaagugugacauu

SEQ ID NO: 1417847 - RNA, 19 nt, Homo sapiens
guucaaagugugacauuca

SEQ ID NO: 1417848 - RNA, 22 nt, Homo sapiens
guucaaagugugacauucagug

SEQ ID NO: 1417849 - RNA, 20 nt, Homo sapiens
guucccaaggacagucagca

SEQ ID NO: 1417850 - RNA, 12 nt, Homo sapiens
guucuguagaag

SEQ ID NO: 1417851 - RNA, 18 nt, Homo sapiens
guugaugguuguacauau

SEQ ID NO: 1417852 - RNA, 21 nt, Homo sapiens
guugcagaacagacacuuuaa

SEQ ID NO: 1417853 - RNA, 21 nt, Homo sapiens
guugcaggaaguuaguuuuag

SEQ ID NO: 1417854 - RNA, 19 nt, Homo sapiens
guugcuuuuuuagauuuau

SEQ ID NO: 1417855 - RNA, 17 nt, Homo sapiens
guuuccaaauggucaac

SEQ ID NO: 1417856 - RNA, 12 nt, Homo sapiens
guuuccuaacag

SEQ ID NO: 1417857 - RNA, 14 nt, Homo sapiens
guuucuacucaaaa

SEQ ID NO: 1417858 - RNA, 11 nt, Homo sapiens
guuugccaagc

SEQ ID NO: 1417859 - RNA, 17 nt, Homo sapiens
guuuuaguucuguagaa

SEQ ID NO: 1417860 - RNA, 19 nt, Homo sapiens
uaaaaaagacgggauuuua

SEQ ID NO: 1417861 - RNA, 19 nt, Homo sapiens
uaaaaauaagccacauauc

SEQ ID NO: 1417862 - RNA, 12 nt, Homo sapiens
uaaaacugaugu

SEQ ID NO: 1417863 - RNA, 16 nt, Homo sapiens
uaaaacugauguuacu

SEQ ID NO: 1417864 - RNA, 12 nt, Homo sapiens
uaaaauaucauu

SEQ ID NO: 1417865 - RNA, 18 nt, Homo sapiens
uaaaauucuacuguaugg

SEQ ID NO: 1417866 - RNA, 13 nt, Homo sapiens
uaaacaauauuac

SEQ ID NO: 1417867 - RNA, 23 nt, Homo sapiens
uaaacaauauuacuaauugccca

SEQ ID NO: 1417868 - RNA, 15 nt, Homo sapiens
uaaaccuucagauua

SEQ ID NO: 1417869 - RNA, 18 nt, Homo sapiens
uaaacucagcugaucuga

SEQ ID NO: 1417870 - RNA, 13 nt, Homo sapiens
uaaacuuccaaac

SEQ ID NO: 1417871 - RNA, 18 nt, Homo sapiens
uaaagcuucucucugagc

SEQ ID NO: 1417872 - RNA, 18 nt, Homo sapiens
uaaaggcaccucccccaa

SEQ ID NO: 1417873 - RNA, 14 nt, Homo sapiens
uaaagguucaugca

SEQ ID NO: 1417874 - RNA, 15 nt, Homo sapiens
uaaaguauauugaaa

SEQ ID NO: 1417875 - RNA, 13 nt, Homo sapiens
uaaauacauuucc

SEQ ID NO: 1417876 - RNA, 15 nt, Homo sapiens
uaaaucagacuauga

SEQ ID NO: 1417877 - RNA, 21 nt, Homo sapiens
uaaaucugcuuuucauguuga

SEQ ID NO: 1417878 - RNA, 19 nt, Homo sapiens
uaaaugagucaaaguucaa

SEQ ID NO: 1417879 - RNA, 16 nt, Homo sapiens
uaaaugcuguauguca

SEQ ID NO: 1417880 - RNA, 15 nt, Homo sapiens
uaaauuccccuuccc

SEQ ID NO: 1417881 - RNA, 16 nt, Homo sapiens
uaaauugaacugccaa

SEQ ID NO: 1417882 - RNA, 18 nt, Homo sapiens
uaacauacugcauuucac

SEQ ID NO: 1417883 - RNA, 16 nt, Homo sapiens
uaaccaagcuauucaa

SEQ ID NO: 1417884 - RNA, 21 nt, Homo sapiens
uaacguuucccguuagucucu

SEQ ID NO: 1417885 - RNA, 15 nt, Homo sapiens
uaacuugagcuuuaa

SEQ ID NO: 1417886 - RNA, 23 nt, Homo sapiens
uaacuuguuuacauagcauuugu

SEQ ID NO: 1417887 - RNA, 21 nt, Homo sapiens
uaagaccucugagaccaaaau

SEQ ID NO: 1417888 - RNA, 12 nt, Homo sapiens
uaaguaauugca

SEQ ID NO: 1417889 - RNA, 23 nt, Homo sapiens
uaagugcacaccgugugccauag

SEQ ID NO: 1417890 - RNA, 20 nt, Homo sapiens
uaaguucucaagcugccuau

SEQ ID NO: 1417891 - RNA, 23 nt, Homo sapiens
uaaguuuccuucccuacccaguc

SEQ ID NO: 1417892 - RNA, 23 nt, Homo sapiens
uaaguuuugaaacuaacuguugg

SEQ ID NO: 1417893 - RNA, 19 nt, Homo sapiens
uaauaaauugucaucagug

SEQ ID NO: 1417894 - RNA, 21 nt, Homo sapiens
uaauacaguuuucuauucuug

SEQ ID NO: 1417895 - RNA, 18 nt, Homo sapiens
uaauagcguucagcagca

SEQ ID NO: 1417896 - RNA, 16 nt, Homo sapiens
uaauauuugucugugu

SEQ ID NO: 1417897 - RNA, 21 nt, Homo sapiens
uaauauuugucugugugcuac

SEQ ID NO: 1417898 - RNA, 16 nt, Homo sapiens
uaaucucuauguagaa

SEQ ID NO: 1417899 - RNA, 17 nt, Homo sapiens
uaaugagugaguucuca

SEQ ID NO: 1417900 - RNA, 18 nt, Homo sapiens
uaaugagugaguucucac

SEQ ID NO: 1417901 - RNA, 23 nt, Homo sapiens
uaaugauggcccauucuacuugc

SEQ ID NO: 1417902 - RNA, 15 nt, Homo sapiens
uaauguucugggaag

SEQ ID NO: 1417903 - RNA, 18 nt, Homo sapiens
uacaaaguacuagcuaaa

SEQ ID NO: 1417904 - RNA, 17 nt, Homo sapiens
uacaauggcgugaucuc

SEQ ID NO: 1417905 - RNA, 18 nt, Homo sapiens
uacaauggcgugaucuca

SEQ ID NO: 1417906 - RNA, 15 nt, Homo sapiens
uacaguccuuccagg

SEQ ID NO: 1417907 - RNA, 14 nt, Homo sapiens
uacauagcauuugu

SEQ ID NO: 1417908 - RNA, 19 nt, Homo sapiens
uacauagcauuuguguaaa

SEQ ID NO: 1417909 - RNA, 21 nt, Homo sapiens
uacauauaagugauugcuggu

SEQ ID NO: 1417910 - RNA, 14 nt, Homo sapiens
uacauccugcagcu

SEQ ID NO: 1417911 - RNA, 15 nt, Homo sapiens
uacauuucuguucau

SEQ ID NO: 1417912 - RNA, 20 nt, Homo sapiens
uacccaccgcccuugccgaa

SEQ ID NO: 1417913 - RNA, 15 nt, Homo sapiens
uaccgagagccaaac

SEQ ID NO: 1417914 - RNA, 16 nt, Homo sapiens
uaccgagagccaaaca

SEQ ID NO: 1417915 - RNA, 19 nt, Homo sapiens
uacuaauugcccaaaaugu

SEQ ID NO: 1417916 - RNA, 15 nt, Homo sapiens
uacucccagcuggug

SEQ ID NO: 1417917 - RNA, 16 nt, Homo sapiens
uacugaaagucugugg

SEQ ID NO: 1417918 - RNA, 18 nt, Homo sapiens
uacugaaggaaaaacaca

SEQ ID NO: 1417919 - RNA, 22 nt, Homo sapiens
uacuucagguuuuaucaguaga

SEQ ID NO: 1417920 - RNA, 22 nt, Homo sapiens
uacuugcuuuggaaaacccaga

SEQ ID NO: 1417921 - RNA, 21 nt, Homo sapiens
uacuuguuugguuugguauua

SEQ ID NO: 1417922 - RNA, 23 nt, Homo sapiens
uagaaaacccacacccacugucc

SEQ ID NO: 1417923 - RNA, 13 nt, Homo sapiens
uagaaaucucauc

SEQ ID NO: 1417924 - RNA, 17 nt, Homo sapiens
uagaagugccaucucaa

SEQ ID NO: 1417925 - RNA, 11 nt, Homo sapiens
uagaccaaauc

SEQ ID NO: 1417926 - RNA, 13 nt, Homo sapiens
uagacucccaugg

SEQ ID NO: 1417927 - RNA, 22 nt, Homo sapiens
cugcccccacacccacuccaca

SEQ ID NO: 1417928 - RNA, 19 nt, Homo sapiens
cugccucgggaaccucacu

SEQ ID NO: 1417929 - RNA, 14 nt, Homo sapiens
cugccugagcuucc

SEQ ID NO: 1417930 - RNA, 16 nt, Homo sapiens
cugccuuaaaaccaaa

SEQ ID NO: 1417931 - RNA, 18 nt, Homo sapiens
cugcugcaugaccuauca

SEQ ID NO: 1417932 - RNA, 18 nt, Homo sapiens
cugcugcucaaaaugcca

SEQ ID NO: 1417933 - RNA, 19 nt, Homo sapiens
cugcugcucaaaaugccac

SEQ ID NO: 1417934 - RNA, 10 nt, Homo sapiens
cugcuuccag

SEQ ID NO: 1417935 - RNA, 20 nt, Homo sapiens
cugcuuuguaguuugcccag

SEQ ID NO: 1417936 - RNA, 20 nt, Homo sapiens
cuggagcagagaacaucugg

SEQ ID NO: 1417937 - RNA, 19 nt, Homo sapiens
cuggagccuguguaacagc

SEQ ID NO: 1417938 - RNA, 20 nt, Homo sapiens
cuggagggaaguuggggaaa

SEQ ID NO: 1417939 - RNA, 23 nt, Homo sapiens
cuggcccucguggguaaaugaca

SEQ ID NO: 1417940 - RNA, 13 nt, Homo sapiens
cuggccucaggug

SEQ ID NO: 1417941 - RNA, 18 nt, Homo sapiens
cuggcugagguuccucug

SEQ ID NO: 1417942 - RNA, 17 nt, Homo sapiens
cuggcugguuugcccag

SEQ ID NO: 1417943 - RNA, 19 nt, Homo sapiens
cugggcacccaguccuuga

SEQ ID NO: 1417944 - RNA, 15 nt, Homo sapiens
cuggggccacccagc

SEQ ID NO: 1417945 - RNA, 14 nt, Homo sapiens
cugggggaugcaaa

SEQ ID NO: 1417946 - RNA, 14 nt, Homo sapiens
cuggguaccaaauu

SEQ ID NO: 1417947 - RNA, 18 nt, Homo sapiens
cuggucuguugcugccac

SEQ ID NO: 1417948 - RNA, 17 nt, Homo sapiens
cugguggccaccguguc

SEQ ID NO: 1417949 - RNA, 15 nt, Homo sapiens
cugguuugaaagccu

SEQ ID NO: 1417950 - RNA, 16 nt, Homo sapiens
cuguaagcccagcauu

SEQ ID NO: 1417951 - RNA, 18 nt, Homo sapiens
cuguaaguuacagucaca

SEQ ID NO: 1417952 - RNA, 16 nt, Homo sapiens
cuguaauaaauaugag

SEQ ID NO: 1417953 - RNA, 21 nt, Homo sapiens
cugucccccacacccguguca

SEQ ID NO: 1417954 - RNA, 20 nt, Homo sapiens
cugucugccagcauaugcag

SEQ ID NO: 1417955 - RNA, 16 nt, Homo sapiens
cugugauauaagugug

SEQ ID NO: 1417956 - RNA, 21 nt, Homo sapiens
cugugcaugacagcggcaauc

SEQ ID NO: 1417957 - RNA, 12 nt, Homo sapiens
cugugugcagug

SEQ ID NO: 1417958 - RNA, 14 nt, Homo sapiens
cugugugcuacuaa

SEQ ID NO: 1417959 - RNA, 17 nt, Homo sapiens
cugugugcuacuaacag

SEQ ID NO: 1417960 - RNA, 22 nt, Homo sapiens
cuguucaaguuuucagcuuuaa

SEQ ID NO: 1417961 - RNA, 21 nt, Homo sapiens
cuguugcaggcaaauguaaag

SEQ ID NO: 1417962 - RNA, 13 nt, Homo sapiens
cuguuucaagcca

SEQ ID NO: 1417963 - RNA, 15 nt, Homo sapiens
cuuacccaccuguca

SEQ ID NO: 1417964 - RNA, 17 nt, Homo sapiens
cuuauuauuucuaauuc

SEQ ID NO: 1417965 - RNA, 17 nt, Homo sapiens
cuucagaacaaucugag

SEQ ID NO: 1417966 - RNA, 20 nt, Homo sapiens
cuucaggagggagcauagaa

SEQ ID NO: 1417967 - RNA, 15 nt, Homo sapiens
cuucaggccuugccu

SEQ ID NO: 1417968 - RNA, 20 nt, Homo sapiens
cuucaggccuugccugggau

SEQ ID NO: 1417969 - RNA, 21 nt, Homo sapiens
cuuccacaaaauuaugcugca

SEQ ID NO: 1417970 - RNA, 20 nt, Homo sapiens
cuuccaucccaggacaccac

SEQ ID NO: 1417971 - RNA, 16 nt, Homo sapiens
cuuccucaucaugaaa

SEQ ID NO: 1417972 - RNA, 18 nt, Homo sapiens
cuuccucuagaagccaag

SEQ ID NO: 1417973 - RNA, 20 nt, Homo sapiens
cuucuaaaggcuuuugcccu

SEQ ID NO: 1417974 - RNA, 15 nt, Homo sapiens
cuucuggauucuugg

SEQ ID NO: 1417975 - RNA, 18 nt, Homo sapiens
cuugaacuccugaccuca

SEQ ID NO: 1417976 - RNA, 20 nt, Homo sapiens
cuugagccgggccccugggc

SEQ ID NO: 1417977 - RNA, 18 nt, Homo sapiens
cuugaguccccaccagcu

SEQ ID NO: 1417978 - RNA, 16 nt, Homo sapiens
cuugaguuaucuuuaa

SEQ ID NO: 1417979 - RNA, 13 nt, Homo sapiens
cuugccaaccugu

SEQ ID NO: 1417980 - RNA, 15 nt, Homo sapiens
cuugccaaccuguaa

SEQ ID NO: 1417981 - RNA, 17 nt, Homo sapiens
cuugccaaccuguaaua

SEQ ID NO: 1417982 - RNA, 14 nt, Homo sapiens
cuugcucucucuca

SEQ ID NO: 1417983 - RNA, 17 nt, Homo sapiens
cuuggagucuuccaaac

SEQ ID NO: 1417984 - RNA, 17 nt, Homo sapiens
cuuggaugcaugagcua

SEQ ID NO: 1417985 - RNA, 18 nt, Homo sapiens
cuugggaugaagagggua

SEQ ID NO: 1417986 - RNA, 15 nt, Homo sapiens
cuugggcaauaaagg

SEQ ID NO: 1417987 - RNA, 18 nt, Homo sapiens
cuugggcaauaaaggcac

SEQ ID NO: 1417988 - RNA, 20 nt, Homo sapiens
cuugucauauucgauguacu

SEQ ID NO: 1417989 - RNA, 11 nt, Homo sapiens
cuuuaucucac

SEQ ID NO: 1417990 - RNA, 12 nt, Homo sapiens
cuuuaugaucuu

SEQ ID NO: 1417991 - RNA, 18 nt, Homo sapiens
cuuucaacuccaguacuc

SEQ ID NO: 1417992 - RNA, 22 nt, Homo sapiens
cuuucaguauuuguuuugaugu

SEQ ID NO: 1417993 - RNA, 15 nt, Homo sapiens
cuuucugaacuguaa

SEQ ID NO: 1417994 - RNA, 23 nt, Homo sapiens
cuuugaauguuguguaacaguua

SEQ ID NO: 1417995 - RNA, 15 nt, Homo sapiens
cuuuggucauuuccc

SEQ ID NO: 1417996 - RNA, 24 nt, Homo sapiens
cuuuguauaaaagggacugagaaa

SEQ ID NO: 1417997 - RNA, 12 nt, Homo sapiens
cuuugugccauc

SEQ ID NO: 1417998 - RNA, 16 nt, Homo sapiens
cuuuuaaaaucaguga

SEQ ID NO: 1417999 - RNA, 21 nt, Homo sapiens
cuuuuaaaaucagugauuugg

SEQ ID NO: 1418000 - RNA, 22 nt, Homo sapiens
cuuuuagcuacaccccuuuguc

SEQ ID NO: 1418001 - RNA, 19 nt, Homo sapiens
cuuuuauuuuuuuggaacu

SEQ ID NO: 1418002 - RNA, 14 nt, Homo sapiens
cuuuuccuugcuga

SEQ ID NO: 1418003 - RNA, 22 nt, Homo sapiens
cuuuuccuugcugauugcuaau

SEQ ID NO: 1418004 - RNA, 15 nt, Homo sapiens
gaaaaaaaaacuggg

SEQ ID NO: 1418005 - RNA, 23 nt, Homo sapiens
gaaaaauauggccuugauggugu

SEQ ID NO: 1418006 - RNA, 13 nt, Homo sapiens
gaaaaauauucag

SEQ ID NO: 1418007 - RNA, 15 nt, Homo sapiens
gaaaacccacaccca

SEQ ID NO: 1418008 - RNA, 14 nt, Homo sapiens
gaaaacccagauaa

SEQ ID NO: 1418009 - RNA, 22 nt, Homo sapiens
gaaaagcuaccaucacuuccuc

SEQ ID NO: 1418010 - RNA, 23 nt, Homo sapiens
gaaaaggagguaaucgccaaaua

SEQ ID NO: 1418011 - RNA, 16 nt, Homo sapiens
gaaaauccccauugaa

SEQ ID NO: 1418012 - RNA, 14 nt, Homo sapiens
gaaacaacauuuaa

SEQ ID NO: 1418013 - RNA, 14 nt, Homo sapiens
gaaacucaucucau

SEQ ID NO: 1418014 - RNA, 14 nt, Homo sapiens
gaaagcaggggcua

SEQ ID NO: 1418015 - RNA, 18 nt, Homo sapiens
gaaauaaacgcuccccuc

SEQ ID NO: 1418016 - RNA, 16 nt, Homo sapiens
gaaaucuguugugcau

SEQ ID NO: 1418017 - RNA, 21 nt, Homo sapiens
gaacauuccuaucaauccaaa

SEQ ID NO: 1418018 - RNA, 23 nt, Homo sapiens
gaaccauauccauguugcugacu

SEQ ID NO: 1418019 - RNA, 19 nt, Homo sapiens
gaaccuaaauugaacugcc

SEQ ID NO: 1418020 - RNA, 14 nt, Homo sapiens
gaacgcucuaggca

SEQ ID NO: 1418021 - RNA, 19 nt, Homo sapiens
gaacuccugaccucaggug

SEQ ID NO: 1418022 - RNA, 18 nt, Homo sapiens
gaacuguggaaucaucac

SEQ ID NO: 1418023 - RNA, 23 nt, Homo sapiens
gaagaaaucguucaucauaagaa

SEQ ID NO: 1418024 - RNA, 12 nt, Homo sapiens
gaagaacaucug

SEQ ID NO: 1418025 - RNA, 19 nt, Homo sapiens
gaagccguccaagaacaag

SEQ ID NO: 1418026 - RNA, 16 nt, Homo sapiens
gaagccgucucaugca

SEQ ID NO: 1418027 - RNA, 20 nt, Homo sapiens
gaagccuucuuagaacucug

SEQ ID NO: 1418028 - RNA, 12 nt, Homo sapiens
gaagcugaccuu

SEQ ID NO: 1418029 - RNA, 19 nt, Homo sapiens
gaagcuuaggcagggcucu

SEQ ID NO: 1418030 - RNA, 19 nt, Homo sapiens
gaaggcaagagggggugga

SEQ ID NO: 1418031 - RNA, 14 nt, Homo sapiens
gaagugccaucuca

SEQ ID NO: 1418032 - RNA, 17 nt, Homo sapiens
gaagugucacagccaua

SEQ ID NO: 1418033 - RNA, 13 nt, Homo sapiens
gaaguuaccaaau

SEQ ID NO: 1418034 - RNA, 21 nt, Homo sapiens
gaaguuaguuuuaguucugua

SEQ ID NO: 1418035 - RNA, 19 nt, Homo sapiens
gaauaaagcuucucucuga

SEQ ID NO: 1418036 - RNA, 20 nt, Homo sapiens
gaauaaagcuucucucugag

SEQ ID NO: 1418037 - RNA, 23 nt, Homo sapiens
gaauauuuuuggcauuccucuaa

SEQ ID NO: 1418038 - RNA, 19 nt, Homo sapiens
gaauccccgaaggugcugg

SEQ ID NO: 1418039 - RNA, 16 nt, Homo sapiens
gaaucccuuucucacu

SEQ ID NO: 1418040 - RNA, 18 nt, Homo sapiens
gaaucccuuucucacuuu

SEQ ID NO: 1418041 - RNA, 18 nt, Homo sapiens
gaaucuaaaaccaaauau

SEQ ID NO: 1418042 - RNA, 18 nt, Homo sapiens
gaaugaucccacucacca

SEQ ID NO: 1418043 - RNA, 14 nt, Homo sapiens
gaaugcuauuuuca

SEQ ID NO: 1418044 - RNA, 22 nt, Homo sapiens
gaauuugaaacacuuugcauaa

SEQ ID NO: 1418045 - RNA, 16 nt, Homo sapiens
gaauuuuguaaguaua

SEQ ID NO: 1418046 - RNA, 14 nt, Homo sapiens
gacaaaugccaaau

SEQ ID NO: 1418047 - RNA, 22 nt, Homo sapiens
gacaagagaugggaaugaggug

SEQ ID NO: 1418048 - RNA, 15 nt, Homo sapiens
gacaguggcaccugg

SEQ ID NO: 1418049 - RNA, 20 nt, Homo sapiens
gacaucugcuucaccaagga

SEQ ID NO: 1418050 - RNA, 23 nt, Homo sapiens
gaccaaaucaaaugcucacuggg

SEQ ID NO: 1418051 - RNA, 14 nt, Homo sapiens
gaccaaugccuuaa

SEQ ID NO: 1418052 - RNA, 11 nt, Homo sapiens
gaccaccaaca

SEQ ID NO: 1418053 - RNA, 17 nt, Homo sapiens
gcccugcacgucauggg

SEQ ID NO: 1418054 - RNA, 15 nt, Homo sapiens
gcccuggaggugcca

SEQ ID NO: 1418055 - RNA, 20 nt, Homo sapiens
gcccugggcucgucuuugca

SEQ ID NO: 1418056 - RNA, 14 nt, Homo sapiens
gccgacucagcaac

SEQ ID NO: 1418057 - RNA, 16 nt, Homo sapiens
gccguccaagaacaag

SEQ ID NO: 1418058 - RNA, 23 nt, Homo sapiens
gccgucucaugcagaagagggaa

SEQ ID NO: 1418059 - RNA, 14 nt, Homo sapiens
gccuagugugccaa

SEQ ID NO: 1418060 - RNA, 18 nt, Homo sapiens
gccuauaauacaguuuuc

SEQ ID NO: 1418061 - RNA, 18 nt, Homo sapiens
cgaaacacccccagauuc

SEQ ID NO: 1418062 - RNA, 19 nt, Homo sapiens
cgaaccaggagcugcucac

SEQ ID NO: 1418063 - RNA, 11 nt, Homo sapiens
cgaaggugcug

SEQ ID NO: 1418064 - RNA, 14 nt, Homo sapiens
cgaccguugccacg

SEQ ID NO: 1418065 - RNA, 14 nt, Homo sapiens
cgagcacccucauc

SEQ ID NO: 1418066 - RNA, 15 nt, Homo sapiens
cgauucucaugccuc

SEQ ID NO: 1418067 - RNA, 19 nt, Homo sapiens
cgccauaagcagaagauca

SEQ ID NO: 1418068 - RNA, 22 nt, Homo sapiens
cgcccugggcucgucuuugcag

SEQ ID NO: 1418069 - RNA, 13 nt, Homo sapiens
cgccuccaugacu

SEQ ID NO: 1418070 - RNA, 14 nt, Homo sapiens
cgccuccaugacuc

SEQ ID NO: 1418071 - RNA, 14 nt, Homo sapiens
cggccaacacuuug

SEQ ID NO: 1418072 - RNA, 22 nt, Homo sapiens
cggccccaccugccucugccca

SEQ ID NO: 1418073 - RNA, 19 nt, Homo sapiens
cggccucccucccccugca

SEQ ID NO: 1418074 - RNA, 19 nt, Homo sapiens
cggcuucccaaagugcuga

SEQ ID NO: 1418075 - RNA, 21 nt, Homo sapiens
cgggaccaauggguuugccaa

SEQ ID NO: 1418076 - RNA, 15 nt, Homo sapiens
cguaaauuauuacau

SEQ ID NO: 1418077 - RNA, 20 nt, Homo sapiens
cgucucuacuaaaaauacaa

SEQ ID NO: 1418078 - RNA, 20 nt, Homo sapiens
cgugccaaaaaucuuuucau

SEQ ID NO: 1418079 - RNA, 20 nt, Homo sapiens
cgugcuuccucaguuacaca

SEQ ID NO: 1418080 - RNA, 15 nt, Homo sapiens
cguuaagugccccac

SEQ ID NO: 1418081 - RNA, 22 nt, Homo sapiens
cguuaagugccccacagagaca

SEQ ID NO: 1418082 - RNA, 18 nt, Homo sapiens
cuaaaacagggauuuuga

SEQ ID NO: 1418083 - RNA, 17 nt, Homo sapiens
cuaaauugaacugccaa

SEQ ID NO: 1418084 - RNA, 20 nt, Homo sapiens
cuaagaauauaauacauuug

SEQ ID NO: 1418085 - RNA, 11 nt, Homo sapiens
cuaagcuuuau

SEQ ID NO: 1418086 - RNA, 16 nt, Homo sapiens
cuaauaaaauaucauu

SEQ ID NO: 1418087 - RNA, 23 nt, Homo sapiens
cuaauauaauagaugacaguggc

SEQ ID NO: 1418088 - RNA, 18 nt, Homo sapiens
cuaaucaguuguaacaau

SEQ ID NO: 1418089 - RNA, 19 nt, Homo sapiens
cuaaucaguuguaacaaua

SEQ ID NO: 1418090 - RNA, 18 nt, Homo sapiens
cuaauguauuaauaccac

SEQ ID NO: 1418091 - RNA, 19 nt, Homo sapiens
cuaauguauuaauaccacu

SEQ ID NO: 1418092 - RNA, 13 nt, Homo sapiens
cuacacucauucu

SEQ ID NO: 1418093 - RNA, 14 nt, Homo sapiens
cuacagaguaacaa

SEQ ID NO: 1418094 - RNA, 15 nt, Homo sapiens
cuacagguccagggu

SEQ ID NO: 1418095 - RNA, 17 nt, Homo sapiens
cuacagguccaggguug

SEQ ID NO: 1418096 - RNA, 22 nt, Homo sapiens
cuaccaaguuucauaccaaaua

SEQ ID NO: 1418097 - RNA, 17 nt, Homo sapiens
cuaccacaucuucaugu

SEQ ID NO: 1418098 - RNA, 15 nt, Homo sapiens
cuaccuggugccuug

SEQ ID NO: 1418099 - RNA, 14 nt, Homo sapiens
cuaccuuccaguca

SEQ ID NO: 1418100 - RNA, 20 nt, Homo sapiens
cuaccuugucuguuagccau

SEQ ID NO: 1418101 - RNA, 15 nt, Homo sapiens
cuacuaacagauuau

SEQ ID NO: 1418102 - RNA, 15 nt, Homo sapiens
cuagaagccaaggga

SEQ ID NO: 1418103 - RNA, 18 nt, Homo sapiens
cuagaagugccaucucaa

SEQ ID NO: 1418104 - RNA, 16 nt, Homo sapiens
cuagacucccauggaa

SEQ ID NO: 1418105 - RNA, 15 nt, Homo sapiens
cuagagggucgggga

SEQ ID NO: 1418106 - RNA, 17 nt, Homo sapiens
cuagauuccauacagug

SEQ ID NO: 1418107 - RNA, 16 nt, Homo sapiens
cuagcuggagugccau

SEQ ID NO: 1418108 - RNA, 21 nt, Homo sapiens
cuaggacuguggaggggagcu

SEQ ID NO: 1418109 - RNA, 21 nt, Homo sapiens
cuagucacuuguuucuacuca

SEQ ID NO: 1418110 - RNA, 21 nt, Homo sapiens
cuagugucaccugcacagggc

SEQ ID NO: 1418111 - RNA, 21 nt, Homo sapiens
cuagugugccaagaaugccca

SEQ ID NO: 1418112 - RNA, 21 nt, Homo sapiens
cuauaaucccagcuacuuggg

SEQ ID NO: 1418113 - RNA, 16 nt, Homo sapiens
cuaugcagaacaguga

SEQ ID NO: 1418114 - RNA, 23 nt, Homo sapiens
cuaugcagaacagugagccaaau

SEQ ID NO: 1418115 - RNA, 14 nt, Homo sapiens
cuaugguugccacc

SEQ ID NO: 1418116 - RNA, 21 nt, Homo sapiens
cuaugguuuuucugugucaau

SEQ ID NO: 1418117 - RNA, 20 nt, Homo sapiens
cuauuuugggaaaaugaagg

SEQ ID NO: 1418118 - RNA, 12 nt, Homo sapiens
cucaacuccucc

SEQ ID NO: 1418119 - RNA, 13 nt, Homo sapiens
cucaagugccuua

SEQ ID NO: 1418120 - RNA, 17 nt, Homo sapiens
cucaaucaugugccaga

SEQ ID NO: 1418121 - RNA, 16 nt, Homo sapiens
cucacaaaucaguaaa

SEQ ID NO: 1418122 - RNA, 17 nt, Homo sapiens
cucaccuaacaguuacu

SEQ ID NO: 1418123 - RNA, 16 nt, Homo sapiens
cucacuaccuccucag

SEQ ID NO: 1418124 - RNA, 15 nt, Homo sapiens
cucacucuugccaac

SEQ ID NO: 1418125 - RNA, 20 nt, Homo sapiens
cucacucuugccaaccugua

SEQ ID NO: 1418126 - RNA, 15 nt, Homo sapiens
cucaguuucugaguc

SEQ ID NO: 1418127 - RNA, 16 nt, Homo sapiens
cucaguuucugagucu

SEQ ID NO: 1418128 - RNA, 18 nt, Homo sapiens
cucauguucaaaguguga

SEQ ID NO: 1418129 - RNA, 15 nt, Homo sapiens
cuccacaaccaccuc

SEQ ID NO: 1418130 - RNA, 13 nt, Homo sapiens
cuccacaucugcc

SEQ ID NO: 1418131 - RNA, 20 nt, Homo sapiens
cucccaaagugcugggauua

SEQ ID NO: 1418132 - RNA, 15 nt, Homo sapiens
cucccaaaugcaaac

SEQ ID NO: 1418133 - RNA, 18 nt, Homo sapiens
cucccacuucuucagcuu

SEQ ID NO: 1418134 - RNA, 20 nt, Homo sapiens
cucccagccugacucccucg

SEQ ID NO: 1418135 - RNA, 19 nt, Homo sapiens
cuccccagacagggcucca

SEQ ID NO: 1418136 - RNA, 14 nt, Homo sapiens
cucccuuugccagc

SEQ ID NO: 1418137 - RNA, 15 nt, Homo sapiens
cuccuccgcccagcu

SEQ ID NO: 1418138 - RNA, 12 nt, Homo sapiens
uugccaagcccu

SEQ ID NO: 1418139 - RNA, 14 nt, Homo sapiens
uugcgaaaauugcg

SEQ ID NO: 1418140 - RNA, 21 nt, Homo sapiens
uugcuaaacgccacggagcuc

SEQ ID NO: 1418141 - RNA, 16 nt, Homo sapiens
uuggcccgcacagagc

SEQ ID NO: 1418142 - RNA, 21 nt, Homo sapiens
uuggucucuauugauauuuca

SEQ ID NO: 1418143 - RNA, 14 nt, Homo sapiens
uuguagaugcuauu

SEQ ID NO: 1418144 - RNA, 13 nt, Homo sapiens
uuguauaacccau

SEQ ID NO: 1418145 - RNA, 21 nt, Homo sapiens
uuguauaacccauauacucuu

SEQ ID NO: 1418146 - RNA, 15 nt, Homo sapiens
uugucugugugcuac

SEQ ID NO: 1418147 - RNA, 14 nt, Homo sapiens
uugugucacugacu

SEQ ID NO: 1418148 - RNA, 14 nt, Homo sapiens
uuguugacugcuga

SEQ ID NO: 1418149 - RNA, 14 nt, Homo sapiens
uuguuggcucagaa

SEQ ID NO: 1418150 - RNA, 13 nt, Homo sapiens
uuguuucuacuca

SEQ ID NO: 1418151 - RNA, 21 nt, Homo sapiens
uuuaaaauaaguugcagaaca

SEQ ID NO: 1418152 - RNA, 12 nt, Homo sapiens
uuuaaacuucag

SEQ ID NO: 1418153 - RNA, 12 nt, Homo sapiens
uuuaacacuuuc

SEQ ID NO: 1418154 - RNA, 12 nt, Homo sapiens
uuuaagcuggug

SEQ ID NO: 1418155 - RNA, 23 nt, Homo sapiens
uuuaaucaaucuuugugccucaa

SEQ ID NO: 1418156 - RNA, 17 nt, Homo sapiens
uuuaauguagagaaaga

SEQ ID NO: 1418157 - RNA, 22 nt, Homo sapiens
uuuaauugcaccugaaaaaccu

SEQ ID NO: 1418158 - RNA, 13 nt, Homo sapiens
uuuacaaagcaaa

SEQ ID NO: 1418159 - RNA, 17 nt, Homo sapiens
uuuacaauuaaacucaa

SEQ ID NO: 1418160 - RNA, 16 nt, Homo sapiens
uuuacauagcauuugu

SEQ ID NO: 1418161 - RNA, 23 nt, Homo sapiens
uuuacuagaacacagaaagccua

SEQ ID NO: 1418162 - RNA, 12 nt, Homo sapiens
uuuagacacugg

SEQ ID NO: 1418163 - RNA, 22 nt, Homo sapiens
uuuaugaucuuaacuucacuuc

SEQ ID NO: 1418164 - RNA, 14 nt, Homo sapiens
uuuauuaaacucau

SEQ ID NO: 1418165 - RNA, 15 nt, Homo sapiens
uuucaccucuacauu

SEQ ID NO: 1418166 - RNA, 17 nt, Homo sapiens
uuucagccgacucagca

SEQ ID NO: 1418167 - RNA, 15 nt, Homo sapiens
uuucauaauuguuga

SEQ ID NO: 1418168 - RNA, 17 nt, Homo sapiens
uuucauauuuuccaaau

SEQ ID NO: 1418169 - RNA, 15 nt, Homo sapiens
uuucauuagaaguua

SEQ ID NO: 1418170 - RNA, 18 nt, Homo sapiens
uuuccaaauuauguggau

SEQ ID NO: 1418171 - RNA, 17 nt, Homo sapiens
uuuccuucuugccuuca

SEQ ID NO: 1418172 - RNA, 18 nt, Homo sapiens
uuucuauuuuaaagagga

SEQ ID NO: 1418173 - RNA, 15 nt, Homo sapiens
uuucuuuaugaucuu

SEQ ID NO: 1418174 - RNA, 15 nt, Homo sapiens
uuugaacuccucuca

SEQ ID NO: 1418175 - RNA, 18 nt, Homo sapiens
uuugaacuccucucagcu

SEQ ID NO: 1418176 - RNA, 17 nt, Homo sapiens
uuugaauaugccaaaca

SEQ ID NO: 1418177 - RNA, 18 nt, Homo sapiens
uuugaauguuguguaaca

SEQ ID NO: 1418178 - RNA, 18 nt, Homo sapiens
uuugauuuuccucucuca

SEQ ID NO: 1418179 - RNA, 23 nt, Homo sapiens
uuugcauuaauaauccuuccagg

SEQ ID NO: 1418180 - RNA, 23 nt, Homo sapiens
uuuggaaggugacuuuucaccuu

SEQ ID NO: 1418181 - RNA, 12 nt, Homo sapiens
uuuggcagagaa

SEQ ID NO: 1418182 - RNA, 16 nt, Homo sapiens
uuuggcugauuccuaa

SEQ ID NO: 1418183 - RNA, 12 nt, Homo sapiens
uuuguaucucau

SEQ ID NO: 1418184 - RNA, 19 nt, Homo sapiens
uuugucccaucgguagcuu

SEQ ID NO: 1418185 - RNA, 14 nt, Homo sapiens
uuugucccaucucu

SEQ ID NO: 1418186 - RNA, 16 nt, Homo sapiens
uuugucuauucuccag

SEQ ID NO: 1418187 - RNA, 22 nt, Homo sapiens
uuugugccauccccauaguaau

SEQ ID NO: 1418188 - RNA, 12 nt, Homo sapiens
uuugugcugcug

SEQ ID NO: 1418189 - RNA, 16 nt, Homo sapiens
uuuguuggcucagaaa

SEQ ID NO: 1418190 - RNA, 20 nt, Homo sapiens
uuuuaucuucuuagcucauc

SEQ ID NO: 1418191 - RNA, 16 nt, Homo sapiens
uuuuauuagacauucu

SEQ ID NO: 1418192 - RNA, 18 nt, Homo sapiens
uuuucgcaaacguuucac

SEQ ID NO: 1418193 - RNA, 23 nt, Homo sapiens
uuuucuaaaacagggauuuugaa

SEQ ID NO: 1418194 - RNA, 16 nt, Homo sapiens
uuuucucaguguccag

SEQ ID NO: 1418195 - RNA, 15 nt, Homo sapiens
uuuuuauguugccag

SEQ ID NO: 1418196 - RNA, 22 nt, Homo sapiens
augagcaauguggauaugacca

SEQ ID NO: 1418197 - RNA, 12 nt, Homo sapiens
augagcuuuaca

SEQ ID NO: 1418198 - RNA, 12 nt, Homo sapiens
augauacuugaa

SEQ ID NO: 1418199 - RNA, 13 nt, Homo sapiens
augaucucauccc

SEQ ID NO: 1418200 - RNA, 14 nt, Homo sapiens
augaugacuaugga

SEQ ID NO: 1418201 - RNA, 15 nt, Homo sapiens
augaugaguccagaa

SEQ ID NO: 1418202 - RNA, 13 nt, Homo sapiens
augauggggucag

SEQ ID NO: 1418203 - RNA, 15 nt, Homo sapiens
augcagaacagugag

SEQ ID NO: 1418204 - RNA, 22 nt, Homo sapiens
augcagaacagugagccaaaua

SEQ ID NO: 1418205 - RNA, 14 nt, Homo sapiens
augcagaagaggga

SEQ ID NO: 1418206 - RNA, 15 nt, Homo sapiens
augcagaagagggaa

SEQ ID NO: 1418207 - RNA, 22 nt, Homo sapiens
augcagagauaauggcauguau

SEQ ID NO: 1418208 - RNA, 17 nt, Homo sapiens
augccucgagccauaga

SEQ ID NO: 1418209 - RNA, 12 nt, Homo sapiens
augcugguggcc

SEQ ID NO: 1418210 - RNA, 22 nt, Homo sapiens
auggaccggcccacacucccag

SEQ ID NO: 1418211 - RNA, 14 nt, Homo sapiens
auggcccauucuac

SEQ ID NO: 1418212 - RNA, 14 nt, Homo sapiens
auggcgucuaccag

SEQ ID NO: 1418213 - RNA, 22 nt, Homo sapiens
augggaaggcuaauauauucca

SEQ ID NO: 1418214 - RNA, 16 nt, Homo sapiens
auggggacugggugca

SEQ ID NO: 1418215 - RNA, 21 nt, Homo sapiens
augggggaucagcagggcagu

SEQ ID NO: 1418216 - RNA, 17 nt, Homo sapiens
auggucaacuuacuuaa

SEQ ID NO: 1418217 - RNA, 18 nt, Homo sapiens
augguuuuaaugcaauga

SEQ ID NO: 1418218 - RNA, 23 nt, Homo sapiens
augguuuuaaugcaaugagcaau

SEQ ID NO: 1418219 - RNA, 14 nt, Homo sapiens
auguagagaaagaa

SEQ ID NO: 1418220 - RNA, 19 nt, Homo sapiens
auguauauuugaacuccuc

SEQ ID NO: 1418221 - RNA, 17 nt, Homo sapiens
augucccaccucucuga

SEQ ID NO: 1418222 - RNA, 18 nt, Homo sapiens
augucccgaccguugcca

SEQ ID NO: 1418223 - RNA, 19 nt, Homo sapiens
augucuaaguaugccucag

SEQ ID NO: 1418224 - RNA, 21 nt, Homo sapiens
augucugaaaaaugccugcug

SEQ ID NO: 1418225 - RNA, 17 nt, Homo sapiens
augugaaacucaucuca

SEQ ID NO: 1418226 - RNA, 19 nt, Homo sapiens
auguguauauguagcaaaa

SEQ ID NO: 1418227 - RNA, 19 nt, Homo sapiens
auguugaggugaccacuua

SEQ ID NO: 1418228 - RNA, 20 nt, Homo sapiens
auguugaggugaccacuuaa

SEQ ID NO: 1418229 - RNA, 14 nt, Homo sapiens
auuaaaagacuguu

SEQ ID NO: 1418230 - RNA, 15 nt, Homo sapiens
auuaaagugcacugu

SEQ ID NO: 1418231 - RNA, 22 nt, Homo sapiens
auuaacaaagugucacuccaua

SEQ ID NO: 1418232 - RNA, 21 nt, Homo sapiens
auuaaugugauuuuggucucu

SEQ ID NO: 1418233 - RNA, 15 nt, Homo sapiens
auuaauugagcagca

SEQ ID NO: 1418234 - RNA, 17 nt, Homo sapiens
auuagaaguuaccaaau

SEQ ID NO: 1418235 - RNA, 14 nt, Homo sapiens
auuauaagccaaac

SEQ ID NO: 1418236 - RNA, 19 nt, Homo sapiens
auuauacacaucuggcuca

SEQ ID NO: 1418237 - RNA, 12 nt, Homo sapiens
auuaucaugaca

SEQ ID NO: 1418238 - RNA, 19 nt, Homo sapiens
auuauuucuuuucuaaaac

SEQ ID NO: 1418239 - RNA, 19 nt, Homo sapiens
auucaagaggaauuccagc

SEQ ID NO: 1418240 - RNA, 23 nt, Homo sapiens
auucaagaggaauuccagcaucu

SEQ ID NO: 1418241 - RNA, 23 nt, Homo sapiens
auucaauagauaccaccguguga

SEQ ID NO: 1418242 - RNA, 18 nt, Homo sapiens
auucaggcuucucaggug

SEQ ID NO: 1418243 - RNA, 18 nt, Homo sapiens
auucaggcuugcauuaaa

SEQ ID NO: 1418244 - RNA, 23 nt, Homo sapiens
auuccaggaggaguuagccaaac

SEQ ID NO: 1418245 - RNA, 16 nt, Homo sapiens
auuccauacagugaca

SEQ ID NO: 1418246 - RNA, 23 nt, Homo sapiens
auuccauggugauuccugggaag

SEQ ID NO: 1418247 - RNA, 20 nt, Homo sapiens
auucccaggaguucugcuca

SEQ ID NO: 1418248 - RNA, 21 nt, Homo sapiens
auucccaggaguucugcucau

SEQ ID NO: 1418249 - RNA, 18 nt, Homo sapiens
auucccucuggaguuuca

SEQ ID NO: 1418250 - RNA, 14 nt, Homo sapiens
auucuacuugcucu

SEQ ID NO: 1418251 - RNA, 18 nt, Homo sapiens
auucuuggcccgcacaga

SEQ ID NO: 1418252 - RNA, 17 nt, Homo sapiens
auucuuuaauuuuggaa

SEQ ID NO: 1418253 - RNA, 12 nt, Homo sapiens
auugaacugcca

SEQ ID NO: 1418254 - RNA, 13 nt, Homo sapiens
auugaacugccaa

SEQ ID NO: 1418255 - RNA, 18 nt, Homo sapiens
auugaaucuaaaaccaaa

SEQ ID NO: 1418256 - RNA, 13 nt, Homo sapiens
auugcauguuaau

SEQ ID NO: 1418257 - RNA, 21 nt, Homo sapiens
auugccugguuuugauugaga

SEQ ID NO: 1418258 - RNA, 16 nt, Homo sapiens
auugccuugugugauu

SEQ ID NO: 1418259 - RNA, 19 nt, Homo sapiens
auugcugguuuuaguugca

SEQ ID NO: 1418260 - RNA, 22 nt, Homo sapiens
auuguguggucauaucuaguca

SEQ ID NO: 1418261 - RNA, 17 nt, Homo sapiens
auuguucagacauucca

SEQ ID NO: 1418262 - RNA, 13 nt, Homo sapiens
auuuauccaccuc

SEQ ID NO: 1418263 - RNA, 19 nt, Homo sapiens
auuuauuguuuaagcagaa

SEQ ID NO: 1418264 - RNA, 21 nt, Homo sapiens
auuucacucuggguaccaaau

SEQ ID NO: 1418265 - RNA, 18 nt, Homo sapiens
auuucauccagggaaaug

SEQ ID NO: 1418266 - RNA, 14 nt, Homo sapiens
auuuccacuuggga

SEQ ID NO: 1418267 - RNA, 18 nt, Homo sapiens
auuucuagacuuccacaa

SEQ ID NO: 1418268 - RNA, 18 nt, Homo sapiens
auuucuauaggcaaagaa

SEQ ID NO: 1418269 - RNA, 17 nt, Homo sapiens
auuucuuuaugaucuua

SEQ ID NO: 1418270 - RNA, 18 nt, Homo sapiens
auuucuuuaugaucuuaa

SEQ ID NO: 1418271 - RNA, 17 nt, Homo sapiens
auuugaacuccucucag

SEQ ID NO: 1418272 - RNA, 14 nt, Homo sapiens
auuuuaaaugcugu

SEQ ID NO: 1418273 - RNA, 17 nt, Homo sapiens
auuuuccuaauggucuc

SEQ ID NO: 1418274 - RNA, 18 nt, Homo sapiens
auuuuccucucucacaaa

SEQ ID NO: 1418275 - RNA, 17 nt, Homo sapiens
auuuucugugccaaagc

SEQ ID NO: 1418276 - RNA, 19 nt, Homo sapiens
auuuugugaaauuucauga

SEQ ID NO: 1418277 - RNA, 12 nt, Homo sapiens
caaaaacuguau

SEQ ID NO: 1418278 - RNA, 19 nt, Homo sapiens
caaaagaaaauauagucac

SEQ ID NO: 1418279 - RNA, 22 nt, Homo sapiens
caaaaggucuauggcucauguc

SEQ ID NO: 1418280 - RNA, 18 nt, Homo sapiens
caaacacaauuaaaucuc

SEQ ID NO: 1418281 - RNA, 13 nt, Homo sapiens
caucuaccuucca

SEQ ID NO: 1418282 - RNA, 23 nt, Homo sapiens
caucucaauugugcuuuguauca

SEQ ID NO: 1418283 - RNA, 19 nt, Homo sapiens
caucucucuggaguuuucu

SEQ ID NO: 1418284 - RNA, 19 nt, Homo sapiens
caucucugagcccguguca

SEQ ID NO: 1418285 - RNA, 22 nt, Homo sapiens
caucucugagcccgugucacag

SEQ ID NO: 1418286 - RNA, 14 nt, Homo sapiens
caucugccaaaaug

SEQ ID NO: 1418287 - RNA, 14 nt, Homo sapiens
caucuucuuugcag

SEQ ID NO: 1418288 - RNA, 16 nt, Homo sapiens
caucuugaucugcuca

SEQ ID NO: 1418289 - RNA, 14 nt, Homo sapiens
caugaaaacuggga

SEQ ID NO: 1418290 - RNA, 12 nt, Homo sapiens
caugaagcccuu

SEQ ID NO: 1418291 - RNA, 16 nt, Homo sapiens
caugaccuaucaguau

SEQ ID NO: 1418292 - RNA, 20 nt, Homo sapiens
caugaugauuaagugcacac

SEQ ID NO: 1418293 - RNA, 20 nt, Homo sapiens
caugcuuccuauacaguucu

SEQ ID NO: 1418294 - RNA, 19 nt, Homo sapiens
cauggacaucuacccagau

SEQ ID NO: 1418295 - RNA, 23 nt, Homo sapiens
caugggagggggcuugaagccaa

SEQ ID NO: 1418296 - RNA, 20 nt, Homo sapiens
cauguaaauauuuuguuauc

SEQ ID NO: 1418297 - RNA, 13 nt, Homo sapiens
caugucauugccc

SEQ ID NO: 1418298 - RNA, 19 nt, Homo sapiens
cauguuaguuuugcuccuu

SEQ ID NO: 1418299 - RNA, 18 nt, Homo sapiens
cauguucaaagugugaca

SEQ ID NO: 1418300 - RNA, 21 nt, Homo sapiens
cauguugugauguacacauuu

SEQ ID NO: 1418301 - RNA, 14 nt, Homo sapiens
cauuaaaagacugu

SEQ ID NO: 1418302 - RNA, 17 nt, Homo sapiens
cauuacauuaacauuua

SEQ ID NO: 1418303 - RNA, 21 nt, Homo sapiens
cauucaggcuucucagguguu

SEQ ID NO: 1418304 - RNA, 18 nt, Homo sapiens
cauuccauggugauuccu

SEQ ID NO: 1418305 - RNA, 22 nt, Homo sapiens
cauugagauucacaugcuggcu

SEQ ID NO: 1418306 - RNA, 14 nt, Homo sapiens
cauuguuggcagca

SEQ ID NO: 1418307 - RNA, 16 nt, Homo sapiens
cauuuaaucaaucuuu

SEQ ID NO: 1418308 - RNA, 16 nt, Homo sapiens
cauuuacaaagcaaaa

SEQ ID NO: 1418309 - RNA, 17 nt, Homo sapiens
cauuuauccaccuccau

SEQ ID NO: 1418310 - RNA, 13 nt, Homo sapiens
cauuucacucugg

SEQ ID NO: 1418311 - RNA, 16 nt, Homo sapiens
cauuucccaucugcac

SEQ ID NO: 1418312 - RNA, 19 nt, Homo sapiens
ccaaagagggcuuccucua

SEQ ID NO: 1418313 - RNA, 22 nt, Homo sapiens
ccaaagugcugggauuacaggu

SEQ ID NO: 1418314 - RNA, 14 nt, Homo sapiens
ccaaauaauuccac

SEQ ID NO: 1418315 - RNA, 14 nt, Homo sapiens
ccaaaugcuuuaaa

SEQ ID NO: 1418316 - RNA, 22 nt, Homo sapiens
ccaaauucccucuggaguuuca

SEQ ID NO: 1418317 - RNA, 19 nt, Homo sapiens
ccaacaacuucuccauccu

SEQ ID NO: 1418318 - RNA, 10 nt, Homo sapiens
ccaacacuuu

SEQ ID NO: 1418319 - RNA, 16 nt, Homo sapiens
ccaacaguugcuaaac

SEQ ID NO: 1418320 - RNA, 21 nt, Homo sapiens
ccaacauaauuaagcuguaua

SEQ ID NO: 1418321 - RNA, 23 nt, Homo sapiens
ccaaccuagaccuguagauuucc

SEQ ID NO: 1418322 - RNA, 20 nt, Homo sapiens
ccaaccuguaauaaauauga

SEQ ID NO: 1418323 - RNA, 19 nt, Homo sapiens
ccaaggacagucagcauuu

SEQ ID NO: 1418324 - RNA, 15 nt, Homo sapiens
ccaagggaaaggggu

SEQ ID NO: 1418325 - RNA, 17 nt, Homo sapiens
ccaagggaaaggggugc

SEQ ID NO: 1418326 - RNA, 15 nt, Homo sapiens
ccaaggucaggaggc

SEQ ID NO: 1418327 - RNA, 13 nt, Homo sapiens
ccaaguccagaau

SEQ ID NO: 1418328 - RNA, 19 nt, Homo sapiens
ccaaguuucauaccaaaua

SEQ ID NO: 1418329 - RNA, 21 nt, Homo sapiens
ccaauaaaacugauguuacua

SEQ ID NO: 1418330 - RNA, 19 nt, Homo sapiens
ccaauccuuaaacugccaa

SEQ ID NO: 1418331 - RNA, 20 nt, Homo sapiens
ccacaaaauuaugcugcauu

SEQ ID NO: 1418332 - RNA, 21 nt, Homo sapiens
ccacaaaauuaugcugcauuu

SEQ ID NO: 1418333 - RNA, 19 nt, Homo sapiens
ccucaaaaggcccuagcua

SEQ ID NO: 1418334 - RNA, 14 nt, Homo sapiens
ccucaagugccuua

SEQ ID NO: 1418335 - RNA, 22 nt, Homo sapiens
ccucaggcaaggucuggccuca

SEQ ID NO: 1418336 - RNA, 12 nt, Homo sapiens
ccucagggccaa

SEQ ID NO: 1418337 - RNA, 15 nt, Homo sapiens
ccucagggccaagcc

SEQ ID NO: 1418338 - RNA, 20 nt, Homo sapiens
ccuccagcccccaguguccc

SEQ ID NO: 1418339 - RNA, 21 nt, Homo sapiens
ccucccaaagugcugggauua

SEQ ID NO: 1418340 - RNA, 16 nt, Homo sapiens
ccucccaccucuguga

SEQ ID NO: 1418341 - RNA, 15 nt, Homo sapiens
ccuccccagaucugu

SEQ ID NO: 1418342 - RNA, 14 nt, Homo sapiens
ccuccggggcucag

SEQ ID NO: 1418343 - RNA, 20 nt, Homo sapiens
ccuccuagcuggagugccau

SEQ ID NO: 1418344 - RNA, 15 nt, Homo sapiens
ccucuagaagccaag

SEQ ID NO: 1418345 - RNA, 20 nt, Homo sapiens
ccucugaggcucagcccuga

SEQ ID NO: 1418346 - RNA, 20 nt, Homo sapiens
ccucuggggcucagcccuga

SEQ ID NO: 1418347 - RNA, 17 nt, Homo sapiens
ccugacagcauaccuca

SEQ ID NO: 1418348 - RNA, 14 nt, Homo sapiens
ccugacugcaauga

SEQ ID NO: 1418349 - RNA, 21 nt, Homo sapiens
ccugagccuggccauguccuc

SEQ ID NO: 1418350 - RNA, 14 nt, Homo sapiens
ccugaggaauaaag

SEQ ID NO: 1418351 - RNA, 23 nt, Homo sapiens
ccugcagccaucccaaggcuccu

SEQ ID NO: 1418352 - RNA, 21 nt, Homo sapiens
ccugcauuugugucauugaca

SEQ ID NO: 1418353 - RNA, 23 nt, Homo sapiens
ccugccagggugggcagacagac

SEQ ID NO: 1418354 - RNA, 20 nt, Homo sapiens
ccugcccugaggagggcccu

SEQ ID NO: 1418355 - RNA, 14 nt, Homo sapiens
ccugccucugccca

SEQ ID NO: 1418356 - RNA, 13 nt, Homo sapiens
ccugccuggucac

SEQ ID NO: 1418357 - RNA, 13 nt, Homo sapiens
ccugccuguacuc

SEQ ID NO: 1418358 - RNA, 13 nt, Homo sapiens
ccugcucugccca

SEQ ID NO: 1418359 - RNA, 21 nt, Homo sapiens
ccuggccaucccuucauuuaa

SEQ ID NO: 1418360 - RNA, 22 nt, Homo sapiens
ccuggccuaauccuuuagauua

SEQ ID NO: 1418361 - RNA, 18 nt, Homo sapiens
ccuggccuuauaucauuu

SEQ ID NO: 1418362 - RNA, 16 nt, Homo sapiens
ccuggggauggccagg

SEQ ID NO: 1418363 - RNA, 17 nt, Homo sapiens
ccugggggaugcaaaua

SEQ ID NO: 1418364 - RNA, 18 nt, Homo sapiens
ccugguauuguaauauua

SEQ ID NO: 1418365 - RNA, 19 nt, Homo sapiens
ccuguaagcccagcauuug

SEQ ID NO: 1418366 - RNA, 22 nt, Homo sapiens
ccuguaauaaauaugagugcca

SEQ ID NO: 1418367 - RNA, 19 nt, Homo sapiens
ccuguaguguaccauucuc

SEQ ID NO: 1418368 - RNA, 16 nt, Homo sapiens
ccugucacacagggaa

SEQ ID NO: 1418369 - RNA, 11 nt, Homo sapiens
ccuguccuccc

SEQ ID NO: 1418370 - RNA, 17 nt, Homo sapiens
ccugugccgcacuagcc

SEQ ID NO: 1418371 - RNA, 20 nt, Homo sapiens
ccuguuuguggaacaaaagu

SEQ ID NO: 1418372 - RNA, 16 nt, Homo sapiens
ccuuaaaaccaaagag

SEQ ID NO: 1418373 - RNA, 14 nt, Homo sapiens
ccuuaaacugccaa

SEQ ID NO: 1418374 - RNA, 18 nt, Homo sapiens
ccuuagagugcugugaga

SEQ ID NO: 1418375 - RNA, 18 nt, Homo sapiens
ccuuaguuugcugccauc

SEQ ID NO: 1418376 - RNA, 18 nt, Homo sapiens
ccuucaccaaagaucugc

SEQ ID NO: 1418377 - RNA, 13 nt, Homo sapiens
ccuuccccagaga

SEQ ID NO: 1418378 - RNA, 20 nt, Homo sapiens
ccuuccuaacaguccgcccu

SEQ ID NO: 1418379 - RNA, 14 nt, Homo sapiens
ccuucuguugagaa

SEQ ID NO: 1418380 - RNA, 17 nt, Homo sapiens
ccuugccugggauauca

SEQ ID NO: 1418381 - RNA, 14 nt, Homo sapiens
ccuuuaaaaagcag

SEQ ID NO: 1418382 - RNA, 16 nt, Homo sapiens
ccuuuccucaggcaag

SEQ ID NO: 1418383 - RNA, 15 nt, Homo sapiens
ccuuucugccucuca

SEQ ID NO: 1418384 - RNA, 15 nt, Homo sapiens
ccuuugacaaaggua

SEQ ID NO: 1418385 - RNA, 17 nt, Homo sapiens
ccuuuggaaacaacauu

SEQ ID NO: 1418386 - RNA, 20 nt, Homo sapiens
ccuuuuaguuaagcaugacu

SEQ ID NO: 1418387 - RNA, 12 nt, Homo sapiens
cgaaaaguugcu

SEQ ID NO: 1418388 - RNA, 14 nt, Homo sapiens
aaaaaaauugcaca

SEQ ID NO: 1418389 - RNA, 14 nt, Homo sapiens
aaaaaacucuugau

SEQ ID NO: 1418390 - RNA, 12 nt, Homo sapiens
aaaaaauuccgg

SEQ ID NO: 1418391 - RNA, 11 nt, Homo sapiens
aaaaaccaaug

SEQ ID NO: 1418392 - RNA, 18 nt, Homo sapiens
aaaaacuaacacccaguc

SEQ ID NO: 1418393 - RNA, 17 nt, Homo sapiens
aaaaaggcauaugcaau

SEQ ID NO: 1418394 - RNA, 13 nt, Homo sapiens
aaaaauauuauaa

SEQ ID NO: 1418395 - RNA, 23 nt, Homo sapiens
aaaaauucacauccaaugcauag

SEQ ID NO: 1418396 - RNA, 13 nt, Homo sapiens
aaaaauugcacaa

SEQ ID NO: 1418397 - RNA, 20 nt, Homo sapiens
aaaaauugguacuuguuuca

SEQ ID NO: 1418398 - RNA, 21 nt, Homo sapiens
aaaaauuucaaccagcauuca

SEQ ID NO: 1418399 - RNA, 13 nt, Homo sapiens
aaaacacuuccau

SEQ ID NO: 1418400 - RNA, 23 nt, Homo sapiens
aaaacaguuuugucagucuuucu

SEQ ID NO: 1418401 - RNA, 13 nt, Homo sapiens
aaaacccagagag

SEQ ID NO: 1418402 - RNA, 16 nt, Homo sapiens
aaaaccuugauuuaaa

SEQ ID NO: 1418403 - RNA, 22 nt, Homo sapiens
aaaaccuugauuuaaaauauca

SEQ ID NO: 1418404 - RNA, 15 nt, Homo sapiens
aaacagagaugugau

SEQ ID NO: 1418405 - RNA, 14 nt, Homo sapiens
aaacauacccagug

SEQ ID NO: 1418406 - RNA, 14 nt, Homo sapiens
aaacauaugcauua

SEQ ID NO: 1418407 - RNA, 12 nt, Homo sapiens
aaacaugaauua

SEQ ID NO: 1418408 - RNA, 17 nt, Homo sapiens
aaacaugcuaaauaguu

SEQ ID NO: 1418409 - RNA, 24 nt, Homo sapiens
aaacaugcuaaauaguucuaucag

SEQ ID NO: 1418410 - RNA, 21 nt, Homo sapiens
aaacauuaaaagaagacugga

SEQ ID NO: 1418411 - RNA, 19 nt, Homo sapiens
aaacauucacacagggcuc

SEQ ID NO: 1418412 - RNA, 23 nt, Homo sapiens
aaacauucacacagggcucuuug

SEQ ID NO: 1418413 - RNA, 13 nt, Homo sapiens
aaaccaaugauuc

SEQ ID NO: 1418414 - RNA, 13 nt, Homo sapiens
aaaccacuguaua

SEQ ID NO: 1418415 - RNA, 17 nt, Homo sapiens
aaaccaggacucugccc

SEQ ID NO: 1418416 - RNA, 23 nt, Homo sapiens
aaaccaugcagcuucaucaauuu

SEQ ID NO: 1418417 - RNA, 14 nt, Homo sapiens
aaacccagcaugua

SEQ ID NO: 1418418 - RNA, 18 nt, Homo sapiens
aaaccuagcaucuuacaa

SEQ ID NO: 1418419 - RNA, 17 nt, Homo sapiens
aaacgaucgcugugaaa

SEQ ID NO: 1418420 - RNA, 18 nt, Homo sapiens
aaacgguaauacgugaaa

SEQ ID NO: 1418421 - RNA, 16 nt, Homo sapiens
aaacuacaaagcugaa

SEQ ID NO: 1418422 - RNA, 21 nt, Homo sapiens
aaacuagcagaagaacuagua

SEQ ID NO: 1418423 - RNA, 19 nt, Homo sapiens
aaacuaguuuccaguggau

SEQ ID NO: 1418424 - RNA, 16 nt, Homo sapiens
aaacuauggcuuuaaa

SEQ ID NO: 1418425 - RNA, 15 nt, Homo sapiens
aaacucacugcucaa

SEQ ID NO: 1418426 - RNA, 16 nt, Homo sapiens
aaacugaaucaagaaa

SEQ ID NO: 1418427 - RNA, 14 nt, Homo sapiens
aaacugcacugcca

SEQ ID NO: 1418428 - RNA, 19 nt, Homo sapiens
aaacugcacugucaagaug

SEQ ID NO: 1418429 - RNA, 16 nt, Homo sapiens
aaacuuauuccuccuu

SEQ ID NO: 1418430 - RNA, 19 nt, Homo sapiens
aaacuuauuugagugauua

SEQ ID NO: 1418431 - RNA, 20 nt, Homo sapiens
aaacuugaaucaaagcaguu

SEQ ID NO: 1418432 - RNA, 16 nt, Homo sapiens
aaacuuuaaugggagg

SEQ ID NO: 1418433 - RNA, 19 nt, Homo sapiens
aaacuuuacucuaagucuc

SEQ ID NO: 1418434 - RNA, 12 nt, Homo sapiens
aaagaaaaccau

SEQ ID NO: 1418435 - RNA, 15 nt, Homo sapiens
aaagaaaacuaacaa

SEQ ID NO: 1418436 - RNA, 14 nt, Homo sapiens
aaagaaacacucaa

SEQ ID NO: 1418437 - RNA, 14 nt, Homo sapiens
aaagaaucagucuu

SEQ ID NO: 1418438 - RNA, 15 nt, Homo sapiens
aaagaaucagucuug

SEQ ID NO: 1418439 - RNA, 20 nt, Homo sapiens
aaagaaugcuggguguugca

SEQ ID NO: 1418440 - RNA, 23 nt, Homo sapiens
aaagaauuuuuuaagaacuguau

SEQ ID NO: 1418441 - RNA, 18 nt, Homo sapiens
aaagacagaaugucacca

SEQ ID NO: 1418442 - RNA, 12 nt, Homo sapiens
aaagacauguug

SEQ ID NO: 1418443 - RNA, 20 nt, Homo sapiens
aaagaccagggcuuuuccca

SEQ ID NO: 1418444 - RNA, 14 nt, Homo sapiens
aaagacuauugcaa

SEQ ID NO: 1418445 - RNA, 16 nt, Homo sapiens
aaagacugcagcugcu

SEQ ID NO: 1418446 - RNA, 23 nt, Homo sapiens
aaagacuuguguccccaccucag

SEQ ID NO: 1418447 - RNA, 17 nt, Homo sapiens
aaagagaaaaaccaaug

SEQ ID NO: 1418448 - RNA, 21 nt, Homo sapiens
aaagagacuggagcaucugac

SEQ ID NO: 1418449 - RNA, 18 nt, Homo sapiens
aaagaguagugcauuuaa

SEQ ID NO: 1418450 - RNA, 14 nt, Homo sapiens
aaagaguccuauuu

SEQ ID NO: 1418451 - RNA, 15 nt, Homo sapiens
aaagauccacccuca

SEQ ID NO: 1418452 - RNA, 22 nt, Homo sapiens
aaagauccacccucaaauguca

SEQ ID NO: 1418453 - RNA, 20 nt, Homo sapiens
aaagaugaucuacucagaaa

SEQ ID NO: 1418454 - RNA, 21 nt, Homo sapiens
aaagaugaucuacucagaaau

SEQ ID NO: 1418455 - RNA, 19 nt, Homo sapiens
aaagauguuugucagauau

SEQ ID NO: 1418456 - RNA, 21 nt, Homo sapiens
acucuuauucccaaacuacag

SEQ ID NO: 1418457 - RNA, 13 nt, Homo sapiens
acucuuugcuaca

SEQ ID NO: 1418458 - RNA, 23 nt, Homo sapiens
acugaaaaaugguaauuguugcu

SEQ ID NO: 1418459 - RNA, 13 nt, Homo sapiens
acugaaacauuca

SEQ ID NO: 1418460 - RNA, 14 nt, Homo sapiens
acugaaaugcuagc

SEQ ID NO: 1418461 - RNA, 20 nt, Homo sapiens
acugaauuuuaaauguucac

SEQ ID NO: 1418462 - RNA, 14 nt, Homo sapiens
acugacaaccugug

SEQ ID NO: 1418463 - RNA, 20 nt, Homo sapiens
acugacauuauaucauggca

SEQ ID NO: 1418464 - RNA, 16 nt, Homo sapiens
acugaccagccuccau

SEQ ID NO: 1418465 - RNA, 12 nt, Homo sapiens
acugacuuucau

SEQ ID NO: 1418466 - RNA, 14 nt, Homo sapiens
acugagacauuaca

SEQ ID NO: 1418467 - RNA, 12 nt, Homo sapiens
acugagagcaga

SEQ ID NO: 1418468 - RNA, 22 nt, Homo sapiens
acugaggccuucucaaacuuua

SEQ ID NO: 1418469 - RNA, 15 nt, Homo sapiens
acugaggucacuggg

SEQ ID NO: 1418470 - RNA, 22 nt, Homo sapiens
acugaugccauguuuagauucc

SEQ ID NO: 1418471 - RNA, 21 nt, Homo sapiens
acugauguuacaucacagugu

SEQ ID NO: 1418472 - RNA, 14 nt, Homo sapiens
acugauuaccuccu

SEQ ID NO: 1418473 - RNA, 14 nt, Homo sapiens
acugauuucacaac

SEQ ID NO: 1418474 - RNA, 20 nt, Homo sapiens
acugcacacacagcuccucu

SEQ ID NO: 1418475 - RNA, 20 nt, Homo sapiens
acugcacuccagccugggca

SEQ ID NO: 1418476 - RNA, 19 nt, Homo sapiens
acugccaggagggacaaag

SEQ ID NO: 1418477 - RNA, 13 nt, Homo sapiens
acugccaugccuc

SEQ ID NO: 1418478 - RNA, 15 nt, Homo sapiens
acugccaugccucaa

SEQ ID NO: 1418479 - RNA, 23 nt, Homo sapiens
acugcgacgcagguguaccuccc

SEQ ID NO: 1418480 - RNA, 15 nt, Homo sapiens
acugcugaucaauga

SEQ ID NO: 1418481 - RNA, 17 nt, Homo sapiens
acugcugcagacaccug

SEQ ID NO: 1418482 - RNA, 13 nt, Homo sapiens
acuggacugugug

SEQ ID NO: 1418483 - RNA, 21 nt, Homo sapiens
acuggagacuuggaagaguug

SEQ ID NO: 1418484 - RNA, 21 nt, Homo sapiens
acuggagcaucugacucacaa

SEQ ID NO: 1418485 - RNA, 14 nt, Homo sapiens
acuggauauguugu

SEQ ID NO: 1418486 - RNA, 19 nt, Homo sapiens
acuggauauguuguuaaac

SEQ ID NO: 1418487 - RNA, 22 nt, Homo sapiens
acuggcacaguuuucugagaaa

SEQ ID NO: 1418488 - RNA, 14 nt, Homo sapiens
acuggcagcuccuc

SEQ ID NO: 1418489 - RNA, 16 nt, Homo sapiens
acuggcaggcagcaga

SEQ ID NO: 1418490 - RNA, 23 nt, Homo sapiens
acuggccagagagggcccagcug

SEQ ID NO: 1418491 - RNA, 23 nt, Homo sapiens
acuggcuucucuuucucugagug

SEQ ID NO: 1418492 - RNA, 22 nt, Homo sapiens
acugggaugagccgcugugagc

SEQ ID NO: 1418493 - RNA, 13 nt, Homo sapiens
acuguaaacauuc

SEQ ID NO: 1418494 - RNA, 19 nt, Homo sapiens
acuguaaacauucaucaag

SEQ ID NO: 1418495 - RNA, 16 nt, Homo sapiens
acuguacauagaugua

SEQ ID NO: 1418496 - RNA, 14 nt, Homo sapiens
acuguacugagaca

SEQ ID NO: 1418497 - RNA, 18 nt, Homo sapiens
acuguauauagaagucua

SEQ ID NO: 1418498 - RNA, 17 nt, Homo sapiens
acugucaaguacaagca

SEQ ID NO: 1418499 - RNA, 20 nt, Homo sapiens
acugucaagucaugauggag

SEQ ID NO: 1418500 - RNA, 22 nt, Homo sapiens
acuguccuggcugcucucaugc

SEQ ID NO: 1418501 - RNA, 15 nt, Homo sapiens
acugugaaaccacua

SEQ ID NO: 1418502 - RNA, 14 nt, Homo sapiens
acuguggccuggca

SEQ ID NO: 1418503 - RNA, 22 nt, Homo sapiens
acuguuauucuauuauaucaga

SEQ ID NO: 1418504 - RNA, 13 nt, Homo sapiens
acuguugcucaaa

SEQ ID NO: 1418505 - RNA, 16 nt, Homo sapiens
acuguuguacaagcuc

SEQ ID NO: 1418506 - RNA, 17 nt, Homo sapiens
acuuaacugugugaaga

SEQ ID NO: 1418507 - RNA, 13 nt, Homo sapiens
acuuaagaggcag

SEQ ID NO: 1418508 - RNA, 20 nt, Homo sapiens
acuuacccuaaaacaugugu

SEQ ID NO: 1418509 - RNA, 17 nt, Homo sapiens
acuuaccuagauucuac

SEQ ID NO: 1418510 - RNA, 22 nt, Homo sapiens
acuuagaaauugcauuuccuga

SEQ ID NO: 1418511 - RNA, 23 nt, Homo sapiens
acuuagaaauugcauuuccugac

SEQ ID NO: 1418512 - RNA, 14 nt, Homo sapiens
acuuauaccaaagg

SEQ ID NO: 1418513 - RNA, 14 nt, Homo sapiens
acuuaucacaugga

SEQ ID NO: 1418514 - RNA, 13 nt, Homo sapiens
acuucaagugcau

SEQ ID NO: 1418515 - RNA, 17 nt, Homo sapiens
acuucacaaaaugcaag

SEQ ID NO: 1418516 - RNA, 12 nt, Homo sapiens
acuucagucuuc

SEQ ID NO: 1418517 - RNA, 22 nt, Homo sapiens
acuuccacauuauacauuugau

SEQ ID NO: 1418518 - RNA, 17 nt, Homo sapiens
acuucccuuuccuccac

SEQ ID NO: 1418519 - RNA, 14 nt, Homo sapiens
acuuccugcacuga

SEQ ID NO: 1418520 - RNA, 19 nt, Homo sapiens
acuuccugugacuucagcu

SEQ ID NO: 1418521 - RNA, 21 nt, Homo sapiens
acuuccuuggacucauuuuaa

SEQ ID NO: 1418522 - RNA, 22 nt, Homo sapiens
acuuccuugguuuggacacagu

SEQ ID NO: 1418523 - RNA, 13 nt, Homo sapiens
acuuccuuugaga

SEQ ID NO: 1418524 - RNA, 18 nt, Homo sapiens
acuucuaugcaaaugccu

SEQ ID NO: 1418525 - RNA, 12 nt, Homo sapiens
acuucucugagu

SEQ ID NO: 1418526 - RNA, 20 nt, Homo sapiens
acuucugagaccuuguuuca

SEQ ID NO: 1418527 - RNA, 21 nt, Homo sapiens
acuucugucuuccuucauuau

SEQ ID NO: 1418528 - RNA, 23 nt, Homo sapiens
acuucuuggaaaaaaauuacaaa

SEQ ID NO: 1418529 - RNA, 15 nt, Homo sapiens
acuugaaaaccucau

SEQ ID NO: 1418530 - RNA, 13 nt, Homo sapiens
acuugaaauacca

SEQ ID NO: 1418531 - RNA, 23 nt, Homo sapiens
acuugaaauaccagugaaccaaa

SEQ ID NO: 1418532 - RNA, 14 nt, Homo sapiens
acuugaacccaggu

SEQ ID NO: 1418533 - RNA, 13 nt, Homo sapiens
acuugcccugcca

SEQ ID NO: 1418534 - RNA, 14 nt, Homo sapiens
acuugcugccugaa

SEQ ID NO: 1418535 - RNA, 13 nt, Homo sapiens
acuuggggaccag

SEQ ID NO: 1418536 - RNA, 22 nt, Homo sapiens
acuugggggaggaggaacaaau

SEQ ID NO: 1418537 - RNA, 21 nt, Homo sapiens
acuuggggucaccacccuccc

SEQ ID NO: 1418538 - RNA, 18 nt, Homo sapiens
acuugguuuuuggcucuu

SEQ ID NO: 1418539 - RNA, 20 nt, Homo sapiens
acuuguagaaaucuguaauu

SEQ ID NO: 1418540 - RNA, 18 nt, Homo sapiens
acuugucaccaugagaua

SEQ ID NO: 1418541 - RNA, 21 nt, Homo sapiens
aaaguuguaguucuugugcau

SEQ ID NO: 1418542 - RNA, 14 nt, Homo sapiens
aaaguuucagagaa

SEQ ID NO: 1418543 - RNA, 14 nt, Homo sapiens
aaauaaauagauuu

SEQ ID NO: 1418544 - RNA, 14 nt, Homo sapiens
aaauaagcuuuauu

SEQ ID NO: 1418545 - RNA, 17 nt, Homo sapiens
aaauaauucaugauuca

SEQ ID NO: 1418546 - RNA, 19 nt, Homo sapiens
aaauacaaacaagcacaga

SEQ ID NO: 1418547 - RNA, 22 nt, Homo sapiens
aaauacauucuccuuuuugccc

SEQ ID NO: 1418548 - RNA, 20 nt, Homo sapiens
aaauaccagugaaccaaaga

SEQ ID NO: 1418549 - RNA, 12 nt, Homo sapiens
aaauacugccua

SEQ ID NO: 1418550 - RNA, 15 nt, Homo sapiens
aaauaguuguccaua

SEQ ID NO: 1418551 - RNA, 17 nt, Homo sapiens
aaauauacaaacaugug

SEQ ID NO: 1418552 - RNA, 19 nt, Homo sapiens
aaauauccacagacucccu

SEQ ID NO: 1418553 - RNA, 19 nt, Homo sapiens
aaauauuaaggagaauuca

SEQ ID NO: 1418554 - RNA, 12 nt, Homo sapiens
aaauauuauuca

SEQ ID NO: 1418555 - RNA, 17 nt, Homo sapiens
aaauauugcuucaauaa

SEQ ID NO: 1418556 - RNA, 18 nt, Homo sapiens
aaauauuuuagccuuaaa

SEQ ID NO: 1418557 - RNA, 14 nt, Homo sapiens
aaaucauuucugca

SEQ ID NO: 1418558 - RNA, 15 nt, Homo sapiens
aaauccaguuuccca

SEQ ID NO: 1418559 - RNA, 22 nt, Homo sapiens
aaauccucaccauccacagcaa

SEQ ID NO: 1418560 - RNA, 13 nt, Homo sapiens
aaaucuagaucaa

SEQ ID NO: 1418561 - RNA, 20 nt, Homo sapiens
aaaucuaggugauuguucau

SEQ ID NO: 1418562 - RNA, 15 nt, Homo sapiens
aaaucugagaucucc

SEQ ID NO: 1418563 - RNA, 16 nt, Homo sapiens
aaaucugguuagauaa

SEQ ID NO: 1418564 - RNA, 15 nt, Homo sapiens
aaaugaaucuuacuc

SEQ ID NO: 1418565 - RNA, 14 nt, Homo sapiens
aaaugacaugcacu

SEQ ID NO: 1418566 - RNA, 17 nt, Homo sapiens
aaaugacaugcacugac

SEQ ID NO: 1418567 - RNA, 19 nt, Homo sapiens
aaaugauauauaccacuuu

SEQ ID NO: 1418568 - RNA, 17 nt, Homo sapiens
aaaugaugccacuuccc

SEQ ID NO: 1418569 - RNA, 15 nt, Homo sapiens
aaaugcaaacacugu

SEQ ID NO: 1418570 - RNA, 16 nt, Homo sapiens
aaaugcaaacacugug

SEQ ID NO: 1418571 - RNA, 13 nt, Homo sapiens
aaaugcauggugc

SEQ ID NO: 1418572 - RNA, 17 nt, Homo sapiens
aaaugcauggugcaguu

SEQ ID NO: 1418573 - RNA, 14 nt, Homo sapiens
aaaugccacaaaga

SEQ ID NO: 1418574 - RNA, 15 nt, Homo sapiens
aaaugccacaaagaa

SEQ ID NO: 1418575 - RNA, 22 nt, Homo sapiens
aaaugccuccaagccauucacu

SEQ ID NO: 1418576 - RNA, 21 nt, Homo sapiens
aaaugcgcgugugcacgugug

SEQ ID NO: 1418577 - RNA, 14 nt, Homo sapiens
aaaugcuauauugc

SEQ ID NO: 1418578 - RNA, 21 nt, Homo sapiens
aaauggagggagccaucccuu

SEQ ID NO: 1418579 - RNA, 16 nt, Homo sapiens
aaauggguuggugcuu

SEQ ID NO: 1418580 - RNA, 14 nt, Homo sapiens
aaauguauauacac

SEQ ID NO: 1418581 - RNA, 19 nt, Homo sapiens
aaauguauauacacauaua

SEQ ID NO: 1418582 - RNA, 12 nt, Homo sapiens
aaaugucaguaa

SEQ ID NO: 1418583 - RNA, 22 nt, Homo sapiens
aaauguccuccaacaauaaaga

SEQ ID NO: 1418584 - RNA, 21 nt, Homo sapiens
aaaugucuguuucaaugaccu

SEQ ID NO: 1418585 - RNA, 14 nt, Homo sapiens
aaaugugcuuaugu

SEQ ID NO: 1418586 - RNA, 16 nt, Homo sapiens
aaauguuauuauguca

SEQ ID NO: 1418587 - RNA, 19 nt, Homo sapiens
aaauguucagaagguugcu

SEQ ID NO: 1418588 - RNA, 20 nt, Homo sapiens
aaauuaagagauacauuccc

SEQ ID NO: 1418589 - RNA, 13 nt, Homo sapiens
aaauuacauuaaa

SEQ ID NO: 1418590 - RNA, 17 nt, Homo sapiens
aaauuauguauguuuac

SEQ ID NO: 1418591 - RNA, 22 nt, Homo sapiens
aaauucaagcugcuuuggacaa

SEQ ID NO: 1418592 - RNA, 21 nt, Homo sapiens
aaauucacagcgcuaugcaau

SEQ ID NO: 1418593 - RNA, 22 nt, Homo sapiens
aaauucaggugaaaauguucau

SEQ ID NO: 1418594 - RNA, 12 nt, Homo sapiens
aaauuccuguag

SEQ ID NO: 1418595 - RNA, 18 nt, Homo sapiens
aaauucucaaccuaccac

SEQ ID NO: 1418596 - RNA, 24 nt, Homo sapiens
aaauucucagucaguaauugccaa

SEQ ID NO: 1418597 - RNA, 17 nt, Homo sapiens
aaauucuugaaguucau

SEQ ID NO: 1418598 - RNA, 14 nt, Homo sapiens
aaauugaaccuggu

SEQ ID NO: 1418599 - RNA, 11 nt, Homo sapiens
aaauugcacaa

SEQ ID NO: 1418600 - RNA, 20 nt, Homo sapiens
aaauugcacuuuuaaaccuc

SEQ ID NO: 1418601 - RNA, 18 nt, Homo sapiens
aaauuguaacuacacuaa

SEQ ID NO: 1418602 - RNA, 13 nt, Homo sapiens
aaauuuucaccug

SEQ ID NO: 1418603 - RNA, 23 nt, Homo sapiens
aacaaacuacauguaauccauca

SEQ ID NO: 1418604 - RNA, 15 nt, Homo sapiens
aacaaauuauguuac

SEQ ID NO: 1418605 - RNA, 15 nt, Homo sapiens
aacaacaaaccaaaa

SEQ ID NO: 1418606 - RNA, 15 nt, Homo sapiens
aacaaccuggucaca

SEQ ID NO: 1418607 - RNA, 23 nt, Homo sapiens
aacaagagcaaaaugaugcuuuc

SEQ ID NO: 1418608 - RNA, 19 nt, Homo sapiens
aacaagaguugucuugucc

SEQ ID NO: 1418609 - RNA, 19 nt, Homo sapiens
aacaaggugucuuuuccac

SEQ ID NO: 1418610 - RNA, 18 nt, Homo sapiens
aacaauaaagacugagac

SEQ ID NO: 1418611 - RNA, 13 nt, Homo sapiens
aacacacauggau

SEQ ID NO: 1418612 - RNA, 19 nt, Homo sapiens
aacacacauggaugcacac

SEQ ID NO: 1418613 - RNA, 17 nt, Homo sapiens
aacacaccgaugcacac

SEQ ID NO: 1418614 - RNA, 15 nt, Homo sapiens
aacacauacuagaaa

SEQ ID NO: 1418615 - RNA, 15 nt, Homo sapiens
aacaccaugaaucuu

SEQ ID NO: 1418616 - RNA, 20 nt, Homo sapiens
aacacccaugaaucaaagac

SEQ ID NO: 1418617 - RNA, 17 nt, Homo sapiens
aacacucuucuugagca

SEQ ID NO: 1418618 - RNA, 18 nt, Homo sapiens
aacagacguuaccaauua

SEQ ID NO: 1418619 - RNA, 13 nt, Homo sapiens
aacagagggccac

SEQ ID NO: 1418620 - RNA, 15 nt, Homo sapiens
aacagccaaaugcau

SEQ ID NO: 1418621 - RNA, 20 nt, Homo sapiens
aacaggcuguucugcacuga

SEQ ID NO: 1418622 - RNA, 21 nt, Homo sapiens
aacaggcuguucugcacugaa

SEQ ID NO: 1418623 - RNA, 23 nt, Homo sapiens
aacaggguggcccccugugccag

SEQ ID NO: 1418624 - RNA, 20 nt, Homo sapiens
aacagucacccuucugggca

SEQ ID NO: 1418625 - RNA, 14 nt, Homo sapiens
aacaguuacaugaa

SEQ ID NO: 1418626 - RNA, 21 nt, Homo sapiens
aacauaaauuucuuuaaucau

SEQ ID NO: 1418627 - RNA, 14 nt, Homo sapiens
acucacugcucaag

SEQ ID NO: 1418628 - RNA, 20 nt, Homo sapiens
acucagacuguugcacucua

SEQ ID NO: 1418629 - RNA, 17 nt, Homo sapiens
acucagcggucauucua

SEQ ID NO: 1418630 - RNA, 12 nt, Homo sapiens
acucaggaucca

SEQ ID NO: 1418631 - RNA, 22 nt, Homo sapiens
acucagucuagugaagauguug

SEQ ID NO: 1418632 - RNA, 18 nt, Homo sapiens
acucaguuguuccuacuc

SEQ ID NO: 1418633 - RNA, 21 nt, Homo sapiens
acucaguuguuccuacucaga

SEQ ID NO: 1418634 - RNA, 23 nt, Homo sapiens
acucaucccuguuccucaaggcc

SEQ ID NO: 1418635 - RNA, 19 nt, Homo sapiens
acuccaagauucaaagaga

SEQ ID NO: 1418636 - RNA, 21 nt, Homo sapiens
acuccacaguuuugccuuaaa

SEQ ID NO: 1418637 - RNA, 22 nt, Homo sapiens
acuccagcccuguccccugaaa

SEQ ID NO: 1418638 - RNA, 13 nt, Homo sapiens
acuccagugguga

SEQ ID NO: 1418639 - RNA, 19 nt, Homo sapiens
acuccauauggaggccuca

SEQ ID NO: 1418640 - RNA, 16 nt, Homo sapiens
acuccauuacuaaaga

SEQ ID NO: 1418641 - RNA, 22 nt, Homo sapiens
acucccacagaggagagaggcu

SEQ ID NO: 1418642 - RNA, 12 nt, Homo sapiens
acucccaggacc

SEQ ID NO: 1418643 - RNA, 20 nt, Homo sapiens
acuccuauaaggagaguuca

SEQ ID NO: 1418644 - RNA, 19 nt, Homo sapiens
acuccucuguccaggcacu

SEQ ID NO: 1418645 - RNA, 18 nt, Homo sapiens
acuccucuuauuugcuca

SEQ ID NO: 1418646 - RNA, 15 nt, Homo sapiens
acuccugucuguccu

SEQ ID NO: 1418647 - RNA, 22 nt, Homo sapiens
acucguucuucugggaacccug

SEQ ID NO: 1418648 - RNA, 22 nt, Homo sapiens
acucucaccgacuuauucugau

SEQ ID NO: 1418649 - RNA, 23 nt, Homo sapiens
acucucauuccccagguggcuga

SEQ ID NO: 1418650 - RNA, 18 nt, Homo sapiens
acucugaaaucucagaau

SEQ ID NO: 1418651 - RNA, 14 nt, Homo sapiens
acucugcacuccau

SEQ ID NO: 1418652 - RNA, 14 nt, Homo sapiens
acucugcaucagca

SEQ ID NO: 1418653 - RNA, 19 nt, Homo sapiens
acucugcgguggugccaga

SEQ ID NO: 1418654 - RNA, 16 nt, Homo sapiens
acucugguggugcuuu

SEQ ID NO: 1418655 - RNA, 17 nt, Homo sapiens
acucuguccaggccacu

SEQ ID NO: 1418656 - RNA, 22 nt, Homo sapiens
acucugugccagagccuggggc

SEQ ID NO: 1418657 - RNA, 15 nt, Homo sapiens
agacauggauuugau

SEQ ID NO: 1418658 - RNA, 18 nt, Homo sapiens
agaccaaagcauugccug

SEQ ID NO: 1418659 - RNA, 12 nt, Homo sapiens
agaccacucccu

SEQ ID NO: 1418660 - RNA, 13 nt, Homo sapiens
agaccaguacugg

SEQ ID NO: 1418661 - RNA, 22 nt, Homo sapiens
agacccacgugcuaggggauga

SEQ ID NO: 1418662 - RNA, 21 nt, Homo sapiens
agacccaguguaaagaauaaa

SEQ ID NO: 1418663 - RNA, 15 nt, Homo sapiens
agaccgggggccaga

SEQ ID NO: 1418664 - RNA, 15 nt, Homo sapiens
agaccuagugcuguu

SEQ ID NO: 1418665 - RNA, 23 nt, Homo sapiens
agaccucugugaggaaagcacac

SEQ ID NO: 1418666 - RNA, 16 nt, Homo sapiens
agaccugacaagcacu

SEQ ID NO: 1418667 - RNA, 19 nt, Homo sapiens
agaccugacaagcacugcu

SEQ ID NO: 1418668 - RNA, 18 nt, Homo sapiens
agaccuuuucucucccau

SEQ ID NO: 1418669 - RNA, 22 nt, Homo sapiens
agacgcagcccugggggccagc

SEQ ID NO: 1418670 - RNA, 15 nt, Homo sapiens
agacggagucuugcu

SEQ ID NO: 1418671 - RNA, 14 nt, Homo sapiens
agacgucucaagac

SEQ ID NO: 1418672 - RNA, 14 nt, Homo sapiens
agacuaaccugccc

SEQ ID NO: 1418673 - RNA, 18 nt, Homo sapiens
agacucagcuccagaaua

SEQ ID NO: 1418674 - RNA, 21 nt, Homo sapiens
agacucgucucaaaaaaaaga

SEQ ID NO: 1418675 - RNA, 19 nt, Homo sapiens
agacucguucuucugggaa

SEQ ID NO: 1418676 - RNA, 23 nt, Homo sapiens
agacugaauuuuaaauguucaca

SEQ ID NO: 1418677 - RNA, 23 nt, Homo sapiens
agacugcagccccggcugacacc

SEQ ID NO: 1418678 - RNA, 20 nt, Homo sapiens
agacugggugaaagugacua

SEQ ID NO: 1418679 - RNA, 15 nt, Homo sapiens
agacuguugcucaaa

SEQ ID NO: 1418680 - RNA, 17 nt, Homo sapiens
agacuuaaaucacagau

SEQ ID NO: 1418681 - RNA, 19 nt, Homo sapiens
agacuucagaacaugcugg

SEQ ID NO: 1418682 - RNA, 13 nt, Homo sapiens
agacuucccugaa

SEQ ID NO: 1418683 - RNA, 16 nt, Homo sapiens
agacuucgacucagga

SEQ ID NO: 1418684 - RNA, 15 nt, Homo sapiens
agacuuuuaucaaaa

SEQ ID NO: 1418685 - RNA, 15 nt, Homo sapiens
agagaacaggggcuu

SEQ ID NO: 1418686 - RNA, 13 nt, Homo sapiens
agagaacuggagg

SEQ ID NO: 1418687 - RNA, 14 nt, Homo sapiens
agagaagaggcugg

SEQ ID NO: 1418688 - RNA, 20 nt, Homo sapiens
agagaauauuucaaaugaac

SEQ ID NO: 1418689 - RNA, 15 nt, Homo sapiens
agagacuauggagcc

SEQ ID NO: 1418690 - RNA, 16 nt, Homo sapiens
agagacuauuuagaca

SEQ ID NO: 1418691 - RNA, 18 nt, Homo sapiens
agagacuauuuagacaaa

SEQ ID NO: 1418692 - RNA, 13 nt, Homo sapiens
agagacuggagca

SEQ ID NO: 1418693 - RNA, 14 nt, Homo sapiens
agagagauggaaua

SEQ ID NO: 1418694 - RNA, 19 nt, Homo sapiens
agagagcaccuggugauca

SEQ ID NO: 1418695 - RNA, 22 nt, Homo sapiens
agagagcucgcucuugggaguc

SEQ ID NO: 1418696 - RNA, 22 nt, Homo sapiens
agagagggccugcuggagagca

SEQ ID NO: 1418697 - RNA, 16 nt, Homo sapiens
agagagggcuuucuca

SEQ ID NO: 1418698 - RNA, 14 nt, Homo sapiens
agagagucuuccag

SEQ ID NO: 1418699 - RNA, 20 nt, Homo sapiens
agagaugggguuucacugug

SEQ ID NO: 1418700 - RNA, 15 nt, Homo sapiens
agagauuuccuccau

SEQ ID NO: 1418701 - RNA, 17 nt, Homo sapiens
agagcaggaaugggaag

SEQ ID NO: 1418702 - RNA, 14 nt, Homo sapiens
agagccacuaccuu

SEQ ID NO: 1418703 - RNA, 14 nt, Homo sapiens
agagccagcucucu

SEQ ID NO: 1418704 - RNA, 15 nt, Homo sapiens
agagccgcauggcac

SEQ ID NO: 1418705 - RNA, 19 nt, Homo sapiens
agagccugagucacugguc

SEQ ID NO: 1418706 - RNA, 20 nt, Homo sapiens
agagccugugcuaaagaagc

SEQ ID NO: 1418707 - RNA, 20 nt, Homo sapiens
agagcgagacuccgucucaa

SEQ ID NO: 1418708 - RNA, 19 nt, Homo sapiens
agagcuagaaccuagaagg

SEQ ID NO: 1418709 - RNA, 14 nt, Homo sapiens
agagcuauggugag

SEQ ID NO: 1418710 - RNA, 14 nt, Homo sapiens
agagcuauguuccc

SEQ ID NO: 1418711 - RNA, 20 nt, Homo sapiens
agagcuccugucccuaccca

SEQ ID NO: 1418712 - RNA, 11 nt, Homo sapiens
agagcucuuaa

SEQ ID NO: 1418713 - RNA, 18 nt, Homo sapiens
agagcugauggagaagga

SEQ ID NO: 1418714 - RNA, 18 nt, Homo sapiens
agagcugggaguagcaug

SEQ ID NO: 1418715 - RNA, 16 nt, Homo sapiens
agaggagagaggcuca

SEQ ID NO: 1418716 - RNA, 13 nt, Homo sapiens
agaggcagugauu

SEQ ID NO: 1418717 - RNA, 22 nt, Homo sapiens
agaggcuaagaugagauuugcc

SEQ ID NO: 1418718 - RNA, 23 nt, Homo sapiens
cuggucuccucccaaaauacuac

SEQ ID NO: 1418719 - RNA, 23 nt, Homo sapiens
cuggucugugcugcccugcucug

SEQ ID NO: 1418720 - RNA, 14 nt, Homo sapiens
cuggucuucacugc

SEQ ID NO: 1418721 - RNA, 15 nt, Homo sapiens
cuggucuucacugcc

SEQ ID NO: 1418722 - RNA, 16 nt, Homo sapiens
cugguggcaccagaug

SEQ ID NO: 1418723 - RNA, 12 nt, Homo sapiens
cugguggccgau

SEQ ID NO: 1418724 - RNA, 18 nt, Homo sapiens
cuggugguggcaccaucu

SEQ ID NO: 1418725 - RNA, 13 nt, Homo sapiens
cugguugcuguau

SEQ ID NO: 1418726 - RNA, 16 nt, Homo sapiens
cuguaaaucacuugua

SEQ ID NO: 1418727 - RNA, 15 nt, Homo sapiens
cuguaacaugcaauu

SEQ ID NO: 1418728 - RNA, 20 nt, Homo sapiens
cuguaaucccagcacuuugg

SEQ ID NO: 1418729 - RNA, 23 nt, Homo sapiens
cuguaaucccagcacuuugggag

SEQ ID NO: 1418730 - RNA, 18 nt, Homo sapiens
cuguacugagacauuaca

SEQ ID NO: 1418731 - RNA, 21 nt, Homo sapiens
cuguagucccagcuacucggg

SEQ ID NO: 1418732 - RNA, 22 nt, Homo sapiens
cuguagucccagcuacucggga

SEQ ID NO: 1418733 - RNA, 17 nt, Homo sapiens
cuguagugagaaacuga

SEQ ID NO: 1418734 - RNA, 17 nt, Homo sapiens
cuguauaaaaugcaaaa

SEQ ID NO: 1418735 - RNA, 20 nt, Homo sapiens
cuguauacagauucuagcca

SEQ ID NO: 1418736 - RNA, 13 nt, Homo sapiens
cuguauacuguac

SEQ ID NO: 1418737 - RNA, 13 nt, Homo sapiens
cuguauauguugu

SEQ ID NO: 1418738 - RNA, 14 nt, Homo sapiens
cuguauggcacuua

SEQ ID NO: 1418739 - RNA, 18 nt, Homo sapiens
cugucauucaaaugggug

SEQ ID NO: 1418740 - RNA, 12 nt, Homo sapiens
cugucccaaaga

SEQ ID NO: 1418741 - RNA, 14 nt, Homo sapiens
cugucccaccaacu

SEQ ID NO: 1418742 - RNA, 22 nt, Homo sapiens
cugucccagagcuuauuggcca

SEQ ID NO: 1418743 - RNA, 23 nt, Homo sapiens
cuguccccucuccccucauggag

SEQ ID NO: 1418744 - RNA, 19 nt, Homo sapiens
cugucccucaaaugaccca

SEQ ID NO: 1418745 - RNA, 13 nt, Homo sapiens
cugucgcaucuca

SEQ ID NO: 1418746 - RNA, 14 nt, Homo sapiens
cugucgcaucucag

SEQ ID NO: 1418747 - RNA, 13 nt, Homo sapiens
cugucuccaggau

SEQ ID NO: 1418748 - RNA, 16 nt, Homo sapiens
cugucuggcugaggau

SEQ ID NO: 1418749 - RNA, 19 nt, Homo sapiens
cugucugucaccagcuauc

SEQ ID NO: 1418750 - RNA, 16 nt, Homo sapiens
cugucugucccaaaga

SEQ ID NO: 1418751 - RNA, 18 nt, Homo sapiens
cugucuuaaggcaucuga

SEQ ID NO: 1418752 - RNA, 23 nt, Homo sapiens
cugugaauagucugugugcacaa

SEQ ID NO: 1418753 - RNA, 15 nt, Homo sapiens
cugugaccugcugag

SEQ ID NO: 1418754 - RNA, 22 nt, Homo sapiens
cugugaggccccuggacaagca

SEQ ID NO: 1418755 - RNA, 15 nt, Homo sapiens
cugugaucccagcua

SEQ ID NO: 1418756 - RNA, 22 nt, Homo sapiens
cugugaucccagcuacuuggga

SEQ ID NO: 1418757 - RNA, 21 nt, Homo sapiens
cugugcauacauguucaucgu

SEQ ID NO: 1418758 - RNA, 15 nt, Homo sapiens
cugugcaugaccuga

SEQ ID NO: 1418759 - RNA, 16 nt, Homo sapiens
cugugcucuaagugaa

SEQ ID NO: 1418760 - RNA, 15 nt, Homo sapiens
cugugcuuugacuca

SEQ ID NO: 1418761 - RNA, 20 nt, Homo sapiens
cuguggaugaugguugcaaa

SEQ ID NO: 1418762 - RNA, 16 nt, Homo sapiens
cuguggauuauuucau

SEQ ID NO: 1418763 - RNA, 15 nt, Homo sapiens
cugugggcagcaccc

SEQ ID NO: 1418764 - RNA, 22 nt, Homo sapiens
cugugggcuuuggguuugucag

SEQ ID NO: 1418765 - RNA, 21 nt, Homo sapiens
gaguguguuugugugcaugaa

SEQ ID NO: 1418766 - RNA, 23 nt, Homo sapiens
gaguuccaugaagaccacaucca

SEQ ID NO: 1418767 - RNA, 15 nt, Homo sapiens
gaguucugacauuca

SEQ ID NO: 1418768 - RNA, 18 nt, Homo sapiens
gaguuggaacugcauucu

SEQ ID NO: 1418769 - RNA, 14 nt, Homo sapiens
gaguuucgagguag

SEQ ID NO: 1418770 - RNA, 22 nt, Homo sapiens
gaguuucuccuuuugaccaaau

SEQ ID NO: 1418771 - RNA, 15 nt, Homo sapiens
gauaaaaggaaccaa

SEQ ID NO: 1418772 - RNA, 19 nt, Homo sapiens
gauaaacacagagguuuua

SEQ ID NO: 1418773 - RNA, 15 nt, Homo sapiens
gauaaagaauauuua

SEQ ID NO: 1418774 - RNA, 19 nt, Homo sapiens
gauaaagaugucaaauauc

SEQ ID NO: 1418775 - RNA, 16 nt, Homo sapiens
gauaaagcaguauuug

SEQ ID NO: 1418776 - RNA, 17 nt, Homo sapiens
gauaacaagacuuugac

SEQ ID NO: 1418777 - RNA, 21 nt, Homo sapiens
gauaacccauacuacccucau

SEQ ID NO: 1418778 - RNA, 23 nt, Homo sapiens
gauacacugaaguuaacagagac

SEQ ID NO: 1418779 - RNA, 19 nt, Homo sapiens
gauacgcaaacacaccgau

SEQ ID NO: 1418780 - RNA, 22 nt, Homo sapiens
gauacugcucaucauuccuuga

SEQ ID NO: 1418781 - RNA, 20 nt, Homo sapiens
gauagucagcuguaccaagc

SEQ ID NO: 1418782 - RNA, 18 nt, Homo sapiens
gauaucaccucucuucag

SEQ ID NO: 1418783 - RNA, 20 nt, Homo sapiens
gauaucaguuaucaauguua

SEQ ID NO: 1418784 - RNA, 21 nt, Homo sapiens
gauauccaguaagcacauguu

SEQ ID NO: 1418785 - RNA, 14 nt, Homo sapiens
gauaugcacacaca

SEQ ID NO: 1418786 - RNA, 23 nt, Homo sapiens
gauauguuacauuagagugagag

SEQ ID NO: 1418787 - RNA, 15 nt, Homo sapiens
gaucaaauauuucaa

SEQ ID NO: 1418788 - RNA, 21 nt, Homo sapiens
gaucagccuccgccauuccaa

SEQ ID NO: 1418789 - RNA, 17 nt, Homo sapiens
gaucauggucagcucac

SEQ ID NO: 1418790 - RNA, 20 nt, Homo sapiens
gaucggagccuccucucuca

SEQ ID NO: 1418791 - RNA, 17 nt, Homo sapiens
gaucuagcuucaugccu

SEQ ID NO: 1418792 - RNA, 22 nt, Homo sapiens
gaucuaguucucaaucacugcu

SEQ ID NO: 1418793 - RNA, 18 nt, Homo sapiens
gaucucacacaccagggc

SEQ ID NO: 1418794 - RNA, 19 nt, Homo sapiens
gaucuccaaggaccagguu

SEQ ID NO: 1418795 - RNA, 22 nt, Homo sapiens
gaugaaaaauaugugcuugaaa

SEQ ID NO: 1418796 - RNA, 20 nt, Homo sapiens
gaugaaauuuucuagacuuu

SEQ ID NO: 1418797 - RNA, 21 nt, Homo sapiens
gaugaagauucuccugugcua

SEQ ID NO: 1418798 - RNA, 20 nt, Homo sapiens
gaugaauagaugugaucacu

SEQ ID NO: 1418799 - RNA, 18 nt, Homo sapiens
gaugagcacacacacacc

SEQ ID NO: 1418800 - RNA, 19 nt, Homo sapiens
gaugcacacacagaugcac

SEQ ID NO: 1418801 - RNA, 22 nt, Homo sapiens
gaugccacuucccagaggcaga

SEQ ID NO: 1418802 - RNA, 20 nt, Homo sapiens
gauggaaaaucacaccaccu

SEQ ID NO: 1418803 - RNA, 16 nt, Homo sapiens
gauggaauaaagcccu

SEQ ID NO: 1418804 - RNA, 18 nt, Homo sapiens
gauggaauaaagcccuug

SEQ ID NO: 1418805 - RNA, 20 nt, Homo sapiens
gauggaauaaagcccuugaa

SEQ ID NO: 1418806 - RNA, 19 nt, Homo sapiens
gauggagauauuuacauga

SEQ ID NO: 1418807 - RNA, 18 nt, Homo sapiens
gauggagccagcucugca

SEQ ID NO: 1418808 - RNA, 14 nt, Homo sapiens
gauggcaccagagg

SEQ ID NO: 1418809 - RNA, 13 nt, Homo sapiens
gauggcacugcuu

SEQ ID NO: 1418810 - RNA, 19 nt, Homo sapiens
gauggcauugggcaaacag

SEQ ID NO: 1418811 - RNA, 21 nt, Homo sapiens
gauggcauuuuuugcaaguua

SEQ ID NO: 1418812 - RNA, 15 nt, Homo sapiens
gauggccaggccaga

SEQ ID NO: 1418813 - RNA, 13 nt, Homo sapiens
gauggugcugacc

SEQ ID NO: 1418814 - RNA, 16 nt, Homo sapiens
gauggugcugaccucu

SEQ ID NO: 1418815 - RNA, 20 nt, Homo sapiens
gauggugguaaacauucucu

SEQ ID NO: 1418816 - RNA, 14 nt, Homo sapiens
gauguaaaugccac

SEQ ID NO: 1418817 - RNA, 14 nt, Homo sapiens
gauguacacacaca

SEQ ID NO: 1418818 - RNA, 18 nt, Homo sapiens
gauguaggguaaggugcc

SEQ ID NO: 1418819 - RNA, 19 nt, Homo sapiens
gauguaggguaaggugccu

SEQ ID NO: 1418820 - RNA, 15 nt, Homo sapiens
gaugucaggcccaga

SEQ ID NO: 1418821 - RNA, 16 nt, Homo sapiens
gaugucauuaaugugu

SEQ ID NO: 1418822 - RNA, 23 nt, Homo sapiens
gaagccuuuuuuuaguaaauccu

SEQ ID NO: 1418823 - RNA, 15 nt, Homo sapiens
gaagcugggagcuac

SEQ ID NO: 1418824 - RNA, 19 nt, Homo sapiens
gaaggaacucuggcuucca

SEQ ID NO: 1418825 - RNA, 16 nt, Homo sapiens
gaaggacaugugcuau

SEQ ID NO: 1418826 - RNA, 20 nt, Homo sapiens
gaaggagauacucauguuga

SEQ ID NO: 1418827 - RNA, 20 nt, Homo sapiens
gaaggcaaagagaccacuca

SEQ ID NO: 1418828 - RNA, 23 nt, Homo sapiens
gaaggcaaauauaagcugggaaa

SEQ ID NO: 1418829 - RNA, 11 nt, Homo sapiens
gaaggcagcug

SEQ ID NO: 1418830 - RNA, 15 nt, Homo sapiens
gaaggccacauguca

SEQ ID NO: 1418831 - RNA, 19 nt, Homo sapiens
gaaggcuccaucuccagug

SEQ ID NO: 1418832 - RNA, 13 nt, Homo sapiens
gaaggcuguggug

SEQ ID NO: 1418833 - RNA, 20 nt, Homo sapiens
gaagggggcggccuaugacu

SEQ ID NO: 1418834 - RNA, 20 nt, Homo sapiens
gaagguuauggucaauccca

SEQ ID NO: 1418835 - RNA, 23 nt, Homo sapiens
gaaguccccaggucaugcugcug

SEQ ID NO: 1418836 - RNA, 19 nt, Homo sapiens
gaaguuaggucauuacuaa

SEQ ID NO: 1418837 - RNA, 22 nt, Homo sapiens
gaaguuauuaacgggcauguau

SEQ ID NO: 1418838 - RNA, 16 nt, Homo sapiens
gaaguuauucuugaca

SEQ ID NO: 1418839 - RNA, 16 nt, Homo sapiens
gaaguuccaguguucu

SEQ ID NO: 1418840 - RNA, 13 nt, Homo sapiens
gaaguuuggcaau

SEQ ID NO: 1418841 - RNA, 18 nt, Homo sapiens
gaauaaaauuguaaaauu

SEQ ID NO: 1418842 - RNA, 16 nt, Homo sapiens
gaauaaagcccuugaa

SEQ ID NO: 1418843 - RNA, 17 nt, Homo sapiens
gaauaaauugcuccuug

SEQ ID NO: 1418844 - RNA, 16 nt, Homo sapiens
gaauaagaauggagca

SEQ ID NO: 1418845 - RNA, 12 nt, Homo sapiens
gaauaaggagcc

SEQ ID NO: 1418846 - RNA, 21 nt, Homo sapiens
gaauacuagaaugguagcacu

SEQ ID NO: 1418847 - RNA, 13 nt, Homo sapiens
gaaucaaagacau

SEQ ID NO: 1418848 - RNA, 17 nt, Homo sapiens
gaaucugcuguugccau

SEQ ID NO: 1418849 - RNA, 16 nt, Homo sapiens
gaaucuguaucagaaa

SEQ ID NO: 1418850 - RNA, 17 nt, Homo sapiens
gaaugcacaccaaaaaa

SEQ ID NO: 1418851 - RNA, 12 nt, Homo sapiens
gaaugcagggaa

SEQ ID NO: 1418852 - RNA, 13 nt, Homo sapiens
gaaugcagggaag

SEQ ID NO: 1418853 - RNA, 15 nt, Homo sapiens
gaaugccacagugaa

SEQ ID NO: 1418854 - RNA, 14 nt, Homo sapiens
gaaugccggggaca

SEQ ID NO: 1418855 - RNA, 17 nt, Homo sapiens
gaaugccucaaugugac

SEQ ID NO: 1418856 - RNA, 24 nt, Homo sapiens
gaaugcuuaccaaguccugggaau

SEQ ID NO: 1418857 - RNA, 14 nt, Homo sapiens
gaauuauaucuaau

SEQ ID NO: 1418858 - RNA, 23 nt, Homo sapiens
gaauuaucccccaaaaugcauuu

SEQ ID NO: 1418859 - RNA, 15 nt, Homo sapiens
gaauuucuuugucau

SEQ ID NO: 1418860 - RNA, 15 nt, Homo sapiens
gaauuugggccucuu

SEQ ID NO: 1418861 - RNA, 20 nt, Homo sapiens
gacaaaccacuguacauaua

SEQ ID NO: 1418862 - RNA, 17 nt, Homo sapiens
gacaaagaaacccaagu

SEQ ID NO: 1418863 - RNA, 18 nt, Homo sapiens
gacaaaggagccugugaa

SEQ ID NO: 1418864 - RNA, 17 nt, Homo sapiens
gacaaagguuuuccucu

SEQ ID NO: 1418865 - RNA, 21 nt, Homo sapiens
gacaaagguuuuccucuucua

SEQ ID NO: 1418866 - RNA, 17 nt, Homo sapiens
gacaacugacaauauga

SEQ ID NO: 1418867 - RNA, 22 nt, Homo sapiens
gacaagcaagggcugugcugag

SEQ ID NO: 1418868 - RNA, 15 nt, Homo sapiens
gacaagcaugguccc

SEQ ID NO: 1418869 - RNA, 16 nt, Homo sapiens
gacaagggcugaccug

SEQ ID NO: 1418870 - RNA, 22 nt, Homo sapiens
gacaauccugaagaaaccacag

SEQ ID NO: 1418871 - RNA, 20 nt, Homo sapiens
gacacauucuccugugcccc

SEQ ID NO: 1418872 - RNA, 18 nt, Homo sapiens
gacccagagagcuagggc

SEQ ID NO: 1418873 - RNA, 17 nt, Homo sapiens
gaccccuacccacuucc

SEQ ID NO: 1418874 - RNA, 18 nt, Homo sapiens
gaccccugaauucaauga

SEQ ID NO: 1418875 - RNA, 23 nt, Homo sapiens
gacccuaaauguggacaucauga

SEQ ID NO: 1418876 - RNA, 21 nt, Homo sapiens
gacccuccuccacuccaccuc

SEQ ID NO: 1418877 - RNA, 20 nt, Homo sapiens
gacccucugaaugguccagg

SEQ ID NO: 1418878 - RNA, 19 nt, Homo sapiens
gaccuccagcuuuccugua

SEQ ID NO: 1418879 - RNA, 14 nt, Homo sapiens
gaccucuacugccu

SEQ ID NO: 1418880 - RNA, 16 nt, Homo sapiens
gaccugaccggcaccu

SEQ ID NO: 1418881 - RNA, 19 nt, Homo sapiens
gaccugccucucacacaca

SEQ ID NO: 1418882 - RNA, 17 nt, Homo sapiens
gaccuuccacacagggu

SEQ ID NO: 1418883 - RNA, 17 nt, Homo sapiens
gaccuuuuauccacuua

SEQ ID NO: 1418884 - RNA, 20 nt, Homo sapiens
gacgcagcccugggggccag

SEQ ID NO: 1418885 - RNA, 18 nt, Homo sapiens
gacgcagguguaccuccc

SEQ ID NO: 1418886 - RNA, 13 nt, Homo sapiens
gacggaaggcaaa

SEQ ID NO: 1418887 - RNA, 23 nt, Homo sapiens
gacggacguugguucugcacuaa

SEQ ID NO: 1418888 - RNA, 16 nt, Homo sapiens
gacggucccacacugg

SEQ ID NO: 1418889 - RNA, 21 nt, Homo sapiens
gacgguuucaaaccaggauuu

SEQ ID NO: 1418890 - RNA, 17 nt, Homo sapiens
gacgucucaagacugaa

SEQ ID NO: 1418891 - RNA, 19 nt, Homo sapiens
gacuaauagagacacagag

SEQ ID NO: 1418892 - RNA, 15 nt, Homo sapiens
gacuaaugcaugugg

SEQ ID NO: 1418893 - RNA, 19 nt, Homo sapiens
gacuacuauacaaacuaca

SEQ ID NO: 1418894 - RNA, 14 nt, Homo sapiens
gacuagaaccugga

SEQ ID NO: 1418895 - RNA, 15 nt, Homo sapiens
gacuagagcucaggc

SEQ ID NO: 1418896 - RNA, 17 nt, Homo sapiens
gacuauauacaugugug

SEQ ID NO: 1418897 - RNA, 12 nt, Homo sapiens
gacuauggagcc

SEQ ID NO: 1418898 - RNA, 14 nt, Homo sapiens
gacuauggguacau

SEQ ID NO: 1418899 - RNA, 20 nt, Homo sapiens
gacuauuucacuaauaaaca

SEQ ID NO: 1418900 - RNA, 18 nt, Homo sapiens
gacucacaagaagaccag

SEQ ID NO: 1418901 - RNA, 21 nt, Homo sapiens
gacucauuuuaaaaaauggaa

SEQ ID NO: 1418902 - RNA, 15 nt, Homo sapiens
gacuccucaaaagca

SEQ ID NO: 1418903 - RNA, 16 nt, Homo sapiens
gacuccucuaagccac

SEQ ID NO: 1418904 - RNA, 23 nt, Homo sapiens
gacugauggcgauucccucucac

SEQ ID NO: 1418905 - RNA, 23 nt, Homo sapiens
gacugauguuacaucacaguguu

SEQ ID NO: 1418906 - RNA, 17 nt, Homo sapiens
gacuggauucgugacaa

SEQ ID NO: 1418907 - RNA, 16 nt, Homo sapiens
gacugguaaguaacug

SEQ ID NO: 1418908 - RNA, 20 nt, Homo sapiens
gacugugaaaguaugugaua

SEQ ID NO: 1418909 - RNA, 15 nt, Homo sapiens
gacugugugcaacgc

SEQ ID NO: 1418910 - RNA, 13 nt, Homo sapiens
gacuguugcacuc

SEQ ID NO: 1418911 - RNA, 13 nt, Homo sapiens
gacuguugcucaa

SEQ ID NO: 1418912 - RNA, 22 nt, Homo sapiens
gacuuaaaauauuccugcauuu

SEQ ID NO: 1418913 - RNA, 13 nt, Homo sapiens
gacuucacacugc

SEQ ID NO: 1418914 - RNA, 16 nt, Homo sapiens
gacuuccuggggcccc

SEQ ID NO: 1418915 - RNA, 15 nt, Homo sapiens
gacuugauacugcaa

SEQ ID NO: 1418916 - RNA, 18 nt, Homo sapiens
gacuuugaugcauuucca

SEQ ID NO: 1418917 - RNA, 20 nt, Homo sapiens
gacuuuuuagccagugacuu

SEQ ID NO: 1418918 - RNA, 20 nt, Homo sapiens
gagaaaacuuauuugaguga

SEQ ID NO: 1418919 - RNA, 22 nt, Homo sapiens
gagaaaacuuauuugagugauu

SEQ ID NO: 1418920 - RNA, 16 nt, Homo sapiens
gagaagaccucuguga

SEQ ID NO: 1418921 - RNA, 22 nt, Homo sapiens
gagaagagcuguucacagccag

SEQ ID NO: 1418922 - RNA, 22 nt, Homo sapiens
gagaagaugugauuuauuuuga

SEQ ID NO: 1418923 - RNA, 14 nt, Homo sapiens
gagaagcagugagc

SEQ ID NO: 1418924 - RNA, 22 nt, Homo sapiens
cccgggacagggucuugcaagc

SEQ ID NO: 1418925 - RNA, 21 nt, Homo sapiens
cccgggguggccacaccacag

SEQ ID NO: 1418926 - RNA, 21 nt, Homo sapiens
cccuaauaaguccacaucuuc

SEQ ID NO: 1418927 - RNA, 15 nt, Homo sapiens
cccuacccucacuca

SEQ ID NO: 1418928 - RNA, 13 nt, Homo sapiens
cccuacugagaaa

SEQ ID NO: 1418929 - RNA, 13 nt, Homo sapiens
cccuagcagugaa

SEQ ID NO: 1418930 - RNA, 13 nt, Homo sapiens
cccuauuaaccua

SEQ ID NO: 1418931 - RNA, 12 nt, Homo sapiens
cccuauuacuug

SEQ ID NO: 1418932 - RNA, 14 nt, Homo sapiens
cccuauuacuuguu

SEQ ID NO: 1418933 - RNA, 13 nt, Homo sapiens
cccucaaaagcac

SEQ ID NO: 1418934 - RNA, 22 nt, Homo sapiens
cccucacuccugccaguugaaa

SEQ ID NO: 1418935 - RNA, 19 nt, Homo sapiens
cccucauccuuuuacuuuu

SEQ ID NO: 1418936 - RNA, 16 nt, Homo sapiens
cccucauuaugacucu

SEQ ID NO: 1418937 - RNA, 17 nt, Homo sapiens
cccucccuggcauguca

SEQ ID NO: 1418938 - RNA, 16 nt, Homo sapiens
cccucccugugugaaa

SEQ ID NO: 1418939 - RNA, 17 nt, Homo sapiens
cccuccuaaccuagaga

SEQ ID NO: 1418940 - RNA, 19 nt, Homo sapiens
cccucuuucuacauucuca

SEQ ID NO: 1418941 - RNA, 13 nt, Homo sapiens
cccugacauuucu

SEQ ID NO: 1418942 - RNA, 11 nt, Homo sapiens
cccugaccucc

SEQ ID NO: 1418943 - RNA, 22 nt, Homo sapiens
cccugagagcucacaguacaau

SEQ ID NO: 1418944 - RNA, 14 nt, Homo sapiens
cccugcacaaagcc

SEQ ID NO: 1418945 - RNA, 18 nt, Homo sapiens
cccugcagggccaagcac

SEQ ID NO: 1418946 - RNA, 14 nt, Homo sapiens
cccugcuuaccuga

SEQ ID NO: 1418947 - RNA, 20 nt, Homo sapiens
cccuggcugaccccaaagag

SEQ ID NO: 1418948 - RNA, 19 nt, Homo sapiens
cccugggccccaccaccua

SEQ ID NO: 1418949 - RNA, 17 nt, Homo sapiens
cccugggcuugugaaca

SEQ ID NO: 1418950 - RNA, 16 nt, Homo sapiens
cccuggugucaggcag

SEQ ID NO: 1418951 - RNA, 14 nt, Homo sapiens
cccuguaugauucc

SEQ ID NO: 1418952 - RNA, 21 nt, Homo sapiens
cccugucccaccaacucugca

SEQ ID NO: 1418953 - RNA, 18 nt, Homo sapiens
cccugucucuacuaaaaa

SEQ ID NO: 1418954 - RNA, 15 nt, Homo sapiens
cccugucucuagcca

SEQ ID NO: 1418955 - RNA, 18 nt, Homo sapiens
cccugucucuagccacuu

SEQ ID NO: 1418956 - RNA, 18 nt, Homo sapiens
cccuguggggccugaugg

SEQ ID NO: 1418957 - RNA, 16 nt, Homo sapiens
cccuuauuuucaagaa

SEQ ID NO: 1418958 - RNA, 21 nt, Homo sapiens
cccuuccaugucgccucugca

SEQ ID NO: 1418959 - RNA, 10 nt, Homo sapiens
cccuuccuuu

SEQ ID NO: 1418960 - RNA, 18 nt, Homo sapiens
cccuucuuuacuagauau

SEQ ID NO: 1418961 - RNA, 12 nt, Homo sapiens
cccuugcauuag

SEQ ID NO: 1418962 - RNA, 19 nt, Homo sapiens
cccuuuccuacucucagga

SEQ ID NO: 1418963 - RNA, 17 nt, Homo sapiens
ccgacuccucaaaagca

SEQ ID NO: 1418964 - RNA, 21 nt, Homo sapiens
ccgacugcuagggaguggucu

SEQ ID NO: 1418965 - RNA, 19 nt, Homo sapiens
ccgacugugaaaguaugug

SEQ ID NO: 1418966 - RNA, 19 nt, Homo sapiens
ccgagaaaacaaacccagg

SEQ ID NO: 1418967 - RNA, 17 nt, Homo sapiens
ccgauguacacacacag

SEQ ID NO: 1418968 - RNA, 19 nt, Homo sapiens
ccgaugugcgcacacacag

SEQ ID NO: 1418969 - RNA, 20 nt, Homo sapiens
ccgaugugcgcacacacaga

SEQ ID NO: 1418970 - RNA, 22 nt, Homo sapiens
ccgcacuuggaaagguuucaag

SEQ ID NO: 1418971 - RNA, 18 nt, Homo sapiens
ccgcagugggaagugaau

SEQ ID NO: 1418972 - RNA, 12 nt, Homo sapiens
ccgccuggagau

SEQ ID NO: 1418973 - RNA, 14 nt, Homo sapiens
ccgcgccaacgcac

SEQ ID NO: 1418974 - RNA, 14 nt, Homo sapiens
ccgcucuggaccaa

SEQ ID NO: 1418975 - RNA, 11 nt, Homo sapiens
ccgcugcugag

SEQ ID NO: 1418976 - RNA, 15 nt, Homo sapiens
ccggcugacaccugg

SEQ ID NO: 1418977 - RNA, 16 nt, Homo sapiens
ccgggcccgggcacug

SEQ ID NO: 1418978 - RNA, 15 nt, Homo sapiens
ccggggaacuggcca

SEQ ID NO: 1418979 - RNA, 13 nt, Homo sapiens
ccgggugccauuc

SEQ ID NO: 1418980 - RNA, 15 nt, Homo sapiens
ccgugcuaacugugu

SEQ ID NO: 1418981 - RNA, 12 nt, Homo sapiens
ccguggaaccag

SEQ ID NO: 1418982 - RNA, 19 nt, Homo sapiens
ccguuuuaaggacauuaaa

SEQ ID NO: 1418983 - RNA, 20 nt, Homo sapiens
ccguuuuuacuaaguaaaag

SEQ ID NO: 1418984 - RNA, 22 nt, Homo sapiens
ccuaaaucuuccagcaugcauc

SEQ ID NO: 1418985 - RNA, 13 nt, Homo sapiens
ccuaaauuucagu

SEQ ID NO: 1418986 - RNA, 19 nt, Homo sapiens
ccuaacaggcuaguucuaa

SEQ ID NO: 1418987 - RNA, 16 nt, Homo sapiens
ccuaaccaaaugcugu

SEQ ID NO: 1418988 - RNA, 21 nt, Homo sapiens
ccuaaccaaaugcugucucca

SEQ ID NO: 1418989 - RNA, 14 nt, Homo sapiens
ccuaaccuagagau

SEQ ID NO: 1418990 - RNA, 14 nt, Homo sapiens
ccuaagaggcagug

SEQ ID NO: 1418991 - RNA, 21 nt, Homo sapiens
ccuaagaucaaaccccaugga

SEQ ID NO: 1418992 - RNA, 18 nt, Homo sapiens
ccuaaggaucucucagga

SEQ ID NO: 1418993 - RNA, 13 nt, Homo sapiens
ccuaauacaacau

SEQ ID NO: 1418994 - RNA, 16 nt, Homo sapiens
ccuaauaugcuuuaca

SEQ ID NO: 1418995 - RNA, 17 nt, Homo sapiens
ccuaaugcuaguuucau

SEQ ID NO: 1418996 - RNA, 18 nt, Homo sapiens
ccuacaaaauggagggag

SEQ ID NO: 1418997 - RNA, 15 nt, Homo sapiens
ccuacagauagucaa

SEQ ID NO: 1418998 - RNA, 19 nt, Homo sapiens
ccuacccucccagcgaguu

SEQ ID NO: 1418999 - RNA, 21 nt, Homo sapiens
ccuacugccucuccagcacuu

SEQ ID NO: 1419000 - RNA, 16 nt, Homo sapiens
ccuacuucuuuugcuc

SEQ ID NO: 1419001 - RNA, 23 nt, Homo sapiens
ccuagcaaggcaugauguuaacc

SEQ ID NO: 1419002 - RNA, 11 nt, Homo sapiens
ccuaggcaaag

SEQ ID NO: 1419003 - RNA, 21 nt, Homo sapiens
ccuaguuugaccucacaguga

SEQ ID NO: 1419004 - RNA, 22 nt, Homo sapiens
ucaaucugagaagacaauaugu

SEQ ID NO: 1419005 - RNA, 19 nt, Homo sapiens
ucaaugaaaacugaaucaa

SEQ ID NO: 1419006 - RNA, 18 nt, Homo sapiens
ucagguauagcugacauc

SEQ ID NO: 1419007 - RNA, 20 nt, Homo sapiens
ucaguaaauauuaaccugaa

SEQ ID NO: 1419008 - RNA, 22 nt, Homo sapiens
ucaguaguauucuaaagcuuuc

SEQ ID NO: 1419009 - RNA, 18 nt, Homo sapiens
ucaguauaaaagacaaaa

SEQ ID NO: 1419010 - RNA, 19 nt, Homo sapiens
uccucagguaguacuggga

SEQ ID NO: 1419011 - RNA, 16 nt, Homo sapiens
uccuccacucacucca

SEQ ID NO: 1419012 - RNA, 18 nt, Homo sapiens
uccuccacuccaccucca

SEQ ID NO: 1419013 - RNA, 17 nt, Homo sapiens
uccuccccuccuggcac

SEQ ID NO: 1419014 - RNA, 21 nt, Homo sapiens
uccuccccuccuggcacccac

SEQ ID NO: 1419015 - RNA, 16 nt, Homo sapiens
uccucccucacaugau

SEQ ID NO: 1419016 - RNA, 15 nt, Homo sapiens
uccucccucauucca

SEQ ID NO: 1419017 - RNA, 20 nt, Homo sapiens
uccucccuccccgcccucac

SEQ ID NO: 1419018 - RNA, 16 nt, Homo sapiens
uuaaaaaacguauuau

SEQ ID NO: 1419019 - RNA, 11 nt, Homo sapiens
uuaaaaaccac

SEQ ID NO: 1419020 - RNA, 18 nt, Homo sapiens
uuaaaaaguucauaacag

SEQ ID NO: 1419021 - RNA, 17 nt, Homo sapiens
uuaaaacauaagaacgu

SEQ ID NO: 1419022 - RNA, 24 nt, Homo sapiens
uuaaaacuaaaaaggaccagagaa

SEQ ID NO: 1419023 - RNA, 17 nt, Homo sapiens
uuaaaagaagacuggaa

SEQ ID NO: 1419024 - RNA, 19 nt, Homo sapiens
uuaaaaguugugauuccag

SEQ ID NO: 1419025 - RNA, 21 nt, Homo sapiens
uuaaaaucauucaauaucuga

SEQ ID NO: 1419026 - RNA, 11 nt, Homo sapiens
uuaaaccugga

SEQ ID NO: 1419027 - RNA, 13 nt, Homo sapiens
uuaaaggaccuuc

SEQ ID NO: 1419028 - RNA, 23 nt, Homo sapiens
uuaaaggagaaguagcugugaac

SEQ ID NO: 1419029 - RNA, 13 nt, Homo sapiens
uuaaaguaccugu

SEQ ID NO: 1419030 - RNA, 18 nt, Homo sapiens
uuaaagucaacaaccaug

SEQ ID NO: 1419031 - RNA, 17 nt, Homo sapiens
uuaaaguguaauaauau

SEQ ID NO: 1419032 - RNA, 21 nt, Homo sapiens
uuaaaugguguuuuauuacaa

SEQ ID NO: 1419033 - RNA, 14 nt, Homo sapiens
uuaaauguuuuaca

SEQ ID NO: 1419034 - RNA, 17 nt, Homo sapiens
uuaaauucaagcugcuu

SEQ ID NO: 1419035 - RNA, 15 nt, Homo sapiens
uuaacagaaccagag

SEQ ID NO: 1419036 - RNA, 21 nt, Homo sapiens
uuaaccugaauuauuccaacu

SEQ ID NO: 1419037 - RNA, 22 nt, Homo sapiens
uuaacuggcuucagccucccca

SEQ ID NO: 1419038 - RNA, 15 nt, Homo sapiens
uuaacuugaggguaa

SEQ ID NO: 1419039 - RNA, 17 nt, Homo sapiens
uuaagcaaaggaaacca

SEQ ID NO: 1419040 - RNA, 14 nt, Homo sapiens
uuaagcaacacaag

SEQ ID NO: 1419041 - RNA, 21 nt, Homo sapiens
uuaagguuuuacuuuucugaa

SEQ ID NO: 1419042 - RNA, 16 nt, Homo sapiens
uuaaguaaaccaaaaa

SEQ ID NO: 1419043 - RNA, 20 nt, Homo sapiens
uuaaguuauugauguuuuaa

SEQ ID NO: 1419044 - RNA, 21 nt, Homo sapiens
uuaauaagaaacaugauguga

SEQ ID NO: 1419045 - RNA, 23 nt, Homo sapiens
uuaauaugcuguggggcauagaa

SEQ ID NO: 1419046 - RNA, 21 nt, Homo sapiens
uuaugucuauuuaagccucau

SEQ ID NO: 1419047 - RNA, 13 nt, Homo sapiens
uuauuccaacucc

SEQ ID NO: 1419048 - RNA, 14 nt, Homo sapiens
uuauuccuccagga

SEQ ID NO: 1419049 - RNA, 15 nt, Homo sapiens
uuauuccuccaggaa

SEQ ID NO: 1419050 - RNA, 15 nt, Homo sapiens
uuauuccuuugcaua

SEQ ID NO: 1419051 - RNA, 14 nt, Homo sapiens
uuauugugccucag

SEQ ID NO: 1419052 - RNA, 13 nt, Homo sapiens
uucaaaccaggau

SEQ ID NO: 1419053 - RNA, 18 nt, Homo sapiens
uucaaacugcaugauuca

SEQ ID NO: 1419054 - RNA, 22 nt, Homo sapiens
uucaaagacagagaagaccaaa

SEQ ID NO: 1419055 - RNA, 19 nt, Homo sapiens
uucaaauuuuuacugagaa

SEQ ID NO: 1419056 - RNA, 21 nt, Homo sapiens
uucaaggcauuucuaucacau

SEQ ID NO: 1419057 - RNA, 23 nt, Homo sapiens
uucaaggcauuucuaucacauau

SEQ ID NO: 1419058 - RNA, 18 nt, Homo sapiens
uucaaguauuagggguaa

SEQ ID NO: 1419059 - RNA, 22 nt, Homo sapiens
uucaagugauauauguauuuau

SEQ ID NO: 1419060 - RNA, 20 nt, Homo sapiens
uucacaaaaaggcauaugca

SEQ ID NO: 1419061 - RNA, 15 nt, Homo sapiens
uucacaaugaaaugc

SEQ ID NO: 1419062 - RNA, 15 nt, Homo sapiens
uucacagccaggaga

SEQ ID NO: 1419063 - RNA, 14 nt, Homo sapiens
uucacagugaccau

SEQ ID NO: 1419064 - RNA, 19 nt, Homo sapiens
uucacauaguuuauuucaa

SEQ ID NO: 1419065 - RNA, 14 nt, Homo sapiens
uucacaucacugau

SEQ ID NO: 1419066 - RNA, 14 nt, Homo sapiens
uucaccugaucaua

SEQ ID NO: 1419067 - RNA, 21 nt, Homo sapiens
uucacuaauaaacauuuggca

SEQ ID NO: 1419068 - RNA, 15 nt, Homo sapiens
uucagaagacacugc

SEQ ID NO: 1419069 - RNA, 23 nt, Homo sapiens
uucagaguugcuuuaaaguaccu

SEQ ID NO: 1419070 - RNA, 19 nt, Homo sapiens
uucagauauauuuuucaca

SEQ ID NO: 1419071 - RNA, 22 nt, Homo sapiens
uucagauggaggugccauauca

SEQ ID NO: 1419072 - RNA, 20 nt, Homo sapiens
uucagcacccugggugccau

SEQ ID NO: 1419073 - RNA, 19 nt, Homo sapiens
uucagccauugcccuguga

SEQ ID NO: 1419074 - RNA, 19 nt, Homo sapiens
uucagccccuagugcuauu

SEQ ID NO: 1419075 - RNA, 18 nt, Homo sapiens
uucagguacuaaauaccu

SEQ ID NO: 1419076 - RNA, 16 nt, Homo sapiens
ccugcuagcuguagaa

SEQ ID NO: 1419077 - RNA, 13 nt, Homo sapiens
ccugcugagcucu

SEQ ID NO: 1419078 - RNA, 15 nt, Homo sapiens
ccugcugagcucuga

SEQ ID NO: 1419079 - RNA, 15 nt, Homo sapiens
ccugcugcucaucca

SEQ ID NO: 1419080 - RNA, 19 nt, Homo sapiens
ccugcugcugaccugauca

SEQ ID NO: 1419081 - RNA, 21 nt, Homo sapiens
ccugcugcuguguuuuugcua

SEQ ID NO: 1419082 - RNA, 14 nt, Homo sapiens
ccugcuuaccugac

SEQ ID NO: 1419083 - RNA, 16 nt, Homo sapiens
ccugcuugcacuuugu

SEQ ID NO: 1419084 - RNA, 21 nt, Homo sapiens
cugccagagcccaagugccau

SEQ ID NO: 1419085 - RNA, 20 nt, Homo sapiens
cugccagugccuuaccuccu

SEQ ID NO: 1419086 - RNA, 19 nt, Homo sapiens
cugcccccagccaugguga

SEQ ID NO: 1419087 - RNA, 23 nt, Homo sapiens
cugccuccauucugaccauuuca

SEQ ID NO: 1419088 - RNA, 23 nt, Homo sapiens
cugccuggguuuucuaacuguaa

SEQ ID NO: 1419089 - RNA, 13 nt, Homo sapiens
cugccuugccaug

SEQ ID NO: 1419090 - RNA, 19 nt, Homo sapiens
cugccuuggacaacuuuuc

SEQ ID NO: 1419091 - RNA, 18 nt, Homo sapiens
cugccuuuuuuaacacua

SEQ ID NO: 1419092 - RNA, 20 nt, Homo sapiens
cugcuacacaaaagccaaaa

SEQ ID NO: 1419093 - RNA, 21 nt, Homo sapiens
cugcuagauaucacuuacuca

SEQ ID NO: 1419094 - RNA, 24 nt, Homo sapiens
cugcuauaugccuuaagccaauau

SEQ ID NO: 1419095 - RNA, 13 nt, Homo sapiens
cugcucaaguuga

SEQ ID NO: 1419096 - RNA, 19 nt, Homo sapiens
cugcucacuguucuaucuc

SEQ ID NO: 1419097 - RNA, 20 nt, Homo sapiens
cugcucauaacaucuuugaa

SEQ ID NO: 1419098 - RNA, 14 nt, Homo sapiens
cugcuccgagucuu

SEQ ID NO: 1419099 - RNA, 12 nt, Homo sapiens
cugcucucaugc

SEQ ID NO: 1419100 - RNA, 18 nt, Homo sapiens
cugcucugcccacuguga

SEQ ID NO: 1419101 - RNA, 12 nt, Homo sapiens
cugcucugcuau

SEQ ID NO: 1419102 - RNA, 19 nt, Homo sapiens
cugcugagcugcgugccac

SEQ ID NO: 1419103 - RNA, 13 nt, Homo sapiens
cugcugcugagaa

SEQ ID NO: 1419104 - RNA, 12 nt, Homo sapiens
cugcugcugcua

SEQ ID NO: 1419105 - RNA, 21 nt, Homo sapiens
cugcugugcccucccauagca

SEQ ID NO: 1419106 - RNA, 21 nt, Homo sapiens
cugcuuccuccccuccuggca

SEQ ID NO: 1419107 - RNA, 21 nt, Homo sapiens
cugcuuguccugcucucuuca

SEQ ID NO: 1419108 - RNA, 19 nt, Homo sapiens
cugcuuuucugaggacuca

SEQ ID NO: 1419109 - RNA, 19 nt, Homo sapiens
cugcuuuuugacaugaaca

SEQ ID NO: 1419110 - RNA, 22 nt, Homo sapiens
cuggaagaaggaagaagccaga

SEQ ID NO: 1419111 - RNA, 15 nt, Homo sapiens
cuggaagccaaacaa

SEQ ID NO: 1419112 - RNA, 17 nt, Homo sapiens
cuggaaggggcaaagaa

SEQ ID NO: 1419113 - RNA, 14 nt, Homo sapiens
cuggaauacaugaa

SEQ ID NO: 1419114 - RNA, 14 nt, Homo sapiens
cuggaccagccugu

SEQ ID NO: 1419115 - RNA, 21 nt, Homo sapiens
cuggacuggguuuugucucug

SEQ ID NO: 1419116 - RNA, 11 nt, Homo sapiens
cuggacuguca

SEQ ID NO: 1419117 - RNA, 20 nt, Homo sapiens
cuggagaacuagagaaggac

SEQ ID NO: 1419118 - RNA, 20 nt, Homo sapiens
cuggagaccgcuucaccccu

SEQ ID NO: 1419119 - RNA, 14 nt, Homo sapiens
cuggagaugaugau

SEQ ID NO: 1419120 - RNA, 16 nt, Homo sapiens
cuggagaugaugauga

SEQ ID NO: 1419121 - RNA, 17 nt, Homo sapiens
cuggagcaaaagucauu

SEQ ID NO: 1419122 - RNA, 18 nt, Homo sapiens
cuggagcaucugacucac

SEQ ID NO: 1419123 - RNA, 15 nt, Homo sapiens
cuggagggacaggga

SEQ ID NO: 1419124 - RNA, 12 nt, Homo sapiens
cuggagggcuag

SEQ ID NO: 1419125 - RNA, 21 nt, Homo sapiens
cuggagggcuugguaaaacac

SEQ ID NO: 1419126 - RNA, 16 nt, Homo sapiens
cuggaggucacauuca

SEQ ID NO: 1419127 - RNA, 12 nt, Homo sapiens
cuggagugcagu

SEQ ID NO: 1419128 - RNA, 19 nt, Homo sapiens
cuggauaccagauauuuga

SEQ ID NO: 1419129 - RNA, 12 nt, Homo sapiens
cuggaugcgugc

SEQ ID NO: 1419130 - RNA, 17 nt, Homo sapiens
cuggauggcaccagagg

SEQ ID NO: 1419131 - RNA, 15 nt, Homo sapiens
cuggauucacucacu

SEQ ID NO: 1419132 - RNA, 19 nt, Homo sapiens
cuggcaauguuuauuucau

SEQ ID NO: 1419133 - RNA, 19 nt, Homo sapiens
cuggcacuuagcccaagag

SEQ ID NO: 1419134 - RNA, 19 nt, Homo sapiens
cuggcaguugaauggggcg

SEQ ID NO: 1419135 - RNA, 12 nt, Homo sapiens
cuggccacugcu

SEQ ID NO: 1419136 - RNA, 18 nt, Homo sapiens
cuggcugagcugaaccca

SEQ ID NO: 1419137 - RNA, 14 nt, Homo sapiens
cuggcugaggggcu

SEQ ID NO: 1419138 - RNA, 14 nt, Homo sapiens
cuggcugucuuccc

SEQ ID NO: 1419139 - RNA, 21 nt, Homo sapiens
cuggcuucucuuucucugagu

SEQ ID NO: 1419140 - RNA, 23 nt, Homo sapiens
cuggcuucuguugcgccacugag

SEQ ID NO: 1419141 - RNA, 17 nt, Homo sapiens
cuggcuuuacauuuuau

SEQ ID NO: 1419142 - RNA, 13 nt, Homo sapiens
cuggcuuugcaag

SEQ ID NO: 1419143 - RNA, 16 nt, Homo sapiens
cugggaaaacagagga

SEQ ID NO: 1419144 - RNA, 18 nt, Homo sapiens
cugggaaaggaaaaccag

SEQ ID NO: 1419145 - RNA, 13 nt, Homo sapiens
cugggaacaugua

SEQ ID NO: 1419146 - RNA, 12 nt, Homo sapiens
cugggaacuggu

SEQ ID NO: 1419147 - RNA, 13 nt, Homo sapiens
cugggacuuucac

SEQ ID NO: 1419148 - RNA, 17 nt, Homo sapiens
cugggcaccucuagugc

SEQ ID NO: 1419149 - RNA, 15 nt, Homo sapiens
cugggccaguuccuc

SEQ ID NO: 1419150 - RNA, 16 nt, Homo sapiens
cugggccccaccaccu

SEQ ID NO: 1419151 - RNA, 19 nt, Homo sapiens
cugggccccaugcucugcc

SEQ ID NO: 1419152 - RNA, 18 nt, Homo sapiens
cugggccugcuuuuccag

SEQ ID NO: 1419153 - RNA, 16 nt, Homo sapiens
cugggccugugcagca

SEQ ID NO: 1419154 - RNA, 21 nt, Homo sapiens
cugggccuuuccugugccaac

SEQ ID NO: 1419155 - RNA, 16 nt, Homo sapiens
cugggcuagggagaau

SEQ ID NO: 1419156 - RNA, 12 nt, Homo sapiens
cugggcucucca

SEQ ID NO: 1419157 - RNA, 17 nt, Homo sapiens
cuggggaacuagaggga

SEQ ID NO: 1419158 - RNA, 19 nt, Homo sapiens
cuggggcugagggcauuaa

SEQ ID NO: 1419159 - RNA, 14 nt, Homo sapiens
cugggggugggggc

SEQ ID NO: 1419160 - RNA, 19 nt, Homo sapiens
cuggguaacugucaaguca

SEQ ID NO: 1419161 - RNA, 18 nt, Homo sapiens
cugggucaagggccaguc

SEQ ID NO: 1419162 - RNA, 19 nt, Homo sapiens
cuggguggccucgggacac

SEQ ID NO: 1419163 - RNA, 23 nt, Homo sapiens
cuggguggcuacucugugccaga

SEQ ID NO: 1419164 - RNA, 20 nt, Homo sapiens
cuggucccccacgugugaag

SEQ ID NO: 1419165 - RNA, 14 nt, Homo sapiens
cuggucugaaaaug

SEQ ID NO: 1419166 - RNA, 16 nt, Homo sapiens
cuggucuucacugcca

SEQ ID NO: 1419167 - RNA, 13 nt, Homo sapiens
cuggucuugugga

SEQ ID NO: 1419168 - RNA, 17 nt, Homo sapiens
cuggugaugcccaaaga

SEQ ID NO: 1419169 - RNA, 19 nt, Homo sapiens
cugguggcccgacagccug

SEQ ID NO: 1419170 - RNA, 18 nt, Homo sapiens
cugguggggcagcuccuc

SEQ ID NO: 1419171 - RNA, 22 nt, Homo sapiens
cuuaguccgcaaguucagggaa

SEQ ID NO: 1419172 - RNA, 13 nt, Homo sapiens
cuuaguggcuuuu

SEQ ID NO: 1419173 - RNA, 18 nt, Homo sapiens
cuuauaaagcauugcaac

SEQ ID NO: 1419174 - RNA, 13 nt, Homo sapiens
cuuauaccaaagg

SEQ ID NO: 1419175 - RNA, 17 nt, Homo sapiens
cuuauaucaucagcaua

SEQ ID NO: 1419176 - RNA, 21 nt, Homo sapiens
cuuauuggccacugggucuca

SEQ ID NO: 1419177 - RNA, 14 nt, Homo sapiens
cuuauuucccucau

SEQ ID NO: 1419178 - RNA, 23 nt, Homo sapiens
cuucagaagacacugcaaaggcg

SEQ ID NO: 1419179 - RNA, 15 nt, Homo sapiens
cuucagaccugacac

SEQ ID NO: 1419180 - RNA, 20 nt, Homo sapiens
cuucagccccuagugcuauu

SEQ ID NO: 1419181 - RNA, 19 nt, Homo sapiens
cuucagggugagugaaugg

SEQ ID NO: 1419182 - RNA, 13 nt, Homo sapiens
cuucaggugcuuu

SEQ ID NO: 1419183 - RNA, 14 nt, Homo sapiens
cuucagguggaaaa

SEQ ID NO: 1419184 - RNA, 23 nt, Homo sapiens
cuucauauguuggguaagaaaca

SEQ ID NO: 1419185 - RNA, 14 nt, Homo sapiens
cuucauccaugucc

SEQ ID NO: 1419186 - RNA, 20 nt, Homo sapiens
cuucaucgaacaaacugaug

SEQ ID NO: 1419187 - RNA, 23 nt, Homo sapiens
cuuccaaccccuuuccacgagcu

SEQ ID NO: 1419188 - RNA, 15 nt, Homo sapiens
cuuccacacagggug

SEQ ID NO: 1419189 - RNA, 15 nt, Homo sapiens
cuuccagguacugau

SEQ ID NO: 1419190 - RNA, 19 nt, Homo sapiens
cuuccagguaucuccagga

SEQ ID NO: 1419191 - RNA, 16 nt, Homo sapiens
cuucccaccucagugc

SEQ ID NO: 1419192 - RNA, 18 nt, Homo sapiens
cuucccagaggccaggaa

SEQ ID NO: 1419193 - RNA, 22 nt, Homo sapiens
cuucccaggaucccucccagau

SEQ ID NO: 1419194 - RNA, 13 nt, Homo sapiens
cuucccugcauuu

SEQ ID NO: 1419195 - RNA, 18 nt, Homo sapiens
cuucccuguccaccucac

SEQ ID NO: 1419196 - RNA, 14 nt, Homo sapiens
cuuccgugcugaac

SEQ ID NO: 1419197 - RNA, 22 nt, Homo sapiens
cuuccgugugucaucaggguug

SEQ ID NO: 1419198 - RNA, 14 nt, Homo sapiens
cuuccuaccaaaua

SEQ ID NO: 1419199 - RNA, 14 nt, Homo sapiens
cuuccuggguccug

SEQ ID NO: 1419200 - RNA, 12 nt, Homo sapiens
cuuccuguaaca

SEQ ID NO: 1419201 - RNA, 16 nt, Homo sapiens
cuuccugugacuucag

SEQ ID NO: 1419202 - RNA, 20 nt, Homo sapiens
cuuccuuaauucacucccac

SEQ ID NO: 1419203 - RNA, 15 nt, Homo sapiens
cuuccuuacccaaac

SEQ ID NO: 1419204 - RNA, 19 nt, Homo sapiens
cuuccuuucuuucucucuc

SEQ ID NO: 1419205 - RNA, 18 nt, Homo sapiens
cuucgacccuuucucuga

SEQ ID NO: 1419206 - RNA, 11 nt, Homo sapiens
cuucgcugcca

SEQ ID NO: 1419207 - RNA, 23 nt, Homo sapiens
cuucgcugccaggacaccugccc

SEQ ID NO: 1419208 - RNA, 20 nt, Homo sapiens
cuucuaugguugacauugua

SEQ ID NO: 1419209 - RNA, 11 nt, Homo sapiens
cuucucagugu

SEQ ID NO: 1419210 - RNA, 16 nt, Homo sapiens
cuucuccuaugcauuu

SEQ ID NO: 1419211 - RNA, 22 nt, Homo sapiens
cuucucuugggaacuccacucu

SEQ ID NO: 1419212 - RNA, 19 nt, Homo sapiens
cuucuggaggacacacagu

SEQ ID NO: 1419213 - RNA, 14 nt, Homo sapiens
cuucugggccucca

SEQ ID NO: 1419214 - RNA, 14 nt, Homo sapiens
cuucuguccaggac

SEQ ID NO: 1419215 - RNA, 15 nt, Homo sapiens
cuucugucugcagug

SEQ ID NO: 1419216 - RNA, 16 nt, Homo sapiens
cuucuugaaacagccu

SEQ ID NO: 1419217 - RNA, 16 nt, Homo sapiens
cuucuuuaucugugau

SEQ ID NO: 1419218 - RNA, 16 nt, Homo sapiens
cuugaaguaaccuuau

SEQ ID NO: 1419219 - RNA, 13 nt, Homo sapiens
cuugaaucuguua

SEQ ID NO: 1419220 - RNA, 15 nt, Homo sapiens
cuugacuaucacaua

SEQ ID NO: 1419221 - RNA, 18 nt, Homo sapiens
cuugacuaucacauacaa

SEQ ID NO: 1419222 - RNA, 21 nt, Homo sapiens
cuugagcagaccgugauuugg

SEQ ID NO: 1419223 - RNA, 21 nt, Homo sapiens
cuugaggauuuugaguaucuc

SEQ ID NO: 1419224 - RNA, 17 nt, Homo sapiens
cuugagguggugccuuc

SEQ ID NO: 1419225 - RNA, 16 nt, Homo sapiens
cuugauucacaaugaa

SEQ ID NO: 1419226 - RNA, 15 nt, Homo sapiens
cuugccaaauuccau

SEQ ID NO: 1419227 - RNA, 17 nt, Homo sapiens
cuugccucucucaggag

SEQ ID NO: 1419228 - RNA, 17 nt, Homo sapiens
cuugccuguaaucccag

SEQ ID NO: 1419229 - RNA, 16 nt, Homo sapiens
cuugcuggacggggac

SEQ ID NO: 1419230 - RNA, 16 nt, Homo sapiens
cuuggaaaaagaaaga

SEQ ID NO: 1419231 - RNA, 19 nt, Homo sapiens
cuuggcaaauuccuaguca

SEQ ID NO: 1419232 - RNA, 14 nt, Homo sapiens
cuuggcaguauucc

SEQ ID NO: 1419233 - RNA, 22 nt, Homo sapiens
cuuggcaguauuccaugggaug

SEQ ID NO: 1419234 - RNA, 15 nt, Homo sapiens
cuuggccucccaagg

SEQ ID NO: 1419235 - RNA, 15 nt, Homo sapiens
cuugggaacuccacu

SEQ ID NO: 1419236 - RNA, 16 nt, Homo sapiens
cuugggcuacuggcag

SEQ ID NO: 1419237 - RNA, 19 nt, Homo sapiens
cuugggcuacuggcagcuc

SEQ ID NO: 1419238 - RNA, 23 nt, Homo sapiens
cuugggggaggaggaacaaauaa

SEQ ID NO: 1419239 - RNA, 18 nt, Homo sapiens
cuugggguucccccagac

SEQ ID NO: 1419240 - RNA, 15 nt, Homo sapiens
cuugguaaauuguaa

SEQ ID NO: 1419241 - RNA, 20 nt, Homo sapiens
cuugguuacuuaagaggcag

SEQ ID NO: 1419242 - RNA, 21 nt, Homo sapiens
cuugguuuuuggcucuuucag

SEQ ID NO: 1419243 - RNA, 17 nt, Homo sapiens
cuuguagccagccgggg

SEQ ID NO: 1419244 - RNA, 16 nt, Homo sapiens
cuuguauaguguaaaa

SEQ ID NO: 1419245 - RNA, 15 nt, Homo sapiens
cuuguauauacauau

SEQ ID NO: 1419246 - RNA, 20 nt, Homo sapiens
cuugucauggaaaauguccu

SEQ ID NO: 1419247 - RNA, 15 nt, Homo sapiens
cuuguccaugugguu

SEQ ID NO: 1419248 - RNA, 21 nt, Homo sapiens
cuuguccccgggguauuagca

SEQ ID NO: 1419249 - RNA, 17 nt, Homo sapiens
cuugucccugcccagaa

SEQ ID NO: 1419250 - RNA, 15 nt, Homo sapiens
cuugucuccauuugg

SEQ ID NO: 1419251 - RNA, 16 nt, Homo sapiens
cuugugauucugggau

SEQ ID NO: 1419252 - RNA, 15 nt, Homo sapiens
cuuguuaccuuuccc

SEQ ID NO: 1419253 - RNA, 22 nt, Homo sapiens
cuuguucugucaccaauguacc

SEQ ID NO: 1419254 - RNA, 22 nt, Homo sapiens
cuuguuggauuccagugcaggu

SEQ ID NO: 1419255 - RNA, 19 nt, Homo sapiens
cuuguuuuaaguugcuuua

SEQ ID NO: 1419256 - RNA, 18 nt, Homo sapiens
cuuuaaauuucaucucag

SEQ ID NO: 1419257 - RNA, 13 nt, Homo sapiens
cuuuaaccucauc

SEQ ID NO: 1419258 - RNA, 20 nt, Homo sapiens
uaaggagaggagaaacugag

SEQ ID NO: 1419259 - RNA, 15 nt, Homo sapiens
uaaggcauauacaaa

SEQ ID NO: 1419260 - RNA, 16 nt, Homo sapiens
uaagggaaacugccag

SEQ ID NO: 1419261 - RNA, 20 nt, Homo sapiens
uaagggaaggaacucuggcu

SEQ ID NO: 1419262 - RNA, 15 nt, Homo sapiens
uaaggggaugggggu

SEQ ID NO: 1419263 - RNA, 16 nt, Homo sapiens
uaagguggguccagga

SEQ ID NO: 1419264 - RNA, 20 nt, Homo sapiens
uaaguaccccugauaagcaa

SEQ ID NO: 1419265 - RNA, 22 nt, Homo sapiens
uaaguagggacuucugucuuca

SEQ ID NO: 1419266 - RNA, 23 nt, Homo sapiens
uaagucacuuugaggugucucaa

SEQ ID NO: 1419267 - RNA, 16 nt, Homo sapiens
uaagugccugagacac

SEQ ID NO: 1419268 - RNA, 19 nt, Homo sapiens
uaauaaaggucuuugcaca

SEQ ID NO: 1419269 - RNA, 21 nt, Homo sapiens
uaauaagcaaagggagcacug

SEQ ID NO: 1419270 - RNA, 21 nt, Homo sapiens
uaauaauagaaaaauacucau

SEQ ID NO: 1419271 - RNA, 13 nt, Homo sapiens
uaauaauugauca

SEQ ID NO: 1419272 - RNA, 19 nt, Homo sapiens
uaauacugccggucaccca

SEQ ID NO: 1419273 - RNA, 14 nt, Homo sapiens
uaauagacacauca

SEQ ID NO: 1419274 - RNA, 16 nt, Homo sapiens
uaauagacacaucaaa

SEQ ID NO: 1419275 - RNA, 13 nt, Homo sapiens
uaauauacuuuaa

SEQ ID NO: 1419276 - RNA, 12 nt, Homo sapiens
uaauauauugcu

SEQ ID NO: 1419277 - RNA, 15 nt, Homo sapiens
uaauauauugcugcu

SEQ ID NO: 1419278 - RNA, 18 nt, Homo sapiens
uaauauucaacaauuaua

SEQ ID NO: 1419279 - RNA, 22 nt, Homo sapiens
uaaucaguuuuauccacagaaa

SEQ ID NO: 1419280 - RNA, 20 nt, Homo sapiens
uaaucauuguaugugcuuca

SEQ ID NO: 1419281 - RNA, 17 nt, Homo sapiens
uaauccaucacuagcca

SEQ ID NO: 1419282 - RNA, 13 nt, Homo sapiens
uaaucccagcacu

SEQ ID NO: 1419283 - RNA, 18 nt, Homo sapiens
uaaucccccuugccaaau

SEQ ID NO: 1419284 - RNA, 23 nt, Homo sapiens
uaauccucaacaacaaaccaaaa

SEQ ID NO: 1419285 - RNA, 13 nt, Homo sapiens
uaaucgugucuuc

SEQ ID NO: 1419286 - RNA, 16 nt, Homo sapiens
uaaucuggacuccucu

SEQ ID NO: 1419287 - RNA, 22 nt, Homo sapiens
uaaucuggacuccucuguccag

SEQ ID NO: 1419288 - RNA, 19 nt, Homo sapiens
uaaucuuccauacuucuuc

SEQ ID NO: 1419289 - RNA, 19 nt, Homo sapiens
uaaugaaggaguucacugu

SEQ ID NO: 1419290 - RNA, 22 nt, Homo sapiens
uaaugagaacuucaaucacugu

SEQ ID NO: 1419291 - RNA, 13 nt, Homo sapiens
uaaugcacucuca

SEQ ID NO: 1419292 - RNA, 17 nt, Homo sapiens
uaaugcuguugccucau

SEQ ID NO: 1419293 - RNA, 15 nt, Homo sapiens
uaaugucaccaccuu

SEQ ID NO: 1419294 - RNA, 17 nt, Homo sapiens
uaaugucgaacucugaa

SEQ ID NO: 1419295 - RNA, 21 nt, Homo sapiens
uaaugucgaacucugaaacaa

SEQ ID NO: 1419296 - RNA, 23 nt, Homo sapiens
uaaugugcaaauuuugcauuuag

SEQ ID NO: 1419297 - RNA, 18 nt, Homo sapiens
uaauuaacuaugugaugu

SEQ ID NO: 1419298 - RNA, 17 nt, Homo sapiens
uaauuaggaucuaugca

SEQ ID NO: 1419299 - RNA, 20 nt, Homo sapiens
uaauuaugaguuugcuuaug

SEQ ID NO: 1419300 - RNA, 14 nt, Homo sapiens
uaauucagcacuga

SEQ ID NO: 1419301 - RNA, 13 nt, Homo sapiens
uaauucauaauua

SEQ ID NO: 1419302 - RNA, 13 nt, Homo sapiens
uaauucauggcau

SEQ ID NO: 1419303 - RNA, 13 nt, Homo sapiens
uaauucuacagga

SEQ ID NO: 1419304 - RNA, 19 nt, Homo sapiens
uaauugaucaaauucauuu

SEQ ID NO: 1419305 - RNA, 18 nt, Homo sapiens
uaauuuguaucugaagga

SEQ ID NO: 1419306 - RNA, 21 nt, Homo sapiens
uaauuuuccuggaaagacuga

SEQ ID NO: 1419307 - RNA, 16 nt, Homo sapiens
uacaaaaacacagcaa

SEQ ID NO: 1419308 - RNA, 17 nt, Homo sapiens
uacaaaaacacagcaag

SEQ ID NO: 1419309 - RNA, 22 nt, Homo sapiens
uacaaaauguacgaaacuguau

SEQ ID NO: 1419310 - RNA, 21 nt, Homo sapiens
uacaaagucagggcguucaua

SEQ ID NO: 1419311 - RNA, 16 nt, Homo sapiens
uacaaauuuuuccugc

SEQ ID NO: 1419312 - RNA, 16 nt, Homo sapiens
uacaagguugugcccu

SEQ ID NO: 1419313 - RNA, 13 nt, Homo sapiens
uacaaguguauau

SEQ ID NO: 1419314 - RNA, 23 nt, Homo sapiens
uacaauccuuugaguuauaguuu

SEQ ID NO: 1419315 - RNA, 19 nt, Homo sapiens
uacaaugaaguuaagguua

SEQ ID NO: 1419316 - RNA, 17 nt, Homo sapiens
uacacaaaagccaaaag

SEQ ID NO: 1419317 - RNA, 15 nt, Homo sapiens
uacacacacagaugc

SEQ ID NO: 1419318 - RNA, 17 nt, Homo sapiens
uacacauacauacacau

SEQ ID NO: 1419319 - RNA, 15 nt, Homo sapiens
uacacauacauacau

SEQ ID NO: 1419320 - RNA, 23 nt, Homo sapiens
uacacuaagcgaauguguacaaa

SEQ ID NO: 1419321 - RNA, 23 nt, Homo sapiens
uacacucuuauagaaaguucaaa

SEQ ID NO: 1419322 - RNA, 21 nt, Homo sapiens
uacagaaauacugcucugaau

SEQ ID NO: 1419323 - RNA, 20 nt, Homo sapiens
uacagacgucucaagacuga

SEQ ID NO: 1419324 - RNA, 14 nt, Homo sapiens
uacagcucuuggca

SEQ ID NO: 1419325 - RNA, 21 nt, Homo sapiens
uacagcucuuggcauuuuccu

SEQ ID NO: 1419326 - RNA, 17 nt, Homo sapiens
uacaguaaauaaauugu

SEQ ID NO: 1419327 - RNA, 14 nt, Homo sapiens
uacaguacagugag

SEQ ID NO: 1419328 - RNA, 13 nt, Homo sapiens
uacagugacuguc

SEQ ID NO: 1419329 - RNA, 18 nt, Homo sapiens
uacauaaaguacauaaca

SEQ ID NO: 1419330 - RNA, 13 nt, Homo sapiens
uacauaagaccau

SEQ ID NO: 1419331 - RNA, 22 nt, Homo sapiens
uacauaaucaaagcuaccugug

SEQ ID NO: 1419332 - RNA, 15 nt, Homo sapiens
uacauacagagguaa

SEQ ID NO: 1419333 - RNA, 13 nt, Homo sapiens
uacauacauacau

SEQ ID NO: 1419334 - RNA, 19 nt, Homo sapiens
uacauaccacuuugaauag

SEQ ID NO: 1419335 - RNA, 22 nt, Homo sapiens
uacauauauauauacacauaca

SEQ ID NO: 1419336 - RNA, 22 nt, Homo sapiens
uacauauguagacuauauacau

SEQ ID NO: 1419337 - RNA, 16 nt, Homo sapiens
uacaucuauguaucua

SEQ ID NO: 1419338 - RNA, 18 nt, Homo sapiens
uacaugaaacuacucaua

SEQ ID NO: 1419339 - RNA, 15 nt, Homo sapiens
uacaugaauugcauu

SEQ ID NO: 1419340 - RNA, 15 nt, Homo sapiens
uacauguaauccauc

SEQ ID NO: 1419341 - RNA, 13 nt, Homo sapiens
uacauguaucuaa

SEQ ID NO: 1419342 - RNA, 13 nt, Homo sapiens
uacauuaucauuc

SEQ ID NO: 1419343 - RNA, 17 nt, Homo sapiens
uacauucccugcaucca

SEQ ID NO: 1419344 - RNA, 16 nt, Homo sapiens
uauacauguguguaua

SEQ ID NO: 1419345 - RNA, 17 nt, Homo sapiens
uauacauguguguauau

SEQ ID NO: 1419346 - RNA, 23 nt, Homo sapiens
uauacauguguguauauaugugu

SEQ ID NO: 1419347 - RNA, 21 nt, Homo sapiens
uauacauucuuuaucuugaca

SEQ ID NO: 1419348 - RNA, 15 nt, Homo sapiens
uauacuguacuuaau

SEQ ID NO: 1419349 - RNA, 19 nt, Homo sapiens
uauacuguagcugaugaaa

SEQ ID NO: 1419350 - RNA, 15 nt, Homo sapiens
uauagacaaauaaua

SEQ ID NO: 1419351 - RNA, 23 nt, Homo sapiens
uauagcguucccaacaacaucca

SEQ ID NO: 1419352 - RNA, 16 nt, Homo sapiens
uauagcugacaucucc

SEQ ID NO: 1419353 - RNA, 15 nt, Homo sapiens
uauauauacauaugu

SEQ ID NO: 1419354 - RNA, 19 nt, Homo sapiens
uauauauaguagcauuuca

SEQ ID NO: 1419355 - RNA, 13 nt, Homo sapiens
uauauauauagua

SEQ ID NO: 1419356 - RNA, 14 nt, Homo sapiens
uauaucaucuauca

SEQ ID NO: 1419357 - RNA, 17 nt, Homo sapiens
uauaucuuuuuccauca

SEQ ID NO: 1419358 - RNA, 15 nt, Homo sapiens
uauaugacauuguua

SEQ ID NO: 1419359 - RNA, 18 nt, Homo sapiens
uauauguauauacauaua

SEQ ID NO: 1419360 - RNA, 11 nt, Homo sapiens
uauauguuaau

SEQ ID NO: 1419361 - RNA, 14 nt, Homo sapiens
uauauuaccucaaa

SEQ ID NO: 1419362 - RNA, 17 nt, Homo sapiens
uauauuauaaucuucca

SEQ ID NO: 1419363 - RNA, 19 nt, Homo sapiens
uauauuaugguguaaugca

SEQ ID NO: 1419364 - RNA, 16 nt, Homo sapiens
uauauugaauauauca

SEQ ID NO: 1419365 - RNA, 16 nt, Homo sapiens
uauauuggaaucugua

SEQ ID NO: 1419366 - RNA, 23 nt, Homo sapiens
uauauuggucauugccuugccaa

SEQ ID NO: 1419367 - RNA, 19 nt, Homo sapiens
uauauuguauuaagggcau

SEQ ID NO: 1419368 - RNA, 15 nt, Homo sapiens
uauauuuauacucua

SEQ ID NO: 1419369 - RNA, 20 nt, Homo sapiens
uauauuuauucaucugggag

SEQ ID NO: 1419370 - RNA, 18 nt, Homo sapiens
uauauuuuuauaagacua

SEQ ID NO: 1419371 - RNA, 15 nt, Homo sapiens
uaucaaaaaguauua

SEQ ID NO: 1419372 - RNA, 16 nt, Homo sapiens
uaucaaaaaguauuaa

SEQ ID NO: 1419373 - RNA, 16 nt, Homo sapiens
uaucaaaacauaucaa

SEQ ID NO: 1419374 - RNA, 20 nt, Homo sapiens
uaucaaaacauaucaauuca

SEQ ID NO: 1419375 - RNA, 21 nt, Homo sapiens
uaucaaaucuguauauguugu

SEQ ID NO: 1419376 - RNA, 13 nt, Homo sapiens
uaucaauagucaa

SEQ ID NO: 1419377 - RNA, 16 nt, Homo sapiens
uaucacauauuugaua

SEQ ID NO: 1419378 - RNA, 15 nt, Homo sapiens
uaucaccucauggcc

SEQ ID NO: 1419379 - RNA, 23 nt, Homo sapiens
uaucauuuauuuacaucuaugua

SEQ ID NO: 1419380 - RNA, 18 nt, Homo sapiens
uauccaauaggcauuuga

SEQ ID NO: 1419381 - RNA, 20 nt, Homo sapiens
uauccugcuagcuguagaaa

SEQ ID NO: 1419382 - RNA, 16 nt, Homo sapiens
uaucugacaucuuauu

SEQ ID NO: 1419383 - RNA, 11 nt, Homo sapiens
uaucugugaua

SEQ ID NO: 1419384 - RNA, 11 nt, Homo sapiens
uaucuuaccug

SEQ ID NO: 1419385 - RNA, 20 nt, Homo sapiens
uaucuucauacaaugacaag

SEQ ID NO: 1419386 - RNA, 13 nt, Homo sapiens
uaugaaacuauug

SEQ ID NO: 1419387 - RNA, 16 nt, Homo sapiens
uaugaaaugggcuuua

SEQ ID NO: 1419388 - RNA, 13 nt, Homo sapiens
uaugaacuugagg

SEQ ID NO: 1419389 - RNA, 14 nt, Homo sapiens
uaugaacuugagga

SEQ ID NO: 1419390 - RNA, 18 nt, Homo sapiens
uaugaauugacagacugu

SEQ ID NO: 1419391 - RNA, 18 nt, Homo sapiens
uaugagggucagggcagu

SEQ ID NO: 1419392 - RNA, 19 nt, Homo sapiens
uaugauauuuugucuccua

SEQ ID NO: 1419393 - RNA, 20 nt, Homo sapiens
uaugauuuaagguacuuaaa

SEQ ID NO: 1419394 - RNA, 16 nt, Homo sapiens
uaugcacacacagaug

SEQ ID NO: 1419395 - RNA, 19 nt, Homo sapiens
uaugcacacacauggauga

SEQ ID NO: 1419396 - RNA, 12 nt, Homo sapiens
uaugccauagca

SEQ ID NO: 1419397 - RNA, 16 nt, Homo sapiens
uaugccuuaagccaau

SEQ ID NO: 1419398 - RNA, 14 nt, Homo sapiens
uaugcuaacuguag

SEQ ID NO: 1419399 - RNA, 12 nt, Homo sapiens
uaugcuggccag

SEQ ID NO: 1419400 - RNA, 23 nt, Homo sapiens
uauggaaaagggucuucuuggca

SEQ ID NO: 1419401 - RNA, 18 nt, Homo sapiens
uauggaaccuucccucca

SEQ ID NO: 1419402 - RNA, 16 nt, Homo sapiens
uauggaauacaguguu

SEQ ID NO: 1419403 - RNA, 14 nt, Homo sapiens
uaugggaagccaua

SEQ ID NO: 1419404 - RNA, 15 nt, Homo sapiens
uaugggggcacugag

SEQ ID NO: 1419405 - RNA, 20 nt, Homo sapiens
uaugguaaaaguuacuuauu

SEQ ID NO: 1419406 - RNA, 16 nt, Homo sapiens
uauguaaaguauguaa

SEQ ID NO: 1419407 - RNA, 22 nt, Homo sapiens
uauguaaucucaccucaccugg

SEQ ID NO: 1419408 - RNA, 18 nt, Homo sapiens
uauguagacuauauacau

SEQ ID NO: 1419409 - RNA, 20 nt, Homo sapiens
uauguaggcaauacauguau

SEQ ID NO: 1419410 - RNA, 13 nt, Homo sapiens
uauguaugcaucu

SEQ ID NO: 1419411 - RNA, 21 nt, Homo sapiens
uauguauggaugcguggauau

SEQ ID NO: 1419412 - RNA, 16 nt, Homo sapiens
uauguauuaagccaaa

SEQ ID NO: 1419413 - RNA, 22 nt, Homo sapiens
uauguauuaagccaaacaugag

SEQ ID NO: 1419414 - RNA, 21 nt, Homo sapiens
uauguauuuuugucauaugua

SEQ ID NO: 1419415 - RNA, 15 nt, Homo sapiens
uaugugcgugcaugu

SEQ ID NO: 1419416 - RNA, 15 nt, Homo sapiens
uaugugcuucacaua

SEQ ID NO: 1419417 - RNA, 14 nt, Homo sapiens
uaugugucuuuauc

SEQ ID NO: 1419418 - RNA, 21 nt, Homo sapiens
uaugugugcauguguguauaa

SEQ ID NO: 1419419 - RNA, 18 nt, Homo sapiens
uauguuaauaacuugucc

SEQ ID NO: 1419420 - RNA, 20 nt, Homo sapiens
uauguucaaugcaaaguaaa

SEQ ID NO: 1419421 - RNA, 15 nt, Homo sapiens
uauguuuacauauca

SEQ ID NO: 1419422 - RNA, 20 nt, Homo sapiens
uauguuucuaaaaauuggua

SEQ ID NO: 1419423 - RNA, 13 nt, Homo sapiens
uauuaaccugaau

SEQ ID NO: 1419424 - RNA, 13 nt, Homo sapiens
uauuaccaaaaaa

SEQ ID NO: 1419425 - RNA, 13 nt, Homo sapiens
uauuaccaugaga

SEQ ID NO: 1419426 - RNA, 22 nt, Homo sapiens
uauuagcagaaauguaucuaua

SEQ ID NO: 1419427 - RNA, 12 nt, Homo sapiens
uauuagcaguag

SEQ ID NO: 1419428 - RNA, 21 nt, Homo sapiens
uauuaguuaggugugccaaac

SEQ ID NO: 1419429 - RNA, 17 nt, Homo sapiens
uauucaauaaagcugcu

SEQ ID NO: 1419430 - RNA, 23 nt, Homo sapiens
uauucagauauaaaacaguuuug

SEQ ID NO: 1419431 - RNA, 20 nt, Homo sapiens
ucacaacacagagcugcuau

SEQ ID NO: 1419432 - RNA, 17 nt, Homo sapiens
ucacaacauuuacuuaa

SEQ ID NO: 1419433 - RNA, 18 nt, Homo sapiens
ucacaagaagaccagacu

SEQ ID NO: 1419434 - RNA, 22 nt, Homo sapiens
ucacaccauuuuguuuagacaa

SEQ ID NO: 1419435 - RNA, 14 nt, Homo sapiens
ucacacccuaauaa

SEQ ID NO: 1419436 - RNA, 15 nt, Homo sapiens
ucacacgggguauuu

SEQ ID NO: 1419437 - RNA, 17 nt, Homo sapiens
ucacacuguaaacauuc

SEQ ID NO: 1419438 - RNA, 14 nt, Homo sapiens
ucacagcugcagcu

SEQ ID NO: 1419439 - RNA, 19 nt, Homo sapiens
ucacaggacucugccuccu

SEQ ID NO: 1419440 - RNA, 20 nt, Homo sapiens
ucacauaacuucucugaguc

SEQ ID NO: 1419441 - RNA, 23 nt, Homo sapiens
ucacaucacugauugggugccau

SEQ ID NO: 1419442 - RNA, 15 nt, Homo sapiens
ucacauccaaugcau

SEQ ID NO: 1419443 - RNA, 14 nt, Homo sapiens
ucacaucuguccag

SEQ ID NO: 1419444 - RNA, 14 nt, Homo sapiens
ucacauucaggaag

SEQ ID NO: 1419445 - RNA, 19 nt, Homo sapiens
ucacauuuguucaugagug

SEQ ID NO: 1419446 - RNA, 15 nt, Homo sapiens
ucacauuuugccuuu

SEQ ID NO: 1419447 - RNA, 20 nt, Homo sapiens
ucaccaaaguauuaauguac

SEQ ID NO: 1419448 - RNA, 22 nt, Homo sapiens
ucaccaggggugcuaugacaug

SEQ ID NO: 1419449 - RNA, 17 nt, Homo sapiens
ucacccgggacucuccc

SEQ ID NO: 1419450 - RNA, 14 nt, Homo sapiens
ucacccuaccugug

SEQ ID NO: 1419451 - RNA, 14 nt, Homo sapiens
ucaccgacaacaug

SEQ ID NO: 1419452 - RNA, 15 nt, Homo sapiens
ucaccucagcugaua

SEQ ID NO: 1419453 - RNA, 16 nt, Homo sapiens
ucaccucagcugauau

SEQ ID NO: 1419454 - RNA, 16 nt, Homo sapiens
ucaccuguuacugaaa

SEQ ID NO: 1419455 - RNA, 17 nt, Homo sapiens
ucaccuuggagccugaa

SEQ ID NO: 1419456 - RNA, 20 nt, Homo sapiens
ucaccuuuuugacuuuucca

SEQ ID NO: 1419457 - RNA, 22 nt, Homo sapiens
ucacgacucuaccauguccaau

SEQ ID NO: 1419458 - RNA, 16 nt, Homo sapiens
ucacgggaacucucca

SEQ ID NO: 1419459 - RNA, 16 nt, Homo sapiens
ucacuacagccucgaa

SEQ ID NO: 1419460 - RNA, 16 nt, Homo sapiens
ucacuacaguacagug

SEQ ID NO: 1419461 - RNA, 19 nt, Homo sapiens
ucacuacuuaaagugcuau

SEQ ID NO: 1419462 - RNA, 17 nt, Homo sapiens
ucacucaaaaaggugug

SEQ ID NO: 1419463 - RNA, 16 nt, Homo sapiens
ucacucccauaagcua

SEQ ID NO: 1419464 - RNA, 15 nt, Homo sapiens
ucacucuuaugaaau

SEQ ID NO: 1419465 - RNA, 14 nt, Homo sapiens
ucacugcaaccucu

SEQ ID NO: 1419466 - RNA, 17 nt, Homo sapiens
ucacuggaccacugggc

SEQ ID NO: 1419467 - RNA, 15 nt, Homo sapiens
ucacuuauaccaaag

SEQ ID NO: 1419468 - RNA, 20 nt, Homo sapiens
ucacuuauaccaaagggaaa

SEQ ID NO: 1419469 - RNA, 16 nt, Homo sapiens
ucacuucccugggaac

SEQ ID NO: 1419470 - RNA, 19 nt, Homo sapiens
ucacuucgaugacuggaua

SEQ ID NO: 1419471 - RNA, 20 nt, Homo sapiens
ucacuuggaagauuuguaua

SEQ ID NO: 1419472 - RNA, 18 nt, Homo sapiens
ucacuuuaaagucuuucc

SEQ ID NO: 1419473 - RNA, 17 nt, Homo sapiens
ucagaaaagaaaaccau

SEQ ID NO: 1419474 - RNA, 12 nt, Homo sapiens
ucagaaaccaaa

SEQ ID NO: 1419475 - RNA, 15 nt, Homo sapiens
ucagaaccgagugag

SEQ ID NO: 1419476 - RNA, 19 nt, Homo sapiens
ucagaaguuucucagcucc

SEQ ID NO: 1419477 - RNA, 23 nt, Homo sapiens
ucagaaucagguugacagucccu

SEQ ID NO: 1419478 - RNA, 12 nt, Homo sapiens
ucagaaucugug

SEQ ID NO: 1419479 - RNA, 20 nt, Homo sapiens
ucagacagguaaaugggcag

SEQ ID NO: 1419480 - RNA, 21 nt, Homo sapiens
ucagaccaacucucuccugua

SEQ ID NO: 1419481 - RNA, 19 nt, Homo sapiens
ucagacuccugugcaacuu

SEQ ID NO: 1419482 - RNA, 16 nt, Homo sapiens
ucagacuuacuuacuc

SEQ ID NO: 1419483 - RNA, 15 nt, Homo sapiens
ucagagccagugaag

SEQ ID NO: 1419484 - RNA, 21 nt, Homo sapiens
ucagauauuuuuucagaaaua

SEQ ID NO: 1419485 - RNA, 16 nt, Homo sapiens
ucagaugaucucucca

SEQ ID NO: 1419486 - RNA, 18 nt, Homo sapiens
ucagauggagacauugga

SEQ ID NO: 1419487 - RNA, 17 nt, Homo sapiens
ucagcagagucuaguag

SEQ ID NO: 1419488 - RNA, 14 nt, Homo sapiens
ucagcauaccugcu

SEQ ID NO: 1419489 - RNA, 18 nt, Homo sapiens
ucagccauugcccuguga

SEQ ID NO: 1419490 - RNA, 13 nt, Homo sapiens
ucagcccucagaa

SEQ ID NO: 1419491 - RNA, 18 nt, Homo sapiens
ucagccucccgaguagcu

SEQ ID NO: 1419492 - RNA, 14 nt, Homo sapiens
ucagccugagucuc

SEQ ID NO: 1419493 - RNA, 16 nt, Homo sapiens
ucagcucacacccuaa

SEQ ID NO: 1419494 - RNA, 16 nt, Homo sapiens
ucagcucucuguauaa

SEQ ID NO: 1419495 - RNA, 20 nt, Homo sapiens
ucagcuggguacgguggcac

SEQ ID NO: 1419496 - RNA, 14 nt, Homo sapiens
ucaggaaaacugac

SEQ ID NO: 1419497 - RNA, 19 nt, Homo sapiens
ucaggaauacauuuggaaa

SEQ ID NO: 1419498 - RNA, 18 nt, Homo sapiens
ucaggaguuggagaccag

SEQ ID NO: 1419499 - RNA, 19 nt, Homo sapiens
ucaggaucaagaaaguguu

SEQ ID NO: 1419500 - RNA, 15 nt, Homo sapiens
ucaggaucaucugag

SEQ ID NO: 1419501 - RNA, 23 nt, Homo sapiens
ucaggauuaaugguccugugaug

SEQ ID NO: 1419502 - RNA, 20 nt, Homo sapiens
ucaggccaagaccccagcuu

SEQ ID NO: 1419503 - RNA, 15 nt, Homo sapiens
ucaggcuucugagua

SEQ ID NO: 1419504 - RNA, 19 nt, Homo sapiens
ucagggauuuuuauuugua

SEQ ID NO: 1419505 - RNA, 22 nt, Homo sapiens
ucagggcugccacuaaccugua

SEQ ID NO: 1419506 - RNA, 23 nt, Homo sapiens
ucagggggccuuuaaagacuuaa

SEQ ID NO: 1419507 - RNA, 18 nt, Homo sapiens
ucaggguguuaaggcagu

SEQ ID NO: 1419508 - RNA, 18 nt, Homo sapiens
ucagugcacuguauauag

SEQ ID NO: 1419509 - RNA, 19 nt, Homo sapiens
ucaguguccucuugcucaa

SEQ ID NO: 1419510 - RNA, 17 nt, Homo sapiens
ucaguuacuuaccugca

SEQ ID NO: 1419511 - RNA, 17 nt, Homo sapiens
ucaguuguuccuacuca

SEQ ID NO: 1419512 - RNA, 17 nt, Homo sapiens
ucauaaggcauauacaa

SEQ ID NO: 1419513 - RNA, 15 nt, Homo sapiens
ucauaauuagaacaa

SEQ ID NO: 1419514 - RNA, 22 nt, Homo sapiens
ucauacacaagucuaacaguua

SEQ ID NO: 1419515 - RNA, 14 nt, Homo sapiens
ucauacaugacuca

SEQ ID NO: 1419516 - RNA, 12 nt, Homo sapiens
ucauaccacaau

SEQ ID NO: 1419517 - RNA, 16 nt, Homo sapiens
ucauaccucugaccaa

SEQ ID NO: 1419518 - RNA, 18 nt, Homo sapiens
acaagcuuguauauacau

SEQ ID NO: 1419519 - RNA, 20 nt, Homo sapiens
acaagcuuguauauacauau

SEQ ID NO: 1419520 - RNA, 14 nt, Homo sapiens
acaaggaaccaccg

SEQ ID NO: 1419521 - RNA, 15 nt, Homo sapiens
acaaggcugaccaag

SEQ ID NO: 1419522 - RNA, 15 nt, Homo sapiens
acaagggcugaccug

SEQ ID NO: 1419523 - RNA, 14 nt, Homo sapiens
acaaguaugaugau

SEQ ID NO: 1419524 - RNA, 18 nt, Homo sapiens
acaauaaaaauuccaaau

SEQ ID NO: 1419525 - RNA, 21 nt, Homo sapiens
acaauaauauauccacaucua

SEQ ID NO: 1419526 - RNA, 23 nt, Homo sapiens
acaauauaaacugaaaaauguca

SEQ ID NO: 1419527 - RNA, 13 nt, Homo sapiens
acaauccacucuc

SEQ ID NO: 1419528 - RNA, 14 nt, Homo sapiens
acaauccacucuca

SEQ ID NO: 1419529 - RNA, 18 nt, Homo sapiens
acaaucugggacuuucac

SEQ ID NO: 1419530 - RNA, 15 nt, Homo sapiens
acaaugaaaugcucu

SEQ ID NO: 1419531 - RNA, 23 nt, Homo sapiens
acaauguauuugucaaugcauca

SEQ ID NO: 1419532 - RNA, 16 nt, Homo sapiens
acaauuuuuaagcauu

SEQ ID NO: 1419533 - RNA, 15 nt, Homo sapiens
acacacaccaaugcg

SEQ ID NO: 1419534 - RNA, 16 nt, Homo sapiens
acacacagagauaugc

SEQ ID NO: 1419535 - RNA, 19 nt, Homo sapiens
acacacagagauaugcaca

SEQ ID NO: 1419536 - RNA, 17 nt, Homo sapiens
acacacagauaugcaca

SEQ ID NO: 1419537 - RNA, 18 nt, Homo sapiens
acacacagauaugcacac

SEQ ID NO: 1419538 - RNA, 20 nt, Homo sapiens
acacaccgaugcugacucca

SEQ ID NO: 1419539 - RNA, 22 nt, Homo sapiens
acacaccgauguacacacacag

SEQ ID NO: 1419540 - RNA, 15 nt, Homo sapiens
acacacgccaaugca

SEQ ID NO: 1419541 - RNA, 20 nt, Homo sapiens
acacacggaugcacacacag

SEQ ID NO: 1419542 - RNA, 16 nt, Homo sapiens
acacacucaaaucaag

SEQ ID NO: 1419543 - RNA, 16 nt, Homo sapiens
acacacugacauuaua

SEQ ID NO: 1419544 - RNA, 15 nt, Homo sapiens
acacagacugcgauu

SEQ ID NO: 1419545 - RNA, 16 nt, Homo sapiens
acacagagauaugcac

SEQ ID NO: 1419546 - RNA, 22 nt, Homo sapiens
acacagcaguaugaaugauguu

SEQ ID NO: 1419547 - RNA, 18 nt, Homo sapiens
acacaggcaaaauccuug

SEQ ID NO: 1419548 - RNA, 22 nt, Homo sapiens
acacaggggcaaagaacugccc

SEQ ID NO: 1419549 - RNA, 14 nt, Homo sapiens
acacagggugcaug

SEQ ID NO: 1419550 - RNA, 15 nt, Homo sapiens
acacauauacauaua

SEQ ID NO: 1419551 - RNA, 17 nt, Homo sapiens
acacauauacauauaua

SEQ ID NO: 1419552 - RNA, 18 nt, Homo sapiens
acacauggacacaccaga

SEQ ID NO: 1419553 - RNA, 16 nt, Homo sapiens
acacauggaugcacac

SEQ ID NO: 1419554 - RNA, 23 nt, Homo sapiens
acacauuaaaggguagccuacaa

SEQ ID NO: 1419555 - RNA, 19 nt, Homo sapiens
acaccaucacccucugggc

SEQ ID NO: 1419556 - RNA, 23 nt, Homo sapiens
acacccaagaagaaaugcuuucc

SEQ ID NO: 1419557 - RNA, 23 nt, Homo sapiens
acacccgccgccuccugcaccga

SEQ ID NO: 1419558 - RNA, 13 nt, Homo sapiens
acacccuaauaag

SEQ ID NO: 1419559 - RNA, 16 nt, Homo sapiens
acaccgaugugcgcac

SEQ ID NO: 1419560 - RNA, 20 nt, Homo sapiens
acaccucaccagaauugugc

SEQ ID NO: 1419561 - RNA, 20 nt, Homo sapiens
acaccuccauuucucuccag

SEQ ID NO: 1419562 - RNA, 15 nt, Homo sapiens
acaccucccuacucc

SEQ ID NO: 1419563 - RNA, 19 nt, Homo sapiens
acaccucuaggacuccaca

SEQ ID NO: 1419564 - RNA, 16 nt, Homo sapiens
acaccugacacaucuu

SEQ ID NO: 1419565 - RNA, 14 nt, Homo sapiens
acaccugccuuaac

SEQ ID NO: 1419566 - RNA, 21 nt, Homo sapiens
acaccuguaaucccagcacuu

SEQ ID NO: 1419567 - RNA, 12 nt, Homo sapiens
acaccuguugca

SEQ ID NO: 1419568 - RNA, 14 nt, Homo sapiens
acacggaggcaucu

SEQ ID NO: 1419569 - RNA, 17 nt, Homo sapiens
acacguaccucucauca

SEQ ID NO: 1419570 - RNA, 17 nt, Homo sapiens
acacucaaaucaagaaa

SEQ ID NO: 1419571 - RNA, 14 nt, Homo sapiens
acacucaacaauaa

SEQ ID NO: 1419572 - RNA, 18 nt, Homo sapiens
acacucaacaauaaagac

SEQ ID NO: 1419573 - RNA, 21 nt, Homo sapiens
acacuguaaucuuaaaagugu

SEQ ID NO: 1419574 - RNA, 21 nt, Homo sapiens
acacuuggagcccgugcagua

SEQ ID NO: 1419575 - RNA, 18 nt, Homo sapiens
acagaaauacugcucuga

SEQ ID NO: 1419576 - RNA, 24 nt, Homo sapiens
acagaacugcuaaauacuguacau

SEQ ID NO: 1419577 - RNA, 18 nt, Homo sapiens
acagaauacaagccacua

SEQ ID NO: 1419578 - RNA, 17 nt, Homo sapiens
acagaaugaaucccaua

SEQ ID NO: 1419579 - RNA, 20 nt, Homo sapiens
acagaauuuuaaagagcaua

SEQ ID NO: 1419580 - RNA, 22 nt, Homo sapiens
acagacauuuucaauaauguga

SEQ ID NO: 1419581 - RNA, 21 nt, Homo sapiens
acagacgauuaacacaccaca

SEQ ID NO: 1419582 - RNA, 15 nt, Homo sapiens
acagacgcuccugaa

SEQ ID NO: 1419583 - RNA, 12 nt, Homo sapiens
acagacugugag

SEQ ID NO: 1419584 - RNA, 13 nt, Homo sapiens
acagacugugagu

SEQ ID NO: 1419585 - RNA, 18 nt, Homo sapiens
acagagaggaguugccag

SEQ ID NO: 1419586 - RNA, 14 nt, Homo sapiens
acagagauaugcac

SEQ ID NO: 1419587 - RNA, 16 nt, Homo sapiens
acagagauaugcacac

SEQ ID NO: 1419588 - RNA, 23 nt, Homo sapiens
acagagccgcaaaucaaccccag

SEQ ID NO: 1419589 - RNA, 20 nt, Homo sapiens
acagagcgagacuccgucuc

SEQ ID NO: 1419590 - RNA, 20 nt, Homo sapiens
acagagcgagauuccgucuu

SEQ ID NO: 1419591 - RNA, 12 nt, Homo sapiens
acagagggccac

SEQ ID NO: 1419592 - RNA, 16 nt, Homo sapiens
acagagggccacacag

SEQ ID NO: 1419593 - RNA, 20 nt, Homo sapiens
acagagguggcugcugugcu

SEQ ID NO: 1419594 - RNA, 15 nt, Homo sapiens
aaguuauucuugaca

SEQ ID NO: 1419595 - RNA, 14 nt, Homo sapiens
aaguuauugauguu

SEQ ID NO: 1419596 - RNA, 17 nt, Homo sapiens
aaguugcuucucaugga

SEQ ID NO: 1419597 - RNA, 20 nt, Homo sapiens
aaguuguuauuucaguuuua

SEQ ID NO: 1419598 - RNA, 13 nt, Homo sapiens
aaguuucacccaa

SEQ ID NO: 1419599 - RNA, 12 nt, Homo sapiens
aaguuugaacuu

SEQ ID NO: 1419600 - RNA, 14 nt, Homo sapiens
aaguuuugaugaaa

SEQ ID NO: 1419601 - RNA, 13 nt, Homo sapiens
aauaaaaagcaug

SEQ ID NO: 1419602 - RNA, 14 nt, Homo sapiens
aauaaaaccucagg

SEQ ID NO: 1419603 - RNA, 15 nt, Homo sapiens
aauaaacccuuccug

SEQ ID NO: 1419604 - RNA, 15 nt, Homo sapiens
aauaaacgugcuccc

SEQ ID NO: 1419605 - RNA, 14 nt, Homo sapiens
aauaaaugugcuua

SEQ ID NO: 1419606 - RNA, 17 nt, Homo sapiens
aauaagccagcaaacca

SEQ ID NO: 1419607 - RNA, 22 nt, Homo sapiens
aauaauagacacuggagacuug

SEQ ID NO: 1419608 - RNA, 22 nt, Homo sapiens
aauaaucauucuuuccccucag

SEQ ID NO: 1419609 - RNA, 22 nt, Homo sapiens
aauaaugaaguuauucuugaca

SEQ ID NO: 1419610 - RNA, 22 nt, Homo sapiens
aauaauuacccacaaaugccac

SEQ ID NO: 1419611 - RNA, 23 nt, Homo sapiens
aauacacagaugauaauaugcua

SEQ ID NO: 1419612 - RNA, 24 nt, Homo sapiens
aauacagcagugucaucagaagau

SEQ ID NO: 1419613 - RNA, 20 nt, Homo sapiens
aauacaugcugcuaauucaa

SEQ ID NO: 1419614 - RNA, 13 nt, Homo sapiens
aauacauguaucu

SEQ ID NO: 1419615 - RNA, 22 nt, Homo sapiens
aauacgugaaagaugcaagcac

SEQ ID NO: 1419616 - RNA, 17 nt, Homo sapiens
aauacucaccuccuccc

SEQ ID NO: 1419617 - RNA, 11 nt, Homo sapiens
aauacugaugu

SEQ ID NO: 1419618 - RNA, 20 nt, Homo sapiens
aauacugauguuccuaguga

SEQ ID NO: 1419619 - RNA, 11 nt, Homo sapiens
aauacuuuauc

SEQ ID NO: 1419620 - RNA, 14 nt, Homo sapiens
aauagacacaucaa

SEQ ID NO: 1419621 - RNA, 20 nt, Homo sapiens
aauagagcgugugcuguuga

SEQ ID NO: 1419622 - RNA, 17 nt, Homo sapiens
aauagaguuccaaauaa

SEQ ID NO: 1419623 - RNA, 14 nt, Homo sapiens
aauagaucuuuuca

SEQ ID NO: 1419624 - RNA, 18 nt, Homo sapiens
aauagcgaaucaucucaa

SEQ ID NO: 1419625 - RNA, 14 nt, Homo sapiens
aauagcucuuucag

SEQ ID NO: 1419626 - RNA, 22 nt, Homo sapiens
aauagcugcuaggguaggaaag

SEQ ID NO: 1419627 - RNA, 12 nt, Homo sapiens
aauagggagaaa

SEQ ID NO: 1419628 - RNA, 23 nt, Homo sapiens
aauaguaaaagauaacaagaucu

SEQ ID NO: 1419629 - RNA, 19 nt, Homo sapiens
aauaguaggaccaauguug

SEQ ID NO: 1419630 - RNA, 21 nt, Homo sapiens
aauauagcguucccaacaaca

SEQ ID NO: 1419631 - RNA, 17 nt, Homo sapiens
aauauauauacauaugu

SEQ ID NO: 1419632 - RNA, 15 nt, Homo sapiens
aauauauuuugccau

SEQ ID NO: 1419633 - RNA, 23 nt, Homo sapiens
aauaucuaccugcccucucucag

SEQ ID NO: 1419634 - RNA, 23 nt, Homo sapiens
aauaucuuuaauagguuaauauc

SEQ ID NO: 1419635 - RNA, 18 nt, Homo sapiens
aauaugauuuuauuugac

SEQ ID NO: 1419636 - RNA, 19 nt, Homo sapiens
aauaugucugccacagaga

SEQ ID NO: 1419637 - RNA, 11 nt, Homo sapiens
aauaugugauu

SEQ ID NO: 1419638 - RNA, 11 nt, Homo sapiens
aauaugugcuu

SEQ ID NO: 1419639 - RNA, 15 nt, Homo sapiens
aauauucagauauaa

SEQ ID NO: 1419640 - RNA, 19 nt, Homo sapiens
aauauuuaaacagcagugu

SEQ ID NO: 1419641 - RNA, 17 nt, Homo sapiens
aauauuuuacaguuuuu

SEQ ID NO: 1419642 - RNA, 15 nt, Homo sapiens
aauauuuuagccuua

SEQ ID NO: 1419643 - RNA, 12 nt, Homo sapiens
aaucaaagacau

SEQ ID NO: 1419644 - RNA, 15 nt, Homo sapiens
aaucaaagcugagga

SEQ ID NO: 1419645 - RNA, 15 nt, Homo sapiens
aaucaaauugcuaca

SEQ ID NO: 1419646 - RNA, 12 nt, Homo sapiens
aaucacuaaccc

SEQ ID NO: 1419647 - RNA, 20 nt, Homo sapiens
aaucagacuucacacugcaa

SEQ ID NO: 1419648 - RNA, 12 nt, Homo sapiens
aaucagcacuga

SEQ ID NO: 1419649 - RNA, 20 nt, Homo sapiens
aaucaggggcaaacggagua

SEQ ID NO: 1419650 - RNA, 18 nt, Homo sapiens
aaucagguccucagagaa

SEQ ID NO: 1419651 - RNA, 22 nt, Homo sapiens
aaucagucuuggaauacuugaa

SEQ ID NO: 1419652 - RNA, 23 nt, Homo sapiens
aaucauguuggauagucagcugu

SEQ ID NO: 1419653 - RNA, 16 nt, Homo sapiens
aaucauuaauacucuu

SEQ ID NO: 1419654 - RNA, 21 nt, Homo sapiens
aaucauucuuuccccucagag

SEQ ID NO: 1419655 - RNA, 23 nt, Homo sapiens
aauccacagccaacaaacauaga

SEQ ID NO: 1419656 - RNA, 22 nt, Homo sapiens
aaucccuguaggcgugcuagca

SEQ ID NO: 1419657 - RNA, 22 nt, Homo sapiens
aauccucaacaacaaaccaaaa

SEQ ID NO: 1419658 - RNA, 23 nt, Homo sapiens
aauccucagguaguacugggaau

SEQ ID NO: 1419659 - RNA, 15 nt, Homo sapiens
aauccugacaccacc

SEQ ID NO: 1419660 - RNA, 18 nt, Homo sapiens
aauccugcccccagccau

SEQ ID NO: 1419661 - RNA, 23 nt, Homo sapiens
aauccugcccccagccaugguga

SEQ ID NO: 1419662 - RNA, 15 nt, Homo sapiens
aauccuuaacauauu

SEQ ID NO: 1419663 - RNA, 17 nt, Homo sapiens
aauccuucucacuaaaa

SEQ ID NO: 1419664 - RNA, 14 nt, Homo sapiens
aaucgaacuaugaa

SEQ ID NO: 1419665 - RNA, 22 nt, Homo sapiens
aaucuaccuguggugacugaac

SEQ ID NO: 1419666 - RNA, 14 nt, Homo sapiens
aaucucauucccag

SEQ ID NO: 1419667 - RNA, 14 nt, Homo sapiens
aaucuccaguuuuc

SEQ ID NO: 1419668 - RNA, 15 nt, Homo sapiens
aaucugggcaucucg

SEQ ID NO: 1419669 - RNA, 15 nt, Homo sapiens
aaucuguagucacuu

SEQ ID NO: 1419670 - RNA, 20 nt, Homo sapiens
aaucuguauauguuguaaua

SEQ ID NO: 1419671 - RNA, 14 nt, Homo sapiens
aaucuuugugacag

SEQ ID NO: 1419672 - RNA, 13 nt, Homo sapiens
aaugaagugcaaa

SEQ ID NO: 1419673 - RNA, 22 nt, Homo sapiens
aaugacaucauguuagucuuug

SEQ ID NO: 1419674 - RNA, 16 nt, Homo sapiens
aaugacccaaagacca

SEQ ID NO: 1419675 - RNA, 19 nt, Homo sapiens
acugagaugugaacacauc

SEQ ID NO: 1419676 - RNA, 20 nt, Homo sapiens
acugagcaguaccagugugc

SEQ ID NO: 1419677 - RNA, 14 nt, Homo sapiens
acugauccuguuuc

SEQ ID NO: 1419678 - RNA, 19 nt, Homo sapiens
acugaugcgaaaacuugaa

SEQ ID NO: 1419679 - RNA, 20 nt, Homo sapiens
acugauguccggagagacag

SEQ ID NO: 1419680 - RNA, 16 nt, Homo sapiens
acugcagauagccaga

SEQ ID NO: 1419681 - RNA, 15 nt, Homo sapiens
acugcagcuuuacau

SEQ ID NO: 1419682 - RNA, 17 nt, Homo sapiens
acugcauaauagccuaa

SEQ ID NO: 1419683 - RNA, 14 nt, Homo sapiens
acugccacccuuga

SEQ ID NO: 1419684 - RNA, 18 nt, Homo sapiens
acugccaugccucaagaa

SEQ ID NO: 1419685 - RNA, 17 nt, Homo sapiens
acugccuucaccuucac

SEQ ID NO: 1419686 - RNA, 20 nt, Homo sapiens
acugcuaggcgagugccagg

SEQ ID NO: 1419687 - RNA, 18 nt, Homo sapiens
acugcugaucaaugaaau

SEQ ID NO: 1419688 - RNA, 16 nt, Homo sapiens
acuggaacagcccauu

SEQ ID NO: 1419689 - RNA, 13 nt, Homo sapiens
acuggacgcccag

SEQ ID NO: 1419690 - RNA, 22 nt, Homo sapiens
acuggagcacugaucaauccuu

SEQ ID NO: 1419691 - RNA, 18 nt, Homo sapiens
acuggaggcaaauuucag

SEQ ID NO: 1419692 - RNA, 20 nt, Homo sapiens
acuggccugauugcagagua

SEQ ID NO: 1419693 - RNA, 22 nt, Homo sapiens
acuggcuucucuuucucugagu

SEQ ID NO: 1419694 - RNA, 20 nt, Homo sapiens
acuggggucuguguggugcc

SEQ ID NO: 1419695 - RNA, 15 nt, Homo sapiens
acuguaaacauucau

SEQ ID NO: 1419696 - RNA, 12 nt, Homo sapiens
acuguaaaucac

SEQ ID NO: 1419697 - RNA, 20 nt, Homo sapiens
acuguaauuaaguaaaccaa

SEQ ID NO: 1419698 - RNA, 14 nt, Homo sapiens
acugucauagaaau

SEQ ID NO: 1419699 - RNA, 12 nt, Homo sapiens
acugucgagucc

SEQ ID NO: 1419700 - RNA, 16 nt, Homo sapiens
acugucucaacuacuc

SEQ ID NO: 1419701 - RNA, 22 nt, Homo sapiens
acugucuucacaaccuccgugc

SEQ ID NO: 1419702 - RNA, 23 nt, Homo sapiens
acuguggagaaauaaaaauaccu

SEQ ID NO: 1419703 - RNA, 14 nt, Homo sapiens
acuguugcacugau

SEQ ID NO: 1419704 - RNA, 17 nt, Homo sapiens
acuuaaaaaaaugacag

SEQ ID NO: 1419705 - RNA, 14 nt, Homo sapiens
acuuaaaagauuca

SEQ ID NO: 1419706 - RNA, 17 nt, Homo sapiens
acuuaaguggcauuaaa

SEQ ID NO: 1419707 - RNA, 16 nt, Homo sapiens
acuuacuuauucuucc

SEQ ID NO: 1419708 - RNA, 17 nt, Homo sapiens
acuuagcaugucccuac

SEQ ID NO: 1419709 - RNA, 15 nt, Homo sapiens
acuuauaucaucagc

SEQ ID NO: 1419710 - RNA, 16 nt, Homo sapiens
acuuauaucaucagca

SEQ ID NO: 1419711 - RNA, 14 nt, Homo sapiens
acuuaucuugcucu

SEQ ID NO: 1419712 - RNA, 19 nt, Homo sapiens
acuuauugucuaggccaga

SEQ ID NO: 1419713 - RNA, 13 nt, Homo sapiens
acuucaaauugca

SEQ ID NO: 1419714 - RNA, 14 nt, Homo sapiens
acuucacauugcaa

SEQ ID NO: 1419715 - RNA, 18 nt, Homo sapiens
acuucacuuuaauucuca

SEQ ID NO: 1419716 - RNA, 12 nt, Homo sapiens
acuuccauuccc

SEQ ID NO: 1419717 - RNA, 20 nt, Homo sapiens
acuuccauucccguggucuc

SEQ ID NO: 1419718 - RNA, 19 nt, Homo sapiens
acuucuaaguaaaaccaca

SEQ ID NO: 1419719 - RNA, 12 nt, Homo sapiens
acuucuaugcaa

SEQ ID NO: 1419720 - RNA, 21 nt, Homo sapiens
acuucugucuucacaacagau

SEQ ID NO: 1419721 - RNA, 23 nt, Homo sapiens
acuucuuaaaaguugugauucca

SEQ ID NO: 1419722 - RNA, 18 nt, Homo sapiens
acuucuucugguccuuca

SEQ ID NO: 1419723 - RNA, 17 nt, Homo sapiens
acuugaaauaccaguga

SEQ ID NO: 1419724 - RNA, 21 nt, Homo sapiens
acuugaaucaaagcaguuaac

SEQ ID NO: 1419725 - RNA, 16 nt, Homo sapiens
acuugagcuguauaua

SEQ ID NO: 1419726 - RNA, 23 nt, Homo sapiens
acuugaggacacauguccagugg

SEQ ID NO: 1419727 - RNA, 20 nt, Homo sapiens
acuugaugacccccaaccaa

SEQ ID NO: 1419728 - RNA, 16 nt, Homo sapiens
acuugccacacacugu

SEQ ID NO: 1419729 - RNA, 18 nt, Homo sapiens
acuugcccugccacuuug

SEQ ID NO: 1419730 - RNA, 13 nt, Homo sapiens
acuuguacuaugu

SEQ ID NO: 1419731 - RNA, 20 nt, Homo sapiens
acuugucuuacauaaucaca

SEQ ID NO: 1419732 - RNA, 22 nt, Homo sapiens
acuuguguccccaccucaggcu

SEQ ID NO: 1419733 - RNA, 19 nt, Homo sapiens
acuuguuuucacuuuauca

SEQ ID NO: 1419734 - RNA, 16 nt, Homo sapiens
acuuuaacugacuuaa

SEQ ID NO: 1419735 - RNA, 21 nt, Homo sapiens
acuuuaucaaagagaaguuac

SEQ ID NO: 1419736 - RNA, 17 nt, Homo sapiens
acuuucccacagcacua

SEQ ID NO: 1419737 - RNA, 16 nt, Homo sapiens
acuuucucugcaaaga

SEQ ID NO: 1419738 - RNA, 19 nt, Homo sapiens
acuuucucuucauacuuuu

SEQ ID NO: 1419739 - RNA, 16 nt, Homo sapiens
acuuugaaucugcaac

SEQ ID NO: 1419740 - RNA, 14 nt, Homo sapiens
acuuugaguaccaa

SEQ ID NO: 1419741 - RNA, 14 nt, Homo sapiens
acuuugaucucugc

SEQ ID NO: 1419742 - RNA, 15 nt, Homo sapiens
acuuugcacagcucu

SEQ ID NO: 1419743 - RNA, 17 nt, Homo sapiens
acuuuugcaugaaaaua

SEQ ID NO: 1419744 - RNA, 11 nt, Homo sapiens
acuuuuugccc

SEQ ID NO: 1419745 - RNA, 12 nt, Homo sapiens
agaaaaauuauu

SEQ ID NO: 1419746 - RNA, 17 nt, Homo sapiens
agaaaacacagccugug

SEQ ID NO: 1419747 - RNA, 14 nt, Homo sapiens
agaaaacaugacuu

SEQ ID NO: 1419748 - RNA, 13 nt, Homo sapiens
agaaaagcacuuu

SEQ ID NO: 1419749 - RNA, 12 nt, Homo sapiens
agaaaagcagac

SEQ ID NO: 1419750 - RNA, 16 nt, Homo sapiens
agaaaaucaguaauug

SEQ ID NO: 1419751 - RNA, 11 nt, Homo sapiens
agaaacacagg

SEQ ID NO: 1419752 - RNA, 22 nt, Homo sapiens
agaaacagagguggcugcugug

SEQ ID NO: 1419753 - RNA, 16 nt, Homo sapiens
agaaacaugacacuga

SEQ ID NO: 1419754 - RNA, 17 nt, Homo sapiens
agaaacaugacacugac

SEQ ID NO: 1419755 - RNA, 18 nt, Homo sapiens
agaaacaugacacugacc

SEQ ID NO: 1419756 - RNA, 17 nt, Homo sapiens
agaaacuuccuuugaga

SEQ ID NO: 1419757 - RNA, 15 nt, Homo sapiens
agaaagaaacacuca

SEQ ID NO: 1419758 - RNA, 18 nt, Homo sapiens
agaaagaaguuaacuaca

SEQ ID NO: 1419759 - RNA, 23 nt, Homo sapiens
agaaagacuauucaaacagucuc

SEQ ID NO: 1419760 - RNA, 13 nt, Homo sapiens
acccuucugggca

SEQ ID NO: 1419761 - RNA, 16 nt, Homo sapiens
acccuuggacuugagg

SEQ ID NO: 1419762 - RNA, 18 nt, Homo sapiens
accgagagagauggaaua

SEQ ID NO: 1419763 - RNA, 16 nt, Homo sapiens
accgagucucuucucc

SEQ ID NO: 1419764 - RNA, 21 nt, Homo sapiens
accgagucucuucuccacugg

SEQ ID NO: 1419765 - RNA, 14 nt, Homo sapiens
accgcuugccauau

SEQ ID NO: 1419766 - RNA, 21 nt, Homo sapiens
accgggacuucaaagccguga

SEQ ID NO: 1419767 - RNA, 15 nt, Homo sapiens
accgggcugggagcu

SEQ ID NO: 1419768 - RNA, 22 nt, Homo sapiens
accuaaaaacauuuacugacca

SEQ ID NO: 1419769 - RNA, 16 nt, Homo sapiens
accuaaaccaccagug

SEQ ID NO: 1419770 - RNA, 17 nt, Homo sapiens
accuaagcaaaaccacu

SEQ ID NO: 1419771 - RNA, 23 nt, Homo sapiens
accuagggagguugaagaaugag

SEQ ID NO: 1419772 - RNA, 17 nt, Homo sapiens
accuaucaauccugccc

SEQ ID NO: 1419773 - RNA, 19 nt, Homo sapiens
accuauuauaaaaucuuac

SEQ ID NO: 1419774 - RNA, 19 nt, Homo sapiens
accucagacaauccacucu

SEQ ID NO: 1419775 - RNA, 21 nt, Homo sapiens
accucauuuaccauaaaaauc

SEQ ID NO: 1419776 - RNA, 15 nt, Homo sapiens
accucccaguuugcu

SEQ ID NO: 1419777 - RNA, 22 nt, Homo sapiens
accuccuagaggugggcagcug

SEQ ID NO: 1419778 - RNA, 23 nt, Homo sapiens
accuccuauccuuggagagcagc

SEQ ID NO: 1419779 - RNA, 16 nt, Homo sapiens
accucuggcuuugucu

SEQ ID NO: 1419780 - RNA, 20 nt, Homo sapiens
accucuucuaugcaagccuu

SEQ ID NO: 1419781 - RNA, 19 nt, Homo sapiens
accucuucucuuccuguaa

SEQ ID NO: 1419782 - RNA, 22 nt, Homo sapiens
accucuuuauuuuuugauugaa

SEQ ID NO: 1419783 - RNA, 20 nt, Homo sapiens
accugaagggugacauccca

SEQ ID NO: 1419784 - RNA, 18 nt, Homo sapiens
accugacaauggcagcua

SEQ ID NO: 1419785 - RNA, 19 nt, Homo sapiens
accugaggcuccugugcua

SEQ ID NO: 1419786 - RNA, 13 nt, Homo sapiens
accugcaguuccu

SEQ ID NO: 1419787 - RNA, 18 nt, Homo sapiens
accugcccacccacuccu

SEQ ID NO: 1419788 - RNA, 19 nt, Homo sapiens
accugcccacccacuccuu

SEQ ID NO: 1419789 - RNA, 22 nt, Homo sapiens
accuggagagcuagaaccuaga

SEQ ID NO: 1419790 - RNA, 18 nt, Homo sapiens
accuggagaugaugauga

SEQ ID NO: 1419791 - RNA, 22 nt, Homo sapiens
accuggaggggcuagaaccuag

SEQ ID NO: 1419792 - RNA, 22 nt, Homo sapiens
accuggaugaucacuaauacua

SEQ ID NO: 1419793 - RNA, 22 nt, Homo sapiens
accuggauugcagacucaugaa

SEQ ID NO: 1419794 - RNA, 13 nt, Homo sapiens
accuguagugaga

SEQ ID NO: 1419795 - RNA, 19 nt, Homo sapiens
accuguuacugaaaguggu

SEQ ID NO: 1419796 - RNA, 21 nt, Homo sapiens
accuguucuuccuaccaaaua

SEQ ID NO: 1419797 - RNA, 14 nt, Homo sapiens
accuuaaucugcca

SEQ ID NO: 1419798 - RNA, 19 nt, Homo sapiens
accuuagauuagcucugga

SEQ ID NO: 1419799 - RNA, 16 nt, Homo sapiens
accuucaucagaccac

SEQ ID NO: 1419800 - RNA, 19 nt, Homo sapiens
accuucaucagaccacucc

SEQ ID NO: 1419801 - RNA, 21 nt, Homo sapiens
accuucaucagaccacucccu

SEQ ID NO: 1419802 - RNA, 16 nt, Homo sapiens
accuucccaugcccug

SEQ ID NO: 1419803 - RNA, 20 nt, Homo sapiens
accuucuguggcucacagaa

SEQ ID NO: 1419804 - RNA, 13 nt, Homo sapiens
accuuuguuccca

SEQ ID NO: 1419805 - RNA, 15 nt, Homo sapiens
accuuuuguauuuaa

SEQ ID NO: 1419806 - RNA, 19 nt, Homo sapiens
accuuuuugacuuuuccaa

SEQ ID NO: 1419807 - RNA, 23 nt, Homo sapiens
acgaagucuguuuuaaugacaag

SEQ ID NO: 1419808 - RNA, 14 nt, Homo sapiens
acgaaucagacuca

SEQ ID NO: 1419809 - RNA, 22 nt, Homo sapiens
acgagcaggcuacugucagcuc

SEQ ID NO: 1419810 - RNA, 12 nt, Homo sapiens
acgagcuauauu

SEQ ID NO: 1419811 - RNA, 20 nt, Homo sapiens
acgagucaccugcaagcccc

SEQ ID NO: 1419812 - RNA, 14 nt, Homo sapiens
acgaucgcugugaa

SEQ ID NO: 1419813 - RNA, 18 nt, Homo sapiens
acgauucuucacuucuug

SEQ ID NO: 1419814 - RNA, 22 nt, Homo sapiens
acgauuuugcacaaauauccac

SEQ ID NO: 1419815 - RNA, 22 nt, Homo sapiens
acgcaagggagaagaaauccau

SEQ ID NO: 1419816 - RNA, 19 nt, Homo sapiens
acgcacauagagauaugca

SEQ ID NO: 1419817 - RNA, 19 nt, Homo sapiens
acgcagcccugggggccag

SEQ ID NO: 1419818 - RNA, 22 nt, Homo sapiens
acgcagcccugggggccagcug

SEQ ID NO: 1419819 - RNA, 11 nt, Homo sapiens
acgccaaugca

SEQ ID NO: 1419820 - RNA, 23 nt, Homo sapiens
acgccaaugcacacacacagaga

SEQ ID NO: 1419821 - RNA, 21 nt, Homo sapiens
acgccuguaaucccagcacuu

SEQ ID NO: 1419822 - RNA, 21 nt, Homo sapiens
acggaagccaacuuggcuuuc

SEQ ID NO: 1419823 - RNA, 21 nt, Homo sapiens
acggagcugaagcugggagcu

SEQ ID NO: 1419824 - RNA, 12 nt, Homo sapiens
acggccagcugc

SEQ ID NO: 1419825 - RNA, 23 nt, Homo sapiens
acggcuuauuagugaaacugggg

SEQ ID NO: 1419826 - RNA, 18 nt, Homo sapiens
acgguaggccaagcugaa

SEQ ID NO: 1419827 - RNA, 14 nt, Homo sapiens
acggugaaauccag

SEQ ID NO: 1419828 - RNA, 20 nt, Homo sapiens
acgguguugcagagacgcaa

SEQ ID NO: 1419829 - RNA, 14 nt, Homo sapiens
acagccuggcacag

SEQ ID NO: 1419830 - RNA, 18 nt, Homo sapiens
acagccuggcacagggca

SEQ ID NO: 1419831 - RNA, 18 nt, Homo sapiens
acagcgagaggcagagaa

SEQ ID NO: 1419832 - RNA, 12 nt, Homo sapiens
acagcuaauaau

SEQ ID NO: 1419833 - RNA, 20 nt, Homo sapiens
acagcucuagacacugccac

SEQ ID NO: 1419834 - RNA, 14 nt, Homo sapiens
acagcugacagaua

SEQ ID NO: 1419835 - RNA, 15 nt, Homo sapiens
acagcugucccuguc

SEQ ID NO: 1419836 - RNA, 22 nt, Homo sapiens
acaggagguuguggaugcucca

SEQ ID NO: 1419837 - RNA, 16 nt, Homo sapiens
acaggcccuuccucuc

SEQ ID NO: 1419838 - RNA, 22 nt, Homo sapiens
acaggcuguucugcacugaaaa

SEQ ID NO: 1419839 - RNA, 21 nt, Homo sapiens
acagggucuaccucugucacc

SEQ ID NO: 1419840 - RNA, 18 nt, Homo sapiens
acagggucucacuauguu

SEQ ID NO: 1419841 - RNA, 21 nt, Homo sapiens
acaggguuuuguauucuuuac

SEQ ID NO: 1419842 - RNA, 15 nt, Homo sapiens
acagguaaaugggca

SEQ ID NO: 1419843 - RNA, 16 nt, Homo sapiens
acaguaaaaacuugua

SEQ ID NO: 1419844 - RNA, 23 nt, Homo sapiens
acaguaaauaaauuguuugacca

SEQ ID NO: 1419845 - RNA, 13 nt, Homo sapiens
acagucauuuaaa

SEQ ID NO: 1419846 - RNA, 16 nt, Homo sapiens
acagugaccaucgcaa

SEQ ID NO: 1419847 - RNA, 17 nt, Homo sapiens
acagugcccagcuaauu

SEQ ID NO: 1419848 - RNA, 21 nt, Homo sapiens
acagugcccaugcaauggcuu

SEQ ID NO: 1419849 - RNA, 21 nt, Homo sapiens
acagugcccuuuucaucucca

SEQ ID NO: 1419850 - RNA, 16 nt, Homo sapiens
acaguuccuucagcuu

SEQ ID NO: 1419851 - RNA, 13 nt, Homo sapiens
acaguugugagau

SEQ ID NO: 1419852 - RNA, 22 nt, Homo sapiens
acaguuuagugcuuuacaugcu

SEQ ID NO: 1419853 - RNA, 19 nt, Homo sapiens
acauaaacacauacauugc

SEQ ID NO: 1419854 - RNA, 14 nt, Homo sapiens
acauaacuaguuua

SEQ ID NO: 1419855 - RNA, 21 nt, Homo sapiens
acauacaauuugcacuguuac

SEQ ID NO: 1419856 - RNA, 16 nt, Homo sapiens
acauacauacauacau

SEQ ID NO: 1419857 - RNA, 19 nt, Homo sapiens
acauacauauauaucugau

SEQ ID NO: 1419858 - RNA, 20 nt, Homo sapiens
acauagagauaugcacacac

SEQ ID NO: 1419859 - RNA, 22 nt, Homo sapiens
acauaguuuauuucaacuauuu

SEQ ID NO: 1419860 - RNA, 16 nt, Homo sapiens
acauauaccuucucaa

SEQ ID NO: 1419861 - RNA, 12 nt, Homo sapiens
acauaugcauuu

SEQ ID NO: 1419862 - RNA, 20 nt, Homo sapiens
acaucaaauuugccaccacu

SEQ ID NO: 1419863 - RNA, 16 nt, Homo sapiens
acaucacaacauuuac

SEQ ID NO: 1419864 - RNA, 12 nt, Homo sapiens
acaucaccuuuu

SEQ ID NO: 1419865 - RNA, 19 nt, Homo sapiens
acaucaccuuuuugacuuu

SEQ ID NO: 1419866 - RNA, 21 nt, Homo sapiens
acaucacuacaguacagugag

SEQ ID NO: 1419867 - RNA, 17 nt, Homo sapiens
acaucacugaaaugcua

SEQ ID NO: 1419868 - RNA, 21 nt, Homo sapiens
acaucagagugacauccagga

SEQ ID NO: 1419869 - RNA, 18 nt, Homo sapiens
acaucagcuugcccuguu

SEQ ID NO: 1419870 - RNA, 14 nt, Homo sapiens
acaucagugcacac

SEQ ID NO: 1419871 - RNA, 13 nt, Homo sapiens
acaucccacagug

SEQ ID NO: 1419872 - RNA, 23 nt, Homo sapiens
acauccugcuuucccuccccaaa

SEQ ID NO: 1419873 - RNA, 23 nt, Homo sapiens
acaucuaagaaaauuuacuguaa

SEQ ID NO: 1419874 - RNA, 13 nt, Homo sapiens
acaucuaaugucu

SEQ ID NO: 1419875 - RNA, 20 nt, Homo sapiens
acaucuauguaucuaccauc

SEQ ID NO: 1419876 - RNA, 16 nt, Homo sapiens
acaucucccucccaca

SEQ ID NO: 1419877 - RNA, 17 nt, Homo sapiens
acaucucuuugauguca

SEQ ID NO: 1419878 - RNA, 15 nt, Homo sapiens
acaugaagagcagcu

SEQ ID NO: 1419879 - RNA, 15 nt, Homo sapiens
acaugacucagcaua

SEQ ID NO: 1419880 - RNA, 17 nt, Homo sapiens
acaugagcgcugaugau

SEQ ID NO: 1419881 - RNA, 15 nt, Homo sapiens
acaugcacugacccu

SEQ ID NO: 1419882 - RNA, 15 nt, Homo sapiens
acaugcugugcucuu

SEQ ID NO: 1419883 - RNA, 14 nt, Homo sapiens
acauggaauuaccu

SEQ ID NO: 1419884 - RNA, 20 nt, Homo sapiens
acauggaauuaccuuagauu

SEQ ID NO: 1419885 - RNA, 14 nt, Homo sapiens
acauggaugcacac

SEQ ID NO: 1419886 - RNA, 16 nt, Homo sapiens
acauggaugcacacac

SEQ ID NO: 1419887 - RNA, 18 nt, Homo sapiens
acauggcuggcacugagc

SEQ ID NO: 1419888 - RNA, 22 nt, Homo sapiens
acauggucuccucugauuauca

SEQ ID NO: 1419889 - RNA, 20 nt, Homo sapiens
acaugucuagccacugauca

SEQ ID NO: 1419890 - RNA, 13 nt, Homo sapiens
acaugugccugua

SEQ ID NO: 1419891 - RNA, 14 nt, Homo sapiens
acaugugucugugu

SEQ ID NO: 1419892 - RNA, 20 nt, Homo sapiens
acaugugucugugugguaua

SEQ ID NO: 1419893 - RNA, 22 nt, Homo sapiens
acauguguucucuauuuugccu

SEQ ID NO: 1419894 - RNA, 16 nt, Homo sapiens
acauuaaacacuguaa

SEQ ID NO: 1419895 - RNA, 13 nt, Homo sapiens
acauuaaauucac

SEQ ID NO: 1419896 - RNA, 19 nt, Homo sapiens
acauuaaauucacaugcag

SEQ ID NO: 1419897 - RNA, 17 nt, Homo sapiens
acauuaaucaccaaagu

SEQ ID NO: 1419898 - RNA, 22 nt, Homo sapiens
acauuaguaucccacuagccca

SEQ ID NO: 1419899 - RNA, 15 nt, Homo sapiens
acauuauacauuuga

SEQ ID NO: 1419900 - RNA, 20 nt, Homo sapiens
acauuccaaugcauugcuaa

SEQ ID NO: 1419901 - RNA, 13 nt, Homo sapiens
acauuccaggaaa

SEQ ID NO: 1419902 - RNA, 16 nt, Homo sapiens
acauucccuaucaaaa

SEQ ID NO: 1419903 - RNA, 22 nt, Homo sapiens
agccauucuuacucgggcgacc

SEQ ID NO: 1419904 - RNA, 16 nt, Homo sapiens
agcccaagaggacuga

SEQ ID NO: 1419905 - RNA, 16 nt, Homo sapiens
agcccaagguuaaaaa

SEQ ID NO: 1419906 - RNA, 15 nt, Homo sapiens
agcccaagugccauc

SEQ ID NO: 1419907 - RNA, 16 nt, Homo sapiens
agcccaagugccaucc

SEQ ID NO: 1419908 - RNA, 18 nt, Homo sapiens
agcccaagugccauccca

SEQ ID NO: 1419909 - RNA, 19 nt, Homo sapiens
agcccaagugccaucccac

SEQ ID NO: 1419910 - RNA, 15 nt, Homo sapiens
agcccagccuagccc

SEQ ID NO: 1419911 - RNA, 17 nt, Homo sapiens
agcccagcuacauuccu

SEQ ID NO: 1419912 - RNA, 18 nt, Homo sapiens
agccccaagccaugguga

SEQ ID NO: 1419913 - RNA, 15 nt, Homo sapiens
agcccgggugugccu

SEQ ID NO: 1419914 - RNA, 21 nt, Homo sapiens
agcccuggcccagagcuggaa

SEQ ID NO: 1419915 - RNA, 15 nt, Homo sapiens
agcccugugaggcug

SEQ ID NO: 1419916 - RNA, 21 nt, Homo sapiens
agccgagauugcgccacugca

SEQ ID NO: 1419917 - RNA, 16 nt, Homo sapiens
agccgcugcacaucac

SEQ ID NO: 1419918 - RNA, 18 nt, Homo sapiens
agccgcugcugagcugcg

SEQ ID NO: 1419919 - RNA, 15 nt, Homo sapiens
agccggccacuuugg

SEQ ID NO: 1419920 - RNA, 16 nt, Homo sapiens
agccggggcacuuuca

SEQ ID NO: 1419921 - RNA, 18 nt, Homo sapiens
agccggggguggugacau

SEQ ID NO: 1419922 - RNA, 18 nt, Homo sapiens
agccguuccgucccaaac

SEQ ID NO: 1419923 - RNA, 13 nt, Homo sapiens
agccuacugccuc

SEQ ID NO: 1419924 - RNA, 18 nt, Homo sapiens
agccuagcccacuuguca

SEQ ID NO: 1419925 - RNA, 18 nt, Homo sapiens
agccucccaaguagcugg

SEQ ID NO: 1419926 - RNA, 19 nt, Homo sapiens
agccuccccaccuucuuca

SEQ ID NO: 1419927 - RNA, 19 nt, Homo sapiens
agccucccgaguagcugag

SEQ ID NO: 1419928 - RNA, 17 nt, Homo sapiens
agauggggacaggugaa

SEQ ID NO: 1419929 - RNA, 22 nt, Homo sapiens
agaugguccuccauuucaacuc

SEQ ID NO: 1419930 - RNA, 14 nt, Homo sapiens
agauguaaaugcca

SEQ ID NO: 1419931 - RNA, 15 nt, Homo sapiens
agauguaaaugccac

SEQ ID NO: 1419932 - RNA, 12 nt, Homo sapiens
agauguacuugu

SEQ ID NO: 1419933 - RNA, 18 nt, Homo sapiens
agauguauaaaucuuucu

SEQ ID NO: 1419934 - RNA, 18 nt, Homo sapiens
agaugugaugcugguacc

SEQ ID NO: 1419935 - RNA, 13 nt, Homo sapiens
agaugugauuuau

SEQ ID NO: 1419936 - RNA, 19 nt, Homo sapiens
agaugugcaagucuuguca

SEQ ID NO: 1419937 - RNA, 17 nt, Homo sapiens
agaugugggcagugaug

SEQ ID NO: 1419938 - RNA, 19 nt, Homo sapiens
agaugugggcagugauguc

SEQ ID NO: 1419939 - RNA, 17 nt, Homo sapiens
agauuagguacuaucug

SEQ ID NO: 1419940 - RNA, 16 nt, Homo sapiens
agauucuccugugcua

SEQ ID NO: 1419941 - RNA, 14 nt, Homo sapiens
agauugacuuugaa

SEQ ID NO: 1419942 - RNA, 16 nt, Homo sapiens
agauugcgccacugca

SEQ ID NO: 1419943 - RNA, 17 nt, Homo sapiens
agauuggcucccaacuc

SEQ ID NO: 1419944 - RNA, 17 nt, Homo sapiens
agauuguccagugcaac

SEQ ID NO: 1419945 - RNA, 17 nt, Homo sapiens
agauuuaacaauuccaa

SEQ ID NO: 1419946 - RNA, 14 nt, Homo sapiens
agauuucaguuacu

SEQ ID NO: 1419947 - RNA, 17 nt, Homo sapiens
agcaaaagucagucuua

SEQ ID NO: 1419948 - RNA, 18 nt, Homo sapiens
agcaaagggagcacuggg

SEQ ID NO: 1419949 - RNA, 15 nt, Homo sapiens
agcaaauguggcucc

SEQ ID NO: 1419950 - RNA, 14 nt, Homo sapiens
agcaaauuaguaau

SEQ ID NO: 1419951 - RNA, 18 nt, Homo sapiens
agcaaccucccaacccag

SEQ ID NO: 1419952 - RNA, 17 nt, Homo sapiens
agcaacucagaaugcuc

SEQ ID NO: 1419953 - RNA, 18 nt, Homo sapiens
agcaagacuuccagguag

SEQ ID NO: 1419954 - RNA, 16 nt, Homo sapiens
agcaagugacaugcca

SEQ ID NO: 1419955 - RNA, 21 nt, Homo sapiens
agcaaugggcacugguauuug

SEQ ID NO: 1419956 - RNA, 20 nt, Homo sapiens
agcaauugacugucacuguu

SEQ ID NO: 1419957 - RNA, 13 nt, Homo sapiens
agcacaccccaag

SEQ ID NO: 1419958 - RNA, 11 nt, Homo sapiens
agcacaugugu

SEQ ID NO: 1419959 - RNA, 20 nt, Homo sapiens
agcaccuuuccuucaagcca

SEQ ID NO: 1419960 - RNA, 18 nt, Homo sapiens
agcacgauuuugcacaaa

SEQ ID NO: 1419961 - RNA, 20 nt, Homo sapiens
agcacucccuuaggcauuau

SEQ ID NO: 1419962 - RNA, 16 nt, Homo sapiens
agcacucgagaccauc

SEQ ID NO: 1419963 - RNA, 15 nt, Homo sapiens
agcacugacugggac

SEQ ID NO: 1419964 - RNA, 21 nt, Homo sapiens
agcacugacugggaccaggca

SEQ ID NO: 1419965 - RNA, 15 nt, Homo sapiens
agcacugcuccagug

SEQ ID NO: 1419966 - RNA, 12 nt, Homo sapiens
agcacuggguug

SEQ ID NO: 1419967 - RNA, 21 nt, Homo sapiens
agcacuguuggagcuacugca

SEQ ID NO: 1419968 - RNA, 22 nt, Homo sapiens
agcacuuuaacccucucuuccc

SEQ ID NO: 1419969 - RNA, 15 nt, Homo sapiens
agcagaagcacauau

SEQ ID NO: 1419970 - RNA, 16 nt, Homo sapiens
agcagagcuuccucag

SEQ ID NO: 1419971 - RNA, 15 nt, Homo sapiens
agcagaggaguccag

SEQ ID NO: 1419972 - RNA, 18 nt, Homo sapiens
agcagauaaagacagcug

SEQ ID NO: 1419973 - RNA, 23 nt, Homo sapiens
agcagaucuucuuuauaacuauu

SEQ ID NO: 1419974 - RNA, 13 nt, Homo sapiens
agcagauggagua

SEQ ID NO: 1419975 - RNA, 16 nt, Homo sapiens
agcagaugguccucca

SEQ ID NO: 1419976 - RNA, 22 nt, Homo sapiens
agcagcagugagcuucuauuaa

SEQ ID NO: 1419977 - RNA, 21 nt, Homo sapiens
agcagcuucaguuguuuuccc

SEQ ID NO: 1419978 - RNA, 14 nt, Homo sapiens
agcaggaacagaga

SEQ ID NO: 1419979 - RNA, 13 nt, Homo sapiens
agcaggccaggga

SEQ ID NO: 1419980 - RNA, 14 nt, Homo sapiens
agcagggcucugcc

SEQ ID NO: 1419981 - RNA, 16 nt, Homo sapiens
agcagguggcaucucu

SEQ ID NO: 1419982 - RNA, 20 nt, Homo sapiens
agcaguaaacuuucucugca

SEQ ID NO: 1419983 - RNA, 13 nt, Homo sapiens
agcauaaugcucc

SEQ ID NO: 1419984 - RNA, 20 nt, Homo sapiens
agcauaaugcucccaucucc

SEQ ID NO: 1419985 - RNA, 18 nt, Homo sapiens
agcauaccaacacgagca

SEQ ID NO: 1419986 - RNA, 18 nt, Homo sapiens
agcauaccuuggacugac

SEQ ID NO: 1419987 - RNA, 14 nt, Homo sapiens
agcaucaaagcacu

SEQ ID NO: 1419988 - RNA, 21 nt, Homo sapiens
agcauccuggccaacauggug

SEQ ID NO: 1419989 - RNA, 11 nt, Homo sapiens
agcauggaaaa

SEQ ID NO: 1419990 - RNA, 20 nt, Homo sapiens
agcaugggacugugccuuug

SEQ ID NO: 1419991 - RNA, 20 nt, Homo sapiens
agcaugucucaauaguaaaa

SEQ ID NO: 1419992 - RNA, 22 nt, Homo sapiens
agcauuacgugagccagguaau

SEQ ID NO: 1419993 - RNA, 17 nt, Homo sapiens
agcauuagucacuuuga

SEQ ID NO: 1419994 - RNA, 18 nt, Homo sapiens
agcauuagucacuuugaa

SEQ ID NO: 1419995 - RNA, 17 nt, Homo sapiens
agcauuucaaaauggac

SEQ ID NO: 1419996 - RNA, 16 nt, Homo sapiens
agccaacuuuaauugc

SEQ ID NO: 1419997 - RNA, 19 nt, Homo sapiens
agccaauauuuacucauca

SEQ ID NO: 1419998 - RNA, 16 nt, Homo sapiens
agccacacuucucagg

SEQ ID NO: 1419999 - RNA, 19 nt, Homo sapiens
agccacagcuucuucaucu

SEQ ID NO: 1420000 - RNA, 12 nt, Homo sapiens
agccacaucacu

SEQ ID NO: 1420001 - RNA, 19 nt, Homo sapiens
agccacaucccuuugaaac

SEQ ID NO: 1420002 - RNA, 21 nt, Homo sapiens
agccacccaggggaaugaucu

SEQ ID NO: 1420003 - RNA, 17 nt, Homo sapiens
agccacccugaggaguc

SEQ ID NO: 1420004 - RNA, 21 nt, Homo sapiens
agccaccugggggagcuggaa

SEQ ID NO: 1420005 - RNA, 14 nt, Homo sapiens
agccacuaccuucu

SEQ ID NO: 1420006 - RNA, 11 nt, Homo sapiens
agccagaguuc

SEQ ID NO: 1420007 - RNA, 15 nt, Homo sapiens
agccaguacagagaa

SEQ ID NO: 1420008 - RNA, 17 nt, Homo sapiens
agccaguggcaguguau

SEQ ID NO: 1420009 - RNA, 14 nt, Homo sapiens
agccauaugcaaua

SEQ ID NO: 1420010 - RNA, 15 nt, Homo sapiens
agccauggugacaca

SEQ ID NO: 1420011 - RNA, 19 nt, Homo sapiens
agccauggugacacacagc

SEQ ID NO: 1420012 - RNA, 20 nt, Homo sapiens
agccauguacuauaauguga

SEQ ID NO: 1420013 - RNA, 13 nt, Homo sapiens
agacuauggagcc

SEQ ID NO: 1420014 - RNA, 20 nt, Homo sapiens
agacuauggagccuggcaca

SEQ ID NO: 1420015 - RNA, 17 nt, Homo sapiens
agacuauucaaacaguc

SEQ ID NO: 1420016 - RNA, 23 nt, Homo sapiens
agacucauucccuagaucuuucu

SEQ ID NO: 1420017 - RNA, 18 nt, Homo sapiens
agacugaaagcagcagcu

SEQ ID NO: 1420018 - RNA, 14 nt, Homo sapiens
agacuguugcacuc

SEQ ID NO: 1420019 - RNA, 14 nt, Homo sapiens
agacuguugcucaa

SEQ ID NO: 1420020 - RNA, 23 nt, Homo sapiens
agacuguugcucaaaucuauuca

SEQ ID NO: 1420021 - RNA, 18 nt, Homo sapiens
agacuuggggaccagagg

SEQ ID NO: 1420022 - RNA, 15 nt, Homo sapiens
agagaaaaaccaaug

SEQ ID NO: 1420023 - RNA, 16 nt, Homo sapiens
agagaaaaaccaauga

SEQ ID NO: 1420024 - RNA, 20 nt, Homo sapiens
agagaagauagcagggcaug

SEQ ID NO: 1420025 - RNA, 16 nt, Homo sapiens
agagaagcaaguggcu

SEQ ID NO: 1420026 - RNA, 11 nt, Homo sapiens
agagacagggu

SEQ ID NO: 1420027 - RNA, 16 nt, Homo sapiens
agagaccccuuccuuu

SEQ ID NO: 1420028 - RNA, 12 nt, Homo sapiens
agagacugugcu

SEQ ID NO: 1420029 - RNA, 21 nt, Homo sapiens
agagacuuggggaccagaggu

SEQ ID NO: 1420030 - RNA, 15 nt, Homo sapiens
agagagaucuagaaa

SEQ ID NO: 1420031 - RNA, 17 nt, Homo sapiens
agagagaugaucgugcc

SEQ ID NO: 1420032 - RNA, 13 nt, Homo sapiens
agagagauggaau

SEQ ID NO: 1420033 - RNA, 15 nt, Homo sapiens
agagagcagaaauaa

SEQ ID NO: 1420034 - RNA, 20 nt, Homo sapiens
agagaggccuuuuguuuaaa

SEQ ID NO: 1420035 - RNA, 15 nt, Homo sapiens
agagagggccugcug

SEQ ID NO: 1420036 - RNA, 22 nt, Homo sapiens
agagagucuuccagguacugau

SEQ ID NO: 1420037 - RNA, 13 nt, Homo sapiens
agagaguggcucc

SEQ ID NO: 1420038 - RNA, 13 nt, Homo sapiens
agagauacauucc

SEQ ID NO: 1420039 - RNA, 23 nt, Homo sapiens
agagauguguguguguguaggua

SEQ ID NO: 1420040 - RNA, 17 nt, Homo sapiens
agagauuguuacagaag

SEQ ID NO: 1420041 - RNA, 23 nt, Homo sapiens
agagauuuugucgggacagagag

SEQ ID NO: 1420042 - RNA, 15 nt, Homo sapiens
agagcaaaaugaugc

SEQ ID NO: 1420043 - RNA, 13 nt, Homo sapiens
agagcauaggguc

SEQ ID NO: 1420044 - RNA, 16 nt, Homo sapiens
agagccaggcucugcc

SEQ ID NO: 1420045 - RNA, 13 nt, Homo sapiens
agagccagugaag

SEQ ID NO: 1420046 - RNA, 17 nt, Homo sapiens
agagccugagucacugg

SEQ ID NO: 1420047 - RNA, 14 nt, Homo sapiens
agagccuggagaag

SEQ ID NO: 1420048 - RNA, 19 nt, Homo sapiens
agagccugugcuaaagaag

SEQ ID NO: 1420049 - RNA, 12 nt, Homo sapiens
agagcugggaaa

SEQ ID NO: 1420050 - RNA, 19 nt, Homo sapiens
agagcugggaaacagggag

SEQ ID NO: 1420051 - RNA, 15 nt, Homo sapiens
agagcuuucaaguac

SEQ ID NO: 1420052 - RNA, 19 nt, Homo sapiens
agaggaccugagucugcua

SEQ ID NO: 1420053 - RNA, 21 nt, Homo sapiens
agaggagaagagacauguacc

SEQ ID NO: 1420054 - RNA, 16 nt, Homo sapiens
agaggcaacugcccag

SEQ ID NO: 1420055 - RNA, 21 nt, Homo sapiens
agaggcggaaaccuugcagca

SEQ ID NO: 1420056 - RNA, 19 nt, Homo sapiens
agaggcugcagaaggccaa

SEQ ID NO: 1420057 - RNA, 16 nt, Homo sapiens
agaggggaagggccag

SEQ ID NO: 1420058 - RNA, 21 nt, Homo sapiens
agagguaaaagugugagcagu

SEQ ID NO: 1420059 - RNA, 18 nt, Homo sapiens
agagguagcgagcugcuc

SEQ ID NO: 1420060 - RNA, 21 nt, Homo sapiens
agaggucucagguucuuucca

SEQ ID NO: 1420061 - RNA, 17 nt, Homo sapiens
agaggugacaguggaug

SEQ ID NO: 1420062 - RNA, 19 nt, Homo sapiens
agaggugacaguggaugac

SEQ ID NO: 1420063 - RNA, 14 nt, Homo sapiens
agagguuaucugcc

SEQ ID NO: 1420064 - RNA, 13 nt, Homo sapiens
agagguuucuuga

SEQ ID NO: 1420065 - RNA, 16 nt, Homo sapiens
agaguaaaaacugaau

SEQ ID NO: 1420066 - RNA, 16 nt, Homo sapiens
agaguaaugaggcuug

SEQ ID NO: 1420067 - RNA, 16 nt, Homo sapiens
agagugaaauaauuaa

SEQ ID NO: 1420068 - RNA, 17 nt, Homo sapiens
agagugugaaacuuccu

SEQ ID NO: 1420069 - RNA, 19 nt, Homo sapiens
agaguuaagugaaugucua

SEQ ID NO: 1420070 - RNA, 16 nt, Homo sapiens
agaguuguacacugug

SEQ ID NO: 1420071 - RNA, 21 nt, Homo sapiens
agaguuucuccuuuugaccaa

SEQ ID NO: 1420072 - RNA, 21 nt, Homo sapiens
agauaaaggaagucaccaaaa

SEQ ID NO: 1420073 - RNA, 23 nt, Homo sapiens
agauaacagcuuaacauuuacau

SEQ ID NO: 1420074 - RNA, 13 nt, Homo sapiens
agauaacucuccu

SEQ ID NO: 1420075 - RNA, 14 nt, Homo sapiens
agauacuggcgcca

SEQ ID NO: 1420076 - RNA, 15 nt, Homo sapiens
agauagguaaauacc

SEQ ID NO: 1420077 - RNA, 15 nt, Homo sapiens
agauauacacaugga

SEQ ID NO: 1420078 - RNA, 18 nt, Homo sapiens
agauaucacuuacucagu

SEQ ID NO: 1420079 - RNA, 17 nt, Homo sapiens
agauaucagagcucuua

SEQ ID NO: 1420080 - RNA, 17 nt, Homo sapiens
agauaucaugauuuuau

SEQ ID NO: 1420081 - RNA, 14 nt, Homo sapiens
agauaugcacacac

SEQ ID NO: 1420082 - RNA, 19 nt, Homo sapiens
agauaugcacacacaugga

SEQ ID NO: 1420083 - RNA, 20 nt, Homo sapiens
agauauuucccaauacauac

SEQ ID NO: 1420084 - RNA, 18 nt, Homo sapiens
agauccacccuaucccug

SEQ ID NO: 1420085 - RNA, 22 nt, Homo sapiens
agauccacccucaaaugucaga

SEQ ID NO: 1420086 - RNA, 22 nt, Homo sapiens
agaucccgugaaauugaugcca

SEQ ID NO: 1420087 - RNA, 16 nt, Homo sapiens
agauccuaggugcugg

SEQ ID NO: 1420088 - RNA, 21 nt, Homo sapiens
agaucgauccuggauucacuc

SEQ ID NO: 1420089 - RNA, 17 nt, Homo sapiens
agaucgcgccacugcac

SEQ ID NO: 1420090 - RNA, 19 nt, Homo sapiens
agaucgcgccacugcacuc

SEQ ID NO: 1420091 - RNA, 17 nt, Homo sapiens
agaucuccacggucaga

SEQ ID NO: 1420092 - RNA, 12 nt, Homo sapiens
agaucugcacug

SEQ ID NO: 1420093 - RNA, 23 nt, Homo sapiens
agaucugcuucuucaucuugaca

SEQ ID NO: 1420094 - RNA, 20 nt, Homo sapiens
agaugauuaaacagacuuua

SEQ ID NO: 1420095 - RNA, 15 nt, Homo sapiens
agaugcacacacacc

SEQ ID NO: 1420096 - RNA, 20 nt, Homo sapiens
agaugcugggccaguuccuc

SEQ ID NO: 1420097 - RNA, 16 nt, Homo sapiens
agauggcugugccucu

SEQ ID NO: 1420098 - RNA, 14 nt, Homo sapiens
agaaagaggcagug

SEQ ID NO: 1420099 - RNA, 18 nt, Homo sapiens
agaaagccguacugucua

SEQ ID NO: 1420100 - RNA, 17 nt, Homo sapiens
agaaaggagcucugaau

SEQ ID NO: 1420101 - RNA, 13 nt, Homo sapiens
agaaaggccugag

SEQ ID NO: 1420102 - RNA, 22 nt, Homo sapiens
agaaagguaaacaaacaaauaa

SEQ ID NO: 1420103 - RNA, 20 nt, Homo sapiens
agaaagucauagauuucuga

SEQ ID NO: 1420104 - RNA, 18 nt, Homo sapiens
agaaauaaaaauaccucu

SEQ ID NO: 1420105 - RNA, 22 nt, Homo sapiens
agaaauaggaccuuccacacag

SEQ ID NO: 1420106 - RNA, 15 nt, Homo sapiens
agaaauauauauaca

SEQ ID NO: 1420107 - RNA, 13 nt, Homo sapiens
agaaauccauaac

SEQ ID NO: 1420108 - RNA, 12 nt, Homo sapiens
agaaaugaauau

SEQ ID NO: 1420109 - RNA, 14 nt, Homo sapiens
agaaauucuguggu

SEQ ID NO: 1420110 - RNA, 17 nt, Homo sapiens
agaacaguaacugccau

SEQ ID NO: 1420111 - RNA, 19 nt, Homo sapiens
agaacaugaccuccgugua

SEQ ID NO: 1420112 - RNA, 16 nt, Homo sapiens
agaacaugcacauuua

SEQ ID NO: 1420113 - RNA, 18 nt, Homo sapiens
agaacccccacauuuacc

SEQ ID NO: 1420114 - RNA, 15 nt, Homo sapiens
agaaccugugcucua

SEQ ID NO: 1420115 - RNA, 23 nt, Homo sapiens
agaacggaagaagagaucaggaa

SEQ ID NO: 1420116 - RNA, 21 nt, Homo sapiens
agaacggcaugugaauucugu

SEQ ID NO: 1420117 - RNA, 22 nt, Homo sapiens
agaacuggaggaguuccuugau

SEQ ID NO: 1420118 - RNA, 16 nt, Homo sapiens
agaagaugugauuuau

SEQ ID NO: 1420119 - RNA, 17 nt, Homo sapiens
agaagcagguucuugau

SEQ ID NO: 1420120 - RNA, 23 nt, Homo sapiens
agaagccaaaauacuucugagac

SEQ ID NO: 1420121 - RNA, 18 nt, Homo sapiens
agaagccugggggccugg

SEQ ID NO: 1420122 - RNA, 13 nt, Homo sapiens
agaaggaaggcag

SEQ ID NO: 1420123 - RNA, 18 nt, Homo sapiens
agaaggaaggcuccaucu

SEQ ID NO: 1420124 - RNA, 17 nt, Homo sapiens
agaaggccaagaaucaa

SEQ ID NO: 1420125 - RNA, 21 nt, Homo sapiens
agaaguacaugaagagcagcu

SEQ ID NO: 1420126 - RNA, 20 nt, Homo sapiens
agaagucccucccaucucua

SEQ ID NO: 1420127 - RNA, 19 nt, Homo sapiens
agaaguuuaaaaaaccaug

SEQ ID NO: 1420128 - RNA, 20 nt, Homo sapiens
agaaguuuaaaaaaccaugc

SEQ ID NO: 1420129 - RNA, 15 nt, Homo sapiens
agaauaaagucuugu

SEQ ID NO: 1420130 - RNA, 20 nt, Homo sapiens
agaauaaaugaaucuuacuc

SEQ ID NO: 1420131 - RNA, 20 nt, Homo sapiens
agaauaagaaaacaaucaca

SEQ ID NO: 1420132 - RNA, 14 nt, Homo sapiens
agaauacacuauca

SEQ ID NO: 1420133 - RNA, 12 nt, Homo sapiens
agaaucaccuca

SEQ ID NO: 1420134 - RNA, 13 nt, Homo sapiens
agaaucagucuug

SEQ ID NO: 1420135 - RNA, 18 nt, Homo sapiens
agaaucauuaauacaaag

SEQ ID NO: 1420136 - RNA, 23 nt, Homo sapiens
agaauccacaaagccgugccuuu

SEQ ID NO: 1420137 - RNA, 21 nt, Homo sapiens
agaaucugcagcuaacuuauu

SEQ ID NO: 1420138 - RNA, 14 nt, Homo sapiens
agaaugaaguggag

SEQ ID NO: 1420139 - RNA, 18 nt, Homo sapiens
agaaugaauaauaauuau

SEQ ID NO: 1420140 - RNA, 21 nt, Homo sapiens
agaaugccucugcugugggcu

SEQ ID NO: 1420141 - RNA, 12 nt, Homo sapiens
agaaugugauuc

SEQ ID NO: 1420142 - RNA, 13 nt, Homo sapiens
agaaugugauucc

SEQ ID NO: 1420143 - RNA, 20 nt, Homo sapiens
agaauguucuccuaaaagac

SEQ ID NO: 1420144 - RNA, 19 nt, Homo sapiens
agaauuaaaacuaugaaau

SEQ ID NO: 1420145 - RNA, 13 nt, Homo sapiens
agaauuauucucu

SEQ ID NO: 1420146 - RNA, 17 nt, Homo sapiens
agaauuccugaagccag

SEQ ID NO: 1420147 - RNA, 19 nt, Homo sapiens
agaauuccugaagccagau

SEQ ID NO: 1420148 - RNA, 13 nt, Homo sapiens
agaauugugcaaa

SEQ ID NO: 1420149 - RNA, 16 nt, Homo sapiens
agaauuuaacaugacu

SEQ ID NO: 1420150 - RNA, 18 nt, Homo sapiens
agacaacugguccacuca

SEQ ID NO: 1420151 - RNA, 20 nt, Homo sapiens
agacaagaaggccacuggua

SEQ ID NO: 1420152 - RNA, 16 nt, Homo sapiens
agacaauccacucuca

SEQ ID NO: 1420153 - RNA, 17 nt, Homo sapiens
agacaauccacucucag

SEQ ID NO: 1420154 - RNA, 19 nt, Homo sapiens
agacaauccacucucagga

SEQ ID NO: 1420155 - RNA, 23 nt, Homo sapiens
agacacagcgucccuagcaguga

SEQ ID NO: 1420156 - RNA, 18 nt, Homo sapiens
agacaccgcgcaucucuu

SEQ ID NO: 1420157 - RNA, 12 nt, Homo sapiens
agacaccugccu

SEQ ID NO: 1420158 - RNA, 19 nt, Homo sapiens
agacaccuuuuguauuuaa

SEQ ID NO: 1420159 - RNA, 17 nt, Homo sapiens
agacagagaagaccaaa

SEQ ID NO: 1420160 - RNA, 18 nt, Homo sapiens
agacagagcccugugagg

SEQ ID NO: 1420161 - RNA, 22 nt, Homo sapiens
agacagagcccugugaggcugg

SEQ ID NO: 1420162 - RNA, 19 nt, Homo sapiens
agacaggaagguggugcuu

SEQ ID NO: 1420163 - RNA, 16 nt, Homo sapiens
agacaggcccaagaga

SEQ ID NO: 1420164 - RNA, 20 nt, Homo sapiens
agacagggucucacuauguu

SEQ ID NO: 1420165 - RNA, 18 nt, Homo sapiens
agacaggucuagacuuuc

SEQ ID NO: 1420166 - RNA, 18 nt, Homo sapiens
agacaguacucuuaacuc

SEQ ID NO: 1420167 - RNA, 14 nt, Homo sapiens
agacaguucaagaa

SEQ ID NO: 1420168 - RNA, 19 nt, Homo sapiens
agacauaguucagccacaa

SEQ ID NO: 1420169 - RNA, 18 nt, Homo sapiens
agacauggaauuaccuua

SEQ ID NO: 1420170 - RNA, 18 nt, Homo sapiens
agacauggagacuccugc

SEQ ID NO: 1420171 - RNA, 19 nt, Homo sapiens
agaccaaagcauugccugc

SEQ ID NO: 1420172 - RNA, 12 nt, Homo sapiens
agaccacugucc

SEQ ID NO: 1420173 - RNA, 17 nt, Homo sapiens
agaccauugucuuccaa

SEQ ID NO: 1420174 - RNA, 15 nt, Homo sapiens
agacccaguguaaag

SEQ ID NO: 1420175 - RNA, 19 nt, Homo sapiens
agacccugagacuccagaa

SEQ ID NO: 1420176 - RNA, 20 nt, Homo sapiens
agaccgggguucaagccaug

SEQ ID NO: 1420177 - RNA, 22 nt, Homo sapiens
agaccucucaacagaucugugg

SEQ ID NO: 1420178 - RNA, 20 nt, Homo sapiens
agaccuuguuucaaucuuug

SEQ ID NO: 1420179 - RNA, 20 nt, Homo sapiens
agacgcucaagaauccucug

SEQ ID NO: 1420180 - RNA, 14 nt, Homo sapiens
agacguguacauag

SEQ ID NO: 1420181 - RNA, 23 nt, Homo sapiens
agacuaaccugcccacccacucc

SEQ ID NO: 1420182 - RNA, 13 nt, Homo sapiens
cucuggaccagcc

SEQ ID NO: 1420183 - RNA, 18 nt, Homo sapiens
cucuggagugaggggaau

SEQ ID NO: 1420184 - RNA, 16 nt, Homo sapiens
cucugggcagcuguca

SEQ ID NO: 1420185 - RNA, 20 nt, Homo sapiens
cucugggccaagacuccugu

SEQ ID NO: 1420186 - RNA, 13 nt, Homo sapiens
cucugugcuuuga

SEQ ID NO: 1420187 - RNA, 15 nt, Homo sapiens
cucuuaacuccuagc

SEQ ID NO: 1420188 - RNA, 16 nt, Homo sapiens
cucuuaaugcuguguu

SEQ ID NO: 1420189 - RNA, 15 nt, Homo sapiens
cucuuacaaccaaga

SEQ ID NO: 1420190 - RNA, 18 nt, Homo sapiens
cucuuauagaaaguucaa

SEQ ID NO: 1420191 - RNA, 19 nt, Homo sapiens
cucuuauagaaaguucaaa

SEQ ID NO: 1420192 - RNA, 15 nt, Homo sapiens
cucuuauuugcucac

SEQ ID NO: 1420193 - RNA, 20 nt, Homo sapiens
cucuucagccccuagugcua

SEQ ID NO: 1420194 - RNA, 13 nt, Homo sapiens
cucuucuaugcaa

SEQ ID NO: 1420195 - RNA, 22 nt, Homo sapiens
cucuucuuccccagguccuucc

SEQ ID NO: 1420196 - RNA, 14 nt, Homo sapiens
cucuugaaccacag

SEQ ID NO: 1420197 - RNA, 20 nt, Homo sapiens
cucuugaauuccugggcuca

SEQ ID NO: 1420198 - RNA, 15 nt, Homo sapiens
cucuugccucucuca

SEQ ID NO: 1420199 - RNA, 19 nt, Homo sapiens
cucuuuauuuuuugauuga

SEQ ID NO: 1420200 - RNA, 15 nt, Homo sapiens
cugaaaaacauucca

SEQ ID NO: 1420201 - RNA, 13 nt, Homo sapiens
cugaaaaauguca

SEQ ID NO: 1420202 - RNA, 14 nt, Homo sapiens
cugaaaaaugucag

SEQ ID NO: 1420203 - RNA, 19 nt, Homo sapiens
cugaaaagacucaguguuc

SEQ ID NO: 1420204 - RNA, 12 nt, Homo sapiens
cugaaagacaga

SEQ ID NO: 1420205 - RNA, 19 nt, Homo sapiens
cugaaagacagaaugucac

SEQ ID NO: 1420206 - RNA, 12 nt, Homo sapiens
cugaaaugccuc

SEQ ID NO: 1420207 - RNA, 18 nt, Homo sapiens
cugaaccauuacuguaau

SEQ ID NO: 1420208 - RNA, 13 nt, Homo sapiens
cugaaccccaugg

SEQ ID NO: 1420209 - RNA, 17 nt, Homo sapiens
cugaaggagauuuuccu

SEQ ID NO: 1420210 - RNA, 22 nt, Homo sapiens
cugaaguuagggaugacuguga

SEQ ID NO: 1420211 - RNA, 21 nt, Homo sapiens
cugaauagcuucuccaaaggc

SEQ ID NO: 1420212 - RNA, 14 nt, Homo sapiens
cugaaugacaucaa

SEQ ID NO: 1420213 - RNA, 18 nt, Homo sapiens
cugaaugccucaauguga

SEQ ID NO: 1420214 - RNA, 20 nt, Homo sapiens
cugaaugccucaaugugacc

SEQ ID NO: 1420215 - RNA, 21 nt, Homo sapiens
cugaaugguuccaugccugag

SEQ ID NO: 1420216 - RNA, 18 nt, Homo sapiens
cugaaugucuuacuguga

SEQ ID NO: 1420217 - RNA, 21 nt, Homo sapiens
cugaaugucuuacugugauca

SEQ ID NO: 1420218 - RNA, 11 nt, Homo sapiens
cugacacaaga

SEQ ID NO: 1420219 - RNA, 17 nt, Homo sapiens
cugacacaggaaaccaa

SEQ ID NO: 1420220 - RNA, 16 nt, Homo sapiens
cugacaccaccaucua

SEQ ID NO: 1420221 - RNA, 18 nt, Homo sapiens
cugacagaaggacucagg

SEQ ID NO: 1420222 - RNA, 14 nt, Homo sapiens
cugacagugcccag

SEQ ID NO: 1420223 - RNA, 13 nt, Homo sapiens
cugcuaccaaggc

SEQ ID NO: 1420224 - RNA, 22 nt, Homo sapiens
cugcuauaugccuuaagccaau

SEQ ID NO: 1420225 - RNA, 15 nt, Homo sapiens
cugcucaaaucauuu

SEQ ID NO: 1420226 - RNA, 15 nt, Homo sapiens
cugcucauccagggu

SEQ ID NO: 1420227 - RNA, 19 nt, Homo sapiens
cugcucggggugcacagga

SEQ ID NO: 1420228 - RNA, 14 nt, Homo sapiens
cugcucugcuauau

SEQ ID NO: 1420229 - RNA, 20 nt, Homo sapiens
cugcugagcugcgugccaca

SEQ ID NO: 1420230 - RNA, 19 nt, Homo sapiens
cugcugaucaaugaaaugc

SEQ ID NO: 1420231 - RNA, 15 nt, Homo sapiens
cugcugcaaagugca

SEQ ID NO: 1420232 - RNA, 14 nt, Homo sapiens
cugcugcuaaggcu

SEQ ID NO: 1420233 - RNA, 19 nt, Homo sapiens
cugcugugcuagugccuga

SEQ ID NO: 1420234 - RNA, 21 nt, Homo sapiens
cugcuguugcuggacugagga

SEQ ID NO: 1420235 - RNA, 19 nt, Homo sapiens
cugcuucccagcuucacaa

SEQ ID NO: 1420236 - RNA, 15 nt, Homo sapiens
cugcuugcacuuugu

SEQ ID NO: 1420237 - RNA, 13 nt, Homo sapiens
cugcuuguuggcu

SEQ ID NO: 1420238 - RNA, 18 nt, Homo sapiens
cugcuuuugaggacaguu

SEQ ID NO: 1420239 - RNA, 14 nt, Homo sapiens
cuggaaaaugugac

SEQ ID NO: 1420240 - RNA, 15 nt, Homo sapiens
cuggaaaaugugacc

SEQ ID NO: 1420241 - RNA, 16 nt, Homo sapiens
cuggaaauaaaccugg

SEQ ID NO: 1420242 - RNA, 23 nt, Homo sapiens
cuggaagcauguaggagaaucca

SEQ ID NO: 1420243 - RNA, 16 nt, Homo sapiens
cuggaauggaauucag

SEQ ID NO: 1420244 - RNA, 18 nt, Homo sapiens
cuggacccuccacuucaa

SEQ ID NO: 1420245 - RNA, 18 nt, Homo sapiens
cuggacggggacugggga

SEQ ID NO: 1420246 - RNA, 15 nt, Homo sapiens
cuggacugaggacca

SEQ ID NO: 1420247 - RNA, 20 nt, Homo sapiens
cuggacuggguuuugucucu

SEQ ID NO: 1420248 - RNA, 17 nt, Homo sapiens
cuggacugugugcaacg

SEQ ID NO: 1420249 - RNA, 20 nt, Homo sapiens
cuggagaggggccugggaaa

SEQ ID NO: 1420250 - RNA, 17 nt, Homo sapiens
cuggagcaucugacuca

SEQ ID NO: 1420251 - RNA, 19 nt, Homo sapiens
cuggagcuggcuuugccaa

SEQ ID NO: 1420252 - RNA, 17 nt, Homo sapiens
cuggaggcaaauuucag

SEQ ID NO: 1420253 - RNA, 20 nt, Homo sapiens
cuggagugcaguggugcgau

SEQ ID NO: 1420254 - RNA, 13 nt, Homo sapiens
cuggagugcaguu

SEQ ID NO: 1420255 - RNA, 17 nt, Homo sapiens
cuggaucagcguggccu

SEQ ID NO: 1420256 - RNA, 20 nt, Homo sapiens
cuggaucguuugacgggacu

SEQ ID NO: 1420257 - RNA, 19 nt, Homo sapiens
cuggaugagacuuccaaac

SEQ ID NO: 1420258 - RNA, 18 nt, Homo sapiens
cuggauuguugacaugag

SEQ ID NO: 1420259 - RNA, 16 nt, Homo sapiens
cuggcacccaauguuu

SEQ ID NO: 1420260 - RNA, 22 nt, Homo sapiens
cuggcaccgcgugccaugcaua

SEQ ID NO: 1420261 - RNA, 21 nt, Homo sapiens
cuggcagagcccccaaggacu

SEQ ID NO: 1420262 - RNA, 16 nt, Homo sapiens
cuggcaugacacucua

SEQ ID NO: 1420263 - RNA, 22 nt, Homo sapiens
cuggccucagccgacugcacag

SEQ ID NO: 1420264 - RNA, 13 nt, Homo sapiens
cuggccucuagaa

SEQ ID NO: 1420265 - RNA, 21 nt, Homo sapiens
cuggccucuagaacacccacu

SEQ ID NO: 1420266 - RNA, 17 nt, Homo sapiens
cuggccugauugcagag

SEQ ID NO: 1420267 - RNA, 12 nt, Homo sapiens
ccaacacccaaa

SEQ ID NO: 1420268 - RNA, 13 nt, Homo sapiens
ccaacacccaaag

SEQ ID NO: 1420269 - RNA, 15 nt, Homo sapiens
ccaacacccugucua

SEQ ID NO: 1420270 - RNA, 22 nt, Homo sapiens
ccaacaggcuguucugcacuga

SEQ ID NO: 1420271 - RNA, 18 nt, Homo sapiens
ccaacagucaaaacagag

SEQ ID NO: 1420272 - RNA, 21 nt, Homo sapiens
ccaaccaacaaacaaugccau

SEQ ID NO: 1420273 - RNA, 14 nt, Homo sapiens
ccaacccaucagaa

SEQ ID NO: 1420274 - RNA, 13 nt, Homo sapiens
ccaacgcacagga

SEQ ID NO: 1420275 - RNA, 14 nt, Homo sapiens
ccaacugcugauca

SEQ ID NO: 1420276 - RNA, 23 nt, Homo sapiens
ccaagaacuuuucccccaaagau

SEQ ID NO: 1420277 - RNA, 17 nt, Homo sapiens
ccaagagagacauugcc

SEQ ID NO: 1420278 - RNA, 14 nt, Homo sapiens
ccaagaggucucca

SEQ ID NO: 1420279 - RNA, 21 nt, Homo sapiens
ccaagaugggcacaugaggag

SEQ ID NO: 1420280 - RNA, 21 nt, Homo sapiens
ccaagcuguuccacuucucua

SEQ ID NO: 1420281 - RNA, 20 nt, Homo sapiens
ccaaggguaugggaagccau

SEQ ID NO: 1420282 - RNA, 21 nt, Homo sapiens
ccaagugccaucccacauucg

SEQ ID NO: 1420283 - RNA, 17 nt, Homo sapiens
ccaaucauuugcaaugc

SEQ ID NO: 1420284 - RNA, 14 nt, Homo sapiens
ccaaucccgugaaa

SEQ ID NO: 1420285 - RNA, 17 nt, Homo sapiens
ccaaugcacacacacag

SEQ ID NO: 1420286 - RNA, 14 nt, Homo sapiens
ccaauggcuguaaa

SEQ ID NO: 1420287 - RNA, 17 nt, Homo sapiens
ccaauucauuucaucua

SEQ ID NO: 1420288 - RNA, 15 nt, Homo sapiens
ccaauuguacauucc

SEQ ID NO: 1420289 - RNA, 15 nt, Homo sapiens
ccaauuuuaaauaca

SEQ ID NO: 1420290 - RNA, 13 nt, Homo sapiens
ccacaaaugccac

SEQ ID NO: 1420291 - RNA, 15 nt, Homo sapiens
ccacaacugacacag

SEQ ID NO: 1420292 - RNA, 17 nt, Homo sapiens
ccacaagcaauggaccu

SEQ ID NO: 1420293 - RNA, 14 nt, Homo sapiens
ccacacagggugca

SEQ ID NO: 1420294 - RNA, 14 nt, Homo sapiens
ccacagaagccagg

SEQ ID NO: 1420295 - RNA, 24 nt, Homo sapiens
ccacagaauacaagccacuaccuu

SEQ ID NO: 1420296 - RNA, 23 nt, Homo sapiens
ccacagccaagguagggucacua

SEQ ID NO: 1420297 - RNA, 11 nt, Homo sapiens
ccacagggaac

SEQ ID NO: 1420298 - RNA, 11 nt, Homo sapiens
ccacaucuaag

SEQ ID NO: 1420299 - RNA, 13 nt, Homo sapiens
ccacauuggacuu

SEQ ID NO: 1420300 - RNA, 16 nt, Homo sapiens
ccaccacuucuuuuau

SEQ ID NO: 1420301 - RNA, 19 nt, Homo sapiens
ccaccauucacauuugaug

SEQ ID NO: 1420302 - RNA, 17 nt, Homo sapiens
ccacccucaaaugucag

SEQ ID NO: 1420303 - RNA, 21 nt, Homo sapiens
ccaccuaaaaacauuuacuga

SEQ ID NO: 1420304 - RNA, 12 nt, Homo sapiens
ccaccuaccugc

SEQ ID NO: 1420305 - RNA, 16 nt, Homo sapiens
ccaccugacaauggca

SEQ ID NO: 1420306 - RNA, 14 nt, Homo sapiens
ccaccugacaggcc

SEQ ID NO: 1420307 - RNA, 20 nt, Homo sapiens
ccaccuuugggaucagccuc

SEQ ID NO: 1420308 - RNA, 19 nt, Homo sapiens
ccacgaagcugugaacuca

SEQ ID NO: 1420309 - RNA, 16 nt, Homo sapiens
ccacgaugucaaggac

SEQ ID NO: 1420310 - RNA, 14 nt, Homo sapiens
ccacucccaaagcu

SEQ ID NO: 1420311 - RNA, 20 nt, Homo sapiens
ccacuccccccauaucuuua

SEQ ID NO: 1420312 - RNA, 22 nt, Homo sapiens
ccacuccccccauaucuuuaaa

SEQ ID NO: 1420313 - RNA, 24 nt, Homo sapiens
ccacuccuuauauugcugugagau

SEQ ID NO: 1420314 - RNA, 14 nt, Homo sapiens
ccacucugcucuga

SEQ ID NO: 1420315 - RNA, 15 nt, Homo sapiens
ccacucugcucugau

SEQ ID NO: 1420316 - RNA, 21 nt, Homo sapiens
ccacugaggaugugagccuga

SEQ ID NO: 1420317 - RNA, 15 nt, Homo sapiens
ccacugcaaauuuca

SEQ ID NO: 1420318 - RNA, 12 nt, Homo sapiens
ccacuggcauua

SEQ ID NO: 1420319 - RNA, 18 nt, Homo sapiens
ccacugggucucacuccu

SEQ ID NO: 1420320 - RNA, 19 nt, Homo sapiens
ccacugugcugaauucugc

SEQ ID NO: 1420321 - RNA, 15 nt, Homo sapiens
ccacuguguauuuaa

SEQ ID NO: 1420322 - RNA, 21 nt, Homo sapiens
ccacuugacauuccuugucac

SEQ ID NO: 1420323 - RNA, 16 nt, Homo sapiens
ccacuuugaguaccaa

SEQ ID NO: 1420324 - RNA, 19 nt, Homo sapiens
ccagaaaaaaaaaaacuua

SEQ ID NO: 1420325 - RNA, 16 nt, Homo sapiens
ccagaaagaggcagug

SEQ ID NO: 1420326 - RNA, 13 nt, Homo sapiens
ccagaaccuggag

SEQ ID NO: 1420327 - RNA, 16 nt, Homo sapiens
ccagaagaauauucag

SEQ ID NO: 1420328 - RNA, 21 nt, Homo sapiens
ccagaauaaaacgcaaagggc

SEQ ID NO: 1420329 - RNA, 22 nt, Homo sapiens
ccagaauauuuauccuucacca

SEQ ID NO: 1420330 - RNA, 18 nt, Homo sapiens
ccagaccccuguggcaga

SEQ ID NO: 1420331 - RNA, 18 nt, Homo sapiens
ccagacugguuagacagu

SEQ ID NO: 1420332 - RNA, 11 nt, Homo sapiens
ccagacugugg

SEQ ID NO: 1420333 - RNA, 14 nt, Homo sapiens
ccagagaauucuua

SEQ ID NO: 1420334 - RNA, 18 nt, Homo sapiens
ccagagacggaagccuuu

SEQ ID NO: 1420335 - RNA, 17 nt, Homo sapiens
ccagagcccaagugcca

SEQ ID NO: 1420336 - RNA, 21 nt, Homo sapiens
ccagagccccccacaaugaug

SEQ ID NO: 1420337 - RNA, 20 nt, Homo sapiens
ccagagccuggggcucuaac

SEQ ID NO: 1420338 - RNA, 18 nt, Homo sapiens
ccagagcuggaaggcagg

SEQ ID NO: 1420339 - RNA, 18 nt, Homo sapiens
ccagaggcagagccugag

SEQ ID NO: 1420340 - RNA, 15 nt, Homo sapiens
ccagagugcugccag

SEQ ID NO: 1420341 - RNA, 19 nt, Homo sapiens
ccagagugugcagacugau

SEQ ID NO: 1420342 - RNA, 18 nt, Homo sapiens
ccagaucgauccuggauu

SEQ ID NO: 1420343 - RNA, 12 nt, Homo sapiens
ccagcaaagagu

SEQ ID NO: 1420344 - RNA, 16 nt, Homo sapiens
ccagcaacacaagcug

SEQ ID NO: 1420345 - RNA, 16 nt, Homo sapiens
ccagcagugguauuaa

SEQ ID NO: 1420346 - RNA, 14 nt, Homo sapiens
ccagccuccaugcu

SEQ ID NO: 1420347 - RNA, 13 nt, Homo sapiens
ccagcuacaagga

SEQ ID NO: 1420348 - RNA, 15 nt, Homo sapiens
ccagcuccaguuucc

SEQ ID NO: 1420349 - RNA, 16 nt, Homo sapiens
ccaggaaggacugugc

SEQ ID NO: 1420350 - RNA, 13 nt, Homo sapiens
ccaggaaugccuc

SEQ ID NO: 1420351 - RNA, 19 nt, Homo sapiens
ccaggaguucugaagcuga

SEQ ID NO: 1420352 - RNA, 14 nt, Homo sapiens
auaaccccaggcau

SEQ ID NO: 1420353 - RNA, 14 nt, Homo sapiens
auaacuuauaucau

SEQ ID NO: 1420354 - RNA, 21 nt, Homo sapiens
auaacuuauaucaucagcaua

SEQ ID NO: 1420355 - RNA, 13 nt, Homo sapiens
auaacuugauaua

SEQ ID NO: 1420356 - RNA, 15 nt, Homo sapiens
auaagaaacaugaug

SEQ ID NO: 1420357 - RNA, 14 nt, Homo sapiens
auaagaacgucauu

SEQ ID NO: 1420358 - RNA, 13 nt, Homo sapiens
auaagacuacuau

SEQ ID NO: 1420359 - RNA, 16 nt, Homo sapiens
auaagauuaaaggaag

SEQ ID NO: 1420360 - RNA, 19 nt, Homo sapiens
auaagcagaagcacauaug

SEQ ID NO: 1420361 - RNA, 14 nt, Homo sapiens
auaagcauucaaua

SEQ ID NO: 1420362 - RNA, 19 nt, Homo sapiens
auaagcucaugagaugaca

SEQ ID NO: 1420363 - RNA, 17 nt, Homo sapiens
auaagcucccagggccu

SEQ ID NO: 1420364 - RNA, 19 nt, Homo sapiens
auaaggaucagaacagcag

SEQ ID NO: 1420365 - RNA, 20 nt, Homo sapiens
auaaguccacaucuucucag

SEQ ID NO: 1420366 - RNA, 16 nt, Homo sapiens
auaaguuccauguuaa

SEQ ID NO: 1420367 - RNA, 15 nt, Homo sapiens
auaaugaacagcaga

SEQ ID NO: 1420368 - RNA, 13 nt, Homo sapiens
auaauuaaugugu

SEQ ID NO: 1420369 - RNA, 23 nt, Homo sapiens
auaauuaggaucuaugcaauuuu

SEQ ID NO: 1420370 - RNA, 19 nt, Homo sapiens
auaauuuucuggcacuggu

SEQ ID NO: 1420371 - RNA, 14 nt, Homo sapiens
auacaaacaagcac

SEQ ID NO: 1420372 - RNA, 14 nt, Homo sapiens
auacaauuugcacu

SEQ ID NO: 1420373 - RNA, 20 nt, Homo sapiens
auacacacauauacauauau

SEQ ID NO: 1420374 - RNA, 17 nt, Homo sapiens
auacaccuacuacucaa

SEQ ID NO: 1420375 - RNA, 22 nt, Homo sapiens
auacagcccucccccagcaguu

SEQ ID NO: 1420376 - RNA, 13 nt, Homo sapiens
auacauauauauc

SEQ ID NO: 1420377 - RNA, 20 nt, Homo sapiens
auacauggaaacgcaaauga

SEQ ID NO: 1420378 - RNA, 15 nt, Homo sapiens
auacauguguguaua

SEQ ID NO: 1420379 - RNA, 15 nt, Homo sapiens
auaccagaucacuca

SEQ ID NO: 1420380 - RNA, 17 nt, Homo sapiens
auaccaguacucaguau

SEQ ID NO: 1420381 - RNA, 18 nt, Homo sapiens
auaccagugaaccaaaga

SEQ ID NO: 1420382 - RNA, 19 nt, Homo sapiens
auaccagugaaccaaagag

SEQ ID NO: 1420383 - RNA, 20 nt, Homo sapiens
acuagaauagugcauuguau

SEQ ID NO: 1420384 - RNA, 17 nt, Homo sapiens
acuagagccugugcuaa

SEQ ID NO: 1420385 - RNA, 22 nt, Homo sapiens
acuagagcugggaaacagggag

SEQ ID NO: 1420386 - RNA, 18 nt, Homo sapiens
acuagagggauacacuga

SEQ ID NO: 1420387 - RNA, 19 nt, Homo sapiens
acuaguauuguccauauca

SEQ ID NO: 1420388 - RNA, 22 nt, Homo sapiens
acuaguguguguguguauauau

SEQ ID NO: 1420389 - RNA, 18 nt, Homo sapiens
acuauaaacuacuguaau

SEQ ID NO: 1420390 - RNA, 21 nt, Homo sapiens
acuauaaagcaguagacaauc

SEQ ID NO: 1420391 - RNA, 21 nt, Homo sapiens
acuauaagcagaagcacauau

SEQ ID NO: 1420392 - RNA, 14 nt, Homo sapiens
acuauagcccaggu

SEQ ID NO: 1420393 - RNA, 14 nt, Homo sapiens
acuaucacauacaa

SEQ ID NO: 1420394 - RNA, 14 nt, Homo sapiens
acuauggagccugg

SEQ ID NO: 1420395 - RNA, 17 nt, Homo sapiens
acuauggguacauucca

SEQ ID NO: 1420396 - RNA, 17 nt, Homo sapiens
acuaugguucccaauaa

SEQ ID NO: 1420397 - RNA, 12 nt, Homo sapiens
acuaugugaugu

SEQ ID NO: 1420398 - RNA, 22 nt, Homo sapiens
acuauguuccaauaaaacuuua

SEQ ID NO: 1420399 - RNA, 15 nt, Homo sapiens
acuauucaaacaguc

SEQ ID NO: 1420400 - RNA, 17 nt, Homo sapiens
acuauuuaugaaggcaa

SEQ ID NO: 1420401 - RNA, 13 nt, Homo sapiens
acucaacaauaaa

SEQ ID NO: 1420402 - RNA, 18 nt, Homo sapiens
acucaaccaucaauggaa

SEQ ID NO: 1420403 - RNA, 15 nt, Homo sapiens
acucaagucuggauc

SEQ ID NO: 1420404 - RNA, 15 nt, Homo sapiens
acucaauaugugauu

SEQ ID NO: 1420405 - RNA, 20 nt, Homo sapiens
acucacuccacaacccaaga

SEQ ID NO: 1420406 - RNA, 16 nt, Homo sapiens
acucagacauuccaag

SEQ ID NO: 1420407 - RNA, 15 nt, Homo sapiens
acucagacuguugca

SEQ ID NO: 1420408 - RNA, 17 nt, Homo sapiens
acucagcacagcagugg

SEQ ID NO: 1420409 - RNA, 17 nt, Homo sapiens
acucaguuguuccuacu

SEQ ID NO: 1420410 - RNA, 13 nt, Homo sapiens
acucauaacucau

SEQ ID NO: 1420411 - RNA, 14 nt, Homo sapiens
acucauaaggcaua

SEQ ID NO: 1420412 - RNA, 20 nt, Homo sapiens
acucauaggcuuauuuccaa

SEQ ID NO: 1420413 - RNA, 13 nt, Homo sapiens
acucauugucuca

SEQ ID NO: 1420414 - RNA, 14 nt, Homo sapiens
acucauugucucag

SEQ ID NO: 1420415 - RNA, 23 nt, Homo sapiens
acucauuuuuguuuucauuaucu

SEQ ID NO: 1420416 - RNA, 18 nt, Homo sapiens
acuccaagcuucaaguga

SEQ ID NO: 1420417 - RNA, 13 nt, Homo sapiens
acuccagaaucca

SEQ ID NO: 1420418 - RNA, 15 nt, Homo sapiens
acuccagcccugucc

SEQ ID NO: 1420419 - RNA, 14 nt, Homo sapiens
acuccauacauaac

SEQ ID NO: 1420420 - RNA, 22 nt, Homo sapiens
acucccacuggaacagcccauu

SEQ ID NO: 1420421 - RNA, 14 nt, Homo sapiens
acucccauuuuccc

SEQ ID NO: 1420422 - RNA, 14 nt, Homo sapiens
acucccuccaugug

SEQ ID NO: 1420423 - RNA, 22 nt, Homo sapiens
acuccucagaucugaacacagu

SEQ ID NO: 1420424 - RNA, 16 nt, Homo sapiens
acuccugccaguugaa

SEQ ID NO: 1420425 - RNA, 17 nt, Homo sapiens
acuccuggagauuucag

SEQ ID NO: 1420426 - RNA, 20 nt, Homo sapiens
acuccuuauauugcugugag

SEQ ID NO: 1420427 - RNA, 23 nt, Homo sapiens
acuccuuccagcuagugacccac

SEQ ID NO: 1420428 - RNA, 17 nt, Homo sapiens
acuccuuugcauuccau

SEQ ID NO: 1420429 - RNA, 15 nt, Homo sapiens
acucuaccugcaaga

SEQ ID NO: 1420430 - RNA, 21 nt, Homo sapiens
acucuagccugggccagagaa

SEQ ID NO: 1420431 - RNA, 21 nt, Homo sapiens
acucuaggggucaggcuccau

SEQ ID NO: 1420432 - RNA, 21 nt, Homo sapiens
acucucaccgacuuauucuga

SEQ ID NO: 1420433 - RNA, 23 nt, Homo sapiens
acucucuagcuuuaggggaccau

SEQ ID NO: 1420434 - RNA, 19 nt, Homo sapiens
acucucuugccagcauuuu

SEQ ID NO: 1420435 - RNA, 13 nt, Homo sapiens
acucugcucugau

SEQ ID NO: 1420436 - RNA, 20 nt, Homo sapiens
acucuggagagacugugcug

SEQ ID NO: 1420437 - RNA, 22 nt, Homo sapiens
acucuggguuuauuacauggca

SEQ ID NO: 1420438 - RNA, 22 nt, Homo sapiens
acucuggguuucauauccagcu

SEQ ID NO: 1420439 - RNA, 21 nt, Homo sapiens
acucuuauagaaaguucaaaa

SEQ ID NO: 1420440 - RNA, 16 nt, Homo sapiens
acucuuaugaaauggg

SEQ ID NO: 1420441 - RNA, 19 nt, Homo sapiens
acucuuguuuucaguuuca

SEQ ID NO: 1420442 - RNA, 16 nt, Homo sapiens
acugaaaaaugucagu

SEQ ID NO: 1420443 - RNA, 14 nt, Homo sapiens
acugaaaacuguaa

SEQ ID NO: 1420444 - RNA, 15 nt, Homo sapiens
acugaaaacuguaaa

SEQ ID NO: 1420445 - RNA, 13 nt, Homo sapiens
acugaagaccucc

SEQ ID NO: 1420446 - RNA, 22 nt, Homo sapiens
acugaauauuaucaguggcugc

SEQ ID NO: 1420447 - RNA, 19 nt, Homo sapiens
acugaauguuuauuccuug

SEQ ID NO: 1420448 - RNA, 14 nt, Homo sapiens
acugacacaggaaa

SEQ ID NO: 1420449 - RNA, 12 nt, Homo sapiens
acugacauuucu

SEQ ID NO: 1420450 - RNA, 13 nt, Homo sapiens
acugagaucuguu

SEQ ID NO: 1420451 - RNA, 21 nt, Homo sapiens
ggagccugaacaugacauuuc

SEQ ID NO: 1420452 - RNA, 22 nt, Homo sapiens
ggagccugaacaugacauuucu

SEQ ID NO: 1420453 - RNA, 20 nt, Homo sapiens
ggagcugaggaggugccuug

SEQ ID NO: 1420454 - RNA, 19 nt, Homo sapiens
ggagcuggaaauaaaccug

SEQ ID NO: 1420455 - RNA, 13 nt, Homo sapiens
ggagcuugcagug

SEQ ID NO: 1420456 - RNA, 22 nt, Homo sapiens
ggagcuuguauauacuucacuc

SEQ ID NO: 1420457 - RNA, 19 nt, Homo sapiens
ggaggacgguuaacuugua

SEQ ID NO: 1420458 - RNA, 16 nt, Homo sapiens
ggaggauggcacuccg

SEQ ID NO: 1420459 - RNA, 14 nt, Homo sapiens
ggaggucgacccca

SEQ ID NO: 1420460 - RNA, 20 nt, Homo sapiens
ggagguggagguugcaguga

SEQ ID NO: 1420461 - RNA, 20 nt, Homo sapiens
ggaguagcauggacucuggg

SEQ ID NO: 1420462 - RNA, 24 nt, Homo sapiens
ggaguagcugagaggaagaugaag

SEQ ID NO: 1420463 - RNA, 23 nt, Homo sapiens
ggaguaguugcuacucuucagaa

SEQ ID NO: 1420464 - RNA, 20 nt, Homo sapiens
ggauaauauccacugcaaua

SEQ ID NO: 1420465 - RNA, 17 nt, Homo sapiens
ggauaccagauauuuga

SEQ ID NO: 1420466 - RNA, 15 nt, Homo sapiens
ggauauuuucuucca

SEQ ID NO: 1420467 - RNA, 20 nt, Homo sapiens
ggauccccagccuacugccu

SEQ ID NO: 1420468 - RNA, 21 nt, Homo sapiens
ggauccuauucucaccaggaa

SEQ ID NO: 1420469 - RNA, 19 nt, Homo sapiens
ggaucuccaaggaccaggu

SEQ ID NO: 1420470 - RNA, 21 nt, Homo sapiens
ggaugacgugaagccacagga

SEQ ID NO: 1420471 - RNA, 14 nt, Homo sapiens
ggaugcacagagau

SEQ ID NO: 1420472 - RNA, 20 nt, Homo sapiens
ggaugcacagagauaugcac

SEQ ID NO: 1420473 - RNA, 14 nt, Homo sapiens
ggauggcaccagag

SEQ ID NO: 1420474 - RNA, 20 nt, Homo sapiens
ggaugggggucaggggcuag

SEQ ID NO: 1420475 - RNA, 16 nt, Homo sapiens
ggauguguuuugcacg

SEQ ID NO: 1420476 - RNA, 21 nt, Homo sapiens
ggauuaauguuuuguacaauu

SEQ ID NO: 1420477 - RNA, 14 nt, Homo sapiens
ggauuauucauuua

SEQ ID NO: 1420478 - RNA, 14 nt, Homo sapiens
ggauucaggaaaag

SEQ ID NO: 1420479 - RNA, 22 nt, Homo sapiens
ggauuccuaagcagugcuugua

SEQ ID NO: 1420480 - RNA, 15 nt, Homo sapiens
ggauugacaggccau

SEQ ID NO: 1420481 - RNA, 15 nt, Homo sapiens
ggauugcagacucau

SEQ ID NO: 1420482 - RNA, 19 nt, Homo sapiens
ggauuggcuauaacauguc

SEQ ID NO: 1420483 - RNA, 15 nt, Homo sapiens
ggauuuauauucaag

SEQ ID NO: 1420484 - RNA, 20 nt, Homo sapiens
ggauuugaugaaagugcaaa

SEQ ID NO: 1420485 - RNA, 22 nt, Homo sapiens
ggcaaagaacugccccaucucc

SEQ ID NO: 1420486 - RNA, 14 nt, Homo sapiens
ggcaaagugcugua

SEQ ID NO: 1420487 - RNA, 15 nt, Homo sapiens
ggcaaaugacaugca

SEQ ID NO: 1420488 - RNA, 22 nt, Homo sapiens
ggcaaaugacaugcacugaccc

SEQ ID NO: 1420489 - RNA, 22 nt, Homo sapiens
ggcaacccaccaucuacccacu

SEQ ID NO: 1420490 - RNA, 19 nt, Homo sapiens
ggcaacccucacuguguug

SEQ ID NO: 1420491 - RNA, 16 nt, Homo sapiens
ggcaagggcaacccac

SEQ ID NO: 1420492 - RNA, 14 nt, Homo sapiens
ggcaagggguuucc

SEQ ID NO: 1420493 - RNA, 21 nt, Homo sapiens
ggcaauaaguuccauguuaaa

SEQ ID NO: 1420494 - RNA, 16 nt, Homo sapiens
ggcaauaucuuuaaua

SEQ ID NO: 1420495 - RNA, 13 nt, Homo sapiens
ggcaaugcaaaag

SEQ ID NO: 1420496 - RNA, 18 nt, Homo sapiens
ggcaauuguccccaggga

SEQ ID NO: 1420497 - RNA, 22 nt, Homo sapiens
ggcaccuccuacgucaaacaug

SEQ ID NO: 1420498 - RNA, 11 nt, Homo sapiens
ggcacugggau

SEQ ID NO: 1420499 - RNA, 15 nt, Homo sapiens
ggcagagccaugggc

SEQ ID NO: 1420500 - RNA, 18 nt, Homo sapiens
ggcagcaucagggacaca

SEQ ID NO: 1420501 - RNA, 16 nt, Homo sapiens
ggcagcugucauggaa

SEQ ID NO: 1420502 - RNA, 17 nt, Homo sapiens
ggcaggcagaucacaag

SEQ ID NO: 1420503 - RNA, 14 nt, Homo sapiens
ggcagguuugccag

SEQ ID NO: 1420504 - RNA, 21 nt, Homo sapiens
gggcuuguagaccacuguccu

SEQ ID NO: 1420505 - RNA, 19 nt, Homo sapiens
ggggcaaagaaaagccaga

SEQ ID NO: 1420506 - RNA, 21 nt, Homo sapiens
ggggcugacuucaauccaugu

SEQ ID NO: 1420507 - RNA, 16 nt, Homo sapiens
gggggccuucacagug

SEQ ID NO: 1420508 - RNA, 21 nt, Homo sapiens
gggguauuuuaggcagggauu

SEQ ID NO: 1420509 - RNA, 15 nt, Homo sapiens
gggguccugauuuca

SEQ ID NO: 1420510 - RNA, 21 nt, Homo sapiens
ggguaucccagaccccucuca

SEQ ID NO: 1420511 - RNA, 21 nt, Homo sapiens
ggguauccuacuacuuugugu

SEQ ID NO: 1420512 - RNA, 21 nt, Homo sapiens
gggucaaagccgguugcagag

SEQ ID NO: 1420513 - RNA, 20 nt, Homo sapiens
ggguccacccagcaaagagu

SEQ ID NO: 1420514 - RNA, 18 nt, Homo sapiens
ggguccuccacaauaagg

SEQ ID NO: 1420515 - RNA, 15 nt, Homo sapiens
ggguccuugguguga

SEQ ID NO: 1420516 - RNA, 16 nt, Homo sapiens
ggguggggggaaugag

SEQ ID NO: 1420517 - RNA, 19 nt, Homo sapiens
ggguggucugagcaccccc

SEQ ID NO: 1420518 - RNA, 11 nt, Homo sapiens
gggugugauga

SEQ ID NO: 1420519 - RNA, 22 nt, Homo sapiens
ggguuccuuuuucaacuuggaa

SEQ ID NO: 1420520 - RNA, 20 nt, Homo sapiens
ggguuucaccaucuuggcca

SEQ ID NO: 1420521 - RNA, 20 nt, Homo sapiens
gguaaccgaacuggugcuuu

SEQ ID NO: 1420522 - RNA, 14 nt, Homo sapiens
gguaauuguugcua

SEQ ID NO: 1420523 - RNA, 18 nt, Homo sapiens
gguaauuuguaucugaag

SEQ ID NO: 1420524 - RNA, 19 nt, Homo sapiens
gguacauuucccugugcug

SEQ ID NO: 1420525 - RNA, 16 nt, Homo sapiens
gguacuacaaccaauu

SEQ ID NO: 1420526 - RNA, 14 nt, Homo sapiens
gguagcgagcugcu

SEQ ID NO: 1420527 - RNA, 16 nt, Homo sapiens
gguagcuuaccugaca

SEQ ID NO: 1420528 - RNA, 16 nt, Homo sapiens
gguagggccagcucac

SEQ ID NO: 1420529 - RNA, 13 nt, Homo sapiens
gguaguacuggga

SEQ ID NO: 1420530 - RNA, 23 nt, Homo sapiens
gguauuucaaaacacaucuuucc

SEQ ID NO: 1420531 - RNA, 19 nt, Homo sapiens
gguauuugcuuuguaacuc

SEQ ID NO: 1420532 - RNA, 16 nt, Homo sapiens
ggucaagggccaguca

SEQ ID NO: 1420533 - RNA, 15 nt, Homo sapiens
ggucacauucaggaa

SEQ ID NO: 1420534 - RNA, 14 nt, Homo sapiens
ggucagcgugcuua

SEQ ID NO: 1420535 - RNA, 18 nt, Homo sapiens
gacaggauaagagggauu

SEQ ID NO: 1420536 - RNA, 23 nt, Homo sapiens
gacaggcccaagagaugaagagu

SEQ ID NO: 1420537 - RNA, 19 nt, Homo sapiens
gacagugcccaugcaaugg

SEQ ID NO: 1420538 - RNA, 14 nt, Homo sapiens
gacagugcugcccu

SEQ ID NO: 1420539 - RNA, 21 nt, Homo sapiens
gacaguuacucuucaguuuua

SEQ ID NO: 1420540 - RNA, 15 nt, Homo sapiens
gacaugcacugaccc

SEQ ID NO: 1420541 - RNA, 21 nt, Homo sapiens
gacaugccacccucuccaugc

SEQ ID NO: 1420542 - RNA, 17 nt, Homo sapiens
gacauggaauuaccuua

SEQ ID NO: 1420543 - RNA, 13 nt, Homo sapiens
gacaugucucaca

SEQ ID NO: 1420544 - RNA, 16 nt, Homo sapiens
gacaugucucacagac

SEQ ID NO: 1420545 - RNA, 14 nt, Homo sapiens
gacauuaaaccugg

SEQ ID NO: 1420546 - RNA, 16 nt, Homo sapiens
gacauuaaaccuggau

SEQ ID NO: 1420547 - RNA, 19 nt, Homo sapiens
gacauugcuucugcuaaau

SEQ ID NO: 1420548 - RNA, 21 nt, Homo sapiens
gacauuggauguggagcuccu

SEQ ID NO: 1420549 - RNA, 18 nt, Homo sapiens
gaccaaagccaccaagac

SEQ ID NO: 1420550 - RNA, 17 nt, Homo sapiens
gaccaaauaaaguacca

SEQ ID NO: 1420551 - RNA, 13 nt, Homo sapiens
gaccaauauucaa

SEQ ID NO: 1420552 - RNA, 19 nt, Homo sapiens
gaccacaccuaaaacugcc

SEQ ID NO: 1420553 - RNA, 18 nt, Homo sapiens
gaccacaggugccuacca

SEQ ID NO: 1420554 - RNA, 20 nt, Homo sapiens
gaccacccgcccuggcaguu

SEQ ID NO: 1420555 - RNA, 11 nt, Homo sapiens
gaccacugucc

SEQ ID NO: 1420556 - RNA, 17 nt, Homo sapiens
gaccaggccugagcaac

SEQ ID NO: 1420557 - RNA, 15 nt, Homo sapiens
gaccaguacugggaa

SEQ ID NO: 1420558 - RNA, 23 nt, Homo sapiens
gaccagugaaagaguagugcauu

SEQ ID NO: 1420559 - RNA, 16 nt, Homo sapiens
gaccauccuauuuaac

SEQ ID NO: 1420560 - RNA, 22 nt, Homo sapiens
gaccauccuggcuaacacguga

SEQ ID NO: 1420561 - RNA, 14 nt, Homo sapiens
gaccauugucuucc

SEQ ID NO: 1420562 - RNA, 24 nt, Homo sapiens
gaccccagggcacaggagcuaccu

SEQ ID NO: 1420563 - RNA, 13 nt, Homo sapiens
gaccccaucucau

SEQ ID NO: 1420564 - RNA, 13 nt, Homo sapiens
gaccccaucucuu

SEQ ID NO: 1420565 - RNA, 17 nt, Homo sapiens
gaccccuggccggccca

SEQ ID NO: 1420566 - RNA, 21 nt, Homo sapiens
gacccuaagaccggcggccau

SEQ ID NO: 1420567 - RNA, 17 nt, Homo sapiens
gacccucccuaccugag

SEQ ID NO: 1420568 - RNA, 12 nt, Homo sapiens
gaccgugcagcu

SEQ ID NO: 1420569 - RNA, 22 nt, Homo sapiens
gaccgugcuaacuguguguaca

SEQ ID NO: 1420570 - RNA, 18 nt, Homo sapiens
gaccguuuuuacuaagua

SEQ ID NO: 1420571 - RNA, 15 nt, Homo sapiens
gaccuccagcuuucc

SEQ ID NO: 1420572 - RNA, 20 nt, Homo sapiens
gaccuccccacccccgcugg

SEQ ID NO: 1420573 - RNA, 23 nt, Homo sapiens
gaccugacaccgucccucaguga

SEQ ID NO: 1420574 - RNA, 20 nt, Homo sapiens
gaccugaggcuccugugcua

SEQ ID NO: 1420575 - RNA, 16 nt, Homo sapiens
gaccuuccacacaggg

SEQ ID NO: 1420576 - RNA, 20 nt, Homo sapiens
gaccuuggagagacacagcg

SEQ ID NO: 1420577 - RNA, 17 nt, Homo sapiens
gaccuuucagcugugaa

SEQ ID NO: 1420578 - RNA, 23 nt, Homo sapiens
gacgcagcccugggggccagcug

SEQ ID NO: 1420579 - RNA, 17 nt, Homo sapiens
gacgcccugcucuggau

SEQ ID NO: 1420580 - RNA, 13 nt, Homo sapiens
gcugaagucauug

SEQ ID NO: 1420581 - RNA, 16 nt, Homo sapiens
gcugaauuucaggcau

SEQ ID NO: 1420582 - RNA, 13 nt, Homo sapiens
gcugacauggcuu

SEQ ID NO: 1420583 - RNA, 17 nt, Homo sapiens
gcugagaagaagcugag

SEQ ID NO: 1420584 - RNA, 21 nt, Homo sapiens
gcugaggggcuucaaccacuc

SEQ ID NO: 1420585 - RNA, 16 nt, Homo sapiens
gcugagugcaccacuu

SEQ ID NO: 1420586 - RNA, 19 nt, Homo sapiens
gcugagugcaccacuucaa

SEQ ID NO: 1420587 - RNA, 19 nt, Homo sapiens
gcugaguuuccccacuuua

SEQ ID NO: 1420588 - RNA, 17 nt, Homo sapiens
gcugaugaugucucuug

SEQ ID NO: 1420589 - RNA, 21 nt, Homo sapiens
gcugcacaucacaacauuuac

SEQ ID NO: 1420590 - RNA, 14 nt, Homo sapiens
gcugcagugaccca

SEQ ID NO: 1420591 - RNA, 16 nt, Homo sapiens
gcugccaagcacucga

SEQ ID NO: 1420592 - RNA, 10 nt, Homo sapiens
gcugcugaga

SEQ ID NO: 1420593 - RNA, 13 nt, Homo sapiens
gcugcuggaagaa

SEQ ID NO: 1420594 - RNA, 16 nt, Homo sapiens
gcugcugugugccuuc

SEQ ID NO: 1420595 - RNA, 22 nt, Homo sapiens
gcugcuugacuaucacauacaa

SEQ ID NO: 1420596 - RNA, 18 nt, Homo sapiens
gcuggaaauaaaccugga

SEQ ID NO: 1420597 - RNA, 23 nt, Homo sapiens
gcuggaagaaggaagaagccaga

SEQ ID NO: 1420598 - RNA, 16 nt, Homo sapiens
gcuggagcccagcauu

SEQ ID NO: 1420599 - RNA, 19 nt, Homo sapiens
gcuggaggacuagaaccug

SEQ ID NO: 1420600 - RNA, 17 nt, Homo sapiens
gcuggauaaaaugucag

SEQ ID NO: 1420601 - RNA, 14 nt, Homo sapiens
gcuggcacugagca

SEQ ID NO: 1420602 - RNA, 23 nt, Homo sapiens
gcugggaaaaaaguuuugaugaa

SEQ ID NO: 1420603 - RNA, 15 nt, Homo sapiens
gcugggaacauguac

SEQ ID NO: 1420604 - RNA, 12 nt, Homo sapiens
gcugguccugag

SEQ ID NO: 1420605 - RNA, 15 nt, Homo sapiens
gcuguaaauacaugu

SEQ ID NO: 1420606 - RNA, 20 nt, Homo sapiens
gcuguacccuuccaccuccu

SEQ ID NO: 1420607 - RNA, 15 nt, Homo sapiens
gcugucgcaucucag

SEQ ID NO: 1420608 - RNA, 16 nt, Homo sapiens
gcugugaacauggacu

SEQ ID NO: 1420609 - RNA, 16 nt, Homo sapiens
gcugugcuagugccug

SEQ ID NO: 1420610 - RNA, 15 nt, Homo sapiens
gcuguggccagggug

SEQ ID NO: 1420611 - RNA, 15 nt, Homo sapiens
gcugugggugcuaag

SEQ ID NO: 1420612 - RNA, 15 nt, Homo sapiens
gcuguuccacuucuc

SEQ ID NO: 1420613 - RNA, 13 nt, Homo sapiens
gaaaaacuuccau

SEQ ID NO: 1420614 - RNA, 21 nt, Homo sapiens
gaaaacauuccaaaacuuuaa

SEQ ID NO: 1420615 - RNA, 12 nt, Homo sapiens
gaaaaccauaug

SEQ ID NO: 1420616 - RNA, 17 nt, Homo sapiens
gaaaaccauuaccugac

SEQ ID NO: 1420617 - RNA, 15 nt, Homo sapiens
gaaaacuuauuugag

SEQ ID NO: 1420618 - RNA, 18 nt, Homo sapiens
gaaaagaaaaaaaauaau

SEQ ID NO: 1420619 - RNA, 12 nt, Homo sapiens
gaaaagccagag

SEQ ID NO: 1420620 - RNA, 20 nt, Homo sapiens
gaaaaguagaauuauaucua

SEQ ID NO: 1420621 - RNA, 14 nt, Homo sapiens
gaaaauaaaccaag

SEQ ID NO: 1420622 - RNA, 18 nt, Homo sapiens
gaaaauacauaagaccau

SEQ ID NO: 1420623 - RNA, 16 nt, Homo sapiens
gaaaauagcucuuuca

SEQ ID NO: 1420624 - RNA, 22 nt, Homo sapiens
gaaaauauauuuaauaccuuug

SEQ ID NO: 1420625 - RNA, 14 nt, Homo sapiens
gaaaauccauggau

SEQ ID NO: 1420626 - RNA, 17 nt, Homo sapiens
gaaaauccauggauauc

SEQ ID NO: 1420627 - RNA, 23 nt, Homo sapiens
gaaaauuguauguuaaguuacuu

SEQ ID NO: 1420628 - RNA, 20 nt, Homo sapiens
gaaacaaaaaaguguucccu

SEQ ID NO: 1420629 - RNA, 22 nt, Homo sapiens
gaaacagggagccccuaggaaa

SEQ ID NO: 1420630 - RNA, 18 nt, Homo sapiens
gaaacaugacacugaccu

SEQ ID NO: 1420631 - RNA, 16 nt, Homo sapiens
gaaacaugaugugaga

SEQ ID NO: 1420632 - RNA, 17 nt, Homo sapiens
gaaacauuaugccuuaa

SEQ ID NO: 1420633 - RNA, 16 nt, Homo sapiens
gaaaccaacacccaaa

SEQ ID NO: 1420634 - RNA, 20 nt, Homo sapiens
gaaacccauuaggcaugccu

SEQ ID NO: 1420635 - RNA, 12 nt, Homo sapiens
gaaaccuugcag

SEQ ID NO: 1420636 - RNA, 21 nt, Homo sapiens
gaaacuccuuuugcugucuuu

SEQ ID NO: 1420637 - RNA, 16 nt, Homo sapiens
gaaacuguuaucacuu

SEQ ID NO: 1420638 - RNA, 16 nt, Homo sapiens
gaaagaaaaauaccau

SEQ ID NO: 1420639 - RNA, 15 nt, Homo sapiens
gaaagaaacacucaa

SEQ ID NO: 1420640 - RNA, 18 nt, Homo sapiens
gaaagaaagcaccuguuu

SEQ ID NO: 1420641 - RNA, 18 nt, Homo sapiens
gaaagaaucagucuugca

SEQ ID NO: 1420642 - RNA, 18 nt, Homo sapiens
gaaagaauuugccuucuc

SEQ ID NO: 1420643 - RNA, 18 nt, Homo sapiens
gaaagacuauucaaacag

SEQ ID NO: 1420644 - RNA, 18 nt, Homo sapiens
gaaagauccacccucaaa

SEQ ID NO: 1420645 - RNA, 15 nt, Homo sapiens
gaaagcacaccucau

SEQ ID NO: 1420646 - RNA, 16 nt, Homo sapiens
gaaaggaaagccaaac

SEQ ID NO: 1420647 - RNA, 14 nt, Homo sapiens
gaaaguaugugaua

SEQ ID NO: 1420648 - RNA, 12 nt, Homo sapiens
gaaagugauauc

SEQ ID NO: 1420649 - RNA, 16 nt, Homo sapiens
gaaaguggcucuucua

SEQ ID NO: 1420650 - RNA, 20 nt, Homo sapiens
gaaauaccagugaaccaaag

SEQ ID NO: 1420651 - RNA, 15 nt, Homo sapiens
gaaauagacaguaua

SEQ ID NO: 1420652 - RNA, 20 nt, Homo sapiens
gaaauaugugguuuccacga

SEQ ID NO: 1420653 - RNA, 17 nt, Homo sapiens
gaaauauuuaaguauau

SEQ ID NO: 1420654 - RNA, 16 nt, Homo sapiens
gaaauccaguuuccca

SEQ ID NO: 1420655 - RNA, 14 nt, Homo sapiens
gaaaucuguaauuc

SEQ ID NO: 1420656 - RNA, 15 nt, Homo sapiens
cccccugccagugcc

SEQ ID NO: 1420657 - RNA, 14 nt, Homo sapiens
cccccuuacugugc

SEQ ID NO: 1420658 - RNA, 19 nt, Homo sapiens
ccccuaagaggcagugaga

SEQ ID NO: 1420659 - RNA, 13 nt, Homo sapiens
ccccuacaugaaa

SEQ ID NO: 1420660 - RNA, 22 nt, Homo sapiens
ccccuagugcuauucuguguug

SEQ ID NO: 1420661 - RNA, 18 nt, Homo sapiens
ccccuaugcccacucuaa

SEQ ID NO: 1420662 - RNA, 22 nt, Homo sapiens
ccccucagagaggcaugugaug

SEQ ID NO: 1420663 - RNA, 22 nt, Homo sapiens
ccccucagagcucuuaugugga

SEQ ID NO: 1420664 - RNA, 14 nt, Homo sapiens
ccccugccuuugaa

SEQ ID NO: 1420665 - RNA, 21 nt, Homo sapiens
ccccuggccuuugaggcaaag

SEQ ID NO: 1420666 - RNA, 22 nt, Homo sapiens
ccccuuaaggguugaaggcagu

SEQ ID NO: 1420667 - RNA, 15 nt, Homo sapiens
ccccuuaucuuuuau

SEQ ID NO: 1420668 - RNA, 14 nt, Homo sapiens
ccccuucuguguca

SEQ ID NO: 1420669 - RNA, 19 nt, Homo sapiens
cccgagcuagagugcagug

SEQ ID NO: 1420670 - RNA, 22 nt, Homo sapiens
cccgcaggcagccccacacccg

SEQ ID NO: 1420671 - RNA, 13 nt, Homo sapiens
cccgggacagggu

SEQ ID NO: 1420672 - RNA, 16 nt, Homo sapiens
cccgucauguuccuca

SEQ ID NO: 1420673 - RNA, 17 nt, Homo sapiens
cccgugccaaguccagg

SEQ ID NO: 1420674 - RNA, 15 nt, Homo sapiens
cccuaaacucaggag

SEQ ID NO: 1420675 - RNA, 22 nt, Homo sapiens
cccuaaauguggacaucaugaa

SEQ ID NO: 1420676 - RNA, 20 nt, Homo sapiens
cccuaagagagcaccuggug

SEQ ID NO: 1420677 - RNA, 20 nt, Homo sapiens
cccuaauuagggcauccugc

SEQ ID NO: 1420678 - RNA, 20 nt, Homo sapiens
cccucaaaugacccaaagac

SEQ ID NO: 1420679 - RNA, 19 nt, Homo sapiens
cccucagagaggcauguga

SEQ ID NO: 1420680 - RNA, 19 nt, Homo sapiens
cccucaucucacugcccag

SEQ ID NO: 1420681 - RNA, 14 nt, Homo sapiens
cccuccacugucac

SEQ ID NO: 1420682 - RNA, 16 nt, Homo sapiens
cccucuacuccaugca

SEQ ID NO: 1420683 - RNA, 23 nt, Homo sapiens
cccucucccuggggauaugcaac

SEQ ID NO: 1420684 - RNA, 12 nt, Homo sapiens
cccucuggaucc

SEQ ID NO: 1420685 - RNA, 13 nt, Homo sapiens
cccucuuccacuc

SEQ ID NO: 1420686 - RNA, 16 nt, Homo sapiens
cccugagucaccagga

SEQ ID NO: 1420687 - RNA, 14 nt, Homo sapiens
cccugaucaaguca

SEQ ID NO: 1420688 - RNA, 17 nt, Homo sapiens
cccugcauuucugaguu

SEQ ID NO: 1420689 - RNA, 17 nt, Homo sapiens
cccugccccucuggcca

SEQ ID NO: 1420690 - RNA, 24 nt, Homo sapiens
cccugcccgaccccaucucauuca

SEQ ID NO: 1420691 - RNA, 15 nt, Homo sapiens
cccugccucaagaaa

SEQ ID NO: 1420692 - RNA, 14 nt, Homo sapiens
cccugccuuugaaa

SEQ ID NO: 1420693 - RNA, 19 nt, Homo sapiens
cccugcuugcacuuuguaa

SEQ ID NO: 1420694 - RNA, 21 nt, Homo sapiens
cccuggcugaccccaaagagc

SEQ ID NO: 1420695 - RNA, 20 nt, Homo sapiens
cccugugcugacggaagcca

SEQ ID NO: 1420696 - RNA, 21 nt, Homo sapiens
cccuuccacuuugaguaccaa

SEQ ID NO: 1420697 - RNA, 22 nt, Homo sapiens
cccuuggcccucucccaugcac

SEQ ID NO: 1420698 - RNA, 11 nt, Homo sapiens
cccuuucacaa

SEQ ID NO: 1420699 - RNA, 19 nt, Homo sapiens
cccuuuucuguauguccuu

SEQ ID NO: 1420700 - RNA, 20 nt, Homo sapiens
ccgaagcccaggcugaagag

SEQ ID NO: 1420701 - RNA, 18 nt, Homo sapiens
ccgaauuuagucacacca

SEQ ID NO: 1420702 - RNA, 23 nt, Homo sapiens
ccgacacugcugcaccagaguga

SEQ ID NO: 1420703 - RNA, 14 nt, Homo sapiens
ccgaccccaucuca

SEQ ID NO: 1420704 - RNA, 21 nt, Homo sapiens
ccgacuuauucugauuucaga

SEQ ID NO: 1420705 - RNA, 17 nt, Homo sapiens
cauaacuaguuuaauua

SEQ ID NO: 1420706 - RNA, 20 nt, Homo sapiens
cauaacucauaauccagaga

SEQ ID NO: 1420707 - RNA, 20 nt, Homo sapiens
cauaacucauugucugugga

SEQ ID NO: 1420708 - RNA, 21 nt, Homo sapiens
cauaacuucucugagucugaa

SEQ ID NO: 1420709 - RNA, 15 nt, Homo sapiens
cauaacuugcugaau

SEQ ID NO: 1420710 - RNA, 19 nt, Homo sapiens
cauaaggcauauacaaaua

SEQ ID NO: 1420711 - RNA, 22 nt, Homo sapiens
cauaauuaaacaugauccugag

SEQ ID NO: 1420712 - RNA, 22 nt, Homo sapiens
cauaauuuguacauauguaaaa

SEQ ID NO: 1420713 - RNA, 16 nt, Homo sapiens
cauacauauauaucug

SEQ ID NO: 1420714 - RNA, 21 nt, Homo sapiens
cauaccgcuggggaacagagc

SEQ ID NO: 1420715 - RNA, 13 nt, Homo sapiens
cauaccucugacc

SEQ ID NO: 1420716 - RNA, 17 nt, Homo sapiens
cauaccucugaccaaca

SEQ ID NO: 1420717 - RNA, 16 nt, Homo sapiens
cauacuucuucauuca

SEQ ID NO: 1420718 - RNA, 21 nt, Homo sapiens
cauagauguaucauuaaugua

SEQ ID NO: 1420719 - RNA, 17 nt, Homo sapiens
cauagcaagauugcuua

SEQ ID NO: 1420720 - RNA, 11 nt, Homo sapiens
cauagcacugc

SEQ ID NO: 1420721 - RNA, 13 nt, Homo sapiens
cauagugcacuag

SEQ ID NO: 1420722 - RNA, 18 nt, Homo sapiens
cauaguuauuuacuugaa

SEQ ID NO: 1420723 - RNA, 22 nt, Homo sapiens
cauauaacuaagacauaugcau

SEQ ID NO: 1420724 - RNA, 16 nt, Homo sapiens
cauauacaaaagcaag

SEQ ID NO: 1420725 - RNA, 12 nt, Homo sapiens
cauauacauaua

SEQ ID NO: 1420726 - RNA, 24 nt, Homo sapiens
cauauauguauauauaugcacaua

SEQ ID NO: 1420727 - RNA, 18 nt, Homo sapiens
cauaugaaaaaaaugcau

SEQ ID NO: 1420728 - RNA, 16 nt, Homo sapiens
cauaugacaugccacc

SEQ ID NO: 1420729 - RNA, 19 nt, Homo sapiens
cauauguagacuauauaca

SEQ ID NO: 1420730 - RNA, 18 nt, Homo sapiens
cauauuguauguaaguaa

SEQ ID NO: 1420731 - RNA, 14 nt, Homo sapiens
cauauuugcacaau

SEQ ID NO: 1420732 - RNA, 23 nt, Homo sapiens
cauauuuuaggacagguaaaaua

SEQ ID NO: 1420733 - RNA, 13 nt, Homo sapiens
cauauuuucacau

SEQ ID NO: 1420734 - RNA, 14 nt, Homo sapiens
caucaaagcacugu

SEQ ID NO: 1420735 - RNA, 23 nt, Homo sapiens
caucaacaagaguugucuugucc

SEQ ID NO: 1420736 - RNA, 12 nt, Homo sapiens
caucacaacauu

SEQ ID NO: 1420737 - RNA, 14 nt, Homo sapiens
caucacuacaguac

SEQ ID NO: 1420738 - RNA, 14 nt, Homo sapiens
caucacugaaaugc

SEQ ID NO: 1420739 - RNA, 14 nt, Homo sapiens
caucacuuugccaa

SEQ ID NO: 1420740 - RNA, 16 nt, Homo sapiens
caucagcaccauggag

SEQ ID NO: 1420741 - RNA, 17 nt, Homo sapiens
uguaaaucacuuguaaa

SEQ ID NO: 1420742 - RNA, 17 nt, Homo sapiens
uguaaaugaccaagaaa

SEQ ID NO: 1420743 - RNA, 13 nt, Homo sapiens
uguaaaugccaca

SEQ ID NO: 1420744 - RNA, 17 nt, Homo sapiens
uguaaaugcucguguga

SEQ ID NO: 1420745 - RNA, 23 nt, Homo sapiens
uguaacacagcugagagacuuuu

SEQ ID NO: 1420746 - RNA, 12 nt, Homo sapiens
uguaaccaaaaa

SEQ ID NO: 1420747 - RNA, 17 nt, Homo sapiens
uguaacuucuuaaucua

SEQ ID NO: 1420748 - RNA, 15 nt, Homo sapiens
uguaagacucauucc

SEQ ID NO: 1420749 - RNA, 12 nt, Homo sapiens
uguaagcacuuc

SEQ ID NO: 1420750 - RNA, 16 nt, Homo sapiens
uguaauagugacauau

SEQ ID NO: 1420751 - RNA, 17 nt, Homo sapiens
uguaaugucaccaccuu

SEQ ID NO: 1420752 - RNA, 23 nt, Homo sapiens
uguacacacacagaugcacacac

SEQ ID NO: 1420753 - RNA, 13 nt, Homo sapiens
uguacaccaaggu

SEQ ID NO: 1420754 - RNA, 13 nt, Homo sapiens
uguacacugugua

SEQ ID NO: 1420755 - RNA, 19 nt, Homo sapiens
uguacagaguaaguucuca

SEQ ID NO: 1420756 - RNA, 22 nt, Homo sapiens
uguacauauauauucuacauau

SEQ ID NO: 1420757 - RNA, 19 nt, Homo sapiens
uguaccaaaaaauauugcu

SEQ ID NO: 1420758 - RNA, 19 nt, Homo sapiens
uguaccaagccccuuggcc

SEQ ID NO: 1420759 - RNA, 12 nt, Homo sapiens
uguacguaaugu

SEQ ID NO: 1420760 - RNA, 19 nt, Homo sapiens
uguacuauguuaauaacuu

SEQ ID NO: 1420761 - RNA, 15 nt, Homo sapiens
uguacuuccugugua

SEQ ID NO: 1420762 - RNA, 13 nt, Homo sapiens
uguagaacuucaa

SEQ ID NO: 1420763 - RNA, 20 nt, Homo sapiens
uguagaaugauuucaugcua

SEQ ID NO: 1420764 - RNA, 12 nt, Homo sapiens
uguagaauuaua

SEQ ID NO: 1420765 - RNA, 13 nt, Homo sapiens
uguagcagugaga

SEQ ID NO: 1420766 - RNA, 19 nt, Homo sapiens
uguagccauggcucaggca

SEQ ID NO: 1420767 - RNA, 22 nt, Homo sapiens
uguagccucgccgucugugaau

SEQ ID NO: 1420768 - RNA, 21 nt, Homo sapiens
uguagcggugaagaguacaga

SEQ ID NO: 1420769 - RNA, 13 nt, Homo sapiens
uguagcugaugaa

SEQ ID NO: 1420770 - RNA, 18 nt, Homo sapiens
uguaggcagggaaccuua

SEQ ID NO: 1420771 - RNA, 22 nt, Homo sapiens
uguagguaaaucuaguuuacuu

SEQ ID NO: 1420772 - RNA, 15 nt, Homo sapiens
uguagguaauauugu

SEQ ID NO: 1420773 - RNA, 15 nt, Homo sapiens
uguaggugaaagugu

SEQ ID NO: 1420774 - RNA, 17 nt, Homo sapiens
uguauacacacauauac

SEQ ID NO: 1420775 - RNA, 16 nt, Homo sapiens
uguauagacagcacuu

SEQ ID NO: 1420776 - RNA, 16 nt, Homo sapiens
uguauauacauauuau

SEQ ID NO: 1420777 - RNA, 20 nt, Homo sapiens
uguauaucaugaaacacuuc

SEQ ID NO: 1420778 - RNA, 20 nt, Homo sapiens
uguauauuccaccauucaca

SEQ ID NO: 1420779 - RNA, 23 nt, Homo sapiens
uguauccccccccuguauaguua

SEQ ID NO: 1420780 - RNA, 20 nt, Homo sapiens
uguauccccgugaaaucugg

SEQ ID NO: 1420781 - RNA, 14 nt, Homo sapiens
uguaugcaucuaua

SEQ ID NO: 1420782 - RNA, 22 nt, Homo sapiens
uguauguuuacauaucaccuca

SEQ ID NO: 1420783 - RNA, 23 nt, Homo sapiens
uguauuaauguguuaagugcagg

SEQ ID NO: 1420784 - RNA, 16 nt, Homo sapiens
uguauuugucaaugca

SEQ ID NO: 1420785 - RNA, 14 nt, Homo sapiens
uguauuuguuccca

SEQ ID NO: 1420786 - RNA, 19 nt, Homo sapiens
ugucaccguggaccuuccu

SEQ ID NO: 1420787 - RNA, 19 nt, Homo sapiens
ugucaccucagcugauauu

SEQ ID NO: 1420788 - RNA, 20 nt, Homo sapiens
ugucauagaaagugccagaa

SEQ ID NO: 1420789 - RNA, 23 nt, Homo sapiens
ugucaucaaauauuaccaaaaaa

SEQ ID NO: 1420790 - RNA, 20 nt, Homo sapiens
ugucauggaaaagcccagug

SEQ ID NO: 1420791 - RNA, 19 nt, Homo sapiens
ugucauuauguacaauaca

SEQ ID NO: 1420792 - RNA, 22 nt, Homo sapiens
uguccagaccauugucuuccaa

SEQ ID NO: 1420793 - RNA, 20 nt, Homo sapiens
uguccagaggcugcaaggau

SEQ ID NO: 1420794 - RNA, 13 nt, Homo sapiens
uguccagcagcug

SEQ ID NO: 1420795 - RNA, 18 nt, Homo sapiens
uguccccuccacugucac

SEQ ID NO: 1420796 - RNA, 16 nt, Homo sapiens
uguccggagaugagau

SEQ ID NO: 1420797 - RNA, 14 nt, Homo sapiens
uguccugccagcug

SEQ ID NO: 1420798 - RNA, 16 nt, Homo sapiens
ugucgccucugcauuc

SEQ ID NO: 1420799 - RNA, 14 nt, Homo sapiens
ugucgucuuuaugu

SEQ ID NO: 1420800 - RNA, 21 nt, Homo sapiens
ugucucaacuacucagcucuc

SEQ ID NO: 1420801 - RNA, 12 nt, Homo sapiens
ugucucugccug

SEQ ID NO: 1420802 - RNA, 13 nt, Homo sapiens
ugucucuugagaa

SEQ ID NO: 1420803 - RNA, 11 nt, Homo sapiens
ugucugaagac

SEQ ID NO: 1420804 - RNA, 12 nt, Homo sapiens
ugucugccacag

SEQ ID NO: 1420805 - RNA, 14 nt, Homo sapiens
ugucugucccaaag

SEQ ID NO: 1420806 - RNA, 21 nt, Homo sapiens
ugucuguuucaaugaccugua

SEQ ID NO: 1420807 - RNA, 21 nt, Homo sapiens
ugucuuaauuaaaagaauauu

SEQ ID NO: 1420808 - RNA, 17 nt, Homo sapiens
ugucuuacauaaucaca

SEQ ID NO: 1420809 - RNA, 15 nt, Homo sapiens
ugucuuacugugauc

SEQ ID NO: 1420810 - RNA, 13 nt, Homo sapiens
ugucuuagcugua

SEQ ID NO: 1420811 - RNA, 14 nt, Homo sapiens
ugucuucacucuuc

SEQ ID NO: 1420812 - RNA, 16 nt, Homo sapiens
ucaggauacucuguca

SEQ ID NO: 1420813 - RNA, 23 nt, Homo sapiens
ucaggcccagagaagcaaguggc

SEQ ID NO: 1420814 - RNA, 16 nt, Homo sapiens
ucagguaguacuggga

SEQ ID NO: 1420815 - RNA, 22 nt, Homo sapiens
ucagguauagcugacaucuccu

SEQ ID NO: 1420816 - RNA, 12 nt, Homo sapiens
ucagguauuugu

SEQ ID NO: 1420817 - RNA, 17 nt, Homo sapiens
ucaguaaguaucuggag

SEQ ID NO: 1420818 - RNA, 22 nt, Homo sapiens
ucaguaggaacuguacaugugu

SEQ ID NO: 1420819 - RNA, 13 nt, Homo sapiens
ucagucacuugaa

SEQ ID NO: 1420820 - RNA, 17 nt, Homo sapiens
ucagucuagcuuuuaag

SEQ ID NO: 1420821 - RNA, 21 nt, Homo sapiens
ucagugcacacggaugcacag

SEQ ID NO: 1420822 - RNA, 23 nt, Homo sapiens
ucaguguaccgcgucuacccugg

SEQ ID NO: 1420823 - RNA, 20 nt, Homo sapiens
ucaguuauaauuauuccacu

SEQ ID NO: 1420824 - RNA, 15 nt, Homo sapiens
ucaguuuccucacca

SEQ ID NO: 1420825 - RNA, 21 nt, Homo sapiens
ucauaacaauguaugugaaag

SEQ ID NO: 1420826 - RNA, 18 nt, Homo sapiens
ucauaaggcauauacaaa

SEQ ID NO: 1420827 - RNA, 20 nt, Homo sapiens
ucauaaggcauauacaaaua

SEQ ID NO: 1420828 - RNA, 16 nt, Homo sapiens
ucauaauccagagaua

SEQ ID NO: 1420829 - RNA, 16 nt, Homo sapiens
ucauacuuggacaguu

SEQ ID NO: 1420830 - RNA, 16 nt, Homo sapiens
ucauagcucacuguaa

SEQ ID NO: 1420831 - RNA, 19 nt, Homo sapiens
ucaucaauucccauugcau

SEQ ID NO: 1420832 - RNA, 12 nt, Homo sapiens
ucaucacuggau

SEQ ID NO: 1420833 - RNA, 16 nt, Homo sapiens
ucaucaggcuuggaau

SEQ ID NO: 1420834 - RNA, 12 nt, Homo sapiens
ucaucauggcaa

SEQ ID NO: 1420835 - RNA, 16 nt, Homo sapiens
ucauccauguccaacc

SEQ ID NO: 1420836 - RNA, 16 nt, Homo sapiens
uggaucuguccaagga

SEQ ID NO: 1420837 - RNA, 19 nt, Homo sapiens
uggaucuucagaaggcuag

SEQ ID NO: 1420838 - RNA, 11 nt, Homo sapiens
uggaugcacac

SEQ ID NO: 1420839 - RNA, 16 nt, Homo sapiens
uggauggacagaauga

SEQ ID NO: 1420840 - RNA, 16 nt, Homo sapiens
uggauguggggucccc

SEQ ID NO: 1420841 - RNA, 15 nt, Homo sapiens
uggauucacucacuc

SEQ ID NO: 1420842 - RNA, 16 nt, Homo sapiens
uggauugcagacucau

SEQ ID NO: 1420843 - RNA, 18 nt, Homo sapiens
uggauugcagacucauga

SEQ ID NO: 1420844 - RNA, 22 nt, Homo sapiens
uggauugcagacucaugaaaga

SEQ ID NO: 1420845 - RNA, 15 nt, Homo sapiens
uggcaagcagggaaa

SEQ ID NO: 1420846 - RNA, 19 nt, Homo sapiens
uggcacaguuuucugagaa

SEQ ID NO: 1420847 - RNA, 15 nt, Homo sapiens
uggcaccagaugcaa

SEQ ID NO: 1420848 - RNA, 21 nt, Homo sapiens
uggcaccucagacaauccacu

SEQ ID NO: 1420849 - RNA, 20 nt, Homo sapiens
uggcagcgccucaucuucaa

SEQ ID NO: 1420850 - RNA, 14 nt, Homo sapiens
uggcaggaccagga

SEQ ID NO: 1420851 - RNA, 19 nt, Homo sapiens
uggcauuaaagugcuguau

SEQ ID NO: 1420852 - RNA, 22 nt, Homo sapiens
uggcauuuuccucgccuaggcc

SEQ ID NO: 1420853 - RNA, 20 nt, Homo sapiens
uggcccauagaaacaugaca

SEQ ID NO: 1420854 - RNA, 16 nt, Homo sapiens
uggcccccugugccag

SEQ ID NO: 1420855 - RNA, 19 nt, Homo sapiens
uggcccugcaaaaauauaa

SEQ ID NO: 1420856 - RNA, 14 nt, Homo sapiens
uggcccugccucau

SEQ ID NO: 1420857 - RNA, 18 nt, Homo sapiens
uggccugcuaauagcugc

SEQ ID NO: 1420858 - RNA, 21 nt, Homo sapiens
uggcgcgggaggcaccagcuc

SEQ ID NO: 1420859 - RNA, 19 nt, Homo sapiens
uggcuaucugcauuuauaa

SEQ ID NO: 1420860 - RNA, 15 nt, Homo sapiens
uggcucuugccugua

SEQ ID NO: 1420861 - RNA, 16 nt, Homo sapiens
uggcucuugccuguaa

SEQ ID NO: 1420862 - RNA, 15 nt, Homo sapiens
uggcugaccccaaag

SEQ ID NO: 1420863 - RNA, 14 nt, Homo sapiens
uggcugccuuagaa

SEQ ID NO: 1420864 - RNA, 16 nt, Homo sapiens
uggcuguaaacuauaa

SEQ ID NO: 1420865 - RNA, 22 nt, Homo sapiens
uggcuuccagguaucuccagga

SEQ ID NO: 1420866 - RNA, 18 nt, Homo sapiens
uggcuucgucauuugcaa

SEQ ID NO: 1420867 - RNA, 18 nt, Homo sapiens
uggcuucugggaccugug

SEQ ID NO: 1420868 - RNA, 18 nt, Homo sapiens
uggcuucuguugcgccac

SEQ ID NO: 1420869 - RNA, 16 nt, Homo sapiens
uggcuuucccuuccag

SEQ ID NO: 1420870 - RNA, 23 nt, Homo sapiens
uggcuuuuuuccuccuguguaca

SEQ ID NO: 1420871 - RNA, 12 nt, Homo sapiens
ugggaagccaua

SEQ ID NO: 1420872 - RNA, 15 nt, Homo sapiens
ugggacuauucauug

SEQ ID NO: 1420873 - RNA, 14 nt, Homo sapiens
ugggagaagagaga

SEQ ID NO: 1420874 - RNA, 16 nt, Homo sapiens
ugggagagacacuccc

SEQ ID NO: 1420875 - RNA, 14 nt, Homo sapiens
ugggagagugcagu

SEQ ID NO: 1420876 - RNA, 15 nt, Homo sapiens
ugggagaucagccac

SEQ ID NO: 1420877 - RNA, 18 nt, Homo sapiens
ugggagaucagccacgga

SEQ ID NO: 1420878 - RNA, 15 nt, Homo sapiens
ugggcaacagaugaa

SEQ ID NO: 1420879 - RNA, 14 nt, Homo sapiens
ugggcaauucugac

SEQ ID NO: 1420880 - RNA, 14 nt, Homo sapiens
ugggcagaaagugg

SEQ ID NO: 1420881 - RNA, 22 nt, Homo sapiens
ugggcagugccuccugggacca

SEQ ID NO: 1420882 - RNA, 18 nt, Homo sapiens
ugggcauuuucccagaug

SEQ ID NO: 1420883 - RNA, 16 nt, Homo sapiens
ugggccaguuccucca

SEQ ID NO: 1420884 - RNA, 22 nt, Homo sapiens
ugggccggccagccuugcacug

SEQ ID NO: 1420885 - RNA, 16 nt, Homo sapiens
ugggcgaagcuaaaag

SEQ ID NO: 1420886 - RNA, 13 nt, Homo sapiens
ugggcuacuggca

SEQ ID NO: 1420887 - RNA, 19 nt, Homo sapiens
ugggcuaugugucacagcu

SEQ ID NO: 1420888 - RNA, 14 nt, Homo sapiens
ugggcugucuguca

SEQ ID NO: 1420889 - RNA, 15 nt, Homo sapiens
ugggcugucugucac

SEQ ID NO: 1420890 - RNA, 18 nt, Homo sapiens
uggggacagcauaccuug

SEQ ID NO: 1420891 - RNA, 19 nt, Homo sapiens
uggggcacagucauucaca

SEQ ID NO: 1420892 - RNA, 19 nt, Homo sapiens
uggggcuccucacauagcu

SEQ ID NO: 1420893 - RNA, 15 nt, Homo sapiens
ugggguucaucuagg

SEQ ID NO: 1420894 - RNA, 19 nt, Homo sapiens
uggguacaauguacauuau

SEQ ID NO: 1420895 - RNA, 15 nt, Homo sapiens
ugggucaaagccggu

SEQ ID NO: 1420896 - RNA, 13 nt, Homo sapiens
uggguuauuucaa

SEQ ID NO: 1420897 - RNA, 15 nt, Homo sapiens
ugguaaacauucucu

SEQ ID NO: 1420898 - RNA, 13 nt, Homo sapiens
ugguaaguaacug

SEQ ID NO: 1420899 - RNA, 16 nt, Homo sapiens
ugguaauaaaccuuga

SEQ ID NO: 1420900 - RNA, 18 nt, Homo sapiens
ugguaauaaaccuugaug

SEQ ID NO: 1420901 - RNA, 12 nt, Homo sapiens
ugguacaaggaa

SEQ ID NO: 1420902 - RNA, 20 nt, Homo sapiens
ugguacaaucucaaauucuc

SEQ ID NO: 1420903 - RNA, 14 nt, Homo sapiens
ugguacagcacugu

SEQ ID NO: 1420904 - RNA, 14 nt, Homo sapiens
ugguaggauuuaua

SEQ ID NO: 1420905 - RNA, 15 nt, Homo sapiens
uggucaaagcaacug

SEQ ID NO: 1420906 - RNA, 16 nt, Homo sapiens
uccauaaggugcagua

SEQ ID NO: 1420907 - RNA, 18 nt, Homo sapiens
uccauauuuauuuaaaca

SEQ ID NO: 1420908 - RNA, 16 nt, Homo sapiens
uccauccccaaacugu

SEQ ID NO: 1420909 - RNA, 15 nt, Homo sapiens
uccaucccgaaaauc

SEQ ID NO: 1420910 - RNA, 17 nt, Homo sapiens
uccauccggcuccuguc

SEQ ID NO: 1420911 - RNA, 22 nt, Homo sapiens
uccauggccaccccgugccacc

SEQ ID NO: 1420912 - RNA, 12 nt, Homo sapiens
uccauguaucua

SEQ ID NO: 1420913 - RNA, 22 nt, Homo sapiens
uccaugucgccucugcauucag

SEQ ID NO: 1420914 - RNA, 16 nt, Homo sapiens
uccauucaacugaaaa

SEQ ID NO: 1420915 - RNA, 12 nt, Homo sapiens
uccauucccaag

SEQ ID NO: 1420916 - RNA, 15 nt, Homo sapiens
uccauuucaacucca

SEQ ID NO: 1420917 - RNA, 21 nt, Homo sapiens
uccauuucucaaucagugcag

SEQ ID NO: 1420918 - RNA, 15 nt, Homo sapiens
ucccaaacuacagaa

SEQ ID NO: 1420919 - RNA, 23 nt, Homo sapiens
ucccaaaggacagccgccuggag

SEQ ID NO: 1420920 - RNA, 15 nt, Homo sapiens
ucccaaauaaacucc

SEQ ID NO: 1420921 - RNA, 17 nt, Homo sapiens
ucccaaucagcacugaa

SEQ ID NO: 1420922 - RNA, 18 nt, Homo sapiens
ucccaaucagcacugaaa

SEQ ID NO: 1420923 - RNA, 19 nt, Homo sapiens
ucccaaucagcacugaaaa

SEQ ID NO: 1420924 - RNA, 16 nt, Homo sapiens
ucccaauucauuucau

SEQ ID NO: 1420925 - RNA, 16 nt, Homo sapiens
ucccacaggcccuucc

SEQ ID NO: 1420926 - RNA, 22 nt, Homo sapiens
ucccaccaacucugcacuccau

SEQ ID NO: 1420927 - RNA, 15 nt, Homo sapiens
ucccaccgcuuugug

SEQ ID NO: 1420928 - RNA, 16 nt, Homo sapiens
ucccacgacuguugua

SEQ ID NO: 1420929 - RNA, 20 nt, Homo sapiens
ucccacgacuguuguacaag

SEQ ID NO: 1420930 - RNA, 18 nt, Homo sapiens
ucccacuaagcuuucucc

SEQ ID NO: 1420931 - RNA, 13 nt, Homo sapiens
ucccagaaccaca

SEQ ID NO: 1420932 - RNA, 14 nt, Homo sapiens
ucccagagcuuccc

SEQ ID NO: 1420933 - RNA, 12 nt, Homo sapiens
ucccagauccuc

SEQ ID NO: 1420934 - RNA, 13 nt, Homo sapiens
ucccagcacuuug

SEQ ID NO: 1420935 - RNA, 23 nt, Homo sapiens
ucccagcagcccuaaggaucucu

SEQ ID NO: 1420936 - RNA, 15 nt, Homo sapiens
ucccagcuacuuggg

SEQ ID NO: 1420937 - RNA, 14 nt, Homo sapiens
ucccaggaccaaga

SEQ ID NO: 1420938 - RNA, 20 nt, Homo sapiens
ucccauccccuggacuggga

SEQ ID NO: 1420939 - RNA, 18 nt, Homo sapiens
ucccaucugucaccaauu

SEQ ID NO: 1420940 - RNA, 23 nt, Homo sapiens
ucccaugugcauggaaauguccu

SEQ ID NO: 1420941 - RNA, 14 nt, Homo sapiens
uccccacauaccau

SEQ ID NO: 1420942 - RNA, 17 nt, Homo sapiens
uccccacauaccaucug

SEQ ID NO: 1420943 - RNA, 17 nt, Homo sapiens
ucccccaaaaugcauuu

SEQ ID NO: 1420944 - RNA, 20 nt, Homo sapiens
ucccccagucauucugggaa

SEQ ID NO: 1420945 - RNA, 20 nt, Homo sapiens
ucccccuaagaggcagugag

SEQ ID NO: 1420946 - RNA, 22 nt, Homo sapiens
uccccgggguauuagcaccucu

SEQ ID NO: 1420947 - RNA, 22 nt, Homo sapiens
uccccuccacugucacauugua

SEQ ID NO: 1420948 - RNA, 13 nt, Homo sapiens
uccccucggagaa

SEQ ID NO: 1420949 - RNA, 23 nt, Homo sapiens
uccccugaaaaacugaucaaaaa

SEQ ID NO: 1420950 - RNA, 15 nt, Homo sapiens
uccccugaagacuua

SEQ ID NO: 1420951 - RNA, 22 nt, Homo sapiens
uccccuggggucucugcugcau

SEQ ID NO: 1420952 - RNA, 21 nt, Homo sapiens
ucccgagcuacucucuugcca

SEQ ID NO: 1420953 - RNA, 11 nt, Homo sapiens
ucccuaauccu

SEQ ID NO: 1420954 - RNA, 22 nt, Homo sapiens
ucccuaauccuccaagucuuca

SEQ ID NO: 1420955 - RNA, 13 nt, Homo sapiens
ucccuaucaaaac

SEQ ID NO: 1420956 - RNA, 16 nt, Homo sapiens
ucccuauuaaccuaga

SEQ ID NO: 1420957 - RNA, 17 nt, Homo sapiens
ucccuauuaaccuagag

SEQ ID NO: 1420958 - RNA, 20 nt, Homo sapiens
ucccucaaaugacccaaaga

SEQ ID NO: 1420959 - RNA, 21 nt, Homo sapiens
ucccucccgggggcacugccu

SEQ ID NO: 1420960 - RNA, 16 nt, Homo sapiens
ucccucggagcugcca

SEQ ID NO: 1420961 - RNA, 19 nt, Homo sapiens
ucccugcuuugaggacaaa

SEQ ID NO: 1420962 - RNA, 20 nt, Homo sapiens
ucccugggccugcugcugag

SEQ ID NO: 1420963 - RNA, 16 nt, Homo sapiens
ucccuguguggcugcu

SEQ ID NO: 1420964 - RNA, 17 nt, Homo sapiens
ucccuguuaucugcuag

SEQ ID NO: 1420965 - RNA, 20 nt, Homo sapiens
ucccuucccccauccuccag

SEQ ID NO: 1420966 - RNA, 23 nt, Homo sapiens
ucccuucccuguccaccucacca

SEQ ID NO: 1420967 - RNA, 19 nt, Homo sapiens
ucccuucgauauaugacuu

SEQ ID NO: 1420968 - RNA, 14 nt, Homo sapiens
ucuaagagaucugg

SEQ ID NO: 1420969 - RNA, 19 nt, Homo sapiens
ucuaaguaaaaccacagca

SEQ ID NO: 1420970 - RNA, 18 nt, Homo sapiens
ucuaagucuccaagaaua

SEQ ID NO: 1420971 - RNA, 17 nt, Homo sapiens
ucuaaguucauguuugu

SEQ ID NO: 1420972 - RNA, 12 nt, Homo sapiens
ucuaaucuaugc

SEQ ID NO: 1420973 - RNA, 13 nt, Homo sapiens
ucuaaucuaugca

SEQ ID NO: 1420974 - RNA, 18 nt, Homo sapiens
ucuaauucucuuacccag

SEQ ID NO: 1420975 - RNA, 21 nt, Homo sapiens
ucuacaaacucccacuuguca

SEQ ID NO: 1420976 - RNA, 13 nt, Homo sapiens
ucuacaaccagag

SEQ ID NO: 1420977 - RNA, 15 nt, Homo sapiens
ucuacauacuaugga

SEQ ID NO: 1420978 - RNA, 18 nt, Homo sapiens
ucuaccugcccucucuca

SEQ ID NO: 1420979 - RNA, 21 nt, Homo sapiens
ucuaccuuuuuuucucuccua

SEQ ID NO: 1420980 - RNA, 16 nt, Homo sapiens
ucuacuccaugcacau

SEQ ID NO: 1420981 - RNA, 11 nt, Homo sapiens
ucuacugccuu

SEQ ID NO: 1420982 - RNA, 18 nt, Homo sapiens
ucuacugccuuggacaac

SEQ ID NO: 1420983 - RNA, 22 nt, Homo sapiens
ucuacugugacugauguuacau

SEQ ID NO: 1420984 - RNA, 17 nt, Homo sapiens
ucuacuucugucuuccu

SEQ ID NO: 1420985 - RNA, 13 nt, Homo sapiens
ucuacuuugucua

SEQ ID NO: 1420986 - RNA, 22 nt, Homo sapiens
ucuagaacacaggcaaaauccu

SEQ ID NO: 1420987 - RNA, 15 nt, Homo sapiens
ucuagagaacaugcc

SEQ ID NO: 1420988 - RNA, 22 nt, Homo sapiens
ucuagagauuuucuuggcagua

SEQ ID NO: 1420989 - RNA, 15 nt, Homo sapiens
uauuauuuugcacug

SEQ ID NO: 1420990 - RNA, 17 nt, Homo sapiens
uauuauuuugcacuguu

SEQ ID NO: 1420991 - RNA, 22 nt, Homo sapiens
uauucaaggaucucaaagaaag

SEQ ID NO: 1420992 - RNA, 14 nt, Homo sapiens
uauucagacaagca

SEQ ID NO: 1420993 - RNA, 23 nt, Homo sapiens
uauuccaugggauguuaagcaaa

SEQ ID NO: 1420994 - RNA, 17 nt, Homo sapiens
uauucucacuccaccac

SEQ ID NO: 1420995 - RNA, 19 nt, Homo sapiens
uauucucacuccaccaccc

SEQ ID NO: 1420996 - RNA, 17 nt, Homo sapiens
uauucucuuaaaagaca

SEQ ID NO: 1420997 - RNA, 15 nt, Homo sapiens
uauucugcauggaaa

SEQ ID NO: 1420998 - RNA, 16 nt, Homo sapiens
uauucuuccgucacau

SEQ ID NO: 1420999 - RNA, 21 nt, Homo sapiens
uauucuuuaaauuucaucuca

SEQ ID NO: 1421000 - RNA, 19 nt, Homo sapiens
uauugaagaaaagcacuuu

SEQ ID NO: 1421001 - RNA, 18 nt, Homo sapiens
uauugacgcauauuuaac

SEQ ID NO: 1421002 - RNA, 16 nt, Homo sapiens
uauugcauaauuuaua

SEQ ID NO: 1421003 - RNA, 20 nt, Homo sapiens
uauugccucugaaaugccuc

SEQ ID NO: 1421004 - RNA, 15 nt, Homo sapiens
uauugcgaaugugca

SEQ ID NO: 1421005 - RNA, 14 nt, Homo sapiens
uauuggaacauguc

SEQ ID NO: 1421006 - RNA, 15 nt, Homo sapiens
uauuguauaaacuau

SEQ ID NO: 1421007 - RNA, 16 nt, Homo sapiens
uauugucggaagacuu

SEQ ID NO: 1421008 - RNA, 14 nt, Homo sapiens
uauugugaucuauc

SEQ ID NO: 1421009 - RNA, 14 nt, Homo sapiens
uauuuaaaaguaua

SEQ ID NO: 1421010 - RNA, 13 nt, Homo sapiens
uauuuaugaaggc

SEQ ID NO: 1421011 - RNA, 17 nt, Homo sapiens
uauuucaaccgcuugcc

SEQ ID NO: 1421012 - RNA, 21 nt, Homo sapiens
uauuucaacuaauauaucuau

SEQ ID NO: 1421013 - RNA, 15 nt, Homo sapiens
uauuucagaaauaca

SEQ ID NO: 1421014 - RNA, 16 nt, Homo sapiens
guacaauguacauuau

SEQ ID NO: 1421015 - RNA, 20 nt, Homo sapiens
guacacacacagaugcacac

SEQ ID NO: 1421016 - RNA, 15 nt, Homo sapiens
guacaccauaugcaa

SEQ ID NO: 1421017 - RNA, 18 nt, Homo sapiens
guacagagaaauucugug

SEQ ID NO: 1421018 - RNA, 20 nt, Homo sapiens
guacauuucccugugcugac

SEQ ID NO: 1421019 - RNA, 14 nt, Homo sapiens
guacauuuggugca

SEQ ID NO: 1421020 - RNA, 23 nt, Homo sapiens
guacccuuccuacagauagucaa

SEQ ID NO: 1421021 - RNA, 16 nt, Homo sapiens
guacgguggcacgugc

SEQ ID NO: 1421022 - RNA, 18 nt, Homo sapiens
guacguaacuauuuccaa

SEQ ID NO: 1421023 - RNA, 15 nt, Homo sapiens
guacuaguccaucau

SEQ ID NO: 1421024 - RNA, 16 nt, Homo sapiens
guacucagcgaaugaa

SEQ ID NO: 1421025 - RNA, 17 nt, Homo sapiens
guacugaaaaaaaaaga

SEQ ID NO: 1421026 - RNA, 19 nt, Homo sapiens
guagaaacacaguuuugaa

SEQ ID NO: 1421027 - RNA, 22 nt, Homo sapiens
guagauuaccugccacuuccag

SEQ ID NO: 1421028 - RNA, 19 nt, Homo sapiens
guagcagauaaagacagcu

SEQ ID NO: 1421029 - RNA, 19 nt, Homo sapiens
guaggggguuauugccucu

SEQ ID NO: 1421030 - RNA, 13 nt, Homo sapiens
guagguaagggcc

SEQ ID NO: 1421031 - RNA, 16 nt, Homo sapiens
guagguggaucaccug

SEQ ID NO: 1421032 - RNA, 17 nt, Homo sapiens
guaguggcauccauuuc

SEQ ID NO: 1421033 - RNA, 23 nt, Homo sapiens
guaguuaaagggcagaaggggaa

SEQ ID NO: 1421034 - RNA, 13 nt, Homo sapiens
guaguucuugucu

SEQ ID NO: 1421035 - RNA, 15 nt, Homo sapiens
guauacacacauaua

SEQ ID NO: 1421036 - RNA, 15 nt, Homo sapiens
guauauauacauaca

SEQ ID NO: 1421037 - RNA, 18 nt, Homo sapiens
guauauauguauaugugc

SEQ ID NO: 1421038 - RNA, 13 nt, Homo sapiens
guaucuaccaucu

SEQ ID NO: 1421039 - RNA, 20 nt, Homo sapiens
guaucuaccaucuaaucuau

SEQ ID NO: 1421040 - RNA, 23 nt, Homo sapiens
guaucuaccaucuaaucuaugca

SEQ ID NO: 1421041 - RNA, 15 nt, Homo sapiens
guaugagcugccaag

SEQ ID NO: 1421042 - RNA, 19 nt, Homo sapiens
guaugaguggcuucuggga

SEQ ID NO: 1421043 - RNA, 23 nt, Homo sapiens
guauguaggcaauacauguaucu

SEQ ID NO: 1421044 - RNA, 11 nt, Homo sapiens
guaugugaaua

SEQ ID NO: 1421045 - RNA, 16 nt, Homo sapiens
uugagcccucccagca

SEQ ID NO: 1421046 - RNA, 14 nt, Homo sapiens
uugaggaauuauca

SEQ ID NO: 1421047 - RNA, 17 nt, Homo sapiens
uugaggacacaugucca

SEQ ID NO: 1421048 - RNA, 11 nt, Homo sapiens
uugaguaccaa

SEQ ID NO: 1421049 - RNA, 16 nt, Homo sapiens
uugaguuucucuccac

SEQ ID NO: 1421050 - RNA, 16 nt, Homo sapiens
uugaguuuucaaagau

SEQ ID NO: 1421051 - RNA, 16 nt, Homo sapiens
uugauaaaugccucau

SEQ ID NO: 1421052 - RNA, 12 nt, Homo sapiens
uugauagcagaa

SEQ ID NO: 1421053 - RNA, 16 nt, Homo sapiens
uugaucaaauauuuca

SEQ ID NO: 1421054 - RNA, 20 nt, Homo sapiens
uugaucccacuucacuguga

SEQ ID NO: 1421055 - RNA, 14 nt, Homo sapiens
uugaucucugcuua

SEQ ID NO: 1421056 - RNA, 23 nt, Homo sapiens
uugcaaaaauuauaaaguaauuu

SEQ ID NO: 1421057 - RNA, 17 nt, Homo sapiens
uugcaaccacugcaacg

SEQ ID NO: 1421058 - RNA, 17 nt, Homo sapiens
ugugcgacuucacaaaa

SEQ ID NO: 1421059 - RNA, 15 nt, Homo sapiens
ugugcgucucucuuu

SEQ ID NO: 1421060 - RNA, 17 nt, Homo sapiens
ugugcuauugaacugag

SEQ ID NO: 1421061 - RNA, 13 nt, Homo sapiens
ugugcucugugac

SEQ ID NO: 1421062 - RNA, 18 nt, Homo sapiens
ugugcuugcccaccacag

SEQ ID NO: 1421063 - RNA, 17 nt, Homo sapiens
uguggaggacuuugaau

SEQ ID NO: 1421064 - RNA, 18 nt, Homo sapiens
uguggaguggacauucaa

SEQ ID NO: 1421065 - RNA, 22 nt, Homo sapiens
uguggauaaggcuuaggugcca

SEQ ID NO: 1421066 - RNA, 14 nt, Homo sapiens
uguggauaagggag

SEQ ID NO: 1421067 - RNA, 18 nt, Homo sapiens
uguggaugcuccagggca

SEQ ID NO: 1421068 - RNA, 19 nt, Homo sapiens
uguggauguguaaauggcu

SEQ ID NO: 1421069 - RNA, 14 nt, Homo sapiens
uguggauuccagca

SEQ ID NO: 1421070 - RNA, 17 nt, Homo sapiens
uguggcugucaggacac

SEQ ID NO: 1421071 - RNA, 14 nt, Homo sapiens
uguggcuuccucag

SEQ ID NO: 1421072 - RNA, 22 nt, Homo sapiens
ugugggcauagcauuagcugcu

SEQ ID NO: 1421073 - RNA, 14 nt, Homo sapiens
ugugggucugggga

SEQ ID NO: 1421074 - RNA, 19 nt, Homo sapiens
uguggucacagccaugaag

SEQ ID NO: 1421075 - RNA, 16 nt, Homo sapiens
uguggugcccaugagg

SEQ ID NO: 1421076 - RNA, 14 nt, Homo sapiens
uguggugucuagca

SEQ ID NO: 1421077 - RNA, 23 nt, Homo sapiens
uguguaaauacaguggaucucaa

SEQ ID NO: 1421078 - RNA, 13 nt, Homo sapiens
uguguacaaagug

SEQ ID NO: 1421079 - RNA, 13 nt, Homo sapiens
uguguagcuguga

SEQ ID NO: 1421080 - RNA, 22 nt, Homo sapiens
uguguauauauaguagcauuuc

SEQ ID NO: 1421081 - RNA, 14 nt, Homo sapiens
ugugucaaugccac

SEQ ID NO: 1421082 - RNA, 21 nt, Homo sapiens
uguguccguggaaccaguccu

SEQ ID NO: 1421083 - RNA, 23 nt, Homo sapiens
ugugugaaaggaagcuccacugu

SEQ ID NO: 1421084 - RNA, 13 nt, Homo sapiens
ugugugcauguau

SEQ ID NO: 1421085 - RNA, 21 nt, Homo sapiens
ugugugcauguaugugcacau

SEQ ID NO: 1421086 - RNA, 20 nt, Homo sapiens
uguguguauaagugcacaca

SEQ ID NO: 1421087 - RNA, 11 nt, Homo sapiens
uguguguauau

SEQ ID NO: 1421088 - RNA, 22 nt, Homo sapiens
uguguguuagcagucaaaucua

SEQ ID NO: 1421089 - RNA, 22 nt, Homo sapiens
uguguuauuauuuugcacuguu

SEQ ID NO: 1421090 - RNA, 20 nt, Homo sapiens
uguguucacacuguaaacau

SEQ ID NO: 1421091 - RNA, 14 nt, Homo sapiens
uguguuucuuacag

SEQ ID NO: 1421092 - RNA, 13 nt, Homo sapiens
uguuaaaauaacu

SEQ ID NO: 1421093 - RNA, 15 nt, Homo sapiens
uguuaaaauguacac

SEQ ID NO: 1421094 - RNA, 19 nt, Homo sapiens
uguuaaaauguacacugga

SEQ ID NO: 1421095 - RNA, 16 nt, Homo sapiens
uguuaaacaugcuaaa

SEQ ID NO: 1421096 - RNA, 13 nt, Homo sapiens
uguuaagcaauuc

SEQ ID NO: 1421097 - RNA, 17 nt, Homo sapiens
uguuacagaagcugaaa

SEQ ID NO: 1421098 - RNA, 20 nt, Homo sapiens
uguuacuugaaauaccagug

SEQ ID NO: 1421099 - RNA, 14 nt, Homo sapiens
uguuagauuccucu

SEQ ID NO: 1421100 - RNA, 19 nt, Homo sapiens
uguuagugugugugcaugu

SEQ ID NO: 1421101 - RNA, 20 nt, Homo sapiens
uguuauguauauagaugugc

SEQ ID NO: 1421102 - RNA, 19 nt, Homo sapiens
uguuauguuugcacuuugu

SEQ ID NO: 1421103 - RNA, 16 nt, Homo sapiens
uguuauugcacuauga

SEQ ID NO: 1421104 - RNA, 17 nt, Homo sapiens
uguuauugcacuaugaa

SEQ ID NO: 1421105 - RNA, 16 nt, Homo sapiens
uguuauuuguacaguu

SEQ ID NO: 1421106 - RNA, 18 nt, Homo sapiens
uguuauuuguacaguuca

SEQ ID NO: 1421107 - RNA, 12 nt, Homo sapiens
uguucacauaua

SEQ ID NO: 1421108 - RNA, 15 nt, Homo sapiens
uguuccaugccugcu

SEQ ID NO: 1421109 - RNA, 22 nt, Homo sapiens
uguucucaaaugcuaaaugcaa

SEQ ID NO: 1421110 - RNA, 20 nt, Homo sapiens
uguucuggccucagaccaac

SEQ ID NO: 1421111 - RNA, 13 nt, Homo sapiens
uguucuggcuuua

SEQ ID NO: 1421112 - RNA, 14 nt, Homo sapiens
uguucuugaugaca

SEQ ID NO: 1421113 - RNA, 17 nt, Homo sapiens
uguugaaaauguucaga

SEQ ID NO: 1421114 - RNA, 17 nt, Homo sapiens
uguugaaucaggggcaa

SEQ ID NO: 1421115 - RNA, 18 nt, Homo sapiens
uguugguguauuugccag

SEQ ID NO: 1421116 - RNA, 14 nt, Homo sapiens
uguuguccaggaaa

SEQ ID NO: 1421117 - RNA, 15 nt, Homo sapiens
uguuuacagacugug

SEQ ID NO: 1421118 - RNA, 14 nt, Homo sapiens
uguuuauuccugau

SEQ ID NO: 1421119 - RNA, 15 nt, Homo sapiens
uguuucccauuacuu

SEQ ID NO: 1421120 - RNA, 18 nt, Homo sapiens
uguuucuaaaacuauggu

SEQ ID NO: 1421121 - RNA, 18 nt, Homo sapiens
uguuucucccacauauuc

SEQ ID NO: 1421122 - RNA, 16 nt, Homo sapiens
uguuucugaaccauua

SEQ ID NO: 1421123 - RNA, 23 nt, Homo sapiens
uguuucugaaccauuacuguaau

SEQ ID NO: 1421124 - RNA, 17 nt, Homo sapiens
uguuucuuucauaugaa

SEQ ID NO: 1421125 - RNA, 17 nt, Homo sapiens
uguuugagcgcagagua

SEQ ID NO: 1421126 - RNA, 12 nt, Homo sapiens
uguuugcacuuu

SEQ ID NO: 1421127 - RNA, 14 nt, Homo sapiens
uguuugcucuugca

SEQ ID NO: 1421128 - RNA, 16 nt, Homo sapiens
uguuugggccacugcc

SEQ ID NO: 1421129 - RNA, 13 nt, Homo sapiens
uguuuuagcuccu

SEQ ID NO: 1421130 - RNA, 17 nt, Homo sapiens
uuccucgcaggucucag

SEQ ID NO: 1421131 - RNA, 20 nt, Homo sapiens
uuccugacccucccuaccug

SEQ ID NO: 1421132 - RNA, 13 nt, Homo sapiens
uuccugagaccuc

SEQ ID NO: 1421133 - RNA, 13 nt, Homo sapiens
uuccugaguaccu

SEQ ID NO: 1421134 - RNA, 14 nt, Homo sapiens
uuccugccaccagu

SEQ ID NO: 1421135 - RNA, 22 nt, Homo sapiens
uuccuguaacacaagccacaga

SEQ ID NO: 1421136 - RNA, 13 nt, Homo sapiens
uuccuuaagccag

SEQ ID NO: 1421137 - RNA, 17 nt, Homo sapiens
uuccuugaucuguauau

SEQ ID NO: 1421138 - RNA, 21 nt, Homo sapiens
uuccuugauggagauauuuac

SEQ ID NO: 1421139 - RNA, 20 nt, Homo sapiens
uuccuuuuaaaacacuucca

SEQ ID NO: 1421140 - RNA, 21 nt, Homo sapiens
uuccuuuuaaaacacuuccau

SEQ ID NO: 1421141 - RNA, 12 nt, Homo sapiens
uuccuuuugcca

SEQ ID NO: 1421142 - RNA, 19 nt, Homo sapiens
uucgagaccagccugacca

SEQ ID NO: 1421143 - RNA, 22 nt, Homo sapiens
aaaggcauaagacccuaagccu

SEQ ID NO: 1421144 - RNA, 17 nt, Homo sapiens
aaagggagcacuggguu

SEQ ID NO: 1421145 - RNA, 18 nt, Homo sapiens
aaagguagcuuaccugac

SEQ ID NO: 1421146 - RNA, 14 nt, Homo sapiens
cagaggcggaaacc

SEQ ID NO: 1421147 - RNA, 22 nt, Homo sapiens
cagaggcggaaaccuugcagca

SEQ ID NO: 1421148 - RNA, 20 nt, Homo sapiens
cagaggcugcaaggauucag

SEQ ID NO: 1421149 - RNA, 18 nt, Homo sapiens
cagaggcugcagaaggcc

SEQ ID NO: 1421150 - RNA, 15 nt, Homo sapiens
cagaggcuucuucag

SEQ ID NO: 1421151 - RNA, 19 nt, Homo sapiens
cagagggggccuucacagu

SEQ ID NO: 1421152 - RNA, 22 nt, Homo sapiens
cagagggggccuucacagugac

SEQ ID NO: 1421153 - RNA, 22 nt, Homo sapiens
cagagggguaggcagagccuuu

SEQ ID NO: 1421154 - RNA, 20 nt, Homo sapiens
cagaggugacccaaugcucc

SEQ ID NO: 1421155 - RNA, 20 nt, Homo sapiens
cagaguaaauagcauucucu

SEQ ID NO: 1421156 - RNA, 19 nt, Homo sapiens
cagaguaacaugccagcuu

SEQ ID NO: 1421157 - RNA, 17 nt, Homo sapiens
cagagugacauccagga

SEQ ID NO: 1421158 - RNA, 19 nt, Homo sapiens
cagagugugcagacugaug

SEQ ID NO: 1421159 - RNA, 14 nt, Homo sapiens
cagauaacucuccu

SEQ ID NO: 1421160 - RNA, 15 nt, Homo sapiens
cagauagccagacac

SEQ ID NO: 1421161 - RNA, 12 nt, Homo sapiens
cagauaguguaa

SEQ ID NO: 1421162 - RNA, 12 nt, Homo sapiens
cagauaugcaca

SEQ ID NO: 1421163 - RNA, 13 nt, Homo sapiens
cagauaugcacac

SEQ ID NO: 1421164 - RNA, 18 nt, Homo sapiens
cagauauuugaaucuuuc

SEQ ID NO: 1421165 - RNA, 14 nt, Homo sapiens
cagaucaaauuuca

SEQ ID NO: 1421166 - RNA, 14 nt, Homo sapiens
cagaucacucaaaa

SEQ ID NO: 1421167 - RNA, 16 nt, Homo sapiens
cagauccucugcugac

SEQ ID NO: 1421168 - RNA, 21 nt, Homo sapiens
cagauccucugcugacuccau

SEQ ID NO: 1421169 - RNA, 20 nt, Homo sapiens
cagaugaaauuuauuuccau

SEQ ID NO: 1421170 - RNA, 11 nt, Homo sapiens
cagaugcacac

SEQ ID NO: 1421171 - RNA, 15 nt, Homo sapiens
cagaugcacacacag

SEQ ID NO: 1421172 - RNA, 16 nt, Homo sapiens
cagaugcacacacaga

SEQ ID NO: 1421173 - RNA, 13 nt, Homo sapiens
cagauggagacau

SEQ ID NO: 1421174 - RNA, 17 nt, Homo sapiens
cagauggucacacagag

SEQ ID NO: 1421175 - RNA, 21 nt, Homo sapiens
cagauguaaaugccacaaaga

SEQ ID NO: 1421176 - RNA, 16 nt, Homo sapiens
cagauugacaagguag

SEQ ID NO: 1421177 - RNA, 21 nt, Homo sapiens
cagauuugcuguucacccaca

SEQ ID NO: 1421178 - RNA, 16 nt, Homo sapiens
cagcaaaccucaguca

SEQ ID NO: 1421179 - RNA, 18 nt, Homo sapiens
cagcacagacucuuucag

SEQ ID NO: 1421180 - RNA, 19 nt, Homo sapiens
aguaaaggccucaucuccu

SEQ ID NO: 1421181 - RNA, 13 nt, Homo sapiens
aguaaaguuuaaa

SEQ ID NO: 1421182 - RNA, 15 nt, Homo sapiens
aguaaauuacauuaa

SEQ ID NO: 1421183 - RNA, 20 nt, Homo sapiens
aguaagguuauaacuguggc

SEQ ID NO: 1421184 - RNA, 21 nt, Homo sapiens
aguaagguuauaacuguggcu

SEQ ID NO: 1421185 - RNA, 15 nt, Homo sapiens
aguaaguaucuggag

SEQ ID NO: 1421186 - RNA, 19 nt, Homo sapiens
aguaauaaacgucuugcca

SEQ ID NO: 1421187 - RNA, 20 nt, Homo sapiens
aguaaucccccuugccaaau

SEQ ID NO: 1421188 - RNA, 16 nt, Homo sapiens
aguaaugcacucucag

SEQ ID NO: 1421189 - RNA, 16 nt, Homo sapiens
aguaauguuaauucuu

SEQ ID NO: 1421190 - RNA, 19 nt, Homo sapiens
aguaauuguaaguaccccu

SEQ ID NO: 1421191 - RNA, 21 nt, Homo sapiens
aguacaauaauaaauccucag

SEQ ID NO: 1421192 - RNA, 22 nt, Homo sapiens
aguacagagaaauucuguggug

SEQ ID NO: 1421193 - RNA, 18 nt, Homo sapiens
aguacagugagccaagau

SEQ ID NO: 1421194 - RNA, 14 nt, Homo sapiens
aguaccagugugcu

SEQ ID NO: 1421195 - RNA, 15 nt, Homo sapiens
aguacccaggaugau

SEQ ID NO: 1421196 - RNA, 20 nt, Homo sapiens
aguacucaguauagcauuga

SEQ ID NO: 1421197 - RNA, 14 nt, Homo sapiens
aguacuggcauggu

SEQ ID NO: 1421198 - RNA, 17 nt, Homo sapiens
aguacuggcaugguacg

SEQ ID NO: 1421199 - RNA, 19 nt, Homo sapiens
aguacuuacccuaaaacau

SEQ ID NO: 1421200 - RNA, 19 nt, Homo sapiens
aguagauagaaagcaauaa

SEQ ID NO: 1421201 - RNA, 19 nt, Homo sapiens
aguagcggaucucacucag

SEQ ID NO: 1421202 - RNA, 18 nt, Homo sapiens
aguauacuuuuguuucag

SEQ ID NO: 1421203 - RNA, 15 nt, Homo sapiens
aguauauaguauauu

SEQ ID NO: 1421204 - RNA, 21 nt, Homo sapiens
aguaucaggucucccacgugg

SEQ ID NO: 1421205 - RNA, 19 nt, Homo sapiens
aguaucuaaagccaguggc

SEQ ID NO: 1421206 - RNA, 17 nt, Homo sapiens
aguaucucucugccuau

SEQ ID NO: 1421207 - RNA, 15 nt, Homo sapiens
aguauggaaucagcu

SEQ ID NO: 1421208 - RNA, 23 nt, Homo sapiens
aguauuccaugggauguuaagca

SEQ ID NO: 1421209 - RNA, 22 nt, Homo sapiens
aguauugcgaaugugcagaaag

SEQ ID NO: 1421210 - RNA, 13 nt, Homo sapiens
agcuggguggugu

SEQ ID NO: 1421211 - RNA, 14 nt, Homo sapiens
agcuggguggugua

SEQ ID NO: 1421212 - RNA, 14 nt, Homo sapiens
agcugguaaacuau

SEQ ID NO: 1421213 - RNA, 18 nt, Homo sapiens
agcugguaaacuauuugu

SEQ ID NO: 1421214 - RNA, 13 nt, Homo sapiens
agcugguccaggg

SEQ ID NO: 1421215 - RNA, 17 nt, Homo sapiens
agcuggugcugcaagga

SEQ ID NO: 1421216 - RNA, 14 nt, Homo sapiens
agcuguaucuguaa

SEQ ID NO: 1421217 - RNA, 12 nt, Homo sapiens
agcugucugcuc

SEQ ID NO: 1421218 - RNA, 13 nt, Homo sapiens
agcugucugcuca

SEQ ID NO: 1421219 - RNA, 20 nt, Homo sapiens
agcugugaccugcugagcuc

SEQ ID NO: 1421220 - RNA, 13 nt, Homo sapiens
agcuguguucaca

SEQ ID NO: 1421221 - RNA, 16 nt, Homo sapiens
agcuuaaaacaagcaa

SEQ ID NO: 1421222 - RNA, 14 nt, Homo sapiens
agcuuaugucagac

SEQ ID NO: 1421223 - RNA, 14 nt, Homo sapiens
agcuuggagggaug

SEQ ID NO: 1421224 - RNA, 22 nt, Homo sapiens
agcuuguauauacuucacucac

SEQ ID NO: 1421225 - RNA, 20 nt, Homo sapiens
agcuuuagcuucucugccaa

SEQ ID NO: 1421226 - RNA, 16 nt, Homo sapiens
agcuuuaggggaccau

SEQ ID NO: 1421227 - RNA, 19 nt, Homo sapiens
agcuuucagagccagugaa

SEQ ID NO: 1421228 - RNA, 19 nt, Homo sapiens
agcuuucaugaguuuccca

SEQ ID NO: 1421229 - RNA, 19 nt, Homo sapiens
agcuuucuucuacaaccag

SEQ ID NO: 1421230 - RNA, 21 nt, Homo sapiens
agcuuucuucuacaaccagag

SEQ ID NO: 1421231 - RNA, 12 nt, Homo sapiens
agcuuugcucuu

SEQ ID NO: 1421232 - RNA, 15 nt, Homo sapiens
aggaaaaacaaacua

SEQ ID NO: 1421233 - RNA, 20 nt, Homo sapiens
aggaaaaucuuaaaauucuu

SEQ ID NO: 1421234 - RNA, 21 nt, Homo sapiens
aggaaaccuuuucaugccuuu

SEQ ID NO: 1421235 - RNA, 20 nt, Homo sapiens
aggaaagaauuugccuucuc

SEQ ID NO: 1421236 - RNA, 16 nt, Homo sapiens
aggaaagccaaacacu

SEQ ID NO: 1421237 - RNA, 19 nt, Homo sapiens
aggaacagagacucuggaa

SEQ ID NO: 1421238 - RNA, 16 nt, Homo sapiens
aggaaccaaccaacaa

SEQ ID NO: 1421239 - RNA, 22 nt, Homo sapiens
aggaaccaaccaacaaacaaug

SEQ ID NO: 1421240 - RNA, 12 nt, Homo sapiens
aggaacucuggc

SEQ ID NO: 1421241 - RNA, 20 nt, Homo sapiens
aggaagaaaccccaagcagc

SEQ ID NO: 1421242 - RNA, 19 nt, Homo sapiens
aggaagcuccacugucacc

SEQ ID NO: 1421243 - RNA, 22 nt, Homo sapiens
aggaagcuccacugucacccuc

SEQ ID NO: 1421244 - RNA, 19 nt, Homo sapiens
aggaaggauggcaagcacg

SEQ ID NO: 1421245 - RNA, 12 nt, Homo sapiens
aggaaguggcug

SEQ ID NO: 1421246 - RNA, 21 nt, Homo sapiens
aggaauagucgcgcaagcauc

SEQ ID NO: 1421247 - RNA, 12 nt, Homo sapiens
aggaaucugcca

SEQ ID NO: 1421248 - RNA, 21 nt, Homo sapiens
aggacaaccauuccagacugc

SEQ ID NO: 1421249 - RNA, 17 nt, Homo sapiens
aggacaccagccuggug

SEQ ID NO: 1421250 - RNA, 16 nt, Homo sapiens
aggacaguugggcuau

SEQ ID NO: 1421251 - RNA, 13 nt, Homo sapiens
aggaccacagugg

SEQ ID NO: 1421252 - RNA, 17 nt, Homo sapiens
aggaccugagucugcua

SEQ ID NO: 1421253 - RNA, 18 nt, Homo sapiens
aggacgguuaacuuguau

SEQ ID NO: 1421254 - RNA, 23 nt, Homo sapiens
aggacuacacaucagggcuugau

SEQ ID NO: 1421255 - RNA, 20 nt, Homo sapiens
aggacuuaacggcuccagga

SEQ ID NO: 1421256 - RNA, 14 nt, Homo sapiens
aggagacauuggua

SEQ ID NO: 1421257 - RNA, 15 nt, Homo sapiens
aggagacucaccucu

SEQ ID NO: 1421258 - RNA, 22 nt, Homo sapiens
aggagacucaccucugccucaa

SEQ ID NO: 1421259 - RNA, 16 nt, Homo sapiens
aggagaucgagaccau

SEQ ID NO: 1421260 - RNA, 22 nt, Homo sapiens
aggagcaaauguuucugcagua

SEQ ID NO: 1421261 - RNA, 13 nt, Homo sapiens
aggagcagcuuca

SEQ ID NO: 1421262 - RNA, 15 nt, Homo sapiens
aggagcugucuccag

SEQ ID NO: 1421263 - RNA, 23 nt, Homo sapiens
aggaggaccccgggcguggacca

SEQ ID NO: 1421264 - RNA, 14 nt, Homo sapiens
aggaggaguuccuc

SEQ ID NO: 1421265 - RNA, 23 nt, Homo sapiens
aggaggcgcagcccgaagcccag

SEQ ID NO: 1421266 - RNA, 17 nt, Homo sapiens
aggaggcugcaugcucu

SEQ ID NO: 1421267 - RNA, 23 nt, Homo sapiens
aggagggcgugacucacccaagc

SEQ ID NO: 1421268 - RNA, 22 nt, Homo sapiens
aggaggggcccacaauggagug

SEQ ID NO: 1421269 - RNA, 22 nt, Homo sapiens
aggaggugggggcuauuucuau

SEQ ID NO: 1421270 - RNA, 17 nt, Homo sapiens
aggagucagaaacuguu

SEQ ID NO: 1421271 - RNA, 18 nt, Homo sapiens
aggaguucaagaccagcc

SEQ ID NO: 1421272 - RNA, 15 nt, Homo sapiens
aggauaagagggauu

SEQ ID NO: 1421273 - RNA, 21 nt, Homo sapiens
aggauagaauauuuacaauaa

SEQ ID NO: 1421274 - RNA, 16 nt, Homo sapiens
aggauauuuucuucca

SEQ ID NO: 1421275 - RNA, 17 nt, Homo sapiens
aggauuaagauacacuc

SEQ ID NO: 1421276 - RNA, 21 nt, Homo sapiens
aggauuaaugguccugugaug

SEQ ID NO: 1421277 - RNA, 19 nt, Homo sapiens
aggcacuugucacuaugcu

SEQ ID NO: 1421278 - RNA, 15 nt, Homo sapiens
aggcagccacagaca

SEQ ID NO: 1421279 - RNA, 22 nt, Homo sapiens
aggcaguauuauugagcucuau

SEQ ID NO: 1421280 - RNA, 14 nt, Homo sapiens
aggcagugagaugu

SEQ ID NO: 1421281 - RNA, 16 nt, Homo sapiens
aggcauauacaaauaa

SEQ ID NO: 1421282 - RNA, 18 nt, Homo sapiens
aggcauccugugugcuga

SEQ ID NO: 1421283 - RNA, 12 nt, Homo sapiens
aggcaugaacac

SEQ ID NO: 1421284 - RNA, 16 nt, Homo sapiens
aggcaugauguuaacc

SEQ ID NO: 1421285 - RNA, 14 nt, Homo sapiens
aggcauuugccuaa

SEQ ID NO: 1421286 - RNA, 13 nt, Homo sapiens
aggccaaggcagg

SEQ ID NO: 1421287 - RNA, 13 nt, Homo sapiens
aggcccaagagau

SEQ ID NO: 1421288 - RNA, 16 nt, Homo sapiens
aggccccaugaccucc

SEQ ID NO: 1421289 - RNA, 19 nt, Homo sapiens
aggccgggcgcaguggcuc

SEQ ID NO: 1421290 - RNA, 13 nt, Homo sapiens
aggccucccucaa

SEQ ID NO: 1421291 - RNA, 14 nt, Homo sapiens
aggccugcccuccc

SEQ ID NO: 1421292 - RNA, 17 nt, Homo sapiens
aggccuguguagcugug

SEQ ID NO: 1421293 - RNA, 17 nt, Homo sapiens
aggcgcaugugccaguu

SEQ ID NO: 1421294 - RNA, 22 nt, Homo sapiens
aggcggaaaccuugcagcauuu

SEQ ID NO: 1421295 - RNA, 14 nt, Homo sapiens
caauugauacuuca

SEQ ID NO: 1421296 - RNA, 19 nt, Homo sapiens
caauuuaauuccauaauca

SEQ ID NO: 1421297 - RNA, 20 nt, Homo sapiens
caauuuaccuacucuaugua

SEQ ID NO: 1421298 - RNA, 23 nt, Homo sapiens
caauuuaccuacucuauguaugc

SEQ ID NO: 1421299 - RNA, 17 nt, Homo sapiens
caauuuuauagcacaaa

SEQ ID NO: 1421300 - RNA, 16 nt, Homo sapiens
caauuuucagguuucu

SEQ ID NO: 1421301 - RNA, 12 nt, Homo sapiens
caauuuuuccau

SEQ ID NO: 1421302 - RNA, 20 nt, Homo sapiens
caauuuuuuuauacuaccaa

SEQ ID NO: 1421303 - RNA, 19 nt, Homo sapiens
cacaaaaaggcauaugcaa

SEQ ID NO: 1421304 - RNA, 18 nt, Homo sapiens
cacaaaaugauaaucaau

SEQ ID NO: 1421305 - RNA, 12 nt, Homo sapiens
cacaaaccacaa

SEQ ID NO: 1421306 - RNA, 18 nt, Homo sapiens
cacaaauauccaccacuu

SEQ ID NO: 1421307 - RNA, 23 nt, Homo sapiens
cacaacacagagcugcuauuaaa

SEQ ID NO: 1421308 - RNA, 14 nt, Homo sapiens
cacaacccaagaau

SEQ ID NO: 1421309 - RNA, 13 nt, Homo sapiens
cacaacugacaca

SEQ ID NO: 1421310 - RNA, 18 nt, Homo sapiens
cacaacugacacaggaaa

SEQ ID NO: 1421311 - RNA, 19 nt, Homo sapiens
cacaacugacacaggaaac

SEQ ID NO: 1421312 - RNA, 22 nt, Homo sapiens
cacaagaagaccagacugugga

SEQ ID NO: 1421313 - RNA, 19 nt, Homo sapiens
cacaagaggaauaagaaug

SEQ ID NO: 1421314 - RNA, 23 nt, Homo sapiens
cacaagaggaauaagaauggagc

SEQ ID NO: 1421315 - RNA, 15 nt, Homo sapiens
cacaagccacagaag

SEQ ID NO: 1421316 - RNA, 18 nt, Homo sapiens
cacaagcuggaagcacau

SEQ ID NO: 1421317 - RNA, 20 nt, Homo sapiens
cacaagcuuguauauacaua

SEQ ID NO: 1421318 - RNA, 14 nt, Homo sapiens
cacaaguccuguga

SEQ ID NO: 1421319 - RNA, 16 nt, Homo sapiens
cacacaaacaccuccu

SEQ ID NO: 1421320 - RNA, 15 nt, Homo sapiens
cacacacacaccaau

SEQ ID NO: 1421321 - RNA, 13 nt, Homo sapiens
cacacacaccaau

SEQ ID NO: 1421322 - RNA, 13 nt, Homo sapiens
cacacacaccgau

SEQ ID NO: 1421323 - RNA, 15 nt, Homo sapiens
cacacacaccgaugu

SEQ ID NO: 1421324 - RNA, 14 nt, Homo sapiens
cacacacagagaua

SEQ ID NO: 1421325 - RNA, 13 nt, Homo sapiens
cacacacagaugg

SEQ ID NO: 1421326 - RNA, 13 nt, Homo sapiens
cacacagauaugc

SEQ ID NO: 1421327 - RNA, 18 nt, Homo sapiens
cacacagauggucacaca

SEQ ID NO: 1421328 - RNA, 14 nt, Homo sapiens
cacacauguuuaca

SEQ ID NO: 1421329 - RNA, 20 nt, Homo sapiens
cacacccgccgccuccugca

SEQ ID NO: 1421330 - RNA, 23 nt, Homo sapiens
cacaccgauguacacacacagau

SEQ ID NO: 1421331 - RNA, 17 nt, Homo sapiens
cacacgccaaugcacac

SEQ ID NO: 1421332 - RNA, 17 nt, Homo sapiens
cacacgcugucucuuga

SEQ ID NO: 1421333 - RNA, 15 nt, Homo sapiens
cacacggaugcacag

SEQ ID NO: 1421334 - RNA, 16 nt, Homo sapiens
cacacggaugcacaga

SEQ ID NO: 1421335 - RNA, 20 nt, Homo sapiens
cacacggaugcacagagaua

SEQ ID NO: 1421336 - RNA, 18 nt, Homo sapiens
cacacuggcgaaccaucu

SEQ ID NO: 1421337 - RNA, 15 nt, Homo sapiens
cacacuggugacugc

SEQ ID NO: 1421338 - RNA, 14 nt, Homo sapiens
cacacuucucagga

SEQ ID NO: 1421339 - RNA, 20 nt, Homo sapiens
cacacuucuugaaacagccu

SEQ ID NO: 1421340 - RNA, 16 nt, Homo sapiens
cacagaaacauuuuca

SEQ ID NO: 1421341 - RNA, 15 nt, Homo sapiens
cacagagauaugcac

SEQ ID NO: 1421342 - RNA, 18 nt, Homo sapiens
cacagagauaugcacaca

SEQ ID NO: 1421343 - RNA, 14 nt, Homo sapiens
cacagagcaauggu

SEQ ID NO: 1421344 - RNA, 20 nt, Homo sapiens
cacagagggggccuucacag

SEQ ID NO: 1421345 - RNA, 23 nt, Homo sapiens
cacagauauacacauggaugcac

SEQ ID NO: 1421346 - RNA, 13 nt, Homo sapiens
cacagauaugcac

SEQ ID NO: 1421347 - RNA, 19 nt, Homo sapiens
uuugagcaauucauuucac

SEQ ID NO: 1421348 - RNA, 20 nt, Homo sapiens
uuugauaguugguguucaaa

SEQ ID NO: 1421349 - RNA, 15 nt, Homo sapiens
uuugcauuccaugau

SEQ ID NO: 1421350 - RNA, 20 nt, Homo sapiens
uuugccccuuccacuuugag

SEQ ID NO: 1421351 - RNA, 17 nt, Homo sapiens
uuugcccuguggauucc

SEQ ID NO: 1421352 - RNA, 14 nt, Homo sapiens
uuugcuaucaaaau

SEQ ID NO: 1421353 - RNA, 21 nt, Homo sapiens
uuuggggagacgguguugcag

SEQ ID NO: 1421354 - RNA, 15 nt, Homo sapiens
uuuggggcaggagua

SEQ ID NO: 1421355 - RNA, 14 nt, Homo sapiens
uuuguaauugcuua

SEQ ID NO: 1421356 - RNA, 22 nt, Homo sapiens
uuuguauagaguucaucccagc

SEQ ID NO: 1421357 - RNA, 16 nt, Homo sapiens
uuuguggucacagcca

SEQ ID NO: 1421358 - RNA, 13 nt, Homo sapiens
uuuguguaugugu

SEQ ID NO: 1421359 - RNA, 18 nt, Homo sapiens
uuuguuucuuucauauga

SEQ ID NO: 1421360 - RNA, 18 nt, Homo sapiens
uuuuaaagagcauggaaa

SEQ ID NO: 1421361 - RNA, 13 nt, Homo sapiens
uuuuaaauuugaa

SEQ ID NO: 1421362 - RNA, 23 nt, Homo sapiens
uuuuaaauuugaagaugggaugu

SEQ ID NO: 1421363 - RNA, 19 nt, Homo sapiens
uuuuaauuuauuucaucca

SEQ ID NO: 1421364 - RNA, 16 nt, Homo sapiens
uuuuaauuugauacaa

SEQ ID NO: 1421365 - RNA, 20 nt, Homo sapiens
uuuuagugacuguaauuaau

SEQ ID NO: 1421366 - RNA, 18 nt, Homo sapiens
uuuucaaagauguguugc

SEQ ID NO: 1421367 - RNA, 12 nt, Homo sapiens
uuuucaaucuca

SEQ ID NO: 1421368 - RNA, 18 nt, Homo sapiens
uuuucaaugcacauuagu

SEQ ID NO: 1421369 - RNA, 23 nt, Homo sapiens
uuuucacgggaacucuccaaaua

SEQ ID NO: 1421370 - RNA, 21 nt, Homo sapiens
uuuucacugcuggcugccuua

SEQ ID NO: 1421371 - RNA, 15 nt, Homo sapiens
uuuucagaccccagc

SEQ ID NO: 1421372 - RNA, 17 nt, Homo sapiens
uuuucaggaauacauuu

SEQ ID NO: 1421373 - RNA, 22 nt, Homo sapiens
uuuuccacaagauucccagaga

SEQ ID NO: 1421374 - RNA, 13 nt, Homo sapiens
uuuuccuaaaaau

SEQ ID NO: 1421375 - RNA, 14 nt, Homo sapiens
uuuuccuacauuga

SEQ ID NO: 1421376 - RNA, 21 nt, Homo sapiens
uuuucuaagguucucauagga

SEQ ID NO: 1421377 - RNA, 16 nt, Homo sapiens
uuuucuauauggggau

SEQ ID NO: 1421378 - RNA, 16 nt, Homo sapiens
uuuucucugugcuuca

SEQ ID NO: 1421379 - RNA, 23 nt, Homo sapiens
uuuugaccaaauaaaguaccauu

SEQ ID NO: 1421380 - RNA, 11 nt, Homo sapiens
uuuugaugaaa

SEQ ID NO: 1421381 - RNA, 22 nt, Homo sapiens
uuuugcacauaacaugcuuuag

SEQ ID NO: 1421382 - RNA, 15 nt, Homo sapiens
uuuuguaaacuguau

SEQ ID NO: 1421383 - RNA, 22 nt, Homo sapiens
uuuuguggugucuagcauuaac

SEQ ID NO: 1421384 - RNA, 19 nt, Homo sapiens
uuuuuaguagagauggggu

SEQ ID NO: 1421385 - RNA, 10 nt, Homo sapiens
uuuuuaguuu

SEQ ID NO: 1421386 - RNA, 17 nt, Homo sapiens
uuuuuauucuccuccuc

SEQ ID NO: 1421387 - RNA, 22 nt, Homo sapiens
uuuuuccucccuuucccugaga

SEQ ID NO: 1421388 - RNA, 20 nt, Homo sapiens
uuuuugagguggagucucau

SEQ ID NO: 1421389 - RNA, 16 nt, Homo sapiens
uuuuugguguauuuga

SEQ ID NO: 1421390 - RNA, 14 nt, Homo sapiens
uuuuuguacacauc

SEQ ID NO: 1421391 - RNA, 13 nt, Homo sapiens
uuuuuuaacauuc

SEQ ID NO: 1421392 - RNA, 20 nt, Homo sapiens
uuuaaagguuaguauggaau

SEQ ID NO: 1421393 - RNA, 15 nt, Homo sapiens
uuuaaauuauacugu

SEQ ID NO: 1421394 - RNA, 14 nt, Homo sapiens
uuuaacacuaaaaa

SEQ ID NO: 1421395 - RNA, 15 nt, Homo sapiens
uuuaacagaaccaga

SEQ ID NO: 1421396 - RNA, 17 nt, Homo sapiens
uuuaacauuuuccaaaa

SEQ ID NO: 1421397 - RNA, 16 nt, Homo sapiens
uuuaacccucucuucc

SEQ ID NO: 1421398 - RNA, 15 nt, Homo sapiens
uuuaaccuacuagac

SEQ ID NO: 1421399 - RNA, 18 nt, Homo sapiens
uuuaacugugaaccugga

SEQ ID NO: 1421400 - RNA, 11 nt, Homo sapiens
uuuaagaacga

SEQ ID NO: 1421401 - RNA, 13 nt, Homo sapiens
uuuaagguacuua

SEQ ID NO: 1421402 - RNA, 15 nt, Homo sapiens
uuuaaguauauagua

SEQ ID NO: 1421403 - RNA, 17 nt, Homo sapiens
uuuaauacucaccuccu

SEQ ID NO: 1421404 - RNA, 22 nt, Homo sapiens
uuuaaugaagacccaguguaaa

SEQ ID NO: 1421405 - RNA, 12 nt, Homo sapiens
uuuaaugagcac

SEQ ID NO: 1421406 - RNA, 19 nt, Homo sapiens
uuuaauuaacuaugugaug

SEQ ID NO: 1421407 - RNA, 20 nt, Homo sapiens
uuuaauucucaugugauccu

SEQ ID NO: 1421408 - RNA, 16 nt, Homo sapiens
uuuaauugauuauucu

SEQ ID NO: 1421409 - RNA, 21 nt, Homo sapiens
uuuacaauccuaaucauauug

SEQ ID NO: 1421410 - RNA, 15 nt, Homo sapiens
uuuacaaucugcacu

SEQ ID NO: 1421411 - RNA, 18 nt, Homo sapiens
uuuacacucucuguacaa

SEQ ID NO: 1421412 - RNA, 20 nt, Homo sapiens
uuuacauaucaccucauggc

SEQ ID NO: 1421413 - RNA, 22 nt, Homo sapiens
uuuaccauaaaaauccuucuca

SEQ ID NO: 1421414 - RNA, 23 nt, Homo sapiens
uuuaccauaagggacugugccag

SEQ ID NO: 1421415 - RNA, 17 nt, Homo sapiens
uuuaccucuucuaugca

SEQ ID NO: 1421416 - RNA, 14 nt, Homo sapiens
uuuacuagugugug

SEQ ID NO: 1421417 - RNA, 14 nt, Homo sapiens
uuuagccagugacu

SEQ ID NO: 1421418 - RNA, 16 nt, Homo sapiens
uuuagccagugacuuu

SEQ ID NO: 1421419 - RNA, 16 nt, Homo sapiens
uuuagucuguauugau

SEQ ID NO: 1421420 - RNA, 15 nt, Homo sapiens
uuuagugauacugga

SEQ ID NO: 1421421 - RNA, 14 nt, Homo sapiens
uuuagugucuugaa

SEQ ID NO: 1421422 - RNA, 17 nt, Homo sapiens
uuuauaaauguguggug

SEQ ID NO: 1421423 - RNA, 14 nt, Homo sapiens
uuuauacauaguca

SEQ ID NO: 1421424 - RNA, 22 nt, Homo sapiens
uuuauacucuagaacaugcaca

SEQ ID NO: 1421425 - RNA, 19 nt, Homo sapiens
uuuauagcacaaacuuuaa

SEQ ID NO: 1421426 - RNA, 19 nt, Homo sapiens
uuuauauauuugaauauca

SEQ ID NO: 1421427 - RNA, 22 nt, Homo sapiens
uuuauauuguauauucuggaaa

SEQ ID NO: 1421428 - RNA, 22 nt, Homo sapiens
uuuauccacagaaacauuuuca

SEQ ID NO: 1421429 - RNA, 13 nt, Homo sapiens
uuuaucugugcaa

SEQ ID NO: 1421430 - RNA, 22 nt, Homo sapiens
uuuaugagacccauuccuauuu

SEQ ID NO: 1421431 - RNA, 18 nt, Homo sapiens
uuuaugagucagucucuc

SEQ ID NO: 1421432 - RNA, 18 nt, Homo sapiens
uuuaugguguguuccuaa

SEQ ID NO: 1421433 - RNA, 15 nt, Homo sapiens
uuuauguucuaguga

SEQ ID NO: 1421434 - RNA, 14 nt, Homo sapiens
uuuauugugaucua

SEQ ID NO: 1421435 - RNA, 17 nt, Homo sapiens
uuuauuuguauuugcca

SEQ ID NO: 1421436 - RNA, 20 nt, Homo sapiens
uuucaaauuuuuacugagaa

SEQ ID NO: 1421437 - RNA, 13 nt, Homo sapiens
uuucaacauauca

SEQ ID NO: 1421438 - RNA, 16 nt, Homo sapiens
uuucaacauaucauuu

SEQ ID NO: 1421439 - RNA, 13 nt, Homo sapiens
uuucaaccagcau

SEQ ID NO: 1421440 - RNA, 16 nt, Homo sapiens
uuucaaggaaagugaa

SEQ ID NO: 1421441 - RNA, 22 nt, Homo sapiens
uuucacaaaaaggcauaugcaa

SEQ ID NO: 1421442 - RNA, 20 nt, Homo sapiens
uuucacauaaacacauacau

SEQ ID NO: 1421443 - RNA, 19 nt, Homo sapiens
uuucacauacacucaaaca

SEQ ID NO: 1421444 - RNA, 14 nt, Homo sapiens
uuucaccaguuucu

SEQ ID NO: 1421445 - RNA, 20 nt, Homo sapiens
uuucagauggaggugccaua

SEQ ID NO: 1421446 - RNA, 16 nt, Homo sapiens
uuucagcacucagaaa

SEQ ID NO: 1421447 - RNA, 17 nt, Homo sapiens
uuucauguaaauuuugu

SEQ ID NO: 1421448 - RNA, 15 nt, Homo sapiens
uuucccaauacauac

SEQ ID NO: 1421449 - RNA, 18 nt, Homo sapiens
uuucccaggaauauccca

SEQ ID NO: 1421450 - RNA, 13 nt, Homo sapiens
uuuccccagacac

SEQ ID NO: 1421451 - RNA, 19 nt, Homo sapiens
uuucccccaaagaugugua

SEQ ID NO: 1421452 - RNA, 15 nt, Homo sapiens
uuucccuugaacugu

SEQ ID NO: 1421453 - RNA, 20 nt, Homo sapiens
uuuccucgccuaggccugug

SEQ ID NO: 1421454 - RNA, 14 nt, Homo sapiens
uuuccucugcagca

SEQ ID NO: 1421455 - RNA, 15 nt, Homo sapiens
uuuccugugccaacc

SEQ ID NO: 1421456 - RNA, 13 nt, Homo sapiens
uuuccuugucucu

SEQ ID NO: 1421457 - RNA, 13 nt, Homo sapiens
uuuccuuuugcca

SEQ ID NO: 1421458 - RNA, 19 nt, Homo sapiens
uuucuaauguaugcauuca

SEQ ID NO: 1421459 - RNA, 21 nt, Homo sapiens
uuucuaguuucuugugggcua

SEQ ID NO: 1421460 - RNA, 21 nt, Homo sapiens
uuucucagcucccaaggcucu

SEQ ID NO: 1421461 - RNA, 20 nt, Homo sapiens
uuucucccacauauucacau

SEQ ID NO: 1421462 - RNA, 13 nt, Homo sapiens
uuucuccuuuuga

SEQ ID NO: 1421463 - RNA, 15 nt, Homo sapiens
uuucucgggugcauu

SEQ ID NO: 1421464 - RNA, 18 nt, Homo sapiens
uuucucgggugcauuuga

SEQ ID NO: 1421465 - RNA, 23 nt, Homo sapiens
uuucucugcuuacccuucaccuu

SEQ ID NO: 1421466 - RNA, 18 nt, Homo sapiens
uuucucuggcuccagaau

SEQ ID NO: 1421467 - RNA, 15 nt, Homo sapiens
uuucucuguauagua

SEQ ID NO: 1421468 - RNA, 22 nt, Homo sapiens
uuucugagaaagacuauucaaa

SEQ ID NO: 1421469 - RNA, 12 nt, Homo sapiens
uuucuggagcaa

SEQ ID NO: 1421470 - RNA, 20 nt, Homo sapiens
uuucuggugaugcccaaaga

SEQ ID NO: 1421471 - RNA, 15 nt, Homo sapiens
uuucuguaaccaaaa

SEQ ID NO: 1421472 - RNA, 14 nt, Homo sapiens
uuucuuacauuagc

SEQ ID NO: 1421473 - RNA, 17 nt, Homo sapiens
uuucuugaaccaauaau

SEQ ID NO: 1421474 - RNA, 17 nt, Homo sapiens
uuucuugcagaucaaau

SEQ ID NO: 1421475 - RNA, 16 nt, Homo sapiens
uuugaaaacauaaucu

SEQ ID NO: 1421476 - RNA, 22 nt, Homo sapiens
uuugagaacaauggagauauca

SEQ ID NO: 1421477 - RNA, 19 nt, Homo sapiens
uugcaauuuuuccaugaag

SEQ ID NO: 1421478 - RNA, 23 nt, Homo sapiens
uugcacagcucuccggucucucu

SEQ ID NO: 1421479 - RNA, 13 nt, Homo sapiens
uugcacaugugac

SEQ ID NO: 1421480 - RNA, 14 nt, Homo sapiens
uugcacaugugacc

SEQ ID NO: 1421481 - RNA, 16 nt, Homo sapiens
uugcacccaugccaua

SEQ ID NO: 1421482 - RNA, 23 nt, Homo sapiens
uugcaccccuccuauaccauaug

SEQ ID NO: 1421483 - RNA, 11 nt, Homo sapiens
uugcacuuugu

SEQ ID NO: 1421484 - RNA, 12 nt, Homo sapiens
uugcauauguau

SEQ ID NO: 1421485 - RNA, 20 nt, Homo sapiens
uugcaucuguuuugugaccu

SEQ ID NO: 1421486 - RNA, 12 nt, Homo sapiens
uugccaaaguga

SEQ ID NO: 1421487 - RNA, 17 nt, Homo sapiens
uugccaaguuuuaagag

SEQ ID NO: 1421488 - RNA, 14 nt, Homo sapiens
uugcccaccacagc

SEQ ID NO: 1421489 - RNA, 17 nt, Homo sapiens
uugcccugccacuuugc

SEQ ID NO: 1421490 - RNA, 18 nt, Homo sapiens
uugccuccuuauuuauca

SEQ ID NO: 1421491 - RNA, 14 nt, Homo sapiens
uugcgaaugugcag

SEQ ID NO: 1421492 - RNA, 13 nt, Homo sapiens
uugcgggggagcu

SEQ ID NO: 1421493 - RNA, 17 nt, Homo sapiens
uugcuacauaguccaaa

SEQ ID NO: 1421494 - RNA, 15 nt, Homo sapiens
uugcucacucaggac

SEQ ID NO: 1421495 - RNA, 22 nt, Homo sapiens
uugcugaguccaacaauguugu

SEQ ID NO: 1421496 - RNA, 23 nt, Homo sapiens
uugcuggaaggcccacuguccag

SEQ ID NO: 1421497 - RNA, 18 nt, Homo sapiens
uugcuguaacucagacau

SEQ ID NO: 1421498 - RNA, 12 nt, Homo sapiens
uugcuguucacc

SEQ ID NO: 1421499 - RNA, 16 nt, Homo sapiens
uugcuguucacccaca

SEQ ID NO: 1421500 - RNA, 13 nt, Homo sapiens
uugcuguuuccuu

SEQ ID NO: 1421501 - RNA, 17 nt, Homo sapiens
uuggacccgcucuggac

SEQ ID NO: 1421502 - RNA, 16 nt, Homo sapiens
uuggagccacuccugu

SEQ ID NO: 1421503 - RNA, 16 nt, Homo sapiens
uuggauaauauccacu

SEQ ID NO: 1421504 - RNA, 16 nt, Homo sapiens
uuggauacacucucua

SEQ ID NO: 1421505 - RNA, 20 nt, Homo sapiens
uuggcaacagaagcaguuga

SEQ ID NO: 1421506 - RNA, 16 nt, Homo sapiens
uuggccgugaggacac

SEQ ID NO: 1421507 - RNA, 21 nt, Homo sapiens
uuggccuuguggauaagggag

SEQ ID NO: 1421508 - RNA, 16 nt, Homo sapiens
uuggcucacugcaacu

SEQ ID NO: 1421509 - RNA, 14 nt, Homo sapiens
uugggaggccaagg

SEQ ID NO: 1421510 - RNA, 20 nt, Homo sapiens
uugggauucuaggaaaccca

SEQ ID NO: 1421511 - RNA, 20 nt, Homo sapiens
uugggauuuugguuucuucc

SEQ ID NO: 1421512 - RNA, 14 nt, Homo sapiens
uugggccacugcca

SEQ ID NO: 1421513 - RNA, 15 nt, Homo sapiens
uugggcugucaacau

SEQ ID NO: 1421514 - RNA, 14 nt, Homo sapiens
uugguauauuucca

SEQ ID NO: 1421515 - RNA, 14 nt, Homo sapiens
uuggugggucucaa

SEQ ID NO: 1421516 - RNA, 23 nt, Homo sapiens
uugguuaaaggaaguuuguucac

SEQ ID NO: 1421517 - RNA, 19 nt, Homo sapiens
uuguaaauuuuagagcaua

SEQ ID NO: 1421518 - RNA, 13 nt, Homo sapiens
uuguaacuccacc

SEQ ID NO: 1421519 - RNA, 16 nt, Homo sapiens
uuguaacuucaaauau

SEQ ID NO: 1421520 - RNA, 13 nt, Homo sapiens
uuguaagcacuga

SEQ ID NO: 1421521 - RNA, 15 nt, Homo sapiens
uuguaagcacugacu

SEQ ID NO: 1421522 - RNA, 19 nt, Homo sapiens
uuguaauaugucugccaca

SEQ ID NO: 1421523 - RNA, 13 nt, Homo sapiens
uuguaauugcuua

SEQ ID NO: 1421524 - RNA, 12 nt, Homo sapiens
uuguacauuccc

SEQ ID NO: 1421525 - RNA, 23 nt, Homo sapiens
uuguagaaaucuguaauucuauu

SEQ ID NO: 1421526 - RNA, 16 nt, Homo sapiens
uuguauacauugauca

SEQ ID NO: 1421527 - RNA, 16 nt, Homo sapiens
uuguauauuauggaag

SEQ ID NO: 1421528 - RNA, 21 nt, Homo sapiens
uuguauauuccaccauucaca

SEQ ID NO: 1421529 - RNA, 19 nt, Homo sapiens
uuguauauugucagauauu

SEQ ID NO: 1421530 - RNA, 22 nt, Homo sapiens
uuguauguuaaguuacuucacu

SEQ ID NO: 1421531 - RNA, 18 nt, Homo sapiens
uuguauuugcauauguau

SEQ ID NO: 1421532 - RNA, 16 nt, Homo sapiens
uugucaaaugucauua

SEQ ID NO: 1421533 - RNA, 15 nt, Homo sapiens
uugucaccagcaaca

SEQ ID NO: 1421534 - RNA, 22 nt, Homo sapiens
uugucauggaaaauguccugug

SEQ ID NO: 1421535 - RNA, 15 nt, Homo sapiens
uuguccugcucucuu

SEQ ID NO: 1421536 - RNA, 16 nt, Homo sapiens
uuguccuucagccaaa

SEQ ID NO: 1421537 - RNA, 20 nt, Homo sapiens
uugucuauaugucuagcuca

SEQ ID NO: 1421538 - RNA, 15 nt, Homo sapiens
uugucucacacagca

SEQ ID NO: 1421539 - RNA, 23 nt, Homo sapiens
uugucucucuaaacccaaauaaa

SEQ ID NO: 1421540 - RNA, 17 nt, Homo sapiens
uugucucugcaucucau

SEQ ID NO: 1421541 - RNA, 11 nt, Homo sapiens
uugugagcucu

SEQ ID NO: 1421542 - RNA, 18 nt, Homo sapiens
uugugaucuaucaauagu

SEQ ID NO: 1421543 - RNA, 20 nt, Homo sapiens
uugugcugugggcagcaccc

SEQ ID NO: 1421544 - RNA, 20 nt, Homo sapiens
uuguggguuuuuucacauaa

SEQ ID NO: 1421545 - RNA, 23 nt, Homo sapiens
uuguguaaauacaguggaucuca

SEQ ID NO: 1421546 - RNA, 21 nt, Homo sapiens
uuguuaaacacgugucuauaa

SEQ ID NO: 1421547 - RNA, 15 nt, Homo sapiens
uuguuuuagcuccuu

SEQ ID NO: 1421548 - RNA, 19 nt, Homo sapiens
uuguuuugacggaugauug

SEQ ID NO: 1421549 - RNA, 12 nt, Homo sapiens
uuguuuugcacu

SEQ ID NO: 1421550 - RNA, 20 nt, Homo sapiens
uuguuuuuaaguccuguaua

SEQ ID NO: 1421551 - RNA, 21 nt, Homo sapiens
uuuaaaaaaaaauacugaugu

SEQ ID NO: 1421552 - RNA, 14 nt, Homo sapiens
uuuaaaaaaccaug

SEQ ID NO: 1421553 - RNA, 15 nt, Homo sapiens
uuuaaaaacaggaaa

SEQ ID NO: 1421554 - RNA, 19 nt, Homo sapiens
uuuaaaaagcuaguucuau

SEQ ID NO: 1421555 - RNA, 12 nt, Homo sapiens
uuuaaaacacaa

SEQ ID NO: 1421556 - RNA, 14 nt, Homo sapiens
uuuaaaacuaucca

SEQ ID NO: 1421557 - RNA, 18 nt, Homo sapiens
uuuaaaauacacacucaa

SEQ ID NO: 1421558 - RNA, 22 nt, Homo sapiens
uuuaaaaucauucccuuuccca

SEQ ID NO: 1421559 - RNA, 12 nt, Homo sapiens
uuuaaacaguga

SEQ ID NO: 1421560 - RNA, 17 nt, Homo sapiens
uuuaaacuguucugugu

SEQ ID NO: 1421561 - RNA, 17 nt, Homo sapiens
uuuaaagagcauaauaa

SEQ ID NO: 1421562 - RNA, 20 nt, Homo sapiens
uacauucuuuaucuugacau

SEQ ID NO: 1421563 - RNA, 15 nt, Homo sapiens
uacauuucuguucau

SEQ ID NO: 1421564 - RNA, 22 nt, Homo sapiens
uacauuuugccugacuuaccuu

SEQ ID NO: 1421565 - RNA, 10 nt, Homo sapiens
uaccaaauau

SEQ ID NO: 1421566 - RNA, 20 nt, Homo sapiens
uaccaaauccacaagccauu

SEQ ID NO: 1421567 - RNA, 12 nt, Homo sapiens
uaccaaggccca

SEQ ID NO: 1421568 - RNA, 14 nt, Homo sapiens
uaccaaguauuuau

SEQ ID NO: 1421569 - RNA, 21 nt, Homo sapiens
uaccacguuacugcauacuga

SEQ ID NO: 1421570 - RNA, 14 nt, Homo sapiens
uaccagauauuuga

SEQ ID NO: 1421571 - RNA, 21 nt, Homo sapiens
uaccagcuaacuccagucucc

SEQ ID NO: 1421572 - RNA, 17 nt, Homo sapiens
uaccagugaaccaaaga

SEQ ID NO: 1421573 - RNA, 13 nt, Homo sapiens
uaccagugugcuu

SEQ ID NO: 1421574 - RNA, 16 nt, Homo sapiens
uaccauaugucugcuu

SEQ ID NO: 1421575 - RNA, 19 nt, Homo sapiens
uacccauucuucagugccu

SEQ ID NO: 1421576 - RNA, 13 nt, Homo sapiens
uaccccaccacga

SEQ ID NO: 1421577 - RNA, 16 nt, Homo sapiens
uacccggcccagagac

SEQ ID NO: 1421578 - RNA, 18 nt, Homo sapiens
uacccuguaacaugcaau

SEQ ID NO: 1421579 - RNA, 16 nt, Homo sapiens
uacccuuguaccccau

SEQ ID NO: 1421580 - RNA, 18 nt, Homo sapiens
uaccugaccaacaguucc

SEQ ID NO: 1421581 - RNA, 16 nt, Homo sapiens
uaccuguagugagaaa

SEQ ID NO: 1421582 - RNA, 23 nt, Homo sapiens
uaccuuagauuagcucuggacca

SEQ ID NO: 1421583 - RNA, 18 nt, Homo sapiens
uaccuuuacauaauugca

SEQ ID NO: 1421584 - RNA, 23 nt, Homo sapiens
uacgguggcacgugccugugauc

SEQ ID NO: 1421585 - RNA, 15 nt, Homo sapiens
uacuaaaaauacaaa

SEQ ID NO: 1421586 - RNA, 15 nt, Homo sapiens
uacuaaagugccuac

SEQ ID NO: 1421587 - RNA, 13 nt, Homo sapiens
uacuaaugugccc

SEQ ID NO: 1421588 - RNA, 21 nt, Homo sapiens
uacuacuugccacacacuguu

SEQ ID NO: 1421589 - RNA, 19 nt, Homo sapiens
uacuaguuuuccuugaaaa

SEQ ID NO: 1421590 - RNA, 16 nt, Homo sapiens
uacuauuugaagcaau

SEQ ID NO: 1421591 - RNA, 16 nt, Homo sapiens
uacuccaugcacauag

SEQ ID NO: 1421592 - RNA, 13 nt, Homo sapiens
uacucccaggcac

SEQ ID NO: 1421593 - RNA, 12 nt, Homo sapiens
uacucuauguau

SEQ ID NO: 1421594 - RNA, 17 nt, Homo sapiens
uacucuauguaugcauc

SEQ ID NO: 1421595 - RNA, 19 nt, Homo sapiens
uacucuauguaugcaucua

SEQ ID NO: 1421596 - RNA, 21 nt, Homo sapiens
uacucuauguaugcaucuaua

SEQ ID NO: 1421597 - RNA, 12 nt, Homo sapiens
uacucucuugcc

SEQ ID NO: 1421598 - RNA, 14 nt, Homo sapiens
uacucuguccaggc

SEQ ID NO: 1421599 - RNA, 11 nt, Homo sapiens
uacugauucuc

SEQ ID NO: 1421600 - RNA, 14 nt, Homo sapiens
uacugcuguaaaua

SEQ ID NO: 1421601 - RNA, 20 nt, Homo sapiens
uacuggaccccgccucccag

SEQ ID NO: 1421602 - RNA, 18 nt, Homo sapiens
uacuggucuuguggaauu

SEQ ID NO: 1421603 - RNA, 17 nt, Homo sapiens
uacuguagcugaugaaa

SEQ ID NO: 1421604 - RNA, 16 nt, Homo sapiens
uacuguuccaaaaaga

SEQ ID NO: 1421605 - RNA, 15 nt, Homo sapiens
uacuguugcacugau

SEQ ID NO: 1421606 - RNA, 19 nt, Homo sapiens
uacuguugcacugaugucc

SEQ ID NO: 1421607 - RNA, 13 nt, Homo sapiens
uacuuaaacccag

SEQ ID NO: 1421608 - RNA, 15 nt, Homo sapiens
uacuuaaagcuucua

SEQ ID NO: 1421609 - RNA, 17 nt, Homo sapiens
uacuuauuaaucuguau

SEQ ID NO: 1421610 - RNA, 15 nt, Homo sapiens
uacuugaaaaccuca

SEQ ID NO: 1421611 - RNA, 14 nt, Homo sapiens
uacuugaaauacca

SEQ ID NO: 1421612 - RNA, 22 nt, Homo sapiens
uacuugaaauaccagugaacca

SEQ ID NO: 1421613 - RNA, 14 nt, Homo sapiens
uacuugcacaagcu

SEQ ID NO: 1421614 - RNA, 18 nt, Homo sapiens
uacuugccacacacuguu

SEQ ID NO: 1421615 - RNA, 13 nt, Homo sapiens
uacuuggacaguu

SEQ ID NO: 1421616 - RNA, 18 nt, Homo sapiens
uacuuguuuucacuuuau

SEQ ID NO: 1421617 - RNA, 20 nt, Homo sapiens
uacuuuauuuguauuugcca

SEQ ID NO: 1421618 - RNA, 18 nt, Homo sapiens
uacuuucccacagcacua

SEQ ID NO: 1421619 - RNA, 16 nt, Homo sapiens
uacuuuuuauacucca

SEQ ID NO: 1421620 - RNA, 15 nt, Homo sapiens
uagaaacaugacacu

SEQ ID NO: 1421621 - RNA, 22 nt, Homo sapiens
uagaaacugaggccauuauuuc

SEQ ID NO: 1421622 - RNA, 22 nt, Homo sapiens
uagaaagaauguguugccuccu

SEQ ID NO: 1421623 - RNA, 18 nt, Homo sapiens
uagaaagcaacuuaucag

SEQ ID NO: 1421624 - RNA, 17 nt, Homo sapiens
uagaacacugcauuaga

SEQ ID NO: 1421625 - RNA, 22 nt, Homo sapiens
uagaacauaaagcaaauagaca

SEQ ID NO: 1421626 - RNA, 20 nt, Homo sapiens
uagaacuucaagaaguaaga

SEQ ID NO: 1421627 - RNA, 12 nt, Homo sapiens
uagaaggcugug

SEQ ID NO: 1421628 - RNA, 16 nt, Homo sapiens
uagaauagugcauugu

SEQ ID NO: 1421629 - RNA, 14 nt, Homo sapiens
uagaaugcauguaa

SEQ ID NO: 1421630 - RNA, 17 nt, Homo sapiens
uagaaugcuuggcacuc

SEQ ID NO: 1421631 - RNA, 21 nt, Homo sapiens
uagacaauccccacauaccau

SEQ ID NO: 1421632 - RNA, 23 nt, Homo sapiens
uagacacccauuuucacauuccc

SEQ ID NO: 1421633 - RNA, 13 nt, Homo sapiens
uagacagccaggu

SEQ ID NO: 1421634 - RNA, 22 nt, Homo sapiens
uagacaugucuagccacugauc

SEQ ID NO: 1421635 - RNA, 13 nt, Homo sapiens
uagaccacugucc

SEQ ID NO: 1421636 - RNA, 23 nt, Homo sapiens
uagagaagaucuaauaccauccu

SEQ ID NO: 1421637 - RNA, 18 nt, Homo sapiens
uagagcucaggccugcug

SEQ ID NO: 1421638 - RNA, 17 nt, Homo sapiens
uagaggaagaccaaaaa

SEQ ID NO: 1421639 - RNA, 20 nt, Homo sapiens
uagauaaugaaugauaagca

SEQ ID NO: 1421640 - RNA, 16 nt, Homo sapiens
uagauauuauucauuc

SEQ ID NO: 1421641 - RNA, 22 nt, Homo sapiens
uagauccauuuggacaaaaugg

SEQ ID NO: 1421642 - RNA, 17 nt, Homo sapiens
uagaucccaugucaccu

SEQ ID NO: 1421643 - RNA, 12 nt, Homo sapiens
uagaucuagaaa

SEQ ID NO: 1421644 - RNA, 14 nt, Homo sapiens
uagauguaucauua

SEQ ID NO: 1421645 - RNA, 18 nt, Homo sapiens
uagaugugacacauucuc

SEQ ID NO: 1421646 - RNA, 14 nt, Homo sapiens
uagauuaccugcca

SEQ ID NO: 1421647 - RNA, 23 nt, Homo sapiens
ccuuccggaagaaaaagagccau

SEQ ID NO: 1421648 - RNA, 18 nt, Homo sapiens
ccuuccuaauaugcuuua

SEQ ID NO: 1421649 - RNA, 18 nt, Homo sapiens
ccuuccugccaccaguca

SEQ ID NO: 1421650 - RNA, 19 nt, Homo sapiens
ccuuccugucccaccucuu

SEQ ID NO: 1421651 - RNA, 18 nt, Homo sapiens
ccuuccuuaagccaggaa

SEQ ID NO: 1421652 - RNA, 21 nt, Homo sapiens
ccuuccuuuaggucugguugu

SEQ ID NO: 1421653 - RNA, 19 nt, Homo sapiens
ccuucugguacaauccuuu

SEQ ID NO: 1421654 - RNA, 13 nt, Homo sapiens
ccuucuucaggga

SEQ ID NO: 1421655 - RNA, 22 nt, Homo sapiens
ccuucuuuucaaaacugcuaaa

SEQ ID NO: 1421656 - RNA, 11 nt, Homo sapiens
ccuugaaccag

SEQ ID NO: 1421657 - RNA, 19 nt, Homo sapiens
ccuugaaggucacucuucc

SEQ ID NO: 1421658 - RNA, 22 nt, Homo sapiens
ccuugauggagauauuuacaug

SEQ ID NO: 1421659 - RNA, 14 nt, Homo sapiens
ccuugccaugucuu

SEQ ID NO: 1421660 - RNA, 18 nt, Homo sapiens
ccuugcuagacagccagg

SEQ ID NO: 1421661 - RNA, 11 nt, Homo sapiens
ccuugcucugc

SEQ ID NO: 1421662 - RNA, 21 nt, Homo sapiens
ccuugcuggacggggacuggg

SEQ ID NO: 1421663 - RNA, 21 nt, Homo sapiens
ccuuguuuggggcaggaguag

SEQ ID NO: 1421664 - RNA, 20 nt, Homo sapiens
ccuuuaaauccuuccaugaa

SEQ ID NO: 1421665 - RNA, 14 nt, Homo sapiens
ccuuuacuaaucca

SEQ ID NO: 1421666 - RNA, 13 nt, Homo sapiens
ccuuuauugugau

SEQ ID NO: 1421667 - RNA, 16 nt, Homo sapiens
ccuuucaaauuucaca

SEQ ID NO: 1421668 - RNA, 15 nt, Homo sapiens
ccuuuccuccacucc

SEQ ID NO: 1421669 - RNA, 22 nt, Homo sapiens
ccuuuccucugcagcacuuuaa

SEQ ID NO: 1421670 - RNA, 21 nt, Homo sapiens
ccuuucucagccacaaaauaa

SEQ ID NO: 1421671 - RNA, 22 nt, Homo sapiens
ccuuucuuucuaacuccaguga

SEQ ID NO: 1421672 - RNA, 19 nt, Homo sapiens
ccuuugaggcaaaggccag

SEQ ID NO: 1421673 - RNA, 21 nt, Homo sapiens
ccuuuggcuaucuacugagac

SEQ ID NO: 1421674 - RNA, 21 nt, Homo sapiens
ccuuuuacagcucuuggcauu

SEQ ID NO: 1421675 - RNA, 16 nt, Homo sapiens
ccuuuuauaccagaga

SEQ ID NO: 1421676 - RNA, 21 nt, Homo sapiens
ccuuuuauucauauuuucaca

SEQ ID NO: 1421677 - RNA, 16 nt, Homo sapiens
ccuuuugaccaaauaa

SEQ ID NO: 1421678 - RNA, 22 nt, Homo sapiens
ccuuuugcacauaacaugcuuu

SEQ ID NO: 1421679 - RNA, 23 nt, Homo sapiens
ccuuuuguauuuaaaaccuugau

SEQ ID NO: 1421680 - RNA, 22 nt, Homo sapiens
cgaacgcucuuagcuuucucag

SEQ ID NO: 1421681 - RNA, 22 nt, Homo sapiens
cgaacucaucccuguuccucaa

SEQ ID NO: 1421682 - RNA, 12 nt, Homo sapiens
cgaagcccaguu

SEQ ID NO: 1421683 - RNA, 13 nt, Homo sapiens
cgaaucaucucaa

SEQ ID NO: 1421684 - RNA, 18 nt, Homo sapiens
cgaauguuagauuccucu

SEQ ID NO: 1421685 - RNA, 10 nt, Homo sapiens
ucuuuuccau

SEQ ID NO: 1421686 - RNA, 13 nt, Homo sapiens
ucuuuuuccuccc

SEQ ID NO: 1421687 - RNA, 14 nt, Homo sapiens
ucuuuuucugucuc

SEQ ID NO: 1421688 - RNA, 17 nt, Homo sapiens
ucuuuuuucaacuggcu

SEQ ID NO: 1421689 - RNA, 16 nt, Homo sapiens
ugaaaaaaaugcauuu

SEQ ID NO: 1421690 - RNA, 22 nt, Homo sapiens
ugaaaaaugguaauuguugcua

SEQ ID NO: 1421691 - RNA, 17 nt, Homo sapiens
ugaaaacaaaauaucug

SEQ ID NO: 1421692 - RNA, 17 nt, Homo sapiens
ugaaaaggaaguuaaua

SEQ ID NO: 1421693 - RNA, 11 nt, Homo sapiens
ugaaaauaacu

SEQ ID NO: 1421694 - RNA, 14 nt, Homo sapiens
ugaaaaucuaauau

SEQ ID NO: 1421695 - RNA, 22 nt, Homo sapiens
ugaaaccagaaggauauuuacu

SEQ ID NO: 1421696 - RNA, 18 nt, Homo sapiens
ugaaacuggggcuugcaa

SEQ ID NO: 1421697 - RNA, 23 nt, Homo sapiens
ugaaagaaaaauaccaugucucu

SEQ ID NO: 1421698 - RNA, 16 nt, Homo sapiens
ugaaagaguagugcau

SEQ ID NO: 1421699 - RNA, 20 nt, Homo sapiens
ugaaagaguagugcauuuaa

SEQ ID NO: 1421700 - RNA, 14 nt, Homo sapiens
ugaaagcagaugag

SEQ ID NO: 1421701 - RNA, 17 nt, Homo sapiens
ugaaaggcacacuuuga

SEQ ID NO: 1421702 - RNA, 21 nt, Homo sapiens
ugaaagggaaagucagcuuuc

SEQ ID NO: 1421703 - RNA, 18 nt, Homo sapiens
ugaaagugaauaaacuuc

SEQ ID NO: 1421704 - RNA, 20 nt, Homo sapiens
aaaacaaaugggaaaauguc

SEQ ID NO: 1421705 - RNA, 15 nt, Homo sapiens
aaaacagaacaauua

SEQ ID NO: 1421706 - RNA, 11 nt, Homo sapiens
aaaacauauca

SEQ ID NO: 1421707 - RNA, 22 nt, Homo sapiens
aaaacauaugcauuaugaaguu

SEQ ID NO: 1421708 - RNA, 13 nt, Homo sapiens
aaaacaugacuuu

SEQ ID NO: 1421709 - RNA, 19 nt, Homo sapiens
aaaaccagaaucauaauuu

SEQ ID NO: 1421710 - RNA, 15 nt, Homo sapiens
aaaacccagcaugua

SEQ ID NO: 1421711 - RNA, 18 nt, Homo sapiens
aaaaccuuucaaauuuca

SEQ ID NO: 1421712 - RNA, 15 nt, Homo sapiens
aaaaccuuuccccag

SEQ ID NO: 1421713 - RNA, 20 nt, Homo sapiens
aaaacucuugauaugaccug

SEQ ID NO: 1421714 - RNA, 14 nt, Homo sapiens
aaaacugacagagg

SEQ ID NO: 1421715 - RNA, 19 nt, Homo sapiens
aaaagaaguguuccuucau

SEQ ID NO: 1421716 - RNA, 16 nt, Homo sapiens
aaaagaauacagaaag

SEQ ID NO: 1421717 - RNA, 20 nt, Homo sapiens
aaaagacauuuuuauuuagu

SEQ ID NO: 1421718 - RNA, 15 nt, Homo sapiens
aaaagaccaguccau

SEQ ID NO: 1421719 - RNA, 18 nt, Homo sapiens
aaaagauuuguuuuguca

SEQ ID NO: 1421720 - RNA, 17 nt, Homo sapiens
aaaagcaaaagcucugu

SEQ ID NO: 1421721 - RNA, 13 nt, Homo sapiens
aaaagcuuagcag

SEQ ID NO: 1421722 - RNA, 22 nt, Homo sapiens
aaaagguagcuuaccugacaca

SEQ ID NO: 1421723 - RNA, 14 nt, Homo sapiens
aaaaguacauguau

SEQ ID NO: 1421724 - RNA, 22 nt, Homo sapiens
aaaagugaucuguccccucucc

SEQ ID NO: 1421725 - RNA, 13 nt, Homo sapiens
aaaaguuacuuau

SEQ ID NO: 1421726 - RNA, 13 nt, Homo sapiens
aaaaguugugauu

SEQ ID NO: 1421727 - RNA, 22 nt, Homo sapiens
aaaaguuuggccgggugcggug

SEQ ID NO: 1421728 - RNA, 16 nt, Homo sapiens
aaaaguuuugaugaaa

SEQ ID NO: 1421729 - RNA, 14 nt, Homo sapiens
aaaauaagcuuuau

SEQ ID NO: 1421730 - RNA, 12 nt, Homo sapiens
aaaauaccucuu

SEQ ID NO: 1421731 - RNA, 13 nt, Homo sapiens
aaaauagcaacac

SEQ ID NO: 1421732 - RNA, 15 nt, Homo sapiens
aaaauagcucuuuca

SEQ ID NO: 1421733 - RNA, 19 nt, Homo sapiens
aaagacugcagcugcugaa

SEQ ID NO: 1421734 - RNA, 13 nt, Homo sapiens
aaagagagcccug

SEQ ID NO: 1421735 - RNA, 16 nt, Homo sapiens
aaagagccuggagaag

SEQ ID NO: 1421736 - RNA, 19 nt, Homo sapiens
aaagaggaaaagugcaaug

SEQ ID NO: 1421737 - RNA, 15 nt, Homo sapiens
aaagaggcagcuuga

SEQ ID NO: 1421738 - RNA, 15 nt, Homo sapiens
aaagaguagugcauu

SEQ ID NO: 1421739 - RNA, 20 nt, Homo sapiens
aaagauaacaagaucuuuca

SEQ ID NO: 1421740 - RNA, 17 nt, Homo sapiens
aaagauuuguuuuguca

SEQ ID NO: 1421741 - RNA, 18 nt, Homo sapiens
aaagcaaaauaauaagaa

SEQ ID NO: 1421742 - RNA, 14 nt, Homo sapiens
aaagcacaccucau

SEQ ID NO: 1421743 - RNA, 12 nt, Homo sapiens
aaagcaccugcc

SEQ ID NO: 1421744 - RNA, 15 nt, Homo sapiens
aaagcaccuuagcug

SEQ ID NO: 1421745 - RNA, 19 nt, Homo sapiens
aaagcagguggcaucucua

SEQ ID NO: 1421746 - RNA, 10 nt, Homo sapiens
aaagcagugu

SEQ ID NO: 1421747 - RNA, 12 nt, Homo sapiens
aaagcagugugu

SEQ ID NO: 1421748 - RNA, 20 nt, Homo sapiens
aaagcauuacauuuccaaau

SEQ ID NO: 1421749 - RNA, 15 nt, Homo sapiens
aaagcauugagaucu

SEQ ID NO: 1421750 - RNA, 15 nt, Homo sapiens
aaagccaacagucaa

SEQ ID NO: 1421751 - RNA, 21 nt, Homo sapiens
aaagccccuggaaaugugcua

SEQ ID NO: 1421752 - RNA, 13 nt, Homo sapiens
aaagcccuuccau

SEQ ID NO: 1421753 - RNA, 15 nt, Homo sapiens
aaagcccuuccaugu

SEQ ID NO: 1421754 - RNA, 14 nt, Homo sapiens
aaagcgagauccca

SEQ ID NO: 1421755 - RNA, 19 nt, Homo sapiens
aaagcgagaucccaucucu

SEQ ID NO: 1421756 - RNA, 12 nt, Homo sapiens
aaagcuaccugu

SEQ ID NO: 1421757 - RNA, 17 nt, Homo sapiens
aaagcugaggacagggu

SEQ ID NO: 1421758 - RNA, 23 nt, Homo sapiens
aaagcuguuuauuuauucacugu

SEQ ID NO: 1421759 - RNA, 15 nt, Homo sapiens
aaaggaaaccaaagg

SEQ ID NO: 1421760 - RNA, 17 nt, Homo sapiens
aaaggaagucaccaaaa

SEQ ID NO: 1421761 - RNA, 13 nt, Homo sapiens
aaaggaccuuccc

SEQ ID NO: 1421762 - RNA, 12 nt, Homo sapiens
aaaggagccugu

SEQ ID NO: 1421763 - RNA, 16 nt, Homo sapiens
aaaggagccugugaac

SEQ ID NO: 1421764 - RNA, 16 nt, Homo sapiens
aaaggaggcaugccuc

SEQ ID NO: 1421765 - RNA, 22 nt, Homo sapiens
aaaggcauccauagugcacuag

SEQ ID NO: 1421766 - RNA, 16 nt, Homo sapiens
aaaggccucaucuccu

SEQ ID NO: 1421767 - RNA, 10 nt, Homo sapiens
aaagggaugg

SEQ ID NO: 1421768 - RNA, 17 nt, Homo sapiens
aaagggcugaaagccau

SEQ ID NO: 1421769 - RNA, 18 nt, Homo sapiens
aaagggugcccacaaaau

SEQ ID NO: 1421770 - RNA, 16 nt, Homo sapiens
aaagguugagauguaa

SEQ ID NO: 1421771 - RNA, 17 nt, Homo sapiens
aaagguuucaagacuug

SEQ ID NO: 1421772 - RNA, 16 nt, Homo sapiens
aaaguaaugcuucaau

SEQ ID NO: 1421773 - RNA, 13 nt, Homo sapiens
aaaguacauguau

SEQ ID NO: 1421774 - RNA, 15 nt, Homo sapiens
aaagugcagcccuuc

SEQ ID NO: 1421775 - RNA, 17 nt, Homo sapiens
aaagugcagcccuuccu

SEQ ID NO: 1421776 - RNA, 20 nt, Homo sapiens
aaagugccagaaaguguuua

SEQ ID NO: 1421777 - RNA, 23 nt, Homo sapiens
aaaguucccuacuuccugugacu

SEQ ID NO: 1421778 - RNA, 23 nt, Homo sapiens
aaaguuguucgccgcguggaaug

SEQ ID NO: 1421779 - RNA, 13 nt, Homo sapiens
aaauaaaccugga

SEQ ID NO: 1421780 - RNA, 14 nt, Homo sapiens
aaauaaacuaguuu

SEQ ID NO: 1421781 - RNA, 16 nt, Homo sapiens
aaauaaaguaccauua

SEQ ID NO: 1421782 - RNA, 13 nt, Homo sapiens
aaauaaaugccaa

SEQ ID NO: 1421783 - RNA, 21 nt, Homo sapiens
aaauaaggggcaccugggaaa

SEQ ID NO: 1421784 - RNA, 22 nt, Homo sapiens
aaauaauaggauauaaaacaca

SEQ ID NO: 1421785 - RNA, 13 nt, Homo sapiens
aaauaaugaacug

SEQ ID NO: 1421786 - RNA, 23 nt, Homo sapiens
aaauacacagaugauaauaugcu

SEQ ID NO: 1421787 - RNA, 17 nt, Homo sapiens
aaauaccagugaaccaa

SEQ ID NO: 1421788 - RNA, 19 nt, Homo sapiens
aaauaccagugaaccaaag

SEQ ID NO: 1421789 - RNA, 20 nt, Homo sapiens
aaauaccuauaugaauauga

SEQ ID NO: 1421790 - RNA, 11 nt, Homo sapiens
aaauacuacac

SEQ ID NO: 1421791 - RNA, 20 nt, Homo sapiens
aaauacuguacauagaugua

SEQ ID NO: 1421792 - RNA, 14 nt, Homo sapiens
aaauauacaaacau

SEQ ID NO: 1421793 - RNA, 13 nt, Homo sapiens
aaauauauauaca

SEQ ID NO: 1421794 - RNA, 23 nt, Homo sapiens
aaauaucuaccugcccucucuca

SEQ ID NO: 1421795 - RNA, 20 nt, Homo sapiens
aaauaugauuuuauuugaca

SEQ ID NO: 1421796 - RNA, 22 nt, Homo sapiens
aaauaugugcuugaaaugagaa

SEQ ID NO: 1421797 - RNA, 19 nt, Homo sapiens
aaauauguugaguguucau

SEQ ID NO: 1421798 - RNA, 13 nt, Homo sapiens
aaauauuccugca

SEQ ID NO: 1421799 - RNA, 11 nt, Homo sapiens
aaauauucucu

SEQ ID NO: 1421800 - RNA, 16 nt, Homo sapiens
aaaucaugaaaagagg

SEQ ID NO: 1421801 - RNA, 19 nt, Homo sapiens
aaaucauuaauacucuucu

SEQ ID NO: 1421802 - RNA, 15 nt, Homo sapiens
aaaucauuguagaaa

SEQ ID NO: 1421803 - RNA, 16 nt, Homo sapiens
aaaucuaguuuacuuc

SEQ ID NO: 1421804 - RNA, 13 nt, Homo sapiens
aaaucuccagugu

SEQ ID NO: 1421805 - RNA, 13 nt, Homo sapiens
aaaucucuaauau

SEQ ID NO: 1421806 - RNA, 19 nt, Homo sapiens
aaaucugacaagacugaaa

SEQ ID NO: 1421807 - RNA, 18 nt, Homo sapiens
aaaucuguuuauaugaca

SEQ ID NO: 1421808 - RNA, 15 nt, Homo sapiens
aaaucuuaacuugaa

SEQ ID NO: 1421809 - RNA, 21 nt, Homo sapiens
aaaugaagguuaggauuuaac

SEQ ID NO: 1421810 - RNA, 13 nt, Homo sapiens
aaaugaaucuuac

SEQ ID NO: 1421811 - RNA, 14 nt, Homo sapiens
aaaugaaucuuacu

SEQ ID NO: 1421812 - RNA, 17 nt, Homo sapiens
aaaugacagauguugaa

SEQ ID NO: 1421813 - RNA, 13 nt, Homo sapiens
aaaugacccaaag

SEQ ID NO: 1421814 - RNA, 13 nt, Homo sapiens
aaaugaguauuuc

SEQ ID NO: 1421815 - RNA, 13 nt, Homo sapiens
aaaugcaagguga

SEQ ID NO: 1421816 - RNA, 23 nt, Homo sapiens
aaaugcaaggugaacaccacuuu

SEQ ID NO: 1421817 - RNA, 18 nt, Homo sapiens
aaaugcauccauuccuca

SEQ ID NO: 1421818 - RNA, 11 nt, Homo sapiens
aaaugccucau

SEQ ID NO: 1421819 - RNA, 14 nt, Homo sapiens
aaauggaguauuuu

SEQ ID NO: 1421820 - RNA, 15 nt, Homo sapiens
aaccuauccuuccag

SEQ ID NO: 1421821 - RNA, 23 nt, Homo sapiens
aaccuauuuaaaacagugaauua

SEQ ID NO: 1421822 - RNA, 20 nt, Homo sapiens
aaccugaugccccuucccca

SEQ ID NO: 1421823 - RNA, 17 nt, Homo sapiens
aaccuggcuuauuccca

SEQ ID NO: 1421824 - RNA, 12 nt, Homo sapiens
aaccugggaugu

SEQ ID NO: 1421825 - RNA, 15 nt, Homo sapiens
aaccuugcagcauuu

SEQ ID NO: 1421826 - RNA, 18 nt, Homo sapiens
aaccuuuucaugccuuua

SEQ ID NO: 1421827 - RNA, 21 nt, Homo sapiens
aacgacgguuucaaaccagga

SEQ ID NO: 1421828 - RNA, 17 nt, Homo sapiens
aacgagggauaauucaa

SEQ ID NO: 1421829 - RNA, 12 nt, Homo sapiens
aacgcacaggaa

SEQ ID NO: 1421830 - RNA, 16 nt, Homo sapiens
aacggagagugcuugg

SEQ ID NO: 1421831 - RNA, 21 nt, Homo sapiens
aacggaguacagacgucucaa

SEQ ID NO: 1421832 - RNA, 18 nt, Homo sapiens
aacggcuccaggauuuua

SEQ ID NO: 1421833 - RNA, 15 nt, Homo sapiens
aacuacacuaauaaa

SEQ ID NO: 1421834 - RNA, 12 nt, Homo sapiens
aacuacauguaa

SEQ ID NO: 1421835 - RNA, 17 nt, Homo sapiens
aacuacuaaagugccua

SEQ ID NO: 1421836 - RNA, 23 nt, Homo sapiens
aacuacuaaagugccuaccccag

SEQ ID NO: 1421837 - RNA, 14 nt, Homo sapiens
aacuagaaccugga

SEQ ID NO: 1421838 - RNA, 15 nt, Homo sapiens
aacuaugcugaagag

SEQ ID NO: 1421839 - RNA, 20 nt, Homo sapiens
aacuauuucuacacaguggg

SEQ ID NO: 1421840 - RNA, 15 nt, Homo sapiens
aacucagacauucca

SEQ ID NO: 1421841 - RNA, 12 nt, Homo sapiens
aacuccagugaa

SEQ ID NO: 1421842 - RNA, 22 nt, Homo sapiens
aacucucuccuguauaaucucu

SEQ ID NO: 1421843 - RNA, 15 nt, Homo sapiens
aacucugcacuccau

SEQ ID NO: 1421844 - RNA, 13 nt, Homo sapiens
aaaaaaucuucca

SEQ ID NO: 1421845 - RNA, 12 nt, Homo sapiens
aaaaacuugggu

SEQ ID NO: 1421846 - RNA, 17 nt, Homo sapiens
aaaaagaggcauuccag

SEQ ID NO: 1421847 - RNA, 16 nt, Homo sapiens
aaaaagcaugaucuga

SEQ ID NO: 1421848 - RNA, 15 nt, Homo sapiens
aaaaaguaugugaau

SEQ ID NO: 1421849 - RNA, 15 nt, Homo sapiens
aaaaauaagcuuuau

SEQ ID NO: 1421850 - RNA, 20 nt, Homo sapiens
aaaaauauauauagugcuau

SEQ ID NO: 1421851 - RNA, 21 nt, Homo sapiens
aaaaaucaugagauccuuuaa

SEQ ID NO: 1421852 - RNA, 14 nt, Homo sapiens
aaaaaugacuaaaa

SEQ ID NO: 1421853 - RNA, 23 nt, Homo sapiens
aaaaauuaacaaaagauucugua

SEQ ID NO: 1421854 - RNA, 12 nt, Homo sapiens
aauaucugacau

SEQ ID NO: 1421855 - RNA, 21 nt, Homo sapiens
aauaucuuuaauagguuaaua

SEQ ID NO: 1421856 - RNA, 19 nt, Homo sapiens
aauaugggcucaagucacu

SEQ ID NO: 1421857 - RNA, 14 nt, Homo sapiens
aauauguaagucag

SEQ ID NO: 1421858 - RNA, 17 nt, Homo sapiens
aauauguuugugccuua

SEQ ID NO: 1421859 - RNA, 13 nt, Homo sapiens
aauauuaaauaca

SEQ ID NO: 1421860 - RNA, 15 nt, Homo sapiens
aauauuauaaaucca

SEQ ID NO: 1421861 - RNA, 23 nt, Homo sapiens
aauauuguucuauuuguauauau

SEQ ID NO: 1421862 - RNA, 17 nt, Homo sapiens
aauauuuaaacuucuug

SEQ ID NO: 1421863 - RNA, 18 nt, Homo sapiens
aauauuuauauauuugaa

SEQ ID NO: 1421864 - RNA, 16 nt, Homo sapiens
aaucacaccucugggc

SEQ ID NO: 1421865 - RNA, 13 nt, Homo sapiens
aaucaccaaagua

SEQ ID NO: 1421866 - RNA, 14 nt, Homo sapiens
aaucaccacaccaa

SEQ ID NO: 1421867 - RNA, 14 nt, Homo sapiens
aaucacucuguccu

SEQ ID NO: 1421868 - RNA, 22 nt, Homo sapiens
aaucaugagauccuuuaaaucc

SEQ ID NO: 1421869 - RNA, 16 nt, Homo sapiens
aaucaugaguaccuca

SEQ ID NO: 1421870 - RNA, 20 nt, Homo sapiens
aaucaugguuguagugaugu

SEQ ID NO: 1421871 - RNA, 20 nt, Homo sapiens
aaucauuguagaaacacagu

SEQ ID NO: 1421872 - RNA, 16 nt, Homo sapiens
aaucauuucugcauca

SEQ ID NO: 1421873 - RNA, 16 nt, Homo sapiens
aaucauuuugccucuu

SEQ ID NO: 1421874 - RNA, 17 nt, Homo sapiens
acacaauugauacuuca

SEQ ID NO: 1421875 - RNA, 17 nt, Homo sapiens
acacacagagauaugca

SEQ ID NO: 1421876 - RNA, 15 nt, Homo sapiens
acacacagauaugca

SEQ ID NO: 1421877 - RNA, 18 nt, Homo sapiens
acacacauggaugcacac

SEQ ID NO: 1421878 - RNA, 19 nt, Homo sapiens
acacaccucuaggacucca

SEQ ID NO: 1421879 - RNA, 15 nt, Homo sapiens
acacacggaugcaca

SEQ ID NO: 1421880 - RNA, 23 nt, Homo sapiens
acacagacccacacauguuuaca

SEQ ID NO: 1421881 - RNA, 15 nt, Homo sapiens
acacagagauaugca

SEQ ID NO: 1421882 - RNA, 18 nt, Homo sapiens
acacagagauaugcacac

SEQ ID NO: 1421883 - RNA, 15 nt, Homo sapiens
acacagagcaauggu

SEQ ID NO: 1421884 - RNA, 16 nt, Homo sapiens
acacagauaugcacac

SEQ ID NO: 1421885 - RNA, 22 nt, Homo sapiens
acacagauggucacacagagau

SEQ ID NO: 1421886 - RNA, 15 nt, Homo sapiens
acacagcaguaugaa

SEQ ID NO: 1421887 - RNA, 12 nt, Homo sapiens
acacagcuccuc

SEQ ID NO: 1421888 - RNA, 14 nt, Homo sapiens
acacaggcaaaauc

SEQ ID NO: 1421889 - RNA, 13 nt, Homo sapiens
acacaggccugug

SEQ ID NO: 1421890 - RNA, 14 nt, Homo sapiens
acacagucucaguc

SEQ ID NO: 1421891 - RNA, 19 nt, Homo sapiens
acacaguguuccagcugcc

SEQ ID NO: 1421892 - RNA, 20 nt, Homo sapiens
acucuaccugcaagauuuca

SEQ ID NO: 1421893 - RNA, 20 nt, Homo sapiens
acucuacuuccucuuaccua

SEQ ID NO: 1421894 - RNA, 13 nt, Homo sapiens
acucucugagaug

SEQ ID NO: 1421895 - RNA, 13 nt, Homo sapiens
acucucugcucua

SEQ ID NO: 1421896 - RNA, 17 nt, Homo sapiens
acucugaggacauggag

SEQ ID NO: 1421897 - RNA, 22 nt, Homo sapiens
acucugccccuucuguuuccau

SEQ ID NO: 1421898 - RNA, 14 nt, Homo sapiens
acucuggguuucau

SEQ ID NO: 1421899 - RNA, 14 nt, Homo sapiens
acucuuaacuccua

SEQ ID NO: 1421900 - RNA, 19 nt, Homo sapiens
acucuuaacuccuagccca

SEQ ID NO: 1421901 - RNA, 14 nt, Homo sapiens
acucuuaugaaaug

SEQ ID NO: 1421902 - RNA, 22 nt, Homo sapiens
acucuucaaggucugcuuuuca

SEQ ID NO: 1421903 - RNA, 15 nt, Homo sapiens
acugaaaaaugucag

SEQ ID NO: 1421904 - RNA, 15 nt, Homo sapiens
acugaaacauucaca

SEQ ID NO: 1421905 - RNA, 23 nt, Homo sapiens
accuuaaucugccauaaagccau

SEQ ID NO: 1421906 - RNA, 18 nt, Homo sapiens
accuuggacugacuacca

SEQ ID NO: 1421907 - RNA, 20 nt, Homo sapiens
accuuuaaaguaaaggccuc

SEQ ID NO: 1421908 - RNA, 21 nt, Homo sapiens
accuuuauugugaucuaucaa

SEQ ID NO: 1421909 - RNA, 14 nt, Homo sapiens
accuuuugucucac

SEQ ID NO: 1421910 - RNA, 12 nt, Homo sapiens
acgaacuggacu

SEQ ID NO: 1421911 - RNA, 17 nt, Homo sapiens
acgaaucguacuucuuu

SEQ ID NO: 1421912 - RNA, 18 nt, Homo sapiens
acgacuguuguacaagcu

SEQ ID NO: 1421913 - RNA, 14 nt, Homo sapiens
acgcacacauggac

SEQ ID NO: 1421914 - RNA, 18 nt, Homo sapiens
acgcacucaacuuccuuu

SEQ ID NO: 1421915 - RNA, 22 nt, Homo sapiens
acgcagaggcggaaaccuugca

SEQ ID NO: 1421916 - RNA, 13 nt, Homo sapiens
cacccaugccaua

SEQ ID NO: 1421917 - RNA, 20 nt, Homo sapiens
caccccagcgccugugcuga

SEQ ID NO: 1421918 - RNA, 13 nt, Homo sapiens
cacccccagucuc

SEQ ID NO: 1421919 - RNA, 19 nt, Homo sapiens
cacccccaugcagccucuu

SEQ ID NO: 1421920 - RNA, 15 nt, Homo sapiens
caccccuaaagagau

SEQ ID NO: 1421921 - RNA, 17 nt, Homo sapiens
cacccgacuccucaaaa

SEQ ID NO: 1421922 - RNA, 15 nt, Homo sapiens
cacccucaaauguca

SEQ ID NO: 1421923 - RNA, 17 nt, Homo sapiens
cacccucaaaugucaga

SEQ ID NO: 1421924 - RNA, 21 nt, Homo sapiens
cacccucaaaugucagagcua

SEQ ID NO: 1421925 - RNA, 16 nt, Homo sapiens
cacccuucucauucca

SEQ ID NO: 1421926 - RNA, 23 nt, Homo sapiens
cuuaguccgcaaguucagggaag

SEQ ID NO: 1421927 - RNA, 17 nt, Homo sapiens
cuuauaaagcauugcaa

SEQ ID NO: 1421928 - RNA, 16 nt, Homo sapiens
cuuauagaaaguucaa

SEQ ID NO: 1421929 - RNA, 15 nt, Homo sapiens
cuuauaucaucagca

SEQ ID NO: 1421930 - RNA, 20 nt, Homo sapiens
cuuauccaggacucugucaa

SEQ ID NO: 1421931 - RNA, 16 nt, Homo sapiens
cuuauugucuaggcca

SEQ ID NO: 1421932 - RNA, 16 nt, Homo sapiens
cuucaaagacaaugga

SEQ ID NO: 1421933 - RNA, 21 nt, Homo sapiens
cuucaacugaccagccuccau

SEQ ID NO: 1421934 - RNA, 21 nt, Homo sapiens
cuucaagcaccugcagauucu

SEQ ID NO: 1421935 - RNA, 15 nt, Homo sapiens
cuucacccugaaugg

SEQ ID NO: 1421936 - RNA, 16 nt, Homo sapiens
cuucacucacugucaa

SEQ ID NO: 1421937 - RNA, 13 nt, Homo sapiens
cuucacucuucau

SEQ ID NO: 1421938 - RNA, 18 nt, Homo sapiens
cuucacugccaugccuca

SEQ ID NO: 1421939 - RNA, 17 nt, Homo sapiens
cuucaucuggauuccag

SEQ ID NO: 1421940 - RNA, 14 nt, Homo sapiens
cuucauuaugcagc

SEQ ID NO: 1421941 - RNA, 17 nt, Homo sapiens
cuuccaaagacaagaaa

SEQ ID NO: 1421942 - RNA, 23 nt, Homo sapiens
cuuccacaccuagcaucucauga

SEQ ID NO: 1421943 - RNA, 20 nt, Homo sapiens
cuuccacagaauacaagcca

SEQ ID NO: 1421944 - RNA, 13 nt, Homo sapiens
cuuccacuuugag

SEQ ID NO: 1421945 - RNA, 14 nt, Homo sapiens
cuuccagguacuga

SEQ ID NO: 1421946 - RNA, 24 nt, Homo sapiens
cuuccauuaacuuagcauguguug

SEQ ID NO: 1421947 - RNA, 18 nt, Homo sapiens
cuucccaguagcucuugc

SEQ ID NO: 1421948 - RNA, 21 nt, Homo sapiens
cuuccccagguccuuccuuua

SEQ ID NO: 1421949 - RNA, 12 nt, Homo sapiens
cuuccccugugg

SEQ ID NO: 1421950 - RNA, 21 nt, Homo sapiens
cuucccuggcuuguaacucca

SEQ ID NO: 1421951 - RNA, 20 nt, Homo sapiens
cuuccuaauaugcuuuacaa

SEQ ID NO: 1421952 - RNA, 15 nt, Homo sapiens
cuuccuaccaaauau

SEQ ID NO: 1421953 - RNA, 20 nt, Homo sapiens
cuuccucccuauuaaccuag

SEQ ID NO: 1421954 - RNA, 20 nt, Homo sapiens
cuuccuccugauggccaaga

SEQ ID NO: 1421955 - RNA, 22 nt, Homo sapiens
cuuccugcaaagggaacugaag

SEQ ID NO: 1421956 - RNA, 20 nt, Homo sapiens
cuuccuguaacacaagccac

SEQ ID NO: 1421957 - RNA, 15 nt, Homo sapiens
cuuccuguccacucu

SEQ ID NO: 1421958 - RNA, 19 nt, Homo sapiens
cuuccuuagccuugcucag

SEQ ID NO: 1421959 - RNA, 13 nt, Homo sapiens
cuucgaugacugg

SEQ ID NO: 1421960 - RNA, 18 nt, Homo sapiens
cuucgguuucugagcaua

SEQ ID NO: 1421961 - RNA, 13 nt, Homo sapiens
cuucuagaucugg

SEQ ID NO: 1421962 - RNA, 19 nt, Homo sapiens
cuucuaugguugacauugu

SEQ ID NO: 1421963 - RNA, 18 nt, Homo sapiens
cuucuauuccauggcuaa

SEQ ID NO: 1421964 - RNA, 16 nt, Homo sapiens
cuucucacaucugucc

SEQ ID NO: 1421965 - RNA, 20 nt, Homo sapiens
cuucucauccccagucccaa

SEQ ID NO: 1421966 - RNA, 12 nt, Homo sapiens
cuucuccugacc

SEQ ID NO: 1421967 - RNA, 22 nt, Homo sapiens
cuucucuauaucaugcuuuaaa

SEQ ID NO: 1421968 - RNA, 15 nt, Homo sapiens
cuucucuuccuguaa

SEQ ID NO: 1421969 - RNA, 21 nt, Homo sapiens
cuucugagaccuuguuucaau

SEQ ID NO: 1421970 - RNA, 18 nt, Homo sapiens
cuucugccccagcuuugc

SEQ ID NO: 1421971 - RNA, 21 nt, Homo sapiens
cuucugcuguauacuguacug

SEQ ID NO: 1421972 - RNA, 16 nt, Homo sapiens
cuucugguugcuucag

SEQ ID NO: 1421973 - RNA, 15 nt, Homo sapiens
cuucuuaaucuaaga

SEQ ID NO: 1421974 - RNA, 22 nt, Homo sapiens
gauguguuuugcacgucuugcu

SEQ ID NO: 1421975 - RNA, 18 nt, Homo sapiens
gauuaaggugaugugauu

SEQ ID NO: 1421976 - RNA, 20 nt, Homo sapiens
gauuacaggugcgcacuacc

SEQ ID NO: 1421977 - RNA, 18 nt, Homo sapiens
gauuagcucuggaccagc

SEQ ID NO: 1421978 - RNA, 21 nt, Homo sapiens
gauucacaaugaaaugcucuc

SEQ ID NO: 1421979 - RNA, 13 nt, Homo sapiens
gauuccacuuuua

SEQ ID NO: 1421980 - RNA, 15 nt, Homo sapiens
gauucccaccaaggu

SEQ ID NO: 1421981 - RNA, 18 nt, Homo sapiens
gauuccugggcaagaacc

SEQ ID NO: 1421982 - RNA, 19 nt, Homo sapiens
gauuccuuuaugagucagu

SEQ ID NO: 1421983 - RNA, 13 nt, Homo sapiens
gauucuccuguca

SEQ ID NO: 1421984 - RNA, 13 nt, Homo sapiens
gauugcagacuca

SEQ ID NO: 1421985 - RNA, 14 nt, Homo sapiens
gauuggcucaccca

SEQ ID NO: 1421986 - RNA, 17 nt, Homo sapiens
gauugugcccagcccuu

SEQ ID NO: 1421987 - RNA, 21 nt, Homo sapiens
gauuuacugcaagaaguacau

SEQ ID NO: 1421988 - RNA, 19 nt, Homo sapiens
gauuuaugaucacuuggaa

SEQ ID NO: 1421989 - RNA, 19 nt, Homo sapiens
gcaaaaaaaaaaauauuaa

SEQ ID NO: 1421990 - RNA, 22 nt, Homo sapiens
gcaaaaaaucuuccaaagacaa

SEQ ID NO: 1421991 - RNA, 11 nt, Homo sapiens
gcaaaaaucuc

SEQ ID NO: 1421992 - RNA, 23 nt, Homo sapiens
gcaaaacugccgcaagucugcag

SEQ ID NO: 1421993 - RNA, 15 nt, Homo sapiens
gcaaaagucagucuu

SEQ ID NO: 1421994 - RNA, 21 nt, Homo sapiens
gcaaaaguggaaucacuguau

SEQ ID NO: 1421995 - RNA, 17 nt, Homo sapiens
gcaaacaguucuuggac

SEQ ID NO: 1421996 - RNA, 16 nt, Homo sapiens
gcaaagcuggcuuccu

SEQ ID NO: 1421997 - RNA, 16 nt, Homo sapiens
gcaaaggaaaccaaag

SEQ ID NO: 1421998 - RNA, 18 nt, Homo sapiens
gcaaaggaagacgugaug

SEQ ID NO: 1421999 - RNA, 18 nt, Homo sapiens
gcaaagggagcacugggu

SEQ ID NO: 1422000 - RNA, 19 nt, Homo sapiens
gcaaaguagugauauucua

SEQ ID NO: 1422001 - RNA, 23 nt, Homo sapiens
gcuuguagcagaaggcaagcacc

SEQ ID NO: 1422002 - RNA, 20 nt, Homo sapiens
gcuuguccugcucucuucag

SEQ ID NO: 1422003 - RNA, 22 nt, Homo sapiens
gcuugugaacaccuccuagcca

SEQ ID NO: 1422004 - RNA, 20 nt, Homo sapiens
gcuuuaaacacccuucacau

SEQ ID NO: 1422005 - RNA, 18 nt, Homo sapiens
gcuuuaguaauguggauu

SEQ ID NO: 1422006 - RNA, 22 nt, Homo sapiens
gcuuuaucaaaaaguacaauaa

SEQ ID NO: 1422007 - RNA, 14 nt, Homo sapiens
gcuuucuuucacaa

SEQ ID NO: 1422008 - RNA, 21 nt, Homo sapiens
gcuuugaauacccccagagac

SEQ ID NO: 1422009 - RNA, 19 nt, Homo sapiens
gcuuugacucaccuguuac

SEQ ID NO: 1422010 - RNA, 14 nt, Homo sapiens
gcuuugaggacaaa

SEQ ID NO: 1422011 - RNA, 13 nt, Homo sapiens
gcuuugcaggcuc

SEQ ID NO: 1422012 - RNA, 18 nt, Homo sapiens
gcuuugucuucagccucu

SEQ ID NO: 1422013 - RNA, 22 nt, Homo sapiens
gcuuuguuugggccacugccag

SEQ ID NO: 1422014 - RNA, 22 nt, Homo sapiens
gcuuuuggugguccccacagcc

SEQ ID NO: 1422015 - RNA, 20 nt, Homo sapiens
ggaaaaaaguuuugaugaaa

SEQ ID NO: 1422016 - RNA, 20 nt, Homo sapiens
ggaaaaagaaagaaacacuc

SEQ ID NO: 1422017 - RNA, 15 nt, Homo sapiens
ggaaaacaggacuua

SEQ ID NO: 1422018 - RNA, 14 nt, Homo sapiens
ggaaaacucaggau

SEQ ID NO: 1422019 - RNA, 14 nt, Homo sapiens
ggaaaagcccagug

SEQ ID NO: 1422020 - RNA, 21 nt, Homo sapiens
ggaaaaucacaccaccugaca

SEQ ID NO: 1422021 - RNA, 17 nt, Homo sapiens
ggaaaaugugacccaga

SEQ ID NO: 1422022 - RNA, 15 nt, Homo sapiens
ggaaaccacacuucu

SEQ ID NO: 1422023 - RNA, 16 nt, Homo sapiens
ggaaagaaaugcccau

SEQ ID NO: 1422024 - RNA, 22 nt, Homo sapiens
ggaaagacguuuuugugcugug

SEQ ID NO: 1422025 - RNA, 20 nt, Homo sapiens
ggaaaggaggcaugccucug

SEQ ID NO: 1422026 - RNA, 12 nt, Homo sapiens
ggaaaguucagc

SEQ ID NO: 1422027 - RNA, 16 nt, Homo sapiens
ggaaauaaaccuggag

SEQ ID NO: 1422028 - RNA, 17 nt, Homo sapiens
ggaaccaaaauguauaa

SEQ ID NO: 1422029 - RNA, 15 nt, Homo sapiens
ggaaccuguacuggg

SEQ ID NO: 1422030 - RNA, 19 nt, Homo sapiens
ggaacucuggcuuccaggu

SEQ ID NO: 1422031 - RNA, 23 nt, Homo sapiens
ggaacugggccaacucaccugag

SEQ ID NO: 1422032 - RNA, 16 nt, Homo sapiens
ggaagaaaugggagaa

SEQ ID NO: 1422033 - RNA, 18 nt, Homo sapiens
ggaagaagccagacuggu

SEQ ID NO: 1422034 - RNA, 17 nt, Homo sapiens
ggaagacgugaugccag

SEQ ID NO: 1422035 - RNA, 13 nt, Homo sapiens
ggaagacuugaag

SEQ ID NO: 1422036 - RNA, 18 nt, Homo sapiens
ggaagacuugaagcacag

SEQ ID NO: 1422037 - RNA, 14 nt, Homo sapiens
ggaagacuugccac

SEQ ID NO: 1422038 - RNA, 16 nt, Homo sapiens
ggaaggaagggacaca

SEQ ID NO: 1422039 - RNA, 12 nt, Homo sapiens
ggaaggggcaaa

SEQ ID NO: 1422040 - RNA, 17 nt, Homo sapiens
ggacaaaacacuguguc

SEQ ID NO: 1422041 - RNA, 18 nt, Homo sapiens
ggacaaaacacugugucc

SEQ ID NO: 1422042 - RNA, 20 nt, Homo sapiens
ggacaaaggagccugugaac

SEQ ID NO: 1422043 - RNA, 19 nt, Homo sapiens
ggacaccccuuauccagga

SEQ ID NO: 1422044 - RNA, 22 nt, Homo sapiens
ggaccaggacuauagcccaggu

SEQ ID NO: 1422045 - RNA, 21 nt, Homo sapiens
ggaccuguuuagagaagccgg

SEQ ID NO: 1422046 - RNA, 22 nt, Homo sapiens
ggacgauagcuuggagggaugg

SEQ ID NO: 1422047 - RNA, 22 nt, Homo sapiens
ggacuaaccccaacgcacagga

SEQ ID NO: 1422048 - RNA, 22 nt, Homo sapiens
ggacuauuauaauuuaaugcau

SEQ ID NO: 1422049 - RNA, 23 nt, Homo sapiens
ggacucagguugucugaagucac

SEQ ID NO: 1422050 - RNA, 14 nt, Homo sapiens
ggacugacauuucu

SEQ ID NO: 1422051 - RNA, 17 nt, Homo sapiens
ggacugcauaaaccaau

SEQ ID NO: 1422052 - RNA, 15 nt, Homo sapiens
ggacuguuuccugag

SEQ ID NO: 1422053 - RNA, 19 nt, Homo sapiens
ggagaaugaagacuguuaa

SEQ ID NO: 1422054 - RNA, 12 nt, Homo sapiens
ggagacuuguau

SEQ ID NO: 1422055 - RNA, 14 nt, Homo sapiens
ggagagacagugac

SEQ ID NO: 1422056 - RNA, 13 nt, Homo sapiens
ggagagagaucua

SEQ ID NO: 1422057 - RNA, 16 nt, Homo sapiens
ggagaguacagugagc

SEQ ID NO: 1422058 - RNA, 17 nt, Homo sapiens
ggagauaaucuagaaca

SEQ ID NO: 1422059 - RNA, 14 nt, Homo sapiens
ggagcaaauguuuc

SEQ ID NO: 1422060 - RNA, 19 nt, Homo sapiens
ggagcaagugacaugccau

SEQ ID NO: 1422061 - RNA, 15 nt, Homo sapiens
ggagcaucugacuca

SEQ ID NO: 1422062 - RNA, 21 nt, Homo sapiens
ggagccuccucugcuugcauc

SEQ ID NO: 1422063 - RNA, 21 nt, Homo sapiens
ggagccuggcuccguccagga

SEQ ID NO: 1422064 - RNA, 12 nt, Homo sapiens
ggaggaugacca

SEQ ID NO: 1422065 - RNA, 23 nt, Homo sapiens
ggaggcaccacgaagcugugaac

SEQ ID NO: 1422066 - RNA, 23 nt, Homo sapiens
ggaggcaccagcucuguggccug

SEQ ID NO: 1422067 - RNA, 13 nt, Homo sapiens
ggcugagcugaac

SEQ ID NO: 1422068 - RNA, 15 nt, Homo sapiens
ggcugcaagggccag

SEQ ID NO: 1422069 - RNA, 16 nt, Homo sapiens
ggcugcacgcggcgga

SEQ ID NO: 1422070 - RNA, 18 nt, Homo sapiens
ggcugcggccuagggguc

SEQ ID NO: 1422071 - RNA, 13 nt, Homo sapiens
ggcugcugacuca

SEQ ID NO: 1422072 - RNA, 18 nt, Homo sapiens
ggcugguagagcagguga

SEQ ID NO: 1422073 - RNA, 23 nt, Homo sapiens
ggcuggugcuguggccaggguga

SEQ ID NO: 1422074 - RNA, 23 nt, Homo sapiens
ggcugucaggacaccagccuggu

SEQ ID NO: 1422075 - RNA, 13 nt, Homo sapiens
ggcuuaugcccuc

SEQ ID NO: 1422076 - RNA, 13 nt, Homo sapiens
ggcuucuccugac

SEQ ID NO: 1422077 - RNA, 14 nt, Homo sapiens
ggcuucucuuucuc

SEQ ID NO: 1422078 - RNA, 14 nt, Homo sapiens
ggcuucugggagau

SEQ ID NO: 1422079 - RNA, 17 nt, Homo sapiens
ggcuuggggcuggagag

SEQ ID NO: 1422080 - RNA, 19 nt, Homo sapiens
gggaacccagcccuggggu

SEQ ID NO: 1422081 - RNA, 21 nt, Homo sapiens
gggaacccugcccacucccag

SEQ ID NO: 1422082 - RNA, 22 nt, Homo sapiens
gcaggcaccuuaguggcuuuuu

SEQ ID NO: 1422083 - RNA, 21 nt, Homo sapiens
gcaggcuauuuguucagagag

SEQ ID NO: 1422084 - RNA, 16 nt, Homo sapiens
gcagggacugccaguc

SEQ ID NO: 1422085 - RNA, 23 nt, Homo sapiens
gcagggcaaaugacaugcacuga

SEQ ID NO: 1422086 - RNA, 19 nt, Homo sapiens
gcagggguccuugguguga

SEQ ID NO: 1422087 - RNA, 23 nt, Homo sapiens
gcagggguccuuggugugacccu

SEQ ID NO: 1422088 - RNA, 23 nt, Homo sapiens
gcaguauccaauaggcauuugau

SEQ ID NO: 1422089 - RNA, 17 nt, Homo sapiens
gcagugcaagagacucu

SEQ ID NO: 1422090 - RNA, 16 nt, Homo sapiens
gcaguguaggcuuuac

SEQ ID NO: 1422091 - RNA, 14 nt, Homo sapiens
gcauaccuuggacu

SEQ ID NO: 1422092 - RNA, 20 nt, Homo sapiens
gcauaccuuuauugugaucu

SEQ ID NO: 1422093 - RNA, 11 nt, Homo sapiens
gcaucagagau

SEQ ID NO: 1422094 - RNA, 19 nt, Homo sapiens
gcaucagccuuuguacucu

SEQ ID NO: 1422095 - RNA, 16 nt, Homo sapiens
gcaucaucagccuauu

SEQ ID NO: 1422096 - RNA, 14 nt, Homo sapiens
gcaucccaggggac

SEQ ID NO: 1422097 - RNA, 20 nt, Homo sapiens
gcauccccuuggcugugagg

SEQ ID NO: 1422098 - RNA, 20 nt, Homo sapiens
gcauccuggccaacauggug

SEQ ID NO: 1422099 - RNA, 16 nt, Homo sapiens
gcauccugugugcuga

SEQ ID NO: 1422100 - RNA, 9 nt, Homo sapiens
gcaucucau

SEQ ID NO: 1422101 - RNA, 23 nt, Homo sapiens
gcaucugggauucccaccaaggu

SEQ ID NO: 1422102 - RNA, 20 nt, Homo sapiens
gcaugagagaauuguaucau

SEQ ID NO: 1422103 - RNA, 20 nt, Homo sapiens
gcauggacucuggguuucau

SEQ ID NO: 1422104 - RNA, 14 nt, Homo sapiens
gcauggugcaguug

SEQ ID NO: 1422105 - RNA, 11 nt, Homo sapiens
gcaugugccag

SEQ ID NO: 1422106 - RNA, 15 nt, Homo sapiens
gcauuaaagugcugu

SEQ ID NO: 1422107 - RNA, 13 nt, Homo sapiens
gcauuacugggaa

SEQ ID NO: 1422108 - RNA, 15 nt, Homo sapiens
gcauucauccaacag

SEQ ID NO: 1422109 - RNA, 21 nt, Homo sapiens
gcauuccaccacacauggcua

SEQ ID NO: 1422110 - RNA, 20 nt, Homo sapiens
gcauuccagccccuauguua

SEQ ID NO: 1422111 - RNA, 23 nt, Homo sapiens
gcauucccccuaagaggcaguga

SEQ ID NO: 1422112 - RNA, 17 nt, Homo sapiens
gcauugcuucagaauga

SEQ ID NO: 1422113 - RNA, 21 nt, Homo sapiens
gcauuuucauuucacugcaca

SEQ ID NO: 1422114 - RNA, 16 nt, Homo sapiens
gccaacaaacauagaa

SEQ ID NO: 1422115 - RNA, 17 nt, Homo sapiens
gccaacaccuucuuggc

SEQ ID NO: 1422116 - RNA, 14 nt, Homo sapiens
gccaacauggugaa

SEQ ID NO: 1422117 - RNA, 16 nt, Homo sapiens
gccaacucacucuuau

SEQ ID NO: 1422118 - RNA, 18 nt, Homo sapiens
gccaagaaucaagcuaga

SEQ ID NO: 1422119 - RNA, 20 nt, Homo sapiens
gccaaugcacacacacagag

SEQ ID NO: 1422120 - RNA, 13 nt, Homo sapiens
gccaaugcagcua

SEQ ID NO: 1422121 - RNA, 18 nt, Homo sapiens
gccacaaagaagaaguuu

SEQ ID NO: 1422122 - RNA, 14 nt, Homo sapiens
gccacaaugccucu

SEQ ID NO: 1422123 - RNA, 15 nt, Homo sapiens
gccacagaagccagg

SEQ ID NO: 1422124 - RNA, 17 nt, Homo sapiens
gccacaucacuacagua

SEQ ID NO: 1422125 - RNA, 16 nt, Homo sapiens
gccaccacgucugcca

SEQ ID NO: 1422126 - RNA, 13 nt, Homo sapiens
gccacuaugucca

SEQ ID NO: 1422127 - RNA, 20 nt, Homo sapiens
gccacuccagaccccuggcu

SEQ ID NO: 1422128 - RNA, 13 nt, Homo sapiens
gccacugcacucc

SEQ ID NO: 1422129 - RNA, 16 nt, Homo sapiens
gccacuguggccagag

SEQ ID NO: 1422130 - RNA, 20 nt, Homo sapiens
gccagagcccaagugccauc

SEQ ID NO: 1422131 - RNA, 22 nt, Homo sapiens
gccagaguuccauguuuguacu

SEQ ID NO: 1422132 - RNA, 16 nt, Homo sapiens
gccagauccacccuau

SEQ ID NO: 1422133 - RNA, 17 nt, Homo sapiens
gccagcaaugaugucca

SEQ ID NO: 1422134 - RNA, 15 nt, Homo sapiens
gccagccaucacaag

SEQ ID NO: 1422135 - RNA, 23 nt, Homo sapiens
gccagcccugccuggaggaccug

SEQ ID NO: 1422136 - RNA, 19 nt, Homo sapiens
gccagcugucgcaucucag

SEQ ID NO: 1422137 - RNA, 19 nt, Homo sapiens
gccaggagcuucucugaug

SEQ ID NO: 1422138 - RNA, 14 nt, Homo sapiens
gccaggcucugccu

SEQ ID NO: 1422139 - RNA, 17 nt, Homo sapiens
gccaggcuguaagcauu

SEQ ID NO: 1422140 - RNA, 19 nt, Homo sapiens
gccaguuugcuuaguucuc

SEQ ID NO: 1422141 - RNA, 14 nt, Homo sapiens
gccauccauucaca

SEQ ID NO: 1422142 - RNA, 19 nt, Homo sapiens
gccaugauggugcugaccu

SEQ ID NO: 1422143 - RNA, 15 nt, Homo sapiens
uaaaaccacagcagu

SEQ ID NO: 1422144 - RNA, 17 nt, Homo sapiens
uaaaacuacacaucccu

SEQ ID NO: 1422145 - RNA, 12 nt, Homo sapiens
uaaaacuaucca

SEQ ID NO: 1422146 - RNA, 17 nt, Homo sapiens
cgaaauuggauuaugca

SEQ ID NO: 1422147 - RNA, 16 nt, Homo sapiens
cgaaguggcucucagg

SEQ ID NO: 1422148 - RNA, 12 nt, Homo sapiens
cgaauccugaca

SEQ ID NO: 1422149 - RNA, 14 nt, Homo sapiens
cgacuucaucccaa

SEQ ID NO: 1422150 - RNA, 17 nt, Homo sapiens
cgagacugagaggcaga

SEQ ID NO: 1422151 - RNA, 19 nt, Homo sapiens
cgagcccagcuacauuccu

SEQ ID NO: 1422152 - RNA, 18 nt, Homo sapiens
ccacuuucaccaguuucu

SEQ ID NO: 1422153 - RNA, 16 nt, Homo sapiens
ccagaacuauuuauuu

SEQ ID NO: 1422154 - RNA, 23 nt, Homo sapiens
ccagaaggagggcagagccaugg

SEQ ID NO: 1422155 - RNA, 16 nt, Homo sapiens
ccagaaggauauuuac

SEQ ID NO: 1422156 - RNA, 15 nt, Homo sapiens
ccagaauugugcaaa

SEQ ID NO: 1422157 - RNA, 13 nt, Homo sapiens
ccagacacauggc

SEQ ID NO: 1422158 - RNA, 21 nt, Homo sapiens
ccagacauacgaaacacaaac

SEQ ID NO: 1422159 - RNA, 14 nt, Homo sapiens
ccagaccaccugcc

SEQ ID NO: 1422160 - RNA, 19 nt, Homo sapiens
ccagacccaccacaccgca

SEQ ID NO: 1422161 - RNA, 20 nt, Homo sapiens
ccagaccuagaccugggcca

SEQ ID NO: 1422162 - RNA, 15 nt, Homo sapiens
ccagacucagcucca

SEQ ID NO: 1422163 - RNA, 14 nt, Homo sapiens
ccagacuggcacag

SEQ ID NO: 1422164 - RNA, 21 nt, Homo sapiens
ccagagacuuggggaccagag

SEQ ID NO: 1422165 - RNA, 15 nt, Homo sapiens
ccagagaguggcucc

SEQ ID NO: 1422166 - RNA, 14 nt, Homo sapiens
ccagagcaaaauaa

SEQ ID NO: 1422167 - RNA, 17 nt, Homo sapiens
ccagagccacuaccuuu

SEQ ID NO: 1422168 - RNA, 22 nt, Homo sapiens
ccagagcuggaaggcagggcag

SEQ ID NO: 1422169 - RNA, 20 nt, Homo sapiens
ccagagcugggaggcauggc

SEQ ID NO: 1422170 - RNA, 19 nt, Homo sapiens
ccagaggcuauuauuuuca

SEQ ID NO: 1422171 - RNA, 18 nt, Homo sapiens
ccagaggguagggcagca

SEQ ID NO: 1422172 - RNA, 21 nt, Homo sapiens
ccagaggguagggcagcagau

SEQ ID NO: 1422173 - RNA, 20 nt, Homo sapiens
ccagaggugcugucagcuca

SEQ ID NO: 1422174 - RNA, 17 nt, Homo sapiens
ccagauccucugcugac

SEQ ID NO: 1422175 - RNA, 20 nt, Homo sapiens
ccagcaaugauguccagaag

SEQ ID NO: 1422176 - RNA, 12 nt, Homo sapiens
ccagcacccucu

SEQ ID NO: 1422177 - RNA, 13 nt, Homo sapiens
ccagcaugcaucc

SEQ ID NO: 1422178 - RNA, 14 nt, Homo sapiens
ccagcauguacaaa

SEQ ID NO: 1422179 - RNA, 21 nt, Homo sapiens
ccagccugggacucccaguga

SEQ ID NO: 1422180 - RNA, 18 nt, Homo sapiens
ccagccugggcaacagau

SEQ ID NO: 1422181 - RNA, 20 nt, Homo sapiens
ccagccugggcaacauagua

SEQ ID NO: 1422182 - RNA, 21 nt, Homo sapiens
ccagcgagcaucccgggcaag

SEQ ID NO: 1422183 - RNA, 13 nt, Homo sapiens
ccagcuacauucc

SEQ ID NO: 1422184 - RNA, 21 nt, Homo sapiens
ccagcuacuugggaggcugag

SEQ ID NO: 1422185 - RNA, 14 nt, Homo sapiens
ccagcuaucuguca

SEQ ID NO: 1422186 - RNA, 19 nt, Homo sapiens
ccagcuccaguuuccaagu

SEQ ID NO: 1422187 - RNA, 16 nt, Homo sapiens
ccagcucuaguuuuca

SEQ ID NO: 1422188 - RNA, 21 nt, Homo sapiens
ccagcuguguucacacuguaa

SEQ ID NO: 1422189 - RNA, 14 nt, Homo sapiens
ccaggacaccugcc

SEQ ID NO: 1422190 - RNA, 23 nt, Homo sapiens
ccaggagaagaaagaggugaccc

SEQ ID NO: 1422191 - RNA, 17 nt, Homo sapiens
ccaggagagagaucuag

SEQ ID NO: 1422192 - RNA, 22 nt, Homo sapiens
ccaggcagagaucaggugggca

SEQ ID NO: 1422193 - RNA, 18 nt, Homo sapiens
ccaggccgccugccauac

SEQ ID NO: 1422194 - RNA, 16 nt, Homo sapiens
ccaggccugagcaaca

SEQ ID NO: 1422195 - RNA, 21 nt, Homo sapiens
ccaggcugagguccugaucag

SEQ ID NO: 1422196 - RNA, 18 nt, Homo sapiens
ccaggcuggagugcagua

SEQ ID NO: 1422197 - RNA, 21 nt, Homo sapiens
ccaggcuucacccugaauggu

SEQ ID NO: 1422198 - RNA, 22 nt, Homo sapiens
ccaggggaaugaucucugauga

SEQ ID NO: 1422199 - RNA, 12 nt, Homo sapiens
ccagggugcaug

SEQ ID NO: 1422200 - RNA, 14 nt, Homo sapiens
ccagguguugccau

SEQ ID NO: 1422201 - RNA, 19 nt, Homo sapiens
ccagguugccugggccacg

SEQ ID NO: 1422202 - RNA, 24 nt, Homo sapiens
ccaguaagguuauaacuguggcua

SEQ ID NO: 1422203 - RNA, 15 nt, Homo sapiens
ccaguagcucuugca

SEQ ID NO: 1422204 - RNA, 14 nt, Homo sapiens
ccagugaaccaaag

SEQ ID NO: 1422205 - RNA, 13 nt, Homo sapiens
ccagugacaccga

SEQ ID NO: 1422206 - RNA, 15 nt, Homo sapiens
ccaguggcaguguau

SEQ ID NO: 1422207 - RNA, 12 nt, Homo sapiens
ccagugucccca

SEQ ID NO: 1422208 - RNA, 23 nt, Homo sapiens
ccaguguccccuccacugucaca

SEQ ID NO: 1422209 - RNA, 23 nt, Homo sapiens
ccagugugcuugcccaccacagc

SEQ ID NO: 1422210 - RNA, 16 nt, Homo sapiens
ccaguuccuccaagag

SEQ ID NO: 1422211 - RNA, 20 nt, Homo sapiens
ccauaaucucauucaaagaa

SEQ ID NO: 1422212 - RNA, 14 nt, Homo sapiens
ccauacacauugga

SEQ ID NO: 1422213 - RNA, 17 nt, Homo sapiens
ccauacauuaucauuca

SEQ ID NO: 1422214 - RNA, 19 nt, Homo sapiens
ccauacuuucccacagcac

SEQ ID NO: 1422215 - RNA, 13 nt, Homo sapiens
ccauagaaacaug

SEQ ID NO: 1422216 - RNA, 13 nt, Homo sapiens
ccauagcugguua

SEQ ID NO: 1422217 - RNA, 19 nt, Homo sapiens
ccauauaucuuauguuaaa

SEQ ID NO: 1422218 - RNA, 22 nt, Homo sapiens
ccauaugauauuuugucuccua

SEQ ID NO: 1422219 - RNA, 18 nt, Homo sapiens
ccauaugucugcuucugu

SEQ ID NO: 1422220 - RNA, 12 nt, Homo sapiens
ccauauucacac

SEQ ID NO: 1422221 - RNA, 16 nt, Homo sapiens
ccaucauggcagugau

SEQ ID NO: 1422222 - RNA, 22 nt, Homo sapiens
ccauccagccgcugcacaucac

SEQ ID NO: 1422223 - RNA, 17 nt, Homo sapiens
ccaucccucggacccac

SEQ ID NO: 1422224 - RNA, 22 nt, Homo sapiens
ccauccuauuuaacuggcuuca

SEQ ID NO: 1422225 - RNA, 15 nt, Homo sapiens
ccaucuaagcugcag

SEQ ID NO: 1422226 - RNA, 22 nt, Homo sapiens
ccaugaaacuuuagagauuaac

SEQ ID NO: 1422227 - RNA, 14 nt, Homo sapiens
ccaugaaucaaaga

SEQ ID NO: 1422228 - RNA, 16 nt, Homo sapiens
ccaugaaucaaagaca

SEQ ID NO: 1422229 - RNA, 16 nt, Homo sapiens
ccaugaaucuuuuuga

SEQ ID NO: 1422230 - RNA, 13 nt, Homo sapiens
ccaugcaauucau

SEQ ID NO: 1422231 - RNA, 21 nt, Homo sapiens
ccaugccacugccaggcaccu

SEQ ID NO: 1422232 - RNA, 16 nt, Homo sapiens
ccauggacacauuuuc

SEQ ID NO: 1422233 - RNA, 17 nt, Homo sapiens
ccauguauuuaucucua

SEQ ID NO: 1422234 - RNA, 21 nt, Homo sapiens
ccaaggguaugggaagccaua

SEQ ID NO: 1422235 - RNA, 20 nt, Homo sapiens
ccaaggguuucugacccaag

SEQ ID NO: 1422236 - RNA, 14 nt, Homo sapiens
ccaauaaaacuuua

SEQ ID NO: 1422237 - RNA, 23 nt, Homo sapiens
ccaauacaugguguauagcacca

SEQ ID NO: 1422238 - RNA, 14 nt, Homo sapiens
ccaaucauuugcaa

SEQ ID NO: 1422239 - RNA, 18 nt, Homo sapiens
ccaaugcacauccauucc

SEQ ID NO: 1422240 - RNA, 13 nt, Homo sapiens
ccaaugcaugcag

SEQ ID NO: 1422241 - RNA, 14 nt, Homo sapiens
ccaaugccuugaca

SEQ ID NO: 1422242 - RNA, 23 nt, Homo sapiens
ccaauuuucuggaauacaugaaa

SEQ ID NO: 1422243 - RNA, 17 nt, Homo sapiens
ccacaacugacacagga

SEQ ID NO: 1422244 - RNA, 18 nt, Homo sapiens
ccacaaucugggacuuuc

SEQ ID NO: 1422245 - RNA, 13 nt, Homo sapiens
ccacaccaaaguc

SEQ ID NO: 1422246 - RNA, 21 nt, Homo sapiens
ccacacgcugucucuugagaa

SEQ ID NO: 1422247 - RNA, 22 nt, Homo sapiens
ccacacuucucaggacacaggc

SEQ ID NO: 1422248 - RNA, 14 nt, Homo sapiens
ccacagagaugcau

SEQ ID NO: 1422249 - RNA, 19 nt, Homo sapiens
ccacagaugcuugugauuu

SEQ ID NO: 1422250 - RNA, 23 nt, Homo sapiens
ccacagcacccaggcuccauggg

SEQ ID NO: 1422251 - RNA, 22 nt, Homo sapiens
ccacagcacuacgauguguuga

SEQ ID NO: 1422252 - RNA, 12 nt, Homo sapiens
ccacagcaguug

SEQ ID NO: 1422253 - RNA, 23 nt, Homo sapiens
ccacagcaguugaaaagacucca

SEQ ID NO: 1422254 - RNA, 10 nt, Homo sapiens
ccacagugaa

SEQ ID NO: 1422255 - RNA, 16 nt, Homo sapiens
ccacaguuuugccuua

SEQ ID NO: 1422256 - RNA, 18 nt, Homo sapiens
ccacaguuuugccuuaaa

SEQ ID NO: 1422257 - RNA, 16 nt, Homo sapiens
ccacaucacuacagua

SEQ ID NO: 1422258 - RNA, 23 nt, Homo sapiens
ccacaucacuacaguacagugag

SEQ ID NO: 1422259 - RNA, 16 nt, Homo sapiens
ccacaucuaaugucuc

SEQ ID NO: 1422260 - RNA, 13 nt, Homo sapiens
ccacaucuucuca

SEQ ID NO: 1422261 - RNA, 19 nt, Homo sapiens
ccacauuauacauuugaug

SEQ ID NO: 1422262 - RNA, 17 nt, Homo sapiens
ccaccccauaaucucau

SEQ ID NO: 1422263 - RNA, 14 nt, Homo sapiens
ccaccggggaaccc

SEQ ID NO: 1422264 - RNA, 22 nt, Homo sapiens
ccaccuaccugccggacacaga

SEQ ID NO: 1422265 - RNA, 12 nt, Homo sapiens
ccaccucaggcu

SEQ ID NO: 1422266 - RNA, 21 nt, Homo sapiens
ccaccuggaaggggcaaagaa

SEQ ID NO: 1422267 - RNA, 22 nt, Homo sapiens
ccaccuguuaaaauguacacug

SEQ ID NO: 1422268 - RNA, 20 nt, Homo sapiens
ccacgacuguuguacaagcu

SEQ ID NO: 1422269 - RNA, 20 nt, Homo sapiens
ccacgugagagaaucugccu

SEQ ID NO: 1422270 - RNA, 17 nt, Homo sapiens
ccacuauccucacuccc

SEQ ID NO: 1422271 - RNA, 23 nt, Homo sapiens
ccacucccuccuaaccuagagau

SEQ ID NO: 1422272 - RNA, 16 nt, Homo sapiens
ccacugagccugagau

SEQ ID NO: 1422273 - RNA, 10 nt, Homo sapiens
ccacugccag

SEQ ID NO: 1422274 - RNA, 14 nt, Homo sapiens
ccacugccagcagc

SEQ ID NO: 1422275 - RNA, 15 nt, Homo sapiens
uaacucuuuggucau

SEQ ID NO: 1422276 - RNA, 20 nt, Homo sapiens
uaacuguaaaucacuuguaa

SEQ ID NO: 1422277 - RNA, 17 nt, Homo sapiens
uaacuuauaucaucagc

SEQ ID NO: 1422278 - RNA, 13 nt, Homo sapiens
uaacuucaaauau

SEQ ID NO: 1422279 - RNA, 15 nt, Homo sapiens
uaacuucuuaaucua

SEQ ID NO: 1422280 - RNA, 16 nt, Homo sapiens
uaacuugauauagaaa

SEQ ID NO: 1422281 - RNA, 16 nt, Homo sapiens
uaacuuguauauucca

SEQ ID NO: 1422282 - RNA, 17 nt, Homo sapiens
uaagaaaacaucacuga

SEQ ID NO: 1422283 - RNA, 18 nt, Homo sapiens
uaagaaaacaucacugaa

SEQ ID NO: 1422284 - RNA, 17 nt, Homo sapiens
uaagaaugcagauuccu

SEQ ID NO: 1422285 - RNA, 15 nt, Homo sapiens
uaagaccccaucucu

SEQ ID NO: 1422286 - RNA, 16 nt, Homo sapiens
uaagagauacauuccc

SEQ ID NO: 1422287 - RNA, 14 nt, Homo sapiens
uaagaggcagugag

SEQ ID NO: 1422288 - RNA, 16 nt, Homo sapiens
uaagaggcagugagau

SEQ ID NO: 1422289 - RNA, 15 nt, Homo sapiens
uaagaggcuauuuaa

SEQ ID NO: 1422290 - RNA, 15 nt, Homo sapiens
uaagauuagaaugaa

SEQ ID NO: 1422291 - RNA, 17 nt, Homo sapiens
uaagcaaaggaaaccaa

SEQ ID NO: 1422292 - RNA, 15 nt, Homo sapiens
uaagcagaagcacau

SEQ ID NO: 1422293 - RNA, 12 nt, Homo sapiens
uaagcauuguau

SEQ ID NO: 1422294 - RNA, 14 nt, Homo sapiens
uaagcuaagccuua

SEQ ID NO: 1422295 - RNA, 14 nt, Homo sapiens
uaaggaucucucag

SEQ ID NO: 1422296 - RNA, 18 nt, Homo sapiens
uaaggcaaaauaaucuaa

SEQ ID NO: 1422297 - RNA, 16 nt, Homo sapiens
uaaggcuuaggugcca

SEQ ID NO: 1422298 - RNA, 23 nt, Homo sapiens
uaagggccacaucccacugccac

SEQ ID NO: 1422299 - RNA, 18 nt, Homo sapiens
uaaggggcaccugggaaa

SEQ ID NO: 1422300 - RNA, 15 nt, Homo sapiens
uaagggucuguugua

SEQ ID NO: 1422301 - RNA, 14 nt, Homo sapiens
uaaguaaaaccaca

SEQ ID NO: 1422302 - RNA, 14 nt, Homo sapiens
uaaguaaaccaaaa

SEQ ID NO: 1422303 - RNA, 22 nt, Homo sapiens
uaaguaccccugauaagcaaau

SEQ ID NO: 1422304 - RNA, 19 nt, Homo sapiens
uaaguccuguauauguaug

SEQ ID NO: 1422305 - RNA, 14 nt, Homo sapiens
uaagugccugagac

SEQ ID NO: 1422306 - RNA, 20 nt, Homo sapiens
uaagugggguugcaaccacu

SEQ ID NO: 1422307 - RNA, 16 nt, Homo sapiens
uaaguuguuauuucag

SEQ ID NO: 1422308 - RNA, 13 nt, Homo sapiens
uaauaaaucugag

SEQ ID NO: 1422309 - RNA, 14 nt, Homo sapiens
uaauacagcagugu

SEQ ID NO: 1422310 - RNA, 15 nt, Homo sapiens
uaauaccuguccaca

SEQ ID NO: 1422311 - RNA, 16 nt, Homo sapiens
uaauacuaaagugucu

SEQ ID NO: 1422312 - RNA, 22 nt, Homo sapiens
uaauagccuaauacaacaugua

SEQ ID NO: 1422313 - RNA, 20 nt, Homo sapiens
uaauagggagaaaccaagag

SEQ ID NO: 1422314 - RNA, 16 nt, Homo sapiens
uaauagugacauauau

SEQ ID NO: 1422315 - RNA, 14 nt, Homo sapiens
uaauauaagccaua

SEQ ID NO: 1422316 - RNA, 13 nt, Homo sapiens
uaauaucaaugaa

SEQ ID NO: 1422317 - RNA, 15 nt, Homo sapiens
uaauauccacugcaa

SEQ ID NO: 1422318 - RNA, 16 nt, Homo sapiens
uaauauccacugcaau

SEQ ID NO: 1422319 - RNA, 17 nt, Homo sapiens
uaauauccacugcaaua

SEQ ID NO: 1422320 - RNA, 15 nt, Homo sapiens
uaauaugacaaaaca

SEQ ID NO: 1422321 - RNA, 14 nt, Homo sapiens
uaaucaccaaagua

SEQ ID NO: 1422322 - RNA, 21 nt, Homo sapiens
uaaucagacaaaguaauuccu

SEQ ID NO: 1422323 - RNA, 12 nt, Homo sapiens
uaaucagcauua

SEQ ID NO: 1422324 - RNA, 21 nt, Homo sapiens
uaaucauguuaccauuacaaa

SEQ ID NO: 1422325 - RNA, 15 nt, Homo sapiens
uaaucccagcacuuu

SEQ ID NO: 1422326 - RNA, 15 nt, Homo sapiens
uaaucuaugcaugua

SEQ ID NO: 1422327 - RNA, 11 nt, Homo sapiens
uaaucucagga

SEQ ID NO: 1422328 - RNA, 21 nt, Homo sapiens
uaaucuuaaauuuauuagaua

SEQ ID NO: 1422329 - RNA, 18 nt, Homo sapiens
uaaugaagacccagugua

SEQ ID NO: 1422330 - RNA, 19 nt, Homo sapiens
uaaugcacucucaguaaug

SEQ ID NO: 1422331 - RNA, 21 nt, Homo sapiens
uaauggaaacauuuacaauaa

SEQ ID NO: 1422332 - RNA, 20 nt, Homo sapiens
uaauggaagagaaaucucau

SEQ ID NO: 1422333 - RNA, 14 nt, Homo sapiens
uaaugucaccaccu

SEQ ID NO: 1422334 - RNA, 17 nt, Homo sapiens
uaauuaaguaaaccaaa

SEQ ID NO: 1422335 - RNA, 22 nt, Homo sapiens
uaauuacaauaaugaguucacu

SEQ ID NO: 1422336 - RNA, 12 nt, Homo sapiens
uaauuauauagu

SEQ ID NO: 1422337 - RNA, 21 nt, Homo sapiens
uaauuauauaguaaugcacuc

SEQ ID NO: 1422338 - RNA, 13 nt, Homo sapiens
uaauuaucugauc

SEQ ID NO: 1422339 - RNA, 21 nt, Homo sapiens
uaauuauuccacucaauaugu

SEQ ID NO: 1422340 - RNA, 19 nt, Homo sapiens
uaauucagcacugauuuca

SEQ ID NO: 1422341 - RNA, 14 nt, Homo sapiens
uaauucaugauuca

SEQ ID NO: 1422342 - RNA, 16 nt, Homo sapiens
uaauucauggcauuga

SEQ ID NO: 1422343 - RNA, 16 nt, Homo sapiens
uaauucucaugugauc

SEQ ID NO: 1422344 - RNA, 21 nt, Homo sapiens
uaauugauuauucugauucca

SEQ ID NO: 1422345 - RNA, 18 nt, Homo sapiens
uaauuggaagaaauuccu

SEQ ID NO: 1422346 - RNA, 21 nt, Homo sapiens
uaauuggaagaaauuccugua

SEQ ID NO: 1422347 - RNA, 19 nt, Homo sapiens
uaauuuaaaaaauaacuac

SEQ ID NO: 1422348 - RNA, 14 nt, Homo sapiens
uaauuuaaugcaug

SEQ ID NO: 1422349 - RNA, 18 nt, Homo sapiens
uaauuugaaaacauaauc

SEQ ID NO: 1422350 - RNA, 14 nt, Homo sapiens
uacaaaaacacagc

SEQ ID NO: 1422351 - RNA, 17 nt, Homo sapiens
uacaaacucccacuugu

SEQ ID NO: 1422352 - RNA, 15 nt, Homo sapiens
uacaaccaauuccaa

SEQ ID NO: 1422353 - RNA, 23 nt, Homo sapiens
uacaagcauuuguuccaugccug

SEQ ID NO: 1422354 - RNA, 14 nt, Homo sapiens
uacaaggacaaugc

SEQ ID NO: 1422355 - RNA, 23 nt, Homo sapiens
uacaauaccagaucacucaaaaa

SEQ ID NO: 1422356 - RNA, 22 nt, Homo sapiens
uacaauuauggaaauauaguuc

SEQ ID NO: 1422357 - RNA, 19 nt, Homo sapiens
uacacacacagaugcacac

SEQ ID NO: 1422358 - RNA, 15 nt, Homo sapiens
uacacagcccaagag

SEQ ID NO: 1422359 - RNA, 13 nt, Homo sapiens
uacacauauaccu

SEQ ID NO: 1422360 - RNA, 18 nt, Homo sapiens
aaguccaagcauaccaac

SEQ ID NO: 1422361 - RNA, 17 nt, Homo sapiens
aaguccacaucuucuca

SEQ ID NO: 1422362 - RNA, 17 nt, Homo sapiens
aagucuaaauaaaugaa

SEQ ID NO: 1422363 - RNA, 17 nt, Homo sapiens
aagucuacuucacuaau

SEQ ID NO: 1422364 - RNA, 13 nt, Homo sapiens
aagucuccaguca

SEQ ID NO: 1422365 - RNA, 14 nt, Homo sapiens
aagugacaugccau

SEQ ID NO: 1422366 - RNA, 14 nt, Homo sapiens
aagugagagagcaa

SEQ ID NO: 1422367 - RNA, 20 nt, Homo sapiens
aagugauccacccaccucag

SEQ ID NO: 1422368 - RNA, 13 nt, Homo sapiens
aagugaucugucc

SEQ ID NO: 1422369 - RNA, 14 nt, Homo sapiens
aagugaucuguccc

SEQ ID NO: 1422370 - RNA, 24 nt, Homo sapiens
aagugcaauuuccccucugugucc

SEQ ID NO: 1422371 - RNA, 18 nt, Homo sapiens
aagugcuaugccaagcca

SEQ ID NO: 1422372 - RNA, 19 nt, Homo sapiens
aagugcuaugccaagccau

SEQ ID NO: 1422373 - RNA, 20 nt, Homo sapiens
aagugcugggauuacaggca

SEQ ID NO: 1422374 - RNA, 15 nt, Homo sapiens
aagugggcauugcaa

SEQ ID NO: 1422375 - RNA, 21 nt, Homo sapiens
aagugguucuggauaucuuuu

SEQ ID NO: 1422376 - RNA, 20 nt, Homo sapiens
aaguguaguggcauccauuu

SEQ ID NO: 1422377 - RNA, 13 nt, Homo sapiens
aaguguguuuccu

SEQ ID NO: 1422378 - RNA, 14 nt, Homo sapiens
aaguguuccuucau

SEQ ID NO: 1422379 - RNA, 20 nt, Homo sapiens
aaguguuuucucagaacagc

SEQ ID NO: 1422380 - RNA, 23 nt, Homo sapiens
aaguuaaaaguguugauuacaua

SEQ ID NO: 1422381 - RNA, 16 nt, Homo sapiens
aaguuauucucuucac

SEQ ID NO: 1422382 - RNA, 15 nt, Homo sapiens
aaguucuaaguucau

SEQ ID NO: 1422383 - RNA, 19 nt, Homo sapiens
aaguucugguaugaacuug

SEQ ID NO: 1422384 - RNA, 22 nt, Homo sapiens
aaguucuucuccaauccuauca

SEQ ID NO: 1422385 - RNA, 18 nt, Homo sapiens
aaguugacuuuaacaagg

SEQ ID NO: 1422386 - RNA, 13 nt, Homo sapiens
aaguugagaacaa

SEQ ID NO: 1422387 - RNA, 14 nt, Homo sapiens
aaguugcagucuca

SEQ ID NO: 1422388 - RNA, 22 nt, Homo sapiens
aaguugcagucucagaaagccu

SEQ ID NO: 1422389 - RNA, 14 nt, Homo sapiens
aaguuuaucuuuca

SEQ ID NO: 1422390 - RNA, 14 nt, Homo sapiens
aauaaaaaaauaca

SEQ ID NO: 1422391 - RNA, 18 nt, Homo sapiens
aauaaaaaaguaacaagg

SEQ ID NO: 1422392 - RNA, 15 nt, Homo sapiens
aauaaaaacccugua

SEQ ID NO: 1422393 - RNA, 13 nt, Homo sapiens
aauaaaaugaugu

SEQ ID NO: 1422394 - RNA, 13 nt, Homo sapiens
aauaaaauguuau

SEQ ID NO: 1422395 - RNA, 18 nt, Homo sapiens
aauaaacauuuggcauag

SEQ ID NO: 1422396 - RNA, 21 nt, Homo sapiens
aauaaaccaagauagauccau

SEQ ID NO: 1422397 - RNA, 17 nt, Homo sapiens
aauaaacgucuugccac

SEQ ID NO: 1422398 - RNA, 13 nt, Homo sapiens
aauaaagcccuug

SEQ ID NO: 1422399 - RNA, 16 nt, Homo sapiens
aauaaauccuccaguc

SEQ ID NO: 1422400 - RNA, 17 nt, Homo sapiens
aauaaaugaaucuuacu

SEQ ID NO: 1422401 - RNA, 19 nt, Homo sapiens
aauaaaugauguacuacau

SEQ ID NO: 1422402 - RNA, 16 nt, Homo sapiens
aauaaaugugccuuca

SEQ ID NO: 1422403 - RNA, 18 nt, Homo sapiens
aauuauuaugucucaaaa

SEQ ID NO: 1422404 - RNA, 22 nt, Homo sapiens
aauuauuccuuuccuagacuaa

SEQ ID NO: 1422405 - RNA, 16 nt, Homo sapiens
aauucaaugucuuaaa

SEQ ID NO: 1422406 - RNA, 21 nt, Homo sapiens
aauucacauaacuucucugag

SEQ ID NO: 1422407 - RNA, 13 nt, Homo sapiens
aauucccagcugu

SEQ ID NO: 1422408 - RNA, 15 nt, Homo sapiens
aauucccagcugucu

SEQ ID NO: 1422409 - RNA, 21 nt, Homo sapiens
aauuccuaauaaguuugauca

SEQ ID NO: 1422410 - RNA, 22 nt, Homo sapiens
aauuccuaauaaguuugaucaa

SEQ ID NO: 1422411 - RNA, 12 nt, Homo sapiens
aauuccuaguca

SEQ ID NO: 1422412 - RNA, 18 nt, Homo sapiens
aauuccuguagcaucuuc

SEQ ID NO: 1422413 - RNA, 17 nt, Homo sapiens
aauucuaggcaucccag

SEQ ID NO: 1422414 - RNA, 16 nt, Homo sapiens
aauucucaaccuacca

SEQ ID NO: 1422415 - RNA, 19 nt, Homo sapiens
aauucuccugccucagccu

SEQ ID NO: 1422416 - RNA, 21 nt, Homo sapiens
aauucuccugccucagccucc

SEQ ID NO: 1422417 - RNA, 13 nt, Homo sapiens
aauucugugaaga

SEQ ID NO: 1422418 - RNA, 15 nt, Homo sapiens
aauugacgccaccau

SEQ ID NO: 1422419 - RNA, 15 nt, Homo sapiens
aauugauacuucagg

SEQ ID NO: 1422420 - RNA, 22 nt, Homo sapiens
aauugcguucuaagaggugaag

SEQ ID NO: 1422421 - RNA, 13 nt, Homo sapiens
aauugcuacauag

SEQ ID NO: 1422422 - RNA, 14 nt, Homo sapiens
aauuggguuuuaaa

SEQ ID NO: 1422423 - RNA, 12 nt, Homo sapiens
aauugugcaaau

SEQ ID NO: 1422424 - RNA, 12 nt, Homo sapiens
aauuguuugacc

SEQ ID NO: 1422425 - RNA, 23 nt, Homo sapiens
aauuuaaaaauaagaaaauacau

SEQ ID NO: 1422426 - RNA, 17 nt, Homo sapiens
aauuuaaaccagcagaa

SEQ ID NO: 1422427 - RNA, 19 nt, Homo sapiens
aauuuaacaugacuucugc

SEQ ID NO: 1422428 - RNA, 17 nt, Homo sapiens
aauuuaaucacuuucau

SEQ ID NO: 1422429 - RNA, 17 nt, Homo sapiens
aauuuagaaaacauuca

SEQ ID NO: 1422430 - RNA, 15 nt, Homo sapiens
aauuuagucacacca

SEQ ID NO: 1422431 - RNA, 18 nt, Homo sapiens
aauuucacgucgucuucu

SEQ ID NO: 1422432 - RNA, 20 nt, Homo sapiens
aauuucucccagucauuuaa

SEQ ID NO: 1422433 - RNA, 17 nt, Homo sapiens
aauuugaauggugcaga

SEQ ID NO: 1422434 - RNA, 21 nt, Homo sapiens
aauuuggccagacacaggugc

SEQ ID NO: 1422435 - RNA, 12 nt, Homo sapiens
aauuuguacaua

SEQ ID NO: 1422436 - RNA, 19 nt, Homo sapiens
aauuuuaaauuauaacuua

SEQ ID NO: 1422437 - RNA, 18 nt, Homo sapiens
aauuuuaugugcuucaca

SEQ ID NO: 1422438 - RNA, 13 nt, Homo sapiens
aauuuuuccugca

SEQ ID NO: 1422439 - RNA, 19 nt, Homo sapiens
acaaaauggagggagccau

SEQ ID NO: 1422440 - RNA, 23 nt, Homo sapiens
acaaaccacaacugacacaggaa

SEQ ID NO: 1422441 - RNA, 11 nt, Homo sapiens
acaaaccaccc

SEQ ID NO: 1422442 - RNA, 16 nt, Homo sapiens
acaaaccacuguacau

SEQ ID NO: 1422443 - RNA, 18 nt, Homo sapiens
acaaaccugcuugucaau

SEQ ID NO: 1422444 - RNA, 18 nt, Homo sapiens
acaaagcccuuccauguc

SEQ ID NO: 1422445 - RNA, 18 nt, Homo sapiens
acaaagccgugccuuucu

SEQ ID NO: 1422446 - RNA, 16 nt, Homo sapiens
acaaagcgagauccca

SEQ ID NO: 1422447 - RNA, 15 nt, Homo sapiens
acaaaggagccugug

SEQ ID NO: 1422448 - RNA, 15 nt, Homo sapiens
acaaaggcccagcag

SEQ ID NO: 1422449 - RNA, 19 nt, Homo sapiens
acaaauaaugaacagcaga

SEQ ID NO: 1422450 - RNA, 22 nt, Homo sapiens
acaaaucaccauguaacaacca

SEQ ID NO: 1422451 - RNA, 18 nt, Homo sapiens
acaaaugaacgauaugua

SEQ ID NO: 1422452 - RNA, 17 nt, Homo sapiens
acaaauuguacauuuga

SEQ ID NO: 1422453 - RNA, 19 nt, Homo sapiens
acaacauuuacuuaacaga

SEQ ID NO: 1422454 - RNA, 22 nt, Homo sapiens
acaaccauccugcucauaacau

SEQ ID NO: 1422455 - RNA, 13 nt, Homo sapiens
acaaccaugccag

SEQ ID NO: 1422456 - RNA, 16 nt, Homo sapiens
acaacugguccacuca

SEQ ID NO: 1422457 - RNA, 16 nt, Homo sapiens
acaagaagaccagacu

SEQ ID NO: 1422458 - RNA, 19 nt, Homo sapiens
acaagaaggccacugguag

SEQ ID NO: 1422459 - RNA, 21 nt, Homo sapiens
acaagaauuguccaugugcuu

SEQ ID NO: 1422460 - RNA, 13 nt, Homo sapiens
acaagcauucucc

SEQ ID NO: 1422461 - RNA, 21 nt, Homo sapiens
acaagcauuugcccuguggau

SEQ ID NO: 1422462 - RNA, 17 nt, Homo sapiens
acaagccaacuuguaaa

SEQ ID NO: 1422463 - RNA, 15 nt, Homo sapiens
acaagccacuaccuu

SEQ ID NO: 1422464 - RNA, 21 nt, Homo sapiens
acaaggacuagagcucaggcc

SEQ ID NO: 1422465 - RNA, 16 nt, Homo sapiens
acaaggcugaccaaga

SEQ ID NO: 1422466 - RNA, 16 nt, Homo sapiens
acaauaaggucaaugc

SEQ ID NO: 1422467 - RNA, 12 nt, Homo sapiens
acaauacaacaa

SEQ ID NO: 1422468 - RNA, 17 nt, Homo sapiens
acaauacaugcugcuaa

SEQ ID NO: 1422469 - RNA, 23 nt, Homo sapiens
acaauacgugaaagaugcaagca

SEQ ID NO: 1422470 - RNA, 12 nt, Homo sapiens
acaaugccucuc

SEQ ID NO: 1422471 - RNA, 15 nt, Homo sapiens
acaauguauuuguca

SEQ ID NO: 1422472 - RNA, 17 nt, Homo sapiens
acaauuaaacagccaaa

SEQ ID NO: 1422473 - RNA, 18 nt, Homo sapiens
acaauuacuaaauuguau

SEQ ID NO: 1422474 - RNA, 15 nt, Homo sapiens
acaauuugcacuguu

SEQ ID NO: 1422475 - RNA, 21 nt, Homo sapiens
acacaacuaggaaguggcuga

SEQ ID NO: 1422476 - RNA, 20 nt, Homo sapiens
acacaaggcugggcaccucu

SEQ ID NO: 1422477 - RNA, 13 nt, Homo sapiens
acacacacaccaa

SEQ ID NO: 1422478 - RNA, 21 nt, Homo sapiens
acacacaccucuaggacucca

SEQ ID NO: 1422479 - RNA, 13 nt, Homo sapiens
acacacagaugca

SEQ ID NO: 1422480 - RNA, 16 nt, Homo sapiens
acacacagaugcacac

SEQ ID NO: 1422481 - RNA, 12 nt, Homo sapiens
acacacauacau

SEQ ID NO: 1422482 - RNA, 17 nt, Homo sapiens
acacacauauacauaua

SEQ ID NO: 1422483 - RNA, 12 nt, Homo sapiens
acacacauggau

SEQ ID NO: 1422484 - RNA, 23 nt, Homo sapiens
acacaccgauguacacacacaga

SEQ ID NO: 1422485 - RNA, 13 nt, Homo sapiens
acacaccugguga

SEQ ID NO: 1422486 - RNA, 14 nt, Homo sapiens
acacagaugcacac

SEQ ID NO: 1422487 - RNA, 19 nt, Homo sapiens
acacagauggucacacaga

SEQ ID NO: 1422488 - RNA, 14 nt, Homo sapiens
acacaggaaaccaa

SEQ ID NO: 1422489 - RNA, 17 nt, Homo sapiens
acacagggugcauguga

SEQ ID NO: 1422490 - RNA, 15 nt, Homo sapiens
acacagucaccuucu

SEQ ID NO: 1422491 - RNA, 15 nt, Homo sapiens
acacauacauugcca

SEQ ID NO: 1422492 - RNA, 14 nt, Homo sapiens
acacauggaugcac

SEQ ID NO: 1422493 - RNA, 18 nt, Homo sapiens
acacauuacuugcacaag

SEQ ID NO: 1422494 - RNA, 17 nt, Homo sapiens
acacauuuggcaguuua

SEQ ID NO: 1422495 - RNA, 12 nt, Homo sapiens
acaccaccaucu

SEQ ID NO: 1422496 - RNA, 14 nt, Homo sapiens
acaccauaugcaag

SEQ ID NO: 1422497 - RNA, 14 nt, Homo sapiens
acacccaagaagaa

SEQ ID NO: 1422498 - RNA, 17 nt, Homo sapiens
acacccgacuccucaaa

SEQ ID NO: 1422499 - RNA, 16 nt, Homo sapiens
acaccgauguacacac

SEQ ID NO: 1422500 - RNA, 21 nt, Homo sapiens
acaccgauguacacacacaga

SEQ ID NO: 1422501 - RNA, 23 nt, Homo sapiens
acaccgaugugcgcacacacaga

SEQ ID NO: 1422502 - RNA, 16 nt, Homo sapiens
acaccgucccucagug

SEQ ID NO: 1422503 - RNA, 19 nt, Homo sapiens
acaccgucccucagugaua

SEQ ID NO: 1422504 - RNA, 21 nt, Homo sapiens
acaccucccuccccacaccuc

SEQ ID NO: 1422505 - RNA, 13 nt, Homo sapiens
acaccucccugaa

SEQ ID NO: 1422506 - RNA, 14 nt, Homo sapiens
acaccuucuuggcu

SEQ ID NO: 1422507 - RNA, 16 nt, Homo sapiens
acaccuuuguuuugca

SEQ ID NO: 1422508 - RNA, 20 nt, Homo sapiens
acacgagcaggcuacuguca

SEQ ID NO: 1422509 - RNA, 14 nt, Homo sapiens
acacggaugcacag

SEQ ID NO: 1422510 - RNA, 22 nt, Homo sapiens
acacuaagcgaauguguacaaa

SEQ ID NO: 1422511 - RNA, 21 nt, Homo sapiens
acacuaguuuugugccagccg

SEQ ID NO: 1422512 - RNA, 20 nt, Homo sapiens
acacuauuuaucugugcaaa

SEQ ID NO: 1422513 - RNA, 20 nt, Homo sapiens
acacucacuccacaacccaa

SEQ ID NO: 1422514 - RNA, 16 nt, Homo sapiens
acacuguaaacauuca

SEQ ID NO: 1422515 - RNA, 13 nt, Homo sapiens
acacugugcuaua

SEQ ID NO: 1422516 - RNA, 20 nt, Homo sapiens
acacuucuaaaugaagugca

SEQ ID NO: 1422517 - RNA, 13 nt, Homo sapiens
acagaaacagaga

SEQ ID NO: 1422518 - RNA, 15 nt, Homo sapiens
acagaaacauuuuca

SEQ ID NO: 1422519 - RNA, 18 nt, Homo sapiens
acagaaauauauauacau

SEQ ID NO: 1422520 - RNA, 19 nt, Homo sapiens
acagaacugcuaaauacug

SEQ ID NO: 1422521 - RNA, 23 nt, Homo sapiens
acagaacugcuaaauacuguaca

SEQ ID NO: 1422522 - RNA, 15 nt, Homo sapiens
acagaaggauguccc

SEQ ID NO: 1422523 - RNA, 15 nt, Homo sapiens
acagaauacaagcca

SEQ ID NO: 1422524 - RNA, 16 nt, Homo sapiens
acagaaugauggacuu

SEQ ID NO: 1422525 - RNA, 18 nt, Homo sapiens
acagacauuaaaccugga

SEQ ID NO: 1422526 - RNA, 14 nt, Homo sapiens
acagacgucucaag

SEQ ID NO: 1422527 - RNA, 22 nt, Homo sapiens
acagacuauuccccaccugcuu

SEQ ID NO: 1422528 - RNA, 20 nt, Homo sapiens
aauauuuuguaacuauuaca

SEQ ID NO: 1422529 - RNA, 21 nt, Homo sapiens
aaucaagacccuuuucuguau

SEQ ID NO: 1422530 - RNA, 14 nt, Homo sapiens
aaucaagagugagu

SEQ ID NO: 1422531 - RNA, 20 nt, Homo sapiens
aaucaagcuagaaggccaca

SEQ ID NO: 1422532 - RNA, 16 nt, Homo sapiens
aaucacaacacagagc

SEQ ID NO: 1422533 - RNA, 20 nt, Homo sapiens
aaucacaaggcaacugugag

SEQ ID NO: 1422534 - RNA, 18 nt, Homo sapiens
aaucagaugggggacuga

SEQ ID NO: 1422535 - RNA, 19 nt, Homo sapiens
aaucagcacauuccuccua

SEQ ID NO: 1422536 - RNA, 14 nt, Homo sapiens
aaucagcauucuca

SEQ ID NO: 1422537 - RNA, 14 nt, Homo sapiens
aaucaucucaaauc

SEQ ID NO: 1422538 - RNA, 12 nt, Homo sapiens
aaucauggagcu

SEQ ID NO: 1422539 - RNA, 21 nt, Homo sapiens
aaucauguuggauagucagcu

SEQ ID NO: 1422540 - RNA, 12 nt, Homo sapiens
aaucauucaaua

SEQ ID NO: 1422541 - RNA, 20 nt, Homo sapiens
aauccaacccaugaugagcu

SEQ ID NO: 1422542 - RNA, 15 nt, Homo sapiens
aauccacaagccauu

SEQ ID NO: 1422543 - RNA, 23 nt, Homo sapiens
aauccaucacuagccaugauaac

SEQ ID NO: 1422544 - RNA, 14 nt, Homo sapiens
aaucccgugaaaga

SEQ ID NO: 1422545 - RNA, 12 nt, Homo sapiens
aauccugaagaa

SEQ ID NO: 1422546 - RNA, 14 nt, Homo sapiens
aauccuuccaugaa

SEQ ID NO: 1422547 - RNA, 17 nt, Homo sapiens
aaucuaacuacaaggac

SEQ ID NO: 1422548 - RNA, 23 nt, Homo sapiens
aaucuauauuggaaucuguauca

SEQ ID NO: 1422549 - RNA, 21 nt, Homo sapiens
aaucugaagaagaaaugaaua

SEQ ID NO: 1422550 - RNA, 15 nt, Homo sapiens
aaucugaauggugcu

SEQ ID NO: 1422551 - RNA, 19 nt, Homo sapiens
aaucugagaagacaauaug

SEQ ID NO: 1422552 - RNA, 18 nt, Homo sapiens
aaucugccauaaagccau

SEQ ID NO: 1422553 - RNA, 15 nt, Homo sapiens
aaucuuacuuuguau

SEQ ID NO: 1422554 - RNA, 16 nt, Homo sapiens
aaucuuccagcaugca

SEQ ID NO: 1422555 - RNA, 19 nt, Homo sapiens
aaucuucggggugugauga

SEQ ID NO: 1422556 - RNA, 16 nt, Homo sapiens
aaucuucuuaugcaau

SEQ ID NO: 1422557 - RNA, 17 nt, Homo sapiens
aaucuuucagcacucag

SEQ ID NO: 1422558 - RNA, 19 nt, Homo sapiens
aaucuuuccuugucucuca

SEQ ID NO: 1422559 - RNA, 19 nt, Homo sapiens
aaucuuucuuuaccugaga

SEQ ID NO: 1422560 - RNA, 21 nt, Homo sapiens
aaugaaaaaaaguacauguau

SEQ ID NO: 1422561 - RNA, 16 nt, Homo sapiens
aaugaagacccagugu

SEQ ID NO: 1422562 - RNA, 23 nt, Homo sapiens
aaugaagacccaguguaaagaau

SEQ ID NO: 1422563 - RNA, 13 nt, Homo sapiens
aaugaagacuguu

SEQ ID NO: 1422564 - RNA, 15 nt, Homo sapiens
aaugaagaugucuaa

SEQ ID NO: 1422565 - RNA, 17 nt, Homo sapiens
aaugaagcccuauuacu

SEQ ID NO: 1422566 - RNA, 17 nt, Homo sapiens
aaugaaucuuacuccuu

SEQ ID NO: 1422567 - RNA, 23 nt, Homo sapiens
aaugaaugaccuuguugcaugau

SEQ ID NO: 1422568 - RNA, 16 nt, Homo sapiens
aaugacaucauguuag

SEQ ID NO: 1422569 - RNA, 13 nt, Homo sapiens
accaguccaugag

SEQ ID NO: 1422570 - RNA, 22 nt, Homo sapiens
accaguguccccuccacuguca

SEQ ID NO: 1422571 - RNA, 14 nt, Homo sapiens
accaguucuggcca

SEQ ID NO: 1422572 - RNA, 17 nt, Homo sapiens
accaguugggagcacug

SEQ ID NO: 1422573 - RNA, 21 nt, Homo sapiens
accaguuucugcggccuucca

SEQ ID NO: 1422574 - RNA, 14 nt, Homo sapiens
accauaacagccaa

SEQ ID NO: 1422575 - RNA, 15 nt, Homo sapiens
accaucaaaugcugu

SEQ ID NO: 1422576 - RNA, 15 nt, Homo sapiens
accauuacauguuua

SEQ ID NO: 1422577 - RNA, 13 nt, Homo sapiens
accauuacuguaa

SEQ ID NO: 1422578 - RNA, 20 nt, Homo sapiens
acccaaauaaauguguaaau

SEQ ID NO: 1422579 - RNA, 14 nt, Homo sapiens
acccaaguccaggc

SEQ ID NO: 1422580 - RNA, 21 nt, Homo sapiens
acccaauucaggacuggcuca

SEQ ID NO: 1422581 - RNA, 18 nt, Homo sapiens
acccacugugcuuacagu

SEQ ID NO: 1422582 - RNA, 11 nt, Homo sapiens
acccacugugg

SEQ ID NO: 1422583 - RNA, 22 nt, Homo sapiens
acccagacacaucgcacugugg

SEQ ID NO: 1422584 - RNA, 18 nt, Homo sapiens
acccagauauugcacuag

SEQ ID NO: 1422585 - RNA, 22 nt, Homo sapiens
acccaggccgccugccauaccg

SEQ ID NO: 1422586 - RNA, 22 nt, Homo sapiens
acccagguuggcgacugcaaca

SEQ ID NO: 1422587 - RNA, 23 nt, Homo sapiens
  misc_feature (7)..(7): n is a, c, g or u
acccagnagggcgucgcuggaca

SEQ ID NO: 1422588 - RNA, 19 nt, Homo sapiens
acccagucccagaaccaca

SEQ ID NO: 1422589 - RNA, 22 nt, Homo sapiens
acccaguguaaagaauaaauga

SEQ ID NO: 1422590 - RNA, 14 nt, Homo sapiens
acccaguguagcau

SEQ ID NO: 1422591 - RNA, 16 nt, Homo sapiens
acccaugaaucaaaga

SEQ ID NO: 1422592 - RNA, 17 nt, Homo sapiens
acccaugaaucaaagac

SEQ ID NO: 1422593 - RNA, 15 nt, Homo sapiens
acccaugccauagaa

SEQ ID NO: 1422594 - RNA, 13 nt, Homo sapiens
accccaccacuuc

SEQ ID NO: 1422595 - RNA, 17 nt, Homo sapiens
accccaccuugccaagc

SEQ ID NO: 1422596 - RNA, 22 nt, Homo sapiens
accccaccuugccaagcuuucu

SEQ ID NO: 1422597 - RNA, 18 nt, Homo sapiens
accccagcgccugugcug

SEQ ID NO: 1422598 - RNA, 22 nt, Homo sapiens
accccaggaucccagagcuucc

SEQ ID NO: 1422599 - RNA, 18 nt, Homo sapiens
accccaucaccuacucac

SEQ ID NO: 1422600 - RNA, 12 nt, Homo sapiens
accccgugccac

SEQ ID NO: 1422601 - RNA, 17 nt, Homo sapiens
accccuguuaagcaauu

SEQ ID NO: 1422602 - RNA, 12 nt, Homo sapiens
accccuuuccac

SEQ ID NO: 1422603 - RNA, 22 nt, Homo sapiens
agaggcuauuauuuucacugua

SEQ ID NO: 1422604 - RNA, 11 nt, Homo sapiens
agaggcucagc

SEQ ID NO: 1422605 - RNA, 14 nt, Homo sapiens
agaggcuccugucc

SEQ ID NO: 1422606 - RNA, 13 nt, Homo sapiens
agaggggaaaaug

SEQ ID NO: 1422607 - RNA, 15 nt, Homo sapiens
agaggggcagccgcu

SEQ ID NO: 1422608 - RNA, 16 nt, Homo sapiens
agaggggccugggaaa

SEQ ID NO: 1422609 - RNA, 11 nt, Homo sapiens
agagggggccu

SEQ ID NO: 1422610 - RNA, 18 nt, Homo sapiens
agagggggccuucacagu

SEQ ID NO: 1422611 - RNA, 23 nt, Homo sapiens
agagguaauuuuuuuguguagca

SEQ ID NO: 1422612 - RNA, 22 nt, Homo sapiens
agaggucuccaucauggcagug

SEQ ID NO: 1422613 - RNA, 20 nt, Homo sapiens
agaggugacccaaugcuccu

SEQ ID NO: 1422614 - RNA, 20 nt, Homo sapiens
agagguggcugcugugcuag

SEQ ID NO: 1422615 - RNA, 14 nt, Homo sapiens
agagguuucuugaa

SEQ ID NO: 1422616 - RNA, 12 nt, Homo sapiens
agaguagucaug

SEQ ID NO: 1422617 - RNA, 13 nt, Homo sapiens
agaguccucugga

SEQ ID NO: 1422618 - RNA, 18 nt, Homo sapiens
agaguccucuggauggca

SEQ ID NO: 1422619 - RNA, 23 nt, Homo sapiens
agagugaaauaauuaaaaaccac

SEQ ID NO: 1422620 - RNA, 19 nt, Homo sapiens
agagugagacucgucucaa

SEQ ID NO: 1422621 - RNA, 16 nt, Homo sapiens
agagugagagggcaug

SEQ ID NO: 1422622 - RNA, 21 nt, Homo sapiens
agaguguuccuguugaaucuu

SEQ ID NO: 1422623 - RNA, 13 nt, Homo sapiens
agaguuccacaaa

SEQ ID NO: 1422624 - RNA, 15 nt, Homo sapiens
agaguucugcucuag

SEQ ID NO: 1422625 - RNA, 20 nt, Homo sapiens
agaguuucuccuuuugacca

SEQ ID NO: 1422626 - RNA, 19 nt, Homo sapiens
agauaaauagaguuccaaa

SEQ ID NO: 1422627 - RNA, 13 nt, Homo sapiens
agccauaugcaau

SEQ ID NO: 1422628 - RNA, 14 nt, Homo sapiens
agcccaagugccau

SEQ ID NO: 1422629 - RNA, 15 nt, Homo sapiens
agcccagauggaaag

SEQ ID NO: 1422630 - RNA, 19 nt, Homo sapiens
agcccauggccucuggcca

SEQ ID NO: 1422631 - RNA, 19 nt, Homo sapiens
agccccacagcacccaggc

SEQ ID NO: 1422632 - RNA, 15 nt, Homo sapiens
agcccccagguugcc

SEQ ID NO: 1422633 - RNA, 19 nt, Homo sapiens
agccccccacaaugaugau

SEQ ID NO: 1422634 - RNA, 15 nt, Homo sapiens
agccccugguccuga

SEQ ID NO: 1422635 - RNA, 21 nt, Homo sapiens
agcccgggacagggucuugca

SEQ ID NO: 1422636 - RNA, 16 nt, Homo sapiens
agcccugggaccgcua

SEQ ID NO: 1422637 - RNA, 14 nt, Homo sapiens
agcccuuuacuuga

SEQ ID NO: 1422638 - RNA, 20 nt, Homo sapiens
agccgagauugcaccacugc

SEQ ID NO: 1422639 - RNA, 14 nt, Homo sapiens
agccgugaugcuca

SEQ ID NO: 1422640 - RNA, 14 nt, Homo sapiens
agccuaaggcugua

SEQ ID NO: 1422641 - RNA, 18 nt, Homo sapiens
agccuacugccucuccag

SEQ ID NO: 1422642 - RNA, 20 nt, Homo sapiens
agccuacugccucuccagca

SEQ ID NO: 1422643 - RNA, 17 nt, Homo sapiens
agccuagccaccuccca

SEQ ID NO: 1422644 - RNA, 22 nt, Homo sapiens
agccucccccucagaugaucuc

SEQ ID NO: 1422645 - RNA, 17 nt, Homo sapiens
agccucccccugcugcu

SEQ ID NO: 1422646 - RNA, 17 nt, Homo sapiens
agccucccgaguagcug

SEQ ID NO: 1422647 - RNA, 15 nt, Homo sapiens
agccuccucucucaa

SEQ ID NO: 1422648 - RNA, 14 nt, Homo sapiens
agccuccugaccug

SEQ ID NO: 1422649 - RNA, 19 nt, Homo sapiens
agccuccugccuaccccaa

SEQ ID NO: 1422650 - RNA, 19 nt, Homo sapiens
agccucuucugccaagaga

SEQ ID NO: 1422651 - RNA, 23 nt, Homo sapiens
agccugaaugucuuacugugauc

SEQ ID NO: 1422652 - RNA, 23 nt, Homo sapiens
agccugcaaacucacugcucaag

SEQ ID NO: 1422653 - RNA, 15 nt, Homo sapiens
agccuggagggaugc

SEQ ID NO: 1422654 - RNA, 14 nt, Homo sapiens
agccuggcaacaca

SEQ ID NO: 1422655 - RNA, 14 nt, Homo sapiens
agccuggcacagga

SEQ ID NO: 1422656 - RNA, 16 nt, Homo sapiens
agccuggccuccugcc

SEQ ID NO: 1422657 - RNA, 17 nt, Homo sapiens
agccugggccagagaag

SEQ ID NO: 1422658 - RNA, 16 nt, Homo sapiens
agccugggccuaugga

SEQ ID NO: 1422659 - RNA, 20 nt, Homo sapiens
agccugugaacccaggacaa

SEQ ID NO: 1422660 - RNA, 20 nt, Homo sapiens
agccugugaauaaaaacccu

SEQ ID NO: 1422661 - RNA, 16 nt, Homo sapiens
agccuucugacaagca

SEQ ID NO: 1422662 - RNA, 17 nt, Homo sapiens
agccuucugacaagcaa

SEQ ID NO: 1422663 - RNA, 13 nt, Homo sapiens
agccuucugauga

SEQ ID NO: 1422664 - RNA, 14 nt, Homo sapiens
agccuucugaugag

SEQ ID NO: 1422665 - RNA, 21 nt, Homo sapiens
agccuucugaugagacugcag

SEQ ID NO: 1422666 - RNA, 18 nt, Homo sapiens
agccuugcucaggugcaa

SEQ ID NO: 1422667 - RNA, 16 nt, Homo sapiens
agccuuugcccuguca

SEQ ID NO: 1422668 - RNA, 15 nt, Homo sapiens
agcgaaucaucucaa

SEQ ID NO: 1422669 - RNA, 19 nt, Homo sapiens
agcgaauguguacaaagug

SEQ ID NO: 1422670 - RNA, 20 nt, Homo sapiens
agcgccugcccucccugggg

SEQ ID NO: 1422671 - RNA, 18 nt, Homo sapiens
agcggaucucacucagcc

SEQ ID NO: 1422672 - RNA, 12 nt, Homo sapiens
agcguucccaac

SEQ ID NO: 1422673 - RNA, 17 nt, Homo sapiens
agcuaacuccagucucc

SEQ ID NO: 1422674 - RNA, 14 nt, Homo sapiens
agcuacaauaucuu

SEQ ID NO: 1422675 - RNA, 12 nt, Homo sapiens
agcuacauuccu

SEQ ID NO: 1422676 - RNA, 18 nt, Homo sapiens
agcuacucgggaggcuga

SEQ ID NO: 1422677 - RNA, 18 nt, Homo sapiens
agcuacuugggaggcuga

SEQ ID NO: 1422678 - RNA, 12 nt, Homo sapiens
agcuagaaggcc

SEQ ID NO: 1422679 - RNA, 14 nt, Homo sapiens
agcuagaaggccac

SEQ ID NO: 1422680 - RNA, 14 nt, Homo sapiens
agcuagccagcugu

SEQ ID NO: 1422681 - RNA, 17 nt, Homo sapiens
agcuaguggcuucaaaa

SEQ ID NO: 1422682 - RNA, 20 nt, Homo sapiens
agcuaugauuaugccacugc

SEQ ID NO: 1422683 - RNA, 22 nt, Homo sapiens
agcuaugauuaugccacugcuu

SEQ ID NO: 1422684 - RNA, 16 nt, Homo sapiens
agcuauugcauguaaa

SEQ ID NO: 1422685 - RNA, 21 nt, Homo sapiens
agcucaagucuucccugauca

SEQ ID NO: 1422686 - RNA, 13 nt, Homo sapiens
agcuccacuguca

SEQ ID NO: 1422687 - RNA, 20 nt, Homo sapiens
agcuccgcuaagaccucccc

SEQ ID NO: 1422688 - RNA, 13 nt, Homo sapiens
agcuccuugacuc

SEQ ID NO: 1422689 - RNA, 12 nt, Homo sapiens
agcucucucuac

SEQ ID NO: 1422690 - RNA, 20 nt, Homo sapiens
agcucuuucuucuuugaauu

SEQ ID NO: 1422691 - RNA, 17 nt, Homo sapiens
agcugaacaaugaaugc

SEQ ID NO: 1422692 - RNA, 15 nt, Homo sapiens
agcuuaccugacaca

SEQ ID NO: 1422693 - RNA, 17 nt, Homo sapiens
agcuuaccugacacaag

SEQ ID NO: 1422694 - RNA, 18 nt, Homo sapiens
agcuuauauauuacuugu

SEQ ID NO: 1422695 - RNA, 14 nt, Homo sapiens
agcuucaaacugca

SEQ ID NO: 1422696 - RNA, 21 nt, Homo sapiens
agcuucagaaguuuggcaaua

SEQ ID NO: 1422697 - RNA, 17 nt, Homo sapiens
agcuucagagccuagcc

SEQ ID NO: 1422698 - RNA, 18 nt, Homo sapiens
agcuucauuaugcagcug

SEQ ID NO: 1422699 - RNA, 16 nt, Homo sapiens
agcuucuaucccagga

SEQ ID NO: 1422700 - RNA, 13 nt, Homo sapiens
agcuucuguccug

SEQ ID NO: 1422701 - RNA, 17 nt, Homo sapiens
agcuugcucuucagugg

SEQ ID NO: 1422702 - RNA, 18 nt, Homo sapiens
agcuuuaggggaccauga

SEQ ID NO: 1422703 - RNA, 23 nt, Homo sapiens
agcuuuugaggggcugacuucaa

SEQ ID NO: 1422704 - RNA, 15 nt, Homo sapiens
aggaaaauuucacau

SEQ ID NO: 1422705 - RNA, 15 nt, Homo sapiens
aggaaaccuuuucau

SEQ ID NO: 1422706 - RNA, 23 nt, Homo sapiens
aggaaagcaaaauccaacuaaug

SEQ ID NO: 1422707 - RNA, 15 nt, Homo sapiens
aggaaagccaaacac

SEQ ID NO: 1422708 - RNA, 12 nt, Homo sapiens
aggaacaggugg

SEQ ID NO: 1422709 - RNA, 12 nt, Homo sapiens
aggaaccuacca

SEQ ID NO: 1422710 - RNA, 14 nt, Homo sapiens
aggaagaagccaga

SEQ ID NO: 1422711 - RNA, 22 nt, Homo sapiens
aggaagaugaagagaagcugag

SEQ ID NO: 1422712 - RNA, 14 nt, Homo sapiens
aggaaggacugugc

SEQ ID NO: 1422713 - RNA, 15 nt, Homo sapiens
aggaagggcauccuu

SEQ ID NO: 1422714 - RNA, 22 nt, Homo sapiens
aggaagggcgugucccauggga

SEQ ID NO: 1422715 - RNA, 22 nt, Homo sapiens
aggaagguggugcuuacauccu

SEQ ID NO: 1422716 - RNA, 15 nt, Homo sapiens
aggaagucaccaaaa

SEQ ID NO: 1422717 - RNA, 17 nt, Homo sapiens
aggaaucugaaaguaua

SEQ ID NO: 1422718 - RNA, 17 nt, Homo sapiens
aggaauguccagacugu

SEQ ID NO: 1422719 - RNA, 16 nt, Homo sapiens
aggaauucuaggcauc

SEQ ID NO: 1422720 - RNA, 12 nt, Homo sapiens
aggacaagcaug

SEQ ID NO: 1422721 - RNA, 22 nt, Homo sapiens
aggacaugauacugaugccaug

SEQ ID NO: 1422722 - RNA, 19 nt, Homo sapiens
aggaccaauguugugauua

SEQ ID NO: 1422723 - RNA, 15 nt, Homo sapiens
aggaccuucccaagu

SEQ ID NO: 1422724 - RNA, 17 nt, Homo sapiens
aggacuucugcagcuau

SEQ ID NO: 1422725 - RNA, 16 nt, Homo sapiens
aggacuugaacccagg

SEQ ID NO: 1422726 - RNA, 17 nt, Homo sapiens
aggagaagcagccuccu

SEQ ID NO: 1422727 - RNA, 19 nt, Homo sapiens
aggagacaagaaauccagu

SEQ ID NO: 1422728 - RNA, 23 nt, Homo sapiens
aggagagaggcucagccacacag

SEQ ID NO: 1422729 - RNA, 19 nt, Homo sapiens
aggagaggggaagggccag

SEQ ID NO: 1422730 - RNA, 15 nt, Homo sapiens
aggagagggggcaag

SEQ ID NO: 1422731 - RNA, 20 nt, Homo sapiens
aggagaucgagaccauccug

SEQ ID NO: 1422732 - RNA, 14 nt, Homo sapiens
aggagcaaaacgcc

SEQ ID NO: 1422733 - RNA, 19 nt, Homo sapiens
aggagcugauuuccaggcc

SEQ ID NO: 1422734 - RNA, 21 nt, Homo sapiens
aggaggcccuggugucaggca

SEQ ID NO: 1422735 - RNA, 20 nt, Homo sapiens
aggaggcggagguugcagug

SEQ ID NO: 1422736 - RNA, 16 nt, Homo sapiens
aggaggcugcaugcuc

SEQ ID NO: 1422737 - RNA, 19 nt, Homo sapiens
aggaggcugcaugcucugg

SEQ ID NO: 1422738 - RNA, 22 nt, Homo sapiens
aggaggugcuaucgcaccacug

SEQ ID NO: 1422739 - RNA, 19 nt, Homo sapiens
aggagguuuggggucugcc

SEQ ID NO: 1422740 - RNA, 13 nt, Homo sapiens
aggaguuccuuga

SEQ ID NO: 1422741 - RNA, 22 nt, Homo sapiens
aggaguucgagaccagccugac

SEQ ID NO: 1422742 - RNA, 16 nt, Homo sapiens
aggauaucgggucacu

SEQ ID NO: 1422743 - RNA, 17 nt, Homo sapiens
aggauauuuucuuccaa

SEQ ID NO: 1422744 - RNA, 13 nt, Homo sapiens
aggaucccuccau

SEQ ID NO: 1422745 - RNA, 17 nt, Homo sapiens
aggaucgccugagccca

SEQ ID NO: 1422746 - RNA, 14 nt, Homo sapiens
aggaucucucagga

SEQ ID NO: 1422747 - RNA, 13 nt, Homo sapiens
aggauguaacuuu

SEQ ID NO: 1422748 - RNA, 16 nt, Homo sapiens
aggauguuuuucauga

SEQ ID NO: 1422749 - RNA, 16 nt, Homo sapiens
aggcaaauauaagcug

SEQ ID NO: 1422750 - RNA, 14 nt, Homo sapiens
aggcaaauggcaca

SEQ ID NO: 1422751 - RNA, 14 nt, Homo sapiens
aggcaacugugagu

SEQ ID NO: 1422752 - RNA, 19 nt, Homo sapiens
aggcaagaaccaguguuua

SEQ ID NO: 1422753 - RNA, 17 nt, Homo sapiens
aggcaauacauguaucu

SEQ ID NO: 1422754 - RNA, 18 nt, Homo sapiens
aggcaccuuaguggcuuu

SEQ ID NO: 1422755 - RNA, 15 nt, Homo sapiens
aggcagaccauccac

SEQ ID NO: 1422756 - RNA, 13 nt, Homo sapiens
aggcagagccuga

SEQ ID NO: 1422757 - RNA, 20 nt, Homo sapiens
aggcagaggauguucuggac

SEQ ID NO: 1422758 - RNA, 12 nt, Homo sapiens
aggcagcuccaa

SEQ ID NO: 1422759 - RNA, 20 nt, Homo sapiens
aggcccagggagcaauggga

SEQ ID NO: 1422760 - RNA, 14 nt, Homo sapiens
aggccccaugaccu

SEQ ID NO: 1422761 - RNA, 23 nt, Homo sapiens
aggcccuuccucuccacugccuu

SEQ ID NO: 1422762 - RNA, 17 nt, Homo sapiens
aggccgagccaauagac

SEQ ID NO: 1422763 - RNA, 15 nt, Homo sapiens
aggccgggcccgggc

SEQ ID NO: 1422764 - RNA, 14 nt, Homo sapiens
aggccugagggcug

SEQ ID NO: 1422765 - RNA, 17 nt, Homo sapiens
aggccuuacuuaaaccc

SEQ ID NO: 1422766 - RNA, 20 nt, Homo sapiens
aggccuuacuuaaacccagc

SEQ ID NO: 1422767 - RNA, 14 nt, Homo sapiens
aggcguucuucgag

SEQ ID NO: 1422768 - RNA, 15 nt, Homo sapiens
aggcuauguauggaa

SEQ ID NO: 1422769 - RNA, 16 nt, Homo sapiens
aggcucacagcuggaa

SEQ ID NO: 1422770 - RNA, 18 nt, Homo sapiens
aggcuccaucuccagugg

SEQ ID NO: 1422771 - RNA, 14 nt, Homo sapiens
aggcuccugugcua

SEQ ID NO: 1422772 - RNA, 19 nt, Homo sapiens
aggcuccugugcuacuuug

SEQ ID NO: 1422773 - RNA, 15 nt, Homo sapiens
aggcugcacugcagu

SEQ ID NO: 1422774 - RNA, 18 nt, Homo sapiens
aggcugcccugaacaaaa

SEQ ID NO: 1422775 - RNA, 14 nt, Homo sapiens
aggcugcucuugaa

SEQ ID NO: 1422776 - RNA, 20 nt, Homo sapiens
aggcuggagauccuaacuga

SEQ ID NO: 1422777 - RNA, 17 nt, Homo sapiens
aggcuggaguacaguga

SEQ ID NO: 1422778 - RNA, 15 nt, Homo sapiens
aggcuggagugcagu

SEQ ID NO: 1422779 - RNA, 20 nt, Homo sapiens
aggcuggaguggaguggcac

SEQ ID NO: 1422780 - RNA, 17 nt, Homo sapiens
aggcuguucugcacuga

SEQ ID NO: 1422781 - RNA, 18 nt, Homo sapiens
aggcuguucugcacugaa

SEQ ID NO: 1422782 - RNA, 22 nt, Homo sapiens
aggcuugccaccggggaaccca

SEQ ID NO: 1422783 - RNA, 23 nt, Homo sapiens
agggaaaguuaaaaguguugauu

SEQ ID NO: 1422784 - RNA, 19 nt, Homo sapiens
agggaaccgugauaagccu

SEQ ID NO: 1422785 - RNA, 20 nt, Homo sapiens
agggaagagugcauuuuccc

SEQ ID NO: 1422786 - RNA, 17 nt, Homo sapiens
agggacaaaacacugug

SEQ ID NO: 1422787 - RNA, 16 nt, Homo sapiens
agggacgaucuuugaa

SEQ ID NO: 1422788 - RNA, 22 nt, Homo sapiens
agggacuucugucuucacaaca

SEQ ID NO: 1422789 - RNA, 21 nt, Homo sapiens
agggagcaacucuccacucca

SEQ ID NO: 1422790 - RNA, 23 nt, Homo sapiens
agggagccaucccuucccugucc

SEQ ID NO: 1422791 - RNA, 14 nt, Homo sapiens
agggagcucacucc

SEQ ID NO: 1422792 - RNA, 22 nt, Homo sapiens
agggagcucacucccacuggaa

SEQ ID NO: 1422793 - RNA, 15 nt, Homo sapiens
agggauguucuagcc

SEQ ID NO: 1422794 - RNA, 17 nt, Homo sapiens
agggcaacccaccaucu

SEQ ID NO: 1422795 - RNA, 23 nt, Homo sapiens
agggcaaguguucccaaauugac

SEQ ID NO: 1422796 - RNA, 15 nt, Homo sapiens
agggcagagccaugg

SEQ ID NO: 1422797 - RNA, 15 nt, Homo sapiens
agggcaggcuugcca

SEQ ID NO: 1422798 - RNA, 21 nt, Homo sapiens
agggcaggcuugccaccgggg

SEQ ID NO: 1422799 - RNA, 18 nt, Homo sapiens
agggcaguaccugggaaa

SEQ ID NO: 1422800 - RNA, 18 nt, Homo sapiens
agggccccucccucugcc

SEQ ID NO: 1422801 - RNA, 17 nt, Homo sapiens
agggcuagaaccuggaa

SEQ ID NO: 1422802 - RNA, 12 nt, Homo sapiens
agggcucugagg

SEQ ID NO: 1422803 - RNA, 21 nt, Homo sapiens
agggcugaccugccucucaca

SEQ ID NO: 1422804 - RNA, 13 nt, Homo sapiens
agggcugugcuga

SEQ ID NO: 1422805 - RNA, 17 nt, Homo sapiens
aggggaaggccuuuuca

SEQ ID NO: 1422806 - RNA, 16 nt, Homo sapiens
aggggcaccugggaaa

SEQ ID NO: 1422807 - RNA, 23 nt, Homo sapiens
aggggcaggccugggacccagcu

SEQ ID NO: 1422808 - RNA, 16 nt, Homo sapiens
aggggccgagccauuu

SEQ ID NO: 1422809 - RNA, 19 nt, Homo sapiens
aggggcucagcaaggugug

SEQ ID NO: 1422810 - RNA, 16 nt, Homo sapiens
agggggaacaaaucac

SEQ ID NO: 1422811 - RNA, 13 nt, Homo sapiens
agggggugugcgu

SEQ ID NO: 1422812 - RNA, 12 nt, Homo sapiens
aggggguugugg

SEQ ID NO: 1422813 - RNA, 19 nt, Homo sapiens
agggguacauuucccugug

SEQ ID NO: 1422814 - RNA, 18 nt, Homo sapiens
aggguaagacaauaugaa

SEQ ID NO: 1422815 - RNA, 23 nt, Homo sapiens
agggucacuaaccaagccagaaa

SEQ ID NO: 1422816 - RNA, 22 nt, Homo sapiens
aggguugggguagcccauguua

SEQ ID NO: 1422817 - RNA, 23 nt, Homo sapiens
aggguuggguucaucugagcaag

SEQ ID NO: 1422818 - RNA, 15 nt, Homo sapiens
agguaguacugggaa

SEQ ID NO: 1422819 - RNA, 12 nt, Homo sapiens
aggucacugggu

SEQ ID NO: 1422820 - RNA, 18 nt, Homo sapiens
aggucagcgugcuuagcc

SEQ ID NO: 1422821 - RNA, 16 nt, Homo sapiens
aggucauuacuaacca

SEQ ID NO: 1422822 - RNA, 17 nt, Homo sapiens
aggucccagagggugga

SEQ ID NO: 1422823 - RNA, 14 nt, Homo sapiens
agguccggaggggu

SEQ ID NO: 1422824 - RNA, 14 nt, Homo sapiens
aggucuaaugauau

SEQ ID NO: 1422825 - RNA, 12 nt, Homo sapiens
aggucuccauca

SEQ ID NO: 1422826 - RNA, 15 nt, Homo sapiens
aggugaccccagggc

SEQ ID NO: 1422827 - RNA, 17 nt, Homo sapiens
aggugagaccaaaggau

SEQ ID NO: 1422828 - RNA, 15 nt, Homo sapiens
auaagaucugagauu

SEQ ID NO: 1422829 - RNA, 12 nt, Homo sapiens
auaagcuuuauu

SEQ ID NO: 1422830 - RNA, 21 nt, Homo sapiens
auaaguccacaucuucucagu

SEQ ID NO: 1422831 - RNA, 13 nt, Homo sapiens
auaauaagaagga

SEQ ID NO: 1422832 - RNA, 17 nt, Homo sapiens
auaaugaguucacuaca

SEQ ID NO: 1422833 - RNA, 17 nt, Homo sapiens
auaaugcuguugccuca

SEQ ID NO: 1422834 - RNA, 18 nt, Homo sapiens
auaaugcuguugccucau

SEQ ID NO: 1422835 - RNA, 17 nt, Homo sapiens
auaaugggaagccugua

SEQ ID NO: 1422836 - RNA, 19 nt, Homo sapiens
auaaugguugacuggguuu

SEQ ID NO: 1422837 - RNA, 13 nt, Homo sapiens
auaauguguguau

SEQ ID NO: 1422838 - RNA, 22 nt, Homo sapiens
auaauugguuagaaccuccuau

SEQ ID NO: 1422839 - RNA, 17 nt, Homo sapiens
auacaaacaagcacaga

SEQ ID NO: 1422840 - RNA, 20 nt, Homo sapiens
auacaaacuacagaguuuau

SEQ ID NO: 1422841 - RNA, 23 nt, Homo sapiens
auacaauucaaguugcuucucau

SEQ ID NO: 1422842 - RNA, 12 nt, Homo sapiens
auacacacauau

SEQ ID NO: 1422843 - RNA, 13 nt, Homo sapiens
auacacacauaua

SEQ ID NO: 1422844 - RNA, 12 nt, Homo sapiens
auacacacucaa

SEQ ID NO: 1422845 - RNA, 16 nt, Homo sapiens
auacacauacauacac

SEQ ID NO: 1422846 - RNA, 16 nt, Homo sapiens
auacagaaaaugcuuu

SEQ ID NO: 1422847 - RNA, 16 nt, Homo sapiens
auacauacacuuguau

SEQ ID NO: 1422848 - RNA, 18 nt, Homo sapiens
auacauacacuuguauaa

SEQ ID NO: 1422849 - RNA, 13 nt, Homo sapiens
auacauacauaca

SEQ ID NO: 1422850 - RNA, 14 nt, Homo sapiens
auacauacauacau

SEQ ID NO: 1422851 - RNA, 13 nt, Homo sapiens
auacauacauaua

SEQ ID NO: 1422852 - RNA, 11 nt, Homo sapiens
auacauaucag

SEQ ID NO: 1422853 - RNA, 19 nt, Homo sapiens
auacauauguagacuauau

SEQ ID NO: 1422854 - RNA, 18 nt, Homo sapiens
auacaugcugcuaauuca

SEQ ID NO: 1422855 - RNA, 15 nt, Homo sapiens
auacauguacuccag

SEQ ID NO: 1422856 - RNA, 20 nt, Homo sapiens
auacauucuccuuuuugccc

SEQ ID NO: 1422857 - RNA, 20 nt, Homo sapiens
auacauucuuuaucuugaca

SEQ ID NO: 1422858 - RNA, 12 nt, Homo sapiens
auacauugccaa

SEQ ID NO: 1422859 - RNA, 14 nt, Homo sapiens
auacccagucccag

SEQ ID NO: 1422860 - RNA, 18 nt, Homo sapiens
auaccccuguuaagcaau

SEQ ID NO: 1422861 - RNA, 14 nt, Homo sapiens
auaccuaucaucuu

SEQ ID NO: 1422862 - RNA, 18 nt, Homo sapiens
auaccuuuauugugaucu

SEQ ID NO: 1422863 - RNA, 23 nt, Homo sapiens
auacgugaaagaugcaagcaccu

SEQ ID NO: 1422864 - RNA, 17 nt, Homo sapiens
auacgugucugugugua

SEQ ID NO: 1422865 - RNA, 12 nt, Homo sapiens
auacuaccaagu

SEQ ID NO: 1422866 - RNA, 20 nt, Homo sapiens
auacuagaaugguagcacua

SEQ ID NO: 1422867 - RNA, 23 nt, Homo sapiens
auacugcaauaaauuauggcucu

SEQ ID NO: 1422868 - RNA, 19 nt, Homo sapiens
auacugcucaucauuccuu

SEQ ID NO: 1422869 - RNA, 21 nt, Homo sapiens
auacugcucaucauuccuuga

SEQ ID NO: 1422870 - RNA, 16 nt, Homo sapiens
auacuguacugagaca

SEQ ID NO: 1422871 - RNA, 19 nt, Homo sapiens
auacuuuuuucuaguuuca

SEQ ID NO: 1422872 - RNA, 18 nt, Homo sapiens
auagaaacaugacacuga

SEQ ID NO: 1422873 - RNA, 15 nt, Homo sapiens
auagaaacugaggag

SEQ ID NO: 1422874 - RNA, 14 nt, Homo sapiens
auagaaagcaauaa

SEQ ID NO: 1422875 - RNA, 22 nt, Homo sapiens
auagaauacauggaaacgcaaa

SEQ ID NO: 1422876 - RNA, 16 nt, Homo sapiens
auagaauuuccaauau

SEQ ID NO: 1422877 - RNA, 20 nt, Homo sapiens
auagacacuggagacuugga

SEQ ID NO: 1422878 - RNA, 13 nt, Homo sapiens
auagagauaugca

SEQ ID NO: 1422879 - RNA, 21 nt, Homo sapiens
auagagugguacagcacuguu

SEQ ID NO: 1422880 - RNA, 13 nt, Homo sapiens
auagaguuccaaa

SEQ ID NO: 1422881 - RNA, 20 nt, Homo sapiens
auagauccuauuacuguuuc

SEQ ID NO: 1422882 - RNA, 17 nt, Homo sapiens
auagauuaauggcacug

SEQ ID NO: 1422883 - RNA, 22 nt, Homo sapiens
auagauuaccugaucaugguca

SEQ ID NO: 1422884 - RNA, 17 nt, Homo sapiens
auagccauguacuauaa

SEQ ID NO: 1422885 - RNA, 21 nt, Homo sapiens
auagccuaauacaacauguag

SEQ ID NO: 1422886 - RNA, 16 nt, Homo sapiens
auagcuacccaaaaga

SEQ ID NO: 1422887 - RNA, 16 nt, Homo sapiens
auagcuauugcaugua

SEQ ID NO: 1422888 - RNA, 23 nt, Homo sapiens
auagcugccuuuuuuaacacuag

SEQ ID NO: 1422889 - RNA, 19 nt, Homo sapiens
auagggugcaguuuuccag

SEQ ID NO: 1422890 - RNA, 18 nt, Homo sapiens
auaguaagccucccuccu

SEQ ID NO: 1422891 - RNA, 14 nt, Homo sapiens
auagucacaaaaau

SEQ ID NO: 1422892 - RNA, 14 nt, Homo sapiens
auagucacaagagc

SEQ ID NO: 1422893 - RNA, 18 nt, Homo sapiens
auaguucuaucaggaaaa

SEQ ID NO: 1422894 - RNA, 20 nt, Homo sapiens
auauaacuaagacauaugca

SEQ ID NO: 1422895 - RNA, 16 nt, Homo sapiens
auauaaugcaaaccau

SEQ ID NO: 1422896 - RNA, 23 nt, Homo sapiens
auauaauggaagagaaaucucau

SEQ ID NO: 1422897 - RNA, 15 nt, Homo sapiens
auauacaauaacaua

SEQ ID NO: 1422898 - RNA, 13 nt, Homo sapiens
auauacacauaca

SEQ ID NO: 1422899 - RNA, 17 nt, Homo sapiens
auauacacauacauaca

SEQ ID NO: 1422900 - RNA, 15 nt, Homo sapiens
auauacacauggaug

SEQ ID NO: 1422901 - RNA, 16 nt, Homo sapiens
auauagcguucccaac

SEQ ID NO: 1422902 - RNA, 22 nt, Homo sapiens
auauaguauauuuauacucuag

SEQ ID NO: 1422903 - RNA, 18 nt, Homo sapiens
auauaugcucaaccagaa

SEQ ID NO: 1422904 - RNA, 15 nt, Homo sapiens
auauaugugcaguau

SEQ ID NO: 1422905 - RNA, 13 nt, Homo sapiens
auaucaagauguu

SEQ ID NO: 1422906 - RNA, 12 nt, Homo sapiens
auaucagaaaag

SEQ ID NO: 1422907 - RNA, 13 nt, Homo sapiens
auaucagagcucu

SEQ ID NO: 1422908 - RNA, 17 nt, Homo sapiens
auaucauuuuuuuaaca

SEQ ID NO: 1422909 - RNA, 12 nt, Homo sapiens
auauccacagac

SEQ ID NO: 1422910 - RNA, 15 nt, Homo sapiens
auauccacagacucc

SEQ ID NO: 1422911 - RNA, 19 nt, Homo sapiens
auauccucucagcucucuu

SEQ ID NO: 1422912 - RNA, 21 nt, Homo sapiens
auaucugacaguuacucuuca

SEQ ID NO: 1422913 - RNA, 23 nt, Homo sapiens
auaucuucaggacuauuucacua

SEQ ID NO: 1422914 - RNA, 19 nt, Homo sapiens
auaucuucauacaaugaca

SEQ ID NO: 1422915 - RNA, 19 nt, Homo sapiens
auaugacuccuuucucuau

SEQ ID NO: 1422916 - RNA, 17 nt, Homo sapiens
auaugacuuuuucucag

SEQ ID NO: 1422917 - RNA, 16 nt, Homo sapiens
auaugauauguaaaca

SEQ ID NO: 1422918 - RNA, 16 nt, Homo sapiens
auaugaucuaauacaa

SEQ ID NO: 1422919 - RNA, 22 nt, Homo sapiens
auaugcacacacacggaugcac

SEQ ID NO: 1422920 - RNA, 22 nt, Homo sapiens
auaugcacacacagaugcacac

SEQ ID NO: 1422921 - RNA, 17 nt, Homo sapiens
auaugcacacacaugga

SEQ ID NO: 1422922 - RNA, 15 nt, Homo sapiens
auaugcagugauaua

SEQ ID NO: 1422923 - RNA, 20 nt, Homo sapiens
auauguagcuuuauccuuag

SEQ ID NO: 1422924 - RNA, 22 nt, Homo sapiens
auauguaggugucugcacccag

SEQ ID NO: 1422925 - RNA, 15 nt, Homo sapiens
auuuauucauucagu

SEQ ID NO: 1422926 - RNA, 18 nt, Homo sapiens
auuuauuggggaucugca

SEQ ID NO: 1422927 - RNA, 20 nt, Homo sapiens
auuuauuggggaucugcauu

SEQ ID NO: 1422928 - RNA, 18 nt, Homo sapiens
auuuauuggggugccuau

SEQ ID NO: 1422929 - RNA, 16 nt, Homo sapiens
auuuauuuauggagga

SEQ ID NO: 1422930 - RNA, 17 nt, Homo sapiens
auuucacaucagcuuua

SEQ ID NO: 1422931 - RNA, 11 nt, Homo sapiens
auuucagggaa

SEQ ID NO: 1422932 - RNA, 14 nt, Homo sapiens
auuucagggaaaug

SEQ ID NO: 1422933 - RNA, 23 nt, Homo sapiens
auuucagguuuuguaaagaugcc

SEQ ID NO: 1422934 - RNA, 15 nt, Homo sapiens
auuucaguuacuuac

SEQ ID NO: 1422935 - RNA, 13 nt, Homo sapiens
auuucaucuacua

SEQ ID NO: 1422936 - RNA, 16 nt, Homo sapiens
auuucaucuacuacag

SEQ ID NO: 1422937 - RNA, 15 nt, Homo sapiens
auuuccauaacucau

SEQ ID NO: 1422938 - RNA, 16 nt, Homo sapiens
auuucccugugcugac

SEQ ID NO: 1422939 - RNA, 20 nt, Homo sapiens
auuuccuacagaaauacugc

SEQ ID NO: 1422940 - RNA, 23 nt, Homo sapiens
auuuccugcuacacaaaagccaa

SEQ ID NO: 1422941 - RNA, 15 nt, Homo sapiens
auuucuacacagugg

SEQ ID NO: 1422942 - RNA, 20 nt, Homo sapiens
auuucuaucuugaauuucau

SEQ ID NO: 1422943 - RNA, 15 nt, Homo sapiens
auuucugcaucagcu

SEQ ID NO: 1422944 - RNA, 16 nt, Homo sapiens
auuugaaaguccuugu

SEQ ID NO: 1422945 - RNA, 16 nt, Homo sapiens
auuugaagaugggaug

SEQ ID NO: 1422946 - RNA, 17 nt, Homo sapiens
auuugagagcuaacuau

SEQ ID NO: 1422947 - RNA, 14 nt, Homo sapiens
auuugagcaauuca

SEQ ID NO: 1422948 - RNA, 23 nt, Homo sapiens
auuugauaguugguguucaaaaa

SEQ ID NO: 1422949 - RNA, 19 nt, Homo sapiens
auuugcacccaugccauag

SEQ ID NO: 1422950 - RNA, 13 nt, Homo sapiens
auuugccaaagug

SEQ ID NO: 1422951 - RNA, 13 nt, Homo sapiens
auuugccaccacu

SEQ ID NO: 1422952 - RNA, 22 nt, Homo sapiens
auuugggauauguuacauuaga

SEQ ID NO: 1422953 - RNA, 15 nt, Homo sapiens
auuuguauuugccau

SEQ ID NO: 1422954 - RNA, 18 nt, Homo sapiens
auuugugugugugauaua

SEQ ID NO: 1422955 - RNA, 15 nt, Homo sapiens
auuuguucagugacu

SEQ ID NO: 1422956 - RNA, 17 nt, Homo sapiens
auuuuaaauguuuuaca

SEQ ID NO: 1422957 - RNA, 18 nt, Homo sapiens
auuuuacuaccaaugcca

SEQ ID NO: 1422958 - RNA, 21 nt, Homo sapiens
auuuuaggcagggauuugagg

SEQ ID NO: 1422959 - RNA, 19 nt, Homo sapiens
auuuuauacauagucacaa

SEQ ID NO: 1422960 - RNA, 22 nt, Homo sapiens
auuuuauguaaagucucucaau

SEQ ID NO: 1422961 - RNA, 13 nt, Homo sapiens
auuuuauuauaau

SEQ ID NO: 1422962 - RNA, 18 nt, Homo sapiens
auuuuauucccuuucaca

SEQ ID NO: 1422963 - RNA, 19 nt, Homo sapiens
auuuucaagaaacugagga

SEQ ID NO: 1422964 - RNA, 22 nt, Homo sapiens
auuuucacaggugugguguaau

SEQ ID NO: 1422965 - RNA, 16 nt, Homo sapiens
auuuucacucugggcu

SEQ ID NO: 1422966 - RNA, 23 nt, Homo sapiens
auuuuccuaaaaauaagcuuuau

SEQ ID NO: 1422967 - RNA, 13 nt, Homo sapiens
auuuuccuacauu

SEQ ID NO: 1422968 - RNA, 16 nt, Homo sapiens
auuuuccugaauauua

SEQ ID NO: 1422969 - RNA, 21 nt, Homo sapiens
auuuucuuuaaagaaugcugg

SEQ ID NO: 1422970 - RNA, 19 nt, Homo sapiens
auuuuguaacgaagacaca

SEQ ID NO: 1422971 - RNA, 15 nt, Homo sapiens
auuuugucacugucu

SEQ ID NO: 1422972 - RNA, 17 nt, Homo sapiens
auuuuuauagacaaaua

SEQ ID NO: 1422973 - RNA, 20 nt, Homo sapiens
auuuuuuguuauguuugcac

SEQ ID NO: 1422974 - RNA, 20 nt, Homo sapiens
auuuuuuuuaacauuccaau

SEQ ID NO: 1422975 - RNA, 20 nt, Homo sapiens
auuuuuuuuacugugcauac

SEQ ID NO: 1422976 - RNA, 22 nt, Homo sapiens
auuuuuuuuuuaaaacuaucca

SEQ ID NO: 1422977 - RNA, 15 nt, Homo sapiens
caaaaagacagugug

SEQ ID NO: 1422978 - RNA, 16 nt, Homo sapiens
caaaaaggcauaugca

SEQ ID NO: 1422979 - RNA, 12 nt, Homo sapiens
caaaaauguaau

SEQ ID NO: 1422980 - RNA, 18 nt, Homo sapiens
caaaaauguaaugaucau

SEQ ID NO: 1422981 - RNA, 16 nt, Homo sapiens
caaaacagagauguga

SEQ ID NO: 1422982 - RNA, 14 nt, Homo sapiens
caaaacugcuaaau

SEQ ID NO: 1422983 - RNA, 20 nt, Homo sapiens
caaaagcugcuugacuauca

SEQ ID NO: 1422984 - RNA, 23 nt, Homo sapiens
caaaaguauuuaacgacccaguc

SEQ ID NO: 1422985 - RNA, 14 nt, Homo sapiens
caaaagucagucuu

SEQ ID NO: 1422986 - RNA, 15 nt, Homo sapiens
caaaagucagucuua

SEQ ID NO: 1422987 - RNA, 19 nt, Homo sapiens
caaaauaccaugccauuua

SEQ ID NO: 1422988 - RNA, 14 nt, Homo sapiens
caaaaucacaagca

SEQ ID NO: 1422989 - RNA, 17 nt, Homo sapiens
caaaaucccuauuuaau

SEQ ID NO: 1422990 - RNA, 22 nt, Homo sapiens
caaaauggagggagccaucccu

SEQ ID NO: 1422991 - RNA, 23 nt, Homo sapiens
caaacaaaacgcaaaacccagua

SEQ ID NO: 1422992 - RNA, 14 nt, Homo sapiens
caaacaaugccauc

SEQ ID NO: 1422993 - RNA, 18 nt, Homo sapiens
caaacaaugccaucacug

SEQ ID NO: 1422994 - RNA, 13 nt, Homo sapiens
caaacacacugua

SEQ ID NO: 1422995 - RNA, 16 nt, Homo sapiens
caaacacacuguaaau

SEQ ID NO: 1422996 - RNA, 20 nt, Homo sapiens
caaacaguagacuuauagua

SEQ ID NO: 1422997 - RNA, 16 nt, Homo sapiens
caaacagucucaggaa

SEQ ID NO: 1422998 - RNA, 19 nt, Homo sapiens
caaaccaagagccaaaaau

SEQ ID NO: 1422999 - RNA, 15 nt, Homo sapiens
caaaccacaacugac

SEQ ID NO: 1423000 - RNA, 16 nt, Homo sapiens
caaaccacuguacaua

SEQ ID NO: 1423001 - RNA, 13 nt, Homo sapiens
caaaccagagcag

SEQ ID NO: 1423002 - RNA, 18 nt, Homo sapiens
caaaccauaaacuucaug

SEQ ID NO: 1423003 - RNA, 14 nt, Homo sapiens
caaaccuacuguau

SEQ ID NO: 1423004 - RNA, 22 nt, Homo sapiens
caaacugccuauauugauaaaa

SEQ ID NO: 1423005 - RNA, 23 nt, Homo sapiens
caaacuguaaaacuuaaaacuga

SEQ ID NO: 1423006 - RNA, 14 nt, Homo sapiens
caaagaacaagauc

SEQ ID NO: 1423007 - RNA, 21 nt, Homo sapiens
caaagaacugccccaucuccu

SEQ ID NO: 1423008 - RNA, 20 nt, Homo sapiens
caaagaaggaauucuaggca

SEQ ID NO: 1423009 - RNA, 21 nt, Homo sapiens
caagccuggucuccucccaaa

SEQ ID NO: 1423010 - RNA, 14 nt, Homo sapiens
caagccuuacucac

SEQ ID NO: 1423011 - RNA, 14 nt, Homo sapiens
caagcuuguauaua

SEQ ID NO: 1423012 - RNA, 13 nt, Homo sapiens
caaggaauccuga

SEQ ID NO: 1423013 - RNA, 23 nt, Homo sapiens
caaggaguaaguacaaauauucc

SEQ ID NO: 1423014 - RNA, 23 nt, Homo sapiens
caaggauucagcauuauuccucc

SEQ ID NO: 1423015 - RNA, 13 nt, Homo sapiens
caagggcagugag

SEQ ID NO: 1423016 - RNA, 19 nt, Homo sapiens
caaggguaugggaagccau

SEQ ID NO: 1423017 - RNA, 14 nt, Homo sapiens
caaggucuuugguu

SEQ ID NO: 1423018 - RNA, 22 nt, Homo sapiens
caagguguggccugcacugggu

SEQ ID NO: 1423019 - RNA, 15 nt, Homo sapiens
caagguuauaugcac

SEQ ID NO: 1423020 - RNA, 19 nt, Homo sapiens
caagguuuuggagucagua

SEQ ID NO: 1423021 - RNA, 19 nt, Homo sapiens
caaguagaggcaaugcaaa

SEQ ID NO: 1423022 - RNA, 20 nt, Homo sapiens
caaguauugcgaaugugcag

SEQ ID NO: 1423023 - RNA, 21 nt, Homo sapiens
caagucaggcccuuauuuuca

SEQ ID NO: 1423024 - RNA, 23 nt, Homo sapiens
caagucccauugaaaaugaaugc

SEQ ID NO: 1423025 - RNA, 24 nt, Homo sapiens
caaguccugggaauaugcuaguga

SEQ ID NO: 1423026 - RNA, 21 nt, Homo sapiens
caaguccugugaauuucuuca

SEQ ID NO: 1423027 - RNA, 19 nt, Homo sapiens
caagucuucccugaucaag

SEQ ID NO: 1423028 - RNA, 20 nt, Homo sapiens
caaguguaaccuugcaucuc

SEQ ID NO: 1423029 - RNA, 18 nt, Homo sapiens
caaguguugaggggacca

SEQ ID NO: 1423030 - RNA, 20 nt, Homo sapiens
caaguuccugcacuccagaa

SEQ ID NO: 1423031 - RNA, 18 nt, Homo sapiens
caaguugcuucucaugga

SEQ ID NO: 1423032 - RNA, 21 nt, Homo sapiens
caaguuuuucagaaagcauua

SEQ ID NO: 1423033 - RNA, 22 nt, Homo sapiens
caauaaaaaaaaaccuagcauc

SEQ ID NO: 1423034 - RNA, 22 nt, Homo sapiens
caauaaagaauauuuacaauaa

SEQ ID NO: 1423035 - RNA, 19 nt, Homo sapiens
caauaaguuccauguuaaa

SEQ ID NO: 1423036 - RNA, 22 nt, Homo sapiens
caauaauauauccacaucuaag

SEQ ID NO: 1423037 - RNA, 14 nt, Homo sapiens
caauaauuucaggu

SEQ ID NO: 1423038 - RNA, 15 nt, Homo sapiens
caauacaugcugcua

SEQ ID NO: 1423039 - RNA, 16 nt, Homo sapiens
caauacaugcugcuaa

SEQ ID NO: 1423040 - RNA, 18 nt, Homo sapiens
caauacaugcugcuaauu

SEQ ID NO: 1423041 - RNA, 13 nt, Homo sapiens
caauacauguauc

SEQ ID NO: 1423042 - RNA, 14 nt, Homo sapiens
caauacauguaucu

SEQ ID NO: 1423043 - RNA, 19 nt, Homo sapiens
caauaccccuguuaagcaa

SEQ ID NO: 1423044 - RNA, 16 nt, Homo sapiens
caauacuaauugagaa

SEQ ID NO: 1423045 - RNA, 22 nt, Homo sapiens
caauagacugaagagaccacag

SEQ ID NO: 1423046 - RNA, 15 nt, Homo sapiens
caauaggcauuugau

SEQ ID NO: 1423047 - RNA, 14 nt, Homo sapiens
caauaguuugcaua

SEQ ID NO: 1423048 - RNA, 22 nt, Homo sapiens
caauaucuuuaauagguuaaua

SEQ ID NO: 1423049 - RNA, 21 nt, Homo sapiens
caauauuaaauacagacacua

SEQ ID NO: 1423050 - RNA, 17 nt, Homo sapiens
caaucagugcagugaua

SEQ ID NO: 1423051 - RNA, 21 nt, Homo sapiens
caauccaggugggagagacac

SEQ ID NO: 1423052 - RNA, 21 nt, Homo sapiens
caaucugagaagacaauaugu

SEQ ID NO: 1423053 - RNA, 16 nt, Homo sapiens
caaucugccuaggguc

SEQ ID NO: 1423054 - RNA, 13 nt, Homo sapiens
caaucuguucaau

SEQ ID NO: 1423055 - RNA, 14 nt, Homo sapiens
caaucuuguccaca

SEQ ID NO: 1423056 - RNA, 21 nt, Homo sapiens
caaucuuuccuugucucucau

SEQ ID NO: 1423057 - RNA, 22 nt, Homo sapiens
caaugaaaaaaaguacauguau

SEQ ID NO: 1423058 - RNA, 15 nt, Homo sapiens
caaugaaaccaaagc

SEQ ID NO: 1423059 - RNA, 16 nt, Homo sapiens
caaugauggcaauuuu

SEQ ID NO: 1423060 - RNA, 21 nt, Homo sapiens
caaugauuauuuucauuacaa

SEQ ID NO: 1423061 - RNA, 17 nt, Homo sapiens
caaugcaaaguaaaaaa

SEQ ID NO: 1423062 - RNA, 17 nt, Homo sapiens
caaugcacauccauucc

SEQ ID NO: 1423063 - RNA, 21 nt, Homo sapiens
caaugcuuugggaggccaagg

SEQ ID NO: 1423064 - RNA, 23 nt, Homo sapiens
caauggaaacuguaccauacaca

SEQ ID NO: 1423065 - RNA, 22 nt, Homo sapiens
caaugggagggggcuccaugga

SEQ ID NO: 1423066 - RNA, 20 nt, Homo sapiens
caauguauuugucaaugcau

SEQ ID NO: 1423067 - RNA, 18 nt, Homo sapiens
caaugugaaaaauguguc

SEQ ID NO: 1423068 - RNA, 12 nt, Homo sapiens
caauuaguacag

SEQ ID NO: 1423069 - RNA, 18 nt, Homo sapiens
caauuauuacauuuauac

SEQ ID NO: 1423070 - RNA, 12 nt, Homo sapiens
caauucauuuca

SEQ ID NO: 1423071 - RNA, 19 nt, Homo sapiens
caauucuccuguugcaaug

SEQ ID NO: 1423072 - RNA, 19 nt, Homo sapiens
caauugaccuucucccuca

SEQ ID NO: 1423073 - RNA, 19 nt, Homo sapiens
caauuuguaauugcuuaca

SEQ ID NO: 1423074 - RNA, 16 nt, Homo sapiens
caauuuguauaucaug

SEQ ID NO: 1423075 - RNA, 17 nt, Homo sapiens
cacaaaaugcaagguga

SEQ ID NO: 1423076 - RNA, 19 nt, Homo sapiens
cacaaagaagaaguuuaaa

SEQ ID NO: 1423077 - RNA, 14 nt, Homo sapiens
cacaaaucuuaacu

SEQ ID NO: 1423078 - RNA, 12 nt, Homo sapiens
cacaaauuguac

SEQ ID NO: 1423079 - RNA, 16 nt, Homo sapiens
cacaacugacacagga

SEQ ID NO: 1423080 - RNA, 13 nt, Homo sapiens
cacaagaagacca

SEQ ID NO: 1423081 - RNA, 18 nt, Homo sapiens
cacaagccacagaagcca

SEQ ID NO: 1423082 - RNA, 12 nt, Homo sapiens
cacaagcucaga

SEQ ID NO: 1423083 - RNA, 16 nt, Homo sapiens
cacaagcuuguauaua

SEQ ID NO: 1423084 - RNA, 16 nt, Homo sapiens
cacaaggucacuagau

SEQ ID NO: 1423085 - RNA, 23 nt, Homo sapiens
cacaauaauauauccacaucuaa

SEQ ID NO: 1423086 - RNA, 16 nt, Homo sapiens
cacaaugcuauugaaa

SEQ ID NO: 1423087 - RNA, 20 nt, Homo sapiens
cacaauuuagaaaacauuca

SEQ ID NO: 1423088 - RNA, 12 nt, Homo sapiens
cacacacaugga

SEQ ID NO: 1423089 - RNA, 17 nt, Homo sapiens
cacacaccgauguacac

SEQ ID NO: 1423090 - RNA, 17 nt, Homo sapiens
cacacaccgaugugcgc

SEQ ID NO: 1423091 - RNA, 22 nt, Homo sapiens
cacacaccgaugugcgcacaca

SEQ ID NO: 1423092 - RNA, 23 nt, Homo sapiens
cacacacggaugcacacacagau

SEQ ID NO: 1423093 - RNA, 11 nt, Homo sapiens
cacacauggau

SEQ ID NO: 1423094 - RNA, 17 nt, Homo sapiens
cacacauggaugagcac

SEQ ID NO: 1423095 - RNA, 17 nt, Homo sapiens
cacacauggaugcacac

SEQ ID NO: 1423096 - RNA, 18 nt, Homo sapiens
cacaccaaagucagggag

SEQ ID NO: 1423097 - RNA, 17 nt, Homo sapiens
cacaccuagcaucucau

SEQ ID NO: 1423098 - RNA, 15 nt, Homo sapiens
cacacggaugcacac

SEQ ID NO: 1423099 - RNA, 21 nt, Homo sapiens
cacacggaugcacacacagau

SEQ ID NO: 1423100 - RNA, 23 nt, Homo sapiens
cacacggaugcacagagauaugc

SEQ ID NO: 1423101 - RNA, 22 nt, Homo sapiens
cacacugauguagauaacagcu

SEQ ID NO: 1423102 - RNA, 11 nt, Homo sapiens
cacacuguaaa

SEQ ID NO: 1423103 - RNA, 13 nt, Homo sapiens
cacacuucuugaa

SEQ ID NO: 1423104 - RNA, 22 nt, Homo sapiens
cacacuuugagaaccugugcuc

SEQ ID NO: 1423105 - RNA, 15 nt, Homo sapiens
cacagacagauccca

SEQ ID NO: 1423106 - RNA, 22 nt, Homo sapiens
cacagacccacacauguuuaca

SEQ ID NO: 1423107 - RNA, 19 nt, Homo sapiens
cacagauauacacauggau

SEQ ID NO: 1423108 - RNA, 18 nt, Homo sapiens
cacagaugauaauaugcu

SEQ ID NO: 1423109 - RNA, 18 nt, Homo sapiens
cacagaugcacacacaga

SEQ ID NO: 1423110 - RNA, 20 nt, Homo sapiens
cacagauggucacacagaga

SEQ ID NO: 1423111 - RNA, 21 nt, Homo sapiens
cacagcagccccugcacaaag

SEQ ID NO: 1423112 - RNA, 15 nt, Homo sapiens
cacagcagcugaaca

SEQ ID NO: 1423113 - RNA, 20 nt, Homo sapiens
cacagcagcugaacagccaa

SEQ ID NO: 1423114 - RNA, 21 nt, Homo sapiens
cacagcuaaaauaauagauaa

SEQ ID NO: 1423115 - RNA, 13 nt, Homo sapiens
cacagguguaaau

SEQ ID NO: 1423116 - RNA, 16 nt, Homo sapiens
cacagguuuucagcaa

SEQ ID NO: 1423117 - RNA, 17 nt, Homo sapiens
cacaguacaauguuuca

SEQ ID NO: 1423118 - RNA, 20 nt, Homo sapiens
cacaguacaauguuucagaa

SEQ ID NO: 1423119 - RNA, 21 nt, Homo sapiens
cacaguccuaccucaguucaa

SEQ ID NO: 1423120 - RNA, 18 nt, Homo sapiens
cacaguuggcuggaugaa

SEQ ID NO: 1423121 - RNA, 19 nt, Homo sapiens
cacauaacuucucugaguc

SEQ ID NO: 1423122 - RNA, 12 nt, Homo sapiens
cacauacauugc

SEQ ID NO: 1423123 - RNA, 24 nt, Homo sapiens
cacauagagauaugcacacacaga

SEQ ID NO: 1423124 - RNA, 22 nt, Homo sapiens
cacaucacuacaguacagugag

SEQ ID NO: 1423125 - RNA, 22 nt, Homo sapiens
cacaucagcuuuaggacugaca

SEQ ID NO: 1423126 - RNA, 20 nt, Homo sapiens
cacauccaccccacuggauc

SEQ ID NO: 1423127 - RNA, 15 nt, Homo sapiens
cacaucccacugcca

SEQ ID NO: 1423128 - RNA, 14 nt, Homo sapiens
cacaucuaaugucu

SEQ ID NO: 1423129 - RNA, 19 nt, Homo sapiens
cacaugaggagggugcccu

SEQ ID NO: 1423130 - RNA, 17 nt, Homo sapiens
cacaugcaucaucagcc

SEQ ID NO: 1423131 - RNA, 18 nt, Homo sapiens
cacauucccaucugucac

SEQ ID NO: 1423132 - RNA, 20 nt, Homo sapiens
cacauuggaaggcucccuaa

SEQ ID NO: 1423133 - RNA, 19 nt, Homo sapiens
caccaacucugcacuccau

SEQ ID NO: 1423134 - RNA, 21 nt, Homo sapiens
caccaaguucuggaaaccacg

SEQ ID NO: 1423135 - RNA, 15 nt, Homo sapiens
caccagaaugcuaaa

SEQ ID NO: 1423136 - RNA, 15 nt, Homo sapiens
caccaugaaacuuua

SEQ ID NO: 1423137 - RNA, 18 nt, Homo sapiens
caccauguaacaaccaga

SEQ ID NO: 1423138 - RNA, 19 nt, Homo sapiens
caccauucacauuugaugu

SEQ ID NO: 1423139 - RNA, 13 nt, Homo sapiens
cacccaaagcaug

SEQ ID NO: 1423140 - RNA, 13 nt, Homo sapiens
cacccaccuccac

SEQ ID NO: 1423141 - RNA, 15 nt, Homo sapiens
cacccaggcuccaug

SEQ ID NO: 1423142 - RNA, 15 nt, Homo sapiens
cacccaggcugcacu

SEQ ID NO: 1423143 - RNA, 15 nt, Homo sapiens
cacccaugaaucaaa

SEQ ID NO: 1423144 - RNA, 16 nt, Homo sapiens
caccccucacucuggc

SEQ ID NO: 1423145 - RNA, 16 nt, Homo sapiens
caccccuuauccagga

SEQ ID NO: 1423146 - RNA, 16 nt, Homo sapiens
cacccgacuccucaaa

SEQ ID NO: 1423147 - RNA, 18 nt, Homo sapiens
cacccgccgccuccugca

SEQ ID NO: 1423148 - RNA, 16 nt, Homo sapiens
cacccucaaaugucag

SEQ ID NO: 1423149 - RNA, 18 nt, Homo sapiens
cacccuccaccucuucac

SEQ ID NO: 1423150 - RNA, 20 nt, Homo sapiens
cacccuccccugucuucucu

SEQ ID NO: 1423151 - RNA, 20 nt, Homo sapiens
cacccugaggagucugaggu

SEQ ID NO: 1423152 - RNA, 20 nt, Homo sapiens
caccgaugcacacgcacaua

SEQ ID NO: 1423153 - RNA, 14 nt, Homo sapiens
caccgcagaaggaa

SEQ ID NO: 1423154 - RNA, 12 nt, Homo sapiens
caccgugaucaa

SEQ ID NO: 1423155 - RNA, 21 nt, Homo sapiens
caccguggaccuuccugccac

SEQ ID NO: 1423156 - RNA, 18 nt, Homo sapiens
caccuacucacacaggca

SEQ ID NO: 1423157 - RNA, 12 nt, Homo sapiens
caccuagccucg

SEQ ID NO: 1423158 - RNA, 13 nt, Homo sapiens
caccucaccagaa

SEQ ID NO: 1423159 - RNA, 22 nt, Homo sapiens
caccucacgcucuggacaugau

SEQ ID NO: 1423160 - RNA, 14 nt, Homo sapiens
caccuccuagccac

SEQ ID NO: 1423161 - RNA, 13 nt, Homo sapiens
caccucuuccuuc

SEQ ID NO: 1423162 - RNA, 18 nt, Homo sapiens
caccuucaccuucaucca

SEQ ID NO: 1423163 - RNA, 14 nt, Homo sapiens
caccuucuucagcc

SEQ ID NO: 1423164 - RNA, 15 nt, Homo sapiens
caccuugccaagcuu

SEQ ID NO: 1423165 - RNA, 18 nt, Homo sapiens
caccuuuugcacauaaca

SEQ ID NO: 1423166 - RNA, 16 nt, Homo sapiens
cacgaacccaccugcu

SEQ ID NO: 1423167 - RNA, 20 nt, Homo sapiens
cacgacuguuguacaagcuc

SEQ ID NO: 1423168 - RNA, 20 nt, Homo sapiens
cacgagagagggcuuucuca

SEQ ID NO: 1423169 - RNA, 12 nt, Homo sapiens
cacgagcuauau

SEQ ID NO: 1423170 - RNA, 21 nt, Homo sapiens
cacgaucucggcucacugcac

SEQ ID NO: 1423171 - RNA, 15 nt, Homo sapiens
cacgaugucaaggac

SEQ ID NO: 1423172 - RNA, 15 nt, Homo sapiens
cacgugccugugauc

SEQ ID NO: 1423173 - RNA, 22 nt, Homo sapiens
cacuaaagggugcccacaaaau

SEQ ID NO: 1423174 - RNA, 19 nt, Homo sapiens
cacuaacccguuuuauucu

SEQ ID NO: 1423175 - RNA, 16 nt, Homo sapiens
cacuaagcuuucuccu

SEQ ID NO: 1423176 - RNA, 11 nt, Homo sapiens
cacuaauuccu

SEQ ID NO: 1423177 - RNA, 19 nt, Homo sapiens
cacuaauugacccaaaacg

SEQ ID NO: 1423178 - RNA, 17 nt, Homo sapiens
cacuagaaaacauucca

SEQ ID NO: 1423179 - RNA, 13 nt, Homo sapiens
cacuagacugugc

SEQ ID NO: 1423180 - RNA, 12 nt, Homo sapiens
cacuagcauuuu

SEQ ID NO: 1423181 - RNA, 16 nt, Homo sapiens
cacuauccucacuccc

SEQ ID NO: 1423182 - RNA, 20 nt, Homo sapiens
cacucagaaaagaaaaccau

SEQ ID NO: 1423183 - RNA, 22 nt, Homo sapiens
cacuccaccacccaaaagucaa

SEQ ID NO: 1423184 - RNA, 23 nt, Homo sapiens
cacuccacccccuccagcuccag

SEQ ID NO: 1423185 - RNA, 21 nt, Homo sapiens
cacuccagaauccacaaagcc

SEQ ID NO: 1423186 - RNA, 22 nt, Homo sapiens
cacuccagcccuguccccugaa

SEQ ID NO: 1423187 - RNA, 17 nt, Homo sapiens
cacucggcuuccaggga

SEQ ID NO: 1423188 - RNA, 23 nt, Homo sapiens
cacucuccccucccucuuccuuc

SEQ ID NO: 1423189 - RNA, 15 nt, Homo sapiens
cacucucuagcuuua

SEQ ID NO: 1423190 - RNA, 13 nt, Homo sapiens
cacucuuaugaaa

SEQ ID NO: 1423191 - RNA, 23 nt, Homo sapiens
cacugaaugccucaaugugacca

SEQ ID NO: 1423192 - RNA, 17 nt, Homo sapiens
cacugacauuauaucau

SEQ ID NO: 1423193 - RNA, 23 nt, Homo sapiens
cacugacuucuaaguaaaaccac

SEQ ID NO: 1423194 - RNA, 11 nt, Homo sapiens
cacugaucaau

SEQ ID NO: 1423195 - RNA, 20 nt, Homo sapiens
cacugcacagugcaucucag

SEQ ID NO: 1423196 - RNA, 17 nt, Homo sapiens
cacuggauauguuguua

SEQ ID NO: 1423197 - RNA, 17 nt, Homo sapiens
cacugggucucacuccu

SEQ ID NO: 1423198 - RNA, 18 nt, Homo sapiens
cacuguaaauauccacag

SEQ ID NO: 1423199 - RNA, 22 nt, Homo sapiens
cacuguaaucuuaaaaguguaa

SEQ ID NO: 1423200 - RNA, 15 nt, Homo sapiens
cacugugaagacaau

SEQ ID NO: 1423201 - RNA, 17 nt, Homo sapiens
cacugugcuuacaguga

SEQ ID NO: 1423202 - RNA, 19 nt, Homo sapiens
cacuucuaaaugaagugca

SEQ ID NO: 1423203 - RNA, 12 nt, Homo sapiens
cacuucucagga

SEQ ID NO: 1423204 - RNA, 21 nt, Homo sapiens
cacuucucuagagaacaugcc

SEQ ID NO: 1423205 - RNA, 22 nt, Homo sapiens
cacuugguuuuuggcucuuuca

SEQ ID NO: 1423206 - RNA, 20 nt, Homo sapiens
cacuuuaauucucaugugau

SEQ ID NO: 1423207 - RNA, 20 nt, Homo sapiens
cagaaaaacucugggaaaua

SEQ ID NO: 1423208 - RNA, 20 nt, Homo sapiens
cagaaaaaugggaacaaggc

SEQ ID NO: 1423209 - RNA, 16 nt, Homo sapiens
cagaaaacauaugcau

SEQ ID NO: 1423210 - RNA, 18 nt, Homo sapiens
cagaaacaaaaacacuaa

SEQ ID NO: 1423211 - RNA, 15 nt, Homo sapiens
cagaaagcauuacau

SEQ ID NO: 1423212 - RNA, 16 nt, Homo sapiens
cagaaauacugcucug

SEQ ID NO: 1423213 - RNA, 17 nt, Homo sapiens
cagaaccccuacaugaa

SEQ ID NO: 1423214 - RNA, 20 nt, Homo sapiens
cagaacuuaaggauggagcc

SEQ ID NO: 1423215 - RNA, 23 nt, Homo sapiens
cagaagaaaaaguugcagucuca

SEQ ID NO: 1423216 - RNA, 18 nt, Homo sapiens
cagaagaauauucaggac

SEQ ID NO: 1423217 - RNA, 15 nt, Homo sapiens
cagaagcacauauga

SEQ ID NO: 1423218 - RNA, 23 nt, Homo sapiens
cagaagcagguucuugaugucau

SEQ ID NO: 1423219 - RNA, 22 nt, Homo sapiens
cagaauaauucuuccagugcaa

SEQ ID NO: 1423220 - RNA, 16 nt, Homo sapiens
cagaauacaagccacu

SEQ ID NO: 1423221 - RNA, 19 nt, Homo sapiens
cagaaugcgcaagggcaaa

SEQ ID NO: 1423222 - RNA, 14 nt, Homo sapiens
cagaauugugcaaa

SEQ ID NO: 1423223 - RNA, 16 nt, Homo sapiens
cagacaaguaaucacu

SEQ ID NO: 1423224 - RNA, 12 nt, Homo sapiens
cagacacauucu

SEQ ID NO: 1423225 - RNA, 16 nt, Homo sapiens
cagacacuaaguuaua

SEQ ID NO: 1423226 - RNA, 23 nt, Homo sapiens
cagacacugccgggccucccucc

SEQ ID NO: 1423227 - RNA, 11 nt, Homo sapiens
cagacacugug

SEQ ID NO: 1423228 - RNA, 18 nt, Homo sapiens
cagacagcaggcuggagc

SEQ ID NO: 1423229 - RNA, 22 nt, Homo sapiens
cagacaggaggaaucaugucag

SEQ ID NO: 1423230 - RNA, 14 nt, Homo sapiens
cagaccacucccuu

SEQ ID NO: 1423231 - RNA, 14 nt, Homo sapiens
cagaccaguacugg

SEQ ID NO: 1423232 - RNA, 17 nt, Homo sapiens
cagaccaguacugggaa

SEQ ID NO: 1423233 - RNA, 16 nt, Homo sapiens
cagaccauccaccagg

SEQ ID NO: 1423234 - RNA, 19 nt, Homo sapiens
cagacggcggggggcagca

SEQ ID NO: 1423235 - RNA, 18 nt, Homo sapiens
cagacgucucaagacuga

SEQ ID NO: 1423236 - RNA, 19 nt, Homo sapiens
cagacucagacuccauuug

SEQ ID NO: 1423237 - RNA, 15 nt, Homo sapiens
cagacuccugugcaa

SEQ ID NO: 1423238 - RNA, 18 nt, Homo sapiens
cagacuccugugcaacuu

SEQ ID NO: 1423239 - RNA, 15 nt, Homo sapiens
cagacuguugcacuc

SEQ ID NO: 1423240 - RNA, 13 nt, Homo sapiens
cagacuuaaauca

SEQ ID NO: 1423241 - RNA, 14 nt, Homo sapiens
cagacuuuaccacu

SEQ ID NO: 1423242 - RNA, 22 nt, Homo sapiens
cagagaagauaauguucuuuaa

SEQ ID NO: 1423243 - RNA, 13 nt, Homo sapiens
cagagacagagag

SEQ ID NO: 1423244 - RNA, 16 nt, Homo sapiens
cagagacaggaaaauc

SEQ ID NO: 1423245 - RNA, 18 nt, Homo sapiens
cagagacaggcccaagag

SEQ ID NO: 1423246 - RNA, 20 nt, Homo sapiens
cagagacaggcccaagagau

SEQ ID NO: 1423247 - RNA, 15 nt, Homo sapiens
cagagaccugaggca

SEQ ID NO: 1423248 - RNA, 21 nt, Homo sapiens
caggacuuugaugcauuucca

SEQ ID NO: 1423249 - RNA, 18 nt, Homo sapiens
caggagaauggugugaac

SEQ ID NO: 1423250 - RNA, 19 nt, Homo sapiens
caggagaauggugugaacc

SEQ ID NO: 1423251 - RNA, 17 nt, Homo sapiens
caggagaucgagaccau

SEQ ID NO: 1423252 - RNA, 20 nt, Homo sapiens
caggaggcggagguugcagu

SEQ ID NO: 1423253 - RNA, 21 nt, Homo sapiens
caggagggguuaaagcugccg

SEQ ID NO: 1423254 - RNA, 18 nt, Homo sapiens
caggagguuggugacuga

SEQ ID NO: 1423255 - RNA, 15 nt, Homo sapiens
caggagguuguggau

SEQ ID NO: 1423256 - RNA, 19 nt, Homo sapiens
caggaguagcugagcucac

SEQ ID NO: 1423257 - RNA, 17 nt, Homo sapiens
caggauaagagggauua

SEQ ID NO: 1423258 - RNA, 15 nt, Homo sapiens
caggauacucuguca

SEQ ID NO: 1423259 - RNA, 23 nt, Homo sapiens
caggaucacaagaaucaccucaa

SEQ ID NO: 1423260 - RNA, 16 nt, Homo sapiens
caggaucccucccaga

SEQ ID NO: 1423261 - RNA, 23 nt, Homo sapiens
caggcacgaacccaccugcugag

SEQ ID NO: 1423262 - RNA, 13 nt, Homo sapiens
caggcagccccac

SEQ ID NO: 1423263 - RNA, 19 nt, Homo sapiens
caggcaggcccugccuuca

SEQ ID NO: 1423264 - RNA, 23 nt, Homo sapiens
caggccagggaaagcccguguca

SEQ ID NO: 1423265 - RNA, 18 nt, Homo sapiens
caggccauccauucacag

SEQ ID NO: 1423266 - RNA, 13 nt, Homo sapiens
caggccccaugac

SEQ ID NO: 1423267 - RNA, 18 nt, Homo sapiens
caggcccuuccucuccac

SEQ ID NO: 1423268 - RNA, 21 nt, Homo sapiens
caggcccuuccucuccacugc

SEQ ID NO: 1423269 - RNA, 15 nt, Homo sapiens
caggccggguggcca

SEQ ID NO: 1423270 - RNA, 14 nt, Homo sapiens
caggccucccucaa

SEQ ID NO: 1423271 - RNA, 16 nt, Homo sapiens
caggcucauaugcguc

SEQ ID NO: 1423272 - RNA, 14 nt, Homo sapiens
caggcucggagcca

SEQ ID NO: 1423273 - RNA, 21 nt, Homo sapiens
caggcucuggagccagagaga

SEQ ID NO: 1423274 - RNA, 13 nt, Homo sapiens
caggcucuucucc

SEQ ID NO: 1423275 - RNA, 14 nt, Homo sapiens
caggcuggagccca

SEQ ID NO: 1423276 - RNA, 16 nt, Homo sapiens
caggcuggagugcagu

SEQ ID NO: 1423277 - RNA, 17 nt, Homo sapiens
caggcugggauggagca

SEQ ID NO: 1423278 - RNA, 20 nt, Homo sapiens
caggcugggauggagcacuu

SEQ ID NO: 1423279 - RNA, 17 nt, Homo sapiens
caggcuucggacagugc

SEQ ID NO: 1423280 - RNA, 18 nt, Homo sapiens
cagggaaagcccguguca

SEQ ID NO: 1423281 - RNA, 19 nt, Homo sapiens
cagggaacaagcauucucc

SEQ ID NO: 1423282 - RNA, 13 nt, Homo sapiens
cagggaagaaggu

SEQ ID NO: 1423283 - RNA, 21 nt, Homo sapiens
cagggacaaaacacugugucc

SEQ ID NO: 1423284 - RNA, 19 nt, Homo sapiens
cagggagaccgagcgcuuu

SEQ ID NO: 1423285 - RNA, 15 nt, Homo sapiens
cagggagcagggcag

SEQ ID NO: 1423286 - RNA, 13 nt, Homo sapiens
cagggagcccuuu

SEQ ID NO: 1423287 - RNA, 20 nt, Homo sapiens
cagggaugccaacaccuucu

SEQ ID NO: 1423288 - RNA, 20 nt, Homo sapiens
cagggccucugggagccuga

SEQ ID NO: 1423289 - RNA, 22 nt, Homo sapiens
caggggcaaagaacugccccau

SEQ ID NO: 1423290 - RNA, 20 nt, Homo sapiens
cagggggugugucugcucag

SEQ ID NO: 1423291 - RNA, 21 nt, Homo sapiens
caggggucgucaccaccucuc

SEQ ID NO: 1423292 - RNA, 18 nt, Homo sapiens
caggguccgcaccagcug

SEQ ID NO: 1423293 - RNA, 23 nt, Homo sapiens
caggguuuacccagugggacaga

SEQ ID NO: 1423294 - RNA, 22 nt, Homo sapiens
cagguaggcccuuguccugcca

SEQ ID NO: 1423295 - RNA, 17 nt, Homo sapiens
caggucaucuccuuuca

SEQ ID NO: 1423296 - RNA, 15 nt, Homo sapiens
caggucaugcugcug

SEQ ID NO: 1423297 - RNA, 14 nt, Homo sapiens
caggucuagacuuu

SEQ ID NO: 1423298 - RNA, 14 nt, Homo sapiens
caggugagcaauua

SEQ ID NO: 1423299 - RNA, 15 nt, Homo sapiens
caggugccuaccacc

SEQ ID NO: 1423300 - RNA, 17 nt, Homo sapiens
caggugcgcacuaccac

SEQ ID NO: 1423301 - RNA, 13 nt, Homo sapiens
cagguguaccucc

SEQ ID NO: 1423302 - RNA, 20 nt, Homo sapiens
cagguguugccauuucucug

SEQ ID NO: 1423303 - RNA, 15 nt, Homo sapiens
cagguuagccuuugc

SEQ ID NO: 1423304 - RNA, 15 nt, Homo sapiens
cagguuggaguguaa

SEQ ID NO: 1423305 - RNA, 16 nt, Homo sapiens
caguaaaaacuuguac

SEQ ID NO: 1423306 - RNA, 18 nt, Homo sapiens
caguaaauccacagccaa

SEQ ID NO: 1423307 - RNA, 19 nt, Homo sapiens
caguaaugggggaccagcu

SEQ ID NO: 1423308 - RNA, 18 nt, Homo sapiens
caguaggaacuguacaug

SEQ ID NO: 1423309 - RNA, 20 nt, Homo sapiens
caguaggcaguagacuauaa

SEQ ID NO: 1423310 - RNA, 13 nt, Homo sapiens
caguagugcauug

SEQ ID NO: 1423311 - RNA, 15 nt, Homo sapiens
caguauggaagggag

SEQ ID NO: 1423312 - RNA, 17 nt, Homo sapiens
cagucacccuucugggc

SEQ ID NO: 1423313 - RNA, 17 nt, Homo sapiens
cagucauuggguuuuau

SEQ ID NO: 1423314 - RNA, 15 nt, Homo sapiens
caguccccagcccuu

SEQ ID NO: 1423315 - RNA, 13 nt, Homo sapiens
cagucucccauuc

SEQ ID NO: 1423316 - RNA, 13 nt, Homo sapiens
cagucugagcugu

SEQ ID NO: 1423317 - RNA, 18 nt, Homo sapiens
cagugaagggaguggcag

SEQ ID NO: 1423318 - RNA, 17 nt, Homo sapiens
cagugacuuuagaaaca

SEQ ID NO: 1423319 - RNA, 23 nt, Homo sapiens
cagugauauaugccuauaauaua

SEQ ID NO: 1423320 - RNA, 19 nt, Homo sapiens
cagugauuugccaaaguga

SEQ ID NO: 1423321 - RNA, 15 nt, Homo sapiens
cagugcccacagcca

SEQ ID NO: 1423322 - RNA, 18 nt, Homo sapiens
cagugccuccugggacca

SEQ ID NO: 1423323 - RNA, 22 nt, Homo sapiens
cagugccuccugggaccaugga

SEQ ID NO: 1423324 - RNA, 17 nt, Homo sapiens
cagugcuauuuugugcc

SEQ ID NO: 1423325 - RNA, 23 nt, Homo sapiens
caguggggacggaaggcaaagag

SEQ ID NO: 1423326 - RNA, 15 nt, Homo sapiens
caguggugugaucuu

SEQ ID NO: 1423327 - RNA, 18 nt, Homo sapiens
caguguuccccaucuggg

SEQ ID NO: 1423328 - RNA, 14 nt, Homo sapiens
caguuaacucuccc

SEQ ID NO: 1423329 - RNA, 12 nt, Homo sapiens
caguuacagggc

SEQ ID NO: 1423330 - RNA, 16 nt, Homo sapiens
caguucaguuccucuu

SEQ ID NO: 1423331 - RNA, 16 nt, Homo sapiens
caguuccuccaagagg

SEQ ID NO: 1423332 - RNA, 18 nt, Homo sapiens
caguuccugaguaccuuc

SEQ ID NO: 1423333 - RNA, 23 nt, Homo sapiens
caucugcacuaauugacccaaaa

SEQ ID NO: 1423334 - RNA, 12 nt, Homo sapiens
caucuguacuca

SEQ ID NO: 1423335 - RNA, 14 nt, Homo sapiens
caucuucucagugu

SEQ ID NO: 1423336 - RNA, 15 nt, Homo sapiens
caucuucuccaucug

SEQ ID NO: 1423337 - RNA, 21 nt, Homo sapiens
caucuuucuucuauuuuauuc

SEQ ID NO: 1423338 - RNA, 16 nt, Homo sapiens
caugaacacacaugga

SEQ ID NO: 1423339 - RNA, 17 nt, Homo sapiens
caugaacacacauggau

SEQ ID NO: 1423340 - RNA, 22 nt, Homo sapiens
caugaacacacauggaugcaca

SEQ ID NO: 1423341 - RNA, 16 nt, Homo sapiens
caugacacucuaguga

SEQ ID NO: 1423342 - RNA, 14 nt, Homo sapiens
caugacacugaccu

SEQ ID NO: 1423343 - RNA, 18 nt, Homo sapiens
caugacacugaccuugga

SEQ ID NO: 1423344 - RNA, 20 nt, Homo sapiens
caugacucagcauaccugcu

SEQ ID NO: 1423345 - RNA, 17 nt, Homo sapiens
caugacuuuuccaugua

SEQ ID NO: 1423346 - RNA, 15 nt, Homo sapiens
caugaugaauuacuu

SEQ ID NO: 1423347 - RNA, 14 nt, Homo sapiens
caugauggugcuga

SEQ ID NO: 1423348 - RNA, 16 nt, Homo sapiens
caugauuuuauacaua

SEQ ID NO: 1423349 - RNA, 16 nt, Homo sapiens
cccuguccccugaaaa

SEQ ID NO: 1423350 - RNA, 14 nt, Homo sapiens
cccuguuaagcaau

SEQ ID NO: 1423351 - RNA, 22 nt, Homo sapiens
cccuuauccaggacucugucaa

SEQ ID NO: 1423352 - RNA, 17 nt, Homo sapiens
cccuucacauacccucc

SEQ ID NO: 1423353 - RNA, 16 nt, Homo sapiens
cccuucccaaucagca

SEQ ID NO: 1423354 - RNA, 13 nt, Homo sapiens
cccuucuucccua

SEQ ID NO: 1423355 - RNA, 21 nt, Homo sapiens
cccuucuuuaaaucaaaagcu

SEQ ID NO: 1423356 - RNA, 13 nt, Homo sapiens
cccuugaaccagc

SEQ ID NO: 1423357 - RNA, 16 nt, Homo sapiens
cccuuggagccaaugg

SEQ ID NO: 1423358 - RNA, 23 nt, Homo sapiens
cccuuuagggaaauucaaagcag

SEQ ID NO: 1423359 - RNA, 13 nt, Homo sapiens
cccuuuccacgag

SEQ ID NO: 1423360 - RNA, 21 nt, Homo sapiens
cccuuuuccuccagacagaua

SEQ ID NO: 1423361 - RNA, 13 nt, Homo sapiens
ccgaagcccaguu

SEQ ID NO: 1423362 - RNA, 23 nt, Homo sapiens
ccgagcccagcuacauuccucag

SEQ ID NO: 1423363 - RNA, 18 nt, Homo sapiens
ccgagcuagagugcagug

SEQ ID NO: 1423364 - RNA, 15 nt, Homo sapiens
ccgagucucuucucc

SEQ ID NO: 1423365 - RNA, 21 nt, Homo sapiens
ccgcaccgggcccuccuugcc

SEQ ID NO: 1423366 - RNA, 13 nt, Homo sapiens
ccgcuugccauau

SEQ ID NO: 1423367 - RNA, 19 nt, Homo sapiens
ccgggaccauugaccucag

SEQ ID NO: 1423368 - RNA, 19 nt, Homo sapiens
ccgggcaagcacuaccagg

SEQ ID NO: 1423369 - RNA, 16 nt, Homo sapiens
ccggggguggugacau

SEQ ID NO: 1423370 - RNA, 14 nt, Homo sapiens
ccgucccucaguga

SEQ ID NO: 1423371 - RNA, 20 nt, Homo sapiens
ccgugaaauugaugccagug

SEQ ID NO: 1423372 - RNA, 16 nt, Homo sapiens
ccgugcaguacaggca

SEQ ID NO: 1423373 - RNA, 16 nt, Homo sapiens
ccgugcuaacugugug

SEQ ID NO: 1423374 - RNA, 18 nt, Homo sapiens
ccguucgcccccauguga

SEQ ID NO: 1423375 - RNA, 21 nt, Homo sapiens
ccuaaauguggacaucaugaa

SEQ ID NO: 1423376 - RNA, 18 nt, Homo sapiens
ccuaaggacacacuaauc

SEQ ID NO: 1423377 - RNA, 15 nt, Homo sapiens
ccuaaggaucucuca

SEQ ID NO: 1423378 - RNA, 18 nt, Homo sapiens
ccuaagggccacauccca

SEQ ID NO: 1423379 - RNA, 17 nt, Homo sapiens
ccuaauacaacauguag

SEQ ID NO: 1423380 - RNA, 20 nt, Homo sapiens
ccuaaucaggcugagguguc

SEQ ID NO: 1423381 - RNA, 16 nt, Homo sapiens
ccuacauugaggagcu

SEQ ID NO: 1423382 - RNA, 14 nt, Homo sapiens
ccuacccucacuca

SEQ ID NO: 1423383 - RNA, 13 nt, Homo sapiens
ccuacuacuuugu

SEQ ID NO: 1423384 - RNA, 21 nt, Homo sapiens
ccuacucagacuguugcacuc

SEQ ID NO: 1423385 - RNA, 15 nt, Homo sapiens
ccuacugaaugcucu

SEQ ID NO: 1423386 - RNA, 11 nt, Homo sapiens
ccuacugccuc

SEQ ID NO: 1423387 - RNA, 16 nt, Homo sapiens
ccuagaacugugccua

SEQ ID NO: 1423388 - RNA, 16 nt, Homo sapiens
ccuagacauaguucag

SEQ ID NO: 1423389 - RNA, 19 nt, Homo sapiens
ccuaggagaagcagccucc

SEQ ID NO: 1423390 - RNA, 13 nt, Homo sapiens
ccuauaaauauua

SEQ ID NO: 1423391 - RNA, 21 nt, Homo sapiens
ccuauggagagcccugggacc

SEQ ID NO: 1423392 - RNA, 23 nt, Homo sapiens
ccuaugucaauuuguauaucaug

SEQ ID NO: 1423393 - RNA, 16 nt, Homo sapiens
ccuauuuauucauuca

SEQ ID NO: 1423394 - RNA, 20 nt, Homo sapiens
ccuauuuauuggggugccua

SEQ ID NO: 1423395 - RNA, 23 nt, Homo sapiens
ccucaaacuccuggacucaugca

SEQ ID NO: 1423396 - RNA, 17 nt, Homo sapiens
ccucaagugauccaccu

SEQ ID NO: 1423397 - RNA, 13 nt, Homo sapiens
ccucaaugugacc

SEQ ID NO: 1423398 - RNA, 14 nt, Homo sapiens
ccucacuguguugg

SEQ ID NO: 1423399 - RNA, 17 nt, Homo sapiens
ccucagagcucuuaugu

SEQ ID NO: 1423400 - RNA, 14 nt, Homo sapiens
ccucagaugaucuc

SEQ ID NO: 1423401 - RNA, 14 nt, Homo sapiens
ccucagccaaacac

SEQ ID NO: 1423402 - RNA, 23 nt, Homo sapiens
ccucagggaguuugacgagcuca

SEQ ID NO: 1423403 - RNA, 15 nt, Homo sapiens
ccucagguaguacug

SEQ ID NO: 1423404 - RNA, 18 nt, Homo sapiens
ccucagguaguacuggga

SEQ ID NO: 1423405 - RNA, 16 nt, Homo sapiens
ccucauggucauggac

SEQ ID NO: 1423406 - RNA, 14 nt, Homo sapiens
ccuccaaagcccau

SEQ ID NO: 1423407 - RNA, 12 nt, Homo sapiens
ccuccaccuacc

SEQ ID NO: 1423408 - RNA, 14 nt, Homo sapiens
ccuccagcuuuccu

SEQ ID NO: 1423409 - RNA, 12 nt, Homo sapiens
ccuccauucuga

SEQ ID NO: 1423410 - RNA, 17 nt, Homo sapiens
ccuccauucugaccauu

SEQ ID NO: 1423411 - RNA, 13 nt, Homo sapiens
ccuccgucaggag

SEQ ID NO: 1423412 - RNA, 14 nt, Homo sapiens
ccuucacagugacc

SEQ ID NO: 1423413 - RNA, 12 nt, Homo sapiens
ccuucaccuuca

SEQ ID NO: 1423414 - RNA, 12 nt, Homo sapiens
ccuucaugauga

SEQ ID NO: 1423415 - RNA, 19 nt, Homo sapiens
ccuucccaaucagcacuga

SEQ ID NO: 1423416 - RNA, 23 nt, Homo sapiens
ccuuccuccccagucuacguucu

SEQ ID NO: 1423417 - RNA, 14 nt, Homo sapiens
ccuucgguuuguau

SEQ ID NO: 1423418 - RNA, 12 nt, Homo sapiens
ccuucucuucuc

SEQ ID NO: 1423419 - RNA, 18 nt, Homo sapiens
ccuucugcacccagaaau

SEQ ID NO: 1423420 - RNA, 18 nt, Homo sapiens
ccuucugcuguauacugu

SEQ ID NO: 1423421 - RNA, 14 nt, Homo sapiens
ccuucuguggcuca

SEQ ID NO: 1423422 - RNA, 19 nt, Homo sapiens
ccuucuuggcuucugggac

SEQ ID NO: 1423423 - RNA, 19 nt, Homo sapiens
ccuucuuucucuucccucc

SEQ ID NO: 1423424 - RNA, 23 nt, Homo sapiens
ccuugacauuguagagcuucugg

SEQ ID NO: 1423425 - RNA, 13 nt, Homo sapiens
ccuugcccagaga

SEQ ID NO: 1423426 - RNA, 13 nt, Homo sapiens
ccuuggccgugag

SEQ ID NO: 1423427 - RNA, 23 nt, Homo sapiens
ccuuggccucccaaagugcuagu

SEQ ID NO: 1423428 - RNA, 13 nt, Homo sapiens
ccuuggcugugag

SEQ ID NO: 1423429 - RNA, 19 nt, Homo sapiens
ccuugggagguuuuauucu

SEQ ID NO: 1423430 - RNA, 12 nt, Homo sapiens
ccuuggggccug

SEQ ID NO: 1423431 - RNA, 16 nt, Homo sapiens
ccuuguaaacaugaag

SEQ ID NO: 1423432 - RNA, 17 nt, Homo sapiens
ccuuguccugccagcug

SEQ ID NO: 1423433 - RNA, 21 nt, Homo sapiens
ccuuguguacaguuauuuaug

SEQ ID NO: 1423434 - RNA, 20 nt, Homo sapiens
ccuuuacauaauugcaauau

SEQ ID NO: 1423435 - RNA, 13 nt, Homo sapiens
ccuuuaccuacca

SEQ ID NO: 1423436 - RNA, 22 nt, Homo sapiens
ccuuuagauauuauucauucau

SEQ ID NO: 1423437 - RNA, 22 nt, Homo sapiens
ccuuucaaauuuuuacugagaa

SEQ ID NO: 1423438 - RNA, 15 nt, Homo sapiens
cuaacccccagugcc

SEQ ID NO: 1423439 - RNA, 17 nt, Homo sapiens
cuaacuguaaaucacuu

SEQ ID NO: 1423440 - RNA, 19 nt, Homo sapiens
cuaagaaaauuauguauuu

SEQ ID NO: 1423441 - RNA, 12 nt, Homo sapiens
cuaagagaucug

SEQ ID NO: 1423442 - RNA, 15 nt, Homo sapiens
cuaagaggcagugag

SEQ ID NO: 1423443 - RNA, 15 nt, Homo sapiens
cuaagcaaaaccacu

SEQ ID NO: 1423444 - RNA, 21 nt, Homo sapiens
cuaagccacucuuccaaaggc

SEQ ID NO: 1423445 - RNA, 22 nt, Homo sapiens
cuaagcgaauguguacaaagug

SEQ ID NO: 1423446 - RNA, 14 nt, Homo sapiens
cuaaggaucucuca

SEQ ID NO: 1423447 - RNA, 22 nt, Homo sapiens
cuaauagagugguacagcacug

SEQ ID NO: 1423448 - RNA, 14 nt, Homo sapiens
cuaauauggcaaaa

SEQ ID NO: 1423449 - RNA, 16 nt, Homo sapiens
cuaaucagcauucuca

SEQ ID NO: 1423450 - RNA, 15 nt, Homo sapiens
cuaaucagcucccuu

SEQ ID NO: 1423451 - RNA, 21 nt, Homo sapiens
cuaaucuaugcauguauguag

SEQ ID NO: 1423452 - RNA, 21 nt, Homo sapiens
cuaaucuucuuaugcaauuuc

SEQ ID NO: 1423453 - RNA, 20 nt, Homo sapiens
cuaaugguauauauuguagg

SEQ ID NO: 1423454 - RNA, 15 nt, Homo sapiens
cuaauguaugcauuc

SEQ ID NO: 1423455 - RNA, 22 nt, Homo sapiens
cuaauuccuggcaugacacucu

SEQ ID NO: 1423456 - RNA, 23 nt, Homo sapiens
cuacaaacucccacuugucaugu

SEQ ID NO: 1423457 - RNA, 20 nt, Homo sapiens
cuacacaguaaaaacuugua

SEQ ID NO: 1423458 - RNA, 22 nt, Homo sapiens
cuacaccacucuggcagccaca

SEQ ID NO: 1423459 - RNA, 20 nt, Homo sapiens
cuacacccuuggacuugagg

SEQ ID NO: 1423460 - RNA, 16 nt, Homo sapiens
cuacaguggcugucac

SEQ ID NO: 1423461 - RNA, 22 nt, Homo sapiens
cuacaguggcugucacgcagcc

SEQ ID NO: 1423462 - RNA, 21 nt, Homo sapiens
cuacauauucuuuaaauuuca

SEQ ID NO: 1423463 - RNA, 17 nt, Homo sapiens
cuaccaguuggccauga

SEQ ID NO: 1423464 - RNA, 19 nt, Homo sapiens
cuaccaucuaaucuaugca

SEQ ID NO: 1423465 - RNA, 23 nt, Homo sapiens
cuaccaucuaaucuaugcaugua

SEQ ID NO: 1423466 - RNA, 17 nt, Homo sapiens
cuaccugaggccuaucu

SEQ ID NO: 1423467 - RNA, 23 nt, Homo sapiens
cuaccugcccucucucaguuauu

SEQ ID NO: 1423468 - RNA, 20 nt, Homo sapiens
cuaccugcugcugcuauuau

SEQ ID NO: 1423469 - RNA, 20 nt, Homo sapiens
cuaccuguguucauucuuac

SEQ ID NO: 1423470 - RNA, 23 nt, Homo sapiens
cuaccuguuacuauuaucugugc

SEQ ID NO: 1423471 - RNA, 14 nt, Homo sapiens
cuacgccaaagugc

SEQ ID NO: 1423472 - RNA, 17 nt, Homo sapiens
cuacuacccgagcccag

SEQ ID NO: 1423473 - RNA, 23 nt, Homo sapiens
cuacucaggaggcugaggcagaa

SEQ ID NO: 1423474 - RNA, 19 nt, Homo sapiens
cuacucgggaggcugaggc

SEQ ID NO: 1423475 - RNA, 13 nt, Homo sapiens
cuacucuauguau

SEQ ID NO: 1423476 - RNA, 20 nt, Homo sapiens
cuacucuauguaugcaucua

SEQ ID NO: 1423477 - RNA, 20 nt, Homo sapiens
cuacugcuagauaucacuua

SEQ ID NO: 1423478 - RNA, 13 nt, Homo sapiens
cuacuggcauuaa

SEQ ID NO: 1423479 - RNA, 13 nt, Homo sapiens
cuacuucagucuu

SEQ ID NO: 1423480 - RNA, 14 nt, Homo sapiens
cuacuucccuuucc

SEQ ID NO: 1423481 - RNA, 23 nt, Homo sapiens
cuacuucuuggaaaaaaauuaca

SEQ ID NO: 1423482 - RNA, 18 nt, Homo sapiens
cuacuugccacacacugu

SEQ ID NO: 1423483 - RNA, 19 nt, Homo sapiens
cuacuugggaggcugaggc

SEQ ID NO: 1423484 - RNA, 19 nt, Homo sapiens
cuagaacaugcacauuuau

SEQ ID NO: 1423485 - RNA, 13 nt, Homo sapiens
cuagaaccuggag

SEQ ID NO: 1423486 - RNA, 18 nt, Homo sapiens
cuagaaccuggagagcua

SEQ ID NO: 1423487 - RNA, 12 nt, Homo sapiens
cuagaaugcaca

SEQ ID NO: 1423488 - RNA, 15 nt, Homo sapiens
cuagagaacaugccc

SEQ ID NO: 1423489 - RNA, 18 nt, Homo sapiens
cuagagcugagagucuga

SEQ ID NO: 1423490 - RNA, 18 nt, Homo sapiens
cuagaggugagaccaaag

SEQ ID NO: 1423491 - RNA, 14 nt, Homo sapiens
cuagaucaauuaau

SEQ ID NO: 1423492 - RNA, 20 nt, Homo sapiens
cuagaugugcaaaugcaagc

SEQ ID NO: 1423493 - RNA, 15 nt, Homo sapiens
cuagcaauuccauca

SEQ ID NO: 1423494 - RNA, 16 nt, Homo sapiens
cuccacagugcugcuu

SEQ ID NO: 1423495 - RNA, 19 nt, Homo sapiens
cuccacaguuuugccuuaa

SEQ ID NO: 1423496 - RNA, 12 nt, Homo sapiens
cuccacauccac

SEQ ID NO: 1423497 - RNA, 14 nt, Homo sapiens
cuccaccucuccuu

SEQ ID NO: 1423498 - RNA, 15 nt, Homo sapiens
cuccacucacuccag

SEQ ID NO: 1423499 - RNA, 12 nt, Homo sapiens
cuccacugucac

SEQ ID NO: 1423500 - RNA, 13 nt, Homo sapiens
cuccagaggccaa

SEQ ID NO: 1423501 - RNA, 16 nt, Homo sapiens
cuccagcauccugcuu

SEQ ID NO: 1423502 - RNA, 14 nt, Homo sapiens
cuccaggaaugccu

SEQ ID NO: 1423503 - RNA, 19 nt, Homo sapiens
cuccaggauugaagagcau

SEQ ID NO: 1423504 - RNA, 22 nt, Homo sapiens
cuccagucuccugacauuaaga

SEQ ID NO: 1423505 - RNA, 17 nt, Homo sapiens
cuccauauuuauuuaaa

SEQ ID NO: 1423506 - RNA, 13 nt, Homo sapiens
cuccaucauggca

SEQ ID NO: 1423507 - RNA, 21 nt, Homo sapiens
cuccaucauggcagugaugaa

SEQ ID NO: 1423508 - RNA, 19 nt, Homo sapiens
cuccaugcugccuccagaa

SEQ ID NO: 1423509 - RNA, 23 nt, Homo sapiens
cuccauggccaccccgugccacc

SEQ ID NO: 1423510 - RNA, 20 nt, Homo sapiens
cuccauugcuguuguugcag

SEQ ID NO: 1423511 - RNA, 14 nt, Homo sapiens
cucccaaaauacua

SEQ ID NO: 1423512 - RNA, 16 nt, Homo sapiens
cucccaaagugcuagu

SEQ ID NO: 1423513 - RNA, 19 nt, Homo sapiens
cucccaaagugcugggauu

SEQ ID NO: 1423514 - RNA, 19 nt, Homo sapiens
cucccaaauugcugggauu

SEQ ID NO: 1423515 - RNA, 14 nt, Homo sapiens
cucccaaccucaau

SEQ ID NO: 1423516 - RNA, 20 nt, Homo sapiens
cucccaaggugcuaggauua

SEQ ID NO: 1423517 - RNA, 14 nt, Homo sapiens
cucccacuauggug

SEQ ID NO: 1423518 - RNA, 16 nt, Homo sapiens
cucccaguucuacaag

SEQ ID NO: 1423519 - RNA, 21 nt, Homo sapiens
cucccaucucuaccccaaaga

SEQ ID NO: 1423520 - RNA, 15 nt, Homo sapiens
cuccccacucuaggg

SEQ ID NO: 1423521 - RNA, 14 nt, Homo sapiens
cuccccccacugca

SEQ ID NO: 1423522 - RNA, 19 nt, Homo sapiens
cuccccucugcccuguaua

SEQ ID NO: 1423523 - RNA, 20 nt, Homo sapiens
cucccuaaggaaucugaaag

SEQ ID NO: 1423524 - RNA, 22 nt, Homo sapiens
cucccuauuaaccuagagauug

SEQ ID NO: 1423525 - RNA, 14 nt, Homo sapiens
cucccuccagggaa

SEQ ID NO: 1423526 - RNA, 15 nt, Homo sapiens
cucccucccagagaa

SEQ ID NO: 1423527 - RNA, 17 nt, Homo sapiens
cucccucuccauaucuc

SEQ ID NO: 1423528 - RNA, 20 nt, Homo sapiens
cugacaccgucccucaguga

SEQ ID NO: 1423529 - RNA, 18 nt, Homo sapiens
cugacagauacauagaug

SEQ ID NO: 1423530 - RNA, 15 nt, Homo sapiens
cugacagguucccag

SEQ ID NO: 1423531 - RNA, 19 nt, Homo sapiens
cugacaucuccucuaucac

SEQ ID NO: 1423532 - RNA, 19 nt, Homo sapiens
cugacaugcaucaucucau

SEQ ID NO: 1423533 - RNA, 13 nt, Homo sapiens
cugaccccaaaga

SEQ ID NO: 1423534 - RNA, 19 nt, Homo sapiens
cugaccucaagugauccac

SEQ ID NO: 1423535 - RNA, 13 nt, Homo sapiens
cugacuaccagcu

SEQ ID NO: 1423536 - RNA, 12 nt, Homo sapiens
cugacuagucau

SEQ ID NO: 1423537 - RNA, 20 nt, Homo sapiens
cugacucacaagaagaccag

SEQ ID NO: 1423538 - RNA, 16 nt, Homo sapiens
cugacuguacuccucc

SEQ ID NO: 1423539 - RNA, 15 nt, Homo sapiens
cugagaaacuuccuu

SEQ ID NO: 1423540 - RNA, 21 nt, Homo sapiens
cugagacggcagagaccccag

SEQ ID NO: 1423541 - RNA, 14 nt, Homo sapiens
cugagcaguaccag

SEQ ID NO: 1423542 - RNA, 16 nt, Homo sapiens
cugagcaguaccagug

SEQ ID NO: 1423543 - RNA, 15 nt, Homo sapiens
cugagccaaacacac

SEQ ID NO: 1423544 - RNA, 20 nt, Homo sapiens
cugagccaaacacacuguaa

SEQ ID NO: 1423545 - RNA, 22 nt, Homo sapiens
cugagccaaacacacuguaaau

SEQ ID NO: 1423546 - RNA, 19 nt, Homo sapiens
cugaggaagaagggauaau

SEQ ID NO: 1423547 - RNA, 15 nt, Homo sapiens
cugaggacucaaggg

SEQ ID NO: 1423548 - RNA, 16 nt, Homo sapiens
cugaggcuuccagaga

SEQ ID NO: 1423549 - RNA, 15 nt, Homo sapiens
cugaggucacugggu

SEQ ID NO: 1423550 - RNA, 15 nt, Homo sapiens
cugagugcaccacuu

SEQ ID NO: 1423551 - RNA, 22 nt, Homo sapiens
cugagugcaccacuucaaguga

SEQ ID NO: 1423552 - RNA, 15 nt, Homo sapiens
cugaguggcuuguga

SEQ ID NO: 1423553 - RNA, 21 nt, Homo sapiens
cugaguuugcuguuugcaauu

SEQ ID NO: 1423554 - RNA, 17 nt, Homo sapiens
cugauaauaauugauca

SEQ ID NO: 1423555 - RNA, 15 nt, Homo sapiens
cugauacccagagca

SEQ ID NO: 1423556 - RNA, 17 nt, Homo sapiens
cugauaugggacugagc

SEQ ID NO: 1423557 - RNA, 22 nt, Homo sapiens
cugaugaccuaaccuaagcaaa

SEQ ID NO: 1423558 - RNA, 23 nt, Homo sapiens
cugaugcuuugcuucaaauccau

SEQ ID NO: 1423559 - RNA, 15 nt, Homo sapiens
cugaugggacaucaa

SEQ ID NO: 1423560 - RNA, 13 nt, Homo sapiens
cugauuucaggga

SEQ ID NO: 1423561 - RNA, 15 nt, Homo sapiens
cugauuucagggaaa

SEQ ID NO: 1423562 - RNA, 19 nt, Homo sapiens
cugcaaacucacugcucaa

SEQ ID NO: 1423563 - RNA, 19 nt, Homo sapiens
cugcaaaggcgcagugcuu

SEQ ID NO: 1423564 - RNA, 15 nt, Homo sapiens
cugcaagaaguacau

SEQ ID NO: 1423565 - RNA, 19 nt, Homo sapiens
cugcaaggauucagcauua

SEQ ID NO: 1423566 - RNA, 13 nt, Homo sapiens
cugcacauuccug

SEQ ID NO: 1423567 - RNA, 13 nt, Homo sapiens
cugcaccgagaga

SEQ ID NO: 1423568 - RNA, 20 nt, Homo sapiens
cugcaccgagagagauggaa

SEQ ID NO: 1423569 - RNA, 22 nt, Homo sapiens
cugcaccgagagagauggaaua

SEQ ID NO: 1423570 - RNA, 14 nt, Homo sapiens
cugcagagauccag

SEQ ID NO: 1423571 - RNA, 13 nt, Homo sapiens
cugcagcacuuua

SEQ ID NO: 1423572 - RNA, 16 nt, Homo sapiens
cugcagccugguagaa

SEQ ID NO: 1423573 - RNA, 19 nt, Homo sapiens
cugcagcugggccccaugc

SEQ ID NO: 1423574 - RNA, 21 nt, Homo sapiens
cugcagcuuaaaacaagcaaa

SEQ ID NO: 1423575 - RNA, 22 nt, Homo sapiens
cugcaggaacgagcacuggcca

SEQ ID NO: 1423576 - RNA, 21 nt, Homo sapiens
cugcaguagucucugugcuuu

SEQ ID NO: 1423577 - RNA, 17 nt, Homo sapiens
ugcacaaagcccuucca

SEQ ID NO: 1423578 - RNA, 14 nt, Homo sapiens
ugcacacacacaga

SEQ ID NO: 1423579 - RNA, 12 nt, Homo sapiens
ugcacacacaga

SEQ ID NO: 1423580 - RNA, 16 nt, Homo sapiens
ugcacacacagaugca

SEQ ID NO: 1423581 - RNA, 14 nt, Homo sapiens
ugcacagcugcuug

SEQ ID NO: 1423582 - RNA, 13 nt, Homo sapiens
ugcacauauuuga

SEQ ID NO: 1423583 - RNA, 15 nt, Homo sapiens
ugcacaucacaacau

SEQ ID NO: 1423584 - RNA, 14 nt, Homo sapiens
ugcaccaccaugcc

SEQ ID NO: 1423585 - RNA, 16 nt, Homo sapiens
ugcaccaccaugccag

SEQ ID NO: 1423586 - RNA, 17 nt, Homo sapiens
ugcaccacuucaaguga

SEQ ID NO: 1423587 - RNA, 18 nt, Homo sapiens
ugcaccaucacacaugca

SEQ ID NO: 1423588 - RNA, 20 nt, Homo sapiens
ugcaccgagagagauggaau

SEQ ID NO: 1423589 - RNA, 13 nt, Homo sapiens
ugcacgcacacau

SEQ ID NO: 1423590 - RNA, 20 nt, Homo sapiens
ugcacgcacaugccaaugca

SEQ ID NO: 1423591 - RNA, 19 nt, Homo sapiens
ugcacuaauugacccaaaa

SEQ ID NO: 1423592 - RNA, 14 nt, Homo sapiens
ugcacuagccugug

SEQ ID NO: 1423593 - RNA, 15 nt, Homo sapiens
ugcacuagccuguga

SEQ ID NO: 1423594 - RNA, 16 nt, Homo sapiens
ugcacucccuaagaaa

SEQ ID NO: 1423595 - RNA, 21 nt, Homo sapiens
ugcacuguauauagaagucua

SEQ ID NO: 1423596 - RNA, 18 nt, Homo sapiens
ugcacuuuuaaaccucuc

SEQ ID NO: 1423597 - RNA, 17 nt, Homo sapiens
ugcagacaccugccuua

SEQ ID NO: 1423598 - RNA, 18 nt, Homo sapiens
ugcagacaccugccuuaa

SEQ ID NO: 1423599 - RNA, 23 nt, Homo sapiens
ugcagcugggccccaugcucugc

SEQ ID NO: 1423600 - RNA, 20 nt, Homo sapiens
ugcagcuuaaaacaagcaaa

SEQ ID NO: 1423601 - RNA, 14 nt, Homo sapiens
ugcagcuuguucag

SEQ ID NO: 1423602 - RNA, 19 nt, Homo sapiens
ugcaggagccgcugcugag

SEQ ID NO: 1423603 - RNA, 19 nt, Homo sapiens
ugcagggaagagggcagua

SEQ ID NO: 1423604 - RNA, 17 nt, Homo sapiens
ugcaguagcacgaucuc

SEQ ID NO: 1423605 - RNA, 21 nt, Homo sapiens
ugcagucucagagacuauuua

SEQ ID NO: 1423606 - RNA, 15 nt, Homo sapiens
ugcaguuuccaaucc

SEQ ID NO: 1423607 - RNA, 16 nt, Homo sapiens
ugcauacuacucucaa

SEQ ID NO: 1423608 - RNA, 13 nt, Homo sapiens
ugcauauguauuu

SEQ ID NO: 1423609 - RNA, 18 nt, Homo sapiens
ugcaucaauuuaccuacu

SEQ ID NO: 1423610 - RNA, 17 nt, Homo sapiens
ugcaucuauauguguau

SEQ ID NO: 1423611 - RNA, 19 nt, Homo sapiens
ugcaugauuuuauacauag

SEQ ID NO: 1423612 - RNA, 11 nt, Homo sapiens
ugcaugccaaa

SEQ ID NO: 1423613 - RNA, 13 nt, Homo sapiens
ugcauguguauau

SEQ ID NO: 1423614 - RNA, 15 nt, Homo sapiens
ugcauguguguauaa

SEQ ID NO: 1423615 - RNA, 18 nt, Homo sapiens
ugcauuagaaacugaaaa

SEQ ID NO: 1423616 - RNA, 18 nt, Homo sapiens
ugcauugcuaaaauauua

SEQ ID NO: 1423617 - RNA, 13 nt, Homo sapiens
ugccaccagucac

SEQ ID NO: 1423618 - RNA, 15 nt, Homo sapiens
ugccaggccuggcaa

SEQ ID NO: 1423619 - RNA, 14 nt, Homo sapiens
ugccauguuuagau

SEQ ID NO: 1423620 - RNA, 22 nt, Homo sapiens
ugcccaauuagggccuagccuu

SEQ ID NO: 1423621 - RNA, 19 nt, Homo sapiens
ugccccaacuccuuccagc

SEQ ID NO: 1423622 - RNA, 14 nt, Homo sapiens
ugccccagcuuuau

SEQ ID NO: 1423623 - RNA, 15 nt, Homo sapiens
ugccccgaauuuagu

SEQ ID NO: 1423624 - RNA, 21 nt, Homo sapiens
ugccccuccagagacaggaaa

SEQ ID NO: 1423625 - RNA, 13 nt, Homo sapiens
ugcccucucucag

SEQ ID NO: 1423626 - RNA, 17 nt, Homo sapiens
ugcccugcccaugggag

SEQ ID NO: 1423627 - RNA, 17 nt, Homo sapiens
ugcccuggauccaucag

SEQ ID NO: 1423628 - RNA, 16 nt, Homo sapiens
ugccgggcugcacaga

SEQ ID NO: 1423629 - RNA, 19 nt, Homo sapiens
ugccggguucuagucuccu

SEQ ID NO: 1423630 - RNA, 17 nt, Homo sapiens
ugccguauaggauguca

SEQ ID NO: 1423631 - RNA, 22 nt, Homo sapiens
ugccuauuuauuggggugccua

SEQ ID NO: 1423632 - RNA, 14 nt, Homo sapiens
ugccuccagcacuc

SEQ ID NO: 1423633 - RNA, 22 nt, Homo sapiens
ugccuccauucugaccauuuca

SEQ ID NO: 1423634 - RNA, 23 nt, Homo sapiens
ugccuccucccugggcagaaagu

SEQ ID NO: 1423635 - RNA, 20 nt, Homo sapiens
ugccucgcuccccacucugc

SEQ ID NO: 1423636 - RNA, 18 nt, Homo sapiens
ugccucucugcuccagag

SEQ ID NO: 1423637 - RNA, 15 nt, Homo sapiens
ugccugagaugcacg

SEQ ID NO: 1423638 - RNA, 11 nt, Homo sapiens
ugccuggucua

SEQ ID NO: 1423639 - RNA, 20 nt, Homo sapiens
ugccuguaaucccagcacuu

SEQ ID NO: 1423640 - RNA, 15 nt, Homo sapiens
ugccuuaaaggaccu

SEQ ID NO: 1423641 - RNA, 20 nt, Homo sapiens
ugccuuaaaggaccuuccca

SEQ ID NO: 1423642 - RNA, 15 nt, Homo sapiens
ugccuuaagccaaua

SEQ ID NO: 1423643 - RNA, 21 nt, Homo sapiens
ugccuuccaaccccuuuccac

SEQ ID NO: 1423644 - RNA, 20 nt, Homo sapiens
ugccuucgguuuguauuuag

SEQ ID NO: 1423645 - RNA, 21 nt, Homo sapiens
ugccuucucacaucuguccag

SEQ ID NO: 1423646 - RNA, 20 nt, Homo sapiens
ugccuuucucuggcuccaga

SEQ ID NO: 1423647 - RNA, 19 nt, Homo sapiens
ugccuuugugggcccagcu

SEQ ID NO: 1423648 - RNA, 14 nt, Homo sapiens
ugcgaacagcaaac

SEQ ID NO: 1423649 - RNA, 13 nt, Homo sapiens
ugcgaaugugcag

SEQ ID NO: 1423650 - RNA, 17 nt, Homo sapiens
ugcgaccgugaccagga

SEQ ID NO: 1423651 - RNA, 16 nt, Homo sapiens
ugcgacgcagguguac

SEQ ID NO: 1423652 - RNA, 19 nt, Homo sapiens
ugcgcacaaggcugaccaa

SEQ ID NO: 1423653 - RNA, 15 nt, Homo sapiens
ugcgcacacacagau

SEQ ID NO: 1423654 - RNA, 16 nt, Homo sapiens
ugcgcacacacagaua

SEQ ID NO: 1423655 - RNA, 20 nt, Homo sapiens
ugcgcacacacagauaugca

SEQ ID NO: 1423656 - RNA, 16 nt, Homo sapiens
ugcgggggagcuggaa

SEQ ID NO: 1423657 - RNA, 18 nt, Homo sapiens
ugcuacaagaaugcaaaa

SEQ ID NO: 1423658 - RNA, 22 nt, Homo sapiens
ugcuacuaauuauauaguauac

SEQ ID NO: 1423659 - RNA, 20 nt, Homo sapiens
ugcuagaugugcaaaugcaa

SEQ ID NO: 1423660 - RNA, 16 nt, Homo sapiens
ugcuagcugcaaguga

SEQ ID NO: 1423661 - RNA, 13 nt, Homo sapiens
ugcuagcuguaga

SEQ ID NO: 1423662 - RNA, 19 nt, Homo sapiens
ugcuauauaaacuuuaaca

SEQ ID NO: 1423663 - RNA, 14 nt, Homo sapiens
ugcuaugacaugca

SEQ ID NO: 1423664 - RNA, 16 nt, Homo sapiens
ugcuaugccaagccau

SEQ ID NO: 1423665 - RNA, 20 nt, Homo sapiens
ugcuaugccaagccaugucu

SEQ ID NO: 1423666 - RNA, 15 nt, Homo sapiens
ugcuauugaacugag

SEQ ID NO: 1423667 - RNA, 23 nt, Homo sapiens
ugcucaccaagcuguuccacuuc

SEQ ID NO: 1423668 - RNA, 14 nt, Homo sapiens
ugcucacucaggac

SEQ ID NO: 1423669 - RNA, 21 nt, Homo sapiens
ugcucccagcagcccuaagga

SEQ ID NO: 1423670 - RNA, 12 nt, Homo sapiens
ugcucucuucag

SEQ ID NO: 1423671 - RNA, 19 nt, Homo sapiens
ugcucugcccacugugaaa

SEQ ID NO: 1423672 - RNA, 19 nt, Homo sapiens
ugcugaagagggaaaguga

SEQ ID NO: 1423673 - RNA, 15 nt, Homo sapiens
ugcugagaaccuggc

SEQ ID NO: 1423674 - RNA, 22 nt, Homo sapiens
ugcugcaggagccgcugcugag

SEQ ID NO: 1423675 - RNA, 21 nt, Homo sapiens
ugcugcugaccugaucaccuc

SEQ ID NO: 1423676 - RNA, 14 nt, Homo sapiens
ugcuggagacacuc

SEQ ID NO: 1423677 - RNA, 23 nt, Homo sapiens
ugcuguacuuuauuuguauuugc

SEQ ID NO: 1423678 - RNA, 15 nt, Homo sapiens
ugcuguauacuguac

SEQ ID NO: 1423679 - RNA, 19 nt, Homo sapiens
ugcuguauacuguacugag

SEQ ID NO: 1423680 - RNA, 10 nt, Homo sapiens
ugcugugaau

SEQ ID NO: 1423681 - RNA, 20 nt, Homo sapiens
ugcugugcuagugccugaga

SEQ ID NO: 1423682 - RNA, 21 nt, Homo sapiens
ugcuguugauaauaucucuca

SEQ ID NO: 1423683 - RNA, 13 nt, Homo sapiens
ugcuuacaaaguc

SEQ ID NO: 1423684 - RNA, 19 nt, Homo sapiens
ugcuuacccuucaccuuug

SEQ ID NO: 1423685 - RNA, 16 nt, Homo sapiens
ugcuuaugacaucacu

SEQ ID NO: 1423686 - RNA, 15 nt, Homo sapiens
ugcuuauucuugagc

SEQ ID NO: 1423687 - RNA, 20 nt, Homo sapiens
ugcuucauuugggaaauuca

SEQ ID NO: 1423688 - RNA, 15 nt, Homo sapiens
ugcuucuguccagga

SEQ ID NO: 1423689 - RNA, 14 nt, Homo sapiens
ugcuugaauugcaa

SEQ ID NO: 1423690 - RNA, 18 nt, Homo sapiens
ugcuugauugagugcucc

SEQ ID NO: 1423691 - RNA, 13 nt, Homo sapiens
ugcuuugacucac

SEQ ID NO: 1423692 - RNA, 14 nt, Homo sapiens
ugcuuugaggacaa

SEQ ID NO: 1423693 - RNA, 14 nt, Homo sapiens
ugcuuuuaaaugca

SEQ ID NO: 1423694 - RNA, 13 nt, Homo sapiens
ugcuuuugaggac

SEQ ID NO: 1423695 - RNA, 15 nt, Homo sapiens
ugcuuuuuccagauu

SEQ ID NO: 1423696 - RNA, 23 nt, Homo sapiens
uggaaaaaagagaaaaaccaaug

SEQ ID NO: 1423697 - RNA, 14 nt, Homo sapiens
uggaaaaugugacc

SEQ ID NO: 1423698 - RNA, 17 nt, Homo sapiens
uggaaaaugugacccag

SEQ ID NO: 1423699 - RNA, 20 nt, Homo sapiens
uggaaacgcaaaugaguauu

SEQ ID NO: 1423700 - RNA, 21 nt, Homo sapiens
uggaaagcagguggcaucucu

SEQ ID NO: 1423701 - RNA, 13 nt, Homo sapiens
uggaaagguuuca

SEQ ID NO: 1423702 - RNA, 14 nt, Homo sapiens
uggaaauaaaccug

SEQ ID NO: 1423703 - RNA, 19 nt, Homo sapiens
uggaaauaaaccuggagau

SEQ ID NO: 1423704 - RNA, 19 nt, Homo sapiens
uggaacacucucugagaug

SEQ ID NO: 1423705 - RNA, 17 nt, Homo sapiens
uggaagaaaugggagaa

SEQ ID NO: 1423706 - RNA, 20 nt, Homo sapiens
uggaagaaggaaacaccgag

SEQ ID NO: 1423707 - RNA, 15 nt, Homo sapiens
uggaagcacaugugu

SEQ ID NO: 1423708 - RNA, 18 nt, Homo sapiens
uggaaggcccacugucca

SEQ ID NO: 1423709 - RNA, 14 nt, Homo sapiens
uggaaggcucccua

SEQ ID NO: 1423710 - RNA, 19 nt, Homo sapiens
uggaaguguucaagaaaua

SEQ ID NO: 1423711 - RNA, 17 nt, Homo sapiens
uggaauaaagcccuuga

SEQ ID NO: 1423712 - RNA, 19 nt, Homo sapiens
uggaaucaaggaauccuga

SEQ ID NO: 1423713 - RNA, 19 nt, Homo sapiens
uggaaucagcuuuuaauaa

SEQ ID NO: 1423714 - RNA, 14 nt, Homo sapiens
uggacaaaauggaa

SEQ ID NO: 1423715 - RNA, 17 nt, Homo sapiens
uggaccucugcuucccc

SEQ ID NO: 1423716 - RNA, 18 nt, Homo sapiens
uggacuguuuccugagua

SEQ ID NO: 1423717 - RNA, 20 nt, Homo sapiens
uggagaggaaaagcaucaga

SEQ ID NO: 1423718 - RNA, 17 nt, Homo sapiens
uggagauuggcucccaa

SEQ ID NO: 1423719 - RNA, 19 nt, Homo sapiens
uggagcaagugacaugcca

SEQ ID NO: 1423720 - RNA, 20 nt, Homo sapiens
uggagcaagugacaugccau

SEQ ID NO: 1423721 - RNA, 15 nt, Homo sapiens
uggagcccgugcagu

SEQ ID NO: 1423722 - RNA, 14 nt, Homo sapiens
uggagcuacuuuaa

SEQ ID NO: 1423723 - RNA, 18 nt, Homo sapiens
uggagcuggcuuugccaa

SEQ ID NO: 1423724 - RNA, 18 nt, Homo sapiens
uggaggaaaauccaugga

SEQ ID NO: 1423725 - RNA, 19 nt, Homo sapiens
uggaggacuagaaccugga

SEQ ID NO: 1423726 - RNA, 14 nt, Homo sapiens
uggagggagccauc

SEQ ID NO: 1423727 - RNA, 19 nt, Homo sapiens
uggagggcuagaaccugga

SEQ ID NO: 1423728 - RNA, 20 nt, Homo sapiens
uggagggcuagaaccuggca

SEQ ID NO: 1423729 - RNA, 13 nt, Homo sapiens
uggaggugagaaa

SEQ ID NO: 1423730 - RNA, 15 nt, Homo sapiens
uggagguugcaguga

SEQ ID NO: 1423731 - RNA, 16 nt, Homo sapiens
uggaguauaauauuca

SEQ ID NO: 1423732 - RNA, 18 nt, Homo sapiens
uggaguguaagugcuuca

SEQ ID NO: 1423733 - RNA, 15 nt, Homo sapiens
uggaguugugaucau

SEQ ID NO: 1423734 - RNA, 18 nt, Homo sapiens
uggaguuugacauuguau

SEQ ID NO: 1423735 - RNA, 14 nt, Homo sapiens
uggauacacucucu

SEQ ID NO: 1423736 - RNA, 21 nt, Homo sapiens
uggauacacucucuagcuuua

SEQ ID NO: 1423737 - RNA, 22 nt, Homo sapiens
uggaugacgugaagccacagga

SEQ ID NO: 1423738 - RNA, 15 nt, Homo sapiens
uggaugagcacacac

SEQ ID NO: 1423739 - RNA, 14 nt, Homo sapiens
uggaugcacgcaca

SEQ ID NO: 1423740 - RNA, 13 nt, Homo sapiens
uggauuauuucau

SEQ ID NO: 1423741 - RNA, 18 nt, Homo sapiens
uggauuccagcauuugcc

SEQ ID NO: 1423742 - RNA, 17 nt, Homo sapiens
uggauugcagacucaug

SEQ ID NO: 1423743 - RNA, 19 nt, Homo sapiens
uggauugcagacucaugaa

SEQ ID NO: 1423744 - RNA, 21 nt, Homo sapiens
uggauuuuguggaggugagaa

SEQ ID NO: 1423745 - RNA, 14 nt, Homo sapiens
uggcaagugauauc

SEQ ID NO: 1423746 - RNA, 20 nt, Homo sapiens
uggcacauggcuggcacuga

SEQ ID NO: 1423747 - RNA, 14 nt, Homo sapiens
caguucugacacac

SEQ ID NO: 1423748 - RNA, 14 nt, Homo sapiens
caguucugcuccuc

SEQ ID NO: 1423749 - RNA, 17 nt, Homo sapiens
caguugaauucauguga

SEQ ID NO: 1423750 - RNA, 15 nt, Homo sapiens
caguugacaaaaagc

SEQ ID NO: 1423751 - RNA, 14 nt, Homo sapiens
caguugacagcagg

SEQ ID NO: 1423752 - RNA, 19 nt, Homo sapiens
caguugauucugaaucuga

SEQ ID NO: 1423753 - RNA, 18 nt, Homo sapiens
caguuguauggagccucu

SEQ ID NO: 1423754 - RNA, 20 nt, Homo sapiens
caguuugcuuuguaugcacu

SEQ ID NO: 1423755 - RNA, 16 nt, Homo sapiens
caguuuucuugcagau

SEQ ID NO: 1423756 - RNA, 14 nt, Homo sapiens
cauaaaaucuguga

SEQ ID NO: 1423757 - RNA, 16 nt, Homo sapiens
cauaaaaucugugaau

SEQ ID NO: 1423758 - RNA, 17 nt, Homo sapiens
cauaacucauugucugu

SEQ ID NO: 1423759 - RNA, 19 nt, Homo sapiens
cauaacuugcugaauuuca

SEQ ID NO: 1423760 - RNA, 21 nt, Homo sapiens
cauaauccagagauaauugcc

SEQ ID NO: 1423761 - RNA, 13 nt, Homo sapiens
ugguguccagaca

SEQ ID NO: 1423762 - RNA, 19 nt, Homo sapiens
ugguguucaaaaaaacacu

SEQ ID NO: 1423763 - RNA, 19 nt, Homo sapiens
ugguuccaagaaagaucca

SEQ ID NO: 1423764 - RNA, 19 nt, Homo sapiens
ugguuccaugccugagggu

SEQ ID NO: 1423765 - RNA, 15 nt, Homo sapiens
ugguugcauuuguca

SEQ ID NO: 1423766 - RNA, 19 nt, Homo sapiens
ugguuuuuggcucuuucag

SEQ ID NO: 1423767 - RNA, 22 nt, Homo sapiens
uguaaacauucaucaagcugua

SEQ ID NO: 1423768 - RNA, 22 nt, Homo sapiens
uguaaaccaucgcgugcaauga

SEQ ID NO: 1423769 - RNA, 17 nt, Homo sapiens
uguaaagaauaaaugaa

SEQ ID NO: 1423770 - RNA, 22 nt, Homo sapiens
uguaaagaauaaaugaaucuua

SEQ ID NO: 1423771 - RNA, 16 nt, Homo sapiens
uguaaauuaauacuuc

SEQ ID NO: 1423772 - RNA, 17 nt, Homo sapiens
uguaacagguaaccaca

SEQ ID NO: 1423773 - RNA, 14 nt, Homo sapiens
uguaacccgcucau

SEQ ID NO: 1423774 - RNA, 11 nt, Homo sapiens
uguaacuauug

SEQ ID NO: 1423775 - RNA, 17 nt, Homo sapiens
uguaagauuuagcaccc

SEQ ID NO: 1423776 - RNA, 18 nt, Homo sapiens
uguaagcauucugagcug

SEQ ID NO: 1423777 - RNA, 18 nt, Homo sapiens
uguaaucaguuuuaucca

SEQ ID NO: 1423778 - RNA, 19 nt, Homo sapiens
uguaaucccagcacuuugg

SEQ ID NO: 1423779 - RNA, 14 nt, Homo sapiens
uguaauugcuacau

SEQ ID NO: 1423780 - RNA, 15 nt, Homo sapiens
uguacacacacagau

SEQ ID NO: 1423781 - RNA, 21 nt, Homo sapiens
uguacacacacagaugcacac

SEQ ID NO: 1423782 - RNA, 11 nt, Homo sapiens
uguacacugug

SEQ ID NO: 1423783 - RNA, 19 nt, Homo sapiens
uguacaguguguaaagugu

SEQ ID NO: 1423784 - RNA, 16 nt, Homo sapiens
uguacauauauauucu

SEQ ID NO: 1423785 - RNA, 19 nt, Homo sapiens
uucugacuucucccaucua

SEQ ID NO: 1423786 - RNA, 22 nt, Homo sapiens
uucugagaguuggcucaggcag

SEQ ID NO: 1423787 - RNA, 13 nt, Homo sapiens
uucugaggcaaau

SEQ ID NO: 1423788 - RNA, 11 nt, Homo sapiens
uucugcacuga

SEQ ID NO: 1423789 - RNA, 17 nt, Homo sapiens
uucugccccagcuuuau

SEQ ID NO: 1423790 - RNA, 17 nt, Homo sapiens
uucugcuguauacugua

SEQ ID NO: 1423791 - RNA, 21 nt, Homo sapiens
uucuggaaaaaaaauauauau

SEQ ID NO: 1423792 - RNA, 18 nt, Homo sapiens
uucuggccucagaccaac

SEQ ID NO: 1423793 - RNA, 12 nt, Homo sapiens
uucuggcuuuac

SEQ ID NO: 1423794 - RNA, 18 nt, Homo sapiens
uucugggugggugaaagg

SEQ ID NO: 1423795 - RNA, 15 nt, Homo sapiens
uucuguccaggacau

SEQ ID NO: 1423796 - RNA, 21 nt, Homo sapiens
uucuguugaucccacuucacu

SEQ ID NO: 1423797 - RNA, 19 nt, Homo sapiens
uucuguugcgccacugaga

SEQ ID NO: 1423798 - RNA, 22 nt, Homo sapiens
uucuguuguaauaguccaugga

SEQ ID NO: 1423799 - RNA, 22 nt, Homo sapiens
uucuguuugaaugcggaaccau

SEQ ID NO: 1423800 - RNA, 18 nt, Homo sapiens
uucuuaaucaagaauauu

SEQ ID NO: 1423801 - RNA, 12 nt, Homo sapiens
uucuuauggaag

SEQ ID NO: 1423802 - RNA, 16 nt, Homo sapiens
uucuucaucuugacau

SEQ ID NO: 1423803 - RNA, 16 nt, Homo sapiens
uucuucuguauguuag

SEQ ID NO: 1423804 - RNA, 16 nt, Homo sapiens
uucuugaaccaauaau

SEQ ID NO: 1423805 - RNA, 20 nt, Homo sapiens
uucuuggaccccugaauuca

SEQ ID NO: 1423806 - RNA, 16 nt, Homo sapiens
uucuuggcuucuggga

SEQ ID NO: 1423807 - RNA, 18 nt, Homo sapiens
uucuuggggucccaggga

SEQ ID NO: 1423808 - RNA, 16 nt, Homo sapiens
uucuugugaaaccaca

SEQ ID NO: 1423809 - RNA, 13 nt, Homo sapiens
uucuugugccuca

SEQ ID NO: 1423810 - RNA, 19 nt, Homo sapiens
uucuuuaaauuucaucuca

SEQ ID NO: 1423811 - RNA, 14 nt, Homo sapiens
uucuuuaccugaga

SEQ ID NO: 1423812 - RNA, 12 nt, Homo sapiens
uugaaaauguuc

SEQ ID NO: 1423813 - RNA, 14 nt, Homo sapiens
uugaaacugaaugu

SEQ ID NO: 1423814 - RNA, 15 nt, Homo sapiens
uugaaacugagaugu

SEQ ID NO: 1423815 - RNA, 16 nt, Homo sapiens
uugaaauaccagugaa

SEQ ID NO: 1423816 - RNA, 15 nt, Homo sapiens
uugaaauauaaugca

SEQ ID NO: 1423817 - RNA, 15 nt, Homo sapiens
uugaaaucugaaugc

SEQ ID NO: 1423818 - RNA, 23 nt, Homo sapiens
uugaacaacuaggcuucagcaua

SEQ ID NO: 1423819 - RNA, 18 nt, Homo sapiens
uugaacugguugugaaua

SEQ ID NO: 1423820 - RNA, 12 nt, Homo sapiens
uugaacuuggaa

SEQ ID NO: 1423821 - RNA, 22 nt, Homo sapiens
uugaagagauuucaacauauca

SEQ ID NO: 1423822 - RNA, 16 nt, Homo sapiens
uugaagccacugccuu

SEQ ID NO: 1423823 - RNA, 20 nt, Homo sapiens
uugaaggaguccuugcauca

SEQ ID NO: 1423824 - RNA, 18 nt, Homo sapiens
uugaauggucuucugcca

SEQ ID NO: 1423825 - RNA, 17 nt, Homo sapiens
uugaauguaagaacaug

SEQ ID NO: 1423826 - RNA, 19 nt, Homo sapiens
uugaauguuuauguucuca

SEQ ID NO: 1423827 - RNA, 19 nt, Homo sapiens
uugaauuugccuuccucau

SEQ ID NO: 1423828 - RNA, 13 nt, Homo sapiens
uugacaggccauc

SEQ ID NO: 1423829 - RNA, 23 nt, Homo sapiens
uugacaggccauccauucacagc

SEQ ID NO: 1423830 - RNA, 14 nt, Homo sapiens
uugacaucagcauu

SEQ ID NO: 1423831 - RNA, 15 nt, Homo sapiens
uugaccaaauaaagu

SEQ ID NO: 1423832 - RNA, 22 nt, Homo sapiens
uugaccaaauaaaguaccauua

SEQ ID NO: 1423833 - RNA, 16 nt, Homo sapiens
uugacccauguucccu

SEQ ID NO: 1423834 - RNA, 22 nt, Homo sapiens
uugacuggguuucucuguauag

SEQ ID NO: 1423835 - RNA, 14 nt, Homo sapiens
uugagaaacaugaa

SEQ ID NO: 1423836 - RNA, 14 nt, Homo sapiens
uugagagacagggu

SEQ ID NO: 1423837 - RNA, 18 nt, Homo sapiens
uugagcaccgucauggcu

SEQ ID NO: 1423838 - RNA, 16 nt, Homo sapiens
uuuccccucugugucc

SEQ ID NO: 1423839 - RNA, 19 nt, Homo sapiens
uuuccucccuuucccugag

SEQ ID NO: 1423840 - RNA, 21 nt, Homo sapiens
uuuccuccuguguacagggaa

SEQ ID NO: 1423841 - RNA, 15 nt, Homo sapiens
uuuccuucagugcau

SEQ ID NO: 1423842 - RNA, 16 nt, Homo sapiens
uuuccuugucucucau

SEQ ID NO: 1423843 - RNA, 14 nt, Homo sapiens
uuucuaacuguaaa

SEQ ID NO: 1423844 - RNA, 15 nt, Homo sapiens
uuucuauaccugucu

SEQ ID NO: 1423845 - RNA, 16 nt, Homo sapiens
uuucuaucacauauuu

SEQ ID NO: 1423846 - RNA, 17 nt, Homo sapiens
uuucuauucucuccuca

SEQ ID NO: 1423847 - RNA, 16 nt, Homo sapiens
uuucucccacauauuc

SEQ ID NO: 1423848 - RNA, 21 nt, Homo sapiens
uuucuccuuuugaccaaauaa

SEQ ID NO: 1423849 - RNA, 21 nt, Homo sapiens
uuucucugagcagucagggug

SEQ ID NO: 1423850 - RNA, 19 nt, Homo sapiens
uuucugaaccauuacugua

SEQ ID NO: 1423851 - RNA, 12 nt, Homo sapiens
uuucugagcuuu

SEQ ID NO: 1423852 - RNA, 16 nt, Homo sapiens
uuucugcggccuucca

SEQ ID NO: 1423853 - RNA, 15 nt, Homo sapiens
uuucuggaccagauc

SEQ ID NO: 1423854 - RNA, 19 nt, Homo sapiens
uuucuuuaccugagaccag

SEQ ID NO: 1423855 - RNA, 23 nt, Homo sapiens
uuucuuuguaaaggucagaguca

SEQ ID NO: 1423856 - RNA, 17 nt, Homo sapiens
uuugaagguaacugaga

SEQ ID NO: 1423857 - RNA, 19 nt, Homo sapiens
uuugaagguauaaccuuca

SEQ ID NO: 1423858 - RNA, 12 nt, Homo sapiens
uuugaccaaaua

SEQ ID NO: 1423859 - RNA, 20 nt, Homo sapiens
uuugaccaaauaaaguacca

SEQ ID NO: 1423860 - RNA, 13 nt, Homo sapiens
uuugacgagcuca

SEQ ID NO: 1423861 - RNA, 13 nt, Homo sapiens
uuugacuuuucca

SEQ ID NO: 1423862 - RNA, 17 nt, Homo sapiens
uuugagcccucccagca

SEQ ID NO: 1423863 - RNA, 20 nt, Homo sapiens
uuugaggaauuaucauggga

SEQ ID NO: 1423864 - RNA, 21 nt, Homo sapiens
uuugaggcaaaggccagcagc

SEQ ID NO: 1423865 - RNA, 14 nt, Homo sapiens
uuugauaaagcagu

SEQ ID NO: 1423866 - RNA, 21 nt, Homo sapiens
uuugaucucacacaccagggc

SEQ ID NO: 1423867 - RNA, 17 nt, Homo sapiens
uuugaugguaagacugu

SEQ ID NO: 1423868 - RNA, 20 nt, Homo sapiens
uuugaugugaaaaucaugaa

SEQ ID NO: 1423869 - RNA, 12 nt, Homo sapiens
uuugcacuuugu

SEQ ID NO: 1423870 - RNA, 13 nt, Homo sapiens
uuugccaaaguga

SEQ ID NO: 1423871 - RNA, 21 nt, Homo sapiens
uuugccaaagugacacagagc

SEQ ID NO: 1423872 - RNA, 20 nt, Homo sapiens
uuugccaaguuuuaagagaa

SEQ ID NO: 1423873 - RNA, 22 nt, Homo sapiens
uuugccauucagucuagcuuuu

SEQ ID NO: 1423874 - RNA, 17 nt, Homo sapiens
uuugcuaucacacagug

SEQ ID NO: 1423875 - RNA, 13 nt, Homo sapiens
uuugcucauggca

SEQ ID NO: 1423876 - RNA, 15 nt, Homo sapiens
uuugcuuaguucuca

SEQ ID NO: 1423877 - RNA, 18 nt, Homo sapiens
uuuggcugguuaauucca

SEQ ID NO: 1423878 - RNA, 21 nt, Homo sapiens
uuugggaguguucugugggcu

SEQ ID NO: 1423879 - RNA, 22 nt, Homo sapiens
uuuggggagaaauaaauuuugu

SEQ ID NO: 1423880 - RNA, 20 nt, Homo sapiens
uuuggguuugucaggaugga

SEQ ID NO: 1423881 - RNA, 18 nt, Homo sapiens
uuugguguuacacagccc

SEQ ID NO: 1423882 - RNA, 13 nt, Homo sapiens
uuuguaaagguca

SEQ ID NO: 1423883 - RNA, 17 nt, Homo sapiens
uuuguaaaggucagagu

SEQ ID NO: 1423884 - RNA, 18 nt, Homo sapiens
uuuguacaauuacuaaau

SEQ ID NO: 1423885 - RNA, 18 nt, Homo sapiens
uuugucucugcaucucau

SEQ ID NO: 1423886 - RNA, 15 nt, Homo sapiens
uuugugugugugaua

SEQ ID NO: 1423887 - RNA, 19 nt, Homo sapiens
cuuguacaguuaacucucc

SEQ ID NO: 1423888 - RNA, 13 nt, Homo sapiens
cuugucagaauuu

SEQ ID NO: 1423889 - RNA, 15 nt, Homo sapiens
cuuguccacagucuc

SEQ ID NO: 1423890 - RNA, 21 nt, Homo sapiens
cuugugauuuuugaacaauac

SEQ ID NO: 1423891 - RNA, 16 nt, Homo sapiens
cuuguggauaagggag

SEQ ID NO: 1423892 - RNA, 19 nt, Homo sapiens
cuugugguuuaugucauca

SEQ ID NO: 1423893 - RNA, 20 nt, Homo sapiens
cuuguguccccaccucaggc

SEQ ID NO: 1423894 - RNA, 15 nt, Homo sapiens
cuuguguccugauga

SEQ ID NO: 1423895 - RNA, 13 nt, Homo sapiens
cuuguucuuuaaa

SEQ ID NO: 1423896 - RNA, 12 nt, Homo sapiens
cuuuaaauucaa

SEQ ID NO: 1423897 - RNA, 13 nt, Homo sapiens
cuuuaacaaaaca

SEQ ID NO: 1423898 - RNA, 18 nt, Homo sapiens
cuuuaagguguuggugua

SEQ ID NO: 1423899 - RNA, 19 nt, Homo sapiens
cuuuaauucucaugugauc

SEQ ID NO: 1423900 - RNA, 20 nt, Homo sapiens
cuuuaauucucaugugaucc

SEQ ID NO: 1423901 - RNA, 20 nt, Homo sapiens
cuuuacaggagguuguggau

SEQ ID NO: 1423902 - RNA, 13 nt, Homo sapiens
cuuuaccuaccac

SEQ ID NO: 1423903 - RNA, 17 nt, Homo sapiens
cuuuaucugugaccaca

SEQ ID NO: 1423904 - RNA, 14 nt, Homo sapiens
cuuuaucugugaua

SEQ ID NO: 1423905 - RNA, 18 nt, Homo sapiens
cuuuauguauggagcucu

SEQ ID NO: 1423906 - RNA, 19 nt, Homo sapiens
cuuuauuuguauuugccau

SEQ ID NO: 1423907 - RNA, 23 nt, Homo sapiens
cuuuauuuguauuugccauucag

SEQ ID NO: 1423908 - RNA, 12 nt, Homo sapiens
cuuucaaagugu

SEQ ID NO: 1423909 - RNA, 15 nt, Homo sapiens
cuuucaccaguuucu

SEQ ID NO: 1423910 - RNA, 14 nt, Homo sapiens
cuuucacucaggcu

SEQ ID NO: 1423911 - RNA, 19 nt, Homo sapiens
cuuucagcauuaggcuuuu

SEQ ID NO: 1423912 - RNA, 19 nt, Homo sapiens
cuuucagccaaaacagauc

SEQ ID NO: 1423913 - RNA, 21 nt, Homo sapiens
cuuucaugaguuucccagaga

SEQ ID NO: 1423914 - RNA, 20 nt, Homo sapiens
cuuuccaaaaccuaaagagg

SEQ ID NO: 1423915 - RNA, 22 nt, Homo sapiens
cuuucccagaaaaaaaaaaacu

SEQ ID NO: 1423916 - RNA, 19 nt, Homo sapiens
cuuucccaugauccagaac

SEQ ID NO: 1423917 - RNA, 13 nt, Homo sapiens
cuuucccuuccag

SEQ ID NO: 1423918 - RNA, 17 nt, Homo sapiens
cuuuccuuuucuuccuu

SEQ ID NO: 1423919 - RNA, 21 nt, Homo sapiens
cuuucucaggaccuaguugcu

SEQ ID NO: 1423920 - RNA, 13 nt, Homo sapiens
cuuucuccuccaa

SEQ ID NO: 1423921 - RNA, 16 nt, Homo sapiens
cuuucuguaaccaaaa

SEQ ID NO: 1423922 - RNA, 13 nt, Homo sapiens
cuuucuugacucu

SEQ ID NO: 1423923 - RNA, 18 nt, Homo sapiens
cuuucuuucuaacuccag

SEQ ID NO: 1423924 - RNA, 22 nt, Homo sapiens
cuuugaaggauuuacugcaaga

SEQ ID NO: 1423925 - RNA, 22 nt, Homo sapiens
cuuugacuuggggagaccucua

SEQ ID NO: 1423926 - RNA, 13 nt, Homo sapiens
cuuugauuuccaa

SEQ ID NO: 1423927 - RNA, 13 nt, Homo sapiens
cuuugcacugagg

SEQ ID NO: 1423928 - RNA, 13 nt, Homo sapiens
cuuugcauuccau

SEQ ID NO: 1423929 - RNA, 17 nt, Homo sapiens
cuuuggacaacugacaa

SEQ ID NO: 1423930 - RNA, 17 nt, Homo sapiens
cuuuguaugcacuuugu

SEQ ID NO: 1423931 - RNA, 19 nt, Homo sapiens
cuuuguuuuuuaauguugu

SEQ ID NO: 1423932 - RNA, 18 nt, Homo sapiens
cuuuuaaaaaaaaauacu

SEQ ID NO: 1423933 - RNA, 18 nt, Homo sapiens
cuuuuaaaacacuuccau

SEQ ID NO: 1423934 - RNA, 14 nt, Homo sapiens
cuuuuaggaugugg

SEQ ID NO: 1423935 - RNA, 19 nt, Homo sapiens
cuuuuauccacuuaccuag

SEQ ID NO: 1423936 - RNA, 19 nt, Homo sapiens
cuuuucaaaacugcuaaau

SEQ ID NO: 1423937 - RNA, 14 nt, Homo sapiens
aaauaaaguaccau

SEQ ID NO: 1423938 - RNA, 16 nt, Homo sapiens
aaauaaauguguaaau

SEQ ID NO: 1423939 - RNA, 11 nt, Homo sapiens
aaauaaauuca

SEQ ID NO: 1423940 - RNA, 12 nt, Homo sapiens
aaauaaauucaa

SEQ ID NO: 1423941 - RNA, 14 nt, Homo sapiens
aaauaaggcuccuu

SEQ ID NO: 1423942 - RNA, 13 nt, Homo sapiens
aaauaauagccau

SEQ ID NO: 1423943 - RNA, 20 nt, Homo sapiens
aaauaauagccauccuuggc

SEQ ID NO: 1423944 - RNA, 19 nt, Homo sapiens
aaauacacacucaaaucaa

SEQ ID NO: 1423945 - RNA, 16 nt, Homo sapiens
aaauaccaaguauuua

SEQ ID NO: 1423946 - RNA, 16 nt, Homo sapiens
aaauaccucauucgcc

SEQ ID NO: 1423947 - RNA, 16 nt, Homo sapiens
aaauacuacacaucca

SEQ ID NO: 1423948 - RNA, 18 nt, Homo sapiens
aaauagacaacucuucca

SEQ ID NO: 1423949 - RNA, 15 nt, Homo sapiens
aaauagagaauccca

SEQ ID NO: 1423950 - RNA, 14 nt, Homo sapiens
aaauagcauucucu

SEQ ID NO: 1423951 - RNA, 15 nt, Homo sapiens
aaauauaaacuugug

SEQ ID NO: 1423952 - RNA, 19 nt, Homo sapiens
aaauauauauagugcuaua

SEQ ID NO: 1423953 - RNA, 21 nt, Homo sapiens
aaauaugauuuuauuugacaa

SEQ ID NO: 1423954 - RNA, 20 nt, Homo sapiens
aaauauggaacuucuaauau

SEQ ID NO: 1423955 - RNA, 12 nt, Homo sapiens
aaauauucccug

SEQ ID NO: 1423956 - RNA, 14 nt, Homo sapiens
aaauauucucucca

SEQ ID NO: 1423957 - RNA, 18 nt, Homo sapiens
aaauauugcuucaauaau

SEQ ID NO: 1423958 - RNA, 17 nt, Homo sapiens
aaauauuuaugcuuaaa

SEQ ID NO: 1423959 - RNA, 15 nt, Homo sapiens
aaaucaacuugugua

SEQ ID NO: 1423960 - RNA, 23 nt, Homo sapiens
aaaucacaacacagagcugcuau

SEQ ID NO: 1423961 - RNA, 19 nt, Homo sapiens
aaaucacaaggcaacugug

SEQ ID NO: 1423962 - RNA, 20 nt, Homo sapiens
aaaucaccacaccaaaccuc

SEQ ID NO: 1423963 - RNA, 13 nt, Homo sapiens
aaaucacuuguaa

SEQ ID NO: 1423964 - RNA, 19 nt, Homo sapiens
aaaucagcacauuccuccu

SEQ ID NO: 1423965 - RNA, 20 nt, Homo sapiens
aaauccacagccaacaaaca

SEQ ID NO: 1423966 - RNA, 23 nt, Homo sapiens
aaauccucagguaguacugggaa

SEQ ID NO: 1423967 - RNA, 21 nt, Homo sapiens
aaauccuuauuuauauaucag

SEQ ID NO: 1423968 - RNA, 11 nt, Homo sapiens
aaauccuugau

SEQ ID NO: 1423969 - RNA, 12 nt, Homo sapiens
aaauccuugaua

SEQ ID NO: 1423970 - RNA, 14 nt, Homo sapiens
aaaugacccaaaga

SEQ ID NO: 1423971 - RNA, 18 nt, Homo sapiens
aaaugacccaaagaccaa

SEQ ID NO: 1423972 - RNA, 12 nt, Homo sapiens
aaaugacugcug

SEQ ID NO: 1423973 - RNA, 18 nt, Homo sapiens
aaaugcaaacacugugua

SEQ ID NO: 1423974 - RNA, 18 nt, Homo sapiens
aaaugcaguccagaauaa

SEQ ID NO: 1423975 - RNA, 12 nt, Homo sapiens
aaaugccagucu

SEQ ID NO: 1423976 - RNA, 21 nt, Homo sapiens
aaaugcccaucuaugucccuu

SEQ ID NO: 1423977 - RNA, 20 nt, Homo sapiens
aaaugccuccaagccauuca

SEQ ID NO: 1423978 - RNA, 19 nt, Homo sapiens
aaauguaauuaugagguga

SEQ ID NO: 1423979 - RNA, 22 nt, Homo sapiens
aaauguacacuggauauguugu

SEQ ID NO: 1423980 - RNA, 16 nt, Homo sapiens
aaauguauuaucacca

SEQ ID NO: 1423981 - RNA, 14 nt, Homo sapiens
aaaugugccuucau

SEQ ID NO: 1423982 - RNA, 17 nt, Homo sapiens
aaauguggacaucauga

SEQ ID NO: 1423983 - RNA, 21 nt, Homo sapiens
aaauguucagcuucagacuuu

SEQ ID NO: 1423984 - RNA, 12 nt, Homo sapiens
aaauguuucuca

SEQ ID NO: 1423985 - RNA, 17 nt, Homo sapiens
aaauuaacaguccuaac

SEQ ID NO: 1423986 - RNA, 21 nt, Homo sapiens
aaauuaagagauacauucccu

SEQ ID NO: 1423987 - RNA, 17 nt, Homo sapiens
aaauuagcugugugaaa

SEQ ID NO: 1423988 - RNA, 17 nt, Homo sapiens
aaauuauaagaugucau

SEQ ID NO: 1423989 - RNA, 14 nt, Homo sapiens
aaauuaugccauag

SEQ ID NO: 1423990 - RNA, 18 nt, Homo sapiens
aaauuauguauguuuaca

SEQ ID NO: 1423991 - RNA, 16 nt, Homo sapiens
aaauuauuguauuaca

SEQ ID NO: 1423992 - RNA, 14 nt, Homo sapiens
aaauucaaacugcc

SEQ ID NO: 1423993 - RNA, 16 nt, Homo sapiens
aaauucaagcugcuuu

SEQ ID NO: 1423994 - RNA, 20 nt, Homo sapiens
aaauucagaaagucauagau

SEQ ID NO: 1423995 - RNA, 22 nt, Homo sapiens
aaauucauuuuuuucacuggag

SEQ ID NO: 1423996 - RNA, 17 nt, Homo sapiens
aaauuccuugauucaca

SEQ ID NO: 1423997 - RNA, 15 nt, Homo sapiens
aaauugcuccuugac

SEQ ID NO: 1423998 - RNA, 22 nt, Homo sapiens
aaauuguauacauuuuguuaua

SEQ ID NO: 1423999 - RNA, 13 nt, Homo sapiens
aaauuguauagag

SEQ ID NO: 1424000 - RNA, 22 nt, Homo sapiens
aaauuuguccaauggcuguaaa

SEQ ID NO: 1424001 - RNA, 12 nt, Homo sapiens
aaauuuuacuuu

SEQ ID NO: 1424002 - RNA, 22 nt, Homo sapiens
aaauuuuagagcauaccaguac

SEQ ID NO: 1424003 - RNA, 22 nt, Homo sapiens
aaauuuuauugguaggauuuau

SEQ ID NO: 1424004 - RNA, 18 nt, Homo sapiens
aaauuuuguccauuuuaa

SEQ ID NO: 1424005 - RNA, 16 nt, Homo sapiens
aaauuuuuacugagaa

SEQ ID NO: 1424006 - RNA, 18 nt, Homo sapiens
aaauuuuugucauuuuaa

SEQ ID NO: 1424007 - RNA, 19 nt, Homo sapiens
aacaaaaauguaaugauca

SEQ ID NO: 1424008 - RNA, 14 nt, Homo sapiens
aacaaacaaugcca

SEQ ID NO: 1424009 - RNA, 15 nt, Homo sapiens
aacaaacuacaugua

SEQ ID NO: 1424010 - RNA, 15 nt, Homo sapiens
aacaaauugaugcaa

SEQ ID NO: 1424011 - RNA, 20 nt, Homo sapiens
aacaacaaagccaacaguca

SEQ ID NO: 1424012 - RNA, 17 nt, Homo sapiens
aacaacaauacaacaag

SEQ ID NO: 1424013 - RNA, 16 nt, Homo sapiens
aacaagacacccaagu

SEQ ID NO: 1424014 - RNA, 12 nt, Homo sapiens
aacaagaucugc

SEQ ID NO: 1424015 - RNA, 12 nt, Homo sapiens
aacaaguagcua

SEQ ID NO: 1424016 - RNA, 20 nt, Homo sapiens
aacaauacgugaaagaugca

SEQ ID NO: 1424017 - RNA, 13 nt, Homo sapiens
aacaauagcacaa

SEQ ID NO: 1424018 - RNA, 11 nt, Homo sapiens
aacaaugccau

SEQ ID NO: 1424019 - RNA, 18 nt, Homo sapiens
aacaaugccaucacugga

SEQ ID NO: 1424020 - RNA, 22 nt, Homo sapiens
aacaauugggagauuaucuuuc

SEQ ID NO: 1424021 - RNA, 13 nt, Homo sapiens
aacacaagccaca

SEQ ID NO: 1424022 - RNA, 16 nt, Homo sapiens
aacacaccgaugcaca

SEQ ID NO: 1424023 - RNA, 14 nt, Homo sapiens
aacacagccugugu

SEQ ID NO: 1424024 - RNA, 13 nt, Homo sapiens
aagcccuggcaac

SEQ ID NO: 1424025 - RNA, 20 nt, Homo sapiens
aagccgguugcagagaaucu

SEQ ID NO: 1424026 - RNA, 22 nt, Homo sapiens
aagccucuggaaaacucaggau

SEQ ID NO: 1424027 - RNA, 17 nt, Homo sapiens
aagcgaauguguacaaa

SEQ ID NO: 1424028 - RNA, 20 nt, Homo sapiens
aagcgagaucccaucucuac

SEQ ID NO: 1424029 - RNA, 20 nt, Homo sapiens
aagcgauucuucugccucag

SEQ ID NO: 1424030 - RNA, 14 nt, Homo sapiens
aagcuaagccuuau

SEQ ID NO: 1424031 - RNA, 24 nt, Homo sapiens
aagcuauugauguuuccagaaaau

SEQ ID NO: 1424032 - RNA, 20 nt, Homo sapiens
aagcucaggaggcgaauaaa

SEQ ID NO: 1424033 - RNA, 12 nt, Homo sapiens
aagcugacagca

SEQ ID NO: 1424034 - RNA, 16 nt, Homo sapiens
aagcugagugacugua

SEQ ID NO: 1424035 - RNA, 20 nt, Homo sapiens
aagcugggcaugaacgcacu

SEQ ID NO: 1424036 - RNA, 17 nt, Homo sapiens
aagcuguuccacuucuc

SEQ ID NO: 1424037 - RNA, 12 nt, Homo sapiens
aagcuuauguca

SEQ ID NO: 1424038 - RNA, 12 nt, Homo sapiens
aagcuucuaucc

SEQ ID NO: 1424039 - RNA, 21 nt, Homo sapiens
aagcuuguauauacauauuau

SEQ ID NO: 1424040 - RNA, 17 nt, Homo sapiens
aaggaaaaccagggaua

SEQ ID NO: 1424041 - RNA, 16 nt, Homo sapiens
aaggaagcuccacugu

SEQ ID NO: 1424042 - RNA, 13 nt, Homo sapiens
aaggacaaugccu

SEQ ID NO: 1424043 - RNA, 14 nt, Homo sapiens
aaggacaugugcua

SEQ ID NO: 1424044 - RNA, 13 nt, Homo sapiens
aaggaccagguua

SEQ ID NO: 1424045 - RNA, 17 nt, Homo sapiens
aaggaccugcauuuucc

SEQ ID NO: 1424046 - RNA, 15 nt, Homo sapiens
aaggaguaugcaggg

SEQ ID NO: 1424047 - RNA, 20 nt, Homo sapiens
aaggaguucguggcugcaaa

SEQ ID NO: 1424048 - RNA, 18 nt, Homo sapiens
aaggauccagagacuugg

SEQ ID NO: 1424049 - RNA, 15 nt, Homo sapiens
aaggaucucucagga

SEQ ID NO: 1424050 - RNA, 18 nt, Homo sapiens
aaggauuguugggcuugg

SEQ ID NO: 1424051 - RNA, 13 nt, Homo sapiens
aaggcaaaaagca

SEQ ID NO: 1424052 - RNA, 18 nt, Homo sapiens
aaggcaaagagaccacuc

SEQ ID NO: 1424053 - RNA, 16 nt, Homo sapiens
aaggcaaauauaagcu

SEQ ID NO: 1424054 - RNA, 13 nt, Homo sapiens
aaggcaagcacca

SEQ ID NO: 1424055 - RNA, 17 nt, Homo sapiens
aaggcaucugacaugca

SEQ ID NO: 1424056 - RNA, 21 nt, Homo sapiens
aaggccaagaaucaagcuaga

SEQ ID NO: 1424057 - RNA, 14 nt, Homo sapiens
aaggccacauguca

SEQ ID NO: 1424058 - RNA, 20 nt, Homo sapiens
aaggccacggccuugugucu

SEQ ID NO: 1424059 - RNA, 16 nt, Homo sapiens
aaggcccacuguccag

SEQ ID NO: 1424060 - RNA, 14 nt, Homo sapiens
aaggccuucaaccc

SEQ ID NO: 1424061 - RNA, 16 nt, Homo sapiens
aaggcuccaucuccag

SEQ ID NO: 1424062 - RNA, 14 nt, Homo sapiens
aaggcucccugugu

SEQ ID NO: 1424063 - RNA, 22 nt, Homo sapiens
aaggcucugagcaaauguggcu

SEQ ID NO: 1424064 - RNA, 14 nt, Homo sapiens
aaggcugagcucuu

SEQ ID NO: 1424065 - RNA, 15 nt, Homo sapiens
aaggcuuugccaugg

SEQ ID NO: 1424066 - RNA, 15 nt, Homo sapiens
aagggaaagucagcu

SEQ ID NO: 1424067 - RNA, 11 nt, Homo sapiens
aagggacacac

SEQ ID NO: 1424068 - RNA, 18 nt, Homo sapiens
aagggagaagaaauccau

SEQ ID NO: 1424069 - RNA, 14 nt, Homo sapiens
aagggaguugcuca

SEQ ID NO: 1424070 - RNA, 21 nt, Homo sapiens
aagggaguugcucacucagga

SEQ ID NO: 1424071 - RNA, 16 nt, Homo sapiens
aagggcagaaggggaa

SEQ ID NO: 1424072 - RNA, 13 nt, Homo sapiens
aagggcagugaga

SEQ ID NO: 1424073 - RNA, 20 nt, Homo sapiens
aagggccacaucccacugcc

SEQ ID NO: 1424074 - RNA, 17 nt, Homo sapiens
aaggggagauacucucc

SEQ ID NO: 1424075 - RNA, 12 nt, Homo sapiens
aaggggucugua

SEQ ID NO: 1424076 - RNA, 18 nt, Homo sapiens
aaggggugcccucuggau

SEQ ID NO: 1424077 - RNA, 13 nt, Homo sapiens
aaggguacugaaa

SEQ ID NO: 1424078 - RNA, 16 nt, Homo sapiens
aagguagacauggauu

SEQ ID NO: 1424079 - RNA, 15 nt, Homo sapiens
aaggucuucagccau

SEQ ID NO: 1424080 - RNA, 17 nt, Homo sapiens
aaggugauugauuguau

SEQ ID NO: 1424081 - RNA, 17 nt, Homo sapiens
aagguguuuccauuucu

SEQ ID NO: 1424082 - RNA, 15 nt, Homo sapiens
aagguuaccucuauu

SEQ ID NO: 1424083 - RNA, 12 nt, Homo sapiens
aagguuacugau

SEQ ID NO: 1424084 - RNA, 12 nt, Homo sapiens
aaguaaaaccac

SEQ ID NO: 1424085 - RNA, 18 nt, Homo sapiens
aaguaaauuuguccaaug

SEQ ID NO: 1424086 - RNA, 20 nt, Homo sapiens
aaguaauuccucucacuaaa

SEQ ID NO: 1424087 - RNA, 18 nt, Homo sapiens
aaguaccuguagugagaa

SEQ ID NO: 1424088 - RNA, 20 nt, Homo sapiens
aaguagaauuauaucuaauu

SEQ ID NO: 1424089 - RNA, 17 nt, Homo sapiens
aaguagcacccuggauu

SEQ ID NO: 1424090 - RNA, 19 nt, Homo sapiens
aaguagcugugaacauugu

SEQ ID NO: 1424091 - RNA, 22 nt, Homo sapiens
aaguaggauucaucauuccaua

SEQ ID NO: 1424092 - RNA, 18 nt, Homo sapiens
aaguagggacuucugucu

SEQ ID NO: 1424093 - RNA, 12 nt, Homo sapiens
aaguauuugaaa

SEQ ID NO: 1424094 - RNA, 14 nt, Homo sapiens
aagucaacaaccau

SEQ ID NO: 1424095 - RNA, 13 nt, Homo sapiens
aagucaccaaaau

SEQ ID NO: 1424096 - RNA, 19 nt, Homo sapiens
aagucaccacuccauuccc

SEQ ID NO: 1424097 - RNA, 18 nt, Homo sapiens
aagucaccggagcuuuca

SEQ ID NO: 1424098 - RNA, 18 nt, Homo sapiens
aaguccaaccugccugug

SEQ ID NO: 1424099 - RNA, 16 nt, Homo sapiens
aagucuacuucacuaa

SEQ ID NO: 1424100 - RNA, 20 nt, Homo sapiens
aagucuagaaaccaguaugg

SEQ ID NO: 1424101 - RNA, 18 nt, Homo sapiens
aagucugggauguagaac

SEQ ID NO: 1424102 - RNA, 23 nt, Homo sapiens
aagucugggauguagaacuucaa

SEQ ID NO: 1424103 - RNA, 17 nt, Homo sapiens
aagucuuauuuccucaa

SEQ ID NO: 1424104 - RNA, 17 nt, Homo sapiens
aagucuuuguugcacca

SEQ ID NO: 1424105 - RNA, 23 nt, Homo sapiens
aagugaagaaaagugaaugcuca

SEQ ID NO: 1424106 - RNA, 16 nt, Homo sapiens
aagugauaucaccucu

SEQ ID NO: 1424107 - RNA, 23 nt, Homo sapiens
aagugcugggauuacaguuguga

SEQ ID NO: 1424108 - RNA, 17 nt, Homo sapiens
aaguggcuaauucaauu

SEQ ID NO: 1424109 - RNA, 16 nt, Homo sapiens
aaguggggcucuggga

SEQ ID NO: 1424110 - RNA, 21 nt, Homo sapiens
aaguuauaguauaucuggaca

SEQ ID NO: 1424111 - RNA, 15 nt, Homo sapiens
acauguaccacugag

SEQ ID NO: 1424112 - RNA, 16 nt, Homo sapiens
acaugugcuauugaac

SEQ ID NO: 1424113 - RNA, 20 nt, Homo sapiens
acauguguguauauaugugu

SEQ ID NO: 1424114 - RNA, 22 nt, Homo sapiens
acauguguguauauauguguau

SEQ ID NO: 1424115 - RNA, 23 nt, Homo sapiens
acauguuauccacaagcaaugga

SEQ ID NO: 1424116 - RNA, 14 nt, Homo sapiens
acauuaaaccugga

SEQ ID NO: 1424117 - RNA, 18 nt, Homo sapiens
acauuaaauucacaugca

SEQ ID NO: 1424118 - RNA, 15 nt, Homo sapiens
acauucccccaacau

SEQ ID NO: 1424119 - RNA, 16 nt, Homo sapiens
acauuccuccuacuuc

SEQ ID NO: 1424120 - RNA, 16 nt, Homo sapiens
acauugguauucuggg

SEQ ID NO: 1424121 - RNA, 15 nt, Homo sapiens
acauugucaccauuu

SEQ ID NO: 1424122 - RNA, 22 nt, Homo sapiens
acauuuaauacagcagugucau

SEQ ID NO: 1424123 - RNA, 19 nt, Homo sapiens
acauuugauguacaugugu

SEQ ID NO: 1424124 - RNA, 14 nt, Homo sapiens
acauuuuguuauag

SEQ ID NO: 1424125 - RNA, 16 nt, Homo sapiens
acauuuuuuguuugcu

SEQ ID NO: 1424126 - RNA, 21 nt, Homo sapiens
accaaaggacauuaugugugc

SEQ ID NO: 1424127 - RNA, 18 nt, Homo sapiens
accaaauaaaguaccauu

SEQ ID NO: 1424128 - RNA, 18 nt, Homo sapiens
accaaaugaugccacuuc

SEQ ID NO: 1424129 - RNA, 15 nt, Homo sapiens
accaacauggugaaa

SEQ ID NO: 1424130 - RNA, 12 nt, Homo sapiens
accaacuuucug

SEQ ID NO: 1424131 - RNA, 14 nt, Homo sapiens
accaagcuucagag

SEQ ID NO: 1424132 - RNA, 13 nt, Homo sapiens
accaauaauguau

SEQ ID NO: 1424133 - RNA, 17 nt, Homo sapiens
accaaugauucauaaca

SEQ ID NO: 1424134 - RNA, 18 nt, Homo sapiens
accaauuguacauucccu

SEQ ID NO: 1424135 - RNA, 15 nt, Homo sapiens
accacaacugacaca

SEQ ID NO: 1424136 - RNA, 19 nt, Homo sapiens
accacaacugacacaggaa

SEQ ID NO: 1424137 - RNA, 15 nt, Homo sapiens
accacaccaaaccuc

SEQ ID NO: 1424138 - RNA, 11 nt, Homo sapiens
accacagcagc

SEQ ID NO: 1424139 - RNA, 12 nt, Homo sapiens
accaccaugcca

SEQ ID NO: 1424140 - RNA, 16 nt, Homo sapiens
accaccugccagccau

SEQ ID NO: 1424141 - RNA, 22 nt, Homo sapiens
accacgaagcugugaacucaga

SEQ ID NO: 1424142 - RNA, 19 nt, Homo sapiens
accacuaugcaauauauca

SEQ ID NO: 1424143 - RNA, 15 nt, Homo sapiens
accacuccauuccca

SEQ ID NO: 1424144 - RNA, 15 nt, Homo sapiens
accacugagccugag

SEQ ID NO: 1424145 - RNA, 14 nt, Homo sapiens
accacuguacauau

SEQ ID NO: 1424146 - RNA, 17 nt, Homo sapiens
accacuguacauauaua

SEQ ID NO: 1424147 - RNA, 20 nt, Homo sapiens
accagaugaaauaauguucu

SEQ ID NO: 1424148 - RNA, 12 nt, Homo sapiens
accagauuugcu

SEQ ID NO: 1424149 - RNA, 14 nt, Homo sapiens
accagcagacacug

SEQ ID NO: 1424150 - RNA, 21 nt, Homo sapiens
accagcuaucugucaucucuc

SEQ ID NO: 1424151 - RNA, 14 nt, Homo sapiens
accagcugcucugc

SEQ ID NO: 1424152 - RNA, 17 nt, Homo sapiens
accaggacuauagccca

SEQ ID NO: 1424153 - RNA, 22 nt, Homo sapiens
accaggauugacaggccaucca

SEQ ID NO: 1424154 - RNA, 21 nt, Homo sapiens
accaggcaccaggcagggucu

SEQ ID NO: 1424155 - RNA, 22 nt, Homo sapiens
accaggguccgcaccagcugcu

SEQ ID NO: 1424156 - RNA, 16 nt, Homo sapiens
accaguacucaguaua

SEQ ID NO: 1424157 - RNA, 23 nt, Homo sapiens
accaguguccccuccacugucac

SEQ ID NO: 1424158 - RNA, 23 nt, Homo sapiens
accagugugcuugcccaccacag

SEQ ID NO: 1424159 - RNA, 19 nt, Homo sapiens
accaguugggagcacugga

SEQ ID NO: 1424160 - RNA, 13 nt, Homo sapiens
accauaacagcca

SEQ ID NO: 1424161 - RNA, 15 nt, Homo sapiens
accaugccaggcuaa

SEQ ID NO: 1424162 - RNA, 14 nt, Homo sapiens
accauuacuguaau

SEQ ID NO: 1424163 - RNA, 19 nt, Homo sapiens
accauugaccucagcugca

SEQ ID NO: 1424164 - RNA, 21 nt, Homo sapiens
accauuguuccuuaccuuuac

SEQ ID NO: 1424165 - RNA, 15 nt, Homo sapiens
acccacaucuaaugu

SEQ ID NO: 1424166 - RNA, 12 nt, Homo sapiens
acccacuggcca

SEQ ID NO: 1424167 - RNA, 16 nt, Homo sapiens
acccagaaauuccuuc

SEQ ID NO: 1424168 - RNA, 14 nt, Homo sapiens
acccagaacuggac

SEQ ID NO: 1424169 - RNA, 18 nt, Homo sapiens
acccagcaacacagagcu

SEQ ID NO: 1424170 - RNA, 16 nt, Homo sapiens
acccagcauguacaaa

SEQ ID NO: 1424171 - RNA, 15 nt, Homo sapiens
acccagcuacucugu

SEQ ID NO: 1424172 - RNA, 23 nt, Homo sapiens
acccagguuggcgacugcaacag

SEQ ID NO: 1424173 - RNA, 20 nt, Homo sapiens
acccaguccuggccauuuuc

SEQ ID NO: 1424174 - RNA, 20 nt, Homo sapiens
acccagugcugccaugccac

SEQ ID NO: 1424175 - RNA, 13 nt, Homo sapiens
acccaguguaaag

SEQ ID NO: 1424176 - RNA, 22 nt, Homo sapiens
acccaugaaucaaagacaugga

SEQ ID NO: 1424177 - RNA, 19 nt, Homo sapiens
acccauggguccaugggaa

SEQ ID NO: 1424178 - RNA, 21 nt, Homo sapiens
accccaacacccccaagacag

SEQ ID NO: 1424179 - RNA, 14 nt, Homo sapiens
accccaagggacaa

SEQ ID NO: 1424180 - RNA, 21 nt, Homo sapiens
accccagccuccugccuaccc

SEQ ID NO: 1424181 - RNA, 15 nt, Homo sapiens
accccaggaucccag

SEQ ID NO: 1424182 - RNA, 14 nt, Homo sapiens
acccccagccuggg

SEQ ID NO: 1424183 - RNA, 11 nt, Homo sapiens
acccccggggc

SEQ ID NO: 1424184 - RNA, 14 nt, Homo sapiens
acccccuucagugc

SEQ ID NO: 1424185 - RNA, 22 nt, Homo sapiens
accccgaccaccugcccaaccu

SEQ ID NO: 1424186 - RNA, 17 nt, Homo sapiens
accccgcggugcucugg

SEQ ID NO: 1424187 - RNA, 18 nt, Homo sapiens
accccugauaagcaaauu

SEQ ID NO: 1424188 - RNA, 23 nt, Homo sapiens
accccugucucuagccacuuugg

SEQ ID NO: 1424189 - RNA, 22 nt, Homo sapiens
accccuuggcuuuugcuuggca

SEQ ID NO: 1424190 - RNA, 16 nt, Homo sapiens
acccgcucuggaccaa

SEQ ID NO: 1424191 - RNA, 15 nt, Homo sapiens
acccuaaauguggac

SEQ ID NO: 1424192 - RNA, 20 nt, Homo sapiens
acccuacuucuuuugcucuu

SEQ ID NO: 1424193 - RNA, 14 nt, Homo sapiens
acccucaaauguca

SEQ ID NO: 1424194 - RNA, 18 nt, Homo sapiens
acccucaccaggaugaag

SEQ ID NO: 1424195 - RNA, 17 nt, Homo sapiens
acccuccuccacuccac

SEQ ID NO: 1424196 - RNA, 21 nt, Homo sapiens
acccugaaugguuccaugccu

SEQ ID NO: 1424197 - RNA, 18 nt, Homo sapiens
acccugaccugcugugca

SEQ ID NO: 1424198 - RNA, 16 nt, Homo sapiens
agagauguagcagaau

SEQ ID NO: 1424199 - RNA, 16 nt, Homo sapiens
agagauucuugugccu

SEQ ID NO: 1424200 - RNA, 23 nt, Homo sapiens
agagauuuucuuggcaguauucc

SEQ ID NO: 1424201 - RNA, 18 nt, Homo sapiens
agagcaaugguagcaaaa

SEQ ID NO: 1424202 - RNA, 15 nt, Homo sapiens
agagcacugcuccag

SEQ ID NO: 1424203 - RNA, 15 nt, Homo sapiens
agagcagcuggucaa

SEQ ID NO: 1424204 - RNA, 14 nt, Homo sapiens
agagcaucaugccu

SEQ ID NO: 1424205 - RNA, 21 nt, Homo sapiens
agagcauggaaaaauacugcc

SEQ ID NO: 1424206 - RNA, 15 nt, Homo sapiens
agagccagcucucuc

SEQ ID NO: 1424207 - RNA, 12 nt, Homo sapiens
agagccagugaa

SEQ ID NO: 1424208 - RNA, 16 nt, Homo sapiens
agagcccaagugccau

SEQ ID NO: 1424209 - RNA, 19 nt, Homo sapiens
agagcgagacuccgucuca

SEQ ID NO: 1424210 - RNA, 19 nt, Homo sapiens
agagcggcugcccgacuca

SEQ ID NO: 1424211 - RNA, 13 nt, Homo sapiens
agagcuagggcug

SEQ ID NO: 1424212 - RNA, 17 nt, Homo sapiens
agaggacgggaggcugg

SEQ ID NO: 1424213 - RNA, 13 nt, Homo sapiens
agaggacugagac

SEQ ID NO: 1424214 - RNA, 13 nt, Homo sapiens
agaggagguuugg

SEQ ID NO: 1424215 - RNA, 13 nt, Homo sapiens
agaggcagagaaa

SEQ ID NO: 1424216 - RNA, 19 nt, Homo sapiens
agaggcaugugaugugcaa

SEQ ID NO: 1424217 - RNA, 20 nt, Homo sapiens
agaggccaggaaucugccau

SEQ ID NO: 1424218 - RNA, 16 nt, Homo sapiens
agaggcugcaaggauu

SEQ ID NO: 1424219 - RNA, 18 nt, Homo sapiens
agagggcaaguguuccca

SEQ ID NO: 1424220 - RNA, 21 nt, Homo sapiens
agagggcagcccccacuuucc

SEQ ID NO: 1424221 - RNA, 22 nt, Homo sapiens
agagggcuguuggacagcugcu

SEQ ID NO: 1424222 - RNA, 20 nt, Homo sapiens
agagggggccuucacaguga

SEQ ID NO: 1424223 - RNA, 14 nt, Homo sapiens
agaggguguuugca

SEQ ID NO: 1424224 - RNA, 13 nt, Homo sapiens
agaggucugagcc

SEQ ID NO: 1424225 - RNA, 18 nt, Homo sapiens
agaggugcugucagcuca

SEQ ID NO: 1424226 - RNA, 13 nt, Homo sapiens
agagguggcugcu

SEQ ID NO: 1424227 - RNA, 21 nt, Homo sapiens
agagguggcugcugugcuagu

SEQ ID NO: 1424228 - RNA, 13 nt, Homo sapiens
agaguacagaugu

SEQ ID NO: 1424229 - RNA, 14 nt, Homo sapiens
agaguccucuggau

SEQ ID NO: 1424230 - RNA, 17 nt, Homo sapiens
agaguccuuucaggaag

SEQ ID NO: 1424231 - RNA, 23 nt, Homo sapiens
agagucugaaagacagaauguca

SEQ ID NO: 1424232 - RNA, 22 nt, Homo sapiens
agagugacauccaggaggaaua

SEQ ID NO: 1424233 - RNA, 16 nt, Homo sapiens
agaguggagucugagu

SEQ ID NO: 1424234 - RNA, 14 nt, Homo sapiens
agaguuucuccuuu

SEQ ID NO: 1424235 - RNA, 23 nt, Homo sapiens
agauaacaagaucuuucaggaaa

SEQ ID NO: 1424236 - RNA, 21 nt, Homo sapiens
agauaacuugagcaccgucau

SEQ ID NO: 1424237 - RNA, 13 nt, Homo sapiens
agauaauugccau

SEQ ID NO: 1424238 - RNA, 17 nt, Homo sapiens
agauacgcaaacacacc

SEQ ID NO: 1424239 - RNA, 21 nt, Homo sapiens
agauacuggcgccagggccaa

SEQ ID NO: 1424240 - RNA, 20 nt, Homo sapiens
agauaucacuuacucaguua

SEQ ID NO: 1424241 - RNA, 17 nt, Homo sapiens
agauaucaguuaucaau

SEQ ID NO: 1424242 - RNA, 11 nt, Homo sapiens
agauaugauau

SEQ ID NO: 1424243 - RNA, 20 nt, Homo sapiens
agauaugcacacacacggau

SEQ ID NO: 1424244 - RNA, 17 nt, Homo sapiens
agauauuauucauucau

SEQ ID NO: 1424245 - RNA, 24 nt, Homo sapiens
agauccacccuaucccuguacaga

SEQ ID NO: 1424246 - RNA, 17 nt, Homo sapiens
agaucuggaaccuuacc

SEQ ID NO: 1424247 - RNA, 20 nt, Homo sapiens
agaucugugggcccagucau

SEQ ID NO: 1424248 - RNA, 17 nt, Homo sapiens
agaucuuucaggaaaga

SEQ ID NO: 1424249 - RNA, 18 nt, Homo sapiens
agaugaaauuuauuucca

SEQ ID NO: 1424250 - RNA, 15 nt, Homo sapiens
agaugcccuccaauc

SEQ ID NO: 1424251 - RNA, 20 nt, Homo sapiens
agaugccuuccugucuuucu

SEQ ID NO: 1424252 - RNA, 20 nt, Homo sapiens
agaugcugacuguacuccuc

SEQ ID NO: 1424253 - RNA, 17 nt, Homo sapiens
agauguaaaugccacaa

SEQ ID NO: 1424254 - RNA, 19 nt, Homo sapiens
agaugugaacacaucagcu

SEQ ID NO: 1424255 - RNA, 22 nt, Homo sapiens
agaugugggcagugaugucacu

SEQ ID NO: 1424256 - RNA, 16 nt, Homo sapiens
agauuaauggcacuga

SEQ ID NO: 1424257 - RNA, 13 nt, Homo sapiens
agauuaccugcca

SEQ ID NO: 1424258 - RNA, 20 nt, Homo sapiens
agauuagcucuggaccagcc

SEQ ID NO: 1424259 - RNA, 21 nt, Homo sapiens
agauuguccagugcaaccaca

SEQ ID NO: 1424260 - RNA, 13 nt, Homo sapiens
agauugugcccag

SEQ ID NO: 1424261 - RNA, 14 nt, Homo sapiens
agauuuaacacuaa

SEQ ID NO: 1424262 - RNA, 15 nt, Homo sapiens
agauuucaacauauc

SEQ ID NO: 1424263 - RNA, 21 nt, Homo sapiens
agauuucuccugacuccagug

SEQ ID NO: 1424264 - RNA, 18 nt, Homo sapiens
agauuugcuguucaccca

SEQ ID NO: 1424265 - RNA, 17 nt, Homo sapiens
agauuuugucgggacag

SEQ ID NO: 1424266 - RNA, 20 nt, Homo sapiens
agauuuugucgggacagaga

SEQ ID NO: 1424267 - RNA, 13 nt, Homo sapiens
agcaaaacaagga

SEQ ID NO: 1424268 - RNA, 20 nt, Homo sapiens
agcaaaacaauaaacuagca

SEQ ID NO: 1424269 - RNA, 17 nt, Homo sapiens
agcaaaagucauuacac

SEQ ID NO: 1424270 - RNA, 15 nt, Homo sapiens
agcaaagcaaaacaa

SEQ ID NO: 1424271 - RNA, 16 nt, Homo sapiens
agcaaauguggcuccu

SEQ ID NO: 1424272 - RNA, 16 nt, Homo sapiens
agcaaauuaguaauug

SEQ ID NO: 1424273 - RNA, 13 nt, Homo sapiens
agcaacacagagc

SEQ ID NO: 1424274 - RNA, 22 nt, Homo sapiens
agcaacaguuaugggacacuga

SEQ ID NO: 1424275 - RNA, 13 nt, Homo sapiens
agcaacugcagaa

SEQ ID NO: 1424276 - RNA, 17 nt, Homo sapiens
agcaauagggugcaguu

SEQ ID NO: 1424277 - RNA, 18 nt, Homo sapiens
agcaaucucgcaguacau

SEQ ID NO: 1424278 - RNA, 19 nt, Homo sapiens
agcaaugcccguaaugcuu

SEQ ID NO: 1424279 - RNA, 16 nt, Homo sapiens
agcaauuccagggugg

SEQ ID NO: 1424280 - RNA, 23 nt, Homo sapiens
agcacaugaaaaccauuaccuga

SEQ ID NO: 1424281 - RNA, 21 nt, Homo sapiens
agcaccaauuguacauucccu

SEQ ID NO: 1424282 - RNA, 23 nt, Homo sapiens
agcaccucuuuuugaacagggaa

SEQ ID NO: 1424283 - RNA, 21 nt, Homo sapiens
agcacugccaggagggacaaa

SEQ ID NO: 1424284 - RNA, 16 nt, Homo sapiens
caacaugcgaccguga

SEQ ID NO: 1424285 - RNA, 16 nt, Homo sapiens
caacauuuaaugagca

SEQ ID NO: 1424286 - RNA, 22 nt, Homo sapiens
caaccccuguacccagcuccuu

SEQ ID NO: 1424287 - RNA, 14 nt, Homo sapiens
caaccccuuuccac

SEQ ID NO: 1424288 - RNA, 14 nt, Homo sapiens
caacccucacugug

SEQ ID NO: 1424289 - RNA, 16 nt, Homo sapiens
caaccugccugugcau

SEQ ID NO: 1424290 - RNA, 20 nt, Homo sapiens
caaccugcucuccucuugcc

SEQ ID NO: 1424291 - RNA, 21 nt, Homo sapiens
caaccuguucuuccuaccaaa

SEQ ID NO: 1424292 - RNA, 17 nt, Homo sapiens
caaccuuuaaaaaagca

SEQ ID NO: 1424293 - RNA, 14 nt, Homo sapiens
caacgagagcacuu

SEQ ID NO: 1424294 - RNA, 18 nt, Homo sapiens
caacgagagcacuugaaa

SEQ ID NO: 1424295 - RNA, 21 nt, Homo sapiens
caacgcacaggaaaagguagc

SEQ ID NO: 1424296 - RNA, 17 nt, Homo sapiens
caacuaccuagacugga

SEQ ID NO: 1424297 - RNA, 15 nt, Homo sapiens
caacuacugugauca

SEQ ID NO: 1424298 - RNA, 21 nt, Homo sapiens
caacugcaucuccaaacauua

SEQ ID NO: 1424299 - RNA, 15 nt, Homo sapiens
caacuggagcacuga

SEQ ID NO: 1424300 - RNA, 19 nt, Homo sapiens
caacuuggaaaaagaaaga

SEQ ID NO: 1424301 - RNA, 12 nt, Homo sapiens
caacuuucugua

SEQ ID NO: 1424302 - RNA, 19 nt, Homo sapiens
caagaaauccaguuuccca

SEQ ID NO: 1424303 - RNA, 17 nt, Homo sapiens
caagaaauugccuccuu

SEQ ID NO: 1424304 - RNA, 13 nt, Homo sapiens
caagaagggcuag

SEQ ID NO: 1424305 - RNA, 12 nt, Homo sapiens
caagaaggugag

SEQ ID NO: 1424306 - RNA, 16 nt, Homo sapiens
caagaaguacaugaag

SEQ ID NO: 1424307 - RNA, 16 nt, Homo sapiens
caagaaucaccucaaa

SEQ ID NO: 1424308 - RNA, 13 nt, Homo sapiens
caagaaugaaaca

SEQ ID NO: 1424309 - RNA, 19 nt, Homo sapiens
caagacuugauacugcaau

SEQ ID NO: 1424310 - RNA, 20 nt, Homo sapiens
caagacuuggcaacagaagc

SEQ ID NO: 1424311 - RNA, 23 nt, Homo sapiens
caagagagaaagaaguaggcaug

SEQ ID NO: 1424312 - RNA, 17 nt, Homo sapiens
caagagcuggcaaaggu

SEQ ID NO: 1424313 - RNA, 16 nt, Homo sapiens
caagaggacugagacu

SEQ ID NO: 1424314 - RNA, 16 nt, Homo sapiens
caagaggcuccugucc

SEQ ID NO: 1424315 - RNA, 14 nt, Homo sapiens
caagaggucuccau

SEQ ID NO: 1424316 - RNA, 16 nt, Homo sapiens
caagagguggggacca

SEQ ID NO: 1424317 - RNA, 15 nt, Homo sapiens
caagaguggacugaa

SEQ ID NO: 1424318 - RNA, 21 nt, Homo sapiens
caagaguuuauuuccaaauaa

SEQ ID NO: 1424319 - RNA, 16 nt, Homo sapiens
caagaucuuucaggaa

SEQ ID NO: 1424320 - RNA, 17 nt, Homo sapiens
caagaucuuucaggaaa

SEQ ID NO: 1424321 - RNA, 21 nt, Homo sapiens
caagauggaggggcugacuca

SEQ ID NO: 1424322 - RNA, 18 nt, Homo sapiens
caagaugugggcagugau

SEQ ID NO: 1424323 - RNA, 22 nt, Homo sapiens
caagauuucagaagccaaguuu

SEQ ID NO: 1424324 - RNA, 16 nt, Homo sapiens
caagauuuucuacuuu

SEQ ID NO: 1424325 - RNA, 18 nt, Homo sapiens
caagcagcauucagcaca

SEQ ID NO: 1424326 - RNA, 18 nt, Homo sapiens
caagcagccgcagcgcag

SEQ ID NO: 1424327 - RNA, 20 nt, Homo sapiens
caagcauugcuucagaauga

SEQ ID NO: 1424328 - RNA, 15 nt, Homo sapiens
caagccacuaccuuc

SEQ ID NO: 1424329 - RNA, 17 nt, Homo sapiens
caagccauucacuuccc

SEQ ID NO: 1424330 - RNA, 16 nt, Homo sapiens
caagccccacuuauuc

SEQ ID NO: 1424331 - RNA, 23 nt, Homo sapiens
caagcuagaaggccacaugucac

SEQ ID NO: 1424332 - RNA, 16 nt, Homo sapiens
caagcugcuuuggaca

SEQ ID NO: 1424333 - RNA, 17 nt, Homo sapiens
caaggacuagagcucag

SEQ ID NO: 1424334 - RNA, 21 nt, Homo sapiens
caaggaggucgggauggggcu

SEQ ID NO: 1424335 - RNA, 17 nt, Homo sapiens
caaggaguaaguacaaa

SEQ ID NO: 1424336 - RNA, 16 nt, Homo sapiens
caaggaucucaaagaa

SEQ ID NO: 1424337 - RNA, 15 nt, Homo sapiens
caaggcaacugugag

SEQ ID NO: 1424338 - RNA, 17 nt, Homo sapiens
caaggcugaccaagaga

SEQ ID NO: 1424339 - RNA, 21 nt, Homo sapiens
caagggaaggaagggacacac

SEQ ID NO: 1424340 - RNA, 18 nt, Homo sapiens
caagguggggggaucaca

SEQ ID NO: 1424341 - RNA, 19 nt, Homo sapiens
caagguggguggaucaccu

SEQ ID NO: 1424342 - RNA, 19 nt, Homo sapiens
caaguacauggcuagcuuu

SEQ ID NO: 1424343 - RNA, 14 nt, Homo sapiens
caaguauugcgaau

SEQ ID NO: 1424344 - RNA, 18 nt, Homo sapiens
caaguccaagcauaccaa

SEQ ID NO: 1424345 - RNA, 15 nt, Homo sapiens
caagucuacuucacu

SEQ ID NO: 1424346 - RNA, 21 nt, Homo sapiens
caagucuacuucacuaaugac

SEQ ID NO: 1424347 - RNA, 15 nt, Homo sapiens
caagugacaugccau

SEQ ID NO: 1424348 - RNA, 18 nt, Homo sapiens
caagugauaucaccucuc

SEQ ID NO: 1424349 - RNA, 14 nt, Homo sapiens
caaguuaggagcuu

SEQ ID NO: 1424350 - RNA, 15 nt, Homo sapiens
caaguuauauugaau

SEQ ID NO: 1424351 - RNA, 16 nt, Homo sapiens
caaguuauucucuuca

SEQ ID NO: 1424352 - RNA, 19 nt, Homo sapiens
caaguucuggaaaccacgu

SEQ ID NO: 1424353 - RNA, 19 nt, Homo sapiens
caaguuucccaaauucccu

SEQ ID NO: 1424354 - RNA, 18 nt, Homo sapiens
caaguuucuagcuagaaa

SEQ ID NO: 1424355 - RNA, 14 nt, Homo sapiens
caaguuuuaagaga

SEQ ID NO: 1424356 - RNA, 14 nt, Homo sapiens
caaguuuuucuaac

SEQ ID NO: 1424357 - RNA, 16 nt, Homo sapiens
caauaaaaaaaaaccu

SEQ ID NO: 1424358 - RNA, 18 nt, Homo sapiens
caauaaacauagcuugua

SEQ ID NO: 1424359 - RNA, 22 nt, Homo sapiens
caauaaagaguauuuacaauaa

SEQ ID NO: 1424360 - RNA, 12 nt, Homo sapiens
caauaagccagc

SEQ ID NO: 1424361 - RNA, 16 nt, Homo sapiens
caauaauaaauccuca

SEQ ID NO: 1424362 - RNA, 17 nt, Homo sapiens
caauaaugaguucacua

SEQ ID NO: 1424363 - RNA, 17 nt, Homo sapiens
caauacaugcugcuaau

SEQ ID NO: 1424364 - RNA, 14 nt, Homo sapiens
caauaccagaucac

SEQ ID NO: 1424365 - RNA, 18 nt, Homo sapiens
caauaccagaucacucaa

SEQ ID NO: 1424366 - RNA, 18 nt, Homo sapiens
caauaugggcucaaguca

SEQ ID NO: 1424367 - RNA, 16 nt, Homo sapiens
caauauuucugauaua

SEQ ID NO: 1424368 - RNA, 12 nt, Homo sapiens
caaucacacuca

SEQ ID NO: 1424369 - RNA, 15 nt, Homo sapiens
caaucagugcaguga

SEQ ID NO: 1424370 - RNA, 15 nt, Homo sapiens
caaucucaucugaua

SEQ ID NO: 1424371 - RNA, 19 nt, Homo sapiens
cagccucagugccacuuga

SEQ ID NO: 1424372 - RNA, 19 nt, Homo sapiens
cagccuccaccuugcucuu

SEQ ID NO: 1424373 - RNA, 18 nt, Homo sapiens
cagccucccaaguagcug

SEQ ID NO: 1424374 - RNA, 19 nt, Homo sapiens
cagccucccgaguagcugg

SEQ ID NO: 1424375 - RNA, 14 nt, Homo sapiens
cagccuccucagua

SEQ ID NO: 1424376 - RNA, 12 nt, Homo sapiens
cagccucucugc

SEQ ID NO: 1424377 - RNA, 14 nt, Homo sapiens
cagccugauggcca

SEQ ID NO: 1424378 - RNA, 19 nt, Homo sapiens
cagccugggcaacauagua

SEQ ID NO: 1424379 - RNA, 22 nt, Homo sapiens
cagccuucugacaagcaagggc

SEQ ID NO: 1424380 - RNA, 15 nt, Homo sapiens
cagccuucuuuucaa

SEQ ID NO: 1424381 - RNA, 17 nt, Homo sapiens
cagcgaaaggauguaaa

SEQ ID NO: 1424382 - RNA, 18 nt, Homo sapiens
cagcgaaugaaugcugua

SEQ ID NO: 1424383 - RNA, 14 nt, Homo sapiens
cagcgauccacgga

SEQ ID NO: 1424384 - RNA, 13 nt, Homo sapiens
cagcgcgugcaca

SEQ ID NO: 1424385 - RNA, 14 nt, Homo sapiens
cagcgcgugcacag

SEQ ID NO: 1424386 - RNA, 20 nt, Homo sapiens
cagcggcacaaaugcaccuc

SEQ ID NO: 1424387 - RNA, 21 nt, Homo sapiens
cagcuaagcccccuacugaga

SEQ ID NO: 1424388 - RNA, 22 nt, Homo sapiens
cagcuaagcccccuacugagaa

SEQ ID NO: 1424389 - RNA, 13 nt, Homo sapiens
cagcuacauuccu

SEQ ID NO: 1424390 - RNA, 19 nt, Homo sapiens
cagcuacucaggaggcuaa

SEQ ID NO: 1424391 - RNA, 19 nt, Homo sapiens
cagcuagggcuggacucug

SEQ ID NO: 1424392 - RNA, 18 nt, Homo sapiens
cagcuaucugucaucucu

SEQ ID NO: 1424393 - RNA, 16 nt, Homo sapiens
cagcucuccugcugca

SEQ ID NO: 1424394 - RNA, 20 nt, Homo sapiens
cagcugaccuuugucaucuu

SEQ ID NO: 1424395 - RNA, 15 nt, Homo sapiens
cagcuggaacccugg

SEQ ID NO: 1424396 - RNA, 13 nt, Homo sapiens
cagcuggugcugc

SEQ ID NO: 1424397 - RNA, 15 nt, Homo sapiens
cagcuggugcugcaa

SEQ ID NO: 1424398 - RNA, 23 nt, Homo sapiens
cagcugugaacauggacucuucc

SEQ ID NO: 1424399 - RNA, 23 nt, Homo sapiens
cagcuguguucacacuguaaaca

SEQ ID NO: 1424400 - RNA, 19 nt, Homo sapiens
cagcuuugcuaccaaagca

SEQ ID NO: 1424401 - RNA, 17 nt, Homo sapiens
caggaaaacaaaucacu

SEQ ID NO: 1424402 - RNA, 14 nt, Homo sapiens
caggaaaccaacac

SEQ ID NO: 1424403 - RNA, 20 nt, Homo sapiens
caggaaaccaacacccaaag

SEQ ID NO: 1424404 - RNA, 14 nt, Homo sapiens
caggaaaucaaaua

SEQ ID NO: 1424405 - RNA, 19 nt, Homo sapiens
caggaacacccgacuccuc

SEQ ID NO: 1424406 - RNA, 14 nt, Homo sapiens
caggaaggagcaaa

SEQ ID NO: 1424407 - RNA, 20 nt, Homo sapiens
caggacacaggccuguguag

SEQ ID NO: 1424408 - RNA, 23 nt, Homo sapiens
caggacaccagccuggugcccau

SEQ ID NO: 1424409 - RNA, 13 nt, Homo sapiens
caggacaccugcc

SEQ ID NO: 1424410 - RNA, 16 nt, Homo sapiens
caggacucugccccuu

SEQ ID NO: 1424411 - RNA, 17 nt, Homo sapiens
caggacuugaacccagg

SEQ ID NO: 1424412 - RNA, 14 nt, Homo sapiens
caggagacaguuca

SEQ ID NO: 1424413 - RNA, 13 nt, Homo sapiens
caggagacccaga

SEQ ID NO: 1424414 - RNA, 17 nt, Homo sapiens
caggagccgcugcugag

SEQ ID NO: 1424415 - RNA, 21 nt, Homo sapiens
caggagcuaccuguguggaca

SEQ ID NO: 1424416 - RNA, 20 nt, Homo sapiens
caggagguggagguugcagu

SEQ ID NO: 1424417 - RNA, 18 nt, Homo sapiens
caggaguagcugagcuca

SEQ ID NO: 1424418 - RNA, 20 nt, Homo sapiens
caggaguugacgcauccugc

SEQ ID NO: 1424419 - RNA, 23 nt, Homo sapiens
caggaucuguacaauaauaauua

SEQ ID NO: 1424420 - RNA, 22 nt, Homo sapiens
caggauggaauccuacagccuc

SEQ ID NO: 1424421 - RNA, 21 nt, Homo sapiens
caggauggggacacuaaugaa

SEQ ID NO: 1424422 - RNA, 22 nt, Homo sapiens
caggauuaaugguccugugaug

SEQ ID NO: 1424423 - RNA, 15 nt, Homo sapiens
caggauugacaggcc

SEQ ID NO: 1424424 - RNA, 22 nt, Homo sapiens
caggauuucaucugagugugga

SEQ ID NO: 1424425 - RNA, 14 nt, Homo sapiens
caggcaagugaaga

SEQ ID NO: 1424426 - RNA, 18 nt, Homo sapiens
caggcagguuugccagug

SEQ ID NO: 1424427 - RNA, 19 nt, Homo sapiens
caggcagguuugccaguga

SEQ ID NO: 1424428 - RNA, 19 nt, Homo sapiens
caggcauggcgaggcugag

SEQ ID NO: 1424429 - RNA, 14 nt, Homo sapiens
caggccaccaggau

SEQ ID NO: 1424430 - RNA, 18 nt, Homo sapiens
caggccacuguggccaga

SEQ ID NO: 1424431 - RNA, 18 nt, Homo sapiens
caggccagagugcugcca

SEQ ID NO: 1424432 - RNA, 15 nt, Homo sapiens
caggccauccauuca

SEQ ID NO: 1424433 - RNA, 13 nt, Homo sapiens
caggcccagagaa

SEQ ID NO: 1424434 - RNA, 16 nt, Homo sapiens
caggcccugccuucag

SEQ ID NO: 1424435 - RNA, 22 nt, Homo sapiens
caggccuguguagcugugaccu

SEQ ID NO: 1424436 - RNA, 19 nt, Homo sapiens
caggcucagacucuggguc

SEQ ID NO: 1424437 - RNA, 19 nt, Homo sapiens
caggcuguaagcauucuga

SEQ ID NO: 1424438 - RNA, 22 nt, Homo sapiens
caggcugugggucugcaccucu

SEQ ID NO: 1424439 - RNA, 16 nt, Homo sapiens
cagggaagagggcagu

SEQ ID NO: 1424440 - RNA, 17 nt, Homo sapiens
cagggaagagggcagua

SEQ ID NO: 1424441 - RNA, 23 nt, Homo sapiens
cagggagcagggcagaaaacaca

SEQ ID NO: 1424442 - RNA, 14 nt, Homo sapiens
cagggaggaugcca

SEQ ID NO: 1424443 - RNA, 17 nt, Homo sapiens
cagggcaaaugcuugau

SEQ ID NO: 1424444 - RNA, 16 nt, Homo sapiens
cagggcagaaaacaca

SEQ ID NO: 1424445 - RNA, 13 nt, Homo sapiens
cagggcagggaaa

SEQ ID NO: 1424446 - RNA, 14 nt, Homo sapiens
cagggcaguaucuc

SEQ ID NO: 1424447 - RNA, 13 nt, Homo sapiens
cagggcucugccc

SEQ ID NO: 1424448 - RNA, 18 nt, Homo sapiens
caggggaaaaugaagguu

SEQ ID NO: 1424449 - RNA, 15 nt, Homo sapiens
caggggaccacaccu

SEQ ID NO: 1424450 - RNA, 21 nt, Homo sapiens
caggggcuucuuucuuuucga

SEQ ID NO: 1424451 - RNA, 19 nt, Homo sapiens
caggggugccugugggggu

SEQ ID NO: 1424452 - RNA, 17 nt, Homo sapiens
cagggucucacuauguu

SEQ ID NO: 1424453 - RNA, 23 nt, Homo sapiens
cagggugaggugcuugcccccau

SEQ ID NO: 1424454 - RNA, 17 nt, Homo sapiens
caggguguuaaggcagu

SEQ ID NO: 1424455 - RNA, 22 nt, Homo sapiens
caggguguuaaggcagugacuu

SEQ ID NO: 1424456 - RNA, 17 nt, Homo sapiens
cagguaaccacaauuuu

SEQ ID NO: 1424457 - RNA, 14 nt, Homo sapiens
ccacaaugccucuc

SEQ ID NO: 1424458 - RNA, 16 nt, Homo sapiens
ccacacagggugcaug

SEQ ID NO: 1424459 - RNA, 16 nt, Homo sapiens
ccacacggaggcaucu

SEQ ID NO: 1424460 - RNA, 17 nt, Homo sapiens
ccacagacaacauggaa

SEQ ID NO: 1424461 - RNA, 20 nt, Homo sapiens
ccacagcagcugaacagcca

SEQ ID NO: 1424462 - RNA, 18 nt, Homo sapiens
ccacaucacuacaguaca

SEQ ID NO: 1424463 - RNA, 20 nt, Homo sapiens
ccacaucacuacaguacagu

SEQ ID NO: 1424464 - RNA, 12 nt, Homo sapiens
ccaccaggcuag

SEQ ID NO: 1424465 - RNA, 16 nt, Homo sapiens
ccacccaaaagucaaa

SEQ ID NO: 1424466 - RNA, 19 nt, Homo sapiens
ccacccaccuguacucugg

SEQ ID NO: 1424467 - RNA, 17 nt, Homo sapiens
ccaccccuaaagagaua

SEQ ID NO: 1424468 - RNA, 20 nt, Homo sapiens
ccacccguaggcagccucuc

SEQ ID NO: 1424469 - RNA, 21 nt, Homo sapiens
ccacccugaggagucugaggu

SEQ ID NO: 1424470 - RNA, 17 nt, Homo sapiens
ccaccgggccugaacca

SEQ ID NO: 1424471 - RNA, 16 nt, Homo sapiens
ccaccucaggcugcca

SEQ ID NO: 1424472 - RNA, 10 nt, Homo sapiens
ccaccucuca

SEQ ID NO: 1424473 - RNA, 16 nt, Homo sapiens
ccaccucuccuuuggc

SEQ ID NO: 1424474 - RNA, 12 nt, Homo sapiens
ccaccuucuuca

SEQ ID NO: 1424475 - RNA, 21 nt, Homo sapiens
ccacgagggucaggacuguga

SEQ ID NO: 1424476 - RNA, 12 nt, Homo sapiens
ccacggagcuga

SEQ ID NO: 1424477 - RNA, 13 nt, Homo sapiens
ccacucacuccag

SEQ ID NO: 1424478 - RNA, 15 nt, Homo sapiens
ccacuccaccuccac

SEQ ID NO: 1424479 - RNA, 17 nt, Homo sapiens
ccacucccaaagcucag

SEQ ID NO: 1424480 - RNA, 12 nt, Homo sapiens
ccacucuaauau

SEQ ID NO: 1424481 - RNA, 16 nt, Homo sapiens
ccacucuuugcuacaa

SEQ ID NO: 1424482 - RNA, 18 nt, Homo sapiens
ccacugaacauuugcuuu

SEQ ID NO: 1424483 - RNA, 22 nt, Homo sapiens
ccacuggcauuaaagugcugua

SEQ ID NO: 1424484 - RNA, 23 nt, Homo sapiens
ccacuuaccuagauucuacauau

SEQ ID NO: 1424485 - RNA, 12 nt, Homo sapiens
ccacuugggagc

SEQ ID NO: 1424486 - RNA, 23 nt, Homo sapiens
ccacuuuucaugucauuugacau

SEQ ID NO: 1424487 - RNA, 14 nt, Homo sapiens
ccagaacccuuccu

SEQ ID NO: 1424488 - RNA, 21 nt, Homo sapiens
ccagaagaauauucaggacuu

SEQ ID NO: 1424489 - RNA, 22 nt, Homo sapiens
ccagaaggcagggaaaggcucu

SEQ ID NO: 1424490 - RNA, 19 nt, Homo sapiens
ccagaaguccuaucgacuu

SEQ ID NO: 1424491 - RNA, 14 nt, Homo sapiens
ccagaaugcuaaag

SEQ ID NO: 1424492 - RNA, 15 nt, Homo sapiens
ccagacacauucucc

SEQ ID NO: 1424493 - RNA, 12 nt, Homo sapiens
ccagacagagcc

SEQ ID NO: 1424494 - RNA, 20 nt, Homo sapiens
ccagacauacgaaacacaaa

SEQ ID NO: 1424495 - RNA, 18 nt, Homo sapiens
ccagaccauugucuucca

SEQ ID NO: 1424496 - RNA, 20 nt, Homo sapiens
ccagacucguucuucuggga

SEQ ID NO: 1424497 - RNA, 21 nt, Homo sapiens
ccagacucguucuucugggaa

SEQ ID NO: 1424498 - RNA, 16 nt, Homo sapiens
ccagacuggcacaguu

SEQ ID NO: 1424499 - RNA, 18 nt, Homo sapiens
ccagagaccugaggcaga

SEQ ID NO: 1424500 - RNA, 20 nt, Homo sapiens
ccagagccccccacaaugau

SEQ ID NO: 1424501 - RNA, 23 nt, Homo sapiens
ccagagccccccacaaugaugau

SEQ ID NO: 1424502 - RNA, 20 nt, Homo sapiens
ccagagccggggcacuuuca

SEQ ID NO: 1424503 - RNA, 14 nt, Homo sapiens
ccagaggcugcaga

SEQ ID NO: 1424504 - RNA, 20 nt, Homo sapiens
ccagauguuuacagacugug

SEQ ID NO: 1424505 - RNA, 13 nt, Homo sapiens
ccagcaacacaga

SEQ ID NO: 1424506 - RNA, 16 nt, Homo sapiens
ccagcacuuugggagg

SEQ ID NO: 1424507 - RNA, 18 nt, Homo sapiens
ccagcagggccucaaagu

SEQ ID NO: 1424508 - RNA, 13 nt, Homo sapiens
ccagccaucacaa

SEQ ID NO: 1424509 - RNA, 13 nt, Homo sapiens
ccagccaugguga

SEQ ID NO: 1424510 - RNA, 14 nt, Homo sapiens
ccagccauggugag

SEQ ID NO: 1424511 - RNA, 20 nt, Homo sapiens
ccagccgugaugcucaggcu

SEQ ID NO: 1424512 - RNA, 14 nt, Homo sapiens
ccagcuacauuccu

SEQ ID NO: 1424513 - RNA, 21 nt, Homo sapiens
ccagcuacucgggaggcugag

SEQ ID NO: 1424514 - RNA, 22 nt, Homo sapiens
ccagcugaggcugggggcgggg

SEQ ID NO: 1424515 - RNA, 16 nt, Homo sapiens
ccagcugcaucuacuc

SEQ ID NO: 1424516 - RNA, 16 nt, Homo sapiens
ccagcuggugcugcaa

SEQ ID NO: 1424517 - RNA, 15 nt, Homo sapiens
ccaggaaggcagcug

SEQ ID NO: 1424518 - RNA, 16 nt, Homo sapiens
ccaggaauaggcauuu

SEQ ID NO: 1424519 - RNA, 13 nt, Homo sapiens
ccaggagacaguu

SEQ ID NO: 1424520 - RNA, 19 nt, Homo sapiens
ccaggagaugcugggccag

SEQ ID NO: 1424521 - RNA, 21 nt, Homo sapiens
ccaggagaugcugggccaguu

SEQ ID NO: 1424522 - RNA, 20 nt, Homo sapiens
ccaggaggaauaagcuccca

SEQ ID NO: 1424523 - RNA, 16 nt, Homo sapiens
ccaggauggugcagga

SEQ ID NO: 1424524 - RNA, 23 nt, Homo sapiens
ccaggcaggggugggagagccag

SEQ ID NO: 1424525 - RNA, 17 nt, Homo sapiens
ccaggcaggugccugga

SEQ ID NO: 1424526 - RNA, 18 nt, Homo sapiens
ccaggcaucccaucccuu

SEQ ID NO: 1424527 - RNA, 17 nt, Homo sapiens
ccaggcccaaggaguaa

SEQ ID NO: 1424528 - RNA, 22 nt, Homo sapiens
ccaggcccggggcuggcggcua

SEQ ID NO: 1424529 - RNA, 17 nt, Homo sapiens
ccaggccgccugccaua

SEQ ID NO: 1424530 - RNA, 15 nt, Homo sapiens
ccaggccugagcaac

SEQ ID NO: 1424531 - RNA, 18 nt, Homo sapiens
ccaggccugagcaacaaa

SEQ ID NO: 1424532 - RNA, 12 nt, Homo sapiens
ccaggcugcacg

SEQ ID NO: 1424533 - RNA, 17 nt, Homo sapiens
ccaggcuggaguacagu

SEQ ID NO: 1424534 - RNA, 20 nt, Homo sapiens
ccaggcuggagugcaguggu

SEQ ID NO: 1424535 - RNA, 20 nt, Homo sapiens
ccaggcugugggucugcacc

SEQ ID NO: 1424536 - RNA, 23 nt, Homo sapiens
ccaggggaaugaucucugaugac

SEQ ID NO: 1424537 - RNA, 16 nt, Homo sapiens
ccaggggcugcucauc

SEQ ID NO: 1424538 - RNA, 22 nt, Homo sapiens
ccagggucuugggcuacuggca

SEQ ID NO: 1424539 - RNA, 21 nt, Homo sapiens
ccagguccggagggguugcgg

SEQ ID NO: 1424540 - RNA, 19 nt, Homo sapiens
ccagguguugccauuucuc

SEQ ID NO: 1424541 - RNA, 14 nt, Homo sapiens
ccagucagcaggag

SEQ ID NO: 1424542 - RNA, 12 nt, Homo sapiens
ccaguccaugag

SEQ ID NO: 1424543 - RNA, 15 nt, Homo sapiens
ccagucccagagcag

SEQ ID NO: 1424544 - RNA, 18 nt, Homo sapiens
ccugaaugguuccaugcc

SEQ ID NO: 1424545 - RNA, 15 nt, Homo sapiens
ccugacagaugucag

SEQ ID NO: 1424546 - RNA, 21 nt, Homo sapiens
ccugacagguucccagcagcu

SEQ ID NO: 1424547 - RNA, 19 nt, Homo sapiens
ccugaccaacauggugaaa

SEQ ID NO: 1424548 - RNA, 17 nt, Homo sapiens
ccugacccuacuucuuu

SEQ ID NO: 1424549 - RNA, 20 nt, Homo sapiens
ccugacccuccuccacucca

SEQ ID NO: 1424550 - RNA, 18 nt, Homo sapiens
ccugaccgugcuaacugu

SEQ ID NO: 1424551 - RNA, 22 nt, Homo sapiens
ccugaccucaggugauccaccc

SEQ ID NO: 1424552 - RNA, 19 nt, Homo sapiens
ccugaccugucaccgugag

SEQ ID NO: 1424553 - RNA, 20 nt, Homo sapiens
ccugaggcucaagaggccca

SEQ ID NO: 1424554 - RNA, 18 nt, Homo sapiens
ccugaggcuccugugcua

SEQ ID NO: 1424555 - RNA, 21 nt, Homo sapiens
ccugaugacagagcgagauuc

SEQ ID NO: 1424556 - RNA, 21 nt, Homo sapiens
ccugaugccccuuccccaaga

SEQ ID NO: 1424557 - RNA, 15 nt, Homo sapiens
ccugauuucagggaa

SEQ ID NO: 1424558 - RNA, 14 nt, Homo sapiens
ccugcaccugugca

SEQ ID NO: 1424559 - RNA, 15 nt, Homo sapiens
ccugcacgccaccgc

SEQ ID NO: 1424560 - RNA, 21 nt, Homo sapiens
ccugcagagccucuacacaga

SEQ ID NO: 1424561 - RNA, 20 nt, Homo sapiens
ccugcagccuccuccugacc

SEQ ID NO: 1424562 - RNA, 15 nt, Homo sapiens
ccugcccucugggag

SEQ ID NO: 1424563 - RNA, 16 nt, Homo sapiens
ccugcccugcugccgc

SEQ ID NO: 1424564 - RNA, 16 nt, Homo sapiens
ccugccuccagcacuc

SEQ ID NO: 1424565 - RNA, 19 nt, Homo sapiens
ccugccucccuuucuggga

SEQ ID NO: 1424566 - RNA, 20 nt, Homo sapiens
ccugccugagcccaggagcu

SEQ ID NO: 1424567 - RNA, 23 nt, Homo sapiens
ccugccugcgggggaguggggga

SEQ ID NO: 1424568 - RNA, 17 nt, Homo sapiens
ccugccuuccaaccccu

SEQ ID NO: 1424569 - RNA, 15 nt, Homo sapiens
ccugcggcccagaag

SEQ ID NO: 1424570 - RNA, 19 nt, Homo sapiens
ccugcgggcaccuacaagg

SEQ ID NO: 1424571 - RNA, 19 nt, Homo sapiens
ccugcucccagcagcccua

SEQ ID NO: 1424572 - RNA, 15 nt, Homo sapiens
ccugcuccgagucuu

SEQ ID NO: 1424573 - RNA, 13 nt, Homo sapiens
ccugcuccuccca

SEQ ID NO: 1424574 - RNA, 18 nt, Homo sapiens
ccugcucuccucuugcca

SEQ ID NO: 1424575 - RNA, 21 nt, Homo sapiens
ccugcucuucuaccauuugaa

SEQ ID NO: 1424576 - RNA, 19 nt, Homo sapiens
ccugcugaaagcaguguau

SEQ ID NO: 1424577 - RNA, 19 nt, Homo sapiens
ccugcugcgucagaccagu

SEQ ID NO: 1424578 - RNA, 16 nt, Homo sapiens
ccuggaaaugugcuaa

SEQ ID NO: 1424579 - RNA, 14 nt, Homo sapiens
ccuggagugcaguu

SEQ ID NO: 1424580 - RNA, 16 nt, Homo sapiens
ccuggcacaggacuga

SEQ ID NO: 1424581 - RNA, 13 nt, Homo sapiens
ccuggcaugucag

SEQ ID NO: 1424582 - RNA, 21 nt, Homo sapiens
ccugggaaggcuaaguucagu

SEQ ID NO: 1424583 - RNA, 14 nt, Homo sapiens
ccugggccuggacc

SEQ ID NO: 1424584 - RNA, 15 nt, Homo sapiens
ccugggggccagcug

SEQ ID NO: 1424585 - RNA, 16 nt, Homo sapiens
ccuggguggcuacucu

SEQ ID NO: 1424586 - RNA, 17 nt, Homo sapiens
ccuggguggggcugcuc

SEQ ID NO: 1424587 - RNA, 13 nt, Homo sapiens
ccuggucccccac

SEQ ID NO: 1424588 - RNA, 21 nt, Homo sapiens
ccuggucccccacgugugaag

SEQ ID NO: 1424589 - RNA, 19 nt, Homo sapiens
ccuggucccuuggagacaa

SEQ ID NO: 1424590 - RNA, 17 nt, Homo sapiens
ccugguggcaccagaug

SEQ ID NO: 1424591 - RNA, 23 nt, Homo sapiens
ccuguacucuggagagacugugc

SEQ ID NO: 1424592 - RNA, 22 nt, Homo sapiens
ccugucauccccuacacuuugg

SEQ ID NO: 1424593 - RNA, 13 nt, Homo sapiens
ccuguccucaaaa

SEQ ID NO: 1424594 - RNA, 23 nt, Homo sapiens
ccugucuuagccucccaaagugc

SEQ ID NO: 1424595 - RNA, 14 nt, Homo sapiens
ccugucuucucuca

SEQ ID NO: 1424596 - RNA, 13 nt, Homo sapiens
ccugugauugcuc

SEQ ID NO: 1424597 - RNA, 14 nt, Homo sapiens
ccugugggaguaga

SEQ ID NO: 1424598 - RNA, 20 nt, Homo sapiens
ccuguuaaaauguacacugg

SEQ ID NO: 1424599 - RNA, 20 nt, Homo sapiens
ccuguucaccuuauguauua

SEQ ID NO: 1424600 - RNA, 21 nt, Homo sapiens
ccuguucuuccuaccaaauau

SEQ ID NO: 1424601 - RNA, 19 nt, Homo sapiens
ccuuaagaggccuccacuc

SEQ ID NO: 1424602 - RNA, 19 nt, Homo sapiens
ccuuaauagccauaugcaa

SEQ ID NO: 1424603 - RNA, 22 nt, Homo sapiens
ccuuacagaacacgcuuucaca

SEQ ID NO: 1424604 - RNA, 12 nt, Homo sapiens
ccuuacccaaac

SEQ ID NO: 1424605 - RNA, 22 nt, Homo sapiens
ccuuagcuggcauuacagcugg

SEQ ID NO: 1424606 - RNA, 17 nt, Homo sapiens
ccuucagcauaauucgg

SEQ ID NO: 1424607 - RNA, 19 nt, Homo sapiens
ccuucauugcuggagacag

SEQ ID NO: 1424608 - RNA, 16 nt, Homo sapiens
ccuuccacacagggug

SEQ ID NO: 1424609 - RNA, 20 nt, Homo sapiens
ccuuccagcuagugacccac

SEQ ID NO: 1424610 - RNA, 17 nt, Homo sapiens
ccuucccucuucuucuc

SEQ ID NO: 1424611 - RNA, 17 nt, Homo sapiens
ccuuccuaauaugcuuu

SEQ ID NO: 1424612 - RNA, 21 nt, Homo sapiens
ccuuccucucaagcuagccag

SEQ ID NO: 1424613 - RNA, 17 nt, Homo sapiens
ccuucgauauaugacuu

SEQ ID NO: 1424614 - RNA, 13 nt, Homo sapiens
ccuucucuccuuc

SEQ ID NO: 1424615 - RNA, 15 nt, Homo sapiens
ccuucuuucucuucc

SEQ ID NO: 1424616 - RNA, 14 nt, Homo sapiens
ccuugaccaagaag

SEQ ID NO: 1424617 - RNA, 13 nt, Homo sapiens
ccuugagcacuca

SEQ ID NO: 1424618 - RNA, 14 nt, Homo sapiens
ccuugauucacaau

SEQ ID NO: 1424619 - RNA, 20 nt, Homo sapiens
ccuugcaucaagggcuuuau

SEQ ID NO: 1424620 - RNA, 18 nt, Homo sapiens
ccuugcccugaccuccca

SEQ ID NO: 1424621 - RNA, 16 nt, Homo sapiens
ccuugcucagugccuc

SEQ ID NO: 1424622 - RNA, 19 nt, Homo sapiens
ccuuggacaacuuuucuca

SEQ ID NO: 1424623 - RNA, 24 nt, Homo sapiens
ccuugugaccuucucuauaucaug

SEQ ID NO: 1424624 - RNA, 14 nt, Homo sapiens
ccuuguuacacauu

SEQ ID NO: 1424625 - RNA, 19 nt, Homo sapiens
ccuuuaccuaccaccuucc

SEQ ID NO: 1424626 - RNA, 14 nt, Homo sapiens
ccuuuccugguccc

SEQ ID NO: 1424627 - RNA, 17 nt, Homo sapiens
ccuuucuaaaucugaga

SEQ ID NO: 1424628 - RNA, 21 nt, Homo sapiens
ccuuucuaaaucugagaucuc

SEQ ID NO: 1424629 - RNA, 15 nt, Homo sapiens
ccuuucuuacauuag

SEQ ID NO: 1424630 - RNA, 16 nt, Homo sapiens
gaccucccagcccuau

SEQ ID NO: 1424631 - RNA, 18 nt, Homo sapiens
gaccucccccucuugguc

SEQ ID NO: 1424632 - RNA, 18 nt, Homo sapiens
gaccuccguguagugucu

SEQ ID NO: 1424633 - RNA, 23 nt, Homo sapiens
gaccucucaacagaucugugggc

SEQ ID NO: 1424634 - RNA, 18 nt, Homo sapiens
gaccugaccggcaccugc

SEQ ID NO: 1424635 - RNA, 22 nt, Homo sapiens
gaccuucaucagaccacucccu

SEQ ID NO: 1424636 - RNA, 14 nt, Homo sapiens
gaccuuccugccac

SEQ ID NO: 1424637 - RNA, 19 nt, Homo sapiens
gaccuuccugccaccaguc

SEQ ID NO: 1424638 - RNA, 17 nt, Homo sapiens
gaccuucuccccauucu

SEQ ID NO: 1424639 - RNA, 21 nt, Homo sapiens
gaccuucucccucacuccugc

SEQ ID NO: 1424640 - RNA, 19 nt, Homo sapiens
gacgcuuccagaccaccug

SEQ ID NO: 1424641 - RNA, 15 nt, Homo sapiens
gacguaaucuccaca

SEQ ID NO: 1424642 - RNA, 23 nt, Homo sapiens
gacuaaccccaacgcacaggaaa

SEQ ID NO: 1424643 - RNA, 18 nt, Homo sapiens
gacuagagcuuucuuuca

SEQ ID NO: 1424644 - RNA, 14 nt, Homo sapiens
gacuauaacuguca

SEQ ID NO: 1424645 - RNA, 21 nt, Homo sapiens
gacuauauacauguguguaua

SEQ ID NO: 1424646 - RNA, 14 nt, Homo sapiens
gacuaucacauaca

SEQ ID NO: 1424647 - RNA, 16 nt, Homo sapiens
gacuauuuaacuugag

SEQ ID NO: 1424648 - RNA, 16 nt, Homo sapiens
gacuauuuaugaaggc

SEQ ID NO: 1424649 - RNA, 17 nt, Homo sapiens
gacuauuucacuaauaa

SEQ ID NO: 1424650 - RNA, 18 nt, Homo sapiens
gacucaacgagagcacuu

SEQ ID NO: 1424651 - RNA, 14 nt, Homo sapiens
gacucacaagaaga

SEQ ID NO: 1424652 - RNA, 22 nt, Homo sapiens
gacucaguuuucuugcagauca

SEQ ID NO: 1424653 - RNA, 16 nt, Homo sapiens
gacucccgcgugaaga

SEQ ID NO: 1424654 - RNA, 13 nt, Homo sapiens
gacuccucaaaag

SEQ ID NO: 1424655 - RNA, 17 nt, Homo sapiens
gacucucccccuuucaa

SEQ ID NO: 1424656 - RNA, 14 nt, Homo sapiens
gacugaggaccaca

SEQ ID NO: 1424657 - RNA, 18 nt, Homo sapiens
gacugaugggacaucaaa

SEQ ID NO: 1424658 - RNA, 11 nt, Homo sapiens
gacugauuacc

SEQ ID NO: 1424659 - RNA, 22 nt, Homo sapiens
gacugcgacgcagguguaccuc

SEQ ID NO: 1424660 - RNA, 17 nt, Homo sapiens
gacugguuagacaguac

SEQ ID NO: 1424661 - RNA, 22 nt, Homo sapiens
gacuguugcucaaaucuauuca

SEQ ID NO: 1424662 - RNA, 13 nt, Homo sapiens
gacuucaucccaa

SEQ ID NO: 1424663 - RNA, 19 nt, Homo sapiens
gacuuccucgccucuccca

SEQ ID NO: 1424664 - RNA, 20 nt, Homo sapiens
gacuucugucuucacaacag

SEQ ID NO: 1424665 - RNA, 17 nt, Homo sapiens
gacuuggggaccagagg

SEQ ID NO: 1424666 - RNA, 20 nt, Homo sapiens
gacuuggucugauuucagga

SEQ ID NO: 1424667 - RNA, 23 nt, Homo sapiens
gacuuucuacaccuguugcaccu

SEQ ID NO: 1424668 - RNA, 23 nt, Homo sapiens
gagaaacagagacaggcccaaga

SEQ ID NO: 1424669 - RNA, 13 nt, Homo sapiens
gagaaacuuccuu

SEQ ID NO: 1424670 - RNA, 21 nt, Homo sapiens
gagaaacuuugaucucugcuu

SEQ ID NO: 1424671 - RNA, 15 nt, Homo sapiens
gagaaagacuauuca

SEQ ID NO: 1424672 - RNA, 20 nt, Homo sapiens
gagaaauaaaaauaccucuu

SEQ ID NO: 1424673 - RNA, 21 nt, Homo sapiens
gagaaccuggccuucagugua

SEQ ID NO: 1424674 - RNA, 22 nt, Homo sapiens
gagaagccggcucuucaaagac

SEQ ID NO: 1424675 - RNA, 17 nt, Homo sapiens
gagaagcucacccaaua

SEQ ID NO: 1424676 - RNA, 18 nt, Homo sapiens
gagaauccugccucuccc

SEQ ID NO: 1424677 - RNA, 22 nt, Homo sapiens
gagaauggggguggggaggcaa

SEQ ID NO: 1424678 - RNA, 22 nt, Homo sapiens
gagaccaagacucugaaaucuc

SEQ ID NO: 1424679 - RNA, 20 nt, Homo sapiens
gagaccccuuccuuuccucu

SEQ ID NO: 1424680 - RNA, 16 nt, Homo sapiens
gagacuauggagccug

SEQ ID NO: 1424681 - RNA, 17 nt, Homo sapiens
gagacuuggggaccaga

SEQ ID NO: 1424682 - RNA, 14 nt, Homo sapiens
gagagaaaucugaa

SEQ ID NO: 1424683 - RNA, 15 nt, Homo sapiens
gagagaagaaagugu

SEQ ID NO: 1424684 - RNA, 13 nt, Homo sapiens
gagagauggaaua

SEQ ID NO: 1424685 - RNA, 20 nt, Homo sapiens
gagagggggcucuccaaagg

SEQ ID NO: 1424686 - RNA, 14 nt, Homo sapiens
gagagucggccaga

SEQ ID NO: 1424687 - RNA, 16 nt, Homo sapiens
gagauacgcaaacaca

SEQ ID NO: 1424688 - RNA, 23 nt, Homo sapiens
gagauacucucccugacauuucu

SEQ ID NO: 1424689 - RNA, 13 nt, Homo sapiens
gagauaugcacac

SEQ ID NO: 1424690 - RNA, 16 nt, Homo sapiens
gagaucuuacagguau

SEQ ID NO: 1424691 - RNA, 15 nt, Homo sapiens
gagaugcugggccag

SEQ ID NO: 1424692 - RNA, 16 nt, Homo sapiens
gagaugcugggccagu

SEQ ID NO: 1424693 - RNA, 17 nt, Homo sapiens
gagauggaggaaaguga

SEQ ID NO: 1424694 - RNA, 20 nt, Homo sapiens
gagauggggucuugcuauau

SEQ ID NO: 1424695 - RNA, 12 nt, Homo sapiens
gagauguguuca

SEQ ID NO: 1424696 - RNA, 21 nt, Homo sapiens
gagauuucaguuacuuaccug

SEQ ID NO: 1424697 - RNA, 15 nt, Homo sapiens
gagauuuucuuggca

SEQ ID NO: 1424698 - RNA, 20 nt, Homo sapiens
gagauuuugucgggacagag

SEQ ID NO: 1424699 - RNA, 21 nt, Homo sapiens
gagcaaccccuguacccagcu

SEQ ID NO: 1424700 - RNA, 17 nt, Homo sapiens
gagcaagugacaugcca

SEQ ID NO: 1424701 - RNA, 16 nt, Homo sapiens
gagcaauucauuucac

SEQ ID NO: 1424702 - RNA, 20 nt, Homo sapiens
gagcaauucuccugccucag

SEQ ID NO: 1424703 - RNA, 17 nt, Homo sapiens
gagcacuggagugcagg

SEQ ID NO: 1424704 - RNA, 15 nt, Homo sapiens
gagcacuggccagag

SEQ ID NO: 1424705 - RNA, 23 nt, Homo sapiens
gagcagaugguccuccauuucaa

SEQ ID NO: 1424706 - RNA, 14 nt, Homo sapiens
gagcaggcuacugu

SEQ ID NO: 1424707 - RNA, 16 nt, Homo sapiens
gagcaggcuacuguca

SEQ ID NO: 1424708 - RNA, 17 nt, Homo sapiens
gagcaggcuacugucag

SEQ ID NO: 1424709 - RNA, 16 nt, Homo sapiens
gagcaguaaacuuucu

SEQ ID NO: 1424710 - RNA, 15 nt, Homo sapiens
gagcauuacgugagc

SEQ ID NO: 1424711 - RNA, 17 nt, Homo sapiens
gagccagccuugcagua

SEQ ID NO: 1424712 - RNA, 18 nt, Homo sapiens
gagcccagcauucagggg

SEQ ID NO: 1424713 - RNA, 14 nt, Homo sapiens
gagccccacacgga

SEQ ID NO: 1424714 - RNA, 17 nt, Homo sapiens
gagccccccacaaugau

SEQ ID NO: 1424715 - RNA, 14 nt, Homo sapiens
gagcccgagggccu

SEQ ID NO: 1424716 - RNA, 20 nt, Homo sapiens
gccaggcaggugccuggaca

SEQ ID NO: 1424717 - RNA, 15 nt, Homo sapiens
gccaggccaccagga

SEQ ID NO: 1424718 - RNA, 21 nt, Homo sapiens
gccaggcuguaagcauucuga

SEQ ID NO: 1424719 - RNA, 23 nt, Homo sapiens
gccagggaaagcccgugucaaug

SEQ ID NO: 1424720 - RNA, 11 nt, Homo sapiens
gccaguauuuu

SEQ ID NO: 1424721 - RNA, 16 nt, Homo sapiens
gccagucuugccuagg

SEQ ID NO: 1424722 - RNA, 11 nt, Homo sapiens
gccagugacuu

SEQ ID NO: 1424723 - RNA, 13 nt, Homo sapiens
gccauaaagccau

SEQ ID NO: 1424724 - RNA, 15 nt, Homo sapiens
gccauaaagugccag

SEQ ID NO: 1424725 - RNA, 14 nt, Homo sapiens
gccauauauauuuc

SEQ ID NO: 1424726 - RNA, 15 nt, Homo sapiens
gccaucuuucuuugg

SEQ ID NO: 1424727 - RNA, 20 nt, Homo sapiens
gccaugauggugcugaccuc

SEQ ID NO: 1424728 - RNA, 10 nt, Homo sapiens
gccaugccuc

SEQ ID NO: 1424729 - RNA, 23 nt, Homo sapiens
gccauugaauuugccuuccucau

SEQ ID NO: 1424730 - RNA, 15 nt, Homo sapiens
gcccaagaggacuga

SEQ ID NO: 1424731 - RNA, 15 nt, Homo sapiens
gcccaagaggucuga

SEQ ID NO: 1424732 - RNA, 18 nt, Homo sapiens
gcccacucccaggaccaa

SEQ ID NO: 1424733 - RNA, 19 nt, Homo sapiens
gcccacugugaaaccacua

SEQ ID NO: 1424734 - RNA, 18 nt, Homo sapiens
gcccagaaagaggcagug

SEQ ID NO: 1424735 - RNA, 13 nt, Homo sapiens
gcccagcccagcu

SEQ ID NO: 1424736 - RNA, 14 nt, Homo sapiens
gcccagcuacauuc

SEQ ID NO: 1424737 - RNA, 15 nt, Homo sapiens
gcccagggagcaaug

SEQ ID NO: 1424738 - RNA, 20 nt, Homo sapiens
gcccaggggcccacagggaa

SEQ ID NO: 1424739 - RNA, 15 nt, Homo sapiens
gcccagugaccugac

SEQ ID NO: 1424740 - RNA, 16 nt, Homo sapiens
gcccauagaaacauga

SEQ ID NO: 1424741 - RNA, 14 nt, Homo sapiens
gccccagcuuuauc

SEQ ID NO: 1424742 - RNA, 21 nt, Homo sapiens
gccccaugaccuccagcuuuc

SEQ ID NO: 1424743 - RNA, 20 nt, Homo sapiens
gcccccugggcuugugaaca

SEQ ID NO: 1424744 - RNA, 17 nt, Homo sapiens
gcccccugugccagcuc

SEQ ID NO: 1424745 - RNA, 18 nt, Homo sapiens
gccccucgcugcugcuac

SEQ ID NO: 1424746 - RNA, 21 nt, Homo sapiens
gccccucgcugcugcuacuac

SEQ ID NO: 1424747 - RNA, 16 nt, Homo sapiens
gccccugcacaaagcc

SEQ ID NO: 1424748 - RNA, 16 nt, Homo sapiens
gcccgaccccaucuca

SEQ ID NO: 1424749 - RNA, 18 nt, Homo sapiens
gcccgggcacuggugggu

SEQ ID NO: 1424750 - RNA, 20 nt, Homo sapiens
gcccgucauguuccucaaaa

SEQ ID NO: 1424751 - RNA, 22 nt, Homo sapiens
gcccucaauaagccagcaaacc

SEQ ID NO: 1424752 - RNA, 16 nt, Homo sapiens
gcccucagaacaaucc

SEQ ID NO: 1424753 - RNA, 19 nt, Homo sapiens
gcccuccccaucccaugua

SEQ ID NO: 1424754 - RNA, 13 nt, Homo sapiens
gcccugaacaaaa

SEQ ID NO: 1424755 - RNA, 15 nt, Homo sapiens
gcccugcccugccac

SEQ ID NO: 1424756 - RNA, 18 nt, Homo sapiens
gcccugcgaaguggcucu

SEQ ID NO: 1424757 - RNA, 14 nt, Homo sapiens
gcccuggauccauc

SEQ ID NO: 1424758 - RNA, 16 nt, Homo sapiens
gcccuggcugacccca

SEQ ID NO: 1424759 - RNA, 16 nt, Homo sapiens
gcccuggggccuguac

SEQ ID NO: 1424760 - RNA, 15 nt, Homo sapiens
gcccuggugcugcca

SEQ ID NO: 1424761 - RNA, 20 nt, Homo sapiens
gcccugugagggcucacucg

SEQ ID NO: 1424762 - RNA, 21 nt, Homo sapiens
gccgcugcugagcugcgugcc

SEQ ID NO: 1424763 - RNA, 11 nt, Homo sapiens
gccggaccaag

SEQ ID NO: 1424764 - RNA, 17 nt, Homo sapiens
gccgggcccgggcacug

SEQ ID NO: 1424765 - RNA, 13 nt, Homo sapiens
gccguacugucua

SEQ ID NO: 1424766 - RNA, 15 nt, Homo sapiens
gccguacugucuaug

SEQ ID NO: 1424767 - RNA, 18 nt, Homo sapiens
gccguccauggcaccagc

SEQ ID NO: 1424768 - RNA, 19 nt, Homo sapiens
gccgugccuucagcucuac

SEQ ID NO: 1424769 - RNA, 20 nt, Homo sapiens
gccuaagggccacaucccac

SEQ ID NO: 1424770 - RNA, 17 nt, Homo sapiens
gccuacaaauguuuuca

SEQ ID NO: 1424771 - RNA, 16 nt, Homo sapiens
gccuauggagagcccu

SEQ ID NO: 1424772 - RNA, 19 nt, Homo sapiens
gccucaaugugaccagggg

SEQ ID NO: 1424773 - RNA, 19 nt, Homo sapiens
gccucacacccagagggua

SEQ ID NO: 1424774 - RNA, 21 nt, Homo sapiens
gccuccaagccauucacuucc

SEQ ID NO: 1424775 - RNA, 14 nt, Homo sapiens
gccuccaccucucc

SEQ ID NO: 1424776 - RNA, 21 nt, Homo sapiens
gccucccccucagaugaucuc

SEQ ID NO: 1424777 - RNA, 13 nt, Homo sapiens
gccuccuggccag

SEQ ID NO: 1424778 - RNA, 15 nt, Homo sapiens
gccuccugggaccau

SEQ ID NO: 1424779 - RNA, 14 nt, Homo sapiens
gccucgaugccucu

SEQ ID NO: 1424780 - RNA, 17 nt, Homo sapiens
gccucgugccaugaucu

SEQ ID NO: 1424781 - RNA, 16 nt, Homo sapiens
gccucuccagcacuuc

SEQ ID NO: 1424782 - RNA, 16 nt, Homo sapiens
gccucugaaaugccuc

SEQ ID NO: 1424783 - RNA, 13 nt, Homo sapiens
gccucugcuuguu

SEQ ID NO: 1424784 - RNA, 17 nt, Homo sapiens
gccucuggaaagcaaag

SEQ ID NO: 1424785 - RNA, 22 nt, Homo sapiens
gccucuuccgugacgucacugg

SEQ ID NO: 1424786 - RNA, 17 nt, Homo sapiens
gccucuuguacaguuaa

SEQ ID NO: 1424787 - RNA, 19 nt, Homo sapiens
gccucuuuucucugugcuu

SEQ ID NO: 1424788 - RNA, 22 nt, Homo sapiens
gccugaaugucuuacugugauc

SEQ ID NO: 1424789 - RNA, 17 nt, Homo sapiens
gccugagcuggggccac

SEQ ID NO: 1424790 - RNA, 23 nt, Homo sapiens
gccugauggugcucacgacucuu

SEQ ID NO: 1424791 - RNA, 22 nt, Homo sapiens
gccugcaaacucacugcucaag

SEQ ID NO: 1424792 - RNA, 15 nt, Homo sapiens
gccuggaagccaaac

SEQ ID NO: 1424793 - RNA, 18 nt, Homo sapiens
gccuggaccgcuucccag

SEQ ID NO: 1424794 - RNA, 23 nt, Homo sapiens
gccuggcccauagaaacaugaca

SEQ ID NO: 1424795 - RNA, 15 nt, Homo sapiens
gccuggcccuggaac

SEQ ID NO: 1424796 - RNA, 16 nt, Homo sapiens
gccuggccuccugccu

SEQ ID NO: 1424797 - RNA, 16 nt, Homo sapiens
gccuggcuccccacga

SEQ ID NO: 1424798 - RNA, 18 nt, Homo sapiens
gccugggcuguggacaga

SEQ ID NO: 1424799 - RNA, 13 nt, Homo sapiens
gccuguugccucg

SEQ ID NO: 1424800 - RNA, 18 nt, Homo sapiens
gccuuaaaggaccuuccc

SEQ ID NO: 1424801 - RNA, 16 nt, Homo sapiens
gccuucucccugggaa

SEQ ID NO: 1424802 - RNA, 16 nt, Homo sapiens
gccuugacaacagacu

SEQ ID NO: 1424803 - RNA, 12 nt, Homo sapiens
ggccuccacucc

SEQ ID NO: 1424804 - RNA, 14 nt, Homo sapiens
ggccuccugccucu

SEQ ID NO: 1424805 - RNA, 21 nt, Homo sapiens
ggccugaagucccagcauuga

SEQ ID NO: 1424806 - RNA, 13 nt, Homo sapiens
ggccugauggugc

SEQ ID NO: 1424807 - RNA, 17 nt, Homo sapiens
ggccugcccucagggau

SEQ ID NO: 1424808 - RNA, 15 nt, Homo sapiens
ggccuggcaucgcau

SEQ ID NO: 1424809 - RNA, 21 nt, Homo sapiens
ggccugugagguaacugggau

SEQ ID NO: 1424810 - RNA, 16 nt, Homo sapiens
ggccuucacagugacc

SEQ ID NO: 1424811 - RNA, 14 nt, Homo sapiens
ggcgaaccaucuca

SEQ ID NO: 1424812 - RNA, 13 nt, Homo sapiens
ggcgaguggcacg

SEQ ID NO: 1424813 - RNA, 20 nt, Homo sapiens
ggcgagugugggcauagcau

SEQ ID NO: 1424814 - RNA, 16 nt, Homo sapiens
ggcggauggcugugac

SEQ ID NO: 1424815 - RNA, 15 nt, Homo sapiens
ggcggcccucaaaag

SEQ ID NO: 1424816 - RNA, 14 nt, Homo sapiens
ggcggcuccagguc

SEQ ID NO: 1424817 - RNA, 12 nt, Homo sapiens
ggcuaaucucag

SEQ ID NO: 1424818 - RNA, 23 nt, Homo sapiens
ggcuaccgugggucaaccuggga

SEQ ID NO: 1424819 - RNA, 17 nt, Homo sapiens
ggcuagaaccuggagag

SEQ ID NO: 1424820 - RNA, 16 nt, Homo sapiens
ggcuagaacuggagag

SEQ ID NO: 1424821 - RNA, 20 nt, Homo sapiens
ggcucaagcaguccucccac

SEQ ID NO: 1424822 - RNA, 22 nt, Homo sapiens
ggcuccaccccauccaguucau

SEQ ID NO: 1424823 - RNA, 16 nt, Homo sapiens
ggcuccuggcugccag

SEQ ID NO: 1424824 - RNA, 19 nt, Homo sapiens
ggcugaauagcuucuccaa

SEQ ID NO: 1424825 - RNA, 21 nt, Homo sapiens
ggcugaauccgugguggcacc

SEQ ID NO: 1424826 - RNA, 12 nt, Homo sapiens
ggcugagcucuu

SEQ ID NO: 1424827 - RNA, 21 nt, Homo sapiens
ggcugccacuaaccuguagaa

SEQ ID NO: 1424828 - RNA, 17 nt, Homo sapiens
ggcugccggaacaacag

SEQ ID NO: 1424829 - RNA, 14 nt, Homo sapiens
ggcuggagugcagu

SEQ ID NO: 1424830 - RNA, 16 nt, Homo sapiens
ggcuggaguucagugg

SEQ ID NO: 1424831 - RNA, 13 nt, Homo sapiens
ggcugugcugagg

SEQ ID NO: 1424832 - RNA, 21 nt, Homo sapiens
ggcugugggucugcaccucug

SEQ ID NO: 1424833 - RNA, 19 nt, Homo sapiens
ggcuuccagguaucuccag

SEQ ID NO: 1424834 - RNA, 16 nt, Homo sapiens
ggcuugaaaugcauua

SEQ ID NO: 1424835 - RNA, 19 nt, Homo sapiens
ggcuuuuaagaaacacagg

SEQ ID NO: 1424836 - RNA, 21 nt, Homo sapiens
gggaaaggauauuuucuucca

SEQ ID NO: 1424837 - RNA, 12 nt, Homo sapiens
gggaaauugcuu

SEQ ID NO: 1424838 - RNA, 14 nt, Homo sapiens
gggaagaaacacuc

SEQ ID NO: 1424839 - RNA, 15 nt, Homo sapiens
gggaagagugcauuu

SEQ ID NO: 1424840 - RNA, 20 nt, Homo sapiens
gggaagcggagcuugcagug

SEQ ID NO: 1424841 - RNA, 15 nt, Homo sapiens
gggaauggauccugg

SEQ ID NO: 1424842 - RNA, 16 nt, Homo sapiens
gggacaaaggagccug

SEQ ID NO: 1424843 - RNA, 21 nt, Homo sapiens
gggacaaaggagccugugaac

SEQ ID NO: 1424844 - RNA, 22 nt, Homo sapiens
gggacacguuaggaauguccag

SEQ ID NO: 1424845 - RNA, 15 nt, Homo sapiens
gggacauuccaaaga

SEQ ID NO: 1424846 - RNA, 13 nt, Homo sapiens
gggaccugugauc

SEQ ID NO: 1424847 - RNA, 18 nt, Homo sapiens
gggacucucccccuuuca

SEQ ID NO: 1424848 - RNA, 15 nt, Homo sapiens
gggagaguucuugcu

SEQ ID NO: 1424849 - RNA, 21 nt, Homo sapiens
gggagccuccucugcuugcau

SEQ ID NO: 1424850 - RNA, 14 nt, Homo sapiens
gggagcuacagggg

SEQ ID NO: 1424851 - RNA, 23 nt, Homo sapiens
gggagcuggaaauaaaccuggag

SEQ ID NO: 1424852 - RNA, 11 nt, Homo sapiens
gggagggauga

SEQ ID NO: 1424853 - RNA, 17 nt, Homo sapiens
gggagguuccucgcagg

SEQ ID NO: 1424854 - RNA, 23 nt, Homo sapiens
gggaucagccuccgccauuccaa

SEQ ID NO: 1424855 - RNA, 19 nt, Homo sapiens
gggaugagccgcugugagc

SEQ ID NO: 1424856 - RNA, 10 nt, Homo sapiens
gggauguuuu

SEQ ID NO: 1424857 - RNA, 20 nt, Homo sapiens
gggcaaacccuucucuucuc

SEQ ID NO: 1424858 - RNA, 22 nt, Homo sapiens
gggcaaaugacaugcacugacc

SEQ ID NO: 1424859 - RNA, 22 nt, Homo sapiens
gggcaguucgcagccacccuga

SEQ ID NO: 1424860 - RNA, 14 nt, Homo sapiens
gggccacaucccac

SEQ ID NO: 1424861 - RNA, 19 nt, Homo sapiens
gggccacaucccacugcca

SEQ ID NO: 1424862 - RNA, 12 nt, Homo sapiens
gggccaguuccu

SEQ ID NO: 1424863 - RNA, 15 nt, Homo sapiens
gggccccaccaccua

SEQ ID NO: 1424864 - RNA, 21 nt, Homo sapiens
gggcgugaaccaccaugccca

SEQ ID NO: 1424865 - RNA, 14 nt, Homo sapiens
ggggaaugaucucu

SEQ ID NO: 1424866 - RNA, 19 nt, Homo sapiens
ggggaccaggaugacaccu

SEQ ID NO: 1424867 - RNA, 15 nt, Homo sapiens
ggggagcaugggacu

SEQ ID NO: 1424868 - RNA, 22 nt, Homo sapiens
ggggauuugaagaagaguuucu

SEQ ID NO: 1424869 - RNA, 15 nt, Homo sapiens
gggggccgugcccag

SEQ ID NO: 1424870 - RNA, 16 nt, Homo sapiens
gggggcggccuaugac

SEQ ID NO: 1424871 - RNA, 17 nt, Homo sapiens
ggggguuuuuaaucuuu

SEQ ID NO: 1424872 - RNA, 20 nt, Homo sapiens
ggggucuguauauacauuuc

SEQ ID NO: 1424873 - RNA, 16 nt, Homo sapiens
ggguacuacugcugca

SEQ ID NO: 1424874 - RNA, 19 nt, Homo sapiens
ggguauuuaccacagcagc

SEQ ID NO: 1424875 - RNA, 16 nt, Homo sapiens
gggucaaccugggaug

SEQ ID NO: 1424876 - RNA, 15 nt, Homo sapiens
ggguccccaccuggg

SEQ ID NO: 1424877 - RNA, 13 nt, Homo sapiens
ggguccuguccau

SEQ ID NO: 1424878 - RNA, 16 nt, Homo sapiens
gggugauuucagagag

SEQ ID NO: 1424879 - RNA, 11 nt, Homo sapiens
gggugccauuc

SEQ ID NO: 1424880 - RNA, 16 nt, Homo sapiens
gggugggccacucucc

SEQ ID NO: 1424881 - RNA, 14 nt, Homo sapiens
gggugugucugcuc

SEQ ID NO: 1424882 - RNA, 23 nt, Homo sapiens
ggguucccccucccugugugaaa

SEQ ID NO: 1424883 - RNA, 21 nt, Homo sapiens
ggguuuugucucugcaucuca

SEQ ID NO: 1424884 - RNA, 14 nt, Homo sapiens
gguaaucagcauua

SEQ ID NO: 1424885 - RNA, 14 nt, Homo sapiens
gguacuuaaagcuu

SEQ ID NO: 1424886 - RNA, 23 nt, Homo sapiens
gguagaaccacuuggcugcucau

SEQ ID NO: 1424887 - RNA, 24 nt, Homo sapiens
gguagaauucuggcugguagagca

SEQ ID NO: 1424888 - RNA, 18 nt, Homo sapiens
gguagcuauuuguuuaca

SEQ ID NO: 1424889 - RNA, 13 nt, Homo sapiens
gguaggccaagcu

SEQ ID NO: 1424890 - RNA, 12 nt, Homo sapiens
gucaaugcauca

SEQ ID NO: 1424891 - RNA, 20 nt, Homo sapiens
gucaaugcaucaauuuaccu

SEQ ID NO: 1424892 - RNA, 22 nt, Homo sapiens
gucaauuggaaagacuauccaa

SEQ ID NO: 1424893 - RNA, 16 nt, Homo sapiens
gucaauuucaguguau

SEQ ID NO: 1424894 - RNA, 21 nt, Homo sapiens
gucaauuuguauaucaugaaa

SEQ ID NO: 1424895 - RNA, 15 nt, Homo sapiens
gucacacaguauuaa

SEQ ID NO: 1424896 - RNA, 21 nt, Homo sapiens
gucaccgggaugaaccuaucc

SEQ ID NO: 1424897 - RNA, 19 nt, Homo sapiens
gucacugcucuggacugug

SEQ ID NO: 1424898 - RNA, 23 nt, Homo sapiens
gucagaauuucuuugucauucaa

SEQ ID NO: 1424899 - RNA, 14 nt, Homo sapiens
gucaggacugugac

SEQ ID NO: 1424900 - RNA, 21 nt, Homo sapiens
gucaggcagguuugccaguga

SEQ ID NO: 1424901 - RNA, 19 nt, Homo sapiens
gucaugauggagacuucag

SEQ ID NO: 1424902 - RNA, 19 nt, Homo sapiens
gucauucaagccugugaau

SEQ ID NO: 1424903 - RNA, 12 nt, Homo sapiens
gucauucuggga

SEQ ID NO: 1424904 - RNA, 16 nt, Homo sapiens
guccaaaauguugauc

SEQ ID NO: 1424905 - RNA, 16 nt, Homo sapiens
guccacaucuucucag

SEQ ID NO: 1424906 - RNA, 21 nt, Homo sapiens
guccacccaggcugcacugca

SEQ ID NO: 1424907 - RNA, 17 nt, Homo sapiens
guccaccugccuaucca

SEQ ID NO: 1424908 - RNA, 18 nt, Homo sapiens
guccacucucggggcccu

SEQ ID NO: 1424909 - RNA, 19 nt, Homo sapiens
guccagaauaagugcuguu

SEQ ID NO: 1424910 - RNA, 21 nt, Homo sapiens
gucccaaguuggaaauauuca

SEQ ID NO: 1424911 - RNA, 19 nt, Homo sapiens
gucccacucccacagagga

SEQ ID NO: 1424912 - RNA, 19 nt, Homo sapiens
guccccagcaccuuccuga

SEQ ID NO: 1424913 - RNA, 13 nt, Homo sapiens
guccccagggaca

SEQ ID NO: 1424914 - RNA, 17 nt, Homo sapiens
guccccaguuugcagaa

SEQ ID NO: 1424915 - RNA, 23 nt, Homo sapiens
guccccuccacugucacauugua

SEQ ID NO: 1424916 - RNA, 16 nt, Homo sapiens
gucccggguguguaca

SEQ ID NO: 1424917 - RNA, 20 nt, Homo sapiens
gucccuacuagagaccucuc

SEQ ID NO: 1424918 - RNA, 18 nt, Homo sapiens
gucccugucaccaagcuc

SEQ ID NO: 1424919 - RNA, 14 nt, Homo sapiens
guccgcaccagcug

SEQ ID NO: 1424920 - RNA, 18 nt, Homo sapiens
guccuaaggacacacuaa

SEQ ID NO: 1424921 - RNA, 21 nt, Homo sapiens
guccuccucucucuacuugaa

SEQ ID NO: 1424922 - RNA, 15 nt, Homo sapiens
guccucuugcucaaa

SEQ ID NO: 1424923 - RNA, 12 nt, Homo sapiens
guccucuuuaca

SEQ ID NO: 1424924 - RNA, 20 nt, Homo sapiens
guccugagcacugccaggag

SEQ ID NO: 1424925 - RNA, 14 nt, Homo sapiens
guccuggcuucuag

SEQ ID NO: 1424926 - RNA, 17 nt, Homo sapiens
guccuuggaaguuucau

SEQ ID NO: 1424927 - RNA, 13 nt, Homo sapiens
gucgaagcuuuga

SEQ ID NO: 1424928 - RNA, 12 nt, Homo sapiens
gucgcaucucag

SEQ ID NO: 1424929 - RNA, 16 nt, Homo sapiens
gucggcacgucccaug

SEQ ID NO: 1424930 - RNA, 22 nt, Homo sapiens
gucuaaauaaaugaaguauuuc

SEQ ID NO: 1424931 - RNA, 14 nt, Homo sapiens
gucuaacaguuaau

SEQ ID NO: 1424932 - RNA, 18 nt, Homo sapiens
gucuagaaaccaguaugg

SEQ ID NO: 1424933 - RNA, 21 nt, Homo sapiens
gucuagacuuucucaguggga

SEQ ID NO: 1424934 - RNA, 14 nt, Homo sapiens
gucuagccacugau

SEQ ID NO: 1424935 - RNA, 17 nt, Homo sapiens
gucuagccacugaucau

SEQ ID NO: 1424936 - RNA, 13 nt, Homo sapiens
gucucaaucugau

SEQ ID NO: 1424937 - RNA, 13 nt, Homo sapiens
gucucaguccaga

SEQ ID NO: 1424938 - RNA, 22 nt, Homo sapiens
gucuccuaccugcugcugcuau

SEQ ID NO: 1424939 - RNA, 15 nt, Homo sapiens
gucucgaacuccugg

SEQ ID NO: 1424940 - RNA, 12 nt, Homo sapiens
gucucucauggg

SEQ ID NO: 1424941 - RNA, 13 nt, Homo sapiens
gucucucauucuc

SEQ ID NO: 1424942 - RNA, 20 nt, Homo sapiens
gucucucggguucaagcaau

SEQ ID NO: 1424943 - RNA, 21 nt, Homo sapiens
gucucucggguucaagcaauu

SEQ ID NO: 1424944 - RNA, 24 nt, Homo sapiens
gucucucuugcuuuguucuuuauu

SEQ ID NO: 1424945 - RNA, 19 nt, Homo sapiens
gucugaacggcugaauaug

SEQ ID NO: 1424946 - RNA, 21 nt, Homo sapiens
gucugagguccugagcacugc

SEQ ID NO: 1424947 - RNA, 15 nt, Homo sapiens
gucugauuggcucac

SEQ ID NO: 1424948 - RNA, 19 nt, Homo sapiens
gucugccccacccucaaac

SEQ ID NO: 1424949 - RNA, 19 nt, Homo sapiens
gucugcuucuguccaggac

SEQ ID NO: 1424950 - RNA, 22 nt, Homo sapiens
gucugggcaaugaaaccaaagc

SEQ ID NO: 1424951 - RNA, 22 nt, Homo sapiens
gucuguagagccgcauggcacu

SEQ ID NO: 1424952 - RNA, 19 nt, Homo sapiens
gucuguauauacauuucau

SEQ ID NO: 1424953 - RNA, 21 nt, Homo sapiens
gucuguuucaaugaccuguau

SEQ ID NO: 1424954 - RNA, 16 nt, Homo sapiens
gucuucuuaaucugaa

SEQ ID NO: 1424955 - RNA, 19 nt, Homo sapiens
gugaaagaugcaagcaccu

SEQ ID NO: 1424956 - RNA, 16 nt, Homo sapiens
gugaacacacucagca

SEQ ID NO: 1424957 - RNA, 14 nt, Homo sapiens
gugaacuuacacuu

SEQ ID NO: 1424958 - RNA, 19 nt, Homo sapiens
gugaaggauaagagaaaca

SEQ ID NO: 1424959 - RNA, 23 nt, Homo sapiens
gugaauagucugugugcacaaug

SEQ ID NO: 1424960 - RNA, 14 nt, Homo sapiens
gugaaucagacccu

SEQ ID NO: 1424961 - RNA, 18 nt, Homo sapiens
gugaauugccugcagaga

SEQ ID NO: 1424962 - RNA, 17 nt, Homo sapiens
gugacagaaucuuguau

SEQ ID NO: 1424963 - RNA, 18 nt, Homo sapiens
gugacaggcccaguggaa

SEQ ID NO: 1424964 - RNA, 19 nt, Homo sapiens
gugacauauauauguauau

SEQ ID NO: 1424965 - RNA, 16 nt, Homo sapiens
gugacucuaccugcaa

SEQ ID NO: 1424966 - RNA, 15 nt, Homo sapiens
gugagagaaucugcc

SEQ ID NO: 1424967 - RNA, 15 nt, Homo sapiens
gugauauaugccuau

SEQ ID NO: 1424968 - RNA, 14 nt, Homo sapiens
gugauaucaccucu

SEQ ID NO: 1424969 - RNA, 23 nt, Homo sapiens
gugauccuucaucgaacaaacug

SEQ ID NO: 1424970 - RNA, 19 nt, Homo sapiens
gugauuucagagagggcag

SEQ ID NO: 1424971 - RNA, 19 nt, Homo sapiens
gugcaaaguucccuacuuc

SEQ ID NO: 1424972 - RNA, 20 nt, Homo sapiens
gugcaacgcuuuuugggaga

SEQ ID NO: 1424973 - RNA, 23 nt, Homo sapiens
gugcacaugugucugugugguau

SEQ ID NO: 1424974 - RNA, 19 nt, Homo sapiens
gugcagacugaugggacau

SEQ ID NO: 1424975 - RNA, 16 nt, Homo sapiens
gugcagaugggcuguu

SEQ ID NO: 1424976 - RNA, 21 nt, Homo sapiens
uccuagaaccaagcuucagag

SEQ ID NO: 1424977 - RNA, 17 nt, Homo sapiens
uccuagaauggaugugc

SEQ ID NO: 1424978 - RNA, 21 nt, Homo sapiens
uccuagaauggaugugcucac

SEQ ID NO: 1424979 - RNA, 21 nt, Homo sapiens
uccuagccacaucacuacagu

SEQ ID NO: 1424980 - RNA, 14 nt, Homo sapiens
uccuagugaaagag

SEQ ID NO: 1424981 - RNA, 21 nt, Homo sapiens
uccuauccuuggagagcagcu

SEQ ID NO: 1424982 - RNA, 20 nt, Homo sapiens
uccuauuuaugaaaaccaua

SEQ ID NO: 1424983 - RNA, 24 nt, Homo sapiens
uccucagggacagagacaccugca

SEQ ID NO: 1424984 - RNA, 20 nt, Homo sapiens
uccucagguaguacugggaa

SEQ ID NO: 1424985 - RNA, 20 nt, Homo sapiens
uccucauuuauaaaauaaug

SEQ ID NO: 1424986 - RNA, 19 nt, Homo sapiens
uccucccaaaauacuacac

SEQ ID NO: 1424987 - RNA, 13 nt, Homo sapiens
uccucccagacuu

SEQ ID NO: 1424988 - RNA, 15 nt, Homo sapiens
uccuccccucuugag

SEQ ID NO: 1424989 - RNA, 20 nt, Homo sapiens
uccucuaagccacucuucca

SEQ ID NO: 1424990 - RNA, 13 nt, Homo sapiens
uccucuccacugc

SEQ ID NO: 1424991 - RNA, 22 nt, Homo sapiens
uccucucccgcgggccuggaca

SEQ ID NO: 1424992 - RNA, 17 nt, Homo sapiens
uccucucccugcaccug

SEQ ID NO: 1424993 - RNA, 16 nt, Homo sapiens
uccucucuucucuauu

SEQ ID NO: 1424994 - RNA, 17 nt, Homo sapiens
uccucugcuugcaucac

SEQ ID NO: 1424995 - RNA, 19 nt, Homo sapiens
uccucuggauggcaccaga

SEQ ID NO: 1424996 - RNA, 19 nt, Homo sapiens
uccucuguccaggcacugc

SEQ ID NO: 1424997 - RNA, 21 nt, Homo sapiens
uccucuugccucucucaggag

SEQ ID NO: 1424998 - RNA, 17 nt, Homo sapiens
uccugauaaacauuaaa

SEQ ID NO: 1424999 - RNA, 15 nt, Homo sapiens
uccugcaccgagaga

SEQ ID NO: 1425000 - RNA, 23 nt, Homo sapiens
uccugcaccgagagagauggaau

SEQ ID NO: 1425001 - RNA, 15 nt, Homo sapiens
uccugcccucuggga

SEQ ID NO: 1425002 - RNA, 13 nt, Homo sapiens
uccugccuacccc

SEQ ID NO: 1425003 - RNA, 18 nt, Homo sapiens
uccugccucuacugggaa

SEQ ID NO: 1425004 - RNA, 22 nt, Homo sapiens
uccugcuacacaaaagccaaaa

SEQ ID NO: 1425005 - RNA, 13 nt, Homo sapiens
uccugcucucuuc

SEQ ID NO: 1425006 - RNA, 13 nt, Homo sapiens
uccugcuucuuca

SEQ ID NO: 1425007 - RNA, 16 nt, Homo sapiens
uccuggcaugacacuc

SEQ ID NO: 1425008 - RNA, 17 nt, Homo sapiens
uccuggcaugacacucu

SEQ ID NO: 1425009 - RNA, 16 nt, Homo sapiens
uccuggcuaacacgug

SEQ ID NO: 1425010 - RNA, 21 nt, Homo sapiens
uccuggcuucuagaucuggaa

SEQ ID NO: 1425011 - RNA, 20 nt, Homo sapiens
uccugggaccauggacacau

SEQ ID NO: 1425012 - RNA, 18 nt, Homo sapiens
uccuguacauuucacaaa

SEQ ID NO: 1425013 - RNA, 20 nt, Homo sapiens
uccuguccaaccuaaccccu

SEQ ID NO: 1425014 - RNA, 14 nt, Homo sapiens
uccugugaauuucu

SEQ ID NO: 1425015 - RNA, 11 nt, Homo sapiens
uccugugcaac

SEQ ID NO: 1425016 - RNA, 15 nt, Homo sapiens
uccugugcuacuuug

SEQ ID NO: 1425017 - RNA, 13 nt, Homo sapiens
uccugugugcuga

SEQ ID NO: 1425018 - RNA, 13 nt, Homo sapiens
uccuguguggaag

SEQ ID NO: 1425019 - RNA, 19 nt, Homo sapiens
uccuguguggaagaaggaa

SEQ ID NO: 1425020 - RNA, 23 nt, Homo sapiens
uccuuaauagccauaugcaauaa

SEQ ID NO: 1425021 - RNA, 16 nt, Homo sapiens
uccuuaccuuuacaua

SEQ ID NO: 1425022 - RNA, 17 nt, Homo sapiens
uccuuacucccaggcac

SEQ ID NO: 1425023 - RNA, 14 nt, Homo sapiens
uccuuccuucccug

SEQ ID NO: 1425024 - RNA, 21 nt, Homo sapiens
uccuugaaaaaaaguugcuuu

SEQ ID NO: 1425025 - RNA, 18 nt, Homo sapiens
uccuugauaaaugccuca

SEQ ID NO: 1425026 - RNA, 14 nt, Homo sapiens
uccuugcaccugca

SEQ ID NO: 1425027 - RNA, 18 nt, Homo sapiens
uccuugugguuuauguca

SEQ ID NO: 1425028 - RNA, 17 nt, Homo sapiens
uccuuuaccuaccaccu

SEQ ID NO: 1425029 - RNA, 23 nt, Homo sapiens
uccuuuaggucugguuguugcac

SEQ ID NO: 1425030 - RNA, 20 nt, Homo sapiens
uccuuugcaccgauccccac

SEQ ID NO: 1425031 - RNA, 18 nt, Homo sapiens
uccuuugcauuccaugau

SEQ ID NO: 1425032 - RNA, 16 nt, Homo sapiens
uccuuuugaccaaaua

SEQ ID NO: 1425033 - RNA, 17 nt, Homo sapiens
uccuuuugaccaaauaa

SEQ ID NO: 1425034 - RNA, 18 nt, Homo sapiens
uccuuuuucaacuuggaa

SEQ ID NO: 1425035 - RNA, 13 nt, Homo sapiens
ucgagguggauca

SEQ ID NO: 1425036 - RNA, 16 nt, Homo sapiens
ucgcagccacccugag

SEQ ID NO: 1425037 - RNA, 22 nt, Homo sapiens
ucgcucagcaauagggugcagu

SEQ ID NO: 1425038 - RNA, 16 nt, Homo sapiens
ucgcuccccacucugc

SEQ ID NO: 1425039 - RNA, 14 nt, Homo sapiens
ucgcucgacugcga

SEQ ID NO: 1425040 - RNA, 12 nt, Homo sapiens
ucgcugugaaaa

SEQ ID NO: 1425041 - RNA, 20 nt, Homo sapiens
ucgcuuguuuuucuuugaag

SEQ ID NO: 1425042 - RNA, 16 nt, Homo sapiens
ucggaagacuugccac

SEQ ID NO: 1425043 - RNA, 20 nt, Homo sapiens
ucggaagacuugccacuuuu

SEQ ID NO: 1425044 - RNA, 22 nt, Homo sapiens
ucguagagacgggguuucacca

SEQ ID NO: 1425045 - RNA, 13 nt, Homo sapiens
ucgugacaacaug

SEQ ID NO: 1425046 - RNA, 15 nt, Homo sapiens
ucguucuucugggaa

SEQ ID NO: 1425047 - RNA, 23 nt, Homo sapiens
ucuaaaugaagugcaaauuugau

SEQ ID NO: 1425048 - RNA, 11 nt, Homo sapiens
ucuaaccucag

SEQ ID NO: 1425049 - RNA, 21 nt, Homo sapiens
ucuaacuacaaggacaaugcc

SEQ ID NO: 1425050 - RNA, 17 nt, Homo sapiens
ucuaacuccagugaagu

SEQ ID NO: 1425051 - RNA, 12 nt, Homo sapiens
ucuaacucuccc

SEQ ID NO: 1425052 - RNA, 17 nt, Homo sapiens
ucuaacuguaaaucacu

SEQ ID NO: 1425053 - RNA, 22 nt, Homo sapiens
ucuaagcugcagcuuccuguca

SEQ ID NO: 1425054 - RNA, 16 nt, Homo sapiens
ucuaaguaaaaccaca

SEQ ID NO: 1425055 - RNA, 18 nt, Homo sapiens
ucuaagugguauauacau

SEQ ID NO: 1425056 - RNA, 21 nt, Homo sapiens
ucuaaugacacgguaggccaa

SEQ ID NO: 1425057 - RNA, 16 nt, Homo sapiens
ucuaauguaugcauuc

SEQ ID NO: 1425058 - RNA, 15 nt, Homo sapiens
ucuacaagcauuugc

SEQ ID NO: 1425059 - RNA, 19 nt, Homo sapiens
ucuacacaguaaaaacuug

SEQ ID NO: 1425060 - RNA, 21 nt, Homo sapiens
ucuacaccuguugcaccucag

SEQ ID NO: 1425061 - RNA, 13 nt, Homo sapiens
ucuacacugagga

SEQ ID NO: 1425062 - RNA, 13 nt, Homo sapiens
ugaaauaccagug

SEQ ID NO: 1425063 - RNA, 14 nt, Homo sapiens
ugaaauaccaguga

SEQ ID NO: 1425064 - RNA, 21 nt, Homo sapiens
ugaaaucugguuagauaauga

SEQ ID NO: 1425065 - RNA, 15 nt, Homo sapiens
ugaaaugacugucua

SEQ ID NO: 1425066 - RNA, 20 nt, Homo sapiens
ugaaauuauguauguuuaca

SEQ ID NO: 1425067 - RNA, 20 nt, Homo sapiens
ugaaauugaugccaguggaa

SEQ ID NO: 1425068 - RNA, 21 nt, Homo sapiens
ugaaauuuucucaucuaaaau

SEQ ID NO: 1425069 - RNA, 23 nt, Homo sapiens
ugaacaaacuaugaucacaguga

SEQ ID NO: 1425070 - RNA, 18 nt, Homo sapiens
ugaacacaauugauacuu

SEQ ID NO: 1425071 - RNA, 15 nt, Homo sapiens
ugaacacacucagca

SEQ ID NO: 1425072 - RNA, 15 nt, Homo sapiens
ugaacacaucagcuu

SEQ ID NO: 1425073 - RNA, 19 nt, Homo sapiens
ugaacccaggacaagcaug

SEQ ID NO: 1425074 - RNA, 23 nt, Homo sapiens
ugaaccccuggccucaagcaauc

SEQ ID NO: 1425075 - RNA, 20 nt, Homo sapiens
ugaacugagccaaacacacu

SEQ ID NO: 1425076 - RNA, 19 nt, Homo sapiens
ugaacuguuuuccuggcau

SEQ ID NO: 1425077 - RNA, 24 nt, Homo sapiens
ugaacuuggaaagaaaugcccauc

SEQ ID NO: 1425078 - RNA, 18 nt, Homo sapiens
ugaacuuggcuguaauca

SEQ ID NO: 1425079 - RNA, 15 nt, Homo sapiens
ugaagaaaagcacuu

SEQ ID NO: 1425080 - RNA, 22 nt, Homo sapiens
ugaagaacaguaacugccauca

SEQ ID NO: 1425081 - RNA, 17 nt, Homo sapiens
ugaagacaaaccacugu

SEQ ID NO: 1425082 - RNA, 16 nt, Homo sapiens
ugaagacccaguguaa

SEQ ID NO: 1425083 - RNA, 22 nt, Homo sapiens
ugaagacccuauuucagaaaua

SEQ ID NO: 1425084 - RNA, 14 nt, Homo sapiens
ugaagagauuucaa

SEQ ID NO: 1425085 - RNA, 19 nt, Homo sapiens
ugaagagauuucaacaaga

SEQ ID NO: 1425086 - RNA, 22 nt, Homo sapiens
ugaagagauuucaacaagaaua

SEQ ID NO: 1425087 - RNA, 22 nt, Homo sapiens
ugaagauacgguugcuucaccu

SEQ ID NO: 1425088 - RNA, 14 nt, Homo sapiens
ugaagccacugccu

SEQ ID NO: 1425089 - RNA, 14 nt, Homo sapiens
ugaagccagaucca

SEQ ID NO: 1425090 - RNA, 22 nt, Homo sapiens
ugaagccucugcccugccuccc

SEQ ID NO: 1425091 - RNA, 22 nt, Homo sapiens
ugaaggaggugagggaugugaa

SEQ ID NO: 1425092 - RNA, 12 nt, Homo sapiens
ugaaggccuuca

SEQ ID NO: 1425093 - RNA, 18 nt, Homo sapiens
ugaagggggcggccuaug

SEQ ID NO: 1425094 - RNA, 18 nt, Homo sapiens
ugaagucaccgggaugaa

SEQ ID NO: 1425095 - RNA, 17 nt, Homo sapiens
ugaagucaucagcuuug

SEQ ID NO: 1425096 - RNA, 22 nt, Homo sapiens
ugaagugcaaauuugauacaua

SEQ ID NO: 1425097 - RNA, 23 nt, Homo sapiens
ugaaguuagggaugacugugauu

SEQ ID NO: 1425098 - RNA, 16 nt, Homo sapiens
ugaaguuugaacuuca

SEQ ID NO: 1425099 - RNA, 16 nt, Homo sapiens
ugaaguuuuuauuuag

SEQ ID NO: 1425100 - RNA, 22 nt, Homo sapiens
ugaauaacauuugugugguggg

SEQ ID NO: 1425101 - RNA, 22 nt, Homo sapiens
ugaauaucugccccaguaguca

SEQ ID NO: 1425102 - RNA, 14 nt, Homo sapiens
ugaaucaggggcaa

SEQ ID NO: 1425103 - RNA, 19 nt, Homo sapiens
ugaaucuuucuuacuauug

SEQ ID NO: 1425104 - RNA, 15 nt, Homo sapiens
ugaaucuuuuccacu

SEQ ID NO: 1425105 - RNA, 21 nt, Homo sapiens
ugaaugaccuuguugcaugau

SEQ ID NO: 1425106 - RNA, 18 nt, Homo sapiens
ugaaugcacacuagccuc

SEQ ID NO: 1425107 - RNA, 22 nt, Homo sapiens
ugaaugguccaggguugaucac

SEQ ID NO: 1425108 - RNA, 22 nt, Homo sapiens
ugaauguagugugucagaguaa

SEQ ID NO: 1425109 - RNA, 17 nt, Homo sapiens
ugaauguauaaagacac

SEQ ID NO: 1425110 - RNA, 17 nt, Homo sapiens
ugaaugucuuacuguga

SEQ ID NO: 1425111 - RNA, 12 nt, Homo sapiens
ugaauguucaau

SEQ ID NO: 1425112 - RNA, 21 nt, Homo sapiens
ugaauucuaccuuuaaggguu

SEQ ID NO: 1425113 - RNA, 15 nt, Homo sapiens
ugaauuuccuaucug

SEQ ID NO: 1425114 - RNA, 23 nt, Homo sapiens
ugacaagcaagggcugugcugag

SEQ ID NO: 1425115 - RNA, 18 nt, Homo sapiens
ugacacacagcagcacug

SEQ ID NO: 1425116 - RNA, 13 nt, Homo sapiens
ugacacauucucu

SEQ ID NO: 1425117 - RNA, 22 nt, Homo sapiens
ugacaccgucccucagugauac

SEQ ID NO: 1425118 - RNA, 23 nt, Homo sapiens
ugacaccgucccucagugauacg

SEQ ID NO: 1425119 - RNA, 22 nt, Homo sapiens
ugacagcugaccuuugucaucu

SEQ ID NO: 1425120 - RNA, 16 nt, Homo sapiens
ugacaggaaagcccuc

SEQ ID NO: 1425121 - RNA, 18 nt, Homo sapiens
ugacaggcccaguggaac

SEQ ID NO: 1425122 - RNA, 16 nt, Homo sapiens
ugacagucuugcauuc

SEQ ID NO: 1425123 - RNA, 18 nt, Homo sapiens
ugacagugcccagcauga

SEQ ID NO: 1425124 - RNA, 14 nt, Homo sapiens
ugacauuauaucau

SEQ ID NO: 1425125 - RNA, 19 nt, Homo sapiens
ugacauuucuaacauaugu

SEQ ID NO: 1425126 - RNA, 15 nt, Homo sapiens
ugacccaaagaccaa

SEQ ID NO: 1425127 - RNA, 21 nt, Homo sapiens
ugacccuccaccgcagaagga

SEQ ID NO: 1425128 - RNA, 16 nt, Homo sapiens
ugacccuuccagacau

SEQ ID NO: 1425129 - RNA, 18 nt, Homo sapiens
ugaccuaugaugaaguca

SEQ ID NO: 1425130 - RNA, 14 nt, Homo sapiens
ugaccucacaguga

SEQ ID NO: 1425131 - RNA, 16 nt, Homo sapiens
ugaccuguuauuacca

SEQ ID NO: 1425132 - RNA, 16 nt, Homo sapiens
ugacggacguccugcu

SEQ ID NO: 1425133 - RNA, 20 nt, Homo sapiens
ugacggucccacacugguga

SEQ ID NO: 1425134 - RNA, 13 nt, Homo sapiens
ugacuaccagcua

SEQ ID NO: 1425135 - RNA, 15 nt, Homo sapiens
ugacuaucacauaca

SEQ ID NO: 1425136 - RNA, 18 nt, Homo sapiens
ugacuauuuccaccauca

SEQ ID NO: 1425137 - RNA, 23 nt, Homo sapiens
ugacucacaagaagaccagacug

SEQ ID NO: 1425138 - RNA, 13 nt, Homo sapiens
ugacucaccuguu

SEQ ID NO: 1425139 - RNA, 13 nt, Homo sapiens
ugacuccaagaac

SEQ ID NO: 1425140 - RNA, 14 nt, Homo sapiens
ugacuggcacccaa

SEQ ID NO: 1425141 - RNA, 17 nt, Homo sapiens
ugacugggaccaggcac

SEQ ID NO: 1425142 - RNA, 15 nt, Homo sapiens
ugacuuaaguggcau

SEQ ID NO: 1425143 - RNA, 15 nt, Homo sapiens
ugacuuuuaucugua

SEQ ID NO: 1425144 - RNA, 17 nt, Homo sapiens
ugagaaacuuccuuuga

SEQ ID NO: 1425145 - RNA, 14 nt, Homo sapiens
ugagaaaggauuaa

SEQ ID NO: 1425146 - RNA, 22 nt, Homo sapiens
ugagaacagacguuaccaauua

SEQ ID NO: 1425147 - RNA, 13 nt, Homo sapiens
ugagacaagcccu

SEQ ID NO: 1425148 - RNA, 17 nt, Homo sapiens
uggcuucgucauuugca

SEQ ID NO: 1425149 - RNA, 19 nt, Homo sapiens
uggcuucuagaucuggaac

SEQ ID NO: 1425150 - RNA, 15 nt, Homo sapiens
uggcuucuuacugaa

SEQ ID NO: 1425151 - RNA, 21 nt, Homo sapiens
uggcuuuuuuccuccugugua

SEQ ID NO: 1425152 - RNA, 21 nt, Homo sapiens
ugggaaaaaaguuuugaugaa

SEQ ID NO: 1425153 - RNA, 13 nt, Homo sapiens
ugggaaaacuggg

SEQ ID NO: 1425154 - RNA, 22 nt, Homo sapiens
ugggaagucguccuuacuccug

SEQ ID NO: 1425155 - RNA, 14 nt, Homo sapiens
ugggagaucagcca

SEQ ID NO: 1425156 - RNA, 16 nt, Homo sapiens
ugggagaucagccacg

SEQ ID NO: 1425157 - RNA, 17 nt, Homo sapiens
ugggaggucuccacuga

SEQ ID NO: 1425158 - RNA, 16 nt, Homo sapiens
ugggauugugguacaa

SEQ ID NO: 1425159 - RNA, 18 nt, Homo sapiens
ugggcaacauaguaagac

SEQ ID NO: 1425160 - RNA, 22 nt, Homo sapiens
ugggcagcugauuuugucacug

SEQ ID NO: 1425161 - RNA, 13 nt, Homo sapiens
ugggccacugcca

SEQ ID NO: 1425162 - RNA, 18 nt, Homo sapiens
ugggccagccucagcuca

SEQ ID NO: 1425163 - RNA, 18 nt, Homo sapiens
ugggcccuggccuggauu

SEQ ID NO: 1425164 - RNA, 16 nt, Homo sapiens
ugggccggccagccuu

SEQ ID NO: 1425165 - RNA, 23 nt, Homo sapiens
ugggccuagggacagacugcaag

SEQ ID NO: 1425166 - RNA, 19 nt, Homo sapiens
ugggcuuggccuuguguca

SEQ ID NO: 1425167 - RNA, 14 nt, Homo sapiens
uggggaacagagcg

SEQ ID NO: 1425168 - RNA, 11 nt, Homo sapiens
uggggccugua

SEQ ID NO: 1425169 - RNA, 10 nt, Homo sapiens
uggggcuccu

SEQ ID NO: 1425170 - RNA, 18 nt, Homo sapiens
uggggcuccuuucuccag

SEQ ID NO: 1425171 - RNA, 14 nt, Homo sapiens
ugggggucaggggc

SEQ ID NO: 1425172 - RNA, 17 nt, Homo sapiens
ugggggucaggggcuag

SEQ ID NO: 1425173 - RNA, 21 nt, Homo sapiens
ugggguauuuaccacagcagc

SEQ ID NO: 1425174 - RNA, 19 nt, Homo sapiens
ugggguugcaaccacugca

SEQ ID NO: 1425175 - RNA, 16 nt, Homo sapiens
ugggguuucaccaucu

SEQ ID NO: 1425176 - RNA, 17 nt, Homo sapiens
ugggguuucaccaucuu

SEQ ID NO: 1425177 - RNA, 16 nt, Homo sapiens
uggguauuuaauaaga

SEQ ID NO: 1425178 - RNA, 16 nt, Homo sapiens
ugggucucaauccuua

SEQ ID NO: 1425179 - RNA, 18 nt, Homo sapiens
ugggucuggggagggaga

SEQ ID NO: 1425180 - RNA, 15 nt, Homo sapiens
ugggucuucccugua

SEQ ID NO: 1425181 - RNA, 18 nt, Homo sapiens
ugggucuuuguacauuuu

SEQ ID NO: 1425182 - RNA, 16 nt, Homo sapiens
uggguuauuuuugucc

SEQ ID NO: 1425183 - RNA, 19 nt, Homo sapiens
uggguuuucuaacuguaaa

SEQ ID NO: 1425184 - RNA, 22 nt, Homo sapiens
uggguuuugucucugcaucuca

SEQ ID NO: 1425185 - RNA, 14 nt, Homo sapiens
ugguacaaggaaua

SEQ ID NO: 1425186 - RNA, 19 nt, Homo sapiens
ugguaccacuggaaucgau

SEQ ID NO: 1425187 - RNA, 12 nt, Homo sapiens
ugguagaaccac

SEQ ID NO: 1425188 - RNA, 17 nt, Homo sapiens
ugguauaucuuuuucca

SEQ ID NO: 1425189 - RNA, 14 nt, Homo sapiens
ugguauauuuccau

SEQ ID NO: 1425190 - RNA, 14 nt, Homo sapiens
ugguauccaaguua

SEQ ID NO: 1425191 - RNA, 20 nt, Homo sapiens
ugguaugcuggccagcaccc

SEQ ID NO: 1425192 - RNA, 19 nt, Homo sapiens
uggucagcucacacccuaa

SEQ ID NO: 1425193 - RNA, 18 nt, Homo sapiens
uggucauugccuugccaa

SEQ ID NO: 1425194 - RNA, 20 nt, Homo sapiens
uggucucaagcaguccuccu

SEQ ID NO: 1425195 - RNA, 19 nt, Homo sapiens
uggucuccucugauuauca

SEQ ID NO: 1425196 - RNA, 14 nt, Homo sapiens
uggucugugcugcc

SEQ ID NO: 1425197 - RNA, 15 nt, Homo sapiens
uggugacacacagca

SEQ ID NO: 1425198 - RNA, 17 nt, Homo sapiens
uggugacaugugccugu

SEQ ID NO: 1425199 - RNA, 22 nt, Homo sapiens
uggugaggaagccccaagccau

SEQ ID NO: 1425200 - RNA, 16 nt, Homo sapiens
uggugaucagugcaau

SEQ ID NO: 1425201 - RNA, 17 nt, Homo sapiens
uggugggaacauucgag

SEQ ID NO: 1425202 - RNA, 22 nt, Homo sapiens
ugguguaaagccaacacccugu

SEQ ID NO: 1425203 - RNA, 22 nt, Homo sapiens
ugguguauuugccagcuuuauu

SEQ ID NO: 1425204 - RNA, 16 nt, Homo sapiens
uggugucuagcauuaa

SEQ ID NO: 1425205 - RNA, 16 nt, Homo sapiens
uggugugucaaugcca

SEQ ID NO: 1425206 - RNA, 21 nt, Homo sapiens
ugguguucaaaaaaacacuag

SEQ ID NO: 1425207 - RNA, 15 nt, Homo sapiens
ugguuccaagaaaga

SEQ ID NO: 1425208 - RNA, 13 nt, Homo sapiens
ugguugauuccca

SEQ ID NO: 1425209 - RNA, 20 nt, Homo sapiens
ugguugggguggggcaggau

SEQ ID NO: 1425210 - RNA, 13 nt, Homo sapiens
ugguuuaugucau

SEQ ID NO: 1425211 - RNA, 15 nt, Homo sapiens
ugguuuaugucauca

SEQ ID NO: 1425212 - RNA, 16 nt, Homo sapiens
ugguuuaugucaucau

SEQ ID NO: 1425213 - RNA, 21 nt, Homo sapiens
ugguuucauuucuacugugac

SEQ ID NO: 1425214 - RNA, 20 nt, Homo sapiens
uguaaaauaaguauuuccau

SEQ ID NO: 1425215 - RNA, 17 nt, Homo sapiens
uguaaaauagaauguua

SEQ ID NO: 1425216 - RNA, 19 nt, Homo sapiens
uguaaaauagaauguuacu

SEQ ID NO: 1425217 - RNA, 19 nt, Homo sapiens
uguaaacauaauucuugua

SEQ ID NO: 1425218 - RNA, 18 nt, Homo sapiens
uguaaagaauaaaugaau

SEQ ID NO: 1425219 - RNA, 15 nt, Homo sapiens
uguaaauacagugga

SEQ ID NO: 1425220 - RNA, 13 nt, Homo sapiens
uguaaaugugcuu

SEQ ID NO: 1425221 - RNA, 23 nt, Homo sapiens
uguaaguaccccugauaagcaaa

SEQ ID NO: 1425222 - RNA, 15 nt, Homo sapiens
uguaauaaaucugag

SEQ ID NO: 1425223 - RNA, 12 nt, Homo sapiens
uguaaugaucau

SEQ ID NO: 1425224 - RNA, 21 nt, Homo sapiens
uguaauuaaguaaaccaaaaa

SEQ ID NO: 1425225 - RNA, 22 nt, Homo sapiens
uguaauuaaguaaaccaaaaag

SEQ ID NO: 1425226 - RNA, 21 nt, Homo sapiens
uguaauuaguaauaaaaccca

SEQ ID NO: 1425227 - RNA, 23 nt, Homo sapiens
uguacacacggaccaugugguau

SEQ ID NO: 1425228 - RNA, 23 nt, Homo sapiens
uguacgguggucuuugaauuaua

SEQ ID NO: 1425229 - RNA, 13 nt, Homo sapiens
uguacuccucuga

SEQ ID NO: 1425230 - RNA, 15 nt, Homo sapiens
uguacuccugugcug

SEQ ID NO: 1425231 - RNA, 17 nt, Homo sapiens
uguacuuccuguguacu

SEQ ID NO: 1425232 - RNA, 22 nt, Homo sapiens
uguacuuuauuuguauuugcca

SEQ ID NO: 1425233 - RNA, 15 nt, Homo sapiens
uguagaagauggacu

SEQ ID NO: 1425234 - RNA, 18 nt, Homo sapiens
uguagacuuacuuuccua

SEQ ID NO: 1425235 - RNA, 18 nt, Homo sapiens
uuaauggguacaauguac

SEQ ID NO: 1425236 - RNA, 13 nt, Homo sapiens
uuaauuauauagu

SEQ ID NO: 1425237 - RNA, 17 nt, Homo sapiens
uuaauucucaugugauc

SEQ ID NO: 1425238 - RNA, 16 nt, Homo sapiens
uuaauuggaguaucua

SEQ ID NO: 1425239 - RNA, 23 nt, Homo sapiens
uuaauuugaaaacauaaucugca

SEQ ID NO: 1425240 - RNA, 19 nt, Homo sapiens
uuacaauuauggaaauaua

SEQ ID NO: 1425241 - RNA, 15 nt, Homo sapiens
uuacacguaccucuc

SEQ ID NO: 1425242 - RNA, 24 nt, Homo sapiens
uuacagcugccugcaguacuuuac

SEQ ID NO: 1425243 - RNA, 22 nt, Homo sapiens
uuacagugacugucguguuuac

SEQ ID NO: 1425244 - RNA, 15 nt, Homo sapiens
uuacauuuccaaaug

SEQ ID NO: 1425245 - RNA, 22 nt, Homo sapiens
uuacccagagaauauauacauu

SEQ ID NO: 1425246 - RNA, 18 nt, Homo sapiens
uuaccuaaaacugcugaa

SEQ ID NO: 1425247 - RNA, 14 nt, Homo sapiens
uuaccuaaacagau

SEQ ID NO: 1425248 - RNA, 19 nt, Homo sapiens
uuaccuaccaccuucccuc

SEQ ID NO: 1425249 - RNA, 21 nt, Homo sapiens
uuaccuauuauaaaaucuuac

SEQ ID NO: 1425250 - RNA, 13 nt, Homo sapiens
uuaccugacacaa

SEQ ID NO: 1425251 - RNA, 22 nt, Homo sapiens
uuaccugcauguguuguacaau

SEQ ID NO: 1425252 - RNA, 22 nt, Homo sapiens
uuacguccacaccgagcccagu

SEQ ID NO: 1425253 - RNA, 13 nt, Homo sapiens
uuacgugagccag

SEQ ID NO: 1425254 - RNA, 13 nt, Homo sapiens
uuacuuauucuuc

SEQ ID NO: 1425255 - RNA, 15 nt, Homo sapiens
uuagaaauugcauuu

SEQ ID NO: 1425256 - RNA, 22 nt, Homo sapiens
uuagaacggagcccucggugau

SEQ ID NO: 1425257 - RNA, 16 nt, Homo sapiens
uuagacaaaguucaag

SEQ ID NO: 1425258 - RNA, 13 nt, Homo sapiens
uuagagaauguuc

SEQ ID NO: 1425259 - RNA, 21 nt, Homo sapiens
uuagaugagggugacugucaa

SEQ ID NO: 1425260 - RNA, 14 nt, Homo sapiens
uuagauuaguauuu

SEQ ID NO: 1425261 - RNA, 21 nt, Homo sapiens
uuagcaccucuuuuugaacag

SEQ ID NO: 1425262 - RNA, 17 nt, Homo sapiens
uuagccuuaguuucuca

SEQ ID NO: 1425263 - RNA, 19 nt, Homo sapiens
uuagcuguuuuuuucauua

SEQ ID NO: 1425264 - RNA, 16 nt, Homo sapiens
uuagcuucucugccaa

SEQ ID NO: 1425265 - RNA, 21 nt, Homo sapiens
uuagcuucucugccaagcccu

SEQ ID NO: 1425266 - RNA, 12 nt, Homo sapiens
uuaggaacagcu

SEQ ID NO: 1425267 - RNA, 13 nt, Homo sapiens
uuaggacugacau

SEQ ID NO: 1425268 - RNA, 23 nt, Homo sapiens
uuaggaggcugcaugcucuggaa

SEQ ID NO: 1425269 - RNA, 23 nt, Homo sapiens
uuaggauuuaacagucauuuaaa

SEQ ID NO: 1425270 - RNA, 14 nt, Homo sapiens
uuaggcagggauuu

SEQ ID NO: 1425271 - RNA, 14 nt, Homo sapiens
uuaguaaauccuua

SEQ ID NO: 1425272 - RNA, 13 nt, Homo sapiens
uuaguaauuguca

SEQ ID NO: 1425273 - RNA, 15 nt, Homo sapiens
uuaguuuuuuccaca

SEQ ID NO: 1425274 - RNA, 19 nt, Homo sapiens
uuauaaaaucuuacuuugu

SEQ ID NO: 1425275 - RNA, 20 nt, Homo sapiens
uuauacaaaauaauuuaacu

SEQ ID NO: 1425276 - RNA, 18 nt, Homo sapiens
uuauaccagagaccugag

SEQ ID NO: 1425277 - RNA, 20 nt, Homo sapiens
uuauacgacuuuuaagcaaa

SEQ ID NO: 1425278 - RNA, 14 nt, Homo sapiens
uuauacuaccaagu

SEQ ID NO: 1425279 - RNA, 22 nt, Homo sapiens
uuauaguuucagauauauauca

SEQ ID NO: 1425280 - RNA, 19 nt, Homo sapiens
uuauauaaggcaguauuau

SEQ ID NO: 1425281 - RNA, 14 nt, Homo sapiens
uuauauauggcaua

SEQ ID NO: 1425282 - RNA, 15 nt, Homo sapiens
uuauaucagccugag

SEQ ID NO: 1425283 - RNA, 13 nt, Homo sapiens
uuauaucaucagc

SEQ ID NO: 1425284 - RNA, 16 nt, Homo sapiens
uuauauguaguacuaa

SEQ ID NO: 1425285 - RNA, 16 nt, Homo sapiens
uuauauuaaaauaugg

SEQ ID NO: 1425286 - RNA, 18 nt, Homo sapiens
uuaucaauuaaugacaau

SEQ ID NO: 1425287 - RNA, 19 nt, Homo sapiens
uuaucacgcagaucacuaa

SEQ ID NO: 1425288 - RNA, 13 nt, Homo sapiens
uuaucauuuauca

SEQ ID NO: 1425289 - RNA, 22 nt, Homo sapiens
uuaugaagcaagccccacuuau

SEQ ID NO: 1425290 - RNA, 23 nt, Homo sapiens
uuaugagucucuaugaucuuggc

SEQ ID NO: 1425291 - RNA, 20 nt, Homo sapiens
uuauggggacagcauaccuu

SEQ ID NO: 1425292 - RNA, 14 nt, Homo sapiens
uuauguaacaucca

SEQ ID NO: 1425293 - RNA, 16 nt, Homo sapiens
uuauuaagauguauaa

SEQ ID NO: 1425294 - RNA, 14 nt, Homo sapiens
uuauuaauucauua

SEQ ID NO: 1425295 - RNA, 21 nt, Homo sapiens
uuauuagguacguaacuauuu

SEQ ID NO: 1425296 - RNA, 13 nt, Homo sapiens
uuauuaugucuca

SEQ ID NO: 1425297 - RNA, 18 nt, Homo sapiens
uuauuauuguucuuuaag

SEQ ID NO: 1425298 - RNA, 12 nt, Homo sapiens
uuauugagcucu

SEQ ID NO: 1425299 - RNA, 23 nt, Homo sapiens
uuauugccucugaaaugccucuu

SEQ ID NO: 1425300 - RNA, 17 nt, Homo sapiens
uuauuuguacaguucag

SEQ ID NO: 1425301 - RNA, 12 nt, Homo sapiens
uuauuuuugcaa

SEQ ID NO: 1425302 - RNA, 12 nt, Homo sapiens
uucaaaagugga

SEQ ID NO: 1425303 - RNA, 17 nt, Homo sapiens
uucaaacugcaugauuc

SEQ ID NO: 1425304 - RNA, 19 nt, Homo sapiens
uucaaacugcaugauucau

SEQ ID NO: 1425305 - RNA, 15 nt, Homo sapiens
uucaaagcaggguuc

SEQ ID NO: 1425306 - RNA, 13 nt, Homo sapiens
uucaaaguguaag

SEQ ID NO: 1425307 - RNA, 14 nt, Homo sapiens
uucaaauggacuca

SEQ ID NO: 1425308 - RNA, 16 nt, Homo sapiens
uucaaauuuaagguua

SEQ ID NO: 1425309 - RNA, 20 nt, Homo sapiens
uucaacaaugacuaaugagu

SEQ ID NO: 1425310 - RNA, 12 nt, Homo sapiens
uucaacuccaga

SEQ ID NO: 1425311 - RNA, 16 nt, Homo sapiens
uucaagagauucuugu

SEQ ID NO: 1425312 - RNA, 15 nt, Homo sapiens
uucaagagugcaguu

SEQ ID NO: 1425313 - RNA, 18 nt, Homo sapiens
uucaagguguaaaauauc

SEQ ID NO: 1425314 - RNA, 21 nt, Homo sapiens
uucaauaaaaaauacaauuca

SEQ ID NO: 1425315 - RNA, 20 nt, Homo sapiens
uucaauaaagcugcugagaa

SEQ ID NO: 1425316 - RNA, 23 nt, Homo sapiens
uucacaaaaaggcauaugcaaua

SEQ ID NO: 1425317 - RNA, 19 nt, Homo sapiens
uucacauaacuucucugag

SEQ ID NO: 1425318 - RNA, 18 nt, Homo sapiens
uucacauaggcaauaucu

SEQ ID NO: 1425319 - RNA, 22 nt, Homo sapiens
uucacauauauguaauuuagca

SEQ ID NO: 1425320 - RNA, 15 nt, Homo sapiens
uucaccagauuugcu

SEQ ID NO: 1425321 - RNA, 15 nt, Homo sapiens
uucagagccagugaa

SEQ ID NO: 1425322 - RNA, 22 nt, Homo sapiens
acacauagauuaauggcacuga

SEQ ID NO: 1425323 - RNA, 16 nt, Homo sapiens
acacauggaugcacgc

SEQ ID NO: 1425324 - RNA, 17 nt, Homo sapiens
acacauuacuugcacaa

SEQ ID NO: 1425325 - RNA, 15 nt, Homo sapiens
acaccaaugcgcaca

SEQ ID NO: 1425326 - RNA, 19 nt, Homo sapiens
acaccaccucuccagaggc

SEQ ID NO: 1425327 - RNA, 16 nt, Homo sapiens
acaccacuuugucucu

SEQ ID NO: 1425328 - RNA, 17 nt, Homo sapiens
acacccaaagcauggac

SEQ ID NO: 1425329 - RNA, 14 nt, Homo sapiens
acacccacuggcca

SEQ ID NO: 1425330 - RNA, 14 nt, Homo sapiens
acacccagagggua

SEQ ID NO: 1425331 - RNA, 19 nt, Homo sapiens
acacccagucuguucccca

SEQ ID NO: 1425332 - RNA, 16 nt, Homo sapiens
acacccgacuccucaa

SEQ ID NO: 1425333 - RNA, 14 nt, Homo sapiens
acaccgaugcacac

SEQ ID NO: 1425334 - RNA, 17 nt, Homo sapiens
acaccgaugugcgcaca

SEQ ID NO: 1425335 - RNA, 17 nt, Homo sapiens
acaccgcgcaucucuuc

SEQ ID NO: 1425336 - RNA, 13 nt, Homo sapiens
acaccuaagagaa

SEQ ID NO: 1425337 - RNA, 22 nt, Homo sapiens
acaccuaagagaaaaagaucga

SEQ ID NO: 1425338 - RNA, 20 nt, Homo sapiens
acaccugaaaauuaugaguc

SEQ ID NO: 1425339 - RNA, 22 nt, Homo sapiens
acaccuucuuggcuucugggac

SEQ ID NO: 1425340 - RNA, 16 nt, Homo sapiens
acacgccaaugcacac

SEQ ID NO: 1425341 - RNA, 12 nt, Homo sapiens
acacgcuuucac

SEQ ID NO: 1425342 - RNA, 14 nt, Homo sapiens
acacggaugcacac

SEQ ID NO: 1425343 - RNA, 15 nt, Homo sapiens
acacggaugcacaga

SEQ ID NO: 1425344 - RNA, 17 nt, Homo sapiens
acacggaugcacagaga

SEQ ID NO: 1425345 - RNA, 16 nt, Homo sapiens
acacguggguauuuaa

SEQ ID NO: 1425346 - RNA, 15 nt, Homo sapiens
acacucaacaauaaa

SEQ ID NO: 1425347 - RNA, 17 nt, Homo sapiens
acacucagaagccuggg

SEQ ID NO: 1425348 - RNA, 22 nt, Homo sapiens
acacucccagggacaagggaag

SEQ ID NO: 1425349 - RNA, 17 nt, Homo sapiens
acacugaaguuaacaga

SEQ ID NO: 1425350 - RNA, 14 nt, Homo sapiens
acacugugcuauaa

SEQ ID NO: 1425351 - RNA, 18 nt, Homo sapiens
acacuucucaggacacag

SEQ ID NO: 1425352 - RNA, 17 nt, Homo sapiens
acacuucugacuucacu

SEQ ID NO: 1425353 - RNA, 14 nt, Homo sapiens
acacuuguauaaau

SEQ ID NO: 1425354 - RNA, 22 nt, Homo sapiens
acagaacugcuaaauacuguac

SEQ ID NO: 1425355 - RNA, 12 nt, Homo sapiens
acagaagccagg

SEQ ID NO: 1425356 - RNA, 16 nt, Homo sapiens
acagaagccaggagca

SEQ ID NO: 1425357 - RNA, 17 nt, Homo sapiens
acagaauacaagccacu

SEQ ID NO: 1425358 - RNA, 13 nt, Homo sapiens
acagacgucucaa

SEQ ID NO: 1425359 - RNA, 21 nt, Homo sapiens
acagacgucucaagacugaaa

SEQ ID NO: 1425360 - RNA, 17 nt, Homo sapiens
acagagaagaccaaagc

SEQ ID NO: 1425361 - RNA, 13 nt, Homo sapiens
acagagacagaaa

SEQ ID NO: 1425362 - RNA, 13 nt, Homo sapiens
acagagacagaga

SEQ ID NO: 1425363 - RNA, 15 nt, Homo sapiens
acagagauaugcaca

SEQ ID NO: 1425364 - RNA, 15 nt, Homo sapiens
acagagaugcaugcg

SEQ ID NO: 1425365 - RNA, 22 nt, Homo sapiens
acagagaugcaugcgcaggcuc

SEQ ID NO: 1425366 - RNA, 21 nt, Homo sapiens
acagagcaaugguagcaaaac

SEQ ID NO: 1425367 - RNA, 22 nt, Homo sapiens
acagagcacuagguucaauucc

SEQ ID NO: 1425368 - RNA, 22 nt, Homo sapiens
acagagcccccaagccucugcc

SEQ ID NO: 1425369 - RNA, 18 nt, Homo sapiens
acagagcgggccucuucc

SEQ ID NO: 1425370 - RNA, 22 nt, Homo sapiens
acagaggagagaggcucagcca

SEQ ID NO: 1425371 - RNA, 15 nt, Homo sapiens
acagagguggcugcu

SEQ ID NO: 1425372 - RNA, 20 nt, Homo sapiens
acagauacauagauggacca

SEQ ID NO: 1425373 - RNA, 17 nt, Homo sapiens
acagauagacagugcug

SEQ ID NO: 1425374 - RNA, 17 nt, Homo sapiens
acagauagucaaaccau

SEQ ID NO: 1425375 - RNA, 13 nt, Homo sapiens
acagauaugcaca

SEQ ID NO: 1425376 - RNA, 14 nt, Homo sapiens
acagauaugcacac

SEQ ID NO: 1425377 - RNA, 22 nt, Homo sapiens
acagauaugcacacacauggau

SEQ ID NO: 1425378 - RNA, 12 nt, Homo sapiens
acagaugcacac

SEQ ID NO: 1425379 - RNA, 17 nt, Homo sapiens
acagaugcacacacaga

SEQ ID NO: 1425380 - RNA, 16 nt, Homo sapiens
acagauggucacacag

SEQ ID NO: 1425381 - RNA, 17 nt, Homo sapiens
acagauggucacacaga

SEQ ID NO: 1425382 - RNA, 15 nt, Homo sapiens
acagauguaaaugcc

SEQ ID NO: 1425383 - RNA, 18 nt, Homo sapiens
acagcacccaggcuccau

SEQ ID NO: 1425384 - RNA, 15 nt, Homo sapiens
acagcagcaucuuca

SEQ ID NO: 1425385 - RNA, 17 nt, Homo sapiens
acagcagccccugcaca

SEQ ID NO: 1425386 - RNA, 18 nt, Homo sapiens
acagccaaaaaggaccaa

SEQ ID NO: 1425387 - RNA, 18 nt, Homo sapiens
acagcuaugcacuguaaa

SEQ ID NO: 1425388 - RNA, 21 nt, Homo sapiens
acagcucaagucuucccugau

SEQ ID NO: 1425389 - RNA, 21 nt, Homo sapiens
acagcucuuggcauuuuccuc

SEQ ID NO: 1425390 - RNA, 15 nt, Homo sapiens
acagcugaacuauuu

SEQ ID NO: 1425391 - RNA, 21 nt, Homo sapiens
accaacccuguuuccugaguu

SEQ ID NO: 1425392 - RNA, 14 nt, Homo sapiens
accaagagcacauu

SEQ ID NO: 1425393 - RNA, 20 nt, Homo sapiens
accacaacugacacaggaaa

SEQ ID NO: 1425394 - RNA, 21 nt, Homo sapiens
accacaacugacacaggaaac

SEQ ID NO: 1425395 - RNA, 13 nt, Homo sapiens
accacacaccuca

SEQ ID NO: 1425396 - RNA, 15 nt, Homo sapiens
accacacuucuugaa

SEQ ID NO: 1425397 - RNA, 15 nt, Homo sapiens
accacuagguucuag

SEQ ID NO: 1425398 - RNA, 22 nt, Homo sapiens
accacuguccuggcugcucuca

SEQ ID NO: 1425399 - RNA, 16 nt, Homo sapiens
accacuguguauuuaa

SEQ ID NO: 1425400 - RNA, 14 nt, Homo sapiens
accacuuaucacau

SEQ ID NO: 1425401 - RNA, 21 nt, Homo sapiens
accagaaagugaggaagccua

SEQ ID NO: 1425402 - RNA, 14 nt, Homo sapiens
accagaaguccuau

SEQ ID NO: 1425403 - RNA, 14 nt, Homo sapiens
accagaggugacag

SEQ ID NO: 1425404 - RNA, 20 nt, Homo sapiens
accagcuaacuccagucucc

SEQ ID NO: 1425405 - RNA, 19 nt, Homo sapiens
accagcuuguuugugaaac

SEQ ID NO: 1425406 - RNA, 22 nt, Homo sapiens
accaggacuaaugcauguggua

SEQ ID NO: 1425407 - RNA, 15 nt, Homo sapiens
aaguaaaccaaaaag

SEQ ID NO: 1425408 - RNA, 15 nt, Homo sapiens
aaguaacuuuuacaa

SEQ ID NO: 1425409 - RNA, 19 nt, Homo sapiens
aaguaacuuuuacaaaaca

SEQ ID NO: 1425410 - RNA, 17 nt, Homo sapiens
aaguacaaauauuccug

SEQ ID NO: 1425411 - RNA, 12 nt, Homo sapiens
aaguacauguau

SEQ ID NO: 1425412 - RNA, 20 nt, Homo sapiens
aaguaccccugauaagcaaa

SEQ ID NO: 1425413 - RNA, 21 nt, Homo sapiens
aaguagugauauucuacuucu

SEQ ID NO: 1425414 - RNA, 19 nt, Homo sapiens
aaguauaucuuuaauucug

SEQ ID NO: 1425415 - RNA, 15 nt, Homo sapiens
aaguaucaugcauuc

SEQ ID NO: 1425416 - RNA, 18 nt, Homo sapiens
aaguaugugaauaugaau

SEQ ID NO: 1425417 - RNA, 14 nt, Homo sapiens
aagucaacacucuu

SEQ ID NO: 1425418 - RNA, 13 nt, Homo sapiens
aagucaaggagaa

SEQ ID NO: 1425419 - RNA, 21 nt, Homo sapiens
aagucaccacuccauucccaa

SEQ ID NO: 1425420 - RNA, 23 nt, Homo sapiens
aagucacugcacagugcaucuca

SEQ ID NO: 1425421 - RNA, 18 nt, Homo sapiens
aagucagucuuauagcaa

SEQ ID NO: 1425422 - RNA, 23 nt, Homo sapiens
aaguccaaccugccugugcauga

SEQ ID NO: 1425423 - RNA, 14 nt, Homo sapiens
aagucccagcauug

SEQ ID NO: 1425424 - RNA, 14 nt, Homo sapiens
aagucguuucagga

SEQ ID NO: 1425425 - RNA, 23 nt, Homo sapiens
aagucuaaauaaaugaaguauuu

SEQ ID NO: 1425426 - RNA, 20 nt, Homo sapiens
aagucuccagucaccuacaa

SEQ ID NO: 1425427 - RNA, 20 nt, Homo sapiens
aagugagggcugggcagcug

SEQ ID NO: 1425428 - RNA, 22 nt, Homo sapiens
aagugauaucccccagccucaa

SEQ ID NO: 1425429 - RNA, 19 nt, Homo sapiens
aagugauccacccaccuca

SEQ ID NO: 1425430 - RNA, 15 nt, Homo sapiens
aagugccaguuugcu

SEQ ID NO: 1425431 - RNA, 15 nt, Homo sapiens
aagugccuaccccag

SEQ ID NO: 1425432 - RNA, 14 nt, Homo sapiens
aaguggccaugcca

SEQ ID NO: 1425433 - RNA, 15 nt, Homo sapiens
aaguguagcacccug

SEQ ID NO: 1425434 - RNA, 16 nt, Homo sapiens
aagugucgaaagcaac

SEQ ID NO: 1425435 - RNA, 16 nt, Homo sapiens
aaguguggaagcagaa

SEQ ID NO: 1425436 - RNA, 16 nt, Homo sapiens
aaguguuccuucauua

SEQ ID NO: 1425437 - RNA, 20 nt, Homo sapiens
aaguguuccuucauuaacuc

SEQ ID NO: 1425438 - RNA, 18 nt, Homo sapiens
aaguguugauuacauaau

SEQ ID NO: 1425439 - RNA, 18 nt, Homo sapiens
aaguguugcucuuggaaa

SEQ ID NO: 1425440 - RNA, 16 nt, Homo sapiens
aaguuaacuacagugu

SEQ ID NO: 1425441 - RNA, 14 nt, Homo sapiens
aaguuacuucacuu

SEQ ID NO: 1425442 - RNA, 21 nt, Homo sapiens
aaguuagggaugacugugauu

SEQ ID NO: 1425443 - RNA, 24 nt, Homo sapiens
aaguuauuaacgggcauguauuau

SEQ ID NO: 1425444 - RNA, 17 nt, Homo sapiens
aaguucaacuuccagaa

SEQ ID NO: 1425445 - RNA, 11 nt, Homo sapiens
aaguucaggga

SEQ ID NO: 1425446 - RNA, 12 nt, Homo sapiens
aaguucagggaa

SEQ ID NO: 1425447 - RNA, 18 nt, Homo sapiens
aaguuccaguguucucuc

SEQ ID NO: 1425448 - RNA, 22 nt, Homo sapiens
aaguuccaguguucucucuuau

SEQ ID NO: 1425449 - RNA, 22 nt, Homo sapiens
aaguucccuacuuccugugacu

SEQ ID NO: 1425450 - RNA, 17 nt, Homo sapiens
aaguuccugcacuccag

SEQ ID NO: 1425451 - RNA, 15 nt, Homo sapiens
aaguuggguuaggag

SEQ ID NO: 1425452 - RNA, 16 nt, Homo sapiens
aaguuuaaaaaaccau

SEQ ID NO: 1425453 - RNA, 20 nt, Homo sapiens
aaguuuauuuuuucuacaca

SEQ ID NO: 1425454 - RNA, 22 nt, Homo sapiens
aaguuuuaagagaagaugugau

SEQ ID NO: 1425455 - RNA, 18 nt, Homo sapiens
aauaaaaaauacaauuca

SEQ ID NO: 1425456 - RNA, 18 nt, Homo sapiens
aauaaaaacccuguaugg

SEQ ID NO: 1425457 - RNA, 18 nt, Homo sapiens
aauaaaacuuaugcuagu

SEQ ID NO: 1425458 - RNA, 16 nt, Homo sapiens
aauaaaaguuuacaga

SEQ ID NO: 1425459 - RNA, 13 nt, Homo sapiens
aauaaaccuugau

SEQ ID NO: 1425460 - RNA, 20 nt, Homo sapiens
aauaaagcccuugaaccagc

SEQ ID NO: 1425461 - RNA, 20 nt, Homo sapiens
aauaaaugaaucuuacuccu

SEQ ID NO: 1425462 - RNA, 18 nt, Homo sapiens
aauaaaugccaacauacc

SEQ ID NO: 1425463 - RNA, 14 nt, Homo sapiens
aauaaauugcuccu

SEQ ID NO: 1425464 - RNA, 23 nt, Homo sapiens
aauaaauuggugauaaguggaaa

SEQ ID NO: 1425465 - RNA, 17 nt, Homo sapiens
aauaagaaacaugaugu

SEQ ID NO: 1425466 - RNA, 11 nt, Homo sapiens
aauaagcuuua

SEQ ID NO: 1425467 - RNA, 20 nt, Homo sapiens
aauaaggggcaccugggaaa

SEQ ID NO: 1425468 - RNA, 20 nt, Homo sapiens
aauaauaaaaagacuauuaa

SEQ ID NO: 1425469 - RNA, 16 nt, Homo sapiens
aauaauguaagggucu

SEQ ID NO: 1425470 - RNA, 20 nt, Homo sapiens
aauaauuaaaaaccacugaa

SEQ ID NO: 1425471 - RNA, 18 nt, Homo sapiens
aauaauucaugauucaac

SEQ ID NO: 1425472 - RNA, 15 nt, Homo sapiens
aauaauugauuucaa

SEQ ID NO: 1425473 - RNA, 14 nt, Homo sapiens
aauacaacauguag

SEQ ID NO: 1425474 - RNA, 17 nt, Homo sapiens
aauacaagccacuaccu

SEQ ID NO: 1425475 - RNA, 20 nt, Homo sapiens
aauacaagccacuaccuucu

SEQ ID NO: 1425476 - RNA, 15 nt, Homo sapiens
aauacauaagaccau

SEQ ID NO: 1425477 - RNA, 22 nt, Homo sapiens
aauaccagugaaccaaagagac

SEQ ID NO: 1425478 - RNA, 15 nt, Homo sapiens
aauacccccagagac

SEQ ID NO: 1425479 - RNA, 22 nt, Homo sapiens
aauacgguaccuggcaauguuu

SEQ ID NO: 1425480 - RNA, 13 nt, Homo sapiens
aauacuguacaua

SEQ ID NO: 1425481 - RNA, 21 nt, Homo sapiens
aauacuuuuuucuaguuucag

SEQ ID NO: 1425482 - RNA, 19 nt, Homo sapiens
aauagaaccaagaauucua

SEQ ID NO: 1425483 - RNA, 17 nt, Homo sapiens
aauagagacacagagau

SEQ ID NO: 1425484 - RNA, 23 nt, Homo sapiens
aauagaucaaaguccagcaggca

SEQ ID NO: 1425485 - RNA, 21 nt, Homo sapiens
aauagauggauuuguaucaau

SEQ ID NO: 1425486 - RNA, 15 nt, Homo sapiens
aauagauuucucaag

SEQ ID NO: 1425487 - RNA, 17 nt, Homo sapiens
aauagcuauugcaugua

SEQ ID NO: 1425488 - RNA, 21 nt, Homo sapiens
aauauaaacugaaaaauguca

SEQ ID NO: 1425489 - RNA, 13 nt, Homo sapiens
aauaucaaugaag

SEQ ID NO: 1425490 - RNA, 14 nt, Homo sapiens
aauauccaccacuu

SEQ ID NO: 1425491 - RNA, 14 nt, Homo sapiens
aauaucuaccugcc

SEQ ID NO: 1425492 - RNA, 14 nt, Homo sapiens
aauaucucucaccc

SEQ ID NO: 1425493 - RNA, 21 nt, Homo sapiens
aauuauacaucacagcagugc

SEQ ID NO: 1425494 - RNA, 17 nt, Homo sapiens
aauuauauuguccuccc

SEQ ID NO: 1425495 - RNA, 15 nt, Homo sapiens
aauucacuuaggguc

SEQ ID NO: 1425496 - RNA, 13 nt, Homo sapiens
aauucagugaaga

SEQ ID NO: 1425497 - RNA, 23 nt, Homo sapiens
aauucucaugugauccuuuuaug

SEQ ID NO: 1425498 - RNA, 19 nt, Homo sapiens
aauucuccuguugcaauga

SEQ ID NO: 1425499 - RNA, 21 nt, Homo sapiens
aauucucuuuaguucugucag

SEQ ID NO: 1425500 - RNA, 20 nt, Homo sapiens
aauucugcaacuagccaagg

SEQ ID NO: 1425501 - RNA, 18 nt, Homo sapiens
aauucuuuuucacacuga

SEQ ID NO: 1425502 - RNA, 13 nt, Homo sapiens
aauugacugucac

SEQ ID NO: 1425503 - RNA, 23 nt, Homo sapiens
aauugauguugcuggacugucau

SEQ ID NO: 1425504 - RNA, 11 nt, Homo sapiens
aauugauucaa

SEQ ID NO: 1425505 - RNA, 10 nt, Homo sapiens
aauugcacaa

SEQ ID NO: 1425506 - RNA, 11 nt, Homo sapiens
aauugcacaau

SEQ ID NO: 1425507 - RNA, 20 nt, Homo sapiens
aauugcacuuuuaaaccucu

SEQ ID NO: 1425508 - RNA, 17 nt, Homo sapiens
aauugcuacauagucca

SEQ ID NO: 1425509 - RNA, 16 nt, Homo sapiens
aauuggccucagugua

SEQ ID NO: 1425510 - RNA, 22 nt, Homo sapiens
aauuguaaguaccccugauaag

SEQ ID NO: 1425511 - RNA, 16 nt, Homo sapiens
aauugucaaaugucau

SEQ ID NO: 1425512 - RNA, 10 nt, Homo sapiens
aguccucaca

SEQ ID NO: 1425513 - RNA, 19 nt, Homo sapiens
aguccugcccaaugccuug

SEQ ID NO: 1425514 - RNA, 14 nt, Homo sapiens
aguccuuucaggaa

SEQ ID NO: 1425515 - RNA, 21 nt, Homo sapiens
agucgcaggauccgcugccac

SEQ ID NO: 1425516 - RNA, 16 nt, Homo sapiens
agucguuucaggacau

SEQ ID NO: 1425517 - RNA, 13 nt, Homo sapiens
agucuaaaacaca

SEQ ID NO: 1425518 - RNA, 14 nt, Homo sapiens
agucuaaaguuuac

SEQ ID NO: 1425519 - RNA, 12 nt, Homo sapiens
agucuagcuuuu

SEQ ID NO: 1425520 - RNA, 19 nt, Homo sapiens
agucuaguaguuucucugu

SEQ ID NO: 1425521 - RNA, 22 nt, Homo sapiens
agucucagagacuauuuagaca

SEQ ID NO: 1425522 - RNA, 16 nt, Homo sapiens
agucucaggaaaucaa

SEQ ID NO: 1425523 - RNA, 16 nt, Homo sapiens
agucugaaagacagaa

SEQ ID NO: 1425524 - RNA, 23 nt, Homo sapiens
agucugaaagacagaaugucacc

SEQ ID NO: 1425525 - RNA, 15 nt, Homo sapiens
agucugaguaaaauc

SEQ ID NO: 1425526 - RNA, 17 nt, Homo sapiens
agucuuauuuccucaac

SEQ ID NO: 1425527 - RNA, 13 nt, Homo sapiens
agucuugcauucu

SEQ ID NO: 1425528 - RNA, 14 nt, Homo sapiens
agucuuggcucacu

SEQ ID NO: 1425529 - RNA, 13 nt, Homo sapiens
agugaaaaaucug

SEQ ID NO: 1425530 - RNA, 20 nt, Homo sapiens
agugaaagaguagugcauuu

SEQ ID NO: 1425531 - RNA, 12 nt, Homo sapiens
agugacauuugu

SEQ ID NO: 1425532 - RNA, 19 nt, Homo sapiens
agugacccacaugccauuu

SEQ ID NO: 1425533 - RNA, 21 nt, Homo sapiens
agugauaucccccagccucaa

SEQ ID NO: 1425534 - RNA, 17 nt, Homo sapiens
agugauaugauguguag

SEQ ID NO: 1425535 - RNA, 17 nt, Homo sapiens
agugauauuguggguaa

SEQ ID NO: 1425536 - RNA, 20 nt, Homo sapiens
agugaucucccugaacauuu

SEQ ID NO: 1425537 - RNA, 16 nt, Homo sapiens
agaggauuuaacugug

SEQ ID NO: 1425538 - RNA, 19 nt, Homo sapiens
agaggauuuaacugugaac

SEQ ID NO: 1425539 - RNA, 13 nt, Homo sapiens
agaggcaccugcu

SEQ ID NO: 1425540 - RNA, 13 nt, Homo sapiens
agaggcagugaga

SEQ ID NO: 1425541 - RNA, 20 nt, Homo sapiens
agaggccaaggaggccuugg

SEQ ID NO: 1425542 - RNA, 17 nt, Homo sapiens
agagggcuuucucagga

SEQ ID NO: 1425543 - RNA, 17 nt, Homo sapiens
agagggggcaagggcaa

SEQ ID NO: 1425544 - RNA, 15 nt, Homo sapiens
agagguaacuaucaa

SEQ ID NO: 1425545 - RNA, 14 nt, Homo sapiens
agaggugagaccaa

SEQ ID NO: 1425546 - RNA, 19 nt, Homo sapiens
agaggugguagaaccacuu

SEQ ID NO: 1425547 - RNA, 15 nt, Homo sapiens
agagguuucuugaau

SEQ ID NO: 1425548 - RNA, 19 nt, Homo sapiens
agaguaaauagcauucucu

SEQ ID NO: 1425549 - RNA, 17 nt, Homo sapiens
agaguauuucugcccca

SEQ ID NO: 1425550 - RNA, 21 nt, Homo sapiens
agaguccuauuugcacuguag

SEQ ID NO: 1425551 - RNA, 18 nt, Homo sapiens
agagugagacucgucuca

SEQ ID NO: 1425552 - RNA, 16 nt, Homo sapiens
agagugcaguggugca

SEQ ID NO: 1425553 - RNA, 19 nt, Homo sapiens
agagugcugccaguccucu

SEQ ID NO: 1425554 - RNA, 22 nt, Homo sapiens
agaguguuuggggguuccguga

SEQ ID NO: 1425555 - RNA, 22 nt, Homo sapiens
agaguuucuccuuuugaccaaa

SEQ ID NO: 1425556 - RNA, 17 nt, Homo sapiens
agauaaaagauguacuu

SEQ ID NO: 1425557 - RNA, 22 nt, Homo sapiens
agauaacagcuuaacauuuaca

SEQ ID NO: 1425558 - RNA, 13 nt, Homo sapiens
agauaacugagaa

SEQ ID NO: 1425559 - RNA, 12 nt, Homo sapiens
agauaguaucuu

SEQ ID NO: 1425560 - RNA, 16 nt, Homo sapiens
agauauacacauggau

SEQ ID NO: 1425561 - RNA, 15 nt, Homo sapiens
agauauaugaauaug

SEQ ID NO: 1425562 - RNA, 12 nt, Homo sapiens
agauaugcacac

SEQ ID NO: 1425563 - RNA, 17 nt, Homo sapiens
agauaugcacacacaga

SEQ ID NO: 1425564 - RNA, 20 nt, Homo sapiens
agauaugcacacacauggau

SEQ ID NO: 1425565 - RNA, 15 nt, Homo sapiens
agauaugcacacacc

SEQ ID NO: 1425566 - RNA, 22 nt, Homo sapiens
agauauugucagaguucugcuc

SEQ ID NO: 1425567 - RNA, 17 nt, Homo sapiens
agaucauuuucuuaucu

SEQ ID NO: 1425568 - RNA, 15 nt, Homo sapiens
agauccucugcugac

SEQ ID NO: 1425569 - RNA, 23 nt, Homo sapiens
agauccuuuuuuacgcuuugcag

SEQ ID NO: 1425570 - RNA, 20 nt, Homo sapiens
agaucgauccuggauucacu

SEQ ID NO: 1425571 - RNA, 15 nt, Homo sapiens
agaucuaauaccauc

SEQ ID NO: 1425572 - RNA, 20 nt, Homo sapiens
agaucuuucaggaaagacgg

SEQ ID NO: 1425573 - RNA, 16 nt, Homo sapiens
agaugagggugacugu

SEQ ID NO: 1425574 - RNA, 19 nt, Homo sapiens
agaugauuaaacagacuuu

SEQ ID NO: 1425575 - RNA, 15 nt, Homo sapiens
agaugcaaccucacu

SEQ ID NO: 1425576 - RNA, 15 nt, Homo sapiens
agaugcugggccagu

SEQ ID NO: 1425577 - RNA, 17 nt, Homo sapiens
agauggaauaaagcccu

SEQ ID NO: 1425578 - RNA, 13 nt, Homo sapiens
agauggauuucac

SEQ ID NO: 1425579 - RNA, 14 nt, Homo sapiens
agaugggacauucc

SEQ ID NO: 1425580 - RNA, 12 nt, Homo sapiens
agauggggacag

SEQ ID NO: 1425581 - RNA, 16 nt, Homo sapiens
agauggggacagguga

SEQ ID NO: 1425582 - RNA, 21 nt, Homo sapiens
agaugggguuucacuguguug

SEQ ID NO: 1425583 - RNA, 22 nt, Homo sapiens
agauggguauuaaacuugucag

SEQ ID NO: 1425584 - RNA, 15 nt, Homo sapiens
agaugggugucacuu

SEQ ID NO: 1425585 - RNA, 17 nt, Homo sapiens
agaugugaucacugaga

SEQ ID NO: 1425586 - RNA, 14 nt, Homo sapiens
agaugugauuuauu

SEQ ID NO: 1425587 - RNA, 19 nt, Homo sapiens
agauguggcaaagugcugu

SEQ ID NO: 1425588 - RNA, 13 nt, Homo sapiens
agauuaauggcac

SEQ ID NO: 1425589 - RNA, 23 nt, Homo sapiens
agauuaguauuuuccacgucacu

SEQ ID NO: 1425590 - RNA, 18 nt, Homo sapiens
agauucuccaaaugauuu

SEQ ID NO: 1425591 - RNA, 15 nt, Homo sapiens
agauugcaccacugc

SEQ ID NO: 1425592 - RNA, 17 nt, Homo sapiens
agauugugcccagcccu

SEQ ID NO: 1425593 - RNA, 16 nt, Homo sapiens
agauuguuaaaauaac

SEQ ID NO: 1425594 - RNA, 20 nt, Homo sapiens
agauuuaaaaaccaacuuau

SEQ ID NO: 1425595 - RNA, 15 nt, Homo sapiens
agauuuaacacuaaa

SEQ ID NO: 1425596 - RNA, 16 nt, Homo sapiens
agauuucaacauauca

SEQ ID NO: 1425597 - RNA, 21 nt, Homo sapiens
agauuugcuguucacccacau

SEQ ID NO: 1425598 - RNA, 21 nt, Homo sapiens
agauuuuuuuuguaacuucaa

SEQ ID NO: 1425599 - RNA, 20 nt, Homo sapiens
agcaaaaccacugagcuucu

SEQ ID NO: 1425600 - RNA, 14 nt, Homo sapiens
agcaaagagugggc

SEQ ID NO: 1425601 - RNA, 17 nt, Homo sapiens
agcaaaggaaaccaaag

SEQ ID NO: 1425602 - RNA, 20 nt, Homo sapiens
agcaaaggaaaccaaaggaa

SEQ ID NO: 1425603 - RNA, 20 nt, Homo sapiens
agcaaauguuucugcaguag

SEQ ID NO: 1425604 - RNA, 21 nt, Homo sapiens
agcaacacucuauauuuagau

SEQ ID NO: 1425605 - RNA, 22 nt, Homo sapiens
augagcaauucuccugccucag

SEQ ID NO: 1425606 - RNA, 16 nt, Homo sapiens
augagcacacacacac

SEQ ID NO: 1425607 - RNA, 14 nt, Homo sapiens
augagcaccuacuu

SEQ ID NO: 1425608 - RNA, 11 nt, Homo sapiens
augagcaugaa

SEQ ID NO: 1425609 - RNA, 22 nt, Homo sapiens
augagcuguggacuagcaauau

SEQ ID NO: 1425610 - RNA, 18 nt, Homo sapiens
augagggaaauugcuauu

SEQ ID NO: 1425611 - RNA, 15 nt, Homo sapiens
augauaaagagggau

SEQ ID NO: 1425612 - RNA, 15 nt, Homo sapiens
augauaaucugggca

SEQ ID NO: 1425613 - RNA, 16 nt, Homo sapiens
augauaauuuacuuaa

SEQ ID NO: 1425614 - RNA, 23 nt, Homo sapiens
augauauuuuaugcaaacaguuc

SEQ ID NO: 1425615 - RNA, 12 nt, Homo sapiens
augaucuuggca

SEQ ID NO: 1425616 - RNA, 19 nt, Homo sapiens
augaugaucuuuaaaauac

SEQ ID NO: 1425617 - RNA, 15 nt, Homo sapiens
augaugccacuuccc

SEQ ID NO: 1425618 - RNA, 19 nt, Homo sapiens
augaugugaguacccagga

SEQ ID NO: 1425619 - RNA, 15 nt, Homo sapiens
augauguguagggcu

SEQ ID NO: 1425620 - RNA, 21 nt, Homo sapiens
augauuccuugagcauuuuau

SEQ ID NO: 1425621 - RNA, 21 nt, Homo sapiens
augauuggauuauucauuuaa

SEQ ID NO: 1425622 - RNA, 21 nt, Homo sapiens
augcaaaauaaauguuuuuau

SEQ ID NO: 1425623 - RNA, 15 nt, Homo sapiens
augcaaaguaaaaaa

SEQ ID NO: 1425624 - RNA, 22 nt, Homo sapiens
augcaaaguaaaaaaauaugaa

SEQ ID NO: 1425625 - RNA, 23 nt, Homo sapiens
augcacacacacagagauaugca

SEQ ID NO: 1425626 - RNA, 22 nt, Homo sapiens
augcacacacacggaugcacac

SEQ ID NO: 1425627 - RNA, 18 nt, Homo sapiens
augcacacacagaugcac

SEQ ID NO: 1425628 - RNA, 17 nt, Homo sapiens
augcacagagauaugca

SEQ ID NO: 1425629 - RNA, 20 nt, Homo sapiens
augcacagagauaugcacac

SEQ ID NO: 1425630 - RNA, 14 nt, Homo sapiens
augccaaauucuua

SEQ ID NO: 1425631 - RNA, 11 nt, Homo sapiens
augccacugcu

SEQ ID NO: 1425632 - RNA, 21 nt, Homo sapiens
augccagagacggaagccuuu

SEQ ID NO: 1425633 - RNA, 14 nt, Homo sapiens
augcccaaccuaag

SEQ ID NO: 1425634 - RNA, 20 nt, Homo sapiens
augccccgaauuuagucaca

SEQ ID NO: 1425635 - RNA, 21 nt, Homo sapiens
augcccuccaauccuuuccac

SEQ ID NO: 1425636 - RNA, 16 nt, Homo sapiens
augccggggacagaga

SEQ ID NO: 1425637 - RNA, 20 nt, Homo sapiens
augccguauaggaugucaga

SEQ ID NO: 1425638 - RNA, 13 nt, Homo sapiens
augccucaagaac

SEQ ID NO: 1425639 - RNA, 22 nt, Homo sapiens
augccuuucuguaaccaaaaau

SEQ ID NO: 1425640 - RNA, 15 nt, Homo sapiens
augcuaucucugugu

SEQ ID NO: 1425641 - RNA, 15 nt, Homo sapiens
augcucgugugauuu

SEQ ID NO: 1425642 - RNA, 13 nt, Homo sapiens
augcugacuguac

SEQ ID NO: 1425643 - RNA, 16 nt, Homo sapiens
augcuggguguugcau

SEQ ID NO: 1425644 - RNA, 14 nt, Homo sapiens
augcuuacaaaguc

SEQ ID NO: 1425645 - RNA, 13 nt, Homo sapiens
augcuugugauuu

SEQ ID NO: 1425646 - RNA, 13 nt, Homo sapiens
auggaacauaaaa

SEQ ID NO: 1425647 - RNA, 17 nt, Homo sapiens
auggaagaaaugggaga

SEQ ID NO: 1425648 - RNA, 22 nt, Homo sapiens
auggacuaaccccaacgcacag

SEQ ID NO: 1425649 - RNA, 17 nt, Homo sapiens
auggacucuucccccac

SEQ ID NO: 1425650 - RNA, 22 nt, Homo sapiens
auggacucuucccccacuccuc

SEQ ID NO: 1425651 - RNA, 22 nt, Homo sapiens
auggagcugaggaggugccuug

SEQ ID NO: 1425652 - RNA, 18 nt, Homo sapiens
auggaggaaagugauauc

SEQ ID NO: 1425653 - RNA, 15 nt, Homo sapiens
auggaggagaaauaa

SEQ ID NO: 1425654 - RNA, 11 nt, Homo sapiens
auggagugugc

SEQ ID NO: 1425655 - RNA, 17 nt, Homo sapiens
auggaugagcacacaca

SEQ ID NO: 1425656 - RNA, 19 nt, Homo sapiens
auggaugcacgcacaugcc

SEQ ID NO: 1425657 - RNA, 23 nt, Homo sapiens
auggauuugaugaaagugcaaag

SEQ ID NO: 1425658 - RNA, 17 nt, Homo sapiens
auggcaagugauaucac

SEQ ID NO: 1425659 - RNA, 17 nt, Homo sapiens
auggcacauggcuggca

SEQ ID NO: 1425660 - RNA, 20 nt, Homo sapiens
auggcaccuuuugcacauaa

SEQ ID NO: 1425661 - RNA, 21 nt, Homo sapiens
auggcacugcuuuucugagga

SEQ ID NO: 1425662 - RNA, 14 nt, Homo sapiens
auggcauugaacug

SEQ ID NO: 1425663 - RNA, 23 nt, Homo sapiens
auggcauugaacugguucaugaa

SEQ ID NO: 1425664 - RNA, 16 nt, Homo sapiens
accaggacuauagccc

SEQ ID NO: 1425665 - RNA, 17 nt, Homo sapiens
accaggccugagcaaca

SEQ ID NO: 1425666 - RNA, 11 nt, Homo sapiens
accagggaugg

SEQ ID NO: 1425667 - RNA, 21 nt, Homo sapiens
accaggggugauuucagagag

SEQ ID NO: 1425668 - RNA, 14 nt, Homo sapiens
accaguacugggaa

SEQ ID NO: 1425669 - RNA, 15 nt, Homo sapiens
accaguagacaacug

SEQ ID NO: 1425670 - RNA, 13 nt, Homo sapiens
accagucacuguc

SEQ ID NO: 1425671 - RNA, 23 nt, Homo sapiens
accaguccuagccgcgugugaca

SEQ ID NO: 1425672 - RNA, 21 nt, Homo sapiens
accagugaaagaguagugcau

SEQ ID NO: 1425673 - RNA, 15 nt, Homo sapiens
acgcagguguaccuc

SEQ ID NO: 1425674 - RNA, 22 nt, Homo sapiens
acgccccucccuccucuggccc

SEQ ID NO: 1425675 - RNA, 15 nt, Homo sapiens
acgccuccuggccag

SEQ ID NO: 1425676 - RNA, 15 nt, Homo sapiens
acgccuguaauccca

SEQ ID NO: 1425677 - RNA, 14 nt, Homo sapiens
acgcgggcgcugcc

SEQ ID NO: 1425678 - RNA, 20 nt, Homo sapiens
acgcucccccgcagucccca

SEQ ID NO: 1425679 - RNA, 18 nt, Homo sapiens
acgcuuccagaccaccug

SEQ ID NO: 1425680 - RNA, 20 nt, Homo sapiens
acgcuuccagaccaccugcc

SEQ ID NO: 1425681 - RNA, 21 nt, Homo sapiens
acgcuuccagaccaccugcca

SEQ ID NO: 1425682 - RNA, 15 nt, Homo sapiens
acggaaggcaaagag

SEQ ID NO: 1425683 - RNA, 21 nt, Homo sapiens
acggaaggucaguugccaugg

SEQ ID NO: 1425684 - RNA, 16 nt, Homo sapiens
acggagucuugcucug

SEQ ID NO: 1425685 - RNA, 21 nt, Homo sapiens
acggcagagaccccaggaucc

SEQ ID NO: 1425686 - RNA, 15 nt, Homo sapiens
acggcagcuguagcu

SEQ ID NO: 1425687 - RNA, 15 nt, Homo sapiens
acgguaggccaagcu

SEQ ID NO: 1425688 - RNA, 14 nt, Homo sapiens
acgguggucuuuga

SEQ ID NO: 1425689 - RNA, 12 nt, Homo sapiens
acguaacuauuu

SEQ ID NO: 1425690 - RNA, 14 nt, Homo sapiens
acgucaagucuccu

SEQ ID NO: 1425691 - RNA, 13 nt, Homo sapiens
acgucuugcuauu

SEQ ID NO: 1425692 - RNA, 19 nt, Homo sapiens
acgugaagccacaggagcc

SEQ ID NO: 1425693 - RNA, 16 nt, Homo sapiens
acgugccagcucuagu

SEQ ID NO: 1425694 - RNA, 19 nt, Homo sapiens
acguuacugcauacugauc

SEQ ID NO: 1425695 - RNA, 14 nt, Homo sapiens
acuaaaaauauuau

SEQ ID NO: 1425696 - RNA, 17 nt, Homo sapiens
acuaaacagacuauuua

SEQ ID NO: 1425697 - RNA, 17 nt, Homo sapiens
acuaaaguauaucuuua

SEQ ID NO: 1425698 - RNA, 15 nt, Homo sapiens
acuaaagugucuauu

SEQ ID NO: 1425699 - RNA, 11 nt, Homo sapiens
acuaaccauag

SEQ ID NO: 1425700 - RNA, 20 nt, Homo sapiens
acuaaccccaacgcacagga

SEQ ID NO: 1425701 - RNA, 15 nt, Homo sapiens
acuaauagagacaca

SEQ ID NO: 1425702 - RNA, 16 nt, Homo sapiens
acuacaaagcuucuau

SEQ ID NO: 1425703 - RNA, 13 nt, Homo sapiens
acuacacauccaa

SEQ ID NO: 1425704 - RNA, 17 nt, Homo sapiens
acuacaggcucaugcca

SEQ ID NO: 1425705 - RNA, 11 nt, Homo sapiens
acuacaguguu

SEQ ID NO: 1425706 - RNA, 21 nt, Homo sapiens
acuacaguguuuuccuuugca

SEQ ID NO: 1425707 - RNA, 16 nt, Homo sapiens
acuacuaaagugccua

SEQ ID NO: 1425708 - RNA, 19 nt, Homo sapiens
acuacuugccacacacugu

SEQ ID NO: 1425709 - RNA, 21 nt, Homo sapiens
acuacuuuuacuacagugaca

SEQ ID NO: 1425710 - RNA, 15 nt, Homo sapiens
acuagagcucaggcc

SEQ ID NO: 1425711 - RNA, 16 nt, Homo sapiens
acuagcaggcaugccg

SEQ ID NO: 1425712 - RNA, 14 nt, Homo sapiens
acuagccugugauu

SEQ ID NO: 1425713 - RNA, 15 nt, Homo sapiens
acuauaaacauuaaa

SEQ ID NO: 1425714 - RNA, 16 nt, Homo sapiens
acuauaaacuacugua

SEQ ID NO: 1425715 - RNA, 17 nt, Homo sapiens
acuauaaugugaugauu

SEQ ID NO: 1425716 - RNA, 15 nt, Homo sapiens
acuaucacauacaau

SEQ ID NO: 1425717 - RNA, 18 nt, Homo sapiens
acuaucacauacaauuug

SEQ ID NO: 1425718 - RNA, 18 nt, Homo sapiens
acuauccaacuuaacaug

SEQ ID NO: 1425719 - RNA, 15 nt, Homo sapiens
acuauguugcccagg

SEQ ID NO: 1425720 - RNA, 18 nt, Homo sapiens
acuauguugcccaggcug

SEQ ID NO: 1425721 - RNA, 15 nt, Homo sapiens
acuauuaccaugaga

SEQ ID NO: 1425722 - RNA, 16 nt, Homo sapiens
acuauucuauggccau

SEQ ID NO: 1425723 - RNA, 12 nt, Homo sapiens
acucaacaauaa

SEQ ID NO: 1425724 - RNA, 15 nt, Homo sapiens
acucaccucucucua

SEQ ID NO: 1425725 - RNA, 17 nt, Homo sapiens
acucaccucugccucaa

SEQ ID NO: 1425726 - RNA, 15 nt, Homo sapiens
acucagacauuccaa

SEQ ID NO: 1425727 - RNA, 12 nt, Homo sapiens
acucagacuguu

SEQ ID NO: 1425728 - RNA, 18 nt, Homo sapiens
acucagacuguugcacuc

SEQ ID NO: 1425729 - RNA, 20 nt, Homo sapiens
acucagccgcagacaaguaa

SEQ ID NO: 1425730 - RNA, 18 nt, Homo sapiens
acucaguauagcauugaa

SEQ ID NO: 1425731 - RNA, 17 nt, Homo sapiens
acucagucuagugaaga

SEQ ID NO: 1425732 - RNA, 18 nt, Homo sapiens
acucaucccuguuccuca

SEQ ID NO: 1425733 - RNA, 15 nt, Homo sapiens
acucauugucucagu

SEQ ID NO: 1425734 - RNA, 18 nt, Homo sapiens
acuccacccccuccagcu

SEQ ID NO: 1425735 - RNA, 18 nt, Homo sapiens
acuccagaaguggggcuc

SEQ ID NO: 1425736 - RNA, 21 nt, Homo sapiens
acuccagauuuuuuacagcug

SEQ ID NO: 1425737 - RNA, 18 nt, Homo sapiens
acuccagccugggcaaca

SEQ ID NO: 1425738 - RNA, 22 nt, Homo sapiens
acucccuucccccauccuccag

SEQ ID NO: 1425739 - RNA, 20 nt, Homo sapiens
acuccgggaccauugaccuc

SEQ ID NO: 1425740 - RNA, 22 nt, Homo sapiens
acuccucaaaagcaaaugagau

SEQ ID NO: 1425741 - RNA, 13 nt, Homo sapiens
acuccucugacug

SEQ ID NO: 1425742 - RNA, 21 nt, Homo sapiens
acuccuugugguuuaugucau

SEQ ID NO: 1425743 - RNA, 19 nt, Homo sapiens
acuccuuugcauuccauga

SEQ ID NO: 1425744 - RNA, 19 nt, Homo sapiens
acucgagaccauccuggcc

SEQ ID NO: 1425745 - RNA, 17 nt, Homo sapiens
acucguucuucugggaa

SEQ ID NO: 1425746 - RNA, 14 nt, Homo sapiens
acucuaccugcaag

SEQ ID NO: 1425747 - RNA, 14 nt, Homo sapiens
acugaacauuugcu

SEQ ID NO: 1425748 - RNA, 14 nt, Homo sapiens
acugaacgagggau

SEQ ID NO: 1425749 - RNA, 23 nt, Homo sapiens
acugaagagaccacagcaauugg

SEQ ID NO: 1425750 - RNA, 14 nt, Homo sapiens
acugaaggggcaca

SEQ ID NO: 1425751 - RNA, 11 nt, Homo sapiens
acugaccagcc

SEQ ID NO: 1425752 - RNA, 15 nt, Homo sapiens
acugaccagccucca

SEQ ID NO: 1425753 - RNA, 19 nt, Homo sapiens
acugaccagccuccaugcu

SEQ ID NO: 1425754 - RNA, 22 nt, Homo sapiens
acugaccccaucaccuacucac

SEQ ID NO: 1425755 - RNA, 14 nt, Homo sapiens
acugaggaccagcc

SEQ ID NO: 1425756 - RNA, 12 nt, Homo sapiens
acugagggccac

SEQ ID NO: 1425757 - RNA, 17 nt, Homo sapiens
acugaguggcuugugau

SEQ ID NO: 1425758 - RNA, 19 nt, Homo sapiens
acugauccuguuucuugcu

SEQ ID NO: 1425759 - RNA, 17 nt, Homo sapiens
acugaugccauguuuag

SEQ ID NO: 1425760 - RNA, 22 nt, Homo sapiens
acugauuaccuccuguguggaa

SEQ ID NO: 1425761 - RNA, 22 nt, Homo sapiens
acugauuuaugaucacuuggaa

SEQ ID NO: 1425762 - RNA, 18 nt, Homo sapiens
acugcaagaaguacauga

SEQ ID NO: 1425763 - RNA, 20 nt, Homo sapiens
acugcaagcagggcucugcc

SEQ ID NO: 1425764 - RNA, 18 nt, Homo sapiens
acugcacagugcaucuca

SEQ ID NO: 1425765 - RNA, 19 nt, Homo sapiens
acugcacagugcaucucag

SEQ ID NO: 1425766 - RNA, 20 nt, Homo sapiens
acugcacuccagccugggug

SEQ ID NO: 1425767 - RNA, 13 nt, Homo sapiens
acugcagcugcug

SEQ ID NO: 1425768 - RNA, 20 nt, Homo sapiens
acugcagggacugccagucc

SEQ ID NO: 1425769 - RNA, 17 nt, Homo sapiens
acugccagcagcuguuu

SEQ ID NO: 1425770 - RNA, 20 nt, Homo sapiens
acugccaugccucaagaaca

SEQ ID NO: 1425771 - RNA, 20 nt, Homo sapiens
acugccucuuccucccucau

SEQ ID NO: 1425772 - RNA, 18 nt, Homo sapiens
acugcgaucuucagagca

SEQ ID NO: 1425773 - RNA, 21 nt, Homo sapiens
acugcgugccaguguccccac

SEQ ID NO: 1425774 - RNA, 13 nt, Homo sapiens
acugcuccagugg

SEQ ID NO: 1425775 - RNA, 13 nt, Homo sapiens
acugcucugccca

SEQ ID NO: 1425776 - RNA, 19 nt, Homo sapiens
acugcugcccagccuccaa

SEQ ID NO: 1425777 - RNA, 22 nt, Homo sapiens
acugcugcccagccuccaagcu

SEQ ID NO: 1425778 - RNA, 16 nt, Homo sapiens
acugcuuuguauccau

SEQ ID NO: 1425779 - RNA, 18 nt, Homo sapiens
acuggacugugugcaacg

SEQ ID NO: 1425780 - RNA, 19 nt, Homo sapiens
acuggacuugucuuccuug

SEQ ID NO: 1425781 - RNA, 16 nt, Homo sapiens
acuggauauguuguua

SEQ ID NO: 1425782 - RNA, 15 nt, Homo sapiens
acuggcagcuccucu

SEQ ID NO: 1425783 - RNA, 14 nt, Homo sapiens
acugggaccaggca

SEQ ID NO: 1425784 - RNA, 19 nt, Homo sapiens
acugggcaaugauggcaau

SEQ ID NO: 1425785 - RNA, 15 nt, Homo sapiens
acugggucucacucc

SEQ ID NO: 1425786 - RNA, 21 nt, Homo sapiens
acuggucuuguggaauuggga

SEQ ID NO: 1425787 - RNA, 17 nt, Homo sapiens
acuguaaauauccacag

SEQ ID NO: 1425788 - RNA, 13 nt, Homo sapiens
acuguacuccucc

SEQ ID NO: 1425789 - RNA, 21 nt, Homo sapiens
acuguacugagacauuacagu

SEQ ID NO: 1425790 - RNA, 16 nt, Homo sapiens
acuguaggcagggaac

SEQ ID NO: 1425791 - RNA, 12 nt, Homo sapiens
acugucacuguu

SEQ ID NO: 1425792 - RNA, 21 nt, Homo sapiens
acugucccucaaaugacccaa

SEQ ID NO: 1425793 - RNA, 18 nt, Homo sapiens
acugucuauguugugauc

SEQ ID NO: 1425794 - RNA, 12 nt, Homo sapiens
acugucucaaga

SEQ ID NO: 1425795 - RNA, 15 nt, Homo sapiens
acuguguagacuccu

SEQ ID NO: 1425796 - RNA, 15 nt, Homo sapiens
acuguguguacauau

SEQ ID NO: 1425797 - RNA, 13 nt, Homo sapiens
acuguuccaaaaa

SEQ ID NO: 1425798 - RNA, 12 nt, Homo sapiens
acuguugcacug

SEQ ID NO: 1425799 - RNA, 17 nt, Homo sapiens
acuguuguacaagcuca

SEQ ID NO: 1425800 - RNA, 15 nt, Homo sapiens
acuguuuccugagua

SEQ ID NO: 1425801 - RNA, 20 nt, Homo sapiens
acuguuuucucucucuaugg

SEQ ID NO: 1425802 - RNA, 16 nt, Homo sapiens
acuuaaaaauauccau

SEQ ID NO: 1425803 - RNA, 13 nt, Homo sapiens
acuuaaacccagc

SEQ ID NO: 1425804 - RNA, 23 nt, Homo sapiens
acuuaagguuaccuuuguuccca

SEQ ID NO: 1425805 - RNA, 23 nt, Homo sapiens
acuuaccugcauguguuguacaa

SEQ ID NO: 1425806 - RNA, 21 nt, Homo sapiens
acuuauuaugaggcuauuaaa

SEQ ID NO: 1425807 - RNA, 13 nt, Homo sapiens
acuucaagugacc

SEQ ID NO: 1425808 - RNA, 16 nt, Homo sapiens
acuucacaauguauau

SEQ ID NO: 1425809 - RNA, 17 nt, Homo sapiens
acuucacuaaugacgau

SEQ ID NO: 1425810 - RNA, 16 nt, Homo sapiens
acuucauaaauguuca

SEQ ID NO: 1425811 - RNA, 13 nt, Homo sapiens
acuuccacauuau

SEQ ID NO: 1425812 - RNA, 21 nt, Homo sapiens
acuuccaguguuggcugugug

SEQ ID NO: 1425813 - RNA, 16 nt, Homo sapiens
acuuccauuaacuuag

SEQ ID NO: 1425814 - RNA, 18 nt, Homo sapiens
acuucgacucaggaucca

SEQ ID NO: 1425815 - RNA, 21 nt, Homo sapiens
acuucuaaaugaagugcaaau

SEQ ID NO: 1425816 - RNA, 20 nt, Homo sapiens
acuucuaaguaaaaccacag

SEQ ID NO: 1425817 - RNA, 13 nt, Homo sapiens
acuucucuagaga

SEQ ID NO: 1425818 - RNA, 14 nt, Homo sapiens
acuucugcagcuau

SEQ ID NO: 1425819 - RNA, 19 nt, Homo sapiens
agacaccugccuuaacaca

SEQ ID NO: 1425820 - RNA, 15 nt, Homo sapiens
agacacuauuuaucu

SEQ ID NO: 1425821 - RNA, 16 nt, Homo sapiens
agacacugagaucugu

SEQ ID NO: 1425822 - RNA, 15 nt, Homo sapiens
agacagagacagaga

SEQ ID NO: 1425823 - RNA, 16 nt, Homo sapiens
agacagagacagagag

SEQ ID NO: 1425824 - RNA, 15 nt, Homo sapiens
agacagagcccugug

SEQ ID NO: 1425825 - RNA, 23 nt, Homo sapiens
agacagguaaaugggcagugccu

SEQ ID NO: 1425826 - RNA, 21 nt, Homo sapiens
agacaguacucuuaacuccua

SEQ ID NO: 1425827 - RNA, 23 nt, Homo sapiens
agacaguacucuuaacuccuagc

SEQ ID NO: 1425828 - RNA, 13 nt, Homo sapiens
agacagucucaag

SEQ ID NO: 1425829 - RNA, 13 nt, Homo sapiens
agacagugcugcc

SEQ ID NO: 1425830 - RNA, 18 nt, Homo sapiens
agacaguggaucaugaaa

SEQ ID NO: 1425831 - RNA, 14 nt, Homo sapiens
agacauccauguuu

SEQ ID NO: 1425832 - RNA, 14 nt, Homo sapiens
agacaugaaugcac

SEQ ID NO: 1425833 - RNA, 23 nt, Homo sapiens
agacaugucuagccacugaucau

SEQ ID NO: 1425834 - RNA, 12 nt, Homo sapiens
agaccaaaauaa

SEQ ID NO: 1425835 - RNA, 19 nt, Homo sapiens
agaccaaaggauccagaga

SEQ ID NO: 1425836 - RNA, 21 nt, Homo sapiens
agaccacaaaaauugacucaa

SEQ ID NO: 1425837 - RNA, 13 nt, Homo sapiens
agaccacauccac

SEQ ID NO: 1425838 - RNA, 18 nt, Homo sapiens
agaccaccucucaauauu

SEQ ID NO: 1425839 - RNA, 23 nt, Homo sapiens
agaccagacuguggagaaauaaa

SEQ ID NO: 1425840 - RNA, 24 nt, Homo sapiens
agaccagccugaccaacaugguga

SEQ ID NO: 1425841 - RNA, 23 nt, Homo sapiens
agaccaggccugagcaacaaagc

SEQ ID NO: 1425842 - RNA, 17 nt, Homo sapiens
agaccaguacugggaag

SEQ ID NO: 1425843 - RNA, 21 nt, Homo sapiens
agaccagugaaagaguagugc

SEQ ID NO: 1425844 - RNA, 22 nt, Homo sapiens
agaccauugucuuccaacccca

SEQ ID NO: 1425845 - RNA, 17 nt, Homo sapiens
agacccaccacaccgca

SEQ ID NO: 1425846 - RNA, 14 nt, Homo sapiens
agacccaguguaaa

SEQ ID NO: 1425847 - RNA, 13 nt, Homo sapiens
agaccccaucucu

SEQ ID NO: 1425848 - RNA, 18 nt, Homo sapiens
agaccccccaucagugga

SEQ ID NO: 1425849 - RNA, 16 nt, Homo sapiens
agaccucuacugccuu

SEQ ID NO: 1425850 - RNA, 23 nt, Homo sapiens
agaccuguugguuagcuggacau

SEQ ID NO: 1425851 - RNA, 19 nt, Homo sapiens
agacgucucaagacugaaa

SEQ ID NO: 1425852 - RNA, 24 nt, Homo sapiens
agacuaagcccugucgagacacuu

SEQ ID NO: 1425853 - RNA, 22 nt, Homo sapiens
agacuauaagcagaagcacaua

SEQ ID NO: 1425854 - RNA, 13 nt, Homo sapiens
agacucaaacuca

SEQ ID NO: 1425855 - RNA, 20 nt, Homo sapiens
agacucaugaaagaccugaa

SEQ ID NO: 1425856 - RNA, 13 nt, Homo sapiens
agacuccaaagaa

SEQ ID NO: 1425857 - RNA, 15 nt, Homo sapiens
agacuccugugcaac

SEQ ID NO: 1425858 - RNA, 14 nt, Homo sapiens
agacucucuuaggg

SEQ ID NO: 1425859 - RNA, 23 nt, Homo sapiens
agacugcagccccagcugacacc

SEQ ID NO: 1425860 - RNA, 18 nt, Homo sapiens
agacuggauucgugacaa

SEQ ID NO: 1425861 - RNA, 17 nt, Homo sapiens
agacugguuagacagua

SEQ ID NO: 1425862 - RNA, 19 nt, Homo sapiens
agacugucucaagagggca

SEQ ID NO: 1425863 - RNA, 22 nt, Homo sapiens
agacugugcugggaacauguac

SEQ ID NO: 1425864 - RNA, 18 nt, Homo sapiens
agacuuaggaaccuacca

SEQ ID NO: 1425865 - RNA, 19 nt, Homo sapiens
agacuuggggaaauugcuu

SEQ ID NO: 1425866 - RNA, 21 nt, Homo sapiens
agacuuguguccccaccucag

SEQ ID NO: 1425867 - RNA, 21 nt, Homo sapiens
agagaaaaaaaauuaagacaa

SEQ ID NO: 1425868 - RNA, 21 nt, Homo sapiens
agagaaaaacuuucauuuuug

SEQ ID NO: 1425869 - RNA, 13 nt, Homo sapiens
agagaaaacuuau

SEQ ID NO: 1425870 - RNA, 18 nt, Homo sapiens
agagaacaggggcuucuu

SEQ ID NO: 1425871 - RNA, 18 nt, Homo sapiens
agagaagaccucugugag

SEQ ID NO: 1425872 - RNA, 9 nt, Homo sapiens
agagaagau

SEQ ID NO: 1425873 - RNA, 12 nt, Homo sapiens
agagacacugcu

SEQ ID NO: 1425874 - RNA, 19 nt, Homo sapiens
agagacagauaacucuccu

SEQ ID NO: 1425875 - RNA, 12 nt, Homo sapiens
agagacaggguc

SEQ ID NO: 1425876 - RNA, 16 nt, Homo sapiens
agagacauugccucca

SEQ ID NO: 1425877 - RNA, 21 nt, Homo sapiens
agagacuuggggaaauugcuu

SEQ ID NO: 1425878 - RNA, 22 nt, Homo sapiens
agagagauggaauaaagcccuu

SEQ ID NO: 1425879 - RNA, 12 nt, Homo sapiens
agagaggcaugu

SEQ ID NO: 1425880 - RNA, 15 nt, Homo sapiens
agagaggcaugugau

SEQ ID NO: 1425881 - RNA, 19 nt, Homo sapiens
agagagggccugcuggaga

SEQ ID NO: 1425882 - RNA, 12 nt, Homo sapiens
agagaguaccau

SEQ ID NO: 1425883 - RNA, 16 nt, Homo sapiens
agagaguccucuggau

SEQ ID NO: 1425884 - RNA, 21 nt, Homo sapiens
agagagucuuccagguacuga

SEQ ID NO: 1425885 - RNA, 17 nt, Homo sapiens
agagaguuaagugaaug

SEQ ID NO: 1425886 - RNA, 13 nt, Homo sapiens
agagauacuugua

SEQ ID NO: 1425887 - RNA, 20 nt, Homo sapiens
agagaucaggaagagaagga

SEQ ID NO: 1425888 - RNA, 11 nt, Homo sapiens
aggugggagag

SEQ ID NO: 1425889 - RNA, 22 nt, Homo sapiens
aggugggggcuauuucuaugca

SEQ ID NO: 1425890 - RNA, 23 nt, Homo sapiens
agguggguccaggaaggcagcug

SEQ ID NO: 1425891 - RNA, 20 nt, Homo sapiens
agguggguuuguaccuuccu

SEQ ID NO: 1425892 - RNA, 17 nt, Homo sapiens
aggugucuuaagccuuu

SEQ ID NO: 1425893 - RNA, 20 nt, Homo sapiens
agguguggccugcacugggu

SEQ ID NO: 1425894 - RNA, 21 nt, Homo sapiens
agguuacccuguaacaugcaa

SEQ ID NO: 1425895 - RNA, 13 nt, Homo sapiens
agguuagaaccua

SEQ ID NO: 1425896 - RNA, 23 nt, Homo sapiens
agguuaucugccuggccuggcuc

SEQ ID NO: 1425897 - RNA, 15 nt, Homo sapiens
agguucacaccauuu

SEQ ID NO: 1425898 - RNA, 16 nt, Homo sapiens
agguugaagaaugaga

SEQ ID NO: 1425899 - RNA, 20 nt, Homo sapiens
agguugcagugagccaugau

SEQ ID NO: 1425900 - RNA, 23 nt, Homo sapiens
agguugccccuuccccaucucca

SEQ ID NO: 1425901 - RNA, 21 nt, Homo sapiens
agguugucugaagucacugca

SEQ ID NO: 1425902 - RNA, 13 nt, Homo sapiens
agguuucaagacu

SEQ ID NO: 1425903 - RNA, 23 nt, Homo sapiens
agguuuggcccccucacuaucuc

SEQ ID NO: 1425904 - RNA, 21 nt, Homo sapiens
aguaaaaaauuaaagcccaua

SEQ ID NO: 1425905 - RNA, 17 nt, Homo sapiens
aguaaauagcauucucu

SEQ ID NO: 1425906 - RNA, 15 nt, Homo sapiens
aguaaguacaaauau

SEQ ID NO: 1425907 - RNA, 19 nt, Homo sapiens
aguaaucccccuugccaaa

SEQ ID NO: 1425908 - RNA, 15 nt, Homo sapiens
aguaaugcacucuca

SEQ ID NO: 1425909 - RNA, 13 nt, Homo sapiens
aguaauuguaagu

SEQ ID NO: 1425910 - RNA, 13 nt, Homo sapiens
aguaauugucaau

SEQ ID NO: 1425911 - RNA, 15 nt, Homo sapiens
aguacagacgucuca

SEQ ID NO: 1425912 - RNA, 19 nt, Homo sapiens
aguacagauguaaaugcca

SEQ ID NO: 1425913 - RNA, 16 nt, Homo sapiens
aguacaguagcuuaaa

SEQ ID NO: 1425914 - RNA, 19 nt, Homo sapiens
aguacucucugcucuagcc

SEQ ID NO: 1425915 - RNA, 15 nt, Homo sapiens
aguacucuuaacucc

SEQ ID NO: 1425916 - RNA, 22 nt, Homo sapiens
aguacucuuaacuccuagccca

SEQ ID NO: 1425917 - RNA, 15 nt, Homo sapiens
aguacuuuaccuccu

SEQ ID NO: 1425918 - RNA, 17 nt, Homo sapiens
aguagaugauuuccuua

SEQ ID NO: 1425919 - RNA, 13 nt, Homo sapiens
aguagcugagcuc

SEQ ID NO: 1425920 - RNA, 17 nt, Homo sapiens
aguagcugugaacauug

SEQ ID NO: 1425921 - RNA, 14 nt, Homo sapiens
aguagugcauuuaa

SEQ ID NO: 1425922 - RNA, 17 nt, Homo sapiens
aguauaaagucacuucc

SEQ ID NO: 1425923 - RNA, 19 nt, Homo sapiens
aguauaaagucacuuccag

SEQ ID NO: 1425924 - RNA, 15 nt, Homo sapiens
aguauaauuaauaga

SEQ ID NO: 1425925 - RNA, 21 nt, Homo sapiens
aguauauuuauagucacaaga

SEQ ID NO: 1425926 - RNA, 13 nt, Homo sapiens
aguauccacuuug

SEQ ID NO: 1425927 - RNA, 21 nt, Homo sapiens
aguaucuaaagccaguggcag

SEQ ID NO: 1425928 - RNA, 16 nt, Homo sapiens
aguauggaaucagcug

SEQ ID NO: 1425929 - RNA, 18 nt, Homo sapiens
aguauuauugagcucuau

SEQ ID NO: 1425930 - RNA, 16 nt, Homo sapiens
aguauuguccauauca

SEQ ID NO: 1425931 - RNA, 11 nt, Homo sapiens
aguauuuccau

SEQ ID NO: 1425932 - RNA, 17 nt, Homo sapiens
aguauuuggggucauau

SEQ ID NO: 1425933 - RNA, 17 nt, Homo sapiens
agucaaaaggugccugu

SEQ ID NO: 1425934 - RNA, 16 nt, Homo sapiens
agucaacaaccaugcc

SEQ ID NO: 1425935 - RNA, 17 nt, Homo sapiens
agucaaccaauguagaa

SEQ ID NO: 1425936 - RNA, 18 nt, Homo sapiens
agucaauuuuacaauuau

SEQ ID NO: 1425937 - RNA, 13 nt, Homo sapiens
agucacaccaucu

SEQ ID NO: 1425938 - RNA, 21 nt, Homo sapiens
agucagaggagaagagacaug

SEQ ID NO: 1425939 - RNA, 16 nt, Homo sapiens
agucagcuuucagagc

SEQ ID NO: 1425940 - RNA, 20 nt, Homo sapiens
agucaggacuugaacccagg

SEQ ID NO: 1425941 - RNA, 21 nt, Homo sapiens
agucauuggguuuuaucagug

SEQ ID NO: 1425942 - RNA, 22 nt, Homo sapiens
agucauugucgcucagcaauag

SEQ ID NO: 1425943 - RNA, 12 nt, Homo sapiens
aguccauuuuaa

SEQ ID NO: 1425944 - RNA, 19 nt, Homo sapiens
agucccgucccugcccaga

SEQ ID NO: 1425945 - RNA, 18 nt, Homo sapiens
aguccgcaaguucaggga

SEQ ID NO: 1425946 - RNA, 19 nt, Homo sapiens
aguccgccaaacacuccac

SEQ ID NO: 1425947 - RNA, 21 nt, Homo sapiens
aguccuaucgacuuuauacag

SEQ ID NO: 1425948 - RNA, 14 nt, Homo sapiens
aguccuauuugcac

SEQ ID NO: 1425949 - RNA, 20 nt, Homo sapiens
augggaaccuaguacucucu

SEQ ID NO: 1425950 - RNA, 13 nt, Homo sapiens
augggacauucca

SEQ ID NO: 1425951 - RNA, 14 nt, Homo sapiens
augggaccagggau

SEQ ID NO: 1425952 - RNA, 17 nt, Homo sapiens
augggagggggcuccau

SEQ ID NO: 1425953 - RNA, 16 nt, Homo sapiens
augguaauuguugcua

SEQ ID NO: 1425954 - RNA, 15 nt, Homo sapiens
augguacuacaacca

SEQ ID NO: 1425955 - RNA, 18 nt, Homo sapiens
auggucaaucccaaaagu

SEQ ID NO: 1425956 - RNA, 16 nt, Homo sapiens
auggucauugcaggaa

SEQ ID NO: 1425957 - RNA, 14 nt, Homo sapiens
augguccugugaug

SEQ ID NO: 1425958 - RNA, 17 nt, Homo sapiens
augguguaaugcacaau

SEQ ID NO: 1425959 - RNA, 17 nt, Homo sapiens
auguaaacagugccugc

SEQ ID NO: 1425960 - RNA, 20 nt, Homo sapiens
auguaaacauaauucuugua

SEQ ID NO: 1425961 - RNA, 16 nt, Homo sapiens
auguaaucucaccuca

SEQ ID NO: 1425962 - RNA, 22 nt, Homo sapiens
auguaauuuagcaguccaaaga

SEQ ID NO: 1425963 - RNA, 20 nt, Homo sapiens
auguacacacacagaugcac

SEQ ID NO: 1425964 - RNA, 16 nt, Homo sapiens
auguacucuacgccaa

SEQ ID NO: 1425965 - RNA, 23 nt, Homo sapiens
auguagaaauauuauaaauccaa

SEQ ID NO: 1425966 - RNA, 21 nt, Homo sapiens
auguaguaguuugggugugua

SEQ ID NO: 1425967 - RNA, 22 nt, Homo sapiens
auguauauauauauaguaacua

SEQ ID NO: 1425968 - RNA, 15 nt, Homo sapiens
auguaucuaccucac

SEQ ID NO: 1425969 - RNA, 20 nt, Homo sapiens
auguauggagcucuaaccca

SEQ ID NO: 1425970 - RNA, 21 nt, Homo sapiens
auguaugugcacaugugucug

SEQ ID NO: 1425971 - RNA, 17 nt, Homo sapiens
auguauuaucacaucaa

SEQ ID NO: 1425972 - RNA, 15 nt, Homo sapiens
auguauuugucaaug

SEQ ID NO: 1425973 - RNA, 22 nt, Homo sapiens
auguauuuuguauuugcauaug

SEQ ID NO: 1425974 - RNA, 16 nt, Homo sapiens
auguauuuugucauau

SEQ ID NO: 1425975 - RNA, 14 nt, Homo sapiens
augucaauugucag

SEQ ID NO: 1425976 - RNA, 13 nt, Homo sapiens
augucaccaccuu

SEQ ID NO: 1425977 - RNA, 19 nt, Homo sapiens
augucagagcuauguuccc

SEQ ID NO: 1425978 - RNA, 16 nt, Homo sapiens
augucauguacuuccu

SEQ ID NO: 1425979 - RNA, 11 nt, Homo sapiens
augucauuuga

SEQ ID NO: 1425980 - RNA, 22 nt, Homo sapiens
auguccaauggaguucagagau

SEQ ID NO: 1425981 - RNA, 20 nt, Homo sapiens
auguccggagagacagugac

SEQ ID NO: 1425982 - RNA, 22 nt, Homo sapiens
auguccuucuuuaucugugaua

SEQ ID NO: 1425983 - RNA, 15 nt, Homo sapiens
augucgaacucugaa

SEQ ID NO: 1425984 - RNA, 18 nt, Homo sapiens
augucuagccacugauca

SEQ ID NO: 1425985 - RNA, 16 nt, Homo sapiens
augugacacauucucu

SEQ ID NO: 1425986 - RNA, 15 nt, Homo sapiens
augugauccuuuuau

SEQ ID NO: 1425987 - RNA, 23 nt, Homo sapiens
augugcgcacacacagauaugca

SEQ ID NO: 1425988 - RNA, 15 nt, Homo sapiens
augugcgucucucuu

SEQ ID NO: 1425989 - RNA, 23 nt, Homo sapiens
augugcuuuuaaaaaaaaauacu

SEQ ID NO: 1425990 - RNA, 22 nt, Homo sapiens
augugggguccccaucauccca

SEQ ID NO: 1425991 - RNA, 20 nt, Homo sapiens
auguguagggaaaguuaaaa

SEQ ID NO: 1425992 - RNA, 22 nt, Homo sapiens
auguguauugaagaaaagcacu

SEQ ID NO: 1425993 - RNA, 16 nt, Homo sapiens
auguguggauguguaa

SEQ ID NO: 1425994 - RNA, 14 nt, Homo sapiens
auguguggugcuaa

SEQ ID NO: 1425995 - RNA, 16 nt, Homo sapiens
auguguguguauauau

SEQ ID NO: 1425996 - RNA, 20 nt, Homo sapiens
auguguguuguccuucagca

SEQ ID NO: 1425997 - RNA, 15 nt, Homo sapiens
auguguugcuauccu

SEQ ID NO: 1425998 - RNA, 23 nt, Homo sapiens
auguuaagcaaaggaaaccaaag

SEQ ID NO: 1425999 - RNA, 21 nt, Homo sapiens
auguuagaauuuggagggaau

SEQ ID NO: 1426000 - RNA, 14 nt, Homo sapiens
auguuccucaaaag

SEQ ID NO: 1426001 - RNA, 13 nt, Homo sapiens
auguuggucaaaa

SEQ ID NO: 1426002 - RNA, 14 nt, Homo sapiens
auguuugcacuuug

SEQ ID NO: 1426003 - RNA, 22 nt, Homo sapiens
auguuuguaaauuaauacuuca

SEQ ID NO: 1426004 - RNA, 13 nt, Homo sapiens
auguuugucagau

SEQ ID NO: 1426005 - RNA, 22 nt, Homo sapiens
auuaaaaaagcucaaugcauug

SEQ ID NO: 1426006 - RNA, 14 nt, Homo sapiens
auuaaaacuaugaa

SEQ ID NO: 1426007 - RNA, 23 nt, Homo sapiens
auuaaaacucauuuuuguuuuca

SEQ ID NO: 1426008 - RNA, 15 nt, Homo sapiens
auuaaaacugcacug

SEQ ID NO: 1426009 - RNA, 13 nt, Homo sapiens
auuaaacaccuga

SEQ ID NO: 1426010 - RNA, 19 nt, Homo sapiens
auuaaacaccugacacauc

SEQ ID NO: 1426011 - RNA, 14 nt, Homo sapiens
auuaaacacuguaa

SEQ ID NO: 1426012 - RNA, 19 nt, Homo sapiens
auuaaacuugucagaauuu

SEQ ID NO: 1426013 - RNA, 17 nt, Homo sapiens
auuaaauacagacacua

SEQ ID NO: 1426014 - RNA, 15 nt, Homo sapiens
auuaacaaaauauuc

SEQ ID NO: 1426015 - RNA, 19 nt, Homo sapiens
auuaacagaagccaaaaua

SEQ ID NO: 1426016 - RNA, 19 nt, Homo sapiens
auuaaccacuucugcgaua

SEQ ID NO: 1426017 - RNA, 23 nt, Homo sapiens
auuaacuuauugucuaggccaga

SEQ ID NO: 1426018 - RNA, 13 nt, Homo sapiens
auuaagacuuuaa

SEQ ID NO: 1426019 - RNA, 17 nt, Homo sapiens
auuaaguaaaccaaaaa

SEQ ID NO: 1426020 - RNA, 13 nt, Homo sapiens
auuaagugccuga

SEQ ID NO: 1426021 - RNA, 16 nt, Homo sapiens
auuacauggcuguggu

SEQ ID NO: 1426022 - RNA, 21 nt, Homo sapiens
auuaccucaaauuccuaauaa

SEQ ID NO: 1426023 - RNA, 14 nt, Homo sapiens
auuacugauuuugu

SEQ ID NO: 1426024 - RNA, 17 nt, Homo sapiens
auuacuuuaauacucac

SEQ ID NO: 1426025 - RNA, 15 nt, Homo sapiens
auuagaaugcaugua

SEQ ID NO: 1426026 - RNA, 20 nt, Homo sapiens
auuaggaucuaugcaauuuu

SEQ ID NO: 1426027 - RNA, 16 nt, Homo sapiens
auuaggcaugccuaau

SEQ ID NO: 1426028 - RNA, 13 nt, Homo sapiens
auuauacauuuga

SEQ ID NO: 1426029 - RNA, 20 nt, Homo sapiens
auuauagaguauacuaaaaa

SEQ ID NO: 1426030 - RNA, 20 nt, Homo sapiens
auuauaucugaggcacugau

SEQ ID NO: 1426031 - RNA, 16 nt, Homo sapiens
uagacaaaguucaagu

SEQ ID NO: 1426032 - RNA, 18 nt, Homo sapiens
uagacacaucaaaugccc

SEQ ID NO: 1426033 - RNA, 15 nt, Homo sapiens
uagacuuacuuuccu

SEQ ID NO: 1426034 - RNA, 13 nt, Homo sapiens
uagagauaugcac

SEQ ID NO: 1426035 - RNA, 14 nt, Homo sapiens
uagagauaugcaca

SEQ ID NO: 1426036 - RNA, 17 nt, Homo sapiens
uagagauaugcacacac

SEQ ID NO: 1426037 - RNA, 11 nt, Homo sapiens
uagagccugug

SEQ ID NO: 1426038 - RNA, 17 nt, Homo sapiens
uagagcugagagucuga

SEQ ID NO: 1426039 - RNA, 13 nt, Homo sapiens
uagagcugggaaa

SEQ ID NO: 1426040 - RNA, 19 nt, Homo sapiens
uagagcugggaaacaggga

SEQ ID NO: 1426041 - RNA, 22 nt, Homo sapiens
uagaggcaugaacacacaugga

SEQ ID NO: 1426042 - RNA, 23 nt, Homo sapiens
uagaggugggcagcugggcccca

SEQ ID NO: 1426043 - RNA, 15 nt, Homo sapiens
uagauccauuuggac

SEQ ID NO: 1426044 - RNA, 14 nt, Homo sapiens
uagaucuaguucuc

SEQ ID NO: 1426045 - RNA, 17 nt, Homo sapiens
uagaugcugacuguacu

SEQ ID NO: 1426046 - RNA, 19 nt, Homo sapiens
uagauguauaaaucuuucu

SEQ ID NO: 1426047 - RNA, 17 nt, Homo sapiens
uagaugugacacauucu

SEQ ID NO: 1426048 - RNA, 17 nt, Homo sapiens
uagauuaguauuuucca

SEQ ID NO: 1426049 - RNA, 22 nt, Homo sapiens
uagauugagaaguuuuguacag

SEQ ID NO: 1426050 - RNA, 19 nt, Homo sapiens
uagcacacaauaagcauuc

SEQ ID NO: 1426051 - RNA, 18 nt, Homo sapiens
uagcagaaggcaagcacc

SEQ ID NO: 1426052 - RNA, 15 nt, Homo sapiens
uagcagucaaaucua

SEQ ID NO: 1426053 - RNA, 21 nt, Homo sapiens
uagcauuuucuugaaccaaua

SEQ ID NO: 1426054 - RNA, 15 nt, Homo sapiens
uagccaacuccuccu

SEQ ID NO: 1426055 - RNA, 22 nt, Homo sapiens
uagccucgccgucugugaauug

SEQ ID NO: 1426056 - RNA, 20 nt, Homo sapiens
uagcgcugccgcaccccaga

SEQ ID NO: 1426057 - RNA, 16 nt, Homo sapiens
uagcggaucucacuca

SEQ ID NO: 1426058 - RNA, 16 nt, Homo sapiens
uagcuagaaugcacac

SEQ ID NO: 1426059 - RNA, 23 nt, Homo sapiens
uagcuagaaugcacaccaaaaaa

SEQ ID NO: 1426060 - RNA, 20 nt, Homo sapiens
uagcuauuuguuuacaugca

SEQ ID NO: 1426061 - RNA, 12 nt, Homo sapiens
uagcucuuucag

SEQ ID NO: 1426062 - RNA, 19 nt, Homo sapiens
uagcugacaaugcacagcu

SEQ ID NO: 1426063 - RNA, 14 nt, Homo sapiens
uagcugacaucucc

SEQ ID NO: 1426064 - RNA, 18 nt, Homo sapiens
uagcugagccuucugaug

SEQ ID NO: 1426065 - RNA, 23 nt, Homo sapiens
uagcugccuuuuuuaacacuaga

SEQ ID NO: 1426066 - RNA, 15 nt, Homo sapiens
uagcugucugcucag

SEQ ID NO: 1426067 - RNA, 18 nt, Homo sapiens
uagcuguuuuuuucauua

SEQ ID NO: 1426068 - RNA, 13 nt, Homo sapiens
uagcuucaugccu

SEQ ID NO: 1426069 - RNA, 14 nt, Homo sapiens
uaggaaaauuucac

SEQ ID NO: 1426070 - RNA, 17 nt, Homo sapiens
uaggaaacccuucuuua

SEQ ID NO: 1426071 - RNA, 21 nt, Homo sapiens
uaggaaaccuggcauggugcu

SEQ ID NO: 1426072 - RNA, 19 nt, Homo sapiens
uaggaaggcuacuggcauu

SEQ ID NO: 1426073 - RNA, 17 nt, Homo sapiens
uaggagacagucucaag

SEQ ID NO: 1426074 - RNA, 11 nt, Homo sapiens
uaggauuuaua

SEQ ID NO: 1426075 - RNA, 12 nt, Homo sapiens
uaggcaaagacu

SEQ ID NO: 1426076 - RNA, 18 nt, Homo sapiens
uaggcaauacauguaucu

SEQ ID NO: 1426077 - RNA, 13 nt, Homo sapiens
uaggcaauaucuu

SEQ ID NO: 1426078 - RNA, 21 nt, Homo sapiens
uaggcggucaugugugcaugu

SEQ ID NO: 1426079 - RNA, 12 nt, Homo sapiens
uaggcuuaucaa

SEQ ID NO: 1426080 - RNA, 17 nt, Homo sapiens
uagggaaauucaaagca

SEQ ID NO: 1426081 - RNA, 14 nt, Homo sapiens
uagggagaaaccaa

SEQ ID NO: 1426082 - RNA, 16 nt, Homo sapiens
uagggcaacaauacau

SEQ ID NO: 1426083 - RNA, 23 nt, Homo sapiens
uagggcaacaauacaugcugcua

SEQ ID NO: 1426084 - RNA, 21 nt, Homo sapiens
uagggcuguagacuuacuuuc

SEQ ID NO: 1426085 - RNA, 22 nt, Homo sapiens
uaggugccaggcuguaagcauu

SEQ ID NO: 1426086 - RNA, 14 nt, Homo sapiens
uaguaaacuuugua

SEQ ID NO: 1426087 - RNA, 22 nt, Homo sapiens
uaguaaagacaggguuucacca

SEQ ID NO: 1426088 - RNA, 21 nt, Homo sapiens
uaguaacuacuuuuuauacuc

SEQ ID NO: 1426089 - RNA, 20 nt, Homo sapiens
uaguaauuguaaguaccccu

SEQ ID NO: 1426090 - RNA, 22 nt, Homo sapiens
uaguaguuucucuguaaggcaa

SEQ ID NO: 1426091 - RNA, 16 nt, Homo sapiens
uaguauauuuauacuc

SEQ ID NO: 1426092 - RNA, 17 nt, Homo sapiens
uaguauauuuauacucu

SEQ ID NO: 1426093 - RNA, 14 nt, Homo sapiens
uagucacaccaucu

SEQ ID NO: 1426094 - RNA, 22 nt, Homo sapiens
uaguccccaucagcaccaugga

SEQ ID NO: 1426095 - RNA, 17 nt, Homo sapiens
uagugacuuccugguga

SEQ ID NO: 1426096 - RNA, 18 nt, Homo sapiens
uaguguccaaauucucac

SEQ ID NO: 1426097 - RNA, 23 nt, Homo sapiens
uagugucuugaauguaagaacau

SEQ ID NO: 1426098 - RNA, 16 nt, Homo sapiens
uaguuaauuauuucaa

SEQ ID NO: 1426099 - RNA, 19 nt, Homo sapiens
uaguucuuacuacuugcca

SEQ ID NO: 1426100 - RNA, 22 nt, Homo sapiens
uaguuuauuuuguuacacuaaa

SEQ ID NO: 1426101 - RNA, 17 nt, Homo sapiens
uaguuuugaaacuagaa

SEQ ID NO: 1426102 - RNA, 12 nt, Homo sapiens
uauaaaacacau

SEQ ID NO: 1426103 - RNA, 15 nt, Homo sapiens
uauaaagauggcuga

SEQ ID NO: 1426104 - RNA, 19 nt, Homo sapiens
uauaaauguguggugcuaa

SEQ ID NO: 1426105 - RNA, 17 nt, Homo sapiens
uauaaccauuacauguu

SEQ ID NO: 1426106 - RNA, 19 nt, Homo sapiens
uauaaccccaccuugccaa

SEQ ID NO: 1426107 - RNA, 20 nt, Homo sapiens
uauaacuaguccuuuacuaa

SEQ ID NO: 1426108 - RNA, 19 nt, Homo sapiens
uauaacuguggcuaauuca

SEQ ID NO: 1426109 - RNA, 20 nt, Homo sapiens
uauaagcagauuuaacaauu

SEQ ID NO: 1426110 - RNA, 22 nt, Homo sapiens
uauaaucuuccauacuucuuca

SEQ ID NO: 1426111 - RNA, 14 nt, Homo sapiens
uauaaugguugacu

SEQ ID NO: 1426112 - RNA, 17 nt, Homo sapiens
uauacacacauauacau

SEQ ID NO: 1426113 - RNA, 20 nt, Homo sapiens
uauacacacauauacauaua

SEQ ID NO: 1426114 - RNA, 11 nt, Homo sapiens
uauacagcuca

SEQ ID NO: 1426115 - RNA, 12 nt, Homo sapiens
uauacauaucag

SEQ ID NO: 1426116 - RNA, 17 nt, Homo sapiens
uuugucucugcaucuca

SEQ ID NO: 1426117 - RNA, 12 nt, Homo sapiens
uuugugagccgu

SEQ ID NO: 1426118 - RNA, 18 nt, Homo sapiens
uuuguggaggacuuugaa

SEQ ID NO: 1426119 - RNA, 22 nt, Homo sapiens
uuuuaaaguauguuauugcaua

SEQ ID NO: 1426120 - RNA, 15 nt, Homo sapiens
uuuuaacacauaacu

SEQ ID NO: 1426121 - RNA, 14 nt, Homo sapiens
uuuuaauaugacaa

SEQ ID NO: 1426122 - RNA, 14 nt, Homo sapiens
uuuuaaucuucuca

SEQ ID NO: 1426123 - RNA, 19 nt, Homo sapiens
uuuuagaggaagaccaaaa

SEQ ID NO: 1426124 - RNA, 17 nt, Homo sapiens
uuuuaguaaauccuuau

SEQ ID NO: 1426125 - RNA, 17 nt, Homo sapiens
uuuucaaaacugcuaaa

SEQ ID NO: 1426126 - RNA, 22 nt, Homo sapiens
uuuucaaguugagaacaaaaau

SEQ ID NO: 1426127 - RNA, 17 nt, Homo sapiens
uuuucagaguugcuuua

SEQ ID NO: 1426128 - RNA, 13 nt, Homo sapiens
uuuuccacuuaga

SEQ ID NO: 1426129 - RNA, 12 nt, Homo sapiens
uuuuccaggaau

SEQ ID NO: 1426130 - RNA, 22 nt, Homo sapiens
uuuuccuaaaaauaagcuuuau

SEQ ID NO: 1426131 - RNA, 20 nt, Homo sapiens
uuuucuccacuuuguuggaa

SEQ ID NO: 1426132 - RNA, 23 nt, Homo sapiens
uuuucucuccuaagacaccugca

SEQ ID NO: 1426133 - RNA, 17 nt, Homo sapiens
uuuucuggugaugccca

SEQ ID NO: 1426134 - RNA, 16 nt, Homo sapiens
uuuugagagacagggu

SEQ ID NO: 1426135 - RNA, 21 nt, Homo sapiens
uuuugaggaauuaucauggga

SEQ ID NO: 1426136 - RNA, 22 nt, Homo sapiens
uuuugaugugaaaaucaugaaa

SEQ ID NO: 1426137 - RNA, 22 nt, Homo sapiens
uuuugcauuugaauaaagccug

SEQ ID NO: 1426138 - RNA, 22 nt, Homo sapiens
uuuuggaggguccuccacaaua

SEQ ID NO: 1426139 - RNA, 14 nt, Homo sapiens
uuuugucacugucu

SEQ ID NO: 1426140 - RNA, 15 nt, Homo sapiens
uuuugucauauguau

SEQ ID NO: 1426141 - RNA, 17 nt, Homo sapiens
uuuuuaacugcauaaua

SEQ ID NO: 1426142 - RNA, 17 nt, Homo sapiens
uuuuuacuccaguggug

SEQ ID NO: 1426143 - RNA, 18 nt, Homo sapiens
uuuuuacugugcauacau

SEQ ID NO: 1426144 - RNA, 15 nt, Homo sapiens
uuuuuacuuccacag

SEQ ID NO: 1426145 - RNA, 14 nt, Homo sapiens
uuuuuauacauauc

SEQ ID NO: 1426146 - RNA, 23 nt, Homo sapiens
uuuuucagaaagcauuacauuuc

SEQ ID NO: 1426147 - RNA, 16 nt, Homo sapiens
uuuuucuaagguucuc

SEQ ID NO: 1426148 - RNA, 12 nt, Homo sapiens
uuuuugcuaaac

SEQ ID NO: 1426149 - RNA, 16 nt, Homo sapiens
uuuuugucauagcagc

SEQ ID NO: 1426150 - RNA, 18 nt, Homo sapiens
uuuuuguggugucuagca

SEQ ID NO: 1426151 - RNA, 12 nt, Homo sapiens
uuuuuugauuga

SEQ ID NO: 1426152 - RNA, 18 nt, Homo sapiens
gccccguuuuaaggacau

SEQ ID NO: 1426153 - RNA, 18 nt, Homo sapiens
gcccgacagccuggcaca

SEQ ID NO: 1426154 - RNA, 17 nt, Homo sapiens
gcccgaccccaucucau

SEQ ID NO: 1426155 - RNA, 14 nt, Homo sapiens
gcccgaggaccggg

SEQ ID NO: 1426156 - RNA, 16 nt, Homo sapiens
gcccugcugugggaga

SEQ ID NO: 1426157 - RNA, 21 nt, Homo sapiens
gcccugggguaugagcugcca

SEQ ID NO: 1426158 - RNA, 21 nt, Homo sapiens
gcccuucccacuggaggucac

SEQ ID NO: 1426159 - RNA, 22 nt, Homo sapiens
gcccuuccuccugaagccucug

SEQ ID NO: 1426160 - RNA, 20 nt, Homo sapiens
gcccuugggguaagccagag

SEQ ID NO: 1426161 - RNA, 22 nt, Homo sapiens
gcccuuuuuuguggugucuagc

SEQ ID NO: 1426162 - RNA, 19 nt, Homo sapiens
gccgcauucccugagucac

SEQ ID NO: 1426163 - RNA, 22 nt, Homo sapiens
gccggcaaccccaguucugcuc

SEQ ID NO: 1426164 - RNA, 17 nt, Homo sapiens
gccggcucuucaaagac

SEQ ID NO: 1426165 - RNA, 16 nt, Homo sapiens
gccgggcugcacagac

SEQ ID NO: 1426166 - RNA, 18 nt, Homo sapiens
gccguguuacuguugcac

SEQ ID NO: 1426167 - RNA, 22 nt, Homo sapiens
gccuaaauaaaaaguauacuuu

SEQ ID NO: 1426168 - RNA, 17 nt, Homo sapiens
gccuaauacaacaugua

SEQ ID NO: 1426169 - RNA, 19 nt, Homo sapiens
gccuacacccgucuugggg

SEQ ID NO: 1426170 - RNA, 19 nt, Homo sapiens
gccuacugccucuccagca

SEQ ID NO: 1426171 - RNA, 14 nt, Homo sapiens
gccucaaugugacc

SEQ ID NO: 1426172 - RNA, 17 nt, Homo sapiens
gccuccaagccauucac

SEQ ID NO: 1426173 - RNA, 14 nt, Homo sapiens
gccuccaugcugcc

SEQ ID NO: 1426174 - RNA, 20 nt, Homo sapiens
gccucccccucagaugaucu

SEQ ID NO: 1426175 - RNA, 23 nt, Homo sapiens
gccucccucccgggggcacugcc

SEQ ID NO: 1426176 - RNA, 16 nt, Homo sapiens
gccucccuuucuggga

SEQ ID NO: 1426177 - RNA, 22 nt, Homo sapiens
gccuccucccugggcagaaagu

SEQ ID NO: 1426178 - RNA, 22 nt, Homo sapiens
gccuccucgggggaaagcacac

SEQ ID NO: 1426179 - RNA, 16 nt, Homo sapiens
gccuccuuauuuauca

SEQ ID NO: 1426180 - RNA, 19 nt, Homo sapiens
gccucuccccaaacauuaa

SEQ ID NO: 1426181 - RNA, 15 nt, Homo sapiens
gccucugccaugccc

SEQ ID NO: 1426182 - RNA, 17 nt, Homo sapiens
gccucugccccaagggg

SEQ ID NO: 1426183 - RNA, 12 nt, Homo sapiens
gccucuggaaaa

SEQ ID NO: 1426184 - RNA, 19 nt, Homo sapiens
gccucuuccucccucauuc

SEQ ID NO: 1426185 - RNA, 13 nt, Homo sapiens
gccugagacaccc

SEQ ID NO: 1426186 - RNA, 20 nt, Homo sapiens
gccugagugcuuuaccuuua

SEQ ID NO: 1426187 - RNA, 19 nt, Homo sapiens
gccugcuaauagcugcuag

SEQ ID NO: 1426188 - RNA, 18 nt, Homo sapiens
gccugcugcugagaaccu

SEQ ID NO: 1426189 - RNA, 12 nt, Homo sapiens
gccugcugugcc

SEQ ID NO: 1426190 - RNA, 23 nt, Homo sapiens
gccuggaucuccccacucuaggg

SEQ ID NO: 1426191 - RNA, 18 nt, Homo sapiens
gccuggcacaggacugau

SEQ ID NO: 1426192 - RNA, 20 nt, Homo sapiens
gccuggcagccgugccuuca

SEQ ID NO: 1426193 - RNA, 14 nt, Homo sapiens
gccuggcaucgcau

SEQ ID NO: 1426194 - RNA, 14 nt, Homo sapiens
gccugggacccagc

SEQ ID NO: 1426195 - RNA, 17 nt, Homo sapiens
gccugggcuuaugcccu

SEQ ID NO: 1426196 - RNA, 16 nt, Homo sapiens
gccugggggcagugac

SEQ ID NO: 1426197 - RNA, 19 nt, Homo sapiens
gccugggucaagggccagu

SEQ ID NO: 1426198 - RNA, 22 nt, Homo sapiens
gccugggucaagggccagucag

SEQ ID NO: 1426199 - RNA, 20 nt, Homo sapiens
gccuguaaucccagcacuuu

SEQ ID NO: 1426200 - RNA, 23 nt, Homo sapiens
gccugugauuaacuugcuuagua

SEQ ID NO: 1426201 - RNA, 14 nt, Homo sapiens
gccugugcuaaaga

SEQ ID NO: 1426202 - RNA, 17 nt, Homo sapiens
gccuguguagcugugac

SEQ ID NO: 1426203 - RNA, 18 nt, Homo sapiens
gccuguguuuguguggau

SEQ ID NO: 1426204 - RNA, 13 nt, Homo sapiens
gccuguugcugaa

SEQ ID NO: 1426205 - RNA, 18 nt, Homo sapiens
gccuuacuuaaacccagc

SEQ ID NO: 1426206 - RNA, 22 nt, Homo sapiens
gccuucaccuucaccuucaucc

SEQ ID NO: 1426207 - RNA, 15 nt, Homo sapiens
gccuucaguguaccg

SEQ ID NO: 1426208 - RNA, 13 nt, Homo sapiens
gccuucugaugag

SEQ ID NO: 1426209 - RNA, 22 nt, Homo sapiens
gccuucugggccuccaaagccc

SEQ ID NO: 1426210 - RNA, 15 nt, Homo sapiens
gccuucuucacccag

SEQ ID NO: 1426211 - RNA, 23 nt, Homo sapiens
gccuucuuuucaaaacugcuaaa

SEQ ID NO: 1426212 - RNA, 15 nt, Homo sapiens
gccuugccaugucuu

SEQ ID NO: 1426213 - RNA, 20 nt, Homo sapiens
gccuuucucuggcuccagaa

SEQ ID NO: 1426214 - RNA, 16 nt, Homo sapiens
gcuguuauucuuccac

SEQ ID NO: 1426215 - RNA, 16 nt, Homo sapiens
gcuguuucuggaaaug

SEQ ID NO: 1426216 - RNA, 14 nt, Homo sapiens
gcuguuugucuaua

SEQ ID NO: 1426217 - RNA, 20 nt, Homo sapiens
gcuguuuuaaaaacaaagaa

SEQ ID NO: 1426218 - RNA, 18 nt, Homo sapiens
gcuuacauuuuuacaaua

SEQ ID NO: 1426219 - RNA, 15 nt, Homo sapiens
gcuuaccaaguccug

SEQ ID NO: 1426220 - RNA, 12 nt, Homo sapiens
gcuuacccuuca

SEQ ID NO: 1426221 - RNA, 14 nt, Homo sapiens
gcuuacuaaugugc

SEQ ID NO: 1426222 - RNA, 18 nt, Homo sapiens
gcuuagccuccugaccug

SEQ ID NO: 1426223 - RNA, 15 nt, Homo sapiens
gcuuauuucccucau

SEQ ID NO: 1426224 - RNA, 22 nt, Homo sapiens
gcuucaaggaguaugcagggag

SEQ ID NO: 1426225 - RNA, 19 nt, Homo sapiens
gcuucaaguguugcucuug

SEQ ID NO: 1426226 - RNA, 17 nt, Homo sapiens
gcuucauuaugcagcug

SEQ ID NO: 1426227 - RNA, 21 nt, Homo sapiens
gcuuccgugugucaucagggu

SEQ ID NO: 1426228 - RNA, 14 nt, Homo sapiens
gcuucucaucccca

SEQ ID NO: 1426229 - RNA, 19 nt, Homo sapiens
gcuucucauggauggcacu

SEQ ID NO: 1426230 - RNA, 15 nt, Homo sapiens
gcuucuguccaggac

SEQ ID NO: 1426231 - RNA, 17 nt, Homo sapiens
gcuucuguccaggacau

SEQ ID NO: 1426232 - RNA, 11 nt, Homo sapiens
gcuugccauau

SEQ ID NO: 1426233 - RNA, 21 nt, Homo sapiens
gcuugggggcuccacuggcuc

SEQ ID NO: 1426234 - RNA, 13 nt, Homo sapiens
gcaaagugcugua

SEQ ID NO: 1426235 - RNA, 19 nt, Homo sapiens
gcaaaugccuccaagccau

SEQ ID NO: 1426236 - RNA, 16 nt, Homo sapiens
gcaaccacacaccuca

SEQ ID NO: 1426237 - RNA, 13 nt, Homo sapiens
gcaaccccaguuc

SEQ ID NO: 1426238 - RNA, 18 nt, Homo sapiens
gcaagaaccaguguuuag

SEQ ID NO: 1426239 - RNA, 17 nt, Homo sapiens
gcaagacuguugcucaa

SEQ ID NO: 1426240 - RNA, 18 nt, Homo sapiens
gcaagagaaaauaaacca

SEQ ID NO: 1426241 - RNA, 13 nt, Homo sapiens
gcaagaugaccua

SEQ ID NO: 1426242 - RNA, 13 nt, Homo sapiens
gcaagcagggaaa

SEQ ID NO: 1426243 - RNA, 15 nt, Homo sapiens
gcaagccacuauguc

SEQ ID NO: 1426244 - RNA, 17 nt, Homo sapiens
gcaagccuugcuagaca

SEQ ID NO: 1426245 - RNA, 22 nt, Homo sapiens
gcaagccuugcuagacagccag

SEQ ID NO: 1426246 - RNA, 21 nt, Homo sapiens
gcaaggacggccuucaacuga

SEQ ID NO: 1426247 - RNA, 20 nt, Homo sapiens
gcaaggcccgagcagcugag

SEQ ID NO: 1426248 - RNA, 17 nt, Homo sapiens
gcaaggccucugccccu

SEQ ID NO: 1426249 - RNA, 15 nt, Homo sapiens
gcaagggcugugcug

SEQ ID NO: 1426250 - RNA, 14 nt, Homo sapiens
gcaagucuugucag

SEQ ID NO: 1426251 - RNA, 21 nt, Homo sapiens
gcaagugcuaugccaagccau

SEQ ID NO: 1426252 - RNA, 17 nt, Homo sapiens
gcaauacauguaucuaa

SEQ ID NO: 1426253 - RNA, 14 nt, Homo sapiens
gcaaugaaacagau

SEQ ID NO: 1426254 - RNA, 17 nt, Homo sapiens
gcaaugggagggggcuc

SEQ ID NO: 1426255 - RNA, 19 nt, Homo sapiens
gcaauucagcaaagaacaa

SEQ ID NO: 1426256 - RNA, 17 nt, Homo sapiens
gcaauucuccugccuca

SEQ ID NO: 1426257 - RNA, 17 nt, Homo sapiens
gcaauuuugcauuugaa

SEQ ID NO: 1426258 - RNA, 23 nt, Homo sapiens
gcaauuuuuuuauacuaccaagu

SEQ ID NO: 1426259 - RNA, 15 nt, Homo sapiens
gcacaaauuguacau

SEQ ID NO: 1426260 - RNA, 19 nt, Homo sapiens
gcacacaauaagcauucaa

SEQ ID NO: 1426261 - RNA, 17 nt, Homo sapiens
gcacacacaccgaugua

SEQ ID NO: 1426262 - RNA, 12 nt, Homo sapiens
gcacacacagau

SEQ ID NO: 1426263 - RNA, 22 nt, Homo sapiens
gcacacacagauauacacaugg

SEQ ID NO: 1426264 - RNA, 22 nt, Homo sapiens
gcacacacagauaugcacacac

SEQ ID NO: 1426265 - RNA, 12 nt, Homo sapiens
gcacacacaugg

SEQ ID NO: 1426266 - RNA, 12 nt, Homo sapiens
gcacacaccgau

SEQ ID NO: 1426267 - RNA, 15 nt, Homo sapiens
gcacaccccaaggga

SEQ ID NO: 1426268 - RNA, 16 nt, Homo sapiens
gcacacggaugcacag

SEQ ID NO: 1426269 - RNA, 21 nt, Homo sapiens
gcacacuagccucuccaggaa

SEQ ID NO: 1426270 - RNA, 16 nt, Homo sapiens
gcacaggagcuaccug

SEQ ID NO: 1426271 - RNA, 16 nt, Homo sapiens
gcacauagagauaugc

SEQ ID NO: 1426272 - RNA, 18 nt, Homo sapiens
gcacauagagauaugcac

SEQ ID NO: 1426273 - RNA, 15 nt, Homo sapiens
gcacauccauuccca

SEQ ID NO: 1426274 - RNA, 14 nt, Homo sapiens
gcaccaccaugcca

SEQ ID NO: 1426275 - RNA, 21 nt, Homo sapiens
gcaccaggcacgaacccaccu

SEQ ID NO: 1426276 - RNA, 18 nt, Homo sapiens
gcacccaugccauagaaa

SEQ ID NO: 1426277 - RNA, 16 nt, Homo sapiens
gcacccccugcagcuu

SEQ ID NO: 1426278 - RNA, 14 nt, Homo sapiens
gcaccgagaccaaa

SEQ ID NO: 1426279 - RNA, 18 nt, Homo sapiens
gcaccgagagagauggaa

SEQ ID NO: 1426280 - RNA, 21 nt, Homo sapiens
gcaccgggcccuccuugccug

SEQ ID NO: 1426281 - RNA, 12 nt, Homo sapiens
gcaccugugcag

SEQ ID NO: 1426282 - RNA, 23 nt, Homo sapiens
gcacggccuuguucuaacccgga

SEQ ID NO: 1426283 - RNA, 16 nt, Homo sapiens
gcacgugccugugauc

SEQ ID NO: 1426284 - RNA, 17 nt, Homo sapiens
gcacuaauugacccaaa

SEQ ID NO: 1426285 - RNA, 19 nt, Homo sapiens
gcacuaccaggcugugggu

SEQ ID NO: 1426286 - RNA, 20 nt, Homo sapiens
gcacuaggucaaaacauuca

SEQ ID NO: 1426287 - RNA, 20 nt, Homo sapiens
gcacucacccaugugccaag

SEQ ID NO: 1426288 - RNA, 16 nt, Homo sapiens
gcacuccauggccacc

SEQ ID NO: 1426289 - RNA, 18 nt, Homo sapiens
gcacucccucccagagaa

SEQ ID NO: 1426290 - RNA, 14 nt, Homo sapiens
gcacugagggccac

SEQ ID NO: 1426291 - RNA, 14 nt, Homo sapiens
gcacugcuccagug

SEQ ID NO: 1426292 - RNA, 15 nt, Homo sapiens
gcacugcuccagugg

SEQ ID NO: 1426293 - RNA, 22 nt, Homo sapiens
ggaggccgaagcuaacagggaa

SEQ ID NO: 1426294 - RNA, 17 nt, Homo sapiens
ggaggccucacacccag

SEQ ID NO: 1426295 - RNA, 20 nt, Homo sapiens
ggaggcggagguugcaguga

SEQ ID NO: 1426296 - RNA, 16 nt, Homo sapiens
ggaggcggcuccaggu

SEQ ID NO: 1426297 - RNA, 16 nt, Homo sapiens
ggaggcugcggccuag

SEQ ID NO: 1426298 - RNA, 22 nt, Homo sapiens
ggagggcgugacucacccaagc

SEQ ID NO: 1426299 - RNA, 23 nt, Homo sapiens
ggaggucgggauggggcuuguag

SEQ ID NO: 1426300 - RNA, 16 nt, Homo sapiens
ggaggugggagacaag

SEQ ID NO: 1426301 - RNA, 14 nt, Homo sapiens
ggagguugcaguga

SEQ ID NO: 1426302 - RNA, 22 nt, Homo sapiens
ggaguaaucaggcagccuucau

SEQ ID NO: 1426303 - RNA, 16 nt, Homo sapiens
ggagucucauucuguu

SEQ ID NO: 1426304 - RNA, 17 nt, Homo sapiens
ggagugagaucuuacag

SEQ ID NO: 1426305 - RNA, 15 nt, Homo sapiens
ggaguguucuguggg

SEQ ID NO: 1426306 - RNA, 14 nt, Homo sapiens
ggaguuggagacca

SEQ ID NO: 1426307 - RNA, 20 nt, Homo sapiens
ggauagcuauuuucuuacag

SEQ ID NO: 1426308 - RNA, 20 nt, Homo sapiens
ggauagucagcuguaccaag

SEQ ID NO: 1426309 - RNA, 20 nt, Homo sapiens
ggaucacaaggucacuagau

SEQ ID NO: 1426310 - RNA, 19 nt, Homo sapiens
ggaucacuugaguucagga

SEQ ID NO: 1426311 - RNA, 19 nt, Homo sapiens
uaaaacuaugguucccaau

SEQ ID NO: 1426312 - RNA, 16 nt, Homo sapiens
uaaaacugcacugcca

SEQ ID NO: 1426313 - RNA, 16 nt, Homo sapiens
uaaaacuuaugcuagu

SEQ ID NO: 1426314 - RNA, 22 nt, Homo sapiens
uaaaagaaaaaguaugugaaua

SEQ ID NO: 1426315 - RNA, 17 nt, Homo sapiens
uaaaagaauuugugaca

SEQ ID NO: 1426316 - RNA, 18 nt, Homo sapiens
uaaaauaaaguacauuau

SEQ ID NO: 1426317 - RNA, 20 nt, Homo sapiens
uaaaauaacuuauaucauca

SEQ ID NO: 1426318 - RNA, 18 nt, Homo sapiens
uaaaauaaggcuccuuca

SEQ ID NO: 1426319 - RNA, 20 nt, Homo sapiens
uaaaauagacaacucuucca

SEQ ID NO: 1426320 - RNA, 17 nt, Homo sapiens
uaaaauauaagaucuga

SEQ ID NO: 1426321 - RNA, 19 nt, Homo sapiens
uaaaauauuccugcauuug

SEQ ID NO: 1426322 - RNA, 14 nt, Homo sapiens
uaaaaugacauuca

SEQ ID NO: 1426323 - RNA, 18 nt, Homo sapiens
uaaaauuaugccauagca

SEQ ID NO: 1426324 - RNA, 17 nt, Homo sapiens
uaaaauuuccacaagca

SEQ ID NO: 1426325 - RNA, 17 nt, Homo sapiens
uaaacaaauaacaaugu

SEQ ID NO: 1426326 - RNA, 14 nt, Homo sapiens
uaaacacccaugaa

SEQ ID NO: 1426327 - RNA, 23 nt, Homo sapiens
uaaacacccaugaaucaaagaca

SEQ ID NO: 1426328 - RNA, 21 nt, Homo sapiens
uaaacagacuuuagcuuacag

SEQ ID NO: 1426329 - RNA, 11 nt, Homo sapiens
uaaacaugaag

SEQ ID NO: 1426330 - RNA, 22 nt, Homo sapiens
uaaaccaaaggacauuaugugu

SEQ ID NO: 1426331 - RNA, 13 nt, Homo sapiens
uaaaccuagggag

SEQ ID NO: 1426332 - RNA, 16 nt, Homo sapiens
uaaacgagauaaugua

SEQ ID NO: 1426333 - RNA, 17 nt, Homo sapiens
uaaacuaucuuggugaa

SEQ ID NO: 1426334 - RNA, 21 nt, Homo sapiens
uaaagaauaaaugaaucuuac

SEQ ID NO: 1426335 - RNA, 14 nt, Homo sapiens
uaaagacagcugac

SEQ ID NO: 1426336 - RNA, 16 nt, Homo sapiens
uaaagaguauuuacaa

SEQ ID NO: 1426337 - RNA, 16 nt, Homo sapiens
uaaagaugaucuacuc

SEQ ID NO: 1426338 - RNA, 17 nt, Homo sapiens
uaaagaugaucuacuca

SEQ ID NO: 1426339 - RNA, 21 nt, Homo sapiens
uaaagccaacacccugucuaa

SEQ ID NO: 1426340 - RNA, 16 nt, Homo sapiens
uaaagccaguggcagu

SEQ ID NO: 1426341 - RNA, 20 nt, Homo sapiens
uaaagcccaaccuccugacc

SEQ ID NO: 1426342 - RNA, 19 nt, Homo sapiens
uaaagcuuugucuuuuugu

SEQ ID NO: 1426343 - RNA, 19 nt, Homo sapiens
uaaaggaaggagauacuca

SEQ ID NO: 1426344 - RNA, 23 nt, Homo sapiens
uaaagggcaggugguucuaauau

SEQ ID NO: 1426345 - RNA, 15 nt, Homo sapiens
uaaaguacauaacaa

SEQ ID NO: 1426346 - RNA, 23 nt, Homo sapiens
uaaaguagcaggacucggaauuc

SEQ ID NO: 1426347 - RNA, 19 nt, Homo sapiens
uaaaguauguuauugcaua

SEQ ID NO: 1426348 - RNA, 20 nt, Homo sapiens
uaaaguauguuauugcauaa

SEQ ID NO: 1426349 - RNA, 17 nt, Homo sapiens
uaaagugccaguuugcu

SEQ ID NO: 1426350 - RNA, 18 nt, Homo sapiens
uaaauaaaaaguauacuu

SEQ ID NO: 1426351 - RNA, 18 nt, Homo sapiens
uaaauaauguauacacau

SEQ ID NO: 1426352 - RNA, 12 nt, Homo sapiens
uaaauacagaca

SEQ ID NO: 1426353 - RNA, 14 nt, Homo sapiens
uaaauacaguggau

SEQ ID NO: 1426354 - RNA, 21 nt, Homo sapiens
uaaauacaguggaucucaauc

SEQ ID NO: 1426355 - RNA, 15 nt, Homo sapiens
uaaauacuguacaua

SEQ ID NO: 1426356 - RNA, 21 nt, Homo sapiens
uaaauacuguacauagaugua

SEQ ID NO: 1426357 - RNA, 14 nt, Homo sapiens
uaaauaugaaauga

SEQ ID NO: 1426358 - RNA, 17 nt, Homo sapiens
uaaauaugauuacuuua

SEQ ID NO: 1426359 - RNA, 21 nt, Homo sapiens
uaaaucacggauggcagauug

SEQ ID NO: 1426360 - RNA, 20 nt, Homo sapiens
uaaaucuuccagcaugcauc

SEQ ID NO: 1426361 - RNA, 22 nt, Homo sapiens
uaaaugacugcugaaugacaua

SEQ ID NO: 1426362 - RNA, 17 nt, Homo sapiens
uaaaugcaaacacugug

SEQ ID NO: 1426363 - RNA, 13 nt, Homo sapiens
uaaaugcagguau

SEQ ID NO: 1426364 - RNA, 14 nt, Homo sapiens
uaaaugccacaaag

SEQ ID NO: 1426365 - RNA, 12 nt, Homo sapiens
uaaaugguggga

SEQ ID NO: 1426366 - RNA, 19 nt, Homo sapiens
uaaauguauaugucauuua

SEQ ID NO: 1426367 - RNA, 17 nt, Homo sapiens
uaaauguaucauagaaa

SEQ ID NO: 1426368 - RNA, 17 nt, Homo sapiens
uaaauguguggugcuaa

SEQ ID NO: 1426369 - RNA, 22 nt, Homo sapiens
uaaauuauuuauuuauggagga

SEQ ID NO: 1426370 - RNA, 21 nt, Homo sapiens
uaaauucaagcugcuuuggac

SEQ ID NO: 1426371 - RNA, 21 nt, Homo sapiens
uaaauucacagcgcuaugcaa

SEQ ID NO: 1426372 - RNA, 18 nt, Homo sapiens
uaaauucagaaagucaua

SEQ ID NO: 1426373 - RNA, 15 nt, Homo sapiens
uaaauugauguugcu

SEQ ID NO: 1426374 - RNA, 15 nt, Homo sapiens
uaacaaaagaagauu

SEQ ID NO: 1426375 - RNA, 21 nt, Homo sapiens
uaacaaggugucuuuuccacu

SEQ ID NO: 1426376 - RNA, 18 nt, Homo sapiens
uaacacaagccacagaag

SEQ ID NO: 1426377 - RNA, 13 nt, Homo sapiens
uaacacaucuuua

SEQ ID NO: 1426378 - RNA, 21 nt, Homo sapiens
uaacaggguggcccccugugc

SEQ ID NO: 1426379 - RNA, 22 nt, Homo sapiens
uaacauaauuuguacauaugua

SEQ ID NO: 1426380 - RNA, 21 nt, Homo sapiens
uaacauauuugcacaauuuua

SEQ ID NO: 1426381 - RNA, 21 nt, Homo sapiens
uaacaucuauuauaaaaccau

SEQ ID NO: 1426382 - RNA, 20 nt, Homo sapiens
uaacaugucuuucagcauua

SEQ ID NO: 1426383 - RNA, 23 nt, Homo sapiens
uaacauuuggaguguguauucaa

SEQ ID NO: 1426384 - RNA, 23 nt, Homo sapiens
uaaccauaguuauuuacuugaaa

SEQ ID NO: 1426385 - RNA, 15 nt, Homo sapiens
uaaccccaccuugcc

SEQ ID NO: 1426386 - RNA, 13 nt, Homo sapiens
uaacccucucuuc

SEQ ID NO: 1426387 - RNA, 15 nt, Homo sapiens
uaacccucucuuccc

SEQ ID NO: 1426388 - RNA, 17 nt, Homo sapiens
uaaccugaauuauucca

SEQ ID NO: 1426389 - RNA, 18 nt, Homo sapiens
uaacgaaugguacuacaa

SEQ ID NO: 1426390 - RNA, 14 nt, Homo sapiens
uaacuacacuaaua

SEQ ID NO: 1426391 - RNA, 19 nt, Homo sapiens
uaacuacuuuuuauacucc

SEQ ID NO: 1426392 - RNA, 17 nt, Homo sapiens
uaacucagacauuccaa

SEQ ID NO: 1426393 - RNA, 14 nt, Homo sapiens
uaacuccagucucc

SEQ ID NO: 1426394 - RNA, 20 nt, Homo sapiens
cauccuggccaacaugguga

SEQ ID NO: 1426395 - RNA, 17 nt, Homo sapiens
caucuaagcugcagcuu

SEQ ID NO: 1426396 - RNA, 13 nt, Homo sapiens
caucuacaagcau

SEQ ID NO: 1426397 - RNA, 16 nt, Homo sapiens
caucuacaagcauuug

SEQ ID NO: 1426398 - RNA, 18 nt, Homo sapiens
caucuacaagcauuugcc

SEQ ID NO: 1426399 - RNA, 13 nt, Homo sapiens
caucuauguaucu

SEQ ID NO: 1426400 - RNA, 18 nt, Homo sapiens
caucuauuauaaaaccau

SEQ ID NO: 1426401 - RNA, 12 nt, Homo sapiens
caucucuuugau

SEQ ID NO: 1426402 - RNA, 22 nt, Homo sapiens
caucugacaugcaucaucucau

SEQ ID NO: 1426403 - RNA, 12 nt, Homo sapiens
caucugacucac

SEQ ID NO: 1426404 - RNA, 15 nt, Homo sapiens
caucugacucacaag

SEQ ID NO: 1426405 - RNA, 18 nt, Homo sapiens
caucugacucacaagaag

SEQ ID NO: 1426406 - RNA, 20 nt, Homo sapiens
caucugacucacaagaagac

SEQ ID NO: 1426407 - RNA, 13 nt, Homo sapiens
caucugagcuccu

SEQ ID NO: 1426408 - RNA, 15 nt, Homo sapiens
caucugcagcucuuu

SEQ ID NO: 1426409 - RNA, 22 nt, Homo sapiens
caucuucuggagucuccagugg

SEQ ID NO: 1426410 - RNA, 20 nt, Homo sapiens
caucuugucaagaaauaucc

SEQ ID NO: 1426411 - RNA, 15 nt, Homo sapiens
caugaaaaacacggc

SEQ ID NO: 1426412 - RNA, 17 nt, Homo sapiens
caugaacagaaacaaua

SEQ ID NO: 1426413 - RNA, 14 nt, Homo sapiens
caugaaucaaagac

SEQ ID NO: 1426414 - RNA, 16 nt, Homo sapiens
caugaauuauuuccag

SEQ ID NO: 1426415 - RNA, 16 nt, Homo sapiens
caugacaaaguuacaa

SEQ ID NO: 1426416 - RNA, 13 nt, Homo sapiens
caugacacugacc

SEQ ID NO: 1426417 - RNA, 24 nt, Homo sapiens
caugaccuccguguagugucugua

SEQ ID NO: 1426418 - RNA, 13 nt, Homo sapiens
caugacuucugcc

SEQ ID NO: 1426419 - RNA, 17 nt, Homo sapiens
caugagaaaaucaguaa

SEQ ID NO: 1426420 - RNA, 16 nt, Homo sapiens
caugaggacaaagugu

SEQ ID NO: 1426421 - RNA, 22 nt, Homo sapiens
caugauaaucugggcaucucgu

SEQ ID NO: 1426422 - RNA, 22 nt, Homo sapiens
caugauacaccuacuacucaau

SEQ ID NO: 1426423 - RNA, 18 nt, Homo sapiens
caugauggugcugaccuc

SEQ ID NO: 1426424 - RNA, 15 nt, Homo sapiens
caugauuuauauaug

SEQ ID NO: 1426425 - RNA, 20 nt, Homo sapiens
caugauuuuauacauaguca

SEQ ID NO: 1426426 - RNA, 14 nt, Homo sapiens
caugcacacaaaca

SEQ ID NO: 1426427 - RNA, 13 nt, Homo sapiens
caugcacggugag

SEQ ID NO: 1426428 - RNA, 12 nt, Homo sapiens
caugcacugacc

SEQ ID NO: 1426429 - RNA, 13 nt, Homo sapiens
caugcagccucuu

SEQ ID NO: 1426430 - RNA, 14 nt, Homo sapiens
caugccucugaggc

SEQ ID NO: 1426431 - RNA, 13 nt, Homo sapiens
caugccucugaua

SEQ ID NO: 1426432 - RNA, 16 nt, Homo sapiens
caugcugcuguugcug

SEQ ID NO: 1426433 - RNA, 15 nt, Homo sapiens
caugcugugugcugg

SEQ ID NO: 1426434 - RNA, 17 nt, Homo sapiens
cauggaaaagcccagug

SEQ ID NO: 1426435 - RNA, 18 nt, Homo sapiens
cauggaaacgcaaaugag

SEQ ID NO: 1426436 - RNA, 21 nt, Homo sapiens
cauggacagauagacagugcu

SEQ ID NO: 1426437 - RNA, 22 nt, Homo sapiens
agauagauccauuuggacaaaa

SEQ ID NO: 1426438 - RNA, 14 nt, Homo sapiens
agauagccagacac

SEQ ID NO: 1426439 - RNA, 11 nt, Homo sapiens
agauaugcaaa

SEQ ID NO: 1426440 - RNA, 17 nt, Homo sapiens
agaucagccacaccuuu

SEQ ID NO: 1426441 - RNA, 23 nt, Homo sapiens
agaucauguaaggaagggacuga

SEQ ID NO: 1426442 - RNA, 23 nt, Homo sapiens
agaucccauccaucagcucccuu

SEQ ID NO: 1426443 - RNA, 16 nt, Homo sapiens
agauccuacucuuccu

SEQ ID NO: 1426444 - RNA, 19 nt, Homo sapiens
agaucugagauugaauauu

SEQ ID NO: 1426445 - RNA, 13 nt, Homo sapiens
agaucugcacugg

SEQ ID NO: 1426446 - RNA, 15 nt, Homo sapiens
agaucugcacugggu

SEQ ID NO: 1426447 - RNA, 14 nt, Homo sapiens
agaucuuacaggua

SEQ ID NO: 1426448 - RNA, 19 nt, Homo sapiens
agaugaucgugccuauaaa

SEQ ID NO: 1426449 - RNA, 13 nt, Homo sapiens
agaugaucucucc

SEQ ID NO: 1426450 - RNA, 14 nt, Homo sapiens
agaugaugaugauc

SEQ ID NO: 1426451 - RNA, 12 nt, Homo sapiens
agaugcacacac

SEQ ID NO: 1426452 - RNA, 14 nt, Homo sapiens
agaugcugggccag

SEQ ID NO: 1426453 - RNA, 18 nt, Homo sapiens
agauggaauaaagcccuu

SEQ ID NO: 1426454 - RNA, 17 nt, Homo sapiens
agauggauuuguaucaa

SEQ ID NO: 1426455 - RNA, 22 nt, Homo sapiens
agauggcugugccucugccugu

SEQ ID NO: 1426456 - RNA, 14 nt, Homo sapiens
agaugggauuucau

SEQ ID NO: 1426457 - RNA, 20 nt, Homo sapiens
agauguggcaaagugcugua

SEQ ID NO: 1426458 - RNA, 18 nt, Homo sapiens
agauuaccugccacuucc

SEQ ID NO: 1426459 - RNA, 15 nt, Homo sapiens
agauuagcucuggac

SEQ ID NO: 1426460 - RNA, 18 nt, Homo sapiens
agauuuugucgggacaga

SEQ ID NO: 1426461 - RNA, 19 nt, Homo sapiens
agauuuuuuuuggacuguu

SEQ ID NO: 1426462 - RNA, 16 nt, Homo sapiens
agcaaaccucagucau

SEQ ID NO: 1426463 - RNA, 15 nt, Homo sapiens
agcaaauuaguaauu

SEQ ID NO: 1426464 - RNA, 16 nt, Homo sapiens
agcaacucacacggga

SEQ ID NO: 1426465 - RNA, 20 nt, Homo sapiens
agcaacucagaaugcucuac

SEQ ID NO: 1426466 - RNA, 16 nt, Homo sapiens
agcaacucugacucuu

SEQ ID NO: 1426467 - RNA, 23 nt, Homo sapiens
agcaagaggugguagaaccacuu

SEQ ID NO: 1426468 - RNA, 18 nt, Homo sapiens
agcaaggacaaccugccc

SEQ ID NO: 1426469 - RNA, 15 nt, Homo sapiens
agcaagggcugugcu

SEQ ID NO: 1426470 - RNA, 18 nt, Homo sapiens
agcaagggcugugcugag

SEQ ID NO: 1426471 - RNA, 15 nt, Homo sapiens
agcaaggugugaaug

SEQ ID NO: 1426472 - RNA, 13 nt, Homo sapiens
agcaaguuucacc

SEQ ID NO: 1426473 - RNA, 14 nt, Homo sapiens
agcaaugaugucca

SEQ ID NO: 1426474 - RNA, 23 nt, Homo sapiens
agcaaugggagggggcuccaugg

SEQ ID NO: 1426475 - RNA, 16 nt, Homo sapiens
agcaaugggcacuggu

SEQ ID NO: 1426476 - RNA, 20 nt, Homo sapiens
agcaauuagauuaguauuuu

SEQ ID NO: 1426477 - RNA, 20 nt, Homo sapiens
agcacacaauaagcauucaa

SEQ ID NO: 1426478 - RNA, 12 nt, Homo sapiens
agcacaccucau

SEQ ID NO: 1426479 - RNA, 15 nt, Homo sapiens
agcacagcagcaucu

SEQ ID NO: 1426480 - RNA, 20 nt, Homo sapiens
agcacagcagccccugcaca

SEQ ID NO: 1426481 - RNA, 16 nt, Homo sapiens
agcacauagcacuggg

SEQ ID NO: 1426482 - RNA, 14 nt, Homo sapiens
agcacauuccuccu

SEQ ID NO: 1426483 - RNA, 15 nt, Homo sapiens
agcaccaauuguaca

SEQ ID NO: 1426484 - RNA, 15 nt, Homo sapiens
agcacugccaggagg

SEQ ID NO: 1426485 - RNA, 20 nt, Homo sapiens
agcacugccucuuccagggc

SEQ ID NO: 1426486 - RNA, 16 nt, Homo sapiens
agcacugcuccagugg

SEQ ID NO: 1426487 - RNA, 18 nt, Homo sapiens
agcacugcuccagugggg

SEQ ID NO: 1426488 - RNA, 13 nt, Homo sapiens
agcacuugaaaau

SEQ ID NO: 1426489 - RNA, 22 nt, Homo sapiens
agcagaaaccaagucuacuuca

SEQ ID NO: 1426490 - RNA, 13 nt, Homo sapiens
agcagaacaugug

SEQ ID NO: 1426491 - RNA, 20 nt, Homo sapiens
agcagaagcacauaugaacu

SEQ ID NO: 1426492 - RNA, 12 nt, Homo sapiens
agcagacacugc

SEQ ID NO: 1426493 - RNA, 15 nt, Homo sapiens
agcagaccgugauuu

SEQ ID NO: 1426494 - RNA, 23 nt, Homo sapiens
agcagagcugauggagaaggaag

SEQ ID NO: 1426495 - RNA, 13 nt, Homo sapiens
agcagaucugaaa

SEQ ID NO: 1426496 - RNA, 18 nt, Homo sapiens
agcagcacgauuuugcac

SEQ ID NO: 1426497 - RNA, 19 nt, Homo sapiens
agcagcccccagguugccu

SEQ ID NO: 1426498 - RNA, 12 nt, Homo sapiens
agcaggcucaga

SEQ ID NO: 1426499 - RNA, 22 nt, Homo sapiens
agcaggcuggagcccagcauuc

SEQ ID NO: 1426500 - RNA, 17 nt, Homo sapiens
agcaguaccagugugcu

SEQ ID NO: 1426501 - RNA, 16 nt, Homo sapiens
agcagugguauuaaua

SEQ ID NO: 1426502 - RNA, 17 nt, Homo sapiens
agcauagggucuggaac

SEQ ID NO: 1426503 - RNA, 13 nt, Homo sapiens
agcaucugacuca

SEQ ID NO: 1426504 - RNA, 19 nt, Homo sapiens
agcaucugacucacaagaa

SEQ ID NO: 1426505 - RNA, 23 nt, Homo sapiens
agcaugaacuguccuuccauuug

SEQ ID NO: 1426506 - RNA, 15 nt, Homo sapiens
agcauggacucuggg

SEQ ID NO: 1426507 - RNA, 21 nt, Homo sapiens
agcauuuuacuacuuguuacc

SEQ ID NO: 1426508 - RNA, 21 nt, Homo sapiens
agcauuuucuugaaccaauaa

SEQ ID NO: 1426509 - RNA, 17 nt, Homo sapiens
agccaacacccugucua

SEQ ID NO: 1426510 - RNA, 23 nt, Homo sapiens
agccaagguagggucacuaacca

SEQ ID NO: 1426511 - RNA, 17 nt, Homo sapiens
agccacacuucucagga

SEQ ID NO: 1426512 - RNA, 14 nt, Homo sapiens
agccacgugaaugg

SEQ ID NO: 1426513 - RNA, 18 nt, Homo sapiens
agccacuaccuucugacc

SEQ ID NO: 1426514 - RNA, 14 nt, Homo sapiens
agccagacuggcac

SEQ ID NO: 1426515 - RNA, 22 nt, Homo sapiens
agccagauggaguaccaugagg

SEQ ID NO: 1426516 - RNA, 16 nt, Homo sapiens
agccagcaaugauguc

SEQ ID NO: 1426517 - RNA, 14 nt, Homo sapiens
agccagcccugccu

SEQ ID NO: 1426518 - RNA, 13 nt, Homo sapiens
agccaggagcaaa

SEQ ID NO: 1426519 - RNA, 17 nt, Homo sapiens
agccaggggcugcucau

SEQ ID NO: 1426520 - RNA, 20 nt, Homo sapiens
agccaguacagagaaauucu

SEQ ID NO: 1426521 - RNA, 18 nt, Homo sapiens
agccauaaagugccaguu

SEQ ID NO: 1426522 - RNA, 22 nt, Homo sapiens
agcugaagaaaaugaagcccua

SEQ ID NO: 1426523 - RNA, 15 nt, Homo sapiens
agcugagagacuuuu

SEQ ID NO: 1426524 - RNA, 16 nt, Homo sapiens
agcugagccuucugau

SEQ ID NO: 1426525 - RNA, 19 nt, Homo sapiens
agcugagccuucugaugag

SEQ ID NO: 1426526 - RNA, 19 nt, Homo sapiens
agcugcagaugccacaccu

SEQ ID NO: 1426527 - RNA, 15 nt, Homo sapiens
agcugcaucuacuca

SEQ ID NO: 1426528 - RNA, 17 nt, Homo sapiens
agcugccuuuuuuaaca

SEQ ID NO: 1426529 - RNA, 15 nt, Homo sapiens
agcugcucaaaucau

SEQ ID NO: 1426530 - RNA, 13 nt, Homo sapiens
agcugcugaagag

SEQ ID NO: 1426531 - RNA, 20 nt, Homo sapiens
agcuggaaauaaaccuggag

SEQ ID NO: 1426532 - RNA, 23 nt, Homo sapiens
agcuggaggacuagaaccuggag

SEQ ID NO: 1426533 - RNA, 19 nt, Homo sapiens
agcuggcaaagguggcucu

SEQ ID NO: 1426534 - RNA, 15 nt, Homo sapiens
agcugggaguagcau

SEQ ID NO: 1426535 - RNA, 18 nt, Homo sapiens
agcugguuggagagcuag

SEQ ID NO: 1426536 - RNA, 15 nt, Homo sapiens
agcuguaacuaacuc

SEQ ID NO: 1426537 - RNA, 22 nt, Homo sapiens
agcuguagcucccgagcuacuc

SEQ ID NO: 1426538 - RNA, 16 nt, Homo sapiens
agcugucgcaucucag

SEQ ID NO: 1426539 - RNA, 17 nt, Homo sapiens
agcugugaccugcugag

SEQ ID NO: 1426540 - RNA, 17 nt, Homo sapiens
agcuguuccacuucucu

SEQ ID NO: 1426541 - RNA, 23 nt, Homo sapiens
agcuuaaauaaauucaaaccauu

SEQ ID NO: 1426542 - RNA, 19 nt, Homo sapiens
aggcagcuggaugagacuu

SEQ ID NO: 1426543 - RNA, 17 nt, Homo sapiens
aggcaggagaauggugu

SEQ ID NO: 1426544 - RNA, 19 nt, Homo sapiens
aggcaggcucccccugccu

SEQ ID NO: 1426545 - RNA, 21 nt, Homo sapiens
aggcagugauuugccaaagug

SEQ ID NO: 1426546 - RNA, 22 nt, Homo sapiens
aggcauaaagacuaauuagcaa

SEQ ID NO: 1426547 - RNA, 22 nt, Homo sapiens
aggcauaagacccuaagccucc

SEQ ID NO: 1426548 - RNA, 14 nt, Homo sapiens
aggcauauacaaau

SEQ ID NO: 1426549 - RNA, 14 nt, Homo sapiens
aggcaugaacacac

SEQ ID NO: 1426550 - RNA, 22 nt, Homo sapiens
aggcaugagggaucacagggcc

SEQ ID NO: 1426551 - RNA, 21 nt, Homo sapiens
aggccaccuggccaggagcuu

SEQ ID NO: 1426552 - RNA, 20 nt, Homo sapiens
aggccacuugaugaccccca

SEQ ID NO: 1426553 - RNA, 23 nt, Homo sapiens
aggccagaaaacauaugcauuau

SEQ ID NO: 1426554 - RNA, 14 nt, Homo sapiens
aggccagagugcug

SEQ ID NO: 1426555 - RNA, 18 nt, Homo sapiens
aggccaggaaucugccau

SEQ ID NO: 1426556 - RNA, 14 nt, Homo sapiens
aggccagggacuca

SEQ ID NO: 1426557 - RNA, 14 nt, Homo sapiens
aggccauccauuca

SEQ ID NO: 1426558 - RNA, 17 nt, Homo sapiens
aggcccacuguccagca

SEQ ID NO: 1426559 - RNA, 22 nt, Homo sapiens
aggcccagaaagaggcagugau

SEQ ID NO: 1426560 - RNA, 18 nt, Homo sapiens
agguugucugaagucacu

SEQ ID NO: 1426561 - RNA, 17 nt, Homo sapiens
agguuucaagacuugau

SEQ ID NO: 1426562 - RNA, 16 nt, Homo sapiens
aguaaaaauacaagca

SEQ ID NO: 1426563 - RNA, 18 nt, Homo sapiens
aguaaaaccacagcaguu

SEQ ID NO: 1426564 - RNA, 13 nt, Homo sapiens
aguaaaccaaaaa

SEQ ID NO: 1426565 - RNA, 18 nt, Homo sapiens
aguaaacuuucucugcaa

SEQ ID NO: 1426566 - RNA, 20 nt, Homo sapiens
aguaaaggccucaucuccuu

SEQ ID NO: 1426567 - RNA, 17 nt, Homo sapiens
aguaacaggaaaccacu

SEQ ID NO: 1426568 - RNA, 19 nt, Homo sapiens
aguaacaggaaaccacuua

SEQ ID NO: 1426569 - RNA, 12 nt, Homo sapiens
aguaaguacaaa

SEQ ID NO: 1426570 - RNA, 18 nt, Homo sapiens
aguaaguacaaauauucc

SEQ ID NO: 1426571 - RNA, 15 nt, Homo sapiens
aguaaugcaaauuaa

SEQ ID NO: 1426572 - RNA, 15 nt, Homo sapiens
aguaauugauuugac

SEQ ID NO: 1426573 - RNA, 19 nt, Homo sapiens
aguaauugucaauaccccu

SEQ ID NO: 1426574 - RNA, 19 nt, Homo sapiens
aguacagacgucucaagac

SEQ ID NO: 1426575 - RNA, 20 nt, Homo sapiens
aguacagauguaaaugccac

SEQ ID NO: 1426576 - RNA, 13 nt, Homo sapiens
aguaccagugugc

SEQ ID NO: 1426577 - RNA, 15 nt, Homo sapiens
aguagaaauuguucc

SEQ ID NO: 1426578 - RNA, 19 nt, Homo sapiens
aguagcaaguucuagagaa

SEQ ID NO: 1426579 - RNA, 14 nt, Homo sapiens
aguagcuaaugaaa

SEQ ID NO: 1426580 - RNA, 14 nt, Homo sapiens
aguaggagcaagag

SEQ ID NO: 1426581 - RNA, 12 nt, Homo sapiens
aguagucucugu

SEQ ID NO: 1426582 - RNA, 21 nt, Homo sapiens
aguauauuuuccucccaguuc

SEQ ID NO: 1426583 - RNA, 12 nt, Homo sapiens
aguaucuuaccu

SEQ ID NO: 1426584 - RNA, 23 nt, Homo sapiens
aguaugguucucagaucuugaca

SEQ ID NO: 1426585 - RNA, 20 nt, Homo sapiens
aguauuaagugacagugcua

SEQ ID NO: 1426586 - RNA, 22 nt, Homo sapiens
aguauucuaaagcuuucugaca

SEQ ID NO: 1426587 - RNA, 18 nt, Homo sapiens
aguauugcgaaugugcag

SEQ ID NO: 1426588 - RNA, 20 nt, Homo sapiens
aguauugcgaaugugcagaa

SEQ ID NO: 1426589 - RNA, 14 nt, Homo sapiens
aguauuggggcccu

SEQ ID NO: 1426590 - RNA, 22 nt, Homo sapiens
aguauuuuauuaaagcaacauu

SEQ ID NO: 1426591 - RNA, 15 nt, Homo sapiens
agucaacacucuucu

SEQ ID NO: 1426592 - RNA, 16 nt, Homo sapiens
agucaaugaaaacuga

SEQ ID NO: 1426593 - RNA, 13 nt, Homo sapiens
agucaccaggaau

SEQ ID NO: 1426594 - RNA, 15 nt, Homo sapiens
agucacuuccagugu

SEQ ID NO: 1426595 - RNA, 20 nt, Homo sapiens
agucagacuuacuuacuccc

SEQ ID NO: 1426596 - RNA, 21 nt, Homo sapiens
agucaggacuugaacccaggu

SEQ ID NO: 1426597 - RNA, 13 nt, Homo sapiens
agucaugcacuca

SEQ ID NO: 1426598 - RNA, 14 nt, Homo sapiens
agucaugcacucag

SEQ ID NO: 1426599 - RNA, 15 nt, Homo sapiens
agucauucugggaac

SEQ ID NO: 1426600 - RNA, 16 nt, Homo sapiens
aguccaaaugugauca

SEQ ID NO: 1426601 - RNA, 15 nt, Homo sapiens
aguccaaccugccug

SEQ ID NO: 1426602 - RNA, 20 nt, Homo sapiens
aguccacaucuucucagugu

SEQ ID NO: 1426603 - RNA, 17 nt, Homo sapiens
agucccguggaggguag

SEQ ID NO: 1426604 - RNA, 21 nt, Homo sapiens
agucccucccaucucuacccc

SEQ ID NO: 1426605 - RNA, 12 nt, Homo sapiens
aguccucugcau

SEQ ID NO: 1426606 - RNA, 24 nt, Homo sapiens
aguccugggaauaugcuagugaug

SEQ ID NO: 1426607 - RNA, 22 nt, Homo sapiens
aguccuuuacuaauccaaccca

SEQ ID NO: 1426608 - RNA, 20 nt, Homo sapiens
agucgaauguuagauuccuc

SEQ ID NO: 1426609 - RNA, 13 nt, Homo sapiens
agucguaaggguu

SEQ ID NO: 1426610 - RNA, 13 nt, Homo sapiens
agucucugcugcu

SEQ ID NO: 1426611 - RNA, 14 nt, Homo sapiens
agucucugcugcua

SEQ ID NO: 1426612 - RNA, 11 nt, Homo sapiens
agucucugugc

SEQ ID NO: 1426613 - RNA, 22 nt, Homo sapiens
agucugagaaugcccaacucuu

SEQ ID NO: 1426614 - RNA, 23 nt, Homo sapiens
agucuuaaaauaacuuauaucau

SEQ ID NO: 1426615 - RNA, 13 nt, Homo sapiens
agucuugucagaa

SEQ ID NO: 1426616 - RNA, 18 nt, Homo sapiens
agugaaagagaguaccau

SEQ ID NO: 1426617 - RNA, 13 nt, Homo sapiens
agugaacacacuc

SEQ ID NO: 1426618 - RNA, 14 nt, Homo sapiens
agugaacacacuca

SEQ ID NO: 1426619 - RNA, 17 nt, Homo sapiens
agugaacacacucagca

SEQ ID NO: 1426620 - RNA, 13 nt, Homo sapiens
agugaaccaaaga

SEQ ID NO: 1426621 - RNA, 23 nt, Homo sapiens
agugaacuauuucuacacagugg

SEQ ID NO: 1426622 - RNA, 15 nt, Homo sapiens
agugaagacuucuug

SEQ ID NO: 1426623 - RNA, 16 nt, Homo sapiens
agugacccacaugcca

SEQ ID NO: 1426624 - RNA, 17 nt, Homo sapiens
agugacgggagccuccu

SEQ ID NO: 1426625 - RNA, 16 nt, Homo sapiens
agugacuccaagaaca

SEQ ID NO: 1426626 - RNA, 17 nt, Homo sapiens
agugacuuuacaggagg

SEQ ID NO: 1426627 - RNA, 20 nt, Homo sapiens
agugagagagagaauaagga

SEQ ID NO: 1426628 - RNA, 15 nt, Homo sapiens
agugagaucuuacag

SEQ ID NO: 1426629 - RNA, 22 nt, Homo sapiens
agugagccugaauuuuguugcu

SEQ ID NO: 1426630 - RNA, 22 nt, Homo sapiens
agugauaucccccagccucaag

SEQ ID NO: 1426631 - RNA, 19 nt, Homo sapiens
agugauccacccaccucag

SEQ ID NO: 1426632 - RNA, 20 nt, Homo sapiens
agugauguuguuugggagag

SEQ ID NO: 1426633 - RNA, 17 nt, Homo sapiens
agugauuucauucugcc

SEQ ID NO: 1426634 - RNA, 19 nt, Homo sapiens
agugcaaccacacaccuca

SEQ ID NO: 1426635 - RNA, 19 nt, Homo sapiens
agugcaagagacucuggcc

SEQ ID NO: 1426636 - RNA, 23 nt, Homo sapiens
agugcacacggaugcacagagau

SEQ ID NO: 1426637 - RNA, 12 nt, Homo sapiens
agugcaccacuu

SEQ ID NO: 1426638 - RNA, 23 nt, Homo sapiens
agugcaucugggaagauuucuac

SEQ ID NO: 1426639 - RNA, 14 nt, Homo sapiens
agugccuaccccag

SEQ ID NO: 1426640 - RNA, 18 nt, Homo sapiens
agugccuggcaaggccuc

SEQ ID NO: 1426641 - RNA, 17 nt, Homo sapiens
agugcuaugccaagcca

SEQ ID NO: 1426642 - RNA, 14 nt, Homo sapiens
aguggaacagucac

SEQ ID NO: 1426643 - RNA, 14 nt, Homo sapiens
aguggcagccaugc

SEQ ID NO: 1426644 - RNA, 20 nt, Homo sapiens
aguggccaugccacccuguu

SEQ ID NO: 1426645 - RNA, 21 nt, Homo sapiens
aggugagaugggacauuccaa

SEQ ID NO: 1426646 - RNA, 19 nt, Homo sapiens
aggugagccggcucugccu

SEQ ID NO: 1426647 - RNA, 21 nt, Homo sapiens
aggugagugcuugucauggaa

SEQ ID NO: 1426648 - RNA, 13 nt, Homo sapiens
aggugcaagccac

SEQ ID NO: 1426649 - RNA, 15 nt, Homo sapiens
aggugcccaggagaa

SEQ ID NO: 1426650 - RNA, 20 nt, Homo sapiens
aggugccuuguaaacaugaa

SEQ ID NO: 1426651 - RNA, 18 nt, Homo sapiens
aggugcuacaaaaacaca

SEQ ID NO: 1426652 - RNA, 19 nt, Homo sapiens
aggugcuaucgcaccacug

SEQ ID NO: 1426653 - RNA, 19 nt, Homo sapiens
agguggcaggaccaggacu

SEQ ID NO: 1426654 - RNA, 16 nt, Homo sapiens
aggugggaaaugguau

SEQ ID NO: 1426655 - RNA, 13 nt, Homo sapiens
agguggugccuuc

SEQ ID NO: 1426656 - RNA, 13 nt, Homo sapiens
aggugugccaaac

SEQ ID NO: 1426657 - RNA, 21 nt, Homo sapiens
agguuccucgcaggucucagc

SEQ ID NO: 1426658 - RNA, 22 nt, Homo sapiens
agguucuugaugucauguacuu

SEQ ID NO: 1426659 - RNA, 13 nt, Homo sapiens
agguugcagugag

SEQ ID NO: 1426660 - RNA, 14 nt, Homo sapiens
agguuggugacuga

SEQ ID NO: 1426661 - RNA, 17 nt, Homo sapiens
aguggcuucugggagau

SEQ ID NO: 1426662 - RNA, 21 nt, Homo sapiens
aguggcuugugauucugggau

SEQ ID NO: 1426663 - RNA, 24 nt, Homo sapiens
agugggugguggaucuguccaagg

SEQ ID NO: 1426664 - RNA, 20 nt, Homo sapiens
aguggugcagucuuggcuca

SEQ ID NO: 1426665 - RNA, 19 nt, Homo sapiens
aguguaaagaauaaaugaa

SEQ ID NO: 1426666 - RNA, 14 nt, Homo sapiens
aguguaagcacuuc

SEQ ID NO: 1426667 - RNA, 22 nt, Homo sapiens
aguguaccgcgucuacccuggg

SEQ ID NO: 1426668 - RNA, 18 nt, Homo sapiens
aguguagggcaacaauac

SEQ ID NO: 1426669 - RNA, 19 nt, Homo sapiens
aguguccccuccacuguca

SEQ ID NO: 1426670 - RNA, 17 nt, Homo sapiens
aguguccucuugcucaa

SEQ ID NO: 1426671 - RNA, 18 nt, Homo sapiens
aguguccucuugcucaaa

SEQ ID NO: 1426672 - RNA, 23 nt, Homo sapiens
agugugaguggcagccaugccuc

SEQ ID NO: 1426673 - RNA, 15 nt, Homo sapiens
agugugcugcaugga

SEQ ID NO: 1426674 - RNA, 15 nt, Homo sapiens
aguguggaagcagaa

SEQ ID NO: 1426675 - RNA, 16 nt, Homo sapiens
agugugggcauagcau

SEQ ID NO: 1426676 - RNA, 18 nt, Homo sapiens
agugugggcauagcauua

SEQ ID NO: 1426677 - RNA, 17 nt, Homo sapiens
aguuaggucauuacuaa

SEQ ID NO: 1426678 - RNA, 23 nt, Homo sapiens
aguuaggucauuacuaaccauag

SEQ ID NO: 1426679 - RNA, 16 nt, Homo sapiens
aguuauuaaacagugu

SEQ ID NO: 1426680 - RNA, 20 nt, Homo sapiens
aguucaaauuuugcauugug

SEQ ID NO: 1426681 - RNA, 21 nt, Homo sapiens
aguucagccagaaucuucguc

SEQ ID NO: 1426682 - RNA, 11 nt, Homo sapiens
aguucagggaa

SEQ ID NO: 1426683 - RNA, 18 nt, Homo sapiens
aguuccccucuacuccau

SEQ ID NO: 1426684 - RNA, 17 nt, Homo sapiens
aguucgaccugcggcug

SEQ ID NO: 1426685 - RNA, 13 nt, Homo sapiens
aguucuaucagga

SEQ ID NO: 1426686 - RNA, 15 nt, Homo sapiens
aguucugaacuggaa

SEQ ID NO: 1426687 - RNA, 19 nt, Homo sapiens
aguucuggcugaacacugg

SEQ ID NO: 1426688 - RNA, 16 nt, Homo sapiens
aguugaccguuuucau

SEQ ID NO: 1426689 - RNA, 13 nt, Homo sapiens
aguugcagucuca

SEQ ID NO: 1426690 - RNA, 16 nt, Homo sapiens
aguugcuucucaugga

SEQ ID NO: 1426691 - RNA, 13 nt, Homo sapiens
aguuggagaccag

SEQ ID NO: 1426692 - RNA, 20 nt, Homo sapiens
aguuguuuuggugccugccu

SEQ ID NO: 1426693 - RNA, 14 nt, Homo sapiens
aguuuaucauguca

SEQ ID NO: 1426694 - RNA, 14 nt, Homo sapiens
aguuuaugauuuaa

SEQ ID NO: 1426695 - RNA, 15 nt, Homo sapiens
aguuuauugacaaua

SEQ ID NO: 1426696 - RNA, 19 nt, Homo sapiens
aguuuauuggaaguguuca

SEQ ID NO: 1426697 - RNA, 21 nt, Homo sapiens
aguuucucagcucccaaggcu

SEQ ID NO: 1426698 - RNA, 14 nt, Homo sapiens
aguuugaccucaca

SEQ ID NO: 1426699 - RNA, 14 nt, Homo sapiens
aguuugaucaaauc

SEQ ID NO: 1426700 - RNA, 18 nt, Homo sapiens
aguuuggaaguguuaacu

SEQ ID NO: 1426701 - RNA, 20 nt, Homo sapiens
aguuuggcugguuaauucca

SEQ ID NO: 1426702 - RNA, 22 nt, Homo sapiens
aguuuguuuuuaaaaaaaucua

SEQ ID NO: 1426703 - RNA, 13 nt, Homo sapiens
aguuuuccucaau

SEQ ID NO: 1426704 - RNA, 14 nt, Homo sapiens
aguuuugccuuaaa

SEQ ID NO: 1426705 - RNA, 22 nt, Homo sapiens
auaaaacgcaaagggcugaaag

SEQ ID NO: 1426706 - RNA, 18 nt, Homo sapiens
auaaaagauguacuugug

SEQ ID NO: 1426707 - RNA, 15 nt, Homo sapiens
auaaaauaaugaacu

SEQ ID NO: 1426708 - RNA, 17 nt, Homo sapiens
auaaaauaguuguccau

SEQ ID NO: 1426709 - RNA, 19 nt, Homo sapiens
auaaaaucugugaauuaaa

SEQ ID NO: 1426710 - RNA, 14 nt, Homo sapiens
auaaaaucuuacuu

SEQ ID NO: 1426711 - RNA, 14 nt, Homo sapiens
auaaacuagaucuc

SEQ ID NO: 1426712 - RNA, 17 nt, Homo sapiens
auaaagaauauuuacaa

SEQ ID NO: 1426713 - RNA, 13 nt, Homo sapiens
auaaagacugaga

SEQ ID NO: 1426714 - RNA, 14 nt, Homo sapiens
auaaagacugagac

SEQ ID NO: 1426715 - RNA, 14 nt, Homo sapiens
auaaagcccuugaa

SEQ ID NO: 1426716 - RNA, 15 nt, Homo sapiens
auaaagcccuugaac

SEQ ID NO: 1426717 - RNA, 18 nt, Homo sapiens
auaaagcccuugaaccag

SEQ ID NO: 1426718 - RNA, 23 nt, Homo sapiens
auaaaggugauugauuguauugc

SEQ ID NO: 1426719 - RNA, 19 nt, Homo sapiens
auaaagguuuuugaauuca

SEQ ID NO: 1426720 - RNA, 15 nt, Homo sapiens
auaaauagaguucca

SEQ ID NO: 1426721 - RNA, 15 nt, Homo sapiens
auaaaucaguuaugu

SEQ ID NO: 1426722 - RNA, 23 nt, Homo sapiens
auaaauccucagguaguacuggg

SEQ ID NO: 1426723 - RNA, 12 nt, Homo sapiens
auaaaugaaucu

SEQ ID NO: 1426724 - RNA, 22 nt, Homo sapiens
auaaaugcaugauuuuauacau

SEQ ID NO: 1426725 - RNA, 18 nt, Homo sapiens
auaaauguguggugcuaa

SEQ ID NO: 1426726 - RNA, 13 nt, Homo sapiens
auaaauguuuaaa

SEQ ID NO: 1426727 - RNA, 14 nt, Homo sapiens
auaaauucaaacca

SEQ ID NO: 1426728 - RNA, 22 nt, Homo sapiens
auaaauuggugauaaguggaaa

SEQ ID NO: 1426729 - RNA, 17 nt, Homo sapiens
auaaauuuuaacauuuu

SEQ ID NO: 1426730 - RNA, 19 nt, Homo sapiens
auaacaaccccggacaaau

SEQ ID NO: 1426731 - RNA, 20 nt, Homo sapiens
auaacaagaucuuucaggaa

SEQ ID NO: 1426732 - RNA, 18 nt, Homo sapiens
auaaccccaggcauccca

SEQ ID NO: 1426733 - RNA, 18 nt, Homo sapiens
auaacuaguguugcuugg

SEQ ID NO: 1426734 - RNA, 18 nt, Homo sapiens
auauguauauacauauca

SEQ ID NO: 1426735 - RNA, 15 nt, Homo sapiens
auauguauauauaug

SEQ ID NO: 1426736 - RNA, 16 nt, Homo sapiens
auauguauuuuuguca

SEQ ID NO: 1426737 - RNA, 14 nt, Homo sapiens
auaugucuagcuca

SEQ ID NO: 1426738 - RNA, 20 nt, Homo sapiens
auauuaaaacugcacugcca

SEQ ID NO: 1426739 - RNA, 23 nt, Homo sapiens
auauuacuuguuuucacuuuauc

SEQ ID NO: 1426740 - RNA, 22 nt, Homo sapiens
auauuaucacgcagaucacuaa

SEQ ID NO: 1426741 - RNA, 20 nt, Homo sapiens
auauucagauauaaaacagu

SEQ ID NO: 1426742 - RNA, 12 nt, Homo sapiens
auauucccugac

SEQ ID NO: 1426743 - RNA, 18 nt, Homo sapiens
auauuccugcauuuguga

SEQ ID NO: 1426744 - RNA, 15 nt, Homo sapiens
auauugcugugagau

SEQ ID NO: 1426745 - RNA, 18 nt, Homo sapiens
auauugcugugagauugc

SEQ ID NO: 1426746 - RNA, 22 nt, Homo sapiens
auauugucugaacggcugaaua

SEQ ID NO: 1426747 - RNA, 12 nt, Homo sapiens
auauuuacuacu

SEQ ID NO: 1426748 - RNA, 17 nt, Homo sapiens
auauuuauucaucuggg

SEQ ID NO: 1426749 - RNA, 16 nt, Homo sapiens
auauuucccaauacau

SEQ ID NO: 1426750 - RNA, 16 nt, Homo sapiens
auauuugaauaucauu

SEQ ID NO: 1426751 - RNA, 17 nt, Homo sapiens
auauuuguguaugugua

SEQ ID NO: 1426752 - RNA, 16 nt, Homo sapiens
auauuuuagccuuaaa

SEQ ID NO: 1426753 - RNA, 13 nt, Homo sapiens
auauuuucacaug

SEQ ID NO: 1426754 - RNA, 17 nt, Homo sapiens
auauuuuucaaccagca

SEQ ID NO: 1426755 - RNA, 18 nt, Homo sapiens
aucaaauauuaccaaaaa

SEQ ID NO: 1426756 - RNA, 13 nt, Homo sapiens
aucaaaugcugua

SEQ ID NO: 1426757 - RNA, 12 nt, Homo sapiens
aucaaauuucac

SEQ ID NO: 1426758 - RNA, 17 nt, Homo sapiens
aucaagcccuuuacuug

SEQ ID NO: 1426759 - RNA, 21 nt, Homo sapiens
aucaaugaagauuuuuaauua

SEQ ID NO: 1426760 - RNA, 15 nt, Homo sapiens
aucaaugucaaguac

SEQ ID NO: 1426761 - RNA, 23 nt, Homo sapiens
aucacagggccccagaaggcagg

SEQ ID NO: 1426762 - RNA, 21 nt, Homo sapiens
aucacaguguuugcaauggug

SEQ ID NO: 1426763 - RNA, 20 nt, Homo sapiens
aucaccagcauauuguguuc

SEQ ID NO: 1426764 - RNA, 18 nt, Homo sapiens
aucaccauguaacaacca

SEQ ID NO: 1426765 - RNA, 15 nt, Homo sapiens
aucaccucucuucag

SEQ ID NO: 1426766 - RNA, 19 nt, Homo sapiens
aucacguacaccauaugca

SEQ ID NO: 1426767 - RNA, 23 nt, Homo sapiens
aucacuagccaugauaacugcaa

SEQ ID NO: 1426768 - RNA, 16 nt, Homo sapiens
aucagaccacucccuu

SEQ ID NO: 1426769 - RNA, 17 nt, Homo sapiens
aucagacuccugugcaa

SEQ ID NO: 1426770 - RNA, 13 nt, Homo sapiens
aucagcacugccg

SEQ ID NO: 1426771 - RNA, 20 nt, Homo sapiens
aucagccuccgccauuccaa

SEQ ID NO: 1426772 - RNA, 21 nt, Homo sapiens
aucagcuucaaggaguaugca

SEQ ID NO: 1426773 - RNA, 20 nt, Homo sapiens
aucaggaaaacaaaucacug

SEQ ID NO: 1426774 - RNA, 13 nt, Homo sapiens
aucaggguuugca

SEQ ID NO: 1426775 - RNA, 12 nt, Homo sapiens
aucaggucuccc

SEQ ID NO: 1426776 - RNA, 11 nt, Homo sapiens
aucagugaugg

SEQ ID NO: 1426777 - RNA, 13 nt, Homo sapiens
aucaguggcugcc

SEQ ID NO: 1426778 - RNA, 21 nt, Homo sapiens
aucaguuaacauuaacaucua

SEQ ID NO: 1426779 - RNA, 15 nt, Homo sapiens
aucauaaccauguga

SEQ ID NO: 1426780 - RNA, 16 nt, Homo sapiens
aucauacaugacucag

SEQ ID NO: 1426781 - RNA, 18 nt, Homo sapiens
aucauauugaauguuucc

SEQ ID NO: 1426782 - RNA, 21 nt, Homo sapiens
aucauauugguauucacuaau

SEQ ID NO: 1426783 - RNA, 23 nt, Homo sapiens
aucaugacccacccagugucuuu

SEQ ID NO: 1426784 - RNA, 16 nt, Homo sapiens
aucauggcaacauaau

SEQ ID NO: 1426785 - RNA, 18 nt, Homo sapiens
aucauggcagugaugaaa

SEQ ID NO: 1426786 - RNA, 19 nt, Homo sapiens
aucauguuaccauuacaaa

SEQ ID NO: 1426787 - RNA, 21 nt, Homo sapiens
aucauguuggauagucagcug

SEQ ID NO: 1426788 - RNA, 13 nt, Homo sapiens
aucauuccuugag

SEQ ID NO: 1426789 - RNA, 22 nt, Homo sapiens
aucauuuauuuacaucuaugua

SEQ ID NO: 1426790 - RNA, 18 nt, Homo sapiens
aucauuucugcaucagcu

SEQ ID NO: 1426791 - RNA, 18 nt, Homo sapiens
auccaaguuauuaaucuu

SEQ ID NO: 1426792 - RNA, 20 nt, Homo sapiens
auccacccucaaaugucaga

SEQ ID NO: 1426793 - RNA, 17 nt, Homo sapiens
auccacgcacacaugga

SEQ ID NO: 1426794 - RNA, 16 nt, Homo sapiens
auccacggagcugaag

SEQ ID NO: 1426795 - RNA, 21 nt, Homo sapiens
auccagaagguuugcaccccu

SEQ ID NO: 1426796 - RNA, 17 nt, Homo sapiens
auccaggacucugucaa

SEQ ID NO: 1426797 - RNA, 15 nt, Homo sapiens
auccaggugggagag

SEQ ID NO: 1426798 - RNA, 21 nt, Homo sapiens
auccaguuucccaccaccuug

SEQ ID NO: 1426799 - RNA, 19 nt, Homo sapiens
auccccagccuacugccuc

SEQ ID NO: 1426800 - RNA, 19 nt, Homo sapiens
aucccccagccucaagucu

SEQ ID NO: 1426801 - RNA, 19 nt, Homo sapiens
aucccggaagggacuuacu

SEQ ID NO: 1426802 - RNA, 21 nt, Homo sapiens
aucccggaagggacuuacuua

SEQ ID NO: 1426803 - RNA, 16 nt, Homo sapiens
aucccuccucacuugc

SEQ ID NO: 1426804 - RNA, 21 nt, Homo sapiens
aucccugaaggccuucaaccc

SEQ ID NO: 1426805 - RNA, 20 nt, Homo sapiens
aucccugcagccugguagaa

SEQ ID NO: 1426806 - RNA, 22 nt, Homo sapiens
aucccuucccuguccaccucac

SEQ ID NO: 1426807 - RNA, 12 nt, Homo sapiens
aucccuuuccag

SEQ ID NO: 1426808 - RNA, 16 nt, Homo sapiens
auccggcuccugucau

SEQ ID NO: 1426809 - RNA, 14 nt, Homo sapiens
auccuaggugcugg

SEQ ID NO: 1426810 - RNA, 16 nt, Homo sapiens
auccuauuauguguuc

SEQ ID NO: 1426811 - RNA, 20 nt, Homo sapiens
caaagaauuuuuuuuaacau

SEQ ID NO: 1426812 - RNA, 15 nt, Homo sapiens
caaagcaacuggaua

SEQ ID NO: 1426813 - RNA, 21 nt, Homo sapiens
caaagcaggguucugaggcaa

SEQ ID NO: 1426814 - RNA, 14 nt, Homo sapiens
caaagcuaccugug

SEQ ID NO: 1426815 - RNA, 21 nt, Homo sapiens
caaaggcauccauagugcacu

SEQ ID NO: 1426816 - RNA, 13 nt, Homo sapiens
caaaggcucccug

SEQ ID NO: 1426817 - RNA, 23 nt, Homo sapiens
caaagggaacugaagaccuccac

SEQ ID NO: 1426818 - RNA, 18 nt, Homo sapiens
caaagggcccacagugac

SEQ ID NO: 1426819 - RNA, 12 nt, Homo sapiens
caaaguaaaaaa

SEQ ID NO: 1426820 - RNA, 23 nt, Homo sapiens
caaagucaauuaaaggcuuucag

SEQ ID NO: 1426821 - RNA, 15 nt, Homo sapiens
caaauaaaguaccau

SEQ ID NO: 1426822 - RNA, 17 nt, Homo sapiens
caaauaaauguguaaau

SEQ ID NO: 1426823 - RNA, 18 nt, Homo sapiens
caaauagaaaucagcaca

SEQ ID NO: 1426824 - RNA, 21 nt, Homo sapiens
caaauaugcaaagcacugacu

SEQ ID NO: 1426825 - RNA, 16 nt, Homo sapiens
caaauauuaccaaaaa

SEQ ID NO: 1426826 - RNA, 21 nt, Homo sapiens
caaauccccggcugcuuccuu

SEQ ID NO: 1426827 - RNA, 21 nt, Homo sapiens
caaaugccuccaagccauuca

SEQ ID NO: 1426828 - RNA, 12 nt, Homo sapiens
caaaugcuauau

SEQ ID NO: 1426829 - RNA, 16 nt, Homo sapiens
caaaugcuauauugca

SEQ ID NO: 1426830 - RNA, 20 nt, Homo sapiens
caaaugcuguagaaugcuug

SEQ ID NO: 1426831 - RNA, 21 nt, Homo sapiens
caaauguaauuaugaggugaa

SEQ ID NO: 1426832 - RNA, 21 nt, Homo sapiens
caaaugucagagcuauguucc

SEQ ID NO: 1426833 - RNA, 15 nt, Homo sapiens
caaauugcuacauag

SEQ ID NO: 1426834 - RNA, 19 nt, Homo sapiens
caaauuguaguucuugucu

SEQ ID NO: 1426835 - RNA, 17 nt, Homo sapiens
caaauuuuuacugagaa

SEQ ID NO: 1426836 - RNA, 16 nt, Homo sapiens
caacaacaaaccaaaa

SEQ ID NO: 1426837 - RNA, 18 nt, Homo sapiens
caacaacauccauguccu

SEQ ID NO: 1426838 - RNA, 15 nt, Homo sapiens
caacaaccaugccag

SEQ ID NO: 1426839 - RNA, 15 nt, Homo sapiens
caacaagaauauugu

SEQ ID NO: 1426840 - RNA, 17 nt, Homo sapiens
caacacccaaagcaugg

SEQ ID NO: 1426841 - RNA, 23 nt, Homo sapiens
caacaccuucuuggcuucuggga

SEQ ID NO: 1426842 - RNA, 23 nt, Homo sapiens
caacagcaccaauuguacauucc

SEQ ID NO: 1426843 - RNA, 23 nt, Homo sapiens
caacaggcuguucugcacugaaa

SEQ ID NO: 1426844 - RNA, 18 nt, Homo sapiens
caacagugagucugucag

SEQ ID NO: 1426845 - RNA, 12 nt, Homo sapiens
caacaguuccuu

SEQ ID NO: 1426846 - RNA, 14 nt, Homo sapiens
caacaguuccuuca

SEQ ID NO: 1426847 - RNA, 12 nt, Homo sapiens
caacauaucauu

SEQ ID NO: 1426848 - RNA, 16 nt, Homo sapiens
caacaucccacagugg

SEQ ID NO: 1426849 - RNA, 14 nt, Homo sapiens
caacaucccauugc

SEQ ID NO: 1426850 - RNA, 20 nt, Homo sapiens
caacaucuuuuuccucccuu

SEQ ID NO: 1426851 - RNA, 21 nt, Homo sapiens
caacauuacuccauuacuaaa

SEQ ID NO: 1426852 - RNA, 23 nt, Homo sapiens
caacauuacuccauuacuaaaga

SEQ ID NO: 1426853 - RNA, 16 nt, Homo sapiens
caacauuuuuggugua

SEQ ID NO: 1426854 - RNA, 20 nt, Homo sapiens
caaccaauuccaaguuuuaa

SEQ ID NO: 1426855 - RNA, 15 nt, Homo sapiens
caaccacacaccuca

SEQ ID NO: 1426856 - RNA, 17 nt, Homo sapiens
caaccagagaugacuga

SEQ ID NO: 1426857 - RNA, 14 nt, Homo sapiens
caacccaccaucua

SEQ ID NO: 1426858 - RNA, 21 nt, Homo sapiens
caacccgugccaaguccaggu

SEQ ID NO: 1426859 - RNA, 17 nt, Homo sapiens
caaccuaaccccuuucc

SEQ ID NO: 1426860 - RNA, 13 nt, Homo sapiens
caaccuaugguau

SEQ ID NO: 1426861 - RNA, 19 nt, Homo sapiens
caaccucaaugcccugcca

SEQ ID NO: 1426862 - RNA, 22 nt, Homo sapiens
caaccugaugccccuuccccaa

SEQ ID NO: 1426863 - RNA, 13 nt, Homo sapiens
caaccugggaugu

SEQ ID NO: 1426864 - RNA, 22 nt, Homo sapiens
caaccugggauguagcggugaa

SEQ ID NO: 1426865 - RNA, 15 nt, Homo sapiens
caacgagagcacuug

SEQ ID NO: 1426866 - RNA, 16 nt, Homo sapiens
caacggcuuagacuuc

SEQ ID NO: 1426867 - RNA, 18 nt, Homo sapiens
caacucagaaugcucuac

SEQ ID NO: 1426868 - RNA, 16 nt, Homo sapiens
caacuccuccuugccu

SEQ ID NO: 1426869 - RNA, 17 nt, Homo sapiens
caacuccuccuugccug

SEQ ID NO: 1426870 - RNA, 20 nt, Homo sapiens
caacuccugguucagccauu

SEQ ID NO: 1426871 - RNA, 22 nt, Homo sapiens
caacucucuccuguauaaucuc

SEQ ID NO: 1426872 - RNA, 20 nt, Homo sapiens
caacugaaaagacucagugu

SEQ ID NO: 1426873 - RNA, 13 nt, Homo sapiens
caacugaccagcc

SEQ ID NO: 1426874 - RNA, 19 nt, Homo sapiens
caacuuguguucuauuaau

SEQ ID NO: 1426875 - RNA, 23 nt, Homo sapiens
caacuuuucucauguugaagcca

SEQ ID NO: 1426876 - RNA, 14 nt, Homo sapiens
caacuuuugugcuc

SEQ ID NO: 1426877 - RNA, 12 nt, Homo sapiens
caagaaacagaa

SEQ ID NO: 1426878 - RNA, 14 nt, Homo sapiens
caagaaguacauga

SEQ ID NO: 1426879 - RNA, 18 nt, Homo sapiens
caagaauuguccaugugc

SEQ ID NO: 1426880 - RNA, 22 nt, Homo sapiens
caagaccuucuccccauucugc

SEQ ID NO: 1426881 - RNA, 15 nt, Homo sapiens
caagacuuccaggua

SEQ ID NO: 1426882 - RNA, 14 nt, Homo sapiens
caagagacacugcu

SEQ ID NO: 1426883 - RNA, 20 nt, Homo sapiens
caagagcaucaugccucuga

SEQ ID NO: 1426884 - RNA, 23 nt, Homo sapiens
caagauaaaggaagucaccaaaa

SEQ ID NO: 1426885 - RNA, 20 nt, Homo sapiens
caagaucgcgccacugcacu

SEQ ID NO: 1426886 - RNA, 19 nt, Homo sapiens
caagaucugaaauaaauga

SEQ ID NO: 1426887 - RNA, 16 nt, Homo sapiens
caagauuucacaucag

SEQ ID NO: 1426888 - RNA, 22 nt, Homo sapiens
caagcaagaggugguagaacca

SEQ ID NO: 1426889 - RNA, 14 nt, Homo sapiens
caagcaaggccaaa

SEQ ID NO: 1426890 - RNA, 19 nt, Homo sapiens
caagcaagggcugugcuga

SEQ ID NO: 1426891 - RNA, 20 nt, Homo sapiens
caagcauaccaacacgagca

SEQ ID NO: 1426892 - RNA, 18 nt, Homo sapiens
caagccacagaagccagg

SEQ ID NO: 1426893 - RNA, 17 nt, Homo sapiens
caagccccucagcccuu

SEQ ID NO: 1426894 - RNA, 16 nt, Homo sapiens
caagccugccuaggaa

SEQ ID NO: 1426895 - RNA, 20 nt, Homo sapiens
cacacagauauacacaugga

SEQ ID NO: 1426896 - RNA, 21 nt, Homo sapiens
cacacagauauacacauggau

SEQ ID NO: 1426897 - RNA, 15 nt, Homo sapiens
cacacagaugcacac

SEQ ID NO: 1426898 - RNA, 20 nt, Homo sapiens
cacacagaugcacacacaga

SEQ ID NO: 1426899 - RNA, 20 nt, Homo sapiens
cacacagggugcaugugagg

SEQ ID NO: 1426900 - RNA, 20 nt, Homo sapiens
cacacagucucaguccagau

SEQ ID NO: 1426901 - RNA, 22 nt, Homo sapiens
cacgcacauagagauaugcaca

SEQ ID NO: 1426902 - RNA, 22 nt, Homo sapiens
cacgccuguaaucccagcacuu

SEQ ID NO: 1426903 - RNA, 22 nt, Homo sapiens
cacggagcugaagcugggagcu

SEQ ID NO: 1426904 - RNA, 17 nt, Homo sapiens
cacggauccauguagca

SEQ ID NO: 1426905 - RNA, 16 nt, Homo sapiens
cacggaugcacacaca

SEQ ID NO: 1426906 - RNA, 15 nt, Homo sapiens
cacggaugcacagag

SEQ ID NO: 1426907 - RNA, 16 nt, Homo sapiens
cacggaugcacagaga

SEQ ID NO: 1426908 - RNA, 19 nt, Homo sapiens
cacggcagcuguagcuccc

SEQ ID NO: 1426909 - RNA, 18 nt, Homo sapiens
ccugacgacacugaagaa

SEQ ID NO: 1426910 - RNA, 18 nt, Homo sapiens
ccugacggacguccugcu

SEQ ID NO: 1426911 - RNA, 13 nt, Homo sapiens
ccugagaccaguu

SEQ ID NO: 1426912 - RNA, 20 nt, Homo sapiens
ccugagcccaggagguggag

SEQ ID NO: 1426913 - RNA, 20 nt, Homo sapiens
ccugaggguggagacuaagc

SEQ ID NO: 1426914 - RNA, 24 nt, Homo sapiens
ccugauaaacauuaaacacuguaa

SEQ ID NO: 1426915 - RNA, 20 nt, Homo sapiens
ccugauaacaaccuggagac

SEQ ID NO: 1426916 - RNA, 12 nt, Homo sapiens
ccugauaagcaa

SEQ ID NO: 1426917 - RNA, 22 nt, Homo sapiens
ccugaucauggucagcucacac

SEQ ID NO: 1426918 - RNA, 14 nt, Homo sapiens
ccugauuucucuga

SEQ ID NO: 1426919 - RNA, 23 nt, Homo sapiens
ccugcaccgagagagauggaaua

SEQ ID NO: 1426920 - RNA, 18 nt, Homo sapiens
ccugccaccagucacugu

SEQ ID NO: 1426921 - RNA, 16 nt, Homo sapiens
ccugccacuuugcaug

SEQ ID NO: 1426922 - RNA, 16 nt, Homo sapiens
ccugccucucugcucc

SEQ ID NO: 1426923 - RNA, 17 nt, Homo sapiens
ccugccucucugcucca

SEQ ID NO: 1426924 - RNA, 22 nt, Homo sapiens
ccugccuggguuuucuaacugu

SEQ ID NO: 1426925 - RNA, 20 nt, Homo sapiens
ccugccuguagcagugagaa

SEQ ID NO: 1426926 - RNA, 14 nt, Homo sapiens
ccugcgauuuugcc

SEQ ID NO: 1426927 - RNA, 23 nt, Homo sapiens
ccugcgugccgggagaggacucu

SEQ ID NO: 1426928 - RNA, 21 nt, Homo sapiens
ccugcuaccaaggcccagcua

SEQ ID NO: 1426929 - RNA, 19 nt, Homo sapiens
ccugcuccaucaugcuuga

SEQ ID NO: 1426930 - RNA, 10 nt, Homo sapiens
ccugcuggaa

SEQ ID NO: 1426931 - RNA, 20 nt, Homo sapiens
ccuggaccuuuugucucaca

SEQ ID NO: 1426932 - RNA, 22 nt, Homo sapiens
ccuggaggugggagacaaggaa

SEQ ID NO: 1426933 - RNA, 21 nt, Homo sapiens
ccuggaugaucacuaauacua

SEQ ID NO: 1426934 - RNA, 13 nt, Homo sapiens
ccuggauguugcu

SEQ ID NO: 1426935 - RNA, 20 nt, Homo sapiens
ccuggccaacaugaugaaac

SEQ ID NO: 1426936 - RNA, 14 nt, Homo sapiens
ccuggccuugucag

SEQ ID NO: 1426937 - RNA, 16 nt, Homo sapiens
ccuggcucugcaaugg

SEQ ID NO: 1426938 - RNA, 17 nt, Homo sapiens
ccugggaaaggacccac

SEQ ID NO: 1426939 - RNA, 14 nt, Homo sapiens
ccugggccuaugga

SEQ ID NO: 1426940 - RNA, 16 nt, Homo sapiens
ccugggcuuaugcccu

SEQ ID NO: 1426941 - RNA, 20 nt, Homo sapiens
ccuggggguggcaggcacac

SEQ ID NO: 1426942 - RNA, 20 nt, Homo sapiens
ccuggguuuucuaacuguaa

SEQ ID NO: 1426943 - RNA, 16 nt, Homo sapiens
ccugguccuagacaua

SEQ ID NO: 1426944 - RNA, 14 nt, Homo sapiens
ccugguguguuucc

SEQ ID NO: 1426945 - RNA, 16 nt, Homo sapiens
ccuguaaagucuaauc

SEQ ID NO: 1426946 - RNA, 21 nt, Homo sapiens
ccuguacucuggagagacugu

SEQ ID NO: 1426947 - RNA, 23 nt, Homo sapiens
ccuguagcaaccuucugcauuca

SEQ ID NO: 1426948 - RNA, 14 nt, Homo sapiens
ccuguagugagaaa

SEQ ID NO: 1426949 - RNA, 23 nt, Homo sapiens
ccugucccagagguuaucugccu

SEQ ID NO: 1426950 - RNA, 17 nt, Homo sapiens
ccugucccccugagauc

SEQ ID NO: 1426951 - RNA, 17 nt, Homo sapiens
ccugucucuagccacuu

SEQ ID NO: 1426952 - RNA, 18 nt, Homo sapiens
ccugugcaacuuucccaa

SEQ ID NO: 1426953 - RNA, 13 nt, Homo sapiens
ccugugccagcuc

SEQ ID NO: 1426954 - RNA, 17 nt, Homo sapiens
ccugugcuggacuguuu

SEQ ID NO: 1426955 - RNA, 15 nt, Homo sapiens
ccuguggccuugccc

SEQ ID NO: 1426956 - RNA, 21 nt, Homo sapiens
ccugugggaagagaagggaag

SEQ ID NO: 1426957 - RNA, 21 nt, Homo sapiens
ccuguggggccugauggugcu

SEQ ID NO: 1426958 - RNA, 14 nt, Homo sapiens
ccuguggugacuga

SEQ ID NO: 1426959 - RNA, 17 nt, Homo sapiens
ccuguguccagcagcug

SEQ ID NO: 1426960 - RNA, 14 nt, Homo sapiens
ccuguucacucuac

SEQ ID NO: 1426961 - RNA, 19 nt, Homo sapiens
ccuguucuuccuaccaaau

SEQ ID NO: 1426962 - RNA, 17 nt, Homo sapiens
ccuguuuagagaagccg

SEQ ID NO: 1426963 - RNA, 23 nt, Homo sapiens
ccuuaacacacacaccucuagga

SEQ ID NO: 1426964 - RNA, 20 nt, Homo sapiens
ccuuaacucaucuguuaucc

SEQ ID NO: 1426965 - RNA, 12 nt, Homo sapiens
ccuuaagccagg

SEQ ID NO: 1426966 - RNA, 17 nt, Homo sapiens
ccuuagagcuuggacag

SEQ ID NO: 1426967 - RNA, 23 nt, Homo sapiens
ccuuagagcuuggacagucugag

SEQ ID NO: 1426968 - RNA, 17 nt, Homo sapiens
ccuuaggaacagcucuu

SEQ ID NO: 1426969 - RNA, 15 nt, Homo sapiens
cgucccaugugcaug

SEQ ID NO: 1426970 - RNA, 14 nt, Homo sapiens
cgucucaagacuga

SEQ ID NO: 1426971 - RNA, 15 nt, Homo sapiens
cgucuccuuugacau

SEQ ID NO: 1426972 - RNA, 19 nt, Homo sapiens
cgugaacugcgugccagug

SEQ ID NO: 1426973 - RNA, 15 nt, Homo sapiens
cgugauuucaguuga

SEQ ID NO: 1426974 - RNA, 14 nt, Homo sapiens
cgugccaguguccc

SEQ ID NO: 1426975 - RNA, 20 nt, Homo sapiens
cgugccccgccuccccgaaa

SEQ ID NO: 1426976 - RNA, 19 nt, Homo sapiens
cgugcugcaugccuggucu

SEQ ID NO: 1426977 - RNA, 18 nt, Homo sapiens
cguggucuccuugcacuu

SEQ ID NO: 1426978 - RNA, 20 nt, Homo sapiens
cguggucuccuugcacuuuc

SEQ ID NO: 1426979 - RNA, 21 nt, Homo sapiens
cguguguauuagaaugcaugu

SEQ ID NO: 1426980 - RNA, 22 nt, Homo sapiens
cguguguauuagaaugcaugua

SEQ ID NO: 1426981 - RNA, 17 nt, Homo sapiens
cguugguucugcacuaa

SEQ ID NO: 1426982 - RNA, 15 nt, Homo sapiens
cuaaaaaugcaacuu

SEQ ID NO: 1426983 - RNA, 22 nt, Homo sapiens
cuaaaagugguuuuuauuuccu

SEQ ID NO: 1426984 - RNA, 19 nt, Homo sapiens
cuaaaauaaaaaccagaau

SEQ ID NO: 1426985 - RNA, 22 nt, Homo sapiens
cuaaaauacaaacaagcacaga

SEQ ID NO: 1426986 - RNA, 14 nt, Homo sapiens
cuaaacagauauaa

SEQ ID NO: 1426987 - RNA, 14 nt, Homo sapiens
cuaaacccaaauaa

SEQ ID NO: 1426988 - RNA, 17 nt, Homo sapiens
cuaaagccaguggcagu

SEQ ID NO: 1426989 - RNA, 17 nt, Homo sapiens
cuaaaguauaucuuuaa

SEQ ID NO: 1426990 - RNA, 18 nt, Homo sapiens
cuaaagugccuaccccag

SEQ ID NO: 1426991 - RNA, 13 nt, Homo sapiens
cuaaauaaaugaa

SEQ ID NO: 1426992 - RNA, 16 nt, Homo sapiens
cuaaaugaagugcaaa

SEQ ID NO: 1426993 - RNA, 21 nt, Homo sapiens
cuaaaugcuggucuaggagcu

SEQ ID NO: 1426994 - RNA, 22 nt, Homo sapiens
cuaacaaguagcacccuggauu

SEQ ID NO: 1426995 - RNA, 14 nt, Homo sapiens
cuaaccaaaugcug

SEQ ID NO: 1426996 - RNA, 23 nt, Homo sapiens
cuaaccauaguuauuuacuugaa

SEQ ID NO: 1426997 - RNA, 18 nt, Homo sapiens
cuauucccuaacucucgg

SEQ ID NO: 1426998 - RNA, 13 nt, Homo sapiens
cuauucucaccag

SEQ ID NO: 1426999 - RNA, 21 nt, Homo sapiens
cuauucucggggcccugugua

SEQ ID NO: 1427000 - RNA, 19 nt, Homo sapiens
cuauugaaaaaucaccaca

SEQ ID NO: 1427001 - RNA, 18 nt, Homo sapiens
cuauuuaugaaaaccaua

SEQ ID NO: 1427002 - RNA, 15 nt, Homo sapiens
cuauuuuaaaaccau

SEQ ID NO: 1427003 - RNA, 18 nt, Homo sapiens
cuauuuuauuuguauuca

SEQ ID NO: 1427004 - RNA, 17 nt, Homo sapiens
cuauuuucuuuuccauu

SEQ ID NO: 1427005 - RNA, 18 nt, Homo sapiens
cucaaaaaggugugucaa

SEQ ID NO: 1427006 - RNA, 18 nt, Homo sapiens
cucaaaauaccaugccau

SEQ ID NO: 1427007 - RNA, 16 nt, Homo sapiens
cucaaaugacccaaag

SEQ ID NO: 1427008 - RNA, 17 nt, Homo sapiens
cucaaaugacccaaaga

SEQ ID NO: 1427009 - RNA, 22 nt, Homo sapiens
cucaaaugacccaaagaccaau

SEQ ID NO: 1427010 - RNA, 19 nt, Homo sapiens
cucaacaacaaaccaaaac

SEQ ID NO: 1427011 - RNA, 19 nt, Homo sapiens
cucaacgagagcacuugaa

SEQ ID NO: 1427012 - RNA, 18 nt, Homo sapiens
cucaacguugcuccccau

SEQ ID NO: 1427013 - RNA, 19 nt, Homo sapiens
cucaagaaauugccuccuu

SEQ ID NO: 1427014 - RNA, 21 nt, Homo sapiens
cucaaguuuuucagaaagcau

SEQ ID NO: 1427015 - RNA, 14 nt, Homo sapiens
cucaauaugugauu

SEQ ID NO: 1427016 - RNA, 23 nt, Homo sapiens
cucacccccagcuuugcuaccaa

SEQ ID NO: 1427017 - RNA, 23 nt, Homo sapiens
cucacccccagguguugccauuu

SEQ ID NO: 1427018 - RNA, 14 nt, Homo sapiens
cucacuacagccuc

SEQ ID NO: 1427019 - RNA, 15 nt, Homo sapiens
cucacucggcuucca

SEQ ID NO: 1427020 - RNA, 13 nt, Homo sapiens
cucacucugucac

SEQ ID NO: 1427021 - RNA, 21 nt, Homo sapiens
cucacucuuaugaaaugggcu

SEQ ID NO: 1427022 - RNA, 18 nt, Homo sapiens
cucacuggggucugugug

SEQ ID NO: 1427023 - RNA, 19 nt, Homo sapiens
cucacuggggucugugugg

SEQ ID NO: 1427024 - RNA, 15 nt, Homo sapiens
cucagaucuugacag

SEQ ID NO: 1427025 - RNA, 13 nt, Homo sapiens
cucagaugaucuc

SEQ ID NO: 1427026 - RNA, 17 nt, Homo sapiens
cucagcaauagggugca

SEQ ID NO: 1427027 - RNA, 19 nt, Homo sapiens
cucagccgugcacucccua

SEQ ID NO: 1427028 - RNA, 16 nt, Homo sapiens
cucagccuccucagua

SEQ ID NO: 1427029 - RNA, 20 nt, Homo sapiens
cucagcugccaagcacucga

SEQ ID NO: 1427030 - RNA, 15 nt, Homo sapiens
cucaggcuugaaaug

SEQ ID NO: 1427031 - RNA, 14 nt, Homo sapiens
cucagggacaacau

SEQ ID NO: 1427032 - RNA, 14 nt, Homo sapiens
cucaggggccagug

SEQ ID NO: 1427033 - RNA, 17 nt, Homo sapiens
cucaggggugauucuga

SEQ ID NO: 1427034 - RNA, 15 nt, Homo sapiens
cucagguaguacugg

SEQ ID NO: 1427035 - RNA, 18 nt, Homo sapiens
cucagguaguacugggaa

SEQ ID NO: 1427036 - RNA, 22 nt, Homo sapiens
cucagguccgcccgaccaggau

SEQ ID NO: 1427037 - RNA, 13 nt, Homo sapiens
cucaguguaguua

SEQ ID NO: 1427038 - RNA, 22 nt, Homo sapiens
cucaguuagaauuuuccuaaaa

SEQ ID NO: 1427039 - RNA, 17 nt, Homo sapiens
cucauaacaucuuugaa

SEQ ID NO: 1427040 - RNA, 13 nt, Homo sapiens
cucauaucaaucc

SEQ ID NO: 1427041 - RNA, 17 nt, Homo sapiens
cucaucagaaaugucau

SEQ ID NO: 1427042 - RNA, 19 nt, Homo sapiens
cucaucuguuauccugcua

SEQ ID NO: 1427043 - RNA, 11 nt, Homo sapiens
cucaugccacu

SEQ ID NO: 1427044 - RNA, 16 nt, Homo sapiens
cucaugggccuagcau

SEQ ID NO: 1427045 - RNA, 17 nt, Homo sapiens
cucaugggccuagcaua

SEQ ID NO: 1427046 - RNA, 23 nt, Homo sapiens
cucauguuguucccacacacaaa

SEQ ID NO: 1427047 - RNA, 16 nt, Homo sapiens
cucauuccaccuuccc

SEQ ID NO: 1427048 - RNA, 14 nt, Homo sapiens
cucauuuuaggccu

SEQ ID NO: 1427049 - RNA, 13 nt, Homo sapiens
cuccaacuggauu

SEQ ID NO: 1427050 - RNA, 15 nt, Homo sapiens
cuccacagugcugcu

SEQ ID NO: 1427051 - RNA, 23 nt, Homo sapiens
cagagaccuuuucucucccauac

SEQ ID NO: 1427052 - RNA, 17 nt, Homo sapiens
cagagacuuggggacca

SEQ ID NO: 1427053 - RNA, 16 nt, Homo sapiens
cagagauaauugccau

SEQ ID NO: 1427054 - RNA, 15 nt, Homo sapiens
cagagauaugcacac

SEQ ID NO: 1427055 - RNA, 16 nt, Homo sapiens
cagagccacuaccuuu

SEQ ID NO: 1427056 - RNA, 17 nt, Homo sapiens
cagagcccaagugccau

SEQ ID NO: 1427057 - RNA, 13 nt, Homo sapiens
cagagccuagcca

SEQ ID NO: 1427058 - RNA, 20 nt, Homo sapiens
cagagccuagccaccuccca

SEQ ID NO: 1427059 - RNA, 14 nt, Homo sapiens
cagagccugaguca

SEQ ID NO: 1427060 - RNA, 17 nt, Homo sapiens
cagaggauguucuggac

SEQ ID NO: 1427061 - RNA, 20 nt, Homo sapiens
cagaggcacagagagaguca

SEQ ID NO: 1427062 - RNA, 23 nt, Homo sapiens
cagagggggccuucacagugacc

SEQ ID NO: 1427063 - RNA, 23 nt, Homo sapiens
cagagguaaaagugugagcagug

SEQ ID NO: 1427064 - RNA, 14 nt, Homo sapiens
cagagguuucuuga

SEQ ID NO: 1427065 - RNA, 12 nt, Homo sapiens
cagaguaaaaua

SEQ ID NO: 1427066 - RNA, 14 nt, Homo sapiens
cagagugacaucca

SEQ ID NO: 1427067 - RNA, 19 nt, Homo sapiens
cagagugagacucgucuca

SEQ ID NO: 1427068 - RNA, 13 nt, Homo sapiens
cagaguggagucu

SEQ ID NO: 1427069 - RNA, 11 nt, Homo sapiens
cagagugugaa

SEQ ID NO: 1427070 - RNA, 24 nt, Homo sapiens
cagaguugcuuuaaaguaccugua

SEQ ID NO: 1427071 - RNA, 18 nt, Homo sapiens
cagauaaaggaaggagau

SEQ ID NO: 1427072 - RNA, 16 nt, Homo sapiens
cagauagacagugcug

SEQ ID NO: 1427073 - RNA, 11 nt, Homo sapiens
cagauagucaa

SEQ ID NO: 1427074 - RNA, 19 nt, Homo sapiens
cagauauacacauggaugc

SEQ ID NO: 1427075 - RNA, 23 nt, Homo sapiens
cagauaugcacacacauggauga

SEQ ID NO: 1427076 - RNA, 15 nt, Homo sapiens
cagaucaauuuguaa

SEQ ID NO: 1427077 - RNA, 21 nt, Homo sapiens
cagaucacucaaaaaggugug

SEQ ID NO: 1427078 - RNA, 16 nt, Homo sapiens
cagaucugcacugggu

SEQ ID NO: 1427079 - RNA, 14 nt, Homo sapiens
cagaugaucucucc

SEQ ID NO: 1427080 - RNA, 13 nt, Homo sapiens
cagaugcacacac

SEQ ID NO: 1427081 - RNA, 15 nt, Homo sapiens
cagauggagacauug

SEQ ID NO: 1427082 - RNA, 16 nt, Homo sapiens
cagauggaguaccaug

SEQ ID NO: 1427083 - RNA, 16 nt, Homo sapiens
cagauggucacacaga

SEQ ID NO: 1427084 - RNA, 15 nt, Homo sapiens
cagauguaaaugcca

SEQ ID NO: 1427085 - RNA, 19 nt, Homo sapiens
cagauguuuacagacugug

SEQ ID NO: 1427086 - RNA, 17 nt, Homo sapiens
cagauuugcuguucacc

SEQ ID NO: 1427087 - RNA, 16 nt, Homo sapiens
cagcaaggugugaaug

SEQ ID NO: 1427088 - RNA, 14 nt, Homo sapiens
cagcagaacaugug

SEQ ID NO: 1427089 - RNA, 20 nt, Homo sapiens
cagcagugagcuucuauuaa

SEQ ID NO: 1427090 - RNA, 11 nt, Homo sapiens
cagcauaccuu

SEQ ID NO: 1427091 - RNA, 11 nt, Homo sapiens
cagcaucaggg

SEQ ID NO: 1427092 - RNA, 23 nt, Homo sapiens
cagcaugaaggcagccacagaca

SEQ ID NO: 1427093 - RNA, 17 nt, Homo sapiens
cagcauucucacuccua

SEQ ID NO: 1427094 - RNA, 12 nt, Homo sapiens
cagcauuugcca

SEQ ID NO: 1427095 - RNA, 15 nt, Homo sapiens
cagccaacaaacaua

SEQ ID NO: 1427096 - RNA, 14 nt, Homo sapiens
cagccagacuggca

SEQ ID NO: 1427097 - RNA, 18 nt, Homo sapiens
cagccaugccucaugcca

SEQ ID NO: 1427098 - RNA, 21 nt, Homo sapiens
cagcccaagaggacugagacu

SEQ ID NO: 1427099 - RNA, 23 nt, Homo sapiens
cagcccugggguaugagcugcca

SEQ ID NO: 1427100 - RNA, 18 nt, Homo sapiens
cagcccuguccccugaaa

SEQ ID NO: 1427101 - RNA, 19 nt, Homo sapiens
cagcccuucccugcuuuga

SEQ ID NO: 1427102 - RNA, 19 nt, Homo sapiens
cagccucccgaguagcuga

SEQ ID NO: 1427103 - RNA, 20 nt, Homo sapiens
cagccucccgaguagcugag

SEQ ID NO: 1427104 - RNA, 17 nt, Homo sapiens
cagccuccuccugacca

SEQ ID NO: 1427105 - RNA, 15 nt, Homo sapiens
cagccucucugcuau

SEQ ID NO: 1427106 - RNA, 22 nt, Homo sapiens
cagccuggggggucguggcaga

SEQ ID NO: 1427107 - RNA, 16 nt, Homo sapiens
cagccuggguggcaga

SEQ ID NO: 1427108 - RNA, 17 nt, Homo sapiens
cagccuugcaucaaggg

SEQ ID NO: 1427109 - RNA, 20 nt, Homo sapiens
cagcggucauucuacacuga

SEQ ID NO: 1427110 - RNA, 19 nt, Homo sapiens
cagcgucccgcguagcugg

SEQ ID NO: 1427111 - RNA, 19 nt, Homo sapiens
cagcuaacuccagucuccu

SEQ ID NO: 1427112 - RNA, 19 nt, Homo sapiens
cagcuaauaaugaaguuau

SEQ ID NO: 1427113 - RNA, 21 nt, Homo sapiens
cagcuagugacccacaugcca

SEQ ID NO: 1427114 - RNA, 20 nt, Homo sapiens
cagcuaucugucaucucucu

SEQ ID NO: 1427115 - RNA, 21 nt, Homo sapiens
cagcuaugcacuguaaaugca

SEQ ID NO: 1427116 - RNA, 19 nt, Homo sapiens
cagcucacacccuaauaag

SEQ ID NO: 1427117 - RNA, 13 nt, Homo sapiens
cagcucagagaug

SEQ ID NO: 1427118 - RNA, 20 nt, Homo sapiens
cagcuccagaauaccuucuu

SEQ ID NO: 1427119 - RNA, 17 nt, Homo sapiens
cagcucuccugcugcag

SEQ ID NO: 1427120 - RNA, 21 nt, Homo sapiens
cagcucugcauuaucugaggu

SEQ ID NO: 1427121 - RNA, 15 nt, Homo sapiens
cagcugaacagccaa

SEQ ID NO: 1427122 - RNA, 16 nt, Homo sapiens
cagcugaacagccaaa

SEQ ID NO: 1427123 - RNA, 16 nt, Homo sapiens
cagcugcaucuacuca

SEQ ID NO: 1427124 - RNA, 23 nt, Homo sapiens
cagcugccaaaaucguagguguu

SEQ ID NO: 1427125 - RNA, 15 nt, Homo sapiens
cagcugcuacaagaa

SEQ ID NO: 1427126 - RNA, 17 nt, Homo sapiens
cagcugcucccaaauaa

SEQ ID NO: 1427127 - RNA, 14 nt, Homo sapiens
cagcugcugaagag

SEQ ID NO: 1427128 - RNA, 20 nt, Homo sapiens
cagcuguguucacacuguaa

SEQ ID NO: 1427129 - RNA, 23 nt, Homo sapiens
cagcuucauuaugcagcugaggu

SEQ ID NO: 1427130 - RNA, 15 nt, Homo sapiens
cagcuuuaucuguca

SEQ ID NO: 1427131 - RNA, 21 nt, Homo sapiens
caggaaaagguagcuuaccug

SEQ ID NO: 1427132 - RNA, 16 nt, Homo sapiens
caggaagaugaaagag

SEQ ID NO: 1427133 - RNA, 23 nt, Homo sapiens
caggaagucucucccgauaucac

SEQ ID NO: 1427134 - RNA, 14 nt, Homo sapiens
caggaauacauuug

SEQ ID NO: 1427135 - RNA, 22 nt, Homo sapiens
caggacucugccuccucuucaa

SEQ ID NO: 1427136 - RNA, 16 nt, Homo sapiens
cucugcaucagcacug

SEQ ID NO: 1427137 - RNA, 23 nt, Homo sapiens
cucugcauguguguuguccuuca

SEQ ID NO: 1427138 - RNA, 15 nt, Homo sapiens
cucugcugacuccau

SEQ ID NO: 1427139 - RNA, 18 nt, Homo sapiens
cucuggaaaaugugaccc

SEQ ID NO: 1427140 - RNA, 11 nt, Homo sapiens
cucuggaccaa

SEQ ID NO: 1427141 - RNA, 19 nt, Homo sapiens
cucuggccacugcugcaga

SEQ ID NO: 1427142 - RNA, 14 nt, Homo sapiens
cucuggcuccagaa

SEQ ID NO: 1427143 - RNA, 19 nt, Homo sapiens
cucugggagccugacagug

SEQ ID NO: 1427144 - RNA, 15 nt, Homo sapiens
cucuggguuucauau

SEQ ID NO: 1427145 - RNA, 21 nt, Homo sapiens
cucuucaacugaccagccucc

SEQ ID NO: 1427146 - RNA, 17 nt, Homo sapiens
cucuucagccccuagug

SEQ ID NO: 1427147 - RNA, 21 nt, Homo sapiens
cucuucccaccucagugccca

SEQ ID NO: 1427148 - RNA, 22 nt, Homo sapiens
cucuuccugauuccccacucaa

SEQ ID NO: 1427149 - RNA, 23 nt, Homo sapiens
cucuucucuuccuguaacacaag

SEQ ID NO: 1427150 - RNA, 13 nt, Homo sapiens
cucuucuuuaugu

SEQ ID NO: 1427151 - RNA, 15 nt, Homo sapiens
cucuugcauugcaaa

SEQ ID NO: 1427152 - RNA, 12 nt, Homo sapiens
cucuugcucaaa

SEQ ID NO: 1427153 - RNA, 15 nt, Homo sapiens
cucuuucuacauucu

SEQ ID NO: 1427154 - RNA, 16 nt, Homo sapiens
cucuuucuucuuugaa

SEQ ID NO: 1427155 - RNA, 20 nt, Homo sapiens
cucuuuuguuccuggcuuug

SEQ ID NO: 1427156 - RNA, 14 nt, Homo sapiens
cugaaaacuguaaa

SEQ ID NO: 1427157 - RNA, 18 nt, Homo sapiens
cugaaagacagaauguca

SEQ ID NO: 1427158 - RNA, 21 nt, Homo sapiens
cugaaagaguccuuucaggaa

SEQ ID NO: 1427159 - RNA, 19 nt, Homo sapiens
cugaaaugcuagcugcaag

SEQ ID NO: 1427160 - RNA, 14 nt, Homo sapiens
cugaacuauuucag

SEQ ID NO: 1427161 - RNA, 15 nt, Homo sapiens
cugaagaacaguaac

SEQ ID NO: 1427162 - RNA, 13 nt, Homo sapiens
cugaagaccucca

SEQ ID NO: 1427163 - RNA, 14 nt, Homo sapiens
cugaagaccuccac

SEQ ID NO: 1427164 - RNA, 20 nt, Homo sapiens
cugaagcgacuauaaagguu

SEQ ID NO: 1427165 - RNA, 18 nt, Homo sapiens
cugaagcugacagcacua

SEQ ID NO: 1427166 - RNA, 18 nt, Homo sapiens
cugaaggggcacaccacu

SEQ ID NO: 1427167 - RNA, 13 nt, Homo sapiens
cugaaugacauau

SEQ ID NO: 1427168 - RNA, 18 nt, Homo sapiens
cugaaugauuuccaaaga

SEQ ID NO: 1427169 - RNA, 15 nt, Homo sapiens
cugaauucuuuucaa

SEQ ID NO: 1427170 - RNA, 14 nt, Homo sapiens
cugacaagauggaa

SEQ ID NO: 1427171 - RNA, 11 nt, Homo sapiens
cugacaccacc

SEQ ID NO: 1427172 - RNA, 16 nt, Homo sapiens
cugcaguuccugagua

SEQ ID NO: 1427173 - RNA, 21 nt, Homo sapiens
cugcauccccuuggcugugag

SEQ ID NO: 1427174 - RNA, 12 nt, Homo sapiens
cugcaugcucug

SEQ ID NO: 1427175 - RNA, 22 nt, Homo sapiens
cugcauguguuguacaauacca

SEQ ID NO: 1427176 - RNA, 18 nt, Homo sapiens
cugcauuugugucaucuu

SEQ ID NO: 1427177 - RNA, 22 nt, Homo sapiens
cugccaagcccucaauaagcca

SEQ ID NO: 1427178 - RNA, 14 nt, Homo sapiens
cugcccaaugccuu

SEQ ID NO: 1427179 - RNA, 23 nt, Homo sapiens
cugcccaaugccuugacaacaga

SEQ ID NO: 1427180 - RNA, 13 nt, Homo sapiens
cugcccacccacu

SEQ ID NO: 1427181 - RNA, 15 nt, Homo sapiens
cugcccgacucaggu

SEQ ID NO: 1427182 - RNA, 14 nt, Homo sapiens
cugcccucucucag

SEQ ID NO: 1427183 - RNA, 18 nt, Homo sapiens
cugcccugccaccugucu

SEQ ID NO: 1427184 - RNA, 16 nt, Homo sapiens
cugcccuucgcugcca

SEQ ID NO: 1427185 - RNA, 16 nt, Homo sapiens
cugccgcugcaccacg

SEQ ID NO: 1427186 - RNA, 18 nt, Homo sapiens
cugccuacaaaauggaga

SEQ ID NO: 1427187 - RNA, 23 nt, Homo sapiens
cugccuccagaauggucuuucua

SEQ ID NO: 1427188 - RNA, 23 nt, Homo sapiens
cugccucugccaugcccagagaa

SEQ ID NO: 1427189 - RNA, 22 nt, Homo sapiens
cugccugugcaugaccugauca

SEQ ID NO: 1427190 - RNA, 23 nt, Homo sapiens
cugcgggcaccagaaugcuaaag

SEQ ID NO: 1427191 - RNA, 13 nt, Homo sapiens
cugcgggggagug

SEQ ID NO: 1427192 - RNA, 21 nt, Homo sapiens
cugcguccgcaucacucugca

SEQ ID NO: 1427193 - RNA, 16 nt, Homo sapiens
cugcguugugagcucu

SEQ ID NO: 1427194 - RNA, 17 nt, Homo sapiens
cugcuaauagcugcuag

SEQ ID NO: 1427195 - RNA, 17 nt, Homo sapiens
cugcuacacaaaagcca

SEQ ID NO: 1427196 - RNA, 16 nt, Homo sapiens
cugcuauuauguaaca

SEQ ID NO: 1427197 - RNA, 16 nt, Homo sapiens
cugcucaagaagacau

SEQ ID NO: 1427198 - RNA, 22 nt, Homo sapiens
cugcucaagagaagcacaugaa

SEQ ID NO: 1427199 - RNA, 12 nt, Homo sapiens
cugcuccagaga

SEQ ID NO: 1427200 - RNA, 15 nt, Homo sapiens
cugcuccgagucuuc

SEQ ID NO: 1427201 - RNA, 23 nt, Homo sapiens
cugcucugaauauuuuguaauaa

SEQ ID NO: 1427202 - RNA, 21 nt, Homo sapiens
cugcucugaggcuuccagaga

SEQ ID NO: 1427203 - RNA, 19 nt, Homo sapiens
cugcucugaugcaucagaa

SEQ ID NO: 1427204 - RNA, 13 nt, Homo sapiens
cugcucugcuaua

SEQ ID NO: 1427205 - RNA, 22 nt, Homo sapiens
cugcucuggaaaaugugaccca

SEQ ID NO: 1427206 - RNA, 21 nt, Homo sapiens
cugcucuggauaacaagacuu

SEQ ID NO: 1427207 - RNA, 18 nt, Homo sapiens
cugcugaaacaacaaaua

SEQ ID NO: 1427208 - RNA, 11 nt, Homo sapiens
cugcugaagag

SEQ ID NO: 1427209 - RNA, 21 nt, Homo sapiens
cugcugcagacaccugccuua

SEQ ID NO: 1427210 - RNA, 16 nt, Homo sapiens
gaaugccacagugaag

SEQ ID NO: 1427211 - RNA, 15 nt, Homo sapiens
gaaugcggaaccaua

SEQ ID NO: 1427212 - RNA, 16 nt, Homo sapiens
gaaugcggaaccauag

SEQ ID NO: 1427213 - RNA, 15 nt, Homo sapiens
gaaugcuuggcacuc

SEQ ID NO: 1427214 - RNA, 20 nt, Homo sapiens
gaauguauugaacuuggaaa

SEQ ID NO: 1427215 - RNA, 12 nt, Homo sapiens
gaaugucucagc

SEQ ID NO: 1427216 - RNA, 15 nt, Homo sapiens
gaauucacaccuuag

SEQ ID NO: 1427217 - RNA, 15 nt, Homo sapiens
gaauucuuuacaaua

SEQ ID NO: 1427218 - RNA, 22 nt, Homo sapiens
gaauugauucaagauuggacau

SEQ ID NO: 1427219 - RNA, 19 nt, Homo sapiens
gaauuugggccucuuguac

SEQ ID NO: 1427220 - RNA, 19 nt, Homo sapiens
gaauuuuuuuuaacauucc

SEQ ID NO: 1427221 - RNA, 15 nt, Homo sapiens
gacaaaacacugugu

SEQ ID NO: 1427222 - RNA, 13 nt, Homo sapiens
gacaaaccagagc

SEQ ID NO: 1427223 - RNA, 21 nt, Homo sapiens
gacaagcaagggcugugcuga

SEQ ID NO: 1427224 - RNA, 22 nt, Homo sapiens
gacaauccccacauaccaucug

SEQ ID NO: 1427225 - RNA, 22 nt, Homo sapiens
gacaaugcaaugaaacagauga

SEQ ID NO: 1427226 - RNA, 20 nt, Homo sapiens
gacaauggaaacuguaccau

SEQ ID NO: 1427227 - RNA, 14 nt, Homo sapiens
gacacacagucuca

SEQ ID NO: 1427228 - RNA, 19 nt, Homo sapiens
gacacagagggggccuuca

SEQ ID NO: 1427229 - RNA, 21 nt, Homo sapiens
gacacagagggggccuucaca

SEQ ID NO: 1427230 - RNA, 15 nt, Homo sapiens
gacacaggugccuca

SEQ ID NO: 1427231 - RNA, 15 nt, Homo sapiens
gacaccgaguuccac

SEQ ID NO: 1427232 - RNA, 14 nt, Homo sapiens
gacaccugccuuaa

SEQ ID NO: 1427233 - RNA, 22 nt, Homo sapiens
gacaccuggauugcagacucau

SEQ ID NO: 1427234 - RNA, 17 nt, Homo sapiens
gacagaagaucuauauu

SEQ ID NO: 1427235 - RNA, 13 nt, Homo sapiens
gacagccuggcac

SEQ ID NO: 1427236 - RNA, 18 nt, Homo sapiens
gacaggacuaacacucag

SEQ ID NO: 1427237 - RNA, 18 nt, Homo sapiens
gacaggagacccagagag

SEQ ID NO: 1427238 - RNA, 12 nt, Homo sapiens
gacaggugaaug

SEQ ID NO: 1427239 - RNA, 23 nt, Homo sapiens
gacaguacucuuaacuccuagcc

SEQ ID NO: 1427240 - RNA, 12 nt, Homo sapiens
gacagucuugca

SEQ ID NO: 1427241 - RNA, 22 nt, Homo sapiens
gacauagcuggaaaauuccuau

SEQ ID NO: 1427242 - RNA, 16 nt, Homo sapiens
gacaucaaauuugcca

SEQ ID NO: 1427243 - RNA, 22 nt, Homo sapiens
gacauccaggaggaauaagcuc

SEQ ID NO: 1427244 - RNA, 19 nt, Homo sapiens
gacaucuccucuaucacau

SEQ ID NO: 1427245 - RNA, 24 nt, Homo sapiens
gacaucuccucuaucacauuacau

SEQ ID NO: 1427246 - RNA, 18 nt, Homo sapiens
gacaugucuagccacuga

SEQ ID NO: 1427247 - RNA, 13 nt, Homo sapiens
gacauuaugugug

SEQ ID NO: 1427248 - RNA, 21 nt, Homo sapiens
gacauuaugugugcaugugug

SEQ ID NO: 1427249 - RNA, 16 nt, Homo sapiens
gacauucaaggcauuu

SEQ ID NO: 1427250 - RNA, 22 nt, Homo sapiens
gacauucaaggcauuucuauca

SEQ ID NO: 1427251 - RNA, 14 nt, Homo sapiens
gacauuccaaagaa

SEQ ID NO: 1427252 - RNA, 20 nt, Homo sapiens
gacauuccaaagaacagccu

SEQ ID NO: 1427253 - RNA, 23 nt, Homo sapiens
gacauuucuaucuugaauuucau

SEQ ID NO: 1427254 - RNA, 19 nt, Homo sapiens
gacauuuucaauaauguga

SEQ ID NO: 1427255 - RNA, 16 nt, Homo sapiens
gaccaaauaaaguacc

SEQ ID NO: 1427256 - RNA, 18 nt, Homo sapiens
gaccaaauaaaguaccau

SEQ ID NO: 1427257 - RNA, 22 nt, Homo sapiens
gaccacacgcugucucuugaga

SEQ ID NO: 1427258 - RNA, 17 nt, Homo sapiens
gaccacauguguucucu

SEQ ID NO: 1427259 - RNA, 18 nt, Homo sapiens
gaccaggaugacaccucc

SEQ ID NO: 1427260 - RNA, 14 nt, Homo sapiens
gaccaggcaccagg

SEQ ID NO: 1427261 - RNA, 21 nt, Homo sapiens
gaccaggcaccaggcaggguc

SEQ ID NO: 1427262 - RNA, 17 nt, Homo sapiens
gaccagggcuuuuccca

SEQ ID NO: 1427263 - RNA, 23 nt, Homo sapiens
gaccaucgcaaccaggauugaca

SEQ ID NO: 1427264 - RNA, 17 nt, Homo sapiens
gaccauuguaacaauag

SEQ ID NO: 1427265 - RNA, 16 nt, Homo sapiens
gaccauugucuuccaa

SEQ ID NO: 1427266 - RNA, 13 nt, Homo sapiens
gacccacacaugu

SEQ ID NO: 1427267 - RNA, 15 nt, Homo sapiens
gacccagucaaugaa

SEQ ID NO: 1427268 - RNA, 18 nt, Homo sapiens
gacccaguguaaagaaua

SEQ ID NO: 1427269 - RNA, 13 nt, Homo sapiens
gaccccacuggac

SEQ ID NO: 1427270 - RNA, 23 nt, Homo sapiens
gaccccagcuucauuaugcagcu

SEQ ID NO: 1427271 - RNA, 21 nt, Homo sapiens
gacccuacuucuuuugcucuu

SEQ ID NO: 1427272 - RNA, 21 nt, Homo sapiens
gacccucugaaugguccaggg

SEQ ID NO: 1427273 - RNA, 16 nt, Homo sapiens
gaccgaaucucacucu

SEQ ID NO: 1427274 - RNA, 21 nt, Homo sapiens
gaccgcuucccagaggccagg

SEQ ID NO: 1427275 - RNA, 18 nt, Homo sapiens
gaccuagaccugggccaa

SEQ ID NO: 1427276 - RNA, 23 nt, Homo sapiens
gaccuagugguuucuacucucac

SEQ ID NO: 1427277 - RNA, 22 nt, Homo sapiens
gaccucaggugauccacccacc

SEQ ID NO: 1427278 - RNA, 15 nt, Homo sapiens
gaccucuacugccuu

SEQ ID NO: 1427279 - RNA, 19 nt, Homo sapiens
gaccugacaagcacugcua

SEQ ID NO: 1427280 - RNA, 16 nt, Homo sapiens
gaccuguguucuugcu

SEQ ID NO: 1427281 - RNA, 18 nt, Homo sapiens
gaccuguuuuuguguuuu

SEQ ID NO: 1427282 - RNA, 23 nt, Homo sapiens
gaccuuccugccaccagucacug

SEQ ID NO: 1427283 - RNA, 18 nt, Homo sapiens
gaccuugaaggguaaaga

SEQ ID NO: 1427284 - RNA, 17 nt, Homo sapiens
gaccuuuucucucccau

SEQ ID NO: 1427285 - RNA, 15 nt, Homo sapiens
gacggaaggcaaaga

SEQ ID NO: 1427286 - RNA, 14 nt, Homo sapiens
gacggccacucugu

SEQ ID NO: 1427287 - RNA, 16 nt, Homo sapiens
gacggccacucuguug

SEQ ID NO: 1427288 - RNA, 15 nt, Homo sapiens
gacggggacugggga

SEQ ID NO: 1427289 - RNA, 19 nt, Homo sapiens
gacuaaccugcccacccac

SEQ ID NO: 1427290 - RNA, 20 nt, Homo sapiens
gacuaccagcuaacuccagu

SEQ ID NO: 1427291 - RNA, 13 nt, Homo sapiens
gacuacuauacaa

SEQ ID NO: 1427292 - RNA, 21 nt, Homo sapiens
gacuagaauagugcauuguau

SEQ ID NO: 1427293 - RNA, 16 nt, Homo sapiens
gacuagaggcagggag

SEQ ID NO: 1427294 - RNA, 13 nt, Homo sapiens
gacuauuuagaca

SEQ ID NO: 1427295 - RNA, 18 nt, Homo sapiens
gacucagcggucauucua

SEQ ID NO: 1427296 - RNA, 12 nt, Homo sapiens
gacuccaagaac

SEQ ID NO: 1427297 - RNA, 23 nt, Homo sapiens
gacuccagaaucugcuguugcca

SEQ ID NO: 1427298 - RNA, 20 nt, Homo sapiens
gacuccauauggaggccuca

SEQ ID NO: 1427299 - RNA, 17 nt, Homo sapiens
gacuccgagaacaacag

SEQ ID NO: 1427300 - RNA, 17 nt, Homo sapiens
gacuccugugcaacuuu

SEQ ID NO: 1427301 - RNA, 15 nt, Homo sapiens
gacucgucucaaaaa

SEQ ID NO: 1427302 - RNA, 17 nt, Homo sapiens
gacucguucuucuggga

SEQ ID NO: 1427303 - RNA, 23 nt, Homo sapiens
gacucugaaaaacauuccaggaa

SEQ ID NO: 1427304 - RNA, 17 nt, Homo sapiens
gacucuuaacauuagag

SEQ ID NO: 1427305 - RNA, 18 nt, Homo sapiens
gacucuucccccacuccu

SEQ ID NO: 1427306 - RNA, 18 nt, Homo sapiens
gacugaaggggcacacca

SEQ ID NO: 1427307 - RNA, 19 nt, Homo sapiens
gacugaaggggcacaccac

SEQ ID NO: 1427308 - RNA, 21 nt, Homo sapiens
gacugcaacaggaacuuggag

SEQ ID NO: 1427309 - RNA, 15 nt, Homo sapiens
gacuggaaccaggga

SEQ ID NO: 1427310 - RNA, 13 nt, Homo sapiens
gacugguuagaca

SEQ ID NO: 1427311 - RNA, 14 nt, Homo sapiens
gacuguugcucaaa

SEQ ID NO: 1427312 - RNA, 18 nt, Homo sapiens
gacuuaggaaccuaccag

SEQ ID NO: 1427313 - RNA, 17 nt, Homo sapiens
gacuucacaaaaugcaa

SEQ ID NO: 1427314 - RNA, 17 nt, Homo sapiens
gacuucaucccaaagga

SEQ ID NO: 1427315 - RNA, 19 nt, Homo sapiens
gacuucugccccagcuuua

SEQ ID NO: 1427316 - RNA, 17 nt, Homo sapiens
gacuugauacugcaaua

SEQ ID NO: 1427317 - RNA, 14 nt, Homo sapiens
gacuuucuacaccu

SEQ ID NO: 1427318 - RNA, 23 nt, Homo sapiens
gagaacuucaaucacuguagucu

SEQ ID NO: 1427319 - RNA, 17 nt, Homo sapiens
gagaagaaagaggugac

SEQ ID NO: 1427320 - RNA, 14 nt, Homo sapiens
gagaagaaauccau

SEQ ID NO: 1427321 - RNA, 18 nt, Homo sapiens
gagaagacccacgugcua

SEQ ID NO: 1427322 - RNA, 15 nt, Homo sapiens
gagaagcucacccaa

SEQ ID NO: 1427323 - RNA, 17 nt, Homo sapiens
gagaaugcccaacucuu

SEQ ID NO: 1427324 - RNA, 17 nt, Homo sapiens
gagaauuauuccuuucc

SEQ ID NO: 1427325 - RNA, 12 nt, Homo sapiens
gagacacuccca

SEQ ID NO: 1427326 - RNA, 15 nt, Homo sapiens
gagacacugugcuau

SEQ ID NO: 1427327 - RNA, 15 nt, Homo sapiens
gagacaggcccaaga

SEQ ID NO: 1427328 - RNA, 13 nt, Homo sapiens
gagacauugccuc

SEQ ID NO: 1427329 - RNA, 20 nt, Homo sapiens
gagacucaccucugccucaa

SEQ ID NO: 1427330 - RNA, 17 nt, Homo sapiens
gagacuggagcaucuga

SEQ ID NO: 1427331 - RNA, 21 nt, Homo sapiens
gagacugucucaagagggcac

SEQ ID NO: 1427332 - RNA, 16 nt, Homo sapiens
gcauagaaacugagga

SEQ ID NO: 1427333 - RNA, 20 nt, Homo sapiens
gcauaggccauauaauguua

SEQ ID NO: 1427334 - RNA, 18 nt, Homo sapiens
gcauaucaaaaaguauua

SEQ ID NO: 1427335 - RNA, 20 nt, Homo sapiens
gcauccacccagugcugcca

SEQ ID NO: 1427336 - RNA, 19 nt, Homo sapiens
gcauccccuuggcugugag

SEQ ID NO: 1427337 - RNA, 18 nt, Homo sapiens
gcauccugugugcugaca

SEQ ID NO: 1427338 - RNA, 22 nt, Homo sapiens
gcaucuucuggagucuccagug

SEQ ID NO: 1427339 - RNA, 17 nt, Homo sapiens
gcaugaacuguccuucc

SEQ ID NO: 1427340 - RNA, 16 nt, Homo sapiens
gcaugacaauugucag

SEQ ID NO: 1427341 - RNA, 13 nt, Homo sapiens
gcaugacacucua

SEQ ID NO: 1427342 - RNA, 19 nt, Homo sapiens
gcaugauuuuauacauagu

SEQ ID NO: 1427343 - RNA, 18 nt, Homo sapiens
gcaugcaauaaugugcaa

SEQ ID NO: 1427344 - RNA, 19 nt, Homo sapiens
gcaugcacagcugcuuguc

SEQ ID NO: 1427345 - RNA, 22 nt, Homo sapiens
gcaugccuccaaaaauucacau

SEQ ID NO: 1427346 - RNA, 17 nt, Homo sapiens
gcaugccuggucuuucc

SEQ ID NO: 1427347 - RNA, 13 nt, Homo sapiens
gcaugcucuggaa

SEQ ID NO: 1427348 - RNA, 13 nt, Homo sapiens
gcauggugcaguu

SEQ ID NO: 1427349 - RNA, 18 nt, Homo sapiens
gcaugucucaauaguaaa

SEQ ID NO: 1427350 - RNA, 13 nt, Homo sapiens
gcaugugccaguu

SEQ ID NO: 1427351 - RNA, 17 nt, Homo sapiens
gcauuagaaacugaaaa

SEQ ID NO: 1427352 - RNA, 12 nt, Homo sapiens
gcauuccaugau

SEQ ID NO: 1427353 - RNA, 15 nt, Homo sapiens
gcauugaagugucga

SEQ ID NO: 1427354 - RNA, 17 nt, Homo sapiens
gcauuguaaaugugcuu

SEQ ID NO: 1427355 - RNA, 15 nt, Homo sapiens
gcauuuacucucuua

SEQ ID NO: 1427356 - RNA, 16 nt, Homo sapiens
gcauuugauuuugccc

SEQ ID NO: 1427357 - RNA, 17 nt, Homo sapiens
gcauuugcccuguggau

SEQ ID NO: 1427358 - RNA, 13 nt, Homo sapiens
gcauuuuacuacu

SEQ ID NO: 1427359 - RNA, 14 nt, Homo sapiens
gccaaacacacugu

SEQ ID NO: 1427360 - RNA, 17 nt, Homo sapiens
gccaaacacacuguaaa

SEQ ID NO: 1427361 - RNA, 20 nt, Homo sapiens
gccaaccaagagcacauucu

SEQ ID NO: 1427362 - RNA, 17 nt, Homo sapiens
gccaaccugaugccccu

SEQ ID NO: 1427363 - RNA, 17 nt, Homo sapiens
gccaacuccuccuugcc

SEQ ID NO: 1427364 - RNA, 13 nt, Homo sapiens
gccaacugcugau

SEQ ID NO: 1427365 - RNA, 14 nt, Homo sapiens
gccacaacccuguu

SEQ ID NO: 1427366 - RNA, 18 nt, Homo sapiens
gccacaucacuacaguac

SEQ ID NO: 1427367 - RNA, 15 nt, Homo sapiens
gccaccauccugcag

SEQ ID NO: 1427368 - RNA, 14 nt, Homo sapiens
gccacccagcaaca

SEQ ID NO: 1427369 - RNA, 19 nt, Homo sapiens
gccacccagcaacacagag

SEQ ID NO: 1427370 - RNA, 23 nt, Homo sapiens
gccacuugguuuuuggcucuuuc

SEQ ID NO: 1427371 - RNA, 14 nt, Homo sapiens
gccagaaaacauau

SEQ ID NO: 1427372 - RNA, 19 nt, Homo sapiens
gccagaaaacauaugcauu

SEQ ID NO: 1427373 - RNA, 22 nt, Homo sapiens
gccagaaacguaacugugugca

SEQ ID NO: 1427374 - RNA, 20 nt, Homo sapiens
gccagaaucuucguccugcc

SEQ ID NO: 1427375 - RNA, 18 nt, Homo sapiens
gccagagcccaagugcca

SEQ ID NO: 1427376 - RNA, 17 nt, Homo sapiens
gccagccgugaugcuca

SEQ ID NO: 1427377 - RNA, 18 nt, Homo sapiens
gccagcugcaucuacuca

SEQ ID NO: 1427378 - RNA, 16 nt, Homo sapiens
gccaggacaccugccc

SEQ ID NO: 1427379 - RNA, 22 nt, Homo sapiens
gccaggagaugcugggccaguu

SEQ ID NO: 1427380 - RNA, 19 nt, Homo sapiens
gccaggagucugugcucuu

SEQ ID NO: 1427381 - RNA, 16 nt, Homo sapiens
gccagggccaagugaa

SEQ ID NO: 1427382 - RNA, 16 nt, Homo sapiens
gccaggggaguuccug

SEQ ID NO: 1427383 - RNA, 12 nt, Homo sapiens
gccagguggcca

SEQ ID NO: 1427384 - RNA, 15 nt, Homo sapiens
gccaguuauggcuau

SEQ ID NO: 1427385 - RNA, 18 nt, Homo sapiens
gccauauucacaccucac

SEQ ID NO: 1427386 - RNA, 17 nt, Homo sapiens
gccaugauggugcugac

SEQ ID NO: 1427387 - RNA, 16 nt, Homo sapiens
gccauggaauaaacca

SEQ ID NO: 1427388 - RNA, 21 nt, Homo sapiens
gccauguuuagauuccaggau

SEQ ID NO: 1427389 - RNA, 22 nt, Homo sapiens
gccauuccaagucaacacucuu

SEQ ID NO: 1427390 - RNA, 17 nt, Homo sapiens
gcgaaaggaaagccaaa

SEQ ID NO: 1427391 - RNA, 14 nt, Homo sapiens
gcgaaucaucucaa

SEQ ID NO: 1427392 - RNA, 12 nt, Homo sapiens
gcgaaugugcag

SEQ ID NO: 1427393 - RNA, 17 nt, Homo sapiens
gcgagcugcucugcuau

SEQ ID NO: 1427394 - RNA, 22 nt, Homo sapiens
gcgcaagccuguaaucccagcu

SEQ ID NO: 1427395 - RNA, 20 nt, Homo sapiens
gcgcagcccgaagcccaguu

SEQ ID NO: 1427396 - RNA, 15 nt, Homo sapiens
gcgcagcgcgugcac

SEQ ID NO: 1427397 - RNA, 14 nt, Homo sapiens
gcgcaguggcucac

SEQ ID NO: 1427398 - RNA, 19 nt, Homo sapiens
gcgcccugcagacccugcc

SEQ ID NO: 1427399 - RNA, 13 nt, Homo sapiens
gcgccugugcuga

SEQ ID NO: 1427400 - RNA, 24 nt, Homo sapiens
gcgcgcagcgcgugcacagcgcgg

SEQ ID NO: 1427401 - RNA, 14 nt, Homo sapiens
gcgcgguggcucac

SEQ ID NO: 1427402 - RNA, 13 nt, Homo sapiens
gcgcgugcacagc

SEQ ID NO: 1427403 - RNA, 16 nt, Homo sapiens
gcggacaucucaggga

SEQ ID NO: 1427404 - RNA, 19 nt, Homo sapiens
gcggccaugauggugcuga

SEQ ID NO: 1427405 - RNA, 21 nt, Homo sapiens
gcggccucgugccaugaucug

SEQ ID NO: 1427406 - RNA, 19 nt, Homo sapiens
gcggcgggucaaucugccu

SEQ ID NO: 1427407 - RNA, 14 nt, Homo sapiens
gcggggugcagaag

SEQ ID NO: 1427408 - RNA, 12 nt, Homo sapiens
gcgguggcucac

SEQ ID NO: 1427409 - RNA, 11 nt, Homo sapiens
gcgguggugcc

SEQ ID NO: 1427410 - RNA, 22 nt, Homo sapiens
gcguaacaaacaaaaucaugga

SEQ ID NO: 1427411 - RNA, 12 nt, Homo sapiens
gcgucaguuuuu

SEQ ID NO: 1427412 - RNA, 19 nt, Homo sapiens
gcguccugcccucugggag

SEQ ID NO: 1427413 - RNA, 19 nt, Homo sapiens
gcgucugccccacccucaa

SEQ ID NO: 1427414 - RNA, 23 nt, Homo sapiens
gcguggcaacccucacuguguug

SEQ ID NO: 1427415 - RNA, 14 nt, Homo sapiens
gcugucgcaucuca

SEQ ID NO: 1427416 - RNA, 19 nt, Homo sapiens
gcugucuccauaaugccac

SEQ ID NO: 1427417 - RNA, 22 nt, Homo sapiens
gcugugcccucccauagcacug

SEQ ID NO: 1427418 - RNA, 11 nt, Homo sapiens
gcugugcucuc

SEQ ID NO: 1427419 - RNA, 20 nt, Homo sapiens
gcugugugugugugaguaug

SEQ ID NO: 1427420 - RNA, 18 nt, Homo sapiens
gcuguguucacacuguaa

SEQ ID NO: 1427421 - RNA, 18 nt, Homo sapiens
gcuguugaugaggccucu

SEQ ID NO: 1427422 - RNA, 13 nt, Homo sapiens
gcuguugccucau

SEQ ID NO: 1427423 - RNA, 21 nt, Homo sapiens
gcuguuggacagcugcuugug

SEQ ID NO: 1427424 - RNA, 15 nt, Homo sapiens
gcuguuuucuucuau

SEQ ID NO: 1427425 - RNA, 21 nt, Homo sapiens
gcuguuuugauuuguacugaa

SEQ ID NO: 1427426 - RNA, 13 nt, Homo sapiens
gcuuaccugacac

SEQ ID NO: 1427427 - RNA, 16 nt, Homo sapiens
gcuuagccuccugacc

SEQ ID NO: 1427428 - RNA, 18 nt, Homo sapiens
gcuuaggugccaggcugu

SEQ ID NO: 1427429 - RNA, 19 nt, Homo sapiens
gcuucaacauucuuugcaa

SEQ ID NO: 1427430 - RNA, 19 nt, Homo sapiens
gcuucaccccugcacuuca

SEQ ID NO: 1427431 - RNA, 18 nt, Homo sapiens
gcuucagagccuagccac

SEQ ID NO: 1427432 - RNA, 23 nt, Homo sapiens
gcuucaucaauuuuuauacauau

SEQ ID NO: 1427433 - RNA, 16 nt, Homo sapiens
gcuucauuaugcagcu

SEQ ID NO: 1427434 - RNA, 20 nt, Homo sapiens
gcuucauuugggaaauucag

SEQ ID NO: 1427435 - RNA, 18 nt, Homo sapiens
gcuuccagaccaccugcc

SEQ ID NO: 1427436 - RNA, 17 nt, Homo sapiens
gcuucuaugguugacau

SEQ ID NO: 1427437 - RNA, 13 nt, Homo sapiens
gcuucucaucccc

SEQ ID NO: 1427438 - RNA, 18 nt, Homo sapiens
gcuuuaacaaaacaagaa

SEQ ID NO: 1427439 - RNA, 15 nt, Homo sapiens
gcuuuaguaaugugg

SEQ ID NO: 1427440 - RNA, 20 nt, Homo sapiens
gcuuuaguccuagaggaccu

SEQ ID NO: 1427441 - RNA, 20 nt, Homo sapiens
gcuuucuucuacaaccagag

SEQ ID NO: 1427442 - RNA, 13 nt, Homo sapiens
gcuuugacucacc

SEQ ID NO: 1427443 - RNA, 15 nt, Homo sapiens
gcuuugaggacaaag

SEQ ID NO: 1427444 - RNA, 19 nt, Homo sapiens
gcuuuguuuugucuuacaa

SEQ ID NO: 1427445 - RNA, 16 nt, Homo sapiens
ggaaaaaaaauaaugu

SEQ ID NO: 1427446 - RNA, 23 nt, Homo sapiens
ggaaaaaaaauaauguaaggguc

SEQ ID NO: 1427447 - RNA, 16 nt, Homo sapiens
ggaaaagaggaguuuc

SEQ ID NO: 1427448 - RNA, 19 nt, Homo sapiens
ggaaaauaaauuauauuaa

SEQ ID NO: 1427449 - RNA, 15 nt, Homo sapiens
ggaaaaugucuuaaa

SEQ ID NO: 1427450 - RNA, 18 nt, Homo sapiens
ggaaacagggcagugaca

SEQ ID NO: 1427451 - RNA, 12 nt, Homo sapiens
ggaaaccaaagg

SEQ ID NO: 1427452 - RNA, 16 nt, Homo sapiens
ggaaagcacaccucau

SEQ ID NO: 1427453 - RNA, 12 nt, Homo sapiens
ggaaagccaaac

SEQ ID NO: 1427454 - RNA, 16 nt, Homo sapiens
ggaaaguucagccaga

SEQ ID NO: 1427455 - RNA, 13 nt, Homo sapiens
ggaacaccaggcu

SEQ ID NO: 1427456 - RNA, 20 nt, Homo sapiens
ggaacccugcuugcacuuug

SEQ ID NO: 1427457 - RNA, 21 nt, Homo sapiens
ggaacuagagggauacacuga

SEQ ID NO: 1427458 - RNA, 20 nt, Homo sapiens
ggaacucuggcuuccaggua

SEQ ID NO: 1427459 - RNA, 17 nt, Homo sapiens
ggaacugguucaagaga

SEQ ID NO: 1427460 - RNA, 22 nt, Homo sapiens
ggaacugguucaagagacacug

SEQ ID NO: 1427461 - RNA, 20 nt, Homo sapiens
ggaagauacugacuagucau

SEQ ID NO: 1427462 - RNA, 15 nt, Homo sapiens
ggaagaugaaagagg

SEQ ID NO: 1427463 - RNA, 15 nt, Homo sapiens
ggaagcuccacuguc

SEQ ID NO: 1427464 - RNA, 15 nt, Homo sapiens
ggaagggacacacac

SEQ ID NO: 1427465 - RNA, 18 nt, Homo sapiens
ggaagucguuucaggaca

SEQ ID NO: 1427466 - RNA, 15 nt, Homo sapiens
ggaaguucaacuucc

SEQ ID NO: 1427467 - RNA, 14 nt, Homo sapiens
ggaauaaagcccuu

SEQ ID NO: 1427468 - RNA, 15 nt, Homo sapiens
ggaauaugcuaguga

SEQ ID NO: 1427469 - RNA, 21 nt, Homo sapiens
ggaauccgccugcagaggaca

SEQ ID NO: 1427470 - RNA, 16 nt, Homo sapiens
ggaaugccacagugaa

SEQ ID NO: 1427471 - RNA, 19 nt, Homo sapiens
ggaauguccagacuguggg

SEQ ID NO: 1427472 - RNA, 23 nt, Homo sapiens
ggaauucuuuacaauaaacauag

SEQ ID NO: 1427473 - RNA, 23 nt, Homo sapiens
ggacaaaauggaagguuggagac

SEQ ID NO: 1427474 - RNA, 17 nt, Homo sapiens
ggacaggacuaacacuc

SEQ ID NO: 1427475 - RNA, 23 nt, Homo sapiens
ggacagugcccaugcaauggcuu

SEQ ID NO: 1427476 - RNA, 15 nt, Homo sapiens
ggacaguugggcuau

SEQ ID NO: 1427477 - RNA, 14 nt, Homo sapiens
ggaccaacccuguu

SEQ ID NO: 1427478 - RNA, 14 nt, Homo sapiens
ggaccaggaugaca

SEQ ID NO: 1427479 - RNA, 23 nt, Homo sapiens
uaaaagaaaaaguaugugaauau

SEQ ID NO: 1427480 - RNA, 16 nt, Homo sapiens
uaaaagaaaucuucau

SEQ ID NO: 1427481 - RNA, 21 nt, Homo sapiens
uaaaagaauaaaauugcacuu

SEQ ID NO: 1427482 - RNA, 14 nt, Homo sapiens
uaaaagaauauuca

SEQ ID NO: 1427483 - RNA, 14 nt, Homo sapiens
uaaaagaccacaga

SEQ ID NO: 1427484 - RNA, 15 nt, Homo sapiens
uaaaagauucacuaa

SEQ ID NO: 1427485 - RNA, 17 nt, Homo sapiens
uaaaauaaaaguuuaca

SEQ ID NO: 1427486 - RNA, 20 nt, Homo sapiens
uaaaauaaggauaauaauca

SEQ ID NO: 1427487 - RNA, 15 nt, Homo sapiens
uaaaauacacacuca

SEQ ID NO: 1427488 - RNA, 15 nt, Homo sapiens
uaagacacaccucug

SEQ ID NO: 1427489 - RNA, 17 nt, Homo sapiens
uaagaccauaacagcca

SEQ ID NO: 1427490 - RNA, 19 nt, Homo sapiens
uaagaccugaucuauagau

SEQ ID NO: 1427491 - RNA, 19 nt, Homo sapiens
uaagagcauagaacucaaa

SEQ ID NO: 1427492 - RNA, 14 nt, Homo sapiens
uaagaggcuauuua

SEQ ID NO: 1427493 - RNA, 19 nt, Homo sapiens
uaagauaaauagaguucca

SEQ ID NO: 1427494 - RNA, 14 nt, Homo sapiens
uaagauacacuccu

SEQ ID NO: 1427495 - RNA, 18 nt, Homo sapiens
uaagauuuccaagugcca

SEQ ID NO: 1427496 - RNA, 19 nt, Homo sapiens
uaagcagaagcacauauga

SEQ ID NO: 1427497 - RNA, 22 nt, Homo sapiens
uaagccaacuuuaauugcuuaa

SEQ ID NO: 1427498 - RNA, 20 nt, Homo sapiens
uaagccacucuuccaaaggc

SEQ ID NO: 1427499 - RNA, 19 nt, Homo sapiens
uaagcccccuacugagaaa

SEQ ID NO: 1427500 - RNA, 17 nt, Homo sapiens
uaagccuuuugcucaca

SEQ ID NO: 1427501 - RNA, 20 nt, Homo sapiens
uaagcuucaaagcugcuuua

SEQ ID NO: 1427502 - RNA, 11 nt, Homo sapiens
uaagcuuuauu

SEQ ID NO: 1427503 - RNA, 17 nt, Homo sapiens
uaaggacauuaaaagcu

SEQ ID NO: 1427504 - RNA, 21 nt, Homo sapiens
uaaggacauuaaaagcuauca

SEQ ID NO: 1427505 - RNA, 16 nt, Homo sapiens
uaaggcauagggaaua

SEQ ID NO: 1427506 - RNA, 15 nt, Homo sapiens
uaaggucaaugccag

SEQ ID NO: 1427507 - RNA, 13 nt, Homo sapiens
uaaggugggucca

SEQ ID NO: 1427508 - RNA, 16 nt, Homo sapiens
uaaguaaaccaaaaag

SEQ ID NO: 1427509 - RNA, 21 nt, Homo sapiens
uaaguaauugcauuucugcuc

SEQ ID NO: 1427510 - RNA, 12 nt, Homo sapiens
uaaguauuucca

SEQ ID NO: 1427511 - RNA, 18 nt, Homo sapiens
uaaguccacaucuucuca

SEQ ID NO: 1427512 - RNA, 15 nt, Homo sapiens
uaaguuacuucacuu

SEQ ID NO: 1427513 - RNA, 22 nt, Homo sapiens
uaauaaucauucuuuccccuca

SEQ ID NO: 1427514 - RNA, 18 nt, Homo sapiens
uaauacuugaugcaugca

SEQ ID NO: 1427515 - RNA, 14 nt, Homo sapiens
uaauagacacugga

SEQ ID NO: 1427516 - RNA, 18 nt, Homo sapiens
uaauagauguuacucaaa

SEQ ID NO: 1427517 - RNA, 11 nt, Homo sapiens
uaauagccauc

SEQ ID NO: 1427518 - RNA, 13 nt, Homo sapiens
uaauagcugcuag

SEQ ID NO: 1427519 - RNA, 18 nt, Homo sapiens
uaauauauccacaucuaa

SEQ ID NO: 1427520 - RNA, 15 nt, Homo sapiens
uaauauaugcucaac

SEQ ID NO: 1427521 - RNA, 15 nt, Homo sapiens
uaauauuuaggcaag

SEQ ID NO: 1427522 - RNA, 22 nt, Homo sapiens
uaaucagguccucagagaauuu

SEQ ID NO: 1427523 - RNA, 18 nt, Homo sapiens
uaaucaguuuuauccaca

SEQ ID NO: 1427524 - RNA, 20 nt, Homo sapiens
uaaucaucaccacaccguga

SEQ ID NO: 1427525 - RNA, 14 nt, Homo sapiens
uaaucccagcacuu

SEQ ID NO: 1427526 - RNA, 12 nt, Homo sapiens
uaaucccaguuu

SEQ ID NO: 1427527 - RNA, 22 nt, Homo sapiens
uaaucccccuugccaaauucca

SEQ ID NO: 1427528 - RNA, 11 nt, Homo sapiens
uaaucuaagaa

SEQ ID NO: 1427529 - RNA, 17 nt, Homo sapiens
uaaucucauaccucuga

SEQ ID NO: 1427530 - RNA, 14 nt, Homo sapiens
uaaucuccacuguu

SEQ ID NO: 1427531 - RNA, 19 nt, Homo sapiens
uaaucuucuuaugcaauuu

SEQ ID NO: 1427532 - RNA, 20 nt, Homo sapiens
uaaucuuugaaagcugaaua

SEQ ID NO: 1427533 - RNA, 16 nt, Homo sapiens
uaaugaagacccagug

SEQ ID NO: 1427534 - RNA, 17 nt, Homo sapiens
uaaugaagacccagugu

SEQ ID NO: 1427535 - RNA, 19 nt, Homo sapiens
uaaugaagacccaguguaa

SEQ ID NO: 1427536 - RNA, 17 nt, Homo sapiens
uaaugacaaggugauau

SEQ ID NO: 1427537 - RNA, 14 nt, Homo sapiens
uaaugaguucacua

SEQ ID NO: 1427538 - RNA, 13 nt, Homo sapiens
uaauggcacugau

SEQ ID NO: 1427539 - RNA, 17 nt, Homo sapiens
uaauguauacacaugga

SEQ ID NO: 1427540 - RNA, 18 nt, Homo sapiens
uaauguguuaagugcagg

SEQ ID NO: 1427541 - RNA, 15 nt, Homo sapiens
uaauguuaauucagc

SEQ ID NO: 1427542 - RNA, 20 nt, Homo sapiens
uaauucuuauuuaaguuauu

SEQ ID NO: 1427543 - RNA, 14 nt, Homo sapiens
uaauugauuucaag

SEQ ID NO: 1427544 - RNA, 22 nt, Homo sapiens
uaauugcauuucugcucuucca

SEQ ID NO: 1427545 - RNA, 16 nt, Homo sapiens
uaauuugaauggugca

SEQ ID NO: 1427546 - RNA, 14 nt, Homo sapiens
uaauuuguaucuga

SEQ ID NO: 1427547 - RNA, 15 nt, Homo sapiens
uaauuuucacucugg

SEQ ID NO: 1427548 - RNA, 13 nt, Homo sapiens
uaauuuugucaaa

SEQ ID NO: 1427549 - RNA, 17 nt, Homo sapiens
uaauuuuuacaugacca

SEQ ID NO: 1427550 - RNA, 17 nt, Homo sapiens
uacaacuucaagugcau

SEQ ID NO: 1427551 - RNA, 18 nt, Homo sapiens
uacaacuugcauauguca

SEQ ID NO: 1427552 - RNA, 14 nt, Homo sapiens
uacaagcauuugcc

SEQ ID NO: 1427553 - RNA, 15 nt, Homo sapiens
uacaagcauuugccc

SEQ ID NO: 1427554 - RNA, 16 nt, Homo sapiens
uacaaggacaaugccu

SEQ ID NO: 1427555 - RNA, 16 nt, Homo sapiens
uacaagguuuggcaaa

SEQ ID NO: 1427556 - RNA, 23 nt, Homo sapiens
uacaauaacauaauuuguacaua

SEQ ID NO: 1427557 - RNA, 19 nt, Homo sapiens
uacaauaccagaucacuca

SEQ ID NO: 1427558 - RNA, 21 nt, Homo sapiens
uacaauaccagaucacucaaa

SEQ ID NO: 1427559 - RNA, 17 nt, Homo sapiens
uacaaucugcacuuuaa

SEQ ID NO: 1427560 - RNA, 21 nt, Homo sapiens
uacacacaaaaauuaacaaaa

SEQ ID NO: 1427561 - RNA, 14 nt, Homo sapiens
uacacacacagaug

SEQ ID NO: 1427562 - RNA, 15 nt, Homo sapiens
uacacacauauacau

SEQ ID NO: 1427563 - RNA, 17 nt, Homo sapiens
uacacacauauacauau

SEQ ID NO: 1427564 - RNA, 13 nt, Homo sapiens
uacacauacauac

SEQ ID NO: 1427565 - RNA, 14 nt, Homo sapiens
uacacauacauaca

SEQ ID NO: 1427566 - RNA, 21 nt, Homo sapiens
uacacauuggaaggcucccua

SEQ ID NO: 1427567 - RNA, 12 nt, Homo sapiens
uacacuaauaaa

SEQ ID NO: 1427568 - RNA, 16 nt, Homo sapiens
uacacuauugcauugu

SEQ ID NO: 1427569 - RNA, 16 nt, Homo sapiens
uacacucaaacaauca

SEQ ID NO: 1427570 - RNA, 16 nt, Homo sapiens
uacacuuugaaguauu

SEQ ID NO: 1427571 - RNA, 13 nt, Homo sapiens
uacagaacaaaga

SEQ ID NO: 1427572 - RNA, 13 nt, Homo sapiens
uacagacugugag

SEQ ID NO: 1427573 - RNA, 13 nt, Homo sapiens
uacagauagucaa

SEQ ID NO: 1427574 - RNA, 18 nt, Homo sapiens
uacagauguaaaugccac

SEQ ID NO: 1427575 - RNA, 19 nt, Homo sapiens
uacagauguaaaugccaca

SEQ ID NO: 1427576 - RNA, 22 nt, Homo sapiens
uacagcuaaucagcauucucac

SEQ ID NO: 1427577 - RNA, 16 nt, Homo sapiens
uacaggugcaagccac

SEQ ID NO: 1427578 - RNA, 13 nt, Homo sapiens
uacaguagugcau

SEQ ID NO: 1427579 - RNA, 15 nt, Homo sapiens
uacaguggaucucaa

SEQ ID NO: 1427580 - RNA, 16 nt, Homo sapiens
uacaguuaacucuccc

SEQ ID NO: 1427581 - RNA, 15 nt, Homo sapiens
uacauaacuugauau

SEQ ID NO: 1427582 - RNA, 18 nt, Homo sapiens
uacauaaucacaauaaua

SEQ ID NO: 1427583 - RNA, 12 nt, Homo sapiens
uacauacauaca

SEQ ID NO: 1427584 - RNA, 17 nt, Homo sapiens
uacauacauacauacau

SEQ ID NO: 1427585 - RNA, 15 nt, Homo sapiens
uacauacauacauau

SEQ ID NO: 1427586 - RNA, 12 nt, Homo sapiens
uacauacauaua

SEQ ID NO: 1427587 - RNA, 16 nt, Homo sapiens
uacauacuauggaauu

SEQ ID NO: 1427588 - RNA, 15 nt, Homo sapiens
uacauagauggacca

SEQ ID NO: 1427589 - RNA, 15 nt, Homo sapiens
uacaucuucagcucc

SEQ ID NO: 1427590 - RNA, 14 nt, Homo sapiens
uacaugcaauuuau

SEQ ID NO: 1427591 - RNA, 17 nt, Homo sapiens
uacauuccucagcugcc

SEQ ID NO: 1427592 - RNA, 17 nt, Homo sapiens
uacauuucccugugcug

SEQ ID NO: 1427593 - RNA, 18 nt, Homo sapiens
uacauuucccugugcuga

SEQ ID NO: 1427594 - RNA, 15 nt, Homo sapiens
uacauuuuuguacac

SEQ ID NO: 1427595 - RNA, 18 nt, Homo sapiens
uaccaccccuuccugucc

SEQ ID NO: 1427596 - RNA, 19 nt, Homo sapiens
uaccacugauuuggagaua

SEQ ID NO: 1427597 - RNA, 18 nt, Homo sapiens
uaccagugaaccaaagag

SEQ ID NO: 1427598 - RNA, 14 nt, Homo sapiens
uaccaucuguagag

SEQ ID NO: 1427599 - RNA, 11 nt, Homo sapiens
uacccacuucc

SEQ ID NO: 1427600 - RNA, 23 nt, Homo sapiens
uacccagagaauauauacauucu

SEQ ID NO: 1427601 - RNA, 16 nt, Homo sapiens
uacccagugggacaga

SEQ ID NO: 1427602 - RNA, 22 nt, Homo sapiens
uacccauauaucuuauguuaaa

SEQ ID NO: 1427603 - RNA, 23 nt, Homo sapiens
uaccccaccacgauguggcccug

SEQ ID NO: 1427604 - RNA, 18 nt, Homo sapiens
uaccccuguuaagcaauu

SEQ ID NO: 1427605 - RNA, 23 nt, Homo sapiens
uacccuuccuacagauagucaaa

SEQ ID NO: 1427606 - RNA, 18 nt, Homo sapiens
uaccgcgucuacccuggg

SEQ ID NO: 1427607 - RNA, 13 nt, Homo sapiens
uaccuaccaccuu

SEQ ID NO: 1427608 - RNA, 20 nt, Homo sapiens
uaccuagagcaggcacuuga

SEQ ID NO: 1427609 - RNA, 21 nt, Homo sapiens
uaccuauuauaaaaucuuacu

SEQ ID NO: 1427610 - RNA, 18 nt, Homo sapiens
uaccucccccugccuucc

SEQ ID NO: 1427611 - RNA, 17 nt, Homo sapiens
uaccugcccucucucag

SEQ ID NO: 1427612 - RNA, 16 nt, Homo sapiens
uaccugcugcugcuau

SEQ ID NO: 1427613 - RNA, 22 nt, Homo sapiens
uaccuguaagggcaaagucaau

SEQ ID NO: 1427614 - RNA, 22 nt, Homo sapiens
uaccuuaaaauguaaaacaaaa

SEQ ID NO: 1427615 - RNA, 19 nt, Homo sapiens
uaccuuccuuaagccagga

SEQ ID NO: 1427616 - RNA, 21 nt, Homo sapiens
uacgaccgggagguccaccug

SEQ ID NO: 1427617 - RNA, 15 nt, Homo sapiens
uacgguggucuuuga

SEQ ID NO: 1427618 - RNA, 17 nt, Homo sapiens
uacuaaaaaucaugaga

SEQ ID NO: 1427619 - RNA, 14 nt, Homo sapiens
uacuaaagugucua

SEQ ID NO: 1427620 - RNA, 23 nt, Homo sapiens
uacuaagccacaagaaauuugau

SEQ ID NO: 1427621 - RNA, 23 nt, Homo sapiens
uacuaguguguguguguauauau

SEQ ID NO: 1427622 - RNA, 19 nt, Homo sapiens
uacuauaaugugaugauuc

SEQ ID NO: 1427623 - RNA, 18 nt, Homo sapiens
uacuauacaacaauguuc

SEQ ID NO: 1427624 - RNA, 22 nt, Homo sapiens
uacucagacuguugcacucuaa

SEQ ID NO: 1427625 - RNA, 14 nt, Homo sapiens
uacuccugugcugg

SEQ ID NO: 1427626 - RNA, 15 nt, Homo sapiens
uacucuaagucucca

SEQ ID NO: 1427627 - RNA, 15 nt, Homo sapiens
uacucuauguaugca

SEQ ID NO: 1427628 - RNA, 10 nt, Homo sapiens
uacucucuua

SEQ ID NO: 1427629 - RNA, 20 nt, Homo sapiens
uacugagacaugacuaggaa

SEQ ID NO: 1427630 - RNA, 17 nt, Homo sapiens
uacugauucuccuguca

SEQ ID NO: 1427631 - RNA, 17 nt, Homo sapiens
uacugauuuuugugauu

SEQ ID NO: 1427632 - RNA, 23 nt, Homo sapiens
uacugcaaaugcuauauugcacu

SEQ ID NO: 1427633 - RNA, 17 nt, Homo sapiens
uacugccggucacccag

SEQ ID NO: 1427634 - RNA, 16 nt, Homo sapiens
uacuguacugagacau

SEQ ID NO: 1427635 - RNA, 12 nt, Homo sapiens
uacuguacuuaa

SEQ ID NO: 1427636 - RNA, 14 nt, Homo sapiens
uacugugcauacau

SEQ ID NO: 1427637 - RNA, 20 nt, Homo sapiens
uacugugcgcgugugugugc

SEQ ID NO: 1427638 - RNA, 19 nt, Homo sapiens
uacuuauucuuccgucaca

SEQ ID NO: 1427639 - RNA, 19 nt, Homo sapiens
uacuucauucagaccagug

SEQ ID NO: 1427640 - RNA, 23 nt, Homo sapiens
uacuucccuuuccuccacucccc

SEQ ID NO: 1427641 - RNA, 17 nt, Homo sapiens
uacuuccuaaauuucag

SEQ ID NO: 1427642 - RNA, 17 nt, Homo sapiens
uacuugccacacacugu

SEQ ID NO: 1427643 - RNA, 20 nt, Homo sapiens
uacuugggaggcugaggcag

SEQ ID NO: 1427644 - RNA, 21 nt, Homo sapiens
uacuuguuucaccauacuuca

SEQ ID NO: 1427645 - RNA, 15 nt, Homo sapiens
uacuuuaccuccuau

SEQ ID NO: 1427646 - RNA, 19 nt, Homo sapiens
uacuuugccuuuugcaaac

SEQ ID NO: 1427647 - RNA, 22 nt, Homo sapiens
uacuuuugaaaaucaacuguau

SEQ ID NO: 1427648 - RNA, 12 nt, Homo sapiens
uacuuuuugccc

SEQ ID NO: 1427649 - RNA, 13 nt, Homo sapiens
uagaaaaacuugg

SEQ ID NO: 1427650 - RNA, 14 nt, Homo sapiens
uagaaaacauucca

SEQ ID NO: 1427651 - RNA, 20 nt, Homo sapiens
uagaaauaccucauucgccu

SEQ ID NO: 1427652 - RNA, 19 nt, Homo sapiens
uagaaauguauccugauaa

SEQ ID NO: 1427653 - RNA, 13 nt, Homo sapiens
uagaacacccacu

SEQ ID NO: 1427654 - RNA, 20 nt, Homo sapiens
uagaagccaguacagagaaa

SEQ ID NO: 1427655 - RNA, 15 nt, Homo sapiens
uugggagagugcagu

SEQ ID NO: 1427656 - RNA, 21 nt, Homo sapiens
uugggaugagaaugaaagcuu

SEQ ID NO: 1427657 - RNA, 18 nt, Homo sapiens
uugggaugggaucccagg

SEQ ID NO: 1427658 - RNA, 16 nt, Homo sapiens
uugguaacauccuuuc

SEQ ID NO: 1427659 - RNA, 13 nt, Homo sapiens
uuggucaugcuuc

SEQ ID NO: 1427660 - RNA, 16 nt, Homo sapiens
uugguuagcuggacau

SEQ ID NO: 1427661 - RNA, 23 nt, Homo sapiens
uuguaaacagcuaauaaugaagu

SEQ ID NO: 1427662 - RNA, 16 nt, Homo sapiens
uuguaaaugaccaaga

SEQ ID NO: 1427663 - RNA, 14 nt, Homo sapiens
uuguacacugugua

SEQ ID NO: 1427664 - RNA, 23 nt, Homo sapiens
uuguacccuuccuacagauaguc

SEQ ID NO: 1427665 - RNA, 17 nt, Homo sapiens
uuguacuccugugcugg

SEQ ID NO: 1427666 - RNA, 14 nt, Homo sapiens
uuguacugacccca

SEQ ID NO: 1427667 - RNA, 17 nt, Homo sapiens
uuguagaccacuguccu

SEQ ID NO: 1427668 - RNA, 15 nt, Homo sapiens
uuguagcagaaggca

SEQ ID NO: 1427669 - RNA, 16 nt, Homo sapiens
uuguaggugaaagugu

SEQ ID NO: 1427670 - RNA, 14 nt, Homo sapiens
uuguauaucaugaa

SEQ ID NO: 1427671 - RNA, 17 nt, Homo sapiens
uuguauuugcauaugua

SEQ ID NO: 1427672 - RNA, 17 nt, Homo sapiens
uugucaaagcauugaga

SEQ ID NO: 1427673 - RNA, 13 nt, Homo sapiens
uugucaaugcauc

SEQ ID NO: 1427674 - RNA, 15 nt, Homo sapiens
uugucaaugcaucaa

SEQ ID NO: 1427675 - RNA, 15 nt, Homo sapiens
uugucauagcagcaa

SEQ ID NO: 1427676 - RNA, 13 nt, Homo sapiens
uugucauauguau

SEQ ID NO: 1427677 - RNA, 20 nt, Homo sapiens
uugucauuauguacaauaca

SEQ ID NO: 1427678 - RNA, 18 nt, Homo sapiens
uugucauucaagccugug

SEQ ID NO: 1427679 - RNA, 20 nt, Homo sapiens
uugucauuuuaaaaucugau

SEQ ID NO: 1427680 - RNA, 22 nt, Homo sapiens
uugucuagaggugagaccaaag

SEQ ID NO: 1427681 - RNA, 16 nt, Homo sapiens
uugugaacaccuccua

SEQ ID NO: 1427682 - RNA, 23 nt, Homo sapiens
uugugaacaccuccuagccacau

SEQ ID NO: 1427683 - RNA, 14 nt, Homo sapiens
uugugaucauccca

SEQ ID NO: 1427684 - RNA, 17 nt, Homo sapiens
uugugccagcagaacau

SEQ ID NO: 1427685 - RNA, 15 nt, Homo sapiens
uuguggugucuagca

SEQ ID NO: 1427686 - RNA, 20 nt, Homo sapiens
uugugguuuaugucaucaua

SEQ ID NO: 1427687 - RNA, 21 nt, Homo sapiens
uuguguauguguauuuguaug

SEQ ID NO: 1427688 - RNA, 15 nt, Homo sapiens
uuguguccugaugaa

SEQ ID NO: 1427689 - RNA, 16 nt, Homo sapiens
uugugugguggcaccu

SEQ ID NO: 1427690 - RNA, 12 nt, Homo sapiens
uuguuaugcuau

SEQ ID NO: 1427691 - RNA, 16 nt, Homo sapiens
uuguucagaagacaca

SEQ ID NO: 1427692 - RNA, 23 nt, Homo sapiens
uuguucaucagacuccugugcaa

SEQ ID NO: 1427693 - RNA, 15 nt, Homo sapiens
uuguucugucuuuag

SEQ ID NO: 1427694 - RNA, 15 nt, Homo sapiens
uuguuucaaucuuug

SEQ ID NO: 1427695 - RNA, 19 nt, Homo sapiens
uuguuugggccacugccag

SEQ ID NO: 1427696 - RNA, 19 nt, Homo sapiens
uuguuugugaaacaaaaaa

SEQ ID NO: 1427697 - RNA, 12 nt, Homo sapiens
uuuaaaaaccaa

SEQ ID NO: 1427698 - RNA, 14 nt, Homo sapiens
uuuaaaacaugcac

SEQ ID NO: 1427699 - RNA, 17 nt, Homo sapiens
uuuaaaauaaggauaau

SEQ ID NO: 1427700 - RNA, 13 nt, Homo sapiens
uuuaaaauaucac

SEQ ID NO: 1427701 - RNA, 23 nt, Homo sapiens
uuuaaagcuacaaucuguucaau

SEQ ID NO: 1427702 - RNA, 18 nt, Homo sapiens
uuuaaauaaaguaucaug

SEQ ID NO: 1427703 - RNA, 15 nt, Homo sapiens
uuuaaauccuuccau

SEQ ID NO: 1427704 - RNA, 22 nt, Homo sapiens
uuuaacacuagaaaacauucca

SEQ ID NO: 1427705 - RNA, 21 nt, Homo sapiens
uuuaacaugacuucugcccca

SEQ ID NO: 1427706 - RNA, 22 nt, Homo sapiens
uaaaauagauccuaggugcugg

SEQ ID NO: 1427707 - RNA, 22 nt, Homo sapiens
uaaaauaggaaccuaugaaacu

SEQ ID NO: 1427708 - RNA, 15 nt, Homo sapiens
uaaaauauacaaaca

SEQ ID NO: 1427709 - RNA, 17 nt, Homo sapiens
uaaaaucauucaauauc

SEQ ID NO: 1427710 - RNA, 16 nt, Homo sapiens
uaaaaucuuacuuugu

SEQ ID NO: 1427711 - RNA, 19 nt, Homo sapiens
uaaaaucuuggcacagaaa

SEQ ID NO: 1427712 - RNA, 14 nt, Homo sapiens
uaaaaugaaauguc

SEQ ID NO: 1427713 - RNA, 12 nt, Homo sapiens
uaaaaugaggcu

SEQ ID NO: 1427714 - RNA, 18 nt, Homo sapiens
uaaaauuagaaagcaacu

SEQ ID NO: 1427715 - RNA, 14 nt, Homo sapiens
uaaaauucacuuag

SEQ ID NO: 1427716 - RNA, 14 nt, Homo sapiens
uaaaauuguaaaau

SEQ ID NO: 1427717 - RNA, 13 nt, Homo sapiens
uaaaauuucaaca

SEQ ID NO: 1427718 - RNA, 17 nt, Homo sapiens
uaaacaagggcagugag

SEQ ID NO: 1427719 - RNA, 17 nt, Homo sapiens
uaaacacccaugaauca

SEQ ID NO: 1427720 - RNA, 20 nt, Homo sapiens
uaaacagugagccugaauuu

SEQ ID NO: 1427721 - RNA, 17 nt, Homo sapiens
uaaacaugagcgcugau

SEQ ID NO: 1427722 - RNA, 12 nt, Homo sapiens
uaaacauucucu

SEQ ID NO: 1427723 - RNA, 21 nt, Homo sapiens
uaaacauuugagagcuaacua

SEQ ID NO: 1427724 - RNA, 15 nt, Homo sapiens
uaaacuaaaagcaua

SEQ ID NO: 1427725 - RNA, 14 nt, Homo sapiens
uaaacuagaucucc

SEQ ID NO: 1427726 - RNA, 14 nt, Homo sapiens
uaaacuaguuucca

SEQ ID NO: 1427727 - RNA, 15 nt, Homo sapiens
uaaacuuucucugca

SEQ ID NO: 1427728 - RNA, 21 nt, Homo sapiens
uaaacuuucucugcaaagacu

SEQ ID NO: 1427729 - RNA, 20 nt, Homo sapiens
uaaagaaguaaauuugucca

SEQ ID NO: 1427730 - RNA, 16 nt, Homo sapiens
uaaagaauauuuacaa

SEQ ID NO: 1427731 - RNA, 10 nt, Homo sapiens
uaaagacuua

SEQ ID NO: 1427732 - RNA, 14 nt, Homo sapiens
uaaagagcauggaa

SEQ ID NO: 1427733 - RNA, 19 nt, Homo sapiens
uaaagcaguagacaauccc

SEQ ID NO: 1427734 - RNA, 13 nt, Homo sapiens
uaaagcauugcaa

SEQ ID NO: 1427735 - RNA, 14 nt, Homo sapiens
uaaagcauugcaac

SEQ ID NO: 1427736 - RNA, 15 nt, Homo sapiens
uaaagcuacaacaaa

SEQ ID NO: 1427737 - RNA, 17 nt, Homo sapiens
uaaagcuacaaucuguu

SEQ ID NO: 1427738 - RNA, 13 nt, Homo sapiens
uaaagcugcugag

SEQ ID NO: 1427739 - RNA, 19 nt, Homo sapiens
uaaaggaagucaccaaaau

SEQ ID NO: 1427740 - RNA, 14 nt, Homo sapiens
uaaaggccuggaac

SEQ ID NO: 1427741 - RNA, 13 nt, Homo sapiens
uaaaguaccauua

SEQ ID NO: 1427742 - RNA, 17 nt, Homo sapiens
uaaagucaacaaccaug

SEQ ID NO: 1427743 - RNA, 20 nt, Homo sapiens
uaaagucaacaaccaugcca

SEQ ID NO: 1427744 - RNA, 18 nt, Homo sapiens
uaaagucacuuccagugu

SEQ ID NO: 1427745 - RNA, 13 nt, Homo sapiens
uaaagucucugcu

SEQ ID NO: 1427746 - RNA, 14 nt, Homo sapiens
uaaagugauuucau

SEQ ID NO: 1427747 - RNA, 18 nt, Homo sapiens
uaaagugguucuggauau

SEQ ID NO: 1427748 - RNA, 17 nt, Homo sapiens
uaaaguguggaagcaga

SEQ ID NO: 1427749 - RNA, 15 nt, Homo sapiens
uaaaguguuugccuc

SEQ ID NO: 1427750 - RNA, 15 nt, Homo sapiens
uaaauaaaucauuaa

SEQ ID NO: 1427751 - RNA, 22 nt, Homo sapiens
uaaauauuaaccugaauuauuc

SEQ ID NO: 1427752 - RNA, 21 nt, Homo sapiens
uaaauccucagguaguacugg

SEQ ID NO: 1427753 - RNA, 20 nt, Homo sapiens
uaaaucugagccuaaaucua

SEQ ID NO: 1427754 - RNA, 21 nt, Homo sapiens
uaaaucuuucuuuugauucuu

SEQ ID NO: 1427755 - RNA, 15 nt, Homo sapiens
uaaaugaagugcaaa

SEQ ID NO: 1427756 - RNA, 18 nt, Homo sapiens
uaaaugauguacuacauu

SEQ ID NO: 1427757 - RNA, 19 nt, Homo sapiens
uaaaugccaggccuggcaa

SEQ ID NO: 1427758 - RNA, 12 nt, Homo sapiens
uaaauggagcuu

SEQ ID NO: 1427759 - RNA, 16 nt, Homo sapiens
uaaauguauaugucau

SEQ ID NO: 1427760 - RNA, 13 nt, Homo sapiens
uaaauguguauuc

SEQ ID NO: 1427761 - RNA, 21 nt, Homo sapiens
uaaauuggaauuuucuuaccc

SEQ ID NO: 1427762 - RNA, 17 nt, Homo sapiens
uaaauuguuugaccaug

SEQ ID NO: 1427763 - RNA, 23 nt, Homo sapiens
uaaauuuguuauuguguauuaug

SEQ ID NO: 1427764 - RNA, 23 nt, Homo sapiens
uaaauuuuaacauuuuccaaaau

SEQ ID NO: 1427765 - RNA, 20 nt, Homo sapiens
uaacaaaacuauacuuguac

SEQ ID NO: 1427766 - RNA, 19 nt, Homo sapiens
uaacaaacuacauguaauc

SEQ ID NO: 1427767 - RNA, 16 nt, Homo sapiens
uaacaacaaugguuua

SEQ ID NO: 1427768 - RNA, 22 nt, Homo sapiens
uaacaaccagagaugacugaaa

SEQ ID NO: 1427769 - RNA, 17 nt, Homo sapiens
uaacaaccccggacaaa

SEQ ID NO: 1427770 - RNA, 22 nt, Homo sapiens
uaacacgaauccugacaccacc

SEQ ID NO: 1427771 - RNA, 16 nt, Homo sapiens
uaacacucaccaucag

SEQ ID NO: 1427772 - RNA, 16 nt, Homo sapiens
uaacagacuuguuuaa

SEQ ID NO: 1427773 - RNA, 15 nt, Homo sapiens
uaacagucauuuaaa

SEQ ID NO: 1427774 - RNA, 17 nt, Homo sapiens
uaacaugacuucugccc

SEQ ID NO: 1427775 - RNA, 17 nt, Homo sapiens
uaacaugcaauuuugca

SEQ ID NO: 1427776 - RNA, 12 nt, Homo sapiens
uaaccaguacuu

SEQ ID NO: 1427777 - RNA, 17 nt, Homo sapiens
uaaccauuacauguuua

SEQ ID NO: 1427778 - RNA, 18 nt, Homo sapiens
uaaccccaggcaucccau

SEQ ID NO: 1427779 - RNA, 19 nt, Homo sapiens
uaaccgaacuggugcuuua

SEQ ID NO: 1427780 - RNA, 18 nt, Homo sapiens
uaaccucaucuacaagca

SEQ ID NO: 1427781 - RNA, 19 nt, Homo sapiens
uaaccugcccacccacucc

SEQ ID NO: 1427782 - RNA, 21 nt, Homo sapiens
uaaccuucuggcuuccuucuc

SEQ ID NO: 1427783 - RNA, 13 nt, Homo sapiens
uaacuaucaauau

SEQ ID NO: 1427784 - RNA, 15 nt, Homo sapiens
uuuguucacaugcau

SEQ ID NO: 1427785 - RNA, 19 nt, Homo sapiens
uuuguucacuucgaugacu

SEQ ID NO: 1427786 - RNA, 21 nt, Homo sapiens
uuuguucuccggguguggccu

SEQ ID NO: 1427787 - RNA, 20 nt, Homo sapiens
uuuguuguuuuuaacaacua

SEQ ID NO: 1427788 - RNA, 15 nt, Homo sapiens
uuuguuuugcacuga

SEQ ID NO: 1427789 - RNA, 19 nt, Homo sapiens
uuuuaacaacugugcuuuu

SEQ ID NO: 1427790 - RNA, 13 nt, Homo sapiens
uuuuaacauucca

SEQ ID NO: 1427791 - RNA, 12 nt, Homo sapiens
uuuuaacugcau

SEQ ID NO: 1427792 - RNA, 14 nt, Homo sapiens
uuuuaagaaagugc

SEQ ID NO: 1427793 - RNA, 12 nt, Homo sapiens
uuuuaauugauu

SEQ ID NO: 1427794 - RNA, 16 nt, Homo sapiens
uuuuaauuucuaugga

SEQ ID NO: 1427795 - RNA, 16 nt, Homo sapiens
uuuuagggcuguagac

SEQ ID NO: 1427796 - RNA, 22 nt, Homo sapiens
uuuuauaaauucagaaagucau

SEQ ID NO: 1427797 - RNA, 16 nt, Homo sapiens
uuuuauacuaccaagu

SEQ ID NO: 1427798 - RNA, 23 nt, Homo sapiens
uuuuauggaggcuuugcauagau

SEQ ID NO: 1427799 - RNA, 20 nt, Homo sapiens
uuuuaugggaauucuuuaca

SEQ ID NO: 1427800 - RNA, 19 nt, Homo sapiens
uuuucaagagugcaguuga

SEQ ID NO: 1427801 - RNA, 14 nt, Homo sapiens
uuuucaagaugcuu

SEQ ID NO: 1427802 - RNA, 23 nt, Homo sapiens
uuuucaauaaugugaacugcuga

SEQ ID NO: 1427803 - RNA, 13 nt, Homo sapiens
uuuucacucuggg

SEQ ID NO: 1427804 - RNA, 10 nt, Homo sapiens
uuuucacugc

SEQ ID NO: 1427805 - RNA, 17 nt, Homo sapiens
uuuucaugucauuugac

SEQ ID NO: 1427806 - RNA, 15 nt, Homo sapiens
uuuuccagauucuuc

SEQ ID NO: 1427807 - RNA, 18 nt, Homo sapiens
uuuuccucgccuaggccu

SEQ ID NO: 1427808 - RNA, 13 nt, Homo sapiens
uuuucgaacauuc

SEQ ID NO: 1427809 - RNA, 15 nt, Homo sapiens
uuuucuagacugucu

SEQ ID NO: 1427810 - RNA, 15 nt, Homo sapiens
uuuucucugugcuuc

SEQ ID NO: 1427811 - RNA, 12 nt, Homo sapiens
uuuucuuggcag

SEQ ID NO: 1427812 - RNA, 18 nt, Homo sapiens
uuuugacaucagcauuag

SEQ ID NO: 1427813 - RNA, 20 nt, Homo sapiens
uuuugagaauacacuaucaa

SEQ ID NO: 1427814 - RNA, 22 nt, Homo sapiens
uuuugaggaauuaucaugggaa

SEQ ID NO: 1427815 - RNA, 14 nt, Homo sapiens
uuuugauagauauc

SEQ ID NO: 1427816 - RNA, 13 nt, Homo sapiens
uuuugcacugaca

SEQ ID NO: 1427817 - RNA, 22 nt, Homo sapiens
uuuugcugucuuucucuaaaua

SEQ ID NO: 1427818 - RNA, 15 nt, Homo sapiens
uuuugggaaaacugg

SEQ ID NO: 1427819 - RNA, 22 nt, Homo sapiens
uuuuggugguccccacagccuc

SEQ ID NO: 1427820 - RNA, 18 nt, Homo sapiens
uuuugugaaguuaccucu

SEQ ID NO: 1427821 - RNA, 12 nt, Homo sapiens
uuuuuaguaugu

SEQ ID NO: 1427822 - RNA, 15 nt, Homo sapiens
ccacugcugcugcag

SEQ ID NO: 1427823 - RNA, 19 nt, Homo sapiens
ccacuuagaaauugcauuu

SEQ ID NO: 1427824 - RNA, 14 nt, Homo sapiens
ccacuugucaucca

SEQ ID NO: 1427825 - RNA, 21 nt, Homo sapiens
aacacaguuuagugcuuuaca

SEQ ID NO: 1427826 - RNA, 23 nt, Homo sapiens
aacaccacuuugucucugagaac

SEQ ID NO: 1427827 - RNA, 15 nt, Homo sapiens
aacacccaugaauca

SEQ ID NO: 1427828 - RNA, 18 nt, Homo sapiens
aacacccaugaaucaaag

SEQ ID NO: 1427829 - RNA, 19 nt, Homo sapiens
aacacccgacuccucaaaa

SEQ ID NO: 1427830 - RNA, 21 nt, Homo sapiens
aacaccuuuguuuugcacuga

SEQ ID NO: 1427831 - RNA, 18 nt, Homo sapiens
aacacguggguauuuaau

SEQ ID NO: 1427832 - RNA, 19 nt, Homo sapiens
aacacuaguuuugugccag

SEQ ID NO: 1427833 - RNA, 16 nt, Homo sapiens
aacacucaacaauaaa

SEQ ID NO: 1427834 - RNA, 22 nt, Homo sapiens
aacacucaacaauaaagacuga

SEQ ID NO: 1427835 - RNA, 17 nt, Homo sapiens
aacacucagaagccugg

SEQ ID NO: 1427836 - RNA, 14 nt, Homo sapiens
aacacucucugaga

SEQ ID NO: 1427837 - RNA, 14 nt, Homo sapiens
aacacugaaucaug

SEQ ID NO: 1427838 - RNA, 19 nt, Homo sapiens
aacacuuauacugacuuuc

SEQ ID NO: 1427839 - RNA, 14 nt, Homo sapiens
aacacuucucauca

SEQ ID NO: 1427840 - RNA, 20 nt, Homo sapiens
aacagaagccaaaauacuuc

SEQ ID NO: 1427841 - RNA, 12 nt, Homo sapiens
aacagaguaaau

SEQ ID NO: 1427842 - RNA, 19 nt, Homo sapiens
aacagagugaaaugccauu

SEQ ID NO: 1427843 - RNA, 14 nt, Homo sapiens
aacagauauuguca

SEQ ID NO: 1427844 - RNA, 15 nt, Homo sapiens
aacaguaacugccau

SEQ ID NO: 1427845 - RNA, 13 nt, Homo sapiens
aacaguucuugga

SEQ ID NO: 1427846 - RNA, 21 nt, Homo sapiens
aacaucacugaaaugcuagcu

SEQ ID NO: 1427847 - RNA, 20 nt, Homo sapiens
aacauccagaagguuugcac

SEQ ID NO: 1427848 - RNA, 23 nt, Homo sapiens
aacauccauguccuaugugugac

SEQ ID NO: 1427849 - RNA, 22 nt, Homo sapiens
aacauccuaagugggaagugaa

SEQ ID NO: 1427850 - RNA, 21 nt, Homo sapiens
aacauguaccacugagccuga

SEQ ID NO: 1427851 - RNA, 21 nt, Homo sapiens
aacauguggcaaccuguucuu

SEQ ID NO: 1427852 - RNA, 20 nt, Homo sapiens
aacauguuugggaaguccua

SEQ ID NO: 1427853 - RNA, 15 nt, Homo sapiens
aacauucaucaagcu

SEQ ID NO: 1427854 - RNA, 14 nt, Homo sapiens
aaccaaccaaccaa

SEQ ID NO: 1427855 - RNA, 19 nt, Homo sapiens
aaccaagucuacuucacua

SEQ ID NO: 1427856 - RNA, 23 nt, Homo sapiens
aaccaagucuacuucacuaauga

SEQ ID NO: 1427857 - RNA, 21 nt, Homo sapiens
aaccaauuuuaaauacauucu

SEQ ID NO: 1427858 - RNA, 13 nt, Homo sapiens
aaccacucaaauu

SEQ ID NO: 1427859 - RNA, 13 nt, Homo sapiens
aaccacuguacau

SEQ ID NO: 1427860 - RNA, 14 nt, Homo sapiens
aaccagaggguugu

SEQ ID NO: 1427861 - RNA, 20 nt, Homo sapiens
aaccagcagaaaagugcuua

SEQ ID NO: 1427862 - RNA, 21 nt, Homo sapiens
aaccauaguuauuuacuugaa

SEQ ID NO: 1427863 - RNA, 15 nt, Homo sapiens
aaccaucccugaugu

SEQ ID NO: 1427864 - RNA, 11 nt, Homo sapiens
aacccaaauaa

SEQ ID NO: 1427865 - RNA, 15 nt, Homo sapiens
aacccacugugcuua

SEQ ID NO: 1427866 - RNA, 17 nt, Homo sapiens
aacccagcauguacaaa

SEQ ID NO: 1427867 - RNA, 15 nt, Homo sapiens
aacccaucagacagg

SEQ ID NO: 1427868 - RNA, 16 nt, Homo sapiens
aacccaucagacaggu

SEQ ID NO: 1427869 - RNA, 21 nt, Homo sapiens
aaccccagacucaaacucaag

SEQ ID NO: 1427870 - RNA, 13 nt, Homo sapiens
aaccccaugggcu

SEQ ID NO: 1427871 - RNA, 16 nt, Homo sapiens
aacccguuuuauucua

SEQ ID NO: 1427872 - RNA, 22 nt, Homo sapiens
aacccugcuugcacuuuguaac

SEQ ID NO: 1427873 - RNA, 22 nt, Homo sapiens
aacccuuuuccuccagacagau

SEQ ID NO: 1427874 - RNA, 18 nt, Homo sapiens
aaccuagcacgugccagu

SEQ ID NO: 1427875 - RNA, 16 nt, Homo sapiens
aaccucaaacugggua

SEQ ID NO: 1427876 - RNA, 12 nt, Homo sapiens
aaccucauucuc

SEQ ID NO: 1427877 - RNA, 18 nt, Homo sapiens
aaccucucuaagccacag

SEQ ID NO: 1427878 - RNA, 20 nt, Homo sapiens
aaccucucuaagccacagcu

SEQ ID NO: 1427879 - RNA, 18 nt, Homo sapiens
aaccucucuucuaccuua

SEQ ID NO: 1427880 - RNA, 20 nt, Homo sapiens
aaccugcccacccacuccuu

SEQ ID NO: 1427881 - RNA, 17 nt, Homo sapiens
aaccugccugugcauga

SEQ ID NO: 1427882 - RNA, 13 nt, Homo sapiens
aaccugcucuccu

SEQ ID NO: 1427883 - RNA, 17 nt, Homo sapiens
aaccuggagaugaugau

SEQ ID NO: 1427884 - RNA, 21 nt, Homo sapiens
aaccuggcagguuagaaccua

SEQ ID NO: 1427885 - RNA, 16 nt, Homo sapiens
aaccugguccuaaccc

SEQ ID NO: 1427886 - RNA, 17 nt, Homo sapiens
aaccugguggcaccaga

SEQ ID NO: 1427887 - RNA, 21 nt, Homo sapiens
aaccuuaaccucucuaagcca

SEQ ID NO: 1427888 - RNA, 18 nt, Homo sapiens
aaccuuuaaaaaagcaaa

SEQ ID NO: 1427889 - RNA, 16 nt, Homo sapiens
aaccuuucaaauuuca

SEQ ID NO: 1427890 - RNA, 22 nt, Homo sapiens
aacgacaaaucaccauguaaca

SEQ ID NO: 1427891 - RNA, 16 nt, Homo sapiens
aacgccuuuuauucua

SEQ ID NO: 1427892 - RNA, 18 nt, Homo sapiens
aacggcuuauuagugaaa

SEQ ID NO: 1427893 - RNA, 22 nt, Homo sapiens
aacgggacccccuggcccugcc

SEQ ID NO: 1427894 - RNA, 22 nt, Homo sapiens
aacguggguauuuccugcuaca

SEQ ID NO: 1427895 - RNA, 17 nt, Homo sapiens
aacguuuugaacuaaua

SEQ ID NO: 1427896 - RNA, 22 nt, Homo sapiens
aacuaauaaaagcauaaaugca

SEQ ID NO: 1427897 - RNA, 20 nt, Homo sapiens
aacuagacauuaccaaagug

SEQ ID NO: 1427898 - RNA, 14 nt, Homo sapiens
aacuaucuuuuugc

SEQ ID NO: 1427899 - RNA, 19 nt, Homo sapiens
aacuaugguucccaauaaa

SEQ ID NO: 1427900 - RNA, 13 nt, Homo sapiens
aacuaugugaugu

SEQ ID NO: 1427901 - RNA, 22 nt, Homo sapiens
aacuaugugauguuaacuauua

SEQ ID NO: 1427902 - RNA, 19 nt, Homo sapiens
aacuauugauaugugaaua

SEQ ID NO: 1427903 - RNA, 16 nt, Homo sapiens
aacucagacauuccaa

SEQ ID NO: 1427904 - RNA, 23 nt, Homo sapiens
aacuccggaaugaccagcaugau

SEQ ID NO: 1427905 - RNA, 14 nt, Homo sapiens
aacuccuccuugcc

SEQ ID NO: 1427906 - RNA, 22 nt, Homo sapiens
aacuccugauuuuguaguuaau

SEQ ID NO: 1427907 - RNA, 14 nt, Homo sapiens
aacucugacaaggg

SEQ ID NO: 1427908 - RNA, 22 nt, Homo sapiens
aacucugacaagggcugaccug

SEQ ID NO: 1427909 - RNA, 21 nt, Homo sapiens
aacucugccugagacuuucag

SEQ ID NO: 1427910 - RNA, 16 nt, Homo sapiens
aacugaaaaaugucag

SEQ ID NO: 1427911 - RNA, 17 nt, Homo sapiens
aauuugguguggcugua

SEQ ID NO: 1427912 - RNA, 19 nt, Homo sapiens
aauuuguaauugcuuacau

SEQ ID NO: 1427913 - RNA, 17 nt, Homo sapiens
aauuuuaaauguucaca

SEQ ID NO: 1427914 - RNA, 13 nt, Homo sapiens
aauuuuaauugau

SEQ ID NO: 1427915 - RNA, 19 nt, Homo sapiens
aauuuuguuuguugaugug

SEQ ID NO: 1427916 - RNA, 22 nt, Homo sapiens
aauuuuuauacauaucagaaaa

SEQ ID NO: 1427917 - RNA, 14 nt, Homo sapiens
aauuuuuccaugaa

SEQ ID NO: 1427918 - RNA, 16 nt, Homo sapiens
acaaaaaagaaggcuu

SEQ ID NO: 1427919 - RNA, 23 nt, Homo sapiens
acaaaaaaguguucccuuuucaa

SEQ ID NO: 1427920 - RNA, 13 nt, Homo sapiens
acaaaaacacagc

SEQ ID NO: 1427921 - RNA, 17 nt, Homo sapiens
acaaaaaggcauaugca

SEQ ID NO: 1427922 - RNA, 12 nt, Homo sapiens
acaaaaauuuca

SEQ ID NO: 1427923 - RNA, 14 nt, Homo sapiens
acaaaacacugugu

SEQ ID NO: 1427924 - RNA, 21 nt, Homo sapiens
acaaaauguacgaaacuguau

SEQ ID NO: 1427925 - RNA, 20 nt, Homo sapiens
acaaacacugaaucauguua

SEQ ID NO: 1427926 - RNA, 18 nt, Homo sapiens
acaaaccacaacugacac

SEQ ID NO: 1427927 - RNA, 16 nt, Homo sapiens
acaaacuacauguaau

SEQ ID NO: 1427928 - RNA, 18 nt, Homo sapiens
acaaagauuauuugcacg

SEQ ID NO: 1427929 - RNA, 13 nt, Homo sapiens
acaaagcuucuau

SEQ ID NO: 1427930 - RNA, 13 nt, Homo sapiens
acaaauauuccug

SEQ ID NO: 1427931 - RNA, 16 nt, Homo sapiens
acaaauuauguuacau

SEQ ID NO: 1427932 - RNA, 15 nt, Homo sapiens
acaaauucuacagca

SEQ ID NO: 1427933 - RNA, 14 nt, Homo sapiens
acaacaaaccaaaa

SEQ ID NO: 1427934 - RNA, 18 nt, Homo sapiens
acaacauccauguccuau

SEQ ID NO: 1427935 - RNA, 14 nt, Homo sapiens
acaacauuuuauua

SEQ ID NO: 1427936 - RNA, 22 nt, Homo sapiens
acaacauuuuugguguauuuga

SEQ ID NO: 1427937 - RNA, 19 nt, Homo sapiens
acaagaagaccagacugug

SEQ ID NO: 1427938 - RNA, 18 nt, Homo sapiens
acaagagacuuaacuuau

SEQ ID NO: 1427939 - RNA, 18 nt, Homo sapiens
acaagaguugucuugucc

SEQ ID NO: 1427940 - RNA, 20 nt, Homo sapiens
acaagcaagggcugugcuga

SEQ ID NO: 1427941 - RNA, 11 nt, Homo sapiens
acaagcacaga

SEQ ID NO: 1427942 - RNA, 14 nt, Homo sapiens
acaagcauauuuga

SEQ ID NO: 1427943 - RNA, 16 nt, Homo sapiens
acaagcauuuguucca

SEQ ID NO: 1427944 - RNA, 18 nt, Homo sapiens
acaaggaucagaauggaa

SEQ ID NO: 1427945 - RNA, 20 nt, Homo sapiens
acaaggcugggcaccucuag

SEQ ID NO: 1427946 - RNA, 21 nt, Homo sapiens
acaagguagacauggauuuga

SEQ ID NO: 1427947 - RNA, 22 nt, Homo sapiens
acaaggugucuuuuccacuccu

SEQ ID NO: 1427948 - RNA, 15 nt, Homo sapiens
acaaguaaucacuaa

SEQ ID NO: 1427949 - RNA, 21 nt, Homo sapiens
acaaguuucccaaauucccug

SEQ ID NO: 1427950 - RNA, 14 nt, Homo sapiens
acaauaaagacuga

SEQ ID NO: 1427951 - RNA, 20 nt, Homo sapiens
acaauaaaggcugagcucuu

SEQ ID NO: 1427952 - RNA, 22 nt, Homo sapiens
acaauaaaugcugaaugaaucc

SEQ ID NO: 1427953 - RNA, 17 nt, Homo sapiens
acaauaaugaguucacu

SEQ ID NO: 1427954 - RNA, 16 nt, Homo sapiens
acaauaauuaaugugu

SEQ ID NO: 1427955 - RNA, 20 nt, Homo sapiens
acaauaucuucauacaauga

SEQ ID NO: 1427956 - RNA, 13 nt, Homo sapiens
acaaucacacuca

SEQ ID NO: 1427957 - RNA, 21 nt, Homo sapiens
acaaucuuuccuugucucuca

SEQ ID NO: 1427958 - RNA, 16 nt, Homo sapiens
acaaugaaaugcucuc

SEQ ID NO: 1427959 - RNA, 18 nt, Homo sapiens
acaauggcuaauucccag

SEQ ID NO: 1427960 - RNA, 20 nt, Homo sapiens
acaauguuucagaagcccca

SEQ ID NO: 1427961 - RNA, 22 nt, Homo sapiens
acaauucucucuuauaugugua

SEQ ID NO: 1427962 - RNA, 20 nt, Homo sapiens
acaauuuagaaaacauucau

SEQ ID NO: 1427963 - RNA, 15 nt, Homo sapiens
acaauuucauucagu

SEQ ID NO: 1427964 - RNA, 24 nt, Homo sapiens
acaauuugagcaauucauuucacu

SEQ ID NO: 1427965 - RNA, 14 nt, Homo sapiens
acacaaauucuaaa

SEQ ID NO: 1427966 - RNA, 23 nt, Homo sapiens
acacaaucuuuccuugucucuca

SEQ ID NO: 1427967 - RNA, 22 nt, Homo sapiens
acacaaugcuauugaaauuacu

SEQ ID NO: 1427968 - RNA, 14 nt, Homo sapiens
acacacacaccucu

SEQ ID NO: 1427969 - RNA, 15 nt, Homo sapiens
acacacacagaugca

SEQ ID NO: 1427970 - RNA, 17 nt, Homo sapiens
acacacacgccaaugca

SEQ ID NO: 1427971 - RNA, 18 nt, Homo sapiens
acacacagagauaugcac

SEQ ID NO: 1427972 - RNA, 16 nt, Homo sapiens
acacacagauaugcac

SEQ ID NO: 1427973 - RNA, 13 nt, Homo sapiens
acacacagucuca

SEQ ID NO: 1427974 - RNA, 17 nt, Homo sapiens
acacacgccaaugcaca

SEQ ID NO: 1427975 - RNA, 21 nt, Homo sapiens
acacacggaugcacacacaga

SEQ ID NO: 1427976 - RNA, 14 nt, Homo sapiens
acacacugacauua

SEQ ID NO: 1427977 - RNA, 12 nt, Homo sapiens
acacacuguaaa

SEQ ID NO: 1427978 - RNA, 21 nt, Homo sapiens
acacagagguuuuaaacaguc

SEQ ID NO: 1427979 - RNA, 14 nt, Homo sapiens
acacagauaugcac

SEQ ID NO: 1427980 - RNA, 19 nt, Homo sapiens
acacagaugcacacacaga

SEQ ID NO: 1427981 - RNA, 21 nt, Homo sapiens
acacagauggucacacagaga

SEQ ID NO: 1427982 - RNA, 23 nt, Homo sapiens
acacagauuuuugggcuccacuc

SEQ ID NO: 1427983 - RNA, 22 nt, Homo sapiens
acacagcaagggugaugggaaa

SEQ ID NO: 1427984 - RNA, 23 nt, Homo sapiens
acacaggaaaccaacacccaaag

SEQ ID NO: 1427985 - RNA, 15 nt, Homo sapiens
acacagggcucuuug

SEQ ID NO: 1427986 - RNA, 18 nt, Homo sapiens
acacagggugcaugugag

SEQ ID NO: 1427987 - RNA, 19 nt, Homo sapiens
acacaguauuaagugacag

SEQ ID NO: 1427988 - RNA, 19 nt, Homo sapiens
acacaucagugcacacgga

SEQ ID NO: 1427989 - RNA, 21 nt, Homo sapiens
acacaucccggccucuuccac

SEQ ID NO: 1427990 - RNA, 17 nt, Homo sapiens
acacauguccaguggga

SEQ ID NO: 1427991 - RNA, 13 nt, Homo sapiens
acaccacgaauuu

SEQ ID NO: 1427992 - RNA, 20 nt, Homo sapiens
acaccaucuuaaaugacagu

SEQ ID NO: 1427993 - RNA, 17 nt, Homo sapiens
acacccacccacuucuc

SEQ ID NO: 1427994 - RNA, 17 nt, Homo sapiens
acacccaugaaucaaag

SEQ ID NO: 1427995 - RNA, 23 nt, Homo sapiens
acacccuaauaaguccacaucuu

SEQ ID NO: 1427996 - RNA, 23 nt, Homo sapiens
acacguuaggaauguccagacug

SEQ ID NO: 1427997 - RNA, 16 nt, Homo sapiens
acccugggauucagga

SEQ ID NO: 1427998 - RNA, 20 nt, Homo sapiens
acccugucucuacuaaaaau

SEQ ID NO: 1427999 - RNA, 14 nt, Homo sapiens
acccuugcauuaga

SEQ ID NO: 1428000 - RNA, 19 nt, Homo sapiens
acccuuggagccaauggag

SEQ ID NO: 1428001 - RNA, 18 nt, Homo sapiens
acccuuuuccuccagaca

SEQ ID NO: 1428002 - RNA, 21 nt, Homo sapiens
acccuuuuccuccagacagau

SEQ ID NO: 1428003 - RNA, 19 nt, Homo sapiens
accgagagagauggaauaa

SEQ ID NO: 1428004 - RNA, 12 nt, Homo sapiens
accgaugcacac

SEQ ID NO: 1428005 - RNA, 12 nt, Homo sapiens
accgcgugccau

SEQ ID NO: 1428006 - RNA, 19 nt, Homo sapiens
accgcuggggaacagagcg

SEQ ID NO: 1428007 - RNA, 22 nt, Homo sapiens
accgggagccucccccucagau

SEQ ID NO: 1428008 - RNA, 21 nt, Homo sapiens
accgggccacuccuuccugcc

SEQ ID NO: 1428009 - RNA, 12 nt, Homo sapiens
accggggaaccc

SEQ ID NO: 1428010 - RNA, 15 nt, Homo sapiens
accgucccucaguga

SEQ ID NO: 1428011 - RNA, 15 nt, Homo sapiens
accgugaccaggaac

SEQ ID NO: 1428012 - RNA, 19 nt, Homo sapiens
accguggaccuuccugcca

SEQ ID NO: 1428013 - RNA, 17 nt, Homo sapiens
accguggcccuuccugg

SEQ ID NO: 1428014 - RNA, 11 nt, Homo sapiens
accuacaaggu

SEQ ID NO: 1428015 - RNA, 19 nt, Homo sapiens
accuacaagguugugcccu

SEQ ID NO: 1428016 - RNA, 20 nt, Homo sapiens
accuaccaccccuuccuguc

SEQ ID NO: 1428017 - RNA, 18 nt, Homo sapiens
accuaccaccuucccucu

SEQ ID NO: 1428018 - RNA, 13 nt, Homo sapiens
accuacuagacaa

SEQ ID NO: 1428019 - RNA, 23 nt, Homo sapiens
accuauaauguguguauguguau

SEQ ID NO: 1428020 - RNA, 13 nt, Homo sapiens
accucacagugac

SEQ ID NO: 1428021 - RNA, 16 nt, Homo sapiens
accucacuccuguuac

SEQ ID NO: 1428022 - RNA, 17 nt, Homo sapiens
accucagacaauccacu

SEQ ID NO: 1428023 - RNA, 16 nt, Homo sapiens
accucagcugcacauu

SEQ ID NO: 1428024 - RNA, 19 nt, Homo sapiens
accucagcugcacauuccu

SEQ ID NO: 1428025 - RNA, 18 nt, Homo sapiens
accuccagcuuuccugua

SEQ ID NO: 1428026 - RNA, 13 nt, Homo sapiens
accucccaaagug

SEQ ID NO: 1428027 - RNA, 19 nt, Homo sapiens
accucccaccccacuccag

SEQ ID NO: 1428028 - RNA, 19 nt, Homo sapiens
accucucuaagccacagcu

SEQ ID NO: 1428029 - RNA, 13 nt, Homo sapiens
accucugcucuga

SEQ ID NO: 1428030 - RNA, 21 nt, Homo sapiens
accucugcucugaggcuucca

SEQ ID NO: 1428031 - RNA, 20 nt, Homo sapiens
accugaaaaaaaguuuacaa

SEQ ID NO: 1428032 - RNA, 14 nt, Homo sapiens
accugacacaagag

SEQ ID NO: 1428033 - RNA, 18 nt, Homo sapiens
accugaccggcaccugcg

SEQ ID NO: 1428034 - RNA, 18 nt, Homo sapiens
accugcaguuccugagua

SEQ ID NO: 1428035 - RNA, 22 nt, Homo sapiens
accugcauguguuguacaauac

SEQ ID NO: 1428036 - RNA, 17 nt, Homo sapiens
accugccagccaucaca

SEQ ID NO: 1428037 - RNA, 17 nt, Homo sapiens
accugcggcugcugugu

SEQ ID NO: 1428038 - RNA, 18 nt, Homo sapiens
accugcguugugagcucu

SEQ ID NO: 1428039 - RNA, 15 nt, Homo sapiens
accugcugcugcuau

SEQ ID NO: 1428040 - RNA, 18 nt, Homo sapiens
accuggaaggggcaaaga

SEQ ID NO: 1428041 - RNA, 16 nt, Homo sapiens
accuggagaugaugau

SEQ ID NO: 1428042 - RNA, 17 nt, Homo sapiens
accuggagaugaugaug

SEQ ID NO: 1428043 - RNA, 22 nt, Homo sapiens
accuggagggaaugaaccugga

SEQ ID NO: 1428044 - RNA, 21 nt, Homo sapiens
accuggaggggcuagaaccua

SEQ ID NO: 1428045 - RNA, 16 nt, Homo sapiens
accuggcacaauggcu

SEQ ID NO: 1428046 - RNA, 23 nt, Homo sapiens
accuggcauggugcuuucagguc

SEQ ID NO: 1428047 - RNA, 16 nt, Homo sapiens
accuggccuucagugu

SEQ ID NO: 1428048 - RNA, 20 nt, Homo sapiens
accuguagugagaaacugau

SEQ ID NO: 1428049 - RNA, 20 nt, Homo sapiens
accuguguggacaggacuaa

SEQ ID NO: 1428050 - RNA, 20 nt, Homo sapiens
accuguguucuugcugagca

SEQ ID NO: 1428051 - RNA, 20 nt, Homo sapiens
accuguuacuugaaauacca

SEQ ID NO: 1428052 - RNA, 14 nt, Homo sapiens
accuuaaaauguaa

SEQ ID NO: 1428053 - RNA, 18 nt, Homo sapiens
accuuaccaacuuucugu

SEQ ID NO: 1428054 - RNA, 22 nt, Homo sapiens
accuuauagguuacucauaagg

SEQ ID NO: 1428055 - RNA, 12 nt, Homo sapiens
accuucauccau

SEQ ID NO: 1428056 - RNA, 15 nt, Homo sapiens
accuuccacacaggg

SEQ ID NO: 1428057 - RNA, 21 nt, Homo sapiens
accuucccaagucucccuuuc

SEQ ID NO: 1428058 - RNA, 19 nt, Homo sapiens
accuuccuuaagccaggaa

SEQ ID NO: 1428059 - RNA, 15 nt, Homo sapiens
accuucugaccuccc

SEQ ID NO: 1428060 - RNA, 12 nt, Homo sapiens
accuucuuggcu

SEQ ID NO: 1428061 - RNA, 17 nt, Homo sapiens
accuuucaaauuucaca

SEQ ID NO: 1428062 - RNA, 17 nt, Homo sapiens
accuuuuugacuuuucc

SEQ ID NO: 1428063 - RNA, 18 nt, Homo sapiens
acgaaacacaaaccacaa

SEQ ID NO: 1428064 - RNA, 23 nt, Homo sapiens
acgaaacacaaaccacaacugac

SEQ ID NO: 1428065 - RNA, 22 nt, Homo sapiens
acgacaagauuuucuacuuuuu

SEQ ID NO: 1428066 - RNA, 18 nt, Homo sapiens
acgaugucaaggacuccu

SEQ ID NO: 1428067 - RNA, 13 nt, Homo sapiens
acgcacacaucag

SEQ ID NO: 1428068 - RNA, 13 nt, Homo sapiens
acgcacaggaaaa

SEQ ID NO: 1428069 - RNA, 17 nt, Homo sapiens
acgcacccccacugcug

SEQ ID NO: 1428070 - RNA, 15 nt, Homo sapiens
acgcagaucacuaaa

SEQ ID NO: 1428071 - RNA, 14 nt, Homo sapiens
acgcagguguaccu

SEQ ID NO: 1428072 - RNA, 17 nt, Homo sapiens
acgcagguguaccuccc

SEQ ID NO: 1428073 - RNA, 20 nt, Homo sapiens
acgccaaagugcagcccuuc

SEQ ID NO: 1428074 - RNA, 14 nt, Homo sapiens
acgccaaugcacac

SEQ ID NO: 1428075 - RNA, 17 nt, Homo sapiens
acgccuguaaucccagc

SEQ ID NO: 1428076 - RNA, 15 nt, Homo sapiens
acgcucaagaauccu

SEQ ID NO: 1428077 - RNA, 17 nt, Homo sapiens
acgcuuccagaccaccu

SEQ ID NO: 1428078 - RNA, 19 nt, Homo sapiens
acggaguacagacgucuca

SEQ ID NO: 1428079 - RNA, 23 nt, Homo sapiens
acggaugauuggauuauucauuu

SEQ ID NO: 1428080 - RNA, 21 nt, Homo sapiens
acggcuggaccugcacgccac

SEQ ID NO: 1428081 - RNA, 12 nt, Homo sapiens
acgguguugcag

SEQ ID NO: 1428082 - RNA, 15 nt, Homo sapiens
acgucucaagacuga

SEQ ID NO: 1428083 - RNA, 14 nt, Homo sapiens
acgugccugugauc

SEQ ID NO: 1428084 - RNA, 17 nt, Homo sapiens
agaagccccuaggcaaa

SEQ ID NO: 1428085 - RNA, 22 nt, Homo sapiens
agaagccggcucuucaaagaca

SEQ ID NO: 1428086 - RNA, 15 nt, Homo sapiens
agaagcggcggguca

SEQ ID NO: 1428087 - RNA, 18 nt, Homo sapiens
agaagcucccagaugcug

SEQ ID NO: 1428088 - RNA, 17 nt, Homo sapiens
agaaggaaaaauuccag

SEQ ID NO: 1428089 - RNA, 16 nt, Homo sapiens
agaaggacaugugcua

SEQ ID NO: 1428090 - RNA, 14 nt, Homo sapiens
agaaggcaagcacc

SEQ ID NO: 1428091 - RNA, 17 nt, Homo sapiens
agaaggcuggggccagu

SEQ ID NO: 1428092 - RNA, 15 nt, Homo sapiens
agaagucccucccau

SEQ ID NO: 1428093 - RNA, 18 nt, Homo sapiens
agaaguggggcucuggga

SEQ ID NO: 1428094 - RNA, 19 nt, Homo sapiens
agaagugucguuuucauaa

SEQ ID NO: 1428095 - RNA, 16 nt, Homo sapiens
agaaguguuccuucau

SEQ ID NO: 1428096 - RNA, 13 nt, Homo sapiens
agaauagugcauu

SEQ ID NO: 1428097 - RNA, 16 nt, Homo sapiens
agaaucaaauugcuac

SEQ ID NO: 1428098 - RNA, 22 nt, Homo sapiens
agaauccacaaagccgugccuu

SEQ ID NO: 1428099 - RNA, 22 nt, Homo sapiens
agaauccucugggguucaucua

SEQ ID NO: 1428100 - RNA, 13 nt, Homo sapiens
agaaucuagccuc

SEQ ID NO: 1428101 - RNA, 14 nt, Homo sapiens
agaaucugcagcua

SEQ ID NO: 1428102 - RNA, 17 nt, Homo sapiens
agaaucugcagcuaacu

SEQ ID NO: 1428103 - RNA, 13 nt, Homo sapiens
agaaugauggacu

SEQ ID NO: 1428104 - RNA, 14 nt, Homo sapiens
agaauggagcagua

SEQ ID NO: 1428105 - RNA, 16 nt, Homo sapiens
agaauggaugugcuca

SEQ ID NO: 1428106 - RNA, 15 nt, Homo sapiens
agaaugguagcacua

SEQ ID NO: 1428107 - RNA, 17 nt, Homo sapiens
agaauguaucuccuccu

SEQ ID NO: 1428108 - RNA, 13 nt, Homo sapiens
agaauuguaucau

SEQ ID NO: 1428109 - RNA, 17 nt, Homo sapiens
agaauuguccaugugcu

SEQ ID NO: 1428110 - RNA, 20 nt, Homo sapiens
agaauuucuuugucauucaa

SEQ ID NO: 1428111 - RNA, 23 nt, Homo sapiens
agaauuugccuucucccugggaa

SEQ ID NO: 1428112 - RNA, 18 nt, Homo sapiens
agaauuuggauacacucu

SEQ ID NO: 1428113 - RNA, 19 nt, Homo sapiens
agaauuuggauacacucuc

SEQ ID NO: 1428114 - RNA, 17 nt, Homo sapiens
agacaaaguaauuccuc

SEQ ID NO: 1428115 - RNA, 17 nt, Homo sapiens
agacaaguaaucacuaa

SEQ ID NO: 1428116 - RNA, 16 nt, Homo sapiens
agacaccugccuuaac

SEQ ID NO: 1428117 - RNA, 14 nt, Homo sapiens
agacacugugcuau

SEQ ID NO: 1428118 - RNA, 15 nt, Homo sapiens
agacacugugcuaua

SEQ ID NO: 1428119 - RNA, 21 nt, Homo sapiens
agacagaaccccuacaugaaa

SEQ ID NO: 1428120 - RNA, 14 nt, Homo sapiens
agacagaaugauau

SEQ ID NO: 1428121 - RNA, 10 nt, Homo sapiens
agacagagac

SEQ ID NO: 1428122 - RNA, 19 nt, Homo sapiens
agacagagcccccaagccu

SEQ ID NO: 1428123 - RNA, 14 nt, Homo sapiens
agacagauugcuga

SEQ ID NO: 1428124 - RNA, 20 nt, Homo sapiens
agacaggcgcuggacagagg

SEQ ID NO: 1428125 - RNA, 20 nt, Homo sapiens
agacagggcaaucuugucca

SEQ ID NO: 1428126 - RNA, 15 nt, Homo sapiens
agacaguucaagaaa

SEQ ID NO: 1428127 - RNA, 16 nt, Homo sapiens
agacaugaaugcacac

SEQ ID NO: 1428128 - RNA, 17 nt, Homo sapiens
agacauuaaaccuggau

SEQ ID NO: 1428129 - RNA, 12 nt, Homo sapiens
agacauuccaag

SEQ ID NO: 1428130 - RNA, 20 nt, Homo sapiens
agaccaacucucuccuguau

SEQ ID NO: 1428131 - RNA, 13 nt, Homo sapiens
agaccaccucuca

SEQ ID NO: 1428132 - RNA, 19 nt, Homo sapiens
agaccacucccuuccccca

SEQ ID NO: 1428133 - RNA, 13 nt, Homo sapiens
agaccaguccaug

SEQ ID NO: 1428134 - RNA, 18 nt, Homo sapiens
agaccaguugggagcacu

SEQ ID NO: 1428135 - RNA, 19 nt, Homo sapiens
agaccaguugggagcacug

SEQ ID NO: 1428136 - RNA, 14 nt, Homo sapiens
agaccgaaucucac

SEQ ID NO: 1428137 - RNA, 21 nt, Homo sapiens
agaccuagaccugggccaaaa

SEQ ID NO: 1428138 - RNA, 15 nt, Homo sapiens
agaccugacaagcac

SEQ ID NO: 1428139 - RNA, 12 nt, Homo sapiens
agacgcagcccu

SEQ ID NO: 1428140 - RNA, 21 nt, Homo sapiens
agacgcagcccugggggccag

SEQ ID NO: 1428141 - RNA, 19 nt, Homo sapiens
agacgccuuucuccuccaa

SEQ ID NO: 1428142 - RNA, 14 nt, Homo sapiens
agacgguguugcag

SEQ ID NO: 1428143 - RNA, 12 nt, Homo sapiens
agacguguacau

SEQ ID NO: 1428144 - RNA, 13 nt, Homo sapiens
agacuauauacau

SEQ ID NO: 1428145 - RNA, 12 nt, Homo sapiens
agacugagcucc

SEQ ID NO: 1428146 - RNA, 18 nt, Homo sapiens
agacugcagcugcugaag

SEQ ID NO: 1428147 - RNA, 18 nt, Homo sapiens
agacuggagcaucugacu

SEQ ID NO: 1428148 - RNA, 17 nt, Homo sapiens
agacuuacuuacuccca

SEQ ID NO: 1428149 - RNA, 19 nt, Homo sapiens
agacuugacaacaucccac

SEQ ID NO: 1428150 - RNA, 15 nt, Homo sapiens
agacuugauacugca

SEQ ID NO: 1428151 - RNA, 15 nt, Homo sapiens
agacuuggggaccag

SEQ ID NO: 1428152 - RNA, 16 nt, Homo sapiens
agacuuggggaccaga

SEQ ID NO: 1428153 - RNA, 20 nt, Homo sapiens
agacuuuaccacuaugcaau

SEQ ID NO: 1428154 - RNA, 18 nt, Homo sapiens
agagaaagaaguaggcau

SEQ ID NO: 1428155 - RNA, 14 nt, Homo sapiens
agagaacaacuacu

SEQ ID NO: 1428156 - RNA, 23 nt, Homo sapiens
agagaagaccaaagcauugccug

SEQ ID NO: 1428157 - RNA, 19 nt, Homo sapiens
agagaaggacaugugcuau

SEQ ID NO: 1428158 - RNA, 13 nt, Homo sapiens
agagaaucugaag

SEQ ID NO: 1428159 - RNA, 22 nt, Homo sapiens
agagaauuguaucauuugaaca

SEQ ID NO: 1428160 - RNA, 13 nt, Homo sapiens
agagacaccugca

SEQ ID NO: 1428161 - RNA, 20 nt, Homo sapiens
agagacacucccagggacaa

SEQ ID NO: 1428162 - RNA, 12 nt, Homo sapiens
agagacccaagg

SEQ ID NO: 1428163 - RNA, 21 nt, Homo sapiens
agagacuaauagagacacaga

SEQ ID NO: 1428164 - RNA, 13 nt, Homo sapiens
agagacucuggcc

SEQ ID NO: 1428165 - RNA, 19 nt, Homo sapiens
agagacuggagcaucugac

SEQ ID NO: 1428166 - RNA, 18 nt, Homo sapiens
agagacugugcugggaac

SEQ ID NO: 1428167 - RNA, 21 nt, Homo sapiens
agagagagggccugcuggaga

SEQ ID NO: 1428168 - RNA, 20 nt, Homo sapiens
agagagcaccuggugaucac

SEQ ID NO: 1428169 - RNA, 14 nt, Homo sapiens
agagaguuaaguga

SEQ ID NO: 1428170 - RNA, 19 nt, Homo sapiens
agagauaugcacacacaga

SEQ ID NO: 1428171 - RNA, 23 nt, Homo sapiens
auucccuguuaaaauuuaaccua

SEQ ID NO: 1428172 - RNA, 19 nt, Homo sapiens
auucccuuggauguagucu

SEQ ID NO: 1428173 - RNA, 13 nt, Homo sapiens
auuccgucuuaaa

SEQ ID NO: 1428174 - RNA, 14 nt, Homo sapiens
auuccgucuuaaaa

SEQ ID NO: 1428175 - RNA, 20 nt, Homo sapiens
auuccuaagcagugcuugua

SEQ ID NO: 1428176 - RNA, 14 nt, Homo sapiens
auuccuacaaagau

SEQ ID NO: 1428177 - RNA, 16 nt, Homo sapiens
auuccuauauguagcu

SEQ ID NO: 1428178 - RNA, 17 nt, Homo sapiens
auucgugacaacaugcg

SEQ ID NO: 1428179 - RNA, 12 nt, Homo sapiens
auucucaccagg

SEQ ID NO: 1428180 - RNA, 17 nt, Homo sapiens
auucucagugcucuccu

SEQ ID NO: 1428181 - RNA, 21 nt, Homo sapiens
auucucaucuacucauugucu

SEQ ID NO: 1428182 - RNA, 15 nt, Homo sapiens
auucuccugccucag

SEQ ID NO: 1428183 - RNA, 16 nt, Homo sapiens
auucucuucacuccca

SEQ ID NO: 1428184 - RNA, 23 nt, Homo sapiens
auucugggcuccuggaaccaauc

SEQ ID NO: 1428185 - RNA, 20 nt, Homo sapiens
auucuuaaaggaaaagucaa

SEQ ID NO: 1428186 - RNA, 20 nt, Homo sapiens
auucuuauuuaaguuauuga

SEQ ID NO: 1428187 - RNA, 16 nt, Homo sapiens
auucuugaaguucaug

SEQ ID NO: 1428188 - RNA, 19 nt, Homo sapiens
auucuuguauauuauggaa

SEQ ID NO: 1428189 - RNA, 23 nt, Homo sapiens
auugaaauauaaugcaaaccaua

SEQ ID NO: 1428190 - RNA, 15 nt, Homo sapiens
auugacgcauauuua

SEQ ID NO: 1428191 - RNA, 16 nt, Homo sapiens
auugacgccaccauaa

SEQ ID NO: 1428192 - RNA, 15 nt, Homo sapiens
auugagaaacaugaa

SEQ ID NO: 1428193 - RNA, 22 nt, Homo sapiens
auugaggaggacuacuauuuga

SEQ ID NO: 1428194 - RNA, 18 nt, Homo sapiens
auugaucacuuuguuaaa

SEQ ID NO: 1428195 - RNA, 12 nt, Homo sapiens
auugauguugcu

SEQ ID NO: 1428196 - RNA, 19 nt, Homo sapiens
auugcacuuuuaaaccucu

SEQ ID NO: 1428197 - RNA, 16 nt, Homo sapiens
auugcauuucugcucu

SEQ ID NO: 1428198 - RNA, 14 nt, Homo sapiens
auugccauucugau

SEQ ID NO: 1428199 - RNA, 19 nt, Homo sapiens
auugccuccuuauuuauca

SEQ ID NO: 1428200 - RNA, 15 nt, Homo sapiens
auugcgaaugugcag

SEQ ID NO: 1428201 - RNA, 17 nt, Homo sapiens
auugcuacauaguccaa

SEQ ID NO: 1428202 - RNA, 21 nt, Homo sapiens
auugcuucaauaauauuagcu

SEQ ID NO: 1428203 - RNA, 20 nt, Homo sapiens
auugcuuuuguugugacuuu

SEQ ID NO: 1428204 - RNA, 21 nt, Homo sapiens
auuggaaguguucaagaaaua

SEQ ID NO: 1428205 - RNA, 19 nt, Homo sapiens
auuggagaguaaaaacuga

SEQ ID NO: 1428206 - RNA, 18 nt, Homo sapiens
auuggcuauaacaugucu

SEQ ID NO: 1428207 - RNA, 22 nt, Homo sapiens
auugggaagcugggggaagggu

SEQ ID NO: 1428208 - RNA, 18 nt, Homo sapiens
auugggcugacaccuacc

SEQ ID NO: 1428209 - RNA, 22 nt, Homo sapiens
auuguaaacagcuaauaaugaa

SEQ ID NO: 1428210 - RNA, 18 nt, Homo sapiens
auuguaacaauagcacaa

SEQ ID NO: 1428211 - RNA, 15 nt, Homo sapiens
auuguaaguaccccu

SEQ ID NO: 1428212 - RNA, 15 nt, Homo sapiens
auuguacacuaucua

SEQ ID NO: 1428213 - RNA, 16 nt, Homo sapiens
auuguagaaacacagu

SEQ ID NO: 1428214 - RNA, 18 nt, Homo sapiens
auuguaggcaaccuuccc

SEQ ID NO: 1428215 - RNA, 13 nt, Homo sapiens
auuguauaagauu

SEQ ID NO: 1428216 - RNA, 23 nt, Homo sapiens
auuguccagugcaaccacacacc

SEQ ID NO: 1428217 - RNA, 16 nt, Homo sapiens
auugucgucuuuaugu

SEQ ID NO: 1428218 - RNA, 16 nt, Homo sapiens
auugugcccagcccuu

SEQ ID NO: 1428219 - RNA, 20 nt, Homo sapiens
auuguguugggaccugugau

SEQ ID NO: 1428220 - RNA, 16 nt, Homo sapiens
auuguuaaaauaacua

SEQ ID NO: 1428221 - RNA, 16 nt, Homo sapiens
auuguuuggcuuccuc

SEQ ID NO: 1428222 - RNA, 13 nt, Homo sapiens
auuuaaaccagca

SEQ ID NO: 1428223 - RNA, 15 nt, Homo sapiens
auuuaacacuaaaaa

SEQ ID NO: 1428224 - RNA, 13 nt, Homo sapiens
auuuaacaugacu

SEQ ID NO: 1428225 - RNA, 13 nt, Homo sapiens
auuuaacuugagg

SEQ ID NO: 1428226 - RNA, 21 nt, Homo sapiens
auuuaauaaaugugccuucau

SEQ ID NO: 1428227 - RNA, 20 nt, Homo sapiens
auuuagaaaacauucaucca

SEQ ID NO: 1428228 - RNA, 21 nt, Homo sapiens
auuuaguaauaguccaauauu

SEQ ID NO: 1428229 - RNA, 17 nt, Homo sapiens
auuuagucacaccaucu

SEQ ID NO: 1428230 - RNA, 14 nt, Homo sapiens
auuuauauguuaau

SEQ ID NO: 1428231 - RNA, 12 nt, Homo sapiens
auuuauauucaa

SEQ ID NO: 1428232 - RNA, 20 nt, Homo sapiens
auuuaugccucuguauuuaa

SEQ ID NO: 1428233 - RNA, 15 nt, Homo sapiens
auuuauuuaagcuua

SEQ ID NO: 1428234 - RNA, 16 nt, Homo sapiens
auuuauuucauccagu

SEQ ID NO: 1428235 - RNA, 20 nt, Homo sapiens
auuucaaccgcuugccauau

SEQ ID NO: 1428236 - RNA, 19 nt, Homo sapiens
auuucacacagguccugaa

SEQ ID NO: 1428237 - RNA, 13 nt, Homo sapiens
auuucacauuaau

SEQ ID NO: 1428238 - RNA, 10 nt, Homo sapiens
auuucaggga

SEQ ID NO: 1428239 - RNA, 13 nt, Homo sapiens
auuuccugacaga

SEQ ID NO: 1428240 - RNA, 21 nt, Homo sapiens
auuuccugacagaaggacuca

SEQ ID NO: 1428241 - RNA, 19 nt, Homo sapiens
auuuccuggugauucugau

SEQ ID NO: 1428242 - RNA, 20 nt, Homo sapiens
auuucuaauguaugcauuca

SEQ ID NO: 1428243 - RNA, 21 nt, Homo sapiens
auuucugauauaacaaacuac

SEQ ID NO: 1428244 - RNA, 22 nt, Homo sapiens
auuucuggacccuccacuucaa

SEQ ID NO: 1428245 - RNA, 16 nt, Homo sapiens
auuucuuauagucaau

SEQ ID NO: 1428246 - RNA, 14 nt, Homo sapiens
auuugaaaugucau

SEQ ID NO: 1428247 - RNA, 15 nt, Homo sapiens
auuugaagaagaguu

SEQ ID NO: 1428248 - RNA, 17 nt, Homo sapiens
auuugaagaagaguuuc

SEQ ID NO: 1428249 - RNA, 16 nt, Homo sapiens
auuugagcaugcacag

SEQ ID NO: 1428250 - RNA, 18 nt, Homo sapiens
auuugagugucuuugacu

SEQ ID NO: 1428251 - RNA, 21 nt, Homo sapiens
auuugauaaacuaaaagcaua

SEQ ID NO: 1428252 - RNA, 15 nt, Homo sapiens
auuugauguacaugu

SEQ ID NO: 1428253 - RNA, 12 nt, Homo sapiens
auuuggacaaaa

SEQ ID NO: 1428254 - RNA, 22 nt, Homo sapiens
auuuguauucaugaacuuggcu

SEQ ID NO: 1428255 - RNA, 19 nt, Homo sapiens
auuuguggaggacuuugaa

SEQ ID NO: 1428256 - RNA, 13 nt, Homo sapiens
auuuguucagaga

SEQ ID NO: 1428257 - RNA, 14 nt, Homo sapiens
auuuguucagagag

SEQ ID NO: 1428258 - RNA, 16 nt, Homo sapiens
caccaccuucccagcu

SEQ ID NO: 1428259 - RNA, 13 nt, Homo sapiens
caccacgaauuug

SEQ ID NO: 1428260 - RNA, 20 nt, Homo sapiens
caccacuuugucucugagaa

SEQ ID NO: 1428261 - RNA, 16 nt, Homo sapiens
caccagaaugcuaaag

SEQ ID NO: 1428262 - RNA, 18 nt, Homo sapiens
caccagaggcugcagaag

SEQ ID NO: 1428263 - RNA, 21 nt, Homo sapiens
caccagaggcugcagaaggcc

SEQ ID NO: 1428264 - RNA, 15 nt, Homo sapiens
caccagcugccaaaa

SEQ ID NO: 1428265 - RNA, 15 nt, Homo sapiens
caccaggccuuugag

SEQ ID NO: 1428266 - RNA, 13 nt, Homo sapiens
caccaugaaucuu

SEQ ID NO: 1428267 - RNA, 14 nt, Homo sapiens
caccaugccaggcu

SEQ ID NO: 1428268 - RNA, 23 nt, Homo sapiens
caccauggcaccuuuugcacaua

SEQ ID NO: 1428269 - RNA, 18 nt, Homo sapiens
caccauguuugagcucag

SEQ ID NO: 1428270 - RNA, 21 nt, Homo sapiens
caccauuuuguuuagacaauu

SEQ ID NO: 1428271 - RNA, 17 nt, Homo sapiens
cacccaaagcauggacu

SEQ ID NO: 1428272 - RNA, 14 nt, Homo sapiens
cacccaauguuuga

SEQ ID NO: 1428273 - RNA, 14 nt, Homo sapiens
cacccacaacaucu

SEQ ID NO: 1428274 - RNA, 14 nt, Homo sapiens
cacccaugccauag

SEQ ID NO: 1428275 - RNA, 19 nt, Homo sapiens
cacccaugccauagaaacu

SEQ ID NO: 1428276 - RNA, 21 nt, Homo sapiens
caccccuaugcccacucuaau

SEQ ID NO: 1428277 - RNA, 12 nt, Homo sapiens
caccgagaccaa

SEQ ID NO: 1428278 - RNA, 21 nt, Homo sapiens
caccgauguacacacacagau

SEQ ID NO: 1428279 - RNA, 13 nt, Homo sapiens
caccgcgugccau

SEQ ID NO: 1428280 - RNA, 11 nt, Homo sapiens
caccuaccugc

SEQ ID NO: 1428281 - RNA, 15 nt, Homo sapiens
caccuagcaucucau

SEQ ID NO: 1428282 - RNA, 23 nt, Homo sapiens
caccuagcaucucaugagugcca

SEQ ID NO: 1428283 - RNA, 16 nt, Homo sapiens
caccucagcugauauu

SEQ ID NO: 1428284 - RNA, 22 nt, Homo sapiens
caccuccuagaggugggcagcu

SEQ ID NO: 1428285 - RNA, 15 nt, Homo sapiens
caccuccuccacuca

SEQ ID NO: 1428286 - RNA, 16 nt, Homo sapiens
caccucuggaucccug

SEQ ID NO: 1428287 - RNA, 22 nt, Homo sapiens
caccucuucucuuccuguaaca

SEQ ID NO: 1428288 - RNA, 19 nt, Homo sapiens
caccugacaauggcagcua

SEQ ID NO: 1428289 - RNA, 20 nt, Homo sapiens
caccugccagccaucacaag

SEQ ID NO: 1428290 - RNA, 22 nt, Homo sapiens
caccugcuggaaaccacacuuc

SEQ ID NO: 1428291 - RNA, 15 nt, Homo sapiens
caccuggauugcaga

SEQ ID NO: 1428292 - RNA, 17 nt, Homo sapiens
caccuugcuccuccuuc

SEQ ID NO: 1428293 - RNA, 18 nt, Homo sapiens
cacgaauccugacaccac

SEQ ID NO: 1428294 - RNA, 17 nt, Homo sapiens
cacgacucuuccugcaa

SEQ ID NO: 1428295 - RNA, 17 nt, Homo sapiens
cacgagagagucuucca

SEQ ID NO: 1428296 - RNA, 21 nt, Homo sapiens
cacgaucuuggcucacugcaa

SEQ ID NO: 1428297 - RNA, 15 nt, Homo sapiens
cacgauuuugcacaa

SEQ ID NO: 1428298 - RNA, 15 nt, Homo sapiens
cacgcaagggcauca

SEQ ID NO: 1428299 - RNA, 15 nt, Homo sapiens
cacggugaaauccag

SEQ ID NO: 1428300 - RNA, 18 nt, Homo sapiens
cacgugugaaguguagug

SEQ ID NO: 1428301 - RNA, 18 nt, Homo sapiens
cacuaaggccgugucucu

SEQ ID NO: 1428302 - RNA, 14 nt, Homo sapiens
cacuacagauauca

SEQ ID NO: 1428303 - RNA, 22 nt, Homo sapiens
cacuagccaugauaacugcaau

SEQ ID NO: 1428304 - RNA, 14 nt, Homo sapiens
cacuauguccagcu

SEQ ID NO: 1428305 - RNA, 20 nt, Homo sapiens
cacucaacaauaaagacuga

SEQ ID NO: 1428306 - RNA, 12 nt, Homo sapiens
cacucacuccag

SEQ ID NO: 1428307 - RNA, 12 nt, Homo sapiens
cacucauuccuu

SEQ ID NO: 1428308 - RNA, 13 nt, Homo sapiens
cacuccauuccca

SEQ ID NO: 1428309 - RNA, 16 nt, Homo sapiens
cacucccuggcucuca

SEQ ID NO: 1428310 - RNA, 23 nt, Homo sapiens
cacucuuauucccaaacuacaga

SEQ ID NO: 1428311 - RNA, 13 nt, Homo sapiens
cacugacugggac

SEQ ID NO: 1428312 - RNA, 17 nt, Homo sapiens
cacugaggaccagccau

SEQ ID NO: 1428313 - RNA, 13 nt, Homo sapiens
cacugagggccac

SEQ ID NO: 1428314 - RNA, 14 nt, Homo sapiens
cacugccaugccuc

SEQ ID NO: 1428315 - RNA, 19 nt, Homo sapiens
cacugccggcccagugaca

SEQ ID NO: 1428316 - RNA, 14 nt, Homo sapiens
cacugcuccagugg

SEQ ID NO: 1428317 - RNA, 23 nt, Homo sapiens
cacugcugcagacaccugccuua

SEQ ID NO: 1428318 - RNA, 14 nt, Homo sapiens
cacugcugcugcag

SEQ ID NO: 1428319 - RNA, 13 nt, Homo sapiens
cacuggguugacu

SEQ ID NO: 1428320 - RNA, 15 nt, Homo sapiens
cacuguaaaugcagc

SEQ ID NO: 1428321 - RNA, 10 nt, Homo sapiens
cacuguccag

SEQ ID NO: 1428322 - RNA, 12 nt, Homo sapiens
cacuguccagca

SEQ ID NO: 1428323 - RNA, 22 nt, Homo sapiens
cacuguuuaacugggagugaua

SEQ ID NO: 1428324 - RNA, 18 nt, Homo sapiens
cacuuagcuaucagaaga

SEQ ID NO: 1428325 - RNA, 15 nt, Homo sapiens
cacuuauaccaaagg

SEQ ID NO: 1428326 - RNA, 12 nt, Homo sapiens
cacuuccagugu

SEQ ID NO: 1428327 - RNA, 21 nt, Homo sapiens
cacuucgaugacuggauacag

SEQ ID NO: 1428328 - RNA, 13 nt, Homo sapiens
cacuucuaugcaa

SEQ ID NO: 1428329 - RNA, 18 nt, Homo sapiens
cacuucuaugcaaaugcc

SEQ ID NO: 1428330 - RNA, 20 nt, Homo sapiens
cacuucucaggacacaggcc

SEQ ID NO: 1428331 - RNA, 20 nt, Homo sapiens
cacuucucaucauauuguau

SEQ ID NO: 1428332 - RNA, 14 nt, Homo sapiens
cacuugacauuccu

SEQ ID NO: 1428333 - RNA, 18 nt, Homo sapiens
cacuuggcugcucauucc

SEQ ID NO: 1428334 - RNA, 14 nt, Homo sapiens
cacuuguauaaaug

SEQ ID NO: 1428335 - RNA, 13 nt, Homo sapiens
cacuuucaccagu

SEQ ID NO: 1428336 - RNA, 22 nt, Homo sapiens
cagaaaaaaauaaaaacauaaa

SEQ ID NO: 1428337 - RNA, 22 nt, Homo sapiens
cagaaaacauaugcauuaugaa

SEQ ID NO: 1428338 - RNA, 16 nt, Homo sapiens
cagaaaagcaccugcc

SEQ ID NO: 1428339 - RNA, 17 nt, Homo sapiens
cagaaaaguagaauuau

SEQ ID NO: 1428340 - RNA, 23 nt, Homo sapiens
cagaaaagugcuuagaaaguuau

SEQ ID NO: 1428341 - RNA, 21 nt, Homo sapiens
cagaaccagaggguuguacua

SEQ ID NO: 1428342 - RNA, 18 nt, Homo sapiens
cagaaccucaagucuaga

SEQ ID NO: 1428343 - RNA, 16 nt, Homo sapiens
cagaacuguuguuuac

SEQ ID NO: 1428344 - RNA, 22 nt, Homo sapiens
cagaagauaacuugagcaccgu

SEQ ID NO: 1428345 - RNA, 19 nt, Homo sapiens
caucacuacaguacaguga

SEQ ID NO: 1428346 - RNA, 20 nt, Homo sapiens
caucacuagccaugauaacu

SEQ ID NO: 1428347 - RNA, 14 nt, Homo sapiens
caucagcauaccuu

SEQ ID NO: 1428348 - RNA, 20 nt, Homo sapiens
caucagcugcugaaacaaca

SEQ ID NO: 1428349 - RNA, 23 nt, Homo sapiens
caucagugcacacggaugcacag

SEQ ID NO: 1428350 - RNA, 16 nt, Homo sapiens
caucauaaccauuccc

SEQ ID NO: 1428351 - RNA, 11 nt, Homo sapiens
caucaucccag

SEQ ID NO: 1428352 - RNA, 13 nt, Homo sapiens
caucauuccuuga

SEQ ID NO: 1428353 - RNA, 12 nt, Homo sapiens
cauccaucagcu

SEQ ID NO: 1428354 - RNA, 22 nt, Homo sapiens
cauccaucccuuaggugagcuu

SEQ ID NO: 1428355 - RNA, 13 nt, Homo sapiens
caucccaucuaag

SEQ ID NO: 1428356 - RNA, 14 nt, Homo sapiens
caucccauguauuu

SEQ ID NO: 1428357 - RNA, 15 nt, Homo sapiens
cauccccuuguguca

SEQ ID NO: 1428358 - RNA, 15 nt, Homo sapiens
cauccccuuuccucc

SEQ ID NO: 1428359 - RNA, 18 nt, Homo sapiens
caucccugaugucugucu

SEQ ID NO: 1428360 - RNA, 17 nt, Homo sapiens
cauccuccuucuucagg

SEQ ID NO: 1428361 - RNA, 15 nt, Homo sapiens
cauccugugugcuga

SEQ ID NO: 1428362 - RNA, 13 nt, Homo sapiens
cauccuucaucug

SEQ ID NO: 1428363 - RNA, 16 nt, Homo sapiens
cauccuucaucuggau

SEQ ID NO: 1428364 - RNA, 22 nt, Homo sapiens
caucuaagaaaauuuacuguaa

SEQ ID NO: 1428365 - RNA, 19 nt, Homo sapiens
caucuacaagcauuugccc

SEQ ID NO: 1428366 - RNA, 18 nt, Homo sapiens
caucuacucauugucuca

SEQ ID NO: 1428367 - RNA, 11 nt, Homo sapiens
caucuauguau

SEQ ID NO: 1428368 - RNA, 23 nt, Homo sapiens
caucuauguaucuaccaucuaau

SEQ ID NO: 1428369 - RNA, 19 nt, Homo sapiens
caucuauuauaaaaccaug

SEQ ID NO: 1428370 - RNA, 15 nt, Homo sapiens
caucuccugauuucu

SEQ ID NO: 1428371 - RNA, 14 nt, Homo sapiens
caucuguccagagg

SEQ ID NO: 1428372 - RNA, 13 nt, Homo sapiens
caugaagaccaca

SEQ ID NO: 1428373 - RNA, 15 nt, Homo sapiens
caugaaucaaagaca

SEQ ID NO: 1428374 - RNA, 17 nt, Homo sapiens
caugaccaguucuggcc

SEQ ID NO: 1428375 - RNA, 19 nt, Homo sapiens
caugacucagcauaccugc

SEQ ID NO: 1428376 - RNA, 20 nt, Homo sapiens
caugacucguauaugucuca

SEQ ID NO: 1428377 - RNA, 22 nt, Homo sapiens
caugacuucugccccagcuuua

SEQ ID NO: 1428378 - RNA, 21 nt, Homo sapiens
caugagagaauuguaucauuu

SEQ ID NO: 1428379 - RNA, 16 nt, Homo sapiens
caugagcgcugaugau

SEQ ID NO: 1428380 - RNA, 19 nt, Homo sapiens
caugauguuaaccagaaua

SEQ ID NO: 1428381 - RNA, 22 nt, Homo sapiens
caugauuuuuuuuuuucagucc

SEQ ID NO: 1428382 - RNA, 14 nt, Homo sapiens
caugcaagugagaa

SEQ ID NO: 1428383 - RNA, 17 nt, Homo sapiens
caugcaauaaugugcaa

SEQ ID NO: 1428384 - RNA, 14 nt, Homo sapiens
caugcacucaggca

SEQ ID NO: 1428385 - RNA, 13 nt, Homo sapiens
caugcacugaccc

SEQ ID NO: 1428386 - RNA, 20 nt, Homo sapiens
caugccaaugcacgcacaca

SEQ ID NO: 1428387 - RNA, 19 nt, Homo sapiens
caugccacccuguuuucag

SEQ ID NO: 1428388 - RNA, 17 nt, Homo sapiens
caugccauuuguacuga

SEQ ID NO: 1428389 - RNA, 23 nt, Homo sapiens
caugcccuggauccaucaggcca

SEQ ID NO: 1428390 - RNA, 21 nt, Homo sapiens
caugccuccaaaaauucacau

SEQ ID NO: 1428391 - RNA, 16 nt, Homo sapiens
caugccuggucuuucc

SEQ ID NO: 1428392 - RNA, 17 nt, Homo sapiens
caugcguauaugugcgu

SEQ ID NO: 1428393 - RNA, 20 nt, Homo sapiens
caugcugcuuuuuggcacag

SEQ ID NO: 1428394 - RNA, 17 nt, Homo sapiens
cauggaaauguccucca

SEQ ID NO: 1428395 - RNA, 13 nt, Homo sapiens
cauggacacagac

SEQ ID NO: 1428396 - RNA, 15 nt, Homo sapiens
cauggagaaacccug

SEQ ID NO: 1428397 - RNA, 21 nt, Homo sapiens
cauggagagagacucaaagag

SEQ ID NO: 1428398 - RNA, 19 nt, Homo sapiens
cauggagcagccagcguua

SEQ ID NO: 1428399 - RNA, 12 nt, Homo sapiens
cauggaugcaca

SEQ ID NO: 1428400 - RNA, 22 nt, Homo sapiens
cauggcacucuucccaccucag

SEQ ID NO: 1428401 - RNA, 15 nt, Homo sapiens
cauggcagugaugaa

SEQ ID NO: 1428402 - RNA, 15 nt, Homo sapiens
cauggcauugaacug

SEQ ID NO: 1428403 - RNA, 19 nt, Homo sapiens
cauggccaccccgugccac

SEQ ID NO: 1428404 - RNA, 14 nt, Homo sapiens
cauggccuaagggc

SEQ ID NO: 1428405 - RNA, 23 nt, Homo sapiens
cauggccuaagggccacauccca

SEQ ID NO: 1428406 - RNA, 21 nt, Homo sapiens
caugguccuggaggaugacca

SEQ ID NO: 1428407 - RNA, 13 nt, Homo sapiens
cauggugacacac

SEQ ID NO: 1428408 - RNA, 14 nt, Homo sapiens
cauggugcuuucag

SEQ ID NO: 1428409 - RNA, 22 nt, Homo sapiens
cauguaaggucuucuugugucc

SEQ ID NO: 1428410 - RNA, 17 nt, Homo sapiens
cauguacuauaauguga

SEQ ID NO: 1428411 - RNA, 17 nt, Homo sapiens
cauguagauuuuaguuc

SEQ ID NO: 1428412 - RNA, 23 nt, Homo sapiens
caugucaccucagcugauauuau

SEQ ID NO: 1428413 - RNA, 15 nt, Homo sapiens
caugucagacuguac

SEQ ID NO: 1428414 - RNA, 15 nt, Homo sapiens
cauguccaaguccaa

SEQ ID NO: 1428415 - RNA, 16 nt, Homo sapiens
caugucgccucugcau

SEQ ID NO: 1428416 - RNA, 16 nt, Homo sapiens
caugucuuguucagaa

SEQ ID NO: 1428417 - RNA, 12 nt, Homo sapiens
caugucuuucag

SEQ ID NO: 1428418 - RNA, 19 nt, Homo sapiens
cauguggccccaggugcca

SEQ ID NO: 1428419 - RNA, 23 nt, Homo sapiens
cauguguccccucacucugucag

SEQ ID NO: 1428420 - RNA, 22 nt, Homo sapiens
cauguguugccuggaagcacau

SEQ ID NO: 1428421 - RNA, 21 nt, Homo sapiens
cauguuaggaaaauuucacau

SEQ ID NO: 1428422 - RNA, 18 nt, Homo sapiens
cauguuauccacaagcaa

SEQ ID NO: 1428423 - RNA, 16 nt, Homo sapiens
cauguuccucaaaagc

SEQ ID NO: 1428424 - RNA, 22 nt, Homo sapiens
cauguugagguacaguuugcau

SEQ ID NO: 1428425 - RNA, 17 nt, Homo sapiens
cauguuggauagucagc

SEQ ID NO: 1428426 - RNA, 15 nt, Homo sapiens
cauguuguaagcacu

SEQ ID NO: 1428427 - RNA, 22 nt, Homo sapiens
cauguuuuguauguuaaauuca

SEQ ID NO: 1428428 - RNA, 15 nt, Homo sapiens
cauuaaacacuguaa

SEQ ID NO: 1428429 - RNA, 17 nt, Homo sapiens
cauuaaauucacaugca

SEQ ID NO: 1428430 - RNA, 13 nt, Homo sapiens
cauuacauggcug

SEQ ID NO: 1428431 - RNA, 17 nt, Homo sapiens
cauuacuuuaauacuca

SEQ ID NO: 1428432 - RNA, 23 nt, Homo sapiens
cccaguauaugcuauucaaugau

SEQ ID NO: 1428433 - RNA, 16 nt, Homo sapiens
cccagucucccaccuu

SEQ ID NO: 1428434 - RNA, 13 nt, Homo sapiens
cccagugaccuga

SEQ ID NO: 1428435 - RNA, 14 nt, Homo sapiens
cccaguguaaagaa

SEQ ID NO: 1428436 - RNA, 12 nt, Homo sapiens
cccauaaggcca

SEQ ID NO: 1428437 - RNA, 15 nt, Homo sapiens
cccaucaccuacuca

SEQ ID NO: 1428438 - RNA, 16 nt, Homo sapiens
cccauccccuuuccuc

SEQ ID NO: 1428439 - RNA, 19 nt, Homo sapiens
cccaucuaagcugcagcuu

SEQ ID NO: 1428440 - RNA, 18 nt, Homo sapiens
cccaugaggacaaagugu

SEQ ID NO: 1428441 - RNA, 17 nt, Homo sapiens
cccauguugcaugccua

SEQ ID NO: 1428442 - RNA, 23 nt, Homo sapiens
cccauuacuuuaauacucaccuc

SEQ ID NO: 1428443 - RNA, 17 nt, Homo sapiens
cccauuccuauuucuua

SEQ ID NO: 1428444 - RNA, 12 nt, Homo sapiens
cccauucuugca

SEQ ID NO: 1428445 - RNA, 23 nt, Homo sapiens
ccccaacaucucccucccacauu

SEQ ID NO: 1428446 - RNA, 19 nt, Homo sapiens
ccccaagcagccagccagu

SEQ ID NO: 1428447 - RNA, 11 nt, Homo sapiens
ccccaccuacu

SEQ ID NO: 1428448 - RNA, 21 nt, Homo sapiens
ccccaccugggacccuugaga

SEQ ID NO: 1428449 - RNA, 20 nt, Homo sapiens
ccccaccuugccaagcuuuc

SEQ ID NO: 1428450 - RNA, 23 nt, Homo sapiens
ccccacgagggucaggacuguga

SEQ ID NO: 1428451 - RNA, 13 nt, Homo sapiens
ccccacgugugaa

SEQ ID NO: 1428452 - RNA, 24 nt, Homo sapiens
ccccagagccacuaccuuugucca

SEQ ID NO: 1428453 - RNA, 16 nt, Homo sapiens
ccccagcccacaggug

SEQ ID NO: 1428454 - RNA, 19 nt, Homo sapiens
cccccacccaguccgccaa

SEQ ID NO: 1428455 - RNA, 13 nt, Homo sapiens
cccccacuuggga

SEQ ID NO: 1428456 - RNA, 15 nt, Homo sapiens
cccccugcugcucau

SEQ ID NO: 1428457 - RNA, 14 nt, Homo sapiens
cccccuggagagaa

SEQ ID NO: 1428458 - RNA, 14 nt, Homo sapiens
ccccgacuucaucc

SEQ ID NO: 1428459 - RNA, 16 nt, Homo sapiens
ccccgacuucauccca

SEQ ID NO: 1428460 - RNA, 16 nt, Homo sapiens
ccccucaaaauccaag

SEQ ID NO: 1428461 - RNA, 12 nt, Homo sapiens
ccccuccacugu

SEQ ID NO: 1428462 - RNA, 21 nt, Homo sapiens
ccccugccucaagaaauugcc

SEQ ID NO: 1428463 - RNA, 17 nt, Homo sapiens
cccgaauuuagucacac

SEQ ID NO: 1428464 - RNA, 13 nt, Homo sapiens
cccgacagccugg

SEQ ID NO: 1428465 - RNA, 22 nt, Homo sapiens
cccgacugugaaaguaugugau

SEQ ID NO: 1428466 - RNA, 18 nt, Homo sapiens
cccgagcuagagugcagu

SEQ ID NO: 1428467 - RNA, 22 nt, Homo sapiens
cccgccgccuccugcaccgaga

SEQ ID NO: 1428468 - RNA, 22 nt, Homo sapiens
cccgccuguccugccucucugc

SEQ ID NO: 1428469 - RNA, 18 nt, Homo sapiens
cccggaguaaucaggcag

SEQ ID NO: 1428470 - RNA, 22 nt, Homo sapiens
cccggggcuggcggcuacucag

SEQ ID NO: 1428471 - RNA, 22 nt, Homo sapiens
cccguaggcagccucucugcua

SEQ ID NO: 1428472 - RNA, 14 nt, Homo sapiens
cccgucauguuccu

SEQ ID NO: 1428473 - RNA, 20 nt, Homo sapiens
cccgucauguuccucaaaag

SEQ ID NO: 1428474 - RNA, 22 nt, Homo sapiens
cccgucauguuccucaaaagca

SEQ ID NO: 1428475 - RNA, 17 nt, Homo sapiens
cccuaagaggcagugag

SEQ ID NO: 1428476 - RNA, 15 nt, Homo sapiens
cccuaauaaguccac

SEQ ID NO: 1428477 - RNA, 14 nt, Homo sapiens
cccuacccacuucc

SEQ ID NO: 1428478 - RNA, 17 nt, Homo sapiens
cccuauuaaccuagaga

SEQ ID NO: 1428479 - RNA, 22 nt, Homo sapiens
cccuauuggguagaugagggga

SEQ ID NO: 1428480 - RNA, 19 nt, Homo sapiens
cccucagcacagacucuuu

SEQ ID NO: 1428481 - RNA, 11 nt, Homo sapiens
cccucagggau

SEQ ID NO: 1428482 - RNA, 17 nt, Homo sapiens
cccucagggaucuugca

SEQ ID NO: 1428483 - RNA, 12 nt, Homo sapiens
cccucaguuuuu

SEQ ID NO: 1428484 - RNA, 13 nt, Homo sapiens
cccuccaauccca

SEQ ID NO: 1428485 - RNA, 14 nt, Homo sapiens
cccucccauagcac

SEQ ID NO: 1428486 - RNA, 18 nt, Homo sapiens
cccuccuggagcauccca

SEQ ID NO: 1428487 - RNA, 18 nt, Homo sapiens
cccucuccccucauggag

SEQ ID NO: 1428488 - RNA, 20 nt, Homo sapiens
cccucugggcagcugucaug

SEQ ID NO: 1428489 - RNA, 19 nt, Homo sapiens
cccugaccgugcuaacugu

SEQ ID NO: 1428490 - RNA, 16 nt, Homo sapiens
cccugaccucccagcc

SEQ ID NO: 1428491 - RNA, 18 nt, Homo sapiens
cccugacgacacugaaga

SEQ ID NO: 1428492 - RNA, 15 nt, Homo sapiens
cccugauaagcaaau

SEQ ID NO: 1428493 - RNA, 16 nt, Homo sapiens
cccugcuugcacuuug

SEQ ID NO: 1428494 - RNA, 14 nt, Homo sapiens
cccuggagugcagu

SEQ ID NO: 1428495 - RNA, 22 nt, Homo sapiens
cccuggcccugccucauccacc

SEQ ID NO: 1428496 - RNA, 16 nt, Homo sapiens
cccugggguaugagcu

SEQ ID NO: 1428497 - RNA, 15 nt, Homo sapiens
cccugguguguuucc

SEQ ID NO: 1428498 - RNA, 22 nt, Homo sapiens
cccugucaugguguccagacag

SEQ ID NO: 1428499 - RNA, 17 nt, Homo sapiens
cccuguccccugaaaaa

SEQ ID NO: 1428500 - RNA, 15 nt, Homo sapiens
cccugucucuacuaa

SEQ ID NO: 1428501 - RNA, 11 nt, Homo sapiens
cccugugcuga

SEQ ID NO: 1428502 - RNA, 15 nt, Homo sapiens
cccuguuaagcaauu

SEQ ID NO: 1428503 - RNA, 20 nt, Homo sapiens
cccuuaaggguugaaggcag

SEQ ID NO: 1428504 - RNA, 22 nt, Homo sapiens
cccuucaaccauuccccauggg

SEQ ID NO: 1428505 - RNA, 19 nt, Homo sapiens
cccuuccuacagauaguca

SEQ ID NO: 1428506 - RNA, 13 nt, Homo sapiens
cccuucugcugua

SEQ ID NO: 1428507 - RNA, 15 nt, Homo sapiens
cccuuggcugugagg

SEQ ID NO: 1428508 - RNA, 12 nt, Homo sapiens
ccgaagcccagu

SEQ ID NO: 1428509 - RNA, 23 nt, Homo sapiens
ccgacggauuccuuuaugaguca

SEQ ID NO: 1428510 - RNA, 16 nt, Homo sapiens
ccgagagagauggaau

SEQ ID NO: 1428511 - RNA, 20 nt, Homo sapiens
ccgagagagauggaauaaag

SEQ ID NO: 1428512 - RNA, 16 nt, Homo sapiens
ccgagcuagagugcag

SEQ ID NO: 1428513 - RNA, 20 nt, Homo sapiens
ccgagucucuucuccacugg

SEQ ID NO: 1428514 - RNA, 18 nt, Homo sapiens
ccgauguacacacacaga

SEQ ID NO: 1428515 - RNA, 16 nt, Homo sapiens
ccgcaaguucagggaa

SEQ ID NO: 1428516 - RNA, 16 nt, Homo sapiens
ccgccaaacacuccac

SEQ ID NO: 1428517 - RNA, 23 nt, Homo sapiens
ccgcgcgaagugggcauugcaaa

SEQ ID NO: 1428518 - RNA, 14 nt, Homo sapiens
ccgcggugcucugg

SEQ ID NO: 1428519 - RNA, 18 nt, Homo sapiens
ccuuugaaauucccccac

SEQ ID NO: 1428520 - RNA, 21 nt, Homo sapiens
ccuuugauaaauguauauaug

SEQ ID NO: 1428521 - RNA, 14 nt, Homo sapiens
ccuuuuaaaacacu

SEQ ID NO: 1428522 - RNA, 15 nt, Homo sapiens
ccuuuucaucuccag

SEQ ID NO: 1428523 - RNA, 13 nt, Homo sapiens
ccuuuugaccaaa

SEQ ID NO: 1428524 - RNA, 18 nt, Homo sapiens
ccuuuuucaacuuggaaa

SEQ ID NO: 1428525 - RNA, 15 nt, Homo sapiens
ccuuuuucuaccuuu

SEQ ID NO: 1428526 - RNA, 16 nt, Homo sapiens
ccuuuuuuguuauuau

SEQ ID NO: 1428527 - RNA, 20 nt, Homo sapiens
cgaaaauucauuucacauua

SEQ ID NO: 1428528 - RNA, 14 nt, Homo sapiens
cgaacaaacugaug

SEQ ID NO: 1428529 - RNA, 15 nt, Homo sapiens
cgaacauucuuugcc

SEQ ID NO: 1428530 - RNA, 17 nt, Homo sapiens
cgaagggggucaaagga

SEQ ID NO: 1428531 - RNA, 14 nt, Homo sapiens
cgaaucaucucaaa

SEQ ID NO: 1428532 - RNA, 21 nt, Homo sapiens
cgaauggggcgaucaagucca

SEQ ID NO: 1428533 - RNA, 14 nt, Homo sapiens
cgaccccaucucau

SEQ ID NO: 1428534 - RNA, 19 nt, Homo sapiens
cgacuucaucccaaaggac

SEQ ID NO: 1428535 - RNA, 15 nt, Homo sapiens
cgacuuuuaagcaaa

SEQ ID NO: 1428536 - RNA, 18 nt, Homo sapiens
cgagaaaacaaacccagg

SEQ ID NO: 1428537 - RNA, 22 nt, Homo sapiens
cgagagaggcgcgucugcccca

SEQ ID NO: 1428538 - RNA, 15 nt, Homo sapiens
cgagcagcugagcag

SEQ ID NO: 1428539 - RNA, 18 nt, Homo sapiens
cgagcuacucucuugcca

SEQ ID NO: 1428540 - RNA, 18 nt, Homo sapiens
cgagggucaggacuguga

SEQ ID NO: 1428541 - RNA, 14 nt, Homo sapiens
cgaguguuugccag

SEQ ID NO: 1428542 - RNA, 18 nt, Homo sapiens
cgauccuggauucacuca

SEQ ID NO: 1428543 - RNA, 13 nt, Homo sapiens
cgaucgcugugaa

SEQ ID NO: 1428544 - RNA, 22 nt, Homo sapiens
cgaucuuugaauauacuuaccu

SEQ ID NO: 1428545 - RNA, 22 nt, Homo sapiens
cgaugccgugugucucgucucc

SEQ ID NO: 1428546 - RNA, 20 nt, Homo sapiens
cgcaaagggcugaaagccau

SEQ ID NO: 1428547 - RNA, 21 nt, Homo sapiens
cgcacaaggcugaccaagaga

SEQ ID NO: 1428548 - RNA, 16 nt, Homo sapiens
cgcaccacuguguauu

SEQ ID NO: 1428549 - RNA, 18 nt, Homo sapiens
cgcagggaggaugccaca

SEQ ID NO: 1428550 - RNA, 12 nt, Homo sapiens
cgcaguggcuca

SEQ ID NO: 1428551 - RNA, 14 nt, Homo sapiens
cgcauauuuaacuc

SEQ ID NO: 1428552 - RNA, 22 nt, Homo sapiens
cgccaacugcugaucaaugaaa

SEQ ID NO: 1428553 - RNA, 20 nt, Homo sapiens
cgccauccgggacgcuucca

SEQ ID NO: 1428554 - RNA, 14 nt, Homo sapiens
cgccauuccaaguc

SEQ ID NO: 1428555 - RNA, 17 nt, Homo sapiens
cgccauuccaagucaac

SEQ ID NO: 1428556 - RNA, 23 nt, Homo sapiens
cgccauuccaagucaacacucuu

SEQ ID NO: 1428557 - RNA, 19 nt, Homo sapiens
cgcccugggcugucuguca

SEQ ID NO: 1428558 - RNA, 22 nt, Homo sapiens
cgccuguaaucccagcacuuug

SEQ ID NO: 1428559 - RNA, 20 nt, Homo sapiens
cgcgaagugggcauugcaaa

SEQ ID NO: 1428560 - RNA, 20 nt, Homo sapiens
cgcgugugacagucuugcau

SEQ ID NO: 1428561 - RNA, 19 nt, Homo sapiens
cgcuucuccuccagguauu

SEQ ID NO: 1428562 - RNA, 14 nt, Homo sapiens
cggaaggcaaagag

SEQ ID NO: 1428563 - RNA, 14 nt, Homo sapiens
cggacagugcccau

SEQ ID NO: 1428564 - RNA, 16 nt, Homo sapiens
cggacccaucuuugcu

SEQ ID NO: 1428565 - RNA, 20 nt, Homo sapiens
cggagcaggggucugagcca

SEQ ID NO: 1428566 - RNA, 19 nt, Homo sapiens
cggaggccggccaccugca

SEQ ID NO: 1428567 - RNA, 18 nt, Homo sapiens
cggaguacagacgucuca

SEQ ID NO: 1428568 - RNA, 17 nt, Homo sapiens
cggagucuugcucuguu

SEQ ID NO: 1428569 - RNA, 17 nt, Homo sapiens
cggaugcacacacagau

SEQ ID NO: 1428570 - RNA, 14 nt, Homo sapiens
cggaugcacagaga

SEQ ID NO: 1428571 - RNA, 17 nt, Homo sapiens
cggcaugugaauucugu

SEQ ID NO: 1428572 - RNA, 17 nt, Homo sapiens
cggcccagaaguuuccc

SEQ ID NO: 1428573 - RNA, 23 nt, Homo sapiens
cgggauccccagccuacugccuc

SEQ ID NO: 1428574 - RNA, 18 nt, Homo sapiens
cgggccaccaaguucugg

SEQ ID NO: 1428575 - RNA, 21 nt, Homo sapiens
cgggccuggagaacuagagaa

SEQ ID NO: 1428576 - RNA, 21 nt, Homo sapiens
cgggcugcccuucgcugccag

SEQ ID NO: 1428577 - RNA, 14 nt, Homo sapiens
cgggggaaagcaca

SEQ ID NO: 1428578 - RNA, 15 nt, Homo sapiens
cgggggcacugccug

SEQ ID NO: 1428579 - RNA, 14 nt, Homo sapiens
cggucccacacugg

SEQ ID NO: 1428580 - RNA, 13 nt, Homo sapiens
cguagacuugaca

SEQ ID NO: 1428581 - RNA, 14 nt, Homo sapiens
cguccauggcacca

SEQ ID NO: 1428582 - RNA, 12 nt, Homo sapiens
cgucucaagacu

SEQ ID NO: 1428583 - RNA, 16 nt, Homo sapiens
cgugaaagcagaugag

SEQ ID NO: 1428584 - RNA, 23 nt, Homo sapiens
cgugaaauugaugccaguggaau

SEQ ID NO: 1428585 - RNA, 13 nt, Homo sapiens
cgugcacucccua

SEQ ID NO: 1428586 - RNA, 20 nt, Homo sapiens
cgugccagcucuaguuuuca

SEQ ID NO: 1428587 - RNA, 21 nt, Homo sapiens
cguggaccacccgcccuggca

SEQ ID NO: 1428588 - RNA, 22 nt, Homo sapiens
cguggggggagguggacagucc

SEQ ID NO: 1428589 - RNA, 22 nt, Homo sapiens
cguuaagggaaggaacucuggc

SEQ ID NO: 1428590 - RNA, 14 nt, Homo sapiens
cguuuuaaggacau

SEQ ID NO: 1428591 - RNA, 17 nt, Homo sapiens
cuaaaaauaagcuuuau

SEQ ID NO: 1428592 - RNA, 13 nt, Homo sapiens
cuaaaaaucauga

SEQ ID NO: 1428593 - RNA, 17 nt, Homo sapiens
cuaaaaaucaugagauc

SEQ ID NO: 1428594 - RNA, 18 nt, Homo sapiens
cuaaaacuaugguuccca

SEQ ID NO: 1428595 - RNA, 19 nt, Homo sapiens
cuaaaauacaaacaagcac

SEQ ID NO: 1428596 - RNA, 13 nt, Homo sapiens
cuaaaauauuauu

SEQ ID NO: 1428597 - RNA, 14 nt, Homo sapiens
cuaaagccaguggc

SEQ ID NO: 1428598 - RNA, 16 nt, Homo sapiens
cuaaauccaaaugagg

SEQ ID NO: 1428599 - RNA, 22 nt, Homo sapiens
cuaaaucuuccagcaugcaucc

SEQ ID NO: 1428600 - RNA, 23 nt, Homo sapiens
cuaacacccagucuguuccccau

SEQ ID NO: 1428601 - RNA, 13 nt, Homo sapiens
cuaacauaaaaua

SEQ ID NO: 1428602 - RNA, 22 nt, Homo sapiens
cuaacuacaaggacaaugccuu

SEQ ID NO: 1428603 - RNA, 15 nt, Homo sapiens
cuaacuccagucucc

SEQ ID NO: 1428604 - RNA, 14 nt, Homo sapiens
cuaacuguaugugu

SEQ ID NO: 1428605 - RNA, 19 nt, Homo sapiens
cuaacuguaugugucuuua

SEQ ID NO: 1428606 - RNA, 14 nt, Homo sapiens
gagccgcugcugag

SEQ ID NO: 1428607 - RNA, 23 nt, Homo sapiens
gagccucccccucagaugaucuc

SEQ ID NO: 1428608 - RNA, 19 nt, Homo sapiens
gagccucgcaacccgugcc

SEQ ID NO: 1428609 - RNA, 12 nt, Homo sapiens
gagccuggagaa

SEQ ID NO: 1428610 - RNA, 15 nt, Homo sapiens
gagccuggcacagga

SEQ ID NO: 1428611 - RNA, 14 nt, Homo sapiens
gagccuucugauga

SEQ ID NO: 1428612 - RNA, 16 nt, Homo sapiens
gagcuagaaccuggag

SEQ ID NO: 1428613 - RNA, 14 nt, Homo sapiens
gagcucagccgugc

SEQ ID NO: 1428614 - RNA, 22 nt, Homo sapiens
gagcucuuaacuacaguggcug

SEQ ID NO: 1428615 - RNA, 15 nt, Homo sapiens
gagcugaagcuggga

SEQ ID NO: 1428616 - RNA, 21 nt, Homo sapiens
gagcuggaaauaaaccuggag

SEQ ID NO: 1428617 - RNA, 23 nt, Homo sapiens
gagcuggaaauaaaccuggagau

SEQ ID NO: 1428618 - RNA, 16 nt, Homo sapiens
gagcuggaacacucuc

SEQ ID NO: 1428619 - RNA, 14 nt, Homo sapiens
gagcuggaaggcag

SEQ ID NO: 1428620 - RNA, 23 nt, Homo sapiens
gagcugggaguagcauggacucu

SEQ ID NO: 1428621 - RNA, 24 nt, Homo sapiens
gagcuucugggaagacaacuagga

SEQ ID NO: 1428622 - RNA, 22 nt, Homo sapiens
gaggagucugagguccugagca

SEQ ID NO: 1428623 - RNA, 14 nt, Homo sapiens
gaggaguuccuuga

SEQ ID NO: 1428624 - RNA, 22 nt, Homo sapiens
gaggaugcagaggggugcugcu

SEQ ID NO: 1428625 - RNA, 14 nt, Homo sapiens
gaggcaagaaccag

SEQ ID NO: 1428626 - RNA, 15 nt, Homo sapiens
gaggcaagaaccagu

SEQ ID NO: 1428627 - RNA, 15 nt, Homo sapiens
gaggcagaacaggcu

SEQ ID NO: 1428628 - RNA, 23 nt, Homo sapiens
gaggcggaaaccuugcagcauuu

SEQ ID NO: 1428629 - RNA, 18 nt, Homo sapiens
gaggcugagacaggagaa

SEQ ID NO: 1428630 - RNA, 21 nt, Homo sapiens
gaggcugagcuggaucacuug

SEQ ID NO: 1428631 - RNA, 16 nt, Homo sapiens
gaggcugcaugcucug

SEQ ID NO: 1428632 - RNA, 20 nt, Homo sapiens
gaggcugggccccugggaug

SEQ ID NO: 1428633 - RNA, 19 nt, Homo sapiens
gagggacaaaggagccugu

SEQ ID NO: 1428634 - RNA, 16 nt, Homo sapiens
gagggcagcagccagc

SEQ ID NO: 1428635 - RNA, 20 nt, Homo sapiens
gagggcucacucggcuucca

SEQ ID NO: 1428636 - RNA, 23 nt, Homo sapiens
gaggggaaacgcaaaaccugcag

SEQ ID NO: 1428637 - RNA, 15 nt, Homo sapiens
gaggggaagggccag

SEQ ID NO: 1428638 - RNA, 14 nt, Homo sapiens
gaggggaccaaagc

SEQ ID NO: 1428639 - RNA, 21 nt, Homo sapiens
gaggggacuauuuaugaaggc

SEQ ID NO: 1428640 - RNA, 23 nt, Homo sapiens
gaggggagcccccucuuccacuc

SEQ ID NO: 1428641 - RNA, 16 nt, Homo sapiens
gagggguugcggggga

SEQ ID NO: 1428642 - RNA, 12 nt, Homo sapiens
gagggugacugu

SEQ ID NO: 1428643 - RNA, 23 nt, Homo sapiens
gaggguuggguucaucugagcaa

SEQ ID NO: 1428644 - RNA, 13 nt, Homo sapiens
gagguacacucuu

SEQ ID NO: 1428645 - RNA, 14 nt, Homo sapiens
gagguccugaucag

SEQ ID NO: 1428646 - RNA, 20 nt, Homo sapiens
gaggucuccacugaggaugu

SEQ ID NO: 1428647 - RNA, 14 nt, Homo sapiens
gaggugagaccaaa

SEQ ID NO: 1428648 - RNA, 17 nt, Homo sapiens
gaggugguagaaccacu

SEQ ID NO: 1428649 - RNA, 16 nt, Homo sapiens
gaguacagugagccaa

SEQ ID NO: 1428650 - RNA, 23 nt, Homo sapiens
gaguaccaaauccacaagccauu

SEQ ID NO: 1428651 - RNA, 22 nt, Homo sapiens
gagucaauccccucauucagga

SEQ ID NO: 1428652 - RNA, 17 nt, Homo sapiens
gagucacaguugacaaa

SEQ ID NO: 1428653 - RNA, 23 nt, Homo sapiens
gagucaccuccuccacucacucc

SEQ ID NO: 1428654 - RNA, 16 nt, Homo sapiens
gaguccaacaauguug

SEQ ID NO: 1428655 - RNA, 14 nt, Homo sapiens
gagucgacuuugag

SEQ ID NO: 1428656 - RNA, 21 nt, Homo sapiens
gagucucauucuguugcccag

SEQ ID NO: 1428657 - RNA, 19 nt, Homo sapiens
gagucucccuuagggcccu

SEQ ID NO: 1428658 - RNA, 14 nt, Homo sapiens
gagucucuguauaa

SEQ ID NO: 1428659 - RNA, 18 nt, Homo sapiens
gagucucuucuccacugg

SEQ ID NO: 1428660 - RNA, 14 nt, Homo sapiens
gagucugugcucuu

SEQ ID NO: 1428661 - RNA, 20 nt, Homo sapiens
gagucuugguuccucuacua

SEQ ID NO: 1428662 - RNA, 17 nt, Homo sapiens
gagugagacucgucuca

SEQ ID NO: 1428663 - RNA, 22 nt, Homo sapiens
gagugagaggguuugagucaaa

SEQ ID NO: 1428664 - RNA, 23 nt, Homo sapiens
gagugcaguaguaauugauuuga

SEQ ID NO: 1428665 - RNA, 20 nt, Homo sapiens
gagugucaccagcugccaaa

SEQ ID NO: 1428666 - RNA, 22 nt, Homo sapiens
gagugugggcauagcauuagcu

SEQ ID NO: 1428667 - RNA, 17 nt, Homo sapiens
gagugugggugaucaga

SEQ ID NO: 1428668 - RNA, 22 nt, Homo sapiens
gaguguucauuuuagugacugu

SEQ ID NO: 1428669 - RNA, 17 nt, Homo sapiens
gaguguuuuuguaucac

SEQ ID NO: 1428670 - RNA, 12 nt, Homo sapiens
gaguucauccca

SEQ ID NO: 1428671 - RNA, 19 nt, Homo sapiens
gaguuccauguuuguacuc

SEQ ID NO: 1428672 - RNA, 14 nt, Homo sapiens
gaguuccucaggga

SEQ ID NO: 1428673 - RNA, 14 nt, Homo sapiens
gaguucugaagcug

SEQ ID NO: 1428674 - RNA, 17 nt, Homo sapiens
gaguugccagggaagaa

SEQ ID NO: 1428675 - RNA, 16 nt, Homo sapiens
gaguugcgcugggaga

SEQ ID NO: 1428676 - RNA, 17 nt, Homo sapiens
gaguugugaucauccca

SEQ ID NO: 1428677 - RNA, 15 nt, Homo sapiens
gaguuuaacaugugu

SEQ ID NO: 1428678 - RNA, 21 nt, Homo sapiens
gaguuucuccuuuugaccaaa

SEQ ID NO: 1428679 - RNA, 14 nt, Homo sapiens
gaguuuucaaagau

SEQ ID NO: 1428680 - RNA, 10 nt, Homo sapiens
gauaaacuaa

SEQ ID NO: 1428681 - RNA, 20 nt, Homo sapiens
gauaaaggaagucaccaaaa

SEQ ID NO: 1428682 - RNA, 21 nt, Homo sapiens
gauaaaggaagucaccaaaau

SEQ ID NO: 1428683 - RNA, 14 nt, Homo sapiens
gauaaaugccucau

SEQ ID NO: 1428684 - RNA, 14 nt, Homo sapiens
gauaacaaccugga

SEQ ID NO: 1428685 - RNA, 14 nt, Homo sapiens
gauaacugcaauuu

SEQ ID NO: 1428686 - RNA, 17 nt, Homo sapiens
gauaacuugagcaccgu

SEQ ID NO: 1428687 - RNA, 15 nt, Homo sapiens
gauaauaugcuaaau

SEQ ID NO: 1428688 - RNA, 15 nt, Homo sapiens
gauaaucagccucuu

SEQ ID NO: 1428689 - RNA, 19 nt, Homo sapiens
gauaaugcuguugccucau

SEQ ID NO: 1428690 - RNA, 18 nt, Homo sapiens
gauaauucaaacugacaa

SEQ ID NO: 1428691 - RNA, 20 nt, Homo sapiens
gauacaaggaucagaaugga

SEQ ID NO: 1428692 - RNA, 19 nt, Homo sapiens
gcagaucauguaaggaagg

SEQ ID NO: 1428693 - RNA, 9 nt, Homo sapiens
gcagcacuu

SEQ ID NO: 1428694 - RNA, 21 nt, Homo sapiens
gcagcagugagcuucuauuaa

SEQ ID NO: 1428695 - RNA, 21 nt, Homo sapiens
gcagcaucuucaaacauguac

SEQ ID NO: 1428696 - RNA, 21 nt, Homo sapiens
gcagccaccaggucaucuccu

SEQ ID NO: 1428697 - RNA, 16 nt, Homo sapiens
gcagccacugugcuga

SEQ ID NO: 1428698 - RNA, 20 nt, Homo sapiens
gcagccuucugacaagcaag

SEQ ID NO: 1428699 - RNA, 15 nt, Homo sapiens
gcagcgcgugcacag

SEQ ID NO: 1428700 - RNA, 15 nt, Homo sapiens
gcagcgguaccccag

SEQ ID NO: 1428701 - RNA, 22 nt, Homo sapiens
gcagcugauuuugucacugucu

SEQ ID NO: 1428702 - RNA, 16 nt, Homo sapiens
gcagcugggccggcca

SEQ ID NO: 1428703 - RNA, 22 nt, Homo sapiens
gcaggaacucccagcaacacaa

SEQ ID NO: 1428704 - RNA, 12 nt, Homo sapiens
gcaggaccagga

SEQ ID NO: 1428705 - RNA, 20 nt, Homo sapiens
gcaggcagccccacacccgc

SEQ ID NO: 1428706 - RNA, 21 nt, Homo sapiens
gcaggcagccccacacccgcc

SEQ ID NO: 1428707 - RNA, 18 nt, Homo sapiens
gcaggcccccaggugcca

SEQ ID NO: 1428708 - RNA, 17 nt, Homo sapiens
gcaggcucagacucugg

SEQ ID NO: 1428709 - RNA, 20 nt, Homo sapiens
gcagggccuugcccagagau

SEQ ID NO: 1428710 - RNA, 20 nt, Homo sapiens
gcagggggugugucugcuca

SEQ ID NO: 1428711 - RNA, 21 nt, Homo sapiens
gcaggguauugcgaaacaacu

SEQ ID NO: 1428712 - RNA, 15 nt, Homo sapiens
gcagguguaccuccc

SEQ ID NO: 1428713 - RNA, 19 nt, Homo sapiens
gcaguauugccacaaugcc

SEQ ID NO: 1428714 - RNA, 20 nt, Homo sapiens
gcagucuuggcucacuacag

SEQ ID NO: 1428715 - RNA, 15 nt, Homo sapiens
gcagugagcuucuau

SEQ ID NO: 1428716 - RNA, 15 nt, Homo sapiens
gcagugauacaugua

SEQ ID NO: 1428717 - RNA, 13 nt, Homo sapiens
gcagugaugucac

SEQ ID NO: 1428718 - RNA, 22 nt, Homo sapiens
gcaguucgcagccacccugagg

SEQ ID NO: 1428719 - RNA, 19 nt, Homo sapiens
gcaguugaaaagacuccaa

SEQ ID NO: 1428720 - RNA, 21 nt, Homo sapiens
gcaguuugcuuuguaugcacu

SEQ ID NO: 1428721 - RNA, 21 nt, Homo sapiens
gcauaaucagcgcccuggagu

SEQ ID NO: 1428722 - RNA, 12 nt, Homo sapiens
gcauaccuuuau

SEQ ID NO: 1428723 - RNA, 14 nt, Homo sapiens
gcauagaaacugag

SEQ ID NO: 1428724 - RNA, 12 nt, Homo sapiens
gcauaugcaaua

SEQ ID NO: 1428725 - RNA, 21 nt, Homo sapiens
gcaucaauuuuucuuauuuca

SEQ ID NO: 1428726 - RNA, 23 nt, Homo sapiens
gcaucagcugcugaaacaacaaa

SEQ ID NO: 1428727 - RNA, 14 nt, Homo sapiens
gcauccuggccaac

SEQ ID NO: 1428728 - RNA, 17 nt, Homo sapiens
gcaucguggugugucaa

SEQ ID NO: 1428729 - RNA, 22 nt, Homo sapiens
gcaucguggugugucaaugcca

SEQ ID NO: 1428730 - RNA, 23 nt, Homo sapiens
gcaucguggugugucaaugccac

SEQ ID NO: 1428731 - RNA, 22 nt, Homo sapiens
gcaucuagaauuaguggagcuu

SEQ ID NO: 1428732 - RNA, 13 nt, Homo sapiens
gcaucucagccua

SEQ ID NO: 1428733 - RNA, 21 nt, Homo sapiens
gcaucugacaugcaucaucuc

SEQ ID NO: 1428734 - RNA, 14 nt, Homo sapiens
gcaucugacucaca

SEQ ID NO: 1428735 - RNA, 20 nt, Homo sapiens
gcaugaaagagaaagacuga

SEQ ID NO: 1428736 - RNA, 16 nt, Homo sapiens
gcaugaacacacaugg

SEQ ID NO: 1428737 - RNA, 20 nt, Homo sapiens
gcaugaaggcagccacagac

SEQ ID NO: 1428738 - RNA, 14 nt, Homo sapiens
gcaugccuauguac

SEQ ID NO: 1428739 - RNA, 16 nt, Homo sapiens
gcaugccuccaaaaau

SEQ ID NO: 1428740 - RNA, 15 nt, Homo sapiens
gcaugcgcaggcuca

SEQ ID NO: 1428741 - RNA, 21 nt, Homo sapiens
gcauggacaccccuuauccag

SEQ ID NO: 1428742 - RNA, 17 nt, Homo sapiens
gcauggagagccucuua

SEQ ID NO: 1428743 - RNA, 22 nt, Homo sapiens
gcaugguuugauuuugaccugg

SEQ ID NO: 1428744 - RNA, 13 nt, Homo sapiens
gcauguaugugca

SEQ ID NO: 1428745 - RNA, 16 nt, Homo sapiens
gcauguggagacacuc

SEQ ID NO: 1428746 - RNA, 22 nt, Homo sapiens
gcauucagcacaccccaaggga

SEQ ID NO: 1428747 - RNA, 15 nt, Homo sapiens
gcauugaacauuucu

SEQ ID NO: 1428748 - RNA, 18 nt, Homo sapiens
gcauuuguuccaugccug

SEQ ID NO: 1428749 - RNA, 19 nt, Homo sapiens
gcauuuucacauuuugccu

SEQ ID NO: 1428750 - RNA, 15 nt, Homo sapiens
gcauuuuuugcaagu

SEQ ID NO: 1428751 - RNA, 21 nt, Homo sapiens
gccaaacaaaggcccagcagc

SEQ ID NO: 1428752 - RNA, 18 nt, Homo sapiens
gccaaacagccccaaagu

SEQ ID NO: 1428753 - RNA, 18 nt, Homo sapiens
gccaaagugacacagagc

SEQ ID NO: 1428754 - RNA, 15 nt, Homo sapiens
gccaacuuguaaaua

SEQ ID NO: 1428755 - RNA, 19 nt, Homo sapiens
gccaagaaucaagcuagaa

SEQ ID NO: 1428756 - RNA, 18 nt, Homo sapiens
gccaagaccccagcuuca

SEQ ID NO: 1428757 - RNA, 20 nt, Homo sapiens
gccaagaucgcgccacugca

SEQ ID NO: 1428758 - RNA, 23 nt, Homo sapiens
gccaagcuuucuucuacaaccag

SEQ ID NO: 1428759 - RNA, 18 nt, Homo sapiens
gccaauauuucugauaua

SEQ ID NO: 1428760 - RNA, 12 nt, Homo sapiens
gccaaugcacac

SEQ ID NO: 1428761 - RNA, 14 nt, Homo sapiens
gccaauuagcaauu

SEQ ID NO: 1428762 - RNA, 11 nt, Homo sapiens
gccacaaagaa

SEQ ID NO: 1428763 - RNA, 14 nt, Homo sapiens
gccacacacuguuc

SEQ ID NO: 1428764 - RNA, 16 nt, Homo sapiens
gccacagaagccagga

SEQ ID NO: 1428765 - RNA, 20 nt, Homo sapiens
gccacagacaacauggaaau

SEQ ID NO: 1428766 - RNA, 17 nt, Homo sapiens
gccaccagucacugucc

SEQ ID NO: 1428767 - RNA, 20 nt, Homo sapiens
gccacuaccuucugaccucc

SEQ ID NO: 1428768 - RNA, 13 nt, Homo sapiens
gccacuaccuuug

SEQ ID NO: 1428769 - RNA, 16 nt, Homo sapiens
gccacucauuccugua

SEQ ID NO: 1428770 - RNA, 16 nt, Homo sapiens
gccacuugacauuccu

SEQ ID NO: 1428771 - RNA, 23 nt, Homo sapiens
gccacuugacauuccuugucacc

SEQ ID NO: 1428772 - RNA, 23 nt, Homo sapiens
gccagaaagaaguuaacuacagu

SEQ ID NO: 1428773 - RNA, 19 nt, Homo sapiens
gccagacugguuagacagu

SEQ ID NO: 1428774 - RNA, 11 nt, Homo sapiens
gccagcauuuu

SEQ ID NO: 1428775 - RNA, 15 nt, Homo sapiens
gccagcucucucuac

SEQ ID NO: 1428776 - RNA, 20 nt, Homo sapiens
gccaggagguuggugacuga

SEQ ID NO: 1428777 - RNA, 22 nt, Homo sapiens
gccaggauuccucucucagguc

SEQ ID NO: 1428778 - RNA, 21 nt, Homo sapiens
gcugguccuucucguuugcuc

SEQ ID NO: 1428779 - RNA, 23 nt, Homo sapiens
gcuguaaacuauaaacuacugua

SEQ ID NO: 1428780 - RNA, 16 nt, Homo sapiens
gcuguacuugaugaca

SEQ ID NO: 1428781 - RNA, 22 nt, Homo sapiens
gcuguagcucccgagcuacucu

SEQ ID NO: 1428782 - RNA, 18 nt, Homo sapiens
gcuguauuuguucaguga

SEQ ID NO: 1428783 - RNA, 22 nt, Homo sapiens
gcugugagccccugguccugag

SEQ ID NO: 1428784 - RNA, 18 nt, Homo sapiens
gcuguggccucacuuccc

SEQ ID NO: 1428785 - RNA, 20 nt, Homo sapiens
gcugugguuccuaagccugu

SEQ ID NO: 1428786 - RNA, 23 nt, Homo sapiens
gcuguucacagccagacuggcac

SEQ ID NO: 1428787 - RNA, 21 nt, Homo sapiens
gcuguuuauuuauucacugua

SEQ ID NO: 1428788 - RNA, 14 nt, Homo sapiens
gcuguuucuggaaa

SEQ ID NO: 1428789 - RNA, 23 nt, Homo sapiens
gcuuaaggagaggagaaacugag

SEQ ID NO: 1428790 - RNA, 14 nt, Homo sapiens
gcuuagccuccuga

SEQ ID NO: 1428791 - RNA, 14 nt, Homo sapiens
gcuuaggauguuuu

SEQ ID NO: 1428792 - RNA, 20 nt, Homo sapiens
gcuuauucaucuguuuuucu

SEQ ID NO: 1428793 - RNA, 18 nt, Homo sapiens
gcuucaagugauauaugu

SEQ ID NO: 1428794 - RNA, 14 nt, Homo sapiens
gcuuccacuucuau

SEQ ID NO: 1428795 - RNA, 16 nt, Homo sapiens
gcuuccagaccaccug

SEQ ID NO: 1428796 - RNA, 18 nt, Homo sapiens
gcuuccagggagcccuuu

SEQ ID NO: 1428797 - RNA, 14 nt, Homo sapiens
gcuucuaguauuuu

SEQ ID NO: 1428798 - RNA, 18 nt, Homo sapiens
gcuucucauggauggcac

SEQ ID NO: 1428799 - RNA, 17 nt, Homo sapiens
gcuucucuuucucugag

SEQ ID NO: 1428800 - RNA, 17 nt, Homo sapiens
gcuucuucaucuuuaaa

SEQ ID NO: 1428801 - RNA, 15 nt, Homo sapiens
gcuugaaguaaccuu

SEQ ID NO: 1428802 - RNA, 14 nt, Homo sapiens
gcuugcaugccaaa

SEQ ID NO: 1428803 - RNA, 20 nt, Homo sapiens
gcuugccaccggggaaccca

SEQ ID NO: 1428804 - RNA, 15 nt, Homo sapiens
gcuuggcccuauuaa

SEQ ID NO: 1428805 - RNA, 19 nt, Homo sapiens
gcuuguccugcucucuuca

SEQ ID NO: 1428806 - RNA, 14 nt, Homo sapiens
gcuuuaacaaaaca

SEQ ID NO: 1428807 - RNA, 19 nt, Homo sapiens
gcuuuaauuuucacucugg

SEQ ID NO: 1428808 - RNA, 14 nt, Homo sapiens
gcuuuacauuuuau

SEQ ID NO: 1428809 - RNA, 19 nt, Homo sapiens
gcuuuacccucaggugcua

SEQ ID NO: 1428810 - RNA, 14 nt, Homo sapiens
gcuuucaacacaca

SEQ ID NO: 1428811 - RNA, 19 nt, Homo sapiens
gcuuucccggacugcaagc

SEQ ID NO: 1428812 - RNA, 18 nt, Homo sapiens
gcuuugcuucaaauccau

SEQ ID NO: 1428813 - RNA, 21 nt, Homo sapiens
gcuuuguuucuuucauaugaa

SEQ ID NO: 1428814 - RNA, 18 nt, Homo sapiens
gcuuuuaagaaacacagg

SEQ ID NO: 1428815 - RNA, 19 nt, Homo sapiens
gcuuuuaagaaacacaggg

SEQ ID NO: 1428816 - RNA, 20 nt, Homo sapiens
gcuuuuuuccuccuguguac

SEQ ID NO: 1428817 - RNA, 22 nt, Homo sapiens
gcuuuuuucuugaguacuagaa

SEQ ID NO: 1428818 - RNA, 22 nt, Homo sapiens
ggaaaacagaggaaucuaccug

SEQ ID NO: 1428819 - RNA, 17 nt, Homo sapiens
ggaaaauuucacauuaa

SEQ ID NO: 1428820 - RNA, 19 nt, Homo sapiens
ggaaaccuugcagcauuuu

SEQ ID NO: 1428821 - RNA, 23 nt, Homo sapiens
ggaaagaaaacuaacaaccaacc

SEQ ID NO: 1428822 - RNA, 23 nt, Homo sapiens
ggaaauucaaaacaauuggcaaa

SEQ ID NO: 1428823 - RNA, 23 nt, Homo sapiens
ggaaccaaccaacaaacaaugcc

SEQ ID NO: 1428824 - RNA, 22 nt, Homo sapiens
ggaacuagagggauacacugaa

SEQ ID NO: 1428825 - RNA, 16 nt, Homo sapiens
ggaacugguucaagag

SEQ ID NO: 1428826 - RNA, 16 nt, Homo sapiens
ggaagaaauuccugua

SEQ ID NO: 1428827 - RNA, 22 nt, Homo sapiens
ggaagacgccuuucuccuccaa

SEQ ID NO: 1428828 - RNA, 18 nt, Homo sapiens
ggaagcaagaaagccgua

SEQ ID NO: 1428829 - RNA, 16 nt, Homo sapiens
ggaagcacauguuuau

SEQ ID NO: 1428830 - RNA, 19 nt, Homo sapiens
ggaagcggagcuugcagug

SEQ ID NO: 1428831 - RNA, 16 nt, Homo sapiens
ggaagcuccacuguca

SEQ ID NO: 1428832 - RNA, 17 nt, Homo sapiens
ggaagcuccacugucac

SEQ ID NO: 1428833 - RNA, 14 nt, Homo sapiens
ggaaggcagggaca

SEQ ID NO: 1428834 - RNA, 18 nt, Homo sapiens
ggaaggucaguugccaug

SEQ ID NO: 1428835 - RNA, 22 nt, Homo sapiens
ggaagucguccuuacuccugug

SEQ ID NO: 1428836 - RNA, 22 nt, Homo sapiens
ggaagucucuuuuuuuacucuu

SEQ ID NO: 1428837 - RNA, 12 nt, Homo sapiens
ggaaguuuucag

SEQ ID NO: 1428838 - RNA, 18 nt, Homo sapiens
ggaauaaagcccuugaac

SEQ ID NO: 1428839 - RNA, 23 nt, Homo sapiens
ggaauauauuugugugugugaua

SEQ ID NO: 1428840 - RNA, 18 nt, Homo sapiens
ggaauucuuuacaauaaa

SEQ ID NO: 1428841 - RNA, 21 nt, Homo sapiens
ggacaaaguguagcagccucc

SEQ ID NO: 1428842 - RNA, 20 nt, Homo sapiens
ggacaccccuuauccaggac

SEQ ID NO: 1428843 - RNA, 18 nt, Homo sapiens
ggacaggauaagagggau

SEQ ID NO: 1428844 - RNA, 17 nt, Homo sapiens
ggacaggugaauggagg

SEQ ID NO: 1428845 - RNA, 17 nt, Homo sapiens
ggacaucaaauuugcca

SEQ ID NO: 1428846 - RNA, 14 nt, Homo sapiens
ggacaugugcuauu

SEQ ID NO: 1428847 - RNA, 16 nt, Homo sapiens
ggaccacauguguucu

SEQ ID NO: 1428848 - RNA, 12 nt, Homo sapiens
ggaccagggaug

SEQ ID NO: 1428849 - RNA, 18 nt, Homo sapiens
ggacgcaauugugggaug

SEQ ID NO: 1428850 - RNA, 21 nt, Homo sapiens
ggacgcgccaggggaguuccu

SEQ ID NO: 1428851 - RNA, 16 nt, Homo sapiens
ggacgcuuccagacca

SEQ ID NO: 1428852 - RNA, 23 nt, Homo sapiens
ggacgcuuccagaccaccugcca

SEQ ID NO: 1428853 - RNA, 22 nt, Homo sapiens
ggacguccugcuggcaccucag

SEQ ID NO: 1428854 - RNA, 21 nt, Homo sapiens
ggacuacaggugcaagccacu

SEQ ID NO: 1428855 - RNA, 10 nt, Homo sapiens
ggacuauuau

SEQ ID NO: 1428856 - RNA, 20 nt, Homo sapiens
ggacucauauauuuaagccu

SEQ ID NO: 1428857 - RNA, 13 nt, Homo sapiens
ggacuccugucug

SEQ ID NO: 1428858 - RNA, 17 nt, Homo sapiens
ggacugaaugugccuaa

SEQ ID NO: 1428859 - RNA, 10 nt, Homo sapiens
ggacugggag

SEQ ID NO: 1428860 - RNA, 15 nt, Homo sapiens
ggacuugaacccagg

SEQ ID NO: 1428861 - RNA, 13 nt, Homo sapiens
ggagaacuagaga

SEQ ID NO: 1428862 - RNA, 18 nt, Homo sapiens
ggagaagagcuguucaca

SEQ ID NO: 1428863 - RNA, 18 nt, Homo sapiens
ggagaagcucacccaaua

SEQ ID NO: 1428864 - RNA, 18 nt, Homo sapiens
gugcagggaaccgugaua

SEQ ID NO: 1428865 - RNA, 12 nt, Homo sapiens
gugcaguauuuu

SEQ ID NO: 1428866 - RNA, 13 nt, Homo sapiens
gugcagugauaca

SEQ ID NO: 1428867 - RNA, 18 nt, Homo sapiens
gugcaugugagcacaugc

SEQ ID NO: 1428868 - RNA, 15 nt, Homo sapiens
gugcauuucuaggac

SEQ ID NO: 1428869 - RNA, 11 nt, Homo sapiens
gugcauuuuau

SEQ ID NO: 1428870 - RNA, 24 nt, Homo sapiens
gugccagcucaggugacuggagcc

SEQ ID NO: 1428871 - RNA, 19 nt, Homo sapiens
gugccauucccacuaagcu

SEQ ID NO: 1428872 - RNA, 21 nt, Homo sapiens
gugcccaggggcccacaggga

SEQ ID NO: 1428873 - RNA, 15 nt, Homo sapiens
gugccgugacagggc

SEQ ID NO: 1428874 - RNA, 20 nt, Homo sapiens
gugccuauuuauucauucag

SEQ ID NO: 1428875 - RNA, 13 nt, Homo sapiens
gugccugcugcug

SEQ ID NO: 1428876 - RNA, 13 nt, Homo sapiens
gugcuacaaaaac

SEQ ID NO: 1428877 - RNA, 17 nt, Homo sapiens
gugcuaucgcaccacug

SEQ ID NO: 1428878 - RNA, 16 nt, Homo sapiens
gugcuaugccaagcca

SEQ ID NO: 1428879 - RNA, 16 nt, Homo sapiens
gugcucuucuguucuc

SEQ ID NO: 1428880 - RNA, 15 nt, Homo sapiens
gugcugggauuacag

SEQ ID NO: 1428881 - RNA, 20 nt, Homo sapiens
gugcuuuuaaaaaaaaauac

SEQ ID NO: 1428882 - RNA, 14 nt, Homo sapiens
guggaagaaggaaa

SEQ ID NO: 1428883 - RNA, 17 nt, Homo sapiens
guggaaggcagugaaca

SEQ ID NO: 1428884 - RNA, 16 nt, Homo sapiens
guggaaugcagggaag

SEQ ID NO: 1428885 - RNA, 16 nt, Homo sapiens
guggacaggacuaaca

SEQ ID NO: 1428886 - RNA, 17 nt, Homo sapiens
guggagaugcagaggua

SEQ ID NO: 1428887 - RNA, 20 nt, Homo sapiens
guggauuccagcauuugcca

SEQ ID NO: 1428888 - RNA, 14 nt, Homo sapiens
guggcaacccucac

SEQ ID NO: 1428889 - RNA, 16 nt, Homo sapiens
guggcaccgagaccaa

SEQ ID NO: 1428890 - RNA, 19 nt, Homo sapiens
guggcacgugccugugauc

SEQ ID NO: 1428891 - RNA, 16 nt, Homo sapiens
guggcagauuuaguga

SEQ ID NO: 1428892 - RNA, 17 nt, Homo sapiens
guggcauuaaacauuug

SEQ ID NO: 1428893 - RNA, 14 nt, Homo sapiens
guggccuuccccuu

SEQ ID NO: 1428894 - RNA, 18 nt, Homo sapiens
guggcuaauucaauuuau

SEQ ID NO: 1428895 - RNA, 18 nt, Homo sapiens
guggcuucccgcucagcc

SEQ ID NO: 1428896 - RNA, 23 nt, Homo sapiens
guggcuuuggcagaccaucucca

SEQ ID NO: 1428897 - RNA, 20 nt, Homo sapiens
guggcuuuuuuccuccugug

SEQ ID NO: 1428898 - RNA, 13 nt, Homo sapiens
gugggaacucuga

SEQ ID NO: 1428899 - RNA, 18 nt, Homo sapiens
gugggacaaaccagagca

SEQ ID NO: 1428900 - RNA, 18 nt, Homo sapiens
gugggagagacacuccca

SEQ ID NO: 1428901 - RNA, 15 nt, Homo sapiens
gugggcauugcaaag

SEQ ID NO: 1428902 - RNA, 11 nt, Homo sapiens
guggguggugg

SEQ ID NO: 1428903 - RNA, 12 nt, Homo sapiens
guggguggugga

SEQ ID NO: 1428904 - RNA, 20 nt, Homo sapiens
guggugcccaugaggacaaa

SEQ ID NO: 1428905 - RNA, 23 nt, Homo sapiens
guguaccucccccugccuuccaa

SEQ ID NO: 1428906 - RNA, 19 nt, Homo sapiens
guguagaggguguuugcag

SEQ ID NO: 1428907 - RNA, 15 nt, Homo sapiens
guguagugucuguaa

SEQ ID NO: 1428908 - RNA, 21 nt, Homo sapiens
guguauauauaguagcauuuc

SEQ ID NO: 1428909 - RNA, 14 nt, Homo sapiens
gugucacccugcag

SEQ ID NO: 1428910 - RNA, 14 nt, Homo sapiens
gugucauaccacaa

SEQ ID NO: 1428911 - RNA, 16 nt, Homo sapiens
gugucccaagcuuuga

SEQ ID NO: 1428912 - RNA, 16 nt, Homo sapiens
guguccguggaaccag

SEQ ID NO: 1428913 - RNA, 18 nt, Homo sapiens
gugucucugaggacguca

SEQ ID NO: 1428914 - RNA, 14 nt, Homo sapiens
gugucuguguguau

SEQ ID NO: 1428915 - RNA, 17 nt, Homo sapiens
gugugaagaaauggaau

SEQ ID NO: 1428916 - RNA, 17 nt, Homo sapiens
gugugcauguguguaua

SEQ ID NO: 1428917 - RNA, 11 nt, Homo sapiens
gugugccaaac

SEQ ID NO: 1428918 - RNA, 20 nt, Homo sapiens
gugugccauagaguuuaaca

SEQ ID NO: 1428919 - RNA, 15 nt, Homo sapiens
guguguacauauaua

SEQ ID NO: 1428920 - RNA, 22 nt, Homo sapiens
guguguaucgcugccuugccau

SEQ ID NO: 1428921 - RNA, 13 nt, Homo sapiens
guguguauucaag

SEQ ID NO: 1428922 - RNA, 17 nt, Homo sapiens
guguuacuguugcacug

SEQ ID NO: 1428923 - RNA, 18 nt, Homo sapiens
guguuauuauuuugcacu

SEQ ID NO: 1428924 - RNA, 20 nt, Homo sapiens
guguuauuauuuugcacugu

SEQ ID NO: 1428925 - RNA, 16 nt, Homo sapiens
guguuccuucauuaac

SEQ ID NO: 1428926 - RNA, 21 nt, Homo sapiens
guguugaggggaccaaagcca

SEQ ID NO: 1428927 - RNA, 18 nt, Homo sapiens
guguugguguauuugcca

SEQ ID NO: 1428928 - RNA, 13 nt, Homo sapiens
guguuuccuucag

SEQ ID NO: 1428929 - RNA, 17 nt, Homo sapiens
guuaaaaauauuuucug

SEQ ID NO: 1428930 - RNA, 23 nt, Homo sapiens
guuaaacacgugucuauaaugga

SEQ ID NO: 1428931 - RNA, 14 nt, Homo sapiens
guuaagaauggaag

SEQ ID NO: 1428932 - RNA, 16 nt, Homo sapiens
guuacauaacaagaaa

SEQ ID NO: 1428933 - RNA, 21 nt, Homo sapiens
guuacaucacaguguuugcaa

SEQ ID NO: 1428934 - RNA, 16 nt, Homo sapiens
guuacuguugcacuga

SEQ ID NO: 1428935 - RNA, 20 nt, Homo sapiens
guuacuugaaauaccaguga

SEQ ID NO: 1428936 - RNA, 13 nt, Homo sapiens
guuauaacugugg

SEQ ID NO: 1428937 - RNA, 15 nt, Homo sapiens
guuauagaaacugau

SEQ ID NO: 1428938 - RNA, 12 nt, Homo sapiens
guuaucacuuau

SEQ ID NO: 1428939 - RNA, 14 nt, Homo sapiens
guuaucaguuaaca

SEQ ID NO: 1428940 - RNA, 22 nt, Homo sapiens
guuaugagggucagggcaguau

SEQ ID NO: 1428941 - RNA, 22 nt, Homo sapiens
guuaugccguauaggaugucag

SEQ ID NO: 1428942 - RNA, 15 nt, Homo sapiens
guuauguuugcacuu

SEQ ID NO: 1428943 - RNA, 22 nt, Homo sapiens
guuauuaguccaaaugugauca

SEQ ID NO: 1428944 - RNA, 15 nt, Homo sapiens
guuauuuuaauuauc

SEQ ID NO: 1428945 - RNA, 20 nt, Homo sapiens
guucaggaguuggagaccag

SEQ ID NO: 1428946 - RNA, 17 nt, Homo sapiens
guucaguggugugaucu

SEQ ID NO: 1428947 - RNA, 13 nt, Homo sapiens
guucaguucuguu

SEQ ID NO: 1428948 - RNA, 17 nt, Homo sapiens
guucauuuuagugacug

SEQ ID NO: 1428949 - RNA, 19 nt, Homo sapiens
guucccccucccuguguga

SEQ ID NO: 1428950 - RNA, 21 nt, Homo sapiens
guucccccucccugugugaaa

SEQ ID NO: 1428951 - RNA, 13 nt, Homo sapiens
ucuacagccucag

SEQ ID NO: 1428952 - RNA, 13 nt, Homo sapiens
ucuacauauaugu

SEQ ID NO: 1428953 - RNA, 18 nt, Homo sapiens
ucuacccggcccagagac

SEQ ID NO: 1428954 - RNA, 20 nt, Homo sapiens
ucuacccggcccagagaccc

SEQ ID NO: 1428955 - RNA, 20 nt, Homo sapiens
ucuaccucugucacccgagc

SEQ ID NO: 1428956 - RNA, 14 nt, Homo sapiens
ucuaccugcaagau

SEQ ID NO: 1428957 - RNA, 11 nt, Homo sapiens
ucuaccugugg

SEQ ID NO: 1428958 - RNA, 16 nt, Homo sapiens
ucuaccuuuacuacau

SEQ ID NO: 1428959 - RNA, 18 nt, Homo sapiens
ucuacuggucuuguggaa

SEQ ID NO: 1428960 - RNA, 22 nt, Homo sapiens
ucuacuuauccucauuacccag

SEQ ID NO: 1428961 - RNA, 15 nt, Homo sapiens
ucuagaacacaggca

SEQ ID NO: 1428962 - RNA, 22 nt, Homo sapiens
ucuagacacugccacacagggu

SEQ ID NO: 1428963 - RNA, 22 nt, Homo sapiens
ucuagacugucucuguggaaua

SEQ ID NO: 1428964 - RNA, 17 nt, Homo sapiens
ucuaggaaacccaagga

SEQ ID NO: 1428965 - RNA, 13 nt, Homo sapiens
ucuaggcaguuca

SEQ ID NO: 1428966 - RNA, 21 nt, Homo sapiens
ucuagucuccuuugcacugag

SEQ ID NO: 1428967 - RNA, 20 nt, Homo sapiens
ucuaguuucuugugggcuaa

SEQ ID NO: 1428968 - RNA, 21 nt, Homo sapiens
ucuauaauggaaacauuuaca

SEQ ID NO: 1428969 - RNA, 23 nt, Homo sapiens
ucuaucuugaauuucaugcuuuc

SEQ ID NO: 1428970 - RNA, 13 nt, Homo sapiens
ucuaugcauguau

SEQ ID NO: 1428971 - RNA, 17 nt, Homo sapiens
ucuauuccuaucugugg

SEQ ID NO: 1428972 - RNA, 13 nt, Homo sapiens
ucuauuccugacc

SEQ ID NO: 1428973 - RNA, 17 nt, Homo sapiens
ucuauuuugccacaagc

SEQ ID NO: 1428974 - RNA, 15 nt, Homo sapiens
ucucaaagaaucuca

SEQ ID NO: 1428975 - RNA, 14 nt, Homo sapiens
ucucaaauucucaa

SEQ ID NO: 1428976 - RNA, 14 nt, Homo sapiens
ucucaagacugaaa

SEQ ID NO: 1428977 - RNA, 21 nt, Homo sapiens
ucucaauaugcuuacaaaguc

SEQ ID NO: 1428978 - RNA, 16 nt, Homo sapiens
ucucaaucagugcagu

SEQ ID NO: 1428979 - RNA, 12 nt, Homo sapiens
ucucacaaacau

SEQ ID NO: 1428980 - RNA, 21 nt, Homo sapiens
ucucaccgggcuacuaccugg

SEQ ID NO: 1428981 - RNA, 15 nt, Homo sapiens
ucucacuaaaaugga

SEQ ID NO: 1428982 - RNA, 12 nt, Homo sapiens
ucucacuauguu

SEQ ID NO: 1428983 - RNA, 21 nt, Homo sapiens
ucucacuuauaccaaagggaa

SEQ ID NO: 1428984 - RNA, 10 nt, Homo sapiens
ucucagccau

SEQ ID NO: 1428985 - RNA, 21 nt, Homo sapiens
ucucagcccgggacagggucu

SEQ ID NO: 1428986 - RNA, 23 nt, Homo sapiens
ucucaggaaaucaaauaugcaaa

SEQ ID NO: 1428987 - RNA, 21 nt, Homo sapiens
ucucaggcgcaugugccaguu

SEQ ID NO: 1428988 - RNA, 20 nt, Homo sapiens
ucucagucaguaauugccaa

SEQ ID NO: 1428989 - RNA, 22 nt, Homo sapiens
ucucaguuauucagauugacaa

SEQ ID NO: 1428990 - RNA, 17 nt, Homo sapiens
ucucauagguugccaau

SEQ ID NO: 1428991 - RNA, 22 nt, Homo sapiens
ucucauguugaagccacugccu

SEQ ID NO: 1428992 - RNA, 22 nt, Homo sapiens
ucuccaaaugagacacauuaaa

SEQ ID NO: 1428993 - RNA, 12 nt, Homo sapiens
ucuccacuccau

SEQ ID NO: 1428994 - RNA, 17 nt, Homo sapiens
ucucccuuagggcccug

SEQ ID NO: 1428995 - RNA, 13 nt, Homo sapiens
ucuccuacuuuac

SEQ ID NO: 1428996 - RNA, 14 nt, Homo sapiens
ucuccucagaagaa

SEQ ID NO: 1428997 - RNA, 18 nt, Homo sapiens
ucuccuccaacccaaccu

SEQ ID NO: 1428998 - RNA, 16 nt, Homo sapiens
ucuccuguauaaucuc

SEQ ID NO: 1428999 - RNA, 20 nt, Homo sapiens
ucuccuuggaaauacuuuau

SEQ ID NO: 1429000 - RNA, 13 nt, Homo sapiens
ucuccuuugaggg

SEQ ID NO: 1429001 - RNA, 18 nt, Homo sapiens
ucuccuuugcacugaggg

SEQ ID NO: 1429002 - RNA, 18 nt, Homo sapiens
ucuccuuuggccauucca

SEQ ID NO: 1429003 - RNA, 17 nt, Homo sapiens
ucucgagcccagaugga

SEQ ID NO: 1429004 - RNA, 16 nt, Homo sapiens
ucucuaaaucaaguau

SEQ ID NO: 1429005 - RNA, 22 nt, Homo sapiens
ucucuaauuggaagaaauuccu

SEQ ID NO: 1429006 - RNA, 18 nt, Homo sapiens
ucucuagcuuuaggggac

SEQ ID NO: 1429007 - RNA, 23 nt, Homo sapiens
ucucuccuaagacaccugcaaua

SEQ ID NO: 1429008 - RNA, 11 nt, Homo sapiens
ucucucucuuu

SEQ ID NO: 1429009 - RNA, 16 nt, Homo sapiens
ucucugagauguguuc

SEQ ID NO: 1429010 - RNA, 22 nt, Homo sapiens
ucucugagauguguucagauag

SEQ ID NO: 1429011 - RNA, 16 nt, Homo sapiens
ucucugcugcauuugu

SEQ ID NO: 1429012 - RNA, 14 nt, Homo sapiens
ucucuuaauuuuuc

SEQ ID NO: 1429013 - RNA, 14 nt, Homo sapiens
ucucuucuuuaaag

SEQ ID NO: 1429014 - RNA, 17 nt, Homo sapiens
ucucuugccagcauuuu

SEQ ID NO: 1429015 - RNA, 14 nt, Homo sapiens
ucugaaauuuccca

SEQ ID NO: 1429016 - RNA, 17 nt, Homo sapiens
ucugaaccauuacugua

SEQ ID NO: 1429017 - RNA, 14 nt, Homo sapiens
ucugaaggagauuu

SEQ ID NO: 1429018 - RNA, 16 nt, Homo sapiens
ucugaauaacauuugu

SEQ ID NO: 1429019 - RNA, 13 nt, Homo sapiens
ucugaccauuuca

SEQ ID NO: 1429020 - RNA, 18 nt, Homo sapiens
ucugaccauuucaggggu

SEQ ID NO: 1429021 - RNA, 23 nt, Homo sapiens
ucugacccaagagguggggacca

SEQ ID NO: 1429022 - RNA, 20 nt, Homo sapiens
ucugacucacaagaagacca

SEQ ID NO: 1429023 - RNA, 16 nt, Homo sapiens
ucugagacuauaacug

SEQ ID NO: 1429024 - RNA, 19 nt, Homo sapiens
ucugagacuauaacuguca

SEQ ID NO: 1429025 - RNA, 12 nt, Homo sapiens
ucugagaucucc

SEQ ID NO: 1429026 - RNA, 15 nt, Homo sapiens
ucugagauugaauau

SEQ ID NO: 1429027 - RNA, 20 nt, Homo sapiens
ucugcaaugggcacugggau

SEQ ID NO: 1429028 - RNA, 13 nt, Homo sapiens
ucugcacugaaaa

SEQ ID NO: 1429029 - RNA, 16 nt, Homo sapiens
ucugcagcuaacuuau

SEQ ID NO: 1429030 - RNA, 15 nt, Homo sapiens
ucugcaguagucucu

SEQ ID NO: 1429031 - RNA, 12 nt, Homo sapiens
ucugcaucucau

SEQ ID NO: 1429032 - RNA, 16 nt, Homo sapiens
ucugccauaaagccau

SEQ ID NO: 1429033 - RNA, 18 nt, Homo sapiens
ucugccauaaagccauuc

SEQ ID NO: 1429034 - RNA, 16 nt, Homo sapiens
ucugccauuacucugc

SEQ ID NO: 1429035 - RNA, 14 nt, Homo sapiens
ucugcccacuguga

SEQ ID NO: 1429036 - RNA, 23 nt, Homo sapiens
ucugcccuagcgcucucuuccag

SEQ ID NO: 1429037 - RNA, 16 nt, Homo sapiens
ucugcuauaugccuua

SEQ ID NO: 1429038 - RNA, 13 nt, Homo sapiens
ugcagaaggccaa

SEQ ID NO: 1429039 - RNA, 19 nt, Homo sapiens
ugcagagguaaaaguguga

SEQ ID NO: 1429040 - RNA, 17 nt, Homo sapiens
ugcagauagccagacac

SEQ ID NO: 1429041 - RNA, 23 nt, Homo sapiens
ugcagcaacucccacgacuguug

SEQ ID NO: 1429042 - RNA, 21 nt, Homo sapiens
ugcagccccggcugacaccug

SEQ ID NO: 1429043 - RNA, 21 nt, Homo sapiens
ugcagcggcacaaaugcaccu

SEQ ID NO: 1429044 - RNA, 22 nt, Homo sapiens
ugcagcuuccugucaacacuuc

SEQ ID NO: 1429045 - RNA, 18 nt, Homo sapiens
ugcagggaagagggcagu

SEQ ID NO: 1429046 - RNA, 14 nt, Homo sapiens
ugcagggacugcca

SEQ ID NO: 1429047 - RNA, 21 nt, Homo sapiens
ugcagggggugugucugcuca

SEQ ID NO: 1429048 - RNA, 23 nt, Homo sapiens
ugcaguauauuucugaaaugaca

SEQ ID NO: 1429049 - RNA, 16 nt, Homo sapiens
ugcaguccccagucac

SEQ ID NO: 1429050 - RNA, 16 nt, Homo sapiens
ugcaguugacagcagg

SEQ ID NO: 1429051 - RNA, 22 nt, Homo sapiens
ugcaguuuccaaucccauagau

SEQ ID NO: 1429052 - RNA, 18 nt, Homo sapiens
ugcauaaaccaaugagcu

SEQ ID NO: 1429053 - RNA, 22 nt, Homo sapiens
ugcauauguauuuuguauuugc

SEQ ID NO: 1429054 - RNA, 21 nt, Homo sapiens
ugcaucaauuuaccuacucua

SEQ ID NO: 1429055 - RNA, 17 nt, Homo sapiens
ugcaucaucagccuauu

SEQ ID NO: 1429056 - RNA, 22 nt, Homo sapiens
ugcauccacgcacacauggaca

SEQ ID NO: 1429057 - RNA, 12 nt, Homo sapiens
ugcaucuacuca

SEQ ID NO: 1429058 - RNA, 13 nt, Homo sapiens
ugcaucuacucag

SEQ ID NO: 1429059 - RNA, 10 nt, Homo sapiens
ugcaucucau

SEQ ID NO: 1429060 - RNA, 11 nt, Homo sapiens
ugcaucucauu

SEQ ID NO: 1429061 - RNA, 15 nt, Homo sapiens
ugcaucuguacucac

SEQ ID NO: 1429062 - RNA, 13 nt, Homo sapiens
ugcaugaccugau

SEQ ID NO: 1429063 - RNA, 13 nt, Homo sapiens
ugcauguaugugu

SEQ ID NO: 1429064 - RNA, 15 nt, Homo sapiens
ugcaugugugugaug

SEQ ID NO: 1429065 - RNA, 10 nt, Homo sapiens
ugcauuccau

SEQ ID NO: 1429066 - RNA, 15 nt, Homo sapiens
ugcauuccccgcugc

SEQ ID NO: 1429067 - RNA, 18 nt, Homo sapiens
ugccaacaccuucuuggc

SEQ ID NO: 1429068 - RNA, 13 nt, Homo sapiens
ugccaacugguca

SEQ ID NO: 1429069 - RNA, 24 nt, Homo sapiens
ugccaagcccucaauaagccagca

SEQ ID NO: 1429070 - RNA, 15 nt, Homo sapiens
ugccaauuagcaauu

SEQ ID NO: 1429071 - RNA, 11 nt, Homo sapiens
ugccacaaaga

SEQ ID NO: 1429072 - RNA, 13 nt, Homo sapiens
ugccacaaugccu

SEQ ID NO: 1429073 - RNA, 15 nt, Homo sapiens
ugccaccugucuguc

SEQ ID NO: 1429074 - RNA, 17 nt, Homo sapiens
ugccagcagaacaugug

SEQ ID NO: 1429075 - RNA, 11 nt, Homo sapiens
ugccagcagcu

SEQ ID NO: 1429076 - RNA, 14 nt, Homo sapiens
ugccagccaucaca

SEQ ID NO: 1429077 - RNA, 17 nt, Homo sapiens
ugccagccgugaugcuc

SEQ ID NO: 1429078 - RNA, 15 nt, Homo sapiens
ugccaggacaccugc

SEQ ID NO: 1429079 - RNA, 21 nt, Homo sapiens
ugcccaaccugcucuccucuu

SEQ ID NO: 1429080 - RNA, 19 nt, Homo sapiens
ugcccccacccaccuguac

SEQ ID NO: 1429081 - RNA, 20 nt, Homo sapiens
ugcccuccaauccuuuccac

SEQ ID NO: 1429082 - RNA, 23 nt, Homo sapiens
ugcccugaguggaucuccaagga

SEQ ID NO: 1429083 - RNA, 14 nt, Homo sapiens
ugcccugccugcau

SEQ ID NO: 1429084 - RNA, 20 nt, Homo sapiens
ugcccuguauauaauacuaa

SEQ ID NO: 1429085 - RNA, 23 nt, Homo sapiens
ugcccuguuguguauagaugcaa

SEQ ID NO: 1429086 - RNA, 20 nt, Homo sapiens
ugccggacacagagggggcc

SEQ ID NO: 1429087 - RNA, 15 nt, Homo sapiens
ugccggcccagugac

SEQ ID NO: 1429088 - RNA, 16 nt, Homo sapiens
ugccggcccagugaca

SEQ ID NO: 1429089 - RNA, 22 nt, Homo sapiens
ugccuaggguccuguccaugcc

SEQ ID NO: 1429090 - RNA, 16 nt, Homo sapiens
ugccuccaagauuuca

SEQ ID NO: 1429091 - RNA, 15 nt, Homo sapiens
ugccuccaagccauu

SEQ ID NO: 1429092 - RNA, 19 nt, Homo sapiens
ugccuccugggaccaugga

SEQ ID NO: 1429093 - RNA, 17 nt, Homo sapiens
ugccucucugcuccaga

SEQ ID NO: 1429094 - RNA, 23 nt, Homo sapiens
ugccucugaggccagccuggccu

SEQ ID NO: 1429095 - RNA, 14 nt, Homo sapiens
ugccugagcccagg

SEQ ID NO: 1429096 - RNA, 13 nt, Homo sapiens
ugccugauuagau

SEQ ID NO: 1429097 - RNA, 16 nt, Homo sapiens
ugccugcuccaagaaa

SEQ ID NO: 1429098 - RNA, 15 nt, Homo sapiens
ugccuggcaaggccu

SEQ ID NO: 1429099 - RNA, 12 nt, Homo sapiens
ugccuuauguaa

SEQ ID NO: 1429100 - RNA, 14 nt, Homo sapiens
ugccuuauguaauu

SEQ ID NO: 1429101 - RNA, 12 nt, Homo sapiens
ugccuucaccuu

SEQ ID NO: 1429102 - RNA, 12 nt, Homo sapiens
ugccuuccucau

SEQ ID NO: 1429103 - RNA, 17 nt, Homo sapiens
ugccuucucccugggaa

SEQ ID NO: 1429104 - RNA, 16 nt, Homo sapiens
ugccuugccaugucuu

SEQ ID NO: 1429105 - RNA, 21 nt, Homo sapiens
ugccuuugggaggcagcauca

SEQ ID NO: 1429106 - RNA, 17 nt, Homo sapiens
ugcgaaguggcucucag

SEQ ID NO: 1429107 - RNA, 22 nt, Homo sapiens
ugcgcaacaacaaggacccugu

SEQ ID NO: 1429108 - RNA, 15 nt, Homo sapiens
ugcgcaauguggcau

SEQ ID NO: 1429109 - RNA, 19 nt, Homo sapiens
ugcgcacacacagauaugc

SEQ ID NO: 1429110 - RNA, 23 nt, Homo sapiens
ugcgcacacacagauaugcacac

SEQ ID NO: 1429111 - RNA, 13 nt, Homo sapiens
ugcgcguccugcc

SEQ ID NO: 1429112 - RNA, 15 nt, Homo sapiens
ugcggagacccugag

SEQ ID NO: 1429113 - RNA, 21 nt, Homo sapiens
ugcgucagaccaguacuggga

SEQ ID NO: 1429114 - RNA, 15 nt, Homo sapiens
ugcuaaauacuguac

SEQ ID NO: 1429115 - RNA, 13 nt, Homo sapiens
ugcuaaaugcaaa

SEQ ID NO: 1429116 - RNA, 18 nt, Homo sapiens
ugcuacaaaaacacagca

SEQ ID NO: 1429117 - RNA, 13 nt, Homo sapiens
ugcuacacaaaag

SEQ ID NO: 1429118 - RNA, 14 nt, Homo sapiens
ugcuagacagccag

SEQ ID NO: 1429119 - RNA, 23 nt, Homo sapiens
ugcuauuauguaacauccagaag

SEQ ID NO: 1429120 - RNA, 20 nt, Homo sapiens
ugcucaggcuugaaaugcau

SEQ ID NO: 1429121 - RNA, 16 nt, Homo sapiens
ugcucaucacccaguc

SEQ ID NO: 1429122 - RNA, 16 nt, Homo sapiens
ugcuccugugugcugg

SEQ ID NO: 1429123 - RNA, 14 nt, Homo sapiens
ugcucucaugccug

SEQ ID NO: 1429124 - RNA, 19 nt, Homo sapiens
ugcucugguuugagcaauu

SEQ ID NO: 1429125 - RNA, 16 nt, Homo sapiens
ugugugcgugugcgca

SEQ ID NO: 1429126 - RNA, 12 nt, Homo sapiens
ugugugugauau

SEQ ID NO: 1429127 - RNA, 12 nt, Homo sapiens
ugugugugcaug

SEQ ID NO: 1429128 - RNA, 15 nt, Homo sapiens
uguguuaagugcagg

SEQ ID NO: 1429129 - RNA, 13 nt, Homo sapiens
uguguuaguaaua

SEQ ID NO: 1429130 - RNA, 20 nt, Homo sapiens
uguguuauuauuuugcacug

SEQ ID NO: 1429131 - RNA, 14 nt, Homo sapiens
uguguucacacugu

SEQ ID NO: 1429132 - RNA, 17 nt, Homo sapiens
uguguugggaccuguga

SEQ ID NO: 1429133 - RNA, 19 nt, Homo sapiens
uguguugggaccugugauc

SEQ ID NO: 1429134 - RNA, 21 nt, Homo sapiens
uguguuuccuucagugcaucu

SEQ ID NO: 1429135 - RNA, 21 nt, Homo sapiens
uguuaagcaaaggaaaccaaa

SEQ ID NO: 1429136 - RNA, 18 nt, Homo sapiens
uguuaauucagcacugau

SEQ ID NO: 1429137 - RNA, 21 nt, Homo sapiens
uguuacuugaaauaccaguga

SEQ ID NO: 1429138 - RNA, 19 nt, Homo sapiens
uguuagauuccucuugccu

SEQ ID NO: 1429139 - RNA, 16 nt, Homo sapiens
uguuagcccaagguua

SEQ ID NO: 1429140 - RNA, 18 nt, Homo sapiens
uguuaggaagggacugca

SEQ ID NO: 1429141 - RNA, 15 nt, Homo sapiens
uguuauccacaagca

SEQ ID NO: 1429142 - RNA, 13 nt, Homo sapiens
uguuaucugcuag

SEQ ID NO: 1429143 - RNA, 17 nt, Homo sapiens
uguuaugugacuaucuu

SEQ ID NO: 1429144 - RNA, 21 nt, Homo sapiens
uguucacaacauaaggagaau

SEQ ID NO: 1429145 - RNA, 12 nt, Homo sapiens
uguucacaugca

SEQ ID NO: 1429146 - RNA, 18 nt, Homo sapiens
uguucagcuggacaauau

SEQ ID NO: 1429147 - RNA, 13 nt, Homo sapiens
uguuccaaaaaga

SEQ ID NO: 1429148 - RNA, 17 nt, Homo sapiens
uguuccugaugugccag

SEQ ID NO: 1429149 - RNA, 17 nt, Homo sapiens
uguuccuguugaaucuu

SEQ ID NO: 1429150 - RNA, 18 nt, Homo sapiens
uguucucaaaugcuaaau

SEQ ID NO: 1429151 - RNA, 14 nt, Homo sapiens
uguucucuucuaua

SEQ ID NO: 1429152 - RNA, 15 nt, Homo sapiens
uguucugucaccaau

SEQ ID NO: 1429153 - RNA, 20 nt, Homo sapiens
uguucuugcugagcacccuc

SEQ ID NO: 1429154 - RNA, 15 nt, Homo sapiens
uguugagugcaacaa

SEQ ID NO: 1429155 - RNA, 12 nt, Homo sapiens
uguugcaccuca

SEQ ID NO: 1429156 - RNA, 18 nt, Homo sapiens
uguugcagggaagucuua

SEQ ID NO: 1429157 - RNA, 18 nt, Homo sapiens
uguugcuaggacauauac

SEQ ID NO: 1429158 - RNA, 21 nt, Homo sapiens
uguugcuggacugucauagaa

SEQ ID NO: 1429159 - RNA, 19 nt, Homo sapiens
uguugguggccucugcuug

SEQ ID NO: 1429160 - RNA, 17 nt, Homo sapiens
uguugguguauuugcca

SEQ ID NO: 1429161 - RNA, 15 nt, Homo sapiens
uguugguuuccaaaa

SEQ ID NO: 1429162 - RNA, 23 nt, Homo sapiens
uguuguaaauaaaaguauuuaau

SEQ ID NO: 1429163 - RNA, 21 nt, Homo sapiens
uguuuaaaaucauuucugcau

SEQ ID NO: 1429164 - RNA, 19 nt, Homo sapiens
uguuuaaauaaaguaucau

SEQ ID NO: 1429165 - RNA, 15 nt, Homo sapiens
uguuuaaguggcuuu

SEQ ID NO: 1429166 - RNA, 22 nt, Homo sapiens
uguuuaaguggcuuucagcaaa

SEQ ID NO: 1429167 - RNA, 20 nt, Homo sapiens
uguuuaccucuucuaugcaa

SEQ ID NO: 1429168 - RNA, 14 nt, Homo sapiens
uguuucccaccuca

SEQ ID NO: 1429169 - RNA, 21 nt, Homo sapiens
uguuucuaaaacuaugguucc

SEQ ID NO: 1429170 - RNA, 14 nt, Homo sapiens
uguuugagguuaaa

SEQ ID NO: 1429171 - RNA, 11 nt, Homo sapiens
uguuugcacuu

SEQ ID NO: 1429172 - RNA, 20 nt, Homo sapiens
uguuugugaaacaaaaaagu

SEQ ID NO: 1429173 - RNA, 19 nt, Homo sapiens
uguuuguguggauacccag

SEQ ID NO: 1429174 - RNA, 22 nt, Homo sapiens
uguuuuccuggcaucuuucaac

SEQ ID NO: 1429175 - RNA, 12 nt, Homo sapiens
uguuuuguacaa

SEQ ID NO: 1429176 - RNA, 13 nt, Homo sapiens
uuaaaaaguaaaa

SEQ ID NO: 1429177 - RNA, 19 nt, Homo sapiens
uuaaaagacugcagcugcu

SEQ ID NO: 1429178 - RNA, 19 nt, Homo sapiens
uuaaaagugacauuugucu

SEQ ID NO: 1429179 - RNA, 18 nt, Homo sapiens
uuaaaauauguaugucua

SEQ ID NO: 1429180 - RNA, 16 nt, Homo sapiens
uuaaaaucauucaaua

SEQ ID NO: 1429181 - RNA, 20 nt, Homo sapiens
uuaaaauguacacuggauau

SEQ ID NO: 1429182 - RNA, 17 nt, Homo sapiens
uuaaacaccugacacau

SEQ ID NO: 1429183 - RNA, 14 nt, Homo sapiens
uuaaacagccaaau

SEQ ID NO: 1429184 - RNA, 15 nt, Homo sapiens
uuaaaccacuguaua

SEQ ID NO: 1429185 - RNA, 17 nt, Homo sapiens
uuaaagugguucuggau

SEQ ID NO: 1429186 - RNA, 18 nt, Homo sapiens
uuaaagugguucuggaua

SEQ ID NO: 1429187 - RNA, 23 nt, Homo sapiens
uuaaauauauuucuugcuauugu

SEQ ID NO: 1429188 - RNA, 22 nt, Homo sapiens
uuaaaucacagauggguauuaa

SEQ ID NO: 1429189 - RNA, 15 nt, Homo sapiens
uuaaaugacagugaa

SEQ ID NO: 1429190 - RNA, 21 nt, Homo sapiens
uuaaaugacugcugaaugaca

SEQ ID NO: 1429191 - RNA, 16 nt, Homo sapiens
uuaaauuaauauugau

SEQ ID NO: 1429192 - RNA, 15 nt, Homo sapiens
uuaaauuucaucuca

SEQ ID NO: 1429193 - RNA, 14 nt, Homo sapiens
uuaaauuucuggau

SEQ ID NO: 1429194 - RNA, 14 nt, Homo sapiens
uuaacauauuugca

SEQ ID NO: 1429195 - RNA, 16 nt, Homo sapiens
uuaacaucaucaggcu

SEQ ID NO: 1429196 - RNA, 16 nt, Homo sapiens
uuaaccuacuagacaa

SEQ ID NO: 1429197 - RNA, 14 nt, Homo sapiens
uuaacuaugugaug

SEQ ID NO: 1429198 - RNA, 17 nt, Homo sapiens
uuaacugugaaccugga

SEQ ID NO: 1429199 - RNA, 14 nt, Homo sapiens
uuaagaaacacagg

SEQ ID NO: 1429200 - RNA, 22 nt, Homo sapiens
uuaagaaacacaggguuuugua

SEQ ID NO: 1429201 - RNA, 14 nt, Homo sapiens
uuaagacacaccuc

SEQ ID NO: 1429202 - RNA, 18 nt, Homo sapiens
uuaagagaagaugugauu

SEQ ID NO: 1429203 - RNA, 17 nt, Homo sapiens
uuaagagauacauuccc

SEQ ID NO: 1429204 - RNA, 17 nt, Homo sapiens
uuaagcuuaugucagac

SEQ ID NO: 1429205 - RNA, 15 nt, Homo sapiens
uuaaggauugugaua

SEQ ID NO: 1429206 - RNA, 23 nt, Homo sapiens
uuaagguguugguguauuugcca

SEQ ID NO: 1429207 - RNA, 22 nt, Homo sapiens
uuaagguuugcccugccugcag

SEQ ID NO: 1429208 - RNA, 21 nt, Homo sapiens
uuaauaacuuguccuauguca

SEQ ID NO: 1429209 - RNA, 13 nt, Homo sapiens
uuaauacaaagaa

SEQ ID NO: 1429210 - RNA, 19 nt, Homo sapiens
uuaaucugccauaaagcca

SEQ ID NO: 1429211 - RNA, 22 nt, Homo sapiens
uuaaugaagacccaguguaaag

SEQ ID NO: 1429212 - RNA, 13 nt, Homo sapiens
uuugaaaugucau

SEQ ID NO: 1429213 - RNA, 13 nt, Homo sapiens
uuugaagcaaagc

SEQ ID NO: 1429214 - RNA, 18 nt, Homo sapiens
uuugaaguggccagauga

SEQ ID NO: 1429215 - RNA, 14 nt, Homo sapiens
uuugaauaucauua

SEQ ID NO: 1429216 - RNA, 17 nt, Homo sapiens
uuugaccaaauaaagua

SEQ ID NO: 1429217 - RNA, 22 nt, Homo sapiens
uuugaccaaauaaaguaccauu

SEQ ID NO: 1429218 - RNA, 13 nt, Homo sapiens
uuugacccacuca

SEQ ID NO: 1429219 - RNA, 23 nt, Homo sapiens
uuugagacggcgcaccuaucacc

SEQ ID NO: 1429220 - RNA, 19 nt, Homo sapiens
uuugagggacgaucuuuga

SEQ ID NO: 1429221 - RNA, 16 nt, Homo sapiens
uuugaggggcugacuu

SEQ ID NO: 1429222 - RNA, 19 nt, Homo sapiens
uuugagugucuuugacuug

SEQ ID NO: 1429223 - RNA, 13 nt, Homo sapiens
uuugauacaaaau

SEQ ID NO: 1429224 - RNA, 18 nt, Homo sapiens
uuugauaugaaguguuag

SEQ ID NO: 1429225 - RNA, 15 nt, Homo sapiens
uuugaugcauuucca

SEQ ID NO: 1429226 - RNA, 22 nt, Homo sapiens
uuugaugccaagaaaguauuug

SEQ ID NO: 1429227 - RNA, 15 nt, Homo sapiens
uuugcauugugugag

SEQ ID NO: 1429228 - RNA, 22 nt, Homo sapiens
uuugcucuuagcugucugcuca

SEQ ID NO: 1429229 - RNA, 14 nt, Homo sapiens
uuugcuguacuuua

SEQ ID NO: 1429230 - RNA, 21 nt, Homo sapiens
uuuggauaauauccacugcaa

SEQ ID NO: 1429231 - RNA, 14 nt, Homo sapiens
uuuggauguuucca

SEQ ID NO: 1429232 - RNA, 20 nt, Homo sapiens
uuuguaaauuaauacuucau

SEQ ID NO: 1429233 - RNA, 14 nt, Homo sapiens
uuuguauucaugaa

SEQ ID NO: 1429234 - RNA, 20 nt, Homo sapiens
uuuguauuuaaaaccuugau

SEQ ID NO: 1429235 - RNA, 13 nt, Homo sapiens
uuuguauuugcca

SEQ ID NO: 1429236 - RNA, 14 nt, Homo sapiens
uuuguauuugccau

SEQ ID NO: 1429237 - RNA, 18 nt, Homo sapiens
uuugucauucaagccugu

SEQ ID NO: 1429238 - RNA, 20 nt, Homo sapiens
uuugugggcccagcuacaag

SEQ ID NO: 1429239 - RNA, 13 nt, Homo sapiens
uuuguucagagag

SEQ ID NO: 1429240 - RNA, 14 nt, Homo sapiens
uuuguuuuaaauac

SEQ ID NO: 1429241 - RNA, 16 nt, Homo sapiens
uuuguuuugcacugac

SEQ ID NO: 1429242 - RNA, 23 nt, Homo sapiens
uuuuaacacuagaaaacauucca

SEQ ID NO: 1429243 - RNA, 18 nt, Homo sapiens
uuuuaagcuauauaggaa

SEQ ID NO: 1429244 - RNA, 14 nt, Homo sapiens
uuuuaagcuguaaa

SEQ ID NO: 1429245 - RNA, 13 nt, Homo sapiens
uuuuaauguacaa

SEQ ID NO: 1429246 - RNA, 17 nt, Homo sapiens
uuuuacgcuuugcagac

SEQ ID NO: 1429247 - RNA, 21 nt, Homo sapiens
uuuuaggaugugggaguaaaa

SEQ ID NO: 1429248 - RNA, 16 nt, Homo sapiens
uuuuagugacuguaau

SEQ ID NO: 1429249 - RNA, 20 nt, Homo sapiens
uuuuauaagacuacuauaca

SEQ ID NO: 1429250 - RNA, 15 nt, Homo sapiens
uuuuauacuaccaag

SEQ ID NO: 1429251 - RNA, 12 nt, Homo sapiens
uuuuauauccac

SEQ ID NO: 1429252 - RNA, 19 nt, Homo sapiens
uuuuauccacuuaccuaga

SEQ ID NO: 1429253 - RNA, 20 nt, Homo sapiens
uuuuauggaggcuuugcaua

SEQ ID NO: 1429254 - RNA, 19 nt, Homo sapiens
uuuuauucaaagacagaga

SEQ ID NO: 1429255 - RNA, 21 nt, Homo sapiens
uuuuauuuuuaugugcucuca

SEQ ID NO: 1429256 - RNA, 17 nt, Homo sapiens
uuuucaaaaaacauuaa

SEQ ID NO: 1429257 - RNA, 21 nt, Homo sapiens
uuuucaaagauguguugcuau

SEQ ID NO: 1429258 - RNA, 17 nt, Homo sapiens
uuuucaacaaguaacuu

SEQ ID NO: 1429259 - RNA, 13 nt, Homo sapiens
uuuucacacugau

SEQ ID NO: 1429260 - RNA, 12 nt, Homo sapiens
uuuucaguauga

SEQ ID NO: 1429261 - RNA, 14 nt, Homo sapiens
uuuucauuaucuca

SEQ ID NO: 1429262 - RNA, 12 nt, Homo sapiens
uuuucauuucac

SEQ ID NO: 1429263 - RNA, 13 nt, Homo sapiens
uuuuccaucaugu

SEQ ID NO: 1429264 - RNA, 13 nt, Homo sapiens
uuuucccaccacc

SEQ ID NO: 1429265 - RNA, 19 nt, Homo sapiens
uuuucccgagcaaagucua

SEQ ID NO: 1429266 - RNA, 21 nt, Homo sapiens
uuuucccgagcaaagucuaaa

SEQ ID NO: 1429267 - RNA, 15 nt, Homo sapiens
uuuucuaacuguaaa

SEQ ID NO: 1429268 - RNA, 21 nt, Homo sapiens
uuuucugagcuuuucauggaa

SEQ ID NO: 1429269 - RNA, 12 nt, Homo sapiens
uuuucugauuug

SEQ ID NO: 1429270 - RNA, 19 nt, Homo sapiens
uuuucuggaauacaugaaa

SEQ ID NO: 1429271 - RNA, 14 nt, Homo sapiens
uuuucugucucucu

SEQ ID NO: 1429272 - RNA, 21 nt, Homo sapiens
uuuucuuaaauauuaugugaa

SEQ ID NO: 1429273 - RNA, 13 nt, Homo sapiens
uuuucuucaucug

SEQ ID NO: 1429274 - RNA, 22 nt, Homo sapiens
uuuugaccaaauaaaguaccau

SEQ ID NO: 1429275 - RNA, 14 nt, Homo sapiens
uuuugaguaucucg

SEQ ID NO: 1429276 - RNA, 18 nt, Homo sapiens
uuuuguucuacaugagga

SEQ ID NO: 1429277 - RNA, 17 nt, Homo sapiens
uuuuuacaguuaugcau

SEQ ID NO: 1429278 - RNA, 12 nt, Homo sapiens
uuuuuacuauua

SEQ ID NO: 1429279 - RNA, 15 nt, Homo sapiens
uuuuuccccaaaguc

SEQ ID NO: 1429280 - RNA, 16 nt, Homo sapiens
uuuuugaaaagcuaau

SEQ ID NO: 1429281 - RNA, 12 nt, Homo sapiens
uuuuugcuauau

SEQ ID NO: 1429282 - RNA, 21 nt, Homo sapiens
uuuuuuguuauguuugcacuu

SEQ ID NO: 1429283 - RNA, 11 nt, Homo sapiens
aaaaaaaagca

SEQ ID NO: 1429284 - RNA, 12 nt, Homo sapiens
aaaaaaauugca

SEQ ID NO: 1429285 - RNA, 14 nt, Homo sapiens
aaaaacaaauggga

SEQ ID NO: 1429286 - RNA, 23 nt, Homo sapiens
aaaaagaaguguuccuucauuaa

SEQ ID NO: 1429287 - RNA, 11 nt, Homo sapiens
aaaaagagcca

SEQ ID NO: 1429288 - RNA, 17 nt, Homo sapiens
aaaaaggaacacuggaa

SEQ ID NO: 1429289 - RNA, 13 nt, Homo sapiens
aaaaagucacaaa

SEQ ID NO: 1429290 - RNA, 17 nt, Homo sapiens
aaaaauaaaccaaagga

SEQ ID NO: 1429291 - RNA, 23 nt, Homo sapiens
aaaaauagaaaauuuucuagucc

SEQ ID NO: 1429292 - RNA, 20 nt, Homo sapiens
aaaaauauauuuaauggcaa

SEQ ID NO: 1429293 - RNA, 21 nt, Homo sapiens
aaaaauauguugaguguucau

SEQ ID NO: 1429294 - RNA, 15 nt, Homo sapiens
aaaaaugggaacaag

SEQ ID NO: 1429295 - RNA, 16 nt, Homo sapiens
aaaaaugugucuguaa

SEQ ID NO: 1429296 - RNA, 14 nt, Homo sapiens
aaaacaaacccagg

SEQ ID NO: 1429297 - RNA, 15 nt, Homo sapiens
aaaacacaucuuucc

SEQ ID NO: 1429298 - RNA, 15 nt, Homo sapiens
aaaacagucgaucaa

SEQ ID NO: 1429299 - RNA, 11 nt, Homo sapiens
aaaacauaugc

SEQ ID NO: 1429300 - RNA, 13 nt, Homo sapiens
aaaacaucacuga

SEQ ID NO: 1429301 - RNA, 10 nt, Homo sapiens
aaaacaugca

SEQ ID NO: 1429302 - RNA, 10 nt, Homo sapiens
aaaaccaaug

SEQ ID NO: 1429303 - RNA, 14 nt, Homo sapiens
aaaaccauguugau

SEQ ID NO: 1429304 - RNA, 19 nt, Homo sapiens
aaaaccuuuccccagacac

SEQ ID NO: 1429305 - RNA, 11 nt, Homo sapiens
aaaacucuccu

SEQ ID NO: 1429306 - RNA, 22 nt, Homo sapiens
aaaacucugggaaauaagagag

SEQ ID NO: 1429307 - RNA, 18 nt, Homo sapiens
aaaacugcugaacuugac

SEQ ID NO: 1429308 - RNA, 16 nt, Homo sapiens
aaaagauaacaagauc

SEQ ID NO: 1429309 - RNA, 11 nt, Homo sapiens
aaaagcacuug

SEQ ID NO: 1429310 - RNA, 14 nt, Homo sapiens
aaaaggaacacugg

SEQ ID NO: 1429311 - RNA, 18 nt, Homo sapiens
aaaagucuacgcucuccu

SEQ ID NO: 1429312 - RNA, 18 nt, Homo sapiens
aaaaguggauggaagugu

SEQ ID NO: 1429313 - RNA, 21 nt, Homo sapiens
aaaaguggcuaauucaauuua

SEQ ID NO: 1429314 - RNA, 16 nt, Homo sapiens
aaaagugugagcagug

SEQ ID NO: 1429315 - RNA, 18 nt, Homo sapiens
aaaauaaacuaguuucca

SEQ ID NO: 1429316 - RNA, 12 nt, Homo sapiens
aaaauaacuuau

SEQ ID NO: 1429317 - RNA, 11 nt, Homo sapiens
aagccacugcc

SEQ ID NO: 1429318 - RNA, 13 nt, Homo sapiens
aagccacugccuu

SEQ ID NO: 1429319 - RNA, 20 nt, Homo sapiens
aagccagaaacguaacugug

SEQ ID NO: 1429320 - RNA, 17 nt, Homo sapiens
aagccagaguuccaugu

SEQ ID NO: 1429321 - RNA, 13 nt, Homo sapiens
aagccaguggcag

SEQ ID NO: 1429322 - RNA, 14 nt, Homo sapiens
aagccccaagccau

SEQ ID NO: 1429323 - RNA, 21 nt, Homo sapiens
aagccccuggaaaugugcuaa

SEQ ID NO: 1429324 - RNA, 15 nt, Homo sapiens
aagcccuuuacuuga

SEQ ID NO: 1429325 - RNA, 15 nt, Homo sapiens
aagccggcucuucaa

SEQ ID NO: 1429326 - RNA, 19 nt, Homo sapiens
aagccggcucuucaaagac

SEQ ID NO: 1429327 - RNA, 20 nt, Homo sapiens
aagcgaaauauuacaguagu

SEQ ID NO: 1429328 - RNA, 16 nt, Homo sapiens
aagcuaacagggaagg

SEQ ID NO: 1429329 - RNA, 15 nt, Homo sapiens
aagcuagaaccugga

SEQ ID NO: 1429330 - RNA, 17 nt, Homo sapiens
aagcuagaaggccacau

SEQ ID NO: 1429331 - RNA, 16 nt, Homo sapiens
aagcuaucaggccaag

SEQ ID NO: 1429332 - RNA, 22 nt, Homo sapiens
aagcuccuguccucccaucccc

SEQ ID NO: 1429333 - RNA, 17 nt, Homo sapiens
aagcucuauuaagauuu

SEQ ID NO: 1429334 - RNA, 20 nt, Homo sapiens
aagcugaagaaaaugaagcc

SEQ ID NO: 1429335 - RNA, 21 nt, Homo sapiens
aagcugcugagaaucuagccu

SEQ ID NO: 1429336 - RNA, 14 nt, Homo sapiens
aagcuggaagcaca

SEQ ID NO: 1429337 - RNA, 21 nt, Homo sapiens
aagcuggauuauuuagaucua

SEQ ID NO: 1429338 - RNA, 21 nt, Homo sapiens
aagcuguacucagagcagagc

SEQ ID NO: 1429339 - RNA, 14 nt, Homo sapiens
aaggaaaccaaagg

SEQ ID NO: 1429340 - RNA, 22 nt, Homo sapiens
aaggaaacuugaaucaaagcag

SEQ ID NO: 1429341 - RNA, 23 nt, Homo sapiens
aaggaaacuuuuuuuguuugcuc

SEQ ID NO: 1429342 - RNA, 21 nt, Homo sapiens
aaggaacugaggcccagaaag

SEQ ID NO: 1429343 - RNA, 15 nt, Homo sapiens
aaggaagaagccaga

SEQ ID NO: 1429344 - RNA, 22 nt, Homo sapiens
aaggaaggcuccaucuccagug

SEQ ID NO: 1429345 - RNA, 16 nt, Homo sapiens
aaggaagucaccaaaa

SEQ ID NO: 1429346 - RNA, 22 nt, Homo sapiens
aaggaccugcauuuuccuacau

SEQ ID NO: 1429347 - RNA, 21 nt, Homo sapiens
aaggacggccuucaacugaaa

SEQ ID NO: 1429348 - RNA, 16 nt, Homo sapiens
aaggacuagagcucag

SEQ ID NO: 1429349 - RNA, 22 nt, Homo sapiens
aaggagauauggcuaguggcaa

SEQ ID NO: 1429350 - RNA, 21 nt, Homo sapiens
aaggaggacgguuaacuugua

SEQ ID NO: 1429351 - RNA, 18 nt, Homo sapiens
aaggauauuuacuacuuu

SEQ ID NO: 1429352 - RNA, 20 nt, Homo sapiens
aaggauauuuacuacuuuug

SEQ ID NO: 1429353 - RNA, 18 nt, Homo sapiens
aaggauggagccagcucu

SEQ ID NO: 1429354 - RNA, 23 nt, Homo sapiens
aaggauggagccagcucugcauu

SEQ ID NO: 1429355 - RNA, 20 nt, Homo sapiens
aaggauuaagauacacuccu

SEQ ID NO: 1429356 - RNA, 14 nt, Homo sapiens
aaggauugugauau

SEQ ID NO: 1429357 - RNA, 21 nt, Homo sapiens
aaggcaaagccccuggaaaug

SEQ ID NO: 1429358 - RNA, 20 nt, Homo sapiens
aaggcacuugucacuaugcu

SEQ ID NO: 1429359 - RNA, 16 nt, Homo sapiens
aaggcaggcagggcuc

SEQ ID NO: 1429360 - RNA, 17 nt, Homo sapiens
aaggcugaccaagagag

SEQ ID NO: 1429361 - RNA, 18 nt, Homo sapiens
aaggcuuugccaugggcc

SEQ ID NO: 1429362 - RNA, 13 nt, Homo sapiens
aagggaacuucca

SEQ ID NO: 1429363 - RNA, 17 nt, Homo sapiens
aagggagggcucugagg

SEQ ID NO: 1429364 - RNA, 18 nt, Homo sapiens
aagggaguugcucacuca

SEQ ID NO: 1429365 - RNA, 14 nt, Homo sapiens
aagggauggcaaga

SEQ ID NO: 1429366 - RNA, 14 nt, Homo sapiens
aagggcagugagaa

SEQ ID NO: 1429367 - RNA, 21 nt, Homo sapiens
aaggggcaaagaaaagccaga

SEQ ID NO: 1429368 - RNA, 19 nt, Homo sapiens
aaggggcuguuacauaaca

SEQ ID NO: 1429369 - RNA, 13 nt, Homo sapiens
aagguagagaugu

SEQ ID NO: 1429370 - RNA, 15 nt, Homo sapiens
aaggucagagucaaa

SEQ ID NO: 1429371 - RNA, 21 nt, Homo sapiens
aagguguugguguauuugcca

SEQ ID NO: 1429372 - RNA, 15 nt, Homo sapiens
aagguucacucucaa

SEQ ID NO: 1429373 - RNA, 17 nt, Homo sapiens
aagguugugcccuccac

SEQ ID NO: 1429374 - RNA, 15 nt, Homo sapiens
aaguaaaagaaccac

SEQ ID NO: 1429375 - RNA, 19 nt, Homo sapiens
aaguaacugugguuuacua

SEQ ID NO: 1429376 - RNA, 14 nt, Homo sapiens
aaguaaugcuucaa

SEQ ID NO: 1429377 - RNA, 22 nt, Homo sapiens
aaguaauuccucucacuaaacu

SEQ ID NO: 1429378 - RNA, 18 nt, Homo sapiens
aaguacauaaaguacaua

SEQ ID NO: 1429379 - RNA, 15 nt, Homo sapiens
aaguaccuguaguga

SEQ ID NO: 1429380 - RNA, 14 nt, Homo sapiens
aaguagggacuucu

SEQ ID NO: 1429381 - RNA, 21 nt, Homo sapiens
aaguauacauuuuugcauugc

SEQ ID NO: 1429382 - RNA, 18 nt, Homo sapiens
aaguauguaaacaggaga

SEQ ID NO: 1429383 - RNA, 19 nt, Homo sapiens
aaguauugcgaaugugcag

SEQ ID NO: 1429384 - RNA, 18 nt, Homo sapiens
aaguauugcugaguccaa

SEQ ID NO: 1429385 - RNA, 13 nt, Homo sapiens
aagucacuuuuau

SEQ ID NO: 1429386 - RNA, 13 nt, Homo sapiens
aagucagcuuuca

SEQ ID NO: 1429387 - RNA, 18 nt, Homo sapiens
aagucguuucaggacaug

SEQ ID NO: 1429388 - RNA, 23 nt, Homo sapiens
aagucuaaaguuuacaguaaaua

SEQ ID NO: 1429389 - RNA, 13 nt, Homo sapiens
aagucuacuucac

SEQ ID NO: 1429390 - RNA, 19 nt, Homo sapiens
aagucuguuuuaaugacaa

SEQ ID NO: 1429391 - RNA, 23 nt, Homo sapiens
aagucuuuccgucucccuaaaau

SEQ ID NO: 1429392 - RNA, 18 nt, Homo sapiens
aagugaagccccuugucc

SEQ ID NO: 1429393 - RNA, 16 nt, Homo sapiens
aagugcaaauuugaua

SEQ ID NO: 1429394 - RNA, 17 nt, Homo sapiens
aagugccacucauuccu

SEQ ID NO: 1429395 - RNA, 14 nt, Homo sapiens
aagugccaucccac

SEQ ID NO: 1429396 - RNA, 18 nt, Homo sapiens
aagugcuauuucuugcau

SEQ ID NO: 1429397 - RNA, 16 nt, Homo sapiens
aagugguuuuuauuuc

SEQ ID NO: 1429398 - RNA, 15 nt, Homo sapiens
aaguguaaauccuuu

SEQ ID NO: 1429399 - RNA, 18 nt, Homo sapiens
aaguguguaugauaauga

SEQ ID NO: 1429400 - RNA, 19 nt, Homo sapiens
aaguuacaaauucaaggag

SEQ ID NO: 1429401 - RNA, 19 nt, Homo sapiens
aaguuagggaugacuguga

SEQ ID NO: 1429402 - RNA, 14 nt, Homo sapiens
aaguuaugaggguc

SEQ ID NO: 1429403 - RNA, 20 nt, Homo sapiens
accccuuuccacgagcuaua

SEQ ID NO: 1429404 - RNA, 21 nt, Homo sapiens
acccgagaaaacaaacccagg

SEQ ID NO: 1429405 - RNA, 20 nt, Homo sapiens
acccgagcuagagugcagug

SEQ ID NO: 1429406 - RNA, 13 nt, Homo sapiens
acccgcucucuca

SEQ ID NO: 1429407 - RNA, 18 nt, Homo sapiens
acccguacaggcaauucc

SEQ ID NO: 1429408 - RNA, 19 nt, Homo sapiens
acccguuuuauucuauucc

SEQ ID NO: 1429409 - RNA, 20 nt, Homo sapiens
acccuaauaaguccacaucu

SEQ ID NO: 1429410 - RNA, 15 nt, Homo sapiens
acccucaaaugucag

SEQ ID NO: 1429411 - RNA, 15 nt, Homo sapiens
acccucacaucagag

SEQ ID NO: 1429412 - RNA, 22 nt, Homo sapiens
acccucccuaccugaggccuau

SEQ ID NO: 1429413 - RNA, 15 nt, Homo sapiens
acccugcgauuuugc

SEQ ID NO: 1429414 - RNA, 19 nt, Homo sapiens
acccuguggggccugaugg

SEQ ID NO: 1429415 - RNA, 18 nt, Homo sapiens
acccuguuuucagcuaaa

SEQ ID NO: 1429416 - RNA, 21 nt, Homo sapiens
acccuucugcuguauacugua

SEQ ID NO: 1429417 - RNA, 22 nt, Homo sapiens
acccuucugcuguauacuguac

SEQ ID NO: 1429418 - RNA, 22 nt, Homo sapiens
acaacauaaggagaauguaucu

SEQ ID NO: 1429419 - RNA, 19 nt, Homo sapiens
acaacaugcgaccgugacc

SEQ ID NO: 1429420 - RNA, 20 nt, Homo sapiens
acaacuuguguucuauuaau

SEQ ID NO: 1429421 - RNA, 18 nt, Homo sapiens
acaagaaggccacuggua

SEQ ID NO: 1429422 - RNA, 16 nt, Homo sapiens
acaagaaucaccucaa

SEQ ID NO: 1429423 - RNA, 15 nt, Homo sapiens
acaagacacccaagu

SEQ ID NO: 1429424 - RNA, 12 nt, Homo sapiens
acaagagcugcu

SEQ ID NO: 1429425 - RNA, 17 nt, Homo sapiens
acaagcuggaagcacau

SEQ ID NO: 1429426 - RNA, 23 nt, Homo sapiens
acauucccuaucaaaacauauca

SEQ ID NO: 1429427 - RNA, 23 nt, Homo sapiens
acauucccuuggauguagucuga

SEQ ID NO: 1429428 - RNA, 12 nt, Homo sapiens
acauuccuggcc

SEQ ID NO: 1429429 - RNA, 19 nt, Homo sapiens
acauuggaaggcucccuaa

SEQ ID NO: 1429430 - RNA, 14 nt, Homo sapiens
acauuucucugagc

SEQ ID NO: 1429431 - RNA, 15 nt, Homo sapiens
acauuuggagugugu

SEQ ID NO: 1429432 - RNA, 14 nt, Homo sapiens
acauuuggcauuug

SEQ ID NO: 1429433 - RNA, 20 nt, Homo sapiens
acauuuuuauuuaguugaaa

SEQ ID NO: 1429434 - RNA, 21 nt, Homo sapiens
accaaaauguauaaauguuau

SEQ ID NO: 1429435 - RNA, 15 nt, Homo sapiens
accaaagagacugga

SEQ ID NO: 1429436 - RNA, 21 nt, Homo sapiens
accaaagagacuggagcaucu

SEQ ID NO: 1429437 - RNA, 23 nt, Homo sapiens
accaaagagacuggagcaucuga

SEQ ID NO: 1429438 - RNA, 16 nt, Homo sapiens
accaaauaaaguacca

SEQ ID NO: 1429439 - RNA, 17 nt, Homo sapiens
accaaauaaaguaccau

SEQ ID NO: 1429440 - RNA, 13 nt, Homo sapiens
accaaaugcuguc

SEQ ID NO: 1429441 - RNA, 16 nt, Homo sapiens
accaacaaacaaugcc

SEQ ID NO: 1429442 - RNA, 18 nt, Homo sapiens
accaacaaacaaugccau

SEQ ID NO: 1429443 - RNA, 19 nt, Homo sapiens
accaacaguuccuucagcu

SEQ ID NO: 1429444 - RNA, 18 nt, Homo sapiens
accaacccuguuuccuga

SEQ ID NO: 1429445 - RNA, 23 nt, Homo sapiens
accaacuuauaaagcauugcaac

SEQ ID NO: 1429446 - RNA, 15 nt, Homo sapiens
accaagacucugaaa

SEQ ID NO: 1429447 - RNA, 23 nt, Homo sapiens
accaagauagauccauuuggaca

SEQ ID NO: 1429448 - RNA, 16 nt, Homo sapiens
accaagauuggccuga

SEQ ID NO: 1429449 - RNA, 13 nt, Homo sapiens
accaaggucuuca

SEQ ID NO: 1429450 - RNA, 14 nt, Homo sapiens
accaaguccuggga

SEQ ID NO: 1429451 - RNA, 22 nt, Homo sapiens
accaagucuacuucacuaauga

SEQ ID NO: 1429452 - RNA, 13 nt, Homo sapiens
accaauauucaaa

SEQ ID NO: 1429453 - RNA, 12 nt, Homo sapiens
accaauguagaa

SEQ ID NO: 1429454 - RNA, 22 nt, Homo sapiens
accaauguugugauuaacauca

SEQ ID NO: 1429455 - RNA, 19 nt, Homo sapiens
accaauuguacauucccug

SEQ ID NO: 1429456 - RNA, 20 nt, Homo sapiens
accacaaaaauugacucaaa

SEQ ID NO: 1429457 - RNA, 13 nt, Homo sapiens
accacaacugaca

SEQ ID NO: 1429458 - RNA, 16 nt, Homo sapiens
accacaccucccugaa

SEQ ID NO: 1429459 - RNA, 14 nt, Homo sapiens
accacacuucuuga

SEQ ID NO: 1429460 - RNA, 16 nt, Homo sapiens
accaccccuuccuguc

SEQ ID NO: 1429461 - RNA, 20 nt, Homo sapiens
accaccgaagaggaagcaag

SEQ ID NO: 1429462 - RNA, 20 nt, Homo sapiens
accaccuucccagcucuccc

SEQ ID NO: 1429463 - RNA, 23 nt, Homo sapiens
accacugguuaaaauaaagccua

SEQ ID NO: 1429464 - RNA, 21 nt, Homo sapiens
accagaaaaaugggaacaagg

SEQ ID NO: 1429465 - RNA, 16 nt, Homo sapiens
accagaauugugcaaa

SEQ ID NO: 1429466 - RNA, 23 nt, Homo sapiens
accagacucguucuucugggaac

SEQ ID NO: 1429467 - RNA, 17 nt, Homo sapiens
accagaggcugcagaag

SEQ ID NO: 1429468 - RNA, 22 nt, Homo sapiens
accagaggcugcagaaggccaa

SEQ ID NO: 1429469 - RNA, 18 nt, Homo sapiens
accagauauuugaaucuu

SEQ ID NO: 1429470 - RNA, 15 nt, Homo sapiens
accagcauauugugu

SEQ ID NO: 1429471 - RNA, 16 nt, Homo sapiens
accagcauucaugccg

SEQ ID NO: 1429472 - RNA, 21 nt, Homo sapiens
accaggacucugccccuucug

SEQ ID NO: 1429473 - RNA, 14 nt, Homo sapiens
accaggucauucuu

SEQ ID NO: 1429474 - RNA, 14 nt, Homo sapiens
accagucacugucc

SEQ ID NO: 1429475 - RNA, 17 nt, Homo sapiens
accagugaaccaaagag

SEQ ID NO: 1429476 - RNA, 23 nt, Homo sapiens
accagugaaccaaagagacugga

SEQ ID NO: 1429477 - RNA, 20 nt, Homo sapiens
accaguguccccuccacugu

SEQ ID NO: 1429478 - RNA, 20 nt, Homo sapiens
accauaaaaauccuucucac

SEQ ID NO: 1429479 - RNA, 16 nt, Homo sapiens
accauaacaacuucau

SEQ ID NO: 1429480 - RNA, 19 nt, Homo sapiens
accauaagggacugugcca

SEQ ID NO: 1429481 - RNA, 21 nt, Homo sapiens
accauaagggacugugccaga

SEQ ID NO: 1429482 - RNA, 11 nt, Homo sapiens
accauccacag

SEQ ID NO: 1429483 - RNA, 16 nt, Homo sapiens
accauccaccaggccu

SEQ ID NO: 1429484 - RNA, 21 nt, Homo sapiens
accauccuggcuaacacguga

SEQ ID NO: 1429485 - RNA, 22 nt, Homo sapiens
accaucuaaucuaugcauguau

SEQ ID NO: 1429486 - RNA, 23 nt, Homo sapiens
accaucuaaucuaugcauguaug

SEQ ID NO: 1429487 - RNA, 12 nt, Homo sapiens
accaugcauggu

SEQ ID NO: 1429488 - RNA, 18 nt, Homo sapiens
accaugcauggugcauca

SEQ ID NO: 1429489 - RNA, 13 nt, Homo sapiens
accaugccaggcu

SEQ ID NO: 1429490 - RNA, 15 nt, Homo sapiens
accaugccagggauu

SEQ ID NO: 1429491 - RNA, 14 nt, Homo sapiens
accaugccauuuaa

SEQ ID NO: 1429492 - RNA, 12 nt, Homo sapiens
accauuacugua

SEQ ID NO: 1429493 - RNA, 15 nt, Homo sapiens
accauuacuguaauu

SEQ ID NO: 1429494 - RNA, 14 nt, Homo sapiens
accauuucagagag

SEQ ID NO: 1429495 - RNA, 12 nt, Homo sapiens
acccaaagacca

SEQ ID NO: 1429496 - RNA, 11 nt, Homo sapiens
acccaccaucu

SEQ ID NO: 1429497 - RNA, 14 nt, Homo sapiens
acccaccucagccu

SEQ ID NO: 1429498 - RNA, 13 nt, Homo sapiens
acccagcaaagag

SEQ ID NO: 1429499 - RNA, 12 nt, Homo sapiens
acccaggaugau

SEQ ID NO: 1429500 - RNA, 22 nt, Homo sapiens
acccaguccgccaaacacucca

SEQ ID NO: 1429501 - RNA, 17 nt, Homo sapiens
acccaucagacagguaa

SEQ ID NO: 1429502 - RNA, 20 nt, Homo sapiens
accccaacacccccaagaca

SEQ ID NO: 1429503 - RNA, 20 nt, Homo sapiens
accccagcuagggcuggacu

SEQ ID NO: 1429504 - RNA, 21 nt, Homo sapiens
accccaggcaucccaucccuu

SEQ ID NO: 1429505 - RNA, 19 nt, Homo sapiens
accccagggccuacugcca

SEQ ID NO: 1429506 - RNA, 12 nt, Homo sapiens
accccaucccuu

SEQ ID NO: 1429507 - RNA, 12 nt, Homo sapiens
acccccagugug

SEQ ID NO: 1429508 - RNA, 17 nt, Homo sapiens
acccccgccacggccac

SEQ ID NO: 1429509 - RNA, 23 nt, Homo sapiens
acccccuccagcuccaguuucca

SEQ ID NO: 1429510 - RNA, 20 nt, Homo sapiens
accccuggccucaagcaauc

SEQ ID NO: 1429511 - RNA, 22 nt, Homo sapiens
ggcagucugaacccuugugcuu

SEQ ID NO: 1429512 - RNA, 20 nt, Homo sapiens
ggcagugccuccugggacca

SEQ ID NO: 1429513 - RNA, 14 nt, Homo sapiens
ggcaguuacagggc

SEQ ID NO: 1429514 - RNA, 23 nt, Homo sapiens
ggcauagaacuccggaaugacca

SEQ ID NO: 1429515 - RNA, 23 nt, Homo sapiens
ggcauagcauuagcugcuuccuc

SEQ ID NO: 1429516 - RNA, 17 nt, Homo sapiens
ggcauagggaauaugua

SEQ ID NO: 1429517 - RNA, 16 nt, Homo sapiens
ggcauccacccagugc

SEQ ID NO: 1429518 - RNA, 22 nt, Homo sapiens
ggcauccacccagugcugccau

SEQ ID NO: 1429519 - RNA, 18 nt, Homo sapiens
ggcauggccagguggcca

SEQ ID NO: 1429520 - RNA, 20 nt, Homo sapiens
ggcauggcccugggguccca

SEQ ID NO: 1429521 - RNA, 11 nt, Homo sapiens
ggcauuugccu

SEQ ID NO: 1429522 - RNA, 17 nt, Homo sapiens
ggccaagacuuggcaac

SEQ ID NO: 1429523 - RNA, 19 nt, Homo sapiens
ggccaagagcaucgugacc

SEQ ID NO: 1429524 - RNA, 22 nt, Homo sapiens
ggccacugggucucacuccuga

SEQ ID NO: 1429525 - RNA, 16 nt, Homo sapiens
ggccagcagcagauaa

SEQ ID NO: 1429526 - RNA, 17 nt, Homo sapiens
ggccagcugcaucuacu

SEQ ID NO: 1429527 - RNA, 21 nt, Homo sapiens
ggccagggaaagcccguguca

SEQ ID NO: 1429528 - RNA, 24 nt, Homo sapiens
ggccagggaaagcccgugucaaug

SEQ ID NO: 1429529 - RNA, 20 nt, Homo sapiens
ggccauccauucacagccag

SEQ ID NO: 1429530 - RNA, 21 nt, Homo sapiens
ggccauggaauaaaccauuuu

SEQ ID NO: 1429531 - RNA, 23 nt, Homo sapiens
ggccauuccaacagcucaagucu

SEQ ID NO: 1429532 - RNA, 20 nt, Homo sapiens
ggcccagcuguagccauggc

SEQ ID NO: 1429533 - RNA, 23 nt, Homo sapiens
ggcccuuccucuccacugccuuc

SEQ ID NO: 1429534 - RNA, 22 nt, Homo sapiens
ggccggggcccugcaccugugc

SEQ ID NO: 1429535 - RNA, 17 nt, Homo sapiens
ggccucaucuccuuuau

SEQ ID NO: 1429536 - RNA, 19 nt, Homo sapiens
ggccuccacucagcaguaa

SEQ ID NO: 1429537 - RNA, 22 nt, Homo sapiens
ggccuccugccucuacugggaa

SEQ ID NO: 1429538 - RNA, 17 nt, Homo sapiens
ggccugcugcugagaac

SEQ ID NO: 1429539 - RNA, 14 nt, Homo sapiens
ggccugugugugaa

SEQ ID NO: 1429540 - RNA, 14 nt, Homo sapiens
ggccuugucaggac

SEQ ID NO: 1429541 - RNA, 20 nt, Homo sapiens
ggcgacagagcgagacuccg

SEQ ID NO: 1429542 - RNA, 18 nt, Homo sapiens
ggacaugcuuuggcaauu

SEQ ID NO: 1429543 - RNA, 21 nt, Homo sapiens
ggaccaacccuguuuccugag

SEQ ID NO: 1429544 - RNA, 17 nt, Homo sapiens
ggaccaagaugggcaca

SEQ ID NO: 1429545 - RNA, 13 nt, Homo sapiens
ggaccacaccucc

SEQ ID NO: 1429546 - RNA, 14 nt, Homo sapiens
ggaccagaggugac

SEQ ID NO: 1429547 - RNA, 19 nt, Homo sapiens
ggaccauugaccucagcug

SEQ ID NO: 1429548 - RNA, 15 nt, Homo sapiens
ggaccgcuacaccac

SEQ ID NO: 1429549 - RNA, 19 nt, Homo sapiens
ggacgagacccuacaggag

SEQ ID NO: 1429550 - RNA, 15 nt, Homo sapiens
ggacgcuuccagacc

SEQ ID NO: 1429551 - RNA, 23 nt, Homo sapiens
ggacuaaccccaacgcacaggaa

SEQ ID NO: 1429552 - RNA, 20 nt, Homo sapiens
ggacuacuauuugaagcaau

SEQ ID NO: 1429553 - RNA, 18 nt, Homo sapiens
ggacuagaaaaacuuggg

SEQ ID NO: 1429554 - RNA, 20 nt, Homo sapiens
ggacuauggguacauuccac

SEQ ID NO: 1429555 - RNA, 15 nt, Homo sapiens
ggacucaagggucca

SEQ ID NO: 1429556 - RNA, 16 nt, Homo sapiens
ggacuucugcagcuau

SEQ ID NO: 1429557 - RNA, 14 nt, Homo sapiens
ggagaacuagagaa

SEQ ID NO: 1429558 - RNA, 17 nt, Homo sapiens
ggagaaugaagacuguu

SEQ ID NO: 1429559 - RNA, 14 nt, Homo sapiens
ggagaaugaugucc

SEQ ID NO: 1429560 - RNA, 24 nt, Homo sapiens
ggagaauuauauagguugugcaaa

SEQ ID NO: 1429561 - RNA, 22 nt, Homo sapiens
ggagacaauaacuccagugaug

SEQ ID NO: 1429562 - RNA, 23 nt, Homo sapiens
ggagacacuauuuaucugugcaa

SEQ ID NO: 1429563 - RNA, 22 nt, Homo sapiens
ggagagacacucccagggacaa

SEQ ID NO: 1429564 - RNA, 18 nt, Homo sapiens
ggagaggggaagggccag

SEQ ID NO: 1429565 - RNA, 21 nt, Homo sapiens
ggagaguacagugagccaaga

SEQ ID NO: 1429566 - RNA, 21 nt, Homo sapiens
ggagauggguuuggaggccaa

SEQ ID NO: 1429567 - RNA, 15 nt, Homo sapiens
ggagauuucaguuac

SEQ ID NO: 1429568 - RNA, 15 nt, Homo sapiens
ggagcaaauguuucu

SEQ ID NO: 1429569 - RNA, 12 nt, Homo sapiens
ggagcacugggu

SEQ ID NO: 1429570 - RNA, 13 nt, Homo sapiens
ggagcacuggguu

SEQ ID NO: 1429571 - RNA, 16 nt, Homo sapiens
ggagcaggaacagaga

SEQ ID NO: 1429572 - RNA, 19 nt, Homo sapiens
ggagcccccucuuccacuc

SEQ ID NO: 1429573 - RNA, 15 nt, Homo sapiens
ggagccgcugcugag

SEQ ID NO: 1429574 - RNA, 12 nt, Homo sapiens
gccucccaaagu

SEQ ID NO: 1429575 - RNA, 17 nt, Homo sapiens
gccucccuuucugggag

SEQ ID NO: 1429576 - RNA, 21 nt, Homo sapiens
gccuccucaguagcuaggacu

SEQ ID NO: 1429577 - RNA, 21 nt, Homo sapiens
gccuccucucucaaacugggg

SEQ ID NO: 1429578 - RNA, 14 nt, Homo sapiens
gccuccugaccuga

SEQ ID NO: 1429579 - RNA, 15 nt, Homo sapiens
gccuccugcaccgag

SEQ ID NO: 1429580 - RNA, 18 nt, Homo sapiens
gccuccuuuugcuugaaa

SEQ ID NO: 1429581 - RNA, 14 nt, Homo sapiens
gccucuacugggaa

SEQ ID NO: 1429582 - RNA, 23 nt, Homo sapiens
gccucuagaacacccacuggcca

SEQ ID NO: 1429583 - RNA, 17 nt, Homo sapiens
gccucuccagcacuucu

SEQ ID NO: 1429584 - RNA, 12 nt, Homo sapiens
gccucuccccaa

SEQ ID NO: 1429585 - RNA, 22 nt, Homo sapiens
gccucuccugcugcugaccuga

SEQ ID NO: 1429586 - RNA, 16 nt, Homo sapiens
gccucucgaguucucc

SEQ ID NO: 1429587 - RNA, 22 nt, Homo sapiens
gccucugccccuggccuuugag

SEQ ID NO: 1429588 - RNA, 21 nt, Homo sapiens
gccucuggaaaacucaggauu

SEQ ID NO: 1429589 - RNA, 14 nt, Homo sapiens
gccugaaccacagc

SEQ ID NO: 1429590 - RNA, 17 nt, Homo sapiens
gccugaagaacaguaac

SEQ ID NO: 1429591 - RNA, 21 nt, Homo sapiens
gccugaagucccagcauugau

SEQ ID NO: 1429592 - RNA, 11 nt, Homo sapiens
gccugagcaac

SEQ ID NO: 1429593 - RNA, 16 nt, Homo sapiens
gccugagcccagggag

SEQ ID NO: 1429594 - RNA, 22 nt, Homo sapiens
gccugagugcuuuaccuuuaaa

SEQ ID NO: 1429595 - RNA, 13 nt, Homo sapiens
gccugcugcugag

SEQ ID NO: 1429596 - RNA, 13 nt, Homo sapiens
gccugcuggagag

SEQ ID NO: 1429597 - RNA, 22 nt, Homo sapiens
gccugcuuggggggugaugagg

SEQ ID NO: 1429598 - RNA, 17 nt, Homo sapiens
gccugguagaauuggga

SEQ ID NO: 1429599 - RNA, 14 nt, Homo sapiens
gccuguaaucccag

SEQ ID NO: 1429600 - RNA, 19 nt, Homo sapiens
gccuguaaucccagcacuu

SEQ ID NO: 1429601 - RNA, 22 nt, Homo sapiens
gccuguaaucccagcacuuugg

SEQ ID NO: 1429602 - RNA, 20 nt, Homo sapiens
gccugugagguaacugggau

SEQ ID NO: 1429603 - RNA, 19 nt, Homo sapiens
gccugugaucccagcuacu

SEQ ID NO: 1429604 - RNA, 18 nt, Homo sapiens
gccuguuuuucaaucuca

SEQ ID NO: 1429605 - RNA, 19 nt, Homo sapiens
gccuuaaguaauguuaauu

SEQ ID NO: 1429606 - RNA, 22 nt, Homo sapiens
gccuuaccuccugcccaggaga

SEQ ID NO: 1429607 - RNA, 18 nt, Homo sapiens
gccuuuagaugugagcuu

SEQ ID NO: 1429608 - RNA, 18 nt, Homo sapiens
gacgcuuccagaccaccu

SEQ ID NO: 1429609 - RNA, 15 nt, Homo sapiens
gacggaugauuggau

SEQ ID NO: 1429610 - RNA, 15 nt, Homo sapiens
gacggcggcggcccu

SEQ ID NO: 1429611 - RNA, 16 nt, Homo sapiens
gacgggaggcuggaag

SEQ ID NO: 1429612 - RNA, 21 nt, Homo sapiens
gacgguuaacuuguauauucc

SEQ ID NO: 1429613 - RNA, 20 nt, Homo sapiens
gacgugaccaugguguuguu

SEQ ID NO: 1429614 - RNA, 19 nt, Homo sapiens
gacuaaaugaaaucuugca

SEQ ID NO: 1429615 - RNA, 21 nt, Homo sapiens
gacuaacauaaaaucugugaa

SEQ ID NO: 1429616 - RNA, 13 nt, Homo sapiens
gacuaacuaucaa

SEQ ID NO: 1429617 - RNA, 22 nt, Homo sapiens
gacuauguuccaauaaaacuuu

SEQ ID NO: 1429618 - RNA, 15 nt, Homo sapiens
gacuauuuagacaaa

SEQ ID NO: 1429619 - RNA, 17 nt, Homo sapiens
gacucacaagaagacca

SEQ ID NO: 1429620 - RNA, 15 nt, Homo sapiens
gacucaguccagcca

SEQ ID NO: 1429621 - RNA, 23 nt, Homo sapiens
gacuccaaagaaauguaagggaa

SEQ ID NO: 1429622 - RNA, 21 nt, Homo sapiens
gacuccacaguuuugccuuaa

SEQ ID NO: 1429623 - RNA, 20 nt, Homo sapiens
gacuccugucuguccuggag

SEQ ID NO: 1429624 - RNA, 13 nt, Homo sapiens
gacuccugugcaa

SEQ ID NO: 1429625 - RNA, 18 nt, Homo sapiens
gacucguucuucugggaa

SEQ ID NO: 1429626 - RNA, 17 nt, Homo sapiens
gacucuuccugcaaagg

SEQ ID NO: 1429627 - RNA, 20 nt, Homo sapiens
gacucuuguuuucaguuuca

SEQ ID NO: 1429628 - RNA, 23 nt, Homo sapiens
gacugaauauggacccugcugaa

SEQ ID NO: 1429629 - RNA, 22 nt, Homo sapiens
gacugaaugugccuaauggaga

SEQ ID NO: 1429630 - RNA, 17 nt, Homo sapiens
gacugauguuacaucac

SEQ ID NO: 1429631 - RNA, 14 nt, Homo sapiens
gacuguacuccucc

SEQ ID NO: 1429632 - RNA, 11 nt, Homo sapiens
gacuucauccc

SEQ ID NO: 1429633 - RNA, 14 nt, Homo sapiens
gacuuccuggugag

SEQ ID NO: 1429634 - RNA, 17 nt, Homo sapiens
gacuucugucuucacaa

SEQ ID NO: 1429635 - RNA, 16 nt, Homo sapiens
gacuugaagcacagag

SEQ ID NO: 1429636 - RNA, 16 nt, Homo sapiens
gacuugaggauuuuga

SEQ ID NO: 1429637 - RNA, 16 nt, Homo sapiens
gacuuugaugcauuuc

SEQ ID NO: 1429638 - RNA, 17 nt, Homo sapiens
gacuuugaugcauuucc

SEQ ID NO: 1429639 - RNA, 22 nt, Homo sapiens
gacuuuguucacuagacugugc

SEQ ID NO: 1429640 - RNA, 18 nt, Homo sapiens
gacuuuuccaagcccuuu

SEQ ID NO: 1429641 - RNA, 12 nt, Homo sapiens
gagaaacaggcc

SEQ ID NO: 1429642 - RNA, 18 nt, Homo sapiens
gagaaauuccuugauuca

SEQ ID NO: 1429643 - RNA, 17 nt, Homo sapiens
gagaacccuuccuuucc

SEQ ID NO: 1429644 - RNA, 23 nt, Homo sapiens
gagaagaauuuucagaccccagc

SEQ ID NO: 1429645 - RNA, 14 nt, Homo sapiens
gagaagaugugauu

SEQ ID NO: 1429646 - RNA, 17 nt, Homo sapiens
gagaagcaaguggcuuu

SEQ ID NO: 1429647 - RNA, 24 nt, Homo sapiens
cuguuugucuauaugucuagcuca

SEQ ID NO: 1429648 - RNA, 15 nt, Homo sapiens
cuuaaaaacuuccau

SEQ ID NO: 1429649 - RNA, 19 nt, Homo sapiens
cuuaaaagauucacuaaag

SEQ ID NO: 1429650 - RNA, 16 nt, Homo sapiens
cuuaaaggaccuuccc

SEQ ID NO: 1429651 - RNA, 21 nt, Homo sapiens
cuuaaaggcaccaucuaauag

SEQ ID NO: 1429652 - RNA, 17 nt, Homo sapiens
cuuaaauauuaugugaa

SEQ ID NO: 1429653 - RNA, 21 nt, Homo sapiens
cuuaagccuuuugcucacaaa

SEQ ID NO: 1429654 - RNA, 19 nt, Homo sapiens
cuuaauggguacaauguac

SEQ ID NO: 1429655 - RNA, 21 nt, Homo sapiens
cuuacacuacauuagaacacu

SEQ ID NO: 1429656 - RNA, 23 nt, Homo sapiens
cuuacaguggagugagaucuuac

SEQ ID NO: 1429657 - RNA, 16 nt, Homo sapiens
cuuacuuaaacccagc

SEQ ID NO: 1429658 - RNA, 14 nt, Homo sapiens
cuuacuuauucuuc

SEQ ID NO: 1429659 - RNA, 20 nt, Homo sapiens
cuuagaaaucauuguagaaa

SEQ ID NO: 1429660 - RNA, 18 nt, Homo sapiens
cuuagcccaagaggucug

SEQ ID NO: 1429661 - RNA, 15 nt, Homo sapiens
cuuaggaaacccuuc

SEQ ID NO: 1429662 - RNA, 16 nt, Homo sapiens
cuuaggaaccuaccag

SEQ ID NO: 1429663 - RNA, 15 nt, Homo sapiens
cuuauaccaaaggga

SEQ ID NO: 1429664 - RNA, 21 nt, Homo sapiens
cuuauaucaucagcauaccuu

SEQ ID NO: 1429665 - RNA, 20 nt, Homo sapiens
cuuaugaaaugggcuuuaac

SEQ ID NO: 1429666 - RNA, 18 nt, Homo sapiens
cuuaugccuauaccugaa

SEQ ID NO: 1429667 - RNA, 18 nt, Homo sapiens
cuuauuuacuuguagaaa

SEQ ID NO: 1429668 - RNA, 15 nt, Homo sapiens
cuuauuuauauauca

SEQ ID NO: 1429669 - RNA, 23 nt, Homo sapiens
cuuauuugagugauuauuuguua

SEQ ID NO: 1429670 - RNA, 17 nt, Homo sapiens
cuuauuuuugacagugu

SEQ ID NO: 1429671 - RNA, 21 nt, Homo sapiens
cuucaagugauauauguauuu

SEQ ID NO: 1429672 - RNA, 14 nt, Homo sapiens
cuucacaacagauu

SEQ ID NO: 1429673 - RNA, 13 nt, Homo sapiens
cuucacaguguuu

SEQ ID NO: 1429674 - RNA, 17 nt, Homo sapiens
cuucagaagacacugca

SEQ ID NO: 1429675 - RNA, 14 nt, Homo sapiens
cuucagauagaaaa

SEQ ID NO: 1429676 - RNA, 16 nt, Homo sapiens
cuucagccaaacacaa

SEQ ID NO: 1429677 - RNA, 16 nt, Homo sapiens
cuucagugggagaaaa

SEQ ID NO: 1429678 - RNA, 13 nt, Homo sapiens
cuucaguuuuagg

SEQ ID NO: 1429679 - RNA, 22 nt, Homo sapiens
cuucauaagguaauucauggca

SEQ ID NO: 1429680 - RNA, 22 nt, Homo sapiens
cuucaucaauuuuuauacauau

SEQ ID NO: 1429681 - RNA, 14 nt, Homo sapiens
cuuccaaccccuuu

SEQ ID NO: 1429682 - RNA, 17 nt, Homo sapiens
cuuccacaccuagcauc

SEQ ID NO: 1429683 - RNA, 15 nt, Homo sapiens
cuuccagcaugcauc

SEQ ID NO: 1429684 - RNA, 15 nt, Homo sapiens
cuuccagcuagugac

SEQ ID NO: 1429685 - RNA, 16 nt, Homo sapiens
cuuccauuugggauau

SEQ ID NO: 1429686 - RNA, 20 nt, Homo sapiens
cuucccaaucagcacugaaa

SEQ ID NO: 1429687 - RNA, 13 nt, Homo sapiens
cuucccaccucag

SEQ ID NO: 1429688 - RNA, 14 nt, Homo sapiens
cuuuaucagugaug

SEQ ID NO: 1429689 - RNA, 13 nt, Homo sapiens
cuuuaucugugac

SEQ ID NO: 1429690 - RNA, 16 nt, Homo sapiens
cuuuauugcugugaau

SEQ ID NO: 1429691 - RNA, 14 nt, Homo sapiens
cuuuauuuauuucu

SEQ ID NO: 1429692 - RNA, 18 nt, Homo sapiens
cuuuauuuguauuugcca

SEQ ID NO: 1429693 - RNA, 22 nt, Homo sapiens
cuuuauuuguauuugccauuca

SEQ ID NO: 1429694 - RNA, 19 nt, Homo sapiens
cuuucaaaguguaagcacu

SEQ ID NO: 1429695 - RNA, 13 nt, Homo sapiens
cuuucccaaauaa

SEQ ID NO: 1429696 - RNA, 21 nt, Homo sapiens
cuuucccggacugcaagcagg

SEQ ID NO: 1429697 - RNA, 23 nt, Homo sapiens
cuuuccuaaagucucugcugcua

SEQ ID NO: 1429698 - RNA, 10 nt, Homo sapiens
cuuuccucau

SEQ ID NO: 1429699 - RNA, 21 nt, Homo sapiens
cuuuccugucugcacaaguga

SEQ ID NO: 1429700 - RNA, 20 nt, Homo sapiens
cuuucgagguggguuuguac

SEQ ID NO: 1429701 - RNA, 22 nt, Homo sapiens
cuuucuauugaaaaaucaccac

SEQ ID NO: 1429702 - RNA, 23 nt, Homo sapiens
cuuucucgugguagaagccagua

SEQ ID NO: 1429703 - RNA, 20 nt, Homo sapiens
cuuucucuaucccaagccaa

SEQ ID NO: 1429704 - RNA, 22 nt, Homo sapiens
cuuucuuacauuagcaguuugc

SEQ ID NO: 1429705 - RNA, 19 nt, Homo sapiens
cuuugacucaccuguuacu

SEQ ID NO: 1429706 - RNA, 14 nt, Homo sapiens
cuuugcacauguga

SEQ ID NO: 1429707 - RNA, 16 nt, Homo sapiens
cuuugcaggcccagca

SEQ ID NO: 1429708 - RNA, 15 nt, Homo sapiens
cuuuggccauuccaa

SEQ ID NO: 1429709 - RNA, 15 nt, Homo sapiens
cuuugggaucagccu

SEQ ID NO: 1429710 - RNA, 19 nt, Homo sapiens
cuuuggggacaguuggcag

SEQ ID NO: 1429711 - RNA, 13 nt, Homo sapiens
cuuugugccuuug

SEQ ID NO: 1429712 - RNA, 22 nt, Homo sapiens
cuuugugggcccagcuacaagg

SEQ ID NO: 1429713 - RNA, 17 nt, Homo sapiens
cuuuguuuugcacugac

SEQ ID NO: 1429714 - RNA, 19 nt, Homo sapiens
cuuuuaagaaacacagggu

SEQ ID NO: 1429715 - RNA, 17 nt, Homo sapiens
cuuuuacagcucuuggc

SEQ ID NO: 1429716 - RNA, 17 nt, Homo sapiens
cuuuuacuacagugaca

SEQ ID NO: 1429717 - RNA, 13 nt, Homo sapiens
cuuuuauaacuag

SEQ ID NO: 1429718 - RNA, 19 nt, Homo sapiens
cuuuuauuugaaaugucau

SEQ ID NO: 1429719 - RNA, 14 nt, Homo sapiens
cuuuucaucuccag

SEQ ID NO: 1429720 - RNA, 15 nt, Homo sapiens
cuuuucaugucauuu

SEQ ID NO: 1429721 - RNA, 17 nt, Homo sapiens
cuuuuccauugcuuauu

SEQ ID NO: 1429722 - RNA, 16 nt, Homo sapiens
cuuuucuaacucuccc

SEQ ID NO: 1429723 - RNA, 20 nt, Homo sapiens
cuuuugaggggcugacuuca

SEQ ID NO: 1429724 - RNA, 15 nt, Homo sapiens
cuuuuggccuugugg

SEQ ID NO: 1429725 - RNA, 19 nt, Homo sapiens
cuuuuggugguauguuggu

SEQ ID NO: 1429726 - RNA, 18 nt, Homo sapiens
cuuuugucucacacagca

SEQ ID NO: 1429727 - RNA, 13 nt, Homo sapiens
cuuuuguguacag

SEQ ID NO: 1429728 - RNA, 19 nt, Homo sapiens
cuuuuuuccaccugccaau

SEQ ID NO: 1429729 - RNA, 18 nt, Homo sapiens
gaaaaaaagccguuuuca

SEQ ID NO: 1429730 - RNA, 19 nt, Homo sapiens
gaaaaaacuagagccugug

SEQ ID NO: 1429731 - RNA, 20 nt, Homo sapiens
cugcaauuuuaauugauuau

SEQ ID NO: 1429732 - RNA, 21 nt, Homo sapiens
cugcacaaagcccuuccaugu

SEQ ID NO: 1429733 - RNA, 18 nt, Homo sapiens
cugcacagugcaucucag

SEQ ID NO: 1429734 - RNA, 15 nt, Homo sapiens
cugcacccucgauga

SEQ ID NO: 1429735 - RNA, 24 nt, Homo sapiens
cugcaccgagagagauggaauaaa

SEQ ID NO: 1429736 - RNA, 14 nt, Homo sapiens
cugcacuccagaau

SEQ ID NO: 1429737 - RNA, 19 nt, Homo sapiens
cugcacuccagaauccaca

SEQ ID NO: 1429738 - RNA, 16 nt, Homo sapiens
cugcacuccauggcca

SEQ ID NO: 1429739 - RNA, 14 nt, Homo sapiens
cugcagaaggccaa

SEQ ID NO: 1429740 - RNA, 19 nt, Homo sapiens
cugcagacaccugccuuaa

SEQ ID NO: 1429741 - RNA, 18 nt, Homo sapiens
cugcagagagaagccugu

SEQ ID NO: 1429742 - RNA, 19 nt, Homo sapiens
cugcagccccagcugacac

SEQ ID NO: 1429743 - RNA, 15 nt, Homo sapiens
cugcagcggcacaaa

SEQ ID NO: 1429744 - RNA, 19 nt, Homo sapiens
cugcagcggcacaaaugca

SEQ ID NO: 1429745 - RNA, 20 nt, Homo sapiens
cugcaggggccgagccauuu

SEQ ID NO: 1429746 - RNA, 17 nt, Homo sapiens
cugccaccagucacugu

SEQ ID NO: 1429747 - RNA, 15 nt, Homo sapiens
cugccacccuugacg

SEQ ID NO: 1429748 - RNA, 22 nt, Homo sapiens
cugccagagcccaagugccauc

SEQ ID NO: 1429749 - RNA, 17 nt, Homo sapiens
cugccauaaagccauuc

SEQ ID NO: 1429750 - RNA, 14 nt, Homo sapiens
cugccauacgcggg

SEQ ID NO: 1429751 - RNA, 23 nt, Homo sapiens
cugccauuaaauccgcaaacagc

SEQ ID NO: 1429752 - RNA, 20 nt, Homo sapiens
cugcccaggaaggacugugc

SEQ ID NO: 1429753 - RNA, 15 nt, Homo sapiens
cugccccacccucaa

SEQ ID NO: 1429754 - RNA, 16 nt, Homo sapiens
cugccccagcuuuauc

SEQ ID NO: 1429755 - RNA, 13 nt, Homo sapiens
cugccccaucucc

SEQ ID NO: 1429756 - RNA, 19 nt, Homo sapiens
cugcccgaccccaucucau

SEQ ID NO: 1429757 - RNA, 16 nt, Homo sapiens
cugcccgacucagguc

SEQ ID NO: 1429758 - RNA, 15 nt, Homo sapiens
cugccggcccaguga

SEQ ID NO: 1429759 - RNA, 18 nt, Homo sapiens
cugccuaaguggcugcug

SEQ ID NO: 1429760 - RNA, 21 nt, Homo sapiens
cugccuaggguccuguccaug

SEQ ID NO: 1429761 - RNA, 15 nt, Homo sapiens
cugccuccucuucaa

SEQ ID NO: 1429762 - RNA, 16 nt, Homo sapiens
cugccugcggcccaga

SEQ ID NO: 1429763 - RNA, 16 nt, Homo sapiens
cugccugcuccaagaa

SEQ ID NO: 1429764 - RNA, 14 nt, Homo sapiens
cugccugugcauga

SEQ ID NO: 1429765 - RNA, 22 nt, Homo sapiens
cugccuuaacacacacaccucu

SEQ ID NO: 1429766 - RNA, 21 nt, Homo sapiens
cugccuugccaugucuuguuc

SEQ ID NO: 1429767 - RNA, 16 nt, Homo sapiens
cugcgacgcaggugua

SEQ ID NO: 1429768 - RNA, 13 nt, Homo sapiens
cugcggcgaccgc

SEQ ID NO: 1429769 - RNA, 14 nt, Homo sapiens
cugcuaaauacugu

SEQ ID NO: 1429770 - RNA, 16 nt, Homo sapiens
cugcuaauagcugcua

SEQ ID NO: 1429771 - RNA, 12 nt, Homo sapiens
cugcuaccaagg

SEQ ID NO: 1429772 - RNA, 14 nt, Homo sapiens
cccagccaugguga

SEQ ID NO: 1429773 - RNA, 18 nt, Homo sapiens
cccagcgaguugcgcugg

SEQ ID NO: 1429774 - RNA, 11 nt, Homo sapiens
cccagcucucg

SEQ ID NO: 1429775 - RNA, 17 nt, Homo sapiens
cccagcuguagccaugg

SEQ ID NO: 1429776 - RNA, 21 nt, Homo sapiens
cccaggagguggcuauggcca

SEQ ID NO: 1429777 - RNA, 18 nt, Homo sapiens
cccaggcaucccaucccu

SEQ ID NO: 1429778 - RNA, 17 nt, Homo sapiens
cccaggccuccagccuc

SEQ ID NO: 1429779 - RNA, 19 nt, Homo sapiens
cccaggcuggaguacagug

SEQ ID NO: 1429780 - RNA, 17 nt, Homo sapiens
cccaggcuggagugcag

SEQ ID NO: 1429781 - RNA, 15 nt, Homo sapiens
cccagggacaaaaca

SEQ ID NO: 1429782 - RNA, 22 nt, Homo sapiens
cccagggcccuaacgggggugc

SEQ ID NO: 1429783 - RNA, 19 nt, Homo sapiens
cccagguucagacugagcu

SEQ ID NO: 1429784 - RNA, 22 nt, Homo sapiens
cccaguccgccaaacacuccac

SEQ ID NO: 1429785 - RNA, 16 nt, Homo sapiens
cccaguggaacaguca

SEQ ID NO: 1429786 - RNA, 12 nt, Homo sapiens
cccaguguaaag

SEQ ID NO: 1429787 - RNA, 12 nt, Homo sapiens
cccaguucugcu

SEQ ID NO: 1429788 - RNA, 23 nt, Homo sapiens
cccauagaaacaugacacugacc

SEQ ID NO: 1429789 - RNA, 17 nt, Homo sapiens
cccaucagcaccaugga

SEQ ID NO: 1429790 - RNA, 13 nt, Homo sapiens
cccaucuuuccuc

SEQ ID NO: 1429791 - RNA, 21 nt, Homo sapiens
cccauuacuuuaauacucacc

SEQ ID NO: 1429792 - RNA, 16 nt, Homo sapiens
cccauugacuugcaca

SEQ ID NO: 1429793 - RNA, 17 nt, Homo sapiens
cccauuuuaucuuugaa

SEQ ID NO: 1429794 - RNA, 13 nt, Homo sapiens
ccccaaagucuua

SEQ ID NO: 1429795 - RNA, 12 nt, Homo sapiens
ccccaaguucug

SEQ ID NO: 1429796 - RNA, 11 nt, Homo sapiens
ccccaccucag

SEQ ID NO: 1429797 - RNA, 21 nt, Homo sapiens
ccccaccuuugggaucagccu

SEQ ID NO: 1429798 - RNA, 10 nt, Homo sapiens
ccccagacag

SEQ ID NO: 1429799 - RNA, 19 nt, Homo sapiens
ccccagaggccucucucuc

SEQ ID NO: 1429800 - RNA, 15 nt, Homo sapiens
ccccagcaguugaau

SEQ ID NO: 1429801 - RNA, 19 nt, Homo sapiens
ccccagcuuuaucugucac

SEQ ID NO: 1429802 - RNA, 13 nt, Homo sapiens
ccccagcuuugca

SEQ ID NO: 1429803 - RNA, 21 nt, Homo sapiens
ccccaucaucccagcugcucc

SEQ ID NO: 1429804 - RNA, 15 nt, Homo sapiens
cccccaccuuuggga

SEQ ID NO: 1429805 - RNA, 15 nt, Homo sapiens
cccccagacagagcc

SEQ ID NO: 1429806 - RNA, 19 nt, Homo sapiens
cccccuaagaggcagugag

SEQ ID NO: 1429807 - RNA, 21 nt, Homo sapiens
cccccucuaacccccagugcc

SEQ ID NO: 1429808 - RNA, 16 nt, Homo sapiens
caacaauaaagacuga

SEQ ID NO: 1429809 - RNA, 17 nt, Homo sapiens
caacaauaaagacugag

SEQ ID NO: 1429810 - RNA, 13 nt, Homo sapiens
caacaauacaugc

SEQ ID NO: 1429811 - RNA, 19 nt, Homo sapiens
caacaauacaugcugcuaa

SEQ ID NO: 1429812 - RNA, 23 nt, Homo sapiens
caacacgagcaggcuacugucag

SEQ ID NO: 1429813 - RNA, 12 nt, Homo sapiens
caacagacugaa

SEQ ID NO: 1429814 - RNA, 16 nt, Homo sapiens
caacagauuauuaccu

SEQ ID NO: 1429815 - RNA, 17 nt, Homo sapiens
caacagugagucuguca

SEQ ID NO: 1429816 - RNA, 16 nt, Homo sapiens
caacaucucgagcccc

SEQ ID NO: 1429817 - RNA, 19 nt, Homo sapiens
caacaugguccuuguccca

SEQ ID NO: 1429818 - RNA, 17 nt, Homo sapiens
caacauucccccaacau

SEQ ID NO: 1429819 - RNA, 13 nt, Homo sapiens
caacauucuuugc

SEQ ID NO: 1429820 - RNA, 15 nt, Homo sapiens
caacauuuauuucaa

SEQ ID NO: 1429821 - RNA, 20 nt, Homo sapiens
caaccacacaccucaccaga

SEQ ID NO: 1429822 - RNA, 14 nt, Homo sapiens
caacccaaccucau

SEQ ID NO: 1429823 - RNA, 14 nt, Homo sapiens
caaccccaccacuu

SEQ ID NO: 1429824 - RNA, 15 nt, Homo sapiens
caaccccugcuuccc

SEQ ID NO: 1429825 - RNA, 17 nt, Homo sapiens
caacccucacuguguug

SEQ ID NO: 1429826 - RNA, 21 nt, Homo sapiens
caacccugcccacuucagccc

SEQ ID NO: 1429827 - RNA, 15 nt, Homo sapiens
caacccuguuuccug

SEQ ID NO: 1429828 - RNA, 20 nt, Homo sapiens
caaccucaaugcccugccau

SEQ ID NO: 1429829 - RNA, 17 nt, Homo sapiens
caaccucccaacccaga

SEQ ID NO: 1429830 - RNA, 18 nt, Homo sapiens
caaccugccugugcauga

SEQ ID NO: 1429831 - RNA, 21 nt, Homo sapiens
caaccugcucuccucuugcca

SEQ ID NO: 1429832 - RNA, 20 nt, Homo sapiens
caaccugggauguagcggug

SEQ ID NO: 1429833 - RNA, 23 nt, Homo sapiens
caaccuggucacaggacucugcc

SEQ ID NO: 1429834 - RNA, 23 nt, Homo sapiens
caaccuguucuuccuaccaaaua

SEQ ID NO: 1429835 - RNA, 12 nt, Homo sapiens
caacuccuggaa

SEQ ID NO: 1429836 - RNA, 15 nt, Homo sapiens
caacucuccacucca

SEQ ID NO: 1429837 - RNA, 16 nt, Homo sapiens
caacucugcacuccau

SEQ ID NO: 1429838 - RNA, 15 nt, Homo sapiens
caacugacaauauga

SEQ ID NO: 1429839 - RNA, 20 nt, Homo sapiens
caacugcagaaaauguccuc

SEQ ID NO: 1429840 - RNA, 15 nt, Homo sapiens
caacugcucugccca

SEQ ID NO: 1429841 - RNA, 16 nt, Homo sapiens
caggucccagagggug

SEQ ID NO: 1429842 - RNA, 15 nt, Homo sapiens
caggucuagacuuuc

SEQ ID NO: 1429843 - RNA, 14 nt, Homo sapiens
caggucucccugga

SEQ ID NO: 1429844 - RNA, 18 nt, Homo sapiens
caggucucccuggaucag

SEQ ID NO: 1429845 - RNA, 22 nt, Homo sapiens
caggugagcugaagacaaacca

SEQ ID NO: 1429846 - RNA, 16 nt, Homo sapiens
caggugauccacccac

SEQ ID NO: 1429847 - RNA, 19 nt, Homo sapiens
caggugccaguuauggcua

SEQ ID NO: 1429848 - RNA, 23 nt, Homo sapiens
cagguggauuuuguggaggugag

SEQ ID NO: 1429849 - RNA, 16 nt, Homo sapiens
cagguggcaucucuaa

SEQ ID NO: 1429850 - RNA, 15 nt, Homo sapiens
caggugggaaauggu

SEQ ID NO: 1429851 - RNA, 13 nt, Homo sapiens
cagguuagccuuu

SEQ ID NO: 1429852 - RNA, 14 nt, Homo sapiens
cagguuagccuuug

SEQ ID NO: 1429853 - RNA, 13 nt, Homo sapiens
cagguuucuuaaa

SEQ ID NO: 1429854 - RNA, 16 nt, Homo sapiens
caguaaugcaaauuaa

SEQ ID NO: 1429855 - RNA, 16 nt, Homo sapiens
caguagcuguggugag

SEQ ID NO: 1429856 - RNA, 20 nt, Homo sapiens
caguagcuuaaauaaauuca

SEQ ID NO: 1429857 - RNA, 22 nt, Homo sapiens
caguccagaugccuuccugucu

SEQ ID NO: 1429858 - RNA, 23 nt, Homo sapiens
cagucccuuacacguaccucuca

SEQ ID NO: 1429859 - RNA, 20 nt, Homo sapiens
caguccgccaaacacuccac

SEQ ID NO: 1429860 - RNA, 11 nt, Homo sapiens
cagucucaagc

SEQ ID NO: 1429861 - RNA, 22 nt, Homo sapiens
cagucucggguggcuagucaga

SEQ ID NO: 1429862 - RNA, 18 nt, Homo sapiens
cagucuggaucguuugac

SEQ ID NO: 1429863 - RNA, 19 nt, Homo sapiens
cagucuucucucacuuuga

SEQ ID NO: 1429864 - RNA, 13 nt, Homo sapiens
cagucuuggaaua

SEQ ID NO: 1429865 - RNA, 16 nt, Homo sapiens
cagucuuggcucacua

SEQ ID NO: 1429866 - RNA, 22 nt, Homo sapiens
cagucuuggcucacuacagccu

SEQ ID NO: 1429867 - RNA, 19 nt, Homo sapiens
cagugaaagaguagugcau

SEQ ID NO: 1429868 - RNA, 21 nt, Homo sapiens
cagugaaccaaagagacugga

SEQ ID NO: 1429869 - RNA, 20 nt, Homo sapiens
cagugagacacagaguggag

SEQ ID NO: 1429870 - RNA, 20 nt, Homo sapiens
cagugaugaaaaccuaacag

SEQ ID NO: 1429871 - RNA, 18 nt, Homo sapiens
cagugauuugccaaagug

SEQ ID NO: 1429872 - RNA, 20 nt, Homo sapiens
cagugcacacggaugcacag

SEQ ID NO: 1429873 - RNA, 16 nt, Homo sapiens
cagugcacuguauaua

SEQ ID NO: 1429874 - RNA, 21 nt, Homo sapiens
cagugcccaccaacaucccau

SEQ ID NO: 1429875 - RNA, 22 nt, Homo sapiens
cagugcuguacuugaugacaga

SEQ ID NO: 1429876 - RNA, 14 nt, Homo sapiens
caguggcaguguau

SEQ ID NO: 1429877 - RNA, 17 nt, Homo sapiens
caguggcaguguaugcu

SEQ ID NO: 1429878 - RNA, 23 nt, Homo sapiens
caguggcccauaaguguaaaaua

SEQ ID NO: 1429879 - RNA, 14 nt, Homo sapiens
caguguaugcucau

SEQ ID NO: 1429880 - RNA, 21 nt, Homo sapiens
caguguaugcucauacuugga

SEQ ID NO: 1429881 - RNA, 16 nt, Homo sapiens
caguguuugcaauggu

SEQ ID NO: 1429882 - RNA, 19 nt, Homo sapiens
caguguuugcaaugguguu

SEQ ID NO: 1429883 - RNA, 15 nt, Homo sapiens
caguucaaauccuca

SEQ ID NO: 1429884 - RNA, 17 nt, Homo sapiens
caguucugaacuggaac

SEQ ID NO: 1429885 - RNA, 21 nt, Homo sapiens
caguugaaugacaacagaagc

SEQ ID NO: 1429886 - RNA, 16 nt, Homo sapiens
caguugggcuaugugu

SEQ ID NO: 1429887 - RNA, 13 nt, Homo sapiens
caguuuucuugca

SEQ ID NO: 1429888 - RNA, 23 nt, Homo sapiens
cauaaacacccaugaaucaaaga

SEQ ID NO: 1429889 - RNA, 14 nt, Homo sapiens
cauaacaugcuuua

SEQ ID NO: 1429890 - RNA, 20 nt, Homo sapiens
auucccuuucccauccauaa

SEQ ID NO: 1429891 - RNA, 12 nt, Homo sapiens
auuccucuugcc

SEQ ID NO: 1429892 - RNA, 15 nt, Homo sapiens
auuccucuugccucu

SEQ ID NO: 1429893 - RNA, 22 nt, Homo sapiens
auuccucuugccucucucagga

SEQ ID NO: 1429894 - RNA, 16 nt, Homo sapiens
auuccugaagccagau

SEQ ID NO: 1429895 - RNA, 13 nt, Homo sapiens
auuccugauaaua

SEQ ID NO: 1429896 - RNA, 20 nt, Homo sapiens
auuccugauaauaauugauc

SEQ ID NO: 1429897 - RNA, 20 nt, Homo sapiens
auuccugggcaagaaccuaa

SEQ ID NO: 1429898 - RNA, 20 nt, Homo sapiens
auuccugggccuguccccca

SEQ ID NO: 1429899 - RNA, 22 nt, Homo sapiens
auuccuguuucugaaccauuac

SEQ ID NO: 1429900 - RNA, 13 nt, Homo sapiens
auuccuucacuca

SEQ ID NO: 1429901 - RNA, 23 nt, Homo sapiens
auuccuugucaccagcaacaucu

SEQ ID NO: 1429902 - RNA, 21 nt, Homo sapiens
auucuacuucugucuuccuuc

SEQ ID NO: 1429903 - RNA, 16 nt, Homo sapiens
auucuauuccuaucug

SEQ ID NO: 1429904 - RNA, 15 nt, Homo sapiens
auucucaaccuacca

SEQ ID NO: 1429905 - RNA, 14 nt, Homo sapiens
auucucaucuacuc

SEQ ID NO: 1429906 - RNA, 14 nt, Homo sapiens
auucucaugugauc

SEQ ID NO: 1429907 - RNA, 21 nt, Homo sapiens
auucucaugugauccuuuuau

SEQ ID NO: 1429908 - RNA, 15 nt, Homo sapiens
auucuccugucagag

SEQ ID NO: 1429909 - RNA, 18 nt, Homo sapiens
auucucuccucagacugc

SEQ ID NO: 1429910 - RNA, 22 nt, Homo sapiens
auucucuccucagacugcucaa

SEQ ID NO: 1429911 - RNA, 21 nt, Homo sapiens
auucugaaaauaccagugugu

SEQ ID NO: 1429912 - RNA, 22 nt, Homo sapiens
auucugccuccauucugaccau

SEQ ID NO: 1429913 - RNA, 21 nt, Homo sapiens
auucugggcuccuggaaccaa

SEQ ID NO: 1429914 - RNA, 17 nt, Homo sapiens
auucuggucuucacugc

SEQ ID NO: 1429915 - RNA, 18 nt, Homo sapiens
auucugguuuugacauca

SEQ ID NO: 1429916 - RNA, 23 nt, Homo sapiens
auucuguggugggaacauucgag

SEQ ID NO: 1429917 - RNA, 17 nt, Homo sapiens
auucuuaauaggcuuua

SEQ ID NO: 1429918 - RNA, 13 nt, Homo sapiens
auucuuggaauac

SEQ ID NO: 1429919 - RNA, 24 nt, Homo sapiens
auucuuuccccucagagcucuuau

SEQ ID NO: 1429920 - RNA, 21 nt, Homo sapiens
auugaagugucgaaagcaacu

SEQ ID NO: 1429921 - RNA, 16 nt, Homo sapiens
auugacccauguuccc

SEQ ID NO: 1429922 - RNA, 14 nt, Homo sapiens
auugagaaacauga

SEQ ID NO: 1429923 - RNA, 20 nt, Homo sapiens
auugagugcuccugugugcu

SEQ ID NO: 1429924 - RNA, 21 nt, Homo sapiens
auugagugcuccugugugcug

SEQ ID NO: 1429925 - RNA, 12 nt, Homo sapiens
auugcagacuca

SEQ ID NO: 1429926 - RNA, 15 nt, Homo sapiens
auugcagacucauga

SEQ ID NO: 1429927 - RNA, 13 nt, Homo sapiens
auugcccugugag

SEQ ID NO: 1429928 - RNA, 15 nt, Homo sapiens
auugccugcagagag

SEQ ID NO: 1429929 - RNA, 16 nt, Homo sapiens
auugcuguuguugcag

SEQ ID NO: 1429930 - RNA, 17 nt, Homo sapiens
auugcuuaaaagacauu

SEQ ID NO: 1429931 - RNA, 18 nt, Homo sapiens
auugcuucaauaauauua

SEQ ID NO: 1429932 - RNA, 14 nt, Homo sapiens
auuggaaucuguau

SEQ ID NO: 1429933 - RNA, 17 nt, Homo sapiens
auuggaccauccuauuu

SEQ ID NO: 1429934 - RNA, 19 nt, Homo sapiens
auuggccucaguguaguua

SEQ ID NO: 1429935 - RNA, 17 nt, Homo sapiens
auugguacuuguuucac

SEQ ID NO: 1429936 - RNA, 19 nt, Homo sapiens
auugguauauuuccauuca

SEQ ID NO: 1429937 - RNA, 22 nt, Homo sapiens
auugguccagcuugcucuucag

SEQ ID NO: 1429938 - RNA, 14 nt, Homo sapiens
auuguacauucccu

SEQ ID NO: 1429939 - RNA, 18 nt, Homo sapiens
auuguggguaacgugaga

SEQ ID NO: 1429940 - RNA, 16 nt, Homo sapiens
auuguucaucaugaca

SEQ ID NO: 1429941 - RNA, 16 nt, Homo sapiens
auuguuuuauguucua

SEQ ID NO: 1429942 - RNA, 15 nt, Homo sapiens
auuuaaaaucauuca

SEQ ID NO: 1429943 - RNA, 22 nt, Homo sapiens
auuuaaaggggagauacucucc

SEQ ID NO: 1429944 - RNA, 17 nt, Homo sapiens
auuuaacagucauuuaa

SEQ ID NO: 1429945 - RNA, 20 nt, Homo sapiens
auuuaagaauaaagucuugu

SEQ ID NO: 1429946 - RNA, 22 nt, Homo sapiens
auuuaaugaagacccaguguaa

SEQ ID NO: 1429947 - RNA, 20 nt, Homo sapiens
auuuaauuuuuacaugacca

SEQ ID NO: 1429948 - RNA, 20 nt, Homo sapiens
auuuacauuuuuaauuuagu

SEQ ID NO: 1429949 - RNA, 18 nt, Homo sapiens
auuuagaacuguauguca

SEQ ID NO: 1429950 - RNA, 17 nt, Homo sapiens
auuuagacaaaguucaa

SEQ ID NO: 1429951 - RNA, 14 nt, Homo sapiens
auuuagauaugcaa

SEQ ID NO: 1429952 - RNA, 14 nt, Homo sapiens
auuuauauaucagu

SEQ ID NO: 1429953 - RNA, 16 nt, Homo sapiens
auuuauauucaaggau

SEQ ID NO: 1429954 - RNA, 19 nt, Homo sapiens
auuuaucugugcaaauccu

SEQ ID NO: 1429955 - RNA, 23 nt, Homo sapiens
auuuaucugugcaaauccuugau

SEQ ID NO: 1429956 - RNA, 23 nt, Homo sapiens
auuuaugguuucugcgugcuuua

SEQ ID NO: 1429957 - RNA, 19 nt, Homo sapiens
auuuauuagcagaaaugua

SEQ ID NO: 1429958 - RNA, 13 nt, Homo sapiens
auuuauucauuca

SEQ ID NO: 1429959 - RNA, 19 nt, Homo sapiens
auuuauucuucuuuuccaa

SEQ ID NO: 1429960 - RNA, 23 nt, Homo sapiens
auuuauugucggaagacuugcca

SEQ ID NO: 1429961 - RNA, 15 nt, Homo sapiens
auuucaacaagaaua

SEQ ID NO: 1429962 - RNA, 22 nt, Homo sapiens
auuucaaccagcauucaugccg

SEQ ID NO: 1429963 - RNA, 19 nt, Homo sapiens
auuucaaccgcuugccaua

SEQ ID NO: 1429964 - RNA, 19 nt, Homo sapiens
auuucaucuacuacagggu

SEQ ID NO: 1429965 - RNA, 17 nt, Homo sapiens
auuucaucugagugugg

SEQ ID NO: 1429966 - RNA, 17 nt, Homo sapiens
auuuccaaaugaaugac

SEQ ID NO: 1429967 - RNA, 13 nt, Homo sapiens
auuucuagcagag

SEQ ID NO: 1429968 - RNA, 16 nt, Homo sapiens
auuucuagcagaguga

SEQ ID NO: 1429969 - RNA, 19 nt, Homo sapiens
auuucuaucuugaauuuca

SEQ ID NO: 1429970 - RNA, 12 nt, Homo sapiens
auuucuauucaa

SEQ ID NO: 1429971 - RNA, 23 nt, Homo sapiens
auuucucaaucagugcagugaua

SEQ ID NO: 1429972 - RNA, 16 nt, Homo sapiens
auuucuguuugaaugc

SEQ ID NO: 1429973 - RNA, 15 nt, Homo sapiens
auuucuugcauucau

SEQ ID NO: 1429974 - RNA, 18 nt, Homo sapiens
ccaggaucccucccagau

SEQ ID NO: 1429975 - RNA, 17 nt, Homo sapiens
ccaggauccugcaggaa

SEQ ID NO: 1429976 - RNA, 20 nt, Homo sapiens
ccaggaugaaggcgugcaag

SEQ ID NO: 1429977 - RNA, 18 nt, Homo sapiens
ccaggcaccaucucccuu

SEQ ID NO: 1429978 - RNA, 14 nt, Homo sapiens
ccaggcacugcugc

SEQ ID NO: 1429979 - RNA, 15 nt, Homo sapiens
ccaggccaaugcagc

SEQ ID NO: 1429980 - RNA, 15 nt, Homo sapiens
ccaggccugccuguu

SEQ ID NO: 1429981 - RNA, 12 nt, Homo sapiens
ccaggcucugcc

SEQ ID NO: 1429982 - RNA, 17 nt, Homo sapiens
ccaggcugcacugcagu

SEQ ID NO: 1429983 - RNA, 18 nt, Homo sapiens
ccaggcugcacugcagug

SEQ ID NO: 1429984 - RNA, 17 nt, Homo sapiens
ccaggcuggagugcagu

SEQ ID NO: 1429985 - RNA, 19 nt, Homo sapiens
ccagggacaaaacacugug

SEQ ID NO: 1429986 - RNA, 19 nt, Homo sapiens
ccagggccugggggcagug

SEQ ID NO: 1429987 - RNA, 14 nt, Homo sapiens
ccagguuagccuuu

SEQ ID NO: 1429988 - RNA, 22 nt, Homo sapiens
ccagucacugucccucaaauga

SEQ ID NO: 1429989 - RNA, 15 nt, Homo sapiens
ccagugaaccaaaga

SEQ ID NO: 1429990 - RNA, 19 nt, Homo sapiens
ccagugagauuacagagga

SEQ ID NO: 1429991 - RNA, 11 nt, Homo sapiens
ccagugcaacc

SEQ ID NO: 1429992 - RNA, 22 nt, Homo sapiens
ccaguguccccuccacugucac

SEQ ID NO: 1429993 - RNA, 23 nt, Homo sapiens
ccauaaacacccaugaaucaaag

SEQ ID NO: 1429994 - RNA, 20 nt, Homo sapiens
ccauaaagccauucuuacuc

SEQ ID NO: 1429995 - RNA, 21 nt, Homo sapiens
ccauacuuucccacagcacua

SEQ ID NO: 1429996 - RNA, 13 nt, Homo sapiens
ccauagauggguc

SEQ ID NO: 1429997 - RNA, 16 nt, Homo sapiens
ccauaucuacccagaa

SEQ ID NO: 1429998 - RNA, 18 nt, Homo sapiens
ccauaucuuuaaagugug

SEQ ID NO: 1429999 - RNA, 24 nt, Homo sapiens
ccauauggaggccucacacccaga

SEQ ID NO: 1430000 - RNA, 15 nt, Homo sapiens
ccaucacaaggggaa

SEQ ID NO: 1430001 - RNA, 14 nt, Homo sapiens
ccaucaccuacuca

SEQ ID NO: 1430002 - RNA, 13 nt, Homo sapiens
ccaucaucacugg

SEQ ID NO: 1430003 - RNA, 17 nt, Homo sapiens
ccaucaugcuugauuga

SEQ ID NO: 1430004 - RNA, 20 nt, Homo sapiens
ccauccaccaggccuuugag

SEQ ID NO: 1430005 - RNA, 18 nt, Homo sapiens
ccauccccuggacuggga

SEQ ID NO: 1430006 - RNA, 19 nt, Homo sapiens
ccauccuaccaaugcaugc

SEQ ID NO: 1430007 - RNA, 13 nt, Homo sapiens
ccauccuauuuaa

SEQ ID NO: 1430008 - RNA, 22 nt, Homo sapiens
ccaucguccuuccucucaagcu

SEQ ID NO: 1430009 - RNA, 13 nt, Homo sapiens
ccaucuccagugg

SEQ ID NO: 1430010 - RNA, 21 nt, Homo sapiens
caucagugcacacggaugcac

SEQ ID NO: 1430011 - RNA, 16 nt, Homo sapiens
caucauacaugacuca

SEQ ID NO: 1430012 - RNA, 15 nt, Homo sapiens
caucauggcagugau

SEQ ID NO: 1430013 - RNA, 12 nt, Homo sapiens
caucccaaagga

SEQ ID NO: 1430014 - RNA, 13 nt, Homo sapiens
caucccacagugg

SEQ ID NO: 1430015 - RNA, 13 nt, Homo sapiens
cauccccuacacu

SEQ ID NO: 1430016 - RNA, 21 nt, Homo sapiens
caucccugggccugcugcuga

SEQ ID NO: 1430017 - RNA, 21 nt, Homo sapiens
cauccuaagugggaagugaag

SEQ ID NO: 1430018 - RNA, 21 nt, Homo sapiens
cauccuaaucugaauggugcu

SEQ ID NO: 1430019 - RNA, 17 nt, Homo sapiens
cauccugcucauaacau

SEQ ID NO: 1430020 - RNA, 20 nt, Homo sapiens
cauccuggcuaacacgugaa

SEQ ID NO: 1430021 - RNA, 16 nt, Homo sapiens
caucuaaucuaugcau

SEQ ID NO: 1430022 - RNA, 16 nt, Homo sapiens
caucuacuacagggug

SEQ ID NO: 1430023 - RNA, 12 nt, Homo sapiens
caucuccagugg

SEQ ID NO: 1430024 - RNA, 14 nt, Homo sapiens
caucugacucacaa

SEQ ID NO: 1430025 - RNA, 23 nt, Homo sapiens
caucugacucacaagaagaccag

SEQ ID NO: 1430026 - RNA, 20 nt, Homo sapiens
caucuuacaaaaacaagaca

SEQ ID NO: 1430027 - RNA, 14 nt, Homo sapiens
caucuucuggaguc

SEQ ID NO: 1430028 - RNA, 21 nt, Homo sapiens
caucuugcccccucaucucac

SEQ ID NO: 1430029 - RNA, 17 nt, Homo sapiens
caucuuguugccaugga

SEQ ID NO: 1430030 - RNA, 19 nt, Homo sapiens
caucuuucaacaaugacua

SEQ ID NO: 1430031 - RNA, 19 nt, Homo sapiens
caugaaaauagcucuuuca

SEQ ID NO: 1430032 - RNA, 15 nt, Homo sapiens
caugaaacacuucuc

SEQ ID NO: 1430033 - RNA, 19 nt, Homo sapiens
caugaacacacauggaugc

SEQ ID NO: 1430034 - RNA, 23 nt, Homo sapiens
caugaacacacauggaugcacac

SEQ ID NO: 1430035 - RNA, 15 nt, Homo sapiens
caugaacgcacuuua

SEQ ID NO: 1430036 - RNA, 20 nt, Homo sapiens
caugaaguguguuuccuuca

SEQ ID NO: 1430037 - RNA, 11 nt, Homo sapiens
caugaaucuuu

SEQ ID NO: 1430038 - RNA, 12 nt, Homo sapiens
caugaaucuuuu

SEQ ID NO: 1430039 - RNA, 13 nt, Homo sapiens
caugaaugcacac

SEQ ID NO: 1430040 - RNA, 18 nt, Homo sapiens
caugaauucuuaugcuua

SEQ ID NO: 1430041 - RNA, 18 nt, Homo sapiens
caugacacucuagugacu

SEQ ID NO: 1430042 - RNA, 11 nt, Homo sapiens
caugacacuga

SEQ ID NO: 1430043 - RNA, 14 nt, Homo sapiens
caugagaauaagag

SEQ ID NO: 1430044 - RNA, 15 nt, Homo sapiens
caugauaacugcaau

SEQ ID NO: 1430045 - RNA, 21 nt, Homo sapiens
caugaucgagccacugcacuc

SEQ ID NO: 1430046 - RNA, 23 nt, Homo sapiens
caugauuuuauacauagucacaa

SEQ ID NO: 1430047 - RNA, 15 nt, Homo sapiens
caugccuccaaaaau

SEQ ID NO: 1430048 - RNA, 17 nt, Homo sapiens
caugcgggccaccaagu

SEQ ID NO: 1430049 - RNA, 21 nt, Homo sapiens
caugcugugugcuggagacac

SEQ ID NO: 1430050 - RNA, 23 nt, Homo sapiens
caugcuuuagauuauauauuccg

SEQ ID NO: 1430051 - RNA, 14 nt, Homo sapiens
caugcuuuugccac

SEQ ID NO: 1430052 - RNA, 16 nt, Homo sapiens
cauggaauaaaccauu

SEQ ID NO: 1430053 - RNA, 13 nt, Homo sapiens
cauggaauuaccu

SEQ ID NO: 1430054 - RNA, 21 nt, Homo sapiens
cauggcaacauaauucacuuu

SEQ ID NO: 1430055 - RNA, 23 nt, Homo sapiens
cauggcaccuuuugcacauaaca

SEQ ID NO: 1430056 - RNA, 17 nt, Homo sapiens
cauggcgaggcugaggu

SEQ ID NO: 1430057 - RNA, 14 nt, Homo sapiens
cauggcuauccuag

SEQ ID NO: 1430058 - RNA, 13 nt, Homo sapiens
caugggacugugc

SEQ ID NO: 1430059 - RNA, 13 nt, Homo sapiens
acguacugguuua

SEQ ID NO: 1430060 - RNA, 16 nt, Homo sapiens
acgucccaugugcaug

SEQ ID NO: 1430061 - RNA, 16 nt, Homo sapiens
acgucucaagacugaa

SEQ ID NO: 1430062 - RNA, 16 nt, Homo sapiens
acgugaagccacagga

SEQ ID NO: 1430063 - RNA, 12 nt, Homo sapiens
acuaaaguauau

SEQ ID NO: 1430064 - RNA, 14 nt, Homo sapiens
acuacacuaauaaa

SEQ ID NO: 1430065 - RNA, 16 nt, Homo sapiens
acuacaggcucaugcc

SEQ ID NO: 1430066 - RNA, 15 nt, Homo sapiens
acuacaguacaguga

SEQ ID NO: 1430067 - RNA, 16 nt, Homo sapiens
acuacaguacagugag

SEQ ID NO: 1430068 - RNA, 21 nt, Homo sapiens
acuacuaaagugccuacccca

SEQ ID NO: 1430069 - RNA, 22 nt, Homo sapiens
acuacuaaagugccuaccccag

SEQ ID NO: 1430070 - RNA, 20 nt, Homo sapiens
acuacugcugcaaagugcaa

SEQ ID NO: 1430071 - RNA, 14 nt, Homo sapiens
acuacugugaucag

SEQ ID NO: 1430072 - RNA, 20 nt, Homo sapiens
acuacuugccacacacuguu

SEQ ID NO: 1430073 - RNA, 16 nt, Homo sapiens
acuagaaaacauucca

SEQ ID NO: 1430074 - RNA, 14 nt, Homo sapiens
acuagaaacagagg

SEQ ID NO: 1430075 - RNA, 13 nt, Homo sapiens
acuagaaccugga

SEQ ID NO: 1430076 - RNA, 15 nt, Homo sapiens
uuaacaaaauuagcu

SEQ ID NO: 1430077 - RNA, 23 nt, Homo sapiens
uuaacaaauuauguuacaucugu

SEQ ID NO: 1430078 - RNA, 23 nt, Homo sapiens
uuaacagaaccagaggguuguac

SEQ ID NO: 1430079 - RNA, 20 nt, Homo sapiens
uuaacaucuugaacugguug

SEQ ID NO: 1430080 - RNA, 13 nt, Homo sapiens
uuaacauuuucca

SEQ ID NO: 1430081 - RNA, 16 nt, Homo sapiens
uuaaccucaucuacaa

SEQ ID NO: 1430082 - RNA, 20 nt, Homo sapiens
uuaacugcauaauagccuaa

SEQ ID NO: 1430083 - RNA, 15 nt, Homo sapiens
uuaagaaacacaggg

SEQ ID NO: 1430084 - RNA, 12 nt, Homo sapiens
uuaagacuuuaa

SEQ ID NO: 1430085 - RNA, 16 nt, Homo sapiens
uuaagggaaggaacuc

SEQ ID NO: 1430086 - RNA, 13 nt, Homo sapiens
uuaagguacuuaa

SEQ ID NO: 1430087 - RNA, 17 nt, Homo sapiens
uuaagguagaaccucac

SEQ ID NO: 1430088 - RNA, 15 nt, Homo sapiens
uuaaguuuaucuuuc

SEQ ID NO: 1430089 - RNA, 15 nt, Homo sapiens
uuaauacucaccucc

SEQ ID NO: 1430090 - RNA, 12 nt, Homo sapiens
uuaauauugaua

SEQ ID NO: 1430091 - RNA, 21 nt, Homo sapiens
uuaaucugccauaaagccauu

SEQ ID NO: 1430092 - RNA, 20 nt, Homo sapiens
uuaaucuuucuuuaccugag

SEQ ID NO: 1430093 - RNA, 16 nt, Homo sapiens
uuaauucacucccaca

SEQ ID NO: 1430094 - RNA, 16 nt, Homo sapiens
uuacaaaaacaagaca

SEQ ID NO: 1430095 - RNA, 13 nt, Homo sapiens
uuacaaauucaag

SEQ ID NO: 1430096 - RNA, 14 nt, Homo sapiens
uuacaucauccucc

SEQ ID NO: 1430097 - RNA, 16 nt, Homo sapiens
uuacaugaaacuacuc

SEQ ID NO: 1430098 - RNA, 22 nt, Homo sapiens
uuacauuauuaaauguuucuca

SEQ ID NO: 1430099 - RNA, 15 nt, Homo sapiens
uuaccaaguccuggg

SEQ ID NO: 1430100 - RNA, 17 nt, Homo sapiens
uuaccacguuacugcau

SEQ ID NO: 1430101 - RNA, 22 nt, Homo sapiens
uuaccacguuacugcauacuga

SEQ ID NO: 1430102 - RNA, 12 nt, Homo sapiens
uuacccauauau

SEQ ID NO: 1430103 - RNA, 16 nt, Homo sapiens
uuaccuuuguucccaa

SEQ ID NO: 1430104 - RNA, 12 nt, Homo sapiens
uuacuaaagaca

SEQ ID NO: 1430105 - RNA, 13 nt, Homo sapiens
uuacuacagugac

SEQ ID NO: 1430106 - RNA, 19 nt, Homo sapiens
uuacuaugacugcucccca

SEQ ID NO: 1430107 - RNA, 19 nt, Homo sapiens
uuacucccaggcacugucu

SEQ ID NO: 1430108 - RNA, 22 nt, Homo sapiens
uuacuggaccccgccucccagc

SEQ ID NO: 1430109 - RNA, 21 nt, Homo sapiens
uuacuguuuggcugacaugac

SEQ ID NO: 1430110 - RNA, 14 nt, Homo sapiens
uuacuuccacagaa

SEQ ID NO: 1430111 - RNA, 19 nt, Homo sapiens
uuacuuuaauacucaccuc

SEQ ID NO: 1430112 - RNA, 22 nt, Homo sapiens
uuacuuuuggauaauauccacu

SEQ ID NO: 1430113 - RNA, 13 nt, Homo sapiens
uuagaugugacac

SEQ ID NO: 1430114 - RNA, 16 nt, Homo sapiens
uuagcaaccauaauau

SEQ ID NO: 1430115 - RNA, 22 nt, Homo sapiens
uuagcacccuucugcuguauac

SEQ ID NO: 1430116 - RNA, 16 nt, Homo sapiens
uuagcaggguacauau

SEQ ID NO: 1430117 - RNA, 20 nt, Homo sapiens
uuagccuugcucaggugcaa

SEQ ID NO: 1430118 - RNA, 22 nt, Homo sapiens
uuagcucuguucuuuauaacaa

SEQ ID NO: 1430119 - RNA, 21 nt, Homo sapiens
uuagcugagccuucugaugag

SEQ ID NO: 1430120 - RNA, 15 nt, Homo sapiens
uuagcugucugcuca

SEQ ID NO: 1430121 - RNA, 20 nt, Homo sapiens
uuaggaggaggugggggcua

SEQ ID NO: 1430122 - RNA, 20 nt, Homo sapiens
uuaggauagaauauuuacaa

SEQ ID NO: 1430123 - RNA, 19 nt, Homo sapiens
uuaggaugugggaguaaaa

SEQ ID NO: 1430124 - RNA, 20 nt, Homo sapiens
uuaggcaggaucuguacaau

SEQ ID NO: 1430125 - RNA, 13 nt, Homo sapiens
uuaggcaugccua

SEQ ID NO: 1430126 - RNA, 16 nt, Homo sapiens
uuaggccauauauauu

SEQ ID NO: 1430127 - RNA, 19 nt, Homo sapiens
uuagugugugugcaugugu

SEQ ID NO: 1430128 - RNA, 19 nt, Homo sapiens
uuaguucucacugucuccu

SEQ ID NO: 1430129 - RNA, 20 nt, Homo sapiens
uuaguuuugggaauaggcau

SEQ ID NO: 1430130 - RNA, 16 nt, Homo sapiens
uuauaaacuagaucuc

SEQ ID NO: 1430131 - RNA, 12 nt, Homo sapiens
uuauaaauccaa

SEQ ID NO: 1430132 - RNA, 16 nt, Homo sapiens
uuauaaauccaaagua

SEQ ID NO: 1430133 - RNA, 17 nt, Homo sapiens
uuauaagacuacuauac

SEQ ID NO: 1430134 - RNA, 19 nt, Homo sapiens
uuauaauaauguucucugg

SEQ ID NO: 1430135 - RNA, 12 nt, Homo sapiens
uuauacauauca

SEQ ID NO: 1430136 - RNA, 21 nt, Homo sapiens
uuauacaucaccuuuuugacu

SEQ ID NO: 1430137 - RNA, 16 nt, Homo sapiens
uuauauauuacuuguu

SEQ ID NO: 1430138 - RNA, 20 nt, Homo sapiens
uuauaucaucagcauaccuu

SEQ ID NO: 1430139 - RNA, 20 nt, Homo sapiens
uuaucaaaaaguacaauaau

SEQ ID NO: 1430140 - RNA, 16 nt, Homo sapiens
uuaucagugauggucu

SEQ ID NO: 1430141 - RNA, 20 nt, Homo sapiens
uuaucccccaaaaugcauuu

SEQ ID NO: 1430142 - RNA, 16 nt, Homo sapiens
uuaucucaaaacugca

SEQ ID NO: 1430143 - RNA, 15 nt, Homo sapiens
uuaucuugacauuca

SEQ ID NO: 1430144 - RNA, 16 nt, Homo sapiens
uuaugaaaaccauaug

SEQ ID NO: 1430145 - RNA, 20 nt, Homo sapiens
uuauggcaugauuuauauau

SEQ ID NO: 1430146 - RNA, 14 nt, Homo sapiens
uuauguaaucucac

SEQ ID NO: 1430147 - RNA, 15 nt, Homo sapiens
uuaugucaucauaca

SEQ ID NO: 1430148 - RNA, 22 nt, Homo sapiens
uccuccagaccccuguggcaga

SEQ ID NO: 1430149 - RNA, 15 nt, Homo sapiens
uccuccaucuagaga

SEQ ID NO: 1430150 - RNA, 22 nt, Homo sapiens
uccucccuuguggcuuccucag

SEQ ID NO: 1430151 - RNA, 12 nt, Homo sapiens
uccuccguccac

SEQ ID NO: 1430152 - RNA, 14 nt, Homo sapiens
uccuccuguguaca

SEQ ID NO: 1430153 - RNA, 17 nt, Homo sapiens
uccucgggggaaagcac

SEQ ID NO: 1430154 - RNA, 19 nt, Homo sapiens
uccucucaagcuagccaga

SEQ ID NO: 1430155 - RNA, 19 nt, Homo sapiens
uccucucucuacuugaaua

SEQ ID NO: 1430156 - RNA, 15 nt, Homo sapiens
uccucugccaccucc

SEQ ID NO: 1430157 - RNA, 23 nt, Homo sapiens
uccucugccucccauucugacca

SEQ ID NO: 1430158 - RNA, 14 nt, Homo sapiens
uccucuugccacug

SEQ ID NO: 1430159 - RNA, 18 nt, Homo sapiens
uccugaagccucugcccu

SEQ ID NO: 1430160 - RNA, 19 nt, Homo sapiens
uccugagucugggcaauga

SEQ ID NO: 1430161 - RNA, 19 nt, Homo sapiens
uccugccaccagucacugu

SEQ ID NO: 1430162 - RNA, 14 nt, Homo sapiens
uccugccucaggcu

SEQ ID NO: 1430163 - RNA, 19 nt, Homo sapiens
uccugccuccagcacuccc

SEQ ID NO: 1430164 - RNA, 15 nt, Homo sapiens
uccugccucuacugg

SEQ ID NO: 1430165 - RNA, 18 nt, Homo sapiens
uccugccuguagcaguga

SEQ ID NO: 1430166 - RNA, 21 nt, Homo sapiens
uccugcugcuguaacugcuga

SEQ ID NO: 1430167 - RNA, 22 nt, Homo sapiens
uccugcuggaugcgugcccuga

SEQ ID NO: 1430168 - RNA, 23 nt, Homo sapiens
uccuggaaccaaucccgugaaag

SEQ ID NO: 1430169 - RNA, 15 nt, Homo sapiens
uccuggauucacuca

SEQ ID NO: 1430170 - RNA, 19 nt, Homo sapiens
uccuggccaacauggugaa

SEQ ID NO: 1430171 - RNA, 17 nt, Homo sapiens
uccugggaauaugcuag

SEQ ID NO: 1430172 - RNA, 16 nt, Homo sapiens
uccuggugauucugau

SEQ ID NO: 1430173 - RNA, 16 nt, Homo sapiens
uccuguacauuucaca

SEQ ID NO: 1430174 - RNA, 17 nt, Homo sapiens
uccuguauaaauacuga

SEQ ID NO: 1430175 - RNA, 16 nt, Homo sapiens
uccugugccaaccuga

SEQ ID NO: 1430176 - RNA, 24 nt, Homo sapiens
uccuguugcaaugacacauaggaa

SEQ ID NO: 1430177 - RNA, 17 nt, Homo sapiens
uccuguuuuucugggug

SEQ ID NO: 1430178 - RNA, 13 nt, Homo sapiens
uccuuaauccuga

SEQ ID NO: 1430179 - RNA, 16 nt, Homo sapiens
uccuucccccaucccc

SEQ ID NO: 1430180 - RNA, 17 nt, Homo sapiens
uccuugauacugcucau

SEQ ID NO: 1430181 - RNA, 12 nt, Homo sapiens
uccuugcacuuu

SEQ ID NO: 1430182 - RNA, 23 nt, Homo sapiens
uccuuggggcacagucauucaca

SEQ ID NO: 1430183 - RNA, 23 nt, Homo sapiens
uccuugucccaagcccagggacu

SEQ ID NO: 1430184 - RNA, 19 nt, Homo sapiens
uccuugucucucauucucu

SEQ ID NO: 1430185 - RNA, 18 nt, Homo sapiens
uccuuuaccuaccaccuu

SEQ ID NO: 1430186 - RNA, 21 nt, Homo sapiens
uccuuuaucaagaagucugaa

SEQ ID NO: 1430187 - RNA, 16 nt, Homo sapiens
uccuuucuccagccag

SEQ ID NO: 1430188 - RNA, 18 nt, Homo sapiens
uccuuuuagguagaauuu

SEQ ID NO: 1430189 - RNA, 13 nt, Homo sapiens
uccuuuugaccaa

SEQ ID NO: 1430190 - RNA, 14 nt, Homo sapiens
uccuuuugaccaaa

SEQ ID NO: 1430191 - RNA, 24 nt, Homo sapiens
uccuuuugaccaaauaaaguacca

SEQ ID NO: 1430192 - RNA, 16 nt, Homo sapiens
uccuuuuugcaguaua

SEQ ID NO: 1430193 - RNA, 20 nt, Homo sapiens
ucgaaccaaggcagccucca

SEQ ID NO: 1430194 - RNA, 18 nt, Homo sapiens
ucgaauuuuucagaugau

SEQ ID NO: 1430195 - RNA, 16 nt, Homo sapiens
ucgagaccaaccugac

SEQ ID NO: 1430196 - RNA, 17 nt, Homo sapiens
ucgagguagguggauca

SEQ ID NO: 1430197 - RNA, 23 nt, Homo sapiens
ucgaguaacuuuaaaaaaaucau

SEQ ID NO: 1430198 - RNA, 20 nt, Homo sapiens
ucgauccuggauucacucac

SEQ ID NO: 1430199 - RNA, 20 nt, Homo sapiens
ucgcccacaaacugauuucu

SEQ ID NO: 1430200 - RNA, 21 nt, Homo sapiens
ucgccccaggcccucccugac

SEQ ID NO: 1430201 - RNA, 23 nt, Homo sapiens
ucgccguguuacuguugcacuga

SEQ ID NO: 1430202 - RNA, 22 nt, Homo sapiens
ucgggaaauuauuaugacucaa

SEQ ID NO: 1430203 - RNA, 22 nt, Homo sapiens
ucggggaacuccuggaaauauc

SEQ ID NO: 1430204 - RNA, 20 nt, Homo sapiens
ucgguagaggauuucuaguu

SEQ ID NO: 1430205 - RNA, 19 nt, Homo sapiens
ucguggugugucaaugcca

SEQ ID NO: 1430206 - RNA, 18 nt, Homo sapiens
ucguuuucauaacuugcu

SEQ ID NO: 1430207 - RNA, 17 nt, Homo sapiens
ucuaaaaagacuaaccu

SEQ ID NO: 1430208 - RNA, 12 nt, Homo sapiens
ucuaaaugaagu

SEQ ID NO: 1430209 - RNA, 17 nt, Homo sapiens
ucuaaaugaagugcaaa

SEQ ID NO: 1430210 - RNA, 16 nt, Homo sapiens
ucuaacuacaaggaca

SEQ ID NO: 1430211 - RNA, 13 nt, Homo sapiens
uaucacgcagauc

SEQ ID NO: 1430212 - RNA, 16 nt, Homo sapiens
uaucagagcucuuaau

SEQ ID NO: 1430213 - RNA, 22 nt, Homo sapiens
uaucauuuuuuuaacacauaac

SEQ ID NO: 1430214 - RNA, 21 nt, Homo sapiens
uauccacaucuuuaaguauug

SEQ ID NO: 1430215 - RNA, 22 nt, Homo sapiens
uauccguagaguagucaugaca

SEQ ID NO: 1430216 - RNA, 16 nt, Homo sapiens
uauccugcuagcugua

SEQ ID NO: 1430217 - RNA, 13 nt, Homo sapiens
uaucgggucacug

SEQ ID NO: 1430218 - RNA, 14 nt, Homo sapiens
uaucuaccaucuaa

SEQ ID NO: 1430219 - RNA, 16 nt, Homo sapiens
uaucucggaccuuuca

SEQ ID NO: 1430220 - RNA, 19 nt, Homo sapiens
uaucucggaccuuucagcu

SEQ ID NO: 1430221 - RNA, 14 nt, Homo sapiens
uaucugucaucucu

SEQ ID NO: 1430222 - RNA, 16 nt, Homo sapiens
uaucugucaucucucu

SEQ ID NO: 1430223 - RNA, 20 nt, Homo sapiens
uaucuucaggacuauuucac

SEQ ID NO: 1430224 - RNA, 13 nt, Homo sapiens
uaucuucauacaa

SEQ ID NO: 1430225 - RNA, 17 nt, Homo sapiens
uaucuuuuugcuuacag

SEQ ID NO: 1430226 - RNA, 19 nt, Homo sapiens
uaugaaaaaucaaugucaa

SEQ ID NO: 1430227 - RNA, 16 nt, Homo sapiens
uaugacaucacuugua

SEQ ID NO: 1430228 - RNA, 16 nt, Homo sapiens
uaugagggucagggca

SEQ ID NO: 1430229 - RNA, 21 nt, Homo sapiens
uaugcaagccuugcuagacag

SEQ ID NO: 1430230 - RNA, 13 nt, Homo sapiens
uaugcaauucuua

SEQ ID NO: 1430231 - RNA, 11 nt, Homo sapiens
uaugcacacac

SEQ ID NO: 1430232 - RNA, 23 nt, Homo sapiens
uaugcacacacacggaugcacac

SEQ ID NO: 1430233 - RNA, 19 nt, Homo sapiens
uaugcaguauugccacaau

SEQ ID NO: 1430234 - RNA, 18 nt, Homo sapiens
uaugccauagcaagauug

SEQ ID NO: 1430235 - RNA, 16 nt, Homo sapiens
uaugcccccaauuuau

SEQ ID NO: 1430236 - RNA, 15 nt, Homo sapiens
uaugccuuaagccaa

SEQ ID NO: 1430237 - RNA, 14 nt, Homo sapiens
uaugccuuauguaa

SEQ ID NO: 1430238 - RNA, 16 nt, Homo sapiens
uaugcuauuacauaca

SEQ ID NO: 1430239 - RNA, 19 nt, Homo sapiens
uauggaaucagcugcuaca

SEQ ID NO: 1430240 - RNA, 21 nt, Homo sapiens
uauggcuauaggugcuacaaa

SEQ ID NO: 1430241 - RNA, 19 nt, Homo sapiens
uauggcucuggcaccacua

SEQ ID NO: 1430242 - RNA, 13 nt, Homo sapiens
uaugggaagccau

SEQ ID NO: 1430243 - RNA, 14 nt, Homo sapiens
uauggguacauucc

SEQ ID NO: 1430244 - RNA, 23 nt, Homo sapiens
uauguaauuuagcaguccaaaga

SEQ ID NO: 1430245 - RNA, 16 nt, Homo sapiens
uauguacuguuauuga

SEQ ID NO: 1430246 - RNA, 20 nt, Homo sapiens
uauguauacacacauauaca

SEQ ID NO: 1430247 - RNA, 18 nt, Homo sapiens
uauguauauagaugugca

SEQ ID NO: 1430248 - RNA, 21 nt, Homo sapiens
uauguaucuggguucuaacca

SEQ ID NO: 1430249 - RNA, 18 nt, Homo sapiens
uauguauuuuugucauag

SEQ ID NO: 1430250 - RNA, 20 nt, Homo sapiens
uaugucaauuuguauaucau

SEQ ID NO: 1430251 - RNA, 12 nt, Homo sapiens
uaugucugccua

SEQ ID NO: 1430252 - RNA, 20 nt, Homo sapiens
uauguggacguaaucuccac

SEQ ID NO: 1430253 - RNA, 12 nt, Homo sapiens
uauguuacauua

SEQ ID NO: 1430254 - RNA, 13 nt, Homo sapiens
uauguuauugcau

SEQ ID NO: 1430255 - RNA, 22 nt, Homo sapiens
uauguucaacuggagacacuau

SEQ ID NO: 1430256 - RNA, 15 nt, Homo sapiens
uauguugaguguuca

SEQ ID NO: 1430257 - RNA, 18 nt, Homo sapiens
uauuaaaacugcacugcc

SEQ ID NO: 1430258 - RNA, 16 nt, Homo sapiens
uauuaaacuugucaga

SEQ ID NO: 1430259 - RNA, 15 nt, Homo sapiens
uauuaagauuuccaa

SEQ ID NO: 1430260 - RNA, 22 nt, Homo sapiens
uauuaaguucucaaugugaaaa

SEQ ID NO: 1430261 - RNA, 14 nt, Homo sapiens
uauuaauucauuaa

SEQ ID NO: 1430262 - RNA, 19 nt, Homo sapiens
uauuaauuuuugaaaccca

SEQ ID NO: 1430263 - RNA, 12 nt, Homo sapiens
uauuaccaaaaa

SEQ ID NO: 1430264 - RNA, 22 nt, Homo sapiens
uauuacuuauuuuugacagugu

SEQ ID NO: 1430265 - RNA, 14 nt, Homo sapiens
uauuagaaugcaug

SEQ ID NO: 1430266 - RNA, 15 nt, Homo sapiens
uauuaggccauauau

SEQ ID NO: 1430267 - RNA, 15 nt, Homo sapiens
uauuaguuaggugug

SEQ ID NO: 1430268 - RNA, 14 nt, Homo sapiens
uauuaucacaucaa

SEQ ID NO: 1430269 - RNA, 13 nt, Homo sapiens
uauuaucaccagc

SEQ ID NO: 1430270 - RNA, 14 nt, Homo sapiens
uauuaucaccagca

SEQ ID NO: 1430271 - RNA, 19 nt, Homo sapiens
uguuuucucagaacagcug

SEQ ID NO: 1430272 - RNA, 20 nt, Homo sapiens
uuaaaaaaaaauacugaugu

SEQ ID NO: 1430273 - RNA, 20 nt, Homo sapiens
uuaaaaauauuuucugaauu

SEQ ID NO: 1430274 - RNA, 15 nt, Homo sapiens
uuaaaagauucacua

SEQ ID NO: 1430275 - RNA, 12 nt, Homo sapiens
uuaaaaugauug

SEQ ID NO: 1430276 - RNA, 22 nt, Homo sapiens
uuaaacaacaaacaaaacgcaa

SEQ ID NO: 1430277 - RNA, 13 nt, Homo sapiens
uuaaacaccugac

SEQ ID NO: 1430278 - RNA, 18 nt, Homo sapiens
uuaaaccucucuucuacc

SEQ ID NO: 1430279 - RNA, 20 nt, Homo sapiens
uuaaagcuuauuaaaacuca

SEQ ID NO: 1430280 - RNA, 22 nt, Homo sapiens
uuaaaggagaaguagcugugaa

SEQ ID NO: 1430281 - RNA, 19 nt, Homo sapiens
uuaaauaaaucauuaauac

SEQ ID NO: 1430282 - RNA, 13 nt, Homo sapiens
uuaaauuauaucu

SEQ ID NO: 1430283 - RNA, 22 nt, Homo sapiens
uuaaauucacaugcagucucag

SEQ ID NO: 1430284 - RNA, 15 nt, Homo sapiens
ucaccagauuugcua

SEQ ID NO: 1430285 - RNA, 16 nt, Homo sapiens
ucaccagcagacacug

SEQ ID NO: 1430286 - RNA, 18 nt, Homo sapiens
ucaccagcuaucugucau

SEQ ID NO: 1430287 - RNA, 12 nt, Homo sapiens
ucaccagugucc

SEQ ID NO: 1430288 - RNA, 17 nt, Homo sapiens
ucaccauguaacaacca

SEQ ID NO: 1430289 - RNA, 14 nt, Homo sapiens
ucaccgugagcagc

SEQ ID NO: 1430290 - RNA, 21 nt, Homo sapiens
ucaccguggaccuuccugcca

SEQ ID NO: 1430291 - RNA, 14 nt, Homo sapiens
ucacgauauuauua

SEQ ID NO: 1430292 - RNA, 15 nt, Homo sapiens
ucacgaugaaauuga

SEQ ID NO: 1430293 - RNA, 23 nt, Homo sapiens
ucacgugucuuuagaacuccagu

SEQ ID NO: 1430294 - RNA, 23 nt, Homo sapiens
ucacuaaagggugcccacaaaau

SEQ ID NO: 1430295 - RNA, 18 nt, Homo sapiens
ucacuaaccaagccagaa

SEQ ID NO: 1430296 - RNA, 14 nt, Homo sapiens
ucacuaauacuaau

SEQ ID NO: 1430297 - RNA, 13 nt, Homo sapiens
ucacuacagccuc

SEQ ID NO: 1430298 - RNA, 14 nt, Homo sapiens
ucacuagacugugc

SEQ ID NO: 1430299 - RNA, 17 nt, Homo sapiens
ucacuagagcugggaaa

SEQ ID NO: 1430300 - RNA, 11 nt, Homo sapiens
ucacucaggcu

SEQ ID NO: 1430301 - RNA, 16 nt, Homo sapiens
ucacugcaaccuccac

SEQ ID NO: 1430302 - RNA, 20 nt, Homo sapiens
ucacugcucccccgugugua

SEQ ID NO: 1430303 - RNA, 19 nt, Homo sapiens
ucacugcucuggacugugu

SEQ ID NO: 1430304 - RNA, 23 nt, Homo sapiens
ucacuguagaaugauuucaugcu

SEQ ID NO: 1430305 - RNA, 15 nt, Homo sapiens
ucacuguucuaucuc

SEQ ID NO: 1430306 - RNA, 13 nt, Homo sapiens
ucacuuguacaaa

SEQ ID NO: 1430307 - RNA, 20 nt, Homo sapiens
ucagaaacaggugcaucugg

SEQ ID NO: 1430308 - RNA, 21 nt, Homo sapiens
ucagaaagggagggcucugag

SEQ ID NO: 1430309 - RNA, 22 nt, Homo sapiens
ucagaacagcugaaacauuccg

SEQ ID NO: 1430310 - RNA, 22 nt, Homo sapiens
ucagaacucuguguugugaaug

SEQ ID NO: 1430311 - RNA, 22 nt, Homo sapiens
ucagaagaaagaaucuuuccau

SEQ ID NO: 1430312 - RNA, 18 nt, Homo sapiens
ucagaaggauggcauuuu

SEQ ID NO: 1430313 - RNA, 22 nt, Homo sapiens
ucagaauuucuuugucauucaa

SEQ ID NO: 1430314 - RNA, 15 nt, Homo sapiens
ucagaccaguacugg

SEQ ID NO: 1430315 - RNA, 20 nt, Homo sapiens
ucagacccuaccccaccacg

SEQ ID NO: 1430316 - RNA, 16 nt, Homo sapiens
ucagacuccugugcaa

SEQ ID NO: 1430317 - RNA, 21 nt, Homo sapiens
ucagacuccugugcaacuuuc

SEQ ID NO: 1430318 - RNA, 20 nt, Homo sapiens
ucagagacuauuuagacaaa

SEQ ID NO: 1430319 - RNA, 14 nt, Homo sapiens
ucagagcacagcag

SEQ ID NO: 1430320 - RNA, 15 nt, Homo sapiens
ucagagcaggcucag

SEQ ID NO: 1430321 - RNA, 14 nt, Homo sapiens
ucagagccagugaa

SEQ ID NO: 1430322 - RNA, 23 nt, Homo sapiens
ucagagccccucccugcuaccaa

SEQ ID NO: 1430323 - RNA, 20 nt, Homo sapiens
ucagagcuauguucccucca

SEQ ID NO: 1430324 - RNA, 23 nt, Homo sapiens
ucagaguuugaagguaacugaga

SEQ ID NO: 1430325 - RNA, 13 nt, Homo sapiens
ucagauaugauau

SEQ ID NO: 1430326 - RNA, 17 nt, Homo sapiens
ucagaucugaacacagu

SEQ ID NO: 1430327 - RNA, 15 nt, Homo sapiens
ucagcaaagaacaag

SEQ ID NO: 1430328 - RNA, 20 nt, Homo sapiens
ucagcaccccugucucuagc

SEQ ID NO: 1430329 - RNA, 21 nt, Homo sapiens
ucagcacugccggcccaguga

SEQ ID NO: 1430330 - RNA, 22 nt, Homo sapiens
ucagcaggaaccuguacugggu

SEQ ID NO: 1430331 - RNA, 20 nt, Homo sapiens
ucagcauuauuccuccagga

SEQ ID NO: 1430332 - RNA, 18 nt, Homo sapiens
ucagcauucucacuccua

SEQ ID NO: 1430333 - RNA, 23 nt, Homo sapiens
ucagcccgggacagggucuugca

SEQ ID NO: 1430334 - RNA, 19 nt, Homo sapiens
ucagccuccgccauuccaa

SEQ ID NO: 1430335 - RNA, 20 nt, Homo sapiens
ucagccucuuaaagcugccu

SEQ ID NO: 1430336 - RNA, 15 nt, Homo sapiens
ucagcgugcuuagcc

SEQ ID NO: 1430337 - RNA, 19 nt, Homo sapiens
ucagcuccagaauaccuuc

SEQ ID NO: 1430338 - RNA, 17 nt, Homo sapiens
ucagcuuugcuuuuccu

SEQ ID NO: 1430339 - RNA, 22 nt, Homo sapiens
ucagcuuuuaauaaaauugaca

SEQ ID NO: 1430340 - RNA, 22 nt, Homo sapiens
ucaggaaaucaaauaugcaaag

SEQ ID NO: 1430341 - RNA, 19 nt, Homo sapiens
ucaggaggcccugguguca

SEQ ID NO: 1430342 - RNA, 15 nt, Homo sapiens
ucaggagucaacgug

SEQ ID NO: 1430343 - RNA, 13 nt, Homo sapiens
ucaggaguucaag

SEQ ID NO: 1430344 - RNA, 22 nt, Homo sapiens
uccaccgggccugaaccacagc

SEQ ID NO: 1430345 - RNA, 14 nt, Homo sapiens
uccaccuugcucuu

SEQ ID NO: 1430346 - RNA, 14 nt, Homo sapiens
uccacgagcuauau

SEQ ID NO: 1430347 - RNA, 15 nt, Homo sapiens
uccacgcacacaugg

SEQ ID NO: 1430348 - RNA, 19 nt, Homo sapiens
uccacucaauaugugauuu

SEQ ID NO: 1430349 - RNA, 21 nt, Homo sapiens
uccacuccagauuuuuuacag

SEQ ID NO: 1430350 - RNA, 16 nt, Homo sapiens
uccacuucaaucugag

SEQ ID NO: 1430351 - RNA, 16 nt, Homo sapiens
uccagaauaaaacgca

SEQ ID NO: 1430352 - RNA, 19 nt, Homo sapiens
uccagacgucaaccaggaa

SEQ ID NO: 1430353 - RNA, 17 nt, Homo sapiens
uccagagacaggaaaga

SEQ ID NO: 1430354 - RNA, 13 nt, Homo sapiens
uccagauucuucc

SEQ ID NO: 1430355 - RNA, 12 nt, Homo sapiens
uccagcauuugc

SEQ ID NO: 1430356 - RNA, 19 nt, Homo sapiens
uccagccgcugcacaucac

SEQ ID NO: 1430357 - RNA, 20 nt, Homo sapiens
uccagcuagccaacuccucc

SEQ ID NO: 1430358 - RNA, 14 nt, Homo sapiens
uccaggaaggcagc

SEQ ID NO: 1430359 - RNA, 22 nt, Homo sapiens
uccaggaauaggcauuugccua

SEQ ID NO: 1430360 - RNA, 14 nt, Homo sapiens
uccaggcaccaucu

SEQ ID NO: 1430361 - RNA, 22 nt, Homo sapiens
uccaggggcacacaaugcuauu

SEQ ID NO: 1430362 - RNA, 14 nt, Homo sapiens
uccagguacugauc

SEQ ID NO: 1430363 - RNA, 17 nt, Homo sapiens
uccaguauccacuuugc

SEQ ID NO: 1430364 - RNA, 17 nt, Homo sapiens
uccaguauucuugucaa

SEQ ID NO: 1430365 - RNA, 15 nt, Homo sapiens
uccaguucaugagaa

SEQ ID NO: 1430366 - RNA, 14 nt, Homo sapiens
uccaguuccgggag

SEQ ID NO: 1430367 - RNA, 18 nt, Homo sapiens
uccaguuucccaccaccu

SEQ ID NO: 1430368 - RNA, 22 nt, Homo sapiens
ugcuaaauaguucuaucaggaa

SEQ ID NO: 1430369 - RNA, 17 nt, Homo sapiens
ugcuaacuguguguaca

SEQ ID NO: 1430370 - RNA, 20 nt, Homo sapiens
ugcuaacuguguguacauau

SEQ ID NO: 1430371 - RNA, 17 nt, Homo sapiens
ugcuaauucaaagcucu

SEQ ID NO: 1430372 - RNA, 17 nt, Homo sapiens
ugcuacaaaaacacagc

SEQ ID NO: 1430373 - RNA, 12 nt, Homo sapiens
ugcuaccaaggc

SEQ ID NO: 1430374 - RNA, 23 nt, Homo sapiens
ugcuauaggcuggagaagcucac

SEQ ID NO: 1430375 - RNA, 21 nt, Homo sapiens
ugcuauaugccuuaagccaau

SEQ ID NO: 1430376 - RNA, 13 nt, Homo sapiens
ugcuauauugccc

SEQ ID NO: 1430377 - RNA, 15 nt, Homo sapiens
ugcuaucgcaccacu

SEQ ID NO: 1430378 - RNA, 13 nt, Homo sapiens
ugcucacucagga

SEQ ID NO: 1430379 - RNA, 13 nt, Homo sapiens
ugcucagugccuc

SEQ ID NO: 1430380 - RNA, 19 nt, Homo sapiens
ugcuccaucaugcuugauu

SEQ ID NO: 1430381 - RNA, 16 nt, Homo sapiens
ugcucggggugcacag

SEQ ID NO: 1430382 - RNA, 20 nt, Homo sapiens
ugcucugaggcuuccagaga

SEQ ID NO: 1430383 - RNA, 18 nt, Homo sapiens
ugcucugagugcuagcua

SEQ ID NO: 1430384 - RNA, 22 nt, Homo sapiens
ugcucugagugcuagcuagcca

SEQ ID NO: 1430385 - RNA, 18 nt, Homo sapiens
ugcucuggaaaaugugac

SEQ ID NO: 1430386 - RNA, 14 nt, Homo sapiens
ugcucugucuucca

SEQ ID NO: 1430387 - RNA, 16 nt, Homo sapiens
ugcucuugcauugcaa

SEQ ID NO: 1430388 - RNA, 13 nt, Homo sapiens
ugcugaccucugg

SEQ ID NO: 1430389 - RNA, 20 nt, Homo sapiens
ugcugaccugaucaccucug

SEQ ID NO: 1430390 - RNA, 21 nt, Homo sapiens
ugcugacggaagccaacuugg

SEQ ID NO: 1430391 - RNA, 15 nt, Homo sapiens
ugcugagcacccucu

SEQ ID NO: 1430392 - RNA, 23 nt, Homo sapiens
ugcugagugcaccacuucaagug

SEQ ID NO: 1430393 - RNA, 20 nt, Homo sapiens
ugcugcccugcucuggggau

SEQ ID NO: 1430394 - RNA, 15 nt, Homo sapiens
ugcugcgucagacca

SEQ ID NO: 1430395 - RNA, 13 nt, Homo sapiens
ugcugcucaucca

SEQ ID NO: 1430396 - RNA, 17 nt, Homo sapiens
ugcugcucccaucugca

SEQ ID NO: 1430397 - RNA, 23 nt, Homo sapiens
ugcugcugagugcaccacuucaa

SEQ ID NO: 1430398 - RNA, 18 nt, Homo sapiens
ugcugcugcccccaccuc

SEQ ID NO: 1430399 - RNA, 17 nt, Homo sapiens
ugcuggacugaggacca

SEQ ID NO: 1430400 - RNA, 14 nt, Homo sapiens
ugcuggagcuggcu

SEQ ID NO: 1430401 - RNA, 22 nt, Homo sapiens
ugcuggcaccucagacaaucca

SEQ ID NO: 1430402 - RNA, 16 nt, Homo sapiens
ugcuggucuauuuuga

SEQ ID NO: 1430403 - RNA, 17 nt, Homo sapiens
ugcuguaacucagacau

SEQ ID NO: 1430404 - RNA, 22 nt, Homo sapiens
ugcuguaacucagacauuccaa

SEQ ID NO: 1430405 - RNA, 13 nt, Homo sapiens
ugcuguauacugu

SEQ ID NO: 1430406 - RNA, 17 nt, Homo sapiens
ugcuguggccucacuuc

SEQ ID NO: 1430407 - RNA, 14 nt, Homo sapiens
ugcugugugccuuc

SEQ ID NO: 1430408 - RNA, 13 nt, Homo sapiens
ugcuguuguugca

SEQ ID NO: 1430409 - RNA, 14 nt, Homo sapiens
ugcuuaaaauagca

SEQ ID NO: 1430410 - RNA, 13 nt, Homo sapiens
ugcuuaacuggcu

SEQ ID NO: 1430411 - RNA, 12 nt, Homo sapiens
ugcuuacauuuu

SEQ ID NO: 1430412 - RNA, 22 nt, Homo sapiens
ugcuuagaugagggugacuguc

SEQ ID NO: 1430413 - RNA, 22 nt, Homo sapiens
ugcuucaaguguugcucuugga

SEQ ID NO: 1430414 - RNA, 12 nt, Homo sapiens
ugcuucacauaa

SEQ ID NO: 1430415 - RNA, 14 nt, Homo sapiens
ugcuucaugcucag

SEQ ID NO: 1430416 - RNA, 17 nt, Homo sapiens
ugcuuccacuucuaugc

SEQ ID NO: 1430417 - RNA, 22 nt, Homo sapiens
ugcuucuucuacuucagucuuc

SEQ ID NO: 1430418 - RNA, 15 nt, Homo sapiens
ugcuucuugugaaac

SEQ ID NO: 1430419 - RNA, 19 nt, Homo sapiens
ugcuugaauugcaaggcua

SEQ ID NO: 1430420 - RNA, 15 nt, Homo sapiens
ugcuugacuaucaca

SEQ ID NO: 1430421 - RNA, 17 nt, Homo sapiens
ugcuugcccccaugugg

SEQ ID NO: 1430422 - RNA, 17 nt, Homo sapiens
ugcuuuguaugcacuuu

SEQ ID NO: 1430423 - RNA, 21 nt, Homo sapiens
uggaaauacuuuaucugugac

SEQ ID NO: 1430424 - RNA, 12 nt, Homo sapiens
uggaaaucuguu

SEQ ID NO: 1430425 - RNA, 13 nt, Homo sapiens
uggaacagcccau

SEQ ID NO: 1430426 - RNA, 21 nt, Homo sapiens
uggaaccaaucccgugaaaga

SEQ ID NO: 1430427 - RNA, 22 nt, Homo sapiens
uggaagaaggaagaagccagac

SEQ ID NO: 1430428 - RNA, 14 nt, Homo sapiens
uggaagcacauguu

SEQ ID NO: 1430429 - RNA, 16 nt, Homo sapiens
uggaagcccuccuucc

SEQ ID NO: 1430430 - RNA, 17 nt, Homo sapiens
uggaaggcucccuaaca

SEQ ID NO: 1430431 - RNA, 16 nt, Homo sapiens
uggaaggggcaaagaa

SEQ ID NO: 1430432 - RNA, 21 nt, Homo sapiens
uggaauacuugaaaaccucau

SEQ ID NO: 1430433 - RNA, 17 nt, Homo sapiens
uggaauccuacagccuc

SEQ ID NO: 1430434 - RNA, 14 nt, Homo sapiens
uggacagcugcuug

SEQ ID NO: 1430435 - RNA, 17 nt, Homo sapiens
uggaccugcaccaaagc

SEQ ID NO: 1430436 - RNA, 16 nt, Homo sapiens
uggacugaggaccaca

SEQ ID NO: 1430437 - RNA, 22 nt, Homo sapiens
ugucuucagccucuccaggcac

SEQ ID NO: 1430438 - RNA, 12 nt, Homo sapiens
ugugaaaccacu

SEQ ID NO: 1430439 - RNA, 21 nt, Homo sapiens
ugugaaaggaagcuccacugu

SEQ ID NO: 1430440 - RNA, 20 nt, Homo sapiens
ugugaauaaaaacccuguau

SEQ ID NO: 1430441 - RNA, 12 nt, Homo sapiens
ugugagcaagaa

SEQ ID NO: 1430442 - RNA, 17 nt, Homo sapiens
ugugagcagugaguuac

SEQ ID NO: 1430443 - RNA, 20 nt, Homo sapiens
ugugaggaugaaaggaguga

SEQ ID NO: 1430444 - RNA, 15 nt, Homo sapiens
ugugagguaacuggg

SEQ ID NO: 1430445 - RNA, 16 nt, Homo sapiens
ugugaucaucccaucu

SEQ ID NO: 1430446 - RNA, 17 nt, Homo sapiens
ugugcaagucuugucag

SEQ ID NO: 1430447 - RNA, 16 nt, Homo sapiens
ugugcacaaugggcaa

SEQ ID NO: 1430448 - RNA, 23 nt, Homo sapiens
ugugccaaacuaccguucccaaa

SEQ ID NO: 1430449 - RNA, 17 nt, Homo sapiens
ugugccaaagugcauag

SEQ ID NO: 1430450 - RNA, 23 nt, Homo sapiens
ugugcccuugggguaagccagag

SEQ ID NO: 1430451 - RNA, 13 nt, Homo sapiens
aaagcaacaguua

SEQ ID NO: 1430452 - RNA, 22 nt, Homo sapiens
aaagccgguugcagagaaucug

SEQ ID NO: 1430453 - RNA, 20 nt, Homo sapiens
aaagcucuauuaagauuucc

SEQ ID NO: 1430454 - RNA, 13 nt, Homo sapiens
aaagcugccugua

SEQ ID NO: 1430455 - RNA, 22 nt, Homo sapiens
aaagcugcugagaaucuagccu

SEQ ID NO: 1430456 - RNA, 18 nt, Homo sapiens
aaagcuucuaucccagga

SEQ ID NO: 1430457 - RNA, 14 nt, Homo sapiens
aaaggaaaccaaag

SEQ ID NO: 1430458 - RNA, 13 nt, Homo sapiens
aaaggaaucucca

SEQ ID NO: 1430459 - RNA, 22 nt, Homo sapiens
aaaggaccugcauuuuccuaca

SEQ ID NO: 1430460 - RNA, 22 nt, Homo sapiens
aaaggaccuucccaagucuccc

SEQ ID NO: 1430461 - RNA, 15 nt, Homo sapiens
aaaggagccugugaa

SEQ ID NO: 1430462 - RNA, 22 nt, Homo sapiens
aaaggagccugugaacccagga

SEQ ID NO: 1430463 - RNA, 15 nt, Homo sapiens
aaaggauugaucacu

SEQ ID NO: 1430464 - RNA, 24 nt, Homo sapiens
aaaggcaaaaagcauguguuugca

SEQ ID NO: 1430465 - RNA, 21 nt, Homo sapiens
aaaggcuagguacacagcucu

SEQ ID NO: 1430466 - RNA, 14 nt, Homo sapiens
aaaggucauugugg

SEQ ID NO: 1430467 - RNA, 22 nt, Homo sapiens
aaaggugugucaaagauuuuac

SEQ ID NO: 1430468 - RNA, 16 nt, Homo sapiens
aaagguucacucucaa

SEQ ID NO: 1430469 - RNA, 13 nt, Homo sapiens
aaagguucuucau

SEQ ID NO: 1430470 - RNA, 18 nt, Homo sapiens
aaagguucuucaucccuu

SEQ ID NO: 1430471 - RNA, 19 nt, Homo sapiens
aaagguuucaagacuugau

SEQ ID NO: 1430472 - RNA, 18 nt, Homo sapiens
aaaguaaaagaaccacga

SEQ ID NO: 1430473 - RNA, 13 nt, Homo sapiens
aaaguacauaaca

SEQ ID NO: 1430474 - RNA, 14 nt, Homo sapiens
aaaguauauuuucc

SEQ ID NO: 1430475 - RNA, 21 nt, Homo sapiens
aaagucaccacuccauuccca

SEQ ID NO: 1430476 - RNA, 22 nt, Homo sapiens
aaagucaccacuccauucccaa

SEQ ID NO: 1430477 - RNA, 19 nt, Homo sapiens
aaagucagggagccuggaa

SEQ ID NO: 1430478 - RNA, 14 nt, Homo sapiens
aaagugacauuugu

SEQ ID NO: 1430479 - RNA, 14 nt, Homo sapiens
aaagugacuaccag

SEQ ID NO: 1430480 - RNA, 22 nt, Homo sapiens
aaagugcaaguggaugcauucc

SEQ ID NO: 1430481 - RNA, 19 nt, Homo sapiens
aaagugcuaguauuauggg

SEQ ID NO: 1430482 - RNA, 21 nt, Homo sapiens
aaaguggcucuucuaaccuca

SEQ ID NO: 1430483 - RNA, 17 nt, Homo sapiens
aaagugguucuggauau

SEQ ID NO: 1430484 - RNA, 13 nt, Homo sapiens
aaaguguggaagc

SEQ ID NO: 1430485 - RNA, 15 nt, Homo sapiens
aacauauuugcacaa

SEQ ID NO: 1430486 - RNA, 20 nt, Homo sapiens
aacaucacugaaaugcuagc

SEQ ID NO: 1430487 - RNA, 22 nt, Homo sapiens
aacaucaucaggcuuggaauga

SEQ ID NO: 1430488 - RNA, 15 nt, Homo sapiens
aacaucccacagugg

SEQ ID NO: 1430489 - RNA, 16 nt, Homo sapiens
aacaugaaacuuguca

SEQ ID NO: 1430490 - RNA, 15 nt, Homo sapiens
aacaugaauuauuuc

SEQ ID NO: 1430491 - RNA, 14 nt, Homo sapiens
aacaugcacgguga

SEQ ID NO: 1430492 - RNA, 16 nt, Homo sapiens
aacaugccauaucuca

SEQ ID NO: 1430493 - RNA, 20 nt, Homo sapiens
aacaugcuaaauaguucuau

SEQ ID NO: 1430494 - RNA, 13 nt, Homo sapiens
aacaugcuuuaga

SEQ ID NO: 1430495 - RNA, 14 nt, Homo sapiens
aacauuaugccuua

SEQ ID NO: 1430496 - RNA, 20 nt, Homo sapiens
aacauucacacagggcucuu

SEQ ID NO: 1430497 - RNA, 16 nt, Homo sapiens
aacauuccaaugcauu

SEQ ID NO: 1430498 - RNA, 15 nt, Homo sapiens
aacauugacuucuug

SEQ ID NO: 1430499 - RNA, 13 nt, Homo sapiens
aacauuuauuuca

SEQ ID NO: 1430500 - RNA, 21 nt, Homo sapiens
aacauuuggauuggugaaugg

SEQ ID NO: 1430501 - RNA, 16 nt, Homo sapiens
aaccaaagagacugga

SEQ ID NO: 1430502 - RNA, 19 nt, Homo sapiens
aaccaaaugcugucuccau

SEQ ID NO: 1430503 - RNA, 19 nt, Homo sapiens
aaccaaguggcucccacac

SEQ ID NO: 1430504 - RNA, 12 nt, Homo sapiens
aaccaaugagcu

SEQ ID NO: 1430505 - RNA, 15 nt, Homo sapiens
aaccacaaaccaccc

SEQ ID NO: 1430506 - RNA, 15 nt, Homo sapiens
aaccacaacugacac

SEQ ID NO: 1430507 - RNA, 15 nt, Homo sapiens
aaccacacuucuuga

SEQ ID NO: 1430508 - RNA, 15 nt, Homo sapiens
aaccacuguacauau

SEQ ID NO: 1430509 - RNA, 15 nt, Homo sapiens
aaccaggaacaugua

SEQ ID NO: 1430510 - RNA, 22 nt, Homo sapiens
aaccaguaagguuauaacugug

SEQ ID NO: 1430511 - RNA, 22 nt, Homo sapiens
aaccauaguuauuuacuugaaa

SEQ ID NO: 1430512 - RNA, 13 nt, Homo sapiens
aaccaucccugau

SEQ ID NO: 1430513 - RNA, 22 nt, Homo sapiens
aaccaugcauggugcaucagca

SEQ ID NO: 1430514 - RNA, 13 nt, Homo sapiens
aacccaaccucau

SEQ ID NO: 1430515 - RNA, 12 nt, Homo sapiens
aacccaccaucu

SEQ ID NO: 1430516 - RNA, 14 nt, Homo sapiens
aacccagcauguac

SEQ ID NO: 1430517 - RNA, 20 nt, Homo sapiens
aacccaggaggcggagguug

SEQ ID NO: 1430518 - RNA, 15 nt, Homo sapiens
aacccaguauaugcu

SEQ ID NO: 1430519 - RNA, 21 nt, Homo sapiens
aacccauuaggcaugccuaau

SEQ ID NO: 1430520 - RNA, 18 nt, Homo sapiens
aacccccgacuucauccc

SEQ ID NO: 1430521 - RNA, 17 nt, Homo sapiens
aacccccgcuccagauc

SEQ ID NO: 1430522 - RNA, 17 nt, Homo sapiens
aacccccuuacugugcg

SEQ ID NO: 1430523 - RNA, 22 nt, Homo sapiens
aacccgagaaaacaaacccagg

SEQ ID NO: 1430524 - RNA, 18 nt, Homo sapiens
aacccuuuuccuccagac

SEQ ID NO: 1430525 - RNA, 14 nt, Homo sapiens
aaccgcuugccaua

SEQ ID NO: 1430526 - RNA, 19 nt, Homo sapiens
aaccgcuugccauauuccg

SEQ ID NO: 1430527 - RNA, 13 nt, Homo sapiens
aaccuacuagaca

SEQ ID NO: 1430528 - RNA, 22 nt, Homo sapiens
aaccuacuagacaaugauguga

SEQ ID NO: 1430529 - RNA, 21 nt, Homo sapiens
aaccucaucuacaagcauuug

SEQ ID NO: 1430530 - RNA, 16 nt, Homo sapiens
aaccugaauuauucca

SEQ ID NO: 1430531 - RNA, 21 nt, Homo sapiens
aaccugaugccccuuccccaa

SEQ ID NO: 1430532 - RNA, 18 nt, Homo sapiens
aaccugcccacccacucc

SEQ ID NO: 1430533 - RNA, 21 nt, Homo sapiens
aaccuggagagcuagaaccua

SEQ ID NO: 1430534 - RNA, 14 nt, Homo sapiens
aaccuggagaugau

SEQ ID NO: 1430535 - RNA, 21 nt, Homo sapiens
aaccuggagggcuagaaccua

SEQ ID NO: 1430536 - RNA, 23 nt, Homo sapiens
aaccuggagggcuagaaccugga

SEQ ID NO: 1430537 - RNA, 18 nt, Homo sapiens
aaccuggaguauaauauu

SEQ ID NO: 1430538 - RNA, 19 nt, Homo sapiens
aaccugguggcaccagaug

SEQ ID NO: 1430539 - RNA, 11 nt, Homo sapiens
aaccuuucaaa

SEQ ID NO: 1430540 - RNA, 15 nt, Homo sapiens
aaccuuuccccagac

SEQ ID NO: 1430541 - RNA, 15 nt, Homo sapiens
aacgauauguagcag

SEQ ID NO: 1430542 - RNA, 20 nt, Homo sapiens
aacgccugagcccagggagg

SEQ ID NO: 1430543 - RNA, 14 nt, Homo sapiens
aacuaaaagcauag

SEQ ID NO: 1430544 - RNA, 18 nt, Homo sapiens
aacuaaaguuuacagucu

SEQ ID NO: 1430545 - RNA, 17 nt, Homo sapiens
aacuaagacauaugcau

SEQ ID NO: 1430546 - RNA, 17 nt, Homo sapiens
aacuaauaaaagcauaa

SEQ ID NO: 1430547 - RNA, 21 nt, Homo sapiens
aacuacagaguuuaugauuua

SEQ ID NO: 1430548 - RNA, 22 nt, Homo sapiens
aacuacagaguuuaugauuuaa

SEQ ID NO: 1430549 - RNA, 16 nt, Homo sapiens
aacuacauguaaucca

SEQ ID NO: 1430550 - RNA, 20 nt, Homo sapiens
aacuacuaaagugccuaccc

SEQ ID NO: 1430551 - RNA, 13 nt, Homo sapiens
aacuacugugauc

SEQ ID NO: 1430552 - RNA, 16 nt, Homo sapiens
aacuaguguugcuugg

SEQ ID NO: 1430553 - RNA, 21 nt, Homo sapiens
aacuaugaucacagugacuuu

SEQ ID NO: 1430554 - RNA, 17 nt, Homo sapiens
aacuauuacaccaaaua

SEQ ID NO: 1430555 - RNA, 17 nt, Homo sapiens
aacuauuuauugaauga

SEQ ID NO: 1430556 - RNA, 16 nt, Homo sapiens
aacuauuuauuucacc

SEQ ID NO: 1430557 - RNA, 15 nt, Homo sapiens
aacucacugcucaag

SEQ ID NO: 1430558 - RNA, 21 nt, Homo sapiens
aacucagaaugcucuacuucu

SEQ ID NO: 1430559 - RNA, 18 nt, Homo sapiens
aacucauuacuuuuccau

SEQ ID NO: 1430560 - RNA, 13 nt, Homo sapiens
aacuccagucucc

SEQ ID NO: 1430561 - RNA, 18 nt, Homo sapiens
aacuccccuuguacucuu

SEQ ID NO: 1430562 - RNA, 15 nt, Homo sapiens
aacuccuccuugccu

SEQ ID NO: 1430563 - RNA, 18 nt, Homo sapiens
aacuccuggagauuucag

SEQ ID NO: 1430564 - RNA, 18 nt, Homo sapiens
aacuccugguucagccau

SEQ ID NO: 1430565 - RNA, 15 nt, Homo sapiens
aacucuccacuccau

SEQ ID NO: 1430566 - RNA, 18 nt, Homo sapiens
aacucugacaagggcuga

SEQ ID NO: 1430567 - RNA, 10 nt, Homo sapiens
aacugacaca

SEQ ID NO: 1430568 - RNA, 14 nt, Homo sapiens
aacugacacaggaa

SEQ ID NO: 1430569 - RNA, 20 nt, Homo sapiens
aacugaccagccuccaugcu

SEQ ID NO: 1430570 - RNA, 18 nt, Homo sapiens
aacugacuuaaguggcau

SEQ ID NO: 1430571 - RNA, 13 nt, Homo sapiens
aacugagagcaga

SEQ ID NO: 1430572 - RNA, 22 nt, Homo sapiens
accugccuuaacacacacaccu

SEQ ID NO: 1430573 - RNA, 22 nt, Homo sapiens
accuggagaacuagaaccugga

SEQ ID NO: 1430574 - RNA, 22 nt, Homo sapiens
accuggagggcuagaaccugga

SEQ ID NO: 1430575 - RNA, 13 nt, Homo sapiens
accuguacucugg

SEQ ID NO: 1430576 - RNA, 16 nt, Homo sapiens
accuguauuuugccag

SEQ ID NO: 1430577 - RNA, 19 nt, Homo sapiens
accuguggugauguugcca

SEQ ID NO: 1430578 - RNA, 15 nt, Homo sapiens
accuguguucuugcu

SEQ ID NO: 1430579 - RNA, 13 nt, Homo sapiens
accuguuacuuga

SEQ ID NO: 1430580 - RNA, 15 nt, Homo sapiens
accuguuacuugaaa

SEQ ID NO: 1430581 - RNA, 14 nt, Homo sapiens
accuuagaaaucau

SEQ ID NO: 1430582 - RNA, 15 nt, Homo sapiens
accuuaguggcuuuu

SEQ ID NO: 1430583 - RNA, 17 nt, Homo sapiens
accuucaccuucaucca

SEQ ID NO: 1430584 - RNA, 18 nt, Homo sapiens
accuucccucuuucuaca

SEQ ID NO: 1430585 - RNA, 13 nt, Homo sapiens
accuugcaucuca

SEQ ID NO: 1430586 - RNA, 20 nt, Homo sapiens
accuugcucagccaucccgu

SEQ ID NO: 1430587 - RNA, 17 nt, Homo sapiens
accuugcuccuccuucu

SEQ ID NO: 1430588 - RNA, 15 nt, Homo sapiens
accuuggacuccucc

SEQ ID NO: 1430589 - RNA, 18 nt, Homo sapiens
accuuggacuccucccac

SEQ ID NO: 1430590 - RNA, 14 nt, Homo sapiens
accuuggagccuga

SEQ ID NO: 1430591 - RNA, 19 nt, Homo sapiens
accuuuacauaauugcaau

SEQ ID NO: 1430592 - RNA, 20 nt, Homo sapiens
accuuuugucucacacagca

SEQ ID NO: 1430593 - RNA, 15 nt, Homo sapiens
acgaaacacaaacca

SEQ ID NO: 1430594 - RNA, 15 nt, Homo sapiens
acgaacccaccugcu

SEQ ID NO: 1430595 - RNA, 22 nt, Homo sapiens
acgaacgcucuuagcuuucuca

SEQ ID NO: 1430596 - RNA, 13 nt, Homo sapiens
acgaaggggcccc

SEQ ID NO: 1430597 - RNA, 20 nt, Homo sapiens
acgaccgggagguccaccug

SEQ ID NO: 1430598 - RNA, 11 nt, Homo sapiens
acgacucuucc

SEQ ID NO: 1430599 - RNA, 16 nt, Homo sapiens
acgagagagucuucca

SEQ ID NO: 1430600 - RNA, 14 nt, Homo sapiens
acgagauaauguau

SEQ ID NO: 1430601 - RNA, 17 nt, Homo sapiens
acgagggauaauucaaa

SEQ ID NO: 1430602 - RNA, 20 nt, Homo sapiens
acgaugaaauugaaccuggu

SEQ ID NO: 1430603 - RNA, 22 nt, Homo sapiens
acgcaaacacaccgaugcacac

SEQ ID NO: 1430604 - RNA, 17 nt, Homo sapiens
acgcacaugccaaugca

SEQ ID NO: 1430605 - RNA, 20 nt, Homo sapiens
aaaacucauuacuuuuccau

SEQ ID NO: 1430606 - RNA, 23 nt, Homo sapiens
aaaacugaucaaaaauaaacuag

SEQ ID NO: 1430607 - RNA, 22 nt, Homo sapiens
aaaagcaagacuguugcucaaa

SEQ ID NO: 1430608 - RNA, 15 nt, Homo sapiens
aaaagcaguggggac

SEQ ID NO: 1430609 - RNA, 14 nt, Homo sapiens
aaaagccacauaga

SEQ ID NO: 1430610 - RNA, 22 nt, Homo sapiens
aaaagccuccgguuuccacuac

SEQ ID NO: 1430611 - RNA, 16 nt, Homo sapiens
aaaagcuacaguuuug

SEQ ID NO: 1430612 - RNA, 10 nt, Homo sapiens
aaaagcuuuu

SEQ ID NO: 1430613 - RNA, 17 nt, Homo sapiens
aaaaggcauaugcaaua

SEQ ID NO: 1430614 - RNA, 13 nt, Homo sapiens
aaaagucagucuu

SEQ ID NO: 1430615 - RNA, 16 nt, Homo sapiens
aaaaguugcagucuca

SEQ ID NO: 1430616 - RNA, 12 nt, Homo sapiens
aaaauacuacac

SEQ ID NO: 1430617 - RNA, 13 nt, Homo sapiens
aaaauacuacaca

SEQ ID NO: 1430618 - RNA, 14 nt, Homo sapiens
aaaauauaaaugca

SEQ ID NO: 1430619 - RNA, 16 nt, Homo sapiens
aaaauauaaccauuac

SEQ ID NO: 1430620 - RNA, 13 nt, Homo sapiens
aaaauauucugua

SEQ ID NO: 1430621 - RNA, 22 nt, Homo sapiens
aaaaugaaaauuaggauuucau

SEQ ID NO: 1430622 - RNA, 20 nt, Homo sapiens
aaaaugaaaugacugucuaa

SEQ ID NO: 1430623 - RNA, 17 nt, Homo sapiens
aaaaugaauugucuuca

SEQ ID NO: 1430624 - RNA, 18 nt, Homo sapiens
aaaaugguaauuguugcu

SEQ ID NO: 1430625 - RNA, 17 nt, Homo sapiens
aaaaugucagucugguu

SEQ ID NO: 1430626 - RNA, 15 nt, Homo sapiens
aaaauuauacucaaa

SEQ ID NO: 1430627 - RNA, 15 nt, Homo sapiens
aaaauucuuggaaua

SEQ ID NO: 1430628 - RNA, 20 nt, Homo sapiens
aaaauucuugggaguguugu

SEQ ID NO: 1430629 - RNA, 19 nt, Homo sapiens
aaaauuucaaaagugaucu

SEQ ID NO: 1430630 - RNA, 18 nt, Homo sapiens
aaaauuuguuuugacgga

SEQ ID NO: 1430631 - RNA, 14 nt, Homo sapiens
aaacaaaucuucaa

SEQ ID NO: 1430632 - RNA, 14 nt, Homo sapiens
aaacacacuguaaa

SEQ ID NO: 1430633 - RNA, 11 nt, Homo sapiens
aaacacagccu

SEQ ID NO: 1430634 - RNA, 20 nt, Homo sapiens
aaacacccaugaaucaaaga

SEQ ID NO: 1430635 - RNA, 15 nt, Homo sapiens
aaacacgugucuaua

SEQ ID NO: 1430636 - RNA, 11 nt, Homo sapiens
aaacacuccac

SEQ ID NO: 1430637 - RNA, 12 nt, Homo sapiens
aaacacuguaau

SEQ ID NO: 1430638 - RNA, 15 nt, Homo sapiens
acgcacccccacugc

SEQ ID NO: 1430639 - RNA, 17 nt, Homo sapiens
acgcagacacugagauc

SEQ ID NO: 1430640 - RNA, 11 nt, Homo sapiens
acgcagaucac

SEQ ID NO: 1430641 - RNA, 16 nt, Homo sapiens
acgccaaugcacacac

SEQ ID NO: 1430642 - RNA, 21 nt, Homo sapiens
acgccaaugcacacacacaga

SEQ ID NO: 1430643 - RNA, 17 nt, Homo sapiens
acgccucuuuucccucu

SEQ ID NO: 1430644 - RNA, 18 nt, Homo sapiens
acgccuguaaucccagca

SEQ ID NO: 1430645 - RNA, 20 nt, Homo sapiens
acgcuuuuugggagaaugau

SEQ ID NO: 1430646 - RNA, 21 nt, Homo sapiens
acggaaggcaaagagaccacu

SEQ ID NO: 1430647 - RNA, 19 nt, Homo sapiens
acggaaggucaguugccau

SEQ ID NO: 1430648 - RNA, 12 nt, Homo sapiens
acggaugcacag

SEQ ID NO: 1430649 - RNA, 13 nt, Homo sapiens
acggggacugggg

SEQ ID NO: 1430650 - RNA, 23 nt, Homo sapiens
acgggguuucaccacauucguca

SEQ ID NO: 1430651 - RNA, 16 nt, Homo sapiens
acgucaaacaugaagu

SEQ ID NO: 1430652 - RNA, 17 nt, Homo sapiens
acgugaagccacaggag

SEQ ID NO: 1430653 - RNA, 14 nt, Homo sapiens
acgugagccaggua

SEQ ID NO: 1430654 - RNA, 17 nt, Homo sapiens
acgugccugugauccca

SEQ ID NO: 1430655 - RNA, 18 nt, Homo sapiens
acgugcucuucuguucuc

SEQ ID NO: 1430656 - RNA, 14 nt, Homo sapiens
acuaaaaaucauga

SEQ ID NO: 1430657 - RNA, 12 nt, Homo sapiens
acuaaaagaauu

SEQ ID NO: 1430658 - RNA, 18 nt, Homo sapiens
acuaaacagacuauuuaa

SEQ ID NO: 1430659 - RNA, 21 nt, Homo sapiens
acuaaccccaacgcacaggaa

SEQ ID NO: 1430660 - RNA, 13 nt, Homo sapiens
acuaagaggcuau

SEQ ID NO: 1430661 - RNA, 22 nt, Homo sapiens
acuaauaaaugccaacugguca

SEQ ID NO: 1430662 - RNA, 17 nt, Homo sapiens
acuaauagagacacaga

SEQ ID NO: 1430663 - RNA, 17 nt, Homo sapiens
acuaauauccugucucu

SEQ ID NO: 1430664 - RNA, 15 nt, Homo sapiens
acuaaugaagauacg

SEQ ID NO: 1430665 - RNA, 15 nt, Homo sapiens
acuaaugcuaagaaa

SEQ ID NO: 1430666 - RNA, 10 nt, Homo sapiens
acuacagggu

SEQ ID NO: 1430667 - RNA, 17 nt, Homo sapiens
acuacaggugcaagcca

SEQ ID NO: 1430668 - RNA, 18 nt, Homo sapiens
acuacaggugcaagccac

SEQ ID NO: 1430669 - RNA, 22 nt, Homo sapiens
acuacccgagcccagcuacauu

SEQ ID NO: 1430670 - RNA, 19 nt, Homo sapiens
acuacucagcucuccugcu

SEQ ID NO: 1430671 - RNA, 16 nt, Homo sapiens
acuacucuacuuccuc

SEQ ID NO: 1430672 - RNA, 16 nt, Homo sapiens
acuacuuuuacuacag

SEQ ID NO: 1430673 - RNA, 15 nt, Homo sapiens
acuagaauagugcau

SEQ ID NO: 1430674 - RNA, 15 nt, Homo sapiens
acuagccugugauua

SEQ ID NO: 1430675 - RNA, 12 nt, Homo sapiens
acuaguaacaug

SEQ ID NO: 1430676 - RNA, 23 nt, Homo sapiens
acuagucauagaaauaccucauu

SEQ ID NO: 1430677 - RNA, 12 nt, Homo sapiens
acuaguuuccag

SEQ ID NO: 1430678 - RNA, 14 nt, Homo sapiens
acuauaaacuacug

SEQ ID NO: 1430679 - RNA, 17 nt, Homo sapiens
acuauaaacuacuguaa

SEQ ID NO: 1430680 - RNA, 22 nt, Homo sapiens
acuauaaauaauauucuauuca

SEQ ID NO: 1430681 - RNA, 13 nt, Homo sapiens
acuauacaacaau

SEQ ID NO: 1430682 - RNA, 15 nt, Homo sapiens
acuauccucacuccc

SEQ ID NO: 1430683 - RNA, 23 nt, Homo sapiens
acuaucucuagagugagaaucug

SEQ ID NO: 1430684 - RNA, 13 nt, Homo sapiens
acuaugaucacag

SEQ ID NO: 1430685 - RNA, 16 nt, Homo sapiens
acuaugaucacaguga

SEQ ID NO: 1430686 - RNA, 15 nt, Homo sapiens
acuauguccagcuag

SEQ ID NO: 1430687 - RNA, 17 nt, Homo sapiens
acuauuaagagcaauaa

SEQ ID NO: 1430688 - RNA, 12 nt, Homo sapiens
acucaaacaauc

SEQ ID NO: 1430689 - RNA, 20 nt, Homo sapiens
acucaaacaaucaugaguca

SEQ ID NO: 1430690 - RNA, 23 nt, Homo sapiens
acucaccaguguccccuccacug

SEQ ID NO: 1430691 - RNA, 11 nt, Homo sapiens
acucacuccag

SEQ ID NO: 1430692 - RNA, 21 nt, Homo sapiens
acucacuccagcccaacagaa

SEQ ID NO: 1430693 - RNA, 18 nt, Homo sapiens
acuugucuuacauaauca

SEQ ID NO: 1430694 - RNA, 16 nt, Homo sapiens
acuugugccagcagaa

SEQ ID NO: 1430695 - RNA, 22 nt, Homo sapiens
acuuuaaaaaaaucauaugcua

SEQ ID NO: 1430696 - RNA, 19 nt, Homo sapiens
acuuuaaauucaagcugcu

SEQ ID NO: 1430697 - RNA, 14 nt, Homo sapiens
acuuuaacugacuu

SEQ ID NO: 1430698 - RNA, 14 nt, Homo sapiens
acuuuaauucucau

SEQ ID NO: 1430699 - RNA, 15 nt, Homo sapiens
acuuuaccacuaugc

SEQ ID NO: 1430700 - RNA, 17 nt, Homo sapiens
acuuuaccacuaugcaa

SEQ ID NO: 1430701 - RNA, 21 nt, Homo sapiens
acuuuaggaggaggugggggc

SEQ ID NO: 1430702 - RNA, 15 nt, Homo sapiens
acuuuauguauggag

SEQ ID NO: 1430703 - RNA, 20 nt, Homo sapiens
acuuucagguacuaaauacc

SEQ ID NO: 1430704 - RNA, 23 nt, Homo sapiens
acuuucccagaaaaaaaaaaacu

SEQ ID NO: 1430705 - RNA, 22 nt, Homo sapiens
acuuuccuauuuucuuuuccau

SEQ ID NO: 1430706 - RNA, 17 nt, Homo sapiens
acuuugaucucugcuua

SEQ ID NO: 1430707 - RNA, 17 nt, Homo sapiens
acuuugggaggccaagg

SEQ ID NO: 1430708 - RNA, 14 nt, Homo sapiens
acuuugggcccaga

SEQ ID NO: 1430709 - RNA, 19 nt, Homo sapiens
acuuuguauuaauguguua

SEQ ID NO: 1430710 - RNA, 17 nt, Homo sapiens
acuuuuacuacagugac

SEQ ID NO: 1430711 - RNA, 21 nt, Homo sapiens
acuuuucuuuauugcugugaa

SEQ ID NO: 1430712 - RNA, 17 nt, Homo sapiens
acuuuugaaaagcuuuu

SEQ ID NO: 1430713 - RNA, 17 nt, Homo sapiens
acuuuuuagccagugac

SEQ ID NO: 1430714 - RNA, 22 nt, Homo sapiens
acuuuuucagaguugcuuuaaa

SEQ ID NO: 1430715 - RNA, 17 nt, Homo sapiens
agaaaaaacuagagccu

SEQ ID NO: 1430716 - RNA, 12 nt, Homo sapiens
agaaaaaaucug

SEQ ID NO: 1430717 - RNA, 14 nt, Homo sapiens
agaaaaagagccau

SEQ ID NO: 1430718 - RNA, 19 nt, Homo sapiens
agaaaaaguugcagucuca

SEQ ID NO: 1430719 - RNA, 15 nt, Homo sapiens
agaaaaccauuuuag

SEQ ID NO: 1430720 - RNA, 12 nt, Homo sapiens
agaaaagccaga

SEQ ID NO: 1430721 - RNA, 18 nt, Homo sapiens
agaaaagugaaugcucaa

SEQ ID NO: 1430722 - RNA, 18 nt, Homo sapiens
agaaaaucaguaauugga

SEQ ID NO: 1430723 - RNA, 22 nt, Homo sapiens
agaaaaugaagcccuauuacuu

SEQ ID NO: 1430724 - RNA, 16 nt, Homo sapiens
agaaaauuggauguuu

SEQ ID NO: 1430725 - RNA, 12 nt, Homo sapiens
agaaacacucaa

SEQ ID NO: 1430726 - RNA, 19 nt, Homo sapiens
agaaacaugacacugaccu

SEQ ID NO: 1430727 - RNA, 20 nt, Homo sapiens
agaaaccaagagaaguuuug

SEQ ID NO: 1430728 - RNA, 19 nt, Homo sapiens
agaaaccaagucuacuuca

SEQ ID NO: 1430729 - RNA, 12 nt, Homo sapiens
agaaacccaagu

SEQ ID NO: 1430730 - RNA, 12 nt, Homo sapiens
agaaacugagaa

SEQ ID NO: 1430731 - RNA, 19 nt, Homo sapiens
agaaacugaggccauuauu

SEQ ID NO: 1430732 - RNA, 16 nt, Homo sapiens
agaaagaaacacucaa

SEQ ID NO: 1430733 - RNA, 14 nt, Homo sapiens
agaaagacuauuca

SEQ ID NO: 1430734 - RNA, 12 nt, Homo sapiens
agaaagacugga

SEQ ID NO: 1430735 - RNA, 19 nt, Homo sapiens
agaaagcucugcaugugug

SEQ ID NO: 1430736 - RNA, 20 nt, Homo sapiens
agaaagggagggcucugagg

SEQ ID NO: 1430737 - RNA, 17 nt, Homo sapiens
agaaaucagcacauucc

SEQ ID NO: 1430738 - RNA, 17 nt, Homo sapiens
agaaaucuuuauucuua

SEQ ID NO: 1430739 - RNA, 13 nt, Homo sapiens
agaaaugcugaaa

SEQ ID NO: 1430740 - RNA, 21 nt, Homo sapiens
agaaaugcuuuccaaaaccgc

SEQ ID NO: 1430741 - RNA, 19 nt, Homo sapiens
agaaauuccuguagcaucu

SEQ ID NO: 1430742 - RNA, 15 nt, Homo sapiens
agaacaacuacugug

SEQ ID NO: 1430743 - RNA, 16 nt, Homo sapiens
agaacaacuacuguga

SEQ ID NO: 1430744 - RNA, 15 nt, Homo sapiens
agaacaaugcuauaa

SEQ ID NO: 1430745 - RNA, 15 nt, Homo sapiens
agaacaggcaaguga

SEQ ID NO: 1430746 - RNA, 20 nt, Homo sapiens
agaaccaaaaguuuuccuga

SEQ ID NO: 1430747 - RNA, 14 nt, Homo sapiens
agaaccaagcuuca

SEQ ID NO: 1430748 - RNA, 14 nt, Homo sapiens
agaaccacacuguu

SEQ ID NO: 1430749 - RNA, 15 nt, Homo sapiens
agaaccacuuggcug

SEQ ID NO: 1430750 - RNA, 13 nt, Homo sapiens
agaaccuagaagg

SEQ ID NO: 1430751 - RNA, 23 nt, Homo sapiens
agaaccuggagggcuagaaccua

SEQ ID NO: 1430752 - RNA, 21 nt, Homo sapiens
agaagaaaaaguugcagucuc

SEQ ID NO: 1430753 - RNA, 17 nt, Homo sapiens
agaagaacauccaagga

SEQ ID NO: 1430754 - RNA, 21 nt, Homo sapiens
agaagaaguuuaaaaaaccau

SEQ ID NO: 1430755 - RNA, 12 nt, Homo sapiens
agaagacugggc

SEQ ID NO: 1430756 - RNA, 23 nt, Homo sapiens
agaagaguuucuccuuuugacca

SEQ ID NO: 1430757 - RNA, 21 nt, Homo sapiens
agaagauaauguucuuuaaug

SEQ ID NO: 1430758 - RNA, 19 nt, Homo sapiens
agaagcaucaccaugcaug

SEQ ID NO: 1430759 - RNA, 11 nt, Homo sapiens
agaagccagac

SEQ ID NO: 1430760 - RNA, 18 nt, Homo sapiens
agaaggaguucugacauu

SEQ ID NO: 1430761 - RNA, 13 nt, Homo sapiens
agaaguaggcaug

SEQ ID NO: 1430762 - RNA, 23 nt, Homo sapiens
agaaguccccaggucaugcugcu

SEQ ID NO: 1430763 - RNA, 15 nt, Homo sapiens
agaauacaagccacu

SEQ ID NO: 1430764 - RNA, 20 nt, Homo sapiens
agaauccugccucuccccaa

SEQ ID NO: 1430765 - RNA, 14 nt, Homo sapiens
agaaucgcuuaaac

SEQ ID NO: 1430766 - RNA, 12 nt, Homo sapiens
agaaugcaugua

SEQ ID NO: 1430767 - RNA, 22 nt, Homo sapiens
agaauggggguggggaggcaag

SEQ ID NO: 1430768 - RNA, 22 nt, Homo sapiens
agaauuccugaagccagaucca

SEQ ID NO: 1430769 - RNA, 23 nt, Homo sapiens
agaauuccuuuucuaacucuccc

SEQ ID NO: 1430770 - RNA, 18 nt, Homo sapiens
agacaaguaaucacuaac

SEQ ID NO: 1430771 - RNA, 12 nt, Homo sapiens
agacaauggcca

SEQ ID NO: 1430772 - RNA, 22 nt, Homo sapiens
agacacauuaaaggguagccua

SEQ ID NO: 1430773 - RNA, 15 nt, Homo sapiens
agacaccugccuuaa

SEQ ID NO: 1430774 - RNA, 14 nt, Homo sapiens
agacagaaugucac

SEQ ID NO: 1430775 - RNA, 21 nt, Homo sapiens
agacagcacuacagauaucau

SEQ ID NO: 1430776 - RNA, 19 nt, Homo sapiens
agacaggucuagacuuucu

SEQ ID NO: 1430777 - RNA, 19 nt, Homo sapiens
agacauacgaaacacaaac

SEQ ID NO: 1430778 - RNA, 22 nt, Homo sapiens
auccucaacaacaaaccaaaac

SEQ ID NO: 1430779 - RNA, 18 nt, Homo sapiens
auccucacaggagcagac

SEQ ID NO: 1430780 - RNA, 15 nt, Homo sapiens
auccucauuacccag

SEQ ID NO: 1430781 - RNA, 15 nt, Homo sapiens
auccuccugccucag

SEQ ID NO: 1430782 - RNA, 18 nt, Homo sapiens
auccugacaccaccaucu

SEQ ID NO: 1430783 - RNA, 16 nt, Homo sapiens
auccugcuagcuguag

SEQ ID NO: 1430784 - RNA, 21 nt, Homo sapiens
auccuggccaacauggugaaa

SEQ ID NO: 1430785 - RNA, 14 nt, Homo sapiens
auccuuuaucaaga

SEQ ID NO: 1430786 - RNA, 14 nt, Homo sapiens
augauaaugaaacu

SEQ ID NO: 1430787 - RNA, 20 nt, Homo sapiens
augauacaccuacuacucaa

SEQ ID NO: 1430788 - RNA, 19 nt, Homo sapiens
augaucgagccacugcacu

SEQ ID NO: 1430789 - RNA, 13 nt, Homo sapiens
augaucucccugc

SEQ ID NO: 1430790 - RNA, 14 nt, Homo sapiens
augaugaugaucuu

SEQ ID NO: 1430791 - RNA, 17 nt, Homo sapiens
augauggugcugaccuc

SEQ ID NO: 1430792 - RNA, 15 nt, Homo sapiens
augauuccuugagca

SEQ ID NO: 1430793 - RNA, 18 nt, Homo sapiens
augauuuagggaagcagg

SEQ ID NO: 1430794 - RNA, 20 nt, Homo sapiens
augauuuuuaaaaguugcua

SEQ ID NO: 1430795 - RNA, 20 nt, Homo sapiens
augcaaaugccuccaagcca

SEQ ID NO: 1430796 - RNA, 23 nt, Homo sapiens
augcaagugcuaugccaagccau

SEQ ID NO: 1430797 - RNA, 16 nt, Homo sapiens
augcaauaaugugcaa

SEQ ID NO: 1430798 - RNA, 14 nt, Homo sapiens
augcacacaaacac

SEQ ID NO: 1430799 - RNA, 15 nt, Homo sapiens
augcacacacagaug

SEQ ID NO: 1430800 - RNA, 16 nt, Homo sapiens
augcacacacagaugc

SEQ ID NO: 1430801 - RNA, 16 nt, Homo sapiens
augcacacacauggau

SEQ ID NO: 1430802 - RNA, 17 nt, Homo sapiens
augcacacacauggaug

SEQ ID NO: 1430803 - RNA, 22 nt, Homo sapiens
augcacacacauggaugagcac

SEQ ID NO: 1430804 - RNA, 19 nt, Homo sapiens
augcacagagauaugcaca

SEQ ID NO: 1430805 - RNA, 15 nt, Homo sapiens
augcagaggggugcu

SEQ ID NO: 1430806 - RNA, 19 nt, Homo sapiens
augcagaggggugcugcuc

SEQ ID NO: 1430807 - RNA, 17 nt, Homo sapiens
augcaguccagaauaag

SEQ ID NO: 1430808 - RNA, 13 nt, Homo sapiens
augcaucaucagc

SEQ ID NO: 1430809 - RNA, 14 nt, Homo sapiens
augcauggugcauc

SEQ ID NO: 1430810 - RNA, 15 nt, Homo sapiens
augcauugcuaaaau

SEQ ID NO: 1430811 - RNA, 19 nt, Homo sapiens
augcauuuuuaauaugaca

SEQ ID NO: 1430812 - RNA, 17 nt, Homo sapiens
augccacugcuuuccag

SEQ ID NO: 1430813 - RNA, 15 nt, Homo sapiens
augccauagcaagau

SEQ ID NO: 1430814 - RNA, 23 nt, Homo sapiens
augccauagcaagauugcuuaaa

SEQ ID NO: 1430815 - RNA, 20 nt, Homo sapiens
augccuauguacucuacgcc

SEQ ID NO: 1430816 - RNA, 23 nt, Homo sapiens
augccuauguacucuacgccaaa

SEQ ID NO: 1430817 - RNA, 12 nt, Homo sapiens
augccucugagg

SEQ ID NO: 1430818 - RNA, 20 nt, Homo sapiens
augcuaaauaguucuaucag

SEQ ID NO: 1430819 - RNA, 22 nt, Homo sapiens
augcucagcccugacuggugcu

SEQ ID NO: 1430820 - RNA, 19 nt, Homo sapiens
augcucugccccaagcccc

SEQ ID NO: 1430821 - RNA, 15 nt, Homo sapiens
augcuguugccucau

SEQ ID NO: 1430822 - RNA, 22 nt, Homo sapiens
augcuuaccaaguccugggaau

SEQ ID NO: 1430823 - RNA, 20 nt, Homo sapiens
augcuucacaucucuucacu

SEQ ID NO: 1430824 - RNA, 22 nt, Homo sapiens
augcuucccuuguauccaguga

SEQ ID NO: 1430825 - RNA, 22 nt, Homo sapiens
augcuugugauuuuugaacaau

SEQ ID NO: 1430826 - RNA, 20 nt, Homo sapiens
auggaaagaaucuaauagag

SEQ ID NO: 1430827 - RNA, 15 nt, Homo sapiens
auggaauaaaccauu

SEQ ID NO: 1430828 - RNA, 14 nt, Homo sapiens
auggacucuucccc

SEQ ID NO: 1430829 - RNA, 18 nt, Homo sapiens
auggagaaauaggaccuu

SEQ ID NO: 1430830 - RNA, 18 nt, Homo sapiens
auggagccagcucugcau

SEQ ID NO: 1430831 - RNA, 14 nt, Homo sapiens
auggagcucuaacc

SEQ ID NO: 1430832 - RNA, 23 nt, Homo sapiens
auggaggcaggcucccccugccu

SEQ ID NO: 1430833 - RNA, 13 nt, Homo sapiens
auggaguuucccu

SEQ ID NO: 1430834 - RNA, 12 nt, Homo sapiens
auggaugcacac

SEQ ID NO: 1430835 - RNA, 15 nt, Homo sapiens
auggaugcacacaca

SEQ ID NO: 1430836 - RNA, 17 nt, Homo sapiens
auggaugugcucacugg

SEQ ID NO: 1430837 - RNA, 15 nt, Homo sapiens
auggcaccuuuugca

SEQ ID NO: 1430838 - RNA, 16 nt, Homo sapiens
auggcaccuuuugcac

SEQ ID NO: 1430839 - RNA, 18 nt, Homo sapiens
auggccaaaucgcaguga

SEQ ID NO: 1430840 - RNA, 14 nt, Homo sapiens
auggccaggccaga

SEQ ID NO: 1430841 - RNA, 18 nt, Homo sapiens
auggccucuggccaggca

SEQ ID NO: 1430842 - RNA, 15 nt, Homo sapiens
auggcuauauggcaa

SEQ ID NO: 1430843 - RNA, 18 nt, Homo sapiens
auggcucaggcaagcccc

SEQ ID NO: 1430844 - RNA, 23 nt, Homo sapiens
auggcucuucaccugggcgccaa

SEQ ID NO: 1430845 - RNA, 22 nt, Homo sapiens
augggaacaaggcaauggucua

SEQ ID NO: 1430846 - RNA, 13 nt, Homo sapiens
augggacaucaaa

SEQ ID NO: 1430847 - RNA, 20 nt, Homo sapiens
augggagggggcuccaugga

SEQ ID NO: 1430848 - RNA, 19 nt, Homo sapiens
augggcacaugaggagggu

SEQ ID NO: 1430849 - RNA, 20 nt, Homo sapiens
augggcagugccuccuggga

SEQ ID NO: 1430850 - RNA, 14 nt, Homo sapiens
auggggugggccca

SEQ ID NO: 1430851 - RNA, 13 nt, Homo sapiens
auggguacauucc

SEQ ID NO: 1430852 - RNA, 21 nt, Homo sapiens
augguacuaguguuuuuuaga

SEQ ID NO: 1430853 - RNA, 18 nt, Homo sapiens
augguacuauguuagccc

SEQ ID NO: 1430854 - RNA, 21 nt, Homo sapiens
augguccuugucccaagccca

SEQ ID NO: 1430855 - RNA, 20 nt, Homo sapiens
auggugcaaauccuacugaa

SEQ ID NO: 1430856 - RNA, 19 nt, Homo sapiens
auggugguaaacauucucu

SEQ ID NO: 1430857 - RNA, 20 nt, Homo sapiens
augguguaaugcacaauuua

SEQ ID NO: 1430858 - RNA, 15 nt, Homo sapiens
augguucccaauaaa

SEQ ID NO: 1430859 - RNA, 21 nt, Homo sapiens
auguaacgaaugguacuacaa

SEQ ID NO: 1430860 - RNA, 24 nt, Homo sapiens
auguaaggucuucuuguguccuga

SEQ ID NO: 1430861 - RNA, 20 nt, Homo sapiens
auguaaugaucauaagucua

SEQ ID NO: 1430862 - RNA, 13 nt, Homo sapiens
auguacacacaca

SEQ ID NO: 1430863 - RNA, 15 nt, Homo sapiens
auguacacacacaga

SEQ ID NO: 1430864 - RNA, 20 nt, Homo sapiens
auguaccacugagccugaga

SEQ ID NO: 1430865 - RNA, 19 nt, Homo sapiens
auguagccuggcccuggaa

SEQ ID NO: 1430866 - RNA, 22 nt, Homo sapiens
auguagcggugaagaguacaga

SEQ ID NO: 1430867 - RNA, 18 nt, Homo sapiens
auguaguacuaacuaagg

SEQ ID NO: 1430868 - RNA, 13 nt, Homo sapiens
auguauaaauguu

SEQ ID NO: 1430869 - RNA, 17 nt, Homo sapiens
auguauacacacauaua

SEQ ID NO: 1430870 - RNA, 19 nt, Homo sapiens
auguauauuaaaacugcac

SEQ ID NO: 1430871 - RNA, 15 nt, Homo sapiens
auguaugaguggcuu

SEQ ID NO: 1430872 - RNA, 19 nt, Homo sapiens
auguaugcauucauccaac

SEQ ID NO: 1430873 - RNA, 15 nt, Homo sapiens
auguaugcgugcaug

SEQ ID NO: 1430874 - RNA, 19 nt, Homo sapiens
auguaugugcacauguguc

SEQ ID NO: 1430875 - RNA, 17 nt, Homo sapiens
auguauuaucaccagca

SEQ ID NO: 1430876 - RNA, 17 nt, Homo sapiens
auguauuugucaaugca

SEQ ID NO: 1430877 - RNA, 20 nt, Homo sapiens
auguauuugucaaugcauca

SEQ ID NO: 1430878 - RNA, 24 nt, Homo sapiens
auguauuuuguauuugcauaugua

SEQ ID NO: 1430879 - RNA, 16 nt, Homo sapiens
augucaaauaucucag

SEQ ID NO: 1430880 - RNA, 16 nt, Homo sapiens
augucaaccagugagg

SEQ ID NO: 1430881 - RNA, 13 nt, Homo sapiens
augucaucaaaua

SEQ ID NO: 1430882 - RNA, 16 nt, Homo sapiens
augucaucauacauga

SEQ ID NO: 1430883 - RNA, 17 nt, Homo sapiens
augucaucauacaugac

SEQ ID NO: 1430884 - RNA, 16 nt, Homo sapiens
auguccccugucccac

SEQ ID NO: 1430885 - RNA, 22 nt, Homo sapiens
auguccgcccaccuagugcuuc

SEQ ID NO: 1430886 - RNA, 17 nt, Homo sapiens
auguccuguggugacag

SEQ ID NO: 1430887 - RNA, 15 nt, Homo sapiens
augucuagcucaucu

SEQ ID NO: 1430888 - RNA, 18 nt, Homo sapiens
augucucagccuccucag

SEQ ID NO: 1430889 - RNA, 15 nt, Homo sapiens
augucucgcuaguga

SEQ ID NO: 1430890 - RNA, 16 nt, Homo sapiens
augucucuuguagaag

SEQ ID NO: 1430891 - RNA, 17 nt, Homo sapiens
augucucuuguagaaga

SEQ ID NO: 1430892 - RNA, 20 nt, Homo sapiens
augugaaaaaugugucugua

SEQ ID NO: 1430893 - RNA, 17 nt, Homo sapiens
augugaacacaucagcu

SEQ ID NO: 1430894 - RNA, 14 nt, Homo sapiens
augugaacugcuga

SEQ ID NO: 1430895 - RNA, 14 nt, Homo sapiens
augugauaucugaa

SEQ ID NO: 1430896 - RNA, 18 nt, Homo sapiens
augugauuuauuuugaaa

SEQ ID NO: 1430897 - RNA, 11 nt, Homo sapiens
augugccaagg

SEQ ID NO: 1430898 - RNA, 23 nt, Homo sapiens
augugcuauugaacugagccaaa

SEQ ID NO: 1430899 - RNA, 15 nt, Homo sapiens
augugcuucacauaa

SEQ ID NO: 1430900 - RNA, 20 nt, Homo sapiens
auguggaguggacauucaaa

SEQ ID NO: 1430901 - RNA, 18 nt, Homo sapiens
augugggagggagcagac

SEQ ID NO: 1430902 - RNA, 20 nt, Homo sapiens
augugggguccccaucaucc

SEQ ID NO: 1430903 - RNA, 20 nt, Homo sapiens
auguguaaauggagcuugua

SEQ ID NO: 1430904 - RNA, 22 nt, Homo sapiens
auguguccccucacucugucag

SEQ ID NO: 1430905 - RNA, 16 nt, Homo sapiens
augugugucugaagac

SEQ ID NO: 1430906 - RNA, 20 nt, Homo sapiens
auguguugccuggaagcaca

SEQ ID NO: 1430907 - RNA, 16 nt, Homo sapiens
auguuaaagcaucaga

SEQ ID NO: 1430908 - RNA, 12 nt, Homo sapiens
auguuacuuugg

SEQ ID NO: 1430909 - RNA, 19 nt, Homo sapiens
auguuagggugcucuggaa

SEQ ID NO: 1430910 - RNA, 14 nt, Homo sapiens
auguuaugugacua

SEQ ID NO: 1430911 - RNA, 23 nt, Homo sapiens
auguuaugugacuaucuuuauga

SEQ ID NO: 1430912 - RNA, 14 nt, Homo sapiens
auguucuagugauu

SEQ ID NO: 1430913 - RNA, 23 nt, Homo sapiens
auguuguuaugcuauuaaaguga

SEQ ID NO: 1430914 - RNA, 16 nt, Homo sapiens
auguuguuugggagag

SEQ ID NO: 1430915 - RNA, 15 nt, Homo sapiens
auguuuagauuccag

SEQ ID NO: 1430916 - RNA, 20 nt, Homo sapiens
auguuucacauaaaaccuca

SEQ ID NO: 1430917 - RNA, 14 nt, Homo sapiens
auguuuccagaaaa

SEQ ID NO: 1430918 - RNA, 11 nt, Homo sapiens
auguuugcacu

SEQ ID NO: 1430919 - RNA, 17 nt, Homo sapiens
auguuuuuaugauaucc

SEQ ID NO: 1430920 - RNA, 19 nt, Homo sapiens
auguuuuuaugauaucccu

SEQ ID NO: 1430921 - RNA, 21 nt, Homo sapiens
auguuuuuuauccccaaacac

SEQ ID NO: 1430922 - RNA, 15 nt, Homo sapiens
auuaaaaaccacuga

SEQ ID NO: 1430923 - RNA, 12 nt, Homo sapiens
auuaaacacugu

SEQ ID NO: 1430924 - RNA, 20 nt, Homo sapiens
auuaaacagacuuuagcuua

SEQ ID NO: 1430925 - RNA, 15 nt, Homo sapiens
auuaaacagccaaau

SEQ ID NO: 1430926 - RNA, 20 nt, Homo sapiens
auuaaacuugucagaauuuc

SEQ ID NO: 1430927 - RNA, 14 nt, Homo sapiens
auuaaaguguuaua

SEQ ID NO: 1430928 - RNA, 15 nt, Homo sapiens
auuaaauaaaucauu

SEQ ID NO: 1430929 - RNA, 21 nt, Homo sapiens
auuaaauaccuauaugaauau

SEQ ID NO: 1430930 - RNA, 21 nt, Homo sapiens
auuaacuaugugauguuaacu

SEQ ID NO: 1430931 - RNA, 17 nt, Homo sapiens
auuaacuuaaaagauuc

SEQ ID NO: 1430932 - RNA, 18 nt, Homo sapiens
auuaacuuugaccagagu

SEQ ID NO: 1430933 - RNA, 13 nt, Homo sapiens
auuaagugcaauu

SEQ ID NO: 1430934 - RNA, 14 nt, Homo sapiens
auuaaguggcuuuu

SEQ ID NO: 1430935 - RNA, 23 nt, Homo sapiens
auuaaguggcuuuuuaacaugaa

SEQ ID NO: 1430936 - RNA, 18 nt, Homo sapiens
auuaaguucucaauguga

SEQ ID NO: 1430937 - RNA, 23 nt, Homo sapiens
auuaaguuguuauuucaguuuua

SEQ ID NO: 1430938 - RNA, 17 nt, Homo sapiens
auuaauaaauuuuaaca

SEQ ID NO: 1430939 - RNA, 20 nt, Homo sapiens
auuaauguguuaagugcagg

SEQ ID NO: 1430940 - RNA, 13 nt, Homo sapiens
auuaauguuaauu

SEQ ID NO: 1430941 - RNA, 15 nt, Homo sapiens
auuacaguagugcau

SEQ ID NO: 1430942 - RNA, 20 nt, Homo sapiens
auuacaguuuggaaguguua

SEQ ID NO: 1430943 - RNA, 16 nt, Homo sapiens
auuacauggcaguguu

SEQ ID NO: 1430944 - RNA, 14 nt, Homo sapiens
auuacuauaugcaa

SEQ ID NO: 1430945 - RNA, 19 nt, Homo sapiens
auuacuccauuacuaaaga

SEQ ID NO: 1430946 - RNA, 13 nt, Homo sapiens
auuagaaugcaug

SEQ ID NO: 1430947 - RNA, 14 nt, Homo sapiens
auuagaaugcaugu

SEQ ID NO: 1430948 - RNA, 19 nt, Homo sapiens
auuagcaauugacugucac

SEQ ID NO: 1430949 - RNA, 20 nt, Homo sapiens
auuagcauucugguuuugac

SEQ ID NO: 1430950 - RNA, 22 nt, Homo sapiens
auuagcauucugguuuugacau

SEQ ID NO: 1430951 - RNA, 21 nt, Homo sapiens
auuagcuagaaugcacaccaa

SEQ ID NO: 1430952 - RNA, 16 nt, Homo sapiens
auuauagccacauccc

SEQ ID NO: 1430953 - RNA, 16 nt, Homo sapiens
auuauaucauggcauu

SEQ ID NO: 1430954 - RNA, 18 nt, Homo sapiens
auuaugagucucuaugau

SEQ ID NO: 1430955 - RNA, 18 nt, Homo sapiens
auuauggagugucaccag

SEQ ID NO: 1430956 - RNA, 17 nt, Homo sapiens
auuauguauuuuuguca

SEQ ID NO: 1430957 - RNA, 16 nt, Homo sapiens
auuauuagauucucca

SEQ ID NO: 1430958 - RNA, 15 nt, Homo sapiens
auuauucccauucua

SEQ ID NO: 1430959 - RNA, 15 nt, Homo sapiens
auuauuguauuacau

SEQ ID NO: 1430960 - RNA, 13 nt, Homo sapiens
auuauuuugcacu

SEQ ID NO: 1430961 - RNA, 14 nt, Homo sapiens
auuauuuugcacug

SEQ ID NO: 1430962 - RNA, 14 nt, Homo sapiens
auucaaacugacaa

SEQ ID NO: 1430963 - RNA, 17 nt, Homo sapiens
auucaaaugggugauau

SEQ ID NO: 1430964 - RNA, 22 nt, Homo sapiens
auucaaguugcuucucauggau

SEQ ID NO: 1430965 - RNA, 21 nt, Homo sapiens
auucacaauagaaacucacca

SEQ ID NO: 1430966 - RNA, 13 nt, Homo sapiens
auucacaccucac

SEQ ID NO: 1430967 - RNA, 21 nt, Homo sapiens
auucacauaacuucucugagu

SEQ ID NO: 1430968 - RNA, 19 nt, Homo sapiens
auucacauccaaugcauag

SEQ ID NO: 1430969 - RNA, 20 nt, Homo sapiens
auucacucccacacccaaga

SEQ ID NO: 1430970 - RNA, 16 nt, Homo sapiens
auucagagaauaucaa

SEQ ID NO: 1430971 - RNA, 17 nt, Homo sapiens
auucagaucguauuaau

SEQ ID NO: 1430972 - RNA, 20 nt, Homo sapiens
auucagcacaccccaaggga

SEQ ID NO: 1430973 - RNA, 19 nt, Homo sapiens
auucagcauuauuccucca

SEQ ID NO: 1430974 - RNA, 14 nt, Homo sapiens
auucaggugaaaau

SEQ ID NO: 1430975 - RNA, 18 nt, Homo sapiens
auucauaauuagaacaau

SEQ ID NO: 1430976 - RNA, 20 nt, Homo sapiens
auucauccaguugcaauaaa

SEQ ID NO: 1430977 - RNA, 22 nt, Homo sapiens
auucaucugggaggcagaacag

SEQ ID NO: 1430978 - RNA, 18 nt, Homo sapiens
auucauuuauucauucau

SEQ ID NO: 1430979 - RNA, 14 nt, Homo sapiens
auucauuucaucua

SEQ ID NO: 1430980 - RNA, 20 nt, Homo sapiens
auucauuuuuuucacuggag

SEQ ID NO: 1430981 - RNA, 16 nt, Homo sapiens
auuccaccuucccaug

SEQ ID NO: 1430982 - RNA, 13 nt, Homo sapiens
auuccagcauuug

SEQ ID NO: 1430983 - RNA, 16 nt, Homo sapiens
auuccagucucugcau

SEQ ID NO: 1430984 - RNA, 14 nt, Homo sapiens
auucccaccaaggu

SEQ ID NO: 1430985 - RNA, 22 nt, Homo sapiens
auucccuaucaaaacauaucaa

SEQ ID NO: 1430986 - RNA, 14 nt, Homo sapiens
auucccugcaucca

SEQ ID NO: 1430987 - RNA, 19 nt, Homo sapiens
auuccuauauaguuuauug

SEQ ID NO: 1430988 - RNA, 13 nt, Homo sapiens
auuccugugauuu

SEQ ID NO: 1430989 - RNA, 21 nt, Homo sapiens
auuccuguuucugaaccauua

SEQ ID NO: 1430990 - RNA, 13 nt, Homo sapiens
auuccuugauuca

SEQ ID NO: 1430991 - RNA, 14 nt, Homo sapiens
auucuacacugagg

SEQ ID NO: 1430992 - RNA, 11 nt, Homo sapiens
auucuacauau

SEQ ID NO: 1430993 - RNA, 23 nt, Homo sapiens
auucuacuucugucuuccuucau

SEQ ID NO: 1430994 - RNA, 20 nt, Homo sapiens
auucuagccaaacuauucua

SEQ ID NO: 1430995 - RNA, 21 nt, Homo sapiens
auucucacuccaccacccaaa

SEQ ID NO: 1430996 - RNA, 19 nt, Homo sapiens
auucucggggcccugugua

SEQ ID NO: 1430997 - RNA, 14 nt, Homo sapiens
auucucuuacccag

SEQ ID NO: 1430998 - RNA, 15 nt, Homo sapiens
auucugaccauuuca

SEQ ID NO: 1430999 - RNA, 20 nt, Homo sapiens
auucuggcugcaagggccag

SEQ ID NO: 1431000 - RNA, 15 nt, Homo sapiens
auucuguuugucucg

SEQ ID NO: 1431001 - RNA, 14 nt, Homo sapiens
auucuugaaugagg

SEQ ID NO: 1431002 - RNA, 17 nt, Homo sapiens
auucuugacaugagaaa

SEQ ID NO: 1431003 - RNA, 15 nt, Homo sapiens
auucuugugccucag

SEQ ID NO: 1431004 - RNA, 20 nt, Homo sapiens
auucuuuaaauuucaucuca

SEQ ID NO: 1431005 - RNA, 22 nt, Homo sapiens
auucuuuccccucagagcucuu

SEQ ID NO: 1431006 - RNA, 14 nt, Homo sapiens
auucuuugcaagau

SEQ ID NO: 1431007 - RNA, 18 nt, Homo sapiens
auugaacuuucacauagc

SEQ ID NO: 1431008 - RNA, 22 nt, Homo sapiens
auugaacuuucacauagcacag

SEQ ID NO: 1431009 - RNA, 20 nt, Homo sapiens
auugaauuggauacaaggau

SEQ ID NO: 1431010 - RNA, 20 nt, Homo sapiens
auugaauuugccuuccucau

SEQ ID NO: 1431011 - RNA, 14 nt, Homo sapiens
auugaccucagcug

SEQ ID NO: 1431012 - RNA, 22 nt, Homo sapiens
auugacuugcacaucucugcag

SEQ ID NO: 1431013 - RNA, 23 nt, Homo sapiens
auugagaaguuuuguacagagaa

SEQ ID NO: 1431014 - RNA, 11 nt, Homo sapiens
auugauuucaa

SEQ ID NO: 1431015 - RNA, 10 nt, Homo sapiens
auugcacaau

SEQ ID NO: 1431016 - RNA, 12 nt, Homo sapiens
auugcugugaau

SEQ ID NO: 1431017 - RNA, 18 nt, Homo sapiens
auuggagggaagacaggu

SEQ ID NO: 1431018 - RNA, 23 nt, Homo sapiens
auuggccacugggucucacuccu

SEQ ID NO: 1431019 - RNA, 18 nt, Homo sapiens
auuggcuggagauggaaa

SEQ ID NO: 1431020 - RNA, 17 nt, Homo sapiens
auuguaggcaaccuucc

SEQ ID NO: 1431021 - RNA, 20 nt, Homo sapiens
auugucagaguucugcucua

SEQ ID NO: 1431022 - RNA, 14 nt, Homo sapiens
auuguguuugacuu

SEQ ID NO: 1431023 - RNA, 14 nt, Homo sapiens
auuguuaccaugaa

SEQ ID NO: 1431024 - RNA, 20 nt, Homo sapiens
auuuaaagguuaguauggaa

SEQ ID NO: 1431025 - RNA, 15 nt, Homo sapiens
auuuaagguacuuaa

SEQ ID NO: 1431026 - RNA, 16 nt, Homo sapiens
auuuaagguacuuaaa

SEQ ID NO: 1431027 - RNA, 20 nt, Homo sapiens
auuuaaugaagacccagugu

SEQ ID NO: 1431028 - RNA, 17 nt, Homo sapiens
auuuaauggcaaugcaa

SEQ ID NO: 1431029 - RNA, 21 nt, Homo sapiens
auuuacaugaauugcauuuua

SEQ ID NO: 1431030 - RNA, 23 nt, Homo sapiens
auuuacugcaagaaguacaugaa

SEQ ID NO: 1431031 - RNA, 19 nt, Homo sapiens
auuuacuuaacagaacagu

SEQ ID NO: 1431032 - RNA, 12 nt, Homo sapiens
auuuagugucuu

SEQ ID NO: 1431033 - RNA, 17 nt, Homo sapiens
auuuauaaaauaaugaa

SEQ ID NO: 1431034 - RNA, 16 nt, Homo sapiens
auuuauauauauaugu

SEQ ID NO: 1431035 - RNA, 14 nt, Homo sapiens
auuuauaucuaagu

SEQ ID NO: 1431036 - RNA, 15 nt, Homo sapiens
auuuaucugugcaaa

SEQ ID NO: 1431037 - RNA, 12 nt, Homo sapiens
auuuaugaaggc

SEQ ID NO: 1431038 - RNA, 24 nt, Homo sapiens
auuuauuaguuaggugugccaaac

SEQ ID NO: 1431039 - RNA, 22 nt, Homo sapiens
auuuauucaucugggaggcaga

SEQ ID NO: 1431040 - RNA, 16 nt, Homo sapiens
auccuuuaucaagaag

SEQ ID NO: 1431041 - RNA, 22 nt, Homo sapiens
aucgcaccuuuuauaccagaga

SEQ ID NO: 1431042 - RNA, 16 nt, Homo sapiens
aucgcugccuugccau

SEQ ID NO: 1431043 - RNA, 20 nt, Homo sapiens
aucgcugccuugccaugucu

SEQ ID NO: 1431044 - RNA, 18 nt, Homo sapiens
aucuaaaaagacuaaccu

SEQ ID NO: 1431045 - RNA, 14 nt, Homo sapiens
aucuaaacaaugua

SEQ ID NO: 1431046 - RNA, 18 nt, Homo sapiens
aucuaaagccaguggcag

SEQ ID NO: 1431047 - RNA, 19 nt, Homo sapiens
aucuaagaaaauuauguau

SEQ ID NO: 1431048 - RNA, 13 nt, Homo sapiens
aucuaauaccauc

SEQ ID NO: 1431049 - RNA, 14 nt, Homo sapiens
aucuaauuuauaca

SEQ ID NO: 1431050 - RNA, 17 nt, Homo sapiens
aucuacagcucaccucu

SEQ ID NO: 1431051 - RNA, 11 nt, Homo sapiens
aucuaccugcc

SEQ ID NO: 1431052 - RNA, 20 nt, Homo sapiens
aucuaccugcccucucucag

SEQ ID NO: 1431053 - RNA, 14 nt, Homo sapiens
aucuacuacagggu

SEQ ID NO: 1431054 - RNA, 15 nt, Homo sapiens
aucuacucauugucu

SEQ ID NO: 1431055 - RNA, 18 nt, Homo sapiens
aucuacugagacaugacu

SEQ ID NO: 1431056 - RNA, 14 nt, Homo sapiens
aucuaguucucaau

SEQ ID NO: 1431057 - RNA, 20 nt, Homo sapiens
aucuaguucucaaucacugc

SEQ ID NO: 1431058 - RNA, 12 nt, Homo sapiens
aucuaguuuacu

SEQ ID NO: 1431059 - RNA, 21 nt, Homo sapiens
aucuauaaaaagaaguguucc

SEQ ID NO: 1431060 - RNA, 17 nt, Homo sapiens
aucucacucuguugccc

SEQ ID NO: 1431061 - RNA, 18 nt, Homo sapiens
aucucaggccucccucaa

SEQ ID NO: 1431062 - RNA, 14 nt, Homo sapiens
aucucaguggcaca

SEQ ID NO: 1431063 - RNA, 17 nt, Homo sapiens
aucucauagguugccaa

SEQ ID NO: 1431064 - RNA, 20 nt, Homo sapiens
aucucaugagugccaagcaa

SEQ ID NO: 1431065 - RNA, 17 nt, Homo sapiens
aucuccccaggccucca

SEQ ID NO: 1431066 - RNA, 17 nt, Homo sapiens
aucuccucuaucacauu

SEQ ID NO: 1431067 - RNA, 23 nt, Homo sapiens
aucucuaauuggaagaaauuccu

SEQ ID NO: 1431068 - RNA, 16 nt, Homo sapiens
aucucuagagugagaa

SEQ ID NO: 1431069 - RNA, 16 nt, Homo sapiens
aucucucugccuauuu

SEQ ID NO: 1431070 - RNA, 15 nt, Homo sapiens
aucucugaaagcaca

SEQ ID NO: 1431071 - RNA, 16 nt, Homo sapiens
aucucugcuuacuaau

SEQ ID NO: 1431072 - RNA, 16 nt, Homo sapiens
aucucuuccuacccaa

SEQ ID NO: 1431073 - RNA, 15 nt, Homo sapiens
aucucuuugauguca

SEQ ID NO: 1431074 - RNA, 16 nt, Homo sapiens
aucucuuugaugucau

SEQ ID NO: 1431075 - RNA, 13 nt, Homo sapiens
aucugacaagacu

SEQ ID NO: 1431076 - RNA, 16 nt, Homo sapiens
aucugacucacaagaa

SEQ ID NO: 1431077 - RNA, 16 nt, Homo sapiens
aucugagaaacuuaaa

SEQ ID NO: 1431078 - RNA, 14 nt, Homo sapiens
aucugagaagacaa

SEQ ID NO: 1431079 - RNA, 13 nt, Homo sapiens
aucugagaucucc

SEQ ID NO: 1431080 - RNA, 11 nt, Homo sapiens
aucugagcucc

SEQ ID NO: 1431081 - RNA, 13 nt, Homo sapiens
aucugcacugggu

SEQ ID NO: 1431082 - RNA, 14 nt, Homo sapiens
aucugcagcuaacu

SEQ ID NO: 1431083 - RNA, 22 nt, Homo sapiens
aucugcagggagcaacucucca

SEQ ID NO: 1431084 - RNA, 15 nt, Homo sapiens
aucugggauucccac

SEQ ID NO: 1431085 - RNA, 14 nt, Homo sapiens
aucuguagucuuuu

SEQ ID NO: 1431086 - RNA, 22 nt, Homo sapiens
aucuguccagaggcugcaagga

SEQ ID NO: 1431087 - RNA, 15 nt, Homo sapiens
aucuguguugucucu

SEQ ID NO: 1431088 - RNA, 16 nt, Homo sapiens
aucuguuauccugcua

SEQ ID NO: 1431089 - RNA, 15 nt, Homo sapiens
aucuguucaauguuu

SEQ ID NO: 1431090 - RNA, 14 nt, Homo sapiens
aucuguuuugugac

SEQ ID NO: 1431091 - RNA, 19 nt, Homo sapiens
aucuuaaaugacagugaau

SEQ ID NO: 1431092 - RNA, 14 nt, Homo sapiens
aucuuaaaugccag

SEQ ID NO: 1431093 - RNA, 19 nt, Homo sapiens
aucuuacaaaaacaagaca

SEQ ID NO: 1431094 - RNA, 14 nt, Homo sapiens
aucuuagcaugccu

SEQ ID NO: 1431095 - RNA, 22 nt, Homo sapiens
aucuucaaacauguacaaaauc

SEQ ID NO: 1431096 - RNA, 12 nt, Homo sapiens
aucuuucaggaa

SEQ ID NO: 1431097 - RNA, 19 nt, Homo sapiens
aucuuuccuugucucucau

SEQ ID NO: 1431098 - RNA, 20 nt, Homo sapiens
augaaaaaaaugcauuuuau

SEQ ID NO: 1431099 - RNA, 15 nt, Homo sapiens
augaaaacugaauca

SEQ ID NO: 1431100 - RNA, 16 nt, Homo sapiens
augaaaugggcuuuaa

SEQ ID NO: 1431101 - RNA, 19 nt, Homo sapiens
augaacacacauggaugca

SEQ ID NO: 1431102 - RNA, 20 nt, Homo sapiens
augaauagagaguauguaau

SEQ ID NO: 1431103 - RNA, 20 nt, Homo sapiens
augaauagcgaaucaucuca

SEQ ID NO: 1431104 - RNA, 21 nt, Homo sapiens
augaauagcgaaucaucucaa

SEQ ID NO: 1431105 - RNA, 14 nt, Homo sapiens
augaaucaaagaca

SEQ ID NO: 1431106 - RNA, 19 nt, Homo sapiens
augaaucccauaauugaca

SEQ ID NO: 1431107 - RNA, 18 nt, Homo sapiens
augaauugacagacuguu

SEQ ID NO: 1431108 - RNA, 15 nt, Homo sapiens
augaauuuggccaga

SEQ ID NO: 1431109 - RNA, 13 nt, Homo sapiens
augacaucacuug

SEQ ID NO: 1431110 - RNA, 13 nt, Homo sapiens
augacaugcacug

SEQ ID NO: 1431111 - RNA, 22 nt, Homo sapiens
augaccagaaaacaaaucuuca

SEQ ID NO: 1431112 - RNA, 16 nt, Homo sapiens
augaccaguucuggcc

SEQ ID NO: 1431113 - RNA, 21 nt, Homo sapiens
augaccuaguaaacuuuguac

SEQ ID NO: 1431114 - RNA, 18 nt, Homo sapiens
augaccuguauuuugcca

SEQ ID NO: 1431115 - RNA, 17 nt, Homo sapiens
augaccuuguugcauga

SEQ ID NO: 1431116 - RNA, 21 nt, Homo sapiens
augacuucugccccagcuuua

SEQ ID NO: 1431117 - RNA, 20 nt, Homo sapiens
augacuuuaucauuuuguua

SEQ ID NO: 1431118 - RNA, 17 nt, Homo sapiens
augagcaccccuaugcc

SEQ ID NO: 1431119 - RNA, 17 nt, Homo sapiens
augagcaugaacugucc

SEQ ID NO: 1431120 - RNA, 19 nt, Homo sapiens
augagcucugaacaaacac

SEQ ID NO: 1431121 - RNA, 20 nt, Homo sapiens
augaggcuuggggcuggaga

SEQ ID NO: 1431122 - RNA, 14 nt, Homo sapiens
augagggcagagag

SEQ ID NO: 1431123 - RNA, 16 nt, Homo sapiens
augagggugacuguca

SEQ ID NO: 1431124 - RNA, 12 nt, Homo sapiens
augaguggcuuc

SEQ ID NO: 1431125 - RNA, 14 nt, Homo sapiens
auuuauucauucag

SEQ ID NO: 1431126 - RNA, 21 nt, Homo sapiens
caugauuuuauacauagucac

SEQ ID NO: 1431127 - RNA, 15 nt, Homo sapiens
caugcacucaggcag

SEQ ID NO: 1431128 - RNA, 19 nt, Homo sapiens
caugcaugggaaagugcaa

SEQ ID NO: 1431129 - RNA, 21 nt, Homo sapiens
caugccaaugcacgcacacau

SEQ ID NO: 1431130 - RNA, 15 nt, Homo sapiens
caugccacugccagg

SEQ ID NO: 1431131 - RNA, 13 nt, Homo sapiens
caugccucugagg

SEQ ID NO: 1431132 - RNA, 22 nt, Homo sapiens
caugccucugaggccagccugg

SEQ ID NO: 1431133 - RNA, 20 nt, Homo sapiens
caugccucugauaugggacu

SEQ ID NO: 1431134 - RNA, 22 nt, Homo sapiens
caugcugcuaauucaaagcucu

SEQ ID NO: 1431135 - RNA, 11 nt, Homo sapiens
caugcuuucuc

SEQ ID NO: 1431136 - RNA, 17 nt, Homo sapiens
caugcuuuggcaauuuu

SEQ ID NO: 1431137 - RNA, 17 nt, Homo sapiens
cauggaauaaaccauuu

SEQ ID NO: 1431138 - RNA, 19 nt, Homo sapiens
cauggacaccccuuaucca

SEQ ID NO: 1431139 - RNA, 20 nt, Homo sapiens
cauggacucuggguuucaua

SEQ ID NO: 1431140 - RNA, 15 nt, Homo sapiens
cauggagaaacaucc

SEQ ID NO: 1431141 - RNA, 14 nt, Homo sapiens
cauggaugagcaca

SEQ ID NO: 1431142 - RNA, 18 nt, Homo sapiens
cauggaugagcacacaca

SEQ ID NO: 1431143 - RNA, 16 nt, Homo sapiens
cauggaugcacacaca

SEQ ID NO: 1431144 - RNA, 19 nt, Homo sapiens
cauggcaccuuuugcacau

SEQ ID NO: 1431145 - RNA, 21 nt, Homo sapiens
cauggccagguggccacucca

SEQ ID NO: 1431146 - RNA, 18 nt, Homo sapiens
cauggcguaaugggccug

SEQ ID NO: 1431147 - RNA, 15 nt, Homo sapiens
cauggcuuugcuuug

SEQ ID NO: 1431148 - RNA, 17 nt, Homo sapiens
cauggggaagugcuccc

SEQ ID NO: 1431149 - RNA, 15 nt, Homo sapiens
caugguguccagaca

SEQ ID NO: 1431150 - RNA, 17 nt, Homo sapiens
cauguaacaaccagaga

SEQ ID NO: 1431151 - RNA, 14 nt, Homo sapiens
cauguauguaggca

SEQ ID NO: 1431152 - RNA, 15 nt, Homo sapiens
cauguaugugcacau

SEQ ID NO: 1431153 - RNA, 13 nt, Homo sapiens
caugucaccucag

SEQ ID NO: 1431154 - RNA, 21 nt, Homo sapiens
caugucaccucagcugauauu

SEQ ID NO: 1431155 - RNA, 15 nt, Homo sapiens
caugucucaauagua

SEQ ID NO: 1431156 - RNA, 12 nt, Homo sapiens
caugugccugua

SEQ ID NO: 1431157 - RNA, 21 nt, Homo sapiens
cauguggaguggacauucaaa

SEQ ID NO: 1431158 - RNA, 17 nt, Homo sapiens
cauguguugccuggaag

SEQ ID NO: 1431159 - RNA, 19 nt, Homo sapiens
cauguguuguacaauacca

SEQ ID NO: 1431160 - RNA, 17 nt, Homo sapiens
cauguuauccacaagca

SEQ ID NO: 1431161 - RNA, 20 nt, Homo sapiens
cauguugaagccacugccuu

SEQ ID NO: 1431162 - RNA, 17 nt, Homo sapiens
cauguuguaagcacuga

SEQ ID NO: 1431163 - RNA, 19 nt, Homo sapiens
cauguuguaagcacugacu

SEQ ID NO: 1431164 - RNA, 13 nt, Homo sapiens
cauuaaacacugu

SEQ ID NO: 1431165 - RNA, 13 nt, Homo sapiens
cauuaaaccugga

SEQ ID NO: 1431166 - RNA, 13 nt, Homo sapiens
cauuaaaugacaa

SEQ ID NO: 1431167 - RNA, 17 nt, Homo sapiens
cauuacuugcacaagcu

SEQ ID NO: 1431168 - RNA, 22 nt, Homo sapiens
cauuacuuuaauacucaccucc

SEQ ID NO: 1431169 - RNA, 20 nt, Homo sapiens
cauuagcauucugguuuuga

SEQ ID NO: 1431170 - RNA, 23 nt, Homo sapiens
cauuagcugcccaggaugcugcu

SEQ ID NO: 1431171 - RNA, 15 nt, Homo sapiens
cauuaggcaugccua

SEQ ID NO: 1431172 - RNA, 21 nt, Homo sapiens
cauuagguuuccuuuuauucu

SEQ ID NO: 1431173 - RNA, 17 nt, Homo sapiens
cauuauuuugaauguga

SEQ ID NO: 1431174 - RNA, 19 nt, Homo sapiens
cauuauuuuuuacaauggc

SEQ ID NO: 1431175 - RNA, 23 nt, Homo sapiens
cauucaauaaauauuaguuaaua

SEQ ID NO: 1431176 - RNA, 15 nt, Homo sapiens
cauucagaccaguga

SEQ ID NO: 1431177 - RNA, 16 nt, Homo sapiens
cauucagucuagcuuu

SEQ ID NO: 1431178 - RNA, 21 nt, Homo sapiens
cauucagugagacacagagug

SEQ ID NO: 1431179 - RNA, 16 nt, Homo sapiens
cauucaucaagcugua

SEQ ID NO: 1431180 - RNA, 19 nt, Homo sapiens
cauucauccaacagaguua

SEQ ID NO: 1431181 - RNA, 17 nt, Homo sapiens
cauucauuuauucauuc

SEQ ID NO: 1431182 - RNA, 18 nt, Homo sapiens
cauuccagacugcuucca

SEQ ID NO: 1431183 - RNA, 13 nt, Homo sapiens
cauuccaggaaac

SEQ ID NO: 1431184 - RNA, 15 nt, Homo sapiens
cauucccagugguca

SEQ ID NO: 1431185 - RNA, 19 nt, Homo sapiens
cauuccuucacucauccag

SEQ ID NO: 1431186 - RNA, 14 nt, Homo sapiens
cauuccuugucacc

SEQ ID NO: 1431187 - RNA, 16 nt, Homo sapiens
cauucuuacucgggcg

SEQ ID NO: 1431188 - RNA, 18 nt, Homo sapiens
cauucuuuaucuugacau

SEQ ID NO: 1431189 - RNA, 18 nt, Homo sapiens
cauugaacagcaaaguag

SEQ ID NO: 1431190 - RNA, 15 nt, Homo sapiens
cauugaauuugccuu

SEQ ID NO: 1431191 - RNA, 16 nt, Homo sapiens
cauugcuucugcuaaa

SEQ ID NO: 1431192 - RNA, 17 nt, Homo sapiens
cauugguaagaaugagc

SEQ ID NO: 1431193 - RNA, 15 nt, Homo sapiens
cauuguagaaacaca

SEQ ID NO: 1431194 - RNA, 13 nt, Homo sapiens
cauuguauguauc

SEQ ID NO: 1431195 - RNA, 12 nt, Homo sapiens
cauugucugugg

SEQ ID NO: 1431196 - RNA, 23 nt, Homo sapiens
cauuucagagaggccuuuuggaa

SEQ ID NO: 1431197 - RNA, 15 nt, Homo sapiens
cauuucgccccucau

SEQ ID NO: 1431198 - RNA, 12 nt, Homo sapiens
cauuucuaacau

SEQ ID NO: 1431199 - RNA, 19 nt, Homo sapiens
cauuucuaauguaugcauu

SEQ ID NO: 1431200 - RNA, 18 nt, Homo sapiens
cauuucuacugugacuga

SEQ ID NO: 1431201 - RNA, 22 nt, Homo sapiens
cauuucucaaucagugcaguga

SEQ ID NO: 1431202 - RNA, 19 nt, Homo sapiens
cauuucucugcuuacccuu

SEQ ID NO: 1431203 - RNA, 15 nt, Homo sapiens
cauuugauguacaug

SEQ ID NO: 1431204 - RNA, 19 nt, Homo sapiens
cauuugcacagguuuucag

SEQ ID NO: 1431205 - RNA, 15 nt, Homo sapiens
cauuugccuaauucc

SEQ ID NO: 1431206 - RNA, 18 nt, Homo sapiens
cauuuguugugacuggca

SEQ ID NO: 1431207 - RNA, 17 nt, Homo sapiens
cauuuucaauaauguga

SEQ ID NO: 1431208 - RNA, 12 nt, Homo sapiens
cauuuuccaaaa

SEQ ID NO: 1431209 - RNA, 22 nt, Homo sapiens
cauuuugggaccuauaucucag

SEQ ID NO: 1431210 - RNA, 15 nt, Homo sapiens
cauuuuguuauagaa

SEQ ID NO: 1431211 - RNA, 23 nt, Homo sapiens
cauuuuuuucacuggaguuacau

SEQ ID NO: 1431212 - RNA, 14 nt, Homo sapiens
ccaaaauacuacac

SEQ ID NO: 1431213 - RNA, 16 nt, Homo sapiens
ccaaaauacuucugag

SEQ ID NO: 1431214 - RNA, 17 nt, Homo sapiens
ccaaaaucguagguguu

SEQ ID NO: 1431215 - RNA, 20 nt, Homo sapiens
ccaaaauuaccaaaaaucuu

SEQ ID NO: 1431216 - RNA, 12 nt, Homo sapiens
ccaaacuccugc

SEQ ID NO: 1431217 - RNA, 23 nt, Homo sapiens
ccaaagagacuggagcaucugac

SEQ ID NO: 1431218 - RNA, 22 nt, Homo sapiens
ccaaagcauggacuaaccccaa

SEQ ID NO: 1431219 - RNA, 22 nt, Homo sapiens
ccaaagccaccaagacaggcuc

SEQ ID NO: 1431220 - RNA, 14 nt, Homo sapiens
ccaaaggacauuau

SEQ ID NO: 1431221 - RNA, 18 nt, Homo sapiens
ccaaaggcauaagacccu

SEQ ID NO: 1431222 - RNA, 16 nt, Homo sapiens
ccaaagugacacagag

SEQ ID NO: 1431223 - RNA, 23 nt, Homo sapiens
ccaaauaaacucuaaacauuaau

SEQ ID NO: 1431224 - RNA, 21 nt, Homo sapiens
ccaaauaaggauuuguucaca

SEQ ID NO: 1431225 - RNA, 19 nt, Homo sapiens
ccaaaugaugccacuuccc

SEQ ID NO: 1431226 - RNA, 13 nt, Homo sapiens
ccaacaaacaaug

SEQ ID NO: 1431227 - RNA, 14 nt, Homo sapiens
ccaacaccaccucu

SEQ ID NO: 1431228 - RNA, 15 nt, Homo sapiens
ccaacccaaccucau

SEQ ID NO: 1431229 - RNA, 18 nt, Homo sapiens
ccaacccccgacuucauc

SEQ ID NO: 1431230 - RNA, 16 nt, Homo sapiens
ccaacccugcccacuu

SEQ ID NO: 1431231 - RNA, 16 nt, Homo sapiens
ccaacucugcacucca

SEQ ID NO: 1431232 - RNA, 14 nt, Homo sapiens
ccaacugcucugcc

SEQ ID NO: 1431233 - RNA, 20 nt, Homo sapiens
ccaacugcugaucaaugaaa

SEQ ID NO: 1431234 - RNA, 13 nt, Homo sapiens
ccaagaaggugag

SEQ ID NO: 1431235 - RNA, 21 nt, Homo sapiens
ccaagagagggccaugcaauu

SEQ ID NO: 1431236 - RNA, 19 nt, Homo sapiens
ccaagaggacugagacugg

SEQ ID NO: 1431237 - RNA, 14 nt, Homo sapiens
ccaagccauucacu

SEQ ID NO: 1431238 - RNA, 22 nt, Homo sapiens
ccaagccucugccccaaggggc

SEQ ID NO: 1431239 - RNA, 19 nt, Homo sapiens
ccaagcugaagugaaggag

SEQ ID NO: 1431240 - RNA, 18 nt, Homo sapiens
ccaaggcccagcuauggc

SEQ ID NO: 1431241 - RNA, 16 nt, Homo sapiens
ccaaggguaugggaag

SEQ ID NO: 1431242 - RNA, 19 nt, Homo sapiens
ccaagguuuuggagucagu

SEQ ID NO: 1431243 - RNA, 24 nt, Homo sapiens
ccaaguccugggaauaugcuagug

SEQ ID NO: 1431244 - RNA, 15 nt, Homo sapiens
ccaauccagguggga

SEQ ID NO: 1431245 - RNA, 19 nt, Homo sapiens
ccaaucccaccaacccuca

SEQ ID NO: 1431246 - RNA, 15 nt, Homo sapiens
ccaauccuuuccacc

SEQ ID NO: 1431247 - RNA, 13 nt, Homo sapiens
ccaaugcacacac

SEQ ID NO: 1431248 - RNA, 21 nt, Homo sapiens
ccaaugcacgcacacaucagu

SEQ ID NO: 1431249 - RNA, 23 nt, Homo sapiens
ccaaugcauugcuaaaauauuau

SEQ ID NO: 1431250 - RNA, 20 nt, Homo sapiens
ccaaugcgcacacacaccga

SEQ ID NO: 1431251 - RNA, 22 nt, Homo sapiens
ccaauucaaucccggaagggac

SEQ ID NO: 1431252 - RNA, 16 nt, Homo sapiens
ccaauuccaaguuuua

SEQ ID NO: 1431253 - RNA, 15 nt, Homo sapiens
ccaauuuauuuuaac

SEQ ID NO: 1431254 - RNA, 13 nt, Homo sapiens
ccacaagccauuu

SEQ ID NO: 1431255 - RNA, 17 nt, Homo sapiens
ccacaauggagugggag

SEQ ID NO: 1431256 - RNA, 14 nt, Homo sapiens
ccacacacagagga

SEQ ID NO: 1431257 - RNA, 13 nt, Homo sapiens
ccacacagggugc

SEQ ID NO: 1431258 - RNA, 19 nt, Homo sapiens
ccacacgcguguguacaca

SEQ ID NO: 1431259 - RNA, 14 nt, Homo sapiens
ccacacuucuugaa

SEQ ID NO: 1431260 - RNA, 14 nt, Homo sapiens
ccacagacucccuc

SEQ ID NO: 1431261 - RNA, 14 nt, Homo sapiens
ccacagccaacaaa

SEQ ID NO: 1431262 - RNA, 22 nt, Homo sapiens
ccacagcgauccacggagcuga

SEQ ID NO: 1431263 - RNA, 18 nt, Homo sapiens
ccacauauggcacaacug

SEQ ID NO: 1431264 - RNA, 15 nt, Homo sapiens
ccaccacgugcucaa

SEQ ID NO: 1431265 - RNA, 17 nt, Homo sapiens
ccacccccuucagugcc

SEQ ID NO: 1431266 - RNA, 20 nt, Homo sapiens
ccaccccuaaccuggcuuau

SEQ ID NO: 1431267 - RNA, 20 nt, Homo sapiens
ccaccugacaauggcagcua

SEQ ID NO: 1431268 - RNA, 19 nt, Homo sapiens
ccaccuguacucuggagag

SEQ ID NO: 1431269 - RNA, 21 nt, Homo sapiens
ccaccuuucucgcuggaauca

SEQ ID NO: 1431270 - RNA, 19 nt, Homo sapiens
ccacgggaagccuccguca

SEQ ID NO: 1431271 - RNA, 18 nt, Homo sapiens
ccacuaccuucugaccuc

SEQ ID NO: 1431272 - RNA, 17 nt, Homo sapiens
ccacucaguuguuccua

SEQ ID NO: 1431273 - RNA, 15 nt, Homo sapiens
ccacucuuugcuaca

SEQ ID NO: 1431274 - RNA, 23 nt, Homo sapiens
ccacuggaucuucagaaggcuag

SEQ ID NO: 1431275 - RNA, 15 nt, Homo sapiens
ccacuggcuccacau

SEQ ID NO: 1431276 - RNA, 21 nt, Homo sapiens
ccacuucuaugcaaaugccuc

SEQ ID NO: 1431277 - RNA, 16 nt, Homo sapiens
ccacuuugucucugag

SEQ ID NO: 1431278 - RNA, 21 nt, Homo sapiens
ccagaaacguaacugugugca

SEQ ID NO: 1431279 - RNA, 18 nt, Homo sapiens
ccagaaagaggcagugau

SEQ ID NO: 1431280 - RNA, 19 nt, Homo sapiens
ccagaaagaggcagugauu

SEQ ID NO: 1431281 - RNA, 13 nt, Homo sapiens
ccagaccuuuuau

SEQ ID NO: 1431282 - RNA, 23 nt, Homo sapiens
ccagacuuuaccacuaugcaaua

SEQ ID NO: 1431283 - RNA, 14 nt, Homo sapiens
ccagacuuucuaca

SEQ ID NO: 1431284 - RNA, 13 nt, Homo sapiens
ccagagagacaga

SEQ ID NO: 1431285 - RNA, 20 nt, Homo sapiens
ccagagcacugcuccagugg

SEQ ID NO: 1431286 - RNA, 18 nt, Homo sapiens
ccagagcaggaaugggaa

SEQ ID NO: 1431287 - RNA, 18 nt, Homo sapiens
ccagagcccaagugccau

SEQ ID NO: 1431288 - RNA, 19 nt, Homo sapiens
ccagagcuguggacuuugu

SEQ ID NO: 1431289 - RNA, 17 nt, Homo sapiens
ccagagguuaucugccu

SEQ ID NO: 1431290 - RNA, 11 nt, Homo sapiens
ccagagucaga

SEQ ID NO: 1431291 - RNA, 13 nt, Homo sapiens
ccagagugcugcc

SEQ ID NO: 1431292 - RNA, 16 nt, Homo sapiens
ccagaguggagucuga

SEQ ID NO: 1431293 - RNA, 12 nt, Homo sapiens
ccagaucugccu

SEQ ID NO: 1431294 - RNA, 12 nt, Homo sapiens
ccagcacagggg

SEQ ID NO: 1431295 - RNA, 12 nt, Homo sapiens
ccagcacuuugg

SEQ ID NO: 1431296 - RNA, 21 nt, Homo sapiens
ccagcacuuugggaggcugag

SEQ ID NO: 1431297 - RNA, 23 nt, Homo sapiens
ccagcaugaagguggggccagug

SEQ ID NO: 1431298 - RNA, 17 nt, Homo sapiens
ccagccgaaaagcuuuu

SEQ ID NO: 1431299 - RNA, 16 nt, Homo sapiens
ccagccuagcccacuu

SEQ ID NO: 1431300 - RNA, 14 nt, Homo sapiens
ccagccucagcuca

SEQ ID NO: 1431301 - RNA, 16 nt, Homo sapiens
ccagccuccaugcugc

SEQ ID NO: 1431302 - RNA, 22 nt, Homo sapiens
ccagccugggacucccagugaa

SEQ ID NO: 1431303 - RNA, 15 nt, Homo sapiens
ccagccugggcaaca

SEQ ID NO: 1431304 - RNA, 23 nt, Homo sapiens
ccagcuacauuccucagcugcca

SEQ ID NO: 1431305 - RNA, 13 nt, Homo sapiens
ccagcuagugacc

SEQ ID NO: 1431306 - RNA, 15 nt, Homo sapiens
ccagcucccuucuuc

SEQ ID NO: 1431307 - RNA, 13 nt, Homo sapiens
ccagcugcuccca

SEQ ID NO: 1431308 - RNA, 18 nt, Homo sapiens
ccagcugcucccaaauaa

SEQ ID NO: 1431309 - RNA, 16 nt, Homo sapiens
ccagcuguagccaugg

SEQ ID NO: 1431310 - RNA, 22 nt, Homo sapiens
ccagcuguguucacacuguaaa

SEQ ID NO: 1431311 - RNA, 21 nt, Homo sapiens
ccagcuuguuugugaaacaaa

SEQ ID NO: 1431312 - RNA, 16 nt, Homo sapiens
ccagcuuuaucuguca

SEQ ID NO: 1431313 - RNA, 12 nt, Homo sapiens
ccaggaaggcag

SEQ ID NO: 1431314 - RNA, 23 nt, Homo sapiens
ccaggagguggagguugcaguga

SEQ ID NO: 1431315 - RNA, 22 nt, Homo sapiens
ccaggauggcgugugugccgug

SEQ ID NO: 1431316 - RNA, 21 nt, Homo sapiens
ccaggauuccucucucagguc

SEQ ID NO: 1431317 - RNA, 13 nt, Homo sapiens
ccaggauugacag

SEQ ID NO: 1431318 - RNA, 11 nt, Homo sapiens
ccaggauuuug

SEQ ID NO: 1431319 - RNA, 20 nt, Homo sapiens
ccaggcgggcggcacgccaa

SEQ ID NO: 1431320 - RNA, 14 nt, Homo sapiens
ccaggcuagaggca

SEQ ID NO: 1431321 - RNA, 15 nt, Homo sapiens
ccaggcuagagugca

SEQ ID NO: 1431322 - RNA, 14 nt, Homo sapiens
ccaggcucugggaa

SEQ ID NO: 1431323 - RNA, 19 nt, Homo sapiens
ccaggcugcacugcaguga

SEQ ID NO: 1431324 - RNA, 23 nt, Homo sapiens
ccagggaugggggaugggccagg

SEQ ID NO: 1431325 - RNA, 21 nt, Homo sapiens
ccagggccugggggcagugac

SEQ ID NO: 1431326 - RNA, 15 nt, Homo sapiens
ccaggggagcaguaa

SEQ ID NO: 1431327 - RNA, 22 nt, Homo sapiens
ccaggguugaucacacucuggg

SEQ ID NO: 1431328 - RNA, 20 nt, Homo sapiens
ccaggucguccaagcaaaaa

SEQ ID NO: 1431329 - RNA, 13 nt, Homo sapiens
ccaguacugggaa

SEQ ID NO: 1431330 - RNA, 15 nt, Homo sapiens
ccagucauucuggga

SEQ ID NO: 1431331 - RNA, 16 nt, Homo sapiens
ccagucauucugggaa

SEQ ID NO: 1431332 - RNA, 15 nt, Homo sapiens
ccagucccaaugcac

SEQ ID NO: 1431333 - RNA, 21 nt, Homo sapiens
ccaguguaaagaauaaaugaa

SEQ ID NO: 1431334 - RNA, 22 nt, Homo sapiens
ccaguuccuguagaacugagaa

SEQ ID NO: 1431335 - RNA, 18 nt, Homo sapiens
ccaguuuuuguugcuuga

SEQ ID NO: 1431336 - RNA, 16 nt, Homo sapiens
ccauaaacacccauga

SEQ ID NO: 1431337 - RNA, 19 nt, Homo sapiens
ccauaaccccaggcauccc

SEQ ID NO: 1431338 - RNA, 15 nt, Homo sapiens
ccauaaggccagaaa

SEQ ID NO: 1431339 - RNA, 15 nt, Homo sapiens
ccauaaucucauuca

SEQ ID NO: 1431340 - RNA, 20 nt, Homo sapiens
ccauaccccugccuggguuu

SEQ ID NO: 1431341 - RNA, 15 nt, Homo sapiens
ccauacuacccucau

SEQ ID NO: 1431342 - RNA, 13 nt, Homo sapiens
ccauagaaacuga

SEQ ID NO: 1431343 - RNA, 16 nt, Homo sapiens
ccauagaaacugaggc

SEQ ID NO: 1431344 - RNA, 20 nt, Homo sapiens
ccauagcaagauugcuuaaa

SEQ ID NO: 1431345 - RNA, 20 nt, Homo sapiens
ccauaguuauuuacuugaaa

SEQ ID NO: 1431346 - RNA, 20 nt, Homo sapiens
ccauauaucuuauguuaaag

SEQ ID NO: 1431347 - RNA, 14 nt, Homo sapiens
ccauaugucugcuu

SEQ ID NO: 1431348 - RNA, 15 nt, Homo sapiens
ccauauucacaccuc

SEQ ID NO: 1431349 - RNA, 13 nt, Homo sapiens
ccaucaaaugcug

SEQ ID NO: 1431350 - RNA, 18 nt, Homo sapiens
ccaucaggccuaaucuca

SEQ ID NO: 1431351 - RNA, 12 nt, Homo sapiens
ccaucaucccag

SEQ ID NO: 1431352 - RNA, 21 nt, Homo sapiens
ccauccgggacgcuuccagac

SEQ ID NO: 1431353 - RNA, 16 nt, Homo sapiens
ccaucggcuuccauau

SEQ ID NO: 1431354 - RNA, 17 nt, Homo sapiens
ccaucuuuuaauaugcu

SEQ ID NO: 1431355 - RNA, 21 nt, Homo sapiens
ccaugcauggugcaucagcag

SEQ ID NO: 1431356 - RNA, 10 nt, Homo sapiens
ccaugccacc

SEQ ID NO: 1431357 - RNA, 20 nt, Homo sapiens
ccaugccacccuguuuucag

SEQ ID NO: 1431358 - RNA, 23 nt, Homo sapiens
ccaugcuuuccuuuucuuccuuc

SEQ ID NO: 1431359 - RNA, 22 nt, Homo sapiens
ccauggcaccuuuugcacauaa

SEQ ID NO: 1431360 - RNA, 19 nt, Homo sapiens
ccaugggauguuaagcaaa

SEQ ID NO: 1431361 - RNA, 17 nt, Homo sapiens
ccaugggccugggccug

SEQ ID NO: 1431362 - RNA, 16 nt, Homo sapiens
ccauuaggcaugccua

SEQ ID NO: 1431363 - RNA, 23 nt, Homo sapiens
ccauuauuucaaccgcuugccau

SEQ ID NO: 1431364 - RNA, 21 nt, Homo sapiens
ccauuccuggaaucaaggaau

SEQ ID NO: 1431365 - RNA, 15 nt, Homo sapiens
ccauugcuguuguug

SEQ ID NO: 1431366 - RNA, 21 nt, Homo sapiens
ccauuuguuggggcaguggua

SEQ ID NO: 1431367 - RNA, 19 nt, Homo sapiens
cccaaaagucaccacucca

SEQ ID NO: 1431368 - RNA, 12 nt, Homo sapiens
cccaaagagccu

SEQ ID NO: 1431369 - RNA, 14 nt, Homo sapiens
cccaaaggcaucca

SEQ ID NO: 1431370 - RNA, 15 nt, Homo sapiens
cccaaaggcauccau

SEQ ID NO: 1431371 - RNA, 16 nt, Homo sapiens
cccaaauuucauaccu

SEQ ID NO: 1431372 - RNA, 19 nt, Homo sapiens
cccaacagcaccaauugua

SEQ ID NO: 1431373 - RNA, 18 nt, Homo sapiens
cccaaccucauggucaug

SEQ ID NO: 1431374 - RNA, 14 nt, Homo sapiens
cccaacgcacagga

SEQ ID NO: 1431375 - RNA, 14 nt, Homo sapiens
cccaacugcucugc

SEQ ID NO: 1431376 - RNA, 17 nt, Homo sapiens
cccaaucagcacugaaa

SEQ ID NO: 1431377 - RNA, 21 nt, Homo sapiens
cccaauucaggacuggcucac

SEQ ID NO: 1431378 - RNA, 19 nt, Homo sapiens
cccaccuagugcuuccacu

SEQ ID NO: 1431379 - RNA, 22 nt, Homo sapiens
cccacucccuggcucucagaag

SEQ ID NO: 1431380 - RNA, 22 nt, Homo sapiens
cccacugaguuugcuguuugca

SEQ ID NO: 1431381 - RNA, 21 nt, Homo sapiens
cccacuuacuaaccugguccu

SEQ ID NO: 1431382 - RNA, 15 nt, Homo sapiens
cccacuucacuguga

SEQ ID NO: 1431383 - RNA, 14 nt, Homo sapiens
cccagaaagaggca

SEQ ID NO: 1431384 - RNA, 12 nt, Homo sapiens
cccagaaggcag

SEQ ID NO: 1431385 - RNA, 22 nt, Homo sapiens
cccagaccuuuuauccacuuac

SEQ ID NO: 1431386 - RNA, 22 nt, Homo sapiens
cccagacucaaacucaagguca

SEQ ID NO: 1431387 - RNA, 17 nt, Homo sapiens
cccagacuuucuacacc

SEQ ID NO: 1431388 - RNA, 20 nt, Homo sapiens
cccagagaagcaaguggcuu

SEQ ID NO: 1431389 - RNA, 23 nt, Homo sapiens
cccagagaccccuuccuuuccuc

SEQ ID NO: 1431390 - RNA, 12 nt, Homo sapiens
cccagagcagga

SEQ ID NO: 1431391 - RNA, 21 nt, Homo sapiens
cccagaggugacccaaugcuc

SEQ ID NO: 1431392 - RNA, 15 nt, Homo sapiens
cccagauacuuccca

SEQ ID NO: 1431393 - RNA, 14 nt, Homo sapiens
cccagauccucugc

SEQ ID NO: 1431394 - RNA, 23 nt, Homo sapiens
cccagauccucugcugacuccau

SEQ ID NO: 1431395 - RNA, 16 nt, Homo sapiens
cccagcacugauguug

SEQ ID NO: 1431396 - RNA, 19 nt, Homo sapiens
cccagcagcgguaccccag

SEQ ID NO: 1431397 - RNA, 11 nt, Homo sapiens
cccagcauuca

SEQ ID NO: 1431398 - RNA, 17 nt, Homo sapiens
cccagcccuauggaugu

SEQ ID NO: 1431399 - RNA, 22 nt, Homo sapiens
cccagcucugcuuuuuccagau

SEQ ID NO: 1431400 - RNA, 21 nt, Homo sapiens
cccagcuucauuaugcagcug

SEQ ID NO: 1431401 - RNA, 17 nt, Homo sapiens
cccaggaaggacugugc

SEQ ID NO: 1431402 - RNA, 19 nt, Homo sapiens
cccaggcugcacugcagug

SEQ ID NO: 1431403 - RNA, 18 nt, Homo sapiens
cccaggcuggagugcagu

SEQ ID NO: 1431404 - RNA, 23 nt, Homo sapiens
cccaggcuggagugcaguagcac

SEQ ID NO: 1431405 - RNA, 16 nt, Homo sapiens
cccaggcuggucuuga

SEQ ID NO: 1431406 - RNA, 15 nt, Homo sapiens
cccagggacaaggga

SEQ ID NO: 1431407 - RNA, 13 nt, Homo sapiens
cccagggcuaccc

SEQ ID NO: 1431408 - RNA, 17 nt, Homo sapiens
cccagggggcggggugc

SEQ ID NO: 1431409 - RNA, 22 nt, Homo sapiens
cccagucgcucgacugcgacgc

SEQ ID NO: 1431410 - RNA, 14 nt, Homo sapiens
cccagugaccugac

SEQ ID NO: 1431411 - RNA, 21 nt, Homo sapiens
cccaguguaaagaauaaauga

SEQ ID NO: 1431412 - RNA, 21 nt, Homo sapiens
cccaguguuugggguguuuca

SEQ ID NO: 1431413 - RNA, 17 nt, Homo sapiens
cccaguuugcuggguuu

SEQ ID NO: 1431414 - RNA, 16 nt, Homo sapiens
cccauaaucucauuca

SEQ ID NO: 1431415 - RNA, 21 nt, Homo sapiens
cccauagaaacaugacacuga

SEQ ID NO: 1431416 - RNA, 15 nt, Homo sapiens
cccaugaaucaaaga

SEQ ID NO: 1431417 - RNA, 21 nt, Homo sapiens
cccaugaaucaaagacaugga

SEQ ID NO: 1431418 - RNA, 20 nt, Homo sapiens
cccaugcccuggauccauca

SEQ ID NO: 1431419 - RNA, 13 nt, Homo sapiens
cccauggccacuu

SEQ ID NO: 1431420 - RNA, 23 nt, Homo sapiens
cccauguauuuaucucuauuuaa

SEQ ID NO: 1431421 - RNA, 17 nt, Homo sapiens
cccauuuugagugacuc

SEQ ID NO: 1431422 - RNA, 23 nt, Homo sapiens
ccccaaaaccuuuccccagacac

SEQ ID NO: 1431423 - RNA, 23 nt, Homo sapiens
ccccaaacauuaaucaccaaagu

SEQ ID NO: 1431424 - RNA, 13 nt, Homo sapiens
ccccacuccagcc

SEQ ID NO: 1431425 - RNA, 24 nt, Homo sapiens
ccccagaaccagcugcagauggag

SEQ ID NO: 1431426 - RNA, 15 nt, Homo sapiens
ccccagcccuuugca

SEQ ID NO: 1431427 - RNA, 21 nt, Homo sapiens
ccccagguugccugggccacg

SEQ ID NO: 1431428 - RNA, 23 nt, Homo sapiens
ccccagugcagggaaccgugaua

SEQ ID NO: 1431429 - RNA, 19 nt, Homo sapiens
ccccauaucuuuaaagugu

SEQ ID NO: 1431430 - RNA, 20 nt, Homo sapiens
ccccauaucuuuaaagugug

SEQ ID NO: 1431431 - RNA, 17 nt, Homo sapiens
ccccaucucauucaggu

SEQ ID NO: 1431432 - RNA, 21 nt, Homo sapiens
cccccauaucuuuaaagugug

SEQ ID NO: 1431433 - RNA, 14 nt, Homo sapiens
cccccgcuccagau

SEQ ID NO: 1431434 - RNA, 17 nt, Homo sapiens
cccccggagcagggguc

SEQ ID NO: 1431435 - RNA, 14 nt, Homo sapiens
cccccuucagugcc

SEQ ID NO: 1431436 - RNA, 13 nt, Homo sapiens
ccccgcuccagau

SEQ ID NO: 1431437 - RNA, 16 nt, Homo sapiens
ccccggccucagcacc

SEQ ID NO: 1431438 - RNA, 15 nt, Homo sapiens
ccccucacucuguca

SEQ ID NO: 1431439 - RNA, 12 nt, Homo sapiens
ccccucaucuca

SEQ ID NO: 1431440 - RNA, 20 nt, Homo sapiens
ccccucauuguuuauuaaca

SEQ ID NO: 1431441 - RNA, 15 nt, Homo sapiens
ccccucggagaagag

SEQ ID NO: 1431442 - RNA, 14 nt, Homo sapiens
ccccuggcuuuuca

SEQ ID NO: 1431443 - RNA, 18 nt, Homo sapiens
ccccuggguaacugucaa

SEQ ID NO: 1431444 - RNA, 22 nt, Homo sapiens
ccccuuauccaggacucuguca

SEQ ID NO: 1431445 - RNA, 23 nt, Homo sapiens
ccccuuauccaggacucugucaa

SEQ ID NO: 1431446 - RNA, 16 nt, Homo sapiens
cccgacuccucaaaag

SEQ ID NO: 1431447 - RNA, 20 nt, Homo sapiens
cccguggucuccuugcacuu

SEQ ID NO: 1431448 - RNA, 22 nt, Homo sapiens
cccguggucuccuugcacuuuc

SEQ ID NO: 1431449 - RNA, 14 nt, Homo sapiens
cccuaaaacaugug

SEQ ID NO: 1431450 - RNA, 19 nt, Homo sapiens
cccuagcgcucucuuccag

SEQ ID NO: 1431451 - RNA, 18 nt, Homo sapiens
cccuaucaaaacauauca

SEQ ID NO: 1431452 - RNA, 16 nt, Homo sapiens
cccuauccacccagcc

SEQ ID NO: 1431453 - RNA, 15 nt, Homo sapiens
cccuauuuuugcaau

SEQ ID NO: 1431454 - RNA, 13 nt, Homo sapiens
cccuccacuucaa

SEQ ID NO: 1431455 - RNA, 21 nt, Homo sapiens
cccuccauccggcuccuguca

SEQ ID NO: 1431456 - RNA, 13 nt, Homo sapiens
cccucccagagaa

SEQ ID NO: 1431457 - RNA, 22 nt, Homo sapiens
cccucccgggggcacugccuga

SEQ ID NO: 1431458 - RNA, 23 nt, Homo sapiens
cccucggugaugcggacaucuca

SEQ ID NO: 1431459 - RNA, 17 nt, Homo sapiens
cccucucccaugcacac

SEQ ID NO: 1431460 - RNA, 22 nt, Homo sapiens
cccucuccuuccuuacccaaac

SEQ ID NO: 1431461 - RNA, 22 nt, Homo sapiens
cccucuucuucucccugugugg

SEQ ID NO: 1431462 - RNA, 19 nt, Homo sapiens
cccucuuuccccaccucuu

SEQ ID NO: 1431463 - RNA, 17 nt, Homo sapiens
cccugaaaacccagaga

SEQ ID NO: 1431464 - RNA, 18 nt, Homo sapiens
cccugaguggaucuccaa

SEQ ID NO: 1431465 - RNA, 14 nt, Homo sapiens
cccugauaagcaaa

SEQ ID NO: 1431466 - RNA, 18 nt, Homo sapiens
cccugccacuuugcaugg

SEQ ID NO: 1431467 - RNA, 21 nt, Homo sapiens
cccuggggcuucuccugaccc

SEQ ID NO: 1431468 - RNA, 22 nt, Homo sapiens
cccuggggcuucuccugaccca

SEQ ID NO: 1431469 - RNA, 21 nt, Homo sapiens
cccuguaccacaaacacauua

SEQ ID NO: 1431470 - RNA, 15 nt, Homo sapiens
cugucucaagcucuu

SEQ ID NO: 1431471 - RNA, 13 nt, Homo sapiens
cugucucuacuaa

SEQ ID NO: 1431472 - RNA, 18 nt, Homo sapiens
cugucugcagugugcacg

SEQ ID NO: 1431473 - RNA, 21 nt, Homo sapiens
cugucuguagagccgcauggc

SEQ ID NO: 1431474 - RNA, 16 nt, Homo sapiens
cugucugucaccagcu

SEQ ID NO: 1431475 - RNA, 20 nt, Homo sapiens
cugucuuaaggcaucugaca

SEQ ID NO: 1431476 - RNA, 17 nt, Homo sapiens
cugucuuccuucauuau

SEQ ID NO: 1431477 - RNA, 23 nt, Homo sapiens
cugugaccugcugagcucugaga

SEQ ID NO: 1431478 - RNA, 24 nt, Homo sapiens
cugugauuuuuuuuaaaugugcag

SEQ ID NO: 1431479 - RNA, 22 nt, Homo sapiens
cugugcccucccauagcacugc

SEQ ID NO: 1431480 - RNA, 11 nt, Homo sapiens
cuguggcacag

SEQ ID NO: 1431481 - RNA, 19 nt, Homo sapiens
cugugggaagagaagggaa

SEQ ID NO: 1431482 - RNA, 17 nt, Homo sapiens
cugugggugcuaagggu

SEQ ID NO: 1431483 - RNA, 19 nt, Homo sapiens
cugugggugcuaaggguaa

SEQ ID NO: 1431484 - RNA, 16 nt, Homo sapiens
cuguguagcugugacc

SEQ ID NO: 1431485 - RNA, 21 nt, Homo sapiens
cuguguauuuaacugccuugu

SEQ ID NO: 1431486 - RNA, 12 nt, Homo sapiens
cugugugcugac

SEQ ID NO: 1431487 - RNA, 22 nt, Homo sapiens
cugugugugaaaggaagcucca

SEQ ID NO: 1431488 - RNA, 17 nt, Homo sapiens
cuguuacugaaaguggu

SEQ ID NO: 1431489 - RNA, 18 nt, Homo sapiens
cuguuacuugaaauacca

SEQ ID NO: 1431490 - RNA, 23 nt, Homo sapiens
cuguuauccugcuagcuguagaa

SEQ ID NO: 1431491 - RNA, 22 nt, Homo sapiens
cuguuauuaccauuagcauucu

SEQ ID NO: 1431492 - RNA, 21 nt, Homo sapiens
cuguucuaagugcuggcaauu

SEQ ID NO: 1431493 - RNA, 15 nt, Homo sapiens
cuguucugcacugaa

SEQ ID NO: 1431494 - RNA, 22 nt, Homo sapiens
cuguucugugugggucugggga

SEQ ID NO: 1431495 - RNA, 12 nt, Homo sapiens
cuguugaaucuu

SEQ ID NO: 1431496 - RNA, 23 nt, Homo sapiens
cuguugaucccacuucacuguga

SEQ ID NO: 1431497 - RNA, 15 nt, Homo sapiens
cuguuguaauagucc

SEQ ID NO: 1431498 - RNA, 17 nt, Homo sapiens
cuguuucuaacucaggg

SEQ ID NO: 1431499 - RNA, 16 nt, Homo sapiens
cuguuuuaaugacaag

SEQ ID NO: 1431500 - RNA, 20 nt, Homo sapiens
cuguuuuguuuuuaaaucaa

SEQ ID NO: 1431501 - RNA, 14 nt, Homo sapiens
cuuaaaauguuaac

SEQ ID NO: 1431502 - RNA, 16 nt, Homo sapiens
cuuaaucuccacuguu

SEQ ID NO: 1431503 - RNA, 15 nt, Homo sapiens
cuuaauguuuauucc

SEQ ID NO: 1431504 - RNA, 13 nt, Homo sapiens
cuuacuacuugcc

SEQ ID NO: 1431505 - RNA, 15 nt, Homo sapiens
cuuacuuauucuucc

SEQ ID NO: 1431506 - RNA, 20 nt, Homo sapiens
cuuacuucgugcgcaacaac

SEQ ID NO: 1431507 - RNA, 13 nt, Homo sapiens
cuuagcauguccc

SEQ ID NO: 1431508 - RNA, 18 nt, Homo sapiens
cuuagccucccaaagugc

SEQ ID NO: 1431509 - RNA, 21 nt, Homo sapiens
cuuagcuucuauuauagccac

SEQ ID NO: 1431510 - RNA, 18 nt, Homo sapiens
cuuauagaaaguucaaaa

SEQ ID NO: 1431511 - RNA, 20 nt, Homo sapiens
cuuauaucaucagcauaccu

SEQ ID NO: 1431512 - RNA, 20 nt, Homo sapiens
cuuaugccuauaccugaaua

SEQ ID NO: 1431513 - RNA, 13 nt, Homo sapiens
cuuaugugagccc

SEQ ID NO: 1431514 - RNA, 13 nt, Homo sapiens
uucagugcuucuu

SEQ ID NO: 1431515 - RNA, 16 nt, Homo sapiens
uucaguggugugaucu

SEQ ID NO: 1431516 - RNA, 20 nt, Homo sapiens
uucaucagacuccugugcaa

SEQ ID NO: 1431517 - RNA, 14 nt, Homo sapiens
uucaucaugacaac

SEQ ID NO: 1431518 - RNA, 22 nt, Homo sapiens
uucauccaguuuguucuccggg

SEQ ID NO: 1431519 - RNA, 20 nt, Homo sapiens
uucaucucaggccucccuca

SEQ ID NO: 1431520 - RNA, 18 nt, Homo sapiens
uucauucaguacaagaga

SEQ ID NO: 1431521 - RNA, 17 nt, Homo sapiens
uuccaaagaacagccug

SEQ ID NO: 1431522 - RNA, 20 nt, Homo sapiens
uuccaaaggcauaagacccu

SEQ ID NO: 1431523 - RNA, 13 nt, Homo sapiens
uuccaaugcauug

SEQ ID NO: 1431524 - RNA, 20 nt, Homo sapiens
uuccacaccuagcaucucau

SEQ ID NO: 1431525 - RNA, 15 nt, Homo sapiens
uuccacgagcuauau

SEQ ID NO: 1431526 - RNA, 20 nt, Homo sapiens
uuccacuggcuccacaucca

SEQ ID NO: 1431527 - RNA, 15 nt, Homo sapiens
uuccacuucuaugca

SEQ ID NO: 1431528 - RNA, 23 nt, Homo sapiens
uuccacuuugaguaccaaaucca

SEQ ID NO: 1431529 - RNA, 15 nt, Homo sapiens
uuccagcauuugcca

SEQ ID NO: 1431530 - RNA, 20 nt, Homo sapiens
uuccagcauuugccauuccu

SEQ ID NO: 1431531 - RNA, 20 nt, Homo sapiens
uuccagcuagugacccacau

SEQ ID NO: 1431532 - RNA, 23 nt, Homo sapiens
uuccaggaguucugaagcugaca

SEQ ID NO: 1431533 - RNA, 19 nt, Homo sapiens
uuccauaaacacccaugaa

SEQ ID NO: 1431534 - RNA, 23 nt, Homo sapiens
uuccauaaccccaggcaucccau

SEQ ID NO: 1431535 - RNA, 19 nt, Homo sapiens
uuccauaaucuggacuccu

SEQ ID NO: 1431536 - RNA, 14 nt, Homo sapiens
uuccaugaaguuug

SEQ ID NO: 1431537 - RNA, 18 nt, Homo sapiens
uuccauuucgccccucau

SEQ ID NO: 1431538 - RNA, 20 nt, Homo sapiens
uucccaacuagacauuacca

SEQ ID NO: 1431539 - RNA, 16 nt, Homo sapiens
uucccaagagcaucau

SEQ ID NO: 1431540 - RNA, 14 nt, Homo sapiens
uucccaauacauac

SEQ ID NO: 1431541 - RNA, 16 nt, Homo sapiens
uucccaauacauacca

SEQ ID NO: 1431542 - RNA, 20 nt, Homo sapiens
uucccaaucagcacugaaaa

SEQ ID NO: 1431543 - RNA, 13 nt, Homo sapiens
uucccacauucau

SEQ ID NO: 1431544 - RNA, 11 nt, Homo sapiens
uucccaccacc

SEQ ID NO: 1431545 - RNA, 12 nt, Homo sapiens
uucccaccucag

SEQ ID NO: 1431546 - RNA, 21 nt, Homo sapiens
uucccagaagggaguugcuca

SEQ ID NO: 1431547 - RNA, 14 nt, Homo sapiens
uucccagcucuccc

SEQ ID NO: 1431548 - RNA, 13 nt, Homo sapiens
uucccagcugucu

SEQ ID NO: 1431549 - RNA, 17 nt, Homo sapiens
uucccaggaauauccca

SEQ ID NO: 1431550 - RNA, 20 nt, Homo sapiens
uucccaguggucaaaccgca

SEQ ID NO: 1431551 - RNA, 23 nt, Homo sapiens
uucccaucacuggagcaccaggc

SEQ ID NO: 1431552 - RNA, 12 nt, Homo sapiens
uucccauccaua

SEQ ID NO: 1431553 - RNA, 23 nt, Homo sapiens
uucccccacuugggagcuuguau

SEQ ID NO: 1431554 - RNA, 12 nt, Homo sapiens
uucccccaguca

SEQ ID NO: 1431555 - RNA, 17 nt, Homo sapiens
uuccccucagagcucuu

SEQ ID NO: 1431556 - RNA, 20 nt, Homo sapiens
uucccuaucaaaacauauca

SEQ ID NO: 1431557 - RNA, 12 nt, Homo sapiens
uuccuaacauaa

SEQ ID NO: 1431558 - RNA, 21 nt, Homo sapiens
uuccuacacccuuggacuuga

SEQ ID NO: 1431559 - RNA, 20 nt, Homo sapiens
uuccuauuuggggcuugcau

SEQ ID NO: 1431560 - RNA, 20 nt, Homo sapiens
uuccucagggacagagacac

SEQ ID NO: 1431561 - RNA, 18 nt, Homo sapiens
uuccucccuauuaaccua

SEQ ID NO: 1431562 - RNA, 19 nt, Homo sapiens
uuccucccuauuaaccuag

SEQ ID NO: 1431563 - RNA, 22 nt, Homo sapiens
uuccucuauccuguacauuuca

SEQ ID NO: 1431564 - RNA, 19 nt, Homo sapiens
uuccucuguucuaucccac

SEQ ID NO: 1431565 - RNA, 23 nt, Homo sapiens
uuccugaaggacgcgccagggga

SEQ ID NO: 1431566 - RNA, 17 nt, Homo sapiens
uuccugcacuccagaau

SEQ ID NO: 1431567 - RNA, 17 nt, Homo sapiens
uuccugcuacacaaaag

SEQ ID NO: 1431568 - RNA, 17 nt, Homo sapiens
cuuauucccaacugcuc

SEQ ID NO: 1431569 - RNA, 22 nt, Homo sapiens
cuuauucuugagcacaaaauga

SEQ ID NO: 1431570 - RNA, 21 nt, Homo sapiens
cuuauuuauauaucaguuaua

SEQ ID NO: 1431571 - RNA, 14 nt, Homo sapiens
cuucaaaucagaag

SEQ ID NO: 1431572 - RNA, 13 nt, Homo sapiens
cuucacagugacc

SEQ ID NO: 1431573 - RNA, 14 nt, Homo sapiens
cuucacaguguuuc

SEQ ID NO: 1431574 - RNA, 16 nt, Homo sapiens
cuucagaagacacugc

SEQ ID NO: 1431575 - RNA, 20 nt, Homo sapiens
cuucagaagacacugcaaag

SEQ ID NO: 1431576 - RNA, 20 nt, Homo sapiens
cuucagaauauggacaaaga

SEQ ID NO: 1431577 - RNA, 19 nt, Homo sapiens
cuucagccaucaacaagag

SEQ ID NO: 1431578 - RNA, 18 nt, Homo sapiens
cuucaggacuauuucacu

SEQ ID NO: 1431579 - RNA, 13 nt, Homo sapiens
cuucagggccaga

SEQ ID NO: 1431580 - RNA, 15 nt, Homo sapiens
cuucagggugaguga

SEQ ID NO: 1431581 - RNA, 22 nt, Homo sapiens
cuucagguucuuucugaaaucg

SEQ ID NO: 1431582 - RNA, 16 nt, Homo sapiens
cuucaguuguuuuccc

SEQ ID NO: 1431583 - RNA, 15 nt, Homo sapiens
cuucaucccaaagga

SEQ ID NO: 1431584 - RNA, 12 nt, Homo sapiens
cuucaucuguga

SEQ ID NO: 1431585 - RNA, 20 nt, Homo sapiens
cuucaucuugacauguaaug

SEQ ID NO: 1431586 - RNA, 20 nt, Homo sapiens
cuucauuugggaaauucagc

SEQ ID NO: 1431587 - RNA, 14 nt, Homo sapiens
cuuccaaaccugac

SEQ ID NO: 1431588 - RNA, 17 nt, Homo sapiens
cuuccacuucuaugcaa

SEQ ID NO: 1431589 - RNA, 19 nt, Homo sapiens
cuuccacuuugaguaccaa

SEQ ID NO: 1431590 - RNA, 22 nt, Homo sapiens
cuuccagagccuaagaaaauca

SEQ ID NO: 1431591 - RNA, 16 nt, Homo sapiens
cuuccauaucuuccag

SEQ ID NO: 1431592 - RNA, 15 nt, Homo sapiens
cuuccauuaaaacaa

SEQ ID NO: 1431593 - RNA, 21 nt, Homo sapiens
cuucccaaucagcacugaaaa

SEQ ID NO: 1431594 - RNA, 15 nt, Homo sapiens
cuuccccaucuccau

SEQ ID NO: 1431595 - RNA, 16 nt, Homo sapiens
cuucccccauccucca

SEQ ID NO: 1431596 - RNA, 13 nt, Homo sapiens
cuuccccuucucg

SEQ ID NO: 1431597 - RNA, 15 nt, Homo sapiens
cuucccuuuccucca

SEQ ID NO: 1431598 - RNA, 15 nt, Homo sapiens
cuuccuccccagucu

SEQ ID NO: 1431599 - RNA, 22 nt, Homo sapiens
cuuccuccugguucaagcgauu

SEQ ID NO: 1431600 - RNA, 15 nt, Homo sapiens
cuuccucuccacugc

SEQ ID NO: 1431601 - RNA, 18 nt, Homo sapiens
cuuccuggacagcugugc

SEQ ID NO: 1431602 - RNA, 21 nt, Homo sapiens
cuuccuggguccuguucccua

SEQ ID NO: 1431603 - RNA, 23 nt, Homo sapiens
cuuccuggguccuguucccuacc

SEQ ID NO: 1431604 - RNA, 14 nt, Homo sapiens
cuucgacucaggau

SEQ ID NO: 1431605 - RNA, 23 nt, Homo sapiens
cuucgauacaccgggccuggaga

SEQ ID NO: 1431606 - RNA, 22 nt, Homo sapiens
cuucgguuuguauuuagugucu

SEQ ID NO: 1431607 - RNA, 18 nt, Homo sapiens
cuucuaaaugaagugcaa

SEQ ID NO: 1431608 - RNA, 19 nt, Homo sapiens
cuucuaccuuaaaauguaa

SEQ ID NO: 1431609 - RNA, 11 nt, Homo sapiens
cuucucaaaag

SEQ ID NO: 1431610 - RNA, 20 nt, Homo sapiens
cuucucaggacacaggccug

SEQ ID NO: 1431611 - RNA, 16 nt, Homo sapiens
guaugcagaauguuuu

SEQ ID NO: 1431612 - RNA, 12 nt, Homo sapiens
guaugcauucau

SEQ ID NO: 1431613 - RNA, 14 nt, Homo sapiens
guaugcucauacuu

SEQ ID NO: 1431614 - RNA, 18 nt, Homo sapiens
guaugcuggccagcaccc

SEQ ID NO: 1431615 - RNA, 18 nt, Homo sapiens
guauggaauacaguguua

SEQ ID NO: 1431616 - RNA, 21 nt, Homo sapiens
guauguguauuuguauguacu

SEQ ID NO: 1431617 - RNA, 20 nt, Homo sapiens
guauuaaagauguguuguug

SEQ ID NO: 1431618 - RNA, 15 nt, Homo sapiens
guauuaucaccagca

SEQ ID NO: 1431619 - RNA, 14 nt, Homo sapiens
guauucuauucaaa

SEQ ID NO: 1431620 - RNA, 16 nt, Homo sapiens
guauuuagugucuuga

SEQ ID NO: 1431621 - RNA, 11 nt, Homo sapiens
guauuugccau

SEQ ID NO: 1431622 - RNA, 18 nt, Homo sapiens
guauuugucaaugcauca

SEQ ID NO: 1431623 - RNA, 14 nt, Homo sapiens
guauuuugccagac

SEQ ID NO: 1431624 - RNA, 13 nt, Homo sapiens
guauuuuugucau

SEQ ID NO: 1431625 - RNA, 14 nt, Homo sapiens
gucaaaacauucag

SEQ ID NO: 1431626 - RNA, 22 nt, Homo sapiens
gucaaaguaaaacuugcugccu

SEQ ID NO: 1431627 - RNA, 13 nt, Homo sapiens
gucaaaugucauu

SEQ ID NO: 1431628 - RNA, 21 nt, Homo sapiens
gucaacaaccaugccagggau

SEQ ID NO: 1431629 - RNA, 14 nt, Homo sapiens
gucaaccaggaaca

SEQ ID NO: 1431630 - RNA, 16 nt, Homo sapiens
gucaagcgugcagcuu

SEQ ID NO: 1431631 - RNA, 15 nt, Homo sapiens
gucaaggacuccugu

SEQ ID NO: 1431632 - RNA, 23 nt, Homo sapiens
gucaauaccccuguuaagcaauu

SEQ ID NO: 1431633 - RNA, 20 nt, Homo sapiens
gucaaucccaaaagucacca

SEQ ID NO: 1431634 - RNA, 11 nt, Homo sapiens
gucaccaaaau

SEQ ID NO: 1431635 - RNA, 17 nt, Homo sapiens
gucaccaauguacccac

SEQ ID NO: 1431636 - RNA, 22 nt, Homo sapiens
gucacccgagcuagagugcagu

SEQ ID NO: 1431637 - RNA, 18 nt, Homo sapiens
gucaccucagcugauauu

SEQ ID NO: 1431638 - RNA, 11 nt, Homo sapiens
gucaccuugcu

SEQ ID NO: 1431639 - RNA, 12 nt, Homo sapiens
gucacugucuca

SEQ ID NO: 1431640 - RNA, 17 nt, Homo sapiens
gucagaacucuguguug

SEQ ID NO: 1431641 - RNA, 15 nt, Homo sapiens
gucagaguucugcuc

SEQ ID NO: 1431642 - RNA, 14 nt, Homo sapiens
gucaggacccaggc

SEQ ID NO: 1431643 - RNA, 19 nt, Homo sapiens
gucaggacuugaacccagg

SEQ ID NO: 1431644 - RNA, 21 nt, Homo sapiens
gucaguuucauggaggggaaa

SEQ ID NO: 1431645 - RNA, 20 nt, Homo sapiens
gucaucaaauauuaccaaaa

SEQ ID NO: 1431646 - RNA, 20 nt, Homo sapiens
gucauccccuugugucagag

SEQ ID NO: 1431647 - RNA, 23 nt, Homo sapiens
gucauuuugggaccuauaucuca

SEQ ID NO: 1431648 - RNA, 23 nt, Homo sapiens
guccagagccggggcacuuucag

SEQ ID NO: 1431649 - RNA, 17 nt, Homo sapiens
guccagccaacauuuaa

SEQ ID NO: 1431650 - RNA, 19 nt, Homo sapiens
guccaggaaggcagcugcu

SEQ ID NO: 1431651 - RNA, 19 nt, Homo sapiens
guccaggcccaaggaguaa

SEQ ID NO: 1431652 - RNA, 19 nt, Homo sapiens
gucccaaacagagggccac

SEQ ID NO: 1431653 - RNA, 16 nt, Homo sapiens
gucccaagcccaggga

SEQ ID NO: 1431654 - RNA, 14 nt, Homo sapiens
gucccacacuggug

SEQ ID NO: 1431655 - RNA, 18 nt, Homo sapiens
gucccacaucccugggcc

SEQ ID NO: 1431656 - RNA, 13 nt, Homo sapiens
gucccaccaacuc

SEQ ID NO: 1431657 - RNA, 19 nt, Homo sapiens
gucccagagguuaucugcc

SEQ ID NO: 1431658 - RNA, 14 nt, Homo sapiens
guccccaccuggga

SEQ ID NO: 1431659 - RNA, 14 nt, Homo sapiens
gucccccccagugc

SEQ ID NO: 1431660 - RNA, 18 nt, Homo sapiens
guccccucacucugucag

SEQ ID NO: 1431661 - RNA, 23 nt, Homo sapiens
guccccugaaaaacugaucaaaa

SEQ ID NO: 1431662 - RNA, 17 nt, Homo sapiens
guccccugccucaagaa

SEQ ID NO: 1431663 - RNA, 12 nt, Homo sapiens
gucccucggagc

SEQ ID NO: 1431664 - RNA, 17 nt, Homo sapiens
guccgccaaacacucca

SEQ ID NO: 1431665 - RNA, 21 nt, Homo sapiens
guccuaacccccuuacugugc

SEQ ID NO: 1431666 - RNA, 21 nt, Homo sapiens
guccuaugucaauuuguauau

SEQ ID NO: 1431667 - RNA, 14 nt, Homo sapiens
guccugagcaccug

SEQ ID NO: 1431668 - RNA, 22 nt, Homo sapiens
guccugcccaaugccuugacaa

SEQ ID NO: 1431669 - RNA, 14 nt, Homo sapiens
guccugcucucuuc

SEQ ID NO: 1431670 - RNA, 16 nt, Homo sapiens
guccugcucucuucag

SEQ ID NO: 1431671 - RNA, 20 nt, Homo sapiens
guccuucuuuaucugugaua

SEQ ID NO: 1431672 - RNA, 20 nt, Homo sapiens
guccuuuuauaaacauuggu

SEQ ID NO: 1431673 - RNA, 17 nt, Homo sapiens
gucgaauguuagauucc

SEQ ID NO: 1431674 - RNA, 15 nt, Homo sapiens
gucgacuuugagcug

SEQ ID NO: 1431675 - RNA, 14 nt, Homo sapiens
gucuagaggugaga

SEQ ID NO: 1431676 - RNA, 22 nt, Homo sapiens
gucucaacuacucagcucuccu

SEQ ID NO: 1431677 - RNA, 15 nt, Homo sapiens
gucucaagacugaaa

SEQ ID NO: 1431678 - RNA, 18 nt, Homo sapiens
gucucccuaaaauaaaaa

SEQ ID NO: 1431679 - RNA, 16 nt, Homo sapiens
gucuccuggucugugc

SEQ ID NO: 1431680 - RNA, 16 nt, Homo sapiens
gucuccuugcacuuuc

SEQ ID NO: 1431681 - RNA, 20 nt, Homo sapiens
gucucucuaaacccaaauaa

SEQ ID NO: 1431682 - RNA, 14 nt, Homo sapiens
gucucugcaucuca

SEQ ID NO: 1431683 - RNA, 19 nt, Homo sapiens
aggaggacuacuauuugaa

SEQ ID NO: 1431684 - RNA, 15 nt, Homo sapiens
aggaggacuugcagg

SEQ ID NO: 1431685 - RNA, 22 nt, Homo sapiens
aggagggggucguggagagcua

SEQ ID NO: 1431686 - RNA, 23 nt, Homo sapiens
aggaggugcuaucgcaccacugu

SEQ ID NO: 1431687 - RNA, 20 nt, Homo sapiens
aggagguggagguugcagug

SEQ ID NO: 1431688 - RNA, 20 nt, Homo sapiens
aggagucaacguguuuaccu

SEQ ID NO: 1431689 - RNA, 12 nt, Homo sapiens
aggaucucagcc

SEQ ID NO: 1431690 - RNA, 14 nt, Homo sapiens
aggaucuguacaau

SEQ ID NO: 1431691 - RNA, 22 nt, Homo sapiens
aggaugauuuccuggggcacag

SEQ ID NO: 1431692 - RNA, 18 nt, Homo sapiens
aggauggcgugugugccg

SEQ ID NO: 1431693 - RNA, 17 nt, Homo sapiens
aggauucauguggaaua

SEQ ID NO: 1431694 - RNA, 13 nt, Homo sapiens
aggcaaaggccag

SEQ ID NO: 1431695 - RNA, 13 nt, Homo sapiens
aggcaaccuuccc

SEQ ID NO: 1431696 - RNA, 21 nt, Homo sapiens
aggcaacugugaguccgggaa

SEQ ID NO: 1431697 - RNA, 13 nt, Homo sapiens
aggcaagagaaaa

SEQ ID NO: 1431698 - RNA, 15 nt, Homo sapiens
aggcaauacauguau

SEQ ID NO: 1431699 - RNA, 19 nt, Homo sapiens
aggcaccugcuggaaacca

SEQ ID NO: 1431700 - RNA, 22 nt, Homo sapiens
aggcacugcugcccagccucca

SEQ ID NO: 1431701 - RNA, 20 nt, Homo sapiens
aggcagcagaaaucauuuuc

SEQ ID NO: 1431702 - RNA, 18 nt, Homo sapiens
aggcagggcaaaugacau

SEQ ID NO: 1431703 - RNA, 21 nt, Homo sapiens
aggcagggcaaaugcuugauu

SEQ ID NO: 1431704 - RNA, 21 nt, Homo sapiens
aggcagggccuugcccagaga

SEQ ID NO: 1431705 - RNA, 23 nt, Homo sapiens
aggcaggggugggagagccagcu

SEQ ID NO: 1431706 - RNA, 19 nt, Homo sapiens
aggcaugaacacacaugga

SEQ ID NO: 1431707 - RNA, 14 nt, Homo sapiens
aggcauuucuauca

SEQ ID NO: 1431708 - RNA, 13 nt, Homo sapiens
aggccaacaaacc

SEQ ID NO: 1431709 - RNA, 22 nt, Homo sapiens
aggccagggaaagcccguguca

SEQ ID NO: 1431710 - RNA, 21 nt, Homo sapiens
aggccauccauucacagccag

SEQ ID NO: 1431711 - RNA, 17 nt, Homo sapiens
aggcccaaggaguaagu

SEQ ID NO: 1431712 - RNA, 18 nt, Homo sapiens
aggcccagaaagaggcag

SEQ ID NO: 1431713 - RNA, 15 nt, Homo sapiens
aggcccagcagccuu

SEQ ID NO: 1431714 - RNA, 17 nt, Homo sapiens
aggcccgagcagcugag

SEQ ID NO: 1431715 - RNA, 16 nt, Homo sapiens
aggcccuccaugggcu

SEQ ID NO: 1431716 - RNA, 19 nt, Homo sapiens
aggcccuuauuuucaagaa

SEQ ID NO: 1431717 - RNA, 15 nt, Homo sapiens
aggccucaucuccuu

SEQ ID NO: 1431718 - RNA, 18 nt, Homo sapiens
aggccucuuggaccucug

SEQ ID NO: 1431719 - RNA, 22 nt, Homo sapiens
aggccuucugggccuccaaagc

SEQ ID NO: 1431720 - RNA, 16 nt, Homo sapiens
aggcgcgguggcucuu

SEQ ID NO: 1431721 - RNA, 18 nt, Homo sapiens
aggcggauggcugugacc

SEQ ID NO: 1431722 - RNA, 23 nt, Homo sapiens
aggcggccucgugccaugaucug

SEQ ID NO: 1431723 - RNA, 22 nt, Homo sapiens
aggcggucaugugugcauguga

SEQ ID NO: 1431724 - RNA, 21 nt, Homo sapiens
aggcuaagaugagauuugcca

SEQ ID NO: 1431725 - RNA, 23 nt, Homo sapiens
aggcuaauuuuuauauuuuuaga

SEQ ID NO: 1431726 - RNA, 23 nt, Homo sapiens
aggcuccugugcuacuuugccuu

SEQ ID NO: 1431727 - RNA, 17 nt, Homo sapiens
aggcucuggagccagag

SEQ ID NO: 1431728 - RNA, 12 nt, Homo sapiens
aggcucugggaa

SEQ ID NO: 1431729 - RNA, 13 nt, Homo sapiens
aggcucugggaag

SEQ ID NO: 1431730 - RNA, 22 nt, Homo sapiens
aggcugagcuggcauuggucug

SEQ ID NO: 1431731 - RNA, 18 nt, Homo sapiens
aggcuggagcccagcauu

SEQ ID NO: 1431732 - RNA, 13 nt, Homo sapiens
aggcuguggugag

SEQ ID NO: 1431733 - RNA, 21 nt, Homo sapiens
agggaacccugcuugcacuuu

SEQ ID NO: 1431734 - RNA, 21 nt, Homo sapiens
agggaagagagggguacauuu

SEQ ID NO: 1431735 - RNA, 10 nt, Homo sapiens
agggacacac

SEQ ID NO: 1431736 - RNA, 19 nt, Homo sapiens
agggacacguuaggaaugu

SEQ ID NO: 1431737 - RNA, 16 nt, Homo sapiens
agggacuccaguucac

SEQ ID NO: 1431738 - RNA, 18 nt, Homo sapiens
agggacugucgcugcuuc

SEQ ID NO: 1431739 - RNA, 14 nt, Homo sapiens
agggagcacugggu

SEQ ID NO: 1431740 - RNA, 13 nt, Homo sapiens
agggagccuggaa

SEQ ID NO: 1431741 - RNA, 16 nt, Homo sapiens
agggagggcucugagg

SEQ ID NO: 1431742 - RNA, 19 nt, Homo sapiens
agggaucuugcauucccag

SEQ ID NO: 1431743 - RNA, 22 nt, Homo sapiens
agggaucuugcauucccagugg

SEQ ID NO: 1431744 - RNA, 16 nt, Homo sapiens
agggaugacugugauu

SEQ ID NO: 1431745 - RNA, 22 nt, Homo sapiens
agggaugccacccagcaacaca

SEQ ID NO: 1431746 - RNA, 16 nt, Homo sapiens
agggauguaacuauug

SEQ ID NO: 1431747 - RNA, 22 nt, Homo sapiens
agggcaaaugacaugcacugac

SEQ ID NO: 1431748 - RNA, 15 nt, Homo sapiens
agggcacaggagcua

SEQ ID NO: 1431749 - RNA, 22 nt, Homo sapiens
agggcagccaggggcugcucau

SEQ ID NO: 1431750 - RNA, 22 nt, Homo sapiens
agggcaggcuugccaccgggga

SEQ ID NO: 1431751 - RNA, 20 nt, Homo sapiens
agggcagucaguaguauucu

SEQ ID NO: 1431752 - RNA, 17 nt, Homo sapiens
agggcauggccaggugg

SEQ ID NO: 1431753 - RNA, 18 nt, Homo sapiens
agggccaggauuccucuc

SEQ ID NO: 1431754 - RNA, 22 nt, Homo sapiens
agggccaggauuccucucucag

SEQ ID NO: 1431755 - RNA, 14 nt, Homo sapiens
agggcuagaaccua

SEQ ID NO: 1431756 - RNA, 23 nt, Homo sapiens
agggcuagaaucuggagagcuag

SEQ ID NO: 1431757 - RNA, 19 nt, Homo sapiens
agggcuccagcauccagcc

SEQ ID NO: 1431758 - RNA, 20 nt, Homo sapiens
agggcucccgagucaugcac

SEQ ID NO: 1431759 - RNA, 14 nt, Homo sapiens
agggcucuuugaug

SEQ ID NO: 1431760 - RNA, 15 nt, Homo sapiens
agggcugaaagccau

SEQ ID NO: 1431761 - RNA, 20 nt, Homo sapiens
agggcuggcugcuggaagaa

SEQ ID NO: 1431762 - RNA, 22 nt, Homo sapiens
aggggaagggccagucugggcu

SEQ ID NO: 1431763 - RNA, 21 nt, Homo sapiens
aggggcaaagaaaagccagag

SEQ ID NO: 1431764 - RNA, 14 nt, Homo sapiens
aggggcccacaggg

SEQ ID NO: 1431765 - RNA, 21 nt, Homo sapiens
agggguaauauauugcugcug

SEQ ID NO: 1431766 - RNA, 17 nt, Homo sapiens
aggggugauuucagaga

SEQ ID NO: 1431767 - RNA, 22 nt, Homo sapiens
agcaaccguggcccuuccugga

SEQ ID NO: 1431768 - RNA, 21 nt, Homo sapiens
agcaaucucgcaguacauguu

SEQ ID NO: 1431769 - RNA, 19 nt, Homo sapiens
agcaauuauugugccucag

SEQ ID NO: 1431770 - RNA, 15 nt, Homo sapiens
agcaauucauuucac

SEQ ID NO: 1431771 - RNA, 22 nt, Homo sapiens
agcaccaauuguacauucccug

SEQ ID NO: 1431772 - RNA, 19 nt, Homo sapiens
agcaccccugucucuagcc

SEQ ID NO: 1431773 - RNA, 17 nt, Homo sapiens
agcacccugggugccau

SEQ ID NO: 1431774 - RNA, 22 nt, Homo sapiens
agcacucagaaaagaaaaccau

SEQ ID NO: 1431775 - RNA, 20 nt, Homo sapiens
agcacugccaggagggacaa

SEQ ID NO: 1431776 - RNA, 17 nt, Homo sapiens
agcacuucucucuucaa

SEQ ID NO: 1431777 - RNA, 15 nt, Homo sapiens
agcagagggccuagg

SEQ ID NO: 1431778 - RNA, 21 nt, Homo sapiens
agcagaugguccuccauuuca

SEQ ID NO: 1431779 - RNA, 15 nt, Homo sapiens
agcagcaucuucaaa

SEQ ID NO: 1431780 - RNA, 21 nt, Homo sapiens
agcagcccuaaggaucucuca

SEQ ID NO: 1431781 - RNA, 16 nt, Homo sapiens
agcagcgguaccccag

SEQ ID NO: 1431782 - RNA, 12 nt, Homo sapiens
agcagcugagca

SEQ ID NO: 1431783 - RNA, 19 nt, Homo sapiens
agcagguggcaucucuaau

SEQ ID NO: 1431784 - RNA, 13 nt, Homo sapiens
agcaguaaacuuu

SEQ ID NO: 1431785 - RNA, 22 nt, Homo sapiens
agcaguuugcuuuguaugcacu

SEQ ID NO: 1431786 - RNA, 21 nt, Homo sapiens
agcauaaugcucccaucuccu

SEQ ID NO: 1431787 - RNA, 14 nt, Homo sapiens
agcaucugacucac

SEQ ID NO: 1431788 - RNA, 17 nt, Homo sapiens
agcaugacuauuuccac

SEQ ID NO: 1431789 - RNA, 17 nt, Homo sapiens
agcauggagagccucuu

SEQ ID NO: 1431790 - RNA, 16 nt, Homo sapiens
agcauugagaucucca

SEQ ID NO: 1431791 - RNA, 18 nt, Homo sapiens
agcauuguaaaugugcuu

SEQ ID NO: 1431792 - RNA, 14 nt, Homo sapiens
agccaaacacuguu

SEQ ID NO: 1431793 - RNA, 18 nt, Homo sapiens
agccaaauaaaaccucag

SEQ ID NO: 1431794 - RNA, 13 nt, Homo sapiens
agccaacuccucc

SEQ ID NO: 1431795 - RNA, 21 nt, Homo sapiens
agccaacugccccgggugccu

SEQ ID NO: 1431796 - RNA, 16 nt, Homo sapiens
agccaacuuggcuuuc

SEQ ID NO: 1431797 - RNA, 20 nt, Homo sapiens
agccaagaucgcgccacugc

SEQ ID NO: 1431798 - RNA, 14 nt, Homo sapiens
agccaauagacuga

SEQ ID NO: 1431799 - RNA, 16 nt, Homo sapiens
agccacacaggaagaa

SEQ ID NO: 1431800 - RNA, 17 nt, Homo sapiens
agccacaccuuuuccag

SEQ ID NO: 1431801 - RNA, 15 nt, Homo sapiens
agccacaucacuaca

SEQ ID NO: 1431802 - RNA, 20 nt, Homo sapiens
agccacaucacuacaguaca

SEQ ID NO: 1431803 - RNA, 22 nt, Homo sapiens
agccacccugaggagucugagg

SEQ ID NO: 1431804 - RNA, 13 nt, Homo sapiens
agccacucuucca

SEQ ID NO: 1431805 - RNA, 15 nt, Homo sapiens
agccacugugcugaa

SEQ ID NO: 1431806 - RNA, 23 nt, Homo sapiens
agccagaaucuucguccugcccc

SEQ ID NO: 1431807 - RNA, 13 nt, Homo sapiens
agccagcaaacca

SEQ ID NO: 1431808 - RNA, 14 nt, Homo sapiens
agccagccugggac

SEQ ID NO: 1431809 - RNA, 15 nt, Homo sapiens
agccagcuguguuca

SEQ ID NO: 1431810 - RNA, 16 nt, Homo sapiens
agccaggagaugcugg

SEQ ID NO: 1431811 - RNA, 18 nt, Homo sapiens
agccagguuagccuuugc

SEQ ID NO: 1431812 - RNA, 11 nt, Homo sapiens
agccauaugca

SEQ ID NO: 1431813 - RNA, 18 nt, Homo sapiens
agccauauucacaccuca

SEQ ID NO: 1431814 - RNA, 20 nt, Homo sapiens
agccaugaucgagccacugc

SEQ ID NO: 1431815 - RNA, 23 nt, Homo sapiens
agccauggcuucgucauuugcaa

SEQ ID NO: 1431816 - RNA, 11 nt, Homo sapiens
agccaugggcc

SEQ ID NO: 1431817 - RNA, 22 nt, Homo sapiens
agccauggugacacacagcagc

SEQ ID NO: 1431818 - RNA, 22 nt, Homo sapiens
agccauuuguuggggcaguggu

SEQ ID NO: 1431819 - RNA, 19 nt, Homo sapiens
agcccagccuagcgugccc

SEQ ID NO: 1431820 - RNA, 12 nt, Homo sapiens
agcccagugugg

SEQ ID NO: 1431821 - RNA, 18 nt, Homo sapiens
agcccagugugggacuga

SEQ ID NO: 1431822 - RNA, 15 nt, Homo sapiens
agcccauaaggccag

SEQ ID NO: 1431823 - RNA, 20 nt, Homo sapiens
agccccagcugacaccugga

SEQ ID NO: 1431824 - RNA, 12 nt, Homo sapiens
agccccuagugc

SEQ ID NO: 1431825 - RNA, 14 nt, Homo sapiens
agcccgaagcccag

SEQ ID NO: 1431826 - RNA, 13 nt, Homo sapiens
agcccuauuacuu

SEQ ID NO: 1431827 - RNA, 19 nt, Homo sapiens
agcccucccccagcaguug

SEQ ID NO: 1431828 - RNA, 13 nt, Homo sapiens
agcccugacuggu

SEQ ID NO: 1431829 - RNA, 19 nt, Homo sapiens
agcccugguccuagacaua

SEQ ID NO: 1431830 - RNA, 18 nt, Homo sapiens
agcccugucgagacacuu

SEQ ID NO: 1431831 - RNA, 15 nt, Homo sapiens
agcccuuuacuugac

SEQ ID NO: 1431832 - RNA, 15 nt, Homo sapiens
agccgaaaagcuuuu

SEQ ID NO: 1431833 - RNA, 21 nt, Homo sapiens
agccgagauugcaccacugca

SEQ ID NO: 1431834 - RNA, 20 nt, Homo sapiens
agccgagauugcgccacugc

SEQ ID NO: 1431835 - RNA, 18 nt, Homo sapiens
agccgcgugugacagucu

SEQ ID NO: 1431836 - RNA, 22 nt, Homo sapiens
agccgcgugugacagucuugca

SEQ ID NO: 1431837 - RNA, 13 nt, Homo sapiens
agccgcugugagc

SEQ ID NO: 1431838 - RNA, 22 nt, Homo sapiens
agccggggguggugacaugugc

SEQ ID NO: 1431839 - RNA, 15 nt, Homo sapiens
agccgugaugcucag

SEQ ID NO: 1431840 - RNA, 17 nt, Homo sapiens
agccgugaugcucaggc

SEQ ID NO: 1431841 - RNA, 17 nt, Homo sapiens
agccgugucguaugacc

SEQ ID NO: 1431842 - RNA, 19 nt, Homo sapiens
agccuaagaaaaucaucuu

SEQ ID NO: 1431843 - RNA, 19 nt, Homo sapiens
agccuaauacaacauguag

SEQ ID NO: 1431844 - RNA, 12 nt, Homo sapiens
agccucaagucu

SEQ ID NO: 1431845 - RNA, 20 nt, Homo sapiens
agccucccccugcugcucau

SEQ ID NO: 1431846 - RNA, 17 nt, Homo sapiens
agccuccgccauuccaa

SEQ ID NO: 1431847 - RNA, 21 nt, Homo sapiens
agccugaaugucuuacuguga

SEQ ID NO: 1431848 - RNA, 19 nt, Homo sapiens
agccugaauuuuguugcug

SEQ ID NO: 1431849 - RNA, 21 nt, Homo sapiens
agccugcucccccacccccuc

SEQ ID NO: 1431850 - RNA, 21 nt, Homo sapiens
agccuggcccuggaacuagaa

SEQ ID NO: 1431851 - RNA, 21 nt, Homo sapiens
agccuguccugguacagcagg

SEQ ID NO: 1431852 - RNA, 23 nt, Homo sapiens
agccuguucauggcagauguagg

SEQ ID NO: 1431853 - RNA, 15 nt, Homo sapiens
agccuugcacugugg

SEQ ID NO: 1431854 - RNA, 15 nt, Homo sapiens
agccuuucuuaugga

SEQ ID NO: 1431855 - RNA, 16 nt, Homo sapiens
agcgagcugcucugcu

SEQ ID NO: 1431856 - RNA, 13 nt, Homo sapiens
agcgcgugcacag

SEQ ID NO: 1431857 - RNA, 14 nt, Homo sapiens
agcgguaccccagg

SEQ ID NO: 1431858 - RNA, 21 nt, Homo sapiens
agcgugcccugccccucuggc

SEQ ID NO: 1431859 - RNA, 22 nt, Homo sapiens
agcuacaaucuguucaauguuu

SEQ ID NO: 1431860 - RNA, 13 nt, Homo sapiens
agcuacauuccuc

SEQ ID NO: 1431861 - RNA, 19 nt, Homo sapiens
agcuaccuguggugauguu

SEQ ID NO: 1431862 - RNA, 14 nt, Homo sapiens
agcuagaaccugga

SEQ ID NO: 1431863 - RNA, 19 nt, Homo sapiens
agcuagagugcaguggugc

SEQ ID NO: 1431864 - RNA, 20 nt, Homo sapiens
agcuagagugcaguggugca

SEQ ID NO: 1431865 - RNA, 19 nt, Homo sapiens
agcuaucugucaucucucu

SEQ ID NO: 1431866 - RNA, 19 nt, Homo sapiens
agcuaugacugcagaucau

SEQ ID NO: 1431867 - RNA, 19 nt, Homo sapiens
agcucaagucuucccugau

SEQ ID NO: 1431868 - RNA, 14 nt, Homo sapiens
agcuccacugucac

SEQ ID NO: 1431869 - RNA, 23 nt, Homo sapiens
agcuccaggaaggggaguucugg

SEQ ID NO: 1431870 - RNA, 14 nt, Homo sapiens
agcuccaguuucca

SEQ ID NO: 1431871 - RNA, 22 nt, Homo sapiens
agcuccaguuuccaaguuccug

SEQ ID NO: 1431872 - RNA, 18 nt, Homo sapiens
agcucccgagcuacucuc

SEQ ID NO: 1431873 - RNA, 18 nt, Homo sapiens
agcuccucuccuugggcu

SEQ ID NO: 1431874 - RNA, 14 nt, Homo sapiens
agcucucuuuccca

SEQ ID NO: 1431875 - RNA, 23 nt, Homo sapiens
agcucugccucccucuccauauc

SEQ ID NO: 1431876 - RNA, 17 nt, Homo sapiens
agcucuguagaaagaau

SEQ ID NO: 1431877 - RNA, 19 nt, Homo sapiens
agcucuguuuuacaauaaa

SEQ ID NO: 1431878 - RNA, 22 nt, Homo sapiens
agcugaagccuauuuauuugaa

SEQ ID NO: 1431879 - RNA, 13 nt, Homo sapiens
agcugaagugaag

SEQ ID NO: 1431880 - RNA, 16 nt, Homo sapiens
agcugacaccuggauu

SEQ ID NO: 1431881 - RNA, 23 nt, Homo sapiens
agcugagacccucgccacgggga

SEQ ID NO: 1431882 - RNA, 22 nt, Homo sapiens
agcugauauuauggcaagugau

SEQ ID NO: 1431883 - RNA, 20 nt, Homo sapiens
agcugauuuugucacugucu

SEQ ID NO: 1431884 - RNA, 14 nt, Homo sapiens
agcugcacauuccu

SEQ ID NO: 1431885 - RNA, 23 nt, Homo sapiens
agcugcaugggugccugcugcug

SEQ ID NO: 1431886 - RNA, 13 nt, Homo sapiens
agcugcucuggaa

SEQ ID NO: 1431887 - RNA, 23 nt, Homo sapiens
agcugcuuccuccccuccuggca

SEQ ID NO: 1431888 - RNA, 18 nt, Homo sapiens
agcuggaaauaaaccugg

SEQ ID NO: 1431889 - RNA, 17 nt, Homo sapiens
agcuggagcucuuggaa

SEQ ID NO: 1431890 - RNA, 15 nt, Homo sapiens
agcugggcaugaacg

SEQ ID NO: 1431891 - RNA, 18 nt, Homo sapiens
agcugggccccaccuacu

SEQ ID NO: 1431892 - RNA, 17 nt, Homo sapiens
agcugggccccaugcuc

SEQ ID NO: 1431893 - RNA, 20 nt, Homo sapiens
agcugggccccaugcucugc

SEQ ID NO: 1431894 - RNA, 20 nt, Homo sapiens
agcugggccgaguaccuuaa

SEQ ID NO: 1431895 - RNA, 20 nt, Homo sapiens
agcuguaaaaagagagaaaa

SEQ ID NO: 1431896 - RNA, 14 nt, Homo sapiens
agcuguagccaugg

SEQ ID NO: 1431897 - RNA, 17 nt, Homo sapiens
agcuguagccauggcuc

SEQ ID NO: 1431898 - RNA, 21 nt, Homo sapiens
agcuguaguagcccuuucugu

SEQ ID NO: 1431899 - RNA, 21 nt, Homo sapiens
agcuguuuuuauuagcaguag

SEQ ID NO: 1431900 - RNA, 14 nt, Homo sapiens
agcuuaaauugcuu

SEQ ID NO: 1431901 - RNA, 18 nt, Homo sapiens
agcuuaccugacacaaga

SEQ ID NO: 1431902 - RNA, 16 nt, Homo sapiens
agcuuauuaaaacuca

SEQ ID NO: 1431903 - RNA, 15 nt, Homo sapiens
agcuuccugucaaca

SEQ ID NO: 1431904 - RNA, 21 nt, Homo sapiens
agcuuccugucaacacuucuc

SEQ ID NO: 1431905 - RNA, 13 nt, Homo sapiens
agcuugcagugag

SEQ ID NO: 1431906 - RNA, 23 nt, Homo sapiens
agcuugcucuucagugggagaaa

SEQ ID NO: 1431907 - RNA, 15 nt, Homo sapiens
agcuuggagggaugg

SEQ ID NO: 1431908 - RNA, 17 nt, Homo sapiens
agcuuuauuugcuguac

SEQ ID NO: 1431909 - RNA, 22 nt, Homo sapiens
agcuuucagagccagugaagga

SEQ ID NO: 1431910 - RNA, 14 nt, Homo sapiens
aggaaaaccaggga

SEQ ID NO: 1431911 - RNA, 17 nt, Homo sapiens
aggaaaaggccuggggu

SEQ ID NO: 1431912 - RNA, 12 nt, Homo sapiens
aggaaaccaaag

SEQ ID NO: 1431913 - RNA, 21 nt, Homo sapiens
aggaaaccaacacccaaagca

SEQ ID NO: 1431914 - RNA, 20 nt, Homo sapiens
aggaaaccuggcauggugcu

SEQ ID NO: 1431915 - RNA, 17 nt, Homo sapiens
aggaaagcacacaguca

SEQ ID NO: 1431916 - RNA, 21 nt, Homo sapiens
aggaaaggggcgagcacccac

SEQ ID NO: 1431917 - RNA, 22 nt, Homo sapiens
aggaacugggccaacucaccug

SEQ ID NO: 1431918 - RNA, 23 nt, Homo sapiens
aggaagccccaagccauggugac

SEQ ID NO: 1431919 - RNA, 17 nt, Homo sapiens
aggaagcuccacuguca

SEQ ID NO: 1431920 - RNA, 22 nt, Homo sapiens
aggaaggcaaagccccuggaaa

SEQ ID NO: 1431921 - RNA, 17 nt, Homo sapiens
aggaaguucaacuucca

SEQ ID NO: 1431922 - RNA, 14 nt, Homo sapiens
aggaauacauuugg

SEQ ID NO: 1431923 - RNA, 13 nt, Homo sapiens
aggaaucauguca

SEQ ID NO: 1431924 - RNA, 16 nt, Homo sapiens
aggacaccagccuggu

SEQ ID NO: 1431925 - RNA, 16 nt, Homo sapiens
aggaccccaaccccuc

SEQ ID NO: 1431926 - RNA, 18 nt, Homo sapiens
aggacccugguuacucug

SEQ ID NO: 1431927 - RNA, 14 nt, Homo sapiens
aggaccuccgggga

SEQ ID NO: 1431928 - RNA, 21 nt, Homo sapiens
aggacgguuaacuuguauauu

SEQ ID NO: 1431929 - RNA, 22 nt, Homo sapiens
aggacuaacacucagaagccug

SEQ ID NO: 1431930 - RNA, 17 nt, Homo sapiens
aggacuagaaccuggag

SEQ ID NO: 1431931 - RNA, 17 nt, Homo sapiens
aggacuauagcccaggu

SEQ ID NO: 1431932 - RNA, 15 nt, Homo sapiens
aggacuugaacccag

SEQ ID NO: 1431933 - RNA, 13 nt, Homo sapiens
aggagaaggugcc

SEQ ID NO: 1431934 - RNA, 21 nt, Homo sapiens
aggagacuuaggaaccuacca

SEQ ID NO: 1431935 - RNA, 13 nt, Homo sapiens
aggagauggcaua

SEQ ID NO: 1431936 - RNA, 18 nt, Homo sapiens
ccauguuugguuguaaau

SEQ ID NO: 1431937 - RNA, 12 nt, Homo sapiens
ccauuacuguaa

SEQ ID NO: 1431938 - RNA, 18 nt, Homo sapiens
ccauuauaaaaaauuaaa

SEQ ID NO: 1431939 - RNA, 11 nt, Homo sapiens
ccauugcauca

SEQ ID NO: 1431940 - RNA, 23 nt, Homo sapiens
ccauuguguugggaccugugauc

SEQ ID NO: 1431941 - RNA, 18 nt, Homo sapiens
ccauuguuccuuaccuuu

SEQ ID NO: 1431942 - RNA, 18 nt, Homo sapiens
ccauuuuucuagacuguc

SEQ ID NO: 1431943 - RNA, 14 nt, Homo sapiens
cccaaagugcuagu

SEQ ID NO: 1431944 - RNA, 21 nt, Homo sapiens
cccaacccugcccacuucagc

SEQ ID NO: 1431945 - RNA, 19 nt, Homo sapiens
cccaacuagacauuaccaa

SEQ ID NO: 1431946 - RNA, 23 nt, Homo sapiens
cccaacugcucugcccacuguga

SEQ ID NO: 1431947 - RNA, 11 nt, Homo sapiens
cccaagacagc

SEQ ID NO: 1431948 - RNA, 18 nt, Homo sapiens
cccaauaaaagugacucu

SEQ ID NO: 1431949 - RNA, 15 nt, Homo sapiens
cccaaucagcacuga

SEQ ID NO: 1431950 - RNA, 22 nt, Homo sapiens
cccaaugcacauccauucccaa

SEQ ID NO: 1431951 - RNA, 16 nt, Homo sapiens
cccaauucauuucauc

SEQ ID NO: 1431952 - RNA, 12 nt, Homo sapiens
cccacaaagggg

SEQ ID NO: 1431953 - RNA, 19 nt, Homo sapiens
cccacaccccuccaaagcc

SEQ ID NO: 1431954 - RNA, 20 nt, Homo sapiens
cccacagcacuacgaugugu

SEQ ID NO: 1431955 - RNA, 15 nt, Homo sapiens
cccacaugaucuuga

SEQ ID NO: 1431956 - RNA, 14 nt, Homo sapiens
cccaccaacucugc

SEQ ID NO: 1431957 - RNA, 20 nt, Homo sapiens
cccaccacgugcucaaucau

SEQ ID NO: 1431958 - RNA, 14 nt, Homo sapiens
cccacccuaccaca

SEQ ID NO: 1431959 - RNA, 22 nt, Homo sapiens
cccaccuucuucagccaccucu

SEQ ID NO: 1431960 - RNA, 14 nt, Homo sapiens
cccacuggccaguc

SEQ ID NO: 1431961 - RNA, 18 nt, Homo sapiens
cccacuguggccuggcau

SEQ ID NO: 1431962 - RNA, 23 nt, Homo sapiens
cccacuuuccuacaaaauggagg

SEQ ID NO: 1431963 - RNA, 17 nt, Homo sapiens
cccagaaagaggcagug

SEQ ID NO: 1431964 - RNA, 14 nt, Homo sapiens
cccagagaccccuu

SEQ ID NO: 1431965 - RNA, 22 nt, Homo sapiens
cccagagcacaaguuccagcug

SEQ ID NO: 1431966 - RNA, 12 nt, Homo sapiens
cccagauccuca

SEQ ID NO: 1431967 - RNA, 15 nt, Homo sapiens
cccagccauggugag

SEQ ID NO: 1431968 - RNA, 17 nt, Homo sapiens
cccagccccaggggugc

SEQ ID NO: 1431969 - RNA, 18 nt, Homo sapiens
cccagccgaaaagcuuuu

SEQ ID NO: 1431970 - RNA, 15 nt, Homo sapiens
cccagccuacugccu

SEQ ID NO: 1431971 - RNA, 21 nt, Homo sapiens
cccagccuagcccacuuguca

SEQ ID NO: 1431972 - RNA, 22 nt, Homo sapiens
cccagcgagcaucccgggcaag

SEQ ID NO: 1431973 - RNA, 13 nt, Homo sapiens
cccagcuacucag

SEQ ID NO: 1431974 - RNA, 16 nt, Homo sapiens
cccaggaacugggcca

SEQ ID NO: 1431975 - RNA, 23 nt, Homo sapiens
cccaggaggucgaccccaaagcc

SEQ ID NO: 1431976 - RNA, 13 nt, Homo sapiens
cccaggccaggga

SEQ ID NO: 1431977 - RNA, 22 nt, Homo sapiens
cccaggcucugggaaggggugc

SEQ ID NO: 1431978 - RNA, 14 nt, Homo sapiens
cccaggcugcacug

SEQ ID NO: 1431979 - RNA, 22 nt, Homo sapiens
cccaggcuucacccugaauggu

SEQ ID NO: 1431980 - RNA, 20 nt, Homo sapiens
cccagggccugggggcagug

SEQ ID NO: 1431981 - RNA, 18 nt, Homo sapiens
cccagguggcugacccag

SEQ ID NO: 1431982 - RNA, 17 nt, Homo sapiens
cccauagaaacaugaca

SEQ ID NO: 1431983 - RNA, 12 nt, Homo sapiens
cccaucauccca

SEQ ID NO: 1431984 - RNA, 14 nt, Homo sapiens
cccaugucaccuca

SEQ ID NO: 1431985 - RNA, 20 nt, Homo sapiens
cccauuugcacagguuuuca

SEQ ID NO: 1431986 - RNA, 22 nt, Homo sapiens
ccccaaacauuaaucaccaaag

SEQ ID NO: 1431987 - RNA, 10 nt, Homo sapiens
ccccaagaca

SEQ ID NO: 1431988 - RNA, 16 nt, Homo sapiens
ccccaagccaugguga

SEQ ID NO: 1431989 - RNA, 21 nt, Homo sapiens
ccccaagguuuuggagucagu

SEQ ID NO: 1431990 - RNA, 14 nt, Homo sapiens
ccccacacgugcuc

SEQ ID NO: 1431991 - RNA, 21 nt, Homo sapiens
ccccaccuuucucgcuggaau

SEQ ID NO: 1431992 - RNA, 18 nt, Homo sapiens
ccccagaacacagugccu

SEQ ID NO: 1431993 - RNA, 12 nt, Homo sapiens
ccccagccaugg

SEQ ID NO: 1431994 - RNA, 15 nt, Homo sapiens
ccccagccaugguga

SEQ ID NO: 1431995 - RNA, 15 nt, Homo sapiens
ccccagcgauucccu

SEQ ID NO: 1431996 - RNA, 22 nt, Homo sapiens
ccccagucuacguucuccagcc

SEQ ID NO: 1431997 - RNA, 15 nt, Homo sapiens
ccccaguucugcucc

SEQ ID NO: 1431998 - RNA, 19 nt, Homo sapiens
ccccauaaucucauucaaa

SEQ ID NO: 1431999 - RNA, 22 nt, Homo sapiens
ccccaucuguuaaaugagagaa

SEQ ID NO: 1432000 - RNA, 18 nt, Homo sapiens
ccccaugaccuccagcuu

SEQ ID NO: 1432001 - RNA, 13 nt, Homo sapiens
ccccauuugcaca

SEQ ID NO: 1432002 - RNA, 11 nt, Homo sapiens
cccccagugug

SEQ ID NO: 1432003 - RNA, 16 nt, Homo sapiens
cccccugcagcuugua

SEQ ID NO: 1432004 - RNA, 14 nt, Homo sapiens
cccccugcugcuca

SEQ ID NO: 1432005 - RNA, 12 nt, Homo sapiens
ccccggcugcuu

SEQ ID NO: 1432006 - RNA, 16 nt, Homo sapiens
ccccuaagaggcagug

SEQ ID NO: 1432007 - RNA, 16 nt, Homo sapiens
ccccucagaugaucuc

SEQ ID NO: 1432008 - RNA, 15 nt, Homo sapiens
ccccuccacugucac

SEQ ID NO: 1432009 - RNA, 16 nt, Homo sapiens
ccccucccugugugaa

SEQ ID NO: 1432010 - RNA, 17 nt, Homo sapiens
ccccugccuggguuuuc

SEQ ID NO: 1432011 - RNA, 17 nt, Homo sapiens
ccccuggacugggaggu

SEQ ID NO: 1432012 - RNA, 15 nt, Homo sapiens
ccccuggccuuugag

SEQ ID NO: 1432013 - RNA, 23 nt, Homo sapiens
ccccuggggcuucuccugaccca

SEQ ID NO: 1432014 - RNA, 16 nt, Homo sapiens
ccccugucuucucuca

SEQ ID NO: 1432015 - RNA, 21 nt, Homo sapiens
ccccuucuuuuuugucucaag

SEQ ID NO: 1432016 - RNA, 14 nt, Homo sapiens
ccccuuggcuguga

SEQ ID NO: 1432017 - RNA, 19 nt, Homo sapiens
auugucagaguucugcucu

SEQ ID NO: 1432018 - RNA, 15 nt, Homo sapiens
auuguccagugcaac

SEQ ID NO: 1432019 - RNA, 15 nt, Homo sapiens
auuguccccagggac

SEQ ID NO: 1432020 - RNA, 17 nt, Homo sapiens
auugucgcucagcaaua

SEQ ID NO: 1432021 - RNA, 11 nt, Homo sapiens
auugucuucca

SEQ ID NO: 1432022 - RNA, 18 nt, Homo sapiens
auugugauauuuuuacuu

SEQ ID NO: 1432023 - RNA, 21 nt, Homo sapiens
auuguguugggaccugugauc

SEQ ID NO: 1432024 - RNA, 21 nt, Homo sapiens
caagcaaaaacaaaugggaaa

SEQ ID NO: 1432025 - RNA, 17 nt, Homo sapiens
caagcaauuauugugcc

SEQ ID NO: 1432026 - RNA, 18 nt, Homo sapiens
caagcacuaaaaaguggc

SEQ ID NO: 1432027 - RNA, 23 nt, Homo sapiens
caagcacuaccaggcuguggguc

SEQ ID NO: 1432028 - RNA, 21 nt, Homo sapiens
caagcaugcaauaaugugcaa

SEQ ID NO: 1432029 - RNA, 15 nt, Homo sapiens
caagcauuuguucca

SEQ ID NO: 1432030 - RNA, 21 nt, Homo sapiens
caagcccuggcaacauaguga

SEQ ID NO: 1432031 - RNA, 14 nt, Homo sapiens
caagcgauucucau

SEQ ID NO: 1432032 - RNA, 13 nt, Homo sapiens
caagcgcagggag

SEQ ID NO: 1432033 - RNA, 14 nt, Homo sapiens
caagcuagaaggcc

SEQ ID NO: 1432034 - RNA, 21 nt, Homo sapiens
caagcugcuuuggacaacuga

SEQ ID NO: 1432035 - RNA, 16 nt, Homo sapiens
caagcuggaagcacau

SEQ ID NO: 1432036 - RNA, 19 nt, Homo sapiens
caaggaguaaguacaaaua

SEQ ID NO: 1432037 - RNA, 19 nt, Homo sapiens
caaggauguucuggcuuua

SEQ ID NO: 1432038 - RNA, 15 nt, Homo sapiens
caaggcuaguuccuu

SEQ ID NO: 1432039 - RNA, 17 nt, Homo sapiens
caaggugaacaccacuu

SEQ ID NO: 1432040 - RNA, 13 nt, Homo sapiens
caaggugugaaug

SEQ ID NO: 1432041 - RNA, 14 nt, Homo sapiens
caagguguuuccau

SEQ ID NO: 1432042 - RNA, 19 nt, Homo sapiens
caagguguuuccauuucuc

SEQ ID NO: 1432043 - RNA, 15 nt, Homo sapiens
caaguagcacccugg

SEQ ID NO: 1432044 - RNA, 17 nt, Homo sapiens
caagucaacacucuucu

SEQ ID NO: 1432045 - RNA, 12 nt, Homo sapiens
caaguccaagca

SEQ ID NO: 1432046 - RNA, 12 nt, Homo sapiens
caaguccagagc

SEQ ID NO: 1432047 - RNA, 21 nt, Homo sapiens
caagucgagagggcuguugga

SEQ ID NO: 1432048 - RNA, 17 nt, Homo sapiens
caagucuaacaguuaau

SEQ ID NO: 1432049 - RNA, 13 nt, Homo sapiens
caagucuacuuca

SEQ ID NO: 1432050 - RNA, 12 nt, Homo sapiens
caagucuucccu

SEQ ID NO: 1432051 - RNA, 23 nt, Homo sapiens
caagugaccauaaaggcauggca

SEQ ID NO: 1432052 - RNA, 15 nt, Homo sapiens
caagugccaucccac

SEQ ID NO: 1432053 - RNA, 22 nt, Homo sapiens
caagugccucuuguugcagaga

SEQ ID NO: 1432054 - RNA, 22 nt, Homo sapiens
caaguuauauugaauauaucag

SEQ ID NO: 1432055 - RNA, 17 nt, Homo sapiens
caaguuauuaaucuuau

SEQ ID NO: 1432056 - RNA, 18 nt, Homo sapiens
caaguuccugcacuccag

SEQ ID NO: 1432057 - RNA, 15 nt, Homo sapiens
caaguugagaacaaa

SEQ ID NO: 1432058 - RNA, 22 nt, Homo sapiens
caaguuggaaauauucaugcuu

SEQ ID NO: 1432059 - RNA, 16 nt, Homo sapiens
caaguuucuaaauuga

SEQ ID NO: 1432060 - RNA, 22 nt, Homo sapiens
caauaaguuccauguuaaaaua

SEQ ID NO: 1432061 - RNA, 21 nt, Homo sapiens
caauaaugugcaaauuuugca

SEQ ID NO: 1432062 - RNA, 12 nt, Homo sapiens
caauacauguau

SEQ ID NO: 1432063 - RNA, 15 nt, Homo sapiens
caauacauguaucua

SEQ ID NO: 1432064 - RNA, 17 nt, Homo sapiens
caauaccagaucacuca

SEQ ID NO: 1432065 - RNA, 14 nt, Homo sapiens
caauaguaaaagau

SEQ ID NO: 1432066 - RNA, 16 nt, Homo sapiens
caauauaucaauguaa

SEQ ID NO: 1432067 - RNA, 16 nt, Homo sapiens
caauauuaaauacaga

SEQ ID NO: 1432068 - RNA, 15 nt, Homo sapiens
caauauuuacauuuu

SEQ ID NO: 1432069 - RNA, 16 nt, Homo sapiens
caauauuuacucauca

SEQ ID NO: 1432070 - RNA, 16 nt, Homo sapiens
caauccccaagcuggc

SEQ ID NO: 1432071 - RNA, 21 nt, Homo sapiens
caauccuagaaccaagcuuca

SEQ ID NO: 1432072 - RNA, 18 nt, Homo sapiens
caaucuuguccacagucu

SEQ ID NO: 1432073 - RNA, 14 nt, Homo sapiens
caaugaaaccaaag

SEQ ID NO: 1432074 - RNA, 14 nt, Homo sapiens
caaugaaaugcucu

SEQ ID NO: 1432075 - RNA, 13 nt, Homo sapiens
caaugacacauag

SEQ ID NO: 1432076 - RNA, 10 nt, Homo sapiens
caaugauuca

SEQ ID NO: 1432077 - RNA, 12 nt, Homo sapiens
caaugauucaua

SEQ ID NO: 1432078 - RNA, 14 nt, Homo sapiens
caaugcauugcuaa

SEQ ID NO: 1432079 - RNA, 9 nt, Homo sapiens
caaugccau

SEQ ID NO: 1432080 - RNA, 23 nt, Homo sapiens
caaugccuugacaacagacugaa

SEQ ID NO: 1432081 - RNA, 14 nt, Homo sapiens
caaugcgcacacac

SEQ ID NO: 1432082 - RNA, 19 nt, Homo sapiens
caaugcuauugaaauuacu

SEQ ID NO: 1432083 - RNA, 16 nt, Homo sapiens
caauggaaacaaucuu

SEQ ID NO: 1432084 - RNA, 20 nt, Homo sapiens
caaugggagggggcuccaug

SEQ ID NO: 1432085 - RNA, 21 nt, Homo sapiens
caaugggagggggcuccaugg

SEQ ID NO: 1432086 - RNA, 21 nt, Homo sapiens
caauguauuugucaaugcauc

SEQ ID NO: 1432087 - RNA, 22 nt, Homo sapiens
caaugugaaaaaugugucugua

SEQ ID NO: 1432088 - RNA, 23 nt, Homo sapiens
caauuaauucuuaauaggcuuua

SEQ ID NO: 1432089 - RNA, 15 nt, Homo sapiens
caauuaggcucugaa

SEQ ID NO: 1432090 - RNA, 20 nt, Homo sapiens
caauucucaaaagaaaaggc

SEQ ID NO: 1432091 - RNA, 21 nt, Homo sapiens
caauugcggggcccaccuuag

SEQ ID NO: 1432092 - RNA, 21 nt, Homo sapiens
caauugucugccucagccucc

SEQ ID NO: 1432093 - RNA, 14 nt, Homo sapiens
caauuucuaccuuu

SEQ ID NO: 1432094 - RNA, 23 nt, Homo sapiens
caauuuuaauugauuauucugau

SEQ ID NO: 1432095 - RNA, 15 nt, Homo sapiens
caauuuuuauacaua

SEQ ID NO: 1432096 - RNA, 18 nt, Homo sapiens
cacaaaaaggcauaugca

SEQ ID NO: 1432097 - RNA, 21 nt, Homo sapiens
cacaaaaguccacugaugcaa

SEQ ID NO: 1432098 - RNA, 12 nt, Homo sapiens
cacaaaaugcaa

SEQ ID NO: 1432099 - RNA, 19 nt, Homo sapiens
cacaaaccacaacugacac

SEQ ID NO: 1432100 - RNA, 20 nt, Homo sapiens
cacaaaccacaacugacaca

SEQ ID NO: 1432101 - RNA, 20 nt, Homo sapiens
cacaaagaagaaguuuaaaa

SEQ ID NO: 1432102 - RNA, 18 nt, Homo sapiens
cacaaagcccuuccaugu

SEQ ID NO: 1432103 - RNA, 23 nt, Homo sapiens
cacaaaucaaagcaagggcucca

SEQ ID NO: 1432104 - RNA, 17 nt, Homo sapiens
cacaaaugcaccuccca

SEQ ID NO: 1432105 - RNA, 16 nt, Homo sapiens
cacaacccuguuuuau

SEQ ID NO: 1432106 - RNA, 20 nt, Homo sapiens
cacaagaagaccagacugug

SEQ ID NO: 1432107 - RNA, 17 nt, Homo sapiens
cacaagcuggaagcaca

SEQ ID NO: 1432108 - RNA, 15 nt, Homo sapiens
cacaaggcugaccaa

SEQ ID NO: 1432109 - RNA, 23 nt, Homo sapiens
cacaaggggaaggguacugaaaa

SEQ ID NO: 1432110 - RNA, 15 nt, Homo sapiens
cacaaguccugugaa

SEQ ID NO: 1432111 - RNA, 18 nt, Homo sapiens
ccuauaaggagaguucaa

SEQ ID NO: 1432112 - RNA, 12 nt, Homo sapiens
ccuauaccauau

SEQ ID NO: 1432113 - RNA, 22 nt, Homo sapiens
ccuauaugaauaugagaucuga

SEQ ID NO: 1432114 - RNA, 16 nt, Homo sapiens
ccuaucuguaugucug

SEQ ID NO: 1432115 - RNA, 16 nt, Homo sapiens
ccuauuaaccuagaga

SEQ ID NO: 1432116 - RNA, 9 nt, Homo sapiens
ccuauuuau

SEQ ID NO: 1432117 - RNA, 18 nt, Homo sapiens
ccuauuucuuauagucaa

SEQ ID NO: 1432118 - RNA, 18 nt, Homo sapiens
ccugcuuugaggacaaag

SEQ ID NO: 1432119 - RNA, 22 nt, Homo sapiens
ccuggaaauaucaguuacucag

SEQ ID NO: 1432120 - RNA, 18 nt, Homo sapiens
ccuggaaggggcaaagaa

SEQ ID NO: 1432121 - RNA, 16 nt, Homo sapiens
ccuggacagcugugcc

SEQ ID NO: 1432122 - RNA, 23 nt, Homo sapiens
ccuggaccgcuucccagaggcca

SEQ ID NO: 1432123 - RNA, 13 nt, Homo sapiens
ccuggacugggag

SEQ ID NO: 1432124 - RNA, 14 nt, Homo sapiens
ccuggagaugauga

SEQ ID NO: 1432125 - RNA, 18 nt, Homo sapiens
ccuggcaugucagagcca

SEQ ID NO: 1432126 - RNA, 18 nt, Homo sapiens
ccuggccuguggagagaa

SEQ ID NO: 1432127 - RNA, 19 nt, Homo sapiens
ccuggcuggcugagggcag

SEQ ID NO: 1432128 - RNA, 20 nt, Homo sapiens
ccuggcuguccccagcaccu

SEQ ID NO: 1432129 - RNA, 19 nt, Homo sapiens
ccugggaggcggagaguac

SEQ ID NO: 1432130 - RNA, 15 nt, Homo sapiens
ccugggauucaggaa

SEQ ID NO: 1432131 - RNA, 23 nt, Homo sapiens
ccugggcugucugucaccagcua

SEQ ID NO: 1432132 - RNA, 19 nt, Homo sapiens
ccuggggcuucuccugacc

SEQ ID NO: 1432133 - RNA, 21 nt, Homo sapiens
ccugggggcagugacuggcag

SEQ ID NO: 1432134 - RNA, 12 nt, Homo sapiens
ccugggggccag

SEQ ID NO: 1432135 - RNA, 13 nt, Homo sapiens
ccuggggugaccc

SEQ ID NO: 1432136 - RNA, 16 nt, Homo sapiens
ccugggugacgguccu

SEQ ID NO: 1432137 - RNA, 18 nt, Homo sapiens
ccuggucccuuggagaca

SEQ ID NO: 1432138 - RNA, 18 nt, Homo sapiens
ccuguaaucccagcacuu

SEQ ID NO: 1432139 - RNA, 19 nt, Homo sapiens
ccuguaaucccagcacuuu

SEQ ID NO: 1432140 - RNA, 12 nt, Homo sapiens
ccuguacccagc

SEQ ID NO: 1432141 - RNA, 20 nt, Homo sapiens
ccuguaccccagcacuugug

SEQ ID NO: 1432142 - RNA, 16 nt, Homo sapiens
ccuguagucccagcua

SEQ ID NO: 1432143 - RNA, 16 nt, Homo sapiens
ccuguauauaauacua

SEQ ID NO: 1432144 - RNA, 13 nt, Homo sapiens
ccugugacuaugg

SEQ ID NO: 1432145 - RNA, 12 nt, Homo sapiens
ccugugaucucc

SEQ ID NO: 1432146 - RNA, 23 nt, Homo sapiens
ccugugaugcuuugaaguacaau

SEQ ID NO: 1432147 - RNA, 14 nt, Homo sapiens
ccugugcuaaagaa

SEQ ID NO: 1432148 - RNA, 22 nt, Homo sapiens
ccugugcucuaagugaauacuu

SEQ ID NO: 1432149 - RNA, 12 nt, Homo sapiens
ccugugcugacg

SEQ ID NO: 1432150 - RNA, 22 nt, Homo sapiens
ccugugugcugacaggagaccc

SEQ ID NO: 1432151 - RNA, 23 nt, Homo sapiens
ccuguuacuugaaauaccaguga

SEQ ID NO: 1432152 - RNA, 20 nt, Homo sapiens
ccuguuuguggaacaaaagu

SEQ ID NO: 1432153 - RNA, 18 nt, Homo sapiens
ccuguuuuccacaccauc

SEQ ID NO: 1432154 - RNA, 22 nt, Homo sapiens
ccuuaaucugccauaaagccau

SEQ ID NO: 1432155 - RNA, 19 nt, Homo sapiens
ccuuaauucacucccacac

SEQ ID NO: 1432156 - RNA, 13 nt, Homo sapiens
ccuuacauuccua

SEQ ID NO: 1432157 - RNA, 16 nt, Homo sapiens
ccuuacucaccucucu

SEQ ID NO: 1432158 - RNA, 15 nt, Homo sapiens
ccuuagcuggcauua

SEQ ID NO: 1432159 - RNA, 22 nt, Homo sapiens
ccuuaguccgcaaguucaggga

SEQ ID NO: 1432160 - RNA, 14 nt, Homo sapiens
ccuucaacccgaga

SEQ ID NO: 1432161 - RNA, 15 nt, Homo sapiens
ccuucagggacucaa

SEQ ID NO: 1432162 - RNA, 20 nt, Homo sapiens
ccuuccaaccccuuuccacg

SEQ ID NO: 1432163 - RNA, 19 nt, Homo sapiens
ccuuccacggauccaugua

SEQ ID NO: 1432164 - RNA, 18 nt, Homo sapiens
ccuuccagcuagugaccc

SEQ ID NO: 1432165 - RNA, 19 nt, Homo sapiens
ccuucccuccccacagucc

SEQ ID NO: 1432166 - RNA, 17 nt, Homo sapiens
ccuucccucuuucccca

SEQ ID NO: 1432167 - RNA, 15 nt, Homo sapiens
ccuuccuggacagcu

SEQ ID NO: 1432168 - RNA, 12 nt, Homo sapiens
ccuucucaaaag

SEQ ID NO: 1432169 - RNA, 20 nt, Homo sapiens
ccuucugcuguauacuguac

SEQ ID NO: 1432170 - RNA, 13 nt, Homo sapiens
ccuugcaccugca

SEQ ID NO: 1432171 - RNA, 10 nt, Homo sapiens
ccuugcagca

SEQ ID NO: 1432172 - RNA, 13 nt, Homo sapiens
ccuugcagcauuu

SEQ ID NO: 1432173 - RNA, 14 nt, Homo sapiens
ccuugcccagagau

SEQ ID NO: 1432174 - RNA, 22 nt, Homo sapiens
ccuugccuguuuuucaaucuca

SEQ ID NO: 1432175 - RNA, 12 nt, Homo sapiens
ccuugcucugca

SEQ ID NO: 1432176 - RNA, 23 nt, Homo sapiens
ccuugcuggacggggacugggga

SEQ ID NO: 1432177 - RNA, 18 nt, Homo sapiens
ccuuggaaaguucagcca

SEQ ID NO: 1432178 - RNA, 13 nt, Homo sapiens
ccuuggagccuga

SEQ ID NO: 1432179 - RNA, 14 nt, Homo sapiens
ccuuggugugaccc

SEQ ID NO: 1432180 - RNA, 15 nt, Homo sapiens
ccuuguaaacaugaa

SEQ ID NO: 1432181 - RNA, 17 nt, Homo sapiens
ccuugugguuuauguca

SEQ ID NO: 1432182 - RNA, 15 nt, Homo sapiens
ccuuuaugagucagu

SEQ ID NO: 1432183 - RNA, 21 nt, Homo sapiens
ccuuucucuaucccaagccaa

SEQ ID NO: 1432184 - RNA, 13 nt, Homo sapiens
ccuuugagggcag

SEQ ID NO: 1432185 - RNA, 14 nt, Homo sapiens
ccuuugucaucauu

SEQ ID NO: 1432186 - RNA, 20 nt, Homo sapiens
ccuuugugggcccagcuaca

SEQ ID NO: 1432187 - RNA, 20 nt, Homo sapiens
ccuuuuccaggaguucugaa

SEQ ID NO: 1432188 - RNA, 21 nt, Homo sapiens
ccuuuucuuuuucccuugaac

SEQ ID NO: 1432189 - RNA, 20 nt, Homo sapiens
ccuuuugaccaaauaaagua

SEQ ID NO: 1432190 - RNA, 10 nt, Homo sapiens
ccuuuugcca

SEQ ID NO: 1432191 - RNA, 15 nt, Homo sapiens
ccuuuuguguaauaa

SEQ ID NO: 1432192 - RNA, 11 nt, Homo sapiens
ccuuuuugccc

SEQ ID NO: 1432193 - RNA, 21 nt, Homo sapiens
cgaaaccaguuaagaauggaa

SEQ ID NO: 1432194 - RNA, 13 nt, Homo sapiens
cgaaagcaacuca

SEQ ID NO: 1432195 - RNA, 23 nt, Homo sapiens
aggggugcuaugacaugcaagug

SEQ ID NO: 1432196 - RNA, 18 nt, Homo sapiens
aggggugugauuggagug

SEQ ID NO: 1432197 - RNA, 18 nt, Homo sapiens
aggguaugggaagccaua

SEQ ID NO: 1432198 - RNA, 20 nt, Homo sapiens
aggguccccagcugguccag

SEQ ID NO: 1432199 - RNA, 16 nt, Homo sapiens
agggugcuaacguauc

SEQ ID NO: 1432200 - RNA, 22 nt, Homo sapiens
agggugggggagggagguuccu

SEQ ID NO: 1432201 - RNA, 22 nt, Homo sapiens
agggugguuuggcaacaccucc

SEQ ID NO: 1432202 - RNA, 21 nt, Homo sapiens
agguaauucucccuaaggaau

SEQ ID NO: 1432203 - RNA, 19 nt, Homo sapiens
agguagacauggauuugau

SEQ ID NO: 1432204 - RNA, 12 nt, Homo sapiens
agguaugggaga

SEQ ID NO: 1432205 - RNA, 15 nt, Homo sapiens
aggucaaaacauuca

SEQ ID NO: 1432206 - RNA, 14 nt, Homo sapiens
aggucaaugccaga

SEQ ID NO: 1432207 - RNA, 21 nt, Homo sapiens
agguccucccgggagcacaga

SEQ ID NO: 1432208 - RNA, 22 nt, Homo sapiens
agguccuccucucucuacuuga

SEQ ID NO: 1432209 - RNA, 21 nt, Homo sapiens
agguccugaaagucugugucc

SEQ ID NO: 1432210 - RNA, 15 nt, Homo sapiens
aggucucagcccggg

SEQ ID NO: 1432211 - RNA, 15 nt, Homo sapiens
aggucucugaacuca

SEQ ID NO: 1432212 - RNA, 18 nt, Homo sapiens
aggugagaaaaggggcau

SEQ ID NO: 1432213 - RNA, 13 nt, Homo sapiens
aggugcaagagac

SEQ ID NO: 1432214 - RNA, 19 nt, Homo sapiens
aggugcaagccacuauguc

SEQ ID NO: 1432215 - RNA, 21 nt, Homo sapiens
aggugcuacaaaaacacagca

SEQ ID NO: 1432216 - RNA, 17 nt, Homo sapiens
aggugcugucagcucag

SEQ ID NO: 1432217 - RNA, 15 nt, Homo sapiens
agguggccacuccag

SEQ ID NO: 1432218 - RNA, 16 nt, Homo sapiens
uugaugaaagugcaaa

SEQ ID NO: 1432219 - RNA, 17 nt, Homo sapiens
uugaugugaaacauuau

SEQ ID NO: 1432220 - RNA, 10 nt, Homo sapiens
uugauuucaa

SEQ ID NO: 1432221 - RNA, 19 nt, Homo sapiens
uugcaaaagaaguugcugg

SEQ ID NO: 1432222 - RNA, 15 nt, Homo sapiens
uugcaagaaucauua

SEQ ID NO: 1432223 - RNA, 20 nt, Homo sapiens
uugcacaagcuuguauauac

SEQ ID NO: 1432224 - RNA, 20 nt, Homo sapiens
uugcaccccuccuauaccau

SEQ ID NO: 1432225 - RNA, 22 nt, Homo sapiens
uugcacgugcucuucuguucuc

SEQ ID NO: 1432226 - RNA, 12 nt, Homo sapiens
uugcacuaugaa

SEQ ID NO: 1432227 - RNA, 18 nt, Homo sapiens
uugcacuguuuucugucg

SEQ ID NO: 1432228 - RNA, 18 nt, Homo sapiens
uugcaggcucugggcuca

SEQ ID NO: 1432229 - RNA, 11 nt, Homo sapiens
uugcccuguga

SEQ ID NO: 1432230 - RNA, 15 nt, Homo sapiens
uugcucugagugcua

SEQ ID NO: 1432231 - RNA, 15 nt, Homo sapiens
uugcugguacuaaga

SEQ ID NO: 1432232 - RNA, 22 nt, Homo sapiens
uugcuguaacucagacauucca

SEQ ID NO: 1432233 - RNA, 21 nt, Homo sapiens
uugcugucauaagaaugaaua

SEQ ID NO: 1432234 - RNA, 13 nt, Homo sapiens
uugcugugagcaa

SEQ ID NO: 1432235 - RNA, 17 nt, Homo sapiens
uugcuuauguaaucuca

SEQ ID NO: 1432236 - RNA, 21 nt, Homo sapiens
uugcuugccgagccuaaugaa

SEQ ID NO: 1432237 - RNA, 14 nt, Homo sapiens
uugcuuuaaaguac

SEQ ID NO: 1432238 - RNA, 20 nt, Homo sapiens
uugcuuuaaaguaccuguag

SEQ ID NO: 1432239 - RNA, 16 nt, Homo sapiens
uuggaaagguuucaag

SEQ ID NO: 1432240 - RNA, 18 nt, Homo sapiens
uuggaaaguucagccaga

SEQ ID NO: 1432241 - RNA, 19 nt, Homo sapiens
uuggaauacuugaaaaccu

SEQ ID NO: 1432242 - RNA, 15 nt, Homo sapiens
uuggaaugaauucuc

SEQ ID NO: 1432243 - RNA, 12 nt, Homo sapiens
uuggaauucugg

SEQ ID NO: 1432244 - RNA, 13 nt, Homo sapiens
uuggacagcugcu

SEQ ID NO: 1432245 - RNA, 18 nt, Homo sapiens
uuggacugacuaccagcu

SEQ ID NO: 1432246 - RNA, 16 nt, Homo sapiens
uuggacuugaggauuu

SEQ ID NO: 1432247 - RNA, 15 nt, Homo sapiens
uuggagagacacagc

SEQ ID NO: 1432248 - RNA, 22 nt, Homo sapiens
uuggaguaucuaaagccagugg

SEQ ID NO: 1432249 - RNA, 21 nt, Homo sapiens
uuggauaauauccacugcaau

SEQ ID NO: 1432250 - RNA, 15 nt, Homo sapiens
uuggauguggagcuc

SEQ ID NO: 1432251 - RNA, 12 nt, Homo sapiens
uuggauuccagu

SEQ ID NO: 1432252 - RNA, 18 nt, Homo sapiens
uuggcauggauuucuguc

SEQ ID NO: 1432253 - RNA, 19 nt, Homo sapiens
uuggccucccaaagugcua

SEQ ID NO: 1432254 - RNA, 14 nt, Homo sapiens
uuggccugaggcug

SEQ ID NO: 1432255 - RNA, 15 nt, Homo sapiens
uuggcugugugacag

SEQ ID NO: 1432256 - RNA, 18 nt, Homo sapiens
uuggcuuuugcuuggcag

SEQ ID NO: 1432257 - RNA, 16 nt, Homo sapiens
uugggagagugcagua

SEQ ID NO: 1432258 - RNA, 13 nt, Homo sapiens
uugggagcacugg

SEQ ID NO: 1432259 - RNA, 10 nt, Homo sapiens
uugggcuccu

SEQ ID NO: 1432260 - RNA, 17 nt, Homo sapiens
uccuacaguggcuguca

SEQ ID NO: 1432261 - RNA, 18 nt, Homo sapiens
uccuacucagacuguugc

SEQ ID NO: 1432262 - RNA, 15 nt, Homo sapiens
uccuauuauguguuc

SEQ ID NO: 1432263 - RNA, 20 nt, Homo sapiens
uccuauuuuaaaaccaugca

SEQ ID NO: 1432264 - RNA, 22 nt, Homo sapiens
uccucaauucaauguggugaug

SEQ ID NO: 1432265 - RNA, 22 nt, Homo sapiens
uccucagagaauuucuaccauu

SEQ ID NO: 1432266 - RNA, 13 nt, Homo sapiens
uccucagcugaca

SEQ ID NO: 1432267 - RNA, 21 nt, Homo sapiens
uccucagcugccaagcacucg

SEQ ID NO: 1432268 - RNA, 22 nt, Homo sapiens
uccucauuuauaaaauaaugaa

SEQ ID NO: 1432269 - RNA, 22 nt, Homo sapiens
uccuccacaauaaggucaaugc

SEQ ID NO: 1432270 - RNA, 16 nt, Homo sapiens
uccuccacagugcugc

SEQ ID NO: 1432271 - RNA, 18 nt, Homo sapiens
uccuccacagugcugcuu

SEQ ID NO: 1432272 - RNA, 13 nt, Homo sapiens
uccuccacuccac

SEQ ID NO: 1432273 - RNA, 16 nt, Homo sapiens
uccucgguacucccau

SEQ ID NO: 1432274 - RNA, 21 nt, Homo sapiens
uccucuacuacuuuuacuaca

SEQ ID NO: 1432275 - RNA, 16 nt, Homo sapiens
uccucuccacugccuu

SEQ ID NO: 1432276 - RNA, 22 nt, Homo sapiens
ucuaccugaccaacaguuccuu

SEQ ID NO: 1432277 - RNA, 22 nt, Homo sapiens
ucuacgcucuccuuucuuucua

SEQ ID NO: 1432278 - RNA, 20 nt, Homo sapiens
ucuacguauaaauaugaaau

SEQ ID NO: 1432279 - RNA, 18 nt, Homo sapiens
ucuacugagacaugacua

SEQ ID NO: 1432280 - RNA, 18 nt, Homo sapiens
ucuacuugaauacucuca

SEQ ID NO: 1432281 - RNA, 15 nt, Homo sapiens
ucuagaaacagaucu

SEQ ID NO: 1432282 - RNA, 15 nt, Homo sapiens
ucuagaacaugcaca

SEQ ID NO: 1432283 - RNA, 21 nt, Homo sapiens
ucuagccugaauucuuuucaa

SEQ ID NO: 1432284 - RNA, 23 nt, Homo sapiens
ucuagcuauuauuuucuuuaaag

SEQ ID NO: 1432285 - RNA, 21 nt, Homo sapiens
ucuaggacuagaaaaacuugg

SEQ ID NO: 1432286 - RNA, 13 nt, Homo sapiens
ucuauagcagauu

SEQ ID NO: 1432287 - RNA, 14 nt, Homo sapiens
ucuaucaauaguca

SEQ ID NO: 1432288 - RNA, 17 nt, Homo sapiens
ucuauccuguacauuuc

SEQ ID NO: 1432289 - RNA, 14 nt, Homo sapiens
ucuaugguugacau

SEQ ID NO: 1432290 - RNA, 15 nt, Homo sapiens
ucuauuaaauguaua

SEQ ID NO: 1432291 - RNA, 14 nt, Homo sapiens
ucuauuauagccac

SEQ ID NO: 1432292 - RNA, 13 nt, Homo sapiens
ucuauuaucugua

SEQ ID NO: 1432293 - RNA, 20 nt, Homo sapiens
ucuauugaaaaaucaccaca

SEQ ID NO: 1432294 - RNA, 14 nt, Homo sapiens
uucagccaccucuc

SEQ ID NO: 1432295 - RNA, 19 nt, Homo sapiens
uucagcgagacccuugcau

SEQ ID NO: 1432296 - RNA, 20 nt, Homo sapiens
uucaggacuuaacggcucca

SEQ ID NO: 1432297 - RNA, 18 nt, Homo sapiens
uucaggaguuggagacca

SEQ ID NO: 1432298 - RNA, 13 nt, Homo sapiens
uucaggugcuuuu

SEQ ID NO: 1432299 - RNA, 20 nt, Homo sapiens
uucaggugcuuuugauguga

SEQ ID NO: 1432300 - RNA, 18 nt, Homo sapiens
uucagugcuguacuugau

SEQ ID NO: 1432301 - RNA, 23 nt, Homo sapiens
uucaguggugugaucuuggcuca

SEQ ID NO: 1432302 - RNA, 23 nt, Homo sapiens
uucaguuccucuuugcauggaau

SEQ ID NO: 1432303 - RNA, 17 nt, Homo sapiens
uucauaaggccugcccu

SEQ ID NO: 1432304 - RNA, 15 nt, Homo sapiens
uucauccguguaacc

SEQ ID NO: 1432305 - RNA, 15 nt, Homo sapiens
uucaugaacuuggcu

SEQ ID NO: 1432306 - RNA, 16 nt, Homo sapiens
uucaugagcugaguga

SEQ ID NO: 1432307 - RNA, 19 nt, Homo sapiens
uucauguaauaaaucugag

SEQ ID NO: 1432308 - RNA, 15 nt, Homo sapiens
uucauuguaaucaaa

SEQ ID NO: 1432309 - RNA, 17 nt, Homo sapiens
uucauuuuuuucacugg

SEQ ID NO: 1432310 - RNA, 21 nt, Homo sapiens
uuccaaaccugacagauguca

SEQ ID NO: 1432311 - RNA, 17 nt, Homo sapiens
uuccaaccccuuuccac

SEQ ID NO: 1432312 - RNA, 17 nt, Homo sapiens
uuccaauaaaacuuuau

SEQ ID NO: 1432313 - RNA, 21 nt, Homo sapiens
uuccacagaauacaagccacu

SEQ ID NO: 1432314 - RNA, 14 nt, Homo sapiens
uuccaccaucaaau

SEQ ID NO: 1432315 - RNA, 23 nt, Homo sapiens
uuccacuuagaaauugcauuucc

SEQ ID NO: 1432316 - RNA, 13 nt, Homo sapiens
uuccagacugcuu

SEQ ID NO: 1432317 - RNA, 12 nt, Homo sapiens
uuccagcaugca

SEQ ID NO: 1432318 - RNA, 15 nt, Homo sapiens
uuccagcaugcaucc

SEQ ID NO: 1432319 - RNA, 17 nt, Homo sapiens
uuccagcuagugaccca

SEQ ID NO: 1432320 - RNA, 23 nt, Homo sapiens
uuccaggggcacacaaugcuauu

SEQ ID NO: 1432321 - RNA, 17 nt, Homo sapiens
uuccauccccaaacugu

SEQ ID NO: 1432322 - RNA, 18 nt, Homo sapiens
uuccaucccuacuuuuca

SEQ ID NO: 1432323 - RNA, 15 nt, Homo sapiens
uuccaugaagaccac

SEQ ID NO: 1432324 - RNA, 21 nt, Homo sapiens
uuccaugggauguuaagcaaa

SEQ ID NO: 1432325 - RNA, 12 nt, Homo sapiens
uuccauguuaaa

SEQ ID NO: 1432326 - RNA, 18 nt, Homo sapiens
uucccaaauuucauaccu

SEQ ID NO: 1432327 - RNA, 17 nt, Homo sapiens
uucccauucuacauacu

SEQ ID NO: 1432328 - RNA, 14 nt, Homo sapiens
uucccauucuugca

SEQ ID NO: 1432329 - RNA, 14 nt, Homo sapiens
uuccccacucaaug

SEQ ID NO: 1432330 - RNA, 16 nt, Homo sapiens
uucccccacuugggag

SEQ ID NO: 1432331 - RNA, 13 nt, Homo sapiens
uucccccagacag

SEQ ID NO: 1432332 - RNA, 19 nt, Homo sapiens
uucccucuuuccccaccuc

SEQ ID NO: 1432333 - RNA, 20 nt, Homo sapiens
uucccugaaaacccagagag

SEQ ID NO: 1432334 - RNA, 20 nt, Homo sapiens
uucccuucucuccuucccuc

SEQ ID NO: 1432335 - RNA, 23 nt, Homo sapiens
uuccggaagaaaaagagccauug

SEQ ID NO: 1432336 - RNA, 17 nt, Homo sapiens
uuccuaacauuuugaag

SEQ ID NO: 1432337 - RNA, 20 nt, Homo sapiens
uuccuccugaagccucugcc

SEQ ID NO: 1432338 - RNA, 19 nt, Homo sapiens
uuccucgcaggucucagcc

SEQ ID NO: 1432339 - RNA, 16 nt, Homo sapiens
uuccucgccucuccca

SEQ ID NO: 1432340 - RNA, 17 nt, Homo sapiens
guuauguuugcacuuug

SEQ ID NO: 1432341 - RNA, 18 nt, Homo sapiens
guuauguuugcacuuugu

SEQ ID NO: 1432342 - RNA, 16 nt, Homo sapiens
guuauugaaucuuaau

SEQ ID NO: 1432343 - RNA, 13 nt, Homo sapiens
guuauuguaggca

SEQ ID NO: 1432344 - RNA, 21 nt, Homo sapiens
guuauuucucccuuguguuag

SEQ ID NO: 1432345 - RNA, 20 nt, Homo sapiens
guucaaaaaacucuugauau

SEQ ID NO: 1432346 - RNA, 22 nt, Homo sapiens
guucaaaugaguucaacuuuga

SEQ ID NO: 1432347 - RNA, 15 nt, Homo sapiens
guucaaggaccacau

SEQ ID NO: 1432348 - RNA, 13 nt, Homo sapiens
guucacacuguaa

SEQ ID NO: 1432349 - RNA, 18 nt, Homo sapiens
guucacaugcaucauaac

SEQ ID NO: 1432350 - RNA, 17 nt, Homo sapiens
guucacucuacuuagca

SEQ ID NO: 1432351 - RNA, 19 nt, Homo sapiens
guucagagaucguuccuau

SEQ ID NO: 1432352 - RNA, 21 nt, Homo sapiens
guucaucagacuccugugcaa

SEQ ID NO: 1432353 - RNA, 20 nt, Homo sapiens
guucauguuuguaaauuaau

SEQ ID NO: 1432354 - RNA, 18 nt, Homo sapiens
guucauucuuaccgagaa

SEQ ID NO: 1432355 - RNA, 15 nt, Homo sapiens
guuccaguugcuuga

SEQ ID NO: 1432356 - RNA, 21 nt, Homo sapiens
guuccuaagccuguugcugaa

SEQ ID NO: 1432357 - RNA, 21 nt, Homo sapiens
guuccuauuuggggcuugcau

SEQ ID NO: 1432358 - RNA, 23 nt, Homo sapiens
guuccuccaagaggucuccauca

SEQ ID NO: 1432359 - RNA, 17 nt, Homo sapiens
guuccucgcaggucuca

SEQ ID NO: 1432360 - RNA, 17 nt, Homo sapiens
guuccugcacuccagaa

SEQ ID NO: 1432361 - RNA, 16 nt, Homo sapiens
guuccuuacugcagaa

SEQ ID NO: 1432362 - RNA, 15 nt, Homo sapiens
guucuaaguucaugu

SEQ ID NO: 1432363 - RNA, 14 nt, Homo sapiens
guucugaacuggaa

SEQ ID NO: 1432364 - RNA, 14 nt, Homo sapiens
guucugcacugaaa

SEQ ID NO: 1432365 - RNA, 15 nt, Homo sapiens
guucugcacugaaaa

SEQ ID NO: 1432366 - RNA, 16 nt, Homo sapiens
guucuggaaaccacgu

SEQ ID NO: 1432367 - RNA, 16 nt, Homo sapiens
guucugguaugaacuu

SEQ ID NO: 1432368 - RNA, 11 nt, Homo sapiens
guucuuaccug

SEQ ID NO: 1432369 - RNA, 15 nt, Homo sapiens
guucuuccuaccaaa

SEQ ID NO: 1432370 - RNA, 18 nt, Homo sapiens
guucuuccuaccaaauau

SEQ ID NO: 1432371 - RNA, 23 nt, Homo sapiens
guucuugugcauguuuacuuuau

SEQ ID NO: 1432372 - RNA, 14 nt, Homo sapiens
guugaaacuguuau

SEQ ID NO: 1432373 - RNA, 17 nt, Homo sapiens
guugaagccacugccuu

SEQ ID NO: 1432374 - RNA, 20 nt, Homo sapiens
guugaaucuugcacauauuu

SEQ ID NO: 1432375 - RNA, 23 nt, Homo sapiens
guugauucccagcauucaguggu

SEQ ID NO: 1432376 - RNA, 20 nt, Homo sapiens
guugcagagauuuccuccau

SEQ ID NO: 1432377 - RNA, 12 nt, Homo sapiens
guugcagucuca

SEQ ID NO: 1432378 - RNA, 23 nt, Homo sapiens
guugcagucucagaaagccuucc

SEQ ID NO: 1432379 - RNA, 21 nt, Homo sapiens
guugcccaggcugcucuugaa

SEQ ID NO: 1432380 - RNA, 15 nt, Homo sapiens
guugcuggacuguca

SEQ ID NO: 1432381 - RNA, 24 nt, Homo sapiens
guugcuuauuucccucaucuugcc

SEQ ID NO: 1432382 - RNA, 22 nt, Homo sapiens
guugcuucaccuuggagccuga

SEQ ID NO: 1432383 - RNA, 21 nt, Homo sapiens
guuggaacugcauucuuuuaa

SEQ ID NO: 1432384 - RNA, 19 nt, Homo sapiens
guugguugaacuaugcuga

SEQ ID NO: 1432385 - RNA, 19 nt, Homo sapiens
guugugccaaagugcauag

SEQ ID NO: 1432386 - RNA, 23 nt, Homo sapiens
guuguucucuucuuuaaagggau

SEQ ID NO: 1432387 - RNA, 13 nt, Homo sapiens
guuguuugggaga

SEQ ID NO: 1432388 - RNA, 22 nt, Homo sapiens
guuuagaucccaugucaccuca

SEQ ID NO: 1432389 - RNA, 18 nt, Homo sapiens
guuucacaaacuacaaag

SEQ ID NO: 1432390 - RNA, 13 nt, Homo sapiens
guuuccaguggau

SEQ ID NO: 1432391 - RNA, 21 nt, Homo sapiens
guuucuccuuuugaccaaaua

SEQ ID NO: 1432392 - RNA, 18 nt, Homo sapiens
guuucugaaccauuacug

SEQ ID NO: 1432393 - RNA, 21 nt, Homo sapiens
guuucugaaccauuacuguaa

SEQ ID NO: 1432394 - RNA, 23 nt, Homo sapiens
guuucugagcauaaugcucccau

SEQ ID NO: 1432395 - RNA, 17 nt, Homo sapiens
guuucuguuucuauucu

SEQ ID NO: 1432396 - RNA, 15 nt, Homo sapiens
guuucuuccuuuccu

SEQ ID NO: 1432397 - RNA, 20 nt, Homo sapiens
guuucuugcucugagugcua

SEQ ID NO: 1432398 - RNA, 15 nt, Homo sapiens
guuucuugggguccc

SEQ ID NO: 1432399 - RNA, 22 nt, Homo sapiens
guuugaugucauuaauguguug

SEQ ID NO: 1432400 - RNA, 23 nt, Homo sapiens
guuugcucuugcauugcaaaaau

SEQ ID NO: 1432401 - RNA, 15 nt, Homo sapiens
guuugcuguuugcaa

SEQ ID NO: 1432402 - RNA, 23 nt, Homo sapiens
guuuggccgggugcgguggcuca

SEQ ID NO: 1432403 - RNA, 23 nt, Homo sapiens
guuugucuauaugucuagcucau

SEQ ID NO: 1432404 - RNA, 14 nt, Homo sapiens
guuugugaaacaaa

SEQ ID NO: 1432405 - RNA, 23 nt, Homo sapiens
guuuuaaauuauaagaugucauc

SEQ ID NO: 1432406 - RNA, 17 nt, Homo sapiens
guuuucauccuggccuc

SEQ ID NO: 1432407 - RNA, 17 nt, Homo sapiens
guuuuuaaaaaucuguu

SEQ ID NO: 1432408 - RNA, 17 nt, Homo sapiens
guuuuuguuuuuuucca

SEQ ID NO: 1432409 - RNA, 23 nt, Homo sapiens
guuuuuuuuuuccacuuagaaau

SEQ ID NO: 1432410 - RNA, 20 nt, Homo sapiens
uaaaaaaaaaccuagcaucu

SEQ ID NO: 1432411 - RNA, 22 nt, Homo sapiens
uaaaaaacauaaauuucuuuaa

SEQ ID NO: 1432412 - RNA, 13 nt, Homo sapiens
uaaaaaaugucua

SEQ ID NO: 1432413 - RNA, 23 nt, Homo sapiens
uaaaaacccuguauggcacuuau

SEQ ID NO: 1432414 - RNA, 23 nt, Homo sapiens
uaaaaaggaccagagaauucuua

SEQ ID NO: 1432415 - RNA, 13 nt, Homo sapiens
uaaaaaguucaua

SEQ ID NO: 1432416 - RNA, 15 nt, Homo sapiens
uaaaaauaagcuuua

SEQ ID NO: 1432417 - RNA, 14 nt, Homo sapiens
uaaaaauacaagca

SEQ ID NO: 1432418 - RNA, 22 nt, Homo sapiens
uaaaaauauauauagugcuaua

SEQ ID NO: 1432419 - RNA, 15 nt, Homo sapiens
uaaaaaugcaacuuc

SEQ ID NO: 1432420 - RNA, 19 nt, Homo sapiens
uaaaacacaccuaagagaa

SEQ ID NO: 1432421 - RNA, 13 nt, Homo sapiens
uccagaucugcac

SEQ ID NO: 1432422 - RNA, 13 nt, Homo sapiens
uccagaugccuuc

SEQ ID NO: 1432423 - RNA, 13 nt, Homo sapiens
uccagcagcugcg

SEQ ID NO: 1432424 - RNA, 11 nt, Homo sapiens
uccagcauuug

SEQ ID NO: 1432425 - RNA, 14 nt, Homo sapiens
uccagcauuugcca

SEQ ID NO: 1432426 - RNA, 21 nt, Homo sapiens
uccagccugcccucagcacag

SEQ ID NO: 1432427 - RNA, 19 nt, Homo sapiens
uccaggaauaggcauuugc

SEQ ID NO: 1432428 - RNA, 16 nt, Homo sapiens
uccaggcccaaggagu

SEQ ID NO: 1432429 - RNA, 22 nt, Homo sapiens
uccagugggaggugagaccacc

SEQ ID NO: 1432430 - RNA, 15 nt, Homo sapiens
uccaguucugacaca

SEQ ID NO: 1432431 - RNA, 13 nt, Homo sapiens
uccauagugcacu

SEQ ID NO: 1432432 - RNA, 12 nt, Homo sapiens
uccaucccgaaa

SEQ ID NO: 1432433 - RNA, 18 nt, Homo sapiens
uccauccggcuccuguca

SEQ ID NO: 1432434 - RNA, 23 nt, Homo sapiens
uccaucuagagauuuucuuggca

SEQ ID NO: 1432435 - RNA, 14 nt, Homo sapiens
uccaugaagaccac

SEQ ID NO: 1432436 - RNA, 23 nt, Homo sapiens
uccauguaggaaaguaaaaugga

SEQ ID NO: 1432437 - RNA, 23 nt, Homo sapiens
uccauuuggauaaaaggaaccaa

SEQ ID NO: 1432438 - RNA, 13 nt, Homo sapiens
ucccaaaauacua

SEQ ID NO: 1432439 - RNA, 22 nt, Homo sapiens
ucccaaaauacuacacauccaa

SEQ ID NO: 1432440 - RNA, 21 nt, Homo sapiens
ucccaaauuucauaccuauca

SEQ ID NO: 1432441 - RNA, 21 nt, Homo sapiens
ucccaacuccucccuauccua

SEQ ID NO: 1432442 - RNA, 14 nt, Homo sapiens
ucccaacucuagcc

SEQ ID NO: 1432443 - RNA, 20 nt, Homo sapiens
ucccaagagcaucaugccuc

SEQ ID NO: 1432444 - RNA, 23 nt, Homo sapiens
ucccaauaacuaaugcuaagaaa

SEQ ID NO: 1432445 - RNA, 18 nt, Homo sapiens
ucccacacccuguuuuac

SEQ ID NO: 1432446 - RNA, 14 nt, Homo sapiens
ucccacccaacagc

SEQ ID NO: 1432447 - RNA, 16 nt, Homo sapiens
ucccaccccacuccag

SEQ ID NO: 1432448 - RNA, 17 nt, Homo sapiens
ucccaccccggccucca

SEQ ID NO: 1432449 - RNA, 16 nt, Homo sapiens
ucccacccuaccacag

SEQ ID NO: 1432450 - RNA, 22 nt, Homo sapiens
ucccaccucuucucuuccugua

SEQ ID NO: 1432451 - RNA, 18 nt, Homo sapiens
ucccacgaugucaaggac

SEQ ID NO: 1432452 - RNA, 18 nt, Homo sapiens
ucccagaagggaguugcu

SEQ ID NO: 1432453 - RNA, 24 nt, Homo sapiens
ucccagauccucugcugacuccau

SEQ ID NO: 1432454 - RNA, 20 nt, Homo sapiens
ucccagcagcgguaccccag

SEQ ID NO: 1432455 - RNA, 19 nt, Homo sapiens
ucccagcccuauggaugug

SEQ ID NO: 1432456 - RNA, 14 nt, Homo sapiens
ucccaguggucaaa

SEQ ID NO: 1432457 - RNA, 14 nt, Homo sapiens
ucccaugauccaga

SEQ ID NO: 1432458 - RNA, 17 nt, Homo sapiens
ucccauguugcaugccu

SEQ ID NO: 1432459 - RNA, 18 nt, Homo sapiens
ucccauugcaucaccucu

SEQ ID NO: 1432460 - RNA, 23 nt, Homo sapiens
uccccaaacaccaugaaucuuuu

SEQ ID NO: 1432461 - RNA, 14 nt, Homo sapiens
uccccaaacugugc

SEQ ID NO: 1432462 - RNA, 17 nt, Homo sapiens
uccccaaaggcauccau

SEQ ID NO: 1432463 - RNA, 18 nt, Homo sapiens
uccccaggggaaaaugaa

SEQ ID NO: 1432464 - RNA, 24 nt, Homo sapiens
uccccagucccaaugcacauccau

SEQ ID NO: 1432465 - RNA, 16 nt, Homo sapiens
ucccccacgugugaag

SEQ ID NO: 1432466 - RNA, 17 nt, Homo sapiens
ucccccagccucaaguc

SEQ ID NO: 1432467 - RNA, 22 nt, Homo sapiens
uccccuagcuuuccccagacac

SEQ ID NO: 1432468 - RNA, 14 nt, Homo sapiens
uccccucacucugu

SEQ ID NO: 1432469 - RNA, 13 nt, Homo sapiens
uccccuccacugu

SEQ ID NO: 1432470 - RNA, 21 nt, Homo sapiens
uccccugaaaaacugaucaaa

SEQ ID NO: 1432471 - RNA, 23 nt, Homo sapiens
uccccuggggucucugcugcauu

SEQ ID NO: 1432472 - RNA, 15 nt, Homo sapiens
uccccugucccacca

SEQ ID NO: 1432473 - RNA, 17 nt, Homo sapiens
uccccuguggucuugga

SEQ ID NO: 1432474 - RNA, 18 nt, Homo sapiens
uccccuguggucuuggaa

SEQ ID NO: 1432475 - RNA, 15 nt, Homo sapiens
uccccuuggcuguga

SEQ ID NO: 1432476 - RNA, 19 nt, Homo sapiens
ucccgagcuacucucuugc

SEQ ID NO: 1432477 - RNA, 23 nt, Homo sapiens
ucccgauaucaaaaagacugugg

SEQ ID NO: 1432478 - RNA, 16 nt, Homo sapiens
ucccggguguguacac

SEQ ID NO: 1432479 - RNA, 16 nt, Homo sapiens
ucccgguucaccuugc

SEQ ID NO: 1432480 - RNA, 18 nt, Homo sapiens
ucccgucuucuccaacac

SEQ ID NO: 1432481 - RNA, 23 nt, Homo sapiens
ucccuacccacucuuugcuacaa

SEQ ID NO: 1432482 - RNA, 21 nt, Homo sapiens
ucccuaccccauuugugguca

SEQ ID NO: 1432483 - RNA, 19 nt, Homo sapiens
ucccuccccaaacccauca

SEQ ID NO: 1432484 - RNA, 15 nt, Homo sapiens
ucccuccucacuugc

SEQ ID NO: 1432485 - RNA, 22 nt, Homo sapiens
ucccucuucuucucccugugug

SEQ ID NO: 1432486 - RNA, 16 nt, Homo sapiens
ucccugcuaccaaggc

SEQ ID NO: 1432487 - RNA, 11 nt, Homo sapiens
ucccugggaag

SEQ ID NO: 1432488 - RNA, 19 nt, Homo sapiens
ucccugggggaagcccugg

SEQ ID NO: 1432489 - RNA, 21 nt, Homo sapiens
ucccuguccuccucggaucac

SEQ ID NO: 1432490 - RNA, 20 nt, Homo sapiens
ucccuuaggcauuauuuaau

SEQ ID NO: 1432491 - RNA, 15 nt, Homo sapiens
ucccuucuacagccu

SEQ ID NO: 1432492 - RNA, 14 nt, Homo sapiens
ucccuuuccuccac

SEQ ID NO: 1432493 - RNA, 15 nt, Homo sapiens
uccgcaccagcugcu

SEQ ID NO: 1432494 - RNA, 14 nt, Homo sapiens
uccgccaaacacuc

SEQ ID NO: 1432495 - RNA, 18 nt, Homo sapiens
uccgccaaacacuccacc

SEQ ID NO: 1432496 - RNA, 16 nt, Homo sapiens
uccguaguucccugaa

SEQ ID NO: 1432497 - RNA, 18 nt, Homo sapiens
uccguccaggagccugug

SEQ ID NO: 1432498 - RNA, 23 nt, Homo sapiens
uccgugguggcaccgagaccaaa

SEQ ID NO: 1432499 - RNA, 19 nt, Homo sapiens
uccuaaaggcccacuggca

SEQ ID NO: 1432500 - RNA, 18 nt, Homo sapiens
uccuaacccccuuacugu

SEQ ID NO: 1432501 - RNA, 13 nt, Homo sapiens
uccuaacugagaa

SEQ ID NO: 1432502 - RNA, 23 nt, Homo sapiens
uccuaagccuguugcugaaguca

SEQ ID NO: 1432503 - RNA, 22 nt, Homo sapiens
uccuaauaugcuuuacaaucug

SEQ ID NO: 1432504 - RNA, 12 nt, Homo sapiens
uccuacagccuc

SEQ ID NO: 1432505 - RNA, 21 nt, Homo sapiens
aguguucauuuuagugacugu

SEQ ID NO: 1432506 - RNA, 16 nt, Homo sapiens
aguguuccuucauuaa

SEQ ID NO: 1432507 - RNA, 18 nt, Homo sapiens
aguuaaaaguguugauua

SEQ ID NO: 1432508 - RNA, 12 nt, Homo sapiens
aguuacauauua

SEQ ID NO: 1432509 - RNA, 23 nt, Homo sapiens
aguuacggagggaggacaucaua

SEQ ID NO: 1432510 - RNA, 13 nt, Homo sapiens
aguuaggggagag

SEQ ID NO: 1432511 - RNA, 11 nt, Homo sapiens
aguuaggugug

SEQ ID NO: 1432512 - RNA, 17 nt, Homo sapiens
aguuaggugugccaaac

SEQ ID NO: 1432513 - RNA, 16 nt, Homo sapiens
aguuauauugaauaua

SEQ ID NO: 1432514 - RNA, 14 nt, Homo sapiens
aguuccauguuaaa

SEQ ID NO: 1432515 - RNA, 16 nt, Homo sapiens
aguucuggaaaccacg

SEQ ID NO: 1432516 - RNA, 23 nt, Homo sapiens
aguugaaagaguccuauuugcac

SEQ ID NO: 1432517 - RNA, 14 nt, Homo sapiens
aguuguacacugug

SEQ ID NO: 1432518 - RNA, 16 nt, Homo sapiens
aguuguacacugugua

SEQ ID NO: 1432519 - RNA, 16 nt, Homo sapiens
aguuuaucaugucagu

SEQ ID NO: 1432520 - RNA, 17 nt, Homo sapiens
aguuuauugacaauaau

SEQ ID NO: 1432521 - RNA, 23 nt, Homo sapiens
aguuuccaaguuccugcacucca

SEQ ID NO: 1432522 - RNA, 20 nt, Homo sapiens
aguuucuccuuuugaccaaa

SEQ ID NO: 1432523 - RNA, 23 nt, Homo sapiens
aguuucuccuuuugaccaaauaa

SEQ ID NO: 1432524 - RNA, 13 nt, Homo sapiens
aguuucucuccac

SEQ ID NO: 1432525 - RNA, 20 nt, Homo sapiens
aguuugacauuguauguauc

SEQ ID NO: 1432526 - RNA, 10 nt, Homo sapiens
aguuugauau

SEQ ID NO: 1432527 - RNA, 20 nt, Homo sapiens
aguuuucaaagaucccguga

SEQ ID NO: 1432528 - RNA, 21 nt, Homo sapiens
aguuuucaaagaucccgugaa

SEQ ID NO: 1432529 - RNA, 15 nt, Homo sapiens
aguuuuccaggaaua

SEQ ID NO: 1432530 - RNA, 13 nt, Homo sapiens
aguuuugaugaaa

SEQ ID NO: 1432531 - RNA, 21 nt, Homo sapiens
auaaaaacccuguauggcacu

SEQ ID NO: 1432532 - RNA, 13 nt, Homo sapiens
auaaaacacauca

SEQ ID NO: 1432533 - RNA, 16 nt, Homo sapiens
auaaaacacaucaagu

SEQ ID NO: 1432534 - RNA, 20 nt, Homo sapiens
auaaaauaaaguacauuauu

SEQ ID NO: 1432535 - RNA, 14 nt, Homo sapiens
auaaaauugcacuu

SEQ ID NO: 1432536 - RNA, 20 nt, Homo sapiens
auaaacaaauaacaaugugc

SEQ ID NO: 1432537 - RNA, 19 nt, Homo sapiens
auaaacacauacauugcca

SEQ ID NO: 1432538 - RNA, 14 nt, Homo sapiens
auaaacacccauga

SEQ ID NO: 1432539 - RNA, 20 nt, Homo sapiens
auaaacauuaaaugucuuau

SEQ ID NO: 1432540 - RNA, 14 nt, Homo sapiens
auaaacauuuggca

SEQ ID NO: 1432541 - RNA, 19 nt, Homo sapiens
auaaaccaaugagcuguau

SEQ ID NO: 1432542 - RNA, 17 nt, Homo sapiens
auaaaccuggagaugau

SEQ ID NO: 1432543 - RNA, 15 nt, Homo sapiens
auaaacuagaucucc

SEQ ID NO: 1432544 - RNA, 15 nt, Homo sapiens
auaaacuaguuucca

SEQ ID NO: 1432545 - RNA, 19 nt, Homo sapiens
auaaacuaguuuccagugg

SEQ ID NO: 1432546 - RNA, 22 nt, Homo sapiens
auaaagagagcccugguccuag

SEQ ID NO: 1432547 - RNA, 14 nt, Homo sapiens
auaaagaugaucua

SEQ ID NO: 1432548 - RNA, 16 nt, Homo sapiens
auaaagccaguggaaa

SEQ ID NO: 1432549 - RNA, 17 nt, Homo sapiens
auaaagcccuugaacca

SEQ ID NO: 1432550 - RNA, 18 nt, Homo sapiens
auaaaggaagucaccaaa

SEQ ID NO: 1432551 - RNA, 19 nt, Homo sapiens
auaaaggaagucaccaaaa

SEQ ID NO: 1432552 - RNA, 15 nt, Homo sapiens
auaaaggcauggcau

SEQ ID NO: 1432553 - RNA, 22 nt, Homo sapiens
auaaaggucuuugcacauguga

SEQ ID NO: 1432554 - RNA, 14 nt, Homo sapiens
auaaagucacuucc

SEQ ID NO: 1432555 - RNA, 22 nt, Homo sapiens
auaaauccucagguaguacugg

SEQ ID NO: 1432556 - RNA, 21 nt, Homo sapiens
auaaaucugagccuaaaucua

SEQ ID NO: 1432557 - RNA, 17 nt, Homo sapiens
auaaauucagauauauu

SEQ ID NO: 1432558 - RNA, 21 nt, Homo sapiens
auaacaugucuuucagcauua

SEQ ID NO: 1432559 - RNA, 17 nt, Homo sapiens
aagccacagaagccagg

SEQ ID NO: 1432560 - RNA, 13 nt, Homo sapiens
aagccacaggagc

SEQ ID NO: 1432561 - RNA, 15 nt, Homo sapiens
aagccacucuuccaa

SEQ ID NO: 1432562 - RNA, 14 nt, Homo sapiens
agggccucugggag

SEQ ID NO: 1432563 - RNA, 23 nt, Homo sapiens
agggcuagaaccuggagagcuag

SEQ ID NO: 1432564 - RNA, 22 nt, Homo sapiens
agggcugccccuguagguugcu

SEQ ID NO: 1432565 - RNA, 23 nt, Homo sapiens
agggcuggaaucuggagagcuag

SEQ ID NO: 1432566 - RNA, 16 nt, Homo sapiens
agggcuggcugcugga

SEQ ID NO: 1432567 - RNA, 15 nt, Homo sapiens
agggcuuucucagga

SEQ ID NO: 1432568 - RNA, 21 nt, Homo sapiens
aggggaccacaccucccugaa

SEQ ID NO: 1432569 - RNA, 10 nt, Homo sapiens
aggggaccau

SEQ ID NO: 1432570 - RNA, 23 nt, Homo sapiens
aggggaccaugaagagacucucu

SEQ ID NO: 1432571 - RNA, 12 nt, Homo sapiens
aggggcaaagaa

SEQ ID NO: 1432572 - RNA, 17 nt, Homo sapiens
aggggcaaagaacugcc

SEQ ID NO: 1432573 - RNA, 14 nt, Homo sapiens
aggggccugggaaa

SEQ ID NO: 1432574 - RNA, 16 nt, Homo sapiens
aggggcucagcaaggu

SEQ ID NO: 1432575 - RNA, 21 nt, Homo sapiens
agggggccuuuaaagacuuaa

SEQ ID NO: 1432576 - RNA, 20 nt, Homo sapiens
agggggcgcucaggacccag

SEQ ID NO: 1432577 - RNA, 20 nt, Homo sapiens
agggggguugugaggccugg

SEQ ID NO: 1432578 - RNA, 21 nt, Homo sapiens
agggggugucuggaagcugag

SEQ ID NO: 1432579 - RNA, 18 nt, Homo sapiens
agggggugugucugcuca

SEQ ID NO: 1432580 - RNA, 18 nt, Homo sapiens
aggggugauucugaaacc

SEQ ID NO: 1432581 - RNA, 22 nt, Homo sapiens
agggucacuaaccaagccagaa

SEQ ID NO: 1432582 - RNA, 16 nt, Homo sapiens
aggguccgcaccagcu

SEQ ID NO: 1432583 - RNA, 19 nt, Homo sapiens
agggucuggaacaccaggc

SEQ ID NO: 1432584 - RNA, 17 nt, Homo sapiens
agggucuuugcaagaau

SEQ ID NO: 1432585 - RNA, 17 nt, Homo sapiens
agggugggaagcuugcu

SEQ ID NO: 1432586 - RNA, 22 nt, Homo sapiens
agguaaaucuaguuuacuuccu

SEQ ID NO: 1432587 - RNA, 22 nt, Homo sapiens
agguaaugauuauguguccuuu

SEQ ID NO: 1432588 - RNA, 14 nt, Homo sapiens
agguagcuuaccug

SEQ ID NO: 1432589 - RNA, 13 nt, Homo sapiens
agguaugagccag

SEQ ID NO: 1432590 - RNA, 14 nt, Homo sapiens
agguaugagccagg

SEQ ID NO: 1432591 - RNA, 20 nt, Homo sapiens
aggucagcgugcuuagccuc

SEQ ID NO: 1432592 - RNA, 18 nt, Homo sapiens
aggucauuauuuuuuaca

SEQ ID NO: 1432593 - RNA, 18 nt, Homo sapiens
aggucccugcuuaccuga

SEQ ID NO: 1432594 - RNA, 22 nt, Homo sapiens
agguccgcccgaccaggaucag

SEQ ID NO: 1432595 - RNA, 14 nt, Homo sapiens
agguccuccucucu

SEQ ID NO: 1432596 - RNA, 18 nt, Homo sapiens
agguccugagcacugcca

SEQ ID NO: 1432597 - RNA, 22 nt, Homo sapiens
aggucuccaucauggcagugau

SEQ ID NO: 1432598 - RNA, 19 nt, Homo sapiens
aggucuucuuguguccuga

SEQ ID NO: 1432599 - RNA, 21 nt, Homo sapiens
aggugacuggagcccgagggc

SEQ ID NO: 1432600 - RNA, 23 nt, Homo sapiens
aggugauccacccaccuuggccu

SEQ ID NO: 1432601 - RNA, 18 nt, Homo sapiens
aggugcaagagacagagc

SEQ ID NO: 1432602 - RNA, 20 nt, Homo sapiens
agguggagucucauucuguu

SEQ ID NO: 1432603 - RNA, 19 nt, Homo sapiens
agguggggaccaaaaccau

SEQ ID NO: 1432604 - RNA, 12 nt, Homo sapiens
aggugguucuga

SEQ ID NO: 1432605 - RNA, 15 nt, Homo sapiens
aggugucugcaccca

SEQ ID NO: 1432606 - RNA, 21 nt, Homo sapiens
aggugucugcacccaggggug

SEQ ID NO: 1432607 - RNA, 16 nt, Homo sapiens
agguguugccauuucu

SEQ ID NO: 1432608 - RNA, 19 nt, Homo sapiens
agguucuucuaaaauugaa

SEQ ID NO: 1432609 - RNA, 14 nt, Homo sapiens
agguucuuuccaug

SEQ ID NO: 1432610 - RNA, 22 nt, Homo sapiens
agguucuuuuuuuuuucaggaa

SEQ ID NO: 1432611 - RNA, 21 nt, Homo sapiens
agguuggugacugaaacauuc

SEQ ID NO: 1432612 - RNA, 18 nt, Homo sapiens
agguuucaagacuugaua

SEQ ID NO: 1432613 - RNA, 20 nt, Homo sapiens
agguuucaccugaucauaua

SEQ ID NO: 1432614 - RNA, 15 nt, Homo sapiens
agguuugcaccccuc

SEQ ID NO: 1432615 - RNA, 15 nt, Homo sapiens
agguuugcccugccu

SEQ ID NO: 1432616 - RNA, 19 nt, Homo sapiens
aguaaaacuuuaaugggag

SEQ ID NO: 1432617 - RNA, 12 nt, Homo sapiens
aguaaacuuucu

SEQ ID NO: 1432618 - RNA, 17 nt, Homo sapiens
cuagcuagaaauaugau

SEQ ID NO: 1432619 - RNA, 22 nt, Homo sapiens
cuaggauuacaggcaugagcca

SEQ ID NO: 1432620 - RNA, 21 nt, Homo sapiens
cuaggcaaagacuggccugau

SEQ ID NO: 1432621 - RNA, 18 nt, Homo sapiens
cuaggggucaggcuccau

SEQ ID NO: 1432622 - RNA, 21 nt, Homo sapiens
cuaggucaaaacauucaggua

SEQ ID NO: 1432623 - RNA, 23 nt, Homo sapiens
cuagugcuuccacuucuaugcaa

SEQ ID NO: 1432624 - RNA, 14 nt, Homo sapiens
cuaguguugcuugg

SEQ ID NO: 1432625 - RNA, 18 nt, Homo sapiens
cuauaacaugucuuucag

SEQ ID NO: 1432626 - RNA, 23 nt, Homo sapiens
cuauaacaugucuuucagcauua

SEQ ID NO: 1432627 - RNA, 23 nt, Homo sapiens
cuauacaaacuacagaguuuaug

SEQ ID NO: 1432628 - RNA, 15 nt, Homo sapiens
cuauauacaugugug

SEQ ID NO: 1432629 - RNA, 17 nt, Homo sapiens
cuauauacaugugugua

SEQ ID NO: 1432630 - RNA, 17 nt, Homo sapiens
cuauauugcacugugac

SEQ ID NO: 1432631 - RNA, 17 nt, Homo sapiens
cuauauuggucauugcc

SEQ ID NO: 1432632 - RNA, 17 nt, Homo sapiens
cuaucaaaacauaucaa

SEQ ID NO: 1432633 - RNA, 14 nt, Homo sapiens
cuaucaauagucaa

SEQ ID NO: 1432634 - RNA, 16 nt, Homo sapiens
cuaucaauuacagucc

SEQ ID NO: 1432635 - RNA, 20 nt, Homo sapiens
cuaucauuuauuuacaucua

SEQ ID NO: 1432636 - RNA, 21 nt, Homo sapiens
cuaucauuuauuuacaucuau

SEQ ID NO: 1432637 - RNA, 23 nt, Homo sapiens
cuaucauuuauuuacaucuaugu

SEQ ID NO: 1432638 - RNA, 20 nt, Homo sapiens
cuaucuacugagacaugacu

SEQ ID NO: 1432639 - RNA, 17 nt, Homo sapiens
cuaugacugcagaucau

SEQ ID NO: 1432640 - RNA, 15 nt, Homo sapiens
cuaugacuugggcac

SEQ ID NO: 1432641 - RNA, 22 nt, Homo sapiens
cuauggcccugcaaaaauauaa

SEQ ID NO: 1432642 - RNA, 15 nt, Homo sapiens
cuauuaaccuagaga

SEQ ID NO: 1432643 - RNA, 18 nt, Homo sapiens
cuauuagagaaacaaaca

SEQ ID NO: 1432644 - RNA, 19 nt, Homo sapiens
cuauucaaguauuaggggu

SEQ ID NO: 1432645 - RNA, 12 nt, Homo sapiens
cuauucaaugau

SEQ ID NO: 1432646 - RNA, 16 nt, Homo sapiens
cuauugaaauuacuga

SEQ ID NO: 1432647 - RNA, 18 nt, Homo sapiens
cuauugaaauuacugaaa

SEQ ID NO: 1432648 - RNA, 22 nt, Homo sapiens
cuauugaacugagccaaacaca

SEQ ID NO: 1432649 - RNA, 19 nt, Homo sapiens
cuauugcauguaaaaugca

SEQ ID NO: 1432650 - RNA, 17 nt, Homo sapiens
cuauuucuacacagugg

SEQ ID NO: 1432651 - RNA, 14 nt, Homo sapiens
cuauuucuaugcaa

SEQ ID NO: 1432652 - RNA, 23 nt, Homo sapiens
cuauuuggggcuugcaugccaaa

SEQ ID NO: 1432653 - RNA, 16 nt, Homo sapiens
cucaaaacugcacugu

SEQ ID NO: 1432654 - RNA, 18 nt, Homo sapiens
cucaaaacugcacuguca

SEQ ID NO: 1432655 - RNA, 13 nt, Homo sapiens
cucaaaacuuaac

SEQ ID NO: 1432656 - RNA, 22 nt, Homo sapiens
cucaaaucauuuaagaaggagu

SEQ ID NO: 1432657 - RNA, 19 nt, Homo sapiens
gagcauuacgugagccagg

SEQ ID NO: 1432658 - RNA, 17 nt, Homo sapiens
gagccaccccuaaagag

SEQ ID NO: 1432659 - RNA, 13 nt, Homo sapiens
gagccacuaccuu

SEQ ID NO: 1432660 - RNA, 23 nt, Homo sapiens
gagccagcucucucuacccggcc

SEQ ID NO: 1432661 - RNA, 20 nt, Homo sapiens
gagcccaagugccaucccac

SEQ ID NO: 1432662 - RNA, 16 nt, Homo sapiens
gagcccagagggccaa

SEQ ID NO: 1432663 - RNA, 18 nt, Homo sapiens
gagcccagcuacauuccu

SEQ ID NO: 1432664 - RNA, 20 nt, Homo sapiens
gagcccaggccguuccccuu

SEQ ID NO: 1432665 - RNA, 14 nt, Homo sapiens
gagccgcugugagc

SEQ ID NO: 1432666 - RNA, 19 nt, Homo sapiens
gagccuggaagccaaacaa

SEQ ID NO: 1432667 - RNA, 20 nt, Homo sapiens
gagccuuucuuauggaagaa

SEQ ID NO: 1432668 - RNA, 18 nt, Homo sapiens
gagcggcugcccgacuca

SEQ ID NO: 1432669 - RNA, 13 nt, Homo sapiens
gagcuagaaccug

SEQ ID NO: 1432670 - RNA, 19 nt, Homo sapiens
gagcuaggagcaaagccug

SEQ ID NO: 1432671 - RNA, 16 nt, Homo sapiens
gagcucacaaggcagc

SEQ ID NO: 1432672 - RNA, 19 nt, Homo sapiens
gagcucacucccacuggaa

SEQ ID NO: 1432673 - RNA, 21 nt, Homo sapiens
gagcucuucgguuucugagca

SEQ ID NO: 1432674 - RNA, 22 nt, Homo sapiens
gagcugaacccauuuugaguga

SEQ ID NO: 1432675 - RNA, 20 nt, Homo sapiens
gagcugacccagaguggagu

SEQ ID NO: 1432676 - RNA, 13 nt, Homo sapiens
gagcugcucugcu

SEQ ID NO: 1432677 - RNA, 23 nt, Homo sapiens
gagcuggcauuggucugcugacc

SEQ ID NO: 1432678 - RNA, 16 nt, Homo sapiens
gagcuggcugucuucc

SEQ ID NO: 1432679 - RNA, 18 nt, Homo sapiens
gagcuucaguauaaaaga

SEQ ID NO: 1432680 - RNA, 12 nt, Homo sapiens
gagcuuccucag

SEQ ID NO: 1432681 - RNA, 21 nt, Homo sapiens
gagcuuggacagucugagcug

SEQ ID NO: 1432682 - RNA, 23 nt, Homo sapiens
gaggaaaaacgaucgcugugaaa

SEQ ID NO: 1432683 - RNA, 19 nt, Homo sapiens
gaggaauucugaagccauu

SEQ ID NO: 1432684 - RNA, 23 nt, Homo sapiens
gaggacuacuauuugaagcaaug

SEQ ID NO: 1432685 - RNA, 13 nt, Homo sapiens
gaggacucaaggg

SEQ ID NO: 1432686 - RNA, 14 nt, Homo sapiens
gaggagaaacugag

SEQ ID NO: 1432687 - RNA, 21 nt, Homo sapiens
gaggaggauugcuucuuguga

SEQ ID NO: 1432688 - RNA, 15 nt, Homo sapiens
gaggaugcaacaaau

SEQ ID NO: 1432689 - RNA, 14 nt, Homo sapiens
gaggcaaaggccag

SEQ ID NO: 1432690 - RNA, 21 nt, Homo sapiens
gaggcaccugcuggaaaccac

SEQ ID NO: 1432691 - RNA, 19 nt, Homo sapiens
gaggcaugugaugugcaag

SEQ ID NO: 1432692 - RNA, 21 nt, Homo sapiens
gaggcccccuggugugucuga

SEQ ID NO: 1432693 - RNA, 20 nt, Homo sapiens
gaggccuuacuuaaacccag

SEQ ID NO: 1432694 - RNA, 21 nt, Homo sapiens
gaggccuuacuuaaacccagc

SEQ ID NO: 1432695 - RNA, 13 nt, Homo sapiens
cgaccccaucuca

SEQ ID NO: 1432696 - RNA, 18 nt, Homo sapiens
cgaccugcggcugcugug

SEQ ID NO: 1432697 - RNA, 13 nt, Homo sapiens
cgacgcaggugua

SEQ ID NO: 1432698 - RNA, 22 nt, Homo sapiens
cgacggcggcggcccucaaaag

SEQ ID NO: 1432699 - RNA, 19 nt, Homo sapiens
cgacugcgacgcaggugua

SEQ ID NO: 1432700 - RNA, 17 nt, Homo sapiens
cgagaaaacaaacccag

SEQ ID NO: 1432701 - RNA, 15 nt, Homo sapiens
cgagagagucuucca

SEQ ID NO: 1432702 - RNA, 17 nt, Homo sapiens
cgagcaggcuacuguca

SEQ ID NO: 1432703 - RNA, 16 nt, Homo sapiens
cgagucaugcacucag

SEQ ID NO: 1432704 - RNA, 16 nt, Homo sapiens
cgaguuccaccccauc

SEQ ID NO: 1432705 - RNA, 19 nt, Homo sapiens
cgaugcacacgcacauaga

SEQ ID NO: 1432706 - RNA, 15 nt, Homo sapiens
cgauguacacacaca

SEQ ID NO: 1432707 - RNA, 17 nt, Homo sapiens
cgauguacacacacaga

SEQ ID NO: 1432708 - RNA, 19 nt, Homo sapiens
cgaugugcgcacacacaga

SEQ ID NO: 1432709 - RNA, 13 nt, Homo sapiens
cgcaaaaccugca

SEQ ID NO: 1432710 - RNA, 16 nt, Homo sapiens
cgcaaaucaaccccag

SEQ ID NO: 1432711 - RNA, 14 nt, Homo sapiens
cgcaaaugaguauu

SEQ ID NO: 1432712 - RNA, 19 nt, Homo sapiens
cgcacacacagauaugcac

SEQ ID NO: 1432713 - RNA, 22 nt, Homo sapiens
cgcaccgggcccuccuugccug

SEQ ID NO: 1432714 - RNA, 17 nt, Homo sapiens
cgcagcccgaagcccag

SEQ ID NO: 1432715 - RNA, 20 nt, Homo sapiens
cgcagcgcgugcacagcgcg

SEQ ID NO: 1432716 - RNA, 14 nt, Homo sapiens
cgcaucauaugcag

SEQ ID NO: 1432717 - RNA, 16 nt, Homo sapiens
cgcaucgugguguguc

SEQ ID NO: 1432718 - RNA, 13 nt, Homo sapiens
cgcauucccugag

SEQ ID NO: 1432719 - RNA, 18 nt, Homo sapiens
cgccaacugcugaucaau

SEQ ID NO: 1432720 - RNA, 13 nt, Homo sapiens
cgccaaugcacac

SEQ ID NO: 1432721 - RNA, 21 nt, Homo sapiens
cgccccucauuuaucccucaa

SEQ ID NO: 1432722 - RNA, 16 nt, Homo sapiens
cgcccgaccaggauca

SEQ ID NO: 1432723 - RNA, 20 nt, Homo sapiens
cgccucucccaccccaugca

SEQ ID NO: 1432724 - RNA, 16 nt, Homo sapiens
cgcuacaccacucugg

SEQ ID NO: 1432725 - RNA, 14 nt, Homo sapiens
cgcuccagaucugc

SEQ ID NO: 1432726 - RNA, 13 nt, Homo sapiens
cgcucucuuccag

SEQ ID NO: 1432727 - RNA, 13 nt, Homo sapiens
cgcugccuggggc

SEQ ID NO: 1432728 - RNA, 16 nt, Homo sapiens
cggaagccaacuuggc

SEQ ID NO: 1432729 - RNA, 12 nt, Homo sapiens
cggaaggcaaag

SEQ ID NO: 1432730 - RNA, 11 nt, Homo sapiens
cggacaaauca

SEQ ID NO: 1432731 - RNA, 23 nt, Homo sapiens
cggacugcaagcagggcucugcc

SEQ ID NO: 1432732 - RNA, 22 nt, Homo sapiens
cggagaagagcuguucacagcc

SEQ ID NO: 1432733 - RNA, 17 nt, Homo sapiens
cggagccuccucucuca

SEQ ID NO: 1432734 - RNA, 16 nt, Homo sapiens
cggaugcacacacaga

SEQ ID NO: 1432735 - RNA, 19 nt, Homo sapiens
cggccagccuugcacugug

SEQ ID NO: 1432736 - RNA, 14 nt, Homo sapiens
cggccucccaaagu

SEQ ID NO: 1432737 - RNA, 21 nt, Homo sapiens
cggcugagucaugaucucccu

SEQ ID NO: 1432738 - RNA, 15 nt, Homo sapiens
cggcugccucaggag

SEQ ID NO: 1432739 - RNA, 15 nt, Homo sapiens
cggggcccuguguag

SEQ ID NO: 1432740 - RNA, 22 nt, Homo sapiens
cgggggaaagcacaccucaugc

SEQ ID NO: 1432741 - RNA, 18 nt, Homo sapiens
cgggggccagacacagau

SEQ ID NO: 1432742 - RNA, 15 nt, Homo sapiens
aacuuauugucuagg

SEQ ID NO: 1432743 - RNA, 14 nt, Homo sapiens
aacuucucugaguc

SEQ ID NO: 1432744 - RNA, 20 nt, Homo sapiens
aacuugcacgacgccugcca

SEQ ID NO: 1432745 - RNA, 14 nt, Homo sapiens
aacuugugcugaga

SEQ ID NO: 1432746 - RNA, 12 nt, Homo sapiens
aacuuuguacca

SEQ ID NO: 1432747 - RNA, 23 nt, Homo sapiens
aacuuugugccuuugaccaucuc

SEQ ID NO: 1432748 - RNA, 20 nt, Homo sapiens
aagaaaaaguugcagucuca

SEQ ID NO: 1432749 - RNA, 16 nt, Homo sapiens
aagaaaacaucacuga

SEQ ID NO: 1432750 - RNA, 13 nt, Homo sapiens
aagaaaaugaagc

SEQ ID NO: 1432751 - RNA, 22 nt, Homo sapiens
aagaaacagauaccauacucau

SEQ ID NO: 1432752 - RNA, 13 nt, Homo sapiens
aagaaacccaagu

SEQ ID NO: 1432753 - RNA, 13 nt, Homo sapiens
aagaaagauccac

SEQ ID NO: 1432754 - RNA, 13 nt, Homo sapiens
aagaaagugcaga

SEQ ID NO: 1432755 - RNA, 17 nt, Homo sapiens
aagaaaguguuggcuaa

SEQ ID NO: 1432756 - RNA, 12 nt, Homo sapiens
aagaaauuccug

SEQ ID NO: 1432757 - RNA, 17 nt, Homo sapiens
aagaaauuccuguagca

SEQ ID NO: 1432758 - RNA, 22 nt, Homo sapiens
aagaaauuccuguagcaucuuc

SEQ ID NO: 1432759 - RNA, 13 nt, Homo sapiens
aagaaauugccuc

SEQ ID NO: 1432760 - RNA, 17 nt, Homo sapiens
aagaacaguaacugcca

SEQ ID NO: 1432761 - RNA, 14 nt, Homo sapiens
aagaacgucauuuu

SEQ ID NO: 1432762 - RNA, 13 nt, Homo sapiens
aagaagaccagac

SEQ ID NO: 1432763 - RNA, 21 nt, Homo sapiens
aagaaggaguucugacauuca

SEQ ID NO: 1432764 - RNA, 13 nt, Homo sapiens
aagaaguguuccu

SEQ ID NO: 1432765 - RNA, 13 nt, Homo sapiens
aagaauacagaaa

SEQ ID NO: 1432766 - RNA, 13 nt, Homo sapiens
aagaauauuguau

SEQ ID NO: 1432767 - RNA, 13 nt, Homo sapiens
aagaaucaccuca

SEQ ID NO: 1432768 - RNA, 14 nt, Homo sapiens
aagaaucagucuug

SEQ ID NO: 1432769 - RNA, 22 nt, Homo sapiens
aagaaucuucugccccagcuuu

SEQ ID NO: 1432770 - RNA, 14 nt, Homo sapiens
aagacagaauguca

SEQ ID NO: 1432771 - RNA, 16 nt, Homo sapiens
aagacagcugacagau

SEQ ID NO: 1432772 - RNA, 19 nt, Homo sapiens
aagacagggaagagcagaa

SEQ ID NO: 1432773 - RNA, 21 nt, Homo sapiens
aagacaggucuagacuuucuc

SEQ ID NO: 1432774 - RNA, 15 nt, Homo sapiens
aagacauaugcauuu

SEQ ID NO: 1432775 - RNA, 11 nt, Homo sapiens
aagaccaaaaa

SEQ ID NO: 1432776 - RNA, 15 nt, Homo sapiens
aagaccaaagcauug

SEQ ID NO: 1432777 - RNA, 22 nt, Homo sapiens
aagaccaauauucaaaugcgua

SEQ ID NO: 1432778 - RNA, 17 nt, Homo sapiens
aagaccagccuggccaa

SEQ ID NO: 1432779 - RNA, 19 nt, Homo sapiens
aagacccaguguaaagaau

SEQ ID NO: 1432780 - RNA, 13 nt, Homo sapiens
aagacuacuauac

SEQ ID NO: 1432781 - RNA, 15 nt, Homo sapiens
aagacuacuauacaa

SEQ ID NO: 1432782 - RNA, 18 nt, Homo sapiens
aagacuugccacuuuuca

SEQ ID NO: 1432783 - RNA, 22 nt, Homo sapiens
aagagacuaauagagacacaga

SEQ ID NO: 1432784 - RNA, 15 nt, Homo sapiens
aagagacucuggccu

SEQ ID NO: 1432785 - RNA, 19 nt, Homo sapiens
aagagacuggagcaucuga

SEQ ID NO: 1432786 - RNA, 14 nt, Homo sapiens
aagagaucaggaag

SEQ ID NO: 1432787 - RNA, 18 nt, Homo sapiens
aagaggaaaaaaagccgu

SEQ ID NO: 1432788 - RNA, 15 nt, Homo sapiens
aagaggucuccauca

SEQ ID NO: 1432789 - RNA, 21 nt, Homo sapiens
aagagugagugaacaacuauu

SEQ ID NO: 1432790 - RNA, 21 nt, Homo sapiens
aagaguucuuaaggauuguga

SEQ ID NO: 1432791 - RNA, 24 nt, Homo sapiens
aagaguuucuccuuuugaccaaau

SEQ ID NO: 1432792 - RNA, 13 nt, Homo sapiens
aagauacacuccu

SEQ ID NO: 1432793 - RNA, 20 nt, Homo sapiens
aagauacgguugucuagagg

SEQ ID NO: 1432794 - RNA, 17 nt, Homo sapiens
aagauaucagagcucuu

SEQ ID NO: 1432795 - RNA, 15 nt, Homo sapiens
aagaucuuugcccuc

SEQ ID NO: 1432796 - RNA, 20 nt, Homo sapiens
aagaugaaaaauggucccuu

SEQ ID NO: 1432797 - RNA, 16 nt, Homo sapiens
aagaugaugaugaucu

SEQ ID NO: 1432798 - RNA, 17 nt, Homo sapiens
aagaugaugaugaucuu

SEQ ID NO: 1432799 - RNA, 20 nt, Homo sapiens
aagaugauucuggcugaaaa

SEQ ID NO: 1432800 - RNA, 15 nt, Homo sapiens
aagaugucaaauauc

SEQ ID NO: 1432801 - RNA, 22 nt, Homo sapiens
aagauucacuaaagcagcacau

SEQ ID NO: 1432802 - RNA, 17 nt, Homo sapiens
aagauucuccugugcua

SEQ ID NO: 1432803 - RNA, 18 nt, Homo sapiens
aagauuguccagugcaac

SEQ ID NO: 1432804 - RNA, 20 nt, Homo sapiens
aagauuuaccauaagggacu

SEQ ID NO: 1432805 - RNA, 20 nt, Homo sapiens
aagauuuuuaauuacaauaa

SEQ ID NO: 1432806 - RNA, 21 nt, Homo sapiens
aagcaaauagacacagucaua

SEQ ID NO: 1432807 - RNA, 23 nt, Homo sapiens
aagcaacacccacccacuucuca

SEQ ID NO: 1432808 - RNA, 13 nt, Homo sapiens
aagcaaggccaaa

SEQ ID NO: 1432809 - RNA, 22 nt, Homo sapiens
aagcaauaaaaauacuaugaaa

SEQ ID NO: 1432810 - RNA, 13 nt, Homo sapiens
aagcaauugucug

SEQ ID NO: 1432811 - RNA, 13 nt, Homo sapiens
aagcacaccucau

SEQ ID NO: 1432812 - RNA, 19 nt, Homo sapiens
aagcacauaugaacuggac

SEQ ID NO: 1432813 - RNA, 23 nt, Homo sapiens
aagcacuguuggagcuacugcaa

SEQ ID NO: 1432814 - RNA, 23 nt, Homo sapiens
aagcagcacauagcacugggaac

SEQ ID NO: 1432815 - RNA, 17 nt, Homo sapiens
aagcagcauucagcaca

SEQ ID NO: 1432816 - RNA, 11 nt, Homo sapiens
aagcagggaaa

SEQ ID NO: 1432817 - RNA, 18 nt, Homo sapiens
aagcagguggcaucucua

SEQ ID NO: 1432818 - RNA, 15 nt, Homo sapiens
aagcagguucuugau

SEQ ID NO: 1432819 - RNA, 15 nt, Homo sapiens
aagcaguccucccac

SEQ ID NO: 1432820 - RNA, 13 nt, Homo sapiens
aagcaguccuccu

SEQ ID NO: 1432821 - RNA, 21 nt, Homo sapiens
aagcagugccucgaggcaccg

SEQ ID NO: 1432822 - RNA, 13 nt, Homo sapiens
aagcaucagagau

SEQ ID NO: 1432823 - RNA, 23 nt, Homo sapiens
aagcaugacuauuuccaccauca

SEQ ID NO: 1432824 - RNA, 11 nt, Homo sapiens
aagcauuguaa

SEQ ID NO: 1432825 - RNA, 19 nt, Homo sapiens
aagcauuguauacauugau

SEQ ID NO: 1432826 - RNA, 19 nt, Homo sapiens
aaaaugaaagcaugucuca

SEQ ID NO: 1432827 - RNA, 19 nt, Homo sapiens
aaaauggaagguuggagac

SEQ ID NO: 1432828 - RNA, 15 nt, Homo sapiens
aaaauguaaugauca

SEQ ID NO: 1432829 - RNA, 16 nt, Homo sapiens
aaaaugugucuguaag

SEQ ID NO: 1432830 - RNA, 23 nt, Homo sapiens
aaaauguuuucuucaucugugac

SEQ ID NO: 1432831 - RNA, 21 nt, Homo sapiens
aaaauuaagagauacauuccc

SEQ ID NO: 1432832 - RNA, 14 nt, Homo sapiens
aaaauuaugccaua

SEQ ID NO: 1432833 - RNA, 23 nt, Homo sapiens
aaaauuauguauuuuugucauau

SEQ ID NO: 1432834 - RNA, 19 nt, Homo sapiens
aaaauucauuucacauuaa

SEQ ID NO: 1432835 - RNA, 15 nt, Homo sapiens
aaaauugcacuuuua

SEQ ID NO: 1432836 - RNA, 20 nt, Homo sapiens
aaaauuuuucuagaagauau

SEQ ID NO: 1432837 - RNA, 13 nt, Homo sapiens
aaacaaaucuuca

SEQ ID NO: 1432838 - RNA, 12 nt, Homo sapiens
aaacaaugccau

SEQ ID NO: 1432839 - RNA, 17 nt, Homo sapiens
aaacaaugccaucacug

SEQ ID NO: 1432840 - RNA, 19 nt, Homo sapiens
aaacaauuggcaaacuuug

SEQ ID NO: 1432841 - RNA, 17 nt, Homo sapiens
aaacacaccgaugcaca

SEQ ID NO: 1432842 - RNA, 21 nt, Homo sapiens
aaacaccggcagaaaacggag

SEQ ID NO: 1432843 - RNA, 17 nt, Homo sapiens
aaacacucaacaauaaa

SEQ ID NO: 1432844 - RNA, 18 nt, Homo sapiens
aaacacucaacaauaaag

SEQ ID NO: 1432845 - RNA, 19 nt, Homo sapiens
aaacaugcuaaauaguucu

SEQ ID NO: 1432846 - RNA, 22 nt, Homo sapiens
aaacauguggcaaccuguucuu

SEQ ID NO: 1432847 - RNA, 19 nt, Homo sapiens
aaacauuaaaugucuuaua

SEQ ID NO: 1432848 - RNA, 19 nt, Homo sapiens
aaacauuaaucaccaaagu

SEQ ID NO: 1432849 - RNA, 18 nt, Homo sapiens
aaacauucaucaagcugu

SEQ ID NO: 1432850 - RNA, 21 nt, Homo sapiens
aaacauucaucaagcuguaca

SEQ ID NO: 1432851 - RNA, 23 nt, Homo sapiens
aaaccaagauagauccauuugga

SEQ ID NO: 1432852 - RNA, 23 nt, Homo sapiens
aaaccauguaguuuuaacagaac

SEQ ID NO: 1432853 - RNA, 18 nt, Homo sapiens
aaacccccgcuccagauc

SEQ ID NO: 1432854 - RNA, 18 nt, Homo sapiens
aaacccuucuuuacuaga

SEQ ID NO: 1432855 - RNA, 17 nt, Homo sapiens
aaaccguaauuuuauua

SEQ ID NO: 1432856 - RNA, 22 nt, Homo sapiens
aaaccucccccaagcagagcuu

SEQ ID NO: 1432857 - RNA, 16 nt, Homo sapiens
aaaccuggagaugaug

SEQ ID NO: 1432858 - RNA, 15 nt, Homo sapiens
aaaccuugauuuaaa

SEQ ID NO: 1432859 - RNA, 22 nt, Homo sapiens
aaaccuugauuuaaaauaucac

SEQ ID NO: 1432860 - RNA, 16 nt, Homo sapiens
aaaccuugcagcauuu

SEQ ID NO: 1432861 - RNA, 19 nt, Homo sapiens
aaaccuuucaaauuucaca

SEQ ID NO: 1432862 - RNA, 18 nt, Homo sapiens
aaaccuuuccccagacac

SEQ ID NO: 1432863 - RNA, 16 nt, Homo sapiens
aaacuaacacccaguc

SEQ ID NO: 1432864 - RNA, 13 nt, Homo sapiens
aaacucaaaauau

SEQ ID NO: 1432865 - RNA, 19 nt, Homo sapiens
aaacucauuacuuuuccau

SEQ ID NO: 1432866 - RNA, 23 nt, Homo sapiens
aaacuccugauuuuguaguuaau

SEQ ID NO: 1432867 - RNA, 22 nt, Homo sapiens
aaacugagaugugaacacauca

SEQ ID NO: 1432868 - RNA, 11 nt, Homo sapiens
aaacugcugaa

SEQ ID NO: 1432869 - RNA, 13 nt, Homo sapiens
aaacuuguguaug

SEQ ID NO: 1432870 - RNA, 21 nt, Homo sapiens
aaacuuuagaguagcaugaga

SEQ ID NO: 1432871 - RNA, 14 nt, Homo sapiens
aaagaaaagccaga

SEQ ID NO: 1432872 - RNA, 14 nt, Homo sapiens
aaagaaaauuagua

SEQ ID NO: 1432873 - RNA, 16 nt, Homo sapiens
aaagaaagaaacugau

SEQ ID NO: 1432874 - RNA, 16 nt, Homo sapiens
aaagaagacuggaagc

SEQ ID NO: 1432875 - RNA, 20 nt, Homo sapiens
aaagaaguguuccuucauua

SEQ ID NO: 1432876 - RNA, 20 nt, Homo sapiens
aaagaaguuaacuacagugu

SEQ ID NO: 1432877 - RNA, 13 nt, Homo sapiens
aaagaaucucaag

SEQ ID NO: 1432878 - RNA, 15 nt, Homo sapiens
aaagacaauggaaac

SEQ ID NO: 1432879 - RNA, 12 nt, Homo sapiens
aaagacuauuaa

SEQ ID NO: 1432880 - RNA, 14 nt, Homo sapiens
aaagacuggccuga

SEQ ID NO: 1432881 - RNA, 22 nt, Homo sapiens
aaagagagcccugguccuagac

SEQ ID NO: 1432882 - RNA, 23 nt, Homo sapiens
aaagaggagagaggaagcucucu

SEQ ID NO: 1432883 - RNA, 16 nt, Homo sapiens
aaagauaucagagcuc

SEQ ID NO: 1432884 - RNA, 19 nt, Homo sapiens
aaagaugaaaaaugguccc

SEQ ID NO: 1432885 - RNA, 16 nt, Homo sapiens
aaagcaaaagcucugu

SEQ ID NO: 1432886 - RNA, 15 nt, Homo sapiens
aaagcaaaauccaac

SEQ ID NO: 1432887 - RNA, 22 nt, Homo sapiens
aaagcaauuauauuguccuccc

SEQ ID NO: 1432888 - RNA, 15 nt, Homo sapiens
aaagcacugacuucu

SEQ ID NO: 1432889 - RNA, 12 nt, Homo sapiens
aaagcacuguuu

SEQ ID NO: 1432890 - RNA, 20 nt, Homo sapiens
aaagcacuguuuaacuggga

SEQ ID NO: 1432891 - RNA, 23 nt, Homo sapiens
aaagcagcacauagcacugggaa

SEQ ID NO: 1432892 - RNA, 20 nt, Homo sapiens
aaagcauggacuaaccccaa

SEQ ID NO: 1432893 - RNA, 19 nt, Homo sapiens
aaagcauuuucauuucacu

SEQ ID NO: 1432894 - RNA, 13 nt, Homo sapiens
aaagccaaaaggu

SEQ ID NO: 1432895 - RNA, 14 nt, Homo sapiens
aaagccucuggaaa

SEQ ID NO: 1432896 - RNA, 22 nt, Homo sapiens
aaagcuacaacaaauacuacag

SEQ ID NO: 1432897 - RNA, 22 nt, Homo sapiens
aaagcuguuuuuauuagcagua

SEQ ID NO: 1432898 - RNA, 14 nt, Homo sapiens
aaaggaacacugga

SEQ ID NO: 1432899 - RNA, 20 nt, Homo sapiens
aaaggaaccaaccaacaaac

SEQ ID NO: 1432900 - RNA, 16 nt, Homo sapiens
aaaggaagacuugaag

SEQ ID NO: 1432901 - RNA, 19 nt, Homo sapiens
aaaggaagcuccacuguca

SEQ ID NO: 1432902 - RNA, 20 nt, Homo sapiens
aaaggaagcuccacugucac

SEQ ID NO: 1432903 - RNA, 19 nt, Homo sapiens
aaaggaccugcauuuuccu

SEQ ID NO: 1432904 - RNA, 21 nt, Homo sapiens
aaaggagaaguagcugugaac

SEQ ID NO: 1432905 - RNA, 14 nt, Homo sapiens
aaaggagcucugaa

SEQ ID NO: 1432906 - RNA, 13 nt, Homo sapiens
aaaggagugaaug

SEQ ID NO: 1432907 - RNA, 15 nt, Homo sapiens
aacaccuucuuggcu

SEQ ID NO: 1432908 - RNA, 14 nt, Homo sapiens
caccaccaugccag

SEQ ID NO: 1432909 - RNA, 23 nt, Homo sapiens
caccagaggcugcagaaggccaa

SEQ ID NO: 1432910 - RNA, 22 nt, Homo sapiens
caccaggaugaaggcgugcaag

SEQ ID NO: 1432911 - RNA, 18 nt, Homo sapiens
caccauccugcagccucc

SEQ ID NO: 1432912 - RNA, 20 nt, Homo sapiens
caccauucacauuugaugua

SEQ ID NO: 1432913 - RNA, 22 nt, Homo sapiens
caccauuguuccuuaccuuuac

SEQ ID NO: 1432914 - RNA, 14 nt, Homo sapiens
cacccaaaagucaa

SEQ ID NO: 1432915 - RNA, 23 nt, Homo sapiens
cacccaaaagucaaaaggugccu

SEQ ID NO: 1432916 - RNA, 11 nt, Homo sapiens
cacccacguga

SEQ ID NO: 1432917 - RNA, 16 nt, Homo sapiens
cacccagugcugccau

SEQ ID NO: 1432918 - RNA, 16 nt, Homo sapiens
cacccaucuuccugcu

SEQ ID NO: 1432919 - RNA, 17 nt, Homo sapiens
cacccaugaaucaaaga

SEQ ID NO: 1432920 - RNA, 14 nt, Homo sapiens
cacccaugugccaa

SEQ ID NO: 1432921 - RNA, 13 nt, Homo sapiens
caccccaacaucu

SEQ ID NO: 1432922 - RNA, 17 nt, Homo sapiens
caccccaucggcuucca

SEQ ID NO: 1432923 - RNA, 12 nt, Homo sapiens
caccccgugcca

SEQ ID NO: 1432924 - RNA, 20 nt, Homo sapiens
cacccgagcuagagugcagu

SEQ ID NO: 1432925 - RNA, 22 nt, Homo sapiens
cacccuaucccuguacagagua

SEQ ID NO: 1432926 - RNA, 17 nt, Homo sapiens
cacccuucugcuguaua

SEQ ID NO: 1432927 - RNA, 15 nt, Homo sapiens
caccgacaacaugcu

SEQ ID NO: 1432928 - RNA, 13 nt, Homo sapiens
caccgaugcacac

SEQ ID NO: 1432929 - RNA, 14 nt, Homo sapiens
caccgcgugccaug

SEQ ID NO: 1432930 - RNA, 20 nt, Homo sapiens
caccuaccugccggacacag

SEQ ID NO: 1432931 - RNA, 21 nt, Homo sapiens
caccuagugcuuccacuucua

SEQ ID NO: 1432932 - RNA, 19 nt, Homo sapiens
caccucagacaauccacuc

SEQ ID NO: 1432933 - RNA, 22 nt, Homo sapiens
caccuccauuucucuccaggaa

SEQ ID NO: 1432934 - RNA, 15 nt, Homo sapiens
caccuccuacgucaa

SEQ ID NO: 1432935 - RNA, 14 nt, Homo sapiens
caccucuccagagg

SEQ ID NO: 1432936 - RNA, 18 nt, Homo sapiens
caccucugccucaaugug

SEQ ID NO: 1432937 - RNA, 13 nt, Homo sapiens
caccucuggaucc

SEQ ID NO: 1432938 - RNA, 21 nt, Homo sapiens
caccugaauuucuguuugaau

SEQ ID NO: 1432939 - RNA, 18 nt, Homo sapiens
caccugcacgugaucugc

SEQ ID NO: 1432940 - RNA, 23 nt, Homo sapiens
caccugcucuucuaccauuugaa

SEQ ID NO: 1432941 - RNA, 19 nt, Homo sapiens
caccugggcgccaacugcu

SEQ ID NO: 1432942 - RNA, 16 nt, Homo sapiens
caccuuaguggcuuuu

SEQ ID NO: 1432943 - RNA, 17 nt, Homo sapiens
caccuucaccuucaucc

SEQ ID NO: 1432944 - RNA, 14 nt, Homo sapiens
caccuucucggcaa

SEQ ID NO: 1432945 - RNA, 17 nt, Homo sapiens
caccuugccaagcuuuc

SEQ ID NO: 1432946 - RNA, 18 nt, Homo sapiens
caccuuguuacacauuau

SEQ ID NO: 1432947 - RNA, 21 nt, Homo sapiens
caccuuuggugcagagguuuc

SEQ ID NO: 1432948 - RNA, 14 nt, Homo sapiens
cacggcggcagggu

SEQ ID NO: 1432949 - RNA, 17 nt, Homo sapiens
cacggcguuuuuuuaca

SEQ ID NO: 1432950 - RNA, 20 nt, Homo sapiens
cacgggguauuuuaggcagg

SEQ ID NO: 1432951 - RNA, 13 nt, Homo sapiens
cacgucugccagg

SEQ ID NO: 1432952 - RNA, 19 nt, Homo sapiens
cacuaaacagacuauuuaa

SEQ ID NO: 1432953 - RNA, 22 nt, Homo sapiens
cacuagcauuuucuugaaccaa

SEQ ID NO: 1432954 - RNA, 12 nt, Homo sapiens
cacuagccugug

SEQ ID NO: 1432955 - RNA, 15 nt, Homo sapiens
cacuagccugugauu

SEQ ID NO: 1432956 - RNA, 20 nt, Homo sapiens
cacuaggucaaaacauucag

SEQ ID NO: 1432957 - RNA, 21 nt, Homo sapiens
cacucaaaaaggugugucaaa

SEQ ID NO: 1432958 - RNA, 17 nt, Homo sapiens
cacucaauaugugauuu

SEQ ID NO: 1432959 - RNA, 21 nt, Homo sapiens
gauauuguggguaacgugaga

SEQ ID NO: 1432960 - RNA, 22 nt, Homo sapiens
gauauuucccaauacauaccac

SEQ ID NO: 1432961 - RNA, 23 nt, Homo sapiens
gauauuugaaucuuucuuacuau

SEQ ID NO: 1432962 - RNA, 15 nt, Homo sapiens
gauauuuuaugcaaa

SEQ ID NO: 1432963 - RNA, 19 nt, Homo sapiens
gaucaaaccccauggagca

SEQ ID NO: 1432964 - RNA, 21 nt, Homo sapiens
gaucaagucaccggagcuuuc

SEQ ID NO: 1432965 - RNA, 23 nt, Homo sapiens
gaucacagggccccagaaggcag

SEQ ID NO: 1432966 - RNA, 17 nt, Homo sapiens
gaucacuaaaguauauc

SEQ ID NO: 1432967 - RNA, 18 nt, Homo sapiens
gaucacuugaguucagga

SEQ ID NO: 1432968 - RNA, 19 nt, Homo sapiens
gaucauagguauuucaaaa

SEQ ID NO: 1432969 - RNA, 21 nt, Homo sapiens
gauccaauggaauacugaaaa

SEQ ID NO: 1432970 - RNA, 18 nt, Homo sapiens
gaucccacuucacuguga

SEQ ID NO: 1432971 - RNA, 14 nt, Homo sapiens
gauccuacucuucc

SEQ ID NO: 1432972 - RNA, 23 nt, Homo sapiens
gauccugcuguggccucacuucc

SEQ ID NO: 1432973 - RNA, 20 nt, Homo sapiens
gaucguauuaauuaucugau

SEQ ID NO: 1432974 - RNA, 22 nt, Homo sapiens
gaucuagcuucaugccucaguu

SEQ ID NO: 1432975 - RNA, 18 nt, Homo sapiens
gaucuccaaggaccaggu

SEQ ID NO: 1432976 - RNA, 14 nt, Homo sapiens
gaucuucuuuauaa

SEQ ID NO: 1432977 - RNA, 20 nt, Homo sapiens
gaucuugcauucccaguggu

SEQ ID NO: 1432978 - RNA, 14 nt, Homo sapiens
gaugaaacuccuga

SEQ ID NO: 1432979 - RNA, 21 nt, Homo sapiens
gaugaagacccuauuucagaa

SEQ ID NO: 1432980 - RNA, 16 nt, Homo sapiens
gaugagaaaggccuga

SEQ ID NO: 1432981 - RNA, 16 nt, Homo sapiens
gaugagccgcugugag

SEQ ID NO: 1432982 - RNA, 18 nt, Homo sapiens
gaugaguuuaucauguca

SEQ ID NO: 1432983 - RNA, 14 nt, Homo sapiens
gaugcaagcaccug

SEQ ID NO: 1432984 - RNA, 12 nt, Homo sapiens
gaugcacacaca

SEQ ID NO: 1432985 - RNA, 21 nt, Homo sapiens
gaugcacacacagauauacac

SEQ ID NO: 1432986 - RNA, 14 nt, Homo sapiens
gauggacucugaaa

SEQ ID NO: 1432987 - RNA, 22 nt, Homo sapiens
gauggacucugaaaaacauucc

SEQ ID NO: 1432988 - RNA, 18 nt, Homo sapiens
gauggagaggggguacaa

SEQ ID NO: 1432989 - RNA, 22 nt, Homo sapiens
gaugggaucccaggccagggaa

SEQ ID NO: 1432990 - RNA, 22 nt, Homo sapiens
gaugggguuucaccaucuuggc

SEQ ID NO: 1432991 - RNA, 22 nt, Homo sapiens
gauggguauuaaacuugucaga

SEQ ID NO: 1432992 - RNA, 15 nt, Homo sapiens
gauggugacuuccuc

SEQ ID NO: 1432993 - RNA, 16 nt, Homo sapiens
gauguaaaugccacaa

SEQ ID NO: 1432994 - RNA, 12 nt, Homo sapiens
gauguacacaca

SEQ ID NO: 1432995 - RNA, 11 nt, Homo sapiens
aaaaacaggaa

SEQ ID NO: 1432996 - RNA, 12 nt, Homo sapiens
aaaaaccaauga

SEQ ID NO: 1432997 - RNA, 12 nt, Homo sapiens
aaaaacuuccau

SEQ ID NO: 1432998 - RNA, 24 nt, Homo sapiens
aaaaacuuccaucccuacuuuuca

SEQ ID NO: 1432999 - RNA, 16 nt, Homo sapiens
aaaaaggcauaugcaa

SEQ ID NO: 1433000 - RNA, 22 nt, Homo sapiens
aaaaauauaaccauuacauguu

SEQ ID NO: 1433001 - RNA, 17 nt, Homo sapiens
aaaaaucagcuggguac

SEQ ID NO: 1433002 - RNA, 12 nt, Homo sapiens
aaaacacugugu

SEQ ID NO: 1433003 - RNA, 18 nt, Homo sapiens
aaaacagagaugugauaa

SEQ ID NO: 1433004 - RNA, 18 nt, Homo sapiens
aaaacagccucacagaag

SEQ ID NO: 1433005 - RNA, 12 nt, Homo sapiens
aaaacauaugca

SEQ ID NO: 1433006 - RNA, 11 nt, Homo sapiens
aaaacaucacu

SEQ ID NO: 1433007 - RNA, 11 nt, Homo sapiens
aaaaccaauga

SEQ ID NO: 1433008 - RNA, 18 nt, Homo sapiens
aaaaccacagcaguugaa

SEQ ID NO: 1433009 - RNA, 21 nt, Homo sapiens
aaaaccgcaaggguagacugg

SEQ ID NO: 1433010 - RNA, 12 nt, Homo sapiens
aaaaccuagcau

SEQ ID NO: 1433011 - RNA, 19 nt, Homo sapiens
aaaaccucauuuaccauaa

SEQ ID NO: 1433012 - RNA, 21 nt, Homo sapiens
aaaacggugcauccacgcaca

SEQ ID NO: 1433013 - RNA, 19 nt, Homo sapiens
aaaacugaaaaucuaauau

SEQ ID NO: 1433014 - RNA, 14 nt, Homo sapiens
aaaacuugcugccu

SEQ ID NO: 1433015 - RNA, 17 nt, Homo sapiens
aaaacuugcugccugaa

SEQ ID NO: 1433016 - RNA, 21 nt, Homo sapiens
aaaagacagcacuacagauau

SEQ ID NO: 1433017 - RNA, 15 nt, Homo sapiens
aaaagacauguugua

SEQ ID NO: 1433018 - RNA, 15 nt, Homo sapiens
aaaagacuccaaaga

SEQ ID NO: 1433019 - RNA, 22 nt, Homo sapiens
aaaagauuguuuuauauguagu

SEQ ID NO: 1433020 - RNA, 13 nt, Homo sapiens
aaaagcaccugcc

SEQ ID NO: 1433021 - RNA, 23 nt, Homo sapiens
aaaagcaugacuauuuccaccau

SEQ ID NO: 1433022 - RNA, 20 nt, Homo sapiens
aaaagcuuauucaucuguuu

SEQ ID NO: 1433023 - RNA, 18 nt, Homo sapiens
aaaagggaaguugugccu

SEQ ID NO: 1433024 - RNA, 14 nt, Homo sapiens
aaaagucagucuua

SEQ ID NO: 1433025 - RNA, 15 nt, Homo sapiens
aaaaguuaugguacu

SEQ ID NO: 1433026 - RNA, 16 nt, Homo sapiens
aaaauaaguauuucca

SEQ ID NO: 1433027 - RNA, 17 nt, Homo sapiens
aaaauaauagauaauua

SEQ ID NO: 1433028 - RNA, 13 nt, Homo sapiens
aaaauacaauuca

SEQ ID NO: 1433029 - RNA, 14 nt, Homo sapiens
aaaauaccaugcca

SEQ ID NO: 1433030 - RNA, 13 nt, Homo sapiens
aaaauacuaugaa

SEQ ID NO: 1433031 - RNA, 19 nt, Homo sapiens
aaaauagaauguuacuuug

SEQ ID NO: 1433032 - RNA, 23 nt, Homo sapiens
aaaauauauaugugcaguauuuu

SEQ ID NO: 1433033 - RNA, 13 nt, Homo sapiens
aaaauauugcuuc

SEQ ID NO: 1433034 - RNA, 24 nt, Homo sapiens
aaaaucacaacacagagcugcuau

SEQ ID NO: 1433035 - RNA, 20 nt, Homo sapiens
aaaaucacaagcaauaauua

SEQ ID NO: 1433036 - RNA, 15 nt, Homo sapiens
aaaaucauuucugca

SEQ ID NO: 1433037 - RNA, 14 nt, Homo sapiens
aaaaugaagcccua

SEQ ID NO: 1433038 - RNA, 14 nt, Homo sapiens
aaaauguacacugg

SEQ ID NO: 1433039 - RNA, 22 nt, Homo sapiens
aaaauguccucccuuguggcuu

SEQ ID NO: 1433040 - RNA, 16 nt, Homo sapiens
aaaaugucuguuucaa

SEQ ID NO: 1433041 - RNA, 18 nt, Homo sapiens
aaaauguuauuaugucaa

SEQ ID NO: 1433042 - RNA, 22 nt, Homo sapiens
aaaauguucguauucuauucaa

SEQ ID NO: 1433043 - RNA, 16 nt, Homo sapiens
aaaauguuuucuucau

SEQ ID NO: 1433044 - RNA, 18 nt, Homo sapiens
aaaauuaaggucugggag

SEQ ID NO: 1433045 - RNA, 12 nt, Homo sapiens
aaaauugcacaa

SEQ ID NO: 1433046 - RNA, 15 nt, Homo sapiens
aaacaaucacacuca

SEQ ID NO: 1433047 - RNA, 11 nt, Homo sapiens
aaacaaugcca

SEQ ID NO: 1433048 - RNA, 20 nt, Homo sapiens
aaacaauuggcaaacuuugu

SEQ ID NO: 1433049 - RNA, 20 nt, Homo sapiens
aaacaauuguaaauuucuuu

SEQ ID NO: 1433050 - RNA, 16 nt, Homo sapiens
aaacacagccugugua

SEQ ID NO: 1433051 - RNA, 14 nt, Homo sapiens
aaacacgugucuau

SEQ ID NO: 1433052 - RNA, 22 nt, Homo sapiens
aaacacuguuucuaacucaggg

SEQ ID NO: 1433053 - RNA, 13 nt, Homo sapiens
aaacacuucucau

SEQ ID NO: 1433054 - RNA, 15 nt, Homo sapiens
aaacagacuauuuaa

SEQ ID NO: 1433055 - RNA, 22 nt, Homo sapiens
aaacagacuauuuaacuugagg

SEQ ID NO: 1433056 - RNA, 22 nt, Homo sapiens
aaacagagacaggcccaagaga

SEQ ID NO: 1433057 - RNA, 21 nt, Homo sapiens
aaacagaggaaucuaccugug

SEQ ID NO: 1433058 - RNA, 19 nt, Homo sapiens
aaacagguggagaaauucc

SEQ ID NO: 1433059 - RNA, 16 nt, Homo sapiens
aaacauaucaauucaa

SEQ ID NO: 1433060 - RNA, 19 nt, Homo sapiens
aaacaugaccuuccacaau

SEQ ID NO: 1433061 - RNA, 15 nt, Homo sapiens
aaacaugcacgguga

SEQ ID NO: 1433062 - RNA, 15 nt, Homo sapiens
aaacauuccaggaaa

SEQ ID NO: 1433063 - RNA, 19 nt, Homo sapiens
aaacauugguauauuucca

SEQ ID NO: 1433064 - RNA, 11 nt, Homo sapiens
aaaccaaagau

SEQ ID NO: 1433065 - RNA, 19 nt, Homo sapiens
aaaccaagccguggcuucc

SEQ ID NO: 1433066 - RNA, 14 nt, Homo sapiens
aaaccaaugauuca

SEQ ID NO: 1433067 - RNA, 21 nt, Homo sapiens
aaaccacaacugacacaggaa

SEQ ID NO: 1433068 - RNA, 15 nt, Homo sapiens
aaacccccgcuccag

SEQ ID NO: 1433069 - RNA, 16 nt, Homo sapiens
aaaccgcacucaccca

SEQ ID NO: 1433070 - RNA, 18 nt, Homo sapiens
aaaccuggagaugaugau

SEQ ID NO: 1433071 - RNA, 13 nt, Homo sapiens
aaaccuguuggcu

SEQ ID NO: 1433072 - RNA, 13 nt, Homo sapiens
aaacgacaaauca

SEQ ID NO: 1433073 - RNA, 21 nt, Homo sapiens
aaacgcaaaaccugcaguucc

SEQ ID NO: 1433074 - RNA, 23 nt, Homo sapiens
aaacgccuuuuauucuauuuaca

SEQ ID NO: 1433075 - RNA, 12 nt, Homo sapiens
aaacgugcuccc

SEQ ID NO: 1433076 - RNA, 17 nt, Homo sapiens
aaacuaaaucucuaaua

SEQ ID NO: 1433077 - RNA, 17 nt, Homo sapiens
aaacuacccuccagagu

SEQ ID NO: 1433078 - RNA, 17 nt, Homo sapiens
aaacuaugguucccaau

SEQ ID NO: 1433079 - RNA, 17 nt, Homo sapiens
aaacuccugacuuugug

SEQ ID NO: 1433080 - RNA, 17 nt, Homo sapiens
aaacugaaaaucuaaua

SEQ ID NO: 1433081 - RNA, 13 nt, Homo sapiens
aaacugcacugcc

SEQ ID NO: 1433082 - RNA, 19 nt, Homo sapiens
aaacuggacuugucuuccu

SEQ ID NO: 1433083 - RNA, 18 nt, Homo sapiens
aaacuuaugcuaguuuau

SEQ ID NO: 1433084 - RNA, 19 nt, Homo sapiens
aaacuuguaaaugcuguca

SEQ ID NO: 1433085 - RNA, 17 nt, Homo sapiens
aaacuuguacuauguua

SEQ ID NO: 1433086 - RNA, 23 nt, Homo sapiens
aaacuuugugccuuugaccaucu

SEQ ID NO: 1433087 - RNA, 18 nt, Homo sapiens
aaacuuuuuuuguuugcu

SEQ ID NO: 1433088 - RNA, 16 nt, Homo sapiens
aaagaaaaaaaaagca

SEQ ID NO: 1433089 - RNA, 19 nt, Homo sapiens
aaagaaaauuaguaauugu

SEQ ID NO: 1433090 - RNA, 22 nt, Homo sapiens
aaagaaacguacuuaacugugu

SEQ ID NO: 1433091 - RNA, 18 nt, Homo sapiens
aaagaaaucuucauuuau

SEQ ID NO: 1433092 - RNA, 16 nt, Homo sapiens
aaagaaaugcccaucu

SEQ ID NO: 1433093 - RNA, 19 nt, Homo sapiens
aaagaacugccccaucucc

SEQ ID NO: 1433094 - RNA, 14 nt, Homo sapiens
aaagaagacuggaa

SEQ ID NO: 1433095 - RNA, 21 nt, Homo sapiens
aaagaaggcacagguguaaau

SEQ ID NO: 1433096 - RNA, 16 nt, Homo sapiens
aaagaaguuucuggag

SEQ ID NO: 1433097 - RNA, 20 nt, Homo sapiens
aaagaaugagcauugagacg

SEQ ID NO: 1433098 - RNA, 20 nt, Homo sapiens
aaagaauuccugaagccaga

SEQ ID NO: 1433099 - RNA, 14 nt, Homo sapiens
aaagacaacauaac

SEQ ID NO: 1433100 - RNA, 20 nt, Homo sapiens
aaagagaauaaagacuucau

SEQ ID NO: 1433101 - RNA, 22 nt, Homo sapiens
aaagagguggauuccugggcaa

SEQ ID NO: 1433102 - RNA, 22 nt, Homo sapiens
aaagaguccuauuugcacugua

SEQ ID NO: 1433103 - RNA, 21 nt, Homo sapiens
aaagagucuugguuccucuac

SEQ ID NO: 1433104 - RNA, 20 nt, Homo sapiens
aaagauauaugaauaugaca

SEQ ID NO: 1433105 - RNA, 19 nt, Homo sapiens
aaagaugcuugaugcccag

SEQ ID NO: 1433106 - RNA, 15 nt, Homo sapiens
aaagauggaugugcu

SEQ ID NO: 1433107 - RNA, 21 nt, Homo sapiens
aaagauggcugugccucugcc

SEQ ID NO: 1433108 - RNA, 18 nt, Homo sapiens
aaagauguguuguugguu

SEQ ID NO: 1433109 - RNA, 16 nt, Homo sapiens
aaagauguuugucaga

SEQ ID NO: 1433110 - RNA, 22 nt, Homo sapiens
aaagauuguuuuauauguagua

SEQ ID NO: 1433111 - RNA, 14 nt, Homo sapiens
aaagauuuuaccug

SEQ ID NO: 1433112 - RNA, 20 nt, Homo sapiens
aaagcaagacuguugcucaa

SEQ ID NO: 1433113 - RNA, 17 nt, Homo sapiens
aaagcagaugagcugug

SEQ ID NO: 1433114 - RNA, 20 nt, Homo sapiens
aaagcagaugagcuguggac

SEQ ID NO: 1433115 - RNA, 13 nt, Homo sapiens
aaagcaguauuug

SEQ ID NO: 1433116 - RNA, 14 nt, Homo sapiens
aaagcaguggggac

SEQ ID NO: 1433117 - RNA, 13 nt, Homo sapiens
aaagcaugucuca

SEQ ID NO: 1433118 - RNA, 22 nt, Homo sapiens
aaagcauuacauuuccaaauga

SEQ ID NO: 1433119 - RNA, 18 nt, Homo sapiens
aaagccagaguuccaugu

SEQ ID NO: 1433120 - RNA, 18 nt, Homo sapiens
aaagcccaaccuccugac

SEQ ID NO: 1433121 - RNA, 14 nt, Homo sapiens
aaagcccauccuug

SEQ ID NO: 1433122 - RNA, 14 nt, Homo sapiens
aaagcccuugaacc

SEQ ID NO: 1433123 - RNA, 15 nt, Homo sapiens
aaagcccuugaacca

SEQ ID NO: 1433124 - RNA, 17 nt, Homo sapiens
aaagcccuugaaccagc

SEQ ID NO: 1433125 - RNA, 22 nt, Homo sapiens
aaagccucuggaaaacucagga

SEQ ID NO: 1433126 - RNA, 20 nt, Homo sapiens
aaagcgagaucccaucucua

SEQ ID NO: 1433127 - RNA, 17 nt, Homo sapiens
aaagcugcuugacuauc

SEQ ID NO: 1433128 - RNA, 15 nt, Homo sapiens
aaagcuuaggcugcu

SEQ ID NO: 1433129 - RNA, 15 nt, Homo sapiens
aaaggaaaagucaac

SEQ ID NO: 1433130 - RNA, 21 nt, Homo sapiens
aaaggaagcuccacugucacc

SEQ ID NO: 1433131 - RNA, 13 nt, Homo sapiens
aaaggcauaugca

SEQ ID NO: 1433132 - RNA, 19 nt, Homo sapiens
aaagguagcuuaccugaca

SEQ ID NO: 1433133 - RNA, 23 nt, Homo sapiens
aaagguauuaaauugauguugcu

SEQ ID NO: 1433134 - RNA, 13 nt, Homo sapiens
aaaggugacuggg

SEQ ID NO: 1433135 - RNA, 16 nt, Homo sapiens
aaagguuacccuguaa

SEQ ID NO: 1433136 - RNA, 12 nt, Homo sapiens
aaagucagucuu

SEQ ID NO: 1433137 - RNA, 21 nt, Homo sapiens
aaagucuggcuaugcucacag

SEQ ID NO: 1433138 - RNA, 11 nt, Homo sapiens
aaagugcugua

SEQ ID NO: 1433139 - RNA, 14 nt, Homo sapiens
aaaguggccaugcc

SEQ ID NO: 1433140 - RNA, 17 nt, Homo sapiens
aaaguguaauaauauga

SEQ ID NO: 1433141 - RNA, 19 nt, Homo sapiens
aaaguugcagucucagaaa

SEQ ID NO: 1433142 - RNA, 22 nt, Homo sapiens
aaaguuguaguucuugugcaug

SEQ ID NO: 1433143 - RNA, 18 nt, Homo sapiens
aaauaaaggugacuggga

SEQ ID NO: 1433144 - RNA, 13 nt, Homo sapiens
aaauaaaguacca

SEQ ID NO: 1433145 - RNA, 22 nt, Homo sapiens
aggagacgggggagcagcacga

SEQ ID NO: 1433146 - RNA, 19 nt, Homo sapiens
aggagauuuuccuuccuac

SEQ ID NO: 1433147 - RNA, 21 nt, Homo sapiens
aggaggacgguuaacuuguau

SEQ ID NO: 1433148 - RNA, 19 nt, Homo sapiens
aggagggguuaaagcugcc

SEQ ID NO: 1433149 - RNA, 22 nt, Homo sapiens
aggagguuuggggucugccacc

SEQ ID NO: 1433150 - RNA, 17 nt, Homo sapiens
aggaguggcagcugucc

SEQ ID NO: 1433151 - RNA, 17 nt, Homo sapiens
aggauagaauacaugga

SEQ ID NO: 1433152 - RNA, 15 nt, Homo sapiens
aggauggcaagcacg

SEQ ID NO: 1433153 - RNA, 15 nt, Homo sapiens
aggaugugagccuga

SEQ ID NO: 1433154 - RNA, 19 nt, Homo sapiens
aggauuuauauucaaggau

SEQ ID NO: 1433155 - RNA, 17 nt, Homo sapiens
aggcaagccccucagcc

SEQ ID NO: 1433156 - RNA, 19 nt, Homo sapiens
aggcaagccccucagcccu

SEQ ID NO: 1433157 - RNA, 15 nt, Homo sapiens
aggcaccugcuggaa

SEQ ID NO: 1433158 - RNA, 22 nt, Homo sapiens
aggcaccuggccugcugggaac

SEQ ID NO: 1433159 - RNA, 16 nt, Homo sapiens
aggcacugguggcauc

SEQ ID NO: 1433160 - RNA, 15 nt, Homo sapiens
aggcaggaguggcag

SEQ ID NO: 1433161 - RNA, 17 nt, Homo sapiens
aggcagggcaaaugaca

SEQ ID NO: 1433162 - RNA, 18 nt, Homo sapiens
aggcaguucaaagcagga

SEQ ID NO: 1433163 - RNA, 11 nt, Homo sapiens
aggcauaugca

SEQ ID NO: 1433164 - RNA, 16 nt, Homo sapiens
aggcauccugugugcu

SEQ ID NO: 1433165 - RNA, 19 nt, Homo sapiens
aggcauccugugugcugac

SEQ ID NO: 1433166 - RNA, 14 nt, Homo sapiens
aggccacaugucac

SEQ ID NO: 1433167 - RNA, 17 nt, Homo sapiens
aggccagagugcugcca

SEQ ID NO: 1433168 - RNA, 12 nt, Homo sapiens
aggccagcagca

SEQ ID NO: 1433169 - RNA, 18 nt, Homo sapiens
aggcccacuggcauuaaa

SEQ ID NO: 1433170 - RNA, 21 nt, Homo sapiens
aggcccgacagagagaugaag

SEQ ID NO: 1433171 - RNA, 18 nt, Homo sapiens
aggcccuaagaugccuug

SEQ ID NO: 1433172 - RNA, 10 nt, Homo sapiens
aggcccuccc

SEQ ID NO: 1433173 - RNA, 20 nt, Homo sapiens
aggcccugccuucagcccug

SEQ ID NO: 1433174 - RNA, 22 nt, Homo sapiens
aggcccuuccucuccacugccu

SEQ ID NO: 1433175 - RNA, 20 nt, Homo sapiens
aggccgggcgcaguggcuca

SEQ ID NO: 1433176 - RNA, 15 nt, Homo sapiens
aggccucacacccag

SEQ ID NO: 1433177 - RNA, 12 nt, Homo sapiens
aggccugccugu

SEQ ID NO: 1433178 - RNA, 15 nt, Homo sapiens
aggccuguguagcug

SEQ ID NO: 1433179 - RNA, 21 nt, Homo sapiens
aggcgccccuucccccuccaa

SEQ ID NO: 1433180 - RNA, 18 nt, Homo sapiens
aggcgggcggcacgccaa

SEQ ID NO: 1433181 - RNA, 17 nt, Homo sapiens
aggcuacuggcauuaau

SEQ ID NO: 1433182 - RNA, 19 nt, Homo sapiens
aggcucagccacacaggaa

SEQ ID NO: 1433183 - RNA, 11 nt, Homo sapiens
aggcucugaaa

SEQ ID NO: 1433184 - RNA, 12 nt, Homo sapiens
aggcucuucucc

SEQ ID NO: 1433185 - RNA, 19 nt, Homo sapiens
aggcugggauggagcacuu

SEQ ID NO: 1433186 - RNA, 13 nt, Homo sapiens
aggcuuaucaaaa

SEQ ID NO: 1433187 - RNA, 15 nt, Homo sapiens
aggcuucacccugaa

SEQ ID NO: 1433188 - RNA, 18 nt, Homo sapiens
agggaacaagcauucucc

SEQ ID NO: 1433189 - RNA, 22 nt, Homo sapiens
agggaaggaacucuggcuucca

SEQ ID NO: 1433190 - RNA, 17 nt, Homo sapiens
agggaaggguuugccaa

SEQ ID NO: 1433191 - RNA, 19 nt, Homo sapiens
agggacaaaacacuguguc

SEQ ID NO: 1433192 - RNA, 13 nt, Homo sapiens
agggagacagaga

SEQ ID NO: 1433193 - RNA, 16 nt, Homo sapiens
agggaggccgaagcua

SEQ ID NO: 1433194 - RNA, 15 nt, Homo sapiens
agggagggcucugag

SEQ ID NO: 1433195 - RNA, 14 nt, Homo sapiens
agggaguugcucac

SEQ ID NO: 1433196 - RNA, 23 nt, Homo sapiens
agggaugccaacaccuucuuggc

SEQ ID NO: 1433197 - RNA, 23 nt, Homo sapiens
agggcaacaauacaugcugcuaa

SEQ ID NO: 1433198 - RNA, 23 nt, Homo sapiens
agggcagccaggggcugcucauc

SEQ ID NO: 1433199 - RNA, 19 nt, Homo sapiens
agggcaguaucucucugcc

SEQ ID NO: 1433200 - RNA, 20 nt, Homo sapiens
agggcaguaucucucugccu

SEQ ID NO: 1433201 - RNA, 19 nt, Homo sapiens
agggcagugacaaguggag

SEQ ID NO: 1433202 - RNA, 18 nt, Homo sapiens
agggccaagcaccuagcc

SEQ ID NO: 1433203 - RNA, 10 nt, Homo sapiens
agggccaguc

SEQ ID NO: 1433204 - RNA, 17 nt, Homo sapiens
agggcccagcuguagcc

SEQ ID NO: 1433205 - RNA, 17 nt, Homo sapiens
agggcuagaaccuggag

SEQ ID NO: 1433206 - RNA, 23 nt, Homo sapiens
agggcuagaaccuguagagcuag

SEQ ID NO: 1433207 - RNA, 19 nt, Homo sapiens
agggcuggagggacaggga

SEQ ID NO: 1433208 - RNA, 20 nt, Homo sapiens
aggggcaaagaaaagccaga

SEQ ID NO: 1433209 - RNA, 22 nt, Homo sapiens
agggguacauuucccugugcug

SEQ ID NO: 1433210 - RNA, 15 nt, Homo sapiens
aggggugcugcuccu

SEQ ID NO: 1433211 - RNA, 22 nt, Homo sapiens
aggggugggagagccagcucuc

SEQ ID NO: 1433212 - RNA, 22 nt, Homo sapiens
agggguugcgggggagcuggaa

SEQ ID NO: 1433213 - RNA, 11 nt, Homo sapiens
agggugacugu

SEQ ID NO: 1433214 - RNA, 13 nt, Homo sapiens
aggguuacuaugc

SEQ ID NO: 1433215 - RNA, 17 nt, Homo sapiens
agguaaacaaacaaaua

SEQ ID NO: 1433216 - RNA, 14 nt, Homo sapiens
aggucagcgugcuu

SEQ ID NO: 1433217 - RNA, 15 nt, Homo sapiens
aggucagcgugcuua

SEQ ID NO: 1433218 - RNA, 19 nt, Homo sapiens
aggucauuacuaaccauag

SEQ ID NO: 1433219 - RNA, 13 nt, Homo sapiens
agguccaccugcg

SEQ ID NO: 1433220 - RNA, 16 nt, Homo sapiens
aggucccugcuuaccu

SEQ ID NO: 1433221 - RNA, 13 nt, Homo sapiens
agguccuccucuc

SEQ ID NO: 1433222 - RNA, 23 nt, Homo sapiens
agguccuccucucucuacuugaa

SEQ ID NO: 1433223 - RNA, 21 nt, Homo sapiens
aggucgaccccaaagccccuu

SEQ ID NO: 1433224 - RNA, 11 nt, Homo sapiens
aggucucagcc

SEQ ID NO: 1433225 - RNA, 13 nt, Homo sapiens
aggugacugggaa

SEQ ID NO: 1433226 - RNA, 15 nt, Homo sapiens
aggugagaccaccuc

SEQ ID NO: 1433227 - RNA, 17 nt, Homo sapiens
aggugcuacaaaaacac

SEQ ID NO: 1433228 - RNA, 20 nt, Homo sapiens
aggugcuacaaaaacacagc

SEQ ID NO: 1433229 - RNA, 13 nt, Homo sapiens
agguggacagucc

SEQ ID NO: 1433230 - RNA, 13 nt, Homo sapiens
agguggcucucca

SEQ ID NO: 1433231 - RNA, 14 nt, Homo sapiens
agguggguccagga

SEQ ID NO: 1433232 - RNA, 16 nt, Homo sapiens
agguggugccuucuca

SEQ ID NO: 1433233 - RNA, 12 nt, Homo sapiens
aggugguguuga

SEQ ID NO: 1433234 - RNA, 13 nt, Homo sapiens
agguguaccuccc

SEQ ID NO: 1433235 - RNA, 20 nt, Homo sapiens
agguguaccucccccugccu

SEQ ID NO: 1433236 - RNA, 19 nt, Homo sapiens
aggugucccaagcuuugaa

SEQ ID NO: 1433237 - RNA, 16 nt, Homo sapiens
aggugugccaaacuac

SEQ ID NO: 1433238 - RNA, 16 nt, Homo sapiens
agguugccugggccac

SEQ ID NO: 1433239 - RNA, 23 nt, Homo sapiens
agguugucugaagucacugcaca

SEQ ID NO: 1433240 - RNA, 12 nt, Homo sapiens
agguuucaagac

SEQ ID NO: 1433241 - RNA, 21 nt, Homo sapiens
agguuucuugaauaucugccc

SEQ ID NO: 1433242 - RNA, 15 nt, Homo sapiens
agguuugccagugaa

SEQ ID NO: 1433243 - RNA, 14 nt, Homo sapiens
aguaaaccaaaaag

SEQ ID NO: 1433244 - RNA, 17 nt, Homo sapiens
aguaacacucaccauca

SEQ ID NO: 1433245 - RNA, 20 nt, Homo sapiens
aguaagaaaacaucacugaa

SEQ ID NO: 1433246 - RNA, 13 nt, Homo sapiens
aguaaucaggcag

SEQ ID NO: 1433247 - RNA, 16 nt, Homo sapiens
aguacagacgucucaa

SEQ ID NO: 1433248 - RNA, 21 nt, Homo sapiens
aguacagacgucucaagacug

SEQ ID NO: 1433249 - RNA, 11 nt, Homo sapiens
aguacagugag

SEQ ID NO: 1433250 - RNA, 19 nt, Homo sapiens
aguacaugaagagcagcug

SEQ ID NO: 1433251 - RNA, 19 nt, Homo sapiens
aguaccccugauaagcaaa

SEQ ID NO: 1433252 - RNA, 14 nt, Homo sapiens
aguaccuguaguga

SEQ ID NO: 1433253 - RNA, 17 nt, Homo sapiens
aguaccuuaaucugcca

SEQ ID NO: 1433254 - RNA, 12 nt, Homo sapiens
aguacugggaag

SEQ ID NO: 1433255 - RNA, 18 nt, Homo sapiens
aguagacuauaagcagaa

SEQ ID NO: 1433256 - RNA, 10 nt, Homo sapiens
aguagcucuu

SEQ ID NO: 1433257 - RNA, 10 nt, Homo sapiens
aguagcugag

SEQ ID NO: 1433258 - RNA, 14 nt, Homo sapiens
aguagcugagcuca

SEQ ID NO: 1433259 - RNA, 17 nt, Homo sapiens
aguaguugacagugcua

SEQ ID NO: 1433260 - RNA, 20 nt, Homo sapiens
aguaguuucucuguaaggca

SEQ ID NO: 1433261 - RNA, 16 nt, Homo sapiens
aguaguuuuucagcua

SEQ ID NO: 1433262 - RNA, 13 nt, Homo sapiens
aguaucuuaccug

SEQ ID NO: 1433263 - RNA, 13 nt, Homo sapiens
aguaugugaauau

SEQ ID NO: 1433264 - RNA, 16 nt, Homo sapiens
aguauucuugucaaaa

SEQ ID NO: 1433265 - RNA, 22 nt, Homo sapiens
aguauugccacaaugccucucc

SEQ ID NO: 1433266 - RNA, 22 nt, Homo sapiens
agucaaaacagagaugugauaa

SEQ ID NO: 1433267 - RNA, 17 nt, Homo sapiens
agucaacaaccaugcca

SEQ ID NO: 1433268 - RNA, 12 nt, Homo sapiens
agucaccaaaau

SEQ ID NO: 1433269 - RNA, 21 nt, Homo sapiens
agucaccacuccauucccaac

SEQ ID NO: 1433270 - RNA, 16 nt, Homo sapiens
agucacccuucugggc

SEQ ID NO: 1433271 - RNA, 14 nt, Homo sapiens
agucaccgggauga

SEQ ID NO: 1433272 - RNA, 23 nt, Homo sapiens
agucaccuccuccacucacucca

SEQ ID NO: 1433273 - RNA, 14 nt, Homo sapiens
agucacugcacagu

SEQ ID NO: 1433274 - RNA, 23 nt, Homo sapiens
agucacugcacagugcaucucag

SEQ ID NO: 1433275 - RNA, 20 nt, Homo sapiens
agucagcuguaccaagcccc

SEQ ID NO: 1433276 - RNA, 14 nt, Homo sapiens
agucaggaccuccg

SEQ ID NO: 1433277 - RNA, 15 nt, Homo sapiens
agucaguaguauucu

SEQ ID NO: 1433278 - RNA, 14 nt, Homo sapiens
agucauucugggaa

SEQ ID NO: 1433279 - RNA, 23 nt, Homo sapiens
aguccucuggauggcaccagagg

SEQ ID NO: 1433280 - RNA, 17 nt, Homo sapiens
agucgaucaagggaugu

SEQ ID NO: 1433281 - RNA, 13 nt, Homo sapiens
agucuaaaguuua

SEQ ID NO: 1433282 - RNA, 17 nt, Homo sapiens
agucuaggagcugggag

SEQ ID NO: 1433283 - RNA, 17 nt, Homo sapiens
agucuccuuugcacuga

SEQ ID NO: 1433284 - RNA, 18 nt, Homo sapiens
agucucuaugaucuuggc

SEQ ID NO: 1433285 - RNA, 18 nt, Homo sapiens
agucucugugcuuugacu

SEQ ID NO: 1433286 - RNA, 13 nt, Homo sapiens
agucuucccugau

SEQ ID NO: 1433287 - RNA, 22 nt, Homo sapiens
agucuugguuccucuacuacuu

SEQ ID NO: 1433288 - RNA, 17 nt, Homo sapiens
agugaaagaguagugca

SEQ ID NO: 1433289 - RNA, 18 nt, Homo sapiens
agugaaagaguagugcau

SEQ ID NO: 1433290 - RNA, 14 nt, Homo sapiens
agugaaccaaagag

SEQ ID NO: 1433291 - RNA, 16 nt, Homo sapiens
agugaauaaacuucag

SEQ ID NO: 1433292 - RNA, 18 nt, Homo sapiens
agugaauaguaacaauaa

SEQ ID NO: 1433293 - RNA, 22 nt, Homo sapiens
agugacauauauauguauauac

SEQ ID NO: 1433294 - RNA, 21 nt, Homo sapiens
agugaccauaaaggcauggca

SEQ ID NO: 1433295 - RNA, 16 nt, Homo sapiens
agugacuuccugguga

SEQ ID NO: 1433296 - RNA, 20 nt, Homo sapiens
agugacuuuagaaacaaauu

SEQ ID NO: 1433297 - RNA, 17 nt, Homo sapiens
agugagaaaaagcuccu

SEQ ID NO: 1433298 - RNA, 13 nt, Homo sapiens
agugagaaacuga

SEQ ID NO: 1433299 - RNA, 13 nt, Homo sapiens
agugagagggcau

SEQ ID NO: 1433300 - RNA, 19 nt, Homo sapiens
agugagaucuuacagguau

SEQ ID NO: 1433301 - RNA, 22 nt, Homo sapiens
agugauaucaccucucuucagc

SEQ ID NO: 1433302 - RNA, 17 nt, Homo sapiens
agugcaaauuugauaca

SEQ ID NO: 1433303 - RNA, 20 nt, Homo sapiens
agugcaauuuccccucugug

SEQ ID NO: 1433304 - RNA, 19 nt, Homo sapiens
agugcacacggaugcacag

SEQ ID NO: 1433305 - RNA, 20 nt, Homo sapiens
agugcacacggaugcacaga

SEQ ID NO: 1433306 - RNA, 18 nt, Homo sapiens
agugcagggaaccgugau

SEQ ID NO: 1433307 - RNA, 14 nt, Homo sapiens
agugcaguggugca

SEQ ID NO: 1433308 - RNA, 20 nt, Homo sapiens
agugccaauauuucugauau

SEQ ID NO: 1433309 - RNA, 23 nt, Homo sapiens
agugccaguuugcuuaguucuca

SEQ ID NO: 1433310 - RNA, 14 nt, Homo sapiens
agugcuaguauuau

SEQ ID NO: 1433311 - RNA, 15 nt, Homo sapiens
agugcuuccacuucu

SEQ ID NO: 1433312 - RNA, 15 nt, Homo sapiens
agugcuugucaugga

SEQ ID NO: 1433313 - RNA, 16 nt, Homo sapiens
agugcuuuaccuuuaa

SEQ ID NO: 1433314 - RNA, 15 nt, Homo sapiens
aguggaucuccaagg

SEQ ID NO: 1433315 - RNA, 18 nt, Homo sapiens
aguggauggaagugucug

SEQ ID NO: 1433316 - RNA, 22 nt, Homo sapiens
aguggcacggagagaaggccca

SEQ ID NO: 1433317 - RNA, 19 nt, Homo sapiens
aguggcauuaaacauuuga

SEQ ID NO: 1433318 - RNA, 14 nt, Homo sapiens
aguggccaugccac

SEQ ID NO: 1433319 - RNA, 20 nt, Homo sapiens
aguggcucuucuaaccucag

SEQ ID NO: 1433320 - RNA, 22 nt, Homo sapiens
aguggggacggaaggcaaagag

SEQ ID NO: 1433321 - RNA, 13 nt, Homo sapiens
aguggguggugga

SEQ ID NO: 1433322 - RNA, 16 nt, Homo sapiens
agugggugguggaucu

SEQ ID NO: 1433323 - RNA, 20 nt, Homo sapiens
agugguuguuuugucaugaa

SEQ ID NO: 1433324 - RNA, 23 nt, Homo sapiens
aguguccagaccauugucuucca

SEQ ID NO: 1433325 - RNA, 20 nt, Homo sapiens
aguguccccuccacugucac

SEQ ID NO: 1433326 - RNA, 22 nt, Homo sapiens
agugucguuuucauaacuugcu

SEQ ID NO: 1433327 - RNA, 17 nt, Homo sapiens
agugugggcauagcauu

SEQ ID NO: 1433328 - RNA, 13 nt, Homo sapiens
aguguucaagaaa

SEQ ID NO: 1433329 - RNA, 12 nt, Homo sapiens
aguguugcuugg

SEQ ID NO: 1433330 - RNA, 16 nt, Homo sapiens
aguguuugcaauggug

SEQ ID NO: 1433331 - RNA, 20 nt, Homo sapiens
aguguuuuuuagauacagag

SEQ ID NO: 1433332 - RNA, 16 nt, Homo sapiens
aguuaaaagacugcag

SEQ ID NO: 1433333 - RNA, 18 nt, Homo sapiens
aguuacaaauucaaggag

SEQ ID NO: 1433334 - RNA, 11 nt, Homo sapiens
aguuacagggc

SEQ ID NO: 1433335 - RNA, 14 nt, Homo sapiens
aguuacuuaccugc

SEQ ID NO: 1433336 - RNA, 15 nt, Homo sapiens
aguuacuuaccugca

SEQ ID NO: 1433337 - RNA, 19 nt, Homo sapiens
aguuauucucuucacuccc

SEQ ID NO: 1433338 - RNA, 14 nt, Homo sapiens
aguuauucuugaca

SEQ ID NO: 1433339 - RNA, 22 nt, Homo sapiens
aguuauucuugacaugagaaaa

SEQ ID NO: 1433340 - RNA, 21 nt, Homo sapiens
aguucaaaaaacucuugauau

SEQ ID NO: 1433341 - RNA, 21 nt, Homo sapiens
aguucacaggccagaaaacau

SEQ ID NO: 1433342 - RNA, 23 nt, Homo sapiens
aguucagaguuguacacugugua

SEQ ID NO: 1433343 - RNA, 18 nt, Homo sapiens
aguucauggugaucagug

SEQ ID NO: 1433344 - RNA, 12 nt, Homo sapiens
aguuccaaauaa

SEQ ID NO: 1433345 - RNA, 19 nt, Homo sapiens
aguuccaugaagaccacau

SEQ ID NO: 1433346 - RNA, 17 nt, Homo sapiens
aguucccggagcacagc

SEQ ID NO: 1433347 - RNA, 19 nt, Homo sapiens
aguuccucagggaguuuga

SEQ ID NO: 1433348 - RNA, 18 nt, Homo sapiens
aguuccugcacuccagaa

SEQ ID NO: 1433349 - RNA, 20 nt, Homo sapiens
aguuccuguagaacugagaa

SEQ ID NO: 1433350 - RNA, 15 nt, Homo sapiens
aguuccuucagcuuc

SEQ ID NO: 1433351 - RNA, 18 nt, Homo sapiens
aguuccuugaucuguaua

SEQ ID NO: 1433352 - RNA, 19 nt, Homo sapiens
aguucgcagccacccugag

SEQ ID NO: 1433353 - RNA, 20 nt, Homo sapiens
aguucuggugaauguucaau

SEQ ID NO: 1433354 - RNA, 13 nt, Homo sapiens
aguugagaacaaa

SEQ ID NO: 1433355 - RNA, 18 nt, Homo sapiens
aguuggccaugaugucuu

SEQ ID NO: 1433356 - RNA, 14 nt, Homo sapiens
aguuggcucaggca

SEQ ID NO: 1433357 - RNA, 16 nt, Homo sapiens
aguugggagcacugga

SEQ ID NO: 1433358 - RNA, 21 nt, Homo sapiens
aguuguaacuuugccuucaca

SEQ ID NO: 1433359 - RNA, 15 nt, Homo sapiens
aguuguuccuacuca

SEQ ID NO: 1433360 - RNA, 19 nt, Homo sapiens
aguuguucgccgcguggaa

SEQ ID NO: 1433361 - RNA, 19 nt, Homo sapiens
aguuguuuucccgagcaaa

SEQ ID NO: 1433362 - RNA, 15 nt, Homo sapiens
aguuuaaaaaaccau

SEQ ID NO: 1433363 - RNA, 20 nt, Homo sapiens
aguuuaacuuugggcccaga

SEQ ID NO: 1433364 - RNA, 17 nt, Homo sapiens
aguuuauuuuguuacac

SEQ ID NO: 1433365 - RNA, 19 nt, Homo sapiens
aguuuccaaucccauagau

SEQ ID NO: 1433366 - RNA, 22 nt, Homo sapiens
aguuucuccuuuugaccaaaua

SEQ ID NO: 1433367 - RNA, 18 nt, Homo sapiens
aguuugaccucacaguga

SEQ ID NO: 1433368 - RNA, 19 nt, Homo sapiens
aguuugcuuuguaugcacu

SEQ ID NO: 1433369 - RNA, 23 nt, Homo sapiens
aguuuggaaguguuaacuauuua

SEQ ID NO: 1433370 - RNA, 20 nt, Homo sapiens
aguuuuaacagaaccagagg

SEQ ID NO: 1433371 - RNA, 18 nt, Homo sapiens
aguuuuauggcaugauuu

SEQ ID NO: 1433372 - RNA, 13 nt, Homo sapiens
auaaaaacauaaa

SEQ ID NO: 1433373 - RNA, 13 nt, Homo sapiens
auaaaaacccugu

SEQ ID NO: 1433374 - RNA, 14 nt, Homo sapiens
auaaaaacccugua

SEQ ID NO: 1433375 - RNA, 12 nt, Homo sapiens
auaaaaauaccu

SEQ ID NO: 1433376 - RNA, 22 nt, Homo sapiens
auaaaaaucauggcaacauaau

SEQ ID NO: 1433377 - RNA, 13 nt, Homo sapiens
auaaaacauuaug

SEQ ID NO: 1433378 - RNA, 21 nt, Homo sapiens
auaaaaccucagggacaacau

SEQ ID NO: 1433379 - RNA, 16 nt, Homo sapiens
auaaaauaguauugaa

SEQ ID NO: 1433380 - RNA, 14 nt, Homo sapiens
auaaaauauguaca

SEQ ID NO: 1433381 - RNA, 20 nt, Homo sapiens
auaaaauuguaaaauuguau

SEQ ID NO: 1433382 - RNA, 20 nt, Homo sapiens
auaaacacccaugaaucaaa

SEQ ID NO: 1433383 - RNA, 23 nt, Homo sapiens
auaaacacccaugaaucaaagac

SEQ ID NO: 1433384 - RNA, 19 nt, Homo sapiens
auaaacauuaaacacugua

SEQ ID NO: 1433385 - RNA, 20 nt, Homo sapiens
auaaaccaaaggacauuaug

SEQ ID NO: 1433386 - RNA, 21 nt, Homo sapiens
auaaaccuggagaugaugaug

SEQ ID NO: 1433387 - RNA, 14 nt, Homo sapiens
auaaacuacuguaa

SEQ ID NO: 1433388 - RNA, 13 nt, Homo sapiens
auaaagacuucau

SEQ ID NO: 1433389 - RNA, 18 nt, Homo sapiens
auaaaggcugagcucuua

SEQ ID NO: 1433390 - RNA, 18 nt, Homo sapiens
auaaagucacuuccagug

SEQ ID NO: 1433391 - RNA, 16 nt, Homo sapiens
auaaagugccaguuug

SEQ ID NO: 1433392 - RNA, 20 nt, Homo sapiens
auaaaugaaguauuucucac

SEQ ID NO: 1433393 - RNA, 17 nt, Homo sapiens
auaaaugauguacuaca

SEQ ID NO: 1433394 - RNA, 13 nt, Homo sapiens
auaaaugccucau

SEQ ID NO: 1433395 - RNA, 14 nt, Homo sapiens
auaaauguguaaau

SEQ ID NO: 1433396 - RNA, 18 nt, Homo sapiens
auaaauguguaaaugugg

SEQ ID NO: 1433397 - RNA, 22 nt, Homo sapiens
auaaauguuauguuugcuaaaa

SEQ ID NO: 1433398 - RNA, 18 nt, Homo sapiens
auaaauugcuccuugaca

SEQ ID NO: 1433399 - RNA, 21 nt, Homo sapiens
auaaauuggugauaaguggaa

SEQ ID NO: 1433400 - RNA, 16 nt, Homo sapiens
auaaccccaccuugcc

SEQ ID NO: 1433401 - RNA, 19 nt, Homo sapiens
auaaccuucaugaugaauu

SEQ ID NO: 1433402 - RNA, 23 nt, Homo sapiens
auaaccuucaugaugaauuacuu

SEQ ID NO: 1433403 - RNA, 17 nt, Homo sapiens
auaacucauugucugug

SEQ ID NO: 1433404 - RNA, 20 nt, Homo sapiens
auaagauugacuuugaaucu

SEQ ID NO: 1433405 - RNA, 23 nt, Homo sapiens
auaagcaaagggagcacuggguu

SEQ ID NO: 1433406 - RNA, 13 nt, Homo sapiens
auaaguauuucca

SEQ ID NO: 1433407 - RNA, 22 nt, Homo sapiens
auaaguauuuccauaacucaua

SEQ ID NO: 1433408 - RNA, 19 nt, Homo sapiens
auaauaaaaagacuauuaa

SEQ ID NO: 1433409 - RNA, 15 nt, Homo sapiens
auaauaauugaucaa

SEQ ID NO: 1433410 - RNA, 14 nt, Homo sapiens
auaauauaagccau

SEQ ID NO: 1433411 - RNA, 17 nt, Homo sapiens
auaauggaaacauuuac

SEQ ID NO: 1433412 - RNA, 15 nt, Homo sapiens
auaauuaaaaaccac

SEQ ID NO: 1433413 - RNA, 16 nt, Homo sapiens
auaauuaaaaaccacu

SEQ ID NO: 1433414 - RNA, 17 nt, Homo sapiens
auaauuaugucccaggg

SEQ ID NO: 1433415 - RNA, 15 nt, Homo sapiens
auaauucuacaggau

SEQ ID NO: 1433416 - RNA, 20 nt, Homo sapiens
auacaaaagcaagacuucca

SEQ ID NO: 1433417 - RNA, 15 nt, Homo sapiens
auacaacacaaagag

SEQ ID NO: 1433418 - RNA, 14 nt, Homo sapiens
auacacaacauuua

SEQ ID NO: 1433419 - RNA, 19 nt, Homo sapiens
auacacacauauacauaua

SEQ ID NO: 1433420 - RNA, 15 nt, Homo sapiens
auacacauggaugca

SEQ ID NO: 1433421 - RNA, 21 nt, Homo sapiens
auacacauggaugcacgcaca

SEQ ID NO: 1433422 - RNA, 19 nt, Homo sapiens
auacaccaccucacuccug

SEQ ID NO: 1433423 - RNA, 14 nt, Homo sapiens
auacagaaugaauc

SEQ ID NO: 1433424 - RNA, 19 nt, Homo sapiens
auacagagguaacuaucaa

SEQ ID NO: 1433425 - RNA, 16 nt, Homo sapiens
auacaguggaucucaa

SEQ ID NO: 1433426 - RNA, 13 nt, Homo sapiens
auacauaagacca

SEQ ID NO: 1433427 - RNA, 18 nt, Homo sapiens
auacauauauauauacac

SEQ ID NO: 1433428 - RNA, 18 nt, Homo sapiens
auacauauauguauauau

SEQ ID NO: 1433429 - RNA, 16 nt, Homo sapiens
auacaugacucagcau

SEQ ID NO: 1433430 - RNA, 14 nt, Homo sapiens
auacauguguguau

SEQ ID NO: 1433431 - RNA, 17 nt, Homo sapiens
auacauguguguauaua

SEQ ID NO: 1433432 - RNA, 23 nt, Homo sapiens
auaccacaauaaaaaaaaaccua

SEQ ID NO: 1433433 - RNA, 19 nt, Homo sapiens
auaccagagaccugaggca

SEQ ID NO: 1433434 - RNA, 16 nt, Homo sapiens
auaccagaucacucaa

SEQ ID NO: 1433435 - RNA, 16 nt, Homo sapiens
auaccagugaaccaaa

SEQ ID NO: 1433436 - RNA, 15 nt, Homo sapiens
auaccaucuguagag

SEQ ID NO: 1433437 - RNA, 20 nt, Homo sapiens
auaccgcuggggaacagagc

SEQ ID NO: 1433438 - RNA, 18 nt, Homo sapiens
auacgcgggcgcugccug

SEQ ID NO: 1433439 - RNA, 18 nt, Homo sapiens
auacuaaaaaucaugaga

SEQ ID NO: 1433440 - RNA, 17 nt, Homo sapiens
auacuaccaagugacca

SEQ ID NO: 1433441 - RNA, 18 nt, Homo sapiens
auacuccauacauaacuu

SEQ ID NO: 1433442 - RNA, 22 nt, Homo sapiens
auacuccauacauaacuugaua

SEQ ID NO: 1433443 - RNA, 13 nt, Homo sapiens
auacuguacauag

SEQ ID NO: 1433444 - RNA, 18 nt, Homo sapiens
auacuuuuuuucacaguu

SEQ ID NO: 1433445 - RNA, 16 nt, Homo sapiens
auagaaacaugacacu

SEQ ID NO: 1433446 - RNA, 17 nt, Homo sapiens
auagaaacaugacacug

SEQ ID NO: 1433447 - RNA, 12 nt, Homo sapiens
auagaaacugag

SEQ ID NO: 1433448 - RNA, 14 nt, Homo sapiens
auagaaaguucaaa

SEQ ID NO: 1433449 - RNA, 18 nt, Homo sapiens
auagaauauuuacaauaa

SEQ ID NO: 1433450 - RNA, 21 nt, Homo sapiens
auagacagcacuuggcuccuu

SEQ ID NO: 1433451 - RNA, 23 nt, Homo sapiens
auagagaagaucuaauaccaucc

SEQ ID NO: 1433452 - RNA, 23 nt, Homo sapiens
auagagauuaauuuuaacuuaaa

SEQ ID NO: 1433453 - RNA, 13 nt, Homo sapiens
auagagguacaug

SEQ ID NO: 1433454 - RNA, 21 nt, Homo sapiens
auagagugacuccaagaacaa

SEQ ID NO: 1433455 - RNA, 13 nt, Homo sapiens
auagaucuuuuca

SEQ ID NO: 1433456 - RNA, 19 nt, Homo sapiens
auagauggguuauuucaac

SEQ ID NO: 1433457 - RNA, 13 nt, Homo sapiens
auagauuaccuga

SEQ ID NO: 1433458 - RNA, 18 nt, Homo sapiens
auagcagauuguguaaca

SEQ ID NO: 1433459 - RNA, 16 nt, Homo sapiens
auagcgaaucaucuca

SEQ ID NO: 1433460 - RNA, 18 nt, Homo sapiens
auagcgaaucaucucaaa

SEQ ID NO: 1433461 - RNA, 17 nt, Homo sapiens
auagcuucuccaaaggc

SEQ ID NO: 1433462 - RNA, 17 nt, Homo sapiens
auaggcaaaaucugaca

SEQ ID NO: 1433463 - RNA, 16 nt, Homo sapiens
auaggcugcauaugag

SEQ ID NO: 1433464 - RNA, 21 nt, Homo sapiens
auagggguaagguaugggaga

SEQ ID NO: 1433465 - RNA, 14 nt, Homo sapiens
auagguaugagcca

SEQ ID NO: 1433466 - RNA, 19 nt, Homo sapiens
auaggugcuacaaaaacac

SEQ ID NO: 1433467 - RNA, 22 nt, Homo sapiens
auagucaaaccauaaacuucau

SEQ ID NO: 1433468 - RNA, 18 nt, Homo sapiens
auagugcacuagcauuuu

SEQ ID NO: 1433469 - RNA, 17 nt, Homo sapiens
auaguuaauuauuucaa

SEQ ID NO: 1433470 - RNA, 17 nt, Homo sapiens
auaguuauuuacuugaa

SEQ ID NO: 1433471 - RNA, 18 nt, Homo sapiens
auaguuauuuacuugaaa

SEQ ID NO: 1433472 - RNA, 15 nt, Homo sapiens
auauaaccauuacau

SEQ ID NO: 1433473 - RNA, 13 nt, Homo sapiens
auauaagccauag

SEQ ID NO: 1433474 - RNA, 20 nt, Homo sapiens
auauacaaaagcaagacuuc

SEQ ID NO: 1433475 - RNA, 15 nt, Homo sapiens
auauacaaacaugug

SEQ ID NO: 1433476 - RNA, 19 nt, Homo sapiens
auauacacauauaccuaua

SEQ ID NO: 1433477 - RNA, 14 nt, Homo sapiens
auauacauaugaca

SEQ ID NO: 1433478 - RNA, 16 nt, Homo sapiens
auauacauaugacaua

SEQ ID NO: 1433479 - RNA, 15 nt, Homo sapiens
auauacauuucauaa

SEQ ID NO: 1433480 - RNA, 20 nt, Homo sapiens
auauacuucacucacuuuuc

SEQ ID NO: 1433481 - RNA, 15 nt, Homo sapiens
auauauagugcuaua

SEQ ID NO: 1433482 - RNA, 12 nt, Homo sapiens
auauauucuaca

SEQ ID NO: 1433483 - RNA, 22 nt, Homo sapiens
auauauuuauuuaagcuuaugu

SEQ ID NO: 1433484 - RNA, 21 nt, Homo sapiens
auauauuuuugguugucaaua

SEQ ID NO: 1433485 - RNA, 23 nt, Homo sapiens
auauauuuuugguugucaauauu

SEQ ID NO: 1433486 - RNA, 17 nt, Homo sapiens
auaucaagauguuaaau

SEQ ID NO: 1433487 - RNA, 13 nt, Homo sapiens
auauccacaucua

SEQ ID NO: 1433488 - RNA, 16 nt, Homo sapiens
auaucgagaacugcca

SEQ ID NO: 1433489 - RNA, 16 nt, Homo sapiens
auaucgggucacuguc

SEQ ID NO: 1433490 - RNA, 14 nt, Homo sapiens
auaucuuauguuaa

SEQ ID NO: 1433491 - RNA, 21 nt, Homo sapiens
auaugaacaaacuaugaucac

SEQ ID NO: 1433492 - RNA, 18 nt, Homo sapiens
auaugaacuggaccugca

SEQ ID NO: 1433493 - RNA, 17 nt, Homo sapiens
auaugcacacacacgga

SEQ ID NO: 1433494 - RNA, 19 nt, Homo sapiens
auaugcacacacauggaug

SEQ ID NO: 1433495 - RNA, 14 nt, Homo sapiens
auaugcauuaugaa

SEQ ID NO: 1433496 - RNA, 21 nt, Homo sapiens
auaugguagcaacacugugaa

SEQ ID NO: 1433497 - RNA, 18 nt, Homo sapiens
auauguagcccucaugau

SEQ ID NO: 1433498 - RNA, 22 nt, Homo sapiens
auauguagcccucaugauaauc

SEQ ID NO: 1433499 - RNA, 12 nt, Homo sapiens
auauguauauau

SEQ ID NO: 1433500 - RNA, 17 nt, Homo sapiens
auauguauuuugucaua

SEQ ID NO: 1433501 - RNA, 16 nt, Homo sapiens
auaugucuaauucuau

SEQ ID NO: 1433502 - RNA, 20 nt, Homo sapiens
auaugucucaggucccugca

SEQ ID NO: 1433503 - RNA, 17 nt, Homo sapiens
auauguguauauauaca

SEQ ID NO: 1433504 - RNA, 16 nt, Homo sapiens
auauguucaacuggag

SEQ ID NO: 1433505 - RNA, 16 nt, Homo sapiens
auauguuuccaucacu

SEQ ID NO: 1433506 - RNA, 14 nt, Homo sapiens
auauuaccaaaaaa

SEQ ID NO: 1433507 - RNA, 12 nt, Homo sapiens
auauuacuuguu

SEQ ID NO: 1433508 - RNA, 21 nt, Homo sapiens
auauuacuuguuuucacuuua

SEQ ID NO: 1433509 - RNA, 18 nt, Homo sapiens
auauuauaaauaaaugcc

SEQ ID NO: 1433510 - RNA, 17 nt, Homo sapiens
auauuauaauaauguuc

SEQ ID NO: 1433511 - RNA, 16 nt, Homo sapiens
auauuaugugaaauca

SEQ ID NO: 1433512 - RNA, 16 nt, Homo sapiens
auauucaaggaucuca

SEQ ID NO: 1433513 - RNA, 17 nt, Homo sapiens
auauuccaccauucaca

SEQ ID NO: 1433514 - RNA, 20 nt, Homo sapiens
auauuccgggugccauuccc

SEQ ID NO: 1433515 - RNA, 18 nt, Homo sapiens
auauuccuauauguagcu

SEQ ID NO: 1433516 - RNA, 19 nt, Homo sapiens
auauuuauagcaauccaug

SEQ ID NO: 1433517 - RNA, 18 nt, Homo sapiens
auauuuaugucuauuuaa

SEQ ID NO: 1433518 - RNA, 23 nt, Homo sapiens
auauuugaauguguaagcauugu

SEQ ID NO: 1433519 - RNA, 16 nt, Homo sapiens
auauuuucacaggugu

SEQ ID NO: 1433520 - RNA, 18 nt, Homo sapiens
auauuuuguaacuauuac

SEQ ID NO: 1433521 - RNA, 14 nt, Homo sapiens
aucaaaacucuccu

SEQ ID NO: 1433522 - RNA, 18 nt, Homo sapiens
aucaaaagcuuauucauc

SEQ ID NO: 1433523 - RNA, 20 nt, Homo sapiens
aucaaaaucuuucagcacuc

SEQ ID NO: 1433524 - RNA, 16 nt, Homo sapiens
aucaaaccccauggag

SEQ ID NO: 1433525 - RNA, 15 nt, Homo sapiens
aucaaauugcuacau

SEQ ID NO: 1433526 - RNA, 20 nt, Homo sapiens
aucaacuuguguacugauaa

SEQ ID NO: 1433527 - RNA, 22 nt, Homo sapiens
aucaagagugagugaacaacua

SEQ ID NO: 1433528 - RNA, 23 nt, Homo sapiens
aucaauccugcccccagccaugg

SEQ ID NO: 1433529 - RNA, 20 nt, Homo sapiens
aucaaugggugguauuugcu

SEQ ID NO: 1433530 - RNA, 22 nt, Homo sapiens
aucacacucauaacucauuguc

SEQ ID NO: 1433531 - RNA, 16 nt, Homo sapiens
aucacagcagugcaua

SEQ ID NO: 1433532 - RNA, 20 nt, Homo sapiens
aucacaguguuugcaauggu

SEQ ID NO: 1433533 - RNA, 14 nt, Homo sapiens
aucacauacaauuu

SEQ ID NO: 1433534 - RNA, 22 nt, Homo sapiens
aucaccuuuuugacuuuuccaa

SEQ ID NO: 1433535 - RNA, 20 nt, Homo sapiens
aucagaccacucccuucccc

SEQ ID NO: 1433536 - RNA, 14 nt, Homo sapiens
aucagcacugaaaa

SEQ ID NO: 1433537 - RNA, 13 nt, Homo sapiens
aucagcauuaguc

SEQ ID NO: 1433538 - RNA, 13 nt, Homo sapiens
aucagccacggag

SEQ ID NO: 1433539 - RNA, 19 nt, Homo sapiens
aucagccuccgccauucca

SEQ ID NO: 1433540 - RNA, 13 nt, Homo sapiens
aucaggauuucau

SEQ ID NO: 1433541 - RNA, 15 nt, Homo sapiens
aucaggucauuauuu

SEQ ID NO: 1433542 - RNA, 15 nt, Homo sapiens
aucagugcagugaua

SEQ ID NO: 1433543 - RNA, 15 nt, Homo sapiens
aucaguggcugccuu

SEQ ID NO: 1433544 - RNA, 12 nt, Homo sapiens
aucauaaggaag

SEQ ID NO: 1433545 - RNA, 17 nt, Homo sapiens
aucauagcucacuguaa

SEQ ID NO: 1433546 - RNA, 19 nt, Homo sapiens
aucaucagcauaccuuuau

SEQ ID NO: 1433547 - RNA, 22 nt, Homo sapiens
aucaucccagcugcucccaaau

SEQ ID NO: 1433548 - RNA, 18 nt, Homo sapiens
aucaugaaaagugcuguu

SEQ ID NO: 1433549 - RNA, 20 nt, Homo sapiens
aucaugaaaaugucuauuca

SEQ ID NO: 1433550 - RNA, 19 nt, Homo sapiens
aucauuuauuuacaucuau

SEQ ID NO: 1433551 - RNA, 17 nt, Homo sapiens
aucauuugcaaugcccu

SEQ ID NO: 1433552 - RNA, 19 nt, Homo sapiens
aucauuuuuaaauauaggu

SEQ ID NO: 1433553 - RNA, 12 nt, Homo sapiens
auccacaucuaa

SEQ ID NO: 1433554 - RNA, 13 nt, Homo sapiens
auccacugcaaua

SEQ ID NO: 1433555 - RNA, 16 nt, Homo sapiens
auccaguugcaauaaa

SEQ ID NO: 1433556 - RNA, 17 nt, Homo sapiens
auccauaaggugcagua

SEQ ID NO: 1433557 - RNA, 20 nt, Homo sapiens
auccauuuggacaaaaugga

SEQ ID NO: 1433558 - RNA, 21 nt, Homo sapiens
auccauuuggacaaaauggaa

SEQ ID NO: 1433559 - RNA, 12 nt, Homo sapiens
aucccaagccaa

SEQ ID NO: 1433560 - RNA, 13 nt, Homo sapiens
aucccaagccaac

SEQ ID NO: 1433561 - RNA, 15 nt, Homo sapiens
aucccaauucauuuc

SEQ ID NO: 1433562 - RNA, 12 nt, Homo sapiens
aucccagcacuu

SEQ ID NO: 1433563 - RNA, 15 nt, Homo sapiens
aucccagcacuuugg

SEQ ID NO: 1433564 - RNA, 22 nt, Homo sapiens
aucccaggaggggccucugaaa

SEQ ID NO: 1433565 - RNA, 17 nt, Homo sapiens
aucccauccaucagcuc

SEQ ID NO: 1433566 - RNA, 15 nt, Homo sapiens
aucccauguauuuau

SEQ ID NO: 1433567 - RNA, 20 nt, Homo sapiens
auccccagaggugacccaau

SEQ ID NO: 1433568 - RNA, 15 nt, Homo sapiens
aucccccagccucaa

SEQ ID NO: 1433569 - RNA, 18 nt, Homo sapiens
aucccccuugccaaauuc

SEQ ID NO: 1433570 - RNA, 16 nt, Homo sapiens
auccccuggacuggga

SEQ ID NO: 1433571 - RNA, 17 nt, Homo sapiens
auccccuggacugggag

SEQ ID NO: 1433572 - RNA, 22 nt, Homo sapiens
aucccgccucuucuucuucaga

SEQ ID NO: 1433573 - RNA, 22 nt, Homo sapiens
aucccgucuucuccaacaccac

SEQ ID NO: 1433574 - RNA, 17 nt, Homo sapiens
auccgggacgcuuccag

SEQ ID NO: 1433575 - RNA, 23 nt, Homo sapiens
auccucaauucaauguggugaug

SEQ ID NO: 1433576 - RNA, 15 nt, Homo sapiens
auccucacaaccacc

SEQ ID NO: 1433577 - RNA, 23 nt, Homo sapiens
auccugcccccagccauggugag

SEQ ID NO: 1433578 - RNA, 18 nt, Homo sapiens
auccugcuagcuguagaa

SEQ ID NO: 1433579 - RNA, 18 nt, Homo sapiens
auccuguuucuugcucug

SEQ ID NO: 1433580 - RNA, 19 nt, Homo sapiens
auccuuaggaaaaugcuuc

SEQ ID NO: 1433581 - RNA, 15 nt, Homo sapiens
auccuucaucuggau

SEQ ID NO: 1433582 - RNA, 22 nt, Homo sapiens
auccuuuccacccuauucccua

SEQ ID NO: 1433583 - RNA, 23 nt, Homo sapiens
auccuuugaguuauaguuugcuu

SEQ ID NO: 1433584 - RNA, 20 nt, Homo sapiens
aucgaucuguacuguaauuu

SEQ ID NO: 1433585 - RNA, 20 nt, Homo sapiens
aucguggugugucaaugcca

SEQ ID NO: 1433586 - RNA, 20 nt, Homo sapiens
aucuaaagccaguggcagug

SEQ ID NO: 1433587 - RNA, 18 nt, Homo sapiens
aucuaacuacaaggacaa

SEQ ID NO: 1433588 - RNA, 18 nt, Homo sapiens
aucuaaucuaugcaugua

SEQ ID NO: 1433589 - RNA, 15 nt, Homo sapiens
aucuacaagcauuug

SEQ ID NO: 1433590 - RNA, 22 nt, Homo sapiens
aucuacacagcaguaugaauga

SEQ ID NO: 1433591 - RNA, 16 nt, Homo sapiens
aucuaccaucuaaucu

SEQ ID NO: 1433592 - RNA, 21 nt, Homo sapiens
aucuaccaucuaaucuaugca

SEQ ID NO: 1433593 - RNA, 20 nt, Homo sapiens
aucuacccacuuacuaaccu

SEQ ID NO: 1433594 - RNA, 21 nt, Homo sapiens
aucuacccacuuacuaaccug

SEQ ID NO: 1433595 - RNA, 17 nt, Homo sapiens
aucuaccucacuauuca

SEQ ID NO: 1433596 - RNA, 18 nt, Homo sapiens
aucuagaucaauuaauuc

SEQ ID NO: 1433597 - RNA, 16 nt, Homo sapiens
aucuagcuucaugccu

SEQ ID NO: 1433598 - RNA, 19 nt, Homo sapiens
aucuagcuucaugccucag

SEQ ID NO: 1433599 - RNA, 18 nt, Homo sapiens
aucuagugcuagauguau

SEQ ID NO: 1433600 - RNA, 16 nt, Homo sapiens
aucuaguuuacuuccu

SEQ ID NO: 1433601 - RNA, 17 nt, Homo sapiens
aucuaucaauagucaag

SEQ ID NO: 1433602 - RNA, 20 nt, Homo sapiens
aucuauguaucuaccaucua

SEQ ID NO: 1433603 - RNA, 14 nt, Homo sapiens
aucucaaaacugca

SEQ ID NO: 1433604 - RNA, 22 nt, Homo sapiens
aucucaaauccuugagcacuca

SEQ ID NO: 1433605 - RNA, 19 nt, Homo sapiens
aucucacucuguugcccag

SEQ ID NO: 1433606 - RNA, 21 nt, Homo sapiens
aucucagggaaacuugcguac

SEQ ID NO: 1433607 - RNA, 15 nt, Homo sapiens
aucucaggugccacu

SEQ ID NO: 1433608 - RNA, 17 nt, Homo sapiens
aucuccacaccaaaguc

SEQ ID NO: 1433609 - RNA, 16 nt, Homo sapiens
aucuccagcauccugc

SEQ ID NO: 1433610 - RNA, 21 nt, Homo sapiens
aucuccaggauugaagagcau

SEQ ID NO: 1433611 - RNA, 13 nt, Homo sapiens
aucuccaguggga

SEQ ID NO: 1433612 - RNA, 22 nt, Homo sapiens
aucuccagugggaacucuucaa

SEQ ID NO: 1433613 - RNA, 22 nt, Homo sapiens
aucucccugccgccucaaugug

SEQ ID NO: 1433614 - RNA, 16 nt, Homo sapiens
aucuccucuaucacau

SEQ ID NO: 1433615 - RNA, 20 nt, Homo sapiens
aucucgcaguacauguuacu

SEQ ID NO: 1433616 - RNA, 18 nt, Homo sapiens
aucucuaauacaguguga

SEQ ID NO: 1433617 - RNA, 16 nt, Homo sapiens
aucucuaauauggcaa

SEQ ID NO: 1433618 - RNA, 19 nt, Homo sapiens
aucucuagagugagaaucu

SEQ ID NO: 1433619 - RNA, 16 nt, Homo sapiens
aucugaacacauacua

SEQ ID NO: 1433620 - RNA, 23 nt, Homo sapiens
aucugacucacaagaagaccaga

SEQ ID NO: 1433621 - RNA, 15 nt, Homo sapiens
aucugagcaaugacu

SEQ ID NO: 1433622 - RNA, 15 nt, Homo sapiens
aucugaucugaguga

SEQ ID NO: 1433623 - RNA, 20 nt, Homo sapiens
aucugccccaguagucagaa

SEQ ID NO: 1433624 - RNA, 17 nt, Homo sapiens
aucuggauuccagagca

SEQ ID NO: 1433625 - RNA, 23 nt, Homo sapiens
aucuguauauacaauaacauaau

SEQ ID NO: 1433626 - RNA, 16 nt, Homo sapiens
aucuguauuuuuuaca

SEQ ID NO: 1433627 - RNA, 15 nt, Homo sapiens
aucugucaucucucu

SEQ ID NO: 1433628 - RNA, 22 nt, Homo sapiens
aucugugcaaauccuugauacu

SEQ ID NO: 1433629 - RNA, 21 nt, Homo sapiens
aucuguuugaucccuguuacc

SEQ ID NO: 1433630 - RNA, 14 nt, Homo sapiens
aucuuaaaugacag

SEQ ID NO: 1433631 - RNA, 22 nt, Homo sapiens
aucuuaauuuuuuuuaauguac

SEQ ID NO: 1433632 - RNA, 12 nt, Homo sapiens
aucuuacuuugu

SEQ ID NO: 1433633 - RNA, 23 nt, Homo sapiens
aucuuagcuucuauuauagccac

SEQ ID NO: 1433634 - RNA, 13 nt, Homo sapiens
aucuuauguuaaa

SEQ ID NO: 1433635 - RNA, 17 nt, Homo sapiens
aucuucaagguguaaaa

SEQ ID NO: 1433636 - RNA, 19 nt, Homo sapiens
aucuucauacaaugacaag

SEQ ID NO: 1433637 - RNA, 15 nt, Homo sapiens
aucuuccugcugcug

SEQ ID NO: 1433638 - RNA, 18 nt, Homo sapiens
aucuucggggugugauga

SEQ ID NO: 1433639 - RNA, 22 nt, Homo sapiens
aucuuguucuuuaaaaucacaa

SEQ ID NO: 1433640 - RNA, 13 nt, Homo sapiens
aucuuuccuccaa

SEQ ID NO: 1433641 - RNA, 18 nt, Homo sapiens
aucuuuccuugucucuca

SEQ ID NO: 1433642 - RNA, 23 nt, Homo sapiens
aucuuuuugagagaaccuuauau

SEQ ID NO: 1433643 - RNA, 20 nt, Homo sapiens
augaaaaaaaguacauguau

SEQ ID NO: 1433644 - RNA, 17 nt, Homo sapiens
augaaaaccauuaccug

SEQ ID NO: 1433645 - RNA, 19 nt, Homo sapiens
augaaaauaagugaauaau

SEQ ID NO: 1433646 - RNA, 16 nt, Homo sapiens
augaaaccagaaggau

SEQ ID NO: 1433647 - RNA, 17 nt, Homo sapiens
augaaaugacugucuaa

SEQ ID NO: 1433648 - RNA, 19 nt, Homo sapiens
augaaaugauaaagauguc

SEQ ID NO: 1433649 - RNA, 15 nt, Homo sapiens
augaaaugcucuccu

SEQ ID NO: 1433650 - RNA, 20 nt, Homo sapiens
augaaauucuugaaguucau

SEQ ID NO: 1433651 - RNA, 23 nt, Homo sapiens
augaacgauauguagcagaaagg

SEQ ID NO: 1433652 - RNA, 16 nt, Homo sapiens
augaagacccagugua

SEQ ID NO: 1433653 - RNA, 18 nt, Homo sapiens
augaagagaagcugagaa

SEQ ID NO: 1433654 - RNA, 21 nt, Homo sapiens
augaagaugucuaauaguuau

SEQ ID NO: 1433655 - RNA, 21 nt, Homo sapiens
augaagauucuccugugcuag

SEQ ID NO: 1433656 - RNA, 15 nt, Homo sapiens
augaaggcgugcaag

SEQ ID NO: 1433657 - RNA, 12 nt, Homo sapiens
augaagugcaaa

SEQ ID NO: 1433658 - RNA, 19 nt, Homo sapiens
augaaucaaagacauggaa

SEQ ID NO: 1433659 - RNA, 17 nt, Homo sapiens
augaaugauguuuuaga

SEQ ID NO: 1433660 - RNA, 12 nt, Homo sapiens
augaaugcacac

SEQ ID NO: 1433661 - RNA, 19 nt, Homo sapiens
augaauugcauuuuacuuu

SEQ ID NO: 1433662 - RNA, 12 nt, Homo sapiens
augacauguuau

SEQ ID NO: 1433663 - RNA, 13 nt, Homo sapiens
augacccaaagac

SEQ ID NO: 1433664 - RNA, 15 nt, Homo sapiens
augacccaaagacca

SEQ ID NO: 1433665 - RNA, 16 nt, Homo sapiens
augacccaaagaccaa

SEQ ID NO: 1433666 - RNA, 18 nt, Homo sapiens
augaccugaucauuacau

SEQ ID NO: 1433667 - RNA, 22 nt, Homo sapiens
augaccuguuauuaccauuagc

SEQ ID NO: 1433668 - RNA, 13 nt, Homo sapiens
augacucagcaua

SEQ ID NO: 1433669 - RNA, 21 nt, Homo sapiens
augacugcugaaugacauauu

SEQ ID NO: 1433670 - RNA, 23 nt, Homo sapiens
augacuucugccccagcuuuauc

SEQ ID NO: 1433671 - RNA, 19 nt, Homo sapiens
augacuugggcacccccag

SEQ ID NO: 1433672 - RNA, 13 nt, Homo sapiens
augacuuuuccau

SEQ ID NO: 1433673 - RNA, 22 nt, Homo sapiens
augagaaacuuugaucucugcu

SEQ ID NO: 1433674 - RNA, 16 nt, Homo sapiens
augagccgcugugagc

SEQ ID NO: 1433675 - RNA, 13 nt, Homo sapiens
augaggauaucau

SEQ ID NO: 1433676 - RNA, 17 nt, Homo sapiens
augaggauaucaucuuu

SEQ ID NO: 1433677 - RNA, 17 nt, Homo sapiens
augaguuuaucauguca

SEQ ID NO: 1433678 - RNA, 16 nt, Homo sapiens
augauaacugcaauuu

SEQ ID NO: 1433679 - RNA, 17 nt, Homo sapiens
augauauuuuaugcaaa

SEQ ID NO: 1433680 - RNA, 19 nt, Homo sapiens
augaugagcuccucuuccu

SEQ ID NO: 1433681 - RNA, 19 nt, Homo sapiens
augauucagaaauuuucau

SEQ ID NO: 1433682 - RNA, 14 nt, Homo sapiens
augauucauaacaa

SEQ ID NO: 1433683 - RNA, 19 nt, Homo sapiens
augauuucaugcuaucucu

SEQ ID NO: 1433684 - RNA, 17 nt, Homo sapiens
augcaaaaaaucuucca

SEQ ID NO: 1433685 - RNA, 14 nt, Homo sapiens
augcaaagcacuga

SEQ ID NO: 1433686 - RNA, 13 nt, Homo sapiens
augcaaaugccuc

SEQ ID NO: 1433687 - RNA, 18 nt, Homo sapiens
augcaagaguggacugaa

SEQ ID NO: 1433688 - RNA, 21 nt, Homo sapiens
augcacacaaacaccuccuag

SEQ ID NO: 1433689 - RNA, 15 nt, Homo sapiens
augcacacacacgga

SEQ ID NO: 1433690 - RNA, 13 nt, Homo sapiens
augcacacacaga

SEQ ID NO: 1433691 - RNA, 20 nt, Homo sapiens
augcacacacagaugcacac

SEQ ID NO: 1433692 - RNA, 15 nt, Homo sapiens
augcacaccaaaaaa

SEQ ID NO: 1433693 - RNA, 16 nt, Homo sapiens
augcacagagauaugc

SEQ ID NO: 1433694 - RNA, 18 nt, Homo sapiens
augcacagagauaugcac

SEQ ID NO: 1433695 - RNA, 19 nt, Homo sapiens
augcacauccauucccaag

SEQ ID NO: 1433696 - RNA, 21 nt, Homo sapiens
augcacgcacaugccaaugca

SEQ ID NO: 1433697 - RNA, 22 nt, Homo sapiens
augcagccacugugcugaauuc

SEQ ID NO: 1433698 - RNA, 18 nt, Homo sapiens
augcagccuucuuuucaa

SEQ ID NO: 1433699 - RNA, 14 nt, Homo sapiens
augcauucauccaa

SEQ ID NO: 1433700 - RNA, 21 nt, Homo sapiens
augccacccucuccaugccca

SEQ ID NO: 1433701 - RNA, 14 nt, Homo sapiens
augccacuucccag

SEQ ID NO: 1433702 - RNA, 13 nt, Homo sapiens
augccaucuguuu

SEQ ID NO: 1433703 - RNA, 15 nt, Homo sapiens
augccuauaccugaa

SEQ ID NO: 1433704 - RNA, 16 nt, Homo sapiens
augccuccaagccauu

SEQ ID NO: 1433705 - RNA, 16 nt, Homo sapiens
augccucuguauuuaa

SEQ ID NO: 1433706 - RNA, 15 nt, Homo sapiens
augccuuaagccaau

SEQ ID NO: 1433707 - RNA, 16 nt, Homo sapiens
augcgcacaaggcuga

SEQ ID NO: 1433708 - RNA, 13 nt, Homo sapiens
augcuauauugca

SEQ ID NO: 1433709 - RNA, 23 nt, Homo sapiens
augcugaaaaucaaaguaaaaaa

SEQ ID NO: 1433710 - RNA, 21 nt, Homo sapiens
augcugggccaguuccuccaa

SEQ ID NO: 1433711 - RNA, 21 nt, Homo sapiens
augcuguuuuaaaaacaaaga

SEQ ID NO: 1433712 - RNA, 14 nt, Homo sapiens
augcuucaguugua

SEQ ID NO: 1433713 - RNA, 11 nt, Homo sapiens
augcuuuacaa

SEQ ID NO: 1433714 - RNA, 21 nt, Homo sapiens
augcuuuccuuuucuuccuuc

SEQ ID NO: 1433715 - RNA, 15 nt, Homo sapiens
augcuuugcuucaaa

SEQ ID NO: 1433716 - RNA, 16 nt, Homo sapiens
auggaagaaaugggag

SEQ ID NO: 1433717 - RNA, 15 nt, Homo sapiens
auggaagugucugga

SEQ ID NO: 1433718 - RNA, 16 nt, Homo sapiens
auggaauaaagcccuu

SEQ ID NO: 1433719 - RNA, 20 nt, Homo sapiens
auggaauuucucccagucau

SEQ ID NO: 1433720 - RNA, 15 nt, Homo sapiens
auggacucaguuuuc

SEQ ID NO: 1433721 - RNA, 19 nt, Homo sapiens
auggagaggcggccucgug

SEQ ID NO: 1433722 - RNA, 21 nt, Homo sapiens
auggagauauuuacaugaauu

SEQ ID NO: 1433723 - RNA, 14 nt, Homo sapiens
auggaugagcacac

SEQ ID NO: 1433724 - RNA, 21 nt, Homo sapiens
auggcacauggcuggcacuga

SEQ ID NO: 1433725 - RNA, 14 nt, Homo sapiens
auggccucuggcca

SEQ ID NO: 1433726 - RNA, 16 nt, Homo sapiens
auggcuauaggugcua

SEQ ID NO: 1433727 - RNA, 18 nt, Homo sapiens
auggcucuggcaccacua

SEQ ID NO: 1433728 - RNA, 16 nt, Homo sapiens
auggcuggcacugagc

SEQ ID NO: 1433729 - RNA, 22 nt, Homo sapiens
auggcuuaauguuuauuccuga

SEQ ID NO: 1433730 - RNA, 17 nt, Homo sapiens
augggaacaaggcaaug

SEQ ID NO: 1433731 - RNA, 13 nt, Homo sapiens
augggacugagcc

SEQ ID NO: 1433732 - RNA, 18 nt, Homo sapiens
augggaucccaggccagg

SEQ ID NO: 1433733 - RNA, 17 nt, Homo sapiens
augggauucagugcuuc

SEQ ID NO: 1433734 - RNA, 20 nt, Homo sapiens
auggggguggggaggcaaga

SEQ ID NO: 1433735 - RNA, 15 nt, Homo sapiens
augguagcaaaacaa

SEQ ID NO: 1433736 - RNA, 21 nt, Homo sapiens
augguaugcuggccagcaccc

SEQ ID NO: 1433737 - RNA, 21 nt, Homo sapiens
auggucacgagguccagaccc

SEQ ID NO: 1433738 - RNA, 17 nt, Homo sapiens
augguccuccauuucaa

SEQ ID NO: 1433739 - RNA, 18 nt, Homo sapiens
augguccuggaggaugac

SEQ ID NO: 1433740 - RNA, 14 nt, Homo sapiens
auggugggaacccu

SEQ ID NO: 1433741 - RNA, 17 nt, Homo sapiens
augguuaccgaggaccc

SEQ ID NO: 1433742 - RNA, 21 nt, Homo sapiens
auguaaaauaaguauuuccau

SEQ ID NO: 1433743 - RNA, 16 nt, Homo sapiens
auguaaaugccacaaa

SEQ ID NO: 1433744 - RNA, 15 nt, Homo sapiens
auguaacgaauggua

SEQ ID NO: 1433745 - RNA, 22 nt, Homo sapiens
auguaauaaaucugagccuaaa

SEQ ID NO: 1433746 - RNA, 22 nt, Homo sapiens
auguacacacacagaugcacac

SEQ ID NO: 1433747 - RNA, 18 nt, Homo sapiens
auguaccacugagccuga

SEQ ID NO: 1433748 - RNA, 18 nt, Homo sapiens
auguacgaaacuguauga

SEQ ID NO: 1433749 - RNA, 19 nt, Homo sapiens
auguaggcaauacauguau

SEQ ID NO: 1433750 - RNA, 18 nt, Homo sapiens
auguaggguaaggugccu

SEQ ID NO: 1433751 - RNA, 22 nt, Homo sapiens
auguagugugucagaguaacau

SEQ ID NO: 1433752 - RNA, 17 nt, Homo sapiens
auguauaaagacaccuu

SEQ ID NO: 1433753 - RNA, 17 nt, Homo sapiens
auguaucuaccaucuaa

SEQ ID NO: 1433754 - RNA, 22 nt, Homo sapiens
auguaucuaccucacuauucaa

SEQ ID NO: 1433755 - RNA, 13 nt, Homo sapiens
auguaugcauuca

SEQ ID NO: 1433756 - RNA, 17 nt, Homo sapiens
auguauuggaacauguc

SEQ ID NO: 1433757 - RNA, 17 nt, Homo sapiens
auguauuuuugucauag

SEQ ID NO: 1433758 - RNA, 13 nt, Homo sapiens
augucaccucagc

SEQ ID NO: 1433759 - RNA, 14 nt, Homo sapiens
augucagagccagg

SEQ ID NO: 1433760 - RNA, 23 nt, Homo sapiens
augucaucaaauauuaccaaaaa

SEQ ID NO: 1433761 - RNA, 15 nt, Homo sapiens
auguccaaguccaac

SEQ ID NO: 1433762 - RNA, 22 nt, Homo sapiens
auguccagaagaauauucagga

SEQ ID NO: 1433763 - RNA, 23 nt, Homo sapiens
augucccuugcugugagcaagaa

SEQ ID NO: 1433764 - RNA, 18 nt, Homo sapiens
augucuaaauggcuuuaa

SEQ ID NO: 1433765 - RNA, 12 nt, Homo sapiens
augucuagcuca

SEQ ID NO: 1433766 - RNA, 21 nt, Homo sapiens
augucucucagaauucuucag

SEQ ID NO: 1433767 - RNA, 17 nt, Homo sapiens
augucugccacagagag

SEQ ID NO: 1433768 - RNA, 19 nt, Homo sapiens
augucuuuuauuuacuuuu

SEQ ID NO: 1433769 - RNA, 19 nt, Homo sapiens
augugagcugucacugugg

SEQ ID NO: 1433770 - RNA, 19 nt, Homo sapiens
augugcgugcauguguaua

SEQ ID NO: 1433771 - RNA, 16 nt, Homo sapiens
augugcuauugaacug

SEQ ID NO: 1433772 - RNA, 17 nt, Homo sapiens
auguggauuagcuagaa

SEQ ID NO: 1433773 - RNA, 18 nt, Homo sapiens
auguggcaaagugcugua

SEQ ID NO: 1433774 - RNA, 19 nt, Homo sapiens
auguguaagcauuguauac

SEQ ID NO: 1433775 - RNA, 12 nt, Homo sapiens
auguguauauau

SEQ ID NO: 1433776 - RNA, 17 nt, Homo sapiens
augugugacuccagccu

SEQ ID NO: 1433777 - RNA, 11 nt, Homo sapiens
auguguugccu

SEQ ID NO: 1433778 - RNA, 15 nt, Homo sapiens
auguguuguacaaua

SEQ ID NO: 1433779 - RNA, 21 nt, Homo sapiens
auguuagauuccucuugccuc

SEQ ID NO: 1433780 - RNA, 19 nt, Homo sapiens
auguuaggaaaauuucaca

SEQ ID NO: 1433781 - RNA, 14 nt, Homo sapiens
auguucaacuggag

SEQ ID NO: 1433782 - RNA, 19 nt, Homo sapiens
auguuccaauaaaacuuua

SEQ ID NO: 1433783 - RNA, 19 nt, Homo sapiens
auguuccucugucaaugaa

SEQ ID NO: 1433784 - RNA, 18 nt, Homo sapiens
auguuuacagacugugag

SEQ ID NO: 1433785 - RNA, 13 nt, Homo sapiens
auuaaaagaaucc

SEQ ID NO: 1433786 - RNA, 16 nt, Homo sapiens
auuaaaaucuggaaau

SEQ ID NO: 1433787 - RNA, 13 nt, Homo sapiens
auuaaacacugua

SEQ ID NO: 1433788 - RNA, 15 nt, Homo sapiens
auuaacaaaagauuc

SEQ ID NO: 1433789 - RNA, 21 nt, Homo sapiens
auuaacaaaauauucuguaag

SEQ ID NO: 1433790 - RNA, 20 nt, Homo sapiens
auuaaccugaauuauuccaa

SEQ ID NO: 1433791 - RNA, 16 nt, Homo sapiens
auuaagauacacuccu

SEQ ID NO: 1433792 - RNA, 14 nt, Homo sapiens
auuaagcaacacaa

SEQ ID NO: 1433793 - RNA, 12 nt, Homo sapiens
auuaagugcaau

SEQ ID NO: 1433794 - RNA, 13 nt, Homo sapiens
auuaauauuugcu

SEQ ID NO: 1433795 - RNA, 23 nt, Homo sapiens
auuaauguuaauucagcacugau

SEQ ID NO: 1433796 - RNA, 17 nt, Homo sapiens
auuacacuuugaaguau

SEQ ID NO: 1433797 - RNA, 16 nt, Homo sapiens
auuacaguagugcauu

SEQ ID NO: 1433798 - RNA, 22 nt, Homo sapiens
auuacaguccguccaccaccuc

SEQ ID NO: 1433799 - RNA, 17 nt, Homo sapiens
auuacauggcugugguu

SEQ ID NO: 1433800 - RNA, 19 nt, Homo sapiens
auuaccuccuguguggaag

SEQ ID NO: 1433801 - RNA, 21 nt, Homo sapiens
auuagaaacugaaaacuguaa

SEQ ID NO: 1433802 - RNA, 17 nt, Homo sapiens
auuagaaggcaaguuuc

SEQ ID NO: 1433803 - RNA, 17 nt, Homo sapiens
auuagaaugcauguaag

SEQ ID NO: 1433804 - RNA, 21 nt, Homo sapiens
auuagagagggcuaaacaagg

SEQ ID NO: 1433805 - RNA, 15 nt, Homo sapiens
auuagcucuggacca

SEQ ID NO: 1433806 - RNA, 23 nt, Homo sapiens
auuagcuguaaauacaugugugg

SEQ ID NO: 1433807 - RNA, 13 nt, Homo sapiens
auuaggcaugccu

SEQ ID NO: 1433808 - RNA, 14 nt, Homo sapiens
auuaggcaugccua

SEQ ID NO: 1433809 - RNA, 16 nt, Homo sapiens
auuauauaguaaugca

SEQ ID NO: 1433810 - RNA, 21 nt, Homo sapiens
auuauauaguauaccauacau

SEQ ID NO: 1433811 - RNA, 20 nt, Homo sapiens
auuauauauuccgcacucaa

SEQ ID NO: 1433812 - RNA, 16 nt, Homo sapiens
auuauaucuucaggac

SEQ ID NO: 1433813 - RNA, 22 nt, Homo sapiens
auuauaugacaauccugaagaa

SEQ ID NO: 1433814 - RNA, 17 nt, Homo sapiens
auuaucacgcagaucac

SEQ ID NO: 1433815 - RNA, 19 nt, Homo sapiens
auuauuccacucaauaugu

SEQ ID NO: 1433816 - RNA, 21 nt, Homo sapiens
auuauucccauucuacauacu

SEQ ID NO: 1433817 - RNA, 23 nt, Homo sapiens
auuauuuauugucggaagacuug

SEQ ID NO: 1433818 - RNA, 17 nt, Homo sapiens
auucaaacugccuauau

SEQ ID NO: 1433819 - RNA, 16 nt, Homo sapiens
auucaaugaucuuaga

SEQ ID NO: 1433820 - RNA, 24 nt, Homo sapiens
auucaaugaucuuagaaguacuga

SEQ ID NO: 1433821 - RNA, 14 nt, Homo sapiens
auucacagccagga

SEQ ID NO: 1433822 - RNA, 19 nt, Homo sapiens
auucacccuucaacauaaa

SEQ ID NO: 1433823 - RNA, 11 nt, Homo sapiens
auucacuuccc

SEQ ID NO: 1433824 - RNA, 16 nt, Homo sapiens
auucagauugacaagg

SEQ ID NO: 1433825 - RNA, 17 nt, Homo sapiens
auucagcaaagaacaag

SEQ ID NO: 1433826 - RNA, 22 nt, Homo sapiens
auucagcauuauuccuccagga

SEQ ID NO: 1433827 - RNA, 23 nt, Homo sapiens
auucagugcuguacuugaugaca

SEQ ID NO: 1433828 - RNA, 14 nt, Homo sapiens
auucauguggaaua

SEQ ID NO: 1433829 - RNA, 15 nt, Homo sapiens
auucauguggaauau

SEQ ID NO: 1433830 - RNA, 20 nt, Homo sapiens
auucauuuaaaaugauuaga

SEQ ID NO: 1433831 - RNA, 20 nt, Homo sapiens
auucauuucaucuacuacag

SEQ ID NO: 1433832 - RNA, 13 nt, Homo sapiens
auuccaagucaac

SEQ ID NO: 1433833 - RNA, 23 nt, Homo sapiens
auuccauaaccccaggcauccca

SEQ ID NO: 1433834 - RNA, 20 nt, Homo sapiens
auucccagcugucuguguca

SEQ ID NO: 1433835 - RNA, 18 nt, Homo sapiens
auucccccuaagaggcag

SEQ ID NO: 1433836 - RNA, 17 nt, Homo sapiens
auuccccucgugugacu

SEQ ID NO: 1433837 - RNA, 14 nt, Homo sapiens
auucccucuugcua

SEQ ID NO: 1433838 - RNA, 15 nt, Homo sapiens
cuaagccaacuuuaa

SEQ ID NO: 1433839 - RNA, 21 nt, Homo sapiens
cuaagccuguugcugaaguca

SEQ ID NO: 1433840 - RNA, 23 nt, Homo sapiens
cuaagcgaauguguacaaagugu

SEQ ID NO: 1433841 - RNA, 19 nt, Homo sapiens
cuaauauuuuuagcucugu

SEQ ID NO: 1433842 - RNA, 17 nt, Homo sapiens
cuaaucagcauucucac

SEQ ID NO: 1433843 - RNA, 15 nt, Homo sapiens
cuaaucuaugcaugu

SEQ ID NO: 1433844 - RNA, 15 nt, Homo sapiens
cuaaugaaauugaga

SEQ ID NO: 1433845 - RNA, 14 nt, Homo sapiens
cuaauguaugcauu

SEQ ID NO: 1433846 - RNA, 18 nt, Homo sapiens
cuaauguaugcauucauc

SEQ ID NO: 1433847 - RNA, 22 nt, Homo sapiens
cuaauguaugcauucauccaac

SEQ ID NO: 1433848 - RNA, 23 nt, Homo sapiens
cuaaugugccccauguccaaguc

SEQ ID NO: 1433849 - RNA, 18 nt, Homo sapiens
cuaauucccagaguguga

SEQ ID NO: 1433850 - RNA, 17 nt, Homo sapiens
cuaauuuaaaccagcag

SEQ ID NO: 1433851 - RNA, 14 nt, Homo sapiens
cuaauuugaucaca

SEQ ID NO: 1433852 - RNA, 18 nt, Homo sapiens
cuacaagguugugcccuc

SEQ ID NO: 1433853 - RNA, 22 nt, Homo sapiens
cuacacagugggaacucugaca

SEQ ID NO: 1433854 - RNA, 19 nt, Homo sapiens
cuacagauagucaaaccau

SEQ ID NO: 1433855 - RNA, 23 nt, Homo sapiens
cuacaggugcaagccacuauguc

SEQ ID NO: 1433856 - RNA, 18 nt, Homo sapiens
cuaccaagugaccauaaa

SEQ ID NO: 1433857 - RNA, 18 nt, Homo sapiens
cuaccaucuaaucuaugc

SEQ ID NO: 1433858 - RNA, 13 nt, Homo sapiens
cuacccacuucca

SEQ ID NO: 1433859 - RNA, 14 nt, Homo sapiens
cuacccgagcccag

SEQ ID NO: 1433860 - RNA, 23 nt, Homo sapiens
cuacccggcccagagaccccuuc

SEQ ID NO: 1433861 - RNA, 17 nt, Homo sapiens
cuaccuguggugauguu

SEQ ID NO: 1433862 - RNA, 17 nt, Homo sapiens
cuaccuuuguccaggcc

SEQ ID NO: 1433863 - RNA, 14 nt, Homo sapiens
cuacucucuugcca

SEQ ID NO: 1433864 - RNA, 21 nt, Homo sapiens
cuacucugugccagagccugg

SEQ ID NO: 1433865 - RNA, 17 nt, Homo sapiens
cuacugagacaugacua

SEQ ID NO: 1433866 - RNA, 19 nt, Homo sapiens
cuacuucugucuuccuuca

SEQ ID NO: 1433867 - RNA, 17 nt, Homo sapiens
cuacuucuuuugcucuu

SEQ ID NO: 1433868 - RNA, 15 nt, Homo sapiens
cuacuuuuuauacuc

SEQ ID NO: 1433869 - RNA, 20 nt, Homo sapiens
cuagaaaacauuccaaaacu

SEQ ID NO: 1433870 - RNA, 19 nt, Homo sapiens
cuagaacacccacuggcca

SEQ ID NO: 1433871 - RNA, 19 nt, Homo sapiens
cuagaaccaagaagggcua

SEQ ID NO: 1433872 - RNA, 19 nt, Homo sapiens
cuagaaccuggaagggcua

SEQ ID NO: 1433873 - RNA, 18 nt, Homo sapiens
cuagaaccuggagggcua

SEQ ID NO: 1433874 - RNA, 18 nt, Homo sapiens
cuagaaccuguagagcua

SEQ ID NO: 1433875 - RNA, 16 nt, Homo sapiens
cuagaaugguagcacu

SEQ ID NO: 1433876 - RNA, 12 nt, Homo sapiens
cuagaauuauuc

SEQ ID NO: 1433877 - RNA, 12 nt, Homo sapiens
cuagacuuucug

SEQ ID NO: 1433878 - RNA, 14 nt, Homo sapiens
cuagagcucaggcc

SEQ ID NO: 1433879 - RNA, 14 nt, Homo sapiens
cuagagcugggaaa

SEQ ID NO: 1433880 - RNA, 22 nt, Homo sapiens
cuagcaucucaugagugccaag

SEQ ID NO: 1433881 - RNA, 16 nt, Homo sapiens
cuagcauuuucuugaa

SEQ ID NO: 1433882 - RNA, 20 nt, Homo sapiens
cuagccacaucacuacagua

SEQ ID NO: 1433883 - RNA, 12 nt, Homo sapiens
cuaggacauaua

SEQ ID NO: 1433884 - RNA, 18 nt, Homo sapiens
cuaggaguugaguacagu

SEQ ID NO: 1433885 - RNA, 18 nt, Homo sapiens
cuaggcaaagacuggccu

SEQ ID NO: 1433886 - RNA, 21 nt, Homo sapiens
cuaggcugagcuggcauuggu

SEQ ID NO: 1433887 - RNA, 21 nt, Homo sapiens
cuagggcuggagggacaggga

SEQ ID NO: 1433888 - RNA, 17 nt, Homo sapiens
cuaggucaaaacauuca

SEQ ID NO: 1433889 - RNA, 17 nt, Homo sapiens
cuagguucuagguccug

SEQ ID NO: 1433890 - RNA, 17 nt, Homo sapiens
cuaguagcggaucucac

SEQ ID NO: 1433891 - RNA, 20 nt, Homo sapiens
cuaguagcggaucucacuca

SEQ ID NO: 1433892 - RNA, 19 nt, Homo sapiens
cuagucuccuuugcacuga

SEQ ID NO: 1433893 - RNA, 18 nt, Homo sapiens
cuagugacuuccugguga

SEQ ID NO: 1433894 - RNA, 21 nt, Homo sapiens
cuagugccugagaugcacgau

SEQ ID NO: 1433895 - RNA, 22 nt, Homo sapiens
cuaguuuaauuaacuaugugau

SEQ ID NO: 1433896 - RNA, 21 nt, Homo sapiens
cuaguuuauuggaaguguuca

SEQ ID NO: 1433897 - RNA, 20 nt, Homo sapiens
cuaguuugaccucacaguga

SEQ ID NO: 1433898 - RNA, 20 nt, Homo sapiens
cuauaaagguugacaauaaa

SEQ ID NO: 1433899 - RNA, 14 nt, Homo sapiens
cuauauugcacugu

SEQ ID NO: 1433900 - RNA, 15 nt, Homo sapiens
cuaucccaagccaac

SEQ ID NO: 1433901 - RNA, 23 nt, Homo sapiens
cuauccuaaaggcccacuggcau

SEQ ID NO: 1433902 - RNA, 19 nt, Homo sapiens
cuaucuauggcccugcaaa

SEQ ID NO: 1433903 - RNA, 17 nt, Homo sapiens
cuaucuccaaaugagac

SEQ ID NO: 1433904 - RNA, 15 nt, Homo sapiens
cuaucuuuuugcuua

SEQ ID NO: 1433905 - RNA, 23 nt, Homo sapiens
cuaugaucacagugacuuuacag

SEQ ID NO: 1433906 - RNA, 17 nt, Homo sapiens
cuaugcaagccuugcua

SEQ ID NO: 1433907 - RNA, 15 nt, Homo sapiens
cuaugcaauucuuaa

SEQ ID NO: 1433908 - RNA, 15 nt, Homo sapiens
cuaugcccacucuaa

SEQ ID NO: 1433909 - RNA, 15 nt, Homo sapiens
cuauguaugcaucua

SEQ ID NO: 1433910 - RNA, 11 nt, Homo sapiens
cuauguucccu

SEQ ID NO: 1433911 - RNA, 21 nt, Homo sapiens
cuauuaaaagaauccaaauuc

SEQ ID NO: 1433912 - RNA, 20 nt, Homo sapiens
cuauuaaauguauaugucau

SEQ ID NO: 1433913 - RNA, 14 nt, Homo sapiens
cuauuaccaugaga

SEQ ID NO: 1433914 - RNA, 15 nt, Homo sapiens
cuauuauaaaaccau

SEQ ID NO: 1433915 - RNA, 21 nt, Homo sapiens
cuauuauaaaaccauguugau

SEQ ID NO: 1433916 - RNA, 16 nt, Homo sapiens
cuauucagacaagcaa

SEQ ID NO: 1433917 - RNA, 14 nt, Homo sapiens
cuauuccaaagugc

SEQ ID NO: 1433918 - RNA, 22 nt, Homo sapiens
cuauucucuccucagacugcuc

SEQ ID NO: 1433919 - RNA, 14 nt, Homo sapiens
cuauugaacugagc

SEQ ID NO: 1433920 - RNA, 21 nt, Homo sapiens
cuauugguaauaaaccuugau

SEQ ID NO: 1433921 - RNA, 23 nt, Homo sapiens
cuauugguaauaaaccuugaugg

SEQ ID NO: 1433922 - RNA, 17 nt, Homo sapiens
cuauuuaacuugagggu

SEQ ID NO: 1433923 - RNA, 23 nt, Homo sapiens
cuauuuauuauaaauuaugagau

SEQ ID NO: 1433924 - RNA, 13 nt, Homo sapiens
cuauuuauuucac

SEQ ID NO: 1433925 - RNA, 20 nt, Homo sapiens
cuauuucauuuuuugcauca

SEQ ID NO: 1433926 - RNA, 15 nt, Homo sapiens
cuauuuccaccauca

SEQ ID NO: 1433927 - RNA, 19 nt, Homo sapiens
cuauuugcacuguagccuc

SEQ ID NO: 1433928 - RNA, 15 nt, Homo sapiens
cuauuuguucagaga

SEQ ID NO: 1433929 - RNA, 17 nt, Homo sapiens
cuauuuguuuacaugca

SEQ ID NO: 1433930 - RNA, 18 nt, Homo sapiens
cuauuuguuuacaugcag

SEQ ID NO: 1433931 - RNA, 22 nt, Homo sapiens
cucaaaauaccaugccauuuaa

SEQ ID NO: 1433932 - RNA, 23 nt, Homo sapiens
cucaaacuccugaccuugugauu

SEQ ID NO: 1433933 - RNA, 20 nt, Homo sapiens
cucaaauccuugagcacuca

SEQ ID NO: 1433934 - RNA, 23 nt, Homo sapiens
cucaaaucuauucagacaagcaa

SEQ ID NO: 1433935 - RNA, 20 nt, Homo sapiens
cucaaaugacccaaagacca

SEQ ID NO: 1433936 - RNA, 17 nt, Homo sapiens
cucaaaugcugggggua

SEQ ID NO: 1433937 - RNA, 14 nt, Homo sapiens
cucaaccuauggua

SEQ ID NO: 1433938 - RNA, 13 nt, Homo sapiens
cucaagacugaaa

SEQ ID NO: 1433939 - RNA, 23 nt, Homo sapiens
cucaaguuuuucagaaagcauua

SEQ ID NO: 1433940 - RNA, 17 nt, Homo sapiens
cucaaucacugcucccc

SEQ ID NO: 1433941 - RNA, 18 nt, Homo sapiens
cucacaaaccaugcaaau

SEQ ID NO: 1433942 - RNA, 22 nt, Homo sapiens
cucacaggagcagacagagaaa

SEQ ID NO: 1433943 - RNA, 20 nt, Homo sapiens
cucacauagcuacccaaaag

SEQ ID NO: 1433944 - RNA, 18 nt, Homo sapiens
cucacaucagagugacau

SEQ ID NO: 1433945 - RNA, 18 nt, Homo sapiens
cucacccuguaccacaaa

SEQ ID NO: 1433946 - RNA, 20 nt, Homo sapiens
cucaccgggcuacuaccugg

SEQ ID NO: 1433947 - RNA, 19 nt, Homo sapiens
cucacuauucaaguauuag

SEQ ID NO: 1433948 - RNA, 12 nt, Homo sapiens
cucacucaggac

SEQ ID NO: 1433949 - RNA, 13 nt, Homo sapiens
cucacucaggacu

SEQ ID NO: 1433950 - RNA, 15 nt, Homo sapiens
cucacuccaccaccc

SEQ ID NO: 1433951 - RNA, 20 nt, Homo sapiens
cucacucggcuuccagggag

SEQ ID NO: 1433952 - RNA, 12 nt, Homo sapiens
cucacucuguca

SEQ ID NO: 1433953 - RNA, 17 nt, Homo sapiens
cucagaacaauccgauu

SEQ ID NO: 1433954 - RNA, 23 nt, Homo sapiens
cucagacagaaccccuacaugaa

SEQ ID NO: 1433955 - RNA, 14 nt, Homo sapiens
cucagacauuccaa

SEQ ID NO: 1433956 - RNA, 15 nt, Homo sapiens
cucagagcaggcuca

SEQ ID NO: 1433957 - RNA, 18 nt, Homo sapiens
cucagaucugaacacagu

SEQ ID NO: 1433958 - RNA, 15 nt, Homo sapiens
cucagcaccccuguc

SEQ ID NO: 1433959 - RNA, 14 nt, Homo sapiens
cucagcauaccugc

SEQ ID NO: 1433960 - RNA, 15 nt, Homo sapiens
cucagccgugcacuc

SEQ ID NO: 1433961 - RNA, 22 nt, Homo sapiens
cucagccgugcacucccuaaga

SEQ ID NO: 1433962 - RNA, 20 nt, Homo sapiens
cucagcuccagaauaccuuc

SEQ ID NO: 1433963 - RNA, 15 nt, Homo sapiens
cucagcugcacauuc

SEQ ID NO: 1433964 - RNA, 16 nt, Homo sapiens
cucagcugcacauucc

SEQ ID NO: 1433965 - RNA, 17 nt, Homo sapiens
cucagcugcacauuccu

SEQ ID NO: 1433966 - RNA, 22 nt, Homo sapiens
cucaggauccagucccuuacac

SEQ ID NO: 1433967 - RNA, 15 nt, Homo sapiens
cucagggaaacuugc

SEQ ID NO: 1433968 - RNA, 16 nt, Homo sapiens
cucagguagauuuugu

SEQ ID NO: 1433969 - RNA, 15 nt, Homo sapiens
cucagguucuuucca

SEQ ID NO: 1433970 - RNA, 12 nt, Homo sapiens
cucagugccacu

SEQ ID NO: 1433971 - RNA, 13 nt, Homo sapiens
cucagugggacaa

SEQ ID NO: 1433972 - RNA, 21 nt, Homo sapiens
cucagugggacaaaccagagc

SEQ ID NO: 1433973 - RNA, 13 nt, Homo sapiens
cucaguuccugcc

SEQ ID NO: 1433974 - RNA, 17 nt, Homo sapiens
cucauacuuaagcaaaa

SEQ ID NO: 1433975 - RNA, 21 nt, Homo sapiens
cucauauuuaaagacagggaa

SEQ ID NO: 1433976 - RNA, 14 nt, Homo sapiens
cucaucauuccuug

SEQ ID NO: 1433977 - RNA, 17 nt, Homo sapiens
cucaucccuguuccuca

SEQ ID NO: 1433978 - RNA, 14 nt, Homo sapiens
cucauccuccuucu

SEQ ID NO: 1433979 - RNA, 17 nt, Homo sapiens
cucaugcugagcgcugu

SEQ ID NO: 1433980 - RNA, 16 nt, Homo sapiens
cucauucuguugccca

SEQ ID NO: 1433981 - RNA, 19 nt, Homo sapiens
cucauuuaauccucccuuc

SEQ ID NO: 1433982 - RNA, 14 nt, Homo sapiens
cuccaaacauuacu

SEQ ID NO: 1433983 - RNA, 21 nt, Homo sapiens
cuccaaaugagacacauuaaa

SEQ ID NO: 1433984 - RNA, 21 nt, Homo sapiens
cuccacaccaaagucagggag

SEQ ID NO: 1433985 - RNA, 18 nt, Homo sapiens
cuccacaguuuugccuua

SEQ ID NO: 1433986 - RNA, 22 nt, Homo sapiens
cuccacauccaccccacuggau

SEQ ID NO: 1433987 - RNA, 18 nt, Homo sapiens
cuccaccaacccaucaga

SEQ ID NO: 1433988 - RNA, 18 nt, Homo sapiens
cuccaccuugcucuucuu

SEQ ID NO: 1433989 - RNA, 21 nt, Homo sapiens
cuccaccuuguuacacauuau

SEQ ID NO: 1433990 - RNA, 19 nt, Homo sapiens
cuccacgguagcacuugac

SEQ ID NO: 1433991 - RNA, 16 nt, Homo sapiens
cuccacuccaccucca

SEQ ID NO: 1433992 - RNA, 16 nt, Homo sapiens
cuccacugccuucgau

SEQ ID NO: 1433993 - RNA, 13 nt, Homo sapiens
cuccacugucaca

SEQ ID NO: 1433994 - RNA, 23 nt, Homo sapiens
cuccagaauggucuuucuaaugu

SEQ ID NO: 1433995 - RNA, 15 nt, Homo sapiens
cuccagcacucccuc

SEQ ID NO: 1433996 - RNA, 22 nt, Homo sapiens
cuccagccagcaaugaugucca

SEQ ID NO: 1433997 - RNA, 13 nt, Homo sapiens
cuccagcuccagu

SEQ ID NO: 1433998 - RNA, 17 nt, Homo sapiens
cuccaggaaggggaguu

SEQ ID NO: 1433999 - RNA, 14 nt, Homo sapiens
cuccaggcucuuug

SEQ ID NO: 1434000 - RNA, 17 nt, Homo sapiens
cuccagugguugcuguu

SEQ ID NO: 1434001 - RNA, 18 nt, Homo sapiens
cuccaguguuacuuuuaa

SEQ ID NO: 1434002 - RNA, 17 nt, Homo sapiens
cuccauacauaacuuga

SEQ ID NO: 1434003 - RNA, 18 nt, Homo sapiens
cuccauacauaacuugau

SEQ ID NO: 1434004 - RNA, 15 nt, Homo sapiens
cuccaucuccagugg

SEQ ID NO: 1434005 - RNA, 14 nt, Homo sapiens
cuccauucugacca

SEQ ID NO: 1434006 - RNA, 15 nt, Homo sapiens
cucccaaggcucuga

SEQ ID NO: 1434007 - RNA, 19 nt, Homo sapiens
cucccaaggcucugagcaa

SEQ ID NO: 1434008 - RNA, 14 nt, Homo sapiens
cucccacagaggag

SEQ ID NO: 1434009 - RNA, 15 nt, Homo sapiens
cucccagcccuaugg

SEQ ID NO: 1434010 - RNA, 15 nt, Homo sapiens
cucccagucauuuaa

SEQ ID NO: 1434011 - RNA, 20 nt, Homo sapiens
cucccauaagcuaagccuua

SEQ ID NO: 1434012 - RNA, 15 nt, Homo sapiens
cucccauagcacugc

SEQ ID NO: 1434013 - RNA, 16 nt, Homo sapiens
cucccaugcacacaaa

SEQ ID NO: 1434014 - RNA, 18 nt, Homo sapiens
cuccccaaacccaucaga

SEQ ID NO: 1434015 - RNA, 21 nt, Homo sapiens
cuccccacaccucccuacucc

SEQ ID NO: 1434016 - RNA, 18 nt, Homo sapiens
cuccccacaguccucaca

SEQ ID NO: 1434017 - RNA, 13 nt, Homo sapiens
cuccccacucuag

SEQ ID NO: 1434018 - RNA, 14 nt, Homo sapiens
cuccccucauggag

SEQ ID NO: 1434019 - RNA, 16 nt, Homo sapiens
cucccgggagcacaga

SEQ ID NO: 1434020 - RNA, 22 nt, Homo sapiens
cucccuaaaauaaaaaccagaa

SEQ ID NO: 1434021 - RNA, 19 nt, Homo sapiens
cucccuaaggaaucugaaa

SEQ ID NO: 1434022 - RNA, 13 nt, Homo sapiens
cucccucauucca

SEQ ID NO: 1434023 - RNA, 15 nt, Homo sapiens
cucccucauuccacc

SEQ ID NO: 1434024 - RNA, 15 nt, Homo sapiens
cucccuggcauguca

SEQ ID NO: 1434025 - RNA, 14 nt, Homo sapiens
cucccuguccuccu

SEQ ID NO: 1434026 - RNA, 18 nt, Homo sapiens
cucccuguguggcugcug

SEQ ID NO: 1434027 - RNA, 18 nt, Homo sapiens
cucccuguuaucugcuag

SEQ ID NO: 1434028 - RNA, 11 nt, Homo sapiens
cuccgaauaaa

SEQ ID NO: 1434029 - RNA, 19 nt, Homo sapiens
cuccggggucugugcugug

SEQ ID NO: 1434030 - RNA, 15 nt, Homo sapiens
cuccuaagacaccug

SEQ ID NO: 1434031 - RNA, 15 nt, Homo sapiens
cuccuagcaagaccu

SEQ ID NO: 1434032 - RNA, 21 nt, Homo sapiens
cuccuauuuaugaaaaccaua

SEQ ID NO: 1434033 - RNA, 12 nt, Homo sapiens
cuccucaaaagc

SEQ ID NO: 1434034 - RNA, 18 nt, Homo sapiens
cuccuccaucucuggcca

SEQ ID NO: 1434035 - RNA, 20 nt, Homo sapiens
cuccugagcucaagugaucc

SEQ ID NO: 1434036 - RNA, 14 nt, Homo sapiens
cuccugccuacuca

SEQ ID NO: 1434037 - RNA, 18 nt, Homo sapiens
cuccuggucugugcugcc

SEQ ID NO: 1434038 - RNA, 20 nt, Homo sapiens
cuccugugcuagaugugcaa

SEQ ID NO: 1434039 - RNA, 15 nt, Homo sapiens
cuccuguguacaggg

SEQ ID NO: 1434040 - RNA, 16 nt, Homo sapiens
cuccuguugcaaugac

SEQ ID NO: 1434041 - RNA, 15 nt, Homo sapiens
cuccuguuuccaugg

SEQ ID NO: 1434042 - RNA, 20 nt, Homo sapiens
cuccuuaauagccauaugca

SEQ ID NO: 1434043 - RNA, 12 nt, Homo sapiens
cuccuugcacuu

SEQ ID NO: 1434044 - RNA, 10 nt, Homo sapiens
cuccuugccu

SEQ ID NO: 1434045 - RNA, 18 nt, Homo sapiens
cuccuuuaccuaccaccu

SEQ ID NO: 1434046 - RNA, 17 nt, Homo sapiens
cuccuuuggccauucca

SEQ ID NO: 1434047 - RNA, 13 nt, Homo sapiens
cuccuuuugacca

SEQ ID NO: 1434048 - RNA, 16 nt, Homo sapiens
cucgaggcucuuccau

SEQ ID NO: 1434049 - RNA, 16 nt, Homo sapiens
cucgaugaagcccaau

SEQ ID NO: 1434050 - RNA, 21 nt, Homo sapiens
cucgcaguacauguuacuugu

SEQ ID NO: 1434051 - RNA, 18 nt, Homo sapiens
cucgccuuuuaggcucag

SEQ ID NO: 1434052 - RNA, 21 nt, Homo sapiens
cucggagaagagcuguucaca

SEQ ID NO: 1434053 - RNA, 18 nt, Homo sapiens
cucggcaccuccccggcc

SEQ ID NO: 1434054 - RNA, 20 nt, Homo sapiens
cucguauaugucucaggucc

SEQ ID NO: 1434055 - RNA, 13 nt, Homo sapiens
cucgucucaaaaa

SEQ ID NO: 1434056 - RNA, 11 nt, Homo sapiens
cucgugccaug

SEQ ID NO: 1434057 - RNA, 18 nt, Homo sapiens
cucuaacgccugagccca

SEQ ID NO: 1434058 - RNA, 17 nt, Homo sapiens
cucuacaaaaaccaaaa

SEQ ID NO: 1434059 - RNA, 21 nt, Homo sapiens
cucuagaacacccacuggcca

SEQ ID NO: 1434060 - RNA, 14 nt, Homo sapiens
cucuauguaugcau

SEQ ID NO: 1434061 - RNA, 16 nt, Homo sapiens
cucucaagcuagccag

SEQ ID NO: 1434062 - RNA, 17 nt, Homo sapiens
cucucaagcuagccaga

SEQ ID NO: 1434063 - RNA, 15 nt, Homo sapiens
cucucaauaugcuua

SEQ ID NO: 1434064 - RNA, 23 nt, Homo sapiens
cucucaggaucaagaaaguguug

SEQ ID NO: 1434065 - RNA, 18 nt, Homo sapiens
cucucaguuauucagauu

SEQ ID NO: 1434066 - RNA, 13 nt, Homo sapiens
cucuccacuccau

SEQ ID NO: 1434067 - RNA, 14 nt, Homo sapiens
cucuccucuugcca

SEQ ID NO: 1434068 - RNA, 21 nt, Homo sapiens
cucucuggcgcaucaccugau

SEQ ID NO: 1434069 - RNA, 21 nt, Homo sapiens
cucugcaaugggcacugggau

SEQ ID NO: 1434070 - RNA, 23 nt, Homo sapiens
cucugcaaugggcacugggauga

SEQ ID NO: 1434071 - RNA, 12 nt, Homo sapiens
cucugcaucuca

SEQ ID NO: 1434072 - RNA, 13 nt, Homo sapiens
cucugcaucucau

SEQ ID NO: 1434073 - RNA, 20 nt, Homo sapiens
cucugccccuucuguuucca

SEQ ID NO: 1434074 - RNA, 14 nt, Homo sapiens
cucugccuauuuau

SEQ ID NO: 1434075 - RNA, 17 nt, Homo sapiens
cucugccuccucuucaa

SEQ ID NO: 1434076 - RNA, 19 nt, Homo sapiens
cucugccugagacuuucag

SEQ ID NO: 1434077 - RNA, 17 nt, Homo sapiens
cucugcuuuuuccagau

SEQ ID NO: 1434078 - RNA, 11 nt, Homo sapiens
cucuggaccag

SEQ ID NO: 1434079 - RNA, 16 nt, Homo sapiens
cucuggaccagccugu

SEQ ID NO: 1434080 - RNA, 16 nt, Homo sapiens
cucuggagagacugug

SEQ ID NO: 1434081 - RNA, 15 nt, Homo sapiens
cucuggauggcacca

SEQ ID NO: 1434082 - RNA, 22 nt, Homo sapiens
cucuggcggcuuccuguccacu

SEQ ID NO: 1434083 - RNA, 21 nt, Homo sapiens
cucugggcagcugucauggaa

SEQ ID NO: 1434084 - RNA, 12 nt, Homo sapiens
cucugugcuuug

SEQ ID NO: 1434085 - RNA, 18 nt, Homo sapiens
cucugugcuuugacucac

SEQ ID NO: 1434086 - RNA, 14 nt, Homo sapiens
cucuuaauguugcu

SEQ ID NO: 1434087 - RNA, 20 nt, Homo sapiens
cucuuaccgcgagacugaga

SEQ ID NO: 1434088 - RNA, 12 nt, Homo sapiens
cucuucaaagac

SEQ ID NO: 1434089 - RNA, 15 nt, Homo sapiens
cucuucaacugacca

SEQ ID NO: 1434090 - RNA, 19 nt, Homo sapiens
cucuucaacugaccagccu

SEQ ID NO: 1434091 - RNA, 22 nt, Homo sapiens
cucuucagaauauggacaaaga

SEQ ID NO: 1434092 - RNA, 19 nt, Homo sapiens
cucuuccagaagaugcccu

SEQ ID NO: 1434093 - RNA, 19 nt, Homo sapiens
cucuucccccacuccucuu

SEQ ID NO: 1434094 - RNA, 18 nt, Homo sapiens
cucuuccccuugcccuug

SEQ ID NO: 1434095 - RNA, 22 nt, Homo sapiens
cucuuccuacccaaccacucaa

SEQ ID NO: 1434096 - RNA, 16 nt, Homo sapiens
cucuuccugcaaggac

SEQ ID NO: 1434097 - RNA, 14 nt, Homo sapiens
cucuucuccacugg

SEQ ID NO: 1434098 - RNA, 17 nt, Homo sapiens
cucuucugucugcagug

SEQ ID NO: 1434099 - RNA, 22 nt, Homo sapiens
cucuugagguggugccuucuca

SEQ ID NO: 1434100 - RNA, 14 nt, Homo sapiens
cucuuggcauuuuc

SEQ ID NO: 1434101 - RNA, 19 nt, Homo sapiens
cucuuuagcauugaagugu

SEQ ID NO: 1434102 - RNA, 13 nt, Homo sapiens
cucuuucuugacu

SEQ ID NO: 1434103 - RNA, 17 nt, Homo sapiens
cucuuuucccacauuca

SEQ ID NO: 1434104 - RNA, 20 nt, Homo sapiens
cucuuuucccucucuaggcc

SEQ ID NO: 1434105 - RNA, 13 nt, Homo sapiens
cugaaaauucugu

SEQ ID NO: 1434106 - RNA, 20 nt, Homo sapiens
cugaaacauucacacagggc

SEQ ID NO: 1434107 - RNA, 15 nt, Homo sapiens
cugaaagccauuugu

SEQ ID NO: 1434108 - RNA, 19 nt, Homo sapiens
cugaaaggcacacuuugau

SEQ ID NO: 1434109 - RNA, 21 nt, Homo sapiens
cugaaagucuguguccaauua

SEQ ID NO: 1434110 - RNA, 15 nt, Homo sapiens
cugaaagugguuuga

SEQ ID NO: 1434111 - RNA, 22 nt, Homo sapiens
cugaaauugcguucuaagaggu

SEQ ID NO: 1434112 - RNA, 12 nt, Homo sapiens
cugaacagccaa

SEQ ID NO: 1434113 - RNA, 18 nt, Homo sapiens
cugaaccaucccugaugu

SEQ ID NO: 1434114 - RNA, 17 nt, Homo sapiens
cugaaccauuacuguaa

SEQ ID NO: 1434115 - RNA, 15 nt, Homo sapiens
cugaacccauuuuga

SEQ ID NO: 1434116 - RNA, 20 nt, Homo sapiens
cugaagaacaguaacugcca

SEQ ID NO: 1434117 - RNA, 22 nt, Homo sapiens
cugaagaacaguaacugccauc

SEQ ID NO: 1434118 - RNA, 16 nt, Homo sapiens
cugaagccagauccac

SEQ ID NO: 1434119 - RNA, 21 nt, Homo sapiens
cugaagcugacagcacuacaa

SEQ ID NO: 1434120 - RNA, 22 nt, Homo sapiens
cugaagcugacagcacuacaaa

SEQ ID NO: 1434121 - RNA, 20 nt, Homo sapiens
cugaaggaauagccagagag

SEQ ID NO: 1434122 - RNA, 23 nt, Homo sapiens
cugaaggacgcgccaggggaguu

SEQ ID NO: 1434123 - RNA, 19 nt, Homo sapiens
cugaagggugacaucccag

SEQ ID NO: 1434124 - RNA, 20 nt, Homo sapiens
cugaauguauugaacuugga

SEQ ID NO: 1434125 - RNA, 20 nt, Homo sapiens
cugaauuuuaaauguucaca

SEQ ID NO: 1434126 - RNA, 13 nt, Homo sapiens
cugacaagcacug

SEQ ID NO: 1434127 - RNA, 12 nt, Homo sapiens
cugacacaggaa

SEQ ID NO: 1434128 - RNA, 14 nt, Homo sapiens
cugacaggccuucu

SEQ ID NO: 1434129 - RNA, 11 nt, Homo sapiens
cugacaucucc

SEQ ID NO: 1434130 - RNA, 13 nt, Homo sapiens
cugacaugucuca

SEQ ID NO: 1434131 - RNA, 22 nt, Homo sapiens
cugacauuaagacacaccucug

SEQ ID NO: 1434132 - RNA, 15 nt, Homo sapiens
cugaccaagagagaa

SEQ ID NO: 1434133 - RNA, 13 nt, Homo sapiens
cugacccacagcc

SEQ ID NO: 1434134 - RNA, 18 nt, Homo sapiens
cugaccccugcaccagcc

SEQ ID NO: 1434135 - RNA, 14 nt, Homo sapiens
cugacgacacugaa

SEQ ID NO: 1434136 - RNA, 18 nt, Homo sapiens
cugacuuaaguggcauua

SEQ ID NO: 1434137 - RNA, 20 nt, Homo sapiens
cugacuuaaguggcauuaaa

SEQ ID NO: 1434138 - RNA, 15 nt, Homo sapiens
cugagaagacaauau

SEQ ID NO: 1434139 - RNA, 16 nt, Homo sapiens
cugagagcucacagua

SEQ ID NO: 1434140 - RNA, 20 nt, Homo sapiens
cugagagucugaaagacaga

SEQ ID NO: 1434141 - RNA, 13 nt, Homo sapiens
cugagcaggauuu

SEQ ID NO: 1434142 - RNA, 21 nt, Homo sapiens
cugagcccugguguguuucca

SEQ ID NO: 1434143 - RNA, 19 nt, Homo sapiens
cugagccuggcccauagaa

SEQ ID NO: 1434144 - RNA, 15 nt, Homo sapiens
cugagcgcuguguua

SEQ ID NO: 1434145 - RNA, 13 nt, Homo sapiens
cugagcucugaga

SEQ ID NO: 1434146 - RNA, 14 nt, Homo sapiens
cugaggacauggag

SEQ ID NO: 1434147 - RNA, 20 nt, Homo sapiens
cugaggcaggagaauggugu

SEQ ID NO: 1434148 - RNA, 21 nt, Homo sapiens
cugaggguccccaccugggac

SEQ ID NO: 1434149 - RNA, 21 nt, Homo sapiens
cugaguagcuaggacuauggg

SEQ ID NO: 1434150 - RNA, 14 nt, Homo sapiens
cugagucaccuccu

SEQ ID NO: 1434151 - RNA, 20 nt, Homo sapiens
cugaguggaaugcagggaag

SEQ ID NO: 1434152 - RNA, 20 nt, Homo sapiens
cugauaaacauuaaacacug

SEQ ID NO: 1434153 - RNA, 13 nt, Homo sapiens
cugauaagcaaau

SEQ ID NO: 1434154 - RNA, 15 nt, Homo sapiens
cugauaauaauugau

SEQ ID NO: 1434155 - RNA, 23 nt, Homo sapiens
cugauauaacaaacuacauguaa

SEQ ID NO: 1434156 - RNA, 19 nt, Homo sapiens
cugauaugcagaguauuuc

SEQ ID NO: 1434157 - RNA, 14 nt, Homo sapiens
cugaucauuacaug

SEQ ID NO: 1434158 - RNA, 16 nt, Homo sapiens
cugaucauuacauggc

SEQ ID NO: 1434159 - RNA, 16 nt, Homo sapiens
cugauccuaacugaag

SEQ ID NO: 1434160 - RNA, 22 nt, Homo sapiens
cugaugaaaaauaugugcuuga

SEQ ID NO: 1434161 - RNA, 15 nt, Homo sapiens
cugaugacuugcuua

SEQ ID NO: 1434162 - RNA, 13 nt, Homo sapiens
cugauggccaagg

SEQ ID NO: 1434163 - RNA, 12 nt, Homo sapiens
cugaugggacau

SEQ ID NO: 1434164 - RNA, 22 nt, Homo sapiens
cugauuaccuccuguguggaag

SEQ ID NO: 1434165 - RNA, 15 nt, Homo sapiens
cugauuccacuuuua

SEQ ID NO: 1434166 - RNA, 16 nt, Homo sapiens
cugauucuccugucag

SEQ ID NO: 1434167 - RNA, 18 nt, Homo sapiens
cugauuuuuuuguuguug

SEQ ID NO: 1434168 - RNA, 23 nt, Homo sapiens
cugcaaaaauauaaccauuacau

SEQ ID NO: 1434169 - RNA, 19 nt, Homo sapiens
cugcaagaaguacaugaag

SEQ ID NO: 1434170 - RNA, 17 nt, Homo sapiens
cugcaagugacaucucu

SEQ ID NO: 1434171 - RNA, 17 nt, Homo sapiens
cugcacagugcaucuca

SEQ ID NO: 1434172 - RNA, 12 nt, Homo sapiens
cugcacauuccu

SEQ ID NO: 1434173 - RNA, 17 nt, Homo sapiens
cugcaccgagagagaug

SEQ ID NO: 1434174 - RNA, 17 nt, Homo sapiens
cugcacuaaaacccauc

SEQ ID NO: 1434175 - RNA, 18 nt, Homo sapiens
cugcacuaaaauucacuu

SEQ ID NO: 1434176 - RNA, 14 nt, Homo sapiens
cugcagaggauuua

SEQ ID NO: 1434177 - RNA, 14 nt, Homo sapiens
cugcagcacuuuaa

SEQ ID NO: 1434178 - RNA, 15 nt, Homo sapiens
cugcagcugcugaag

SEQ ID NO: 1434179 - RNA, 22 nt, Homo sapiens
cugcagggggugugucugcuca

SEQ ID NO: 1434180 - RNA, 19 nt, Homo sapiens
cugcauggagugagcagua

SEQ ID NO: 1434181 - RNA, 23 nt, Homo sapiens
cugcauuagagcccauuucaauu

SEQ ID NO: 1434182 - RNA, 22 nt, Homo sapiens
cugcauucuuuuaaaguuuuau

SEQ ID NO: 1434183 - RNA, 19 nt, Homo sapiens
cugcauuuauaaaugugug

SEQ ID NO: 1434184 - RNA, 13 nt, Homo sapiens
cugccaagcccuc

SEQ ID NO: 1434185 - RNA, 13 nt, Homo sapiens
cuggugggugaca

SEQ ID NO: 1434186 - RNA, 14 nt, Homo sapiens
cugguuacucuggu

SEQ ID NO: 1434187 - RNA, 16 nt, Homo sapiens
cugguuagacaguacu

SEQ ID NO: 1434188 - RNA, 21 nt, Homo sapiens
cugguugcuucagaccugaca

SEQ ID NO: 1434189 - RNA, 13 nt, Homo sapiens
cuguaaacauuca

SEQ ID NO: 1434190 - RNA, 14 nt, Homo sapiens
cuguaaacauucau

SEQ ID NO: 1434191 - RNA, 17 nt, Homo sapiens
cuguaaacuauaaacua

SEQ ID NO: 1434192 - RNA, 23 nt, Homo sapiens
cuguaaacuauaaacuacuguaa

SEQ ID NO: 1434193 - RNA, 17 nt, Homo sapiens
cuguaaauacaugugug

SEQ ID NO: 1434194 - RNA, 19 nt, Homo sapiens
cuguaacucagacauucca

SEQ ID NO: 1434195 - RNA, 12 nt, Homo sapiens
cuguaagcauuc

SEQ ID NO: 1434196 - RNA, 17 nt, Homo sapiens
cuguaaucccagcacuu

SEQ ID NO: 1434197 - RNA, 18 nt, Homo sapiens
cuguaaucccagcacuuu

SEQ ID NO: 1434198 - RNA, 19 nt, Homo sapiens
cuguaaucccagcuacuca

SEQ ID NO: 1434199 - RNA, 11 nt, Homo sapiens
cuguagacuua

SEQ ID NO: 1434200 - RNA, 18 nt, Homo sapiens
cuguagguuaaaugcagg

SEQ ID NO: 1434201 - RNA, 15 nt, Homo sapiens
cuguaguagcccuuu

SEQ ID NO: 1434202 - RNA, 21 nt, Homo sapiens
cuguauaaucuauuuacauaa

SEQ ID NO: 1434203 - RNA, 16 nt, Homo sapiens
cuguaugauuccuuga

SEQ ID NO: 1434204 - RNA, 16 nt, Homo sapiens
cugucagaggcuaaga

SEQ ID NO: 1434205 - RNA, 18 nt, Homo sapiens
cugucauggaaaagccca

SEQ ID NO: 1434206 - RNA, 19 nt, Homo sapiens
cuguccaggacaugauacu

SEQ ID NO: 1434207 - RNA, 21 nt, Homo sapiens
cugucccgccuuccuccucca

SEQ ID NO: 1434208 - RNA, 15 nt, Homo sapiens
cugucccuacccacu

SEQ ID NO: 1434209 - RNA, 21 nt, Homo sapiens
cuguccugccucucugcucca

SEQ ID NO: 1434210 - RNA, 15 nt, Homo sapiens
cuguccuggcugcuc

SEQ ID NO: 1434211 - RNA, 20 nt, Homo sapiens
cugugaauaaaaacccugua

SEQ ID NO: 1434212 - RNA, 22 nt, Homo sapiens
cugugaccugcugagcucugag

SEQ ID NO: 1434213 - RNA, 18 nt, Homo sapiens
cugugauuaacuugcuua

SEQ ID NO: 1434214 - RNA, 21 nt, Homo sapiens
cugugcacggccagcugcauc

SEQ ID NO: 1434215 - RNA, 23 nt, Homo sapiens
cugugccucgcuccccacucugc

SEQ ID NO: 1434216 - RNA, 16 nt, Homo sapiens
cugugcugugucugca

SEQ ID NO: 1434217 - RNA, 21 nt, Homo sapiens
cuguggaggccugaugcugcc

SEQ ID NO: 1434218 - RNA, 16 nt, Homo sapiens
cuguggggccugaugg

SEQ ID NO: 1434219 - RNA, 15 nt, Homo sapiens
cuguguggugcccau

SEQ ID NO: 1434220 - RNA, 17 nt, Homo sapiens
cuguguucauucuuacc

SEQ ID NO: 1434221 - RNA, 13 nt, Homo sapiens
cuguguugucucu

SEQ ID NO: 1434222 - RNA, 13 nt, Homo sapiens
cuguuaagcaauu

SEQ ID NO: 1434223 - RNA, 14 nt, Homo sapiens
cuguuacccagaga

SEQ ID NO: 1434224 - RNA, 17 nt, Homo sapiens
cuguuacuuaccuaaac

SEQ ID NO: 1434225 - RNA, 23 nt, Homo sapiens
cuguuacuugaaauaccagugaa

SEQ ID NO: 1434226 - RNA, 20 nt, Homo sapiens
cuguuacuuuuuagucuuuu

SEQ ID NO: 1434227 - RNA, 22 nt, Homo sapiens
cuguuagaugugacacauucuc

SEQ ID NO: 1434228 - RNA, 19 nt, Homo sapiens
cuguuaucugcuagaucua

SEQ ID NO: 1434229 - RNA, 19 nt, Homo sapiens
cuguucucaaaugcuaaau

SEQ ID NO: 1434230 - RNA, 14 nt, Homo sapiens
cuguucugcacuga

SEQ ID NO: 1434231 - RNA, 18 nt, Homo sapiens
cuguucugccuuccgcag

SEQ ID NO: 1434232 - RNA, 19 nt, Homo sapiens
cuguucuggccucagacca

SEQ ID NO: 1434233 - RNA, 19 nt, Homo sapiens
cuguucuuccuaccaaaua

SEQ ID NO: 1434234 - RNA, 16 nt, Homo sapiens
cuguugauaauaucuc

SEQ ID NO: 1434235 - RNA, 21 nt, Homo sapiens
cuguugaucccacuucacugu

SEQ ID NO: 1434236 - RNA, 11 nt, Homo sapiens
cuguugcacug

SEQ ID NO: 1434237 - RNA, 17 nt, Homo sapiens
cuguugcgccacugaga

SEQ ID NO: 1434238 - RNA, 19 nt, Homo sapiens
cuguuguaaaugaccaaga

SEQ ID NO: 1434239 - RNA, 18 nt, Homo sapiens
cuguuucaaugaccugua

SEQ ID NO: 1434240 - RNA, 13 nt, Homo sapiens
cuguuucuauucu

SEQ ID NO: 1434241 - RNA, 12 nt, Homo sapiens
cuguuugucucg

SEQ ID NO: 1434242 - RNA, 17 nt, Homo sapiens
cuuaaaaacagcuguaa

SEQ ID NO: 1434243 - RNA, 23 nt, Homo sapiens
cuuaaaggccuggaaccagggag

SEQ ID NO: 1434244 - RNA, 18 nt, Homo sapiens
cuuaaaugacagugaauu

SEQ ID NO: 1434245 - RNA, 24 nt, Homo sapiens
cuuaaauuuuaagcuugaagauua

SEQ ID NO: 1434246 - RNA, 17 nt, Homo sapiens
cuuaacggcuccaggau

SEQ ID NO: 1434247 - RNA, 18 nt, Homo sapiens
cuuaacuacaguggcuga

SEQ ID NO: 1434248 - RNA, 15 nt, Homo sapiens
cuuaacugugugaag

SEQ ID NO: 1434249 - RNA, 19 nt, Homo sapiens
cuuaagacuuuugggacau

SEQ ID NO: 1434250 - RNA, 17 nt, Homo sapiens
cuuaaggcuugaaguaa

SEQ ID NO: 1434251 - RNA, 18 nt, Homo sapiens
cuuaauagccauaugcaa

SEQ ID NO: 1434252 - RNA, 20 nt, Homo sapiens
cuuaaucaagaauauucaaa

SEQ ID NO: 1434253 - RNA, 20 nt, Homo sapiens
cuuaaucuccacuguuauuc

SEQ ID NO: 1434254 - RNA, 14 nt, Homo sapiens
cuuaauggguacaa

SEQ ID NO: 1434255 - RNA, 16 nt, Homo sapiens
cuuaauucacucccac

SEQ ID NO: 1434256 - RNA, 20 nt, Homo sapiens
cuuacauuuucccaguaauu

SEQ ID NO: 1434257 - RNA, 14 nt, Homo sapiens
cuuaccugacacaa

SEQ ID NO: 1434258 - RNA, 17 nt, Homo sapiens
cuuacuaaugugcccca

SEQ ID NO: 1434259 - RNA, 21 nt, Homo sapiens
cuuacugcaaccuuugccucc

SEQ ID NO: 1434260 - RNA, 18 nt, Homo sapiens
cuuacuuaaacccagcuc

SEQ ID NO: 1434261 - RNA, 18 nt, Homo sapiens
cuuagaaauugcauuucc

SEQ ID NO: 1434262 - RNA, 18 nt, Homo sapiens
cuuagaauaaaauuguaa

SEQ ID NO: 1434263 - RNA, 16 nt, Homo sapiens
cuuagacuucgacuca

SEQ ID NO: 1434264 - RNA, 20 nt, Homo sapiens
cuuagauuagcucuggacca

SEQ ID NO: 1434265 - RNA, 23 nt, Homo sapiens
cuuagauuagcucuggaccagcc

SEQ ID NO: 1434266 - RNA, 17 nt, Homo sapiens
cuuagccucccaaagug

SEQ ID NO: 1434267 - RNA, 18 nt, Homo sapiens
cuuagccuccugaccuga

SEQ ID NO: 1434268 - RNA, 20 nt, Homo sapiens
cuuaggaaacccuucuuuac

SEQ ID NO: 1434269 - RNA, 23 nt, Homo sapiens
cuuaggaauuucuccuacuuuac

SEQ ID NO: 1434270 - RNA, 23 nt, Homo sapiens
cuuagggcagucaguaguauucu

SEQ ID NO: 1434271 - RNA, 21 nt, Homo sapiens
cuuuaaccucaucuacaagca

SEQ ID NO: 1434272 - RNA, 20 nt, Homo sapiens
cuuuaagagagaaaucugaa

SEQ ID NO: 1434273 - RNA, 18 nt, Homo sapiens
cuuuaauacucaccuccu

SEQ ID NO: 1434274 - RNA, 12 nt, Homo sapiens
cuuuaauguugu

SEQ ID NO: 1434275 - RNA, 12 nt, Homo sapiens
cuuuacaauaaa

SEQ ID NO: 1434276 - RNA, 20 nt, Homo sapiens
cuuuacaaucugcacuuuaa

SEQ ID NO: 1434277 - RNA, 21 nt, Homo sapiens
cuuuacaaucugcacuuuaac

SEQ ID NO: 1434278 - RNA, 15 nt, Homo sapiens
cuuuaccacuaugca

SEQ ID NO: 1434279 - RNA, 18 nt, Homo sapiens
cuuuaccugagaccaguu

SEQ ID NO: 1434280 - RNA, 20 nt, Homo sapiens
cuuuacuagauauccuggcc

SEQ ID NO: 1434281 - RNA, 22 nt, Homo sapiens
cuuuaggaggaggugggggcua

SEQ ID NO: 1434282 - RNA, 14 nt, Homo sapiens
cuuuaggggaccau

SEQ ID NO: 1434283 - RNA, 17 nt, Homo sapiens
cuuuauaaaagcaaaag

SEQ ID NO: 1434284 - RNA, 22 nt, Homo sapiens
cuuuaucaaaaaguacaauaau

SEQ ID NO: 1434285 - RNA, 19 nt, Homo sapiens
cuuuauguauggagcucua

SEQ ID NO: 1434286 - RNA, 15 nt, Homo sapiens
cuuuauugugaucua

SEQ ID NO: 1434287 - RNA, 20 nt, Homo sapiens
cuuuauuucuagcagaguga

SEQ ID NO: 1434288 - RNA, 14 nt, Homo sapiens
cuuuauuugcugua

SEQ ID NO: 1434289 - RNA, 20 nt, Homo sapiens
cuuuauuuguauuugccauu

SEQ ID NO: 1434290 - RNA, 20 nt, Homo sapiens
cuuucaacaaugacuaauga

SEQ ID NO: 1434291 - RNA, 14 nt, Homo sapiens
cuuucagcauuagg

SEQ ID NO: 1434292 - RNA, 13 nt, Homo sapiens
cuuucagcuguga

SEQ ID NO: 1434293 - RNA, 16 nt, Homo sapiens
cuuucagcugugaaca

SEQ ID NO: 1434294 - RNA, 15 nt, Homo sapiens
cuuucaggaccuuuu

SEQ ID NO: 1434295 - RNA, 18 nt, Homo sapiens
cuuucaugaguuucccag

SEQ ID NO: 1434296 - RNA, 19 nt, Homo sapiens
cuuuccccaccucuuccuu

SEQ ID NO: 1434297 - RNA, 16 nt, Homo sapiens
cuuuccccagacacau

SEQ ID NO: 1434298 - RNA, 16 nt, Homo sapiens
cuuuccgucucccuaa

SEQ ID NO: 1434299 - RNA, 15 nt, Homo sapiens
cuuucuacaccuguu

SEQ ID NO: 1434300 - RNA, 21 nt, Homo sapiens
cuuucucgugguagaagccag

SEQ ID NO: 1434301 - RNA, 12 nt, Homo sapiens
cuuucucugcaa

SEQ ID NO: 1434302 - RNA, 15 nt, Homo sapiens
cuuucucuggcucca

SEQ ID NO: 1434303 - RNA, 22 nt, Homo sapiens
cuuucugacaagauaaaggaag

SEQ ID NO: 1434304 - RNA, 20 nt, Homo sapiens
cuuucugagaguuggcucag

SEQ ID NO: 1434305 - RNA, 16 nt, Homo sapiens
cuuucuggaaaagagg

SEQ ID NO: 1434306 - RNA, 23 nt, Homo sapiens
cuuucuggaccagauccuacucu

SEQ ID NO: 1434307 - RNA, 15 nt, Homo sapiens
cuuucuguugccaca

SEQ ID NO: 1434308 - RNA, 20 nt, Homo sapiens
cuuugcagaccgcauaguca

SEQ ID NO: 1434309 - RNA, 18 nt, Homo sapiens
cuuugcucuuucuugacu

SEQ ID NO: 1434310 - RNA, 15 nt, Homo sapiens
cuuugcucuuuggua

SEQ ID NO: 1434311 - RNA, 17 nt, Homo sapiens
cuuugcugucuggugua

SEQ ID NO: 1434312 - RNA, 22 nt, Homo sapiens
cuuuguaaaggucagagucaaa

SEQ ID NO: 1434313 - RNA, 14 nt, Homo sapiens
cuuuguauccauga

SEQ ID NO: 1434314 - RNA, 15 nt, Homo sapiens
cuuugucucugagaa

SEQ ID NO: 1434315 - RNA, 15 nt, Homo sapiens
cuuuuaaaugcauaa

SEQ ID NO: 1434316 - RNA, 16 nt, Homo sapiens
cuuuuaaaugcauaaa

SEQ ID NO: 1434317 - RNA, 15 nt, Homo sapiens
cuuuuaagaaacaca

SEQ ID NO: 1434318 - RNA, 17 nt, Homo sapiens
cuuuuaagaaacacagg

SEQ ID NO: 1434319 - RNA, 22 nt, Homo sapiens
cuuuuaagcaaaguugggugua

SEQ ID NO: 1434320 - RNA, 22 nt, Homo sapiens
cuuuuaggauguaacuuuauaa

SEQ ID NO: 1434321 - RNA, 20 nt, Homo sapiens
cuuuuaugagacccauuccu

SEQ ID NO: 1434322 - RNA, 23 nt, Homo sapiens
cuuuucacugcuggcugccuuag

SEQ ID NO: 1434323 - RNA, 17 nt, Homo sapiens
cuuuucagcagagucua

SEQ ID NO: 1434324 - RNA, 16 nt, Homo sapiens
cuuuuccauguaucua

SEQ ID NO: 1434325 - RNA, 16 nt, Homo sapiens
cuuuucccacauucau

SEQ ID NO: 1434326 - RNA, 21 nt, Homo sapiens
cuuuucccccaaagaugugua

SEQ ID NO: 1434327 - RNA, 16 nt, Homo sapiens
cuuuucugaggacuca

SEQ ID NO: 1434328 - RNA, 16 nt, Homo sapiens
cuuuugaaaagcuuuu

SEQ ID NO: 1434329 - RNA, 14 nt, Homo sapiens
cuuuugaccaaaua

SEQ ID NO: 1434330 - RNA, 13 nt, Homo sapiens
cuuuugaggggcu

SEQ ID NO: 1434331 - RNA, 20 nt, Homo sapiens
cuuuugcuugaaaccaaaga

SEQ ID NO: 1434332 - RNA, 15 nt, Homo sapiens
cuuuugucuuccuca

SEQ ID NO: 1434333 - RNA, 22 nt, Homo sapiens
cuuuugugcuccccuuugccua

SEQ ID NO: 1434334 - RNA, 12 nt, Homo sapiens
cuuuuguuucag

SEQ ID NO: 1434335 - RNA, 20 nt, Homo sapiens
cuuuuucaaaaaacauuaaa

SEQ ID NO: 1434336 - RNA, 12 nt, Homo sapiens
cuuuuuccagag

SEQ ID NO: 1434337 - RNA, 16 nt, Homo sapiens
cuuuuucugagcuuuu

SEQ ID NO: 1434338 - RNA, 13 nt, Homo sapiens
cuuuuucuggaaa

SEQ ID NO: 1434339 - RNA, 16 nt, Homo sapiens
cuuuuuucuaguuuca

SEQ ID NO: 1434340 - RNA, 20 nt, Homo sapiens
cuuuuuuguggugucuagca

SEQ ID NO: 1434341 - RNA, 22 nt, Homo sapiens
cuuuuuuguggugucuagcauu

SEQ ID NO: 1434342 - RNA, 15 nt, Homo sapiens
gaaaaaccaaugauu

SEQ ID NO: 1434343 - RNA, 15 nt, Homo sapiens
gaaaaacuuccauga

SEQ ID NO: 1434344 - RNA, 13 nt, Homo sapiens
gaaaaagagccau

SEQ ID NO: 1434345 - RNA, 17 nt, Homo sapiens
gaaaaaggccucugucc

SEQ ID NO: 1434346 - RNA, 18 nt, Homo sapiens
gaaaaaguugcagucuca

SEQ ID NO: 1434347 - RNA, 17 nt, Homo sapiens
gaaaaauaugugcuuga

SEQ ID NO: 1434348 - RNA, 20 nt, Homo sapiens
gaaaaaucaccacaccaaac

SEQ ID NO: 1434349 - RNA, 20 nt, Homo sapiens
gaaaaaugggaacaaggcaa

SEQ ID NO: 1434350 - RNA, 15 nt, Homo sapiens
gaaaaauuccaggag

SEQ ID NO: 1434351 - RNA, 15 nt, Homo sapiens
gaaaacaaacccagg

SEQ ID NO: 1434352 - RNA, 15 nt, Homo sapiens
gaaaacauaugcauu

SEQ ID NO: 1434353 - RNA, 13 nt, Homo sapiens
gaaaacucuucau

SEQ ID NO: 1434354 - RNA, 11 nt, Homo sapiens
gaaaagccaga

SEQ ID NO: 1434355 - RNA, 14 nt, Homo sapiens
gaaaagcccaguga

SEQ ID NO: 1434356 - RNA, 22 nt, Homo sapiens
gaaaagguagcuuaccugacac

SEQ ID NO: 1434357 - RNA, 16 nt, Homo sapiens
gaaaaguacauuuaau

SEQ ID NO: 1434358 - RNA, 20 nt, Homo sapiens
uccauucaugccaaagcaaa

SEQ ID NO: 1434359 - RNA, 15 nt, Homo sapiens
uccauugcuguuguu

SEQ ID NO: 1434360 - RNA, 14 nt, Homo sapiens
uccauuuggacaaa

SEQ ID NO: 1434361 - RNA, 19 nt, Homo sapiens
uccauuuggacaaaaugga

SEQ ID NO: 1434362 - RNA, 21 nt, Homo sapiens
ucccaaaagucaccacuccau

SEQ ID NO: 1434363 - RNA, 15 nt, Homo sapiens
ucccaaagugcuagu

SEQ ID NO: 1434364 - RNA, 16 nt, Homo sapiens
ucccaacaacauccau

SEQ ID NO: 1434365 - RNA, 22 nt, Homo sapiens
ucccaacaacauccauguccua

SEQ ID NO: 1434366 - RNA, 22 nt, Homo sapiens
ucccaagagcaucaugccucug

SEQ ID NO: 1434367 - RNA, 21 nt, Homo sapiens
ucccaauaaaagugacucuca

SEQ ID NO: 1434368 - RNA, 16 nt, Homo sapiens
ucccaaucagcacuga

SEQ ID NO: 1434369 - RNA, 17 nt, Homo sapiens
ucccaaugcacauccau

SEQ ID NO: 1434370 - RNA, 21 nt, Homo sapiens
ucccaaugcacauccauuccc

SEQ ID NO: 1434371 - RNA, 17 nt, Homo sapiens
ucccacaaucugggacu

SEQ ID NO: 1434372 - RNA, 20 nt, Homo sapiens
ucccacacacaaaccaagag

SEQ ID NO: 1434373 - RNA, 18 nt, Homo sapiens
ucccacaugaucuugaga

SEQ ID NO: 1434374 - RNA, 17 nt, Homo sapiens
ucccaccccacuccagc

SEQ ID NO: 1434375 - RNA, 23 nt, Homo sapiens
ucccaccucuucucuuccuguaa

SEQ ID NO: 1434376 - RNA, 12 nt, Homo sapiens
ucccacucaugu

SEQ ID NO: 1434377 - RNA, 12 nt, Homo sapiens
ucccacuggaac

SEQ ID NO: 1434378 - RNA, 15 nt, Homo sapiens
ucccacuugucaugu

SEQ ID NO: 1434379 - RNA, 23 nt, Homo sapiens
ucccagaaauuagaaaccuuaau

SEQ ID NO: 1434380 - RNA, 11 nt, Homo sapiens
ucccagcauug

SEQ ID NO: 1434381 - RNA, 17 nt, Homo sapiens
ucccagccacucgggag

SEQ ID NO: 1434382 - RNA, 22 nt, Homo sapiens
ucccagccccaggggugccugu

SEQ ID NO: 1434383 - RNA, 15 nt, Homo sapiens
ucccaggaacugggc

SEQ ID NO: 1434384 - RNA, 19 nt, Homo sapiens
ucccaggccccaugaccuc

SEQ ID NO: 1434385 - RNA, 19 nt, Homo sapiens
ucccauaagcuaagccuua

SEQ ID NO: 1434386 - RNA, 14 nt, Homo sapiens
ucccauagcacugc

SEQ ID NO: 1434387 - RNA, 18 nt, Homo sapiens
ucccauagcgcuggcuca

SEQ ID NO: 1434388 - RNA, 14 nt, Homo sapiens
ucccauguauuuau

SEQ ID NO: 1434389 - RNA, 15 nt, Homo sapiens
uccccacaccucccu

SEQ ID NO: 1434390 - RNA, 21 nt, Homo sapiens
uccccacccccgcugggggug

SEQ ID NO: 1434391 - RNA, 20 nt, Homo sapiens
uccccaccuuccccagacuc

SEQ ID NO: 1434392 - RNA, 11 nt, Homo sapiens
uccccagacac

SEQ ID NO: 1434393 - RNA, 18 nt, Homo sapiens
uccccagcaccuuccuga

SEQ ID NO: 1434394 - RNA, 17 nt, Homo sapiens
uccccagccuacugccu

SEQ ID NO: 1434395 - RNA, 11 nt, Homo sapiens
uccccaucagc

SEQ ID NO: 1434396 - RNA, 14 nt, Homo sapiens
uccccaucauccca

SEQ ID NO: 1434397 - RNA, 19 nt, Homo sapiens
uccccaucuggguccuugc

SEQ ID NO: 1434398 - RNA, 23 nt, Homo sapiens
uccccaugcaugggaaagugcaa

SEQ ID NO: 1434399 - RNA, 17 nt, Homo sapiens
ucccccgacacugcugc

SEQ ID NO: 1434400 - RNA, 20 nt, Homo sapiens
ucccccucccugugugaaau

SEQ ID NO: 1434401 - RNA, 21 nt, Homo sapiens
uccccucgugugacucucuug

SEQ ID NO: 1434402 - RNA, 15 nt, Homo sapiens
uccccuggacuggga

SEQ ID NO: 1434403 - RNA, 20 nt, Homo sapiens
ucccgaguagcugggauuac

SEQ ID NO: 1434404 - RNA, 17 nt, Homo sapiens
ucccgagucaugcacuc

SEQ ID NO: 1434405 - RNA, 21 nt, Homo sapiens
ucccgagucaugcacucaggc

SEQ ID NO: 1434406 - RNA, 19 nt, Homo sapiens
ucccgccuuccuccuccac

SEQ ID NO: 1434407 - RNA, 19 nt, Homo sapiens
ucccgcgugaagaugucac

SEQ ID NO: 1434408 - RNA, 14 nt, Homo sapiens
ucccggacugcaag

SEQ ID NO: 1434409 - RNA, 20 nt, Homo sapiens
ucccggauuuuuguuaauau

SEQ ID NO: 1434410 - RNA, 18 nt, Homo sapiens
ucccgggggcacugccug

SEQ ID NO: 1434411 - RNA, 19 nt, Homo sapiens
ucccucaaaugacccaaag

SEQ ID NO: 1434412 - RNA, 22 nt, Homo sapiens
ucccucaaaugcgcgugugcac

SEQ ID NO: 1434413 - RNA, 13 nt, Homo sapiens
ucccucaacccca

SEQ ID NO: 1434414 - RNA, 20 nt, Homo sapiens
ucccucccagagaacagggg

SEQ ID NO: 1434415 - RNA, 21 nt, Homo sapiens
ucccuccccaaacccaucaga

SEQ ID NO: 1434416 - RNA, 19 nt, Homo sapiens
ucccuccucacuugcccug

SEQ ID NO: 1434417 - RNA, 20 nt, Homo sapiens
ucccuccuucccuucucucc

SEQ ID NO: 1434418 - RNA, 20 nt, Homo sapiens
ucccucgcccccacacccca

SEQ ID NO: 1434419 - RNA, 19 nt, Homo sapiens
ucccugaaaacccagagag

SEQ ID NO: 1434420 - RNA, 19 nt, Homo sapiens
ucccugauaacaaccugga

SEQ ID NO: 1434421 - RNA, 20 nt, Homo sapiens
ucccugauaacaaccuggag

SEQ ID NO: 1434422 - RNA, 16 nt, Homo sapiens
ucccuggaucagaaca

SEQ ID NO: 1434423 - RNA, 18 nt, Homo sapiens
ucccugggaacugguuca

SEQ ID NO: 1434424 - RNA, 19 nt, Homo sapiens
ucccuggucccucguccac

SEQ ID NO: 1434425 - RNA, 14 nt, Homo sapiens
ucccuguuccucaa

SEQ ID NO: 1434426 - RNA, 13 nt, Homo sapiens
ucccuuucuggga

SEQ ID NO: 1434427 - RNA, 13 nt, Homo sapiens
uccgaguguuugc

SEQ ID NO: 1434428 - RNA, 20 nt, Homo sapiens
uccgccauuccaagucaaca

SEQ ID NO: 1434429 - RNA, 21 nt, Homo sapiens
uccgccugcagaggacagagc

SEQ ID NO: 1434430 - RNA, 16 nt, Homo sapiens
uccggagaauugccuc

SEQ ID NO: 1434431 - RNA, 23 nt, Homo sapiens
uccggagggguugcgggggagcu

SEQ ID NO: 1434432 - RNA, 15 nt, Homo sapiens
uccgggacgcuucca

SEQ ID NO: 1434433 - RNA, 18 nt, Homo sapiens
uccguccggaaaugaagg

SEQ ID NO: 1434434 - RNA, 18 nt, Homo sapiens
uccuaaaucuuccagcau

SEQ ID NO: 1434435 - RNA, 13 nt, Homo sapiens
uccuaaccuagag

SEQ ID NO: 1434436 - RNA, 21 nt, Homo sapiens
uccuaagcuucaaaucagaag

SEQ ID NO: 1434437 - RNA, 15 nt, Homo sapiens
uccuaauaugcuuua

SEQ ID NO: 1434438 - RNA, 16 nt, Homo sapiens
uccuacaaaauggagg

SEQ ID NO: 1434439 - RNA, 14 nt, Homo sapiens
uccuacuacuuugu

SEQ ID NO: 1434440 - RNA, 14 nt, Homo sapiens
uccuaguuugaccu

SEQ ID NO: 1434441 - RNA, 20 nt, Homo sapiens
uccucaacaacaaaccaaaa

SEQ ID NO: 1434442 - RNA, 15 nt, Homo sapiens
uauucauucauucau

SEQ ID NO: 1434443 - RNA, 22 nt, Homo sapiens
uauuccauggcuaacuggcgag

SEQ ID NO: 1434444 - RNA, 19 nt, Homo sapiens
uauuccaugggauguuaag

SEQ ID NO: 1434445 - RNA, 23 nt, Homo sapiens
uauuccgggugccauucccacua

SEQ ID NO: 1434446 - RNA, 20 nt, Homo sapiens
uauuccugacccucccuacc

SEQ ID NO: 1434447 - RNA, 13 nt, Homo sapiens
uauuccugcauuu

SEQ ID NO: 1434448 - RNA, 21 nt, Homo sapiens
uauuccuguuucugaaccauu

SEQ ID NO: 1434449 - RNA, 15 nt, Homo sapiens
uauucuaaagcuuuc

SEQ ID NO: 1434450 - RNA, 14 nt, Homo sapiens
uauucuauuuacaa

SEQ ID NO: 1434451 - RNA, 14 nt, Homo sapiens
uauucucuaagaua

SEQ ID NO: 1434452 - RNA, 16 nt, Homo sapiens
uauucuugacaugaga

SEQ ID NO: 1434453 - RNA, 12 nt, Homo sapiens
uauucuugucaa

SEQ ID NO: 1434454 - RNA, 16 nt, Homo sapiens
uauucuuuaaauuuca

SEQ ID NO: 1434455 - RNA, 14 nt, Homo sapiens
uauugaaucuuaau

SEQ ID NO: 1434456 - RNA, 18 nt, Homo sapiens
uauugauguuuccagaaa

SEQ ID NO: 1434457 - RNA, 12 nt, Homo sapiens
uauugcaagaca

SEQ ID NO: 1434458 - RNA, 16 nt, Homo sapiens
uauugccuuugccucu

SEQ ID NO: 1434459 - RNA, 13 nt, Homo sapiens
uauugcugugaau

SEQ ID NO: 1434460 - RNA, 20 nt, Homo sapiens
uauuggucauugccuugcca

SEQ ID NO: 1434461 - RNA, 22 nt, Homo sapiens
uauugguccagcuugcucuuca

SEQ ID NO: 1434462 - RNA, 14 nt, Homo sapiens
uauuguccauauca

SEQ ID NO: 1434463 - RNA, 21 nt, Homo sapiens
uauugucggaagacuugccac

SEQ ID NO: 1434464 - RNA, 13 nt, Homo sapiens
uauugugccucag

SEQ ID NO: 1434465 - RNA, 16 nt, Homo sapiens
uauuuaaaaguauaaa

SEQ ID NO: 1434466 - RNA, 21 nt, Homo sapiens
uauuuaaauaaaaucauauug

SEQ ID NO: 1434467 - RNA, 22 nt, Homo sapiens
uauuuacuugaaagaugggucu

SEQ ID NO: 1434468 - RNA, 15 nt, Homo sapiens
uauuuauagucacaa

SEQ ID NO: 1434469 - RNA, 16 nt, Homo sapiens
uauuuaucugugcaaa

SEQ ID NO: 1434470 - RNA, 14 nt, Homo sapiens
uauuuauucccugu

SEQ ID NO: 1434471 - RNA, 16 nt, Homo sapiens
uauuucaaaacacauc

SEQ ID NO: 1434472 - RNA, 21 nt, Homo sapiens
uauuucaaaacacaucuuucc

SEQ ID NO: 1434473 - RNA, 20 nt, Homo sapiens
uauuucaaaugaacacgugc

SEQ ID NO: 1434474 - RNA, 15 nt, Homo sapiens
uauuucuugcauuca

SEQ ID NO: 1434475 - RNA, 13 nt, Homo sapiens
uauuugaaucuuu

SEQ ID NO: 1434476 - RNA, 21 nt, Homo sapiens
uauuugccauucagucuagcu

SEQ ID NO: 1434477 - RNA, 15 nt, Homo sapiens
uauuuguauuugcca

SEQ ID NO: 1434478 - RNA, 20 nt, Homo sapiens
uauuugugugugugauauau

SEQ ID NO: 1434479 - RNA, 19 nt, Homo sapiens
uauuuuauucccuuucaca

SEQ ID NO: 1434480 - RNA, 20 nt, Homo sapiens
uauuuuauucccuuucacaa

SEQ ID NO: 1434481 - RNA, 23 nt, Homo sapiens
uauuuuucaaagauguguugcua

SEQ ID NO: 1434482 - RNA, 15 nt, Homo sapiens
uauuuuuucuacaca

SEQ ID NO: 1434483 - RNA, 18 nt, Homo sapiens
uauuuuuuuaagcuguaa

SEQ ID NO: 1434484 - RNA, 14 nt, Homo sapiens
ucaaaaccuuucaa

SEQ ID NO: 1434485 - RNA, 15 nt, Homo sapiens
ucaaaacugcuaaau

SEQ ID NO: 1434486 - RNA, 21 nt, Homo sapiens
ucaaaagacagcacuacagau

SEQ ID NO: 1434487 - RNA, 18 nt, Homo sapiens
ucaaaagugaucuguccc

SEQ ID NO: 1434488 - RNA, 20 nt, Homo sapiens
ucaaaauggacguacugguu

SEQ ID NO: 1434489 - RNA, 18 nt, Homo sapiens
ucaaacugacaaccugug

SEQ ID NO: 1434490 - RNA, 17 nt, Homo sapiens
ucaaacugcaugauuca

SEQ ID NO: 1434491 - RNA, 15 nt, Homo sapiens
ucaaacuuuacucua

SEQ ID NO: 1434492 - RNA, 14 nt, Homo sapiens
ucaaagacaaugga

SEQ ID NO: 1434493 - RNA, 15 nt, Homo sapiens
ucaaagacaauggaa

SEQ ID NO: 1434494 - RNA, 13 nt, Homo sapiens
ucaaagacagaga

SEQ ID NO: 1434495 - RNA, 15 nt, Homo sapiens
ucaaaguaaaacuug

SEQ ID NO: 1434496 - RNA, 14 nt, Homo sapiens
ucaaauaugcaaag

SEQ ID NO: 1434497 - RNA, 17 nt, Homo sapiens
ucaaauauuaccaaaaa

SEQ ID NO: 1434498 - RNA, 15 nt, Homo sapiens
ucaaaugacccaaag

SEQ ID NO: 1434499 - RNA, 14 nt, Homo sapiens
ucaaaugcauuuug

SEQ ID NO: 1434500 - RNA, 15 nt, Homo sapiens
ucaaaugucagagcu

SEQ ID NO: 1434501 - RNA, 17 nt, Homo sapiens
ucaaauugcuacauagu

SEQ ID NO: 1434502 - RNA, 22 nt, Homo sapiens
ucaaauugcuacauaguccaaa

SEQ ID NO: 1434503 - RNA, 22 nt, Homo sapiens
ucaaauuucuguucucucuucc

SEQ ID NO: 1434504 - RNA, 23 nt, Homo sapiens
ucaaauuugccaccacuagagcu

SEQ ID NO: 1434505 - RNA, 18 nt, Homo sapiens
ucaacaauaaagacugag

SEQ ID NO: 1434506 - RNA, 20 nt, Homo sapiens
ucaacaauaaagacugagac

SEQ ID NO: 1434507 - RNA, 16 nt, Homo sapiens
ucaaccgcuugccaua

SEQ ID NO: 1434508 - RNA, 14 nt, Homo sapiens
ucaacuacucagcu

SEQ ID NO: 1434509 - RNA, 12 nt, Homo sapiens
ucaagacuugau

SEQ ID NO: 1434510 - RNA, 18 nt, Homo sapiens
ucaagacuugauacugca

SEQ ID NO: 1434511 - RNA, 14 nt, Homo sapiens
ucaagagacacugc

SEQ ID NO: 1434512 - RNA, 15 nt, Homo sapiens
ucaagagacacugcu

SEQ ID NO: 1434513 - RNA, 18 nt, Homo sapiens
ucaagaugagagaacugg

SEQ ID NO: 1434514 - RNA, 19 nt, Homo sapiens
ucaagaugaugaugaucuu

SEQ ID NO: 1434515 - RNA, 17 nt, Homo sapiens
ucaagcuagaaggccac

SEQ ID NO: 1434516 - RNA, 21 nt, Homo sapiens
ucaaggacuccugucuguccu

SEQ ID NO: 1434517 - RNA, 15 nt, Homo sapiens
ucaagggccagucag

SEQ ID NO: 1434518 - RNA, 17 nt, Homo sapiens
ucaagggccagucagca

SEQ ID NO: 1434519 - RNA, 16 nt, Homo sapiens
ucaagucuucccugau

SEQ ID NO: 1434520 - RNA, 23 nt, Homo sapiens
ucaagucuucccugaucaaguca

SEQ ID NO: 1434521 - RNA, 20 nt, Homo sapiens
ucaagugauccaccugccuu

SEQ ID NO: 1434522 - RNA, 19 nt, Homo sapiens
ucaaguugagaacaaaaau

SEQ ID NO: 1434523 - RNA, 16 nt, Homo sapiens
ucaaguugcuucucau

SEQ ID NO: 1434524 - RNA, 22 nt, Homo sapiens
ucaauaccccuguuaagcaauu

SEQ ID NO: 1434525 - RNA, 17 nt, Homo sapiens
ucaauauuaaauacaga

SEQ ID NO: 1434526 - RNA, 16 nt, Homo sapiens
ucaaucagugcaguga

SEQ ID NO: 1434527 - RNA, 10 nt, Homo sapiens
uguacauuuc

SEQ ID NO: 1434528 - RNA, 12 nt, Homo sapiens
uguacauuucac

SEQ ID NO: 1434529 - RNA, 17 nt, Homo sapiens
uguacauuugagugucu

SEQ ID NO: 1434530 - RNA, 15 nt, Homo sapiens
uguaccacaaacaca

SEQ ID NO: 1434531 - RNA, 21 nt, Homo sapiens
uguaccucccccugccuucca

SEQ ID NO: 1434532 - RNA, 23 nt, Homo sapiens
uguacucuacgccaaagugcagc

SEQ ID NO: 1434533 - RNA, 17 nt, Homo sapiens
uguacugagacauuaca

SEQ ID NO: 1434534 - RNA, 15 nt, Homo sapiens
uguagaaugauuuca

SEQ ID NO: 1434535 - RNA, 15 nt, Homo sapiens
uguagaccacugucc

SEQ ID NO: 1434536 - RNA, 16 nt, Homo sapiens
uguagagcuucuggca

SEQ ID NO: 1434537 - RNA, 20 nt, Homo sapiens
uguagcaauagguagcugac

SEQ ID NO: 1434538 - RNA, 20 nt, Homo sapiens
uguagccucgccgucuguga

SEQ ID NO: 1434539 - RNA, 15 nt, Homo sapiens
uguagcuuugcucuu

SEQ ID NO: 1434540 - RNA, 23 nt, Homo sapiens
uguagcuuugcucuuugguagaa

SEQ ID NO: 1434541 - RNA, 20 nt, Homo sapiens
uguaggcaauacauguaucu

SEQ ID NO: 1434542 - RNA, 22 nt, Homo sapiens
uguagugucuguaauaccuuag

SEQ ID NO: 1434543 - RNA, 16 nt, Homo sapiens
uguagugugucagagu

SEQ ID NO: 1434544 - RNA, 15 nt, Homo sapiens
uguauaaacuaucag

SEQ ID NO: 1434545 - RNA, 21 nt, Homo sapiens
uguauaaccccaccuugccaa

SEQ ID NO: 1434546 - RNA, 21 nt, Homo sapiens
uguauacagauucuagccaaa

SEQ ID NO: 1434547 - RNA, 12 nt, Homo sapiens
uguauacugugg

SEQ ID NO: 1434548 - RNA, 13 nt, Homo sapiens
uguauccugauaa

SEQ ID NO: 1434549 - RNA, 20 nt, Homo sapiens
uguaucuaccucacuauuca

SEQ ID NO: 1434550 - RNA, 12 nt, Homo sapiens
uguaugcacuuu

SEQ ID NO: 1434551 - RNA, 16 nt, Homo sapiens
uguaugcauucaucca

SEQ ID NO: 1434552 - RNA, 15 nt, Homo sapiens
uguaugucugccuaa

SEQ ID NO: 1434553 - RNA, 16 nt, Homo sapiens
uguauuugcauaugua

SEQ ID NO: 1434554 - RNA, 12 nt, Homo sapiens
uguauuugccau

SEQ ID NO: 1434555 - RNA, 18 nt, Homo sapiens
uguauuuuugucauagca

SEQ ID NO: 1434556 - RNA, 21 nt, Homo sapiens
ugucaaagcauugagaucucc

SEQ ID NO: 1434557 - RNA, 13 nt, Homo sapiens
ugucaaugcauca

SEQ ID NO: 1434558 - RNA, 14 nt, Homo sapiens
ugucacaccugaaa

SEQ ID NO: 1434559 - RNA, 22 nt, Homo sapiens
ugucaccagcuaucugucaucu

SEQ ID NO: 1434560 - RNA, 14 nt, Homo sapiens
ugucacuaugcuau

SEQ ID NO: 1434561 - RNA, 16 nt, Homo sapiens
ugucaguuucauggag

SEQ ID NO: 1434562 - RNA, 23 nt, Homo sapiens
ugucauauguauuuuguauuugc

SEQ ID NO: 1434563 - RNA, 16 nt, Homo sapiens
ugucauuaauguguug

SEQ ID NO: 1434564 - RNA, 15 nt, Homo sapiens
uguccaaguccaacc

SEQ ID NO: 1434565 - RNA, 19 nt, Homo sapiens
ugucccaccaacucugcac

SEQ ID NO: 1434566 - RNA, 14 nt, Homo sapiens
uguccccaccucag

SEQ ID NO: 1434567 - RNA, 16 nt, Homo sapiens
uguccccuccacuguc

SEQ ID NO: 1434568 - RNA, 19 nt, Homo sapiens
uguccccuccacugucaca

SEQ ID NO: 1434569 - RNA, 18 nt, Homo sapiens
uguccuaaaauacaaaca

SEQ ID NO: 1434570 - RNA, 17 nt, Homo sapiens
uguccucccuuguggcu

SEQ ID NO: 1434571 - RNA, 15 nt, Homo sapiens
uguccucuugcucaa

SEQ ID NO: 1434572 - RNA, 21 nt, Homo sapiens
uguccuucuuuaucugugaua

SEQ ID NO: 1434573 - RNA, 12 nt, Homo sapiens
ugucgcaucuca

SEQ ID NO: 1434574 - RNA, 13 nt, Homo sapiens
ugucgcaucucag

SEQ ID NO: 1434575 - RNA, 16 nt, Homo sapiens
ugucuaauaguuauuc

SEQ ID NO: 1434576 - RNA, 15 nt, Homo sapiens
ugucuauaauggaaa

SEQ ID NO: 1434577 - RNA, 22 nt, Homo sapiens
ugucuccuccagcgugguggaa

SEQ ID NO: 1434578 - RNA, 17 nt, Homo sapiens
ugucucuagccacuuug

SEQ ID NO: 1434579 - RNA, 19 nt, Homo sapiens
ugucugaacggcugaauau

SEQ ID NO: 1434580 - RNA, 15 nt, Homo sapiens
ugucugucaccagcu

SEQ ID NO: 1434581 - RNA, 17 nt, Homo sapiens
ugucuuaaggcaucuga

SEQ ID NO: 1434582 - RNA, 19 nt, Homo sapiens
ugucuuccuuggccuauuc

SEQ ID NO: 1434583 - RNA, 22 nt, Homo sapiens
ugucuuugacuugguuaaagga

SEQ ID NO: 1434584 - RNA, 18 nt, Homo sapiens
ugugaaaguaugugauau

SEQ ID NO: 1434585 - RNA, 22 nt, Homo sapiens
ugugaaaguaugugauaucuga

SEQ ID NO: 1434586 - RNA, 15 nt, Homo sapiens
ugugaacacaucagc

SEQ ID NO: 1434587 - RNA, 19 nt, Homo sapiens
ugugaacauggacucuucc

SEQ ID NO: 1434588 - RNA, 19 nt, Homo sapiens
augaagacccaguguaaag

SEQ ID NO: 1434589 - RNA, 20 nt, Homo sapiens
augaagacccuggaguucaa

SEQ ID NO: 1434590 - RNA, 19 nt, Homo sapiens
augaagagaagcugagaag

SEQ ID NO: 1434591 - RNA, 16 nt, Homo sapiens
augaagagacucucuu

SEQ ID NO: 1434592 - RNA, 22 nt, Homo sapiens
augaagauuuuuaauuacaaua

SEQ ID NO: 1434593 - RNA, 20 nt, Homo sapiens
augaauagaugugaucacug

SEQ ID NO: 1434594 - RNA, 17 nt, Homo sapiens
augaaucaaagacaugg

SEQ ID NO: 1434595 - RNA, 11 nt, Homo sapiens
augaauucuua

SEQ ID NO: 1434596 - RNA, 13 nt, Homo sapiens
augaauugucuuc

SEQ ID NO: 1434597 - RNA, 12 nt, Homo sapiens
augacacugacc

SEQ ID NO: 1434598 - RNA, 18 nt, Homo sapiens
augacagcugucccuguc

SEQ ID NO: 1434599 - RNA, 17 nt, Homo sapiens
augacagggaugccaac

SEQ ID NO: 1434600 - RNA, 23 nt, Homo sapiens
augacagggaugccaacaccuuc

SEQ ID NO: 1434601 - RNA, 14 nt, Homo sapiens
augacaugcacuga

SEQ ID NO: 1434602 - RNA, 15 nt, Homo sapiens
augacaugcacugac

SEQ ID NO: 1434603 - RNA, 23 nt, Homo sapiens
augacaugccacccucuccaugc

SEQ ID NO: 1434604 - RNA, 14 nt, Homo sapiens
augacccacccagu

SEQ ID NO: 1434605 - RNA, 23 nt, Homo sapiens
augacccccaaccaaguggcucc

SEQ ID NO: 1434606 - RNA, 18 nt, Homo sapiens
augaccuaaccuaagcaa

SEQ ID NO: 1434607 - RNA, 22 nt, Homo sapiens
augaccuacuaguuuuccuuga

SEQ ID NO: 1434608 - RNA, 21 nt, Homo sapiens
augaccuccguguagugucug

SEQ ID NO: 1434609 - RNA, 23 nt, Homo sapiens
augaccuguuauuaccauuagca

SEQ ID NO: 1434610 - RNA, 15 nt, Homo sapiens
augagagaacuggag

SEQ ID NO: 1434611 - RNA, 17 nt, Homo sapiens
augagaugacauucacc

SEQ ID NO: 1434612 - RNA, 18 nt, Homo sapiens
augagcaaggacaaccug

SEQ ID NO: 1434613 - RNA, 22 nt, Homo sapiens
aacugaugcgaaaacuugaauc

SEQ ID NO: 1434614 - RNA, 14 nt, Homo sapiens
aacugcacugucaa

SEQ ID NO: 1434615 - RNA, 15 nt, Homo sapiens
aacugccccaucucc

SEQ ID NO: 1434616 - RNA, 18 nt, Homo sapiens
aacuggccaagcugaggu

SEQ ID NO: 1434617 - RNA, 17 nt, Homo sapiens
aacuuaaaaaaaugaca

SEQ ID NO: 1434618 - RNA, 19 nt, Homo sapiens
aacuuauaucaucagcaua

SEQ ID NO: 1434619 - RNA, 22 nt, Homo sapiens
aacuuccuuggacucauuuuaa

SEQ ID NO: 1434620 - RNA, 12 nt, Homo sapiens
aacuucucugag

SEQ ID NO: 1434621 - RNA, 17 nt, Homo sapiens
aacuuguguacugauaa

SEQ ID NO: 1434622 - RNA, 21 nt, Homo sapiens
aacuuuaaauucaagcugcuu

SEQ ID NO: 1434623 - RNA, 16 nt, Homo sapiens
aagaaaaccauuuuag

SEQ ID NO: 1434624 - RNA, 13 nt, Homo sapiens
aagaaaagccaga

SEQ ID NO: 1434625 - RNA, 15 nt, Homo sapiens
aagaaaauuaguaau

SEQ ID NO: 1434626 - RNA, 12 nt, Homo sapiens
aagaaacauaac

SEQ ID NO: 1434627 - RNA, 12 nt, Homo sapiens
aagaaacaugau

SEQ ID NO: 1434628 - RNA, 16 nt, Homo sapiens
aagaaaggaacugagg

SEQ ID NO: 1434629 - RNA, 18 nt, Homo sapiens
aagaaauccaguuuccca

SEQ ID NO: 1434630 - RNA, 12 nt, Homo sapiens
aagaaaugaaua

SEQ ID NO: 1434631 - RNA, 14 nt, Homo sapiens
aagaaaugggagaa

SEQ ID NO: 1434632 - RNA, 19 nt, Homo sapiens
aagaacaucccaagccaga

SEQ ID NO: 1434633 - RNA, 18 nt, Homo sapiens
aagaacugccccaucucc

SEQ ID NO: 1434634 - RNA, 14 nt, Homo sapiens
aagaagaauauucu

SEQ ID NO: 1434635 - RNA, 21 nt, Homo sapiens
aagaagaauauucuaugaagu

SEQ ID NO: 1434636 - RNA, 20 nt, Homo sapiens
aagaagaguuucuccuuuug

SEQ ID NO: 1434637 - RNA, 16 nt, Homo sapiens
aagaagcuuuaauauu

SEQ ID NO: 1434638 - RNA, 18 nt, Homo sapiens
aagaaggaagaagccaga

SEQ ID NO: 1434639 - RNA, 21 nt, Homo sapiens
aagaaggaauucuaggcaucc

SEQ ID NO: 1434640 - RNA, 17 nt, Homo sapiens
aagaauaaaauugcacu

SEQ ID NO: 1434641 - RNA, 13 nt, Homo sapiens
aagaaucagucuu

SEQ ID NO: 1434642 - RNA, 13 nt, Homo sapiens
aagaauggaagaa

SEQ ID NO: 1434643 - RNA, 17 nt, Homo sapiens
aagaauuccaaccgacc

SEQ ID NO: 1434644 - RNA, 17 nt, Homo sapiens
aagaauugaacccagga

SEQ ID NO: 1434645 - RNA, 19 nt, Homo sapiens
aagacaauggccauugugu

SEQ ID NO: 1434646 - RNA, 21 nt, Homo sapiens
aagacagagaagaccaaagca

SEQ ID NO: 1434647 - RNA, 14 nt, Homo sapiens
aagaccaauauuca

SEQ ID NO: 1434648 - RNA, 13 nt, Homo sapiens
aagaccagacugu

SEQ ID NO: 1434649 - RNA, 22 nt, Homo sapiens
aagaccauaacagccaacaggu

SEQ ID NO: 1434650 - RNA, 11 nt, Homo sapiens
aagacccagug

SEQ ID NO: 1434651 - RNA, 13 nt, Homo sapiens
aagacccagugua

SEQ ID NO: 1434652 - RNA, 16 nt, Homo sapiens
aagacccaguguaaag

SEQ ID NO: 1434653 - RNA, 18 nt, Homo sapiens
aagacuacuauacaaacu

SEQ ID NO: 1434654 - RNA, 20 nt, Homo sapiens
aagacuauucaaacagucuc

SEQ ID NO: 1434655 - RNA, 15 nt, Homo sapiens
aagacuggacgggga

SEQ ID NO: 1434656 - RNA, 19 nt, Homo sapiens
aagacuguggccugcccag

SEQ ID NO: 1434657 - RNA, 23 nt, Homo sapiens
aagacuguuaaaugaaaccagaa

SEQ ID NO: 1434658 - RNA, 15 nt, Homo sapiens
aagacuguugcucaa

SEQ ID NO: 1434659 - RNA, 22 nt, Homo sapiens
aagacuuguguccccaccucag

SEQ ID NO: 1434660 - RNA, 19 nt, Homo sapiens
aagagaaaauaaaccaaga

SEQ ID NO: 1434661 - RNA, 15 nt, Homo sapiens
aagagaagcugagaa

SEQ ID NO: 1434662 - RNA, 14 nt, Homo sapiens
aagagacacugcuu

SEQ ID NO: 1434663 - RNA, 21 nt, Homo sapiens
aagagagaaagaaguaggcau

SEQ ID NO: 1434664 - RNA, 13 nt, Homo sapiens
aagagaguaccau

SEQ ID NO: 1434665 - RNA, 17 nt, Homo sapiens
aagagcauagaacucaa

SEQ ID NO: 1434666 - RNA, 18 nt, Homo sapiens
aagagcauagaacucaaa

SEQ ID NO: 1434667 - RNA, 21 nt, Homo sapiens
aagagcaucaugccucugagg

SEQ ID NO: 1434668 - RNA, 19 nt, Homo sapiens
aagagcuggcaaagguggc

SEQ ID NO: 1434669 - RNA, 22 nt, Homo sapiens
aagagcuggcaaagguggcucu

SEQ ID NO: 1434670 - RNA, 14 nt, Homo sapiens
aagaggacugagac

SEQ ID NO: 1434671 - RNA, 23 nt, Homo sapiens
aagaggaggaagguuggaccuuc

SEQ ID NO: 1434672 - RNA, 20 nt, Homo sapiens
aagaggaggugguucugaaa

SEQ ID NO: 1434673 - RNA, 23 nt, Homo sapiens
aagaggcagcuugaaacugagau

SEQ ID NO: 1434674 - RNA, 13 nt, Homo sapiens
aagaggcagugau

SEQ ID NO: 1434675 - RNA, 18 nt, Homo sapiens
aagagggccugugggagc

SEQ ID NO: 1434676 - RNA, 21 nt, Homo sapiens
caaaaaugaaagcaugucuca

SEQ ID NO: 1434677 - RNA, 19 nt, Homo sapiens
caaaaauguaaugaucaua

SEQ ID NO: 1434678 - RNA, 17 nt, Homo sapiens
caaaacaaaacaacaac

SEQ ID NO: 1434679 - RNA, 19 nt, Homo sapiens
caaaacgcaaaacccagua

SEQ ID NO: 1434680 - RNA, 12 nt, Homo sapiens
caaaacucuccu

SEQ ID NO: 1434681 - RNA, 18 nt, Homo sapiens
caaaagaugccauucaua

SEQ ID NO: 1434682 - RNA, 11 nt, Homo sapiens
caaaaguggau

SEQ ID NO: 1434683 - RNA, 17 nt, Homo sapiens
caaaauaaggggcaccu

SEQ ID NO: 1434684 - RNA, 22 nt, Homo sapiens
caaaaucaauuuuuugcuaaac

SEQ ID NO: 1434685 - RNA, 22 nt, Homo sapiens
caaaauuucaaaagugaucugu

SEQ ID NO: 1434686 - RNA, 19 nt, Homo sapiens
caaacacaccgaugcacac

SEQ ID NO: 1434687 - RNA, 16 nt, Homo sapiens
caaacagccccaaagu

SEQ ID NO: 1434688 - RNA, 15 nt, Homo sapiens
caaaccacuguacau

SEQ ID NO: 1434689 - RNA, 12 nt, Homo sapiens
caaaccauuuaa

SEQ ID NO: 1434690 - RNA, 16 nt, Homo sapiens
caaaccccgaccaccu

SEQ ID NO: 1434691 - RNA, 14 nt, Homo sapiens
caaaccgcaggcaa

SEQ ID NO: 1434692 - RNA, 19 nt, Homo sapiens
caaacguuuugaacuaaua

SEQ ID NO: 1434693 - RNA, 16 nt, Homo sapiens
caaacuacaaagcuga

SEQ ID NO: 1434694 - RNA, 14 nt, Homo sapiens
caaacuacauguaa

SEQ ID NO: 1434695 - RNA, 19 nt, Homo sapiens
caaacuaugaucacaguga

SEQ ID NO: 1434696 - RNA, 17 nt, Homo sapiens
caaacucacugcucaag

SEQ ID NO: 1434697 - RNA, 21 nt, Homo sapiens
caaacucacugcucaagaaga

SEQ ID NO: 1434698 - RNA, 20 nt, Homo sapiens
caaacucucccccaaaugua

SEQ ID NO: 1434699 - RNA, 17 nt, Homo sapiens
caaacugacaaccugug

SEQ ID NO: 1434700 - RNA, 18 nt, Homo sapiens
caaagaaaugcugaugga

SEQ ID NO: 1434701 - RNA, 17 nt, Homo sapiens
caaagaagaaguuuaaa

SEQ ID NO: 1434702 - RNA, 14 nt, Homo sapiens
caaagaauacuaga

SEQ ID NO: 1434703 - RNA, 22 nt, Homo sapiens
caaagaauuccugaagccagau

SEQ ID NO: 1434704 - RNA, 22 nt, Homo sapiens
caaagagaaaaagaaaugcaaa

SEQ ID NO: 1434705 - RNA, 19 nt, Homo sapiens
caaagagaauaaagacuuc

SEQ ID NO: 1434706 - RNA, 14 nt, Homo sapiens
caaagagguauuua

SEQ ID NO: 1434707 - RNA, 13 nt, Homo sapiens
caaagcaccagcu

SEQ ID NO: 1434708 - RNA, 22 nt, Homo sapiens
caaagccccuggaaaugugcua

SEQ ID NO: 1434709 - RNA, 19 nt, Homo sapiens
caaaguuacaaauucaagg

SEQ ID NO: 1434710 - RNA, 13 nt, Homo sapiens
caaauaaacucca

SEQ ID NO: 1434711 - RNA, 12 nt, Homo sapiens
caaauagcacau

SEQ ID NO: 1434712 - RNA, 15 nt, Homo sapiens
caaauaugcaaagca

SEQ ID NO: 1434713 - RNA, 18 nt, Homo sapiens
caaaucuuaacuugaagg

SEQ ID NO: 1434714 - RNA, 15 nt, Homo sapiens
caaaugacccaaaga

SEQ ID NO: 1434715 - RNA, 16 nt, Homo sapiens
caaaugacccaaagac

SEQ ID NO: 1434716 - RNA, 20 nt, Homo sapiens
caaaugaguucaacuuugag

SEQ ID NO: 1434717 - RNA, 23 nt, Homo sapiens
caaauucauuuuuuucacuggag

SEQ ID NO: 1434718 - RNA, 16 nt, Homo sapiens
caaauucuuuuucaca

SEQ ID NO: 1434719 - RNA, 20 nt, Homo sapiens
caaauucuuuuucacacuga

SEQ ID NO: 1434720 - RNA, 19 nt, Homo sapiens
caaauugcugggauuacag

SEQ ID NO: 1434721 - RNA, 15 nt, Homo sapiens
caacaaacauagaaa

SEQ ID NO: 1434722 - RNA, 19 nt, Homo sapiens
caacaaagccaacagucaa

SEQ ID NO: 1434723 - RNA, 13 nt, Homo sapiens
caacaacaaggac

SEQ ID NO: 1434724 - RNA, 17 nt, Homo sapiens
caacaauacaugcugcu

SEQ ID NO: 1434725 - RNA, 19 nt, Homo sapiens
caacaauggggugggccca

SEQ ID NO: 1434726 - RNA, 23 nt, Homo sapiens
caacacaagcuggaagcacaugu

SEQ ID NO: 1434727 - RNA, 13 nt, Homo sapiens
caacaccaccucu

SEQ ID NO: 1434728 - RNA, 22 nt, Homo sapiens
caacacgagcaggcuacuguca

SEQ ID NO: 1434729 - RNA, 21 nt, Homo sapiens
caacaggcuguucugcacuga

SEQ ID NO: 1434730 - RNA, 22 nt, Homo sapiens
caacagguggcaggaccaggac

SEQ ID NO: 1434731 - RNA, 17 nt, Homo sapiens
caacaugcgaccgugac

SEQ ID NO: 1434732 - RNA, 16 nt, Homo sapiens
caacauucaaagcagc

SEQ ID NO: 1434733 - RNA, 13 nt, Homo sapiens
caaccaaccacaa

SEQ ID NO: 1434734 - RNA, 12 nt, Homo sapiens
caaccaauucca

SEQ ID NO: 1434735 - RNA, 20 nt, Homo sapiens
caaccagagaugacugaaac

SEQ ID NO: 1434736 - RNA, 14 nt, Homo sapiens
caaccagcauucau

SEQ ID NO: 1434737 - RNA, 18 nt, Homo sapiens
caaccaggaacauguaac

SEQ ID NO: 1434738 - RNA, 13 nt, Homo sapiens
caacccaccaucu

SEQ ID NO: 1434739 - RNA, 18 nt, Homo sapiens
caacccccgacuucaucc

SEQ ID NO: 1434740 - RNA, 21 nt, Homo sapiens
caacccccgacuucaucccaa

SEQ ID NO: 1434741 - RNA, 17 nt, Homo sapiens
caaccccuuuccacgag

SEQ ID NO: 1434742 - RNA, 23 nt, Homo sapiens
caacccgagaaaacaaacccagg

SEQ ID NO: 1434743 - RNA, 16 nt, Homo sapiens
caaccgcuugccauau

SEQ ID NO: 1434744 - RNA, 23 nt, Homo sapiens
caaccuguuuuggucacaucacu

SEQ ID NO: 1434745 - RNA, 19 nt, Homo sapiens
caacuaggauacuuucuac

SEQ ID NO: 1434746 - RNA, 18 nt, Homo sapiens
caacuauuuauugaauga

SEQ ID NO: 1434747 - RNA, 18 nt, Homo sapiens
caacuccuggagauuuca

SEQ ID NO: 1434748 - RNA, 22 nt, Homo sapiens
caacucuucauuuugagucuca

SEQ ID NO: 1434749 - RNA, 12 nt, Homo sapiens
caacugacacag

SEQ ID NO: 1434750 - RNA, 10 nt, Homo sapiens
caacugacca

SEQ ID NO: 1434751 - RNA, 23 nt, Homo sapiens
caacugcccaggaaggacugugc

SEQ ID NO: 1434752 - RNA, 19 nt, Homo sapiens
caacugcugaucaaugaaa

SEQ ID NO: 1434753 - RNA, 20 nt, Homo sapiens
caacuggcuucugugcacua

SEQ ID NO: 1434754 - RNA, 20 nt, Homo sapiens
caacuuauaaagcauugcaa

SEQ ID NO: 1434755 - RNA, 18 nt, Homo sapiens
caacuuguguucuauuaa

SEQ ID NO: 1434756 - RNA, 23 nt, Homo sapiens
caacuuuaauugcuuaaaagaca

SEQ ID NO: 1434757 - RNA, 22 nt, Homo sapiens
caagaaaaagaaaaaaaaagca

SEQ ID NO: 1434758 - RNA, 21 nt, Homo sapiens
caagaaagauccacccucaaa

SEQ ID NO: 1434759 - RNA, 19 nt, Homo sapiens
caagaaauaaaaaucaacu

SEQ ID NO: 1434760 - RNA, 23 nt, Homo sapiens
caagaacauuaucuuaguggaag

SEQ ID NO: 1434761 - RNA, 21 nt, Homo sapiens
caagaacuuuucccccaaaga

SEQ ID NO: 1434762 - RNA, 17 nt, Homo sapiens
caagaagucaaaguaaa

SEQ ID NO: 1434763 - RNA, 20 nt, Homo sapiens
caagaauauuguauguuaaa

SEQ ID NO: 1434764 - RNA, 16 nt, Homo sapiens
caagaccuucucccca

SEQ ID NO: 1434765 - RNA, 13 nt, Homo sapiens
caagacugaaaca

SEQ ID NO: 1434766 - RNA, 17 nt, Homo sapiens
caagacuugauacugca

SEQ ID NO: 1434767 - RNA, 12 nt, Homo sapiens
caagacuuugac

SEQ ID NO: 1434768 - RNA, 22 nt, Homo sapiens
caagaggacugagacuggcacu

SEQ ID NO: 1434769 - RNA, 16 nt, Homo sapiens
caagaggucuccauca

SEQ ID NO: 1434770 - RNA, 15 nt, Homo sapiens
caagaugggcacaug

SEQ ID NO: 1434771 - RNA, 21 nt, Homo sapiens
aucaucaccacaccgugagca

SEQ ID NO: 1434772 - RNA, 20 nt, Homo sapiens
aucaugaguaccucaaagga

SEQ ID NO: 1434773 - RNA, 21 nt, Homo sapiens
aucauguuuucccuaugagca

SEQ ID NO: 1434774 - RNA, 19 nt, Homo sapiens
aucauuguagaaacacagu

SEQ ID NO: 1434775 - RNA, 12 nt, Homo sapiens
auccacaagcaa

SEQ ID NO: 1434776 - RNA, 18 nt, Homo sapiens
auccacagccaacaaaca

SEQ ID NO: 1434777 - RNA, 21 nt, Homo sapiens
auccacagccaacaaacauag

SEQ ID NO: 1434778 - RNA, 18 nt, Homo sapiens
auccacccaccuuggccu

SEQ ID NO: 1434779 - RNA, 20 nt, Homo sapiens
auccacucuucuagggauau

SEQ ID NO: 1434780 - RNA, 23 nt, Homo sapiens
auccagaacugaggucacugggu

SEQ ID NO: 1434781 - RNA, 17 nt, Homo sapiens
auccagagauaauugcc

SEQ ID NO: 1434782 - RNA, 23 nt, Homo sapiens
auccauaacacccccaccccaac

SEQ ID NO: 1434783 - RNA, 22 nt, Homo sapiens
auccauagugcacuagcauuuu

SEQ ID NO: 1434784 - RNA, 22 nt, Homo sapiens
auccaucaggguuugcaaagua

SEQ ID NO: 1434785 - RNA, 18 nt, Homo sapiens
auccaugcgucaguuuuu

SEQ ID NO: 1434786 - RNA, 20 nt, Homo sapiens
auccauuucuaauguaugca

SEQ ID NO: 1434787 - RNA, 15 nt, Homo sapiens
aucccaaaggacagc

SEQ ID NO: 1434788 - RNA, 18 nt, Homo sapiens
aucccacuucacugugag

SEQ ID NO: 1434789 - RNA, 17 nt, Homo sapiens
aucccaucuaagcugca

SEQ ID NO: 1434790 - RNA, 17 nt, Homo sapiens
auccccaaaaaacaaga

SEQ ID NO: 1434791 - RNA, 14 nt, Homo sapiens
auccccucaaaauc

SEQ ID NO: 1434792 - RNA, 19 nt, Homo sapiens
auccccuggacugggaggu

SEQ ID NO: 1434793 - RNA, 17 nt, Homo sapiens
auccccuuggcugugag

SEQ ID NO: 1434794 - RNA, 19 nt, Homo sapiens
aucccgucuucuccaacac

SEQ ID NO: 1434795 - RNA, 18 nt, Homo sapiens
aucccgugaaagaauuau

SEQ ID NO: 1434796 - RNA, 20 nt, Homo sapiens
auccucaacaacaaaccaaa

SEQ ID NO: 1434797 - RNA, 17 nt, Homo sapiens
auccucaccauccacag

SEQ ID NO: 1434798 - RNA, 21 nt, Homo sapiens
auccucagguaguacugggaa

SEQ ID NO: 1434799 - RNA, 22 nt, Homo sapiens
auccuccucccaacucuagccu

SEQ ID NO: 1434800 - RNA, 17 nt, Homo sapiens
auccugccucuccccaa

SEQ ID NO: 1434801 - RNA, 22 nt, Homo sapiens
auccugcucauaacaucuuuga

SEQ ID NO: 1434802 - RNA, 13 nt, Homo sapiens
auccugugugcug

SEQ ID NO: 1434803 - RNA, 16 nt, Homo sapiens
auccuugauaaaugcc

SEQ ID NO: 1434804 - RNA, 20 nt, Homo sapiens
auccuugauaaaugccucau

SEQ ID NO: 1434805 - RNA, 15 nt, Homo sapiens
auccuuucuauugaa

SEQ ID NO: 1434806 - RNA, 14 nt, Homo sapiens
aucgagccacugca

SEQ ID NO: 1434807 - RNA, 20 nt, Homo sapiens
aucgauccuggauucacuca

SEQ ID NO: 1434808 - RNA, 21 nt, Homo sapiens
aucguggugugucaaugccac

SEQ ID NO: 1434809 - RNA, 19 nt, Homo sapiens
aucuaaaaagacuaaccug

SEQ ID NO: 1434810 - RNA, 15 nt, Homo sapiens
aucuaauaccauccu

SEQ ID NO: 1434811 - RNA, 17 nt, Homo sapiens
aucuaaucuaugcaugu

SEQ ID NO: 1434812 - RNA, 16 nt, Homo sapiens
aucuacccacuuacua

SEQ ID NO: 1434813 - RNA, 13 nt, Homo sapiens
aucuaguuuacuu

SEQ ID NO: 1434814 - RNA, 13 nt, Homo sapiens
aucuaugcaauuu

SEQ ID NO: 1434815 - RNA, 17 nt, Homo sapiens
aucuauuauaaaaccau

SEQ ID NO: 1434816 - RNA, 14 nt, Homo sapiens
aucucaaauucuca

SEQ ID NO: 1434817 - RNA, 19 nt, Homo sapiens
aucucacacaccagggcau

SEQ ID NO: 1434818 - RNA, 15 nt, Homo sapiens
aucucagccuaccau

SEQ ID NO: 1434819 - RNA, 18 nt, Homo sapiens
aucucauucagguguucu

SEQ ID NO: 1434820 - RNA, 13 nt, Homo sapiens
aucuccacuguua

SEQ ID NO: 1434821 - RNA, 14 nt, Homo sapiens
aucuccauuucaca

SEQ ID NO: 1434822 - RNA, 21 nt, Homo sapiens
aucucgugccagggcaggcua

SEQ ID NO: 1434823 - RNA, 21 nt, Homo sapiens
aucucuuaaaaaaugaauuug

SEQ ID NO: 1434824 - RNA, 13 nt, Homo sapiens
aucugaacacagu

SEQ ID NO: 1434825 - RNA, 22 nt, Homo sapiens
aucugagacuauaacugucauc

SEQ ID NO: 1434826 - RNA, 12 nt, Homo sapiens
aucugcacuggg

SEQ ID NO: 1434827 - RNA, 22 nt, Homo sapiens
aucugccuaggguccuguccau

SEQ ID NO: 1434828 - RNA, 16 nt, Homo sapiens
aucuguauauacaaua

SEQ ID NO: 1434829 - RNA, 18 nt, Homo sapiens
aucuguaugucugccuaa

SEQ ID NO: 1434830 - RNA, 14 nt, Homo sapiens
aucuguccaaggaa

SEQ ID NO: 1434831 - RNA, 17 nt, Homo sapiens
aucugugcaaauccuug

SEQ ID NO: 1434832 - RNA, 13 nt, Homo sapiens
aucuguguauaug

SEQ ID NO: 1434833 - RNA, 22 nt, Homo sapiens
aucuguuacugaaaugaggaga

SEQ ID NO: 1434834 - RNA, 20 nt, Homo sapiens
aucuguuugaucccuguuac

SEQ ID NO: 1434835 - RNA, 17 nt, Homo sapiens
aucuuaaaaaccugccu

SEQ ID NO: 1434836 - RNA, 20 nt, Homo sapiens
aucuucauacaaugacaagu

SEQ ID NO: 1434837 - RNA, 15 nt, Homo sapiens
aucuucuuaugcaau

SEQ ID NO: 1434838 - RNA, 17 nt, Homo sapiens
aucuugacauguaauga

SEQ ID NO: 1434839 - RNA, 18 nt, Homo sapiens
aucuuuaaaauacacacu

SEQ ID NO: 1434840 - RNA, 13 nt, Homo sapiens
aucuuucuuacua

SEQ ID NO: 1434841 - RNA, 18 nt, Homo sapiens
aucuuucuuuaccugaga

SEQ ID NO: 1434842 - RNA, 12 nt, Homo sapiens
aucuuuuccacu

SEQ ID NO: 1434843 - RNA, 14 nt, Homo sapiens
aucuuuuuccuccc

SEQ ID NO: 1434844 - RNA, 23 nt, Homo sapiens
augaaaacucauuacuuuuccau

SEQ ID NO: 1434845 - RNA, 19 nt, Homo sapiens
augaaaacugaaucaagaa

SEQ ID NO: 1434846 - RNA, 16 nt, Homo sapiens
augaaaauuaggauuu

SEQ ID NO: 1434847 - RNA, 22 nt, Homo sapiens
augaaacuccugauuuuguagu

SEQ ID NO: 1434848 - RNA, 13 nt, Homo sapiens
augaaaucuugca

SEQ ID NO: 1434849 - RNA, 17 nt, Homo sapiens
augaacacacauggaug

SEQ ID NO: 1434850 - RNA, 22 nt, Homo sapiens
augaacacacauggaugcacac

SEQ ID NO: 1434851 - RNA, 17 nt, Homo sapiens
augaacagcagaaagac

SEQ ID NO: 1434852 - RNA, 17 nt, Homo sapiens
augaacuggaccugcac

SEQ ID NO: 1434853 - RNA, 15 nt, Homo sapiens
augaagacccagugu

SEQ ID NO: 1434854 - RNA, 18 nt, Homo sapiens
augaagacccaguguaaa

SEQ ID NO: 1434855 - RNA, 14 nt, Homo sapiens
cugagaaucuagcc

SEQ ID NO: 1434856 - RNA, 12 nt, Homo sapiens
cugagaauucca

SEQ ID NO: 1434857 - RNA, 16 nt, Homo sapiens
cugagaauuccaagga

SEQ ID NO: 1434858 - RNA, 22 nt, Homo sapiens
cugagacuucaggugcauucca

SEQ ID NO: 1434859 - RNA, 16 nt, Homo sapiens
cugagagaaacugagg

SEQ ID NO: 1434860 - RNA, 22 nt, Homo sapiens
cugagagacccaaggaggaaaa

SEQ ID NO: 1434861 - RNA, 19 nt, Homo sapiens
cugagaugcacgaugcugg

SEQ ID NO: 1434862 - RNA, 18 nt, Homo sapiens
cugagaugugaacacauc

SEQ ID NO: 1434863 - RNA, 16 nt, Homo sapiens
cugagcauaaugcucc

SEQ ID NO: 1434864 - RNA, 17 nt, Homo sapiens
cugagccugccgagcaa

SEQ ID NO: 1434865 - RNA, 22 nt, Homo sapiens
cugagcuagaauuauucucuua

SEQ ID NO: 1434866 - RNA, 18 nt, Homo sapiens
cugagcuggaucacuuga

SEQ ID NO: 1434867 - RNA, 18 nt, Homo sapiens
cugaggaugugagccuga

SEQ ID NO: 1434868 - RNA, 13 nt, Homo sapiens
cugaggauuucaa

SEQ ID NO: 1434869 - RNA, 21 nt, Homo sapiens
cugaggcccagaaagaggcag

SEQ ID NO: 1434870 - RNA, 17 nt, Homo sapiens
cugaggcuccugugcua

SEQ ID NO: 1434871 - RNA, 21 nt, Homo sapiens
cugaggggggccgugcccagg

SEQ ID NO: 1434872 - RNA, 22 nt, Homo sapiens
cugaggguccccaccugggacc

SEQ ID NO: 1434873 - RNA, 15 nt, Homo sapiens
cugagguccugagca

SEQ ID NO: 1434874 - RNA, 19 nt, Homo sapiens
cugaguggaucuccaagga

SEQ ID NO: 1434875 - RNA, 13 nt, Homo sapiens
cugaguggggcca

SEQ ID NO: 1434876 - RNA, 15 nt, Homo sapiens
cugauaaacauuaaa

SEQ ID NO: 1434877 - RNA, 12 nt, Homo sapiens
cugauaagcaaa

SEQ ID NO: 1434878 - RNA, 22 nt, Homo sapiens
cugauaauauguuugagguuaa

SEQ ID NO: 1434879 - RNA, 18 nt, Homo sapiens
cugauaugggacugagcc

SEQ ID NO: 1434880 - RNA, 23 nt, Homo sapiens
cugaucccuuucccaugauccag

SEQ ID NO: 1434881 - RNA, 17 nt, Homo sapiens
cugaugacacauuuggc

SEQ ID NO: 1434882 - RNA, 22 nt, Homo sapiens
cugaugaugucucuuguagaag

SEQ ID NO: 1434883 - RNA, 12 nt, Homo sapiens
cugaugugccag

SEQ ID NO: 1434884 - RNA, 13 nt, Homo sapiens
cugauucaagaaa

SEQ ID NO: 1434885 - RNA, 14 nt, Homo sapiens
cugauuucagggaa

SEQ ID NO: 1434886 - RNA, 14 nt, Homo sapiens
cugcaaauuucaaa

SEQ ID NO: 1434887 - RNA, 13 nt, Homo sapiens
cugcaagggccag

SEQ ID NO: 1434888 - RNA, 17 nt, Homo sapiens
cugcaauuuuaauugau

SEQ ID NO: 1434889 - RNA, 20 nt, Homo sapiens
cugcacuccagccugggcaa

SEQ ID NO: 1434890 - RNA, 17 nt, Homo sapiens
cugcagaaggccaagaa

SEQ ID NO: 1434891 - RNA, 19 nt, Homo sapiens
cugcagagcugacccagag

SEQ ID NO: 1434892 - RNA, 19 nt, Homo sapiens
cugcagccccggcugacac

SEQ ID NO: 1434893 - RNA, 16 nt, Homo sapiens
cugcagcuuccuguca

SEQ ID NO: 1434894 - RNA, 11 nt, Homo sapiens
cugcaucucau

SEQ ID NO: 1434895 - RNA, 15 nt, Homo sapiens
cugcaugcucuggaa

SEQ ID NO: 1434896 - RNA, 14 nt, Homo sapiens
cugcauguucugcu

SEQ ID NO: 1434897 - RNA, 21 nt, Homo sapiens
cuggaaucaaggaauccugag

SEQ ID NO: 1434898 - RNA, 20 nt, Homo sapiens
cuggacacuuauggggacag

SEQ ID NO: 1434899 - RNA, 15 nt, Homo sapiens
cuggaccacugggca

SEQ ID NO: 1434900 - RNA, 12 nt, Homo sapiens
cuggacugggag

SEQ ID NO: 1434901 - RNA, 21 nt, Homo sapiens
cuggagaaagggaaguggaag

SEQ ID NO: 1434902 - RNA, 17 nt, Homo sapiens
cuggagagacugugcug

SEQ ID NO: 1434903 - RNA, 22 nt, Homo sapiens
cuggagauggaaaaucacacca

SEQ ID NO: 1434904 - RNA, 20 nt, Homo sapiens
cuggagggcuagaaucugga

SEQ ID NO: 1434905 - RNA, 20 nt, Homo sapiens
cuggagggcuggaaucugga

SEQ ID NO: 1434906 - RNA, 13 nt, Homo sapiens
cuggauccaucag

SEQ ID NO: 1434907 - RNA, 15 nt, Homo sapiens
cuggauucgugacaa

SEQ ID NO: 1434908 - RNA, 16 nt, Homo sapiens
cuggauugcagacuca

SEQ ID NO: 1434909 - RNA, 16 nt, Homo sapiens
cuggcaagcagggaaa

SEQ ID NO: 1434910 - RNA, 15 nt, Homo sapiens
cuggcacaggacuga

SEQ ID NO: 1434911 - RNA, 15 nt, Homo sapiens
cuggcacaguuuucu

SEQ ID NO: 1434912 - RNA, 12 nt, Homo sapiens
cuggcacccacu

SEQ ID NO: 1434913 - RNA, 11 nt, Homo sapiens
cuggcacugag

SEQ ID NO: 1434914 - RNA, 20 nt, Homo sapiens
cuggcacuuagcccaagagg

SEQ ID NO: 1434915 - RNA, 19 nt, Homo sapiens
cuggcagccgugccuucag

SEQ ID NO: 1434916 - RNA, 15 nt, Homo sapiens
cuggcaugacacucu

SEQ ID NO: 1434917 - RNA, 12 nt, Homo sapiens
cuggccagagag

SEQ ID NO: 1434918 - RNA, 18 nt, Homo sapiens
cuggccauccccagaggu

SEQ ID NO: 1434919 - RNA, 20 nt, Homo sapiens
cuggccccgggcucuggcca

SEQ ID NO: 1434920 - RNA, 23 nt, Homo sapiens
cuggccuggaucuccccacucua

SEQ ID NO: 1434921 - RNA, 18 nt, Homo sapiens
cuggcgcaucauaugcag

SEQ ID NO: 1434922 - RNA, 14 nt, Homo sapiens
cuggcucucagaag

SEQ ID NO: 1434923 - RNA, 13 nt, Homo sapiens
cuggcugagcuga

SEQ ID NO: 1434924 - RNA, 23 nt, Homo sapiens
cuggcuuccagguaucuccagga

SEQ ID NO: 1434925 - RNA, 14 nt, Homo sapiens
cuggcuuccuagaa

SEQ ID NO: 1434926 - RNA, 14 nt, Homo sapiens
cuggcuuugucucu

SEQ ID NO: 1434927 - RNA, 21 nt, Homo sapiens
cugggaaaggaaaaccaggga

SEQ ID NO: 1434928 - RNA, 20 nt, Homo sapiens
cugggcagcugucauggaaa

SEQ ID NO: 1434929 - RNA, 22 nt, Homo sapiens
cugggccccaccaccuaggcca

SEQ ID NO: 1434930 - RNA, 15 nt, Homo sapiens
cugggccucaguuca

SEQ ID NO: 1434931 - RNA, 16 nt, Homo sapiens
cugggcgccaacugcu

SEQ ID NO: 1434932 - RNA, 19 nt, Homo sapiens
cugggcuugugaacaccuc

SEQ ID NO: 1434933 - RNA, 21 nt, Homo sapiens
cugggugccgggcugcacaga

SEQ ID NO: 1434934 - RNA, 15 nt, Homo sapiens
cuggguuuucuaacu

SEQ ID NO: 1434935 - RNA, 17 nt, Homo sapiens
cugguaauuuguaucug

SEQ ID NO: 1434936 - RNA, 16 nt, Homo sapiens
cugguccugagucuug

SEQ ID NO: 1434937 - RNA, 22 nt, Homo sapiens
cuguuaaaauguacacuggaua

SEQ ID NO: 1434938 - RNA, 12 nt, Homo sapiens
cuguuaagcaau

SEQ ID NO: 1434939 - RNA, 23 nt, Homo sapiens
cuguuacauaacaagaaaaucaa

SEQ ID NO: 1434940 - RNA, 22 nt, Homo sapiens
cuguuacuugaaauaccaguga

SEQ ID NO: 1434941 - RNA, 19 nt, Homo sapiens
cuguuccacuucucuagag

SEQ ID NO: 1434942 - RNA, 11 nt, Homo sapiens
cuguuccucaa

SEQ ID NO: 1434943 - RNA, 22 nt, Homo sapiens
cuguugaaaauuauuuuaaaca

SEQ ID NO: 1434944 - RNA, 13 nt, Homo sapiens
cuguugaaucuug

SEQ ID NO: 1434945 - RNA, 14 nt, Homo sapiens
cuguugcaccucag

SEQ ID NO: 1434946 - RNA, 12 nt, Homo sapiens
cuguugcucaaa

SEQ ID NO: 1434947 - RNA, 12 nt, Homo sapiens
cuguuggucugu

SEQ ID NO: 1434948 - RNA, 15 nt, Homo sapiens
cuguuucugaaccau

SEQ ID NO: 1434949 - RNA, 21 nt, Homo sapiens
cuguuuuuuuaagaaagugca

SEQ ID NO: 1434950 - RNA, 21 nt, Homo sapiens
cuuaaaacugaaaaauuuuau

SEQ ID NO: 1434951 - RNA, 19 nt, Homo sapiens
cuuaaagcacagucugaug

SEQ ID NO: 1434952 - RNA, 21 nt, Homo sapiens
cuuaaauaaauucaaaccauu

SEQ ID NO: 1434953 - RNA, 20 nt, Homo sapiens
cuuaaccucucuaagccaca

SEQ ID NO: 1434954 - RNA, 16 nt, Homo sapiens
cuuaagccuuuugcuc

SEQ ID NO: 1434955 - RNA, 23 nt, Homo sapiens
cuuaaggcuugaaguaaccuuau

SEQ ID NO: 1434956 - RNA, 19 nt, Homo sapiens
cuuaaggggauggggguca

SEQ ID NO: 1434957 - RNA, 14 nt, Homo sapiens
cuuaauaggcuuua

SEQ ID NO: 1434958 - RNA, 20 nt, Homo sapiens
cuuaaucugccauaaagcca

SEQ ID NO: 1434959 - RNA, 19 nt, Homo sapiens
cuuacaucugcagcucuuu

SEQ ID NO: 1434960 - RNA, 15 nt, Homo sapiens
cuuaccaacuuucug

SEQ ID NO: 1434961 - RNA, 19 nt, Homo sapiens
cuuaccuagauucuacaua

SEQ ID NO: 1434962 - RNA, 22 nt, Homo sapiens
cuuaccuauuauaaaaucuuac

SEQ ID NO: 1434963 - RNA, 13 nt, Homo sapiens
cuuaccuuuacau

SEQ ID NO: 1434964 - RNA, 20 nt, Homo sapiens
cuuacucccaggcacugucu

SEQ ID NO: 1434965 - RNA, 14 nt, Homo sapiens
cuuacuuaaaccca

SEQ ID NO: 1434966 - RNA, 21 nt, Homo sapiens
cuuacuuuuggauaauaucca

SEQ ID NO: 1434967 - RNA, 19 nt, Homo sapiens
cuuagaccgaaggggaaaa

SEQ ID NO: 1434968 - RNA, 22 nt, Homo sapiens
cuuagaugagggugacugucaa

SEQ ID NO: 1434969 - RNA, 17 nt, Homo sapiens
cuuagcugaacaaugaa

SEQ ID NO: 1434970 - RNA, 16 nt, Homo sapiens
cuuagcugucugcuca

SEQ ID NO: 1434971 - RNA, 22 nt, Homo sapiens
cuuaggaacagcucuucacuca

SEQ ID NO: 1434972 - RNA, 11 nt, Homo sapiens
cuuaggugcca

SEQ ID NO: 1434973 - RNA, 13 nt, Homo sapiens
cuuagguuuuaac

SEQ ID NO: 1434974 - RNA, 18 nt, Homo sapiens
cuuaguaaucccccuugc

SEQ ID NO: 1434975 - RNA, 14 nt, Homo sapiens
gagaaggaaggcuc

SEQ ID NO: 1434976 - RNA, 12 nt, Homo sapiens
gagaauugccuc

SEQ ID NO: 1434977 - RNA, 18 nt, Homo sapiens
gagacagaccgggguuca

SEQ ID NO: 1434978 - RNA, 12 nt, Homo sapiens
gagacagucuca

SEQ ID NO: 1434979 - RNA, 14 nt, Homo sapiens
gagacaguucaaga

SEQ ID NO: 1434980 - RNA, 19 nt, Homo sapiens
gagacauguaccuugacca

SEQ ID NO: 1434981 - RNA, 19 nt, Homo sapiens
gagacccagagagcuaggg

SEQ ID NO: 1434982 - RNA, 17 nt, Homo sapiens
gagaccucuacugccuu

SEQ ID NO: 1434983 - RNA, 23 nt, Homo sapiens
gagacgcagcccugggggccagc

SEQ ID NO: 1434984 - RNA, 17 nt, Homo sapiens
gagacuauaacugucau

SEQ ID NO: 1434985 - RNA, 23 nt, Homo sapiens
gagacugugcugggaacauguac

SEQ ID NO: 1434986 - RNA, 20 nt, Homo sapiens
gagacuuggggaccagaggu

SEQ ID NO: 1434987 - RNA, 13 nt, Homo sapiens
gagagacccaagg

SEQ ID NO: 1434988 - RNA, 22 nt, Homo sapiens
gagagacgcagcccugggggcc

SEQ ID NO: 1434989 - RNA, 20 nt, Homo sapiens
gagagauggaauaaagcccu

SEQ ID NO: 1434990 - RNA, 20 nt, Homo sapiens
gagagcagaugguccuccau

SEQ ID NO: 1434991 - RNA, 20 nt, Homo sapiens
gagagcggcugcccgacuca

SEQ ID NO: 1434992 - RNA, 18 nt, Homo sapiens
gagagcucgcucuuggga

SEQ ID NO: 1434993 - RNA, 17 nt, Homo sapiens
gagaggaagcucucuuu

SEQ ID NO: 1434994 - RNA, 18 nt, Homo sapiens
gagaggaccccacuggac

SEQ ID NO: 1434995 - RNA, 12 nt, Homo sapiens
gagaggacucug

SEQ ID NO: 1434996 - RNA, 14 nt, Homo sapiens
gagaggcaugugau

SEQ ID NO: 1434997 - RNA, 18 nt, Homo sapiens
gagaggccuuuuggaaug

SEQ ID NO: 1434998 - RNA, 18 nt, Homo sapiens
gagagggaagagugcauu

SEQ ID NO: 1434999 - RNA, 20 nt, Homo sapiens
gagaguacagugagccaaga

SEQ ID NO: 1435000 - RNA, 20 nt, Homo sapiens
gagaguccucuggauggcac

SEQ ID NO: 1435001 - RNA, 11 nt, Homo sapiens
gagauaugcac

SEQ ID NO: 1435002 - RNA, 15 nt, Homo sapiens
gagauaugcacacac

SEQ ID NO: 1435003 - RNA, 13 nt, Homo sapiens
gagauauuuacau

SEQ ID NO: 1435004 - RNA, 20 nt, Homo sapiens
gagaugcaugcgcaggcuca

SEQ ID NO: 1435005 - RNA, 17 nt, Homo sapiens
gagauggaauaaagccc

SEQ ID NO: 1435006 - RNA, 23 nt, Homo sapiens
gagauuuucuuggcaguauucca

SEQ ID NO: 1435007 - RNA, 19 nt, Homo sapiens
gagauuuugucgggacaga

SEQ ID NO: 1435008 - RNA, 18 nt, Homo sapiens
gagcaaauguggcuccug

SEQ ID NO: 1435009 - RNA, 23 nt, Homo sapiens
gagcaacaguuaugggacacuga

SEQ ID NO: 1435010 - RNA, 16 nt, Homo sapiens
gagcaagugacaugcc

SEQ ID NO: 1435011 - RNA, 14 nt, Homo sapiens
gagcacaaguucca

SEQ ID NO: 1435012 - RNA, 21 nt, Homo sapiens
gagcacuggguugacuuucag

SEQ ID NO: 1435013 - RNA, 20 nt, Homo sapiens
gagcaggcuacugucagcuc

SEQ ID NO: 1435014 - RNA, 18 nt, Homo sapiens
gagcaggcucagacucug

SEQ ID NO: 1435015 - RNA, 17 nt, Homo sapiens
gagcaggguuagcucac

SEQ ID NO: 1435016 - RNA, 22 nt, Homo sapiens
gagcauaauaaauuauauuaaa

SEQ ID NO: 1435017 - RNA, 22 nt, Homo sapiens
gagcauaucaaaaaguauuaaa

SEQ ID NO: 1435018 - RNA, 13 nt, Homo sapiens
gagcaucaugccu

SEQ ID NO: 1435019 - RNA, 16 nt, Homo sapiens
gagccaaacacacugu

SEQ ID NO: 1435020 - RNA, 19 nt, Homo sapiens
gagccaaacacacuguaaa

SEQ ID NO: 1435021 - RNA, 21 nt, Homo sapiens
gagcccauuucaauucucaaa

SEQ ID NO: 1435022 - RNA, 23 nt, Homo sapiens
gagcccugugaggcuggguccaa

SEQ ID NO: 1435023 - RNA, 12 nt, Homo sapiens
gagccgcuguga

SEQ ID NO: 1435024 - RNA, 14 nt, Homo sapiens
gagccuagccaccu

SEQ ID NO: 1435025 - RNA, 12 nt, Homo sapiens
gagccucuuagu

SEQ ID NO: 1435026 - RNA, 16 nt, Homo sapiens
gagccuggaagccaaa

SEQ ID NO: 1435027 - RNA, 20 nt, Homo sapiens
gagccuggagggaugccacc

SEQ ID NO: 1435028 - RNA, 13 nt, Homo sapiens
gagcuagaaccua

SEQ ID NO: 1435029 - RNA, 17 nt, Homo sapiens
gagcuauggugaggugu

SEQ ID NO: 1435030 - RNA, 23 nt, Homo sapiens
gagcucacaguacaauguuucag

SEQ ID NO: 1435031 - RNA, 23 nt, Homo sapiens
gagcuccugucccagcuccagga

SEQ ID NO: 1435032 - RNA, 22 nt, Homo sapiens
gagcucgcucuugggagucagg

SEQ ID NO: 1435033 - RNA, 15 nt, Homo sapiens
gagcugccagccggg

SEQ ID NO: 1435034 - RNA, 14 nt, Homo sapiens
gagcugcgugccac

SEQ ID NO: 1435035 - RNA, 17 nt, Homo sapiens
gagcugcucugcuauau

SEQ ID NO: 1435036 - RNA, 15 nt, Homo sapiens
gagcugucuccagga

SEQ ID NO: 1435037 - RNA, 19 nt, Homo sapiens
gagcuuagccuugugcccu

SEQ ID NO: 1435038 - RNA, 13 nt, Homo sapiens
gagcuucaguaua

SEQ ID NO: 1435039 - RNA, 17 nt, Homo sapiens
gagcuuuaguccuagag

SEQ ID NO: 1435040 - RNA, 22 nt, Homo sapiens
gaggaaaaacgaucgcugugaa

SEQ ID NO: 1435041 - RNA, 13 nt, Homo sapiens
gaggaaccucaaa

SEQ ID NO: 1435042 - RNA, 21 nt, Homo sapiens
gaggaagaggaggaagguugg

SEQ ID NO: 1435043 - RNA, 17 nt, Homo sapiens
gaggaauaagcucccag

SEQ ID NO: 1435044 - RNA, 13 nt, Homo sapiens
gaggacaaagugu

SEQ ID NO: 1435045 - RNA, 14 nt, Homo sapiens
gaggaccgggcugg

SEQ ID NO: 1435046 - RNA, 16 nt, Homo sapiens
gaggagacccuggaau

SEQ ID NO: 1435047 - RNA, 12 nt, Homo sapiens
gaggaugaccag

SEQ ID NO: 1435048 - RNA, 20 nt, Homo sapiens
gaggauugcuucuugugaaa

SEQ ID NO: 1435049 - RNA, 15 nt, Homo sapiens
gaggcaaaggccagc

SEQ ID NO: 1435050 - RNA, 17 nt, Homo sapiens
gaggcagaauaagaaaa

SEQ ID NO: 1435051 - RNA, 19 nt, Homo sapiens
gaggcagaccauccaccag

SEQ ID NO: 1435052 - RNA, 22 nt, Homo sapiens
gaggcagaccauccaccaggcc

SEQ ID NO: 1435053 - RNA, 23 nt, Homo sapiens
gaggcagcgugaaagcagaugag

SEQ ID NO: 1435054 - RNA, 17 nt, Homo sapiens
gaggccgggcgcagugg

SEQ ID NO: 1435055 - RNA, 20 nt, Homo sapiens
gaggccugcccucagggauc

SEQ ID NO: 1435056 - RNA, 12 nt, Homo sapiens
gaggcuauuaaa

SEQ ID NO: 1435057 - RNA, 15 nt, Homo sapiens
gaggcucagccacac

SEQ ID NO: 1435058 - RNA, 17 nt, Homo sapiens
gaggcucagccacacag

SEQ ID NO: 1435059 - RNA, 20 nt, Homo sapiens
gaggcucagccacacaggaa

SEQ ID NO: 1435060 - RNA, 12 nt, Homo sapiens
gaggcugcagaa

SEQ ID NO: 1435061 - RNA, 16 nt, Homo sapiens
gaggcugcagaaggcc

SEQ ID NO: 1435062 - RNA, 23 nt, Homo sapiens
uuuaaagugguucuggauaucuu

SEQ ID NO: 1435063 - RNA, 15 nt, Homo sapiens
uuuaaaguguggaag

SEQ ID NO: 1435064 - RNA, 14 nt, Homo sapiens
uuuaaaugacugcu

SEQ ID NO: 1435065 - RNA, 19 nt, Homo sapiens
uuuaaucauuuugccucuu

SEQ ID NO: 1435066 - RNA, 17 nt, Homo sapiens
uuuaauuucuauggaag

SEQ ID NO: 1435067 - RNA, 17 nt, Homo sapiens
uuuaauuuguuaucuca

SEQ ID NO: 1435068 - RNA, 16 nt, Homo sapiens
uuuacagcucuuggca

SEQ ID NO: 1435069 - RNA, 21 nt, Homo sapiens
uuuacauaucaccucauggcc

SEQ ID NO: 1435070 - RNA, 14 nt, Homo sapiens
uuuaccacagcagc

SEQ ID NO: 1435071 - RNA, 14 nt, Homo sapiens
uuuaccacuaugca

SEQ ID NO: 1435072 - RNA, 17 nt, Homo sapiens
uuuaccuaccaccuucc

SEQ ID NO: 1435073 - RNA, 17 nt, Homo sapiens
uuuaccugagaccaguu

SEQ ID NO: 1435074 - RNA, 17 nt, Homo sapiens
uuuacucaucaggucau

SEQ ID NO: 1435075 - RNA, 21 nt, Homo sapiens
uuuacuggaccccgccuccca

SEQ ID NO: 1435076 - RNA, 20 nt, Homo sapiens
uuuagaucccaugucaccuc

SEQ ID NO: 1435077 - RNA, 19 nt, Homo sapiens
uuuagcuucucugccaagc

SEQ ID NO: 1435078 - RNA, 21 nt, Homo sapiens
uuuaggagacagucucaagca

SEQ ID NO: 1435079 - RNA, 15 nt, Homo sapiens
uuuauaucuauagua

SEQ ID NO: 1435080 - RNA, 13 nt, Homo sapiens
uuuaucugucaca

SEQ ID NO: 1435081 - RNA, 14 nt, Homo sapiens
uuuaucugugcaaa

SEQ ID NO: 1435082 - RNA, 16 nt, Homo sapiens
uuuauuaauucauuaa

SEQ ID NO: 1435083 - RNA, 23 nt, Homo sapiens
uuuauuaguuaggugugccaaac

SEQ ID NO: 1435084 - RNA, 18 nt, Homo sapiens
uuuauuggggugccuauu

SEQ ID NO: 1435085 - RNA, 22 nt, Homo sapiens
uuuauugucggaagacuugcca

SEQ ID NO: 1435086 - RNA, 15 nt, Homo sapiens
uuuauugugaucuau

SEQ ID NO: 1435087 - RNA, 17 nt, Homo sapiens
uuuauuuacaucuaugu

SEQ ID NO: 1435088 - RNA, 13 nt, Homo sapiens
uuuauuucuguca

SEQ ID NO: 1435089 - RNA, 23 nt, Homo sapiens
uuucaaagaaggaauucuaggca

SEQ ID NO: 1435090 - RNA, 12 nt, Homo sapiens
uuucaaagugua

SEQ ID NO: 1435091 - RNA, 17 nt, Homo sapiens
uuucaacuaauauaucu

SEQ ID NO: 1435092 - RNA, 14 nt, Homo sapiens
uuucaccauuuccg

SEQ ID NO: 1435093 - RNA, 23 nt, Homo sapiens
uuucagaagccccauuugcacag

SEQ ID NO: 1435094 - RNA, 23 nt, Homo sapiens
uuucaguguaugauauacuuuau

SEQ ID NO: 1435095 - RNA, 19 nt, Homo sapiens
uuucauaccuaucaucuua

SEQ ID NO: 1435096 - RNA, 17 nt, Homo sapiens
uuucaugcuuuccuaaa

SEQ ID NO: 1435097 - RNA, 17 nt, Homo sapiens
uuucaugucauuugaca

SEQ ID NO: 1435098 - RNA, 13 nt, Homo sapiens
uuucauucaucca

SEQ ID NO: 1435099 - RNA, 21 nt, Homo sapiens
uuuccaaaaaggaacacugga

SEQ ID NO: 1435100 - RNA, 16 nt, Homo sapiens
uuuccaauugaacuuu

SEQ ID NO: 1435101 - RNA, 22 nt, Homo sapiens
uuuccacaagauucccagagac

SEQ ID NO: 1435102 - RNA, 21 nt, Homo sapiens
uuuccaccaucaaaugcugua

SEQ ID NO: 1435103 - RNA, 21 nt, Homo sapiens
uuuccauaaacacccaugaau

SEQ ID NO: 1435104 - RNA, 20 nt, Homo sapiens
uuuccauguaucuaccucac

SEQ ID NO: 1435105 - RNA, 15 nt, Homo sapiens
ggucuccuugcacuu

SEQ ID NO: 1435106 - RNA, 16 nt, Homo sapiens
ggucucgaacuccuga

SEQ ID NO: 1435107 - RNA, 16 nt, Homo sapiens
ggucugauuucaggau

SEQ ID NO: 1435108 - RNA, 18 nt, Homo sapiens
ggucugguuguugcacca

SEQ ID NO: 1435109 - RNA, 17 nt, Homo sapiens
ggugaccccagggcaca

SEQ ID NO: 1435110 - RNA, 15 nt, Homo sapiens
ggugagugcuuguca

SEQ ID NO: 1435111 - RNA, 19 nt, Homo sapiens
ggugagugcuugucaugga

SEQ ID NO: 1435112 - RNA, 19 nt, Homo sapiens
ggugccacucccugagcuu

SEQ ID NO: 1435113 - RNA, 18 nt, Homo sapiens
ggugccugccucugccau

SEQ ID NO: 1435114 - RNA, 22 nt, Homo sapiens
ggugccuucucacaucugucca

SEQ ID NO: 1435115 - RNA, 22 nt, Homo sapiens
ggugcgaucuuggcucacugca

SEQ ID NO: 1435116 - RNA, 16 nt, Homo sapiens
ggugcucacgacucuu

SEQ ID NO: 1435117 - RNA, 21 nt, Homo sapiens
gacaccuccauuucucuccag

SEQ ID NO: 1435118 - RNA, 15 nt, Homo sapiens
gacaccugccuuaac

SEQ ID NO: 1435119 - RNA, 23 nt, Homo sapiens
gacaccuuuuguauuuaaaaccu

SEQ ID NO: 1435120 - RNA, 20 nt, Homo sapiens
gacacucuagugacuuccug

SEQ ID NO: 1435121 - RNA, 14 nt, Homo sapiens
gacacugugcuaua

SEQ ID NO: 1435122 - RNA, 13 nt, Homo sapiens
gacagaaugucac

SEQ ID NO: 1435123 - RNA, 21 nt, Homo sapiens
gacagagaggggcagguugac

SEQ ID NO: 1435124 - RNA, 23 nt, Homo sapiens
gacagagccgcaaaucaacccca

SEQ ID NO: 1435125 - RNA, 16 nt, Homo sapiens
gacagagcgagacucc

SEQ ID NO: 1435126 - RNA, 22 nt, Homo sapiens
gacagaucccauccaucagcuc

SEQ ID NO: 1435127 - RNA, 19 nt, Homo sapiens
gacaggaggaaucauguca

SEQ ID NO: 1435128 - RNA, 13 nt, Homo sapiens
gacaggguuucac

SEQ ID NO: 1435129 - RNA, 19 nt, Homo sapiens
gacagguucccagcagcug

SEQ ID NO: 1435130 - RNA, 23 nt, Homo sapiens
gacagucccuugcugacauggcu

SEQ ID NO: 1435131 - RNA, 20 nt, Homo sapiens
gacagucucaagcacuaaaa

SEQ ID NO: 1435132 - RNA, 13 nt, Homo sapiens
gacagucuugcau

SEQ ID NO: 1435133 - RNA, 17 nt, Homo sapiens
gacauauaccuucucaa

SEQ ID NO: 1435134 - RNA, 19 nt, Homo sapiens
gacaugaacagaaacaaua

SEQ ID NO: 1435135 - RNA, 15 nt, Homo sapiens
gacaugacuaggaag

SEQ ID NO: 1435136 - RNA, 14 nt, Homo sapiens
gacaugcacugacc

SEQ ID NO: 1435137 - RNA, 16 nt, Homo sapiens
gacauggaauuaccuu

SEQ ID NO: 1435138 - RNA, 15 nt, Homo sapiens
gacauuaaaccugga

SEQ ID NO: 1435139 - RNA, 18 nt, Homo sapiens
gacauuucuaacauaugu

SEQ ID NO: 1435140 - RNA, 19 nt, Homo sapiens
gaccaccucucaauauuca

SEQ ID NO: 1435141 - RNA, 22 nt, Homo sapiens
gaccaccucucaauauucaaua

SEQ ID NO: 1435142 - RNA, 17 nt, Homo sapiens
gaccacugggcaaugau

SEQ ID NO: 1435143 - RNA, 24 nt, Homo sapiens
gaccacugggcaaugauggcaauu

SEQ ID NO: 1435144 - RNA, 20 nt, Homo sapiens
gaccauaaaggcauggcauu

SEQ ID NO: 1435145 - RNA, 16 nt, Homo sapiens
gaccaucgcaaccagg

SEQ ID NO: 1435146 - RNA, 20 nt, Homo sapiens
gacccaaagaccaauauuca

SEQ ID NO: 1435147 - RNA, 21 nt, Homo sapiens
gacccaagagguggggaccaa

SEQ ID NO: 1435148 - RNA, 23 nt, Homo sapiens
gacccaaguguugaggggaccaa

SEQ ID NO: 1435149 - RNA, 14 nt, Homo sapiens
gacccacccagugu

SEQ ID NO: 1435150 - RNA, 19 nt, Homo sapiens
gacccacgaacgcucuuag

SEQ ID NO: 1435151 - RNA, 12 nt, Homo sapiens
guauuaaacuug

SEQ ID NO: 1435152 - RNA, 21 nt, Homo sapiens
guauucuuuacuaaagauauc

SEQ ID NO: 1435153 - RNA, 17 nt, Homo sapiens
guauuuaccacagcagc

SEQ ID NO: 1435154 - RNA, 16 nt, Homo sapiens
guauuugccagcuuua

SEQ ID NO: 1435155 - RNA, 19 nt, Homo sapiens
guauuuuagcaggguacau

SEQ ID NO: 1435156 - RNA, 13 nt, Homo sapiens
gucaaauaucuca

SEQ ID NO: 1435157 - RNA, 17 nt, Homo sapiens
gucaacaaccaugccag

SEQ ID NO: 1435158 - RNA, 14 nt, Homo sapiens
gucaacuaugauau

SEQ ID NO: 1435159 - RNA, 21 nt, Homo sapiens
gucaauauuaaauacagacac

SEQ ID NO: 1435160 - RNA, 11 nt, Homo sapiens
gucaaugccac

SEQ ID NO: 1435161 - RNA, 23 nt, Homo sapiens
gucaauuucaguguaugauauac

SEQ ID NO: 1435162 - RNA, 14 nt, Homo sapiens
gucacagccaugaa

SEQ ID NO: 1435163 - RNA, 20 nt, Homo sapiens
gucacauauacaaaagcaag

SEQ ID NO: 1435164 - RNA, 19 nt, Homo sapiens
gucaccagcaacaucucga

SEQ ID NO: 1435165 - RNA, 18 nt, Homo sapiens
gucaccagcuaucuguca

SEQ ID NO: 1435166 - RNA, 17 nt, Homo sapiens
gucaccagcugccaaaa

SEQ ID NO: 1435167 - RNA, 11 nt, Homo sapiens
gucacugucuu

SEQ ID NO: 1435168 - RNA, 12 nt, Homo sapiens
gucacugucuuc

SEQ ID NO: 1435169 - RNA, 17 nt, Homo sapiens
gucacuuuuauuugaaa

SEQ ID NO: 1435170 - RNA, 22 nt, Homo sapiens
gucacuuuuuaaaccacuguau

SEQ ID NO: 1435171 - RNA, 18 nt, Homo sapiens
gucagaccaguacuggga

SEQ ID NO: 1435172 - RNA, 16 nt, Homo sapiens
gucagccuugcaucaa

SEQ ID NO: 1435173 - RNA, 20 nt, Homo sapiens
gucagccuugcaucaagggc

SEQ ID NO: 1435174 - RNA, 13 nt, Homo sapiens
gucaggacuguga

SEQ ID NO: 1435175 - RNA, 15 nt, Homo sapiens
gucaggcccagagaa

SEQ ID NO: 1435176 - RNA, 23 nt, Homo sapiens
gucagggagccuggaagccaaac

SEQ ID NO: 1435177 - RNA, 10 nt, Homo sapiens
gucauagaaa

SEQ ID NO: 1435178 - RNA, 13 nt, Homo sapiens
gucauauauucau

SEQ ID NO: 1435179 - RNA, 22 nt, Homo sapiens
gucaucaaauauuaccaaaaaa

SEQ ID NO: 1435180 - RNA, 17 nt, Homo sapiens
gucauucuacacugagg

SEQ ID NO: 1435181 - RNA, 16 nt, Homo sapiens
guccaaguccaaccug

SEQ ID NO: 1435182 - RNA, 13 nt, Homo sapiens
guccaauauuugg

SEQ ID NO: 1435183 - RNA, 19 nt, Homo sapiens
guccacccaggcugcacug

SEQ ID NO: 1435184 - RNA, 18 nt, Homo sapiens
guccagaagaauauucag

SEQ ID NO: 1435185 - RNA, 21 nt, Homo sapiens
guccagacagagcccugugag

SEQ ID NO: 1435186 - RNA, 11 nt, Homo sapiens
guccaggaaac

SEQ ID NO: 1435187 - RNA, 13 nt, Homo sapiens
guccagggcggga

SEQ ID NO: 1435188 - RNA, 17 nt, Homo sapiens
guccaggguugaucaca

SEQ ID NO: 1435189 - RNA, 13 nt, Homo sapiens
guccagugcaacc

SEQ ID NO: 1435190 - RNA, 19 nt, Homo sapiens
guccaugugguucuucaaa

SEQ ID NO: 1435191 - RNA, 17 nt, Homo sapiens
gucccaagcccagggac

SEQ ID NO: 1435192 - RNA, 19 nt, Homo sapiens
gucccagaaccacacuguu

SEQ ID NO: 1435193 - RNA, 20 nt, Homo sapiens
gucccagagguuaucugccu

SEQ ID NO: 1435194 - RNA, 15 nt, Homo sapiens
guccccuccacuguc

SEQ ID NO: 1435195 - RNA, 16 nt, Homo sapiens
guccccuccacuguca

SEQ ID NO: 1435196 - RNA, 16 nt, Homo sapiens
guccccucuugaccca

SEQ ID NO: 1435197 - RNA, 21 nt, Homo sapiens
gucccucaaaugacccaaaga

SEQ ID NO: 1435198 - RNA, 14 nt, Homo sapiens
gucccucagugaua

SEQ ID NO: 1435199 - RNA, 16 nt, Homo sapiens
gucccucccaucucua

SEQ ID NO: 1435200 - RNA, 23 nt, Homo sapiens
gucccuucuucccuaaucagcuc

SEQ ID NO: 1435201 - RNA, 14 nt, Homo sapiens
gucccuugcugaca

SEQ ID NO: 1435202 - RNA, 17 nt, Homo sapiens
gucccuugcugugagca

SEQ ID NO: 1435203 - RNA, 13 nt, Homo sapiens
gucccuuggagac

SEQ ID NO: 1435204 - RNA, 14 nt, Homo sapiens
guccguggaaccag

SEQ ID NO: 1435205 - RNA, 22 nt, Homo sapiens
guccuccauuucaacuccagaa

SEQ ID NO: 1435206 - RNA, 15 nt, Homo sapiens
guccugcuggcaccu

SEQ ID NO: 1435207 - RNA, 23 nt, Homo sapiens
guccugggaauaugcuagugaug

SEQ ID NO: 1435208 - RNA, 13 nt, Homo sapiens
guccuucauucuu

SEQ ID NO: 1435209 - RNA, 22 nt, Homo sapiens
gucggcacgucccaugugcaug

SEQ ID NO: 1435210 - RNA, 16 nt, Homo sapiens
gucuaaagagcuuuag

SEQ ID NO: 1435211 - RNA, 14 nt, Homo sapiens
gucuacuucacuaa

SEQ ID NO: 1435212 - RNA, 20 nt, Homo sapiens
gucuagaggugagaccaaag

SEQ ID NO: 1435213 - RNA, 18 nt, Homo sapiens
gucuaguagcggaucuca

SEQ ID NO: 1435214 - RNA, 15 nt, Homo sapiens
gucuauaugucuagc

SEQ ID NO: 1435215 - RNA, 13 nt, Homo sapiens
gucucaauccuua

SEQ ID NO: 1435216 - RNA, 23 nt, Homo sapiens
gucucaccccucauccuuuuacu

SEQ ID NO: 1435217 - RNA, 16 nt, Homo sapiens
gucuccgcacuuggaa

SEQ ID NO: 1435218 - RNA, 18 nt, Homo sapiens
gucuccuuugcacugagg

SEQ ID NO: 1435219 - RNA, 23 nt, Homo sapiens
gucucgucuccugacaugucuca

SEQ ID NO: 1435220 - RNA, 18 nt, Homo sapiens
gucucuacuaaaaauaca

SEQ ID NO: 1435221 - RNA, 11 nt, Homo sapiens
gucucuagcca

SEQ ID NO: 1435222 - RNA, 21 nt, Homo sapiens
gucucucauucucuuucuuuu

SEQ ID NO: 1435223 - RNA, 16 nt, Homo sapiens
gucugagcuucaguau

SEQ ID NO: 1435224 - RNA, 12 nt, Homo sapiens
gucugagguccu

SEQ ID NO: 1435225 - RNA, 15 nt, Homo sapiens
gucugccccacccuc

SEQ ID NO: 1435226 - RNA, 14 nt, Homo sapiens
gucuuacugugauc

SEQ ID NO: 1435227 - RNA, 21 nt, Homo sapiens
gucuucacaaccuccgugcug

SEQ ID NO: 1435228 - RNA, 14 nt, Homo sapiens
gucuuccacuguac

SEQ ID NO: 1435229 - RNA, 16 nt, Homo sapiens
gucuuccagguacuga

SEQ ID NO: 1435230 - RNA, 19 nt, Homo sapiens
gucuucccugaucaaguca

SEQ ID NO: 1435231 - RNA, 17 nt, Homo sapiens
gucuucucucaaaggga

SEQ ID NO: 1435232 - RNA, 18 nt, Homo sapiens
gucuucugccagcccauu

SEQ ID NO: 1435233 - RNA, 18 nt, Homo sapiens
gucuugguuccucuacua

SEQ ID NO: 1435234 - RNA, 19 nt, Homo sapiens
gucuugucagaauuggccu

SEQ ID NO: 1435235 - RNA, 14 nt, Homo sapiens
gucuuuaaucccag

SEQ ID NO: 1435236 - RNA, 14 nt, Homo sapiens
gugaacacaucagc

SEQ ID NO: 1435237 - RNA, 18 nt, Homo sapiens
gugaacccaggacaagca

SEQ ID NO: 1435238 - RNA, 23 nt, Homo sapiens
gugaagaacaucccaagccagaa

SEQ ID NO: 1435239 - RNA, 18 nt, Homo sapiens
gugaauaaaaacccugua

SEQ ID NO: 1435240 - RNA, 14 nt, Homo sapiens
gugaauugacccau

SEQ ID NO: 1435241 - RNA, 15 nt, Homo sapiens
gugacacacagcagc

SEQ ID NO: 1435242 - RNA, 20 nt, Homo sapiens
gugacccuucagggccagaa

SEQ ID NO: 1435243 - RNA, 21 nt, Homo sapiens
gugacccuucccaaucagcac

SEQ ID NO: 1435244 - RNA, 13 nt, Homo sapiens
gugagaaguucau

SEQ ID NO: 1435245 - RNA, 13 nt, Homo sapiens
gugagcugucacu

SEQ ID NO: 1435246 - RNA, 19 nt, Homo sapiens
gugagugcuugucauggaa

SEQ ID NO: 1435247 - RNA, 21 nt, Homo sapiens
gugaguuacagcgagaggcag

SEQ ID NO: 1435248 - RNA, 13 nt, Homo sapiens
gugauauaugcau

SEQ ID NO: 1435249 - RNA, 19 nt, Homo sapiens
gugaucaacuguucagggu

SEQ ID NO: 1435250 - RNA, 20 nt, Homo sapiens
gugaucuaucaauagucaag

SEQ ID NO: 1435251 - RNA, 19 nt, Homo sapiens
gugaucuccacaccaaagu

SEQ ID NO: 1435252 - RNA, 14 nt, Homo sapiens
gugaugcccaaaga

SEQ ID NO: 1435253 - RNA, 23 nt, Homo sapiens
gugauggcgcgggaggcaccagc

SEQ ID NO: 1435254 - RNA, 13 nt, Homo sapiens
gugauuucagaga

SEQ ID NO: 1435255 - RNA, 15 nt, Homo sapiens
gugauuucagagagg

SEQ ID NO: 1435256 - RNA, 19 nt, Homo sapiens
gugcaaauggaagacaaaa

SEQ ID NO: 1435257 - RNA, 16 nt, Homo sapiens
gugcaagagacagagc

SEQ ID NO: 1435258 - RNA, 17 nt, Homo sapiens
gugcaaguggaugcauu

SEQ ID NO: 1435259 - RNA, 16 nt, Homo sapiens
gugcaccaccaugcca

SEQ ID NO: 1435260 - RNA, 17 nt, Homo sapiens
gugcagaagaauccgag

SEQ ID NO: 1435261 - RNA, 16 nt, Homo sapiens
gugcagggacaaagag

SEQ ID NO: 1435262 - RNA, 18 nt, Homo sapiens
gugcaguaguaauugauu

SEQ ID NO: 1435263 - RNA, 17 nt, Homo sapiens
gugcaguugacagcagg

SEQ ID NO: 1435264 - RNA, 12 nt, Homo sapiens
gugcauguguau

SEQ ID NO: 1435265 - RNA, 22 nt, Homo sapiens
gugcauuuaauuggaguaucua

SEQ ID NO: 1435266 - RNA, 17 nt, Homo sapiens
gugccaauauuucugau

SEQ ID NO: 1435267 - RNA, 18 nt, Homo sapiens
gugccacuugacauuccu

SEQ ID NO: 1435268 - RNA, 21 nt, Homo sapiens
gugccaggcuguaagcauucu

SEQ ID NO: 1435269 - RNA, 17 nt, Homo sapiens
gugccaguuggggcccc

SEQ ID NO: 1435270 - RNA, 13 nt, Homo sapiens
gugccaugaucug

SEQ ID NO: 1435271 - RNA, 11 nt, Homo sapiens
gugccugagac

SEQ ID NO: 1435272 - RNA, 15 nt, Homo sapiens
gugccuguaauccca

SEQ ID NO: 1435273 - RNA, 20 nt, Homo sapiens
gugccuucucacaucugucc

SEQ ID NO: 1435274 - RNA, 22 nt, Homo sapiens
gugccuuucucuggcuccagaa

SEQ ID NO: 1435275 - RNA, 17 nt, Homo sapiens
gugccuuugaccaucuc

SEQ ID NO: 1435276 - RNA, 15 nt, Homo sapiens
gugcgcacacacaga

SEQ ID NO: 1435277 - RNA, 18 nt, Homo sapiens
gugcuaacuguguguaca

SEQ ID NO: 1435278 - RNA, 23 nt, Homo sapiens
gugcuacuuugccuuuugcaaac

SEQ ID NO: 1435279 - RNA, 18 nt, Homo sapiens
gugcuauaggcuggagaa

SEQ ID NO: 1435280 - RNA, 15 nt, Homo sapiens
gugcucuccuacccc

SEQ ID NO: 1435281 - RNA, 13 nt, Homo sapiens
gugcugcaaggaa

SEQ ID NO: 1435282 - RNA, 15 nt, Homo sapiens
gugcuggagacacuc

SEQ ID NO: 1435283 - RNA, 19 nt, Homo sapiens
gugcuggagcaaaagucau

SEQ ID NO: 1435284 - RNA, 18 nt, Homo sapiens
gugcugugggcagcaccc

SEQ ID NO: 1435285 - RNA, 11 nt, Homo sapiens
guggaaccagu

SEQ ID NO: 1435286 - RNA, 17 nt, Homo sapiens
guggcaacccucacugu

SEQ ID NO: 1435287 - RNA, 20 nt, Homo sapiens
guggcaacccucacuguguu

SEQ ID NO: 1435288 - RNA, 21 nt, Homo sapiens
guggcccccugugccagcuca

SEQ ID NO: 1435289 - RNA, 22 nt, Homo sapiens
guggccuuccccuuuugccugg

SEQ ID NO: 1435290 - RNA, 22 nt, Homo sapiens
guggcucuugccuguaauccca

SEQ ID NO: 1435291 - RNA, 14 nt, Homo sapiens
guggcuucugucug

SEQ ID NO: 1435292 - RNA, 18 nt, Homo sapiens
guggcuuuuuaacaugaa

SEQ ID NO: 1435293 - RNA, 16 nt, Homo sapiens
gugggacugacauuuc

SEQ ID NO: 1435294 - RNA, 16 nt, Homo sapiens
gugggagagacacucc

SEQ ID NO: 1435295 - RNA, 20 nt, Homo sapiens
guggggaccgggcucugaca

SEQ ID NO: 1435296 - RNA, 14 nt, Homo sapiens
gugggguacauuuc

SEQ ID NO: 1435297 - RNA, 20 nt, Homo sapiens
gugggguccccaucauccca

SEQ ID NO: 1435298 - RNA, 23 nt, Homo sapiens
guggguaacgugagaagauagaa

SEQ ID NO: 1435299 - RNA, 16 nt, Homo sapiens
guggucuccuugcacu

SEQ ID NO: 1435300 - RNA, 14 nt, Homo sapiens
guggugauguugcc

SEQ ID NO: 1435301 - RNA, 19 nt, Homo sapiens
guggugcccaugaggacaa

SEQ ID NO: 1435302 - RNA, 13 nt, Homo sapiens
guggugugucaau

SEQ ID NO: 1435303 - RNA, 13 nt, Homo sapiens
gugguugcuguug

SEQ ID NO: 1435304 - RNA, 11 nt, Homo sapiens
guguacaggga

SEQ ID NO: 1435305 - RNA, 15 nt, Homo sapiens
guguagcuuugcucu

SEQ ID NO: 1435306 - RNA, 16 nt, Homo sapiens
guguauauauguguau

SEQ ID NO: 1435307 - RNA, 12 nt, Homo sapiens
guguauguguau

SEQ ID NO: 1435308 - RNA, 19 nt, Homo sapiens
gugugcgugugcgugcgug

SEQ ID NO: 1435309 - RNA, 11 nt, Homo sapiens
guguggcugcu

SEQ ID NO: 1435310 - RNA, 15 nt, Homo sapiens
gugugucaaugccac

SEQ ID NO: 1435311 - RNA, 14 nt, Homo sapiens
guguguguguauau

SEQ ID NO: 1435312 - RNA, 13 nt, Homo sapiens
guguuaggcacag

SEQ ID NO: 1435313 - RNA, 16 nt, Homo sapiens
guguucacacuguaaa

SEQ ID NO: 1435314 - RNA, 14 nt, Homo sapiens
guuaaaaaguucau

SEQ ID NO: 1435315 - RNA, 19 nt, Homo sapiens
guuaacuauuuauucccug

SEQ ID NO: 1435316 - RNA, 18 nt, Homo sapiens
guuaauuuguuauguaua

SEQ ID NO: 1435317 - RNA, 22 nt, Homo sapiens
guuacaaauucaaggagauaua

SEQ ID NO: 1435318 - RNA, 21 nt, Homo sapiens
guuacagcuaugcacuguaaa

SEQ ID NO: 1435319 - RNA, 17 nt, Homo sapiens
guuacucauaaggcaua

SEQ ID NO: 1435320 - RNA, 22 nt, Homo sapiens
guuagauaaugaaugauaagca

SEQ ID NO: 1435321 - RNA, 24 nt, Homo sapiens
guuagaugcccccacccaccugua

SEQ ID NO: 1435322 - RNA, 18 nt, Homo sapiens
guuaggaaauaaaaccuu

SEQ ID NO: 1435323 - RNA, 15 nt, Homo sapiens
guuaggauagcauuu

SEQ ID NO: 1435324 - RNA, 17 nt, Homo sapiens
guuagggaugacuguga

SEQ ID NO: 1435325 - RNA, 16 nt, Homo sapiens
guuaggugugccaaac

SEQ ID NO: 1435326 - RNA, 23 nt, Homo sapiens
guuaguaauaaacgucuugccac

SEQ ID NO: 1435327 - RNA, 22 nt, Homo sapiens
guuauccugcuagcuguagaaa

SEQ ID NO: 1435328 - RNA, 12 nt, Homo sapiens
guuaucugcuag

SEQ ID NO: 1435329 - RNA, 16 nt, Homo sapiens
guuauggucaauccca

SEQ ID NO: 1435330 - RNA, 16 nt, Homo sapiens
guuaugugacuaucuu

SEQ ID NO: 1435331 - RNA, 21 nt, Homo sapiens
ucuauuuacauaaaaugggug

SEQ ID NO: 1435332 - RNA, 21 nt, Homo sapiens
ucucaaaacugcacugucaag

SEQ ID NO: 1435333 - RNA, 15 nt, Homo sapiens
ucucaacuacucagc

SEQ ID NO: 1435334 - RNA, 14 nt, Homo sapiens
ucucaauaguaaaa

SEQ ID NO: 1435335 - RNA, 15 nt, Homo sapiens
ucucacacagcagua

SEQ ID NO: 1435336 - RNA, 23 nt, Homo sapiens
ucucaucaguguccucuugcuca

SEQ ID NO: 1435337 - RNA, 12 nt, Homo sapiens
ucucauucaaag

SEQ ID NO: 1435338 - RNA, 18 nt, Homo sapiens
ucuccaacaccaccucuc

SEQ ID NO: 1435339 - RNA, 22 nt, Homo sapiens
ucuccaccaacuggagcacuga

SEQ ID NO: 1435340 - RNA, 18 nt, Homo sapiens
ucuccaccuuguuacaca

SEQ ID NO: 1435341 - RNA, 14 nt, Homo sapiens
ucuccacuuuguug

SEQ ID NO: 1435342 - RNA, 12 nt, Homo sapiens
ucuccagcacuu

SEQ ID NO: 1435343 - RNA, 22 nt, Homo sapiens
ucuccagccagcaaugaugucc

SEQ ID NO: 1435344 - RNA, 20 nt, Homo sapiens
ucuccaggauugaagagcau

SEQ ID NO: 1435345 - RNA, 20 nt, Homo sapiens
ucuccaugcccaaccuaaga

SEQ ID NO: 1435346 - RNA, 16 nt, Homo sapiens
ucuccccaggccucca

SEQ ID NO: 1435347 - RNA, 15 nt, Homo sapiens
ucuccucuaucacau

SEQ ID NO: 1435348 - RNA, 13 nt, Homo sapiens
ucuccugcugcag

SEQ ID NO: 1435349 - RNA, 21 nt, Homo sapiens
ucuccugucagagaucuggga

SEQ ID NO: 1435350 - RNA, 14 nt, Homo sapiens
ucuccuucugaaag

SEQ ID NO: 1435351 - RNA, 13 nt, Homo sapiens
ucuccuuuggcca

SEQ ID NO: 1435352 - RNA, 14 nt, Homo sapiens
ucuccuuuugacca

SEQ ID NO: 1435353 - RNA, 17 nt, Homo sapiens
ucuccuuuugaccaaau

SEQ ID NO: 1435354 - RNA, 14 nt, Homo sapiens
ucucgaacuccuga

SEQ ID NO: 1435355 - RNA, 16 nt, Homo sapiens
ucucgcagauguuacc

SEQ ID NO: 1435356 - RNA, 17 nt, Homo sapiens
ucucgcagauguuaccu

SEQ ID NO: 1435357 - RNA, 16 nt, Homo sapiens
ucucgggugcauuuga

SEQ ID NO: 1435358 - RNA, 18 nt, Homo sapiens
ucucgucuccugacaugu

SEQ ID NO: 1435359 - RNA, 23 nt, Homo sapiens
ucucuacaaacucccacuuguca

SEQ ID NO: 1435360 - RNA, 21 nt, Homo sapiens
ucucuacuaaaaacacaaaag

SEQ ID NO: 1435361 - RNA, 18 nt, Homo sapiens
ucucuaggccuguugccu

SEQ ID NO: 1435362 - RNA, 23 nt, Homo sapiens
ucucuaucccaagccaaccaaga

SEQ ID NO: 1435363 - RNA, 14 nt, Homo sapiens
ucucugagaacaga

SEQ ID NO: 1435364 - RNA, 21 nt, Homo sapiens
ucucugauguaguuaaguauu

SEQ ID NO: 1435365 - RNA, 18 nt, Homo sapiens
ucucugccaagcccucaa

SEQ ID NO: 1435366 - RNA, 15 nt, Homo sapiens
ucucuggcgcaucac

SEQ ID NO: 1435367 - RNA, 16 nt, Homo sapiens
ucucugugugcacaaa

SEQ ID NO: 1435368 - RNA, 18 nt, Homo sapiens
ucucuuacccagaauauu

SEQ ID NO: 1435369 - RNA, 15 nt, Homo sapiens
ucucuucacucccaa

SEQ ID NO: 1435370 - RNA, 13 nt, Homo sapiens
ucugaaacuucau

SEQ ID NO: 1435371 - RNA, 18 nt, Homo sapiens
ucugaaccauuacuguaa

SEQ ID NO: 1435372 - RNA, 14 nt, Homo sapiens
ucugacauucauuu

SEQ ID NO: 1435373 - RNA, 11 nt, Homo sapiens
ucugagcccac

SEQ ID NO: 1435374 - RNA, 22 nt, Homo sapiens
ucugaggcgccccaacccgugg

SEQ ID NO: 1435375 - RNA, 20 nt, Homo sapiens
ucugauacccagagcauuac

SEQ ID NO: 1435376 - RNA, 19 nt, Homo sapiens
ucugaucaguuuccuccaa

SEQ ID NO: 1435377 - RNA, 15 nt, Homo sapiens
ucugaugcaucagaa

SEQ ID NO: 1435378 - RNA, 19 nt, Homo sapiens
ucugauuuuuaauuucuau

SEQ ID NO: 1435379 - RNA, 17 nt, Homo sapiens
ucugcaaagacuagauc

SEQ ID NO: 1435380 - RNA, 18 nt, Homo sapiens
ucugcaaggucuuugguu

SEQ ID NO: 1435381 - RNA, 21 nt, Homo sapiens
ucugcacccagaaauuccuuc

SEQ ID NO: 1435382 - RNA, 12 nt, Homo sapiens
ucugcacugggu

SEQ ID NO: 1435383 - RNA, 23 nt, Homo sapiens
ucugcagcccggcgccaccaucc

SEQ ID NO: 1435384 - RNA, 18 nt, Homo sapiens
ucugcagggagcaacucu

SEQ ID NO: 1435385 - RNA, 23 nt, Homo sapiens
ucugcagggggugugucugcuca

SEQ ID NO: 1435386 - RNA, 21 nt, Homo sapiens
ucugcauuccccgcugcccaa

SEQ ID NO: 1435387 - RNA, 15 nt, Homo sapiens
ucugcccacugugaa

SEQ ID NO: 1435388 - RNA, 16 nt, Homo sapiens
ucugccccacccucaa

SEQ ID NO: 1435389 - RNA, 21 nt, Homo sapiens
ucugcccuguauauaauacua

SEQ ID NO: 1435390 - RNA, 22 nt, Homo sapiens
ucugccugggcuuaugcccuca

SEQ ID NO: 1435391 - RNA, 15 nt, Homo sapiens
ucugcuaaauuuaau

SEQ ID NO: 1435392 - RNA, 18 nt, Homo sapiens
ucugcucugaugcaucag

SEQ ID NO: 1435393 - RNA, 22 nt, Homo sapiens
ucugcuugcaucacuugggguc

SEQ ID NO: 1435394 - RNA, 16 nt, Homo sapiens
ucuggaagccuggacu

SEQ ID NO: 1435395 - RNA, 21 nt, Homo sapiens
ucuggaaggccccucccagca

SEQ ID NO: 1435396 - RNA, 20 nt, Homo sapiens
ucuggacccuccacuucaau

SEQ ID NO: 1435397 - RNA, 19 nt, Homo sapiens
uccucucgagcccagaugg

SEQ ID NO: 1435398 - RNA, 22 nt, Homo sapiens
uccucugacuggagucuaggaa

SEQ ID NO: 1435399 - RNA, 12 nt, Homo sapiens
uccucugcugac

SEQ ID NO: 1435400 - RNA, 14 nt, Homo sapiens
uccucugcuugcau

SEQ ID NO: 1435401 - RNA, 11 nt, Homo sapiens
uccucuucuau

SEQ ID NO: 1435402 - RNA, 15 nt, Homo sapiens
uccucuuugcaugga

SEQ ID NO: 1435403 - RNA, 19 nt, Homo sapiens
uccugacagaaggacucag

SEQ ID NO: 1435404 - RNA, 13 nt, Homo sapiens
uccugacccuccc

SEQ ID NO: 1435405 - RNA, 22 nt, Homo sapiens
uccugagugugggcuucugaaa

SEQ ID NO: 1435406 - RNA, 21 nt, Homo sapiens
uccugauaaacauuaaacacu

SEQ ID NO: 1435407 - RNA, 23 nt, Homo sapiens
uccugauaaacauuaaacacugu

SEQ ID NO: 1435408 - RNA, 15 nt, Homo sapiens
uccugauuucaggga

SEQ ID NO: 1435409 - RNA, 16 nt, Homo sapiens
uccugauuucagggaa

SEQ ID NO: 1435410 - RNA, 16 nt, Homo sapiens
uccugauuucucugaa

SEQ ID NO: 1435411 - RNA, 19 nt, Homo sapiens
uccugcaaaaguggaauca

SEQ ID NO: 1435412 - RNA, 20 nt, Homo sapiens
uccugcacuccagaauccac

SEQ ID NO: 1435413 - RNA, 16 nt, Homo sapiens
uccugcagagauccag

SEQ ID NO: 1435414 - RNA, 22 nt, Homo sapiens
uccugcccccagccauggugag

SEQ ID NO: 1435415 - RNA, 19 nt, Homo sapiens
uccugccucuacugggaag

SEQ ID NO: 1435416 - RNA, 15 nt, Homo sapiens
uccuggacagcugug

SEQ ID NO: 1435417 - RNA, 16 nt, Homo sapiens
uccuggaggugggaga

SEQ ID NO: 1435418 - RNA, 23 nt, Homo sapiens
uccuggaggugggagacaaggaa

SEQ ID NO: 1435419 - RNA, 18 nt, Homo sapiens
uccuggcuaacacgugaa

SEQ ID NO: 1435420 - RNA, 13 nt, Homo sapiens
uccuguccaugcc

SEQ ID NO: 1435421 - RNA, 15 nt, Homo sapiens
uccugucccuaccca

SEQ ID NO: 1435422 - RNA, 22 nt, Homo sapiens
uccugucuuggaaggacuacua

SEQ ID NO: 1435423 - RNA, 18 nt, Homo sapiens
uccugugcuacuuugccu

SEQ ID NO: 1435424 - RNA, 24 nt, Homo sapiens
uccuguuucugaaccauuacugua

SEQ ID NO: 1435425 - RNA, 19 nt, Homo sapiens
uccuguuucuugcucugag

SEQ ID NO: 1435426 - RNA, 18 nt, Homo sapiens
uccuuaggaacagcucuu

SEQ ID NO: 1435427 - RNA, 22 nt, Homo sapiens
uccuuauuuaucaacaucuuuu

SEQ ID NO: 1435428 - RNA, 13 nt, Homo sapiens
uccuucagugcau

SEQ ID NO: 1435429 - RNA, 15 nt, Homo sapiens
uccuucccugggaag

SEQ ID NO: 1435430 - RNA, 18 nt, Homo sapiens
uccuucucguuugcucua

SEQ ID NO: 1435431 - RNA, 19 nt, Homo sapiens
uccuugauacuaaaaguuc

SEQ ID NO: 1435432 - RNA, 20 nt, Homo sapiens
uccuuuaaauccuuccauga

SEQ ID NO: 1435433 - RNA, 15 nt, Homo sapiens
uccuuuacuaaucca

SEQ ID NO: 1435434 - RNA, 22 nt, Homo sapiens
uccuuuacuaauccaacccaug

SEQ ID NO: 1435435 - RNA, 15 nt, Homo sapiens
uccuuucacaaccuu

SEQ ID NO: 1435436 - RNA, 16 nt, Homo sapiens
uccuuucucuauccca

SEQ ID NO: 1435437 - RNA, 16 nt, Homo sapiens
uccuuuggccauucca

SEQ ID NO: 1435438 - RNA, 23 nt, Homo sapiens
uccuuuugaaagaaucagucuug

SEQ ID NO: 1435439 - RNA, 15 nt, Homo sapiens
uccuuuuguguacag

SEQ ID NO: 1435440 - RNA, 19 nt, Homo sapiens
ucgauccuggauucacuca

SEQ ID NO: 1435441 - RNA, 11 nt, Homo sapiens
ucgcaucucag

SEQ ID NO: 1435442 - RNA, 22 nt, Homo sapiens
ucgccguguuacuguugcacug

SEQ ID NO: 1435443 - RNA, 23 nt, Homo sapiens
ucgccucucccaccccaugcauu

SEQ ID NO: 1435444 - RNA, 17 nt, Homo sapiens
ucgggaggcugaggcag

SEQ ID NO: 1435445 - RNA, 16 nt, Homo sapiens
ucgggauuguguuuga

SEQ ID NO: 1435446 - RNA, 15 nt, Homo sapiens
ucggggaacuccugg

SEQ ID NO: 1435447 - RNA, 10 nt, Homo sapiens
ucggggagcu

SEQ ID NO: 1435448 - RNA, 14 nt, Homo sapiens
ucggggugugauga

SEQ ID NO: 1435449 - RNA, 18 nt, Homo sapiens
ucguauccccaagccaca

SEQ ID NO: 1435450 - RNA, 21 nt, Homo sapiens
ucgucuccugacaugucucac

SEQ ID NO: 1435451 - RNA, 23 nt, Homo sapiens
ucgugggagagagacguguacau

SEQ ID NO: 1435452 - RNA, 23 nt, Homo sapiens
ucguggggggagguggacagucc

SEQ ID NO: 1435453 - RNA, 17 nt, Homo sapiens
ucuaaaaucccuuucaa

SEQ ID NO: 1435454 - RNA, 14 nt, Homo sapiens
ucuaaacccaaaua

SEQ ID NO: 1435455 - RNA, 19 nt, Homo sapiens
ucuaaaugaagugcaaauu

SEQ ID NO: 1435456 - RNA, 20 nt, Homo sapiens
ucuaacaguauuuguacaaa

SEQ ID NO: 1435457 - RNA, 14 nt, Homo sapiens
ucuaacauauguau

SEQ ID NO: 1435458 - RNA, 14 nt, Homo sapiens
ucuaacucaggggu

SEQ ID NO: 1435459 - RNA, 15 nt, Homo sapiens
ucuaagugugcugca

SEQ ID NO: 1435460 - RNA, 18 nt, Homo sapiens
ucuaauauuuuuagcucu

SEQ ID NO: 1435461 - RNA, 19 nt, Homo sapiens
ucuacaaacucccacuugu

SEQ ID NO: 1435462 - RNA, 14 nt, Homo sapiens
ucuacaagcauuug

SEQ ID NO: 1435463 - RNA, 13 nt, Homo sapiens
ucuaccauuugaa

SEQ ID NO: 1435464 - RNA, 20 nt, Homo sapiens
ucuaccuaggaugcaugaca

SEQ ID NO: 1435465 - RNA, 15 nt, Homo sapiens
ucuggagagacugug

SEQ ID NO: 1435466 - RNA, 13 nt, Homo sapiens
ucuggagccagag

SEQ ID NO: 1435467 - RNA, 22 nt, Homo sapiens
ucuggauaacaagacuuugacu

SEQ ID NO: 1435468 - RNA, 22 nt, Homo sapiens
ucuggcagccacacuucucagg

SEQ ID NO: 1435469 - RNA, 16 nt, Homo sapiens
ucuggcccagccuacc

SEQ ID NO: 1435470 - RNA, 16 nt, Homo sapiens
ucuggcccuucuugcc

SEQ ID NO: 1435471 - RNA, 17 nt, Homo sapiens
ucuggcuuuacauuuua

SEQ ID NO: 1435472 - RNA, 18 nt, Homo sapiens
ucuggcuuuacauuuuau

SEQ ID NO: 1435473 - RNA, 23 nt, Homo sapiens
ucugggagguuacugucugguag

SEQ ID NO: 1435474 - RNA, 18 nt, Homo sapiens
ucugggauucccaccaag

SEQ ID NO: 1435475 - RNA, 15 nt, Homo sapiens
ucugggcagcuguca

SEQ ID NO: 1435476 - RNA, 14 nt, Homo sapiens
ucuggguccuugca

SEQ ID NO: 1435477 - RNA, 23 nt, Homo sapiens
ucuggucuucacugccaugccuc

SEQ ID NO: 1435478 - RNA, 16 nt, Homo sapiens
ucugucaucucucugg

SEQ ID NO: 1435479 - RNA, 22 nt, Homo sapiens
ucugucuguagagccgcauggc

SEQ ID NO: 1435480 - RNA, 19 nt, Homo sapiens
ucugugacuccuggucuga

SEQ ID NO: 1435481 - RNA, 15 nt, Homo sapiens
ucugugcacuagccu

SEQ ID NO: 1435482 - RNA, 17 nt, Homo sapiens
ucugugcuuugacucac

SEQ ID NO: 1435483 - RNA, 22 nt, Homo sapiens
ucuguggaguuugacauuguau

SEQ ID NO: 1435484 - RNA, 17 nt, Homo sapiens
ucuguuccccauggcca

SEQ ID NO: 1435485 - RNA, 15 nt, Homo sapiens
ucuguuguccaucau

SEQ ID NO: 1435486 - RNA, 18 nt, Homo sapiens
ucuuaaaggaaaagucaa

SEQ ID NO: 1435487 - RNA, 13 nt, Homo sapiens
ucuuaacuugaag

SEQ ID NO: 1435488 - RNA, 15 nt, Homo sapiens
ucuuacauaaucaca

SEQ ID NO: 1435489 - RNA, 22 nt, Homo sapiens
ucuuacauaauuuuuuauucaa

SEQ ID NO: 1435490 - RNA, 15 nt, Homo sapiens
ucuuacauuagcagu

SEQ ID NO: 1435491 - RNA, 23 nt, Homo sapiens
ucuuacuuuuggauaauauccac

SEQ ID NO: 1435492 - RNA, 18 nt, Homo sapiens
ucuuagcugaacaaugaa

SEQ ID NO: 1435493 - RNA, 12 nt, Homo sapiens
ucuuagcuuucu

SEQ ID NO: 1435494 - RNA, 20 nt, Homo sapiens
ucuuaugaaaugggcuuuaa

SEQ ID NO: 1435495 - RNA, 18 nt, Homo sapiens
ucuuauucucacuccacc

SEQ ID NO: 1435496 - RNA, 17 nt, Homo sapiens
ucuucaaagacaaugga

SEQ ID NO: 1435497 - RNA, 19 nt, Homo sapiens
ucuucaacuuuugugcucc

SEQ ID NO: 1435498 - RNA, 13 nt, Homo sapiens
ucuucaaggugua

SEQ ID NO: 1435499 - RNA, 17 nt, Homo sapiens
ucuucaauaaauuaagu

SEQ ID NO: 1435500 - RNA, 18 nt, Homo sapiens
ucuucacaacagauuauu

SEQ ID NO: 1435501 - RNA, 12 nt, Homo sapiens
ucuucacugcca

SEQ ID NO: 1435502 - RNA, 16 nt, Homo sapiens
ucuucagaagacacug

SEQ ID NO: 1435503 - RNA, 17 nt, Homo sapiens
ucuucaguuuuaggcuu

SEQ ID NO: 1435504 - RNA, 22 nt, Homo sapiens
ucuuccacuggcuccacaucca

SEQ ID NO: 1435505 - RNA, 16 nt, Homo sapiens
ucuuccagcaugcauc

SEQ ID NO: 1435506 - RNA, 20 nt, Homo sapiens
ucuuccagggccucugggag

SEQ ID NO: 1435507 - RNA, 21 nt, Homo sapiens
ucuucccaccucagugcccac

SEQ ID NO: 1435508 - RNA, 20 nt, Homo sapiens
ucuuccuaccaaauauaaac

SEQ ID NO: 1435509 - RNA, 21 nt, Homo sapiens
ucuuccuuucuaaaucugaga

SEQ ID NO: 1435510 - RNA, 16 nt, Homo sapiens
ucuucuacaaccagag

SEQ ID NO: 1435511 - RNA, 13 nt, Homo sapiens
ucuucuccacugg

SEQ ID NO: 1435512 - RNA, 17 nt, Homo sapiens
ucuucuuauucaugcuu

SEQ ID NO: 1435513 - RNA, 20 nt, Homo sapiens
ucuugaaccccuggccucaa

SEQ ID NO: 1435514 - RNA, 15 nt, Homo sapiens
ucuugaaguucaugg

SEQ ID NO: 1435515 - RNA, 16 nt, Homo sapiens
ucuugcauucccagug

SEQ ID NO: 1435516 - RNA, 11 nt, Homo sapiens
ucuugcauucu

SEQ ID NO: 1435517 - RNA, 22 nt, Homo sapiens
ucuugcuguaacucagacauuc

SEQ ID NO: 1435518 - RNA, 24 nt, Homo sapiens
ucuugcuguaacucagacauucca

SEQ ID NO: 1435519 - RNA, 16 nt, Homo sapiens
ucuuggaauacuugaa

SEQ ID NO: 1435520 - RNA, 14 nt, Homo sapiens
ucuuggaccccuga

SEQ ID NO: 1435521 - RNA, 20 nt, Homo sapiens
ucuuggcucacuacagccuc

SEQ ID NO: 1435522 - RNA, 20 nt, Homo sapiens
ucuugggcuacuggcagcuc

SEQ ID NO: 1435523 - RNA, 19 nt, Homo sapiens
ucuuggggucccagggaag

SEQ ID NO: 1435524 - RNA, 21 nt, Homo sapiens
ucuugggguuuucaguaugaa

SEQ ID NO: 1435525 - RNA, 17 nt, Homo sapiens
ucuugugaaaccacagg

SEQ ID NO: 1435526 - RNA, 14 nt, Homo sapiens
ucuuuaaaucaaaa

SEQ ID NO: 1435527 - RNA, 17 nt, Homo sapiens
ucuuuacaauaaacaua

SEQ ID NO: 1435528 - RNA, 22 nt, Homo sapiens
ucuuuauucuuagggcagucag

SEQ ID NO: 1435529 - RNA, 12 nt, Homo sapiens
ucuuucagagag

SEQ ID NO: 1435530 - RNA, 18 nt, Homo sapiens
ucuuucccagaugcccca

SEQ ID NO: 1435531 - RNA, 14 nt, Homo sapiens
ucuuuccuugucuc

SEQ ID NO: 1435532 - RNA, 22 nt, Homo sapiens
ucuuucuaacuccagugaagua

SEQ ID NO: 1435533 - RNA, 18 nt, Homo sapiens
ucuuucuaaugugugaau

SEQ ID NO: 1435534 - RNA, 19 nt, Homo sapiens
ucuuucuguuauugcacua

SEQ ID NO: 1435535 - RNA, 17 nt, Homo sapiens
ucuuugagaacaaugga

SEQ ID NO: 1435536 - RNA, 12 nt, Homo sapiens
ucuuugcuacaa

SEQ ID NO: 1435537 - RNA, 11 nt, Homo sapiens
ucuuuuccacu

SEQ ID NO: 1435538 - RNA, 11 nt, Homo sapiens
ucuuuugcucu

SEQ ID NO: 1435539 - RNA, 18 nt, Homo sapiens
ucuuuuuugucucaagau

SEQ ID NO: 1435540 - RNA, 19 nt, Homo sapiens
ugaaaaacauuccaggaaa

SEQ ID NO: 1435541 - RNA, 12 nt, Homo sapiens
ugaaaaauacuu

SEQ ID NO: 1435542 - RNA, 17 nt, Homo sapiens
ugaaaagacucaguguu

SEQ ID NO: 1435543 - RNA, 17 nt, Homo sapiens
ugaaaauauuuguauca

SEQ ID NO: 1435544 - RNA, 16 nt, Homo sapiens
ugaaaaucaaaguaaa

SEQ ID NO: 1435545 - RNA, 18 nt, Homo sapiens
ugaaaaucaguuauauuc

SEQ ID NO: 1435546 - RNA, 12 nt, Homo sapiens
ugaaaauguuca

SEQ ID NO: 1435547 - RNA, 20 nt, Homo sapiens
ugaaaauguuguuaugcuau

SEQ ID NO: 1435548 - RNA, 18 nt, Homo sapiens
ugaaaauuaugagucucu

SEQ ID NO: 1435549 - RNA, 20 nt, Homo sapiens
ugaaacaagauaacugagaa

SEQ ID NO: 1435550 - RNA, 22 nt, Homo sapiens
uucugaauuauuaugucucaaa

SEQ ID NO: 1435551 - RNA, 15 nt, Homo sapiens
uucugaccuccccac

SEQ ID NO: 1435552 - RNA, 19 nt, Homo sapiens
uucugaugagaaaggccug

SEQ ID NO: 1435553 - RNA, 22 nt, Homo sapiens
uucugauuugaagguauaaccu

SEQ ID NO: 1435554 - RNA, 13 nt, Homo sapiens
uucuggaaaccac

SEQ ID NO: 1435555 - RNA, 18 nt, Homo sapiens
uucuggagucuccagugg

SEQ ID NO: 1435556 - RNA, 19 nt, Homo sapiens
uucuggguggccucgggac

SEQ ID NO: 1435557 - RNA, 22 nt, Homo sapiens
uucuguagcuuguucccugucu

SEQ ID NO: 1435558 - RNA, 13 nt, Homo sapiens
uucuguugccaca

SEQ ID NO: 1435559 - RNA, 14 nt, Homo sapiens
uucuguuuccauag

SEQ ID NO: 1435560 - RNA, 13 nt, Homo sapiens
uucuuaaggggau

SEQ ID NO: 1435561 - RNA, 18 nt, Homo sapiens
uucuuacagacugcaugu

SEQ ID NO: 1435562 - RNA, 21 nt, Homo sapiens
uucuuauggaagaaaugggag

SEQ ID NO: 1435563 - RNA, 21 nt, Homo sapiens
uucuucaucccuuuccaguua

SEQ ID NO: 1435564 - RNA, 19 nt, Homo sapiens
uucuucaucugugacuccu

SEQ ID NO: 1435565 - RNA, 17 nt, Homo sapiens
uucuuccuaccaaauau

SEQ ID NO: 1435566 - RNA, 13 nt, Homo sapiens
uucuugaaccaau

SEQ ID NO: 1435567 - RNA, 23 nt, Homo sapiens
uucuuggcagcuuaacauugacu

SEQ ID NO: 1435568 - RNA, 18 nt, Homo sapiens
uucuuuaauguuguccag

SEQ ID NO: 1435569 - RNA, 15 nt, Homo sapiens
uucuuuaucuugaca

SEQ ID NO: 1435570 - RNA, 23 nt, Homo sapiens
uucuuuccucuuccccuugcccu

SEQ ID NO: 1435571 - RNA, 17 nt, Homo sapiens
uugaaaagacuccaaag

SEQ ID NO: 1435572 - RNA, 12 nt, Homo sapiens
uugaaaagcuaa

SEQ ID NO: 1435573 - RNA, 14 nt, Homo sapiens
uugaaauaaacagg

SEQ ID NO: 1435574 - RNA, 19 nt, Homo sapiens
uugaaauuuuauuuaguuc

SEQ ID NO: 1435575 - RNA, 16 nt, Homo sapiens
uugaacacaauugaua

SEQ ID NO: 1435576 - RNA, 21 nt, Homo sapiens
uugaagaagaguuucuccuuu

SEQ ID NO: 1435577 - RNA, 21 nt, Homo sapiens
uugaagagauuucaacauauc

SEQ ID NO: 1435578 - RNA, 14 nt, Homo sapiens
uugaaguaugguug

SEQ ID NO: 1435579 - RNA, 21 nt, Homo sapiens
uugaauaaagccugcuuuuua

SEQ ID NO: 1435580 - RNA, 12 nt, Homo sapiens
uugaauaucauu

SEQ ID NO: 1435581 - RNA, 17 nt, Homo sapiens
uugaauggucuucugcc

SEQ ID NO: 1435582 - RNA, 15 nt, Homo sapiens
uugacaacagacuga

SEQ ID NO: 1435583 - RNA, 15 nt, Homo sapiens
uugacaauaauuuca

SEQ ID NO: 1435584 - RNA, 16 nt, Homo sapiens
uugacaggccauccau

SEQ ID NO: 1435585 - RNA, 14 nt, Homo sapiens
uugacauaacacua

SEQ ID NO: 1435586 - RNA, 14 nt, Homo sapiens
uugacgccaccaua

SEQ ID NO: 1435587 - RNA, 15 nt, Homo sapiens
uugacucuacugauc

SEQ ID NO: 1435588 - RNA, 23 nt, Homo sapiens
uugacugucacuguuccuuguca

SEQ ID NO: 1435589 - RNA, 18 nt, Homo sapiens
uugagacuauaaagcagu

SEQ ID NO: 1435590 - RNA, 21 nt, Homo sapiens
uugaggacaaccauuccagac

SEQ ID NO: 1435591 - RNA, 18 nt, Homo sapiens
uugaggggcugacuucaa

SEQ ID NO: 1435592 - RNA, 15 nt, Homo sapiens
uugagggguggaccc

SEQ ID NO: 1435593 - RNA, 20 nt, Homo sapiens
uugagugacucgaggguugg

SEQ ID NO: 1435594 - RNA, 17 nt, Homo sapiens
uugaguucaaauuuugc

SEQ ID NO: 1435595 - RNA, 12 nt, Homo sapiens
acagauaaaaca

SEQ ID NO: 1435596 - RNA, 13 nt, Homo sapiens
acagauagucaaa

SEQ ID NO: 1435597 - RNA, 14 nt, Homo sapiens
acagauagucaaac

SEQ ID NO: 1435598 - RNA, 17 nt, Homo sapiens
acagauguaaaugccac

SEQ ID NO: 1435599 - RNA, 20 nt, Homo sapiens
acagauguaaaugccacaaa

SEQ ID NO: 1435600 - RNA, 20 nt, Homo sapiens
acagcaagggugaugggaaa

SEQ ID NO: 1435601 - RNA, 13 nt, Homo sapiens
acagcacccaggc

SEQ ID NO: 1435602 - RNA, 16 nt, Homo sapiens
acagcagcacugcaga

SEQ ID NO: 1435603 - RNA, 18 nt, Homo sapiens
acagcagcugaacagcca

SEQ ID NO: 1435604 - RNA, 20 nt, Homo sapiens
acagcaguggagaguguucc

SEQ ID NO: 1435605 - RNA, 21 nt, Homo sapiens
acagccauuauaaaaaauuaa

SEQ ID NO: 1435606 - RNA, 11 nt, Homo sapiens
agccuccucag

SEQ ID NO: 1435607 - RNA, 19 nt, Homo sapiens
agccucgcaacccgugcca

SEQ ID NO: 1435608 - RNA, 14 nt, Homo sapiens
agccucuccaggaa

SEQ ID NO: 1435609 - RNA, 19 nt, Homo sapiens
agccucugcccugccuccc

SEQ ID NO: 1435610 - RNA, 15 nt, Homo sapiens
agccugagaugggga

SEQ ID NO: 1435611 - RNA, 22 nt, Homo sapiens
agccugauuauccuauaggcag

SEQ ID NO: 1435612 - RNA, 17 nt, Homo sapiens
agccuggccaacaugau

SEQ ID NO: 1435613 - RNA, 17 nt, Homo sapiens
agccuggccuccugccu

SEQ ID NO: 1435614 - RNA, 21 nt, Homo sapiens
agccugggugagaauccugcc

SEQ ID NO: 1435615 - RNA, 12 nt, Homo sapiens
agccugugauua

SEQ ID NO: 1435616 - RNA, 14 nt, Homo sapiens
agccugugauuaac

SEQ ID NO: 1435617 - RNA, 21 nt, Homo sapiens
agccuguucauggcagaugua

SEQ ID NO: 1435618 - RNA, 22 nt, Homo sapiens
agccuguuggacccgcucugga

SEQ ID NO: 1435619 - RNA, 14 nt, Homo sapiens
agccuuaugugagc

SEQ ID NO: 1435620 - RNA, 21 nt, Homo sapiens
agcgaaauauuacaguagugc

SEQ ID NO: 1435621 - RNA, 15 nt, Homo sapiens
agcgaaaucaugguu

SEQ ID NO: 1435622 - RNA, 17 nt, Homo sapiens
agcgaguugcgcuggga

SEQ ID NO: 1435623 - RNA, 19 nt, Homo sapiens
agcgcagguuuaguuuacu

SEQ ID NO: 1435624 - RNA, 14 nt, Homo sapiens
agcgcgugcacagc

SEQ ID NO: 1435625 - RNA, 12 nt, Homo sapiens
agcgcuguguua

SEQ ID NO: 1435626 - RNA, 14 nt, Homo sapiens
agcgcuuucuggaa

SEQ ID NO: 1435627 - RNA, 21 nt, Homo sapiens
agcggucauucuacacugagg

SEQ ID NO: 1435628 - RNA, 22 nt, Homo sapiens
agcggucauucuacacugagga

SEQ ID NO: 1435629 - RNA, 18 nt, Homo sapiens
agcgguugcuucuggcuc

SEQ ID NO: 1435630 - RNA, 16 nt, Homo sapiens
agcuaacuuauuuucc

SEQ ID NO: 1435631 - RNA, 20 nt, Homo sapiens
agcuaaguucuaaguucaug

SEQ ID NO: 1435632 - RNA, 18 nt, Homo sapiens
agcuacauuccucagcug

SEQ ID NO: 1435633 - RNA, 21 nt, Homo sapiens
agcuagaagugggccaggaca

SEQ ID NO: 1435634 - RNA, 15 nt, Homo sapiens
agcuagaaugcacac

SEQ ID NO: 1435635 - RNA, 16 nt, Homo sapiens
agcuaucugucaucuc

SEQ ID NO: 1435636 - RNA, 14 nt, Homo sapiens
agcuauggccccag

SEQ ID NO: 1435637 - RNA, 15 nt, Homo sapiens
agcucacaagcccag

SEQ ID NO: 1435638 - RNA, 21 nt, Homo sapiens
agcucacaguacaauguuuca

SEQ ID NO: 1435639 - RNA, 17 nt, Homo sapiens
agcucagccgugcacuc

SEQ ID NO: 1435640 - RNA, 14 nt, Homo sapiens
agcucaggcauuug

SEQ ID NO: 1435641 - RNA, 18 nt, Homo sapiens
agcucaggugguccucuu

SEQ ID NO: 1435642 - RNA, 15 nt, Homo sapiens
agcucuggaccagcc

SEQ ID NO: 1435643 - RNA, 15 nt, Homo sapiens
agcucuuaauguugc

SEQ ID NO: 1435644 - RNA, 23 nt, Homo sapiens
agcucuucgguuucugagcauaa

SEQ ID NO: 1435645 - RNA, 20 nt, Homo sapiens
agcugaacagccaaaugcau

SEQ ID NO: 1435646 - RNA, 14 nt, Homo sapiens
agcugaagugaagg

SEQ ID NO: 1435647 - RNA, 18 nt, Homo sapiens
agcugacagcacuacaaa

SEQ ID NO: 1435648 - RNA, 18 nt, Homo sapiens
agcugacauagggguaag

SEQ ID NO: 1435649 - RNA, 18 nt, Homo sapiens
agcugacaucuccucuau

SEQ ID NO: 1435650 - RNA, 13 nt, Homo sapiens
agcugagccuucu

SEQ ID NO: 1435651 - RNA, 18 nt, Homo sapiens
agcugagccuucugauga

SEQ ID NO: 1435652 - RNA, 18 nt, Homo sapiens
agcugaggaggugccuug

SEQ ID NO: 1435653 - RNA, 14 nt, Homo sapiens
agcugagugaaaaa

SEQ ID NO: 1435654 - RNA, 18 nt, Homo sapiens
agcugaguuuaacaugug

SEQ ID NO: 1435655 - RNA, 22 nt, Homo sapiens
agcugccuuuuuuaacacuaga

SEQ ID NO: 1435656 - RNA, 24 nt, Homo sapiens
agcugccuuuuuuaacacuagaaa

SEQ ID NO: 1435657 - RNA, 13 nt, Homo sapiens
agcugcgugccac

SEQ ID NO: 1435658 - RNA, 14 nt, Homo sapiens
agcugcuacaagaa

SEQ ID NO: 1435659 - RNA, 19 nt, Homo sapiens
agcuggaaauaaaccugga

SEQ ID NO: 1435660 - RNA, 21 nt, Homo sapiens
agcuggaacacucucugagau

SEQ ID NO: 1435661 - RNA, 19 nt, Homo sapiens
agcuggacaugcuuuggca

SEQ ID NO: 1435662 - RNA, 14 nt, Homo sapiens
agcuggcaaaggug

SEQ ID NO: 1435663 - RNA, 19 nt, Homo sapiens
agcuggcauuggucugcug

SEQ ID NO: 1435664 - RNA, 23 nt, Homo sapiens
agcuggcucuccaccuuguuaca

SEQ ID NO: 1435665 - RNA, 13 nt, Homo sapiens
agcugggccgagu

SEQ ID NO: 1435666 - RNA, 14 nt, Homo sapiens
auaugaaguguuag

SEQ ID NO: 1435667 - RNA, 16 nt, Homo sapiens
auaugcacacacagau

SEQ ID NO: 1435668 - RNA, 20 nt, Homo sapiens
auaugcacacacagaugcac

SEQ ID NO: 1435669 - RNA, 14 nt, Homo sapiens
auaugcagugauau

SEQ ID NO: 1435670 - RNA, 18 nt, Homo sapiens
auaugggacugagccugg

SEQ ID NO: 1435671 - RNA, 19 nt, Homo sapiens
auauguaaauagugcagaa

SEQ ID NO: 1435672 - RNA, 18 nt, Homo sapiens
auaugugcgucucucuuu

SEQ ID NO: 1435673 - RNA, 19 nt, Homo sapiens
auauguguauauauauaug

SEQ ID NO: 1435674 - RNA, 17 nt, Homo sapiens
auauuaaaauauggcua

SEQ ID NO: 1435675 - RNA, 18 nt, Homo sapiens
auauucaauaaagcugcu

SEQ ID NO: 1435676 - RNA, 16 nt, Homo sapiens
auauucucuccacuuu

SEQ ID NO: 1435677 - RNA, 22 nt, Homo sapiens
auauucuuuaaauuucaucuca

SEQ ID NO: 1435678 - RNA, 22 nt, Homo sapiens
auauuggucauugccuugccaa

SEQ ID NO: 1435679 - RNA, 18 nt, Homo sapiens
auauuuaauggcaaugca

SEQ ID NO: 1435680 - RNA, 18 nt, Homo sapiens
auauuuccauucaugcca

SEQ ID NO: 1435681 - RNA, 14 nt, Homo sapiens
auauuucuagacau

SEQ ID NO: 1435682 - RNA, 22 nt, Homo sapiens
auauuuguaucacaaaucuuaa

SEQ ID NO: 1435683 - RNA, 15 nt, Homo sapiens
auauuuucacaugac

SEQ ID NO: 1435684 - RNA, 14 nt, Homo sapiens
auauuuuucaacca

SEQ ID NO: 1435685 - RNA, 19 nt, Homo sapiens
auauuuuugguugucaaua

SEQ ID NO: 1435686 - RNA, 21 nt, Homo sapiens
aucaaaaucuuucagcacuca

SEQ ID NO: 1435687 - RNA, 21 nt, Homo sapiens
aucaaaugccccgaauuuagu

SEQ ID NO: 1435688 - RNA, 14 nt, Homo sapiens
aucaagggcuuuau

SEQ ID NO: 1435689 - RNA, 18 nt, Homo sapiens
aucaaugaaaugcuuguu

SEQ ID NO: 1435690 - RNA, 19 nt, Homo sapiens
aucaauucaacacauuacu

SEQ ID NO: 1435691 - RNA, 22 nt, Homo sapiens
aucaauuuaccuacucuaugua

SEQ ID NO: 1435692 - RNA, 19 nt, Homo sapiens
aucaauuuuuauacauauc

SEQ ID NO: 1435693 - RNA, 20 nt, Homo sapiens
aucaauuuuuauacauauca

SEQ ID NO: 1435694 - RNA, 19 nt, Homo sapiens
aucacaacauuuacuuaac

SEQ ID NO: 1435695 - RNA, 17 nt, Homo sapiens
aucacaguguuugcaau

SEQ ID NO: 1435696 - RNA, 18 nt, Homo sapiens
aucaccaggaugucacau

SEQ ID NO: 1435697 - RNA, 15 nt, Homo sapiens
aucaccuacucacac

SEQ ID NO: 1435698 - RNA, 23 nt, Homo sapiens
aucaccuacucacacaggcauuu

SEQ ID NO: 1435699 - RNA, 21 nt, Homo sapiens
aucaccucuggcuuugucucu

SEQ ID NO: 1435700 - RNA, 17 nt, Homo sapiens
aucacuagccaugauaa

SEQ ID NO: 1435701 - RNA, 20 nt, Homo sapiens
aucacugauugggugccaug

SEQ ID NO: 1435702 - RNA, 22 nt, Homo sapiens
aucacuuacucaguuagaauuu

SEQ ID NO: 1435703 - RNA, 19 nt, Homo sapiens
aucagccccgcuccucccc

SEQ ID NO: 1435704 - RNA, 21 nt, Homo sapiens
aucaggcuauguauggaauac

SEQ ID NO: 1435705 - RNA, 22 nt, Homo sapiens
aucaggucauuauuuuuuacaa

SEQ ID NO: 1435706 - RNA, 21 nt, Homo sapiens
aucagucuuggaauacuugaa

SEQ ID NO: 1435707 - RNA, 15 nt, Homo sapiens
aucagugcacacgga

SEQ ID NO: 1435708 - RNA, 15 nt, Homo sapiens
aucaguugcagauag

SEQ ID NO: 1435709 - RNA, 18 nt, Homo sapiens
aucaucaccacaccguga

SEQ ID NO: 1435710 - RNA, 17 nt, Homo sapiens
aucaugaaaagugcugu

SEQ ID NO: 1435711 - RNA, 16 nt, Homo sapiens
aucauggcagugauga

SEQ ID NO: 1435712 - RNA, 20 nt, Homo sapiens
aucaugggauuuuacuagaa

SEQ ID NO: 1435713 - RNA, 17 nt, Homo sapiens
aucauguuaauagacag

SEQ ID NO: 1435714 - RNA, 18 nt, Homo sapiens
aucauguuggauagucag

SEQ ID NO: 1435715 - RNA, 18 nt, Homo sapiens
aucauguuggccaggcug

SEQ ID NO: 1435716 - RNA, 14 nt, Homo sapiens
aucauuccuugaga

SEQ ID NO: 1435717 - RNA, 14 nt, Homo sapiens
aucauuugcaaugc

SEQ ID NO: 1435718 - RNA, 22 nt, Homo sapiens
aucauuuuaagaagacaugaca

SEQ ID NO: 1435719 - RNA, 23 nt, Homo sapiens
auccaagcgaggucaacagagaa

SEQ ID NO: 1435720 - RNA, 21 nt, Homo sapiens
auccaauauguuuccaucacu

SEQ ID NO: 1435721 - RNA, 14 nt, Homo sapiens
auccacaagccauu

SEQ ID NO: 1435722 - RNA, 15 nt, Homo sapiens
auccacaagccauuu

SEQ ID NO: 1435723 - RNA, 15 nt, Homo sapiens
auccacccaccucag

SEQ ID NO: 1435724 - RNA, 19 nt, Homo sapiens
auccacgcacacauggaca

SEQ ID NO: 1435725 - RNA, 22 nt, Homo sapiens
auccauaacacccccaccccaa

SEQ ID NO: 1435726 - RNA, 22 nt, Homo sapiens
auccaucacuagccaugauaac

SEQ ID NO: 1435727 - RNA, 21 nt, Homo sapiens
auccauguuaguuuuuacuuu

SEQ ID NO: 1435728 - RNA, 23 nt, Homo sapiens
auccauuccucagggacagagac

SEQ ID NO: 1435729 - RNA, 14 nt, Homo sapiens
aucccaagccagaa

SEQ ID NO: 1435730 - RNA, 16 nt, Homo sapiens
aucccacccaacagcu

SEQ ID NO: 1435731 - RNA, 20 nt, Homo sapiens
aucccacccaacagcucaga

SEQ ID NO: 1435732 - RNA, 18 nt, Homo sapiens
aucccagagcuucccagg

SEQ ID NO: 1435733 - RNA, 14 nt, Homo sapiens
aucccagcacuuug

SEQ ID NO: 1435734 - RNA, 14 nt, Homo sapiens
aucccagcuacuca

SEQ ID NO: 1435735 - RNA, 22 nt, Homo sapiens
aucccaggcgggcggcacgcca

SEQ ID NO: 1435736 - RNA, 21 nt, Homo sapiens
aucccaggggaccacaccucc

SEQ ID NO: 1435737 - RNA, 13 nt, Homo sapiens
aucccaugucacc

SEQ ID NO: 1435738 - RNA, 18 nt, Homo sapiens
auccccagcgauucccuc

SEQ ID NO: 1435739 - RNA, 18 nt, Homo sapiens
aucccccaaaaugcauuu

SEQ ID NO: 1435740 - RNA, 13 nt, Homo sapiens
auccccuuuauua

SEQ ID NO: 1435741 - RNA, 17 nt, Homo sapiens
aucccgaaaaucucucg

SEQ ID NO: 1435742 - RNA, 14 nt, Homo sapiens
aucccuucccuguc

SEQ ID NO: 1435743 - RNA, 23 nt, Homo sapiens
auccgggacgcuuccagaccacc

SEQ ID NO: 1435744 - RNA, 17 nt, Homo sapiens
auccguaguucccugaa

SEQ ID NO: 1435745 - RNA, 15 nt, Homo sapiens
auccuacuacuuugu

SEQ ID NO: 1435746 - RNA, 19 nt, Homo sapiens
auccucaacaacaaaccaa

SEQ ID NO: 1435747 - RNA, 21 nt, Homo sapiens
auccucaacaacaaaccaaaa

SEQ ID NO: 1435748 - RNA, 16 nt, Homo sapiens
auccucacaggagcag

SEQ ID NO: 1435749 - RNA, 22 nt, Homo sapiens
auccugauaaacauuaaacacu

SEQ ID NO: 1435750 - RNA, 20 nt, Homo sapiens
auacccagucccagaaccac

SEQ ID NO: 1435751 - RNA, 14 nt, Homo sapiens
auaccucugaccaa

SEQ ID NO: 1435752 - RNA, 17 nt, Homo sapiens
auaccuuuauugugauc

SEQ ID NO: 1435753 - RNA, 13 nt, Homo sapiens
auacgugucugug

SEQ ID NO: 1435754 - RNA, 18 nt, Homo sapiens
auacucauuucuaaaaga

SEQ ID NO: 1435755 - RNA, 19 nt, Homo sapiens
auacucuagaacaugcaca

SEQ ID NO: 1435756 - RNA, 15 nt, Homo sapiens
auacugauauuucau

SEQ ID NO: 1435757 - RNA, 13 nt, Homo sapiens
auacuguacugag

SEQ ID NO: 1435758 - RNA, 21 nt, Homo sapiens
auacuguacugagacauuaca

SEQ ID NO: 1435759 - RNA, 19 nt, Homo sapiens
auacuuucccacagcacua

SEQ ID NO: 1435760 - RNA, 14 nt, Homo sapiens
auagaaaacugaaa

SEQ ID NO: 1435761 - RNA, 14 nt, Homo sapiens
auagaaacugagga

SEQ ID NO: 1435762 - RNA, 12 nt, Homo sapiens
auagaaacugau

SEQ ID NO: 1435763 - RNA, 23 nt, Homo sapiens
auagaaauguaaaaguacucuga

SEQ ID NO: 1435764 - RNA, 15 nt, Homo sapiens
auagaauauuuacaa

SEQ ID NO: 1435765 - RNA, 20 nt, Homo sapiens
auagacaauuugcccuauca

SEQ ID NO: 1435766 - RNA, 21 nt, Homo sapiens
auagauccauuuggacaaaau

SEQ ID NO: 1435767 - RNA, 21 nt, Homo sapiens
auagauggauuuguaucaaua

SEQ ID NO: 1435768 - RNA, 16 nt, Homo sapiens
auagaugugaucacug

SEQ ID NO: 1435769 - RNA, 23 nt, Homo sapiens
auagaugugcaagucuugucaga

SEQ ID NO: 1435770 - RNA, 19 nt, Homo sapiens
auagauuaauggcacugau

SEQ ID NO: 1435771 - RNA, 23 nt, Homo sapiens
auagcagcaaacagagugaaaug

SEQ ID NO: 1435772 - RNA, 17 nt, Homo sapiens
auagcgaaucaucucaa

SEQ ID NO: 1435773 - RNA, 22 nt, Homo sapiens
auagggguaagguaugggagag

SEQ ID NO: 1435774 - RNA, 16 nt, Homo sapiens
auagguaugagccagg

SEQ ID NO: 1435775 - RNA, 11 nt, Homo sapiens
auaguacuggc

SEQ ID NO: 1435776 - RNA, 13 nt, Homo sapiens
auaguacuggcau

SEQ ID NO: 1435777 - RNA, 13 nt, Homo sapiens
auaguagcauuuc

SEQ ID NO: 1435778 - RNA, 15 nt, Homo sapiens
auaguauaccauaca

SEQ ID NO: 1435779 - RNA, 17 nt, Homo sapiens
auagugcacuagcauuu

SEQ ID NO: 1435780 - RNA, 12 nt, Homo sapiens
auaguguccaaa

SEQ ID NO: 1435781 - RNA, 15 nt, Homo sapiens
auaguucuuacuacu

SEQ ID NO: 1435782 - RNA, 22 nt, Homo sapiens
auauaaggaaagugauccaaaa

SEQ ID NO: 1435783 - RNA, 17 nt, Homo sapiens
auauaccuauaaugugu

SEQ ID NO: 1435784 - RNA, 16 nt, Homo sapiens
auauagguugugcaaa

SEQ ID NO: 1435785 - RNA, 20 nt, Homo sapiens
auauaguaacuacuuuuuau

SEQ ID NO: 1435786 - RNA, 21 nt, Homo sapiens
auauauacacauacauacaca

SEQ ID NO: 1435787 - RNA, 14 nt, Homo sapiens
auauauaccacuuu

SEQ ID NO: 1435788 - RNA, 16 nt, Homo sapiens
auauauaguagcauuu

SEQ ID NO: 1435789 - RNA, 15 nt, Homo sapiens
auauauauauaguaa

SEQ ID NO: 1435790 - RNA, 21 nt, Homo sapiens
auauauauguauauacauauc

SEQ ID NO: 1435791 - RNA, 12 nt, Homo sapiens
auauauaugugu

SEQ ID NO: 1435792 - RNA, 13 nt, Homo sapiens
auauaucaaggau

SEQ ID NO: 1435793 - RNA, 18 nt, Homo sapiens
auauaugacuuuuucuca

SEQ ID NO: 1435794 - RNA, 19 nt, Homo sapiens
auauauuccgcacucaagg

SEQ ID NO: 1435795 - RNA, 17 nt, Homo sapiens
auaucaaaaaguauuaa

SEQ ID NO: 1435796 - RNA, 14 nt, Homo sapiens
auaucacuuacuca

SEQ ID NO: 1435797 - RNA, 18 nt, Homo sapiens
auaucacuuacucaguua

SEQ ID NO: 1435798 - RNA, 13 nt, Homo sapiens
auaucaucagcau

SEQ ID NO: 1435799 - RNA, 15 nt, Homo sapiens
auaucaucagcauac

SEQ ID NO: 1435800 - RNA, 21 nt, Homo sapiens
auaucaucagcauaccuuuau

SEQ ID NO: 1435801 - RNA, 13 nt, Homo sapiens
auaucuaccugcc

SEQ ID NO: 1435802 - RNA, 15 nt, Homo sapiens
auaucuuauguuaaa

SEQ ID NO: 1435803 - RNA, 22 nt, Homo sapiens
auaugaaaugauaaagauguca

SEQ ID NO: 1435804 - RNA, 14 nt, Homo sapiens
aaaauauggcuaua

SEQ ID NO: 1435805 - RNA, 21 nt, Homo sapiens
aaaauaugugcuugaaaugag

SEQ ID NO: 1435806 - RNA, 22 nt, Homo sapiens
aaaauauuuguaucacaaaucu

SEQ ID NO: 1435807 - RNA, 14 nt, Homo sapiens
aaaaucaacuguau

SEQ ID NO: 1435808 - RNA, 15 nt, Homo sapiens
aaaaucuuacuuugu

SEQ ID NO: 1435809 - RNA, 20 nt, Homo sapiens
auuucuuuucauuguaauca

SEQ ID NO: 1435810 - RNA, 20 nt, Homo sapiens
auuugagagaagccacgcug

SEQ ID NO: 1435811 - RNA, 21 nt, Homo sapiens
auuugagcaugcacagcugcu

SEQ ID NO: 1435812 - RNA, 14 nt, Homo sapiens
auuugcccuaucau

SEQ ID NO: 1435813 - RNA, 16 nt, Homo sapiens
auuugcuguucaccca

SEQ ID NO: 1435814 - RNA, 21 nt, Homo sapiens
auuugcuguucacccacaucu

SEQ ID NO: 1435815 - RNA, 14 nt, Homo sapiens
auuuguaaguuuau

SEQ ID NO: 1435816 - RNA, 17 nt, Homo sapiens
auuuguacaaauacugc

SEQ ID NO: 1435817 - RNA, 19 nt, Homo sapiens
auuuguacaaauacugccu

SEQ ID NO: 1435818 - RNA, 14 nt, Homo sapiens
auuuguauuugcca

SEQ ID NO: 1435819 - RNA, 14 nt, Homo sapiens
auuugucaaugcau

SEQ ID NO: 1435820 - RNA, 16 nt, Homo sapiens
auuugucaaugcauca

SEQ ID NO: 1435821 - RNA, 14 nt, Homo sapiens
auuuguuaucucaa

SEQ ID NO: 1435822 - RNA, 20 nt, Homo sapiens
auuuguuuucuucuguaugu

SEQ ID NO: 1435823 - RNA, 13 nt, Homo sapiens
auuuuaauuaucu

SEQ ID NO: 1435824 - RNA, 20 nt, Homo sapiens
auuuuaauugauuauucuga

SEQ ID NO: 1435825 - RNA, 19 nt, Homo sapiens
auuuuaccugggauaugac

SEQ ID NO: 1435826 - RNA, 23 nt, Homo sapiens
auuuuaccugggauaugacaagc

SEQ ID NO: 1435827 - RNA, 15 nt, Homo sapiens
auuuuagaugcaaug

SEQ ID NO: 1435828 - RNA, 19 nt, Homo sapiens
auuuuaggagacagucuca

SEQ ID NO: 1435829 - RNA, 23 nt, Homo sapiens
auuuuagggcuguagacuuacuu

SEQ ID NO: 1435830 - RNA, 21 nt, Homo sapiens
auuuuaugugcuucacauaau

SEQ ID NO: 1435831 - RNA, 21 nt, Homo sapiens
auuuucacuagguuugaauga

SEQ ID NO: 1435832 - RNA, 15 nt, Homo sapiens
auuuucagguuucuu

SEQ ID NO: 1435833 - RNA, 22 nt, Homo sapiens
auuuuccuaaaaauaagcuuua

SEQ ID NO: 1435834 - RNA, 13 nt, Homo sapiens
auuuucuaccugu

SEQ ID NO: 1435835 - RNA, 15 nt, Homo sapiens
auuuucuagacuuuc

SEQ ID NO: 1435836 - RNA, 14 nt, Homo sapiens
auuuucuaguccau

SEQ ID NO: 1435837 - RNA, 16 nt, Homo sapiens
auuuucuauuuaugua

SEQ ID NO: 1435838 - RNA, 19 nt, Homo sapiens
auuuucuuggcaguauucc

SEQ ID NO: 1435839 - RNA, 14 nt, Homo sapiens
auuuuguaugaaaa

SEQ ID NO: 1435840 - RNA, 15 nt, Homo sapiens
auuuuguuacacuaa

SEQ ID NO: 1435841 - RNA, 14 nt, Homo sapiens
caacuuaacaugaa

SEQ ID NO: 1435842 - RNA, 13 nt, Homo sapiens
caacuuggcuuuc

SEQ ID NO: 1435843 - RNA, 21 nt, Homo sapiens
caacuugguuauuguaggcaa

SEQ ID NO: 1435844 - RNA, 13 nt, Homo sapiens
caacuuucuguaa

SEQ ID NO: 1435845 - RNA, 22 nt, Homo sapiens
caagaaaagaggaaaaaaagcc

SEQ ID NO: 1435846 - RNA, 17 nt, Homo sapiens
caagaaaguauuuggua

SEQ ID NO: 1435847 - RNA, 19 nt, Homo sapiens
caagaagaccagacugugg

SEQ ID NO: 1435848 - RNA, 23 nt, Homo sapiens
caagaauagaugcugacuguacu

SEQ ID NO: 1435849 - RNA, 19 nt, Homo sapiens
caagaauauuguauguuaa

SEQ ID NO: 1435850 - RNA, 22 nt, Homo sapiens
caagacaccuuuuguauuuaaa

SEQ ID NO: 1435851 - RNA, 18 nt, Homo sapiens
caagacuugauacugcaa

SEQ ID NO: 1435852 - RNA, 22 nt, Homo sapiens
caagagagggccaugcaauuca

SEQ ID NO: 1435853 - RNA, 16 nt, Homo sapiens
caagaggcccagggag

SEQ ID NO: 1435854 - RNA, 15 nt, Homo sapiens
caagaggucuccauc

SEQ ID NO: 1435855 - RNA, 21 nt, Homo sapiens
caagaggugguagaaccacuu

SEQ ID NO: 1435856 - RNA, 20 nt, Homo sapiens
caagagugagugaacaacua

SEQ ID NO: 1435857 - RNA, 13 nt, Homo sapiens
caagaucuuucag

SEQ ID NO: 1435858 - RNA, 13 nt, Homo sapiens
caagaugggcaca

SEQ ID NO: 1435859 - RNA, 23 nt, Homo sapiens
caagauuggccugaggcugcacu

SEQ ID NO: 1435860 - RNA, 18 nt, Homo sapiens
caagcaagggcugugcug

SEQ ID NO: 1435861 - RNA, 21 nt, Homo sapiens
caagcauggucccacaucccu

SEQ ID NO: 1435862 - RNA, 14 nt, Homo sapiens
caagccacuauguc

SEQ ID NO: 1435863 - RNA, 14 nt, Homo sapiens
caagccauggugac

SEQ ID NO: 1435864 - RNA, 15 nt, Homo sapiens
caagccauggugaca

SEQ ID NO: 1435865 - RNA, 22 nt, Homo sapiens
caagccuguauagacagcacuu

SEQ ID NO: 1435866 - RNA, 22 nt, Homo sapiens
caagcuagaaggccacauguca

SEQ ID NO: 1435867 - RNA, 16 nt, Homo sapiens
caagcugaggugccca

SEQ ID NO: 1435868 - RNA, 17 nt, Homo sapiens
caagcugagugacugua

SEQ ID NO: 1435869 - RNA, 20 nt, Homo sapiens
caagcugagugacuguaggc

SEQ ID NO: 1435870 - RNA, 20 nt, Homo sapiens
caagcuuuguauauaaauga

SEQ ID NO: 1435871 - RNA, 16 nt, Homo sapiens
caaggacaaccugccc

SEQ ID NO: 1435872 - RNA, 19 nt, Homo sapiens
caagggagaagaaauccau

SEQ ID NO: 1435873 - RNA, 16 nt, Homo sapiens
caaggggucuguauau

SEQ ID NO: 1435874 - RNA, 20 nt, Homo sapiens
caaguauuuuaucuguguug

SEQ ID NO: 1435875 - RNA, 15 nt, Homo sapiens
caagucaacacucuu

SEQ ID NO: 1435876 - RNA, 17 nt, Homo sapiens
caagucaccggagcuuu

SEQ ID NO: 1435877 - RNA, 16 nt, Homo sapiens
caagucuacuucacua

SEQ ID NO: 1435878 - RNA, 22 nt, Homo sapiens
caagugaagaaaagugaaugcu

SEQ ID NO: 1435879 - RNA, 14 nt, Homo sapiens
caagugacaucucu

SEQ ID NO: 1435880 - RNA, 20 nt, Homo sapiens
caagugacaugccauccauu

SEQ ID NO: 1435881 - RNA, 17 nt, Homo sapiens
caagugauaucaccucu

SEQ ID NO: 1435882 - RNA, 12 nt, Homo sapiens
caaguguuccca

SEQ ID NO: 1435883 - RNA, 17 nt, Homo sapiens
caaguuauagauucaau

SEQ ID NO: 1435884 - RNA, 13 nt, Homo sapiens
caaguuauauuga

SEQ ID NO: 1435885 - RNA, 19 nt, Homo sapiens
caauaaaagugacucucag

SEQ ID NO: 1435886 - RNA, 14 nt, Homo sapiens
caauaaagacugag

SEQ ID NO: 1435887 - RNA, 17 nt, Homo sapiens
caauaaauaaucuguac

SEQ ID NO: 1435888 - RNA, 13 nt, Homo sapiens
caauaaugugcaa

SEQ ID NO: 1435889 - RNA, 21 nt, Homo sapiens
caauacaugcugcuaauucaa

SEQ ID NO: 1435890 - RNA, 14 nt, Homo sapiens
caauaccaaauagc

SEQ ID NO: 1435891 - RNA, 15 nt, Homo sapiens
caauaccaaauagcu

SEQ ID NO: 1435892 - RNA, 20 nt, Homo sapiens
caauagggugcaguuuucca

SEQ ID NO: 1435893 - RNA, 12 nt, Homo sapiens
augucaccucag

SEQ ID NO: 1435894 - RNA, 21 nt, Homo sapiens
augucaucaaauauuaccaaa

SEQ ID NO: 1435895 - RNA, 15 nt, Homo sapiens
augucccaacuugua

SEQ ID NO: 1435896 - RNA, 18 nt, Homo sapiens
augucccuucucaugccu

SEQ ID NO: 1435897 - RNA, 23 nt, Homo sapiens
auguccggagagacagugacagc

SEQ ID NO: 1435898 - RNA, 19 nt, Homo sapiens
auguccuaaggacacacua

SEQ ID NO: 1435899 - RNA, 21 nt, Homo sapiens
augucucuaagccaacuuuaa

SEQ ID NO: 1435900 - RNA, 23 nt, Homo sapiens
augucuguuucaaugaccuguau

SEQ ID NO: 1435901 - RNA, 16 nt, Homo sapiens
augugaaaaauguguc

SEQ ID NO: 1435902 - RNA, 18 nt, Homo sapiens
augugagauuacuuuguc

SEQ ID NO: 1435903 - RNA, 16 nt, Homo sapiens
augugauuuauuuuga

SEQ ID NO: 1435904 - RNA, 17 nt, Homo sapiens
augugcgcacacacaga

SEQ ID NO: 1435905 - RNA, 22 nt, Homo sapiens
auguggccuaaaaaugcaacuu

SEQ ID NO: 1435906 - RNA, 21 nt, Homo sapiens
augugggguccccaucauccc

SEQ ID NO: 1435907 - RNA, 18 nt, Homo sapiens
auguguauuuguauguac

SEQ ID NO: 1435908 - RNA, 18 nt, Homo sapiens
auguguccccucacucug

SEQ ID NO: 1435909 - RNA, 21 nt, Homo sapiens
auguguccccucacucuguca

SEQ ID NO: 1435910 - RNA, 15 nt, Homo sapiens
augugucuugucucc

SEQ ID NO: 1435911 - RNA, 16 nt, Homo sapiens
auguguuaagugcagg

SEQ ID NO: 1435912 - RNA, 23 nt, Homo sapiens
auguuaggaaaauuucacauuaa

SEQ ID NO: 1435913 - RNA, 17 nt, Homo sapiens
auguuauccacaagcaa

SEQ ID NO: 1435914 - RNA, 22 nt, Homo sapiens
auguuauccacaagcaauggac

SEQ ID NO: 1435915 - RNA, 20 nt, Homo sapiens
auguuccaauaaaacuuuau

SEQ ID NO: 1435916 - RNA, 23 nt, Homo sapiens
auguugcaugccuauguacucua

SEQ ID NO: 1435917 - RNA, 19 nt, Homo sapiens
auguugccaccuguuaaaa

SEQ ID NO: 1435918 - RNA, 12 nt, Homo sapiens
auguugcuuaga

SEQ ID NO: 1435919 - RNA, 21 nt, Homo sapiens
auguuguuccuuuugaaagaa

SEQ ID NO: 1435920 - RNA, 20 nt, Homo sapiens
auguuuacuuuucagggcau

SEQ ID NO: 1435921 - RNA, 12 nt, Homo sapiens
auguuugcacuu

SEQ ID NO: 1435922 - RNA, 15 nt, Homo sapiens
auguuugcacuuugu

SEQ ID NO: 1435923 - RNA, 13 nt, Homo sapiens
auuaaaagcuauc

SEQ ID NO: 1435924 - RNA, 18 nt, Homo sapiens
auuaaaagugacauuugu

SEQ ID NO: 1435925 - RNA, 22 nt, Homo sapiens
augaggacuugugucucugugc

SEQ ID NO: 1435926 - RNA, 17 nt, Homo sapiens
augagggugacugucaa

SEQ ID NO: 1435927 - RNA, 14 nt, Homo sapiens
augagucagucucu

SEQ ID NO: 1435928 - RNA, 23 nt, Homo sapiens
augauaaauucacauaggcaaua

SEQ ID NO: 1435929 - RNA, 12 nt, Homo sapiens
augaugaugaug

SEQ ID NO: 1435930 - RNA, 14 nt, Homo sapiens
augauggugcugac

SEQ ID NO: 1435931 - RNA, 18 nt, Homo sapiens
augauuacuauaugcaaa

SEQ ID NO: 1435932 - RNA, 22 nt, Homo sapiens
augauucagaaauuuucauuca

SEQ ID NO: 1435933 - RNA, 22 nt, Homo sapiens
augauuuccuggggcacagugg

SEQ ID NO: 1435934 - RNA, 14 nt, Homo sapiens
augauuuuauuuga

SEQ ID NO: 1435935 - RNA, 12 nt, Homo sapiens
augauuuuuaca

SEQ ID NO: 1435936 - RNA, 16 nt, Homo sapiens
augcaaaagucuuccu

SEQ ID NO: 1435937 - RNA, 13 nt, Homo sapiens
augcaagugagaa

SEQ ID NO: 1435938 - RNA, 19 nt, Homo sapiens
augcacacaaacaccuccu

SEQ ID NO: 1435939 - RNA, 15 nt, Homo sapiens
augcacacacacaga

SEQ ID NO: 1435940 - RNA, 21 nt, Homo sapiens
augcacacacacggaugcaca

SEQ ID NO: 1435941 - RNA, 17 nt, Homo sapiens
augcacacacagaugca

SEQ ID NO: 1435942 - RNA, 19 nt, Homo sapiens
augcacacacagaugcaca

SEQ ID NO: 1435943 - RNA, 23 nt, Homo sapiens
augcacaccaaaaaaauacuuga

SEQ ID NO: 1435944 - RNA, 23 nt, Homo sapiens
augcacgcacacaucagugcaca

SEQ ID NO: 1435945 - RNA, 18 nt, Homo sapiens
augcacugacccuuccag

SEQ ID NO: 1435946 - RNA, 18 nt, Homo sapiens
augcaguauugagcacug

SEQ ID NO: 1435947 - RNA, 19 nt, Homo sapiens
augcaugcagccacugugc

SEQ ID NO: 1435948 - RNA, 18 nt, Homo sapiens
augcaugcgcaggcucau

SEQ ID NO: 1435949 - RNA, 15 nt, Homo sapiens
augcauguauguagg

SEQ ID NO: 1435950 - RNA, 15 nt, Homo sapiens
augccaacuggucac

SEQ ID NO: 1435951 - RNA, 17 nt, Homo sapiens
augccaagaaaguauuu

SEQ ID NO: 1435952 - RNA, 18 nt, Homo sapiens
augccacccucuccaugc

SEQ ID NO: 1435953 - RNA, 17 nt, Homo sapiens
augccacccuguuuuca

SEQ ID NO: 1435954 - RNA, 11 nt, Homo sapiens
augccaggacc

SEQ ID NO: 1435955 - RNA, 13 nt, Homo sapiens
augcccacucuaa

SEQ ID NO: 1435956 - RNA, 16 nt, Homo sapiens
augcccagagaaucag

SEQ ID NO: 1435957 - RNA, 19 nt, Homo sapiens
augccuaauauuuaggcaa

SEQ ID NO: 1435958 - RNA, 14 nt, Homo sapiens
augccuccaaaaau

SEQ ID NO: 1435959 - RNA, 18 nt, Homo sapiens
augccuccaagccauuca

SEQ ID NO: 1435960 - RNA, 22 nt, Homo sapiens
augccuugagucuuuaauccca

SEQ ID NO: 1435961 - RNA, 21 nt, Homo sapiens
augccuuucuguaaccaaaaa

SEQ ID NO: 1435962 - RNA, 17 nt, Homo sapiens
augcgucccuguacaga

SEQ ID NO: 1435963 - RNA, 15 nt, Homo sapiens
augcucauacuugga

SEQ ID NO: 1435964 - RNA, 21 nt, Homo sapiens
augcucauacuuggacaguua

SEQ ID NO: 1435965 - RNA, 15 nt, Homo sapiens
augcugaaugaaucc

SEQ ID NO: 1435966 - RNA, 17 nt, Homo sapiens
augcugagcgcuguguu

SEQ ID NO: 1435967 - RNA, 15 nt, Homo sapiens
augcugcuaauucaa

SEQ ID NO: 1435968 - RNA, 15 nt, Homo sapiens
augcugugcucuuug

SEQ ID NO: 1435969 - RNA, 20 nt, Homo sapiens
augcuucaguuguacuucca

SEQ ID NO: 1435970 - RNA, 15 nt, Homo sapiens
augcuuuugccacuu

SEQ ID NO: 1435971 - RNA, 23 nt, Homo sapiens
auggaaaagcccagugaccugac

SEQ ID NO: 1435972 - RNA, 17 nt, Homo sapiens
auggaaguggcagugaa

SEQ ID NO: 1435973 - RNA, 18 nt, Homo sapiens
auggaaguggcagugaaa

SEQ ID NO: 1435974 - RNA, 13 nt, Homo sapiens
auggaagugucug

SEQ ID NO: 1435975 - RNA, 15 nt, Homo sapiens
auggaauaaagcccu

SEQ ID NO: 1435976 - RNA, 17 nt, Homo sapiens
auggaaucagcugcuac

SEQ ID NO: 1435977 - RNA, 23 nt, Homo sapiens
auggacaccccuuauccaggacu

SEQ ID NO: 1435978 - RNA, 20 nt, Homo sapiens
auggacucugaaaaacauuc

SEQ ID NO: 1435979 - RNA, 15 nt, Homo sapiens
auggacuguguuucc

SEQ ID NO: 1435980 - RNA, 18 nt, Homo sapiens
auggagaggggguacaau

SEQ ID NO: 1435981 - RNA, 18 nt, Homo sapiens
auggagggagccaucccu

SEQ ID NO: 1435982 - RNA, 15 nt, Homo sapiens
auggaugcacgcaca

SEQ ID NO: 1435983 - RNA, 15 nt, Homo sapiens
auggaugcguggaua

SEQ ID NO: 1435984 - RNA, 21 nt, Homo sapiens
auggcacucuucccaccucag

SEQ ID NO: 1435985 - RNA, 18 nt, Homo sapiens
auggcgugugugccguga

SEQ ID NO: 1435986 - RNA, 20 nt, Homo sapiens
augggaauucuuuacaauaa

SEQ ID NO: 1435987 - RNA, 18 nt, Homo sapiens
augggcucaagucacuuu

SEQ ID NO: 1435988 - RNA, 22 nt, Homo sapiens
auggggcgaucaaguccagagc

SEQ ID NO: 1435989 - RNA, 21 nt, Homo sapiens
auggggguggggaggcaagaa

SEQ ID NO: 1435990 - RNA, 14 nt, Homo sapiens
augggucaaagccg

SEQ ID NO: 1435991 - RNA, 22 nt, Homo sapiens
augggucuggcugagcugaacc

SEQ ID NO: 1435992 - RNA, 16 nt, Homo sapiens
augguaaaaguuacuu

SEQ ID NO: 1435993 - RNA, 15 nt, Homo sapiens
augguaagacuguaa

SEQ ID NO: 1435994 - RNA, 23 nt, Homo sapiens
auggucagcucacacccuaauaa

SEQ ID NO: 1435995 - RNA, 23 nt, Homo sapiens
auggugacuaacaguuacaugaa

SEQ ID NO: 1435996 - RNA, 20 nt, Homo sapiens
auggugcucacgacucuucc

SEQ ID NO: 1435997 - RNA, 17 nt, Homo sapiens
auggugggaacccuccc

SEQ ID NO: 1435998 - RNA, 21 nt, Homo sapiens
augguguguuccuaacauaaa

SEQ ID NO: 1435999 - RNA, 20 nt, Homo sapiens
augguucucagaucuugaca

SEQ ID NO: 1436000 - RNA, 14 nt, Homo sapiens
augguuuacaugaa

SEQ ID NO: 1436001 - RNA, 16 nt, Homo sapiens
auguacacacacagau

SEQ ID NO: 1436002 - RNA, 21 nt, Homo sapiens
auguacacacacagaugcaca

SEQ ID NO: 1436003 - RNA, 12 nt, Homo sapiens
auguauacacac

SEQ ID NO: 1436004 - RNA, 18 nt, Homo sapiens
auguauguuuacauauca

SEQ ID NO: 1436005 - RNA, 19 nt, Homo sapiens
auguauuuuugucauagca

SEQ ID NO: 1436006 - RNA, 17 nt, Homo sapiens
augucaaauaucucaga

SEQ ID NO: 1436007 - RNA, 23 nt, Homo sapiens
augucaaguaccaaaauguuaau

SEQ ID NO: 1436008 - RNA, 20 nt, Homo sapiens
augucaccguggaccuuccu

SEQ ID NO: 1436009 - RNA, 16 nt, Homo sapiens
auccugcgagcuccuu

SEQ ID NO: 1436010 - RNA, 18 nt, Homo sapiens
auccuggcuaacacguga

SEQ ID NO: 1436011 - RNA, 18 nt, Homo sapiens
auccuuauuuauauauca

SEQ ID NO: 1436012 - RNA, 20 nt, Homo sapiens
auccuuugagaaugugauuc

SEQ ID NO: 1436013 - RNA, 16 nt, Homo sapiens
aucgaucuguacugua

SEQ ID NO: 1436014 - RNA, 21 nt, Homo sapiens
aucgcaaccaggauugacagg

SEQ ID NO: 1436015 - RNA, 23 nt, Homo sapiens
aucgccguguuacuguugcacug

SEQ ID NO: 1436016 - RNA, 18 nt, Homo sapiens
aucgcugccuugccaugu

SEQ ID NO: 1436017 - RNA, 21 nt, Homo sapiens
aucuaaaaagacuaaccugcc

SEQ ID NO: 1436018 - RNA, 21 nt, Homo sapiens
aucuaagaaaauuuacuguaa

SEQ ID NO: 1436019 - RNA, 18 nt, Homo sapiens
aucuacaagcauuugccc

SEQ ID NO: 1436020 - RNA, 19 nt, Homo sapiens
aucuaccugcccucucuca

SEQ ID NO: 1436021 - RNA, 17 nt, Homo sapiens
aucuacucauugucuca

SEQ ID NO: 1436022 - RNA, 19 nt, Homo sapiens
aucuaguucucaaucacug

SEQ ID NO: 1436023 - RNA, 14 nt, Homo sapiens
aucuaguuuacuuc

SEQ ID NO: 1436024 - RNA, 23 nt, Homo sapiens
aucucaguggcacagguuuaaga

SEQ ID NO: 1436025 - RNA, 19 nt, Homo sapiens
aucucauaccucugaccaa

SEQ ID NO: 1436026 - RNA, 23 nt, Homo sapiens
aucucauucccagagucagagga

SEQ ID NO: 1436027 - RNA, 12 nt, Homo sapiens
aucuccaaggac

SEQ ID NO: 1436028 - RNA, 21 nt, Homo sapiens
aucuccacggucagauuugcu

SEQ ID NO: 1436029 - RNA, 20 nt, Homo sapiens
aucuccaguauucuugucaa

SEQ ID NO: 1436030 - RNA, 22 nt, Homo sapiens
aucuccuaaaagugguuuuuau

SEQ ID NO: 1436031 - RNA, 14 nt, Homo sapiens
aucucucuccugua

SEQ ID NO: 1436032 - RNA, 20 nt, Homo sapiens
aucucuggccauauccugcc

SEQ ID NO: 1436033 - RNA, 20 nt, Homo sapiens
aucugaaaggcacacuuuga

SEQ ID NO: 1436034 - RNA, 19 nt, Homo sapiens
aucugaacacauacuagaa

SEQ ID NO: 1436035 - RNA, 20 nt, Homo sapiens
aucugacaucuuauuuacuu

SEQ ID NO: 1436036 - RNA, 15 nt, Homo sapiens
aucugauaugcagag

SEQ ID NO: 1436037 - RNA, 17 nt, Homo sapiens
aucugcauuccccgcug

SEQ ID NO: 1436038 - RNA, 17 nt, Homo sapiens
aucugccauaaagccau

SEQ ID NO: 1436039 - RNA, 15 nt, Homo sapiens
aucugccuuuaccua

SEQ ID NO: 1436040 - RNA, 11 nt, Homo sapiens
aucuguacaau

SEQ ID NO: 1436041 - RNA, 16 nt, Homo sapiens
aucuguuuuucaugua

SEQ ID NO: 1436042 - RNA, 22 nt, Homo sapiens
aucuuacagguaucaggcacag

SEQ ID NO: 1436043 - RNA, 12 nt, Homo sapiens
aucuucagcucc

SEQ ID NO: 1436044 - RNA, 20 nt, Homo sapiens
aucuucaggacuauuucacu

SEQ ID NO: 1436045 - RNA, 14 nt, Homo sapiens
aucuuccaaagaca

SEQ ID NO: 1436046 - RNA, 15 nt, Homo sapiens
aucuuccccggaugu

SEQ ID NO: 1436047 - RNA, 18 nt, Homo sapiens
aucuuccugccucaggcu

SEQ ID NO: 1436048 - RNA, 17 nt, Homo sapiens
aucuugcacauauuuga

SEQ ID NO: 1436049 - RNA, 23 nt, Homo sapiens
aucuuggccaggcuggucuugaa

SEQ ID NO: 1436050 - RNA, 21 nt, Homo sapiens
aucuuuaaaauacacacucaa

SEQ ID NO: 1436051 - RNA, 14 nt, Homo sapiens
aucuuugugacagg

SEQ ID NO: 1436052 - RNA, 14 nt, Homo sapiens
aucuuugugcuuca

SEQ ID NO: 1436053 - RNA, 18 nt, Homo sapiens
augaaaaagauauaugaa

SEQ ID NO: 1436054 - RNA, 12 nt, Homo sapiens
augaaaccaaag

SEQ ID NO: 1436055 - RNA, 13 nt, Homo sapiens
augaaaccaaagc

SEQ ID NO: 1436056 - RNA, 14 nt, Homo sapiens
augaaagugcaaag

SEQ ID NO: 1436057 - RNA, 22 nt, Homo sapiens
augaaauccugcuucaguguau

SEQ ID NO: 1436058 - RNA, 15 nt, Homo sapiens
augaaaucuugcaau

SEQ ID NO: 1436059 - RNA, 21 nt, Homo sapiens
augaacaaacuaugaucacag

SEQ ID NO: 1436060 - RNA, 18 nt, Homo sapiens
augaacacagcugcugaa

SEQ ID NO: 1436061 - RNA, 16 nt, Homo sapiens
augaacuguccuucca

SEQ ID NO: 1436062 - RNA, 12 nt, Homo sapiens
augaacuuucuc

SEQ ID NO: 1436063 - RNA, 17 nt, Homo sapiens
augaagacccaguguaa

SEQ ID NO: 1436064 - RNA, 15 nt, Homo sapiens
augaagagacucucu

SEQ ID NO: 1436065 - RNA, 20 nt, Homo sapiens
augaagcaagccccacuuau

SEQ ID NO: 1436066 - RNA, 23 nt, Homo sapiens
augaaggaauagcccgaggaccg

SEQ ID NO: 1436067 - RNA, 20 nt, Homo sapiens
augaaguguguuuccuucag

SEQ ID NO: 1436068 - RNA, 18 nt, Homo sapiens
augaaguuauucuugaca

SEQ ID NO: 1436069 - RNA, 18 nt, Homo sapiens
augaauauuuuguaacua

SEQ ID NO: 1436070 - RNA, 20 nt, Homo sapiens
augaauauuuuguaacuauu

SEQ ID NO: 1436071 - RNA, 15 nt, Homo sapiens
augaaucuuacuccu

SEQ ID NO: 1436072 - RNA, 16 nt, Homo sapiens
augaaucuuacuccuu

SEQ ID NO: 1436073 - RNA, 14 nt, Homo sapiens
augaauugucuuca

SEQ ID NO: 1436074 - RNA, 20 nt, Homo sapiens
augacaaaguuacaaauuca

SEQ ID NO: 1436075 - RNA, 23 nt, Homo sapiens
augacaccuccauuucucuccag

SEQ ID NO: 1436076 - RNA, 11 nt, Homo sapiens
augacacugac

SEQ ID NO: 1436077 - RNA, 13 nt, Homo sapiens
augacacugaccu

SEQ ID NO: 1436078 - RNA, 20 nt, Homo sapiens
augacagaaugcuguuuuaa

SEQ ID NO: 1436079 - RNA, 15 nt, Homo sapiens
augacaucaacauuc

SEQ ID NO: 1436080 - RNA, 16 nt, Homo sapiens
augacaucaacauucc

SEQ ID NO: 1436081 - RNA, 20 nt, Homo sapiens
augacaucacuuguacaaaa

SEQ ID NO: 1436082 - RNA, 12 nt, Homo sapiens
augaccaagaaa

SEQ ID NO: 1436083 - RNA, 17 nt, Homo sapiens
augacccacccaguguc

SEQ ID NO: 1436084 - RNA, 15 nt, Homo sapiens
augacucagcauacc

SEQ ID NO: 1436085 - RNA, 17 nt, Homo sapiens
augacucagcauaccug

SEQ ID NO: 1436086 - RNA, 22 nt, Homo sapiens
augacuucugccccagcuuuau

SEQ ID NO: 1436087 - RNA, 14 nt, Homo sapiens
augagagaacugga

SEQ ID NO: 1436088 - RNA, 20 nt, Homo sapiens
augagcaaggacaaccugcc

SEQ ID NO: 1436089 - RNA, 20 nt, Homo sapiens
augagcacacacacaccaau

SEQ ID NO: 1436090 - RNA, 23 nt, Homo sapiens
augagcacacacacaccaaugcg

SEQ ID NO: 1436091 - RNA, 18 nt, Homo sapiens
augagccaccaugcccag

SEQ ID NO: 1436092 - RNA, 15 nt, Homo sapiens
augagcccuagaaga

SEQ ID NO: 1436093 - RNA, 13 nt, Homo sapiens
uggacuugucuuc

SEQ ID NO: 1436094 - RNA, 20 nt, Homo sapiens
uggacuuuugaaaagcuuuu

SEQ ID NO: 1436095 - RNA, 19 nt, Homo sapiens
uggagaaagggaaguggaa

SEQ ID NO: 1436096 - RNA, 22 nt, Homo sapiens
uggagaaauuccuugauucaca

SEQ ID NO: 1436097 - RNA, 21 nt, Homo sapiens
uggagaaggaaggcuccaucu

SEQ ID NO: 1436098 - RNA, 19 nt, Homo sapiens
uggagagcuagaaccugga

SEQ ID NO: 1436099 - RNA, 17 nt, Homo sapiens
uggagauuucaguuacu

SEQ ID NO: 1436100 - RNA, 19 nt, Homo sapiens
uggaggacacacagucuca

SEQ ID NO: 1436101 - RNA, 13 nt, Homo sapiens
uggaggaccugag

SEQ ID NO: 1436102 - RNA, 15 nt, Homo sapiens
uggaggccaaggugg

SEQ ID NO: 1436103 - RNA, 14 nt, Homo sapiens
uggagggaauuuga

SEQ ID NO: 1436104 - RNA, 19 nt, Homo sapiens
uggagggcuagaaucugga

SEQ ID NO: 1436105 - RNA, 18 nt, Homo sapiens
uggagugcaguggugcga

SEQ ID NO: 1436106 - RNA, 15 nt, Homo sapiens
uggaguggacauuca

SEQ ID NO: 1436107 - RNA, 23 nt, Homo sapiens
uggagugucaccagcugccaaaa

SEQ ID NO: 1436108 - RNA, 13 nt, Homo sapiens
uggaguucagaga

SEQ ID NO: 1436109 - RNA, 23 nt, Homo sapiens
ucaucccaucuaagcugcagcuu

SEQ ID NO: 1436110 - RNA, 17 nt, Homo sapiens
ucauccccucguccugu

SEQ ID NO: 1436111 - RNA, 15 nt, Homo sapiens
ucaucccuaugggau

SEQ ID NO: 1436112 - RNA, 19 nt, Homo sapiens
ucaucccuuuccaguuaag

SEQ ID NO: 1436113 - RNA, 21 nt, Homo sapiens
ucauccuccuuauaagcccag

SEQ ID NO: 1436114 - RNA, 19 nt, Homo sapiens
ucaucuacaagcauuugcc

SEQ ID NO: 1436115 - RNA, 13 nt, Homo sapiens
ucaucuacuacag

SEQ ID NO: 1436116 - RNA, 16 nt, Homo sapiens
ucaucuauaacaugca

SEQ ID NO: 1436117 - RNA, 13 nt, Homo sapiens
ucaucuguuguuu

SEQ ID NO: 1436118 - RNA, 14 nt, Homo sapiens
ucaucuugacaugu

SEQ ID NO: 1436119 - RNA, 21 nt, Homo sapiens
ucaucuuguugccauggaguu

SEQ ID NO: 1436120 - RNA, 22 nt, Homo sapiens
ucaugacuuuuccauguaucua

SEQ ID NO: 1436121 - RNA, 18 nt, Homo sapiens
ucaugaguaccucaaagg

SEQ ID NO: 1436122 - RNA, 16 nt, Homo sapiens
ucaugauggagacuuc

SEQ ID NO: 1436123 - RNA, 15 nt, Homo sapiens
ucaugcacucaggca

SEQ ID NO: 1436124 - RNA, 17 nt, Homo sapiens
ucauggaaaagcccagu

SEQ ID NO: 1436125 - RNA, 20 nt, Homo sapiens
ucauggacagauagacagug

SEQ ID NO: 1436126 - RNA, 18 nt, Homo sapiens
ucauggagaaacauccua

SEQ ID NO: 1436127 - RNA, 20 nt, Homo sapiens
ucauggcuuagaaaucuuua

SEQ ID NO: 1436128 - RNA, 15 nt, Homo sapiens
ucaugugaaaauaau

SEQ ID NO: 1436129 - RNA, 16 nt, Homo sapiens
ucaugugugcauguga

SEQ ID NO: 1436130 - RNA, 14 nt, Homo sapiens
ucauguuccucaaa

SEQ ID NO: 1436131 - RNA, 16 nt, Homo sapiens
ucauguuggauaguca

SEQ ID NO: 1436132 - RNA, 11 nt, Homo sapiens
ucauuaucuca

SEQ ID NO: 1436133 - RNA, 19 nt, Homo sapiens
ucauuaugcagcugagguc

SEQ ID NO: 1436134 - RNA, 18 nt, Homo sapiens
ucauucaaaacaaccauc

SEQ ID NO: 1436135 - RNA, 16 nt, Homo sapiens
ucauucaagccuguga

SEQ ID NO: 1436136 - RNA, 17 nt, Homo sapiens
ucauucaauaucugaca

SEQ ID NO: 1436137 - RNA, 16 nt, Homo sapiens
ucauuccaccuuccca

SEQ ID NO: 1436138 - RNA, 19 nt, Homo sapiens
ucauugucgcucagcaaua

SEQ ID NO: 1436139 - RNA, 20 nt, Homo sapiens
ucauuguuuauuaacaaauu

SEQ ID NO: 1436140 - RNA, 15 nt, Homo sapiens
ucauuuaauccuccc

SEQ ID NO: 1436141 - RNA, 13 nt, Homo sapiens
ucauuuaccauaa

SEQ ID NO: 1436142 - RNA, 15 nt, Homo sapiens
ucauuuaucccucaa

SEQ ID NO: 1436143 - RNA, 18 nt, Homo sapiens
ucauuuucaaugcacauu

SEQ ID NO: 1436144 - RNA, 22 nt, Homo sapiens
ucauuuucaaugcacauuaguu

SEQ ID NO: 1436145 - RNA, 19 nt, Homo sapiens
ucauuuuguuauagaaacu

SEQ ID NO: 1436146 - RNA, 23 nt, Homo sapiens
ucauuuuugguaggcuuaucaaa

SEQ ID NO: 1436147 - RNA, 18 nt, Homo sapiens
ucauuuuuuucacuggag

SEQ ID NO: 1436148 - RNA, 21 nt, Homo sapiens
uccaaaaaggaacacuggaaa

SEQ ID NO: 1436149 - RNA, 16 nt, Homo sapiens
uccaaagaacagccug

SEQ ID NO: 1436150 - RNA, 17 nt, Homo sapiens
uccaaaggaaucuccag

SEQ ID NO: 1436151 - RNA, 16 nt, Homo sapiens
uccaaccuaaccccuu

SEQ ID NO: 1436152 - RNA, 20 nt, Homo sapiens
uccaacuccuggagauuuca

SEQ ID NO: 1436153 - RNA, 16 nt, Homo sapiens
uccaacuccugguuca

SEQ ID NO: 1436154 - RNA, 13 nt, Homo sapiens
uccaagaacaauu

SEQ ID NO: 1436155 - RNA, 19 nt, Homo sapiens
uccaagaggucuccaucau

SEQ ID NO: 1436156 - RNA, 14 nt, Homo sapiens
uccaagcauaccaa

SEQ ID NO: 1436157 - RNA, 18 nt, Homo sapiens
uccaaggaguuccaugaa

SEQ ID NO: 1436158 - RNA, 13 nt, Homo sapiens
uccaagugccaau

SEQ ID NO: 1436159 - RNA, 15 nt, Homo sapiens
uccaauaggcauuug

SEQ ID NO: 1436160 - RNA, 17 nt, Homo sapiens
uccaauauuggagcaua

SEQ ID NO: 1436161 - RNA, 13 nt, Homo sapiens
uccacaagccauu

SEQ ID NO: 1436162 - RNA, 16 nt, Homo sapiens
uccacaauaaggucaa

SEQ ID NO: 1436163 - RNA, 17 nt, Homo sapiens
uccacagucucccauuc

SEQ ID NO: 1436164 - RNA, 17 nt, Homo sapiens
uccacaguuuugccuua

SEQ ID NO: 1436165 - RNA, 18 nt, Homo sapiens
uccacaguuuugccuuaa

SEQ ID NO: 1436166 - RNA, 17 nt, Homo sapiens
uccacccacaacaucua

SEQ ID NO: 1436167 - RNA, 15 nt, Homo sapiens
uccacccagugcugc

SEQ ID NO: 1436168 - RNA, 16 nt, Homo sapiens
uccacccuauucccua

SEQ ID NO: 1436169 - RNA, 18 nt, Homo sapiens
uccacccucaaaugucag

SEQ ID NO: 1436170 - RNA, 18 nt, Homo sapiens
ucugaggcuuccagagag

SEQ ID NO: 1436171 - RNA, 16 nt, Homo sapiens
ucugauauaacaaacu

SEQ ID NO: 1436172 - RNA, 15 nt, Homo sapiens
ucugaucugugaauu

SEQ ID NO: 1436173 - RNA, 12 nt, Homo sapiens
ucugcacccagg

SEQ ID NO: 1436174 - RNA, 20 nt, Homo sapiens
ucugcagggagcaacucucc

SEQ ID NO: 1436175 - RNA, 15 nt, Homo sapiens
ucugcagugugcacg

SEQ ID NO: 1436176 - RNA, 15 nt, Homo sapiens
ucugcauguguguug

SEQ ID NO: 1436177 - RNA, 21 nt, Homo sapiens
ucugcauuaucugaggucaca

SEQ ID NO: 1436178 - RNA, 20 nt, Homo sapiens
ucugcccacugugaaaccac

SEQ ID NO: 1436179 - RNA, 16 nt, Homo sapiens
ucugccccagcuuuau

SEQ ID NO: 1436180 - RNA, 14 nt, Homo sapiens
ucugcccuguauau

SEQ ID NO: 1436181 - RNA, 20 nt, Homo sapiens
ucugccuauuuauuggggug

SEQ ID NO: 1436182 - RNA, 13 nt, Homo sapiens
ucugccugggcuu

SEQ ID NO: 1436183 - RNA, 23 nt, Homo sapiens
ucugccuguggccuugcccgcca

SEQ ID NO: 1436184 - RNA, 14 nt, Homo sapiens
ucugcggccuucca

SEQ ID NO: 1436185 - RNA, 16 nt, Homo sapiens
ucugcuauauuuucau

SEQ ID NO: 1436186 - RNA, 19 nt, Homo sapiens
ucugcuggccuggaucucc

SEQ ID NO: 1436187 - RNA, 23 nt, Homo sapiens
ucugcuguauacuguacugagac

SEQ ID NO: 1436188 - RNA, 13 nt, Homo sapiens
ucuggaaaccacg

SEQ ID NO: 1436189 - RNA, 19 nt, Homo sapiens
ucuggaaagggcacgagag

SEQ ID NO: 1436190 - RNA, 17 nt, Homo sapiens
uauuuccaucuaggacu

SEQ ID NO: 1436191 - RNA, 19 nt, Homo sapiens
uauuuccugcuacacaaaa

SEQ ID NO: 1436192 - RNA, 14 nt, Homo sapiens
uauuucuaugcaaa

SEQ ID NO: 1436193 - RNA, 14 nt, Homo sapiens
uauuugaauaucau

SEQ ID NO: 1436194 - RNA, 19 nt, Homo sapiens
uauuuggagcaagugacau

SEQ ID NO: 1436195 - RNA, 16 nt, Homo sapiens
uauuuguauuugccau

SEQ ID NO: 1436196 - RNA, 16 nt, Homo sapiens
uauuugugcucuguga

SEQ ID NO: 1436197 - RNA, 16 nt, Homo sapiens
uauuuuaaaacauaag

SEQ ID NO: 1436198 - RNA, 17 nt, Homo sapiens
uauuuuaaaacauaaga

SEQ ID NO: 1436199 - RNA, 13 nt, Homo sapiens
uauuuucacauga

SEQ ID NO: 1436200 - RNA, 19 nt, Homo sapiens
uauuuuccccuagcuuucc

SEQ ID NO: 1436201 - RNA, 16 nt, Homo sapiens
uauuuuuguacguuau

SEQ ID NO: 1436202 - RNA, 16 nt, Homo sapiens
uauuuuuuaaagucua

SEQ ID NO: 1436203 - RNA, 21 nt, Homo sapiens
uauuuuuuaaagucuauuguu

SEQ ID NO: 1436204 - RNA, 17 nt, Homo sapiens
ucaaaacagagauguga

SEQ ID NO: 1436205 - RNA, 13 nt, Homo sapiens
ucaaaacauauca

SEQ ID NO: 1436206 - RNA, 20 nt, Homo sapiens
ucaaaagccugggugagaau

SEQ ID NO: 1436207 - RNA, 12 nt, Homo sapiens
ucaaaaggugcc

SEQ ID NO: 1436208 - RNA, 22 nt, Homo sapiens
ucaaaauaccaugccauuuaaa

SEQ ID NO: 1436209 - RNA, 23 nt, Homo sapiens
ucaaacaugaaguguguuuccuu

SEQ ID NO: 1436210 - RNA, 18 nt, Homo sapiens
ucaaaccccgaccaccug

SEQ ID NO: 1436211 - RNA, 21 nt, Homo sapiens
ucaaacugcaugauucaugcc

SEQ ID NO: 1436212 - RNA, 14 nt, Homo sapiens
ucaaagacauggaa

SEQ ID NO: 1436213 - RNA, 18 nt, Homo sapiens
ucaaagauccagugcagu

SEQ ID NO: 1436214 - RNA, 23 nt, Homo sapiens
ucaaagauguguugcuauccuga

SEQ ID NO: 1436215 - RNA, 14 nt, Homo sapiens
ucaaagcacuguuu

SEQ ID NO: 1436216 - RNA, 15 nt, Homo sapiens
ucaaaggaagacuug

SEQ ID NO: 1436217 - RNA, 16 nt, Homo sapiens
ucaaaggaagacuuga

SEQ ID NO: 1436218 - RNA, 19 nt, Homo sapiens
ucaaauagauggauuugua

SEQ ID NO: 1436219 - RNA, 21 nt, Homo sapiens
ucaaauaugcaaagcacugac

SEQ ID NO: 1436220 - RNA, 16 nt, Homo sapiens
ucaaauauuaccaaaa

SEQ ID NO: 1436221 - RNA, 13 nt, Homo sapiens
ucaaauauuucaa

SEQ ID NO: 1436222 - RNA, 14 nt, Homo sapiens
ucaaauauuucaac

SEQ ID NO: 1436223 - RNA, 21 nt, Homo sapiens
ucaaaucacauggcuuuccac

SEQ ID NO: 1436224 - RNA, 17 nt, Homo sapiens
ucaaaucuauucagaca

SEQ ID NO: 1436225 - RNA, 12 nt, Homo sapiens
ucaaaucuccag

SEQ ID NO: 1436226 - RNA, 20 nt, Homo sapiens
ucaaauuuugcauuguguga

SEQ ID NO: 1436227 - RNA, 18 nt, Homo sapiens
ucaacaacaaaccaaaac

SEQ ID NO: 1436228 - RNA, 21 nt, Homo sapiens
ucaacauucccccaacauuac

SEQ ID NO: 1436229 - RNA, 15 nt, Homo sapiens
ucaaccaauguagaa

SEQ ID NO: 1436230 - RNA, 15 nt, Homo sapiens
ucaaccacucgccga

SEQ ID NO: 1436231 - RNA, 15 nt, Homo sapiens
ucaaccgcuugccau

SEQ ID NO: 1436232 - RNA, 18 nt, Homo sapiens
ucaagaagucugaagcga

SEQ ID NO: 1436233 - RNA, 21 nt, Homo sapiens
ucaagacuugauacugcaaua

SEQ ID NO: 1436234 - RNA, 19 nt, Homo sapiens
ucaagagaagcacaugaaa

SEQ ID NO: 1436235 - RNA, 17 nt, Homo sapiens
ucaagagugagugaaca

SEQ ID NO: 1436236 - RNA, 18 nt, Homo sapiens
ucaagcaauugucugccu

SEQ ID NO: 1436237 - RNA, 13 nt, Homo sapiens
ucaagcaugcaau

SEQ ID NO: 1436238 - RNA, 11 nt, Homo sapiens
ucaagccaugg

SEQ ID NO: 1436239 - RNA, 18 nt, Homo sapiens
ucaagcuagaaggccaca

SEQ ID NO: 1436240 - RNA, 20 nt, Homo sapiens
ucaagggauguauuggaaca

SEQ ID NO: 1436241 - RNA, 20 nt, Homo sapiens
ucaaguaccaaaauguuaau

SEQ ID NO: 1436242 - RNA, 23 nt, Homo sapiens
ucaagugccucuuguugcagaga

SEQ ID NO: 1436243 - RNA, 17 nt, Homo sapiens
ucaauaauauuagcuua

SEQ ID NO: 1436244 - RNA, 21 nt, Homo sapiens
ucaauaccccuguuaagcaau

SEQ ID NO: 1436245 - RNA, 14 nt, Homo sapiens
ucaauaugugauuu

SEQ ID NO: 1436246 - RNA, 19 nt, Homo sapiens
ucaaucagugcagugauac

SEQ ID NO: 1436247 - RNA, 20 nt, Homo sapiens
ucaaucaugaguaccucaaa

SEQ ID NO: 1436248 - RNA, 20 nt, Homo sapiens
ucaauccugcccccagccau

SEQ ID NO: 1436249 - RNA, 22 nt, Homo sapiens
ucaauccugcccccagccaugg

SEQ ID NO: 1436250 - RNA, 20 nt, Homo sapiens
gugucaggcagguuugccag

SEQ ID NO: 1436251 - RNA, 15 nt, Homo sapiens
guguccccaccucag

SEQ ID NO: 1436252 - RNA, 16 nt, Homo sapiens
gugucuggaagcugag

SEQ ID NO: 1436253 - RNA, 18 nt, Homo sapiens
gugugauuuccuacagaa

SEQ ID NO: 1436254 - RNA, 16 nt, Homo sapiens
gugugcagacugaugg

SEQ ID NO: 1436255 - RNA, 16 nt, Homo sapiens
gugugcauguguguau

SEQ ID NO: 1436256 - RNA, 19 nt, Homo sapiens
guguguauauauguguaua

SEQ ID NO: 1436257 - RNA, 20 nt, Homo sapiens
guguguauauauguguauau

SEQ ID NO: 1436258 - RNA, 19 nt, Homo sapiens
guguguccguggaaccagu

SEQ ID NO: 1436259 - RNA, 19 nt, Homo sapiens
guguguuugugugcaugaa

SEQ ID NO: 1436260 - RNA, 19 nt, Homo sapiens
guguuauuauuuugcacug

SEQ ID NO: 1436261 - RNA, 17 nt, Homo sapiens
guguugccuccuaccuu

SEQ ID NO: 1436262 - RNA, 19 nt, Homo sapiens
guguugguguauuugccag

SEQ ID NO: 1436263 - RNA, 22 nt, Homo sapiens
guguuguacaauaccagaucac

SEQ ID NO: 1436264 - RNA, 22 nt, Homo sapiens
guguuuuugcuaucacacagug

SEQ ID NO: 1436265 - RNA, 17 nt, Homo sapiens
guuaaaauuuaaccuac

SEQ ID NO: 1436266 - RNA, 16 nt, Homo sapiens
guuaagugaaugucua

SEQ ID NO: 1436267 - RNA, 16 nt, Homo sapiens
guuaauucagcacuga

SEQ ID NO: 1436268 - RNA, 16 nt, Homo sapiens
guuacacagcccaaga

SEQ ID NO: 1436269 - RNA, 16 nt, Homo sapiens
guuacaucacaguguu

SEQ ID NO: 1436270 - RNA, 15 nt, Homo sapiens
guuaccaacuaccua

SEQ ID NO: 1436271 - RNA, 20 nt, Homo sapiens
guuaccgaggacccugguua

SEQ ID NO: 1436272 - RNA, 17 nt, Homo sapiens
guuaccuuucccaugcu

SEQ ID NO: 1436273 - RNA, 11 nt, Homo sapiens
guuacuauuau

SEQ ID NO: 1436274 - RNA, 17 nt, Homo sapiens
guuacuguugcacugau

SEQ ID NO: 1436275 - RNA, 18 nt, Homo sapiens
guuagaauuuuccuaaaa

SEQ ID NO: 1436276 - RNA, 14 nt, Homo sapiens
guuagaugaggcac

SEQ ID NO: 1436277 - RNA, 23 nt, Homo sapiens
guuaggaaaauuucacauuaaua

SEQ ID NO: 1436278 - RNA, 19 nt, Homo sapiens
guuagggaugacugugauu

SEQ ID NO: 1436279 - RNA, 19 nt, Homo sapiens
guuauagaaacugauauau

SEQ ID NO: 1436280 - RNA, 14 nt, Homo sapiens
guuauguuugcacu

SEQ ID NO: 1436281 - RNA, 16 nt, Homo sapiens
uagauuccucuugccu

SEQ ID NO: 1436282 - RNA, 19 nt, Homo sapiens
uagcagaaggcaagcacca

SEQ ID NO: 1436283 - RNA, 15 nt, Homo sapiens
uagcaucugagcucc

SEQ ID NO: 1436284 - RNA, 15 nt, Homo sapiens
uagcauuuuuauuca

SEQ ID NO: 1436285 - RNA, 17 nt, Homo sapiens
uagccauccuuggccug

SEQ ID NO: 1436286 - RNA, 19 nt, Homo sapiens
uagccaugauaacugcaau

SEQ ID NO: 1436287 - RNA, 16 nt, Homo sapiens
uagccuaauacaacau

SEQ ID NO: 1436288 - RNA, 23 nt, Homo sapiens
uagccucccaaagugcugggauu

SEQ ID NO: 1436289 - RNA, 17 nt, Homo sapiens
uagccucgcucuuggca

SEQ ID NO: 1436290 - RNA, 16 nt, Homo sapiens
uagcgaaucaucucaa

SEQ ID NO: 1436291 - RNA, 17 nt, Homo sapiens
uagcgcuggcucaggaa

SEQ ID NO: 1436292 - RNA, 21 nt, Homo sapiens
uagcguaacaaacaaaaucau

SEQ ID NO: 1436293 - RNA, 17 nt, Homo sapiens
uagcuagccagcugugu

SEQ ID NO: 1436294 - RNA, 19 nt, Homo sapiens
uagcuauuuucuuacagug

SEQ ID NO: 1436295 - RNA, 17 nt, Homo sapiens
uagcucuggaccagccu

SEQ ID NO: 1436296 - RNA, 14 nt, Homo sapiens
uagcugacaaugca

SEQ ID NO: 1436297 - RNA, 19 nt, Homo sapiens
uagcuguaaauacaugugu

SEQ ID NO: 1436298 - RNA, 20 nt, Homo sapiens
uagcuuguauaguguaaaau

SEQ ID NO: 1436299 - RNA, 17 nt, Homo sapiens
uaggacauauaccuucu

SEQ ID NO: 1436300 - RNA, 23 nt, Homo sapiens
uaggacuccacaguuuugccuua

SEQ ID NO: 1436301 - RNA, 17 nt, Homo sapiens
uaggaguugaguacagu

SEQ ID NO: 1436302 - RNA, 16 nt, Homo sapiens
uaggauggauugcagu

SEQ ID NO: 1436303 - RNA, 16 nt, Homo sapiens
uaggcaauacauguau

SEQ ID NO: 1436304 - RNA, 15 nt, Homo sapiens
uaggcagggauuuga

SEQ ID NO: 1436305 - RNA, 20 nt, Homo sapiens
uagggcuggagggacaggga

SEQ ID NO: 1436306 - RNA, 16 nt, Homo sapiens
uaggggucaggcucca

SEQ ID NO: 1436307 - RNA, 17 nt, Homo sapiens
uaggguccuggcccucu

SEQ ID NO: 1436308 - RNA, 22 nt, Homo sapiens
uaggguuauuaguccaaaugug

SEQ ID NO: 1436309 - RNA, 20 nt, Homo sapiens
uagguacuucacauugcaaa

SEQ ID NO: 1436310 - RNA, 17 nt, Homo sapiens
uaggugucuguuuccca

SEQ ID NO: 1436311 - RNA, 19 nt, Homo sapiens
uaguaaagugauaauuucu

SEQ ID NO: 1436312 - RNA, 16 nt, Homo sapiens
uaguaauugauuugac

SEQ ID NO: 1436313 - RNA, 14 nt, Homo sapiens
uaguacaauucuua

SEQ ID NO: 1436314 - RNA, 13 nt, Homo sapiens
uagucacaaaaau

SEQ ID NO: 1436315 - RNA, 17 nt, Homo sapiens
uagugauuuccuguaua

SEQ ID NO: 1436316 - RNA, 16 nt, Homo sapiens
uagugcagaaucucau

SEQ ID NO: 1436317 - RNA, 18 nt, Homo sapiens
uaguucuaggguuucccu

SEQ ID NO: 1436318 - RNA, 15 nt, Homo sapiens
uaguucuugugcaug

SEQ ID NO: 1436319 - RNA, 13 nt, Homo sapiens
uaguuuauuucaa

SEQ ID NO: 1436320 - RNA, 23 nt, Homo sapiens
uaguuucuuucuguuauugcacu

SEQ ID NO: 1436321 - RNA, 19 nt, Homo sapiens
uaguuugaccucacaguga

SEQ ID NO: 1436322 - RNA, 21 nt, Homo sapiens
uauaaaagaauaaaauugcac

SEQ ID NO: 1436323 - RNA, 14 nt, Homo sapiens
uauaaaaucuagau

SEQ ID NO: 1436324 - RNA, 13 nt, Homo sapiens
uauaaacauuggu

SEQ ID NO: 1436325 - RNA, 18 nt, Homo sapiens
uauaaauguauauacaca

SEQ ID NO: 1436326 - RNA, 20 nt, Homo sapiens
uauaaauguauauacacaua

SEQ ID NO: 1436327 - RNA, 19 nt, Homo sapiens
uauaaauguuugucuggau

SEQ ID NO: 1436328 - RNA, 21 nt, Homo sapiens
uauaacaaacuacauguaauc

SEQ ID NO: 1436329 - RNA, 13 nt, Homo sapiens
uauaagacuacua

SEQ ID NO: 1436330 - RNA, 18 nt, Homo sapiens
uauaagaugucauccccu

SEQ ID NO: 1436331 - RNA, 12 nt, Homo sapiens
uauacacauaca

SEQ ID NO: 1436332 - RNA, 13 nt, Homo sapiens
uauacacauacau

SEQ ID NO: 1436333 - RNA, 12 nt, Homo sapiens
uauacacaugga

SEQ ID NO: 1436334 - RNA, 15 nt, Homo sapiens
uauacacauggaugc

SEQ ID NO: 1436335 - RNA, 11 nt, Homo sapiens
uauacauauca

SEQ ID NO: 1436336 - RNA, 22 nt, Homo sapiens
uauaccauaugucugcuucugu

SEQ ID NO: 1436337 - RNA, 17 nt, Homo sapiens
uauagcagauuguguaa

SEQ ID NO: 1436338 - RNA, 20 nt, Homo sapiens
uauaggaaacauaauuuuga

SEQ ID NO: 1436339 - RNA, 22 nt, Homo sapiens
uauaggaucauuuguuggaaug

SEQ ID NO: 1436340 - RNA, 15 nt, Homo sapiens
ggucagucacuugaa

SEQ ID NO: 1436341 - RNA, 22 nt, Homo sapiens
gguccagcuugcucuucagugg

SEQ ID NO: 1436342 - RNA, 23 nt, Homo sapiens
gguccuaacccccuuacugugcg

SEQ ID NO: 1436343 - RNA, 14 nt, Homo sapiens
gguccuucauucuu

SEQ ID NO: 1436344 - RNA, 21 nt, Homo sapiens
ggucucuggcccuucuugccu

SEQ ID NO: 1436345 - RNA, 12 nt, Homo sapiens
ggucuugcaagc

SEQ ID NO: 1436346 - RNA, 16 nt, Homo sapiens
ggugaaagauggaacu

SEQ ID NO: 1436347 - RNA, 16 nt, Homo sapiens
ggugacacacagcagc

SEQ ID NO: 1436348 - RNA, 20 nt, Homo sapiens
ggugcagucuuggcucacua

SEQ ID NO: 1436349 - RNA, 15 nt, Homo sapiens
ggugccucagagcag

SEQ ID NO: 1436350 - RNA, 12 nt, Homo sapiens
ggugcugagcuu

SEQ ID NO: 1436351 - RNA, 16 nt, Homo sapiens
gguggaucuguccaag

SEQ ID NO: 1436352 - RNA, 21 nt, Homo sapiens
gguggauuuuguggaggugag

SEQ ID NO: 1436353 - RNA, 18 nt, Homo sapiens
gguggcccccugugccag

SEQ ID NO: 1436354 - RNA, 15 nt, Homo sapiens
gguggcgggcaccug

SEQ ID NO: 1436355 - RNA, 16 nt, Homo sapiens
ggugggugacagucau

SEQ ID NO: 1436356 - RNA, 15 nt, Homo sapiens
ggugguagaaccacu

SEQ ID NO: 1436357 - RNA, 14 nt, Homo sapiens
gguguauuugccag

SEQ ID NO: 1436358 - RNA, 19 nt, Homo sapiens
gguguauuugccagcuuua

SEQ ID NO: 1436359 - RNA, 13 nt, Homo sapiens
gguguggccucag

SEQ ID NO: 1436360 - RNA, 16 nt, Homo sapiens
gguguggccugcacug

SEQ ID NO: 1436361 - RNA, 13 nt, Homo sapiens
gguuaacuuguau

SEQ ID NO: 1436362 - RNA, 22 nt, Homo sapiens
gguucccaauaaaagugacucu

SEQ ID NO: 1436363 - RNA, 21 nt, Homo sapiens
gguugaaacuguuaucacuua

SEQ ID NO: 1436364 - RNA, 18 nt, Homo sapiens
gguugaucacacucuggg

SEQ ID NO: 1436365 - RNA, 11 nt, Homo sapiens
gguugcaguga

SEQ ID NO: 1436366 - RNA, 15 nt, Homo sapiens
gguugccugggccac

SEQ ID NO: 1436367 - RNA, 22 nt, Homo sapiens
gguugcuguauuuguucaguga

SEQ ID NO: 1436368 - RNA, 22 nt, Homo sapiens
gguuuaagaacgaaggagaaaa

SEQ ID NO: 1436369 - RNA, 11 nt, Homo sapiens
gguuugcaguu

SEQ ID NO: 1436370 - RNA, 21 nt, Homo sapiens
gguuuugucucugcaucucau

SEQ ID NO: 1436371 - RNA, 16 nt, Homo sapiens
guaaaagugugagcag

SEQ ID NO: 1436372 - RNA, 21 nt, Homo sapiens
guaaaauagaauguuacuuug

SEQ ID NO: 1436373 - RNA, 18 nt, Homo sapiens
guaaaauaucuaccugcc

SEQ ID NO: 1436374 - RNA, 15 nt, Homo sapiens
guaaacuguaucaaa

SEQ ID NO: 1436375 - RNA, 15 nt, Homo sapiens
guaaauaugacuccu

SEQ ID NO: 1436376 - RNA, 16 nt, Homo sapiens
guaaaugccacaaaga

SEQ ID NO: 1436377 - RNA, 20 nt, Homo sapiens
guaacaaggugucuuuucca

SEQ ID NO: 1436378 - RNA, 16 nt, Homo sapiens
guaacauccuuucuau

SEQ ID NO: 1436379 - RNA, 20 nt, Homo sapiens
guaacccgcucaucacugga

SEQ ID NO: 1436380 - RNA, 19 nt, Homo sapiens
guaacgaaugguacuacaa

SEQ ID NO: 1436381 - RNA, 15 nt, Homo sapiens
guaacugucaaguca

SEQ ID NO: 1436382 - RNA, 17 nt, Homo sapiens
guaacuuuuacaaaaca

SEQ ID NO: 1436383 - RNA, 15 nt, Homo sapiens
guaagguaugggaga

SEQ ID NO: 1436384 - RNA, 22 nt, Homo sapiens
guaaggucuucuuguguccuga

SEQ ID NO: 1436385 - RNA, 22 nt, Homo sapiens
guaaguaccccugauaagcaaa

SEQ ID NO: 1436386 - RNA, 13 nt, Homo sapiens
guaauauaaugga

SEQ ID NO: 1436387 - RNA, 18 nt, Homo sapiens
guaaucccagcacuuugg

SEQ ID NO: 1436388 - RNA, 19 nt, Homo sapiens
guaaucccccuugccaaau

SEQ ID NO: 1436389 - RNA, 15 nt, Homo sapiens
guaaugucaccaccu

SEQ ID NO: 1436390 - RNA, 18 nt, Homo sapiens
guaauugcauuucugcuc

SEQ ID NO: 1436391 - RNA, 23 nt, Homo sapiens
guaauugcauuucugcucuucca

SEQ ID NO: 1436392 - RNA, 20 nt, Homo sapiens
guaauuuagcaguccaaaga

SEQ ID NO: 1436393 - RNA, 22 nt, Homo sapiens
guaauuuguggaggacuuugaa

SEQ ID NO: 1436394 - RNA, 14 nt, Homo sapiens
gucuccuugcacuu

SEQ ID NO: 1436395 - RNA, 23 nt, Homo sapiens
gucuccuuugcacugagggccac

SEQ ID NO: 1436396 - RNA, 15 nt, Homo sapiens
gucucgaacuccuga

SEQ ID NO: 1436397 - RNA, 14 nt, Homo sapiens
gucucuacuaaaaa

SEQ ID NO: 1436398 - RNA, 18 nt, Homo sapiens
gucucuaugaucuuggca

SEQ ID NO: 1436399 - RNA, 22 nt, Homo sapiens
gucucucccaccccggccucca

SEQ ID NO: 1436400 - RNA, 17 nt, Homo sapiens
gucucuccugaugcuca

SEQ ID NO: 1436401 - RNA, 18 nt, Homo sapiens
gucucucuaaacccaaau

SEQ ID NO: 1436402 - RNA, 15 nt, Homo sapiens
gucucugcaucucau

SEQ ID NO: 1436403 - RNA, 21 nt, Homo sapiens
gucucugccugcggcccagaa

SEQ ID NO: 1436404 - RNA, 21 nt, Homo sapiens
gucugaaagacagaaugucac

SEQ ID NO: 1436405 - RNA, 22 nt, Homo sapiens
gucugagcuucaguauaaaaga

SEQ ID NO: 1436406 - RNA, 19 nt, Homo sapiens
gucugauuggcucacccaa

SEQ ID NO: 1436407 - RNA, 21 nt, Homo sapiens
gucugauuggcucacccaagc

SEQ ID NO: 1436408 - RNA, 15 nt, Homo sapiens
gucuggcuaugcuca

SEQ ID NO: 1436409 - RNA, 19 nt, Homo sapiens
gucuggcugaggauuucaa

SEQ ID NO: 1436410 - RNA, 12 nt, Homo sapiens
gucugucccaaa

SEQ ID NO: 1436411 - RNA, 14 nt, Homo sapiens
gucugucccaaaga

SEQ ID NO: 1436412 - RNA, 20 nt, Homo sapiens
gucuuaagccuuuugcucac

SEQ ID NO: 1436413 - RNA, 20 nt, Homo sapiens
gucuuagccucccaaagugc

SEQ ID NO: 1436414 - RNA, 16 nt, Homo sapiens
gucuucuuacuuggaa

SEQ ID NO: 1436415 - RNA, 15 nt, Homo sapiens
gucuuggccugccuc

SEQ ID NO: 1436416 - RNA, 19 nt, Homo sapiens
gucuugggucgcccuaccc

SEQ ID NO: 1436417 - RNA, 16 nt, Homo sapiens
gucuugucuccauuug

SEQ ID NO: 1436418 - RNA, 16 nt, Homo sapiens
gucuuuaucagugaug

SEQ ID NO: 1436419 - RNA, 21 nt, Homo sapiens
gucuuuguaaugucaccaccu

SEQ ID NO: 1436420 - RNA, 13 nt, Homo sapiens
gugaaacaaaaaa

SEQ ID NO: 1436421 - RNA, 12 nt, Homo sapiens
gugaaaccacua

SEQ ID NO: 1436422 - RNA, 19 nt, Homo sapiens
gugaaacuggggcuugcaa

SEQ ID NO: 1436423 - RNA, 19 nt, Homo sapiens
gugaaagaaaauucuugga

SEQ ID NO: 1436424 - RNA, 21 nt, Homo sapiens
gugaaaggaagcuccacuguc

SEQ ID NO: 1436425 - RNA, 13 nt, Homo sapiens
ggcgcagugcuuc

SEQ ID NO: 1436426 - RNA, 13 nt, Homo sapiens
ggcgcaugugcca

SEQ ID NO: 1436427 - RNA, 23 nt, Homo sapiens
ggcguagacuugacaacauccca

SEQ ID NO: 1436428 - RNA, 13 nt, Homo sapiens
ggcuacucugugc

SEQ ID NO: 1436429 - RNA, 21 nt, Homo sapiens
ggcuagacacccauuuucaca

SEQ ID NO: 1436430 - RNA, 16 nt, Homo sapiens
ggcuaucugcauuuau

SEQ ID NO: 1436431 - RNA, 23 nt, Homo sapiens
ggcuccacauccaccccacugga

SEQ ID NO: 1436432 - RNA, 18 nt, Homo sapiens
ggcuccugugcuacuuug

SEQ ID NO: 1436433 - RNA, 21 nt, Homo sapiens
ggcucugcaaugggcacuggg

SEQ ID NO: 1436434 - RNA, 21 nt, Homo sapiens
ggcugacaccuaccaugcugc

SEQ ID NO: 1436435 - RNA, 23 nt, Homo sapiens
ggcugacaccuaccaugcugcuu

SEQ ID NO: 1436436 - RNA, 14 nt, Homo sapiens
ggcugagcucuuau

SEQ ID NO: 1436437 - RNA, 15 nt, Homo sapiens
ggcugaggauuucaa

SEQ ID NO: 1436438 - RNA, 18 nt, Homo sapiens
ggcugcucggggugcaca

SEQ ID NO: 1436439 - RNA, 17 nt, Homo sapiens
ggcuggaaucuggagag

SEQ ID NO: 1436440 - RNA, 15 nt, Homo sapiens
ggcugguuaauucca

SEQ ID NO: 1436441 - RNA, 16 nt, Homo sapiens
ggcuguaggugguguu

SEQ ID NO: 1436442 - RNA, 15 nt, Homo sapiens
ggcugucuuccccca

SEQ ID NO: 1436443 - RNA, 10 nt, Homo sapiens
ggcugugagg

SEQ ID NO: 1436444 - RNA, 16 nt, Homo sapiens
ggcuguuauucuucca

SEQ ID NO: 1436445 - RNA, 19 nt, Homo sapiens
ggcuuccagagaguccucu

SEQ ID NO: 1436446 - RNA, 22 nt, Homo sapiens
ggcuucggacagugcccaugca

SEQ ID NO: 1436447 - RNA, 18 nt, Homo sapiens
gggaaaagcaguggggac

SEQ ID NO: 1436448 - RNA, 16 nt, Homo sapiens
gggaaagagauccagg

SEQ ID NO: 1436449 - RNA, 15 nt, Homo sapiens
gggaaaggaggcaug

SEQ ID NO: 1436450 - RNA, 17 nt, Homo sapiens
gggaacaagcauucucc

SEQ ID NO: 1436451 - RNA, 22 nt, Homo sapiens
gggaacauguaccacugagccu

SEQ ID NO: 1436452 - RNA, 13 nt, Homo sapiens
gggaacucuccaa

SEQ ID NO: 1436453 - RNA, 21 nt, Homo sapiens
gggaagacaacuaggauacuu

SEQ ID NO: 1436454 - RNA, 14 nt, Homo sapiens
gggaagagggcagu

SEQ ID NO: 1436455 - RNA, 22 nt, Homo sapiens
gggaagauacugacuagucaua

SEQ ID NO: 1436456 - RNA, 21 nt, Homo sapiens
gggaagccuccgucaggagag

SEQ ID NO: 1436457 - RNA, 13 nt, Homo sapiens
gggacaaccccau

SEQ ID NO: 1436458 - RNA, 15 nt, Homo sapiens
gggacacaggggcaa

SEQ ID NO: 1436459 - RNA, 18 nt, Homo sapiens
gggacagggucuugcaag

SEQ ID NO: 1436460 - RNA, 16 nt, Homo sapiens
gggaccacaccucccu

SEQ ID NO: 1436461 - RNA, 15 nt, Homo sapiens
gggaggugggguaca

SEQ ID NO: 1436462 - RNA, 13 nt, Homo sapiens
gggaguggcagaa

SEQ ID NO: 1436463 - RNA, 20 nt, Homo sapiens
gggauaauagacacaucaaa

SEQ ID NO: 1436464 - RNA, 16 nt, Homo sapiens
gggaucuugcauuccc

SEQ ID NO: 1436465 - RNA, 19 nt, Homo sapiens
gggaugagaaugaaagcuu

SEQ ID NO: 1436466 - RNA, 18 nt, Homo sapiens
gggcaaagaaaagccaga

SEQ ID NO: 1436467 - RNA, 14 nt, Homo sapiens
gggcacugcagggg

SEQ ID NO: 1436468 - RNA, 13 nt, Homo sapiens
gggcacugguggc

SEQ ID NO: 1436469 - RNA, 13 nt, Homo sapiens
gggccacugccag

SEQ ID NO: 1436470 - RNA, 23 nt, Homo sapiens
gggcccacaauggagugggagau

SEQ ID NO: 1436471 - RNA, 23 nt, Homo sapiens
gggccgaguaccuuaaucugcca

SEQ ID NO: 1436472 - RNA, 14 nt, Homo sapiens
gggccuacacccgu

SEQ ID NO: 1436473 - RNA, 12 nt, Homo sapiens
gggccucugaaa

SEQ ID NO: 1436474 - RNA, 17 nt, Homo sapiens
gggccugauggugcuca

SEQ ID NO: 1436475 - RNA, 15 nt, Homo sapiens
gggccugcugcugag

SEQ ID NO: 1436476 - RNA, 21 nt, Homo sapiens
gggcugaccugccucucacac

SEQ ID NO: 1436477 - RNA, 15 nt, Homo sapiens
gggcugcccuggugc

SEQ ID NO: 1436478 - RNA, 11 nt, Homo sapiens
gggcuguagac

SEQ ID NO: 1436479 - RNA, 23 nt, Homo sapiens
gccuuuggggacggccacucugu

SEQ ID NO: 1436480 - RNA, 23 nt, Homo sapiens
gcgaccgccgcagggacggggac

SEQ ID NO: 1436481 - RNA, 14 nt, Homo sapiens
gcgcacacacagau

SEQ ID NO: 1436482 - RNA, 13 nt, Homo sapiens
gcgccagggccaa

SEQ ID NO: 1436483 - RNA, 15 nt, Homo sapiens
gcgcuggcucaggaa

SEQ ID NO: 1436484 - RNA, 13 nt, Homo sapiens
gcggaaccauagc

SEQ ID NO: 1436485 - RNA, 15 nt, Homo sapiens
gcggaaccauagcug

SEQ ID NO: 1436486 - RNA, 16 nt, Homo sapiens
gcggagcuugcaguga

SEQ ID NO: 1436487 - RNA, 23 nt, Homo sapiens
gcgggagugggggcugugccgug

SEQ ID NO: 1436488 - RNA, 20 nt, Homo sapiens
gcggucauucuacacugagg

SEQ ID NO: 1436489 - RNA, 13 nt, Homo sapiens
gcguggaccaccc

SEQ ID NO: 1436490 - RNA, 19 nt, Homo sapiens
gcgugugacagucuugcau

SEQ ID NO: 1436491 - RNA, 13 nt, Homo sapiens
gcuaaauacugua

SEQ ID NO: 1436492 - RNA, 15 nt, Homo sapiens
gcuaauagcugcuag

SEQ ID NO: 1436493 - RNA, 20 nt, Homo sapiens
gcuaaucauuaagguauuau

SEQ ID NO: 1436494 - RNA, 17 nt, Homo sapiens
gcuacauuccucagcug

SEQ ID NO: 1436495 - RNA, 12 nt, Homo sapiens
gcuacuaccugg

SEQ ID NO: 1436496 - RNA, 11 nt, Homo sapiens
gcuagaaccua

SEQ ID NO: 1436497 - RNA, 13 nt, Homo sapiens
gcuagaaccugga

SEQ ID NO: 1436498 - RNA, 13 nt, Homo sapiens
gcuagaaggccac

SEQ ID NO: 1436499 - RNA, 21 nt, Homo sapiens
gcuagaaggccacaugucacc

SEQ ID NO: 1436500 - RNA, 15 nt, Homo sapiens
gcuagagugcagugg

SEQ ID NO: 1436501 - RNA, 13 nt, Homo sapiens
gcuaggagcaaag

SEQ ID NO: 1436502 - RNA, 18 nt, Homo sapiens
gcuaggagcaaagccugu

SEQ ID NO: 1436503 - RNA, 14 nt, Homo sapiens
gcuagggagugguc

SEQ ID NO: 1436504 - RNA, 15 nt, Homo sapiens
gcuagggaguggucu

SEQ ID NO: 1436505 - RNA, 13 nt, Homo sapiens
gcuauaggugcua

SEQ ID NO: 1436506 - RNA, 11 nt, Homo sapiens
gcuaucucugu

SEQ ID NO: 1436507 - RNA, 17 nt, Homo sapiens
gcuauuugagcaugcac

SEQ ID NO: 1436508 - RNA, 19 nt, Homo sapiens
gcucacaaaccaugcaaau

SEQ ID NO: 1436509 - RNA, 16 nt, Homo sapiens
gcucacacccuaauaa

SEQ ID NO: 1436510 - RNA, 21 nt, Homo sapiens
gcucacccaagcaaggccaaa

SEQ ID NO: 1436511 - RNA, 16 nt, Homo sapiens
gcucacucggcuucca

SEQ ID NO: 1436512 - RNA, 14 nt, Homo sapiens
gcucaggcauuuga

SEQ ID NO: 1436513 - RNA, 13 nt, Homo sapiens
gcucaggugcaag

SEQ ID NO: 1436514 - RNA, 19 nt, Homo sapiens
gcucauccaggguguuaca

SEQ ID NO: 1436515 - RNA, 22 nt, Homo sapiens
gcucccgagcuacucucuugcc

SEQ ID NO: 1436516 - RNA, 12 nt, Homo sapiens
gcucccuaacac

SEQ ID NO: 1436517 - RNA, 18 nt, Homo sapiens
gcuccuaguuugaccuca

SEQ ID NO: 1436518 - RNA, 15 nt, Homo sapiens
gcuccugugcuacuu

SEQ ID NO: 1436519 - RNA, 23 nt, Homo sapiens
gcucucaccgggcuacuaccugg

SEQ ID NO: 1436520 - RNA, 19 nt, Homo sapiens
gcucucagaagguauuccu

SEQ ID NO: 1436521 - RNA, 13 nt, Homo sapiens
gcucugagugcua

SEQ ID NO: 1436522 - RNA, 14 nt, Homo sapiens
gcucugcaggcacc

SEQ ID NO: 1436523 - RNA, 14 nt, Homo sapiens
gcucugcaugugug

SEQ ID NO: 1436524 - RNA, 23 nt, Homo sapiens
gcucuggauaacaagacuuugac

SEQ ID NO: 1436525 - RNA, 22 nt, Homo sapiens
gcucuggcaccacuaggguccu

SEQ ID NO: 1436526 - RNA, 23 nt, Homo sapiens
gcucuggcuguuugucuauaugu

SEQ ID NO: 1436527 - RNA, 18 nt, Homo sapiens
gcucuuccuuacucccag

SEQ ID NO: 1436528 - RNA, 19 nt, Homo sapiens
gcucuucuaccauuugaau

SEQ ID NO: 1436529 - RNA, 23 nt, Homo sapiens
gcucuuucagagaggucucaggu

SEQ ID NO: 1436530 - RNA, 12 nt, Homo sapiens
gcugaacacugg

SEQ ID NO: 1436531 - RNA, 19 nt, Homo sapiens
gaagccuggacucuaagcu

SEQ ID NO: 1436532 - RNA, 19 nt, Homo sapiens
gaagcggagcuugcaguga

SEQ ID NO: 1436533 - RNA, 22 nt, Homo sapiens
gaagcuauugauguuuccagaa

SEQ ID NO: 1436534 - RNA, 13 nt, Homo sapiens
gaagcucacccaa

SEQ ID NO: 1436535 - RNA, 17 nt, Homo sapiens
gaagcucacccaauaaa

SEQ ID NO: 1436536 - RNA, 14 nt, Homo sapiens
gaagcuccacuguc

SEQ ID NO: 1436537 - RNA, 22 nt, Homo sapiens
gaagcuguguccuugcaccugc

SEQ ID NO: 1436538 - RNA, 20 nt, Homo sapiens
gaaggaacucuggcuuccag

SEQ ID NO: 1436539 - RNA, 17 nt, Homo sapiens
gaaggaagaagccagac

SEQ ID NO: 1436540 - RNA, 18 nt, Homo sapiens
gaaggaauagccagagag

SEQ ID NO: 1436541 - RNA, 23 nt, Homo sapiens
gaaggagccacgugaauggcccu

SEQ ID NO: 1436542 - RNA, 16 nt, Homo sapiens
gaaggauuuacugcaa

SEQ ID NO: 1436543 - RNA, 20 nt, Homo sapiens
gaaggcaaagccccuggaaa

SEQ ID NO: 1436544 - RNA, 17 nt, Homo sapiens
gaaggcccacuguccag

SEQ ID NO: 1436545 - RNA, 13 nt, Homo sapiens
gaaggcgugcaag

SEQ ID NO: 1436546 - RNA, 19 nt, Homo sapiens
gaagggcuagaaccuggag

SEQ ID NO: 1436547 - RNA, 22 nt, Homo sapiens
gaaggggcaaagaaaagccaga

SEQ ID NO: 1436548 - RNA, 13 nt, Homo sapiens
gaagguugcucua

SEQ ID NO: 1436549 - RNA, 17 nt, Homo sapiens
gaagguuggaccuucau

SEQ ID NO: 1436550 - RNA, 16 nt, Homo sapiens
gaaguaaaagcuaauu

SEQ ID NO: 1436551 - RNA, 13 nt, Homo sapiens
gaaguaaccuuau

SEQ ID NO: 1436552 - RNA, 16 nt, Homo sapiens
gaagucacugcacagu

SEQ ID NO: 1436553 - RNA, 15 nt, Homo sapiens
gaagucguuucagga

SEQ ID NO: 1436554 - RNA, 15 nt, Homo sapiens
gaagucuacuuuguc

SEQ ID NO: 1436555 - RNA, 17 nt, Homo sapiens
gaaguuaacuacagugu

SEQ ID NO: 1436556 - RNA, 21 nt, Homo sapiens
gaaguuagggaugacugugau

SEQ ID NO: 1436557 - RNA, 16 nt, Homo sapiens
gaaguuuaaaaaacca

SEQ ID NO: 1436558 - RNA, 22 nt, Homo sapiens
gaaguuuugaguuucucuccac

SEQ ID NO: 1436559 - RNA, 15 nt, Homo sapiens
gaauaaaauugcacu

SEQ ID NO: 1436560 - RNA, 14 nt, Homo sapiens
gaauaaagcccuug

SEQ ID NO: 1436561 - RNA, 17 nt, Homo sapiens
gaauaaagcccuugaac

SEQ ID NO: 1436562 - RNA, 19 nt, Homo sapiens
gaauaaagcccuugaacca

SEQ ID NO: 1436563 - RNA, 21 nt, Homo sapiens
gaauaaagcccuugaaccagc

SEQ ID NO: 1436564 - RNA, 14 nt, Homo sapiens
gaauaaaugaaucu

SEQ ID NO: 1436565 - RNA, 17 nt, Homo sapiens
gaauaagaaaacaauca

SEQ ID NO: 1436566 - RNA, 16 nt, Homo sapiens
gaauaauggaaucuau

SEQ ID NO: 1436567 - RNA, 12 nt, Homo sapiens
gaauacuuggaa

SEQ ID NO: 1436568 - RNA, 20 nt, Homo sapiens
gaauagauggguuauuucaa

SEQ ID NO: 1436569 - RNA, 20 nt, Homo sapiens
gaauauauuauaaucuucca

SEQ ID NO: 1436570 - RNA, 22 nt, Homo sapiens
gaaucaaagcaguuaacuuuaa

SEQ ID NO: 1436571 - RNA, 18 nt, Homo sapiens
gaaucauuaauacaaaga

SEQ ID NO: 1436572 - RNA, 14 nt, Homo sapiens
gaauccuacagccu

SEQ ID NO: 1436573 - RNA, 17 nt, Homo sapiens
gaaucgccccagacucc

SEQ ID NO: 1436574 - RNA, 17 nt, Homo sapiens
gaaucgcuuaaaccugg

SEQ ID NO: 1436575 - RNA, 19 nt, Homo sapiens
cuguauauacaauaacaua

SEQ ID NO: 1436576 - RNA, 12 nt, Homo sapiens
cugucaccuugc

SEQ ID NO: 1436577 - RNA, 15 nt, Homo sapiens
cugucaccuugcuca

SEQ ID NO: 1436578 - RNA, 15 nt, Homo sapiens
cugucagcucaggug

SEQ ID NO: 1436579 - RNA, 15 nt, Homo sapiens
cugucaggacaccag

SEQ ID NO: 1436580 - RNA, 19 nt, Homo sapiens
cugucauggaaaagcccag

SEQ ID NO: 1436581 - RNA, 19 nt, Homo sapiens
cugucaugguguccagaca

SEQ ID NO: 1436582 - RNA, 21 nt, Homo sapiens
cuguccaggccacuguggcca

SEQ ID NO: 1436583 - RNA, 23 nt, Homo sapiens
cugucccccugagaucagagucc

SEQ ID NO: 1436584 - RNA, 13 nt, Homo sapiens
cuguccccugaaa

SEQ ID NO: 1436585 - RNA, 21 nt, Homo sapiens
cuguccccugaaaaacugauc

SEQ ID NO: 1436586 - RNA, 23 nt, Homo sapiens
cugucccucaaaugacccaaaga

SEQ ID NO: 1436587 - RNA, 16 nt, Homo sapiens
cugucucaacuacuca

SEQ ID NO: 1436588 - RNA, 17 nt, Homo sapiens
cugucuccuuucucagc

SEQ ID NO: 1436589 - RNA, 17 nt, Homo sapiens
cugucugucaccagcua

SEQ ID NO: 1436590 - RNA, 14 nt, Homo sapiens
cugucugucugucu

SEQ ID NO: 1436591 - RNA, 16 nt, Homo sapiens
cugucuuccacuguac

SEQ ID NO: 1436592 - RNA, 14 nt, Homo sapiens
cugucuuuguggga

SEQ ID NO: 1436593 - RNA, 21 nt, Homo sapiens
cugugaauaaaaacccuguau

SEQ ID NO: 1436594 - RNA, 19 nt, Homo sapiens
cugugaccugcugagcucu

SEQ ID NO: 1436595 - RNA, 18 nt, Homo sapiens
cugugaggccccuggaca

SEQ ID NO: 1436596 - RNA, 12 nt, Homo sapiens
cugugaucccag

SEQ ID NO: 1436597 - RNA, 18 nt, Homo sapiens
cugugcaaauccuugaua

SEQ ID NO: 1436598 - RNA, 17 nt, Homo sapiens
cugugccucugccuguc

SEQ ID NO: 1436599 - RNA, 16 nt, Homo sapiens
cugugcuuugacucac

SEQ ID NO: 1436600 - RNA, 22 nt, Homo sapiens
cuguggagaaauaaaaauaccu

SEQ ID NO: 1436601 - RNA, 16 nt, Homo sapiens
cuguggcggugccugg

SEQ ID NO: 1436602 - RNA, 15 nt, Homo sapiens
cugugggcccaguca

SEQ ID NO: 1436603 - RNA, 14 nt, Homo sapiens
cuguggucauguaa

SEQ ID NO: 1436604 - RNA, 16 nt, Homo sapiens
cuguggugauguugcc

SEQ ID NO: 1436605 - RNA, 15 nt, Homo sapiens
cuguguagcugugac

SEQ ID NO: 1436606 - RNA, 20 nt, Homo sapiens
cuguguccaauuaugcacug

SEQ ID NO: 1436607 - RNA, 19 nt, Homo sapiens
cuguguccuugcaccugca

SEQ ID NO: 1436608 - RNA, 19 nt, Homo sapiens
cugugugaugaacuuucuc

SEQ ID NO: 1436609 - RNA, 21 nt, Homo sapiens
cuguguucucaccgugaucaa

SEQ ID NO: 1436610 - RNA, 15 nt, Homo sapiens
cuguuaucugcuaga

SEQ ID NO: 1436611 - RNA, 13 nt, Homo sapiens
cuguucacagcca

SEQ ID NO: 1436612 - RNA, 16 nt, Homo sapiens
cuguucugcacugaaa

SEQ ID NO: 1436613 - RNA, 14 nt, Homo sapiens
cuguugagugcaac

SEQ ID NO: 1436614 - RNA, 22 nt, Homo sapiens
cuguugaguuggacacacugua

SEQ ID NO: 1436615 - RNA, 18 nt, Homo sapiens
cuguugaucccacuucac

SEQ ID NO: 1436616 - RNA, 15 nt, Homo sapiens
cuguugcacugaugu

SEQ ID NO: 1436617 - RNA, 14 nt, Homo sapiens
cuguuggucugucc

SEQ ID NO: 1436618 - RNA, 15 nt, Homo sapiens
cuguuucaaacugag

SEQ ID NO: 1436619 - RNA, 15 nt, Homo sapiens
cuugauaugaccugu

SEQ ID NO: 1436620 - RNA, 13 nt, Homo sapiens
cuugaucuguaua

SEQ ID NO: 1436621 - RNA, 18 nt, Homo sapiens
cuugaucuguauauacaa

SEQ ID NO: 1436622 - RNA, 15 nt, Homo sapiens
cuugaugcaugcaca

SEQ ID NO: 1436623 - RNA, 20 nt, Homo sapiens
cuugauugagugcuccugug

SEQ ID NO: 1436624 - RNA, 15 nt, Homo sapiens
cuugcacauauuuga

SEQ ID NO: 1436625 - RNA, 13 nt, Homo sapiens
cuugcauucauuu

SEQ ID NO: 1436626 - RNA, 13 nt, Homo sapiens
cuugccagcauuu

SEQ ID NO: 1436627 - RNA, 20 nt, Homo sapiens
cuugcccagagaugccucca

SEQ ID NO: 1436628 - RNA, 23 nt, Homo sapiens
cuugcccgccagccucagugcca

SEQ ID NO: 1436629 - RNA, 15 nt, Homo sapiens
cuugccuaggccaaa

SEQ ID NO: 1436630 - RNA, 16 nt, Homo sapiens
cuugccucucucagga

SEQ ID NO: 1436631 - RNA, 16 nt, Homo sapiens
cuugccuguuuuucaa

SEQ ID NO: 1436632 - RNA, 21 nt, Homo sapiens
cuugcuagacagccagguuag

SEQ ID NO: 1436633 - RNA, 22 nt, Homo sapiens
cuugcuauuugagcaugcacag

SEQ ID NO: 1436634 - RNA, 11 nt, Homo sapiens
cuugcucugca

SEQ ID NO: 1436635 - RNA, 19 nt, Homo sapiens
cuugcugaauuucaggcau

SEQ ID NO: 1436636 - RNA, 19 nt, Homo sapiens
cuuggaaaaaaauuacaaa

SEQ ID NO: 1436637 - RNA, 20 nt, Homo sapiens
cuuggaagucguuucaggac

SEQ ID NO: 1436638 - RNA, 22 nt, Homo sapiens
cuuggaaguguguggaaggcag

SEQ ID NO: 1436639 - RNA, 18 nt, Homo sapiens
cuuggaaugaauucucuc

SEQ ID NO: 1436640 - RNA, 16 nt, Homo sapiens
cuuggcaguauuccau

SEQ ID NO: 1436641 - RNA, 22 nt, Homo sapiens
cuuggccucccaaagugcuagu

SEQ ID NO: 1436642 - RNA, 21 nt, Homo sapiens
cuuggggggugaugagggcag

SEQ ID NO: 1436643 - RNA, 17 nt, Homo sapiens
cuugggguaagccagag

SEQ ID NO: 1436644 - RNA, 13 nt, Homo sapiens
cuuguaucuguag

SEQ ID NO: 1436645 - RNA, 17 nt, Homo sapiens
cuugucaugugacaggu

SEQ ID NO: 1436646 - RNA, 15 nt, Homo sapiens
cuuguccuaugucaa

SEQ ID NO: 1436647 - RNA, 14 nt, Homo sapiens
cuugucuccauuug

SEQ ID NO: 1436648 - RNA, 16 nt, Homo sapiens
cuugugaccauuguaa

SEQ ID NO: 1436649 - RNA, 18 nt, Homo sapiens
cuuguguccccaccucag

SEQ ID NO: 1436650 - RNA, 18 nt, Homo sapiens
cuuguuguuuuuaagucc

SEQ ID NO: 1436651 - RNA, 20 nt, Homo sapiens
cuuuaaagggauggcaagau

SEQ ID NO: 1436652 - RNA, 17 nt, Homo sapiens
cuuuaaaguaccuguag

SEQ ID NO: 1436653 - RNA, 15 nt, Homo sapiens
cuuuaaauccuucca

SEQ ID NO: 1436654 - RNA, 18 nt, Homo sapiens
cuuuaaccucaucuacaa

SEQ ID NO: 1436655 - RNA, 14 nt, Homo sapiens
cuuuaacugacuua

SEQ ID NO: 1436656 - RNA, 14 nt, Homo sapiens
cuuuaaguuuagaa

SEQ ID NO: 1436657 - RNA, 12 nt, Homo sapiens
cuuuaaugggag

SEQ ID NO: 1436658 - RNA, 13 nt, Homo sapiens
cuuuagaaugaga

SEQ ID NO: 1436659 - RNA, 12 nt, Homo sapiens
cuuuaucaaaga

SEQ ID NO: 1436660 - RNA, 18 nt, Homo sapiens
cuuuaucaagaagucuga

SEQ ID NO: 1436661 - RNA, 16 nt, Homo sapiens
caugggccuagcauag

SEQ ID NO: 1436662 - RNA, 19 nt, Homo sapiens
cauggucccacaucccugg

SEQ ID NO: 1436663 - RNA, 15 nt, Homo sapiens
caugguuaccgagga

SEQ ID NO: 1436664 - RNA, 16 nt, Homo sapiens
caugguuuugaaaugc

SEQ ID NO: 1436665 - RNA, 17 nt, Homo sapiens
cauguaauaaaucugag

SEQ ID NO: 1436666 - RNA, 14 nt, Homo sapiens
cauguaccacugag

SEQ ID NO: 1436667 - RNA, 23 nt, Homo sapiens
cauguagauuuuaguucacuaaa

SEQ ID NO: 1436668 - RNA, 22 nt, Homo sapiens
cauguaucuaccucacuauuca

SEQ ID NO: 1436669 - RNA, 18 nt, Homo sapiens
caugugacuuuuaucugu

SEQ ID NO: 1436670 - RNA, 12 nt, Homo sapiens
caugugccaguu

SEQ ID NO: 1436671 - RNA, 20 nt, Homo sapiens
cauguggaguggacauucaa

SEQ ID NO: 1436672 - RNA, 18 nt, Homo sapiens
cauguggcguauugggcc

SEQ ID NO: 1436673 - RNA, 16 nt, Homo sapiens
cauguguguauauaug

SEQ ID NO: 1436674 - RNA, 14 nt, Homo sapiens
cauguuccucaaaa

SEQ ID NO: 1436675 - RNA, 19 nt, Homo sapiens
cauguugaagccacugccu

SEQ ID NO: 1436676 - RNA, 18 nt, Homo sapiens
cauguuuagauuccagga

SEQ ID NO: 1436677 - RNA, 18 nt, Homo sapiens
cauguuuuguauguuaaa

SEQ ID NO: 1436678 - RNA, 15 nt, Homo sapiens
cauuaaaagcuauca

SEQ ID NO: 1436679 - RNA, 20 nt, Homo sapiens
cauuaaauaccuauaugaau

SEQ ID NO: 1436680 - RNA, 14 nt, Homo sapiens
cauuaauacaaaga

SEQ ID NO: 1436681 - RNA, 19 nt, Homo sapiens
cauuagaacacugcauuag

SEQ ID NO: 1436682 - RNA, 16 nt, Homo sapiens
cauuagucacuuugaa

SEQ ID NO: 1436683 - RNA, 14 nt, Homo sapiens
cauuaguuuugcau

SEQ ID NO: 1436684 - RNA, 18 nt, Homo sapiens
cauuauaacugaaggaga

SEQ ID NO: 1436685 - RNA, 22 nt, Homo sapiens
cauuaucucaaaacugcacugu

SEQ ID NO: 1436686 - RNA, 17 nt, Homo sapiens
cauuauguaauguccuu

SEQ ID NO: 1436687 - RNA, 17 nt, Homo sapiens
cauuauuucaaccgcuu

SEQ ID NO: 1436688 - RNA, 23 nt, Homo sapiens
cauuauuucaaccgcuugccaua

SEQ ID NO: 1436689 - RNA, 17 nt, Homo sapiens
cauucacagccaggaga

SEQ ID NO: 1436690 - RNA, 18 nt, Homo sapiens
cauucagguauagcugac

SEQ ID NO: 1436691 - RNA, 15 nt, Homo sapiens
cauucagugagacac

SEQ ID NO: 1436692 - RNA, 19 nt, Homo sapiens
cauucauuuauucauucau

SEQ ID NO: 1436693 - RNA, 15 nt, Homo sapiens
cauucccaucuguca

SEQ ID NO: 1436694 - RNA, 13 nt, Homo sapiens
cauucccccaugu

SEQ ID NO: 1436695 - RNA, 11 nt, Homo sapiens
cauucccugag

SEQ ID NO: 1436696 - RNA, 21 nt, Homo sapiens
cauucccugagucaccaggaa

SEQ ID NO: 1436697 - RNA, 12 nt, Homo sapiens
cugaccaagaga

SEQ ID NO: 1436698 - RNA, 23 nt, Homo sapiens
cugacccaagagguggggaccaa

SEQ ID NO: 1436699 - RNA, 14 nt, Homo sapiens
cugaccccaaagag

SEQ ID NO: 1436700 - RNA, 15 nt, Homo sapiens
cugaccgaguaccug

SEQ ID NO: 1436701 - RNA, 19 nt, Homo sapiens
cugaccucaggugauccac

SEQ ID NO: 1436702 - RNA, 15 nt, Homo sapiens
cugaccuugugaucu

SEQ ID NO: 1436703 - RNA, 23 nt, Homo sapiens
cugacugggaccaggcaccaggc

SEQ ID NO: 1436704 - RNA, 13 nt, Homo sapiens
cugagaaacuucc

SEQ ID NO: 1436705 - RNA, 18 nt, Homo sapiens
cugagacaugacuaggaa

SEQ ID NO: 1436706 - RNA, 23 nt, Homo sapiens
cugagaccaguugggagcacugg

SEQ ID NO: 1436707 - RNA, 19 nt, Homo sapiens
cugagacuauuuuaacugg

SEQ ID NO: 1436708 - RNA, 18 nt, Homo sapiens
cugagacuuucagugcac

SEQ ID NO: 1436709 - RNA, 16 nt, Homo sapiens
cugagagacccaagga

SEQ ID NO: 1436710 - RNA, 20 nt, Homo sapiens
cugagaguuggcucaggcag

SEQ ID NO: 1436711 - RNA, 11 nt, Homo sapiens
cugagaucucc

SEQ ID NO: 1436712 - RNA, 13 nt, Homo sapiens
cugagaucucccu

SEQ ID NO: 1436713 - RNA, 15 nt, Homo sapiens
cugagcauaaugcuc

SEQ ID NO: 1436714 - RNA, 19 nt, Homo sapiens
cugagccaaacacacugua

SEQ ID NO: 1436715 - RNA, 21 nt, Homo sapiens
cugagccacucgcagucgcag

SEQ ID NO: 1436716 - RNA, 17 nt, Homo sapiens
cugagcuccugucccag

SEQ ID NO: 1436717 - RNA, 20 nt, Homo sapiens
cugagcugaacccauuuuga

SEQ ID NO: 1436718 - RNA, 22 nt, Homo sapiens
cugaggaagcacagcagcaucu

SEQ ID NO: 1436719 - RNA, 13 nt, Homo sapiens
cugaggaccagcc

SEQ ID NO: 1436720 - RNA, 20 nt, Homo sapiens
cugaggagucugagguccug

SEQ ID NO: 1436721 - RNA, 17 nt, Homo sapiens
cugaggcaaauggcaca

SEQ ID NO: 1436722 - RNA, 15 nt, Homo sapiens
cugagggcauuaaaa

SEQ ID NO: 1436723 - RNA, 21 nt, Homo sapiens
cugagucaggacuugaaccca

SEQ ID NO: 1436724 - RNA, 22 nt, Homo sapiens
cugagucaggacuugaacccag

SEQ ID NO: 1436725 - RNA, 18 nt, Homo sapiens
cugaguccaacaauguug

SEQ ID NO: 1436726 - RNA, 14 nt, Homo sapiens
cugaguggaucucc

SEQ ID NO: 1436727 - RNA, 19 nt, Homo sapiens
cugaguuauuuugcuaaac

SEQ ID NO: 1436728 - RNA, 21 nt, Homo sapiens
cugauaaacauuaaacacugu

SEQ ID NO: 1436729 - RNA, 22 nt, Homo sapiens
cugauaaacauuaaacacugua

SEQ ID NO: 1436730 - RNA, 22 nt, Homo sapiens
cugauauaacaaacuacaugua

SEQ ID NO: 1436731 - RNA, 19 nt, Homo sapiens
cugauaugggacugagccu

SEQ ID NO: 1436732 - RNA, 18 nt, Homo sapiens
cugaucauggucagcuca

SEQ ID NO: 1436733 - RNA, 18 nt, Homo sapiens
cugaugagaaaggccuga

SEQ ID NO: 1436734 - RNA, 21 nt, Homo sapiens
cugauggaccgggugggccug

SEQ ID NO: 1436735 - RNA, 21 nt, Homo sapiens
cugauguaguuaaguauuuac

SEQ ID NO: 1436736 - RNA, 22 nt, Homo sapiens
cugauucagccuggccaucccc

SEQ ID NO: 1436737 - RNA, 23 nt, Homo sapiens
cugauuuugucacugucuucaca

SEQ ID NO: 1436738 - RNA, 15 nt, Homo sapiens
cugcaagauuucaca

SEQ ID NO: 1436739 - RNA, 20 nt, Homo sapiens
cugcaauacuaauugagaaa

SEQ ID NO: 1436740 - RNA, 18 nt, Homo sapiens
cugcaaugggcacuggga

SEQ ID NO: 1436741 - RNA, 17 nt, Homo sapiens
aaugacccaaagaccaa

SEQ ID NO: 1436742 - RNA, 12 nt, Homo sapiens
aaugaccuguau

SEQ ID NO: 1436743 - RNA, 14 nt, Homo sapiens
aaugagaacuucaa

SEQ ID NO: 1436744 - RNA, 15 nt, Homo sapiens
aaugaggacauguuu

SEQ ID NO: 1436745 - RNA, 19 nt, Homo sapiens
aaugauaaagaugucaaau

SEQ ID NO: 1436746 - RNA, 21 nt, Homo sapiens
aaugauaagcaggaaggaugg

SEQ ID NO: 1436747 - RNA, 19 nt, Homo sapiens
aaugauuauuuucauuaca

SEQ ID NO: 1436748 - RNA, 23 nt, Homo sapiens
aaugauuucaugcuaucucugug

SEQ ID NO: 1436749 - RNA, 14 nt, Homo sapiens
aaugcaaaaaaucu

SEQ ID NO: 1436750 - RNA, 13 nt, Homo sapiens
aaugcaaaaaucu

SEQ ID NO: 1436751 - RNA, 22 nt, Homo sapiens
aaugcaaggugaacaccacuuu

SEQ ID NO: 1436752 - RNA, 16 nt, Homo sapiens
aaugcacaccaaaaaa

SEQ ID NO: 1436753 - RNA, 18 nt, Homo sapiens
aaugcacgcacacaucag

SEQ ID NO: 1436754 - RNA, 16 nt, Homo sapiens
aaugcauugcuaaaau

SEQ ID NO: 1436755 - RNA, 12 nt, Homo sapiens
aaugccacaaaa

SEQ ID NO: 1436756 - RNA, 12 nt, Homo sapiens
aaugccacagug

SEQ ID NO: 1436757 - RNA, 22 nt, Homo sapiens
aaugccagagacggaagccuuu

SEQ ID NO: 1436758 - RNA, 16 nt, Homo sapiens
aaugccucaaugugac

SEQ ID NO: 1436759 - RNA, 21 nt, Homo sapiens
aaugcuagcugcaagugacau

SEQ ID NO: 1436760 - RNA, 13 nt, Homo sapiens
aaugcuucaauca

SEQ ID NO: 1436761 - RNA, 19 nt, Homo sapiens
aaugcuuuuugaauguuau

SEQ ID NO: 1436762 - RNA, 15 nt, Homo sapiens
aauggacguacuggu

SEQ ID NO: 1436763 - RNA, 19 nt, Homo sapiens
aauggacuauuuguuccac

SEQ ID NO: 1436764 - RNA, 16 nt, Homo sapiens
aaugguaauuguugcu

SEQ ID NO: 1436765 - RNA, 20 nt, Homo sapiens
aauguaaauuaaaauuucca

SEQ ID NO: 1436766 - RNA, 20 nt, Homo sapiens
aauguaacucuauaguuauu

SEQ ID NO: 1436767 - RNA, 16 nt, Homo sapiens
aauguaucauagaaau

SEQ ID NO: 1436768 - RNA, 15 nt, Homo sapiens
aauguaugauuacau

SEQ ID NO: 1436769 - RNA, 12 nt, Homo sapiens
aauguaugcauu

SEQ ID NO: 1436770 - RNA, 13 nt, Homo sapiens
aauguauugaacu

SEQ ID NO: 1436771 - RNA, 12 nt, Homo sapiens
aauguccuccaa

SEQ ID NO: 1436772 - RNA, 14 nt, Homo sapiens
aauguguggugcua

SEQ ID NO: 1436773 - RNA, 20 nt, Homo sapiens
aauguuagauuccucuugcc

SEQ ID NO: 1436774 - RNA, 14 nt, Homo sapiens
aauguugggagaaa

SEQ ID NO: 1436775 - RNA, 12 nt, Homo sapiens
aauuagcaauug

SEQ ID NO: 1436776 - RNA, 23 nt, Homo sapiens
aauuagcaauugacugucacugu

SEQ ID NO: 1436777 - RNA, 19 nt, Homo sapiens
aauuagggcauccugcccc

SEQ ID NO: 1436778 - RNA, 16 nt, Homo sapiens
aauuaguacaguagcu

SEQ ID NO: 1436779 - RNA, 18 nt, Homo sapiens
aauuaguuaacaguuuuu

SEQ ID NO: 1436780 - RNA, 21 nt, Homo sapiens
aauuauacuguagcugaugaa

SEQ ID NO: 1436781 - RNA, 21 nt, Homo sapiens
aauuauauuaaagaaccaaaa

SEQ ID NO: 1436782 - RNA, 15 nt, Homo sapiens
aauuaugagucucua

SEQ ID NO: 1436783 - RNA, 21 nt, Homo sapiens
aauuauuaugucucaaaauaa

SEQ ID NO: 1436784 - RNA, 19 nt, Homo sapiens
aauuauugugccucagccu

SEQ ID NO: 1436785 - RNA, 16 nt, Homo sapiens
aauucacauaggcaau

SEQ ID NO: 1436786 - RNA, 13 nt, Homo sapiens
aauucacucccac

SEQ ID NO: 1436787 - RNA, 14 nt, Homo sapiens
aauucagcaaagaa

SEQ ID NO: 1436788 - RNA, 13 nt, Homo sapiens
aauucagcacuga

SEQ ID NO: 1436789 - RNA, 20 nt, Homo sapiens
aauucauuuuuuucacugga

SEQ ID NO: 1436790 - RNA, 14 nt, Homo sapiens
aauuccuugauuca

SEQ ID NO: 1436791 - RNA, 15 nt, Homo sapiens
aauuccuuuuugcag

SEQ ID NO: 1436792 - RNA, 15 nt, Homo sapiens
aauucuaaaugcugg

SEQ ID NO: 1436793 - RNA, 16 nt, Homo sapiens
aauucucaugugaucc

SEQ ID NO: 1436794 - RNA, 22 nt, Homo sapiens
aauucuggcugcgggucucaga

SEQ ID NO: 1436795 - RNA, 16 nt, Homo sapiens
aauucuugaaguucau

SEQ ID NO: 1436796 - RNA, 16 nt, Homo sapiens
aauucuuuacaauaaa

SEQ ID NO: 1436797 - RNA, 16 nt, Homo sapiens
aauugagaaacaugaa

SEQ ID NO: 1436798 - RNA, 21 nt, Homo sapiens
aauugauuauucugauuccac

SEQ ID NO: 1436799 - RNA, 19 nt, Homo sapiens
aauugcauacuacucucaa

SEQ ID NO: 1436800 - RNA, 12 nt, Homo sapiens
aauugcauuucc

SEQ ID NO: 1436801 - RNA, 16 nt, Homo sapiens
aauugcauuucugcuc

SEQ ID NO: 1436802 - RNA, 14 nt, Homo sapiens
aauugcuacauucu

SEQ ID NO: 1436803 - RNA, 20 nt, Homo sapiens
aauuguaacuacacuaauaa

SEQ ID NO: 1436804 - RNA, 14 nt, Homo sapiens
aauuguacauuccc

SEQ ID NO: 1436805 - RNA, 11 nt, Homo sapiens
aauuguugcua

SEQ ID NO: 1436806 - RNA, 12 nt, Homo sapiens
aauuuaaccuac

SEQ ID NO: 1436807 - RNA, 21 nt, Homo sapiens
aauuuauauaaaaauaccuua

SEQ ID NO: 1436808 - RNA, 20 nt, Homo sapiens
aauuuauuucaaaaagggaa

SEQ ID NO: 1436809 - RNA, 15 nt, Homo sapiens
aauuucaaaagugau

SEQ ID NO: 1436810 - RNA, 16 nt, Homo sapiens
aauuucauaccuauca

SEQ ID NO: 1436811 - RNA, 15 nt, Homo sapiens
aauuucucccaguca

SEQ ID NO: 1436812 - RNA, 14 nt, Homo sapiens
aauuucuuugucau

SEQ ID NO: 1436813 - RNA, 20 nt, Homo sapiens
aauuugauacaaaaugcuga

SEQ ID NO: 1436814 - RNA, 22 nt, Homo sapiens
aauuuuaaauguucacaacaua

SEQ ID NO: 1436815 - RNA, 21 nt, Homo sapiens
aauuuuguuuguaauccugua

SEQ ID NO: 1436816 - RNA, 15 nt, Homo sapiens
aauuuuuacugagaa

SEQ ID NO: 1436817 - RNA, 17 nt, Homo sapiens
aauuuuuauacauauca

SEQ ID NO: 1436818 - RNA, 22 nt, Homo sapiens
acaaaaaugaaagcaugucuca

SEQ ID NO: 1436819 - RNA, 16 nt, Homo sapiens
acaaacaaugccauca

SEQ ID NO: 1436820 - RNA, 15 nt, Homo sapiens
acaaaccacuguaca

SEQ ID NO: 1436821 - RNA, 15 nt, Homo sapiens
acaaagcccuuccau

SEQ ID NO: 1436822 - RNA, 12 nt, Homo sapiens
acaaauaaacuu

SEQ ID NO: 1436823 - RNA, 21 nt, Homo sapiens
acaaaucuucaagguguaaaa

SEQ ID NO: 1436824 - RNA, 17 nt, Homo sapiens
acaacaaccuggucaca

SEQ ID NO: 1436825 - RNA, 17 nt, Homo sapiens
acaacauaaggagaaug

SEQ ID NO: 1436826 - RNA, 21 nt, Homo sapiens
cacucacuccacaacccaaga

SEQ ID NO: 1436827 - RNA, 19 nt, Homo sapiens
cacucagggcugccacuaa

SEQ ID NO: 1436828 - RNA, 20 nt, Homo sapiens
cacucaguuguuccuacuca

SEQ ID NO: 1436829 - RNA, 17 nt, Homo sapiens
cacucauuccuucacuc

SEQ ID NO: 1436830 - RNA, 18 nt, Homo sapiens
cacucauuccuucacuca

SEQ ID NO: 1436831 - RNA, 12 nt, Homo sapiens
cacucccaaagc

SEQ ID NO: 1436832 - RNA, 21 nt, Homo sapiens
cacuccccccauaucuuuaaa

SEQ ID NO: 1436833 - RNA, 18 nt, Homo sapiens
cacucccuccuaaccuag

SEQ ID NO: 1436834 - RNA, 14 nt, Homo sapiens
cacucuaauauuca

SEQ ID NO: 1436835 - RNA, 16 nt, Homo sapiens
cacucugaaauaauga

SEQ ID NO: 1436836 - RNA, 14 nt, Homo sapiens
cacucugcucugau

SEQ ID NO: 1436837 - RNA, 22 nt, Homo sapiens
cacugaaaugcuagcugcaagu

SEQ ID NO: 1436838 - RNA, 18 nt, Homo sapiens
cacugacauuauaucaug

SEQ ID NO: 1436839 - RNA, 23 nt, Homo sapiens
cacugacauuauaucauggcauu

SEQ ID NO: 1436840 - RNA, 21 nt, Homo sapiens
cacugaccuuggagagacaca

SEQ ID NO: 1436841 - RNA, 13 nt, Homo sapiens
cacugcacccucc

SEQ ID NO: 1436842 - RNA, 14 nt, Homo sapiens
cacugccucuucca

SEQ ID NO: 1436843 - RNA, 12 nt, Homo sapiens
cacugccuucac

SEQ ID NO: 1436844 - RNA, 15 nt, Homo sapiens
cacugccuucaccuu

SEQ ID NO: 1436845 - RNA, 14 nt, Homo sapiens
cacugcucaagaag

SEQ ID NO: 1436846 - RNA, 23 nt, Homo sapiens
cacuggaaucgaucuguacugua

SEQ ID NO: 1436847 - RNA, 13 nt, Homo sapiens
cacuggcauuaaa

SEQ ID NO: 1436848 - RNA, 21 nt, Homo sapiens
cacuggcauuaaagugcugua

SEQ ID NO: 1436849 - RNA, 22 nt, Homo sapiens
cacugggaugagccgcugugag

SEQ ID NO: 1436850 - RNA, 16 nt, Homo sapiens
cacugucacccuccac

SEQ ID NO: 1436851 - RNA, 15 nt, Homo sapiens
cacugugaaaccacu

SEQ ID NO: 1436852 - RNA, 16 nt, Homo sapiens
cacugugaaaccacua

SEQ ID NO: 1436853 - RNA, 21 nt, Homo sapiens
cacugugggggcugguccuga

SEQ ID NO: 1436854 - RNA, 23 nt, Homo sapiens
cacuuacuaaccugguccuaacc

SEQ ID NO: 1436855 - RNA, 16 nt, Homo sapiens
cacuuagcccaagagg

SEQ ID NO: 1436856 - RNA, 17 nt, Homo sapiens
cacuucucacaucuuau

SEQ ID NO: 1436857 - RNA, 19 nt, Homo sapiens
cacuucucaucauauugua

SEQ ID NO: 1436858 - RNA, 13 nt, Homo sapiens
cacuucugagcuc

SEQ ID NO: 1436859 - RNA, 15 nt, Homo sapiens
cacuugacauuccuu

SEQ ID NO: 1436860 - RNA, 19 nt, Homo sapiens
cagcacccaggcuccaugg

SEQ ID NO: 1436861 - RNA, 21 nt, Homo sapiens
cagcaccccugucucuagcca

SEQ ID NO: 1436862 - RNA, 11 nt, Homo sapiens
cagcacccucc

SEQ ID NO: 1436863 - RNA, 17 nt, Homo sapiens
cagcagcugaacagcca

SEQ ID NO: 1436864 - RNA, 21 nt, Homo sapiens
cagcagugagcuucuauuaaa

SEQ ID NO: 1436865 - RNA, 18 nt, Homo sapiens
cagcagugguauuaauac

SEQ ID NO: 1436866 - RNA, 17 nt, Homo sapiens
cagcauuugccauuccu

SEQ ID NO: 1436867 - RNA, 21 nt, Homo sapiens
cagcauuuucacauuuugccu

SEQ ID NO: 1436868 - RNA, 14 nt, Homo sapiens
cagccaaacacaga

SEQ ID NO: 1436869 - RNA, 13 nt, Homo sapiens
cagccaacaaaca

SEQ ID NO: 1436870 - RNA, 12 nt, Homo sapiens
cagccaccucuc

SEQ ID NO: 1436871 - RNA, 18 nt, Homo sapiens
cagccaggagaugcuggg

SEQ ID NO: 1436872 - RNA, 18 nt, Homo sapiens
cagccagguuagccuuug

SEQ ID NO: 1436873 - RNA, 15 nt, Homo sapiens
cagccagucuugccu

SEQ ID NO: 1436874 - RNA, 14 nt, Homo sapiens
cagccaugaaguca

SEQ ID NO: 1436875 - RNA, 16 nt, Homo sapiens
cagccaugaccaguuc

SEQ ID NO: 1436876 - RNA, 16 nt, Homo sapiens
cagcccaggcagagau

SEQ ID NO: 1436877 - RNA, 11 nt, Homo sapiens
cagcccauucu

SEQ ID NO: 1436878 - RNA, 14 nt, Homo sapiens
cagcccccacuuuc

SEQ ID NO: 1436879 - RNA, 16 nt, Homo sapiens
cagccgaaaagcuuuu

SEQ ID NO: 1436880 - RNA, 14 nt, Homo sapiens
cagccuacugccuc

SEQ ID NO: 1436881 - RNA, 19 nt, Homo sapiens
cagccucccaaguagcugg

SEQ ID NO: 1436882 - RNA, 20 nt, Homo sapiens
cagccucccaaguagcugga

SEQ ID NO: 1436883 - RNA, 18 nt, Homo sapiens
cagccucccgaguagcug

SEQ ID NO: 1436884 - RNA, 21 nt, Homo sapiens
cagccugaccaacauggugaa

SEQ ID NO: 1436885 - RNA, 19 nt, Homo sapiens
cagccugcccucagcacag

SEQ ID NO: 1436886 - RNA, 19 nt, Homo sapiens
cagccuguuggacccgcuc

SEQ ID NO: 1436887 - RNA, 17 nt, Homo sapiens
cagccuucugacaagca

SEQ ID NO: 1436888 - RNA, 23 nt, Homo sapiens
cagcgagaggcagagaaagaaga

SEQ ID NO: 1436889 - RNA, 18 nt, Homo sapiens
cagcuaacuccagucucc

SEQ ID NO: 1436890 - RNA, 23 nt, Homo sapiens
cagcuacauuccucagcugccaa

SEQ ID NO: 1436891 - RNA, 23 nt, Homo sapiens
cagcugacagcugcucaaaucau

SEQ ID NO: 1436892 - RNA, 15 nt, Homo sapiens
cagcuguagccaugg

SEQ ID NO: 1436893 - RNA, 17 nt, Homo sapiens
cagcugucgcaucucag

SEQ ID NO: 1436894 - RNA, 15 nt, Homo sapiens
cagcuguguucacac

SEQ ID NO: 1436895 - RNA, 15 nt, Homo sapiens
cagcuucaucaauuu

SEQ ID NO: 1436896 - RNA, 22 nt, Homo sapiens
cagcuucaucaauuuuuauaca

SEQ ID NO: 1436897 - RNA, 18 nt, Homo sapiens
cagcuucuucaucuuuaa

SEQ ID NO: 1436898 - RNA, 15 nt, Homo sapiens
caggaacucccagca

SEQ ID NO: 1436899 - RNA, 13 nt, Homo sapiens
caggaaucugcca

SEQ ID NO: 1436900 - RNA, 14 nt, Homo sapiens
caggacaccugccc

SEQ ID NO: 1436901 - RNA, 17 nt, Homo sapiens
caggacuuggucugauu

SEQ ID NO: 1436902 - RNA, 14 nt, Homo sapiens
caggagacauuggu

SEQ ID NO: 1436903 - RNA, 18 nt, Homo sapiens
caggagcaggaacagaga

SEQ ID NO: 1436904 - RNA, 17 nt, Homo sapiens
caggaggugcuaucgca

SEQ ID NO: 1436905 - RNA, 19 nt, Homo sapiens
caggagguuguggaugcuc

SEQ ID NO: 1436906 - RNA, 20 nt, Homo sapiens
caggagguuguggaugcucc

SEQ ID NO: 1436907 - RNA, 22 nt, Homo sapiens
caggauccuauucucaccagga

SEQ ID NO: 1436908 - RNA, 10 nt, Homo sapiens
caggaucuca

SEQ ID NO: 1436909 - RNA, 11 nt, Homo sapiens
caggaucucag

SEQ ID NO: 1436910 - RNA, 14 nt, Homo sapiens
caggaucugaguua

SEQ ID NO: 1436911 - RNA, 12 nt, Homo sapiens
cuccaagauuuc

SEQ ID NO: 1436912 - RNA, 19 nt, Homo sapiens
cuccaagccauucacuucc

SEQ ID NO: 1436913 - RNA, 14 nt, Homo sapiens
cuccaccucuucac

SEQ ID NO: 1436914 - RNA, 18 nt, Homo sapiens
cuccacugaggaugugag

SEQ ID NO: 1436915 - RNA, 13 nt, Homo sapiens
cuccacugucacc

SEQ ID NO: 1436916 - RNA, 18 nt, Homo sapiens
cuccagaauccacaaagc

SEQ ID NO: 1436917 - RNA, 17 nt, Homo sapiens
cuccagaaucugcuguu

SEQ ID NO: 1436918 - RNA, 20 nt, Homo sapiens
cuccagagugugcagacuga

SEQ ID NO: 1436919 - RNA, 16 nt, Homo sapiens
cuccagccagcaauga

SEQ ID NO: 1436920 - RNA, 17 nt, Homo sapiens
cuccaguauucuuguca

SEQ ID NO: 1436921 - RNA, 16 nt, Homo sapiens
cuccagugugaauaua

SEQ ID NO: 1436922 - RNA, 21 nt, Homo sapiens
cuccauacuuucccacagcac

SEQ ID NO: 1436923 - RNA, 15 nt, Homo sapiens
cuccaucaugcuuga

SEQ ID NO: 1436924 - RNA, 14 nt, Homo sapiens
cuccaucauggcag

SEQ ID NO: 1436925 - RNA, 12 nt, Homo sapiens
cuccaucuccag

SEQ ID NO: 1436926 - RNA, 19 nt, Homo sapiens
cuccauucugaccauuuca

SEQ ID NO: 1436927 - RNA, 19 nt, Homo sapiens
cuccauuucaacuccagaa

SEQ ID NO: 1436928 - RNA, 15 nt, Homo sapiens
cucccaaagcucaga

SEQ ID NO: 1436929 - RNA, 22 nt, Homo sapiens
cucccacauugucaccauuuca

SEQ ID NO: 1436930 - RNA, 18 nt, Homo sapiens
cucccaccccacccccuu

SEQ ID NO: 1436931 - RNA, 17 nt, Homo sapiens
cucccaccccacuccag

SEQ ID NO: 1436932 - RNA, 22 nt, Homo sapiens
cucccaccccggccuccacucc

SEQ ID NO: 1436933 - RNA, 17 nt, Homo sapiens
cucccagguggauuuug

SEQ ID NO: 1436934 - RNA, 19 nt, Homo sapiens
cucccauagcgcuggcuca

SEQ ID NO: 1436935 - RNA, 23 nt, Homo sapiens
cucccauagcgcuggcucaggaa

SEQ ID NO: 1436936 - RNA, 21 nt, Homo sapiens
cucccauccccuggacuggga

SEQ ID NO: 1436937 - RNA, 13 nt, Homo sapiens
cucccaugcacac

SEQ ID NO: 1436938 - RNA, 14 nt, Homo sapiens
cuccccacacgugc

SEQ ID NO: 1436939 - RNA, 23 nt, Homo sapiens
cuccccagcccuggcucugcaau

SEQ ID NO: 1436940 - RNA, 17 nt, Homo sapiens
cuccccccaacacaauc

SEQ ID NO: 1436941 - RNA, 14 nt, Homo sapiens
cuccccgccugucc

SEQ ID NO: 1436942 - RNA, 18 nt, Homo sapiens
cuccccuuguacucuugc

SEQ ID NO: 1436943 - RNA, 19 nt, Homo sapiens
cucccgggggcacugccug

SEQ ID NO: 1436944 - RNA, 22 nt, Homo sapiens
cucccuauccuaaaggcccacu

SEQ ID NO: 1436945 - RNA, 20 nt, Homo sapiens
cucccuguagcucugccucc

SEQ ID NO: 1436946 - RNA, 20 nt, Homo sapiens
cucccuguuaucugcuagau

SEQ ID NO: 1436947 - RNA, 20 nt, Homo sapiens
cucccuugcucagugccucc

SEQ ID NO: 1436948 - RNA, 19 nt, Homo sapiens
cucccuuguggcuuccuca

SEQ ID NO: 1436949 - RNA, 21 nt, Homo sapiens
cuccgaauaaacgugcucccc

SEQ ID NO: 1436950 - RNA, 13 nt, Homo sapiens
cuccgccauucca

SEQ ID NO: 1436951 - RNA, 14 nt, Homo sapiens
gagaagcucaccca

SEQ ID NO: 1436952 - RNA, 11 nt, Homo sapiens
gagaagcugag

SEQ ID NO: 1436953 - RNA, 19 nt, Homo sapiens
gagaaggaaggagacucac

SEQ ID NO: 1436954 - RNA, 19 nt, Homo sapiens
gagaagggaagccucuuca

SEQ ID NO: 1436955 - RNA, 22 nt, Homo sapiens
gagaaucagggcaggcuugcca

SEQ ID NO: 1436956 - RNA, 21 nt, Homo sapiens
gagacaaaaucuuaaaugcca

SEQ ID NO: 1436957 - RNA, 22 nt, Homo sapiens
gagacacuauuuaucugugcaa

SEQ ID NO: 1436958 - RNA, 23 nt, Homo sapiens
gagacacuauuuaucugugcaaa

SEQ ID NO: 1436959 - RNA, 14 nt, Homo sapiens
gagacagauaacuc

SEQ ID NO: 1436960 - RNA, 16 nt, Homo sapiens
gagacaggcccaagag

SEQ ID NO: 1436961 - RNA, 22 nt, Homo sapiens
gagaccaaaggauccagagacu

SEQ ID NO: 1436962 - RNA, 17 nt, Homo sapiens
gagaccaggccugagca

SEQ ID NO: 1436963 - RNA, 15 nt, Homo sapiens
gagaccauccuggcc

SEQ ID NO: 1436964 - RNA, 22 nt, Homo sapiens
gagaccuuguuucaaucuuugc

SEQ ID NO: 1436965 - RNA, 21 nt, Homo sapiens
gagacgcagcccugggggcca

SEQ ID NO: 1436966 - RNA, 16 nt, Homo sapiens
gagacuauaacuguca

SEQ ID NO: 1436967 - RNA, 21 nt, Homo sapiens
gagagaacaacuacugugauc

SEQ ID NO: 1436968 - RNA, 13 nt, Homo sapiens
gagagaacuggag

SEQ ID NO: 1436969 - RNA, 15 nt, Homo sapiens
gagagacacucccag

SEQ ID NO: 1436970 - RNA, 15 nt, Homo sapiens
gagagacauugccuc

SEQ ID NO: 1436971 - RNA, 22 nt, Homo sapiens
gagagaucauagcucacuguaa

SEQ ID NO: 1436972 - RNA, 14 nt, Homo sapiens
gagagauggaauaa

SEQ ID NO: 1436973 - RNA, 20 nt, Homo sapiens
gagagcagcuggcucuccac

SEQ ID NO: 1436974 - RNA, 14 nt, Homo sapiens
gagagcaggacagg

SEQ ID NO: 1436975 - RNA, 14 nt, Homo sapiens
gagagcgaaggggg

SEQ ID NO: 1436976 - RNA, 17 nt, Homo sapiens
gagagcuaggagcaaag

SEQ ID NO: 1436977 - RNA, 17 nt, Homo sapiens
gagaggaaaaguggaug

SEQ ID NO: 1436978 - RNA, 15 nt, Homo sapiens
gagaggcaugugaug

SEQ ID NO: 1436979 - RNA, 23 nt, Homo sapiens
gagaggucucagguucuuuccau

SEQ ID NO: 1436980 - RNA, 11 nt, Homo sapiens
gagaguaccau

SEQ ID NO: 1436981 - RNA, 19 nt, Homo sapiens
gagaguaguuuuucagcua

SEQ ID NO: 1436982 - RNA, 16 nt, Homo sapiens
gagaguggcuccuccc

SEQ ID NO: 1436983 - RNA, 20 nt, Homo sapiens
gagauauggcuaguggcaau

SEQ ID NO: 1436984 - RNA, 17 nt, Homo sapiens
gagauccuuuaaauccu

SEQ ID NO: 1436985 - RNA, 14 nt, Homo sapiens
gagaugcugggcca

SEQ ID NO: 1436986 - RNA, 19 nt, Homo sapiens
gagauggaauaaagcccuu

SEQ ID NO: 1436987 - RNA, 21 nt, Homo sapiens
gagauguggcaaagugcugua

SEQ ID NO: 1436988 - RNA, 18 nt, Homo sapiens
gagauucuugugccucag

SEQ ID NO: 1436989 - RNA, 17 nt, Homo sapiens
gagauuuaccagggaug

SEQ ID NO: 1436990 - RNA, 23 nt, Homo sapiens
gagcaaugggagggggcuccaug

SEQ ID NO: 1436991 - RNA, 18 nt, Homo sapiens
gagcacccccucauuccc

SEQ ID NO: 1436992 - RNA, 18 nt, Homo sapiens
gagcacuugcguccugca

SEQ ID NO: 1436993 - RNA, 14 nt, Homo sapiens
gagcagacagagaa

SEQ ID NO: 1436994 - RNA, 19 nt, Homo sapiens
gagcagcuuuggaaacagg

SEQ ID NO: 1436995 - RNA, 22 nt, Homo sapiens
gagcaguaaacuuucucugcaa

SEQ ID NO: 1436996 - RNA, 17 nt, Homo sapiens
gagcauaaugcucccau

SEQ ID NO: 1436997 - RNA, 19 nt, Homo sapiens
cuaaguuugguuagccuua

SEQ ID NO: 1436998 - RNA, 14 nt, Homo sapiens
cuaauacuaauuca

SEQ ID NO: 1436999 - RNA, 19 nt, Homo sapiens
cuaauagagacacagagau

SEQ ID NO: 1437000 - RNA, 22 nt, Homo sapiens
cuaauccucaacaacaaaccaa

SEQ ID NO: 1437001 - RNA, 15 nt, Homo sapiens
cuaauccuccaaguc

SEQ ID NO: 1437002 - RNA, 19 nt, Homo sapiens
cuaauccuccaagucuuca

SEQ ID NO: 1437003 - RNA, 14 nt, Homo sapiens
cuaaucuaugcaug

SEQ ID NO: 1437004 - RNA, 22 nt, Homo sapiens
cuaaucucauaccucugaccaa

SEQ ID NO: 1437005 - RNA, 14 nt, Homo sapiens
cuaaugaaauugag

SEQ ID NO: 1437006 - RNA, 20 nt, Homo sapiens
cuaaugauauuuuaugcaaa

SEQ ID NO: 1437007 - RNA, 18 nt, Homo sapiens
cuaauuaaaaucuggaaa

SEQ ID NO: 1437008 - RNA, 23 nt, Homo sapiens
cuaauuccuggcaugacacucua

SEQ ID NO: 1437009 - RNA, 19 nt, Homo sapiens
cuaauuggaagaaauuccu

SEQ ID NO: 1437010 - RNA, 13 nt, Homo sapiens
cuacaaaauggag

SEQ ID NO: 1437011 - RNA, 15 nt, Homo sapiens
cuacaaccagagccc

SEQ ID NO: 1437012 - RNA, 22 nt, Homo sapiens
cuacacaguaaaaacuuguacu

SEQ ID NO: 1437013 - RNA, 13 nt, Homo sapiens
cuacaccuguugc

SEQ ID NO: 1437014 - RNA, 14 nt, Homo sapiens
cuacagauuuuaga

SEQ ID NO: 1437015 - RNA, 11 nt, Homo sapiens
cuacaggguga

SEQ ID NO: 1437016 - RNA, 17 nt, Homo sapiens
cuacaggugcaagccac

SEQ ID NO: 1437017 - RNA, 19 nt, Homo sapiens
cuacaucuucagcucccau

SEQ ID NO: 1437018 - RNA, 19 nt, Homo sapiens
cuaccccaagaugccccuc

SEQ ID NO: 1437019 - RNA, 22 nt, Homo sapiens
cuacgucaaacaugaagugugu

SEQ ID NO: 1437020 - RNA, 15 nt, Homo sapiens
cuacuaaagugccua

SEQ ID NO: 1437021 - RNA, 21 nt, Homo sapiens
cuacuaaagugccuaccccag
